United States Patent 7,888,497 (BIOINFORMATICALLY DETECTABLE GROUP OF NOVEL REGULATORY OLIGONUCLEOTIDES AND USES THEREOF) - sequence listing, part 63

SEQ ID NO: 2650289 - DNA, 23 bp, Homo sapiens
gtggttaatgccatggacagaag

SEQ ID NO: 2650290 - DNA, 14 bp, Homo sapiens
gtggttatttctca

SEQ ID NO: 2650291 - DNA, 16 bp, Homo sapiens
gtggtttggtgtgttc

SEQ ID NO: 2650292 - DNA, 19 bp, Homo sapiens
gtggttttcccctccctgg

SEQ ID NO: 2650293 - DNA, 21 bp, Homo sapiens
gtggttttcccctccctgggt

SEQ ID NO: 2650294 - DNA, 17 bp, Homo sapiens
gtggttttctgttcttt

SEQ ID NO: 2650295 - DNA, 19 bp, Homo sapiens
gtgtaaaatattttgaatc

SEQ ID NO: 2650296 - DNA, 21 bp, Homo sapiens
gtgtaaagcattccaacaaag

SEQ ID NO: 2650297 - DNA, 16 bp, Homo sapiens
gtgtaaagttagtcta

SEQ ID NO: 2650298 - DNA, 19 bp, Homo sapiens
gtgtaaatagttactccag

SEQ ID NO: 2650299 - DNA, 15 bp, Homo sapiens
gtgtaacagctgagg

SEQ ID NO: 2650300 - DNA, 21 bp, Homo sapiens
gtgtaacagctgaggtctctt

SEQ ID NO: 2650301 - DNA, 19 bp, Homo sapiens
gtgtaacaggtctcctctt

SEQ ID NO: 2650302 - DNA, 18 bp, Homo sapiens
gtgtaactggcagttttc

SEQ ID NO: 2650303 - DNA, 13 bp, Homo sapiens
gtgtaataagaca

SEQ ID NO: 2650304 - DNA, 14 bp, Homo sapiens
gtgtaataagacat

SEQ ID NO: 2650305 - DNA, 17 bp, Homo sapiens
gtttctgtgcatggtgg

SEQ ID NO: 2650306 - DNA, 14 bp, Homo sapiens
gtttctgttctgtg

SEQ ID NO: 2650307 - DNA, 22 bp, Homo sapiens
gtttctgttctgtggaaagtgt

SEQ ID NO: 2650308 - DNA, 20 bp, Homo sapiens
gtttcttcaacaggagaatt

SEQ ID NO: 2650309 - DNA, 11 bp, Homo sapiens
gtttcttccaa

SEQ ID NO: 2650310 - DNA, 21 bp, Homo sapiens
gtttctttcctgccttcttct

SEQ ID NO: 2650311 - DNA, 18 bp, Homo sapiens
gtttctttctagtggtct

SEQ ID NO: 2650312 - DNA, 23 bp, Homo sapiens
gtttctttctagtggtctttgta

SEQ ID NO: 2650313 - DNA, 15 bp, Homo sapiens
gtttgaaacaaagaa

SEQ ID NO: 2650314 - DNA, 17 bp, Homo sapiens
gtttgaatataaacact

SEQ ID NO: 2650315 - DNA, 19 bp, Homo sapiens
gtttgattaaattcttgca

SEQ ID NO: 2650316 - DNA, 23 bp, Homo sapiens
gtttgattaaattcttgcaaagt

SEQ ID NO: 2650317 - DNA, 21 bp, Homo sapiens
gtttgattcagacagctgcct

SEQ ID NO: 2650318 - DNA, 13 bp, Homo sapiens
gtttgcaaggaag

SEQ ID NO: 2650319 - DNA, 22 bp, Homo sapiens
gtttgcaaggaagccacagctg

SEQ ID NO: 2650320 - DNA, 14 bp, Homo sapiens
gtttgcataggtga

SEQ ID NO: 2650321 - DNA, 20 bp, Homo sapiens
gtttgccactttgcaaagga

SEQ ID NO: 2650322 - DNA, 16 bp, Homo sapiens
gtttgcctctgcctct

SEQ ID NO: 2650323 - DNA, 17 bp, Homo sapiens
gtttgcctctgcctctg

SEQ ID NO: 2650324 - DNA, 14 bp, Homo sapiens
gtttgcctgagggc

SEQ ID NO: 2650325 - DNA, 17 bp, Homo sapiens
gtttgctcacctggggt

SEQ ID NO: 2650326 - DNA, 18 bp, Homo sapiens
gtttgctgttgatttctt

SEQ ID NO: 2650327 - DNA, 14 bp, Homo sapiens
gtttgcttattgtt

SEQ ID NO: 2650328 - DNA, 16 bp, Homo sapiens
gtttgcttcataaatg

SEQ ID NO: 2650329 - DNA, 21 bp, Homo sapiens
gtttggaggagcaaaggctga

SEQ ID NO: 2650330 - DNA, 18 bp, Homo sapiens
gtttggattcttatgtag

SEQ ID NO: 2650331 - DNA, 20 bp, Homo sapiens
gtttggattcttatgtagca

SEQ ID NO: 2650332 - DNA, 15 bp, Homo sapiens
gtttggcaatagttt

SEQ ID NO: 2650333 - DNA, 17 bp, Homo sapiens
gtttggcaatagtttgc

SEQ ID NO: 2650334 - DNA, 19 bp, Homo sapiens
gtttggcaatagtttgcat

SEQ ID NO: 2650335 - DNA, 15 bp, Homo sapiens
gtttggccatctctg

SEQ ID NO: 2650336 - DNA, 16 bp, Homo sapiens
gtttggcgggccaagg

SEQ ID NO: 2650337 - DNA, 18 bp, Homo sapiens
gtttggcgggccaaggac

SEQ ID NO: 2650338 - DNA, 17 bp, Homo sapiens
gtttggggcgaggcaga

SEQ ID NO: 2650339 - DNA, 22 bp, Homo sapiens
gtttggtgggggtagagctgat

SEQ ID NO: 2650340 - DNA, 13 bp, Homo sapiens
gtttgtaaaacta

SEQ ID NO: 2650341 - DNA, 17 bp, Homo sapiens
gtttgtaaattaacttt

SEQ ID NO: 2650342 - DNA, 15 bp, Homo sapiens
gtttgtataacttct

SEQ ID NO: 2650343 - DNA, 16 bp, Homo sapiens
gtttgtataacttctt

SEQ ID NO: 2650344 - DNA, 13 bp, Homo sapiens
gtttgtatgtgtg

SEQ ID NO: 2650345 - DNA, 17 bp, Homo sapiens
gtttgtcacatgaaaca

SEQ ID NO: 2650346 - DNA, 17 bp, Homo sapiens
gtttgtcttctccccag

SEQ ID NO: 2650347 - DNA, 19 bp, Homo sapiens
gtttgtggaaaatgaaaat

SEQ ID NO: 2650348 - DNA, 12 bp, Homo sapiens
gtttgtggcctc

SEQ ID NO: 2650349 - DNA, 14 bp, Homo sapiens
gtttgtggcctcag

SEQ ID NO: 2650350 - DNA, 19 bp, Homo sapiens
gtttgttggatcttcaatg

SEQ ID NO: 2650351 - DNA, 19 bp, Homo sapiens
gtttgtttctccccctggg

SEQ ID NO: 2650352 - DNA, 20 bp, Homo sapiens
gtttgtttctccccctgggc

SEQ ID NO: 2650353 - DNA, 18 bp, Homo sapiens
gtttgtttctgaaaggga

SEQ ID NO: 2650354 - DNA, 21 bp, Homo sapiens
gttttaaaataaaaattctga

SEQ ID NO: 2650355 - DNA, 12 bp, Homo sapiens
gttttaaaatta

SEQ ID NO: 2650356 - DNA, 22 bp, Homo sapiens
gttttaaatacgcactacatgt

SEQ ID NO: 2650357 - DNA, 18 bp, Homo sapiens
gttttaagttgtttgcat

SEQ ID NO: 2650358 - DNA, 20 bp, Homo sapiens
gttttaattccaatatgatg

SEQ ID NO: 2650359 - DNA, 23 bp, Homo sapiens
gttttaattccaatatgatgact

SEQ ID NO: 2650360 - DNA, 16 bp, Homo sapiens
gttttaattccatgaa

SEQ ID NO: 2650361 - DNA, 22 bp, Homo sapiens
gttttaattccatgaatcgctt

SEQ ID NO: 2650362 - DNA, 21 bp, Homo sapiens
gttttaatttaaacacctcct

SEQ ID NO: 2650363 - DNA, 23 bp, Homo sapiens
gttttacaataaaatcttgaaaa

SEQ ID NO: 2650364 - DNA, 15 bp, Homo sapiens
gttttactgcagctt

SEQ ID NO: 2650365 - DNA, 14 bp, Homo sapiens
gttttactgtgaaa

SEQ ID NO: 2650366 - DNA, 13 bp, Homo sapiens
gttttagaaaaca

SEQ ID NO: 2650367 - DNA, 22 bp, Homo sapiens
gttttagacaaatactcatgtg

SEQ ID NO: 2650368 - DNA, 23 bp, Homo sapiens
gttttagacaaatactcatgtgt

SEQ ID NO: 2650369 - DNA, 21 bp, Homo sapiens
gttttagttgcagaaacattt

SEQ ID NO: 2650370 - DNA, 18 bp, Homo sapiens
gttttatcacatgtatgt

SEQ ID NO: 2650371 - DNA, 14 bp, Homo sapiens
gttttatcatgaca

SEQ ID NO: 2650372 - DNA, 18 bp, Homo sapiens
gttttatgacttcattaa

SEQ ID NO: 2650373 - DNA, 12 bp, Homo sapiens
gttttcactctt

SEQ ID NO: 2650374 - DNA, 21 bp, Homo sapiens
gttttcagaacctcttcccca

SEQ ID NO: 2650375 - DNA, 17 bp, Homo sapiens
gttttcagtgtacatgg

SEQ ID NO: 2650376 - DNA, 22 bp, Homo sapiens
gttttcatggtgaaaatgtact

SEQ ID NO: 2650377 - DNA, 14 bp, Homo sapiens
gttttccaccctgg

SEQ ID NO: 2650378 - DNA, 16 bp, Homo sapiens
gttttccaccctggaa

SEQ ID NO: 2650379 - DNA, 18 bp, Homo sapiens
gttttccatgaaaacgtt

SEQ ID NO: 2650380 - DNA, 17 bp, Homo sapiens
gttttccattgtttgaa

SEQ ID NO: 2650381 - DNA, 17 bp, Homo sapiens
gttttcccctccctggg

SEQ ID NO: 2650382 - DNA, 17 bp, Homo sapiens
gttttcctttctcaccg

SEQ ID NO: 2650383 - DNA, 17 bp, Homo sapiens
gttttcgaagctcagcc

SEQ ID NO: 2650384 - DNA, 23 bp, Homo sapiens
gttttcgcacctaccatcaggga

SEQ ID NO: 2650385 - DNA, 16 bp, Homo sapiens
gttttctcctcccagg

SEQ ID NO: 2650386 - DNA, 18 bp, Homo sapiens
gttttctcctcccaggaa

SEQ ID NO: 2650387 - DNA, 12 bp, Homo sapiens
gttttctcttga

SEQ ID NO: 2650388 - DNA, 13 bp, Homo sapiens
gttttctgagccc

SEQ ID NO: 2650389 - DNA, 17 bp, Homo sapiens
gttttctggctggagcc

SEQ ID NO: 2650390 - DNA, 14 bp, Homo sapiens
gttttctttgaatg

SEQ ID NO: 2650391 - DNA, 15 bp, Homo sapiens
gttttgaaaagctat

SEQ ID NO: 2650392 - DNA, 13 bp, Homo sapiens
gttttgaaatgct

SEQ ID NO: 2650393 - DNA, 17 bp, Homo sapiens
gttttgaactaataaaa

SEQ ID NO: 2650394 - DNA, 18 bp, Homo sapiens
gttttgaatggtgttgta

SEQ ID NO: 2650395 - DNA, 17 bp, Homo sapiens
gttttgacatttttagt

SEQ ID NO: 2650396 - DNA, 16 bp, Homo sapiens
gttttgacggatgatt

SEQ ID NO: 2650397 - DNA, 23 bp, Homo sapiens
gttttgaggtttccttcagacag

SEQ ID NO: 2650398 - DNA, 20 bp, Homo sapiens
gttttgatttaatgttttca

SEQ ID NO: 2650399 - DNA, 20 bp, Homo sapiens
gttttgccatgttggccagg

SEQ ID NO: 2650400 - DNA, 15 bp, Homo sapiens
gttttgtattctctg

SEQ ID NO: 2650401 - DNA, 17 bp, Homo sapiens
gttttgtcaaactgtag

SEQ ID NO: 2650402 - DNA, 14 bp, Homo sapiens
gttttgtcttgaat

SEQ ID NO: 2650403 - DNA, 24 bp, Homo sapiens
gttttgtgactatatagagatgtt

SEQ ID NO: 2650404 - DNA, 19 bp, Homo sapiens
gttttgtggaggagctcag

SEQ ID NO: 2650405 - DNA, 15 bp, Homo sapiens
gtttttaaaagtttc

SEQ ID NO: 2650406 - DNA, 18 bp, Homo sapiens
gtttttaaaagtttcaat

SEQ ID NO: 2650407 - DNA, 15 bp, Homo sapiens
gtttttaactcaata

SEQ ID NO: 2650408 - DNA, 21 bp, Homo sapiens
gtttttatgaagaaaaaatac

SEQ ID NO: 2650409 - DNA, 19 bp, Homo sapiens
gtttttatggcttttgtgc

SEQ ID NO: 2650410 - DNA, 23 bp, Homo sapiens
gtttttatggcttttgtgcatta

SEQ ID NO: 2650411 - DNA, 13 bp, Homo sapiens
gtttttcaattaa

SEQ ID NO: 2650412 - DNA, 16 bp, Homo sapiens
gtttttcaattaaacg

SEQ ID NO: 2650413 - DNA, 17 bp, Homo sapiens
gtttttcaattaaacgg

SEQ ID NO: 2650414 - DNA, 12 bp, Homo sapiens
gtttttcagttt

SEQ ID NO: 2650415 - DNA, 15 bp, Homo sapiens
gtttttccactactg

SEQ ID NO: 2650416 - DNA, 19 bp, Homo sapiens
gtttttccttgtatttaaa

SEQ ID NO: 2650417 - DNA, 14 bp, Homo sapiens
gtttttcctttaaa

SEQ ID NO: 2650418 - DNA, 15 bp, Homo sapiens
gtttttcctttaaaa

SEQ ID NO: 2650419 - DNA, 22 bp, Homo sapiens
gtttttcttcaacatcaatgtt

SEQ ID NO: 2650420 - DNA, 14 bp, Homo sapiens
gtttttgtactgta

SEQ ID NO: 2650421 - DNA, 14 bp, Homo sapiens
gttttttcctgagc

SEQ ID NO: 2650422 - DNA, 19 bp, Homo sapiens
taaaaaaaaaaaagttata

SEQ ID NO: 2650423 - DNA, 22 bp, Homo sapiens
taaaaaaaaaggcatattgctt

SEQ ID NO: 2650424 - DNA, 16 bp, Homo sapiens
taaaaaaaagaaaaaa

SEQ ID NO: 2650425 - DNA, 15 bp, Homo sapiens
taaaaaaatttaagt

SEQ ID NO: 2650426 - DNA, 17 bp, Homo sapiens
taaaaaaatttaagtgc

SEQ ID NO: 2650427 - DNA, 15 bp, Homo sapiens
taaaaaatggaaaga

SEQ ID NO: 2650428 - DNA, 16 bp, Homo sapiens
taaaaacagcattgct

SEQ ID NO: 2650429 - DNA, 20 bp, Homo sapiens
taaaaagattgaagtatttt

SEQ ID NO: 2650430 - DNA, 17 bp, Homo sapiens
taaaaagtcttcactct

SEQ ID NO: 2650431 - DNA, 17 bp, Homo sapiens
taaaaagtgacacagca

SEQ ID NO: 2650432 - DNA, 15 bp, Homo sapiens
taaaaagtggaaaaa

SEQ ID NO: 2650433 - DNA, 15 bp, Homo sapiens
taaaaagttaaaaag

SEQ ID NO: 2650434 - DNA, 17 bp, Homo sapiens
taaaaagttaaaaagtt

SEQ ID NO: 2650435 - DNA, 19 bp, Homo sapiens
taaaaatatggaacttcta

SEQ ID NO: 2650436 - DNA, 15 bp, Homo sapiens
taaaaatatgtacaa

SEQ ID NO: 2650437 - DNA, 16 bp, Homo sapiens
taaaaatctcaaattt

SEQ ID NO: 2650438 - DNA, 18 bp, Homo sapiens
taaaaatggtttaaatgg

SEQ ID NO: 2650439 - DNA, 13 bp, Homo sapiens
taaaaatgtaaat

SEQ ID NO: 2650440 - DNA, 18 bp, Homo sapiens
taaaaatgtaaatattct

SEQ ID NO: 2650441 - DNA, 15 bp, Homo sapiens
taaaaattctgaatg

SEQ ID NO: 2650442 - DNA, 18 bp, Homo sapiens
taaaacaatattgtttct

SEQ ID NO: 2650443 - DNA, 15 bp, Homo sapiens
taaaacagacactgg

SEQ ID NO: 2650444 - DNA, 18 bp, Homo sapiens
taaaacattttcacacaa

SEQ ID NO: 2650445 - DNA, 13 bp, Homo sapiens
taaaaccacagca

SEQ ID NO: 2650446 - DNA, 21 bp, Homo sapiens
taaaaccccagccaactcatt

SEQ ID NO: 2650447 - DNA, 18 bp, Homo sapiens
taaaacctgagctagaag

SEQ ID NO: 2650448 - DNA, 16 bp, Homo sapiens
taaaacctgtcaatga

SEQ ID NO: 2650449 - DNA, 11 bp, Homo sapiens
taaaacctttc

SEQ ID NO: 2650450 - DNA, 18 bp, Homo sapiens
taaccccgggcgggtggc

SEQ ID NO: 2650451 - DNA, 17 bp, Homo sapiens
taacccttatcaccagc

SEQ ID NO: 2650452 - DNA, 20 bp, Homo sapiens
taaccgtcctcgagcaactg

SEQ ID NO: 2650453 - DNA, 22 bp, Homo sapiens
taacctatatgatttatagttt

SEQ ID NO: 2650454 - DNA, 22 bp, Homo sapiens
taacctattttgaaaaattcct

SEQ ID NO: 2650455 - DNA, 13 bp, Homo sapiens
taacctcagctct

SEQ ID NO: 2650456 - DNA, 18 bp, Homo sapiens
taacctcatcttcttcac

SEQ ID NO: 2650457 - DNA, 17 bp, Homo sapiens
taacctcttcagaggcc

SEQ ID NO: 2650458 - DNA, 12 bp, Homo sapiens
taacctggtgct

SEQ ID NO: 2650459 - DNA, 22 bp, Homo sapiens
taacctggtgctggatattttc

SEQ ID NO: 2650460 - DNA, 23 bp, Homo sapiens
taacgacttcagggcagggctct

SEQ ID NO: 2650461 - DNA, 13 bp, Homo sapiens
taacggctccagg

SEQ ID NO: 2650462 - DNA, 18 bp, Homo sapiens
taacggctccaggatttt

SEQ ID NO: 2650463 - DNA, 16 bp, Homo sapiens
taacgttgagcccctg

SEQ ID NO: 2650464 - DNA, 14 bp, Homo sapiens
taacgttgctgtgg

SEQ ID NO: 2650465 - DNA, 17 bp, Homo sapiens
taacgttgctgtgggaa

SEQ ID NO: 2650466 - DNA, 19 bp, Homo sapiens
taacgtttttcctttaaaa

SEQ ID NO: 2650467 - DNA, 23 bp, Homo sapiens
taactaatatgggcattgtagtt

SEQ ID NO: 2650468 - DNA, 19 bp, Homo sapiens
taactaatctattgggttc

SEQ ID NO: 2650469 - DNA, 15 bp, Homo sapiens
taactactgtgttcc

SEQ ID NO: 2650470 - DNA, 16 bp, Homo sapiens
taactactgtgttcct

SEQ ID NO: 2650471 - DNA, 18 bp, Homo sapiens
taactagaatttattcaa

SEQ ID NO: 2650472 - DNA, 21 bp, Homo sapiens
taactagagcagccctggagt

SEQ ID NO: 2650473 - DNA, 17 bp, Homo sapiens
taactagtgttgcttgg

SEQ ID NO: 2650474 - DNA, 16 bp, Homo sapiens
taactatgttgataaa

SEQ ID NO: 2650475 - DNA, 14 bp, Homo sapiens
taactcaatatttt

SEQ ID NO: 2650476 - DNA, 16 bp, Homo sapiens
taactcacctaactca

SEQ ID NO: 2650477 - DNA, 14 bp, Homo sapiens
taactcagatcact

SEQ ID NO: 2650478 - DNA, 23 bp, Homo sapiens
taactcagatcactactgcagtc

SEQ ID NO: 2650479 - DNA, 23 bp, Homo sapiens
taactcatactgtgctggagcca

SEQ ID NO: 2650480 - DNA, 11 bp, Homo sapiens
taactctgtct

SEQ ID NO: 2650481 - DNA, 14 bp, Homo sapiens
taactcttgtctat

SEQ ID NO: 2650482 - DNA, 18 bp, Homo sapiens
taactggagccccatcag

SEQ ID NO: 2650483 - DNA, 24 bp, Homo sapiens
taactggcagttttccattggttt

SEQ ID NO: 2650484 - DNA, 21 bp, Homo sapiens
taactgttatttataatcact

SEQ ID NO: 2650485 - DNA, 21 bp, Homo sapiens
taacttaaaaatgtaaatatt

SEQ ID NO: 2650486 - DNA, 23 bp, Homo sapiens
taacttaaaaatgtaaatattct

SEQ ID NO: 2650487 - DNA, 22 bp, Homo sapiens
taacttaaaagaacatgtatat

SEQ ID NO: 2650488 - DNA, 16 bp, Homo sapiens
taacttaatagtattt

SEQ ID NO: 2650489 - DNA, 17 bp, Homo sapiens
taacttatattgtaaga

SEQ ID NO: 2650490 - DNA, 21 bp, Homo sapiens
taacttatattgtaagaaata

SEQ ID NO: 2650491 - DNA, 21 bp, Homo sapiens
taacttccttggactcatttt

SEQ ID NO: 2650492 - DNA, 16 bp, Homo sapiens
taacttgtctttggac

SEQ ID NO: 2650493 - DNA, 12 bp, Homo sapiens
taactttaagtt

SEQ ID NO: 2650494 - DNA, 14 bp, Homo sapiens
taactttatgtgta

SEQ ID NO: 2650495 - DNA, 23 bp, Homo sapiens
taactttcattaaagcatttact

SEQ ID NO: 2650496 - DNA, 18 bp, Homo sapiens
taacttttataaacttta

SEQ ID NO: 2650497 - DNA, 21 bp, Homo sapiens
taacttttataaactttacct

SEQ ID NO: 2650498 - DNA, 13 bp, Homo sapiens
taacttttgtaag

SEQ ID NO: 2650499 - DNA, 18 bp, Homo sapiens
taacttttgtaagacaaa

SEQ ID NO: 2650500 - DNA, 16 bp, Homo sapiens
taagaaaacatcactg

SEQ ID NO: 2650501 - DNA, 21 bp, Homo sapiens
taagaaacaactctttgagaa

SEQ ID NO: 2650502 - DNA, 21 bp, Homo sapiens
taagaaacacactgaggcagg

SEQ ID NO: 2650503 - DNA, 18 bp, Homo sapiens
taagaaagtgaagcaaat

SEQ ID NO: 2650504 - DNA, 19 bp, Homo sapiens
taagaactgctttctttcg

SEQ ID NO: 2650505 - DNA, 15 bp, Homo sapiens
taagaagctgttgta

SEQ ID NO: 2650506 - DNA, 22 bp, Homo sapiens
taagaagctgttgtacatttat

SEQ ID NO: 2650507 - DNA, 20 bp, Homo sapiens
taagaagggatggattccaa

SEQ ID NO: 2650508 - DNA, 13 bp, Homo sapiens
taagaagtgaaaa

SEQ ID NO: 2650509 - DNA, 21 bp, Homo sapiens
taagaatgctggttttcctaa

SEQ ID NO: 2650510 - DNA, 16 bp, Homo sapiens
taagaatttagggaga

SEQ ID NO: 2650511 - DNA, 19 bp, Homo sapiens
taagacagtcccatcaaaa

SEQ ID NO: 2650512 - DNA, 17 bp, Homo sapiens
taagacataacgttttt

SEQ ID NO: 2650513 - DNA, 20 bp, Homo sapiens
taagacatactccttccatc

SEQ ID NO: 2650514 - DNA, 19 bp, Homo sapiens
taagaccataacagccaac

SEQ ID NO: 2650515 - DNA, 14 bp, Homo sapiens
taagacgacaagga

SEQ ID NO: 2650516 - DNA, 18 bp, Homo sapiens
taagactcattccctaga

SEQ ID NO: 2650517 - DNA, 16 bp, Homo sapiens
taagactgtaatgaat

SEQ ID NO: 2650518 - DNA, 15 bp, Homo sapiens
taagagagagagaca

SEQ ID NO: 2650519 - DNA, 19 bp, Homo sapiens
taagagcaccttcctcact

SEQ ID NO: 2650520 - DNA, 20 bp, Homo sapiens
taagagcaccttcctcactt

SEQ ID NO: 2650521 - DNA, 22 bp, Homo sapiens
taagagccatataagtttgaag

SEQ ID NO: 2650522 - DNA, 12 bp, Homo sapiens
taagaggcaggg

SEQ ID NO: 2650523 - DNA, 22 bp, Homo sapiens
taagaggcagggtctcactctg

SEQ ID NO: 2650524 - DNA, 18 bp, Homo sapiens
taagagggcacacactgt

SEQ ID NO: 2650525 - DNA, 21 bp, Homo sapiens
taagagtagaaactgcaggga

SEQ ID NO: 2650526 - DNA, 13 bp, Homo sapiens
taagagtgtagaa

SEQ ID NO: 2650527 - DNA, 16 bp, Homo sapiens
taagagtgtagaagca

SEQ ID NO: 2650528 - DNA, 18 bp, Homo sapiens
taagagtgtagaagcatt

SEQ ID NO: 2650529 - DNA, 15 bp, Homo sapiens
taagataataatata

SEQ ID NO: 2650530 - DNA, 22 bp, Homo sapiens
taagataataatatatgtttac

SEQ ID NO: 2650531 - DNA, 15 bp, Homo sapiens
taagatatttttcat

SEQ ID NO: 2650532 - DNA, 17 bp, Homo sapiens
taagatatttttcatga

SEQ ID NO: 2650533 - DNA, 17 bp, Homo sapiens
taagatgacattgctaa

SEQ ID NO: 2650534 - DNA, 17 bp, Homo sapiens
taagatgctaccttgtg

SEQ ID NO: 2650535 - DNA, 23 bp, Homo sapiens
taagatgctaccttgtgacccag

SEQ ID NO: 2650536 - DNA, 24 bp, Homo sapiens
taagatgctctatcttgctctgta

SEQ ID NO: 2650537 - DNA, 13 bp, Homo sapiens
taagatgctgggt

SEQ ID NO: 2650538 - DNA, 18 bp, Homo sapiens
taagatggattctcagat

SEQ ID NO: 2650539 - DNA, 20 bp, Homo sapiens
taagatggattctcagatat

SEQ ID NO: 2650540 - DNA, 14 bp, Homo sapiens
taagattcatattt

SEQ ID NO: 2650541 - DNA, 19 bp, Homo sapiens
taagcagcatttctgaagt

SEQ ID NO: 2650542 - DNA, 16 bp, Homo sapiens
taagcatcaaactctt

SEQ ID NO: 2650543 - DNA, 19 bp, Homo sapiens
taagcattaccactcaggc

SEQ ID NO: 2650544 - DNA, 12 bp, Homo sapiens
taagcattgttt

SEQ ID NO: 2650545 - DNA, 17 bp, Homo sapiens
taagcattgtttgctta

SEQ ID NO: 2650546 - DNA, 18 bp, Homo sapiens
taagcattgtttgcttat

SEQ ID NO: 2650547 - DNA, 13 bp, Homo sapiens
taagccagacatc

SEQ ID NO: 2650548 - DNA, 19 bp, Homo sapiens
taagccattctgactcata

SEQ ID NO: 2650549 - DNA, 20 bp, Homo sapiens
taagccctgtcgagacactt

SEQ ID NO: 2650550 - DNA, 15 bp, Homo sapiens
taagcctacctgctc

SEQ ID NO: 2650551 - DNA, 19 bp, Homo sapiens
taagcctccatttagttct

SEQ ID NO: 2650552 - DNA, 21 bp, Homo sapiens
taagcctccatttagttcttt

SEQ ID NO: 2650553 - DNA, 23 bp, Homo sapiens
taagcgaatgtgtacaaagtgta

SEQ ID NO: 2650554 - DNA, 21 bp, Homo sapiens
taagctattcagtaataactc

SEQ ID NO: 2650555 - DNA, 21 bp, Homo sapiens
taagctgtttattttatatta

SEQ ID NO: 2650556 - DNA, 17 bp, Homo sapiens
taagctttgccagctgc

SEQ ID NO: 2650557 - DNA, 20 bp, Homo sapiens
taaggaaactcttatctcag

SEQ ID NO: 2650558 - DNA, 16 bp, Homo sapiens
taaggaaagcaataaa

SEQ ID NO: 2650559 - DNA, 13 bp, Homo sapiens
taaggaagacaat

SEQ ID NO: 2650560 - DNA, 19 bp, Homo sapiens
taaggaatgtagctggttt

SEQ ID NO: 2650561 - DNA, 18 bp, Homo sapiens
taaggacatttcccaggg

SEQ ID NO: 2650562 - DNA, 17 bp, Homo sapiens
taaggatactttacatg

SEQ ID NO: 2650563 - DNA, 20 bp, Homo sapiens
taaggatgcttgtacataat

SEQ ID NO: 2650564 - DNA, 19 bp, Homo sapiens
taaggattttatgctttaa

SEQ ID NO: 2650565 - DNA, 22 bp, Homo sapiens
taaggattttatgctttaaaca

SEQ ID NO: 2650566 - DNA, 13 bp, Homo sapiens
taaggcatgaagg

SEQ ID NO: 2650567 - DNA, 15 bp, Homo sapiens
taaggcatgaaggat

SEQ ID NO: 2650568 - DNA, 20 bp, Homo sapiens
taaggcgtggagctgcctga

SEQ ID NO: 2650569 - DNA, 20 bp, Homo sapiens
taaggctgaggaaaggccag

SEQ ID NO: 2650570 - DNA, 20 bp, Homo sapiens
taagggacatgttttgataa

SEQ ID NO: 2650571 - DNA, 13 bp, Homo sapiens
taagggcagagtc

SEQ ID NO: 2650572 - DNA, 17 bp, Homo sapiens
taagggtatctggtgac

SEQ ID NO: 2650573 - DNA, 20 bp, Homo sapiens
taaggtttcgtttctgtata

SEQ ID NO: 2650574 - DNA, 15 bp, Homo sapiens
taagtaaaaccacag

SEQ ID NO: 2650575 - DNA, 23 bp, Homo sapiens
taagtaattatcgggaacagtgt

SEQ ID NO: 2650576 - DNA, 17 bp, Homo sapiens
taagtactatgtatcaa

SEQ ID NO: 2650577 - DNA, 19 bp, Homo sapiens
taagtactatgtatcaatg

SEQ ID NO: 2650578 - DNA, 19 bp, Homo sapiens
taagtattcttatttaatg

SEQ ID NO: 2650579 - DNA, 14 bp, Homo sapiens
taagtatttatata

SEQ ID NO: 2650580 - DNA, 15 bp, Homo sapiens
taagtcaacctgcct

SEQ ID NO: 2650581 - DNA, 15 bp, Homo sapiens
taagtcctttatgtg

SEQ ID NO: 2650582 - DNA, 16 bp, Homo sapiens
taagtgaaaaggtcat

SEQ ID NO: 2650583 - DNA, 13 bp, Homo sapiens
taagtgaaataag

SEQ ID NO: 2650584 - DNA, 14 bp, Homo sapiens
taagtgcacaacat

SEQ ID NO: 2650585 - DNA, 22 bp, Homo sapiens
taagtgcacaacattacaggga

SEQ ID NO: 2650586 - DNA, 18 bp, Homo sapiens
taagtgctgcatttaaaa

SEQ ID NO: 2650587 - DNA, 22 bp, Homo sapiens
taagtgctgcatttaaaagata

SEQ ID NO: 2650588 - DNA, 13 bp, Homo sapiens
taagtgctttgta

SEQ ID NO: 2650589 - DNA, 21 bp, Homo sapiens
taagttacacatttttcagat

SEQ ID NO: 2650590 - DNA, 14 bp, Homo sapiens
taagttacttcact

SEQ ID NO: 2650591 - DNA, 14 bp, Homo sapiens
taagttatagtata

SEQ ID NO: 2650592 - DNA, 12 bp, Homo sapiens
taagttattgca

SEQ ID NO: 2650593 - DNA, 20 bp, Homo sapiens
taagttattgcagtttatca

SEQ ID NO: 2650594 - DNA, 19 bp, Homo sapiens
taatttaaacaggcccagc

SEQ ID NO: 2650595 - DNA, 21 bp, Homo sapiens
taatttacaaaaatataaaat

SEQ ID NO: 2650596 - DNA, 22 bp, Homo sapiens
taatttacaaaaatataaaata

SEQ ID NO: 2650597 - DNA, 23 bp, Homo sapiens
taatttatcttgtctctgggctt

SEQ ID NO: 2650598 - DNA, 14 bp, Homo sapiens
taatttattattga

SEQ ID NO: 2650599 - DNA, 20 bp, Homo sapiens
taatttattgtttttccttg

SEQ ID NO: 2650600 - DNA, 12 bp, Homo sapiens
taatttatttat

SEQ ID NO: 2650601 - DNA, 19 bp, Homo sapiens
taatttatttattaagatg

SEQ ID NO: 2650602 - DNA, 18 bp, Homo sapiens
taatttctttgcctgttc

SEQ ID NO: 2650603 - DNA, 22 bp, Homo sapiens
taatttgaaaacataatctgca

SEQ ID NO: 2650604 - DNA, 22 bp, Homo sapiens
taatttgatagtattgtgcata

SEQ ID NO: 2650605 - DNA, 12 bp, Homo sapiens
taatttgatctt

SEQ ID NO: 2650606 - DNA, 14 bp, Homo sapiens
taattttaaacaaa

SEQ ID NO: 2650607 - DNA, 12 bp, Homo sapiens
taattttaatat

SEQ ID NO: 2650608 - DNA, 17 bp, Homo sapiens
taattttcctaataaag

SEQ ID NO: 2650609 - DNA, 23 bp, Homo sapiens
taattttcttcatgcaatgacat

SEQ ID NO: 2650610 - DNA, 18 bp, Homo sapiens
taattttgtattttccaa

SEQ ID NO: 2650611 - DNA, 16 bp, Homo sapiens
taatttttgctctaga

SEQ ID NO: 2650612 - DNA, 13 bp, Homo sapiens
taattttttacta

SEQ ID NO: 2650613 - DNA, 22 bp, Homo sapiens
taattttttttttccttttaaa

SEQ ID NO: 2650614 - DNA, 21 bp, Homo sapiens
tacaaaaaaaaaaaaaaatta

SEQ ID NO: 2650615 - DNA, 16 bp, Homo sapiens
tacaaaaacacagcaa

SEQ ID NO: 2650616 - DNA, 18 bp, Homo sapiens
tacaaaaacacagcaagg

SEQ ID NO: 2650617 - DNA, 20 bp, Homo sapiens
tacaaaaagcataaaaatta

SEQ ID NO: 2650618 - DNA, 15 bp, Homo sapiens
tacaaaagcatgtga

SEQ ID NO: 2650619 - DNA, 19 bp, Homo sapiens
tacaaaataaacaaataac

SEQ ID NO: 2650620 - DNA, 22 bp, Homo sapiens
tacaaacaatggaaactgaatg

SEQ ID NO: 2650621 - DNA, 14 bp, Homo sapiens
tacaaagaagacat

SEQ ID NO: 2650622 - DNA, 17 bp, Homo sapiens
tacaaagaagacatgtt

SEQ ID NO: 2650623 - DNA, 22 bp, Homo sapiens
tacaaagaagacatgttttaga

SEQ ID NO: 2650624 - DNA, 12 bp, Homo sapiens
tacaaatgtctt

SEQ ID NO: 2650625 - DNA, 21 bp, Homo sapiens
tacaaattgcttactttggaa

SEQ ID NO: 2650626 - DNA, 16 bp, Homo sapiens
tacaaattgcttgaaa

SEQ ID NO: 2650627 - DNA, 19 bp, Homo sapiens
tacaaattgcttgaaagaa

SEQ ID NO: 2650628 - DNA, 16 bp, Homo sapiens
tacaaatttgttattt

SEQ ID NO: 2650629 - DNA, 22 bp, Homo sapiens
tacaacaagagtttatttccaa

SEQ ID NO: 2650630 - DNA, 13 bp, Homo sapiens
tacaacagatttg

SEQ ID NO: 2650631 - DNA, 17 bp, Homo sapiens
tacaacagatttgtgaa

SEQ ID NO: 2650632 - DNA, 19 bp, Homo sapiens
tacaacagatttgtgaact

SEQ ID NO: 2650633 - DNA, 21 bp, Homo sapiens
tacaacagatttgtgaactca

SEQ ID NO: 2650634 - DNA, 14 bp, Homo sapiens
tacaacagtgctaa

SEQ ID NO: 2650635 - DNA, 20 bp, Homo sapiens
tacaactgagtccttaaaca

SEQ ID NO: 2650636 - DNA, 14 bp, Homo sapiens
tacaacttcagcag

SEQ ID NO: 2650637 - DNA, 16 bp, Homo sapiens
tacaagagcagcctgt

SEQ ID NO: 2650638 - DNA, 20 bp, Homo sapiens
tacaagagcagcctgtggca

SEQ ID NO: 2650639 - DNA, 13 bp, Homo sapiens
tacaagattagaa

SEQ ID NO: 2650640 - DNA, 21 bp, Homo sapiens
tacaagccattctaaggaaat

SEQ ID NO: 2650641 - DNA, 16 bp, Homo sapiens
tacaagcgtgagccac

SEQ ID NO: 2650642 - DNA, 14 bp, Homo sapiens
tacaaggcaacata

SEQ ID NO: 2650643 - DNA, 21 bp, Homo sapiens
tacaagtgtatatcagaaaag

SEQ ID NO: 2650644 - DNA, 15 bp, Homo sapiens
tacaataaataatct

SEQ ID NO: 2650645 - DNA, 17 bp, Homo sapiens
tacaatcattgctgaaa

SEQ ID NO: 2650646 - DNA, 23 bp, Homo sapiens
tacaatcattgctgaaaatggta

SEQ ID NO: 2650647 - DNA, 14 bp, Homo sapiens
tacaatgactttat

SEQ ID NO: 2650648 - DNA, 21 bp, Homo sapiens
tacaatgctgtgccctaaagt

SEQ ID NO: 2650649 - DNA, 14 bp, Homo sapiens
tacaatgtatttat

SEQ ID NO: 2650650 - DNA, 19 bp, Homo sapiens
tacaatgtatttatttaaa

SEQ ID NO: 2650651 - DNA, 20 bp, Homo sapiens
tacaatgtatttatttaaaa

SEQ ID NO: 2650652 - DNA, 23 bp, Homo sapiens
tacaattttttatcatgcatgtc

SEQ ID NO: 2650653 - DNA, 23 bp, Homo sapiens
tacacaaaacaaatgccacacat

SEQ ID NO: 2650654 - DNA, 20 bp, Homo sapiens
tacacacacacacacagcca

SEQ ID NO: 2650655 - DNA, 22 bp, Homo sapiens
tacacacacacacacagccaca

SEQ ID NO: 2650656 - DNA, 17 bp, Homo sapiens
tacacactgcatgtttg

SEQ ID NO: 2650657 - DNA, 22 bp, Homo sapiens
tacacattttattttattatgc

SEQ ID NO: 2650658 - DNA, 21 bp, Homo sapiens
tacacatttttcagatataaa

SEQ ID NO: 2650659 - DNA, 19 bp, Homo sapiens
tacaccagagataatatga

SEQ ID NO: 2650660 - DNA, 20 bp, Homo sapiens
tacaccagagataatatgag

SEQ ID NO: 2650661 - DNA, 19 bp, Homo sapiens
tacaccattatcttggaaa

SEQ ID NO: 2650662 - DNA, 13 bp, Homo sapiens
tacacgtgtcctg

SEQ ID NO: 2650663 - DNA, 15 bp, Homo sapiens
tacactccagcctga

SEQ ID NO: 2650664 - DNA, 17 bp, Homo sapiens
tacactccagcctgagc

SEQ ID NO: 2650665 - DNA, 20 bp, Homo sapiens
tacactgaagttaacagaga

SEQ ID NO: 2650666 - DNA, 17 bp, Homo sapiens
tacactgaatatttata

SEQ ID NO: 2650667 - DNA, 21 bp, Homo sapiens
tacactggaggagagaagaat

SEQ ID NO: 2650668 - DNA, 22 bp, Homo sapiens
tacactggaggagagaagaatg

SEQ ID NO: 2650669 - DNA, 22 bp, Homo sapiens
tacactgggagaggtgccagca

SEQ ID NO: 2650670 - DNA, 12 bp, Homo sapiens
tacactgtgaac

SEQ ID NO: 2650671 - DNA, 16 bp, Homo sapiens
tacactgtgctgagtc

SEQ ID NO: 2650672 - DNA, 18 bp, Homo sapiens
tacactgtttcaaacttt

SEQ ID NO: 2650673 - DNA, 19 bp, Homo sapiens
tacactgtttcaaacttta

SEQ ID NO: 2650674 - DNA, 20 bp, Homo sapiens
tacactgtttcaaactttac

SEQ ID NO: 2650675 - DNA, 21 bp, Homo sapiens
tacagaaagatggatgtgctt

SEQ ID NO: 2650676 - DNA, 20 bp, Homo sapiens
tacagaaagtggtgctcagt

SEQ ID NO: 2650677 - DNA, 17 bp, Homo sapiens
tacagaaattagccggg

SEQ ID NO: 2650678 - DNA, 18 bp, Homo sapiens
tacagaattctgctacct

SEQ ID NO: 2650679 - DNA, 13 bp, Homo sapiens
tacagacactaag

SEQ ID NO: 2650680 - DNA, 18 bp, Homo sapiens
tacagacactaagttata

SEQ ID NO: 2650681 - DNA, 20 bp, Homo sapiens
tacagaccgaactgttgtat

SEQ ID NO: 2650682 - DNA, 15 bp, Homo sapiens
tacagacttctccag

SEQ ID NO: 2650683 - DNA, 17 bp, Homo sapiens
tacagagacagaaagca

SEQ ID NO: 2650684 - DNA, 22 bp, Homo sapiens
tacagagaggagaaacacatct

SEQ ID NO: 2650685 - DNA, 15 bp, Homo sapiens
tacagagcttccctg

SEQ ID NO: 2650686 - DNA, 14 bp, Homo sapiens
tacagaggacagta

SEQ ID NO: 2650687 - DNA, 23 bp, Homo sapiens
tacagaggtctctgccggctctt

SEQ ID NO: 2650688 - DNA, 19 bp, Homo sapiens
tacagatagtcaaaccata

SEQ ID NO: 2650689 - DNA, 15 bp, Homo sapiens
tacagcactactctg

SEQ ID NO: 2650690 - DNA, 19 bp, Homo sapiens
tacagcgagaggcagagaa

SEQ ID NO: 2650691 - DNA, 21 bp, Homo sapiens
tacagctgggtggcactgcca

SEQ ID NO: 2650692 - DNA, 19 bp, Homo sapiens
tacaggaaaagctgctgac

SEQ ID NO: 2650693 - DNA, 21 bp, Homo sapiens
tacaggaagcaccccatgcca

SEQ ID NO: 2650694 - DNA, 18 bp, Homo sapiens
tacaggaaggtagaaata

SEQ ID NO: 2650695 - DNA, 20 bp, Homo sapiens
tacaggatttgaactcagat

SEQ ID NO: 2650696 - DNA, 23 bp, Homo sapiens
tacaggatttgaactcagatctg

SEQ ID NO: 2650697 - DNA, 15 bp, Homo sapiens
tacaggcatagagtt

SEQ ID NO: 2650698 - DNA, 20 bp, Homo sapiens
tacagggaatgcctgagtgc

SEQ ID NO: 2650699 - DNA, 16 bp, Homo sapiens
tacagggagctgggac

SEQ ID NO: 2650700 - DNA, 21 bp, Homo sapiens
tacaggtaaggtgagggaata

SEQ ID NO: 2650701 - DNA, 15 bp, Homo sapiens
tacaggttacaacag

SEQ ID NO: 2650702 - DNA, 18 bp, Homo sapiens
tacaggttacaacagatt

SEQ ID NO: 2650703 - DNA, 13 bp, Homo sapiens
tacagtaacttta

SEQ ID NO: 2650704 - DNA, 20 bp, Homo sapiens
tacagtaactttatgtgtaa

SEQ ID NO: 2650705 - DNA, 23 bp, Homo sapiens
tacagtaactttatgtgtaaata

SEQ ID NO: 2650706 - DNA, 22 bp, Homo sapiens
tacagtaggagcccagctctga

SEQ ID NO: 2650707 - DNA, 14 bp, Homo sapiens
tacagtctgtcatg

SEQ ID NO: 2650708 - DNA, 22 bp, Homo sapiens
tacagtcttccatttgcaaggg

SEQ ID NO: 2650709 - DNA, 20 bp, Homo sapiens
tacagtgaaaatgtaagctg

SEQ ID NO: 2650710 - DNA, 21 bp, Homo sapiens
tacagtgaaaatgtaagctgt

SEQ ID NO: 2650711 - DNA, 13 bp, Homo sapiens
tacagtgtacagt

SEQ ID NO: 2650712 - DNA, 13 bp, Homo sapiens
tacataaaggtgg

SEQ ID NO: 2650713 - DNA, 16 bp, Homo sapiens
tacataagataaatgt

SEQ ID NO: 2650714 - DNA, 17 bp, Homo sapiens
tacataagataaatgtg

SEQ ID NO: 2650715 - DNA, 15 bp, Homo sapiens
tacataatctgtaca

SEQ ID NO: 2650716 - DNA, 20 bp, Homo sapiens
tacataatctgtacaatgaa

SEQ ID NO: 2650717 - DNA, 24 bp, Homo sapiens
tacataatgcgtgcataccacttt

SEQ ID NO: 2650718 - DNA, 19 bp, Homo sapiens
tacataattttttattcaa

SEQ ID NO: 2650719 - DNA, 22 bp, Homo sapiens
tacataccctggccgccccctg

SEQ ID NO: 2650720 - DNA, 15 bp, Homo sapiens
tacatagcctatatt

SEQ ID NO: 2650721 - DNA, 20 bp, Homo sapiens
tacatagcctatatttacag

SEQ ID NO: 2650722 - DNA, 13 bp, Homo sapiens
tacatatgaaatt

SEQ ID NO: 2650723 - DNA, 16 bp, Homo sapiens
tacatatgagtgtgga

SEQ ID NO: 2650724 - DNA, 17 bp, Homo sapiens
tacatatgtaaaataaa

SEQ ID NO: 2650725 - DNA, 18 bp, Homo sapiens
tacatattaggaaaatat

SEQ ID NO: 2650726 - DNA, 15 bp, Homo sapiens
tacatattctttaaa

SEQ ID NO: 2650727 - DNA, 16 bp, Homo sapiens
tacatatttgtggaat

SEQ ID NO: 2650728 - DNA, 16 bp, Homo sapiens
tacatcccatgtaaca

SEQ ID NO: 2650729 - DNA, 22 bp, Homo sapiens
tacatcccatgtaacagaaagg

SEQ ID NO: 2650730 - DNA, 22 bp, Homo sapiens
tacatcctcatgcagccgtgat

SEQ ID NO: 2650731 - DNA, 15 bp, Homo sapiens
tacatctttcacatt

SEQ ID NO: 2650732 - DNA, 16 bp, Homo sapiens
tacatgacatttattt

SEQ ID NO: 2650733 - DNA, 22 bp, Homo sapiens
tacatgaggtactgagagtgaa

SEQ ID NO: 2650734 - DNA, 16 bp, Homo sapiens
tacatgcaatttatta

SEQ ID NO: 2650735 - DNA, 19 bp, Homo sapiens
tacatgcaatttattaaaa

SEQ ID NO: 2650736 - DNA, 22 bp, Homo sapiens
tacatgcaatttattaaaatga

SEQ ID NO: 2650737 - DNA, 20 bp, Homo sapiens
taggaggaccagagctactg

SEQ ID NO: 2650738 - DNA, 23 bp, Homo sapiens
taggagttcacttcatcttctca

SEQ ID NO: 2650739 - DNA, 23 bp, Homo sapiens
taggagttcgagaccagcctggc

SEQ ID NO: 2650740 - DNA, 21 bp, Homo sapiens
taggatttaacagtcatttaa

SEQ ID NO: 2650741 - DNA, 12 bp, Homo sapiens
taggcagagcct

SEQ ID NO: 2650742 - DNA, 17 bp, Homo sapiens
taggcaggacatgctga

SEQ ID NO: 2650743 - DNA, 22 bp, Homo sapiens
taggcaggacatgctgaagcca

SEQ ID NO: 2650744 - DNA, 14 bp, Homo sapiens
taggcaggacctgt

SEQ ID NO: 2650745 - DNA, 15 bp, Homo sapiens
taggcaggacctgtg

SEQ ID NO: 2650746 - DNA, 21 bp, Homo sapiens
taggcatgagggatcacaggg

SEQ ID NO: 2650747 - DNA, 16 bp, Homo sapiens
taggcatttgctgaat

SEQ ID NO: 2650748 - DNA, 20 bp, Homo sapiens
taggcatttgctgaatacag

SEQ ID NO: 2650749 - DNA, 14 bp, Homo sapiens
taggccatgaaaaa

SEQ ID NO: 2650750 - DNA, 14 bp, Homo sapiens
taggcctggccaga

SEQ ID NO: 2650751 - DNA, 15 bp, Homo sapiens
taggcctggccagat

SEQ ID NO: 2650752 - DNA, 20 bp, Homo sapiens
taggcctgggtgctggctgc

SEQ ID NO: 2650753 - DNA, 14 bp, Homo sapiens
taggcgagtgccag

SEQ ID NO: 2650754 - DNA, 16 bp, Homo sapiens
taggcgggaaggaggg

SEQ ID NO: 2650755 - DNA, 15 bp, Homo sapiens
taggctattcacaac

SEQ ID NO: 2650756 - DNA, 19 bp, Homo sapiens
taggctggagaagctcacc

SEQ ID NO: 2650757 - DNA, 19 bp, Homo sapiens
tagggaaaaaccagcgtgt

SEQ ID NO: 2650758 - DNA, 16 bp, Homo sapiens
tagggaaaacattcca

SEQ ID NO: 2650759 - DNA, 18 bp, Homo sapiens
tagggaaaacattccatc

SEQ ID NO: 2650760 - DNA, 14 bp, Homo sapiens
tagggaagggcctg

SEQ ID NO: 2650761 - DNA, 21 bp, Homo sapiens
tagggaatggcacagcccaaa

SEQ ID NO: 2650762 - DNA, 13 bp, Homo sapiens
tagggacttaaaa

SEQ ID NO: 2650763 - DNA, 14 bp, Homo sapiens
tagggacttaaaaa

SEQ ID NO: 2650764 - DNA, 22 bp, Homo sapiens
tagggaggaccttatctgtgcg

SEQ ID NO: 2650765 - DNA, 18 bp, Homo sapiens
tagggatgttctggccct

SEQ ID NO: 2650766 - DNA, 13 bp, Homo sapiens
tagggcagcttgc

SEQ ID NO: 2650767 - DNA, 19 bp, Homo sapiens
tagggcataatgatgatgg

SEQ ID NO: 2650768 - DNA, 18 bp, Homo sapiens
tagggcatttgagaaatg

SEQ ID NO: 2650769 - DNA, 16 bp, Homo sapiens
tagggccaagcccagc

SEQ ID NO: 2650770 - DNA, 23 bp, Homo sapiens
tagggccaagcccagcactgctt

SEQ ID NO: 2650771 - DNA, 17 bp, Homo sapiens
tagggttataataatgt

SEQ ID NO: 2650772 - DNA, 14 bp, Homo sapiens
taggtacacagctc

SEQ ID NO: 2650773 - DNA, 15 bp, Homo sapiens
taggtatgaataagt

SEQ ID NO: 2650774 - DNA, 14 bp, Homo sapiens
taggtcagtgaggc

SEQ ID NO: 2650775 - DNA, 11 bp, Homo sapiens
taggtgacaga

SEQ ID NO: 2650776 - DNA, 16 bp, Homo sapiens
taggtgacagagtgag

SEQ ID NO: 2650777 - DNA, 23 bp, Homo sapiens
taggtgacagagtgagactctgt

SEQ ID NO: 2650778 - DNA, 21 bp, Homo sapiens
taggtgatctcatttaatcct

SEQ ID NO: 2650779 - DNA, 18 bp, Homo sapiens
taggtgctacaaaaacac

SEQ ID NO: 2650780 - DNA, 23 bp, Homo sapiens
taggtgctacaaaaacacagcaa

SEQ ID NO: 2650781 - DNA, 16 bp, Homo sapiens
taggtggcaaggctgt

SEQ ID NO: 2650782 - DNA, 21 bp, Homo sapiens
taggtgtgactgaatttcttt

SEQ ID NO: 2650783 - DNA, 12 bp, Homo sapiens
taggttctaaaa

SEQ ID NO: 2650784 - DNA, 17 bp, Homo sapiens
taggtttaactcagatc

SEQ ID NO: 2650785 - DNA, 21 bp, Homo sapiens
taggtttaactcagatcacta

SEQ ID NO: 2650786 - DNA, 20 bp, Homo sapiens
taggtttttttccttctgaa

SEQ ID NO: 2650787 - DNA, 16 bp, Homo sapiens
tagtaaaaataaaatt

SEQ ID NO: 2650788 - DNA, 13 bp, Homo sapiens
tagtaaggctgtg

SEQ ID NO: 2650789 - DNA, 14 bp, Homo sapiens
tagtaagtgccttc

SEQ ID NO: 2650790 - DNA, 21 bp, Homo sapiens
tagtaatgctacgtgtgattt

SEQ ID NO: 2650791 - DNA, 14 bp, Homo sapiens
tagtaattctcagg

SEQ ID NO: 2650792 - DNA, 21 bp, Homo sapiens
tagtacataaaggtggtatgt

SEQ ID NO: 2650793 - DNA, 18 bp, Homo sapiens
tagtacctgaaaagtaac

SEQ ID NO: 2650794 - DNA, 14 bp, Homo sapiens
tagtactaactcct

SEQ ID NO: 2650795 - DNA, 19 bp, Homo sapiens
tagtactcctgcaaaattt

SEQ ID NO: 2650796 - DNA, 13 bp, Homo sapiens
tagtactgctctt

SEQ ID NO: 2650797 - DNA, 15 bp, Homo sapiens
tagtactgctcttgt

SEQ ID NO: 2650798 - DNA, 15 bp, Homo sapiens
tagtagagacagggt

SEQ ID NO: 2650799 - DNA, 18 bp, Homo sapiens
tagtagccctttctgtgt

SEQ ID NO: 2650800 - DNA, 19 bp, Homo sapiens
tagtagccctttctgtgtg

SEQ ID NO: 2650801 - DNA, 14 bp, Homo sapiens
tagtataaagaaaa

SEQ ID NO: 2650802 - DNA, 14 bp, Homo sapiens
tagtatcaaatatt

SEQ ID NO: 2650803 - DNA, 20 bp, Homo sapiens
tagtatcaaatattagatgt

SEQ ID NO: 2650804 - DNA, 21 bp, Homo sapiens
tagtatcaaatattagatgtg

SEQ ID NO: 2650805 - DNA, 13 bp, Homo sapiens
tagtatcctccag

SEQ ID NO: 2650806 - DNA, 14 bp, Homo sapiens
tagtatcctccagg

SEQ ID NO: 2650807 - DNA, 19 bp, Homo sapiens
tagtatcctccaggttttt

SEQ ID NO: 2650808 - DNA, 20 bp, Homo sapiens
tagtatcctccaggtttttc

SEQ ID NO: 2650809 - DNA, 21 bp, Homo sapiens
tagtatcctccaggtttttca

SEQ ID NO: 2650810 - DNA, 16 bp, Homo sapiens
tagtatggtggctggg

SEQ ID NO: 2650811 - DNA, 21 bp, Homo sapiens
tagtcacatggcctatgcaca

SEQ ID NO: 2650812 - DNA, 14 bp, Homo sapiens
tagtcactgagaca

SEQ ID NO: 2650813 - DNA, 22 bp, Homo sapiens
tagtccaatgtctttttaagct

SEQ ID NO: 2650814 - DNA, 23 bp, Homo sapiens
tagtctaaggatgctaaacctta

SEQ ID NO: 2650815 - DNA, 20 bp, Homo sapiens
tagtctactcttaagccatc

SEQ ID NO: 2650816 - DNA, 12 bp, Homo sapiens
tagtctcaggac

SEQ ID NO: 2650817 - DNA, 21 bp, Homo sapiens
tagtctcattacttttgaagt

SEQ ID NO: 2650818 - DNA, 17 bp, Homo sapiens
tagtctcctttgcactg

SEQ ID NO: 2650819 - DNA, 18 bp, Homo sapiens
tagtctcctttgcactga

SEQ ID NO: 2650820 - DNA, 19 bp, Homo sapiens
tagtctcctttgcactgag

SEQ ID NO: 2650821 - DNA, 23 bp, Homo sapiens
tagtctctctggggccacacaga

SEQ ID NO: 2650822 - DNA, 17 bp, Homo sapiens
tagtctctgtgctttga

SEQ ID NO: 2650823 - DNA, 12 bp, Homo sapiens
tagtcttctcat

SEQ ID NO: 2650824 - DNA, 14 bp, Homo sapiens
tagtcttctcatag

SEQ ID NO: 2650825 - DNA, 18 bp, Homo sapiens
tagtcttctcatagcatt

SEQ ID NO: 2650826 - DNA, 24 bp, Homo sapiens
tagtgaaaccccatctctactgaa

SEQ ID NO: 2650827 - DNA, 23 bp, Homo sapiens
tagtgaaatgaatatttaaataa

SEQ ID NO: 2650828 - DNA, 21 bp, Homo sapiens
tagtgaatcacgtaaagctag

SEQ ID NO: 2650829 - DNA, 13 bp, Homo sapiens
tagtgcagctgat

SEQ ID NO: 2650830 - DNA, 17 bp, Homo sapiens
tagtgcggacaagtttt

SEQ ID NO: 2650831 - DNA, 19 bp, Homo sapiens
tagtgcggacaagttttaa

SEQ ID NO: 2650832 - DNA, 19 bp, Homo sapiens
tagtgctcgctttctatgt

SEQ ID NO: 2650833 - DNA, 20 bp, Homo sapiens
tagtggcttcattagagcag

SEQ ID NO: 2650834 - DNA, 13 bp, Homo sapiens
tagtggtctttgt

SEQ ID NO: 2650835 - DNA, 21 bp, Homo sapiens
tagtggtctttgtaagagtgt

SEQ ID NO: 2650836 - DNA, 23 bp, Homo sapiens
tagtggtctttgtaagagtgtag

SEQ ID NO: 2650837 - DNA, 20 bp, Homo sapiens
tagtgtaggtcagcgtgctt

SEQ ID NO: 2650838 - DNA, 12 bp, Homo sapiens
tagtgtctatca

SEQ ID NO: 2650839 - DNA, 22 bp, Homo sapiens
tagtgtggaaattaagaagaaa

SEQ ID NO: 2650840 - DNA, 15 bp, Homo sapiens
tagtgtgttctgatt

SEQ ID NO: 2650841 - DNA, 19 bp, Homo sapiens
tagtgtgttctgattagaa

SEQ ID NO: 2650842 - DNA, 16 bp, Homo sapiens
tagtgttaatcaattt

SEQ ID NO: 2650843 - DNA, 16 bp, Homo sapiens
tagtgtttctgtgcat

SEQ ID NO: 2650844 - DNA, 15 bp, Homo sapiens
tagttaaatttctgg

SEQ ID NO: 2650845 - DNA, 14 bp, Homo sapiens
tagttacagctgtg

SEQ ID NO: 2650846 - DNA, 21 bp, Homo sapiens
tagttactgttgtgacctgaa

SEQ ID NO: 2650847 - DNA, 16 bp, Homo sapiens
tagttaggaaataaaa

SEQ ID NO: 2650848 - DNA, 21 bp, Homo sapiens
tagttaggaaataaaaccttt

SEQ ID NO: 2650849 - DNA, 15 bp, Homo sapiens
tagttagtagcatgt

SEQ ID NO: 2650850 - DNA, 15 bp, Homo sapiens
tagttatagtttcag

SEQ ID NO: 2650851 - DNA, 16 bp, Homo sapiens
tagttcctgctacaac

SEQ ID NO: 2650852 - DNA, 15 bp, Homo sapiens
tagttcgtagctttc

SEQ ID NO: 2650853 - DNA, 14 bp, Homo sapiens
tagttgaactgata

SEQ ID NO: 2650854 - DNA, 13 bp, Homo sapiens
tagttgagcccca

SEQ ID NO: 2650855 - DNA, 18 bp, Homo sapiens
tagttgcagactcagttt

SEQ ID NO: 2650856 - DNA, 23 bp, Homo sapiens
tagttgcagactcagtttgtcag

SEQ ID NO: 2650857 - DNA, 17 bp, Homo sapiens
tagtttctgttctgtgg

SEQ ID NO: 2650858 - DNA, 18 bp, Homo sapiens
tagtttctgttctgtgga

SEQ ID NO: 2650859 - DNA, 15 bp, Homo sapiens
tagtttgattaaatt

SEQ ID NO: 2650860 - DNA, 23 bp, Homo sapiens
tagtttgattaaattcttgcaaa

SEQ ID NO: 2650861 - DNA, 17 bp, Homo sapiens
tagtttgcattcctgat

SEQ ID NO: 2650862 - DNA, 14 bp, Homo sapiens
tagtttgtataact

SEQ ID NO: 2650863 - DNA, 17 bp, Homo sapiens
tagtttgtataacttct

SEQ ID NO: 2650864 - DNA, 18 bp, Homo sapiens
tagtttgtataacttctt

SEQ ID NO: 2650865 - DNA, 17 bp, Homo sapiens
tagttttatcacatgta

SEQ ID NO: 2650866 - DNA, 19 bp, Homo sapiens
tagttttatcacatgtatg

SEQ ID NO: 2650867 - DNA, 23 bp, Homo sapiens
tagttttcatacacagcctgggc

SEQ ID NO: 2650868 - DNA, 18 bp, Homo sapiens
tagtttttacctaccaca

SEQ ID NO: 2650869 - DNA, 21 bp, Homo sapiens
tataaaaagaaaagataaaga

SEQ ID NO: 2650870 - DNA, 13 bp, Homo sapiens
tataaaagtgatt

SEQ ID NO: 2650871 - DNA, 15 bp, Homo sapiens
tataaaattaagcaa

SEQ ID NO: 2650872 - DNA, 14 bp, Homo sapiens
tataaacatcacac

SEQ ID NO: 2650873 - DNA, 18 bp, Homo sapiens
tataaacatcacacacac

SEQ ID NO: 2650874 - DNA, 22 bp, Homo sapiens
tataaacatgcttgcattatat

SEQ ID NO: 2650875 - DNA, 14 bp, Homo sapiens
tataaactttacct

SEQ ID NO: 2650876 - DNA, 16 bp, Homo sapiens
tataaactttaccttt

SEQ ID NO: 2650877 - DNA, 18 bp, Homo sapiens
tataaactttaccttttt

SEQ ID NO: 2650878 - DNA, 15 bp, Homo sapiens
tataaactttagagt

SEQ ID NO: 2650879 - DNA, 21 bp, Homo sapiens
tataaactttagagtagcatg

SEQ ID NO: 2650880 - DNA, 19 bp, Homo sapiens
tataaagaagaacttgcat

SEQ ID NO: 2650881 - DNA, 15 bp, Homo sapiens
tattgtccattgtcc

SEQ ID NO: 2650882 - DNA, 21 bp, Homo sapiens
tattgtgatctatcaatagtc

SEQ ID NO: 2650883 - DNA, 19 bp, Homo sapiens
tattgttccaagacattgt

SEQ ID NO: 2650884 - DNA, 13 bp, Homo sapiens
tattgttcccagt

SEQ ID NO: 2650885 - DNA, 21 bp, Homo sapiens
tattgttcccagtgacacttc

SEQ ID NO: 2650886 - DNA, 15 bp, Homo sapiens
tattgtttaaaatca

SEQ ID NO: 2650887 - DNA, 20 bp, Homo sapiens
tattgtttaaaatcatttct

SEQ ID NO: 2650888 - DNA, 12 bp, Homo sapiens
tattgtttcaat

SEQ ID NO: 2650889 - DNA, 11 bp, Homo sapiens
tattgtttcta

SEQ ID NO: 2650890 - DNA, 22 bp, Homo sapiens
tattgttttcagtgtacatgga

SEQ ID NO: 2650891 - DNA, 22 bp, Homo sapiens
tattgtttttccttgtatttaa

SEQ ID NO: 2650892 - DNA, 13 bp, Homo sapiens
tatttaaaacttg

SEQ ID NO: 2650893 - DNA, 23 bp, Homo sapiens
tatttaaaagaaagcctcagaga

SEQ ID NO: 2650894 - DNA, 16 bp, Homo sapiens
tatttaaaagattcat

SEQ ID NO: 2650895 - DNA, 12 bp, Homo sapiens
tatttaaagaca

SEQ ID NO: 2650896 - DNA, 17 bp, Homo sapiens
tatttaagataattata

SEQ ID NO: 2650897 - DNA, 21 bp, Homo sapiens
tatttaagcctcatatttaaa

SEQ ID NO: 2650898 - DNA, 13 bp, Homo sapiens
tatttaataacat

SEQ ID NO: 2650899 - DNA, 15 bp, Homo sapiens
tatttaatgttatgt

SEQ ID NO: 2650900 - DNA, 22 bp, Homo sapiens
tatttacagtgaaaatgtaagc

SEQ ID NO: 2650901 - DNA, 14 bp, Homo sapiens
tatttacatatgaa

SEQ ID NO: 2650902 - DNA, 16 bp, Homo sapiens
tatttacatatgaaat

SEQ ID NO: 2650903 - DNA, 21 bp, Homo sapiens
tatttacatatgaaatttaat

SEQ ID NO: 2650904 - DNA, 23 bp, Homo sapiens
tatttactgagcttctctgtgaa

SEQ ID NO: 2650905 - DNA, 17 bp, Homo sapiens
tatttagattgttaaaa

SEQ ID NO: 2650906 - DNA, 19 bp, Homo sapiens
tatttagattgttaaaata

SEQ ID NO: 2650907 - DNA, 22 bp, Homo sapiens
tatttagattgttaaaataact

SEQ ID NO: 2650908 - DNA, 11 bp, Homo sapiens
tatttagcatg

SEQ ID NO: 2650909 - DNA, 18 bp, Homo sapiens
tatttagggaactgcttg

SEQ ID NO: 2650910 - DNA, 17 bp, Homo sapiens
tatttagttatagtttc

SEQ ID NO: 2650911 - DNA, 17 bp, Homo sapiens
tatttataaatatattt

SEQ ID NO: 2650912 - DNA, 21 bp, Homo sapiens
tatttataactcatcataaaa

SEQ ID NO: 2650913 - DNA, 14 bp, Homo sapiens
tatttataagcaga

SEQ ID NO: 2650914 - DNA, 20 bp, Homo sapiens
tatttatatattggtaacat

SEQ ID NO: 2650915 - DNA, 19 bp, Homo sapiens
tatttatatatttataact

SEQ ID NO: 2650916 - DNA, 14 bp, Homo sapiens
tatttatatttcac

SEQ ID NO: 2650917 - DNA, 21 bp, Homo sapiens
tatttatatttttattttatt

SEQ ID NO: 2650918 - DNA, 22 bp, Homo sapiens
tatttatctgtgtttttgaaat

SEQ ID NO: 2650919 - DNA, 19 bp, Homo sapiens
tatttattattttcacctg

SEQ ID NO: 2650920 - DNA, 16 bp, Homo sapiens
tatttatttaaaagat

SEQ ID NO: 2650921 - DNA, 13 bp, Homo sapiens
tatttatttaaat

SEQ ID NO: 2650922 - DNA, 14 bp, Homo sapiens
tatttatttatgga

SEQ ID NO: 2650923 - DNA, 17 bp, Homo sapiens
tatttattttcctcccc

SEQ ID NO: 2650924 - DNA, 14 bp, Homo sapiens
tatttcaagacatt

SEQ ID NO: 2650925 - DNA, 20 bp, Homo sapiens
tatttcactttagatgctga

SEQ ID NO: 2650926 - DNA, 17 bp, Homo sapiens
tatttcatgaaaattgt

SEQ ID NO: 2650927 - DNA, 21 bp, Homo sapiens
tatttccattccagaatatct

SEQ ID NO: 2650928 - DNA, 22 bp, Homo sapiens
tatttccccaggggaaaatgaa

SEQ ID NO: 2650929 - DNA, 18 bp, Homo sapiens
tatttccctctcattttg

SEQ ID NO: 2650930 - DNA, 19 bp, Homo sapiens
tatttcctcatgtgatcac

SEQ ID NO: 2650931 - DNA, 16 bp, Homo sapiens
tatttctatgagaaaa

SEQ ID NO: 2650932 - DNA, 18 bp, Homo sapiens
tatttctatttcctggaa

SEQ ID NO: 2650933 - DNA, 19 bp, Homo sapiens
tatttctcaacaaagcaca

SEQ ID NO: 2650934 - DNA, 16 bp, Homo sapiens
tatttctgagaaggtc

SEQ ID NO: 2650935 - DNA, 19 bp, Homo sapiens
tatttcttaaatctagtaa

SEQ ID NO: 2650936 - DNA, 16 bp, Homo sapiens
tatttgagactagttt

SEQ ID NO: 2650937 - DNA, 18 bp, Homo sapiens
tatttgcagttcacctgc

SEQ ID NO: 2650938 - DNA, 17 bp, Homo sapiens
tatttgccatgggcttc

SEQ ID NO: 2650939 - DNA, 15 bp, Homo sapiens
tatttgctttttgct

SEQ ID NO: 2650940 - DNA, 12 bp, Homo sapiens
tatttgtatctc

SEQ ID NO: 2650941 - DNA, 22 bp, Homo sapiens
tatttgtatctctgaagcatgt

SEQ ID NO: 2650942 - DNA, 12 bp, Homo sapiens
tatttgtggaat

SEQ ID NO: 2650943 - DNA, 20 bp, Homo sapiens
tatttgttaatggtttgaat

SEQ ID NO: 2650944 - DNA, 19 bp, Homo sapiens
tattttaaacaaaatagaa

SEQ ID NO: 2650945 - DNA, 23 bp, Homo sapiens
tattttacaattttttatcatgc

SEQ ID NO: 2650946 - DNA, 14 bp, Homo sapiens
tattttacttttat

SEQ ID NO: 2650947 - DNA, 21 bp, Homo sapiens
tattttattacatctttcaca

SEQ ID NO: 2650948 - DNA, 19 bp, Homo sapiens
tattttattccctttcaca

SEQ ID NO: 2650949 - DNA, 16 bp, Homo sapiens
tattttcaagaaactg

SEQ ID NO: 2650950 - DNA, 14 bp, Homo sapiens
tattttcaccattt

SEQ ID NO: 2650951 - DNA, 15 bp, Homo sapiens
tattttccaagtgtg

SEQ ID NO: 2650952 - DNA, 24 bp, Homo sapiens
tattttccaagtgtgcatattgta

SEQ ID NO: 2650953 - DNA, 12 bp, Homo sapiens
tattttcctccc

SEQ ID NO: 2650954 - DNA, 15 bp, Homo sapiens
tattttcctccccag

SEQ ID NO: 2650955 - DNA, 16 bp, Homo sapiens
tattttcctccccagc

SEQ ID NO: 2650956 - DNA, 20 bp, Homo sapiens
tattttctggtagatagaaa

SEQ ID NO: 2650957 - DNA, 23 bp, Homo sapiens
tattttgaatcaataatatattt

SEQ ID NO: 2650958 - DNA, 16 bp, Homo sapiens
tattttgattattgta

SEQ ID NO: 2650959 - DNA, 18 bp, Homo sapiens
tattttgattattgtatt

SEQ ID NO: 2650960 - DNA, 13 bp, Homo sapiens
tattttgctttgt

SEQ ID NO: 2650961 - DNA, 15 bp, Homo sapiens
tattttgctttgtga

SEQ ID NO: 2650962 - DNA, 14 bp, Homo sapiens
tattttggtacttt

SEQ ID NO: 2650963 - DNA, 21 bp, Homo sapiens
tattttggttcttagttctca

SEQ ID NO: 2650964 - DNA, 21 bp, Homo sapiens
tattttgtaaactcaaaatat

SEQ ID NO: 2650965 - DNA, 17 bp, Homo sapiens
tatttttaattaaataa

SEQ ID NO: 2650966 - DNA, 12 bp, Homo sapiens
tatttttactgc

SEQ ID NO: 2650967 - DNA, 21 bp, Homo sapiens
tatttttatatttagttatag

SEQ ID NO: 2650968 - DNA, 11 bp, Homo sapiens
tatttttcata

SEQ ID NO: 2650969 - DNA, 19 bp, Homo sapiens
tatttttcatattgtgcca

SEQ ID NO: 2650970 - DNA, 20 bp, Homo sapiens
tatttttcatgattttgaaa

SEQ ID NO: 2650971 - DNA, 14 bp, Homo sapiens
tatttttctcatga

SEQ ID NO: 2650972 - DNA, 22 bp, Homo sapiens
tatttttgaaaggcatgttcct

SEQ ID NO: 2650973 - DNA, 12 bp, Homo sapiens
tatttttgcatg

SEQ ID NO: 2650974 - DNA, 19 bp, Homo sapiens
tatttttggcagtctgaat

SEQ ID NO: 2650975 - DNA, 20 bp, Homo sapiens
tatttttgtttcttccaaag

SEQ ID NO: 2650976 - DNA, 15 bp, Homo sapiens
tatttttttactaat

SEQ ID NO: 2650977 - DNA, 14 bp, Homo sapiens
tatttttttctacc

SEQ ID NO: 2650978 - DNA, 15 bp, Homo sapiens
tatttttttctgatt

SEQ ID NO: 2650979 - DNA, 17 bp, Homo sapiens
tatttttttctgattgt

SEQ ID NO: 2650980 - DNA, 18 bp, Homo sapiens
tatttttttctgattgta

SEQ ID NO: 2650981 - DNA, 15 bp, Homo sapiens
tcaaaaaaagaaaaa

SEQ ID NO: 2650982 - DNA, 23 bp, Homo sapiens
tcaaaaagtctacgctctccttt

SEQ ID NO: 2650983 - DNA, 12 bp, Homo sapiens
tcaaaaagtgtt

SEQ ID NO: 2650984 - DNA, 14 bp, Homo sapiens
tcaaaaagtgttta

SEQ ID NO: 2650985 - DNA, 19 bp, Homo sapiens
tcaaaaagtgtttattttt

SEQ ID NO: 2650986 - DNA, 13 bp, Homo sapiens
tcaaaaatataac

SEQ ID NO: 2650987 - DNA, 14 bp, Homo sapiens
tcaaaaatataact

SEQ ID NO: 2650988 - DNA, 21 bp, Homo sapiens
tcaaaacacatctttcctgtc

SEQ ID NO: 2650989 - DNA, 15 bp, Homo sapiens
tcaaaactcaaatgc

SEQ ID NO: 2650990 - DNA, 14 bp, Homo sapiens
tcaaaagacaattc

SEQ ID NO: 2650991 - DNA, 18 bp, Homo sapiens
tcaaaagcaaatgagatc

SEQ ID NO: 2650992 - DNA, 16 bp, Homo sapiens
tcaaaagtattttcct

SEQ ID NO: 2650993 - DNA, 18 bp, Homo sapiens
tcaaaagtattttcctgt

SEQ ID NO: 2650994 - DNA, 14 bp, Homo sapiens
tcaaaagttgaaat

SEQ ID NO: 2650995 - DNA, 15 bp, Homo sapiens
tcaaaagttgaaatt

SEQ ID NO: 2650996 - DNA, 16 bp, Homo sapiens
tcaaaagttgaaatta

SEQ ID NO: 2650997 - DNA, 12 bp, Homo sapiens
tcaaaataaaaa

SEQ ID NO: 2650998 - DNA, 20 bp, Homo sapiens
tcaaaataaaaagtgacaca

SEQ ID NO: 2650999 - DNA, 21 bp, Homo sapiens
tcaaaataccatgccatttaa

SEQ ID NO: 2651000 - DNA, 23 bp, Homo sapiens
tcaaaataccatgccatttaaag

SEQ ID NO: 2651001 - DNA, 16 bp, Homo sapiens
tcaaaatatttgtaca

SEQ ID NO: 2651002 - DNA, 17 bp, Homo sapiens
tcaaaatatttgtacat

SEQ ID NO: 2651003 - DNA, 16 bp, Homo sapiens
tcaaaatttgaagaat

SEQ ID NO: 2651004 - DNA, 19 bp, Homo sapiens
tcaaacaaactctctgaac

SEQ ID NO: 2651005 - DNA, 15 bp, Homo sapiens
tcaaacaaagccaga

SEQ ID NO: 2651006 - DNA, 15 bp, Homo sapiens
tcaaacaacactggt

SEQ ID NO: 2651007 - DNA, 16 bp, Homo sapiens
tcaaacagaattttaa

SEQ ID NO: 2651008 - DNA, 15 bp, Homo sapiens
tcaaacagtaggttg

SEQ ID NO: 2651009 - DNA, 15 bp, Homo sapiens
tcaaaccataaactt

SEQ ID NO: 2651010 - DNA, 16 bp, Homo sapiens
tcaaaccataaacttc

SEQ ID NO: 2651011 - DNA, 17 bp, Homo sapiens
tcaaacctgtttaaata

SEQ ID NO: 2651012 - DNA, 15 bp, Homo sapiens
tcaaacgtgaaaatg

SEQ ID NO: 2651013 - DNA, 23 bp, Homo sapiens
tcaaactgaatgaaacccccaca

SEQ ID NO: 2651014 - DNA, 15 bp, Homo sapiens
tcaaactgaggaatt

SEQ ID NO: 2651015 - DNA, 14 bp, Homo sapiens
tcaaactgtagaaa

SEQ ID NO: 2651016 - DNA, 17 bp, Homo sapiens
tcaaactgtagaaatga

SEQ ID NO: 2651017 - DNA, 15 bp, Homo sapiens
tcaaactttactatg

SEQ ID NO: 2651018 - DNA, 16 bp, Homo sapiens
tcaaagaaatgctgat

SEQ ID NO: 2651019 - DNA, 19 bp, Homo sapiens
tcaaagaaatgctgatgga

SEQ ID NO: 2651020 - DNA, 22 bp, Homo sapiens
tcaaagaaggatggcacctaaa

SEQ ID NO: 2651021 - DNA, 17 bp, Homo sapiens
tcaaagacattctgaca

SEQ ID NO: 2651022 - DNA, 23 bp, Homo sapiens
tcaaagaggttttaaaaaaatcc

SEQ ID NO: 2651023 - DNA, 20 bp, Homo sapiens
tcaaagcaaggaaactatgt

SEQ ID NO: 2651024 - DNA, 19 bp, Homo sapiens
tcaaagcaatgcattttgg

SEQ ID NO: 2651025 - DNA, 21 bp, Homo sapiens
tcaaagcaccaaaataagaaa

SEQ ID NO: 2651026 - DNA, 17 bp, Homo sapiens
tcagccagccccatcag

SEQ ID NO: 2651027 - DNA, 19 bp, Homo sapiens
tcagccaggagctgggcag

SEQ ID NO: 2651028 - DNA, 16 bp, Homo sapiens
tcagccattcactgcc

SEQ ID NO: 2651029 - DNA, 13 bp, Homo sapiens
tcagcccaccccc

SEQ ID NO: 2651030 - DNA, 12 bp, Homo sapiens
tcagcccctctt

SEQ ID NO: 2651031 - DNA, 21 bp, Homo sapiens
tcagcccctcttgccccccac

SEQ ID NO: 2651032 - DNA, 13 bp, Homo sapiens
tcagccctgaggt

SEQ ID NO: 2651033 - DNA, 23 bp, Homo sapiens
tcagccctgaggtgaaagggagc

SEQ ID NO: 2651034 - DNA, 16 bp, Homo sapiens
tcagccgggccctgag

SEQ ID NO: 2651035 - DNA, 20 bp, Homo sapiens
tcagcctagccgacctcagc

SEQ ID NO: 2651036 - DNA, 23 bp, Homo sapiens
tcagcctagccgacctcagcctt

SEQ ID NO: 2651037 - DNA, 15 bp, Homo sapiens
tcagcctccagcctc

SEQ ID NO: 2651038 - DNA, 12 bp, Homo sapiens
tcagcctcccaa

SEQ ID NO: 2651039 - DNA, 22 bp, Homo sapiens
tcagcctcccaaagtgctggga

SEQ ID NO: 2651040 - DNA, 21 bp, Homo sapiens
tcagcctcccgaatagctggg

SEQ ID NO: 2651041 - DNA, 19 bp, Homo sapiens
tcagcctcctcatctgggg

SEQ ID NO: 2651042 - DNA, 21 bp, Homo sapiens
tcagcctcctgagtagctgga

SEQ ID NO: 2651043 - DNA, 15 bp, Homo sapiens
tcagcctgagtctcc

SEQ ID NO: 2651044 - DNA, 16 bp, Homo sapiens
tcagcctgctccagct

SEQ ID NO: 2651045 - DNA, 18 bp, Homo sapiens
tcagcctgctccagctgt

SEQ ID NO: 2651046 - DNA, 18 bp, Homo sapiens
tcagcctgtctcttccat

SEQ ID NO: 2651047 - DNA, 12 bp, Homo sapiens
tcagcctgtgct

SEQ ID NO: 2651048 - DNA, 21 bp, Homo sapiens
tcagccttccccctcccaggg

SEQ ID NO: 2651049 - DNA, 23 bp, Homo sapiens
tcagccttccccttgcccagggc

SEQ ID NO: 2651050 - DNA, 14 bp, Homo sapiens
tcagctactgattt

SEQ ID NO: 2651051 - DNA, 16 bp, Homo sapiens
tcagctcccatttcta

SEQ ID NO: 2651052 - DNA, 19 bp, Homo sapiens
tcagctcccatttctactc

SEQ ID NO: 2651053 - DNA, 20 bp, Homo sapiens
tcagctcccatttctactct

SEQ ID NO: 2651054 - DNA, 13 bp, Homo sapiens
tcagctccccaga

SEQ ID NO: 2651055 - DNA, 17 bp, Homo sapiens
tcagctccccagagtcc

SEQ ID NO: 2651056 - DNA, 21 bp, Homo sapiens
tcagctcccctcggagaagag

SEQ ID NO: 2651057 - DNA, 22 bp, Homo sapiens
tcagctcccctcggagaagagc

SEQ ID NO: 2651058 - DNA, 15 bp, Homo sapiens
tcagctccttcctgg

SEQ ID NO: 2651059 - DNA, 16 bp, Homo sapiens
tcagctccttcctgga

SEQ ID NO: 2651060 - DNA, 17 bp, Homo sapiens
tcagctctgggagagga

SEQ ID NO: 2651061 - DNA, 16 bp, Homo sapiens
tcagctgaacctgggt

SEQ ID NO: 2651062 - DNA, 21 bp, Homo sapiens
tcagctggcactgtctctgct

SEQ ID NO: 2651063 - DNA, 12 bp, Homo sapiens
tcagctgtactt

SEQ ID NO: 2651064 - DNA, 15 bp, Homo sapiens
tcagctgtttgtcat

SEQ ID NO: 2651065 - DNA, 18 bp, Homo sapiens
tcagcttcatttgtgtca

SEQ ID NO: 2651066 - DNA, 19 bp, Homo sapiens
tcagcttcctacccacacc

SEQ ID NO: 2651067 - DNA, 23 bp, Homo sapiens
tcagcttcctacccacacctctg

SEQ ID NO: 2651068 - DNA, 21 bp, Homo sapiens
tcagcttcgtttattttcaag

SEQ ID NO: 2651069 - DNA, 22 bp, Homo sapiens
tcagcttgtaaatagctcaggt

SEQ ID NO: 2651070 - DNA, 16 bp, Homo sapiens
tcagcttttgcttcat

SEQ ID NO: 2651071 - DNA, 20 bp, Homo sapiens
tcagctttttgtcttttctg

SEQ ID NO: 2651072 - DNA, 20 bp, Homo sapiens
tcaggaaatatatatgtgtg

SEQ ID NO: 2651073 - DNA, 21 bp, Homo sapiens
tcaggaaatatatatgtgtgt

SEQ ID NO: 2651074 - DNA, 23 bp, Homo sapiens
tcaggaaatcaaatatgcaaagc

SEQ ID NO: 2651075 - DNA, 16 bp, Homo sapiens
tcaggaagctcagggc

SEQ ID NO: 2651076 - DNA, 17 bp, Homo sapiens
tcaggaagctcagggcc

SEQ ID NO: 2651077 - DNA, 20 bp, Homo sapiens
tcaggaagctcagggcctgg

SEQ ID NO: 2651078 - DNA, 17 bp, Homo sapiens
tcaggaaggatgagcat

SEQ ID NO: 2651079 - DNA, 12 bp, Homo sapiens
tcaggacactaa

SEQ ID NO: 2651080 - DNA, 14 bp, Homo sapiens
tcaggaccaggcaa

SEQ ID NO: 2651081 - DNA, 14 bp, Homo sapiens
tcaggactcctctc

SEQ ID NO: 2651082 - DNA, 17 bp, Homo sapiens
tcaggagaggggcagaa

SEQ ID NO: 2651083 - DNA, 18 bp, Homo sapiens
tcaggagaggggcagaac

SEQ ID NO: 2651084 - DNA, 10 bp, Homo sapiens
tcaggagcag

SEQ ID NO: 2651085 - DNA, 17 bp, Homo sapiens
tcaggagttagaggcca

SEQ ID NO: 2651086 - DNA, 19 bp, Homo sapiens
tcaggagttagaggccagc

SEQ ID NO: 2651087 - DNA, 20 bp, Homo sapiens
tcaggatcaaaccccgacca

SEQ ID NO: 2651088 - DNA, 15 bp, Homo sapiens
tcaggatgaacccag

SEQ ID NO: 2651089 - DNA, 20 bp, Homo sapiens
tcaggatgatacactatgaa

SEQ ID NO: 2651090 - DNA, 17 bp, Homo sapiens
tcaggattctgttcctt

SEQ ID NO: 2651091 - DNA, 16 bp, Homo sapiens
tcaggcataggcctgg

SEQ ID NO: 2651092 - DNA, 17 bp, Homo sapiens
tcaggcatgaacatgta

SEQ ID NO: 2651093 - DNA, 18 bp, Homo sapiens
tcaggcatgaacatgtac

SEQ ID NO: 2651094 - DNA, 16 bp, Homo sapiens
tcaggcatgcctgtgt

SEQ ID NO: 2651095 - DNA, 17 bp, Homo sapiens
tcaggccacctgccccc

SEQ ID NO: 2651096 - DNA, 19 bp, Homo sapiens
tcaggccacctgccccctt

SEQ ID NO: 2651097 - DNA, 13 bp, Homo sapiens
tcaggccacttga

SEQ ID NO: 2651098 - DNA, 17 bp, Homo sapiens
tcaggccaggccctctg

SEQ ID NO: 2651099 - DNA, 19 bp, Homo sapiens
tcaggccaggccctctgcc

SEQ ID NO: 2651100 - DNA, 23 bp, Homo sapiens
tcaggccatcatcagtggagcca

SEQ ID NO: 2651101 - DNA, 17 bp, Homo sapiens
tcaggcctccctctctc

SEQ ID NO: 2651102 - DNA, 13 bp, Homo sapiens
tcaggcctgtgtg

SEQ ID NO: 2651103 - DNA, 21 bp, Homo sapiens
tcaggcgatccacctgtctca

SEQ ID NO: 2651104 - DNA, 23 bp, Homo sapiens
tcaggcgtagatcaccagaataa

SEQ ID NO: 2651105 - DNA, 14 bp, Homo sapiens
tcaggctctgccct

SEQ ID NO: 2651106 - DNA, 12 bp, Homo sapiens
tcaggctgctgg

SEQ ID NO: 2651107 - DNA, 14 bp, Homo sapiens
tcaggctgctggcg

SEQ ID NO: 2651108 - DNA, 19 bp, Homo sapiens
tcagggaaaagcagctctc

SEQ ID NO: 2651109 - DNA, 23 bp, Homo sapiens
tcagggaaaagcagctctcccct

SEQ ID NO: 2651110 - DNA, 16 bp, Homo sapiens
tcagggaaaggccagt

SEQ ID NO: 2651111 - DNA, 22 bp, Homo sapiens
tcagggaatttcaggaactaga

SEQ ID NO: 2651112 - DNA, 15 bp, Homo sapiens
tcagggaccaaggac

SEQ ID NO: 2651113 - DNA, 20 bp, Homo sapiens
tcagggaccaaggacccctc

SEQ ID NO: 2651114 - DNA, 16 bp, Homo sapiens
tcagggacccctgccc

SEQ ID NO: 2651115 - DNA, 20 bp, Homo sapiens
tcagggattttttttttaaa

SEQ ID NO: 2651116 - DNA, 17 bp, Homo sapiens
tcagggccatgcctgcc

SEQ ID NO: 2651117 - DNA, 14 bp, Homo sapiens
tcagggcccaagtc

SEQ ID NO: 2651118 - DNA, 15 bp, Homo sapiens
tcagggcccaagtcc

SEQ ID NO: 2651119 - DNA, 19 bp, Homo sapiens
tcagggcccaagtccctgt

SEQ ID NO: 2651120 - DNA, 14 bp, Homo sapiens
tcagggccccagca

SEQ ID NO: 2651121 - DNA, 23 bp, Homo sapiens
tcagggccccagcactaaagcag

SEQ ID NO: 2651122 - DNA, 14 bp, Homo sapiens
tcagggcctggctc

SEQ ID NO: 2651123 - DNA, 13 bp, Homo sapiens
tcagggctcctgc

SEQ ID NO: 2651124 - DNA, 14 bp, Homo sapiens
tcagggctcctgcc

SEQ ID NO: 2651125 - DNA, 15 bp, Homo sapiens
tcagggctcctgcct

SEQ ID NO: 2651126 - DNA, 16 bp, Homo sapiens
tcaggggactcagccc

SEQ ID NO: 2651127 - DNA, 15 bp, Homo sapiens
tcaggggccagagga

SEQ ID NO: 2651128 - DNA, 16 bp, Homo sapiens
tcaggggccagaggaa

SEQ ID NO: 2651129 - DNA, 14 bp, Homo sapiens
tcaggggctgtttg

SEQ ID NO: 2651130 - DNA, 20 bp, Homo sapiens
tcaggggggttgtgaggcct

SEQ ID NO: 2651131 - DNA, 19 bp, Homo sapiens
tcaggggtgtgcggccttt

SEQ ID NO: 2651132 - DNA, 18 bp, Homo sapiens
tcaggggttcgagaccag

SEQ ID NO: 2651133 - DNA, 22 bp, Homo sapiens
tcaggggttcgagaccagtctg

SEQ ID NO: 2651134 - DNA, 13 bp, Homo sapiens
tcagggtccctgg

SEQ ID NO: 2651135 - DNA, 12 bp, Homo sapiens
tcagggtctctg

SEQ ID NO: 2651136 - DNA, 16 bp, Homo sapiens
tcagggttggcccctg

SEQ ID NO: 2651137 - DNA, 17 bp, Homo sapiens
tcagggttggcccctgc

SEQ ID NO: 2651138 - DNA, 19 bp, Homo sapiens
tcagggttggcccctgccc

SEQ ID NO: 2651139 - DNA, 15 bp, Homo sapiens
tcaggtaacaggcag

SEQ ID NO: 2651140 - DNA, 15 bp, Homo sapiens
tcaggtattaagaaa

SEQ ID NO: 2651141 - DNA, 15 bp, Homo sapiens
tcaggtcagggtgag

SEQ ID NO: 2651142 - DNA, 12 bp, Homo sapiens
tcaggtccctgc

SEQ ID NO: 2651143 - DNA, 19 bp, Homo sapiens
tcaggtctcccacgtggga

SEQ ID NO: 2651144 - DNA, 16 bp, Homo sapiens
tcaggtgacatgtgaa

SEQ ID NO: 2651145 - DNA, 17 bp, Homo sapiens
tcaggtgacatgtgaaa

SEQ ID NO: 2651146 - DNA, 21 bp, Homo sapiens
tcaggtgacatgtgaaacctt

SEQ ID NO: 2651147 - DNA, 22 bp, Homo sapiens
tcaggtgaccaaaatccccttc

SEQ ID NO: 2651148 - DNA, 16 bp, Homo sapiens
tcaggtgatccaccca

SEQ ID NO: 2651149 - DNA, 23 bp, Homo sapiens
tcaggtgatccacccacctcagc

SEQ ID NO: 2651150 - DNA, 15 bp, Homo sapiens
tcaggtgctgccatc

SEQ ID NO: 2651151 - DNA, 19 bp, Homo sapiens
tcaggtggggcagcttgag

SEQ ID NO: 2651152 - DNA, 22 bp, Homo sapiens
tcaggtggggtcactctggcag

SEQ ID NO: 2651153 - DNA, 18 bp, Homo sapiens
tcaggtgtccctgcactt

SEQ ID NO: 2651154 - DNA, 16 bp, Homo sapiens
tcaggttctccttgat

SEQ ID NO: 2651155 - DNA, 13 bp, Homo sapiens
tcaggtttggggt

SEQ ID NO: 2651156 - DNA, 14 bp, Homo sapiens
tcaggttttgtaaa

SEQ ID NO: 2651157 - DNA, 17 bp, Homo sapiens
tcagtaagaaaaagaag

SEQ ID NO: 2651158 - DNA, 14 bp, Homo sapiens
tcagtaatttgagg

SEQ ID NO: 2651159 - DNA, 17 bp, Homo sapiens
tcagtaccctctcagct

SEQ ID NO: 2651160 - DNA, 15 bp, Homo sapiens
tcagtacctggagga

SEQ ID NO: 2651161 - DNA, 16 bp, Homo sapiens
tcagtataattctgta

SEQ ID NO: 2651162 - DNA, 20 bp, Homo sapiens
tcagtataattctgtactga

SEQ ID NO: 2651163 - DNA, 18 bp, Homo sapiens
tcagtatctgtatctctc

SEQ ID NO: 2651164 - DNA, 16 bp, Homo sapiens
tcagtatgtggaagtg

SEQ ID NO: 2651165 - DNA, 23 bp, Homo sapiens
tcagtattgaagcattttataaa

SEQ ID NO: 2651166 - DNA, 18 bp, Homo sapiens
tcagtattttccctgcta

SEQ ID NO: 2651167 - DNA, 20 bp, Homo sapiens
tcagtcccctcccatctggg

SEQ ID NO: 2651168 - DNA, 23 bp, Homo sapiens
tcagtcccctcccatctgggagt

SEQ ID NO: 2651169 - DNA, 19 bp, Homo sapiens
tcagtctcccttctcccat

SEQ ID NO: 2651170 - DNA, 23 bp, Homo sapiens
tcagtctcccttctcccatgagg

SEQ ID NO: 2651171 - DNA, 22 bp, Homo sapiens
tctctagaattttaagtgcttt

SEQ ID NO: 2651172 - DNA, 12 bp, Homo sapiens
tctctagccact

SEQ ID NO: 2651173 - DNA, 24 bp, Homo sapiens
tctctagctggtggtttcacggtg

SEQ ID NO: 2651174 - DNA, 19 bp, Homo sapiens
tctctagtgctgtgaaaaa

SEQ ID NO: 2651175 - DNA, 22 bp, Homo sapiens
tctctatagcaccagggctcac

SEQ ID NO: 2651176 - DNA, 14 bp, Homo sapiens
tctctatttaatat

SEQ ID NO: 2651177 - DNA, 17 bp, Homo sapiens
tctctatttaatattta

SEQ ID NO: 2651178 - DNA, 16 bp, Homo sapiens
tctctcaatatgctta

SEQ ID NO: 2651179 - DNA, 16 bp, Homo sapiens
tctctcagaagggagg

SEQ ID NO: 2651180 - DNA, 17 bp, Homo sapiens
tctctcagaagggaggc

SEQ ID NO: 2651181 - DNA, 14 bp, Homo sapiens
tctctcaggagcac

SEQ ID NO: 2651182 - DNA, 17 bp, Homo sapiens
tctctcaggagcacagg

SEQ ID NO: 2651183 - DNA, 13 bp, Homo sapiens
tctctccagcccc

SEQ ID NO: 2651184 - DNA, 15 bp, Homo sapiens
tctctccagcccctg

SEQ ID NO: 2651185 - DNA, 16 bp, Homo sapiens
tctctccagcccctgg

SEQ ID NO: 2651186 - DNA, 17 bp, Homo sapiens
tctctccagcccctgga

SEQ ID NO: 2651187 - DNA, 13 bp, Homo sapiens
tctctcccatgga

SEQ ID NO: 2651188 - DNA, 17 bp, Homo sapiens
tctctcccatggagccc

SEQ ID NO: 2651189 - DNA, 20 bp, Homo sapiens
tctctcccctcaaagtctgc

SEQ ID NO: 2651190 - DNA, 21 bp, Homo sapiens
tctctcccctcaaagtctgca

SEQ ID NO: 2651191 - DNA, 21 bp, Homo sapiens
tctctccctcccctgccattt

SEQ ID NO: 2651192 - DNA, 15 bp, Homo sapiens
tctctcggctcccca

SEQ ID NO: 2651193 - DNA, 20 bp, Homo sapiens
tctctcggctccccatgtgt

SEQ ID NO: 2651194 - DNA, 17 bp, Homo sapiens
tctctctcaatttttgg

SEQ ID NO: 2651195 - DNA, 22 bp, Homo sapiens
tctctctcctgtactttttcca

SEQ ID NO: 2651196 - DNA, 13 bp, Homo sapiens
tctctctggccct

SEQ ID NO: 2651197 - DNA, 21 bp, Homo sapiens
tctctctggccctctacccct

SEQ ID NO: 2651198 - DNA, 14 bp, Homo sapiens
tctctcttctgctc

SEQ ID NO: 2651199 - DNA, 22 bp, Homo sapiens
tctctgaagagtgggtttcaca

SEQ ID NO: 2651200 - DNA, 13 bp, Homo sapiens
tctctgaagcatg

SEQ ID NO: 2651201 - DNA, 14 bp, Homo sapiens
tctctgaagcatgt

SEQ ID NO: 2651202 - DNA, 21 bp, Homo sapiens
tctctgaagcatgtttcatgt

SEQ ID NO: 2651203 - DNA, 22 bp, Homo sapiens
tctctgaagcatgtttcatgtt

SEQ ID NO: 2651204 - DNA, 16 bp, Homo sapiens
tctctgaagtgaaact

SEQ ID NO: 2651205 - DNA, 12 bp, Homo sapiens
tctctgacctac

SEQ ID NO: 2651206 - DNA, 19 bp, Homo sapiens
tctctgattttcaaagctt

SEQ ID NO: 2651207 - DNA, 17 bp, Homo sapiens
tctctgccctccaagac

SEQ ID NO: 2651208 - DNA, 15 bp, Homo sapiens
tctctgccggctctt

SEQ ID NO: 2651209 - DNA, 21 bp, Homo sapiens
tctctgcctccctcaccctga

SEQ ID NO: 2651210 - DNA, 14 bp, Homo sapiens
tctctgctccacca

SEQ ID NO: 2651211 - DNA, 18 bp, Homo sapiens
tctctgctctgcgtgtca

SEQ ID NO: 2651212 - DNA, 18 bp, Homo sapiens
tctctggagccaagtcca

SEQ ID NO: 2651213 - DNA, 19 bp, Homo sapiens
tctctggcctcccacccga

SEQ ID NO: 2651214 - DNA, 21 bp, Homo sapiens
tctctgggcttggggcttcct

SEQ ID NO: 2651215 - DNA, 17 bp, Homo sapiens
tctctggtgagcgagga

SEQ ID NO: 2651216 - DNA, 19 bp, Homo sapiens
tctctgtagggaactctgg

SEQ ID NO: 2651217 - DNA, 12 bp, Homo sapiens
tctctgtctcat

SEQ ID NO: 2651218 - DNA, 16 bp, Homo sapiens
tctctgtctcatgtgt

SEQ ID NO: 2651219 - DNA, 16 bp, Homo sapiens
tctctgtgaacgattt

SEQ ID NO: 2651220 - DNA, 22 bp, Homo sapiens
tctctgtgaacgatttagaaag

SEQ ID NO: 2651221 - DNA, 15 bp, Homo sapiens
tctctgtgctgtgga

SEQ ID NO: 2651222 - DNA, 19 bp, Homo sapiens
tctctgtgcttcaattaat

SEQ ID NO: 2651223 - DNA, 10 bp, Homo sapiens
tctctgtgtt

SEQ ID NO: 2651224 - DNA, 21 bp, Homo sapiens
tctctgttccattgaatctgt

SEQ ID NO: 2651225 - DNA, 15 bp, Homo sapiens
tctcttatagaatat

SEQ ID NO: 2651226 - DNA, 13 bp, Homo sapiens
tctcttcaggttc

SEQ ID NO: 2651227 - DNA, 16 bp, Homo sapiens
tctcttcaggttctta

SEQ ID NO: 2651228 - DNA, 11 bp, Homo sapiens
tctcttcctac

SEQ ID NO: 2651229 - DNA, 20 bp, Homo sapiens
tctcttccttttatcagtag

SEQ ID NO: 2651230 - DNA, 14 bp, Homo sapiens
tctcttctgctcca

SEQ ID NO: 2651231 - DNA, 16 bp, Homo sapiens
tctcttctgctccacc

SEQ ID NO: 2651232 - DNA, 15 bp, Homo sapiens
tctcttgagcctggg

SEQ ID NO: 2651233 - DNA, 17 bp, Homo sapiens
tctcttgagcctgggag

SEQ ID NO: 2651234 - DNA, 22 bp, Homo sapiens
tctcttgagggagcttagccaa

SEQ ID NO: 2651235 - DNA, 13 bp, Homo sapiens
tctcttgcacccg

SEQ ID NO: 2651236 - DNA, 16 bp, Homo sapiens
tctcttggtcctgctg

SEQ ID NO: 2651237 - DNA, 17 bp, Homo sapiens
tctcttggtcctgctgc

SEQ ID NO: 2651238 - DNA, 16 bp, Homo sapiens
tctcttggtttccttc

SEQ ID NO: 2651239 - DNA, 17 bp, Homo sapiens
tctcttggtttccttcc

SEQ ID NO: 2651240 - DNA, 16 bp, Homo sapiens
tctcttttcaaaacat

SEQ ID NO: 2651241 - DNA, 13 bp, Homo sapiens
tctcttttcttta

SEQ ID NO: 2651242 - DNA, 17 bp, Homo sapiens
tctcttttgaaacaata

SEQ ID NO: 2651243 - DNA, 13 bp, Homo sapiens
tctctttttcagt

SEQ ID NO: 2651244 - DNA, 18 bp, Homo sapiens
tctctttttgctttcgaa

SEQ ID NO: 2651245 - DNA, 17 bp, Homo sapiens
tctgaaaacggccctct

SEQ ID NO: 2651246 - DNA, 14 bp, Homo sapiens
tctgaaaatgtatg

SEQ ID NO: 2651247 - DNA, 18 bp, Homo sapiens
tctgaaaattaacactgc

SEQ ID NO: 2651248 - DNA, 20 bp, Homo sapiens
tctgaaaccagtgttaggga

SEQ ID NO: 2651249 - DNA, 13 bp, Homo sapiens
tctgaaatgaaga

SEQ ID NO: 2651250 - DNA, 14 bp, Homo sapiens
tctgaaatgtgata

SEQ ID NO: 2651251 - DNA, 14 bp, Homo sapiens
tctgaactcaaact

SEQ ID NO: 2651252 - DNA, 22 bp, Homo sapiens
tctgaagagtgggtttcacaag

SEQ ID NO: 2651253 - DNA, 13 bp, Homo sapiens
tctgaagcatgtt

SEQ ID NO: 2651254 - DNA, 20 bp, Homo sapiens
tctgaagcatgtttcatgtt

SEQ ID NO: 2651255 - DNA, 21 bp, Homo sapiens
tctgaagcatgtttcatgttt

SEQ ID NO: 2651256 - DNA, 13 bp, Homo sapiens
tctgaagcctcac

SEQ ID NO: 2651257 - DNA, 16 bp, Homo sapiens
tctgaagcctctggga

SEQ ID NO: 2651258 - DNA, 20 bp, Homo sapiens
tctgaagctgacgaacttcc

SEQ ID NO: 2651259 - DNA, 21 bp, Homo sapiens
tctgaaggagccccattcctg

SEQ ID NO: 2651260 - DNA, 18 bp, Homo sapiens
tctgaaggctgggttctg

SEQ ID NO: 2651261 - DNA, 14 bp, Homo sapiens
tctgaagggaggtg

SEQ ID NO: 2651262 - DNA, 22 bp, Homo sapiens
tctgaagtcacatcacaggaca

SEQ ID NO: 2651263 - DNA, 22 bp, Homo sapiens
tctgaagtgaaactgcttgttt

SEQ ID NO: 2651264 - DNA, 13 bp, Homo sapiens
tctgaatggtcca

SEQ ID NO: 2651265 - DNA, 13 bp, Homo sapiens
tctgaatgttctg

SEQ ID NO: 2651266 - DNA, 19 bp, Homo sapiens
tctgaatgttctgacatta

SEQ ID NO: 2651267 - DNA, 18 bp, Homo sapiens
tctgaattagtccttgct

SEQ ID NO: 2651268 - DNA, 19 bp, Homo sapiens
tctgaattagtccttgctt

SEQ ID NO: 2651269 - DNA, 12 bp, Homo sapiens
tctgacacacag

SEQ ID NO: 2651270 - DNA, 14 bp, Homo sapiens
tctgacacacagct

SEQ ID NO: 2651271 - DNA, 15 bp, Homo sapiens
tctgacatctctgca

SEQ ID NO: 2651272 - DNA, 16 bp, Homo sapiens
tctgacatctctgcaa

SEQ ID NO: 2651273 - DNA, 15 bp, Homo sapiens
tctgacattaacagt

SEQ ID NO: 2651274 - DNA, 18 bp, Homo sapiens
tctgacattaacagtttt

SEQ ID NO: 2651275 - DNA, 19 bp, Homo sapiens
tctgacattaacagttttc

SEQ ID NO: 2651276 - DNA, 18 bp, Homo sapiens
tctgaccacacttcctgt

SEQ ID NO: 2651277 - DNA, 22 bp, Homo sapiens
tctgaccacacttcctgtccag

SEQ ID NO: 2651278 - DNA, 13 bp, Homo sapiens
tctgaccacgtgc

SEQ ID NO: 2651279 - DNA, 14 bp, Homo sapiens
tctgacccactgct

SEQ ID NO: 2651280 - DNA, 14 bp, Homo sapiens
tctgacccagtgag

SEQ ID NO: 2651281 - DNA, 17 bp, Homo sapiens
tctgacccatgctgccc

SEQ ID NO: 2651282 - DNA, 23 bp, Homo sapiens
tctgacccatgctgccctgtgag

SEQ ID NO: 2651283 - DNA, 14 bp, Homo sapiens
tctgacctccatga

SEQ ID NO: 2651284 - DNA, 18 bp, Homo sapiens
tctgacctgcactgggga

SEQ ID NO: 2651285 - DNA, 16 bp, Homo sapiens
tctgacctgcaggcca

SEQ ID NO: 2651286 - DNA, 17 bp, Homo sapiens
tctgacctgcaggccaa

SEQ ID NO: 2651287 - DNA, 21 bp, Homo sapiens
tctgacctgcaggccaagagc

SEQ ID NO: 2651288 - DNA, 14 bp, Homo sapiens
tctgactcagggct

SEQ ID NO: 2651289 - DNA, 20 bp, Homo sapiens
tctgactcagggctcctggg

SEQ ID NO: 2651290 - DNA, 19 bp, Homo sapiens
tctgagaaagactattcaa

SEQ ID NO: 2651291 - DNA, 20 bp, Homo sapiens
tctgagaaagactattcaaa

SEQ ID NO: 2651292 - DNA, 17 bp, Homo sapiens
tctgagcaagagctggc

SEQ ID NO: 2651293 - DNA, 19 bp, Homo sapiens
tctgagcccgggctgcctg

SEQ ID NO: 2651294 - DNA, 20 bp, Homo sapiens
tctgagctatttcatctatt

SEQ ID NO: 2651295 - DNA, 22 bp, Homo sapiens
tctgagctatttcatctatttt

SEQ ID NO: 2651296 - DNA, 17 bp, Homo sapiens
tctgagctgctctgaat

SEQ ID NO: 2651297 - DNA, 16 bp, Homo sapiens
tctgaggaatccagac

SEQ ID NO: 2651298 - DNA, 20 bp, Homo sapiens
tctgaggacactaaccacgc

SEQ ID NO: 2651299 - DNA, 11 bp, Homo sapiens
tctgaggctgt

SEQ ID NO: 2651300 - DNA, 19 bp, Homo sapiens
tctgaggcttccagagagt

SEQ ID NO: 2651301 - DNA, 13 bp, Homo sapiens
tctgagggaggag

SEQ ID NO: 2651302 - DNA, 21 bp, Homo sapiens
tctgagggaggaggccacctc

SEQ ID NO: 2651303 - DNA, 19 bp, Homo sapiens
tctgaggggcaactgagtc

SEQ ID NO: 2651304 - DNA, 23 bp, Homo sapiens
tctgagtatctcctcgcaagctg

SEQ ID NO: 2651305 - DNA, 22 bp, Homo sapiens
tctgagtttcattctcctgcct

SEQ ID NO: 2651306 - DNA, 15 bp, Homo sapiens
tctgataggccaagt

SEQ ID NO: 2651307 - DNA, 17 bp, Homo sapiens
tctgatattccatgaat

SEQ ID NO: 2651308 - DNA, 22 bp, Homo sapiens
tctgatattccatgaatgtatc

SEQ ID NO: 2651309 - DNA, 17 bp, Homo sapiens
tctgatcatccactgtg

SEQ ID NO: 2651310 - DNA, 22 bp, Homo sapiens
tctgatctgtgctttccagctc

SEQ ID NO: 2651311 - DNA, 23 bp, Homo sapiens
tctgatctgtgctttccagctca

SEQ ID NO: 2651312 - DNA, 13 bp, Homo sapiens
tctgatggcttct

SEQ ID NO: 2651313 - DNA, 18 bp, Homo sapiens
tctgattacacaaaacaa

SEQ ID NO: 2651314 - DNA, 13 bp, Homo sapiens
tctgattccactt

SEQ ID NO: 2651315 - DNA, 20 bp, Homo sapiens
tctgcaagaattgaagcagg

SEQ ID NO: 2651316 - DNA, 16 bp, Homo sapiens
tgaattttgttgctgt

SEQ ID NO: 2651317 - DNA, 18 bp, Homo sapiens
tgaattttgtttggactt

SEQ ID NO: 2651318 - DNA, 22 bp, Homo sapiens
tgaatttttaaaacccatttaa

SEQ ID NO: 2651319 - DNA, 15 bp, Homo sapiens
tgaatttttctctaa

SEQ ID NO: 2651320 - DNA, 22 bp, Homo sapiens
tgaatttttctctaactcagaa

SEQ ID NO: 2651321 - DNA, 14 bp, Homo sapiens
tgacaaaaattcaa

SEQ ID NO: 2651322 - DNA, 17 bp, Homo sapiens
tgacaaacctctaaccc

SEQ ID NO: 2651323 - DNA, 19 bp, Homo sapiens
tgacaaagactgagtacgt

SEQ ID NO: 2651324 - DNA, 21 bp, Homo sapiens
tgacaaagagtagacatttct

SEQ ID NO: 2651325 - DNA, 16 bp, Homo sapiens
tgacaaagcttggaag

SEQ ID NO: 2651326 - DNA, 14 bp, Homo sapiens
tgacaaagttactg

SEQ ID NO: 2651327 - DNA, 13 bp, Homo sapiens
tgacaacagaagc

SEQ ID NO: 2651328 - DNA, 16 bp, Homo sapiens
tgacaaccaccgctcc

SEQ ID NO: 2651329 - DNA, 19 bp, Homo sapiens
tgacaactttgccagcttt

SEQ ID NO: 2651330 - DNA, 15 bp, Homo sapiens
tgacaagccccaggc

SEQ ID NO: 2651331 - DNA, 18 bp, Homo sapiens
tgacaaggattgctactg

SEQ ID NO: 2651332 - DNA, 23 bp, Homo sapiens
tgacaaggattgctactgtccta

SEQ ID NO: 2651333 - DNA, 14 bp, Homo sapiens
tgacaaggccccag

SEQ ID NO: 2651334 - DNA, 14 bp, Homo sapiens
tgacaagtcatttt

SEQ ID NO: 2651335 - DNA, 15 bp, Homo sapiens
tgacaatcaactcta

SEQ ID NO: 2651336 - DNA, 22 bp, Homo sapiens
tgacaattttgtacaaatttgt

SEQ ID NO: 2651337 - DNA, 14 bp, Homo sapiens
tgacacacagctct

SEQ ID NO: 2651338 - DNA, 19 bp, Homo sapiens
tgacacacagctctgtcct

SEQ ID NO: 2651339 - DNA, 21 bp, Homo sapiens
tgacacatatgcaccttgtgt

SEQ ID NO: 2651340 - DNA, 13 bp, Homo sapiens
tgacaccagcctt

SEQ ID NO: 2651341 - DNA, 16 bp, Homo sapiens
tgacaccagcctttct

SEQ ID NO: 2651342 - DNA, 18 bp, Homo sapiens
tgacactagcccaatgaa

SEQ ID NO: 2651343 - DNA, 22 bp, Homo sapiens
tgacactagcccaatgaaatga

SEQ ID NO: 2651344 - DNA, 14 bp, Homo sapiens
tgacactcccttgg

SEQ ID NO: 2651345 - DNA, 20 bp, Homo sapiens
tgacacttcagagagctggt

SEQ ID NO: 2651346 - DNA, 23 bp, Homo sapiens
tgacacttcagagagctggtagt

SEQ ID NO: 2651347 - DNA, 14 bp, Homo sapiens
tgacacttccagtc

SEQ ID NO: 2651348 - DNA, 15 bp, Homo sapiens
tgacacttgtcccca

SEQ ID NO: 2651349 - DNA, 22 bp, Homo sapiens
tgacactttaattaccaacctg

SEQ ID NO: 2651350 - DNA, 13 bp, Homo sapiens
tgacagaaagcag

SEQ ID NO: 2651351 - DNA, 15 bp, Homo sapiens
tgacagaacactgtc

SEQ ID NO: 2651352 - DNA, 13 bp, Homo sapiens
tgacagacacagg

SEQ ID NO: 2651353 - DNA, 18 bp, Homo sapiens
tgacagacacaggcccgg

SEQ ID NO: 2651354 - DNA, 20 bp, Homo sapiens
tgacagacacaggcccggct

SEQ ID NO: 2651355 - DNA, 14 bp, Homo sapiens
tgacagactcctga

SEQ ID NO: 2651356 - DNA, 15 bp, Homo sapiens
tgacagactcctgag

SEQ ID NO: 2651357 - DNA, 22 bp, Homo sapiens
tgacagagcaagtgagaccctg

SEQ ID NO: 2651358 - DNA, 12 bp, Homo sapiens
tgacagagccag

SEQ ID NO: 2651359 - DNA, 23 bp, Homo sapiens
tgacagagccttctgaggacatt

SEQ ID NO: 2651360 - DNA, 13 bp, Homo sapiens
tgacagaggcagc

SEQ ID NO: 2651361 - DNA, 14 bp, Homo sapiens
tgacagaggcagcc

SEQ ID NO: 2651362 - DNA, 17 bp, Homo sapiens
tgacagaggcagcccca

SEQ ID NO: 2651363 - DNA, 14 bp, Homo sapiens
tgacagagtgagac

SEQ ID NO: 2651364 - DNA, 15 bp, Homo sapiens
tgacagagttcacta

SEQ ID NO: 2651365 - DNA, 18 bp, Homo sapiens
tgacagatcaagctgtga

SEQ ID NO: 2651366 - DNA, 22 bp, Homo sapiens
tgacagatgtcagccgagccgg

SEQ ID NO: 2651367 - DNA, 19 bp, Homo sapiens
tgacagatgttgaatgccc

SEQ ID NO: 2651368 - DNA, 14 bp, Homo sapiens
tgacagcaggtggg

SEQ ID NO: 2651369 - DNA, 19 bp, Homo sapiens
tgacagcctcccaccccca

SEQ ID NO: 2651370 - DNA, 20 bp, Homo sapiens
tgacaggcaatgctggctgt

SEQ ID NO: 2651371 - DNA, 19 bp, Homo sapiens
tgacaggcagcagagactt

SEQ ID NO: 2651372 - DNA, 13 bp, Homo sapiens
tgacagggaagct

SEQ ID NO: 2651373 - DNA, 16 bp, Homo sapiens
tgacagggaagctaca

SEQ ID NO: 2651374 - DNA, 20 bp, Homo sapiens
tgacagggaagctacaggtt

SEQ ID NO: 2651375 - DNA, 23 bp, Homo sapiens
tgacagggaagctacaggttaca

SEQ ID NO: 2651376 - DNA, 11 bp, Homo sapiens
tgacagggcac

SEQ ID NO: 2651377 - DNA, 17 bp, Homo sapiens
tgacaggtaaattaaga

SEQ ID NO: 2651378 - DNA, 23 bp, Homo sapiens
tgacagtcttgtgcttttcctat

SEQ ID NO: 2651379 - DNA, 19 bp, Homo sapiens
tgacagtgttgaaaatgtt

SEQ ID NO: 2651380 - DNA, 17 bp, Homo sapiens
tgacagttctgaagaat

SEQ ID NO: 2651381 - DNA, 15 bp, Homo sapiens
tgacatatttttgct

SEQ ID NO: 2651382 - DNA, 20 bp, Homo sapiens
tgacatcacttgtacaaaat

SEQ ID NO: 2651383 - DNA, 17 bp, Homo sapiens
tgacatcagtggcatgg

SEQ ID NO: 2651384 - DNA, 19 bp, Homo sapiens
tgacatctcaggggccaga

SEQ ID NO: 2651385 - DNA, 13 bp, Homo sapiens
tgacatctctgca

SEQ ID NO: 2651386 - DNA, 13 bp, Homo sapiens
tgacatctctttg

SEQ ID NO: 2651387 - DNA, 18 bp, Homo sapiens
tgacatgcactcagctct

SEQ ID NO: 2651388 - DNA, 17 bp, Homo sapiens
tgacatgtgaaaccttt

SEQ ID NO: 2651389 - DNA, 21 bp, Homo sapiens
tgacatgtgaaacctttttta

SEQ ID NO: 2651390 - DNA, 17 bp, Homo sapiens
tgacatgtggaaagtga

SEQ ID NO: 2651391 - DNA, 21 bp, Homo sapiens
tgacatgtggaaagtgaattt

SEQ ID NO: 2651392 - DNA, 19 bp, Homo sapiens
tgacatgttatatattttt

SEQ ID NO: 2651393 - DNA, 17 bp, Homo sapiens
tgacattaacagttttc

SEQ ID NO: 2651394 - DNA, 15 bp, Homo sapiens
tgacattgctttact

SEQ ID NO: 2651395 - DNA, 20 bp, Homo sapiens
tgacattgttggccaaagcc

SEQ ID NO: 2651396 - DNA, 21 bp, Homo sapiens
tgacatttatttttcatttag

SEQ ID NO: 2651397 - DNA, 21 bp, Homo sapiens
tgacatttggagtgttcccct

SEQ ID NO: 2651398 - DNA, 16 bp, Homo sapiens
tgaccaaaatcccctt

SEQ ID NO: 2651399 - DNA, 16 bp, Homo sapiens
tgaccaactagacatt

SEQ ID NO: 2651400 - DNA, 16 bp, Homo sapiens
tgaccaagcaggaagc

SEQ ID NO: 2651401 - DNA, 16 bp, Homo sapiens
tgaccaagttataaat

SEQ ID NO: 2651402 - DNA, 17 bp, Homo sapiens
tgaccaatattgtacag

SEQ ID NO: 2651403 - DNA, 18 bp, Homo sapiens
tgaccaatattgtacagt

SEQ ID NO: 2651404 - DNA, 18 bp, Homo sapiens
tgaccaatgatggtcacc

SEQ ID NO: 2651405 - DNA, 13 bp, Homo sapiens
tgaccaccctccc

SEQ ID NO: 2651406 - DNA, 15 bp, Homo sapiens
tgaccaccctcccct

SEQ ID NO: 2651407 - DNA, 16 bp, Homo sapiens
tgaccaccctcccctc

SEQ ID NO: 2651408 - DNA, 20 bp, Homo sapiens
tgaccactgcagaagacagt

SEQ ID NO: 2651409 - DNA, 20 bp, Homo sapiens
tgaccagcagatcccagctc

SEQ ID NO: 2651410 - DNA, 22 bp, Homo sapiens
tgaccagcctccatgctgcctc

SEQ ID NO: 2651411 - DNA, 16 bp, Homo sapiens
tgaccaggcatcctcc

SEQ ID NO: 2651412 - DNA, 21 bp, Homo sapiens
tgaccagtttaacctgatgca

SEQ ID NO: 2651413 - DNA, 22 bp, Homo sapiens
tgaccatccactctaccctccc

SEQ ID NO: 2651414 - DNA, 16 bp, Homo sapiens
tgaccattctccacct

SEQ ID NO: 2651415 - DNA, 18 bp, Homo sapiens
tgaccattctccacctgc

SEQ ID NO: 2651416 - DNA, 19 bp, Homo sapiens
tgaccattctccacctgcc

SEQ ID NO: 2651417 - DNA, 21 bp, Homo sapiens
tgaccattctccacctgccag

SEQ ID NO: 2651418 - DNA, 22 bp, Homo sapiens
tgaccattctccacctgccagg

SEQ ID NO: 2651419 - DNA, 17 bp, Homo sapiens
tgacccacaagaaatga

SEQ ID NO: 2651420 - DNA, 16 bp, Homo sapiens
tgacccacccctgtgc

SEQ ID NO: 2651421 - DNA, 17 bp, Homo sapiens
tgacccacccctgtgct

SEQ ID NO: 2651422 - DNA, 13 bp, Homo sapiens
tgacccaggccgc

SEQ ID NO: 2651423 - DNA, 15 bp, Homo sapiens
tgacccaggccgcag

SEQ ID NO: 2651424 - DNA, 22 bp, Homo sapiens
tgacccaggccgcagctcttgc

SEQ ID NO: 2651425 - DNA, 14 bp, Homo sapiens
tgacccaggctggg

SEQ ID NO: 2651426 - DNA, 17 bp, Homo sapiens
tgacccaggctgggcaa

SEQ ID NO: 2651427 - DNA, 13 bp, Homo sapiens
tgacccagtgaga

SEQ ID NO: 2651428 - DNA, 16 bp, Homo sapiens
tgacccatgctgccct

SEQ ID NO: 2651429 - DNA, 22 bp, Homo sapiens
tgaccccaaacaccttccagct

SEQ ID NO: 2651430 - DNA, 22 bp, Homo sapiens
tgacccccaaccaagtggctcc

SEQ ID NO: 2651431 - DNA, 13 bp, Homo sapiens
tgacccctgctca

SEQ ID NO: 2651432 - DNA, 14 bp, Homo sapiens
tgacccggaggcca

SEQ ID NO: 2651433 - DNA, 20 bp, Homo sapiens
tgacccggaggccacatgag

SEQ ID NO: 2651434 - DNA, 21 bp, Homo sapiens
tgacccggaggccacatgagt

SEQ ID NO: 2651435 - DNA, 13 bp, Homo sapiens
tgaccctcctgtt

SEQ ID NO: 2651436 - DNA, 16 bp, Homo sapiens
tgaccctcctgttgca

SEQ ID NO: 2651437 - DNA, 23 bp, Homo sapiens
tgaccctctgaatggtccagggt

SEQ ID NO: 2651438 - DNA, 15 bp, Homo sapiens
tgaccctgaagtgag

SEQ ID NO: 2651439 - DNA, 20 bp, Homo sapiens
tgaccgtgggcggggccttg

SEQ ID NO: 2651440 - DNA, 18 bp, Homo sapiens
tgacctactcgagggact

SEQ ID NO: 2651441 - DNA, 13 bp, Homo sapiens
tgacctactctca

SEQ ID NO: 2651442 - DNA, 17 bp, Homo sapiens
tgacctcaacctgtgat

SEQ ID NO: 2651443 - DNA, 18 bp, Homo sapiens
tgacctcaacctgtgatg

SEQ ID NO: 2651444 - DNA, 20 bp, Homo sapiens
tgacctcaggtgatccaccc

SEQ ID NO: 2651445 - DNA, 21 bp, Homo sapiens
tgacctcaggtgatccaccca

SEQ ID NO: 2651446 - DNA, 22 bp, Homo sapiens
tgacctcaggtgatccacccac

SEQ ID NO: 2651447 - DNA, 22 bp, Homo sapiens
tgacctcatgcatctccacctg

SEQ ID NO: 2651448 - DNA, 14 bp, Homo sapiens
tgacctcccagccc

SEQ ID NO: 2651449 - DNA, 15 bp, Homo sapiens
tgacctcccagccct

SEQ ID NO: 2651450 - DNA, 16 bp, Homo sapiens
tgacctcccagcccta

SEQ ID NO: 2651451 - DNA, 22 bp, Homo sapiens
tgacctcccagccctatggatg

SEQ ID NO: 2651452 - DNA, 14 bp, Homo sapiens
tgacctccctctaa

SEQ ID NO: 2651453 - DNA, 21 bp, Homo sapiens
tgacctctgcagcaataaagc

SEQ ID NO: 2651454 - DNA, 17 bp, Homo sapiens
tgacctctgttgtcctc

SEQ ID NO: 2651455 - DNA, 13 bp, Homo sapiens
tgacctgaagttc

SEQ ID NO: 2651456 - DNA, 14 bp, Homo sapiens
tgacctgaagttca

SEQ ID NO: 2651457 - DNA, 15 bp, Homo sapiens
tgacctgaggaagcg

SEQ ID NO: 2651458 - DNA, 17 bp, Homo sapiens
tgacctgaggcccttct

SEQ ID NO: 2651459 - DNA, 20 bp, Homo sapiens
tgacctgtcatgcccccctc

SEQ ID NO: 2651460 - DNA, 18 bp, Homo sapiens
tgattccctcctgctact

SEQ ID NO: 2651461 - DNA, 22 bp, Homo sapiens
tgattcgcccaaagccagacag

SEQ ID NO: 2651462 - DNA, 19 bp, Homo sapiens
tgattctaatgtcttcatt

SEQ ID NO: 2651463 - DNA, 12 bp, Homo sapiens
tgattctcaggg

SEQ ID NO: 2651464 - DNA, 21 bp, Homo sapiens
tgattctcagggtctctgctg

SEQ ID NO: 2651465 - DNA, 22 bp, Homo sapiens
tgattctcagggtctctgctgc

SEQ ID NO: 2651466 - DNA, 13 bp, Homo sapiens
tgattctcctgcc

SEQ ID NO: 2651467 - DNA, 15 bp, Homo sapiens
tgattctcctgcctc

SEQ ID NO: 2651468 - DNA, 12 bp, Homo sapiens
tgattctgcctt

SEQ ID NO: 2651469 - DNA, 15 bp, Homo sapiens
tgattcttgagttta

SEQ ID NO: 2651470 - DNA, 23 bp, Homo sapiens
tgattctttttaaagtgtttctg

SEQ ID NO: 2651471 - DNA, 13 bp, Homo sapiens
tgattgctaaatg

SEQ ID NO: 2651472 - DNA, 13 bp, Homo sapiens
tgattggaggggg

SEQ ID NO: 2651473 - DNA, 12 bp, Homo sapiens
tgattggctcac

SEQ ID NO: 2651474 - DNA, 15 bp, Homo sapiens
tgattgggacagagg

SEQ ID NO: 2651475 - DNA, 19 bp, Homo sapiens
tgattggtgcaacccttac

SEQ ID NO: 2651476 - DNA, 14 bp, Homo sapiens
tgattgtaaaatag

SEQ ID NO: 2651477 - DNA, 18 bp, Homo sapiens
tgattgtaacgttgctgt

SEQ ID NO: 2651478 - DNA, 21 bp, Homo sapiens
tgattgtaacgttgctgtggg

SEQ ID NO: 2651479 - DNA, 13 bp, Homo sapiens
tgatttaataaaa

SEQ ID NO: 2651480 - DNA, 19 bp, Homo sapiens
tgatttaataaaataattc

SEQ ID NO: 2651481 - DNA, 21 bp, Homo sapiens
tgatttaataaaataattcta

SEQ ID NO: 2651482 - DNA, 22 bp, Homo sapiens
tgatttaataaaataattctaa

SEQ ID NO: 2651483 - DNA, 23 bp, Homo sapiens
tgatttaataaaataattctaaa

SEQ ID NO: 2651484 - DNA, 18 bp, Homo sapiens
tgatttaatagtgttaat

SEQ ID NO: 2651485 - DNA, 22 bp, Homo sapiens
tgatttaatagtgttaatcaat

SEQ ID NO: 2651486 - DNA, 16 bp, Homo sapiens
tgatttcacaacagat

SEQ ID NO: 2651487 - DNA, 19 bp, Homo sapiens
tgatttcacaacagatcaa

SEQ ID NO: 2651488 - DNA, 21 bp, Homo sapiens
tgatttcagcacctacagtgt

SEQ ID NO: 2651489 - DNA, 13 bp, Homo sapiens
tgatttcattcaa

SEQ ID NO: 2651490 - DNA, 17 bp, Homo sapiens
tgatttcatttcaactg

SEQ ID NO: 2651491 - DNA, 18 bp, Homo sapiens
tgatttccgttaaaatac

SEQ ID NO: 2651492 - DNA, 17 bp, Homo sapiens
tgatttctagaaagcct

SEQ ID NO: 2651493 - DNA, 13 bp, Homo sapiens
tgatttctattca

SEQ ID NO: 2651494 - DNA, 20 bp, Homo sapiens
tgatttctattcaaggtggc

SEQ ID NO: 2651495 - DNA, 19 bp, Homo sapiens
tgatttcttctgttttctg

SEQ ID NO: 2651496 - DNA, 14 bp, Homo sapiens
tgatttgactgttt

SEQ ID NO: 2651497 - DNA, 20 bp, Homo sapiens
tgatttgactgtttttaccc

SEQ ID NO: 2651498 - DNA, 16 bp, Homo sapiens
tgattttaacaataac

SEQ ID NO: 2651499 - DNA, 18 bp, Homo sapiens
tgattttaacaataacta

SEQ ID NO: 2651500 - DNA, 22 bp, Homo sapiens
tgattttaacaataactactgt

SEQ ID NO: 2651501 - DNA, 15 bp, Homo sapiens
tgattttaactctgt

SEQ ID NO: 2651502 - DNA, 13 bp, Homo sapiens
tgattttcattgc

SEQ ID NO: 2651503 - DNA, 15 bp, Homo sapiens
tgattttcattgctg

SEQ ID NO: 2651504 - DNA, 13 bp, Homo sapiens
tgattttgcaaat

SEQ ID NO: 2651505 - DNA, 16 bp, Homo sapiens
tgattttgctgtagaa

SEQ ID NO: 2651506 - DNA, 18 bp, Homo sapiens
tgatttttttttcataca

SEQ ID NO: 2651507 - DNA, 16 bp, Homo sapiens
tgatttttttttttca

SEQ ID NO: 2651508 - DNA, 20 bp, Homo sapiens
tgcaaaagactaatttaaaa

SEQ ID NO: 2651509 - DNA, 19 bp, Homo sapiens
tgcaaaaggactctcagga

SEQ ID NO: 2651510 - DNA, 17 bp, Homo sapiens
tgcaaaatgagaccctc

SEQ ID NO: 2651511 - DNA, 22 bp, Homo sapiens
tgcaaacatggggttggctggg

SEQ ID NO: 2651512 - DNA, 12 bp, Homo sapiens
tgcaaactttat

SEQ ID NO: 2651513 - DNA, 12 bp, Homo sapiens
tgcaaagaaaat

SEQ ID NO: 2651514 - DNA, 18 bp, Homo sapiens
tgcaaagcactgacttct

SEQ ID NO: 2651515 - DNA, 22 bp, Homo sapiens
tgcaaagcactgacttctaagt

SEQ ID NO: 2651516 - DNA, 13 bp, Homo sapiens
tgcaaaggaaata

SEQ ID NO: 2651517 - DNA, 14 bp, Homo sapiens
tgcaaaggctggga

SEQ ID NO: 2651518 - DNA, 14 bp, Homo sapiens
tgcaaatcctatgt

SEQ ID NO: 2651519 - DNA, 17 bp, Homo sapiens
tgcaaatcctatgtgat

SEQ ID NO: 2651520 - DNA, 18 bp, Homo sapiens
tgcaaatcctatgtgatt

SEQ ID NO: 2651521 - DNA, 19 bp, Homo sapiens
tgcaaatcctatgtgattt

SEQ ID NO: 2651522 - DNA, 22 bp, Homo sapiens
tgcaaatgtcagatacaatgta

SEQ ID NO: 2651523 - DNA, 18 bp, Homo sapiens
tgcaaatgtcatcagaac

SEQ ID NO: 2651524 - DNA, 24 bp, Homo sapiens
tgcaacagcactggctctctccag

SEQ ID NO: 2651525 - DNA, 20 bp, Homo sapiens
tgcaacaggctgggcttcag

SEQ ID NO: 2651526 - DNA, 14 bp, Homo sapiens
tgcaacagtagcat

SEQ ID NO: 2651527 - DNA, 15 bp, Homo sapiens
tgcaacccttacccc

SEQ ID NO: 2651528 - DNA, 20 bp, Homo sapiens
tgcaacctccgcctcccggg

SEQ ID NO: 2651529 - DNA, 19 bp, Homo sapiens
tgcaacctcgctggactct

SEQ ID NO: 2651530 - DNA, 22 bp, Homo sapiens
tgcaacctcgctggactctcag

SEQ ID NO: 2651531 - DNA, 14 bp, Homo sapiens
tgcaacctgttgat

SEQ ID NO: 2651532 - DNA, 22 bp, Homo sapiens
tgcaacttcatgtcaacttctg

SEQ ID NO: 2651533 - DNA, 13 bp, Homo sapiens
tgcaacttctgcc

SEQ ID NO: 2651534 - DNA, 19 bp, Homo sapiens
tgcaactttaagcagctct

SEQ ID NO: 2651535 - DNA, 20 bp, Homo sapiens
tgcaactttaagcagctctt

SEQ ID NO: 2651536 - DNA, 17 bp, Homo sapiens
tgcaagagactctggcc

SEQ ID NO: 2651537 - DNA, 18 bp, Homo sapiens
tgcaagagactctggcct

SEQ ID NO: 2651538 - DNA, 19 bp, Homo sapiens
tgcaagagactctggcctc

SEQ ID NO: 2651539 - DNA, 18 bp, Homo sapiens
tgcaagattctgaaacat

SEQ ID NO: 2651540 - DNA, 16 bp, Homo sapiens
tgcaagcagggctctg

SEQ ID NO: 2651541 - DNA, 20 bp, Homo sapiens
tgcaaggaagccacagctgg

SEQ ID NO: 2651542 - DNA, 12 bp, Homo sapiens
tgcaaggaagga

SEQ ID NO: 2651543 - DNA, 19 bp, Homo sapiens
tgcaaggaaggaaagaaag

SEQ ID NO: 2651544 - DNA, 17 bp, Homo sapiens
tgcaaggaccaggactc

SEQ ID NO: 2651545 - DNA, 13 bp, Homo sapiens
tgcaaggcaaaga

SEQ ID NO: 2651546 - DNA, 20 bp, Homo sapiens
tgcaagggcagaacactaac

SEQ ID NO: 2651547 - DNA, 21 bp, Homo sapiens
tgcaagggcagaacactaacc

SEQ ID NO: 2651548 - DNA, 22 bp, Homo sapiens
tgcaagggcagaacactaacct

SEQ ID NO: 2651549 - DNA, 16 bp, Homo sapiens
tgcaagggctccccac

SEQ ID NO: 2651550 - DNA, 22 bp, Homo sapiens
tgcaagtatgtgagtgtgtcca

SEQ ID NO: 2651551 - DNA, 22 bp, Homo sapiens
tgcaagtatgttttagcatgtg

SEQ ID NO: 2651552 - DNA, 21 bp, Homo sapiens
tgcaagtggtagcaagaagtg

SEQ ID NO: 2651553 - DNA, 18 bp, Homo sapiens
tgcaagtgtctgtgtgca

SEQ ID NO: 2651554 - DNA, 21 bp, Homo sapiens
tgcaagtgtgtgcacatgtgt

SEQ ID NO: 2651555 - DNA, 20 bp, Homo sapiens
tgcaatagaacagagaaaga

SEQ ID NO: 2651556 - DNA, 23 bp, Homo sapiens
tgcaatatatctaaattgaataa

SEQ ID NO: 2651557 - DNA, 22 bp, Homo sapiens
tgcaatcgtaatgtacagatgg

SEQ ID NO: 2651558 - DNA, 21 bp, Homo sapiens
tgcaatgacacagtcttggct

SEQ ID NO: 2651559 - DNA, 16 bp, Homo sapiens
tgcaatgacatcttca

SEQ ID NO: 2651560 - DNA, 17 bp, Homo sapiens
tgcaatgacatcttcaa

SEQ ID NO: 2651561 - DNA, 15 bp, Homo sapiens
tgcaatggcagcctt

SEQ ID NO: 2651562 - DNA, 16 bp, Homo sapiens
tgcaatggcagccttg

SEQ ID NO: 2651563 - DNA, 17 bp, Homo sapiens
tgcaatggttaacatct

SEQ ID NO: 2651564 - DNA, 16 bp, Homo sapiens
tgcaatgtgctactga

SEQ ID NO: 2651565 - DNA, 22 bp, Homo sapiens
tgcaatttattaaaatgattgt

SEQ ID NO: 2651566 - DNA, 19 bp, Homo sapiens
tgcaatttgggagatatat

SEQ ID NO: 2651567 - DNA, 18 bp, Homo sapiens
tgcacaagctccaagctc

SEQ ID NO: 2651568 - DNA, 15 bp, Homo sapiens
tgcacaagctgcacc

SEQ ID NO: 2651569 - DNA, 18 bp, Homo sapiens
tgcacaagctgcaccctc

SEQ ID NO: 2651570 - DNA, 15 bp, Homo sapiens
tgcacaataaaaatg

SEQ ID NO: 2651571 - DNA, 20 bp, Homo sapiens
tgcacaataaaaatgtttaa

SEQ ID NO: 2651572 - DNA, 10 bp, Homo sapiens
tgcacacatt

SEQ ID NO: 2651573 - DNA, 15 bp, Homo sapiens
tgcacacatttttta

SEQ ID NO: 2651574 - DNA, 20 bp, Homo sapiens
tgcacacattttttaaatgc

SEQ ID NO: 2651575 - DNA, 18 bp, Homo sapiens
tgcacactcccctgcact

SEQ ID NO: 2651576 - DNA, 23 bp, Homo sapiens
tgcacacttgtgtgtgggctgtg

SEQ ID NO: 2651577 - DNA, 14 bp, Homo sapiens
tgcacactttgcca

SEQ ID NO: 2651578 - DNA, 12 bp, Homo sapiens
tgcacagagctc

SEQ ID NO: 2651579 - DNA, 18 bp, Homo sapiens
tgcacagagctctccagc

SEQ ID NO: 2651580 - DNA, 21 bp, Homo sapiens
tgcacagagctctccagctcc

SEQ ID NO: 2651581 - DNA, 17 bp, Homo sapiens
tgcacagagttgttaca

SEQ ID NO: 2651582 - DNA, 16 bp, Homo sapiens
tgcacagcggcccctg

SEQ ID NO: 2651583 - DNA, 14 bp, Homo sapiens
tgcacagggagacg

SEQ ID NO: 2651584 - DNA, 16 bp, Homo sapiens
tgcacagggagacgta

SEQ ID NO: 2651585 - DNA, 21 bp, Homo sapiens
tgcacatacgcaccacatctc

SEQ ID NO: 2651586 - DNA, 18 bp, Homo sapiens
tgcacatatggactctgc

SEQ ID NO: 2651587 - DNA, 19 bp, Homo sapiens
tgcacatatggactctgca

SEQ ID NO: 2651588 - DNA, 15 bp, Homo sapiens
tgcacatgtcttgta

SEQ ID NO: 2651589 - DNA, 19 bp, Homo sapiens
tgcacatgtcttgtacatg

SEQ ID NO: 2651590 - DNA, 22 bp, Homo sapiens
tgcacatgtcttgtacatgtgt

SEQ ID NO: 2651591 - DNA, 19 bp, Homo sapiens
tgcacatgtgtgcgtgtgc

SEQ ID NO: 2651592 - DNA, 15 bp, Homo sapiens
tgcaccactgcactc

SEQ ID NO: 2651593 - DNA, 17 bp, Homo sapiens
tgcacccacccaggagt

SEQ ID NO: 2651594 - DNA, 15 bp, Homo sapiens
tgcacccaggggtgg

SEQ ID NO: 2651595 - DNA, 16 bp, Homo sapiens
tgcaccccatgctgtt

SEQ ID NO: 2651596 - DNA, 18 bp, Homo sapiens
tgcaccctccaccctgtc

SEQ ID NO: 2651597 - DNA, 22 bp, Homo sapiens
tgcaccctggggcctggacctg

SEQ ID NO: 2651598 - DNA, 18 bp, Homo sapiens
tgcaccggctggcctggc

SEQ ID NO: 2651599 - DNA, 16 bp, Homo sapiens
tgcacctgccagcctg

SEQ ID NO: 2651600 - DNA, 20 bp, Homo sapiens
tgcacctgccagcctggctt

SEQ ID NO: 2651601 - DNA, 18 bp, Homo sapiens
tgcaccttaccaactttc

SEQ ID NO: 2651602 - DNA, 20 bp, Homo sapiens
tgcaccttaccaactttctg

SEQ ID NO: 2651603 - DNA, 21 bp, Homo sapiens
tgcaccttaccaactttctgt

SEQ ID NO: 2651604 - DNA, 21 bp, Homo sapiens
tgccccatcagtgctccctca

SEQ ID NO: 2651605 - DNA, 23 bp, Homo sapiens
tgccccatgcctgtccagcctgg

SEQ ID NO: 2651606 - DNA, 21 bp, Homo sapiens
tgcccccaccacggccactgg

SEQ ID NO: 2651607 - DNA, 15 bp, Homo sapiens
tgccccccaccccag

SEQ ID NO: 2651608 - DNA, 18 bp, Homo sapiens
tgccccccttgccagaca

SEQ ID NO: 2651609 - DNA, 15 bp, Homo sapiens
tgcccccggccccct

SEQ ID NO: 2651610 - DNA, 11 bp, Homo sapiens
tgccccctcct

SEQ ID NO: 2651611 - DNA, 12 bp, Homo sapiens
tgccccctcctc

SEQ ID NO: 2651612 - DNA, 14 bp, Homo sapiens
tgccccctgctggc

SEQ ID NO: 2651613 - DNA, 21 bp, Homo sapiens
tgccccctggtggacagtcct

SEQ ID NO: 2651614 - DNA, 17 bp, Homo sapiens
tgcccccttctcccaca

SEQ ID NO: 2651615 - DNA, 20 bp, Homo sapiens
tgcccccttctcccacactg

SEQ ID NO: 2651616 - DNA, 22 bp, Homo sapiens
tgcccccttctcccacactgct

SEQ ID NO: 2651617 - DNA, 23 bp, Homo sapiens
tgccccctttcagatgtcttctg

SEQ ID NO: 2651618 - DNA, 17 bp, Homo sapiens
tgccccgtcaccatctc

SEQ ID NO: 2651619 - DNA, 19 bp, Homo sapiens
tgccccgtcaccatctcag

SEQ ID NO: 2651620 - DNA, 17 bp, Homo sapiens
tgcccctcccccaaccc

SEQ ID NO: 2651621 - DNA, 20 bp, Homo sapiens
tgcccctctccaggcgccgg

SEQ ID NO: 2651622 - DNA, 14 bp, Homo sapiens
tgcccctgctgcct

SEQ ID NO: 2651623 - DNA, 17 bp, Homo sapiens
tgcccctgctgcctccc

SEQ ID NO: 2651624 - DNA, 21 bp, Homo sapiens
tgccccttcccatctcttcct

SEQ ID NO: 2651625 - DNA, 15 bp, Homo sapiens
tgcccggattctggg

SEQ ID NO: 2651626 - DNA, 16 bp, Homo sapiens
tgcccggattctggga

SEQ ID NO: 2651627 - DNA, 22 bp, Homo sapiens
tgcccggattctgggaggaagc

SEQ ID NO: 2651628 - DNA, 14 bp, Homo sapiens
tgcccggctgcgga

SEQ ID NO: 2651629 - DNA, 20 bp, Homo sapiens
tgcccgggcgcggccagccc

SEQ ID NO: 2651630 - DNA, 18 bp, Homo sapiens
tgcccgtctctctcccat

SEQ ID NO: 2651631 - DNA, 20 bp, Homo sapiens
tgcccgtctctctcccatgg

SEQ ID NO: 2651632 - DNA, 20 bp, Homo sapiens
tgccctaaagtgtatttttt

SEQ ID NO: 2651633 - DNA, 18 bp, Homo sapiens
tgccctacagaggtctct

SEQ ID NO: 2651634 - DNA, 17 bp, Homo sapiens
tgccctagagcacactg

SEQ ID NO: 2651635 - DNA, 23 bp, Homo sapiens
tgccctagagcacactgtagcat

SEQ ID NO: 2651636 - DNA, 14 bp, Homo sapiens
tgccctagctccac

SEQ ID NO: 2651637 - DNA, 16 bp, Homo sapiens
tgccctcaatcccagc

SEQ ID NO: 2651638 - DNA, 18 bp, Homo sapiens
tgccctcattttatgtca

SEQ ID NO: 2651639 - DNA, 20 bp, Homo sapiens
tgccctccaagaccttctcc

SEQ ID NO: 2651640 - DNA, 14 bp, Homo sapiens
tgccctccatcccg

SEQ ID NO: 2651641 - DNA, 15 bp, Homo sapiens
tgccctccccagagc

SEQ ID NO: 2651642 - DNA, 14 bp, Homo sapiens
tgccctcccctctc

SEQ ID NO: 2651643 - DNA, 21 bp, Homo sapiens
tgccctcccctctctgcaccg

SEQ ID NO: 2651644 - DNA, 13 bp, Homo sapiens
tgccctcgctgct

SEQ ID NO: 2651645 - DNA, 14 bp, Homo sapiens
tgccctcgctgctt

SEQ ID NO: 2651646 - DNA, 20 bp, Homo sapiens
tgccctcgtggccagcccgg

SEQ ID NO: 2651647 - DNA, 12 bp, Homo sapiens
tgccctcttcat

SEQ ID NO: 2651648 - DNA, 12 bp, Homo sapiens
tgccctgacctc

SEQ ID NO: 2651649 - DNA, 18 bp, Homo sapiens
tgccctgacctcccagcc

SEQ ID NO: 2651650 - DNA, 23 bp, Homo sapiens
tgccctgagtggatctccaagga

SEQ ID NO: 2651651 - DNA, 15 bp, Homo sapiens
tgccctgcccacctg

SEQ ID NO: 2651652 - DNA, 21 bp, Homo sapiens
tgccctgctgccgcctcccag

SEQ ID NO: 2651653 - DNA, 15 bp, Homo sapiens
tgccctgtgggcccc

SEQ ID NO: 2651654 - DNA, 18 bp, Homo sapiens
tgccctgtgggcccccaa

SEQ ID NO: 2651655 - DNA, 15 bp, Homo sapiens
tgcccttaaatcata

SEQ ID NO: 2651656 - DNA, 17 bp, Homo sapiens
tgcccttcacagtgttt

SEQ ID NO: 2651657 - DNA, 20 bp, Homo sapiens
tgcccttcaccccagtggcc

SEQ ID NO: 2651658 - DNA, 13 bp, Homo sapiens
tgcccttccctgt

SEQ ID NO: 2651659 - DNA, 18 bp, Homo sapiens
tgcccttccctgtccctc

SEQ ID NO: 2651660 - DNA, 18 bp, Homo sapiens
tgcccttgccctgacctc

SEQ ID NO: 2651661 - DNA, 22 bp, Homo sapiens
tgccgaatgtgcaggtttgtta

SEQ ID NO: 2651662 - DNA, 21 bp, Homo sapiens
tgccgaccagagccccacacg

SEQ ID NO: 2651663 - DNA, 22 bp, Homo sapiens
tgccgaccagagccccacacgg

SEQ ID NO: 2651664 - DNA, 16 bp, Homo sapiens
tgccgaccgaggctgg

SEQ ID NO: 2651665 - DNA, 22 bp, Homo sapiens
tgccgcaatggccatgtgggga

SEQ ID NO: 2651666 - DNA, 14 bp, Homo sapiens
tgccgccccaccca

SEQ ID NO: 2651667 - DNA, 10 bp, Homo sapiens
tgccgcctgc

SEQ ID NO: 2651668 - DNA, 15 bp, Homo sapiens
tgccggccctggggc

SEQ ID NO: 2651669 - DNA, 15 bp, Homo sapiens
tgccgtctacctgag

SEQ ID NO: 2651670 - DNA, 17 bp, Homo sapiens
tgccgtctacctgaggg

SEQ ID NO: 2651671 - DNA, 19 bp, Homo sapiens
tgcctcaagccccagagtg

SEQ ID NO: 2651672 - DNA, 19 bp, Homo sapiens
tgcctcaatgtgaccaggg

SEQ ID NO: 2651673 - DNA, 23 bp, Homo sapiens
tgcctcaatgtgaccaggggtga

SEQ ID NO: 2651674 - DNA, 18 bp, Homo sapiens
tgcctcagcctcccgagt

SEQ ID NO: 2651675 - DNA, 14 bp, Homo sapiens
tgcctcagcctccg

SEQ ID NO: 2651676 - DNA, 14 bp, Homo sapiens
tgcctcaggttcct

SEQ ID NO: 2651677 - DNA, 14 bp, Homo sapiens
tgcctccaccacca

SEQ ID NO: 2651678 - DNA, 12 bp, Homo sapiens
tgcctccaccct

SEQ ID NO: 2651679 - DNA, 14 bp, Homo sapiens
tgcctccaccctct

SEQ ID NO: 2651680 - DNA, 17 bp, Homo sapiens
tgcctccaccctctgag

SEQ ID NO: 2651681 - DNA, 17 bp, Homo sapiens
tgcctccaggtgtgcac

SEQ ID NO: 2651682 - DNA, 14 bp, Homo sapiens
tgcctcccatcacc

SEQ ID NO: 2651683 - DNA, 15 bp, Homo sapiens
tgcctccccaaccct

SEQ ID NO: 2651684 - DNA, 23 bp, Homo sapiens
tgcctccccaaccctgcccctgc

SEQ ID NO: 2651685 - DNA, 22 bp, Homo sapiens
tgcctccctcaccctgagcccc

SEQ ID NO: 2651686 - DNA, 19 bp, Homo sapiens
tgcctccgcctcagtaaga

SEQ ID NO: 2651687 - DNA, 22 bp, Homo sapiens
tgcctccgcgtgatcaaagcca

SEQ ID NO: 2651688 - DNA, 19 bp, Homo sapiens
tgcctcctcacccccagct

SEQ ID NO: 2651689 - DNA, 12 bp, Homo sapiens
tgcctcctcctt

SEQ ID NO: 2651690 - DNA, 14 bp, Homo sapiens
tgcctcctcttcaa

SEQ ID NO: 2651691 - DNA, 14 bp, Homo sapiens
tgcctcctgcctgc

SEQ ID NO: 2651692 - DNA, 16 bp, Homo sapiens
tgcctcctttgtgagg

SEQ ID NO: 2651693 - DNA, 19 bp, Homo sapiens
tgcctcgaactggctgcaa

SEQ ID NO: 2651694 - DNA, 20 bp, Homo sapiens
tgcctcgaactggctgcaaa

SEQ ID NO: 2651695 - DNA, 17 bp, Homo sapiens
tgcctctcctttgtata

SEQ ID NO: 2651696 - DNA, 20 bp, Homo sapiens
tgcctctcctttgtatatta

SEQ ID NO: 2651697 - DNA, 22 bp, Homo sapiens
tgcctctgacacacagctctgt

SEQ ID NO: 2651698 - DNA, 11 bp, Homo sapiens
tgcctctgcct

SEQ ID NO: 2651699 - DNA, 12 bp, Homo sapiens
tgcctctgcctc

SEQ ID NO: 2651700 - DNA, 18 bp, Homo sapiens
tgcctctgcctctgacac

SEQ ID NO: 2651701 - DNA, 13 bp, Homo sapiens
tgcctctgcctgt

SEQ ID NO: 2651702 - DNA, 18 bp, Homo sapiens
tgcctctgcctgtctccc

SEQ ID NO: 2651703 - DNA, 14 bp, Homo sapiens
tgcctctgggactg

SEQ ID NO: 2651704 - DNA, 13 bp, Homo sapiens
tgcctcttcctcc

SEQ ID NO: 2651705 - DNA, 21 bp, Homo sapiens
tgcctcttctctactctaggg

SEQ ID NO: 2651706 - DNA, 13 bp, Homo sapiens
tgcctcttctggg

SEQ ID NO: 2651707 - DNA, 21 bp, Homo sapiens
tgcctcttctgggagggcagc

SEQ ID NO: 2651708 - DNA, 16 bp, Homo sapiens
tgcctgaaccttccat

SEQ ID NO: 2651709 - DNA, 13 bp, Homo sapiens
tgcctgaagaaca

SEQ ID NO: 2651710 - DNA, 18 bp, Homo sapiens
tgcctgacatttggagtg

SEQ ID NO: 2651711 - DNA, 14 bp, Homo sapiens
tgcctgagggcccc

SEQ ID NO: 2651712 - DNA, 17 bp, Homo sapiens
tgcctgagggcccctct

SEQ ID NO: 2651713 - DNA, 23 bp, Homo sapiens
tgcctgagggcccctctgcccag

SEQ ID NO: 2651714 - DNA, 14 bp, Homo sapiens
tgcctgagggtgga

SEQ ID NO: 2651715 - DNA, 16 bp, Homo sapiens
tgcctgaggtctgtac

SEQ ID NO: 2651716 - DNA, 18 bp, Homo sapiens
tgcctgaggtctgtacgt

SEQ ID NO: 2651717 - DNA, 19 bp, Homo sapiens
tgcctgagtcacccatgaa

SEQ ID NO: 2651718 - DNA, 22 bp, Homo sapiens
tgcctgatatttccctcccctg

SEQ ID NO: 2651719 - DNA, 15 bp, Homo sapiens
tgcctgattgccaag

SEQ ID NO: 2651720 - DNA, 16 bp, Homo sapiens
tgcctgcccacccgtg

SEQ ID NO: 2651721 - DNA, 13 bp, Homo sapiens
tgcctgcccaggc

SEQ ID NO: 2651722 - DNA, 17 bp, Homo sapiens
tgcctgcccaggcccct

SEQ ID NO: 2651723 - DNA, 23 bp, Homo sapiens
tgcctgcccaggcccctgccacc

SEQ ID NO: 2651724 - DNA, 15 bp, Homo sapiens
tgcctgcctgtctgt

SEQ ID NO: 2651725 - DNA, 17 bp, Homo sapiens
tgcctggatggggctgc

SEQ ID NO: 2651726 - DNA, 15 bp, Homo sapiens
tgcctggcaggctgt

SEQ ID NO: 2651727 - DNA, 12 bp, Homo sapiens
tgcctggccagg

SEQ ID NO: 2651728 - DNA, 16 bp, Homo sapiens
tgcctggcctggcaca

SEQ ID NO: 2651729 - DNA, 22 bp, Homo sapiens
tgcctggcttcgcaaaatgttt

SEQ ID NO: 2651730 - DNA, 14 bp, Homo sapiens
tgcctgggaatgta

SEQ ID NO: 2651731 - DNA, 22 bp, Homo sapiens
tgcctgggagttttgtattcat

SEQ ID NO: 2651732 - DNA, 21 bp, Homo sapiens
tgcctgggatccctcatcctc

SEQ ID NO: 2651733 - DNA, 22 bp, Homo sapiens
tgcctgggctcccttgtgcgtg

SEQ ID NO: 2651734 - DNA, 20 bp, Homo sapiens
tgcctgtagttaggaaataa

SEQ ID NO: 2651735 - DNA, 21 bp, Homo sapiens
tgcctgtagttaggaaataaa

SEQ ID NO: 2651736 - DNA, 11 bp, Homo sapiens
tgcctgtctcc

SEQ ID NO: 2651737 - DNA, 18 bp, Homo sapiens
tgcctgtctgtctctcca

SEQ ID NO: 2651738 - DNA, 18 bp, Homo sapiens
tgcctgtctgttacactg

SEQ ID NO: 2651739 - DNA, 16 bp, Homo sapiens
tgcctgtgccacccac

SEQ ID NO: 2651740 - DNA, 19 bp, Homo sapiens
tgcctgtgccacccaccag

SEQ ID NO: 2651741 - DNA, 19 bp, Homo sapiens
tgcctgtggaatctggagt

SEQ ID NO: 2651742 - DNA, 17 bp, Homo sapiens
tgcctgttcagttacag

SEQ ID NO: 2651743 - DNA, 20 bp, Homo sapiens
tgcctgttcagttacagaaa

SEQ ID NO: 2651744 - DNA, 14 bp, Homo sapiens
tgcctgttcccatt

SEQ ID NO: 2651745 - DNA, 13 bp, Homo sapiens
tgccttaaagaaa

SEQ ID NO: 2651746 - DNA, 15 bp, Homo sapiens
tgccttagtctcagt

SEQ ID NO: 2651747 - DNA, 16 bp, Homo sapiens
tgccttagtctcagtt

SEQ ID NO: 2651748 - DNA, 13 bp, Homo sapiens
tgccttccataat

SEQ ID NO: 2651749 - DNA, 19 bp, Homo sapiens
tggactctgcacatgtctt

SEQ ID NO: 2651750 - DNA, 15 bp, Homo sapiens
tggactcttgctctt

SEQ ID NO: 2651751 - DNA, 15 bp, Homo sapiens
tggactgaagcctgc

SEQ ID NO: 2651752 - DNA, 18 bp, Homo sapiens
tggactgaagcctgcagg

SEQ ID NO: 2651753 - DNA, 19 bp, Homo sapiens
tggactgaagcctgcagga

SEQ ID NO: 2651754 - DNA, 16 bp, Homo sapiens
tggactggagtggagc

SEQ ID NO: 2651755 - DNA, 15 bp, Homo sapiens
tggactggcccctgg

SEQ ID NO: 2651756 - DNA, 13 bp, Homo sapiens
tggactgggaggt

SEQ ID NO: 2651757 - DNA, 21 bp, Homo sapiens
tggactgtcatagaaattaca

SEQ ID NO: 2651758 - DNA, 15 bp, Homo sapiens
tggactgtgatgcca

SEQ ID NO: 2651759 - DNA, 20 bp, Homo sapiens
tggacttcttttactcatga

SEQ ID NO: 2651760 - DNA, 17 bp, Homo sapiens
tggacttgagcttggca

SEQ ID NO: 2651761 - DNA, 19 bp, Homo sapiens
tggactttccaccccctcc

SEQ ID NO: 2651762 - DNA, 22 bp, Homo sapiens
tggagaaactgtagtctcagga

SEQ ID NO: 2651763 - DNA, 23 bp, Homo sapiens
tggagaaataaaaatacctcttt

SEQ ID NO: 2651764 - DNA, 11 bp, Homo sapiens
tggagaaatta

SEQ ID NO: 2651765 - DNA, 15 bp, Homo sapiens
tggagaactcctagg

SEQ ID NO: 2651766 - DNA, 17 bp, Homo sapiens
tggagaactcctagggt

SEQ ID NO: 2651767 - DNA, 13 bp, Homo sapiens
tggagaagccatt

SEQ ID NO: 2651768 - DNA, 22 bp, Homo sapiens
tggagaagcggctggcagccca

SEQ ID NO: 2651769 - DNA, 22 bp, Homo sapiens
tggagaagtcttagacttgaaa

SEQ ID NO: 2651770 - DNA, 21 bp, Homo sapiens
tggagacattcctgggcacag

SEQ ID NO: 2651771 - DNA, 18 bp, Homo sapiens
tggagaccatgcagagcg

SEQ ID NO: 2651772 - DNA, 22 bp, Homo sapiens
tggagactcctaggcaggacat

SEQ ID NO: 2651773 - DNA, 20 bp, Homo sapiens
tggagactgcttcccatcct

SEQ ID NO: 2651774 - DNA, 11 bp, Homo sapiens
tggagagaagt

SEQ ID NO: 2651775 - DNA, 18 bp, Homo sapiens
tggagagccagaacctgg

SEQ ID NO: 2651776 - DNA, 23 bp, Homo sapiens
tggagagctagaacctggagagc

SEQ ID NO: 2651777 - DNA, 18 bp, Homo sapiens
tggagagctggagcctgg

SEQ ID NO: 2651778 - DNA, 20 bp, Homo sapiens
tggagagctggagcctggtg

SEQ ID NO: 2651779 - DNA, 17 bp, Homo sapiens
tggagagtgcaacagta

SEQ ID NO: 2651780 - DNA, 21 bp, Homo sapiens
tggagagttcaatggctgctg

SEQ ID NO: 2651781 - DNA, 23 bp, Homo sapiens
tggagatgtcttcgtacagttct

SEQ ID NO: 2651782 - DNA, 19 bp, Homo sapiens
tggagatgttttagagtta

SEQ ID NO: 2651783 - DNA, 13 bp, Homo sapiens
tggagcagagggg

SEQ ID NO: 2651784 - DNA, 16 bp, Homo sapiens
tggagccaactgctgc

SEQ ID NO: 2651785 - DNA, 15 bp, Homo sapiens
tggagccaagtccag

SEQ ID NO: 2651786 - DNA, 13 bp, Homo sapiens
tggagccccagcc

SEQ ID NO: 2651787 - DNA, 14 bp, Homo sapiens
tggagccccagccc

SEQ ID NO: 2651788 - DNA, 15 bp, Homo sapiens
tggagccccagcccc

SEQ ID NO: 2651789 - DNA, 15 bp, Homo sapiens
tggagcccctgggtg

SEQ ID NO: 2651790 - DNA, 18 bp, Homo sapiens
tggagcccgcacccccac

SEQ ID NO: 2651791 - DNA, 19 bp, Homo sapiens
tggagcccgcacccccacc

SEQ ID NO: 2651792 - DNA, 13 bp, Homo sapiens
tggagcctggtgc

SEQ ID NO: 2651793 - DNA, 19 bp, Homo sapiens
tggagcctttgaataaaaa

SEQ ID NO: 2651794 - DNA, 18 bp, Homo sapiens
tggagctcagagagggca

SEQ ID NO: 2651795 - DNA, 13 bp, Homo sapiens
tggagctgagcct

SEQ ID NO: 2651796 - DNA, 15 bp, Homo sapiens
tggagctgagcctct

SEQ ID NO: 2651797 - DNA, 18 bp, Homo sapiens
tggagctggcgtctgtct

SEQ ID NO: 2651798 - DNA, 21 bp, Homo sapiens
tggagcttcatggcagaaggc

SEQ ID NO: 2651799 - DNA, 14 bp, Homo sapiens
tggaggaaagcaac

SEQ ID NO: 2651800 - DNA, 12 bp, Homo sapiens
tggaggaaggaa

SEQ ID NO: 2651801 - DNA, 18 bp, Homo sapiens
tggaggaaggattgtaaa

SEQ ID NO: 2651802 - DNA, 20 bp, Homo sapiens
tggaggaaggattgtaaaaa

SEQ ID NO: 2651803 - DNA, 15 bp, Homo sapiens
tggaggaatgctccc

SEQ ID NO: 2651804 - DNA, 16 bp, Homo sapiens
tggaggaatgctcccc

SEQ ID NO: 2651805 - DNA, 21 bp, Homo sapiens
tggaggagcaaaggctgagaa

SEQ ID NO: 2651806 - DNA, 20 bp, Homo sapiens
tggaggagctcaggacacta

SEQ ID NO: 2651807 - DNA, 22 bp, Homo sapiens
tggaggagctcaggacactaat

SEQ ID NO: 2651808 - DNA, 14 bp, Homo sapiens
tggaggccagccag

SEQ ID NO: 2651809 - DNA, 15 bp, Homo sapiens
tggaggccagccagt

SEQ ID NO: 2651810 - DNA, 22 bp, Homo sapiens
tggaggctgtcttctcaggctc

SEQ ID NO: 2651811 - DNA, 19 bp, Homo sapiens
tggagggaatgaacctgga

SEQ ID NO: 2651812 - DNA, 21 bp, Homo sapiens
tggagggctggaatctggaga

SEQ ID NO: 2651813 - DNA, 19 bp, Homo sapiens
tggaggggtggtcctgact

SEQ ID NO: 2651814 - DNA, 14 bp, Homo sapiens
tggaggtacactct

SEQ ID NO: 2651815 - DNA, 18 bp, Homo sapiens
tggaggtcacattcagga

SEQ ID NO: 2651816 - DNA, 15 bp, Homo sapiens
tggaggtggggttgg

SEQ ID NO: 2651817 - DNA, 17 bp, Homo sapiens
tggaggttaaggctgag

SEQ ID NO: 2651818 - DNA, 22 bp, Homo sapiens
tggaggttaaggctgaggaaag

SEQ ID NO: 2651819 - DNA, 14 bp, Homo sapiens
tggagtatatgtca

SEQ ID NO: 2651820 - DNA, 14 bp, Homo sapiens
tggagtcccctcac

SEQ ID NO: 2651821 - DNA, 15 bp, Homo sapiens
tggagtcccctcacc

SEQ ID NO: 2651822 - DNA, 14 bp, Homo sapiens
tggagtcggaaggg

SEQ ID NO: 2651823 - DNA, 17 bp, Homo sapiens
tggagtctccagtggtt

SEQ ID NO: 2651824 - DNA, 15 bp, Homo sapiens
tggagtgcagggagg

SEQ ID NO: 2651825 - DNA, 19 bp, Homo sapiens
tggagtgcagggaggagag

SEQ ID NO: 2651826 - DNA, 14 bp, Homo sapiens
tggagtgcagtgag

SEQ ID NO: 2651827 - DNA, 17 bp, Homo sapiens
tggagtgtggctgagga

SEQ ID NO: 2651828 - DNA, 17 bp, Homo sapiens
tggagttacattaatgt

SEQ ID NO: 2651829 - DNA, 16 bp, Homo sapiens
tggagttcctgaacct

SEQ ID NO: 2651830 - DNA, 14 bp, Homo sapiens
tggagttcttgtgc

SEQ ID NO: 2651831 - DNA, 21 bp, Homo sapiens
tggagtttttgtttggagagc

SEQ ID NO: 2651832 - DNA, 22 bp, Homo sapiens
tggatactgcccggggcagctg

SEQ ID NO: 2651833 - DNA, 16 bp, Homo sapiens
tggataggagcctgct

SEQ ID NO: 2651834 - DNA, 17 bp, Homo sapiens
tggatatagttttactt

SEQ ID NO: 2651835 - DNA, 23 bp, Homo sapiens
tggatattttcaaattgtatcta

SEQ ID NO: 2651836 - DNA, 15 bp, Homo sapiens
tggatcacagctgct

SEQ ID NO: 2651837 - DNA, 20 bp, Homo sapiens
tggatcacagctgctttctg

SEQ ID NO: 2651838 - DNA, 14 bp, Homo sapiens
tggatctccaagga

SEQ ID NO: 2651839 - DNA, 15 bp, Homo sapiens
tggatctccaaggac

SEQ ID NO: 2651840 - DNA, 19 bp, Homo sapiens
tggatctccccactctagg

SEQ ID NO: 2651841 - DNA, 18 bp, Homo sapiens
tggatctgtccaaggaaa

SEQ ID NO: 2651842 - DNA, 20 bp, Homo sapiens
tggatctgtccaaggaaact

SEQ ID NO: 2651843 - DNA, 18 bp, Homo sapiens
tggatgaaattttctaga

SEQ ID NO: 2651844 - DNA, 22 bp, Homo sapiens
tggatgaagattctcctgtgct

SEQ ID NO: 2651845 - DNA, 20 bp, Homo sapiens
tggatgaccagaacaaggtt

SEQ ID NO: 2651846 - DNA, 14 bp, Homo sapiens
tggatgatgtttcg

SEQ ID NO: 2651847 - DNA, 13 bp, Homo sapiens
tggatgcctgatt

SEQ ID NO: 2651848 - DNA, 14 bp, Homo sapiens
tggatgcctggtgg

SEQ ID NO: 2651849 - DNA, 20 bp, Homo sapiens
tggatgcctggtggcagctg

SEQ ID NO: 2651850 - DNA, 21 bp, Homo sapiens
tggatgcctggtggcagctgc

SEQ ID NO: 2651851 - DNA, 17 bp, Homo sapiens
tggatgtctgccaattt

SEQ ID NO: 2651852 - DNA, 14 bp, Homo sapiens
tggatgtcttcctt

SEQ ID NO: 2651853 - DNA, 15 bp, Homo sapiens
tggatgtcttccttg

SEQ ID NO: 2651854 - DNA, 20 bp, Homo sapiens
tggatgttttaattccatga

SEQ ID NO: 2651855 - DNA, 18 bp, Homo sapiens
tggattattcatttaaaa

SEQ ID NO: 2651856 - DNA, 20 bp, Homo sapiens
tggattattcatttaaaatg

SEQ ID NO: 2651857 - DNA, 16 bp, Homo sapiens
tggattatttaataac

SEQ ID NO: 2651858 - DNA, 18 bp, Homo sapiens
tggattatttaataacat

SEQ ID NO: 2651859 - DNA, 20 bp, Homo sapiens
tggattatttaataacatta

SEQ ID NO: 2651860 - DNA, 16 bp, Homo sapiens
tggattctcagatatt

SEQ ID NO: 2651861 - DNA, 19 bp, Homo sapiens
tggattctcagatatttat

SEQ ID NO: 2651862 - DNA, 13 bp, Homo sapiens
tggattgagggta

SEQ ID NO: 2651863 - DNA, 23 bp, Homo sapiens
tggattggagaagtaatcctagg

SEQ ID NO: 2651864 - DNA, 21 bp, Homo sapiens
tggattgtccccgacccttgc

SEQ ID NO: 2651865 - DNA, 24 bp, Homo sapiens
tggatttaacagaaatgtacagca

SEQ ID NO: 2651866 - DNA, 13 bp, Homo sapiens
tggatttgatgct

SEQ ID NO: 2651867 - DNA, 17 bp, Homo sapiens
tggatttgcctgtgcca

SEQ ID NO: 2651868 - DNA, 18 bp, Homo sapiens
tggatttgcctgtgccac

SEQ ID NO: 2651869 - DNA, 15 bp, Homo sapiens
tggatttgtttaaaa

SEQ ID NO: 2651870 - DNA, 16 bp, Homo sapiens
tggatttgtttaaaag

SEQ ID NO: 2651871 - DNA, 13 bp, Homo sapiens
tggcaacagaagc

SEQ ID NO: 2651872 - DNA, 14 bp, Homo sapiens
tggcaacagaagtg

SEQ ID NO: 2651873 - DNA, 13 bp, Homo sapiens
tggcaagagcccc

SEQ ID NO: 2651874 - DNA, 16 bp, Homo sapiens
tggcaagcccctgccc

SEQ ID NO: 2651875 - DNA, 19 bp, Homo sapiens
tggcaaggacacagatgaa

SEQ ID NO: 2651876 - DNA, 14 bp, Homo sapiens
tggcaaggctgtgc

SEQ ID NO: 2651877 - DNA, 17 bp, Homo sapiens
tggcaatagtgtgttct

SEQ ID NO: 2651878 - DNA, 14 bp, Homo sapiens
tggcaattctttga

SEQ ID NO: 2651879 - DNA, 14 bp, Homo sapiens
tggcaattttgtaa

SEQ ID NO: 2651880 - DNA, 23 bp, Homo sapiens
tggcacaatggctaattcccaga

SEQ ID NO: 2651881 - DNA, 16 bp, Homo sapiens
tggcacaggccccctt

SEQ ID NO: 2651882 - DNA, 22 bp, Homo sapiens
tggcacagttttctgagaaaga

SEQ ID NO: 2651883 - DNA, 23 bp, Homo sapiens
tggcacatcagcacgatttctgt

SEQ ID NO: 2651884 - DNA, 19 bp, Homo sapiens
tggcaccactgcactccag

SEQ ID NO: 2651885 - DNA, 20 bp, Homo sapiens
tggcaccagaggctgcagaa

SEQ ID NO: 2651886 - DNA, 16 bp, Homo sapiens
tggcaccagcagcctg

SEQ ID NO: 2651887 - DNA, 17 bp, Homo sapiens
tggcaccagcagcctgg

SEQ ID NO: 2651888 - DNA, 18 bp, Homo sapiens
tggcaccagcagcctgga

SEQ ID NO: 2651889 - DNA, 18 bp, Homo sapiens
tggcaccagcgaagggag

SEQ ID NO: 2651890 - DNA, 19 bp, Homo sapiens
tggcacccggcccctgctg

SEQ ID NO: 2651891 - DNA, 15 bp, Homo sapiens
tggcaccgccttctc

SEQ ID NO: 2651892 - DNA, 19 bp, Homo sapiens
tggcacggtggctcaggcc

SEQ ID NO: 2651893 - DNA, 15 bp, Homo sapiens
tggcactataatgta

SEQ ID NO: 2651894 - DNA, 22 bp, Homo sapiens
tgggtagctgtaaggcatgaag

SEQ ID NO: 2651895 - DNA, 18 bp, Homo sapiens
tgggtcacccctccagga

SEQ ID NO: 2651896 - DNA, 13 bp, Homo sapiens
tgggtccaaataa

SEQ ID NO: 2651897 - DNA, 20 bp, Homo sapiens
tgggtccaggggatgggagg

SEQ ID NO: 2651898 - DNA, 18 bp, Homo sapiens
tgggtccaggggcccctc

SEQ ID NO: 2651899 - DNA, 14 bp, Homo sapiens
tgggtctgtgtctc

SEQ ID NO: 2651900 - DNA, 15 bp, Homo sapiens
tgggtctgtgtgtgt

SEQ ID NO: 2651901 - DNA, 14 bp, Homo sapiens
tgggtgacagagca

SEQ ID NO: 2651902 - DNA, 17 bp, Homo sapiens
tgggtgacagagcaaga

SEQ ID NO: 2651903 - DNA, 13 bp, Homo sapiens
tgggtgctcccta

SEQ ID NO: 2651904 - DNA, 19 bp, Homo sapiens
tgggtggaaccaggaacct

SEQ ID NO: 2651905 - DNA, 16 bp, Homo sapiens
tgggtggacaggggcc

SEQ ID NO: 2651906 - DNA, 16 bp, Homo sapiens
tgggtggagaagccat

SEQ ID NO: 2651907 - DNA, 21 bp, Homo sapiens
tgggtggagaagccattgtct

SEQ ID NO: 2651908 - DNA, 23 bp, Homo sapiens
tgggtggagaagccattgtcttc

SEQ ID NO: 2651909 - DNA, 17 bp, Homo sapiens
tgggtggcaccagcagc

SEQ ID NO: 2651910 - DNA, 20 bp, Homo sapiens
tgggtggcaccagcagcctg

SEQ ID NO: 2651911 - DNA, 15 bp, Homo sapiens
tgggtggcctcggga

SEQ ID NO: 2651912 - DNA, 12 bp, Homo sapiens
tgggtgggagag

SEQ ID NO: 2651913 - DNA, 16 bp, Homo sapiens
tgggtgggtggtgggg

SEQ ID NO: 2651914 - DNA, 14 bp, Homo sapiens
tgggtggtggatct

SEQ ID NO: 2651915 - DNA, 20 bp, Homo sapiens
tgggtgtatttattttcctc

SEQ ID NO: 2651916 - DNA, 21 bp, Homo sapiens
tgggtgtcaagagggtctgag

SEQ ID NO: 2651917 - DNA, 18 bp, Homo sapiens
tgggtgtccaaaggaaga

SEQ ID NO: 2651918 - DNA, 18 bp, Homo sapiens
tgggtgtgtgtagccaag

SEQ ID NO: 2651919 - DNA, 16 bp, Homo sapiens
tgggttagggaaaaca

SEQ ID NO: 2651920 - DNA, 21 bp, Homo sapiens
tgggttagggaaaacattcca

SEQ ID NO: 2651921 - DNA, 20 bp, Homo sapiens
tgggttcagaaatgctgcct

SEQ ID NO: 2651922 - DNA, 21 bp, Homo sapiens
tgggttcagaaatgctgcctg

SEQ ID NO: 2651923 - DNA, 16 bp, Homo sapiens
tgggttcattattgga

SEQ ID NO: 2651924 - DNA, 18 bp, Homo sapiens
tgggttcattattggaat

SEQ ID NO: 2651925 - DNA, 15 bp, Homo sapiens
tgggttggtgcacag

SEQ ID NO: 2651926 - DNA, 20 bp, Homo sapiens
tgggttggtgcacagtgatt

SEQ ID NO: 2651927 - DNA, 16 bp, Homo sapiens
tgggttggtgcttcta

SEQ ID NO: 2651928 - DNA, 14 bp, Homo sapiens
tgggtttggacccc

SEQ ID NO: 2651929 - DNA, 20 bp, Homo sapiens
tgggtttggaccccagctgg

SEQ ID NO: 2651930 - DNA, 21 bp, Homo sapiens
tgggtttggaccccagctggg

SEQ ID NO: 2651931 - DNA, 21 bp, Homo sapiens
tggtaaactatttgtctttca

SEQ ID NO: 2651932 - DNA, 17 bp, Homo sapiens
tggtaaagactggcttt

SEQ ID NO: 2651933 - DNA, 20 bp, Homo sapiens
tggtaaatttccccaacagt

SEQ ID NO: 2651934 - DNA, 13 bp, Homo sapiens
tggtaactgttaa

SEQ ID NO: 2651935 - DNA, 15 bp, Homo sapiens
tggtaccagataaaa

SEQ ID NO: 2651936 - DNA, 14 bp, Homo sapiens
tggtacccagccat

SEQ ID NO: 2651937 - DNA, 22 bp, Homo sapiens
tggtacccagccatctgcccag

SEQ ID NO: 2651938 - DNA, 16 bp, Homo sapiens
tggtaccctcctggct

SEQ ID NO: 2651939 - DNA, 17 bp, Homo sapiens
tggtactctcctagaga

SEQ ID NO: 2651940 - DNA, 22 bp, Homo sapiens
tggtacttttatgatgtatatt

SEQ ID NO: 2651941 - DNA, 20 bp, Homo sapiens
tggtagaattggagagtaaa

SEQ ID NO: 2651942 - DNA, 17 bp, Homo sapiens
tggtagggacttaaaaa

SEQ ID NO: 2651943 - DNA, 19 bp, Homo sapiens
tggtagggggaaaatgtgt

SEQ ID NO: 2651944 - DNA, 22 bp, Homo sapiens
tggtagtaatcacagttggcct

SEQ ID NO: 2651945 - DNA, 14 bp, Homo sapiens
tggtatagaaatgc

SEQ ID NO: 2651946 - DNA, 22 bp, Homo sapiens
tggtatagaaatgctggttttt

SEQ ID NO: 2651947 - DNA, 22 bp, Homo sapiens
tggtatcctgtgacatgtaaca

SEQ ID NO: 2651948 - DNA, 22 bp, Homo sapiens
tggtatctagacccatcttctt

SEQ ID NO: 2651949 - DNA, 14 bp, Homo sapiens
tggtatctgttctt

SEQ ID NO: 2651950 - DNA, 14 bp, Homo sapiens
tggtatgagctgag

SEQ ID NO: 2651951 - DNA, 15 bp, Homo sapiens
tggtatgtgtgtgta

SEQ ID NO: 2651952 - DNA, 17 bp, Homo sapiens
tggtatgtgtgtgtatg

SEQ ID NO: 2651953 - DNA, 19 bp, Homo sapiens
tggtatgtgtgtgtatgct

SEQ ID NO: 2651954 - DNA, 18 bp, Homo sapiens
tggtattacactgtattt

SEQ ID NO: 2651955 - DNA, 20 bp, Homo sapiens
tggtattacactgtatttgt

SEQ ID NO: 2651956 - DNA, 16 bp, Homo sapiens
tggtattcctgcctcc

SEQ ID NO: 2651957 - DNA, 21 bp, Homo sapiens
tggtcaaacaaactctctgaa

SEQ ID NO: 2651958 - DNA, 16 bp, Homo sapiens
tggtcaacctcctgga

SEQ ID NO: 2651959 - DNA, 18 bp, Homo sapiens
tggtcaacctcctggaca

SEQ ID NO: 2651960 - DNA, 22 bp, Homo sapiens
tggtcaagattttgaatgcttc

SEQ ID NO: 2651961 - DNA, 15 bp, Homo sapiens
tggtcacagcctcct

SEQ ID NO: 2651962 - DNA, 23 bp, Homo sapiens
tggtcacaggactctgcctcctc

SEQ ID NO: 2651963 - DNA, 21 bp, Homo sapiens
tggtcaccaaatcagctgcta

SEQ ID NO: 2651964 - DNA, 13 bp, Homo sapiens
tggtcactgctgt

SEQ ID NO: 2651965 - DNA, 15 bp, Homo sapiens
tggtcagatttgaac

SEQ ID NO: 2651966 - DNA, 16 bp, Homo sapiens
tggtcagatttgaact

SEQ ID NO: 2651967 - DNA, 22 bp, Homo sapiens
tggtcagccctagggtggagag

SEQ ID NO: 2651968 - DNA, 19 bp, Homo sapiens
tggtcagctcccttctctg

SEQ ID NO: 2651969 - DNA, 21 bp, Homo sapiens
tggtcatagcccagatcagct

SEQ ID NO: 2651970 - DNA, 16 bp, Homo sapiens
tggtccaggagaaggc

SEQ ID NO: 2651971 - DNA, 14 bp, Homo sapiens
tggtccagggttga

SEQ ID NO: 2651972 - DNA, 15 bp, Homo sapiens
tggtccatagagagc

SEQ ID NO: 2651973 - DNA, 16 bp, Homo sapiens
tggtccatagagagca

SEQ ID NO: 2651974 - DNA, 20 bp, Homo sapiens
tggtccatggaatgcttgaa

SEQ ID NO: 2651975 - DNA, 14 bp, Homo sapiens
tggtcccaccccac

SEQ ID NO: 2651976 - DNA, 16 bp, Homo sapiens
tggtcccaccccacac

SEQ ID NO: 2651977 - DNA, 15 bp, Homo sapiens
tggtcccatccaggc

SEQ ID NO: 2651978 - DNA, 16 bp, Homo sapiens
tggtcccccttccatg

SEQ ID NO: 2651979 - DNA, 13 bp, Homo sapiens
tggtccctgggag

SEQ ID NO: 2651980 - DNA, 19 bp, Homo sapiens
tggtccctgggaggaaatt

SEQ ID NO: 2651981 - DNA, 19 bp, Homo sapiens
tggtccggacactcctaga

SEQ ID NO: 2651982 - DNA, 15 bp, Homo sapiens
tggtcctcttgcctc

SEQ ID NO: 2651983 - DNA, 20 bp, Homo sapiens
tggtcctgagggtccccacc

SEQ ID NO: 2651984 - DNA, 23 bp, Homo sapiens
tggtcctgctgcagttgccagtc

SEQ ID NO: 2651985 - DNA, 14 bp, Homo sapiens
tggtcctggggctc

SEQ ID NO: 2651986 - DNA, 13 bp, Homo sapiens
tggtcgcccagga

SEQ ID NO: 2651987 - DNA, 15 bp, Homo sapiens
tggtcgcccaggaga

SEQ ID NO: 2651988 - DNA, 18 bp, Homo sapiens
tggtctcaaactcctgac

SEQ ID NO: 2651989 - DNA, 16 bp, Homo sapiens
tggtctcaaactcttg

SEQ ID NO: 2651990 - DNA, 23 bp, Homo sapiens
tggtctcctcagcctcctcatct

SEQ ID NO: 2651991 - DNA, 22 bp, Homo sapiens
tggtctccttggaaatccgtct

SEQ ID NO: 2651992 - DNA, 19 bp, Homo sapiens
tggtctctaggctggggaa

SEQ ID NO: 2651993 - DNA, 14 bp, Homo sapiens
tggtctgaatgttc

SEQ ID NO: 2651994 - DNA, 15 bp, Homo sapiens
tggtctgaatgttct

SEQ ID NO: 2651995 - DNA, 16 bp, Homo sapiens
tggtctgacccactgc

SEQ ID NO: 2651996 - DNA, 17 bp, Homo sapiens
tggtcttgagatgtctt

SEQ ID NO: 2651997 - DNA, 14 bp, Homo sapiens
tggtctttaatgaa

SEQ ID NO: 2651998 - DNA, 15 bp, Homo sapiens
tggtctttctggaga

SEQ ID NO: 2651999 - DNA, 20 bp, Homo sapiens
tggtctttcttacaaggaag

SEQ ID NO: 2652000 - DNA, 15 bp, Homo sapiens
tggtctttgtaagag

SEQ ID NO: 2652001 - DNA, 23 bp, Homo sapiens
tggtctttgtaagagtgtagaag

SEQ ID NO: 2652002 - DNA, 17 bp, Homo sapiens
tggtgacctctgcctga

SEQ ID NO: 2652003 - DNA, 19 bp, Homo sapiens
tggtgactttcctctttgg

SEQ ID NO: 2652004 - DNA, 22 bp, Homo sapiens
tggtgagtcttggcggcagcag

SEQ ID NO: 2652005 - DNA, 18 bp, Homo sapiens
tggtgccacaaataaaat

SEQ ID NO: 2652006 - DNA, 13 bp, Homo sapiens
tggtgccagcctt

SEQ ID NO: 2652007 - DNA, 21 bp, Homo sapiens
tggtgccagccttcctctgca

SEQ ID NO: 2652008 - DNA, 12 bp, Homo sapiens
tggtgcctggcc

SEQ ID NO: 2652009 - DNA, 14 bp, Homo sapiens
tggtgcctggcctg

SEQ ID NO: 2652010 - DNA, 19 bp, Homo sapiens
tggtgcctggcctggcaca

SEQ ID NO: 2652011 - DNA, 22 bp, Homo sapiens
tggtgcctggcctggcacacat

SEQ ID NO: 2652012 - DNA, 23 bp, Homo sapiens
tggtgcctggcctggcacacatc

SEQ ID NO: 2652013 - DNA, 16 bp, Homo sapiens
tggtgcgatctgggtt

SEQ ID NO: 2652014 - DNA, 18 bp, Homo sapiens
tggtgctggatattttca

SEQ ID NO: 2652015 - DNA, 14 bp, Homo sapiens
tggtgctgggactg

SEQ ID NO: 2652016 - DNA, 15 bp, Homo sapiens
tggtgctgggactga

SEQ ID NO: 2652017 - DNA, 16 bp, Homo sapiens
tggtgctgggactgag

SEQ ID NO: 2652018 - DNA, 21 bp, Homo sapiens
tggtgctgggactgagccagt

SEQ ID NO: 2652019 - DNA, 17 bp, Homo sapiens
tggtgctgtggccaggg

SEQ ID NO: 2652020 - DNA, 17 bp, Homo sapiens
tggtggacagtcctggg

SEQ ID NO: 2652021 - DNA, 13 bp, Homo sapiens
tggtggagggcca

SEQ ID NO: 2652022 - DNA, 16 bp, Homo sapiens
tggtggcaagagcccc

SEQ ID NO: 2652023 - DNA, 19 bp, Homo sapiens
tggtggcactgagcccccc

SEQ ID NO: 2652024 - DNA, 12 bp, Homo sapiens
tggtggcagctg

SEQ ID NO: 2652025 - DNA, 13 bp, Homo sapiens
tggtggcagctgc

SEQ ID NO: 2652026 - DNA, 18 bp, Homo sapiens
tggtggcagtgggagctg

SEQ ID NO: 2652027 - DNA, 13 bp, Homo sapiens
tggtggctgggtt

SEQ ID NO: 2652028 - DNA, 22 bp, Homo sapiens
tggtggggaggggcgctggccc

SEQ ID NO: 2652029 - DNA, 16 bp, Homo sapiens
tggtgggggcctcggt

SEQ ID NO: 2652030 - DNA, 18 bp, Homo sapiens
tggtgggggtagagctga

SEQ ID NO: 2652031 - DNA, 18 bp, Homo sapiens
tggtgggtccatgggcag

SEQ ID NO: 2652032 - DNA, 18 bp, Homo sapiens
tggtggtttcagaaatgt

SEQ ID NO: 2652033 - DNA, 19 bp, Homo sapiens
tggtggttttctgttcttt

SEQ ID NO: 2652034 - DNA, 14 bp, Homo sapiens
tggtgtaataagac

SEQ ID NO: 2652035 - DNA, 15 bp, Homo sapiens
tggtgtaataagaca

SEQ ID NO: 2652036 - DNA, 12 bp, Homo sapiens
tggtgtgaaggt

SEQ ID NO: 2652037 - DNA, 16 bp, Homo sapiens
tggtgttgtatgcctt

SEQ ID NO: 2652038 - DNA, 18 bp, Homo sapiens
tggttaagtctgttttat

SEQ ID NO: 2652039 - DNA, 16 bp, Homo sapiens
tgtctgcccttcaccc

SEQ ID NO: 2652040 - DNA, 19 bp, Homo sapiens
tgtctgctttctccattgt

SEQ ID NO: 2652041 - DNA, 15 bp, Homo sapiens
tgtctggattcccag

SEQ ID NO: 2652042 - DNA, 15 bp, Homo sapiens
tgtctggccaggcct

SEQ ID NO: 2652043 - DNA, 22 bp, Homo sapiens
tgtctggttttaacaatttcct

SEQ ID NO: 2652044 - DNA, 19 bp, Homo sapiens
tgtctgtacacgtgtcctg

SEQ ID NO: 2652045 - DNA, 20 bp, Homo sapiens
tgtctgtacacgtgtcctgt

SEQ ID NO: 2652046 - DNA, 23 bp, Homo sapiens
tgtctgtagctcctcaactcacc

SEQ ID NO: 2652047 - DNA, 21 bp, Homo sapiens
tgtctgtcccggggtcctgtg

SEQ ID NO: 2652048 - DNA, 21 bp, Homo sapiens
tgtctgtgtgcaagtgtgtgc

SEQ ID NO: 2652049 - DNA, 11 bp, Homo sapiens
tgtctgttaca

SEQ ID NO: 2652050 - DNA, 12 bp, Homo sapiens
tgtctgttacac

SEQ ID NO: 2652051 - DNA, 23 bp, Homo sapiens
tgtctgttaccatgtcactgtgg

SEQ ID NO: 2652052 - DNA, 13 bp, Homo sapiens
tgtctgttctaca

SEQ ID NO: 2652053 - DNA, 12 bp, Homo sapiens
tgtcttaattaa

SEQ ID NO: 2652054 - DNA, 14 bp, Homo sapiens
tgtcttaattatta

SEQ ID NO: 2652055 - DNA, 13 bp, Homo sapiens
tgtcttatatata

SEQ ID NO: 2652056 - DNA, 17 bp, Homo sapiens
tgtcttcatttcattgt

SEQ ID NO: 2652057 - DNA, 12 bp, Homo sapiens
tgtcttccataa

SEQ ID NO: 2652058 - DNA, 13 bp, Homo sapiens
tgtcttccataat

SEQ ID NO: 2652059 - DNA, 17 bp, Homo sapiens
tgtcttccataatgtat

SEQ ID NO: 2652060 - DNA, 14 bp, Homo sapiens
tgtcttcccagggt

SEQ ID NO: 2652061 - DNA, 16 bp, Homo sapiens
tgtcttcccagggtag

SEQ ID NO: 2652062 - DNA, 21 bp, Homo sapiens
tgtcttcccagggtagcccgc

SEQ ID NO: 2652063 - DNA, 19 bp, Homo sapiens
tgtcttcggaaaccttggt

SEQ ID NO: 2652064 - DNA, 18 bp, Homo sapiens
tgtcttcgtacagttctt

SEQ ID NO: 2652065 - DNA, 21 bp, Homo sapiens
tgtcttctcaggctctgccct

SEQ ID NO: 2652066 - DNA, 14 bp, Homo sapiens
tgtcttctccccag

SEQ ID NO: 2652067 - DNA, 13 bp, Homo sapiens
tgtcttctgcctg

SEQ ID NO: 2652068 - DNA, 15 bp, Homo sapiens
tgtcttgtgtttctt

SEQ ID NO: 2652069 - DNA, 21 bp, Homo sapiens
tgtctttaggcagcagctttt

SEQ ID NO: 2652070 - DNA, 17 bp, Homo sapiens
tgtctttggaccctgag

SEQ ID NO: 2652071 - DNA, 16 bp, Homo sapiens
tgtcttttcttgcatg

SEQ ID NO: 2652072 - DNA, 23 bp, Homo sapiens
tgtctttttctggactgaagcct

SEQ ID NO: 2652073 - DNA, 16 bp, Homo sapiens
tgtcttttttcactac

SEQ ID NO: 2652074 - DNA, 21 bp, Homo sapiens
tgtgaaagtcagatgcccaga

SEQ ID NO: 2652075 - DNA, 20 bp, Homo sapiens
tgtgaactaaactttcacac

SEQ ID NO: 2652076 - DNA, 14 bp, Homo sapiens
tgtgaactcagcca

SEQ ID NO: 2652077 - DNA, 15 bp, Homo sapiens
tgtgaactcagccaa

SEQ ID NO: 2652078 - DNA, 16 bp, Homo sapiens
tgtgaactcagccaag

SEQ ID NO: 2652079 - DNA, 19 bp, Homo sapiens
tgtgaactcagccaagcac

SEQ ID NO: 2652080 - DNA, 15 bp, Homo sapiens
tgtgaagttagaatt

SEQ ID NO: 2652081 - DNA, 20 bp, Homo sapiens
tgtgaagttagaattccttc

SEQ ID NO: 2652082 - DNA, 23 bp, Homo sapiens
tgtgaatatttccatatggattt

SEQ ID NO: 2652083 - DNA, 20 bp, Homo sapiens
tgtgaattagctcacttggt

SEQ ID NO: 2652084 - DNA, 13 bp, Homo sapiens
tgtgaattcagat

SEQ ID NO: 2652085 - DNA, 18 bp, Homo sapiens
tgtgaattgcctgcagag

SEQ ID NO: 2652086 - DNA, 23 bp, Homo sapiens
tgtgaatttcttcactgttgaaa

SEQ ID NO: 2652087 - DNA, 14 bp, Homo sapiens
tgtgacatgtaaca

SEQ ID NO: 2652088 - DNA, 22 bp, Homo sapiens
tgtgacccagcactgcccaaag

SEQ ID NO: 2652089 - DNA, 16 bp, Homo sapiens
tgtgacctgaagttca

SEQ ID NO: 2652090 - DNA, 13 bp, Homo sapiens
tgtgacctgaggg

SEQ ID NO: 2652091 - DNA, 15 bp, Homo sapiens
tgtgaccttagtgtt

SEQ ID NO: 2652092 - DNA, 19 bp, Homo sapiens
tgtgaccttagtgtttctg

SEQ ID NO: 2652093 - DNA, 22 bp, Homo sapiens
tgtgactatatagagatgtttt

SEQ ID NO: 2652094 - DNA, 23 bp, Homo sapiens
tgtgacttgcatcgtggagacag

SEQ ID NO: 2652095 - DNA, 14 bp, Homo sapiens
tgtgagaatcaaaa

SEQ ID NO: 2652096 - DNA, 15 bp, Homo sapiens
tgtgagacccccaca

SEQ ID NO: 2652097 - DNA, 16 bp, Homo sapiens
tgtgagacccccacac

SEQ ID NO: 2652098 - DNA, 14 bp, Homo sapiens
tgtgagcaagaagt

SEQ ID NO: 2652099 - DNA, 14 bp, Homo sapiens
tgtgagcagtgagt

SEQ ID NO: 2652100 - DNA, 12 bp, Homo sapiens
tgtgagcccctg

SEQ ID NO: 2652101 - DNA, 14 bp, Homo sapiens
tgtgagcccctggt

SEQ ID NO: 2652102 - DNA, 12 bp, Homo sapiens
tgtgaggaagcc

SEQ ID NO: 2652103 - DNA, 18 bp, Homo sapiens
tgtgaggaagccgctggg

SEQ ID NO: 2652104 - DNA, 13 bp, Homo sapiens
tgtgaggagctgc

SEQ ID NO: 2652105 - DNA, 14 bp, Homo sapiens
tgtgaggagctgct

SEQ ID NO: 2652106 - DNA, 17 bp, Homo sapiens
tgtgaggagctgctggc

SEQ ID NO: 2652107 - DNA, 14 bp, Homo sapiens
tgtgaggccagggc

SEQ ID NO: 2652108 - DNA, 13 bp, Homo sapiens
tgtgaggcccctg

SEQ ID NO: 2652109 - DNA, 18 bp, Homo sapiens
tgtgaggcctggccaggc

SEQ ID NO: 2652110 - DNA, 18 bp, Homo sapiens
tgtgaggggctctctcat

SEQ ID NO: 2652111 - DNA, 19 bp, Homo sapiens
tgtgagtaagagctggtgt

SEQ ID NO: 2652112 - DNA, 17 bp, Homo sapiens
tgtgagtcaccaagccc

SEQ ID NO: 2652113 - DNA, 19 bp, Homo sapiens
tgtgagtcaccaagcccag

SEQ ID NO: 2652114 - DNA, 23 bp, Homo sapiens
tgtgagtgtgtccaagtgtgtgt

SEQ ID NO: 2652115 - DNA, 20 bp, Homo sapiens
tgtgatcaggctatgtatgg

SEQ ID NO: 2652116 - DNA, 23 bp, Homo sapiens
tgtgatcccaagtgccagtcttg

SEQ ID NO: 2652117 - DNA, 16 bp, Homo sapiens
tgtgatgaatactgta

SEQ ID NO: 2652118 - DNA, 14 bp, Homo sapiens
tgtgatgaggggag

SEQ ID NO: 2652119 - DNA, 15 bp, Homo sapiens
tgtgatgccacacag

SEQ ID NO: 2652120 - DNA, 20 bp, Homo sapiens
tgtgatggggccctgcctcc

SEQ ID NO: 2652121 - DNA, 21 bp, Homo sapiens
tgtgattctaatgtcttcatt

SEQ ID NO: 2652122 - DNA, 15 bp, Homo sapiens
tgtgattgggaataa

SEQ ID NO: 2652123 - DNA, 19 bp, Homo sapiens
tgtgatttaatagtgttaa

SEQ ID NO: 2652124 - DNA, 17 bp, Homo sapiens
tgtgatttagaactgta

SEQ ID NO: 2652125 - DNA, 18 bp, Homo sapiens
tgtgatttagaactgtat

SEQ ID NO: 2652126 - DNA, 23 bp, Homo sapiens
tgtgatttcctactaacctgttc

SEQ ID NO: 2652127 - DNA, 23 bp, Homo sapiens
tgtgatttgactgtttttaccca

SEQ ID NO: 2652128 - DNA, 14 bp, Homo sapiens
tgtgattttaactc

SEQ ID NO: 2652129 - DNA, 20 bp, Homo sapiens
tgtgattttaactctgtctt

SEQ ID NO: 2652130 - DNA, 17 bp, Homo sapiens
tgtgcaagtatgtgagt

SEQ ID NO: 2652131 - DNA, 15 bp, Homo sapiens
tgtgcaagtgtctgt

SEQ ID NO: 2652132 - DNA, 12 bp, Homo sapiens
tgtgcaagtgtg

SEQ ID NO: 2652133 - DNA, 21 bp, Homo sapiens
tgtgcaagtgtgtgcatgtgt

SEQ ID NO: 2652134 - DNA, 15 bp, Homo sapiens
tgtgcacaattctgt

SEQ ID NO: 2652135 - DNA, 20 bp, Homo sapiens
tgtgcacatctgtgtcttgt

SEQ ID NO: 2652136 - DNA, 18 bp, Homo sapiens
tgtgcacatgtgtgcgtg

SEQ ID NO: 2652137 - DNA, 21 bp, Homo sapiens
tgtgcaccttaccaactttct

SEQ ID NO: 2652138 - DNA, 19 bp, Homo sapiens
tgtgcacgtggcatgtggc

SEQ ID NO: 2652139 - DNA, 17 bp, Homo sapiens
tgtgcactgtcactttg

SEQ ID NO: 2652140 - DNA, 19 bp, Homo sapiens
tgtgcagactcaataaaat

SEQ ID NO: 2652141 - DNA, 17 bp, Homo sapiens
tgtgcagtcctgggatg

SEQ ID NO: 2652142 - DNA, 20 bp, Homo sapiens
tgtgcagtcctgggatgtgg

SEQ ID NO: 2652143 - DNA, 14 bp, Homo sapiens
tgtgcagtgtagcc

SEQ ID NO: 2652144 - DNA, 12 bp, Homo sapiens
tgtgcagtgttg

SEQ ID NO: 2652145 - DNA, 19 bp, Homo sapiens
tgtgcagttctagtttgca

SEQ ID NO: 2652146 - DNA, 13 bp, Homo sapiens
tgtgcatattgta

SEQ ID NO: 2652147 - DNA, 19 bp, Homo sapiens
tgtgcatattgtacacttt

SEQ ID NO: 2652148 - DNA, 15 bp, Homo sapiens
tgtgcatgggagcaa

SEQ ID NO: 2652149 - DNA, 20 bp, Homo sapiens
tgtgcatgtatgtcttggac

SEQ ID NO: 2652150 - DNA, 15 bp, Homo sapiens
tgtgcatgtgtgtgc

SEQ ID NO: 2652151 - DNA, 20 bp, Homo sapiens
tgtgcattatctagatactg

SEQ ID NO: 2652152 - DNA, 21 bp, Homo sapiens
tgtgcattatctagatactgt

SEQ ID NO: 2652153 - DNA, 16 bp, Homo sapiens
tgtgccaatatgtatt

SEQ ID NO: 2652154 - DNA, 18 bp, Homo sapiens
tgtgccaatatgtattgt

SEQ ID NO: 2652155 - DNA, 20 bp, Homo sapiens
tgtgccacccaccagggcga

SEQ ID NO: 2652156 - DNA, 18 bp, Homo sapiens
tgtgccatagagtttaac

SEQ ID NO: 2652157 - DNA, 18 bp, Homo sapiens
tgtgccatagtcacatgg

SEQ ID NO: 2652158 - DNA, 21 bp, Homo sapiens
tgtgcccacatcccaggcttc

SEQ ID NO: 2652159 - DNA, 14 bp, Homo sapiens
tgtgccccatgcct

SEQ ID NO: 2652160 - DNA, 19 bp, Homo sapiens
tgtgccccatgcctgtcca

SEQ ID NO: 2652161 - DNA, 14 bp, Homo sapiens
tgtgccctcttgat

SEQ ID NO: 2652162 - DNA, 13 bp, Homo sapiens
tgtgccctggtgg

SEQ ID NO: 2652163 - DNA, 15 bp, Homo sapiens
tgtgccgaatgtgca

SEQ ID NO: 2652164 - DNA, 15 bp, Homo sapiens
tgtgccgacagaagg

SEQ ID NO: 2652165 - DNA, 15 bp, Homo sapiens
tgtgcctctgcctgt

SEQ ID NO: 2652166 - DNA, 16 bp, Homo sapiens
tgtgcctctgggactg

SEQ ID NO: 2652167 - DNA, 17 bp, Homo sapiens
tgtgcctctgggactgg

SEQ ID NO: 2652168 - DNA, 15 bp, Homo sapiens
tgtgcctgaccctac

SEQ ID NO: 2652169 - DNA, 13 bp, Homo sapiens
tgtgcctgcagcc

SEQ ID NO: 2652170 - DNA, 16 bp, Homo sapiens
tgtgccttttatagct

SEQ ID NO: 2652171 - DNA, 18 bp, Homo sapiens
tgtgccttttatagctat

SEQ ID NO: 2652172 - DNA, 16 bp, Homo sapiens
tgtgccttttgccatc

SEQ ID NO: 2652173 - DNA, 19 bp, Homo sapiens
tgtgcgcctacaggagtga

SEQ ID NO: 2652174 - DNA, 14 bp, Homo sapiens
tgtgcgtgaaacac

SEQ ID NO: 2652175 - DNA, 15 bp, Homo sapiens
tgtgcgtgaaacaca

SEQ ID NO: 2652176 - DNA, 20 bp, Homo sapiens
tgtgcgtgtgtccatgtgtg

SEQ ID NO: 2652177 - DNA, 21 bp, Homo sapiens
tgtgcgtgtgtccatgtgtgt

SEQ ID NO: 2652178 - DNA, 14 bp, Homo sapiens
tgtgctactttgcc

SEQ ID NO: 2652179 - DNA, 20 bp, Homo sapiens
tgtgctccgtgcctccacca

SEQ ID NO: 2652180 - DNA, 23 bp, Homo sapiens
tgtgctccgtgcctccaccacca

SEQ ID NO: 2652181 - DNA, 16 bp, Homo sapiens
tgtgctctggacaggc

SEQ ID NO: 2652182 - DNA, 19 bp, Homo sapiens
tgtgctgaattctgcaatg

SEQ ID NO: 2652183 - DNA, 18 bp, Homo sapiens
tgtgctgagtctgaaggc

SEQ ID NO: 2652184 - DNA, 17 bp, Homo sapiens
ttataacttaaaatatt

SEQ ID NO: 2652185 - DNA, 16 bp, Homo sapiens
ttataagcagatttaa

SEQ ID NO: 2652186 - DNA, 21 bp, Homo sapiens
ttataataaaaggaaaagcaa

SEQ ID NO: 2652187 - DNA, 14 bp, Homo sapiens
ttataattgtatca

SEQ ID NO: 2652188 - DNA, 16 bp, Homo sapiens
ttataattttcctaat

SEQ ID NO: 2652189 - DNA, 21 bp, Homo sapiens
ttataatttttttattactga

SEQ ID NO: 2652190 - DNA, 15 bp, Homo sapiens
ttatacaatatcatc

SEQ ID NO: 2652191 - DNA, 22 bp, Homo sapiens
ttatacagaccgaactgttgta

SEQ ID NO: 2652192 - DNA, 18 bp, Homo sapiens
ttatacagctcagctttt

SEQ ID NO: 2652193 - DNA, 13 bp, Homo sapiens
ttatacataaaca

SEQ ID NO: 2652194 - DNA, 15 bp, Homo sapiens
ttatacgtgtagcta

SEQ ID NO: 2652195 - DNA, 17 bp, Homo sapiens
ttatacgtgtagctata

SEQ ID NO: 2652196 - DNA, 12 bp, Homo sapiens
ttatactaagaa

SEQ ID NO: 2652197 - DNA, 22 bp, Homo sapiens
ttatactgtacttaataaattc

SEQ ID NO: 2652198 - DNA, 14 bp, Homo sapiens
ttatagaaagttca

SEQ ID NO: 2652199 - DNA, 23 bp, Homo sapiens
ttatagaatatttattacctctg

SEQ ID NO: 2652200 - DNA, 19 bp, Homo sapiens
ttatagagggccaagactt

SEQ ID NO: 2652201 - DNA, 17 bp, Homo sapiens
ttatagcaaacttggaa

SEQ ID NO: 2652202 - DNA, 17 bp, Homo sapiens
ttatagctattactgtc

SEQ ID NO: 2652203 - DNA, 17 bp, Homo sapiens
ttataggtcactcctgg

SEQ ID NO: 2652204 - DNA, 12 bp, Homo sapiens
ttatagtttgta

SEQ ID NO: 2652205 - DNA, 13 bp, Homo sapiens
ttatataaatgct

SEQ ID NO: 2652206 - DNA, 14 bp, Homo sapiens
ttatatatgtattt

SEQ ID NO: 2652207 - DNA, 12 bp, Homo sapiens
ttatatatgtga

SEQ ID NO: 2652208 - DNA, 15 bp, Homo sapiens
ttatatatttataac

SEQ ID NO: 2652209 - DNA, 15 bp, Homo sapiens
ttatatcagcctgag

SEQ ID NO: 2652210 - DNA, 15 bp, Homo sapiens
ttatatgaagaaaat

SEQ ID NO: 2652211 - DNA, 20 bp, Homo sapiens
ttatatggatgattcagaaa

SEQ ID NO: 2652212 - DNA, 22 bp, Homo sapiens
ttatatggatgattcagaaatt

SEQ ID NO: 2652213 - DNA, 15 bp, Homo sapiens
ttatattaaaatatg

SEQ ID NO: 2652214 - DNA, 18 bp, Homo sapiens
ttatatttagttatagtt

SEQ ID NO: 2652215 - DNA, 22 bp, Homo sapiens
ttatatttagttatagtttcag

SEQ ID NO: 2652216 - DNA, 15 bp, Homo sapiens
ttatcaaaactttct

SEQ ID NO: 2652217 - DNA, 16 bp, Homo sapiens
ttatcaaaactttctt

SEQ ID NO: 2652218 - DNA, 13 bp, Homo sapiens
ttatcaaatcagt

SEQ ID NO: 2652219 - DNA, 14 bp, Homo sapiens
ttatcaagtgtctt

SEQ ID NO: 2652220 - DNA, 16 bp, Homo sapiens
ttatcacatgtatgtt

SEQ ID NO: 2652221 - DNA, 18 bp, Homo sapiens
ttatcacatgtatgtttt

SEQ ID NO: 2652222 - DNA, 17 bp, Homo sapiens
ttatcaccagctgcctc

SEQ ID NO: 2652223 - DNA, 21 bp, Homo sapiens
ttatcaccgtgggctccctga

SEQ ID NO: 2652224 - DNA, 21 bp, Homo sapiens
ttatcagtcataactaaataa

SEQ ID NO: 2652225 - DNA, 16 bp, Homo sapiens
ttatcatccacattgt

SEQ ID NO: 2652226 - DNA, 18 bp, Homo sapiens
ttatcatccacattgttt

SEQ ID NO: 2652227 - DNA, 15 bp, Homo sapiens
ttatcatgtgtaatc

SEQ ID NO: 2652228 - DNA, 21 bp, Homo sapiens
ttatcatgtgtaatcaataaa

SEQ ID NO: 2652229 - DNA, 18 bp, Homo sapiens
ttatcattcaagtgtaaa

SEQ ID NO: 2652230 - DNA, 21 bp, Homo sapiens
ttatcctctgatctccatggc

SEQ ID NO: 2652231 - DNA, 19 bp, Homo sapiens
ttatcgaaataacaatgtt

SEQ ID NO: 2652232 - DNA, 21 bp, Homo sapiens
ttatcgaaataacaatgttaa

SEQ ID NO: 2652233 - DNA, 22 bp, Homo sapiens
ttatcgaaataacaatgttaag

SEQ ID NO: 2652234 - DNA, 17 bp, Homo sapiens
ttatcgggaacagtgtt

SEQ ID NO: 2652235 - DNA, 18 bp, Homo sapiens
ttatcgggagcagtgtct

SEQ ID NO: 2652236 - DNA, 19 bp, Homo sapiens
ttatcgggagcagtgtctt

SEQ ID NO: 2652237 - DNA, 23 bp, Homo sapiens
ttatcgggagcagtgtcttccat

SEQ ID NO: 2652238 - DNA, 20 bp, Homo sapiens
ttatctaatacctctgtgtg

SEQ ID NO: 2652239 - DNA, 19 bp, Homo sapiens
ttatctcagtcatgcataa

SEQ ID NO: 2652240 - DNA, 20 bp, Homo sapiens
ttatctcagtcatgcataaa

SEQ ID NO: 2652241 - DNA, 14 bp, Homo sapiens
ttatctctctgtgc

SEQ ID NO: 2652242 - DNA, 20 bp, Homo sapiens
ttatctgggcatagatgcag

SEQ ID NO: 2652243 - DNA, 12 bp, Homo sapiens
ttatctgtgaat

SEQ ID NO: 2652244 - DNA, 19 bp, Homo sapiens
ttatcttgggactgggttt

SEQ ID NO: 2652245 - DNA, 12 bp, Homo sapiens
ttatctttatat

SEQ ID NO: 2652246 - DNA, 18 bp, Homo sapiens
ttatgaaaggtttacatt

SEQ ID NO: 2652247 - DNA, 18 bp, Homo sapiens
ttatgaagaaaaaataca

SEQ ID NO: 2652248 - DNA, 14 bp, Homo sapiens
ttatgacagttata

SEQ ID NO: 2652249 - DNA, 16 bp, Homo sapiens
ttatgacatcacttgt

SEQ ID NO: 2652250 - DNA, 18 bp, Homo sapiens
ttatgacatcacttgtac

SEQ ID NO: 2652251 - DNA, 21 bp, Homo sapiens
ttatgacatcacttgtacaaa

SEQ ID NO: 2652252 - DNA, 13 bp, Homo sapiens
ttatgagggccac

SEQ ID NO: 2652253 - DNA, 20 bp, Homo sapiens
ttatgatgtgggtcaaggaa

SEQ ID NO: 2652254 - DNA, 21 bp, Homo sapiens
ttatgatgtgggtcaaggaat

SEQ ID NO: 2652255 - DNA, 22 bp, Homo sapiens
ttatgcaaggaaggaaagaaag

SEQ ID NO: 2652256 - DNA, 17 bp, Homo sapiens
ttatgcccagcgtttga

SEQ ID NO: 2652257 - DNA, 22 bp, Homo sapiens
ttatggaagattttaaattcac

SEQ ID NO: 2652258 - DNA, 14 bp, Homo sapiens
ttatggcacatcag

SEQ ID NO: 2652259 - DNA, 18 bp, Homo sapiens
ttatggcctcagctgcct

SEQ ID NO: 2652260 - DNA, 18 bp, Homo sapiens
ttatggctataggtgcta

SEQ ID NO: 2652261 - DNA, 13 bp, Homo sapiens
ttatggtgtttct

SEQ ID NO: 2652262 - DNA, 20 bp, Homo sapiens
ttatgtaaaaggccaaacct

SEQ ID NO: 2652263 - DNA, 22 bp, Homo sapiens
ttatgtaaaaggccaaacctct

SEQ ID NO: 2652264 - DNA, 17 bp, Homo sapiens
ttatgtaataatgtgaa

SEQ ID NO: 2652265 - DNA, 16 bp, Homo sapiens
ttatgtagatgtgcat

SEQ ID NO: 2652266 - DNA, 21 bp, Homo sapiens
ttatgtatatttaaaagaaag

SEQ ID NO: 2652267 - DNA, 18 bp, Homo sapiens
ttatgtgccgtgttattg

SEQ ID NO: 2652268 - DNA, 15 bp, Homo sapiens
ttatgtgtaaataca

SEQ ID NO: 2652269 - DNA, 12 bp, Homo sapiens
ttatgtgtgtat

SEQ ID NO: 2652270 - DNA, 18 bp, Homo sapiens
ttatgtgtgtatatgtat

SEQ ID NO: 2652271 - DNA, 22 bp, Homo sapiens
ttatgtgtgtatatgtatgtgt

SEQ ID NO: 2652272 - DNA, 22 bp, Homo sapiens
ttatgttaagggaagaattcca

SEQ ID NO: 2652273 - DNA, 19 bp, Homo sapiens
ttatgtttatataaatgct

SEQ ID NO: 2652274 - DNA, 20 bp, Homo sapiens
ttatgtttgccactttgcaa

SEQ ID NO: 2652275 - DNA, 16 bp, Homo sapiens
ttattaaaatcttaaa

SEQ ID NO: 2652276 - DNA, 20 bp, Homo sapiens
ttattaaaatgattgtaaaa

SEQ ID NO: 2652277 - DNA, 21 bp, Homo sapiens
ttattaaaatgattgtaaaat

SEQ ID NO: 2652278 - DNA, 21 bp, Homo sapiens
ttattaaacagatttttacaa

SEQ ID NO: 2652279 - DNA, 22 bp, Homo sapiens
ttattaaacgtatgcatgtgaa

SEQ ID NO: 2652280 - DNA, 18 bp, Homo sapiens
ttattaatgcactttcta

SEQ ID NO: 2652281 - DNA, 22 bp, Homo sapiens
ttattaattgttttgcactttt

SEQ ID NO: 2652282 - DNA, 17 bp, Homo sapiens
ttattagagtgtctttc

SEQ ID NO: 2652283 - DNA, 22 bp, Homo sapiens
ttattagccaggtaatgtgaat

SEQ ID NO: 2652284 - DNA, 20 bp, Homo sapiens
ttattagtaagaaaacatca

SEQ ID NO: 2652285 - DNA, 14 bp, Homo sapiens
ttattagtttacat

SEQ ID NO: 2652286 - DNA, 18 bp, Homo sapiens
ttattataattgtatcag

SEQ ID NO: 2652287 - DNA, 15 bp, Homo sapiens
ttattattgaaattg

SEQ ID NO: 2652288 - DNA, 15 bp, Homo sapiens
ttattcagcttcatt

SEQ ID NO: 2652289 - DNA, 17 bp, Homo sapiens
ttattcctgataataat

SEQ ID NO: 2652290 - DNA, 20 bp, Homo sapiens
ttattcctgataataattga

SEQ ID NO: 2652291 - DNA, 22 bp, Homo sapiens
ttattgacaataatttcaggtt

SEQ ID NO: 2652292 - DNA, 16 bp, Homo sapiens
ttattgcagtttatca

SEQ ID NO: 2652293 - DNA, 18 bp, Homo sapiens
ttattgcagtttatcatt

SEQ ID NO: 2652294 - DNA, 15 bp, Homo sapiens
ttattgcccacgctg

SEQ ID NO: 2652295 - DNA, 14 bp, Homo sapiens
ttattgtacctctc

SEQ ID NO: 2652296 - DNA, 17 bp, Homo sapiens
ttattgtacctctctta

SEQ ID NO: 2652297 - DNA, 14 bp, Homo sapiens
ttattgtataaact

SEQ ID NO: 2652298 - DNA, 16 bp, Homo sapiens
ttatttaaaagattca

SEQ ID NO: 2652299 - DNA, 18 bp, Homo sapiens
ttatttaaaagattcatt

SEQ ID NO: 2652300 - DNA, 14 bp, Homo sapiens
ttatttaaatttta

SEQ ID NO: 2652301 - DNA, 12 bp, Homo sapiens
ttatttaataac

SEQ ID NO: 2652302 - DNA, 14 bp, Homo sapiens
ttatttaattaaaa

SEQ ID NO: 2652303 - DNA, 17 bp, Homo sapiens
ttatttagggaactgct

SEQ ID NO: 2652304 - DNA, 21 bp, Homo sapiens
ttatttagggaactgcttgac

SEQ ID NO: 2652305 - DNA, 14 bp, Homo sapiens
ttatttatcagtga

SEQ ID NO: 2652306 - DNA, 13 bp, Homo sapiens
ttatttattaaga

SEQ ID NO: 2652307 - DNA, 14 bp, Homo sapiens
ttatttattaagat

SEQ ID NO: 2652308 - DNA, 15 bp, Homo sapiens
ttatttattaagatg

SEQ ID NO: 2652309 - DNA, 17 bp, Homo sapiens
ttatttcagaaatgtac

SEQ ID NO: 2652310 - DNA, 17 bp, Homo sapiens
ttatttccaaataaaat

SEQ ID NO: 2652311 - DNA, 19 bp, Homo sapiens
ttatttctaggaagaattt

SEQ ID NO: 2652312 - DNA, 22 bp, Homo sapiens
ttatttctcagactttggaaaa

SEQ ID NO: 2652313 - DNA, 16 bp, Homo sapiens
ttatttctctgatttg

SEQ ID NO: 2652314 - DNA, 19 bp, Homo sapiens
ttatttcttaaacaaatgt

SEQ ID NO: 2652315 - DNA, 14 bp, Homo sapiens
ttatttgacaaaat

SEQ ID NO: 2652316 - DNA, 18 bp, Homo sapiens
ttatttgcagagacagga

SEQ ID NO: 2652317 - DNA, 13 bp, Homo sapiens
ttatttgtgtaat

SEQ ID NO: 2652318 - DNA, 22 bp, Homo sapiens
ttatttgtgttttaatttaaac

SEQ ID NO: 2652319 - DNA, 18 bp, Homo sapiens
ttatttgttattttcagt

SEQ ID NO: 2652320 - DNA, 14 bp, Homo sapiens
ttattttcctcccc

SEQ ID NO: 2652321 - DNA, 17 bp, Homo sapiens
ttattttctttgaaatt

SEQ ID NO: 2652322 - DNA, 18 bp, Homo sapiens
ttatttttagacagagtc

SEQ ID NO: 2652323 - DNA, 23 bp, Homo sapiens
ttatttttgtttcttccaaagca

SEQ ID NO: 2652324 - DNA, 18 bp, Homo sapiens
ttattttttaagtattta

SEQ ID NO: 2652325 - DNA, 14 bp, Homo sapiens
ttattttttaatta

SEQ ID NO: 2652326 - DNA, 13 bp, Homo sapiens
ttattttttattg

SEQ ID NO: 2652327 - DNA, 16 bp, Homo sapiens
ttattttttcagaccg

SEQ ID NO: 2652328 - DNA, 16 bp, Homo sapiens
ttctgtgcctgaatat

SEQ ID NO: 2652329 - DNA, 13 bp, Homo sapiens
ttctgtggaaagt

SEQ ID NO: 2652330 - DNA, 19 bp, Homo sapiens
ttctgtggaaagtgtaaag

SEQ ID NO: 2652331 - DNA, 22 bp, Homo sapiens
ttctgtggaaagtgtaaagcat

SEQ ID NO: 2652332 - DNA, 23 bp, Homo sapiens
ttctgtggttttcccctccctgg

SEQ ID NO: 2652333 - DNA, 20 bp, Homo sapiens
ttctgtgtgttttcataata

SEQ ID NO: 2652334 - DNA, 16 bp, Homo sapiens
ttctgttctgtggaaa

SEQ ID NO: 2652335 - DNA, 13 bp, Homo sapiens
ttctgtttagata

SEQ ID NO: 2652336 - DNA, 11 bp, Homo sapiens
ttctgtttctt

SEQ ID NO: 2652337 - DNA, 16 bp, Homo sapiens
ttctgtttggaggagc

SEQ ID NO: 2652338 - DNA, 13 bp, Homo sapiens
ttcttaaagagtt

SEQ ID NO: 2652339 - DNA, 21 bp, Homo sapiens
ttcttaaatgggctactttgt

SEQ ID NO: 2652340 - DNA, 23 bp, Homo sapiens
ttcttaagacgtgattttgctgt

SEQ ID NO: 2652341 - DNA, 22 bp, Homo sapiens
ttcttaagtatgttattttctg

SEQ ID NO: 2652342 - DNA, 14 bp, Homo sapiens
ttcttaattgcact

SEQ ID NO: 2652343 - DNA, 15 bp, Homo sapiens
ttcttacaaacatgt

SEQ ID NO: 2652344 - DNA, 12 bp, Homo sapiens
ttcttacaagga

SEQ ID NO: 2652345 - DNA, 19 bp, Homo sapiens
ttcttagttctcactgttc

SEQ ID NO: 2652346 - DNA, 13 bp, Homo sapiens
ttcttataaatat

SEQ ID NO: 2652347 - DNA, 17 bp, Homo sapiens
ttcttataaatatgaag

SEQ ID NO: 2652348 - DNA, 22 bp, Homo sapiens
ttcttataaatatgaagctcac

SEQ ID NO: 2652349 - DNA, 21 bp, Homo sapiens
ttcttatacatttgataaagt

SEQ ID NO: 2652350 - DNA, 16 bp, Homo sapiens
ttcttatatatgtgaa

SEQ ID NO: 2652351 - DNA, 17 bp, Homo sapiens
ttcttcaacatcaatgt

SEQ ID NO: 2652352 - DNA, 14 bp, Homo sapiens
ttcttcacccagct

SEQ ID NO: 2652353 - DNA, 13 bp, Homo sapiens
ttcttcagagact

SEQ ID NO: 2652354 - DNA, 23 bp, Homo sapiens
ttcttcagccacctctctttttc

SEQ ID NO: 2652355 - DNA, 14 bp, Homo sapiens
ttcttcatgcaatg

SEQ ID NO: 2652356 - DNA, 20 bp, Homo sapiens
ttcttcccttttacatactg

SEQ ID NO: 2652357 - DNA, 22 bp, Homo sapiens
ttcttcccttttacatactgct

SEQ ID NO: 2652358 - DNA, 15 bp, Homo sapiens
ttcttcgggaagaga

SEQ ID NO: 2652359 - DNA, 23 bp, Homo sapiens
ttcttctcaggcatgaacatgta

SEQ ID NO: 2652360 - DNA, 21 bp, Homo sapiens
ttcttctttttgcttcaaaaa

SEQ ID NO: 2652361 - DNA, 20 bp, Homo sapiens
ttcttggggccctacacctt

SEQ ID NO: 2652362 - DNA, 18 bp, Homo sapiens
ttcttggttcataaatga

SEQ ID NO: 2652363 - DNA, 16 bp, Homo sapiens
ttcttggttggctggc

SEQ ID NO: 2652364 - DNA, 21 bp, Homo sapiens
ttcttgtaatttaaacaggcc

SEQ ID NO: 2652365 - DNA, 13 bp, Homo sapiens
ttcttgtattaag

SEQ ID NO: 2652366 - DNA, 22 bp, Homo sapiens
ttcttgtgccatagtcacatgg

SEQ ID NO: 2652367 - DNA, 21 bp, Homo sapiens
ttctttaagaattacaggttg

SEQ ID NO: 2652368 - DNA, 20 bp, Homo sapiens
ttctttcaagtgaatctaaa

SEQ ID NO: 2652369 - DNA, 20 bp, Homo sapiens
ttctttccattatgattctt

SEQ ID NO: 2652370 - DNA, 22 bp, Homo sapiens
ttctttctagtggtctttgtaa

SEQ ID NO: 2652371 - DNA, 22 bp, Homo sapiens
ttctttctggctatgcatttga

SEQ ID NO: 2652372 - DNA, 15 bp, Homo sapiens
ttctttgaaattgtt

SEQ ID NO: 2652373 - DNA, 11 bp, Homo sapiens
ttctttgaatg

SEQ ID NO: 2652374 - DNA, 22 bp, Homo sapiens
ttctttgataatgttaaatttg

SEQ ID NO: 2652375 - DNA, 13 bp, Homo sapiens
ttctttgatgtta

SEQ ID NO: 2652376 - DNA, 20 bp, Homo sapiens
ttctttgatgttaacacatt

SEQ ID NO: 2652377 - DNA, 22 bp, Homo sapiens
ttctttgatgttaacacatttt

SEQ ID NO: 2652378 - DNA, 14 bp, Homo sapiens
ttctttgcctgttc

SEQ ID NO: 2652379 - DNA, 16 bp, Homo sapiens
ttctttgttacaggca

SEQ ID NO: 2652380 - DNA, 21 bp, Homo sapiens
ttcttttaaaggggcagaaaa

SEQ ID NO: 2652381 - DNA, 21 bp, Homo sapiens
ttcttttctggaatgtaatca

SEQ ID NO: 2652382 - DNA, 14 bp, Homo sapiens
ttcttttggcttcc

SEQ ID NO: 2652383 - DNA, 22 bp, Homo sapiens
ttcttttggtaaagactggctt

SEQ ID NO: 2652384 - DNA, 23 bp, Homo sapiens
ttctttttgctgttgtttctaaa

SEQ ID NO: 2652385 - DNA, 22 bp, Homo sapiens
ttgaaaaaatagagcctgaggg

SEQ ID NO: 2652386 - DNA, 21 bp, Homo sapiens
ttgaaaaatgtgcaaaacagc

SEQ ID NO: 2652387 - DNA, 13 bp, Homo sapiens
ttgaaaaattcct

SEQ ID NO: 2652388 - DNA, 20 bp, Homo sapiens
ttgaaaaattcctattgtga

SEQ ID NO: 2652389 - DNA, 23 bp, Homo sapiens
ttgaaaacactgttctctgccct

SEQ ID NO: 2652390 - DNA, 13 bp, Homo sapiens
ttgaaaacttttc

SEQ ID NO: 2652391 - DNA, 13 bp, Homo sapiens
ttgaaaagctatt

SEQ ID NO: 2652392 - DNA, 19 bp, Homo sapiens
ttgaaaccaccttttatta

SEQ ID NO: 2652393 - DNA, 17 bp, Homo sapiens
ttgaaagaaaggactct

SEQ ID NO: 2652394 - DNA, 13 bp, Homo sapiens
ttgaaagaccttc

SEQ ID NO: 2652395 - DNA, 14 bp, Homo sapiens
ttgaaagagatggc

SEQ ID NO: 2652396 - DNA, 16 bp, Homo sapiens
ttgaaagcatccatgt

SEQ ID NO: 2652397 - DNA, 22 bp, Homo sapiens
ttgaaagctgtggccagcttgt

SEQ ID NO: 2652398 - DNA, 19 bp, Homo sapiens
ttgaaaggcattctctgaa

SEQ ID NO: 2652399 - DNA, 20 bp, Homo sapiens
ttgaaaggcattctctgaag

SEQ ID NO: 2652400 - DNA, 13 bp, Homo sapiens
ttgaaatctttta

SEQ ID NO: 2652401 - DNA, 23 bp, Homo sapiens
ttgaaattatgtatgtttacata

SEQ ID NO: 2652402 - DNA, 12 bp, Homo sapiens
ttgaaattttaa

SEQ ID NO: 2652403 - DNA, 21 bp, Homo sapiens
ttgaaatttttattaaattat

SEQ ID NO: 2652404 - DNA, 20 bp, Homo sapiens
ttgaacaagttgtttcattg

SEQ ID NO: 2652405 - DNA, 19 bp, Homo sapiens
ttgaacactcatgctgaaa

SEQ ID NO: 2652406 - DNA, 13 bp, Homo sapiens
ttgaacactgggg

SEQ ID NO: 2652407 - DNA, 15 bp, Homo sapiens
ttgaactgatagtta

SEQ ID NO: 2652408 - DNA, 20 bp, Homo sapiens
ttgaactgatagttactgtt

SEQ ID NO: 2652409 - DNA, 22 bp, Homo sapiens
ttgaactgatagttactgttgt

SEQ ID NO: 2652410 - DNA, 18 bp, Homo sapiens
ttgaacttaaataaatgt

SEQ ID NO: 2652411 - DNA, 16 bp, Homo sapiens
ttgaacttttttccac

SEQ ID NO: 2652412 - DNA, 13 bp, Homo sapiens
ttgaagacactga

SEQ ID NO: 2652413 - DNA, 22 bp, Homo sapiens
ttgaagacactgaaatatacac

SEQ ID NO: 2652414 - DNA, 23 bp, Homo sapiens
ttgaagccaagtcagctttgcct

SEQ ID NO: 2652415 - DNA, 21 bp, Homo sapiens
ttgaagccactgaagctggga

SEQ ID NO: 2652416 - DNA, 15 bp, Homo sapiens
ttgaaggatctgttt

SEQ ID NO: 2652417 - DNA, 19 bp, Homo sapiens
ttgaagggtaaagaagttt

SEQ ID NO: 2652418 - DNA, 21 bp, Homo sapiens
ttgaataaagcctgcttttta

SEQ ID NO: 2652419 - DNA, 19 bp, Homo sapiens
ttgaataaagttgaagcta

SEQ ID NO: 2652420 - DNA, 12 bp, Homo sapiens
ttgaataaataa

SEQ ID NO: 2652421 - DNA, 12 bp, Homo sapiens
ttgaataatggt

SEQ ID NO: 2652422 - DNA, 16 bp, Homo sapiens
ttgaatatcccctccc

SEQ ID NO: 2652423 - DNA, 17 bp, Homo sapiens
ttgaatatcccctccca

SEQ ID NO: 2652424 - DNA, 14 bp, Homo sapiens
ttgaatcaataata

SEQ ID NO: 2652425 - DNA, 23 bp, Homo sapiens
ttgaatcatgtagtatcaaatat

SEQ ID NO: 2652426 - DNA, 17 bp, Homo sapiens
ttgaatccatgcttggg

SEQ ID NO: 2652427 - DNA, 19 bp, Homo sapiens
ttgaatccatgcttgggtg

SEQ ID NO: 2652428 - DNA, 17 bp, Homo sapiens
ttgaatctatttaagta

SEQ ID NO: 2652429 - DNA, 15 bp, Homo sapiens
ttgaatctttccaat

SEQ ID NO: 2652430 - DNA, 12 bp, Homo sapiens
ttgaatgaaaaa

SEQ ID NO: 2652431 - DNA, 15 bp, Homo sapiens
ttgaatgaaaaattt

SEQ ID NO: 2652432 - DNA, 22 bp, Homo sapiens
ttgaatgaaaaatttaagcatt

SEQ ID NO: 2652433 - DNA, 20 bp, Homo sapiens
ttgaatggtgttgtatgcct

SEQ ID NO: 2652434 - DNA, 16 bp, Homo sapiens
ttgaatgtcttttgaa

SEQ ID NO: 2652435 - DNA, 22 bp, Homo sapiens
ttgaattatcttggttgaaaat

SEQ ID NO: 2652436 - DNA, 18 bp, Homo sapiens
ttgaattgtaactgttct

SEQ ID NO: 2652437 - DNA, 14 bp, Homo sapiens
ttgaattttctgtg

SEQ ID NO: 2652438 - DNA, 13 bp, Homo sapiens
ttgacaaactctc

SEQ ID NO: 2652439 - DNA, 22 bp, Homo sapiens
ttgacaagtcattttaacttta

SEQ ID NO: 2652440 - DNA, 18 bp, Homo sapiens
ttgacaataatttcaggt

SEQ ID NO: 2652441 - DNA, 17 bp, Homo sapiens
ttgacacttaaaaatgg

SEQ ID NO: 2652442 - DNA, 17 bp, Homo sapiens
ttgacagatcaagctgt

SEQ ID NO: 2652443 - DNA, 19 bp, Homo sapiens
ttgacagatcaagctgtga

SEQ ID NO: 2652444 - DNA, 19 bp, Homo sapiens
ttgacaggattattggaaa

SEQ ID NO: 2652445 - DNA, 15 bp, Homo sapiens
ttgacagttctgaag

SEQ ID NO: 2652446 - DNA, 17 bp, Homo sapiens
ttgacagttctgaagaa

SEQ ID NO: 2652447 - DNA, 18 bp, Homo sapiens
ttgacagttctgaagaat

SEQ ID NO: 2652448 - DNA, 14 bp, Homo sapiens
ttgacatgtggaaa

SEQ ID NO: 2652449 - DNA, 22 bp, Homo sapiens
ttgacatgtggaaagtgaattt

SEQ ID NO: 2652450 - DNA, 18 bp, Homo sapiens
ttgaccaagcaggaagct

SEQ ID NO: 2652451 - DNA, 21 bp, Homo sapiens
ttgaccagcagatcccagctc

SEQ ID NO: 2652452 - DNA, 19 bp, Homo sapiens
ttgaccattctccacctgc

SEQ ID NO: 2652453 - DNA, 24 bp, Homo sapiens
ttgaccattctccacctgccaggg

SEQ ID NO: 2652454 - DNA, 21 bp, Homo sapiens
ttgacctcaggtgatccaccc

SEQ ID NO: 2652455 - DNA, 22 bp, Homo sapiens
ttgacctgcctcccttcatgca

SEQ ID NO: 2652456 - DNA, 23 bp, Homo sapiens
ttgacctgcctcccttcatgcat

SEQ ID NO: 2652457 - DNA, 15 bp, Homo sapiens
ttgacgccatcccag

SEQ ID NO: 2652458 - DNA, 18 bp, Homo sapiens
ttgacgccatcccagccc

SEQ ID NO: 2652459 - DNA, 15 bp, Homo sapiens
ttgacggatgattgg

SEQ ID NO: 2652460 - DNA, 19 bp, Homo sapiens
ttgactagggattcaggct

SEQ ID NO: 2652461 - DNA, 21 bp, Homo sapiens
ttgactagggattcaggctgc

SEQ ID NO: 2652462 - DNA, 23 bp, Homo sapiens
ttgactccttgtggtttatgtca

SEQ ID NO: 2652463 - DNA, 13 bp, Homo sapiens
ttgactctgggga

SEQ ID NO: 2652464 - DNA, 20 bp, Homo sapiens
ttgactgaagatgcagctca

SEQ ID NO: 2652465 - DNA, 16 bp, Homo sapiens
ttgacttattttctct

SEQ ID NO: 2652466 - DNA, 20 bp, Homo sapiens
ttgacttgacagaacactgt

SEQ ID NO: 2652467 - DNA, 13 bp, Homo sapiens
ttgactttcaggt

SEQ ID NO: 2652468 - DNA, 15 bp, Homo sapiens
ttgactttcaggtac

SEQ ID NO: 2652469 - DNA, 10 bp, Homo sapiens
ttgagaaacc

SEQ ID NO: 2652470 - DNA, 15 bp, Homo sapiens
ttgagaaatgaataa

SEQ ID NO: 2652471 - DNA, 18 bp, Homo sapiens
ttgttttaaaattaaagc

SEQ ID NO: 2652472 - DNA, 20 bp, Homo sapiens
ttgttttaaaattaaagcta

SEQ ID NO: 2652473 - DNA, 19 bp, Homo sapiens
ttgttttatcatgacatgt

SEQ ID NO: 2652474 - DNA, 16 bp, Homo sapiens
ttgttttcagtgtaca

SEQ ID NO: 2652475 - DNA, 14 bp, Homo sapiens
ttgttttcattatc

SEQ ID NO: 2652476 - DNA, 18 bp, Homo sapiens
ttgttttcttctgtatgt

SEQ ID NO: 2652477 - DNA, 22 bp, Homo sapiens
ttgtttttccttgtatttaaat

SEQ ID NO: 2652478 - DNA, 17 bp, Homo sapiens
tttaaaaaaatttaagt

SEQ ID NO: 2652479 - DNA, 15 bp, Homo sapiens
tttaaaaaccttgta

SEQ ID NO: 2652480 - DNA, 13 bp, Homo sapiens
tttaaaaatcata

SEQ ID NO: 2652481 - DNA, 22 bp, Homo sapiens
tttaaaaatctaccttctgtag

SEQ ID NO: 2652482 - DNA, 20 bp, Homo sapiens
tttaaaaggatttttatctt

SEQ ID NO: 2652483 - DNA, 16 bp, Homo sapiens
tttaaaattgtgatgt

SEQ ID NO: 2652484 - DNA, 14 bp, Homo sapiens
tttaaactgtgtac

SEQ ID NO: 2652485 - DNA, 22 bp, Homo sapiens
tttaaactgtgtacataactga

SEQ ID NO: 2652486 - DNA, 13 bp, Homo sapiens
tttaaagaatgct

SEQ ID NO: 2652487 - DNA, 24 bp, Homo sapiens
tttaaagcttattaaaactcattt

SEQ ID NO: 2652488 - DNA, 17 bp, Homo sapiens
tttaaaggaaaaaatgt

SEQ ID NO: 2652489 - DNA, 18 bp, Homo sapiens
tttaaagtgattaaacgt

SEQ ID NO: 2652490 - DNA, 21 bp, Homo sapiens
tttaaataaagtatcatgcat

SEQ ID NO: 2652491 - DNA, 23 bp, Homo sapiens
tttaaataaagtatcatgcattc

SEQ ID NO: 2652492 - DNA, 20 bp, Homo sapiens
tttaaatacgcactacatgt

SEQ ID NO: 2652493 - DNA, 15 bp, Homo sapiens
tttaacaaaagcaag

SEQ ID NO: 2652494 - DNA, 16 bp, Homo sapiens
tttaacaaaagcaaga

SEQ ID NO: 2652495 - DNA, 20 bp, Homo sapiens
tttaacaataactactgtgt

SEQ ID NO: 2652496 - DNA, 17 bp, Homo sapiens
tttaacacctgatgtgt

SEQ ID NO: 2652497 - DNA, 23 bp, Homo sapiens
tttaacagggtctctagtgctgt

SEQ ID NO: 2652498 - DNA, 15 bp, Homo sapiens
tttaactagaattta

SEQ ID NO: 2652499 - DNA, 15 bp, Homo sapiens
tttaactcagatcac

SEQ ID NO: 2652500 - DNA, 23 bp, Homo sapiens
tttaactcagatcactactgcag

SEQ ID NO: 2652501 - DNA, 18 bp, Homo sapiens
tttaactttaagtttcag

SEQ ID NO: 2652502 - DNA, 18 bp, Homo sapiens
tttaagaaaaaggatgca

SEQ ID NO: 2652503 - DNA, 15 bp, Homo sapiens
tttaagacacttttt

SEQ ID NO: 2652504 - DNA, 15 bp, Homo sapiens
tttaagataaattat

SEQ ID NO: 2652505 - DNA, 23 bp, Homo sapiens
tttaagataataatatatgttta

SEQ ID NO: 2652506 - DNA, 12 bp, Homo sapiens
tttaagattttt

SEQ ID NO: 2652507 - DNA, 16 bp, Homo sapiens
tttaagatttttctca

SEQ ID NO: 2652508 - DNA, 18 bp, Homo sapiens
tttaagatttttctcaaa

SEQ ID NO: 2652509 - DNA, 13 bp, Homo sapiens
tttaagcattgtt

SEQ ID NO: 2652510 - DNA, 18 bp, Homo sapiens
tttaagctgtttccatag

SEQ ID NO: 2652511 - DNA, 11 bp, Homo sapiens
tttaaggaaaa

SEQ ID NO: 2652512 - DNA, 12 bp, Homo sapiens
tttaaggaaaca

SEQ ID NO: 2652513 - DNA, 20 bp, Homo sapiens
tttaaggatgcttgtacata

SEQ ID NO: 2652514 - DNA, 22 bp, Homo sapiens
tttaaggatgcttgtacataat

SEQ ID NO: 2652515 - DNA, 17 bp, Homo sapiens
tttaagggtttgtggaa

SEQ ID NO: 2652516 - DNA, 16 bp, Homo sapiens
tttaaggtttttactg

SEQ ID NO: 2652517 - DNA, 18 bp, Homo sapiens
tttaagtatttaggtttt

SEQ ID NO: 2652518 - DNA, 18 bp, Homo sapiens
tttaagtgcgtgtgtaga

SEQ ID NO: 2652519 - DNA, 15 bp, Homo sapiens
tttaagtgctgcatt

SEQ ID NO: 2652520 - DNA, 18 bp, Homo sapiens
tttaagtgctttgtaatg

SEQ ID NO: 2652521 - DNA, 18 bp, Homo sapiens
tttaagttacacattttt

SEQ ID NO: 2652522 - DNA, 15 bp, Homo sapiens
tttaagttgtttgca

SEQ ID NO: 2652523 - DNA, 15 bp, Homo sapiens
tttaataacattacc

SEQ ID NO: 2652524 - DNA, 14 bp, Homo sapiens
tttaatacagcagt

SEQ ID NO: 2652525 - DNA, 13 bp, Homo sapiens
tttaatatttaaa

SEQ ID NO: 2652526 - DNA, 15 bp, Homo sapiens
tttaatatttaaaca

SEQ ID NO: 2652527 - DNA, 18 bp, Homo sapiens
tttaatatttaaacagca

SEQ ID NO: 2652528 - DNA, 13 bp, Homo sapiens
tttaatcttcagt

SEQ ID NO: 2652529 - DNA, 23 bp, Homo sapiens
tttaatgaaagactgtacaaagt

SEQ ID NO: 2652530 - DNA, 22 bp, Homo sapiens
tttaatggccggctggaaatgc

SEQ ID NO: 2652531 - DNA, 22 bp, Homo sapiens
tttaatgggggtagcagctgga

SEQ ID NO: 2652532 - DNA, 15 bp, Homo sapiens
tttaatgtgctgtgt

SEQ ID NO: 2652533 - DNA, 16 bp, Homo sapiens
tttaatgtgctgtgta

SEQ ID NO: 2652534 - DNA, 19 bp, Homo sapiens
tttaatgtgctgtgtaaag

SEQ ID NO: 2652535 - DNA, 20 bp, Homo sapiens
tttaatgtgctgtgtaaagt

SEQ ID NO: 2652536 - DNA, 14 bp, Homo sapiens
tttaattattattc

SEQ ID NO: 2652537 - DNA, 11 bp, Homo sapiens
tttaattctct

SEQ ID NO: 2652538 - DNA, 18 bp, Homo sapiens
tttaattgttgtttcttt

SEQ ID NO: 2652539 - DNA, 15 bp, Homo sapiens
tttaattttgtattt

SEQ ID NO: 2652540 - DNA, 19 bp, Homo sapiens
tttaatttttttgagacag

SEQ ID NO: 2652541 - DNA, 15 bp, Homo sapiens
tttacaagccccccc

SEQ ID NO: 2652542 - DNA, 21 bp, Homo sapiens
tttacaatcagccacattcta

SEQ ID NO: 2652543 - DNA, 19 bp, Homo sapiens
tttacaattttttatcatg

SEQ ID NO: 2652544 - DNA, 15 bp, Homo sapiens
tttacagcactactc

SEQ ID NO: 2652545 - DNA, 16 bp, Homo sapiens
tttacagcactactct

SEQ ID NO: 2652546 - DNA, 21 bp, Homo sapiens
tttacagcactactctgtgcc

SEQ ID NO: 2652547 - DNA, 13 bp, Homo sapiens
tttacagctgcct

SEQ ID NO: 2652548 - DNA, 16 bp, Homo sapiens
tttacagctgcctgca

SEQ ID NO: 2652549 - DNA, 18 bp, Homo sapiens
tttacctaccacagtgtc

SEQ ID NO: 2652550 - DNA, 19 bp, Homo sapiens
tttacctaccacagtgtct

SEQ ID NO: 2652551 - DNA, 21 bp, Homo sapiens
tttacctgtgcgttactaatt

SEQ ID NO: 2652552 - DNA, 16 bp, Homo sapiens
tttaccttttaattaa

SEQ ID NO: 2652553 - DNA, 19 bp, Homo sapiens
tttaccttttttatacata

SEQ ID NO: 2652554 - DNA, 17 bp, Homo sapiens
tttacggacaccccctc

SEQ ID NO: 2652555 - DNA, 22 bp, Homo sapiens
tttactaagccacaagaaattt

SEQ ID NO: 2652556 - DNA, 14 bp, Homo sapiens
tttactaatagaca

SEQ ID NO: 2652557 - DNA, 17 bp, Homo sapiens
tttactaatagacaatt

SEQ ID NO: 2652558 - DNA, 18 bp, Homo sapiens
tttactaatagacaattt

SEQ ID NO: 2652559 - DNA, 23 bp, Homo sapiens
tttactactgtggaaaaatattt

SEQ ID NO: 2652560 - DNA, 21 bp, Homo sapiens
tttactcaaccctctcaggtg

SEQ ID NO: 2652561 - DNA, 21 bp, Homo sapiens
tttactccagtggtgaagaaa

SEQ ID NO: 2652562 - DNA, 18 bp, Homo sapiens
tttactgagcttctctgt

SEQ ID NO: 2652563 - DNA, 16 bp, Homo sapiens
tttactgcagctttgt

SEQ ID NO: 2652564 - DNA, 14 bp, Homo sapiens
tttactgtttgtta

SEQ ID NO: 2652565 - DNA, 22 bp, Homo sapiens
tttacttcttatacatttgata

SEQ ID NO: 2652566 - DNA, 18 bp, Homo sapiens
tttacttgcattgaatat

SEQ ID NO: 2652567 - DNA, 18 bp, Homo sapiens
tttacttgccattactca

SEQ ID NO: 2652568 - DNA, 18 bp, Homo sapiens
tttacttttaaacagtga

SEQ ID NO: 2652569 - DNA, 15 bp, Homo sapiens
tttagaaagaatatt

SEQ ID NO: 2652570 - DNA, 19 bp, Homo sapiens
tttagaagaagtgtgtcac

SEQ ID NO: 2652571 - DNA, 19 bp, Homo sapiens
tttagacaaatactcatgt

SEQ ID NO: 2652572 - DNA, 23 bp, Homo sapiens
tttagacaaatactcatgtgtat

SEQ ID NO: 2652573 - DNA, 19 bp, Homo sapiens
tttagaccctattgctgct

SEQ ID NO: 2652574 - DNA, 15 bp, Homo sapiens
tttagactgtagcct

SEQ ID NO: 2652575 - DNA, 18 bp, Homo sapiens
tttagagaactgtggccg

SEQ ID NO: 2652576 - DNA, 21 bp, Homo sapiens
tttagagatgaattaaattta

SEQ ID NO: 2652577 - DNA, 11 bp, Homo sapiens
tttagatgctg

SEQ ID NO: 2652578 - DNA, 19 bp, Homo sapiens
tttagattgaaaacttttc

SEQ ID NO: 2652579 - DNA, 15 bp, Homo sapiens
tttagccaaaccctt

SEQ ID NO: 2652580 - DNA, 15 bp, Homo sapiens
tttagccaccatctt

SEQ ID NO: 2652581 - DNA, 15 bp, Homo sapiens
tttagcctagttcat

SEQ ID NO: 2652582 - DNA, 13 bp, Homo sapiens
tttaggagatttt

SEQ ID NO: 2652583 - DNA, 23 bp, Homo sapiens
tttagggactcaatttctcccca

SEQ ID NO: 2652584 - DNA, 19 bp, Homo sapiens
tttagggagagtcatattt

SEQ ID NO: 2652585 - DNA, 21 bp, Homo sapiens
tttagggagagtcatattttg

SEQ ID NO: 2652586 - DNA, 16 bp, Homo sapiens
tttagtaaggctgtgt

SEQ ID NO: 2652587 - DNA, 17 bp, Homo sapiens
tttagttaaatttctgg

SEQ ID NO: 2652588 - DNA, 15 bp, Homo sapiens
tttagttatagtttc

SEQ ID NO: 2652589 - DNA, 17 bp, Homo sapiens
tttagttctttggaaat

SEQ ID NO: 2652590 - DNA, 11 bp, Homo sapiens
tttagtttttg

SEQ ID NO: 2652591 - DNA, 14 bp, Homo sapiens
tttataaactttac

SEQ ID NO: 2652592 - DNA, 19 bp, Homo sapiens
tttataactcatcataaaa

SEQ ID NO: 2652593 - DNA, 12 bp, Homo sapiens
tttatacataaa

SEQ ID NO: 2652594 - DNA, 17 bp, Homo sapiens
tttatagtttgtacatg

SEQ ID NO: 2652595 - DNA, 14 bp, Homo sapiens
tttatataaatgct

SEQ ID NO: 2652596 - DNA, 13 bp, Homo sapiens
tttatatatacag

SEQ ID NO: 2652597 - DNA, 15 bp, Homo sapiens
tttatatatacagta

SEQ ID NO: 2652598 - DNA, 15 bp, Homo sapiens
tttatatatttataa

SEQ ID NO: 2652599 - DNA, 14 bp, Homo sapiens
tttatatttagtga

SEQ ID NO: 2652600 - DNA, 22 bp, Homo sapiens
tttatcaaacagaattttaaag

SEQ ID NO: 2652601 - DNA, 14 bp, Homo sapiens
tttatcaaatcagt

SEQ ID NO: 2652602 - DNA, 18 bp, Homo sapiens
tttatcaatcagtataat

SEQ ID NO: 2652603 - DNA, 15 bp, Homo sapiens
tttatcacacttctg

SEQ ID NO: 2652604 - DNA, 22 bp, Homo sapiens
tttatcacatgtatgttttggt

SEQ ID NO: 2652605 - DNA, 13 bp, Homo sapiens
tttatcagtgaca

SEQ ID NO: 2652606 - DNA, 18 bp, Homo sapiens
tttatcagtgacagagtt

SEQ ID NO: 2652607 - DNA, 14 bp, Homo sapiens
tttatcatgacatg

SEQ ID NO: 2652608 - DNA, 15 bp, Homo sapiens
tttatcatgacatgt

SEQ ID NO: 2652609 - DNA, 16 bp, Homo sapiens
tttatcatgcatgtcc

SEQ ID NO: 2652610 - DNA, 16 bp, Homo sapiens
tttatcgtcactgctt

SEQ ID NO: 2652611 - DNA, 12 bp, Homo sapiens
tttatctttata

SEQ ID NO: 2652612 - DNA, 12 bp, Homo sapiens
tttatgagccag

SEQ ID NO: 2652613 - DNA, 17 bp, Homo sapiens
tttatgcaaggaaggaa

SEQ ID NO: 2652614 - DNA, 13 bp, Homo sapiens
tttatggcctcag

SEQ ID NO: 2652615 - DNA, 20 bp, Homo sapiens
tttatggcttttgtgcatta

SEQ ID NO: 2652616 - DNA, 15 bp, Homo sapiens
ttttacttttaaatg

SEQ ID NO: 2652617 - DNA, 12 bp, Homo sapiens
ttttacttttat

SEQ ID NO: 2652618 - DNA, 18 bp, Homo sapiens
ttttagacaaatactcat

SEQ ID NO: 2652619 - DNA, 22 bp, Homo sapiens
ttttagacaaatactcatgtgt

SEQ ID NO: 2652620 - DNA, 23 bp, Homo sapiens
ttttagacaaatactcatgtgta

SEQ ID NO: 2652621 - DNA, 21 bp, Homo sapiens
ttttagaccctattgctgctt

SEQ ID NO: 2652622 - DNA, 19 bp, Homo sapiens
ttttagatcaaatacttta

SEQ ID NO: 2652623 - DNA, 20 bp, Homo sapiens
ttttagatgagattgtttta

SEQ ID NO: 2652624 - DNA, 22 bp, Homo sapiens
ttttagcatgtgtttggttctg

SEQ ID NO: 2652625 - DNA, 19 bp, Homo sapiens
ttttagcctagttcatcca

SEQ ID NO: 2652626 - DNA, 20 bp, Homo sapiens
ttttagctgatgaacttatt

SEQ ID NO: 2652627 - DNA, 22 bp, Homo sapiens
ttttagctggtggcaataaata

SEQ ID NO: 2652628 - DNA, 18 bp, Homo sapiens
ttttaggtctcttcccct

SEQ ID NO: 2652629 - DNA, 13 bp, Homo sapiens
ttttagttttagt

SEQ ID NO: 2652630 - DNA, 20 bp, Homo sapiens
ttttataaatcgcttttgat

SEQ ID NO: 2652631 - DNA, 12 bp, Homo sapiens
ttttatactgta

SEQ ID NO: 2652632 - DNA, 15 bp, Homo sapiens
ttttatactgtactt

SEQ ID NO: 2652633 - DNA, 11 bp, Homo sapiens
ttttatattta

SEQ ID NO: 2652634 - DNA, 13 bp, Homo sapiens
ttttatatttagt

SEQ ID NO: 2652635 - DNA, 23 bp, Homo sapiens
ttttatatttagttatagtttca

SEQ ID NO: 2652636 - DNA, 16 bp, Homo sapiens
ttttatcatgcatgtc

SEQ ID NO: 2652637 - DNA, 23 bp, Homo sapiens
ttttatctccccttcacatgcat

SEQ ID NO: 2652638 - DNA, 21 bp, Homo sapiens
ttttatggcttttgtgcatta

SEQ ID NO: 2652639 - DNA, 14 bp, Homo sapiens
ttttattaatgcac

SEQ ID NO: 2652640 - DNA, 19 bp, Homo sapiens
ttttattaatgcactttct

SEQ ID NO: 2652641 - DNA, 14 bp, Homo sapiens
ttttattcaagtta

SEQ ID NO: 2652642 - DNA, 13 bp, Homo sapiens
ttttattccacat

SEQ ID NO: 2652643 - DNA, 15 bp, Homo sapiens
ttttatttgcatgtg

SEQ ID NO: 2652644 - DNA, 18 bp, Homo sapiens
ttttatttttctaaaaaa

SEQ ID NO: 2652645 - DNA, 17 bp, Homo sapiens
ttttatttttttctacc

SEQ ID NO: 2652646 - DNA, 14 bp, Homo sapiens
ttttcaaaatggag

SEQ ID NO: 2652647 - DNA, 15 bp, Homo sapiens
ttttcaagaaactga

SEQ ID NO: 2652648 - DNA, 14 bp, Homo sapiens
ttttcaatatttat

SEQ ID NO: 2652649 - DNA, 14 bp, Homo sapiens
ttttcaattttgca

SEQ ID NO: 2652650 - DNA, 18 bp, Homo sapiens
ttttcacattcttataaa

SEQ ID NO: 2652651 - DNA, 22 bp, Homo sapiens
ttttcacattcttataaatatg

SEQ ID NO: 2652652 - DNA, 19 bp, Homo sapiens
ttttcaccagatttgctaa

SEQ ID NO: 2652653 - DNA, 13 bp, Homo sapiens
ttttcaccccacc

SEQ ID NO: 2652654 - DNA, 18 bp, Homo sapiens
ttttcactttgtgattat

SEQ ID NO: 2652655 - DNA, 15 bp, Homo sapiens
ttttcagaaatatgt

SEQ ID NO: 2652656 - DNA, 18 bp, Homo sapiens
ttttcagaacctcttccc

SEQ ID NO: 2652657 - DNA, 11 bp, Homo sapiens
ttttcagaccg

SEQ ID NO: 2652658 - DNA, 13 bp, Homo sapiens
ttttcagaccgaa

SEQ ID NO: 2652659 - DNA, 15 bp, Homo sapiens
ttttcagatataaaa

SEQ ID NO: 2652660 - DNA, 19 bp, Homo sapiens
ttttcagcaaactcttttc

SEQ ID NO: 2652661 - DNA, 23 bp, Homo sapiens
ttttcagtagggctacaaaacct

SEQ ID NO: 2652662 - DNA, 23 bp, Homo sapiens
ttttcagtcatataaaagctatg

SEQ ID NO: 2652663 - DNA, 12 bp, Homo sapiens
ttttcagttttc

SEQ ID NO: 2652664 - DNA, 18 bp, Homo sapiens
ttttcatacttttacctt

SEQ ID NO: 2652665 - DNA, 21 bp, Homo sapiens
ttttcatagattgagaagttt

SEQ ID NO: 2652666 - DNA, 14 bp, Homo sapiens
ttttcatattgtgc

SEQ ID NO: 2652667 - DNA, 14 bp, Homo sapiens
ttttcatctgggaa

SEQ ID NO: 2652668 - DNA, 15 bp, Homo sapiens
ttttcatttgcctat

SEQ ID NO: 2652669 - DNA, 16 bp, Homo sapiens
ttttcatttgcctatt

SEQ ID NO: 2652670 - DNA, 15 bp, Homo sapiens
ttttccaaaaaaata

SEQ ID NO: 2652671 - DNA, 20 bp, Homo sapiens
ttttccaaaagtggcctctt

SEQ ID NO: 2652672 - DNA, 13 bp, Homo sapiens
ttttccactttgt

SEQ ID NO: 2652673 - DNA, 14 bp, Homo sapiens
ttttccatgaaaac

SEQ ID NO: 2652674 - DNA, 19 bp, Homo sapiens
ttttccatgaaaatgcaac

SEQ ID NO: 2652675 - DNA, 20 bp, Homo sapiens
ttttccatgcgtgtttctga

SEQ ID NO: 2652676 - DNA, 19 bp, Homo sapiens
ttttcccccttttctgcat

SEQ ID NO: 2652677 - DNA, 13 bp, Homo sapiens
ttttcctatttgt

SEQ ID NO: 2652678 - DNA, 21 bp, Homo sapiens
ttttcctcccttgggttctga

SEQ ID NO: 2652679 - DNA, 19 bp, Homo sapiens
ttttcctccgggagagggg

SEQ ID NO: 2652680 - DNA, 21 bp, Homo sapiens
ttttcctttaaaaaaatttaa

SEQ ID NO: 2652681 - DNA, 23 bp, Homo sapiens
ttttcgaacattctttgcctggt

SEQ ID NO: 2652682 - DNA, 19 bp, Homo sapiens
ttttcgaagctcagcccac

SEQ ID NO: 2652683 - DNA, 21 bp, Homo sapiens
ttttctagcccgaatacaaac

SEQ ID NO: 2652684 - DNA, 23 bp, Homo sapiens
ttttctattgttactctggttct

SEQ ID NO: 2652685 - DNA, 19 bp, Homo sapiens
ttttctcaaagttttgaaa

SEQ ID NO: 2652686 - DNA, 10 bp, Homo sapiens
ttttctgagc

SEQ ID NO: 2652687 - DNA, 16 bp, Homo sapiens
ttttctgagcccgggc

SEQ ID NO: 2652688 - DNA, 14 bp, Homo sapiens
ttttctgattgtaa

SEQ ID NO: 2652689 - DNA, 16 bp, Homo sapiens
ttttctgcttttgaaa

SEQ ID NO: 2652690 - DNA, 21 bp, Homo sapiens
ttttctggaatacatgaaata

SEQ ID NO: 2652691 - DNA, 18 bp, Homo sapiens
ttttctggaatgtaatca

SEQ ID NO: 2652692 - DNA, 21 bp, Homo sapiens
ttttctggaggttgataactt

SEQ ID NO: 2652693 - DNA, 23 bp, Homo sapiens
ttttctggaggttgataactttg

SEQ ID NO: 2652694 - DNA, 17 bp, Homo sapiens
ttttctgtctctgcctc

SEQ ID NO: 2652695 - DNA, 12 bp, Homo sapiens
ttttctgttata

SEQ ID NO: 2652696 - DNA, 23 bp, Homo sapiens
ttttctgttgaagtttacaatca

SEQ ID NO: 2652697 - DNA, 14 bp, Homo sapiens
ttttcttaaataat

SEQ ID NO: 2652698 - DNA, 21 bp, Homo sapiens
ttttcttcaacatcaatgttc

SEQ ID NO: 2652699 - DNA, 15 bp, Homo sapiens
ttttcttcactgtcc

SEQ ID NO: 2652700 - DNA, 16 bp, Homo sapiens
ttttctttaaaagaat

SEQ ID NO: 2652701 - DNA, 19 bp, Homo sapiens
ttttctttgtgtagctttg

SEQ ID NO: 2652702 - DNA, 18 bp, Homo sapiens
ttttgaaaaattcctatt

SEQ ID NO: 2652703 - DNA, 23 bp, Homo sapiens
ttttgaaaagctattagccagga

SEQ ID NO: 2652704 - DNA, 17 bp, Homo sapiens
ttttgaaattaacctct

SEQ ID NO: 2652705 - DNA, 13 bp, Homo sapiens
ttttgaatgttat

SEQ ID NO: 2652706 - DNA, 16 bp, Homo sapiens
ttttgacactatatct

SEQ ID NO: 2652707 - DNA, 19 bp, Homo sapiens
ttttgacagtgttgaaaat

SEQ ID NO: 2652708 - DNA, 17 bp, Homo sapiens
ttttgacttaaagcaga

SEQ ID NO: 2652709 - DNA, 15 bp, Homo sapiens
ttttgaggagcccca

SEQ ID NO: 2652710 - DNA, 17 bp, Homo sapiens
ttttgatccaagctggt

SEQ ID NO: 2652711 - DNA, 20 bp, Homo sapiens
ttttgatgtttgtggcctca

SEQ ID NO: 2652712 - DNA, 18 bp, Homo sapiens
ttttgattattgtattta

SEQ ID NO: 2652713 - DNA, 20 bp, Homo sapiens
ttttgatttaatgttttcag

SEQ ID NO: 2652714 - DNA, 15 bp, Homo sapiens
ttttgatttatgcat

SEQ ID NO: 2652715 - DNA, 13 bp, Homo sapiens
ttttgcaaaattt

SEQ ID NO: 2652716 - DNA, 10 bp, Homo sapiens
ttttgcacag

SEQ ID NO: 2652717 - DNA, 17 bp, Homo sapiens
ttttgcaccccatgctg

SEQ ID NO: 2652718 - DNA, 21 bp, Homo sapiens
ttttgcaccccatgctgttga

SEQ ID NO: 2652719 - DNA, 16 bp, Homo sapiens
ttttgcacccctccca

SEQ ID NO: 2652720 - DNA, 12 bp, Homo sapiens
ttttgcactttt

SEQ ID NO: 2652721 - DNA, 14 bp, Homo sapiens
ttttgcagcagtga

SEQ ID NO: 2652722 - DNA, 21 bp, Homo sapiens
ttttgcagcccagacaaatgt

SEQ ID NO: 2652723 - DNA, 13 bp, Homo sapiens
ttttgcaggagca

SEQ ID NO: 2652724 - DNA, 18 bp, Homo sapiens
ttttgcatttaaaacaga

SEQ ID NO: 2652725 - DNA, 18 bp, Homo sapiens
ttttgcccttcacagtgt

SEQ ID NO: 2652726 - DNA, 15 bp, Homo sapiens
ttttgcctcttttct

SEQ ID NO: 2652727 - DNA, 17 bp, Homo sapiens
ttttgctattgtaaata

SEQ ID NO: 2652728 - DNA, 18 bp, Homo sapiens
ttttgctgtttcctttta

SEQ ID NO: 2652729 - DNA, 16 bp, Homo sapiens
ttttggccaaagtgtt

SEQ ID NO: 2652730 - DNA, 18 bp, Homo sapiens
ttttggggaagtgaggaa

SEQ ID NO: 2652731 - DNA, 19 bp, Homo sapiens
ttttggggttgtgttgtca

SEQ ID NO: 2652732 - DNA, 19 bp, Homo sapiens
ttttggtaaagactggctt

SEQ ID NO: 2652733 - DNA, 15 bp, Homo sapiens
ttttggttgaataaa

SEQ ID NO: 2652734 - DNA, 20 bp, Homo sapiens
ttttggttgtattctttgat

SEQ ID NO: 2652735 - DNA, 22 bp, Homo sapiens
ttttggttgtcaatattaaata

SEQ ID NO: 2652736 - DNA, 15 bp, Homo sapiens
ttttgtaaagatgcc

SEQ ID NO: 2652737 - DNA, 21 bp, Homo sapiens
ttttgtaaagatgccgggttt

SEQ ID NO: 2652738 - DNA, 13 bp, Homo sapiens
ttttgtaaagtgt

SEQ ID NO: 2652739 - DNA, 20 bp, Homo sapiens
ttttgtaagatgctgggttg

SEQ ID NO: 2652740 - DNA, 17 bp, Homo sapiens
ttttgtactgtaaagag

SEQ ID NO: 2652741 - DNA, 23 bp, Homo sapiens
ttttgtaggggtcaaagaaatgc

SEQ ID NO: 2652742 - DNA, 16 bp, Homo sapiens
ttttgtatagtaaagt

SEQ ID NO: 2652743 - DNA, 14 bp, Homo sapiens
ttttgtatctacat

SEQ ID NO: 2652744 - DNA, 18 bp, Homo sapiens
ttttgtatttttaatggg

SEQ ID NO: 2652745 - DNA, 19 bp, Homo sapiens
ttttgtgaatggattggat

SEQ ID NO: 2652746 - DNA, 16 bp, Homo sapiens
ttttgttacctttatg

SEQ ID NO: 2652747 - DNA, 12 bp, Homo sapiens
ttttgtttcata

SEQ ID NO: 2652748 - DNA, 16 bp, Homo sapiens
tttttaaataaaagca

SEQ ID NO: 2652749 - DNA, 20 bp, Homo sapiens
tttttaaattttatttcctg

SEQ ID NO: 2652750 - DNA, 12 bp, Homo sapiens
tttttaagaaaa

SEQ ID NO: 2652751 - DNA, 17 bp, Homo sapiens
tttttaagtgctgcatt

SEQ ID NO: 2652752 - DNA, 22 bp, Homo sapiens
tttttaagtgctgcatttaaaa

SEQ ID NO: 2652753 - DNA, 18 bp, Homo sapiens
tttttaagttacacattt

SEQ ID NO: 2652754 - DNA, 18 bp, Homo sapiens
tttttaataaaaaggcac

SEQ ID NO: 2652755 - DNA, 13 bp, Homo sapiens
tttttaatcatga

SEQ ID NO: 2652756 - DNA, 20 bp, Homo sapiens
tttttaattgttgtttcttt

SEQ ID NO: 2652757 - DNA, 21 bp, Homo sapiens
tttttaatttattattgaaat

SEQ ID NO: 2652758 - DNA, 16 bp, Homo sapiens
tttttaatttatttat

SEQ ID NO: 2652759 - DNA, 18 bp, Homo sapiens
tttttacaagttttaaat

SEQ ID NO: 2652760 - DNA, 19 bp, Homo sapiens
tttttacaagttttaaata

SEQ ID NO: 2652761 - DNA, 12 bp, Homo sapiens
aaaatcatgaga

SEQ ID NO: 2652762 - DNA, 17 bp, Homo sapiens
aaaatcatggaatggtt

SEQ ID NO: 2652763 - DNA, 18 bp, Homo sapiens
aaaatcatgtacatttct

SEQ ID NO: 2652764 - DNA, 13 bp, Homo sapiens
aaaatccttgctt

SEQ ID NO: 2652765 - DNA, 20 bp, Homo sapiens
aaaatccttgcttatgacat

SEQ ID NO: 2652766 - DNA, 15 bp, Homo sapiens
aaaatctaatattaa

SEQ ID NO: 2652767 - DNA, 15 bp, Homo sapiens
aaaatctcaaatttc

SEQ ID NO: 2652768 - DNA, 18 bp, Homo sapiens
aaaatctcaaatttctaa

SEQ ID NO: 2652769 - DNA, 13 bp, Homo sapiens
aaaatctgaaaat

SEQ ID NO: 2652770 - DNA, 22 bp, Homo sapiens
aaaatgaaagcatgtctcaata

SEQ ID NO: 2652771 - DNA, 15 bp, Homo sapiens
aaaatgaatcctaca

SEQ ID NO: 2652772 - DNA, 18 bp, Homo sapiens
aaaatgacagatgttgaa

SEQ ID NO: 2652773 - DNA, 21 bp, Homo sapiens
aaaatgagcctggcaagaatg

SEQ ID NO: 2652774 - DNA, 18 bp, Homo sapiens
aaaatgaggttcaactgt

SEQ ID NO: 2652775 - DNA, 20 bp, Homo sapiens
aaaatgcaaatcctatgtga

SEQ ID NO: 2652776 - DNA, 17 bp, Homo sapiens
aaaatgccaagacatga

SEQ ID NO: 2652777 - DNA, 12 bp, Homo sapiens
aaaatgcctttg

SEQ ID NO: 2652778 - DNA, 17 bp, Homo sapiens
aaaatgcctttgagaca

SEQ ID NO: 2652779 - DNA, 16 bp, Homo sapiens
aaaatgctgaacattg

SEQ ID NO: 2652780 - DNA, 20 bp, Homo sapiens
aaaatgctgaacattgcata

SEQ ID NO: 2652781 - DNA, 21 bp, Homo sapiens
aaaatgctgtattagtcacag

SEQ ID NO: 2652782 - DNA, 22 bp, Homo sapiens
aaaatgggacttcttttcacat

SEQ ID NO: 2652783 - DNA, 16 bp, Homo sapiens
aaaatggtttaaatgg

SEQ ID NO: 2652784 - DNA, 21 bp, Homo sapiens
aaaatgtaagctgtttatttt

SEQ ID NO: 2652785 - DNA, 10 bp, Homo sapiens
aaaatgtact

SEQ ID NO: 2652786 - DNA, 17 bp, Homo sapiens
aaaatgtatatgcactt

SEQ ID NO: 2652787 - DNA, 21 bp, Homo sapiens
aaaatgtctgtagctcctcaa

SEQ ID NO: 2652788 - DNA, 18 bp, Homo sapiens
aaaatgtctgttaactta

SEQ ID NO: 2652789 - DNA, 19 bp, Homo sapiens
aaaatgtgacccagatcct

SEQ ID NO: 2652790 - DNA, 16 bp, Homo sapiens
aaaatgttcagaaggt

SEQ ID NO: 2652791 - DNA, 15 bp, Homo sapiens
aaaatgttggattta

SEQ ID NO: 2652792 - DNA, 17 bp, Homo sapiens
aaaattaaatcaacctt

SEQ ID NO: 2652793 - DNA, 15 bp, Homo sapiens
aaaattagccaagtg

SEQ ID NO: 2652794 - DNA, 18 bp, Homo sapiens
aaaattagccgggcgtgg

SEQ ID NO: 2652795 - DNA, 19 bp, Homo sapiens
aaaattaggatttcatgat

SEQ ID NO: 2652796 - DNA, 22 bp, Homo sapiens
aaaattatagatgggaatgaag

SEQ ID NO: 2652797 - DNA, 19 bp, Homo sapiens
aaaattatttcagaaatgt

SEQ ID NO: 2652798 - DNA, 14 bp, Homo sapiens
aaaattatttgcat

SEQ ID NO: 2652799 - DNA, 18 bp, Homo sapiens
aaaattcaaaaagtgttt

SEQ ID NO: 2652800 - DNA, 21 bp, Homo sapiens
aaaattccatcccatcatctt

SEQ ID NO: 2652801 - DNA, 17 bp, Homo sapiens
aaaattcctattgtgat

SEQ ID NO: 2652802 - DNA, 22 bp, Homo sapiens
aaaattcctttgtgtttctatt

SEQ ID NO: 2652803 - DNA, 20 bp, Homo sapiens
aaaattctgtaggttctgtg

SEQ ID NO: 2652804 - DNA, 16 bp, Homo sapiens
aaaattgtgatgtgtc

SEQ ID NO: 2652805 - DNA, 22 bp, Homo sapiens
aaaatttaaagggtgtacttat

SEQ ID NO: 2652806 - DNA, 14 bp, Homo sapiens
aaaatttaagcatt

SEQ ID NO: 2652807 - DNA, 21 bp, Homo sapiens
aaaatttaagcattgtttgct

SEQ ID NO: 2652808 - DNA, 15 bp, Homo sapiens
aaaatttagtttttg

SEQ ID NO: 2652809 - DNA, 13 bp, Homo sapiens
aaaatttcacatt

SEQ ID NO: 2652810 - DNA, 20 bp, Homo sapiens
aaaatttcacattaatattt

SEQ ID NO: 2652811 - DNA, 17 bp, Homo sapiens
aaaatttccagtacctt

SEQ ID NO: 2652812 - DNA, 14 bp, Homo sapiens
aaaatttgttgcat

SEQ ID NO: 2652813 - DNA, 22 bp, Homo sapiens
aaaatttgttttgacggatgat

SEQ ID NO: 2652814 - DNA, 19 bp, Homo sapiens
aaacaaaaattaaaatcct

SEQ ID NO: 2652815 - DNA, 20 bp, Homo sapiens
aaacaaaatttgtttgaaat

SEQ ID NO: 2652816 - DNA, 12 bp, Homo sapiens
aaacaaagccag

SEQ ID NO: 2652817 - DNA, 13 bp, Homo sapiens
aaacaaagccaga

SEQ ID NO: 2652818 - DNA, 23 bp, Homo sapiens
aaacaaagcttagcaggagagga

SEQ ID NO: 2652819 - DNA, 15 bp, Homo sapiens
aaacaagtgctggca

SEQ ID NO: 2652820 - DNA, 15 bp, Homo sapiens
aaacaataaatgtgc

SEQ ID NO: 2652821 - DNA, 15 bp, Homo sapiens
aaacaatattgtttc

SEQ ID NO: 2652822 - DNA, 16 bp, Homo sapiens
aaacaatattgtttct

SEQ ID NO: 2652823 - DNA, 19 bp, Homo sapiens
aaacacaaacgggctcagc

SEQ ID NO: 2652824 - DNA, 13 bp, Homo sapiens
aaacacaaatgca

SEQ ID NO: 2652825 - DNA, 14 bp, Homo sapiens
aaacacaaatgcag

SEQ ID NO: 2652826 - DNA, 17 bp, Homo sapiens
aaacacaccaggctgtg

SEQ ID NO: 2652827 - DNA, 18 bp, Homo sapiens
aaacacaccaggctgtgg

SEQ ID NO: 2652828 - DNA, 21 bp, Homo sapiens
aaacacagacattctgccagg

SEQ ID NO: 2652829 - DNA, 14 bp, Homo sapiens
aaacacatcttccc

SEQ ID NO: 2652830 - DNA, 18 bp, Homo sapiens
aaacacctcctcatgtac

SEQ ID NO: 2652831 - DNA, 22 bp, Homo sapiens
aaacaccttccagctcctgtaa

SEQ ID NO: 2652832 - DNA, 13 bp, Homo sapiens
aaacaccttctct

SEQ ID NO: 2652833 - DNA, 20 bp, Homo sapiens
aaacactcggcatttcaaat

SEQ ID NO: 2652834 - DNA, 15 bp, Homo sapiens
aaacactgcaggcat

SEQ ID NO: 2652835 - DNA, 19 bp, Homo sapiens
aaacactggggctggcaca

SEQ ID NO: 2652836 - DNA, 16 bp, Homo sapiens
aaacactgttctctgc

SEQ ID NO: 2652837 - DNA, 15 bp, Homo sapiens
aaacagatataaatg

SEQ ID NO: 2652838 - DNA, 20 bp, Homo sapiens
aaacagatctcctggcaaag

SEQ ID NO: 2652839 - DNA, 19 bp, Homo sapiens
aaacagatttttacaaatg

SEQ ID NO: 2652840 - DNA, 21 bp, Homo sapiens
aaacagcattgctttctgaaa

SEQ ID NO: 2652841 - DNA, 21 bp, Homo sapiens
aaacagcgctgggtccacccc

SEQ ID NO: 2652842 - DNA, 17 bp, Homo sapiens
aaacagctaatgggaca

SEQ ID NO: 2652843 - DNA, 18 bp, Homo sapiens
aaacaggagacaggaagg

SEQ ID NO: 2652844 - DNA, 14 bp, Homo sapiens
aaacaggcccagca

SEQ ID NO: 2652845 - DNA, 17 bp, Homo sapiens
aaacagggcatctccag

SEQ ID NO: 2652846 - DNA, 15 bp, Homo sapiens
aaacagtctcaggaa

SEQ ID NO: 2652847 - DNA, 23 bp, Homo sapiens
aaacagttaactttcagaagaga

SEQ ID NO: 2652848 - DNA, 21 bp, Homo sapiens
aaacataattcttgtatatta

SEQ ID NO: 2652849 - DNA, 14 bp, Homo sapiens
aaacatcacacaca

SEQ ID NO: 2652850 - DNA, 20 bp, Homo sapiens
aaacatcagttactctgaag

SEQ ID NO: 2652851 - DNA, 18 bp, Homo sapiens
aaacatccttcaagaact

SEQ ID NO: 2652852 - DNA, 19 bp, Homo sapiens
aaacatgaccctaaatctt

SEQ ID NO: 2652853 - DNA, 22 bp, Homo sapiens
aaacatgctacacactgcatgt

SEQ ID NO: 2652854 - DNA, 15 bp, Homo sapiens
aaacattaagattga

SEQ ID NO: 2652855 - DNA, 12 bp, Homo sapiens
aaacattgaaga

SEQ ID NO: 2652856 - DNA, 17 bp, Homo sapiens
aaacattggttcttgta

SEQ ID NO: 2652857 - DNA, 18 bp, Homo sapiens
aaacattggttcttgtat

SEQ ID NO: 2652858 - DNA, 23 bp, Homo sapiens
aaacatttaacttgtttccaatg

SEQ ID NO: 2652859 - DNA, 12 bp, Homo sapiens
aaaccaagaaga

SEQ ID NO: 2652860 - DNA, 21 bp, Homo sapiens
aaaccacaaggctgttgcatg

SEQ ID NO: 2652861 - DNA, 12 bp, Homo sapiens
aaaccacagcag

SEQ ID NO: 2652862 - DNA, 15 bp, Homo sapiens
aaaccacagcagttg

SEQ ID NO: 2652863 - DNA, 12 bp, Homo sapiens
aaaccagaagca

SEQ ID NO: 2652864 - DNA, 19 bp, Homo sapiens
aaaccagtgttagggaagg

SEQ ID NO: 2652865 - DNA, 15 bp, Homo sapiens
aaaccatgcaaatgc

SEQ ID NO: 2652866 - DNA, 12 bp, Homo sapiens
aaacccagctct

SEQ ID NO: 2652867 - DNA, 16 bp, Homo sapiens
aaacccagctctggtc

SEQ ID NO: 2652868 - DNA, 13 bp, Homo sapiens
aaaccccatctct

SEQ ID NO: 2652869 - DNA, 16 bp, Homo sapiens
aaacccccacacacac

SEQ ID NO: 2652870 - DNA, 16 bp, Homo sapiens
aaacccgacagaggga

SEQ ID NO: 2652871 - DNA, 18 bp, Homo sapiens
aaacccgacagagggaag

SEQ ID NO: 2652872 - DNA, 16 bp, Homo sapiens
aaaccgccaaggctgg

SEQ ID NO: 2652873 - DNA, 22 bp, Homo sapiens
aaacctcacccgaggctgccca

SEQ ID NO: 2652874 - DNA, 19 bp, Homo sapiens
aaacctctaacccaggtct

SEQ ID NO: 2652875 - DNA, 11 bp, Homo sapiens
aaacctctcct

SEQ ID NO: 2652876 - DNA, 16 bp, Homo sapiens
aaacctctgttcagtg

SEQ ID NO: 2652877 - DNA, 21 bp, Homo sapiens
aaacctctgttcagtgtaaat

SEQ ID NO: 2652878 - DNA, 18 bp, Homo sapiens
aaacctgacccctgctca

SEQ ID NO: 2652879 - DNA, 16 bp, Homo sapiens
aaacctgccctgcctg

SEQ ID NO: 2652880 - DNA, 17 bp, Homo sapiens
aaacctgccctgcctga

SEQ ID NO: 2652881 - DNA, 18 bp, Homo sapiens
aaacctgtcaatgataca

SEQ ID NO: 2652882 - DNA, 21 bp, Homo sapiens
aaacctgtttaaatatttcaa

SEQ ID NO: 2652883 - DNA, 16 bp, Homo sapiens
aaacctttagggcagc

SEQ ID NO: 2652884 - DNA, 17 bp, Homo sapiens
aaacctttcaaatttca

SEQ ID NO: 2652885 - DNA, 19 bp, Homo sapiens
aaacgatttaattctcttg

SEQ ID NO: 2652886 - DNA, 21 bp, Homo sapiens
aaacgatttaattctcttgaa

SEQ ID NO: 2652887 - DNA, 23 bp, Homo sapiens
aaacggattagggcatttgagaa

SEQ ID NO: 2652888 - DNA, 21 bp, Homo sapiens
aaacggattattttttcagac

SEQ ID NO: 2652889 - DNA, 13 bp, Homo sapiens
aaacggccctctt

SEQ ID NO: 2652890 - DNA, 13 bp, Homo sapiens
aaactaaatctct

SEQ ID NO: 2652891 - DNA, 17 bp, Homo sapiens
aaactaaatctctaata

SEQ ID NO: 2652892 - DNA, 23 bp, Homo sapiens
aaactagctcgtgattggcatat

SEQ ID NO: 2652893 - DNA, 22 bp, Homo sapiens
aaactatttatctgtgtttttg

SEQ ID NO: 2652894 - DNA, 22 bp, Homo sapiens
aaactcaaaacttaacatattt

SEQ ID NO: 2652895 - DNA, 21 bp, Homo sapiens
aaactcaaaatatttgtacat

SEQ ID NO: 2652896 - DNA, 15 bp, Homo sapiens
aaactcaaacttttc

SEQ ID NO: 2652897 - DNA, 16 bp, Homo sapiens
aaactcacctgctggc

SEQ ID NO: 2652898 - DNA, 15 bp, Homo sapiens
aaactcactgctcaa

SEQ ID NO: 2652899 - DNA, 20 bp, Homo sapiens
aaactcactgctcaagaaga

SEQ ID NO: 2652900 - DNA, 13 bp, Homo sapiens
aaactcagggaca

SEQ ID NO: 2652901 - DNA, 20 bp, Homo sapiens
aaactcgaggactgtatttg

SEQ ID NO: 2652902 - DNA, 18 bp, Homo sapiens
aaactctcctctgctgct

SEQ ID NO: 2652903 - DNA, 13 bp, Homo sapiens
aaactctctgaac

SEQ ID NO: 2652904 - DNA, 22 bp, Homo sapiens
aaactctgggaaataagagaga

SEQ ID NO: 2652905 - DNA, 23 bp, Homo sapiens
aaactcttaaaacccaagtgcct

SEQ ID NO: 2652906 - DNA, 17 bp, Homo sapiens
aacaacttctttgtaat

SEQ ID NO: 2652907 - DNA, 17 bp, Homo sapiens
aacaagaccacgtttct

SEQ ID NO: 2652908 - DNA, 19 bp, Homo sapiens
aacaagaccacgtttctaa

SEQ ID NO: 2652909 - DNA, 19 bp, Homo sapiens
aacaagaccccgtctcaaa

SEQ ID NO: 2652910 - DNA, 17 bp, Homo sapiens
aacaagatctttcagga

SEQ ID NO: 2652911 - DNA, 19 bp, Homo sapiens
aacaagatctttcaggaaa

SEQ ID NO: 2652912 - DNA, 22 bp, Homo sapiens
aacaagatgctggatgtctgcc

SEQ ID NO: 2652913 - DNA, 19 bp, Homo sapiens
aacaagcaagctcccaagg

SEQ ID NO: 2652914 - DNA, 15 bp, Homo sapiens
aacaagtgctggcac

SEQ ID NO: 2652915 - DNA, 19 bp, Homo sapiens
aacaataaatgttggcttg

SEQ ID NO: 2652916 - DNA, 15 bp, Homo sapiens
aacaataactactgt

SEQ ID NO: 2652917 - DNA, 19 bp, Homo sapiens
aacaatactcataatgtga

SEQ ID NO: 2652918 - DNA, 18 bp, Homo sapiens
aacaatagtaattctcag

SEQ ID NO: 2652919 - DNA, 17 bp, Homo sapiens
aacaatcctagtgcttt

SEQ ID NO: 2652920 - DNA, 15 bp, Homo sapiens
aacaatgatatatgg

SEQ ID NO: 2652921 - DNA, 17 bp, Homo sapiens
aacaatggaaactgaat

SEQ ID NO: 2652922 - DNA, 11 bp, Homo sapiens
aacaatgttaa

SEQ ID NO: 2652923 - DNA, 18 bp, Homo sapiens
aacaatgttaaggaaact

SEQ ID NO: 2652924 - DNA, 22 bp, Homo sapiens
aacaatgttaaggaaactctta

SEQ ID NO: 2652925 - DNA, 13 bp, Homo sapiens
aacaatttatgaa

SEQ ID NO: 2652926 - DNA, 20 bp, Homo sapiens
aacaatttcctttatattta

SEQ ID NO: 2652927 - DNA, 13 bp, Homo sapiens
aacaattttaatg

SEQ ID NO: 2652928 - DNA, 23 bp, Homo sapiens
aacaattttaggaggaccagagc

SEQ ID NO: 2652929 - DNA, 13 bp, Homo sapiens
aacacaaatgcag

SEQ ID NO: 2652930 - DNA, 16 bp, Homo sapiens
aacacaagccacagaa

SEQ ID NO: 2652931 - DNA, 17 bp, Homo sapiens
aacacaagccacagaag

SEQ ID NO: 2652932 - DNA, 18 bp, Homo sapiens
aacacaagctggaagcac

SEQ ID NO: 2652933 - DNA, 12 bp, Homo sapiens
aacacacagaca

SEQ ID NO: 2652934 - DNA, 18 bp, Homo sapiens
aacacagcaagggtgatg

SEQ ID NO: 2652935 - DNA, 16 bp, Homo sapiens
aacacagcatgtgtat

SEQ ID NO: 2652936 - DNA, 19 bp, Homo sapiens
aacacagcgagactccgtc

SEQ ID NO: 2652937 - DNA, 19 bp, Homo sapiens
aacacagtgccttcaataa

SEQ ID NO: 2652938 - DNA, 20 bp, Homo sapiens
aacacagtgtttttgtaaag

SEQ ID NO: 2652939 - DNA, 12 bp, Homo sapiens
aacacatcagct

SEQ ID NO: 2652940 - DNA, 17 bp, Homo sapiens
aacacatctttcctgtc

SEQ ID NO: 2652941 - DNA, 20 bp, Homo sapiens
aacacatttgattctgtgtg

SEQ ID NO: 2652942 - DNA, 14 bp, Homo sapiens
aacacattttgtat

SEQ ID NO: 2652943 - DNA, 15 bp, Homo sapiens
aacacattttgtata

SEQ ID NO: 2652944 - DNA, 16 bp, Homo sapiens
aacacattttgtataa

SEQ ID NO: 2652945 - DNA, 16 bp, Homo sapiens
aacaccacagacacac

SEQ ID NO: 2652946 - DNA, 18 bp, Homo sapiens
aacaccacagacacacac

SEQ ID NO: 2652947 - DNA, 16 bp, Homo sapiens
aacacctcctcatgta

SEQ ID NO: 2652948 - DNA, 13 bp, Homo sapiens
aacaccttctctg

SEQ ID NO: 2652949 - DNA, 14 bp, Homo sapiens
aacactaaaaataa

SEQ ID NO: 2652950 - DNA, 15 bp, Homo sapiens
aacactaaaaataaa

SEQ ID NO: 2652951 - DNA, 21 bp, Homo sapiens
aacactatatggcagtgtctt

SEQ ID NO: 2652952 - DNA, 16 bp, Homo sapiens
aacactcatgctgaaa

SEQ ID NO: 2652953 - DNA, 17 bp, Homo sapiens
aacactcattgacctga

SEQ ID NO: 2652954 - DNA, 15 bp, Homo sapiens
aacactgagctgtca

SEQ ID NO: 2652955 - DNA, 17 bp, Homo sapiens
aacactgcttgtgtttt

SEQ ID NO: 2652956 - DNA, 22 bp, Homo sapiens
aacactggtgtgacctgagggc

SEQ ID NO: 2652957 - DNA, 16 bp, Homo sapiens
aacactgtgccctggt

SEQ ID NO: 2652958 - DNA, 18 bp, Homo sapiens
aacactgtgccctggtgg

SEQ ID NO: 2652959 - DNA, 17 bp, Homo sapiens
aacactgttctctgccc

SEQ ID NO: 2652960 - DNA, 20 bp, Homo sapiens
aacactgttctctgccctcc

SEQ ID NO: 2652961 - DNA, 21 bp, Homo sapiens
aacactgttctctgccctcca

SEQ ID NO: 2652962 - DNA, 11 bp, Homo sapiens
aacacttccat

SEQ ID NO: 2652963 - DNA, 10 bp, Homo sapiens
aacagaaatg

SEQ ID NO: 2652964 - DNA, 13 bp, Homo sapiens
aacagaaatgtac

SEQ ID NO: 2652965 - DNA, 20 bp, Homo sapiens
aacagaacatcattagaaca

SEQ ID NO: 2652966 - DNA, 14 bp, Homo sapiens
aacagaagcttcca

SEQ ID NO: 2652967 - DNA, 14 bp, Homo sapiens
aacagaatgtttta

SEQ ID NO: 2652968 - DNA, 19 bp, Homo sapiens
aacagacaccatcttttgt

SEQ ID NO: 2652969 - DNA, 18 bp, Homo sapiens
aacagaccccctctagaa

SEQ ID NO: 2652970 - DNA, 20 bp, Homo sapiens
aacagactggaagcacagct

SEQ ID NO: 2652971 - DNA, 19 bp, Homo sapiens
aacagataagcaagagaga

SEQ ID NO: 2652972 - DNA, 16 bp, Homo sapiens
aacagatcaatttgta

SEQ ID NO: 2652973 - DNA, 21 bp, Homo sapiens
aacagatgcaatgtgctactg

SEQ ID NO: 2652974 - DNA, 14 bp, Homo sapiens
aacagatgcttttc

SEQ ID NO: 2652975 - DNA, 18 bp, Homo sapiens
aacagattcacactgtct

SEQ ID NO: 2652976 - DNA, 18 bp, Homo sapiens
aacagatttgtgaactca

SEQ ID NO: 2652977 - DNA, 17 bp, Homo sapiens
aacagatttttacaaat

SEQ ID NO: 2652978 - DNA, 21 bp, Homo sapiens
aacagcactggctctctccag

SEQ ID NO: 2652979 - DNA, 11 bp, Homo sapiens
aacagcagtgt

SEQ ID NO: 2652980 - DNA, 16 bp, Homo sapiens
aacagcattgctttct

SEQ ID NO: 2652981 - DNA, 22 bp, Homo sapiens
aacagccgtcagccaaatgtaa

SEQ ID NO: 2652982 - DNA, 18 bp, Homo sapiens
aacagctatgggagcccc

SEQ ID NO: 2652983 - DNA, 18 bp, Homo sapiens
aacagctcaagtcttccc

SEQ ID NO: 2652984 - DNA, 18 bp, Homo sapiens
aacagctcagttctagtc

SEQ ID NO: 2652985 - DNA, 21 bp, Homo sapiens
aacagctgaggtctcttgagg

SEQ ID NO: 2652986 - DNA, 22 bp, Homo sapiens
aacaggaaaggctcgaaataca

SEQ ID NO: 2652987 - DNA, 17 bp, Homo sapiens
aacaggaggacaattca

SEQ ID NO: 2652988 - DNA, 20 bp, Homo sapiens
aacaggctcaatattcctga

SEQ ID NO: 2652989 - DNA, 21 bp, Homo sapiens
aacaggtggcaggaccaggac

SEQ ID NO: 2652990 - DNA, 20 bp, Homo sapiens
aacaggttattttagtttct

SEQ ID NO: 2652991 - DNA, 21 bp, Homo sapiens
aacaggttattttagtttctg

SEQ ID NO: 2652992 - DNA, 22 bp, Homo sapiens
aacagtagtgatagttgtaccg

SEQ ID NO: 2652993 - DNA, 17 bp, Homo sapiens
aacagtcaaaacagaga

SEQ ID NO: 2652994 - DNA, 17 bp, Homo sapiens
aacagtctcaggaaatc

SEQ ID NO: 2652995 - DNA, 12 bp, Homo sapiens
aacagtctgatc

SEQ ID NO: 2652996 - DNA, 21 bp, Homo sapiens
aacagtgagcctgaattttgt

SEQ ID NO: 2652997 - DNA, 22 bp, Homo sapiens
aacagtgcatattcctttctat

SEQ ID NO: 2652998 - DNA, 13 bp, Homo sapiens
aacagtgtgaagt

SEQ ID NO: 2652999 - DNA, 17 bp, Homo sapiens
aacagtgtgaagttaga

SEQ ID NO: 2653000 - DNA, 18 bp, Homo sapiens
aacagtgtttcccataat

SEQ ID NO: 2653001 - DNA, 21 bp, Homo sapiens
aacagtgtttcccataatttt

SEQ ID NO: 2653002 - DNA, 20 bp, Homo sapiens
aacagtgttttggaataaaa

SEQ ID NO: 2653003 - DNA, 13 bp, Homo sapiens
aacagttaacttt

SEQ ID NO: 2653004 - DNA, 18 bp, Homo sapiens
aacagttaactttcagaa

SEQ ID NO: 2653005 - DNA, 16 bp, Homo sapiens
aacagttcatgtttgc

SEQ ID NO: 2653006 - DNA, 15 bp, Homo sapiens
aacagttttccatga

SEQ ID NO: 2653007 - DNA, 17 bp, Homo sapiens
aacagttttccatgaaa

SEQ ID NO: 2653008 - DNA, 18 bp, Homo sapiens
aacataattcttgtatat

SEQ ID NO: 2653009 - DNA, 18 bp, Homo sapiens
aacatataatgttgttat

SEQ ID NO: 2653010 - DNA, 21 bp, Homo sapiens
aacatataatgttgttattta

SEQ ID NO: 2653011 - DNA, 19 bp, Homo sapiens
aacatcaatgttcattgta

SEQ ID NO: 2653012 - DNA, 18 bp, Homo sapiens
aacatcagttactctgaa

SEQ ID NO: 2653013 - DNA, 21 bp, Homo sapiens
aacatcatcaaggcactgcct

SEQ ID NO: 2653014 - DNA, 22 bp, Homo sapiens
aacatccaaggagaaacagaga

SEQ ID NO: 2653015 - DNA, 22 bp, Homo sapiens
aacatcctatcaacaacaaggt

SEQ ID NO: 2653016 - DNA, 22 bp, Homo sapiens
aacatctgtcctgtgaaagact

SEQ ID NO: 2653017 - DNA, 14 bp, Homo sapiens
aacatggacttgta

SEQ ID NO: 2653018 - DNA, 23 bp, Homo sapiens
aacatggacttgtatatttgtac

SEQ ID NO: 2653019 - DNA, 20 bp, Homo sapiens
aacatggttacaatcattgc

SEQ ID NO: 2653020 - DNA, 20 bp, Homo sapiens
aacattacagggaatgcctg

SEQ ID NO: 2653021 - DNA, 16 bp, Homo sapiens
aacattaccttactgt

SEQ ID NO: 2653022 - DNA, 19 bp, Homo sapiens
aacattaccttactgtgga

SEQ ID NO: 2653023 - DNA, 16 bp, Homo sapiens
aacattatttattcag

SEQ ID NO: 2653024 - DNA, 23 bp, Homo sapiens
aacattatttattcagcttcatt

SEQ ID NO: 2653025 - DNA, 14 bp, Homo sapiens
aacattccatcctt

SEQ ID NO: 2653026 - DNA, 16 bp, Homo sapiens
aacattctgatttgga

SEQ ID NO: 2653027 - DNA, 18 bp, Homo sapiens
aacattctgatttggaaa

SEQ ID NO: 2653028 - DNA, 23 bp, Homo sapiens
aacattgtgttcccatttcagct

SEQ ID NO: 2653029 - DNA, 15 bp, Homo sapiens
aacattttaaataaa

SEQ ID NO: 2653030 - DNA, 19 bp, Homo sapiens
aacattttaaataaaagaa

SEQ ID NO: 2653031 - DNA, 15 bp, Homo sapiens
aacattttacccaca

SEQ ID NO: 2653032 - DNA, 20 bp, Homo sapiens
aaccaaaaagaccagactaa

SEQ ID NO: 2653033 - DNA, 19 bp, Homo sapiens
aaccaaagagactggagca

SEQ ID NO: 2653034 - DNA, 14 bp, Homo sapiens
aaccaagaagggct

SEQ ID NO: 2653035 - DNA, 14 bp, Homo sapiens
aaccacagccctgt

SEQ ID NO: 2653036 - DNA, 15 bp, Homo sapiens
aaccacagccctgtc

SEQ ID NO: 2653037 - DNA, 16 bp, Homo sapiens
aaccacagccctgtca

SEQ ID NO: 2653038 - DNA, 13 bp, Homo sapiens
aaccacatcttgc

SEQ ID NO: 2653039 - DNA, 19 bp, Homo sapiens
aaccaccgctccccagccc

SEQ ID NO: 2653040 - DNA, 17 bp, Homo sapiens
aaccactgaatctggac

SEQ ID NO: 2653041 - DNA, 13 bp, Homo sapiens
aaccacttaaaaa

SEQ ID NO: 2653042 - DNA, 15 bp, Homo sapiens
aaccacttcagctga

SEQ ID NO: 2653043 - DNA, 17 bp, Homo sapiens
aaccagaagcaacagaa

SEQ ID NO: 2653044 - DNA, 21 bp, Homo sapiens
aaccagaagcaacagaaaaaa

SEQ ID NO: 2653045 - DNA, 21 bp, Homo sapiens
aaccagggagcccctttgatg

SEQ ID NO: 2653046 - DNA, 21 bp, Homo sapiens
aaccaggtttagacagtatga

SEQ ID NO: 2653047 - DNA, 19 bp, Homo sapiens
aaccagtgttgtggattta

SEQ ID NO: 2653048 - DNA, 14 bp, Homo sapiens
aaccagttatgtga

SEQ ID NO: 2653049 - DNA, 13 bp, Homo sapiens
aaccataaacttc

SEQ ID NO: 2653050 - DNA, 17 bp, Homo sapiens
aagcagcgtttctatga

SEQ ID NO: 2653051 - DNA, 20 bp, Homo sapiens
aagcagcgtttctatgacac

SEQ ID NO: 2653052 - DNA, 21 bp, Homo sapiens
aagcagcgtttctatgacaca

SEQ ID NO: 2653053 - DNA, 22 bp, Homo sapiens
aagcagcgtttctatgacacat

SEQ ID NO: 2653054 - DNA, 13 bp, Homo sapiens
aagcagctcaaag

SEQ ID NO: 2653055 - DNA, 16 bp, Homo sapiens
aagcagctcaaaggca

SEQ ID NO: 2653056 - DNA, 13 bp, Homo sapiens
aagcagctctccc

SEQ ID NO: 2653057 - DNA, 17 bp, Homo sapiens
aagcagctctcccctca

SEQ ID NO: 2653058 - DNA, 22 bp, Homo sapiens
aagcaggctacactgacactgg

SEQ ID NO: 2653059 - DNA, 17 bp, Homo sapiens
aagcagggtctgggcag

SEQ ID NO: 2653060 - DNA, 13 bp, Homo sapiens
aagcagtaactga

SEQ ID NO: 2653061 - DNA, 15 bp, Homo sapiens
aagcagtgcttctca

SEQ ID NO: 2653062 - DNA, 17 bp, Homo sapiens
aagcatattgttattat

SEQ ID NO: 2653063 - DNA, 16 bp, Homo sapiens
aagcatcacctcaggc

SEQ ID NO: 2653064 - DNA, 12 bp, Homo sapiens
aagcatccatgt

SEQ ID NO: 2653065 - DNA, 19 bp, Homo sapiens
aagcatgtggcatgttcat

SEQ ID NO: 2653066 - DNA, 18 bp, Homo sapiens
aagcattaacttctctgg

SEQ ID NO: 2653067 - DNA, 18 bp, Homo sapiens
aagcattaccactcaggc

SEQ ID NO: 2653068 - DNA, 18 bp, Homo sapiens
aagcattccttctttgat

SEQ ID NO: 2653069 - DNA, 20 bp, Homo sapiens
aagcattccttctttgataa

SEQ ID NO: 2653070 - DNA, 21 bp, Homo sapiens
aagcattccttctttgataat

SEQ ID NO: 2653071 - DNA, 19 bp, Homo sapiens
aagcattgtaaatgtgctt

SEQ ID NO: 2653072 - DNA, 14 bp, Homo sapiens
aagcattgtttgct

SEQ ID NO: 2653073 - DNA, 20 bp, Homo sapiens
aagcattgtttgcttattgt

SEQ ID NO: 2653074 - DNA, 19 bp, Homo sapiens
aagcatttaatgtagccat

SEQ ID NO: 2653075 - DNA, 16 bp, Homo sapiens
aagcatttactttgtg

SEQ ID NO: 2653076 - DNA, 21 bp, Homo sapiens
aagcattttataaatcgcttt

SEQ ID NO: 2653077 - DNA, 14 bp, Homo sapiens
aagccaaactctgc

SEQ ID NO: 2653078 - DNA, 15 bp, Homo sapiens
aagccaaactctgcc

SEQ ID NO: 2653079 - DNA, 16 bp, Homo sapiens
aagccaaagacttagt

SEQ ID NO: 2653080 - DNA, 18 bp, Homo sapiens
aagccaaagctaggcctg

SEQ ID NO: 2653081 - DNA, 22 bp, Homo sapiens
aagccaaagctaggcctggcca

SEQ ID NO: 2653082 - DNA, 17 bp, Homo sapiens
aagccaagcagccaagc

SEQ ID NO: 2653083 - DNA, 17 bp, Homo sapiens
aagccaataacacacag

SEQ ID NO: 2653084 - DNA, 15 bp, Homo sapiens
aagccaatcccctcc

SEQ ID NO: 2653085 - DNA, 16 bp, Homo sapiens
aagccaatcccctcct

SEQ ID NO: 2653086 - DNA, 19 bp, Homo sapiens
aagccaatcccctccttgg

SEQ ID NO: 2653087 - DNA, 20 bp, Homo sapiens
aagccaatcccctccttggg

SEQ ID NO: 2653088 - DNA, 11 bp, Homo sapiens
aagccacagaa

SEQ ID NO: 2653089 - DNA, 19 bp, Homo sapiens
aagccaccaacatactccc

SEQ ID NO: 2653090 - DNA, 17 bp, Homo sapiens
aagccagcgtcctcctc

SEQ ID NO: 2653091 - DNA, 12 bp, Homo sapiens
aagccagctttc

SEQ ID NO: 2653092 - DNA, 21 bp, Homo sapiens
aagccaggagcaaatgtttct

SEQ ID NO: 2653093 - DNA, 20 bp, Homo sapiens
aagccattctaaggaaatta

SEQ ID NO: 2653094 - DNA, 13 bp, Homo sapiens
aagccattgtctt

SEQ ID NO: 2653095 - DNA, 14 bp, Homo sapiens
aagccattgtcttc

SEQ ID NO: 2653096 - DNA, 18 bp, Homo sapiens
aagcccagaaaaggacag

SEQ ID NO: 2653097 - DNA, 22 bp, Homo sapiens
aagcccaggaaaggctccagga

SEQ ID NO: 2653098 - DNA, 19 bp, Homo sapiens
aagcccatgagtccttgaa

SEQ ID NO: 2653099 - DNA, 20 bp, Homo sapiens
aagcccatgagtccttgaaa

SEQ ID NO: 2653100 - DNA, 22 bp, Homo sapiens
aagcccatgagtccttgaaaat

SEQ ID NO: 2653101 - DNA, 12 bp, Homo sapiens
aagccccaggca

SEQ ID NO: 2653102 - DNA, 17 bp, Homo sapiens
aagcccctgcccatctg

SEQ ID NO: 2653103 - DNA, 21 bp, Homo sapiens
aagccccttgctctcccctgc

SEQ ID NO: 2653104 - DNA, 15 bp, Homo sapiens
aagcccgacttgctg

SEQ ID NO: 2653105 - DNA, 21 bp, Homo sapiens
aagccctcttccatcatgtcc

SEQ ID NO: 2653106 - DNA, 20 bp, Homo sapiens
aagccgctggggccagttgg

SEQ ID NO: 2653107 - DNA, 12 bp, Homo sapiens
aagccggcggcc

SEQ ID NO: 2653108 - DNA, 13 bp, Homo sapiens
aagccggcggccc

SEQ ID NO: 2653109 - DNA, 14 bp, Homo sapiens
aagccgtgccctgc

SEQ ID NO: 2653110 - DNA, 22 bp, Homo sapiens
aagcctagtgaaggcttctctc

SEQ ID NO: 2653111 - DNA, 20 bp, Homo sapiens
aagcctcatatttaaagaca

SEQ ID NO: 2653112 - DNA, 19 bp, Homo sapiens
aagcctccatttagttctt

SEQ ID NO: 2653113 - DNA, 11 bp, Homo sapiens
aagcctctgct

SEQ ID NO: 2653114 - DNA, 14 bp, Homo sapiens
aagcctctgctgcc

SEQ ID NO: 2653115 - DNA, 12 bp, Homo sapiens
aagcctctggct

SEQ ID NO: 2653116 - DNA, 12 bp, Homo sapiens
aagcctctggga

SEQ ID NO: 2653117 - DNA, 21 bp, Homo sapiens
aagcctggcctacatggttga

SEQ ID NO: 2653118 - DNA, 17 bp, Homo sapiens
aagcctgggattgacag

SEQ ID NO: 2653119 - DNA, 19 bp, Homo sapiens
aagcctgttttgttggaag

SEQ ID NO: 2653120 - DNA, 23 bp, Homo sapiens
aagccttatcaagtgtcttccat

SEQ ID NO: 2653121 - DNA, 15 bp, Homo sapiens
aagcctttccataag

SEQ ID NO: 2653122 - DNA, 20 bp, Homo sapiens
aagcgatgaatttggagact

SEQ ID NO: 2653123 - DNA, 17 bp, Homo sapiens
aagcgattcttctgctt

SEQ ID NO: 2653124 - DNA, 13 bp, Homo sapiens
aagctagaaatga

SEQ ID NO: 2653125 - DNA, 17 bp, Homo sapiens
aagctagaaggccacat

SEQ ID NO: 2653126 - DNA, 10 bp, Homo sapiens
aagctagaat

SEQ ID NO: 2653127 - DNA, 15 bp, Homo sapiens
aagctagctcccctc

SEQ ID NO: 2653128 - DNA, 18 bp, Homo sapiens
aagctagctcccctcctc

SEQ ID NO: 2653129 - DNA, 17 bp, Homo sapiens
aagctaggcctggccag

SEQ ID NO: 2653130 - DNA, 19 bp, Homo sapiens
aagctagtggcttcaaaat

SEQ ID NO: 2653131 - DNA, 17 bp, Homo sapiens
aagctatcctggctctt

SEQ ID NO: 2653132 - DNA, 21 bp, Homo sapiens
aagctatggtgagatgcagct

SEQ ID NO: 2653133 - DNA, 23 bp, Homo sapiens
aagctatggtgagatgcagctgg

SEQ ID NO: 2653134 - DNA, 16 bp, Homo sapiens
aagctattagccagga

SEQ ID NO: 2653135 - DNA, 18 bp, Homo sapiens
aagctcacctgttgctta

SEQ ID NO: 2653136 - DNA, 17 bp, Homo sapiens
aagctcagactggttga

SEQ ID NO: 2653137 - DNA, 15 bp, Homo sapiens
aagctcagccagccc

SEQ ID NO: 2653138 - DNA, 13 bp, Homo sapiens
aagctcagcccac

SEQ ID NO: 2653139 - DNA, 14 bp, Homo sapiens
aagctcagcccacc

SEQ ID NO: 2653140 - DNA, 15 bp, Homo sapiens
aagctcagcccaccc

SEQ ID NO: 2653141 - DNA, 18 bp, Homo sapiens
aagctcagggcctggctc

SEQ ID NO: 2653142 - DNA, 12 bp, Homo sapiens
aagctcatattt

SEQ ID NO: 2653143 - DNA, 20 bp, Homo sapiens
aagctcatattttgtatata

SEQ ID NO: 2653144 - DNA, 22 bp, Homo sapiens
aagctcatattttgtatatatc

SEQ ID NO: 2653145 - DNA, 14 bp, Homo sapiens
aagctccatctcca

SEQ ID NO: 2653146 - DNA, 20 bp, Homo sapiens
aagctccatctccactccag

SEQ ID NO: 2653147 - DNA, 16 bp, Homo sapiens
aagctcctagcagaga

SEQ ID NO: 2653148 - DNA, 22 bp, Homo sapiens
aagctcctgtcctcccatcccc

SEQ ID NO: 2653149 - DNA, 18 bp, Homo sapiens
aagctcgaaaacaattgt

SEQ ID NO: 2653150 - DNA, 15 bp, Homo sapiens
aagctctattaagat

SEQ ID NO: 2653151 - DNA, 24 bp, Homo sapiens
aagctctggctgaaccctgtgctg

SEQ ID NO: 2653152 - DNA, 20 bp, Homo sapiens
aagctctggtgacaccagcc

SEQ ID NO: 2653153 - DNA, 22 bp, Homo sapiens
aagctcttacactacattagaa

SEQ ID NO: 2653154 - DNA, 17 bp, Homo sapiens
aagctcttgaagacact

SEQ ID NO: 2653155 - DNA, 20 bp, Homo sapiens
aagctcttgaagacactgaa

SEQ ID NO: 2653156 - DNA, 21 bp, Homo sapiens
aagctgaagtgcatccaaagg

SEQ ID NO: 2653157 - DNA, 19 bp, Homo sapiens
aagctgacgaacttccatg

SEQ ID NO: 2653158 - DNA, 20 bp, Homo sapiens
aagctgacgaacttccatgg

SEQ ID NO: 2653159 - DNA, 22 bp, Homo sapiens
aagctgacgaacttccatggcc

SEQ ID NO: 2653160 - DNA, 14 bp, Homo sapiens
aagctgaggcggga

SEQ ID NO: 2653161 - DNA, 20 bp, Homo sapiens
aagctgcctggtatatccaa

SEQ ID NO: 2653162 - DNA, 14 bp, Homo sapiens
aagctgcctgtagt

SEQ ID NO: 2653163 - DNA, 22 bp, Homo sapiens
aagctgcctgtagttaggaaat

SEQ ID NO: 2653164 - DNA, 14 bp, Homo sapiens
aagctgctgacagt

SEQ ID NO: 2653165 - DNA, 16 bp, Homo sapiens
aagctgctgacagtgt

SEQ ID NO: 2653166 - DNA, 14 bp, Homo sapiens
aagctggaagcaca

SEQ ID NO: 2653167 - DNA, 22 bp, Homo sapiens
aagctgtagtagccctttctgt

SEQ ID NO: 2653168 - DNA, 23 bp, Homo sapiens
aagctgtagtagccctttctgtg

SEQ ID NO: 2653169 - DNA, 12 bp, Homo sapiens
aagctgttgtac

SEQ ID NO: 2653170 - DNA, 14 bp, Homo sapiens
aagctgttgtacat

SEQ ID NO: 2653171 - DNA, 15 bp, Homo sapiens
aagcttagcaggaga

SEQ ID NO: 2653172 - DNA, 20 bp, Homo sapiens
aagcttagcaggagaggaga

SEQ ID NO: 2653173 - DNA, 22 bp, Homo sapiens
aagcttagcaggagaggagagc

SEQ ID NO: 2653174 - DNA, 21 bp, Homo sapiens
aagcttccagtccaatctcat

SEQ ID NO: 2653175 - DNA, 21 bp, Homo sapiens
aagcttggcagccgagctcgt

SEQ ID NO: 2653176 - DNA, 13 bp, Homo sapiens
aagcttgtgtatc

SEQ ID NO: 2653177 - DNA, 22 bp, Homo sapiens
aagcttgtgtatccattatcat

SEQ ID NO: 2653178 - DNA, 19 bp, Homo sapiens
aagctttatacgtgtagct

SEQ ID NO: 2653179 - DNA, 17 bp, Homo sapiens
aaggaaaaaatgttgga

SEQ ID NO: 2653180 - DNA, 16 bp, Homo sapiens
aaggaaaccacagctg

SEQ ID NO: 2653181 - DNA, 12 bp, Homo sapiens
aaggaaactctt

SEQ ID NO: 2653182 - DNA, 20 bp, Homo sapiens
aaggaaactgggttcctgca

SEQ ID NO: 2653183 - DNA, 15 bp, Homo sapiens
aaggaaagagggagg

SEQ ID NO: 2653184 - DNA, 16 bp, Homo sapiens
aaggaaagcaataaat

SEQ ID NO: 2653185 - DNA, 20 bp, Homo sapiens
aaggaaagcaataaatgaat

SEQ ID NO: 2653186 - DNA, 14 bp, Homo sapiens
aaggaaatgattga

SEQ ID NO: 2653187 - DNA, 20 bp, Homo sapiens
aaggaactctggcttccagg

SEQ ID NO: 2653188 - DNA, 11 bp, Homo sapiens
aaggaaggaaa

SEQ ID NO: 2653189 - DNA, 17 bp, Homo sapiens
aaggaaggttttctcca

SEQ ID NO: 2653190 - DNA, 21 bp, Homo sapiens
aaggaatccactcccaggcag

SEQ ID NO: 2653191 - DNA, 15 bp, Homo sapiens
aaggaattctaggca

SEQ ID NO: 2653192 - DNA, 14 bp, Homo sapiens
aaggacaatttcaa

SEQ ID NO: 2653193 - DNA, 14 bp, Homo sapiens
aaggacacactaat

SEQ ID NO: 2653194 - DNA, 18 bp, Homo sapiens
aaggacacagatgaaaca

SEQ ID NO: 2653195 - DNA, 22 bp, Homo sapiens
aataaaacctttcaaatttcac

SEQ ID NO: 2653196 - DNA, 21 bp, Homo sapiens
aataaaagcagcatctgctaa

SEQ ID NO: 2653197 - DNA, 14 bp, Homo sapiens
aataaaaggaaaag

SEQ ID NO: 2653198 - DNA, 14 bp, Homo sapiens
aataaaatgtgatt

SEQ ID NO: 2653199 - DNA, 14 bp, Homo sapiens
aataaaattgcact

SEQ ID NO: 2653200 - DNA, 13 bp, Homo sapiens
aataaaatttgtt

SEQ ID NO: 2653201 - DNA, 14 bp, Homo sapiens
aataaaatttgttg

SEQ ID NO: 2653202 - DNA, 16 bp, Homo sapiens
aataaaatttgttgca

SEQ ID NO: 2653203 - DNA, 15 bp, Homo sapiens
aataaacgatttaat

SEQ ID NO: 2653204 - DNA, 20 bp, Homo sapiens
aataaacttttttttgagaa

SEQ ID NO: 2653205 - DNA, 11 bp, Homo sapiens
aataaagacag

SEQ ID NO: 2653206 - DNA, 14 bp, Homo sapiens
aataaagtaattat

SEQ ID NO: 2653207 - DNA, 11 bp, Homo sapiens
aataaagtatc

SEQ ID NO: 2653208 - DNA, 17 bp, Homo sapiens
aataaagtatcatgcat

SEQ ID NO: 2653209 - DNA, 16 bp, Homo sapiens
aataaatatgcctctc

SEQ ID NO: 2653210 - DNA, 20 bp, Homo sapiens
aataaatatgcctctccttt

SEQ ID NO: 2653211 - DNA, 16 bp, Homo sapiens
aataaatcataaaact

SEQ ID NO: 2653212 - DNA, 22 bp, Homo sapiens
aataaatctgttgccaagctgg

SEQ ID NO: 2653213 - DNA, 16 bp, Homo sapiens
aataaatgagctatgt

SEQ ID NO: 2653214 - DNA, 17 bp, Homo sapiens
aataaatgcaatatgta

SEQ ID NO: 2653215 - DNA, 16 bp, Homo sapiens
aataaattgctccttg

SEQ ID NO: 2653216 - DNA, 20 bp, Homo sapiens
aataaattgctccttgacat

SEQ ID NO: 2653217 - DNA, 20 bp, Homo sapiens
aataaattgtaattgtaaag

SEQ ID NO: 2653218 - DNA, 18 bp, Homo sapiens
aataaatttggttctaat

SEQ ID NO: 2653219 - DNA, 13 bp, Homo sapiens
aataacaatgtgc

SEQ ID NO: 2653220 - DNA, 14 bp, Homo sapiens
aataaccacttaaa

SEQ ID NO: 2653221 - DNA, 18 bp, Homo sapiens
aataactactgtgttcct

SEQ ID NO: 2653222 - DNA, 19 bp, Homo sapiens
aataactactgtgttcctg

SEQ ID NO: 2653223 - DNA, 21 bp, Homo sapiens
aataactccttcttgtagtag

SEQ ID NO: 2653224 - DNA, 12 bp, Homo sapiens
aataagaaaaga

SEQ ID NO: 2653225 - DNA, 22 bp, Homo sapiens
aataagaaacaactctttgaga

SEQ ID NO: 2653226 - DNA, 15 bp, Homo sapiens
aataagagaaagaaa

SEQ ID NO: 2653227 - DNA, 14 bp, Homo sapiens
aataagctaaagag

SEQ ID NO: 2653228 - DNA, 16 bp, Homo sapiens
aataaggtcaatgcca

SEQ ID NO: 2653229 - DNA, 14 bp, Homo sapiens
aataaggttgaaca

SEQ ID NO: 2653230 - DNA, 14 bp, Homo sapiens
aataagttattgca

SEQ ID NO: 2653231 - DNA, 18 bp, Homo sapiens
aataagttattgcagttt

SEQ ID NO: 2653232 - DNA, 13 bp, Homo sapiens
aataataaacttt

SEQ ID NO: 2653233 - DNA, 13 bp, Homo sapiens
aataataaagatc

SEQ ID NO: 2653234 - DNA, 11 bp, Homo sapiens
aataataatta

SEQ ID NO: 2653235 - DNA, 13 bp, Homo sapiens
aataatatatgtt

SEQ ID NO: 2653236 - DNA, 13 bp, Homo sapiens
aataatatgcatt

SEQ ID NO: 2653237 - DNA, 20 bp, Homo sapiens
aataatcacgctttcctgaa

SEQ ID NO: 2653238 - DNA, 21 bp, Homo sapiens
aataatcacgctttcctgaat

SEQ ID NO: 2653239 - DNA, 22 bp, Homo sapiens
aataatgaatggactcaaactg

SEQ ID NO: 2653240 - DNA, 19 bp, Homo sapiens
aataatgggcttagagcag

SEQ ID NO: 2653241 - DNA, 13 bp, Homo sapiens
aataatggtacca

SEQ ID NO: 2653242 - DNA, 21 bp, Homo sapiens
aataatggtcccatccaggca

SEQ ID NO: 2653243 - DNA, 15 bp, Homo sapiens
aataatgtgaatcat

SEQ ID NO: 2653244 - DNA, 19 bp, Homo sapiens
aataatgttaacatggaca

SEQ ID NO: 2653245 - DNA, 18 bp, Homo sapiens
aataattatccagagttt

SEQ ID NO: 2653246 - DNA, 20 bp, Homo sapiens
aataattatgagtttgctta

SEQ ID NO: 2653247 - DNA, 18 bp, Homo sapiens
aataattatttatttaat

SEQ ID NO: 2653248 - DNA, 16 bp, Homo sapiens
aataattttaaacaaa

SEQ ID NO: 2653249 - DNA, 13 bp, Homo sapiens
aatacaaacaatg

SEQ ID NO: 2653250 - DNA, 17 bp, Homo sapiens
aatacaaacatatttgt

SEQ ID NO: 2653251 - DNA, 20 bp, Homo sapiens
aatacaaacatatttgttaa

SEQ ID NO: 2653252 - DNA, 22 bp, Homo sapiens
aatacaacatgtagctgagttt

SEQ ID NO: 2653253 - DNA, 17 bp, Homo sapiens
aatacacaagtaaacat

SEQ ID NO: 2653254 - DNA, 14 bp, Homo sapiens
aatacacactcaaa

SEQ ID NO: 2653255 - DNA, 20 bp, Homo sapiens
aatacaccactacattctgt

SEQ ID NO: 2653256 - DNA, 15 bp, Homo sapiens
aatacagacactaag

SEQ ID NO: 2653257 - DNA, 18 bp, Homo sapiens
aatacagcaacaatttat

SEQ ID NO: 2653258 - DNA, 19 bp, Homo sapiens
aatacagccaaagataatc

SEQ ID NO: 2653259 - DNA, 16 bp, Homo sapiens
aatacagggcatgcat

SEQ ID NO: 2653260 - DNA, 21 bp, Homo sapiens
aatacagtcttccatttgcaa

SEQ ID NO: 2653261 - DNA, 12 bp, Homo sapiens
aatacagtgtta

SEQ ID NO: 2653262 - DNA, 12 bp, Homo sapiens
aatacattttat

SEQ ID NO: 2653263 - DNA, 20 bp, Homo sapiens
aataccaaaattatttcaga

SEQ ID NO: 2653264 - DNA, 16 bp, Homo sapiens
aataccaagtatttat

SEQ ID NO: 2653265 - DNA, 17 bp, Homo sapiens
aataccagccagtaaat

SEQ ID NO: 2653266 - DNA, 18 bp, Homo sapiens
aataccatgccatttaaa

SEQ ID NO: 2653267 - DNA, 20 bp, Homo sapiens
aataccattttttaaggaaa

SEQ ID NO: 2653268 - DNA, 18 bp, Homo sapiens
aatacctgtccccctgac

SEQ ID NO: 2653269 - DNA, 21 bp, Homo sapiens
aatacctgtccccctgacaac

SEQ ID NO: 2653270 - DNA, 21 bp, Homo sapiens
aatactatatttatactgtat

SEQ ID NO: 2653271 - DNA, 21 bp, Homo sapiens
aatactatttttactgccact

SEQ ID NO: 2653272 - DNA, 19 bp, Homo sapiens
aatactcataatgtgaagt

SEQ ID NO: 2653273 - DNA, 13 bp, Homo sapiens
aatactcatgtgt

SEQ ID NO: 2653274 - DNA, 23 bp, Homo sapiens
aatactcttaggaagagaaacca

SEQ ID NO: 2653275 - DNA, 22 bp, Homo sapiens
aatactgccagatgctgatgtt

SEQ ID NO: 2653276 - DNA, 22 bp, Homo sapiens
aatactgtacaatgactttatt

SEQ ID NO: 2653277 - DNA, 17 bp, Homo sapiens
aatacttgtcaatattt

SEQ ID NO: 2653278 - DNA, 16 bp, Homo sapiens
aatactttaaaggaaa

SEQ ID NO: 2653279 - DNA, 20 bp, Homo sapiens
aatagaaaactgaaaatcta

SEQ ID NO: 2653280 - DNA, 15 bp, Homo sapiens
aatagaagaacatcc

SEQ ID NO: 2653281 - DNA, 17 bp, Homo sapiens
aatagaatataattatc

SEQ ID NO: 2653282 - DNA, 20 bp, Homo sapiens
aatagaatataattatcgga

SEQ ID NO: 2653283 - DNA, 23 bp, Homo sapiens
aatagacaatttattatggcaca

SEQ ID NO: 2653284 - DNA, 15 bp, Homo sapiens
aatagacagtatatt

SEQ ID NO: 2653285 - DNA, 16 bp, Homo sapiens
aatagagcctgaggga

SEQ ID NO: 2653286 - DNA, 16 bp, Homo sapiens
aatagagtatatgcac

SEQ ID NO: 2653287 - DNA, 17 bp, Homo sapiens
aatagagtatatgcact

SEQ ID NO: 2653288 - DNA, 20 bp, Homo sapiens
aatagataagagtagaaact

SEQ ID NO: 2653289 - DNA, 21 bp, Homo sapiens
aatagatatccacttgagaca

SEQ ID NO: 2653290 - DNA, 22 bp, Homo sapiens
aatagccaacacccatctgttt

SEQ ID NO: 2653291 - DNA, 20 bp, Homo sapiens
aatagccacttaccttcaat

SEQ ID NO: 2653292 - DNA, 20 bp, Homo sapiens
aatagcctgcctcttctcta

SEQ ID NO: 2653293 - DNA, 17 bp, Homo sapiens
aatagctatatccatgt

SEQ ID NO: 2653294 - DNA, 22 bp, Homo sapiens
aatagctatatccatgtactgt

SEQ ID NO: 2653295 - DNA, 15 bp, Homo sapiens
aataggagaggatga

SEQ ID NO: 2653296 - DNA, 13 bp, Homo sapiens
aataggcaaaggg

SEQ ID NO: 2653297 - DNA, 18 bp, Homo sapiens
aatagtatttatgaaatg

SEQ ID NO: 2653298 - DNA, 15 bp, Homo sapiens
aatagtctgtgtgaa

SEQ ID NO: 2653299 - DNA, 20 bp, Homo sapiens
aatagtgcttaaaaatcatt

SEQ ID NO: 2653300 - DNA, 22 bp, Homo sapiens
aatagtggtgtgatttggggat

SEQ ID NO: 2653301 - DNA, 20 bp, Homo sapiens
aatagtgtggaaattaagaa

SEQ ID NO: 2653302 - DNA, 22 bp, Homo sapiens
aatagtgtgttctgattagaaa

SEQ ID NO: 2653303 - DNA, 17 bp, Homo sapiens
aatagtgttaatcaatt

SEQ ID NO: 2653304 - DNA, 22 bp, Homo sapiens
aatagtgttaatcaatttaaac

SEQ ID NO: 2653305 - DNA, 14 bp, Homo sapiens
aatagttgagcccc

SEQ ID NO: 2653306 - DNA, 14 bp, Homo sapiens
aatataaaaggcaa

SEQ ID NO: 2653307 - DNA, 22 bp, Homo sapiens
aatataaaaggcaaatgtgtac

SEQ ID NO: 2653308 - DNA, 11 bp, Homo sapiens
aatataattat

SEQ ID NO: 2653309 - DNA, 15 bp, Homo sapiens
aatataattctgtaa

SEQ ID NO: 2653310 - DNA, 18 bp, Homo sapiens
aatataattttttagaga

SEQ ID NO: 2653311 - DNA, 13 bp, Homo sapiens
aatatacacacag

SEQ ID NO: 2653312 - DNA, 13 bp, Homo sapiens
aatatactgtaaa

SEQ ID NO: 2653313 - DNA, 21 bp, Homo sapiens
aatatactgtaaagaaagaga

SEQ ID NO: 2653314 - DNA, 22 bp, Homo sapiens
aatatagaaacacgaactttag

SEQ ID NO: 2653315 - DNA, 16 bp, Homo sapiens
aatataggaacttaaa

SEQ ID NO: 2653316 - DNA, 20 bp, Homo sapiens
aatataggaacttaaataat

SEQ ID NO: 2653317 - DNA, 21 bp, Homo sapiens
aatataggaacttaaataatg

SEQ ID NO: 2653318 - DNA, 17 bp, Homo sapiens
aatatatctaaattgaa

SEQ ID NO: 2653319 - DNA, 12 bp, Homo sapiens
aatatatgttta

SEQ ID NO: 2653320 - DNA, 13 bp, Homo sapiens
aatatatgtttac

SEQ ID NO: 2653321 - DNA, 20 bp, Homo sapiens
aatatatgtttaccttttaa

SEQ ID NO: 2653322 - DNA, 20 bp, Homo sapiens
aatatatttaagataattat

SEQ ID NO: 2653323 - DNA, 13 bp, Homo sapiens
aatatatttgtgt

SEQ ID NO: 2653324 - DNA, 14 bp, Homo sapiens
aatatatttgtgta

SEQ ID NO: 2653325 - DNA, 24 bp, Homo sapiens
aatatatttgtgtatttaacaggg

SEQ ID NO: 2653326 - DNA, 15 bp, Homo sapiens
aatatatttttatat

SEQ ID NO: 2653327 - DNA, 20 bp, Homo sapiens
aatatatttttatatttagt

SEQ ID NO: 2653328 - DNA, 20 bp, Homo sapiens
aatatcagcaagtctcttta

SEQ ID NO: 2653329 - DNA, 19 bp, Homo sapiens
aatatcagtagaaactcta

SEQ ID NO: 2653330 - DNA, 16 bp, Homo sapiens
aatatctgaaaatgta

SEQ ID NO: 2653331 - DNA, 18 bp, Homo sapiens
aatatctgaaaatgtatg

SEQ ID NO: 2653332 - DNA, 13 bp, Homo sapiens
aatatctgaaatg

SEQ ID NO: 2653333 - DNA, 13 bp, Homo sapiens
aatatctgtattt

SEQ ID NO: 2653334 - DNA, 14 bp, Homo sapiens
aatatctgtattta

SEQ ID NO: 2653335 - DNA, 20 bp, Homo sapiens
aatatctgtatttaattttg

SEQ ID NO: 2653336 - DNA, 21 bp, Homo sapiens
aatatctgtatttaattttga

SEQ ID NO: 2653337 - DNA, 18 bp, Homo sapiens
aatatgaagctcacctgt

SEQ ID NO: 2653338 - DNA, 19 bp, Homo sapiens
aatatgacggaagaacata

SEQ ID NO: 2653339 - DNA, 17 bp, Homo sapiens
aatatgatattgcatat

SEQ ID NO: 2653340 - DNA, 15 bp, Homo sapiens
aattgtataacaggt

SEQ ID NO: 2653341 - DNA, 19 bp, Homo sapiens
aattgtataacaggttatt

SEQ ID NO: 2653342 - DNA, 17 bp, Homo sapiens
aattgtatcagaggcct

SEQ ID NO: 2653343 - DNA, 19 bp, Homo sapiens
aattgtatcgtatagctgt

SEQ ID NO: 2653344 - DNA, 13 bp, Homo sapiens
aattgtatctagt

SEQ ID NO: 2653345 - DNA, 12 bp, Homo sapiens
aattgtatgtta

SEQ ID NO: 2653346 - DNA, 16 bp, Homo sapiens
aattgtattttagtaa

SEQ ID NO: 2653347 - DNA, 17 bp, Homo sapiens
aattgtccgtgttcata

SEQ ID NO: 2653348 - DNA, 12 bp, Homo sapiens
aattgtgaaaaa

SEQ ID NO: 2653349 - DNA, 15 bp, Homo sapiens
aattgtgatgtgtcc

SEQ ID NO: 2653350 - DNA, 18 bp, Homo sapiens
aattgttgacagttctga

SEQ ID NO: 2653351 - DNA, 12 bp, Homo sapiens
aattgttgtttc

SEQ ID NO: 2653352 - DNA, 21 bp, Homo sapiens
aattgttgtttctttctagtg

SEQ ID NO: 2653353 - DNA, 13 bp, Homo sapiens
aattgttgtttgt

SEQ ID NO: 2653354 - DNA, 14 bp, Homo sapiens
aattgttgtttgta

SEQ ID NO: 2653355 - DNA, 20 bp, Homo sapiens
aattgtttaagtgttgtaaa

SEQ ID NO: 2653356 - DNA, 20 bp, Homo sapiens
aattgttttgcactttttta

SEQ ID NO: 2653357 - DNA, 14 bp, Homo sapiens
aatttaaaaaataa

SEQ ID NO: 2653358 - DNA, 13 bp, Homo sapiens
aatttaaaagtct

SEQ ID NO: 2653359 - DNA, 9 bp, Homo sapiens
aatttaaac

SEQ ID NO: 2653360 - DNA, 18 bp, Homo sapiens
aatttaaacaggcccagc

SEQ ID NO: 2653361 - DNA, 17 bp, Homo sapiens
aatttaaacccatttta

SEQ ID NO: 2653362 - DNA, 22 bp, Homo sapiens
aatttaaagggtgtacttatat

SEQ ID NO: 2653363 - DNA, 14 bp, Homo sapiens
aatttaagtgcgtg

SEQ ID NO: 2653364 - DNA, 20 bp, Homo sapiens
aatttaagtgcgtgtgtaga

SEQ ID NO: 2653365 - DNA, 21 bp, Homo sapiens
aatttaattaggggttgctaa

SEQ ID NO: 2653366 - DNA, 19 bp, Homo sapiens
aatttaattcatgtttctt

SEQ ID NO: 2653367 - DNA, 23 bp, Homo sapiens
aatttaattcatgtttcttaaat

SEQ ID NO: 2653368 - DNA, 21 bp, Homo sapiens
aatttacaaaaatataaaata

SEQ ID NO: 2653369 - DNA, 17 bp, Homo sapiens
aatttacagagacagaa

SEQ ID NO: 2653370 - DNA, 19 bp, Homo sapiens
aatttacatactctgctta

SEQ ID NO: 2653371 - DNA, 15 bp, Homo sapiens
aatttagttattgat

SEQ ID NO: 2653372 - DNA, 17 bp, Homo sapiens
aatttattagttaatat

SEQ ID NO: 2653373 - DNA, 16 bp, Homo sapiens
aatttattattgaaat

SEQ ID NO: 2653374 - DNA, 16 bp, Homo sapiens
aatttattattgttct

SEQ ID NO: 2653375 - DNA, 16 bp, Homo sapiens
aatttattgcttgata

SEQ ID NO: 2653376 - DNA, 22 bp, Homo sapiens
aatttatttattaagatggatt

SEQ ID NO: 2653377 - DNA, 15 bp, Homo sapiens
aatttatttttgcat

SEQ ID NO: 2653378 - DNA, 22 bp, Homo sapiens
aatttcaggttttgtaaagatg

SEQ ID NO: 2653379 - DNA, 22 bp, Homo sapiens
aatttcatacctatcatcttaa

SEQ ID NO: 2653380 - DNA, 17 bp, Homo sapiens
aatttccagtacctttg

SEQ ID NO: 2653381 - DNA, 20 bp, Homo sapiens
aatttccagtacctttgtca

SEQ ID NO: 2653382 - DNA, 22 bp, Homo sapiens
aatttccccaacagtgtgaagt

SEQ ID NO: 2653383 - DNA, 18 bp, Homo sapiens
aatttcctggtgtgaagg

SEQ ID NO: 2653384 - DNA, 21 bp, Homo sapiens
aatttcctgttggatttgttt

SEQ ID NO: 2653385 - DNA, 16 bp, Homo sapiens
aatttctaccatttca

SEQ ID NO: 2653386 - DNA, 16 bp, Homo sapiens
aatttctactttgaag

SEQ ID NO: 2653387 - DNA, 20 bp, Homo sapiens
aatttcttggtaagaagccg

SEQ ID NO: 2653388 - DNA, 22 bp, Homo sapiens
aatttctttatgtaatctatgt

SEQ ID NO: 2653389 - DNA, 19 bp, Homo sapiens
aatttgaaaataattgttc

SEQ ID NO: 2653390 - DNA, 12 bp, Homo sapiens
aatttgaatgaa

SEQ ID NO: 2653391 - DNA, 13 bp, Homo sapiens
aatttgaatgaaa

SEQ ID NO: 2653392 - DNA, 14 bp, Homo sapiens
aatttgaatgaaaa

SEQ ID NO: 2653393 - DNA, 18 bp, Homo sapiens
aatttgagagaaatatga

SEQ ID NO: 2653394 - DNA, 13 bp, Homo sapiens
aatttgaggacaa

SEQ ID NO: 2653395 - DNA, 13 bp, Homo sapiens
aatttgagtgctc

SEQ ID NO: 2653396 - DNA, 20 bp, Homo sapiens
aatttgatacatatgtgaat

SEQ ID NO: 2653397 - DNA, 21 bp, Homo sapiens
aatttgatagtattgtgcata

SEQ ID NO: 2653398 - DNA, 17 bp, Homo sapiens
aatttgattattaacat

SEQ ID NO: 2653399 - DNA, 15 bp, Homo sapiens
aatttgccctcccat

SEQ ID NO: 2653400 - DNA, 16 bp, Homo sapiens
aatttggttctaatag

SEQ ID NO: 2653401 - DNA, 23 bp, Homo sapiens
aatttgtaaaaacagcattgctt

SEQ ID NO: 2653402 - DNA, 14 bp, Homo sapiens
aatttgtaagtttc

SEQ ID NO: 2653403 - DNA, 16 bp, Homo sapiens
aatttgtaagtttcag

SEQ ID NO: 2653404 - DNA, 15 bp, Homo sapiens
aatttgtaattgctt

SEQ ID NO: 2653405 - DNA, 20 bp, Homo sapiens
aatttgtacatatgtaaaat

SEQ ID NO: 2653406 - DNA, 14 bp, Homo sapiens
aatttgtgatacaa

SEQ ID NO: 2653407 - DNA, 20 bp, Homo sapiens
aatttgtgatacaatgctgt

SEQ ID NO: 2653408 - DNA, 17 bp, Homo sapiens
aatttgtttgaaatctt

SEQ ID NO: 2653409 - DNA, 18 bp, Homo sapiens
aattttaaataaaagtga

SEQ ID NO: 2653410 - DNA, 22 bp, Homo sapiens
aattttaagtgctttgtaatgg

SEQ ID NO: 2653411 - DNA, 13 bp, Homo sapiens
aattttaatttat

SEQ ID NO: 2653412 - DNA, 19 bp, Homo sapiens
aattttatagctcagttta

SEQ ID NO: 2653413 - DNA, 16 bp, Homo sapiens
aattttatctcttatt

SEQ ID NO: 2653414 - DNA, 12 bp, Homo sapiens
aattttatgaat

SEQ ID NO: 2653415 - DNA, 19 bp, Homo sapiens
aattttatgagggccacgg

SEQ ID NO: 2653416 - DNA, 12 bp, Homo sapiens
aattttattcct

SEQ ID NO: 2653417 - DNA, 19 bp, Homo sapiens
aattttcaagtaattgtga

SEQ ID NO: 2653418 - DNA, 18 bp, Homo sapiens
aattttctcccaggaagc

SEQ ID NO: 2653419 - DNA, 21 bp, Homo sapiens
aattttctgtgttctgaagtc

SEQ ID NO: 2653420 - DNA, 13 bp, Homo sapiens
aattttcttcatg

SEQ ID NO: 2653421 - DNA, 14 bp, Homo sapiens
aattttcttcatgc

SEQ ID NO: 2653422 - DNA, 16 bp, Homo sapiens
aattttgacactatat

SEQ ID NO: 2653423 - DNA, 14 bp, Homo sapiens
aattttgatgtttt

SEQ ID NO: 2653424 - DNA, 19 bp, Homo sapiens
aattttggttgtattcttt

SEQ ID NO: 2653425 - DNA, 20 bp, Homo sapiens
aattttggttgtattctttg

SEQ ID NO: 2653426 - DNA, 14 bp, Homo sapiens
aattttgtattttc

SEQ ID NO: 2653427 - DNA, 13 bp, Homo sapiens
aattttgttgctg

SEQ ID NO: 2653428 - DNA, 22 bp, Homo sapiens
aatttttaaagtatatatttat

SEQ ID NO: 2653429 - DNA, 20 bp, Homo sapiens
aatttttaaatgtaaaacat

SEQ ID NO: 2653430 - DNA, 17 bp, Homo sapiens
aatttttattaaattat

SEQ ID NO: 2653431 - DNA, 18 bp, Homo sapiens
aatttttattaaattatg

SEQ ID NO: 2653432 - DNA, 18 bp, Homo sapiens
aatttttggttgaataaa

SEQ ID NO: 2653433 - DNA, 20 bp, Homo sapiens
aattttttatcatgcatgtc

SEQ ID NO: 2653434 - DNA, 20 bp, Homo sapiens
aatttttttaattttgtatt

SEQ ID NO: 2653435 - DNA, 22 bp, Homo sapiens
aatttttttatcgtcactgctt

SEQ ID NO: 2653436 - DNA, 19 bp, Homo sapiens
aatttttttcaatatttat

SEQ ID NO: 2653437 - DNA, 21 bp, Homo sapiens
aatttttttcatcttctctgg

SEQ ID NO: 2653438 - DNA, 19 bp, Homo sapiens
aatttttttttcctagccc

SEQ ID NO: 2653439 - DNA, 20 bp, Homo sapiens
aattttttttttttaacttt

SEQ ID NO: 2653440 - DNA, 17 bp, Homo sapiens
acaaaaaaaaagtttta

SEQ ID NO: 2653441 - DNA, 19 bp, Homo sapiens
acaaaaaaaaagttttatt

SEQ ID NO: 2653442 - DNA, 14 bp, Homo sapiens
acaaaaacacagca

SEQ ID NO: 2653443 - DNA, 13 bp, Homo sapiens
acaaaaacatggc

SEQ ID NO: 2653444 - DNA, 14 bp, Homo sapiens
acaaaaattaaaat

SEQ ID NO: 2653445 - DNA, 12 bp, Homo sapiens
acaaaacaaatg

SEQ ID NO: 2653446 - DNA, 22 bp, Homo sapiens
acaaaagcatgtgagactggtt

SEQ ID NO: 2653447 - DNA, 22 bp, Homo sapiens
acaaaataaccaatcctggaca

SEQ ID NO: 2653448 - DNA, 15 bp, Homo sapiens
acaaaatagaagctg

SEQ ID NO: 2653449 - DNA, 20 bp, Homo sapiens
acaaaatttagtttttgttc

SEQ ID NO: 2653450 - DNA, 18 bp, Homo sapiens
acaaacaatggaaactga

SEQ ID NO: 2653451 - DNA, 14 bp, Homo sapiens
acaaacatcactct

SEQ ID NO: 2653452 - DNA, 14 bp, Homo sapiens
acaaacatgaccct

SEQ ID NO: 2653453 - DNA, 19 bp, Homo sapiens
acaaacatgtggttaatgc

SEQ ID NO: 2653454 - DNA, 21 bp, Homo sapiens
acaaaccgagtgcaatgaatg

SEQ ID NO: 2653455 - DNA, 15 bp, Homo sapiens
acaaacgggctcagc

SEQ ID NO: 2653456 - DNA, 18 bp, Homo sapiens
acaaacgtatgtaaatgt

SEQ ID NO: 2653457 - DNA, 21 bp, Homo sapiens
acaaacgtatgtaaatgtata

SEQ ID NO: 2653458 - DNA, 22 bp, Homo sapiens
acaaactatttcttatatatgt

SEQ ID NO: 2653459 - DNA, 18 bp, Homo sapiens
acaaagaagacaacatta

SEQ ID NO: 2653460 - DNA, 19 bp, Homo sapiens
acaaagaagacatgtttta

SEQ ID NO: 2653461 - DNA, 18 bp, Homo sapiens
acaaagacaaattctgtt

SEQ ID NO: 2653462 - DNA, 19 bp, Homo sapiens
acaaagacaaattctgttt

SEQ ID NO: 2653463 - DNA, 13 bp, Homo sapiens
acaaagactgagt

SEQ ID NO: 2653464 - DNA, 14 bp, Homo sapiens
acaaagcacagtgt

SEQ ID NO: 2653465 - DNA, 16 bp, Homo sapiens
acaaagcacagtgtta

SEQ ID NO: 2653466 - DNA, 16 bp, Homo sapiens
acaaagcacagtttga

SEQ ID NO: 2653467 - DNA, 11 bp, Homo sapiens
acaaagccaga

SEQ ID NO: 2653468 - DNA, 16 bp, Homo sapiens
acaaagccagaagctg

SEQ ID NO: 2653469 - DNA, 18 bp, Homo sapiens
acaaagcccttccatgtc

SEQ ID NO: 2653470 - DNA, 16 bp, Homo sapiens
acaaagcttagcagga

SEQ ID NO: 2653471 - DNA, 19 bp, Homo sapiens
acaaagcttagcaggagag

SEQ ID NO: 2653472 - DNA, 20 bp, Homo sapiens
acaaagcttctatcccagga

SEQ ID NO: 2653473 - DNA, 23 bp, Homo sapiens
acaaagcttggaagagcctgcag

SEQ ID NO: 2653474 - DNA, 15 bp, Homo sapiens
acaaagggttttaat

SEQ ID NO: 2653475 - DNA, 16 bp, Homo sapiens
acaaataacaatgtgc

SEQ ID NO: 2653476 - DNA, 17 bp, Homo sapiens
acaaatactcatgtgta

SEQ ID NO: 2653477 - DNA, 18 bp, Homo sapiens
acaaatactcatgtgtat

SEQ ID NO: 2653478 - DNA, 18 bp, Homo sapiens
acaaatatttattttctt

SEQ ID NO: 2653479 - DNA, 21 bp, Homo sapiens
acaaatctcaagcaaacagct

SEQ ID NO: 2653480 - DNA, 16 bp, Homo sapiens
acaaattctgtttctt

SEQ ID NO: 2653481 - DNA, 19 bp, Homo sapiens
acaaatttacagagacaga

SEQ ID NO: 2653482 - DNA, 13 bp, Homo sapiens
acaacaagagttt

SEQ ID NO: 2653483 - DNA, 19 bp, Homo sapiens
acaacagaagcttcagaag

SEQ ID NO: 2653484 - DNA, 14 bp, Homo sapiens
acaacagatttgtg

SEQ ID NO: 2653485 - DNA, 17 bp, Homo sapiens
acaggaagatcttaaat

SEQ ID NO: 2653486 - DNA, 15 bp, Homo sapiens
acaggaagcacccca

SEQ ID NO: 2653487 - DNA, 17 bp, Homo sapiens
acaggacagtgcttcag

SEQ ID NO: 2653488 - DNA, 23 bp, Homo sapiens
acaggaccagggatttccatgat

SEQ ID NO: 2653489 - DNA, 17 bp, Homo sapiens
acaggacccccttcccc

SEQ ID NO: 2653490 - DNA, 16 bp, Homo sapiens
acaggactctgcctcc

SEQ ID NO: 2653491 - DNA, 20 bp, Homo sapiens
acaggaggacaattcatgaa

SEQ ID NO: 2653492 - DNA, 19 bp, Homo sapiens
acaggataaagatatcaat

SEQ ID NO: 2653493 - DNA, 21 bp, Homo sapiens
acaggatcctattctcaccag

SEQ ID NO: 2653494 - DNA, 19 bp, Homo sapiens
acaggatgggggctggcct

SEQ ID NO: 2653495 - DNA, 14 bp, Homo sapiens
acaggattattgga

SEQ ID NO: 2653496 - DNA, 20 bp, Homo sapiens
acaggcaagcacctcctgcc

SEQ ID NO: 2653497 - DNA, 23 bp, Homo sapiens
acaggcaagcacctcctgcctcg

SEQ ID NO: 2653498 - DNA, 14 bp, Homo sapiens
acaggcaatgctgg

SEQ ID NO: 2653499 - DNA, 16 bp, Homo sapiens
acaggcaatgctggct

SEQ ID NO: 2653500 - DNA, 23 bp, Homo sapiens
acaggcaatgctggctgttggct

SEQ ID NO: 2653501 - DNA, 12 bp, Homo sapiens
acaggcacaaaa

SEQ ID NO: 2653502 - DNA, 14 bp, Homo sapiens
acaggcacccacca

SEQ ID NO: 2653503 - DNA, 17 bp, Homo sapiens
acaggcaccgagaatgt

SEQ ID NO: 2653504 - DNA, 22 bp, Homo sapiens
acaggcagcctggacatagaga

SEQ ID NO: 2653505 - DNA, 13 bp, Homo sapiens
acaggcaggtcca

SEQ ID NO: 2653506 - DNA, 15 bp, Homo sapiens
acaggcatgttctct

SEQ ID NO: 2653507 - DNA, 22 bp, Homo sapiens
acaggcatgttctctgaggaca

SEQ ID NO: 2653508 - DNA, 22 bp, Homo sapiens
acaggcccagcattgctggttc

SEQ ID NO: 2653509 - DNA, 23 bp, Homo sapiens
acaggcccagcattgctggttct

SEQ ID NO: 2653510 - DNA, 21 bp, Homo sapiens
acaggcccccttgagtggggt

SEQ ID NO: 2653511 - DNA, 17 bp, Homo sapiens
acaggcccggctccagg

SEQ ID NO: 2653512 - DNA, 21 bp, Homo sapiens
acaggcccggctccaggctcc

SEQ ID NO: 2653513 - DNA, 17 bp, Homo sapiens
acaggctgggcttcagt

SEQ ID NO: 2653514 - DNA, 21 bp, Homo sapiens
acaggctgggcttcagtggca

SEQ ID NO: 2653515 - DNA, 23 bp, Homo sapiens
acagggaaccctgcttgcacttt

SEQ ID NO: 2653516 - DNA, 13 bp, Homo sapiens
acagggaagctac

SEQ ID NO: 2653517 - DNA, 12 bp, Homo sapiens
acagggagggga

SEQ ID NO: 2653518 - DNA, 23 bp, Homo sapiens
acagggatgagcatggagctggc

SEQ ID NO: 2653519 - DNA, 17 bp, Homo sapiens
acagggcagctgggccc

SEQ ID NO: 2653520 - DNA, 18 bp, Homo sapiens
acagggcagctgggccca

SEQ ID NO: 2653521 - DNA, 21 bp, Homo sapiens
acagggcatctccaggaaggc

SEQ ID NO: 2653522 - DNA, 21 bp, Homo sapiens
acagggctgataagctaacac

SEQ ID NO: 2653523 - DNA, 20 bp, Homo sapiens
acagggctggcccagccctg

SEQ ID NO: 2653524 - DNA, 22 bp, Homo sapiens
acagggctggcccagccctgct

SEQ ID NO: 2653525 - DNA, 23 bp, Homo sapiens
acagggtctctagtgctgtgaaa

SEQ ID NO: 2653526 - DNA, 22 bp, Homo sapiens
acaggtcaatacagtacaggca

SEQ ID NO: 2653527 - DNA, 18 bp, Homo sapiens
acaggtggacacacaagg

SEQ ID NO: 2653528 - DNA, 22 bp, Homo sapiens
acaggtgggcttcccagtggct

SEQ ID NO: 2653529 - DNA, 22 bp, Homo sapiens
acaggtgtgagtcaccaagccc

SEQ ID NO: 2653530 - DNA, 14 bp, Homo sapiens
acaggtgtttatac

SEQ ID NO: 2653531 - DNA, 18 bp, Homo sapiens
acaggttacaacagattt

SEQ ID NO: 2653532 - DNA, 22 bp, Homo sapiens
acaggttacaacagatttgtga

SEQ ID NO: 2653533 - DNA, 21 bp, Homo sapiens
acaggttattttagtttctgt

SEQ ID NO: 2653534 - DNA, 10 bp, Homo sapiens
acagtaactt

SEQ ID NO: 2653535 - DNA, 13 bp, Homo sapiens
acagtacaggcag

SEQ ID NO: 2653536 - DNA, 16 bp, Homo sapiens
acagtacaggcagcac

SEQ ID NO: 2653537 - DNA, 14 bp, Homo sapiens
acagtaggagccca

SEQ ID NO: 2653538 - DNA, 17 bp, Homo sapiens
acagtattacttctgct

SEQ ID NO: 2653539 - DNA, 14 bp, Homo sapiens
acagtccagcctgg

SEQ ID NO: 2653540 - DNA, 15 bp, Homo sapiens
acagtccagcctgga

SEQ ID NO: 2653541 - DNA, 16 bp, Homo sapiens
acagtccagcctggag

SEQ ID NO: 2653542 - DNA, 18 bp, Homo sapiens
acagtccagcctggagat

SEQ ID NO: 2653543 - DNA, 12 bp, Homo sapiens
acagtccctgcc

SEQ ID NO: 2653544 - DNA, 13 bp, Homo sapiens
acagtcctcccat

SEQ ID NO: 2653545 - DNA, 17 bp, Homo sapiens
acagtcctcccatctca

SEQ ID NO: 2653546 - DNA, 23 bp, Homo sapiens
acagtcctgggagaacctcaggc

SEQ ID NO: 2653547 - DNA, 18 bp, Homo sapiens
acagtccttaccagcaga

SEQ ID NO: 2653548 - DNA, 14 bp, Homo sapiens
acagtctcaggaaa

SEQ ID NO: 2653549 - DNA, 16 bp, Homo sapiens
acagtctcaggaaatc

SEQ ID NO: 2653550 - DNA, 22 bp, Homo sapiens
acagtctgatcgtgacgctgaa

SEQ ID NO: 2653551 - DNA, 13 bp, Homo sapiens
acagtctgtcatg

SEQ ID NO: 2653552 - DNA, 19 bp, Homo sapiens
acagtcttccatttgcaag

SEQ ID NO: 2653553 - DNA, 14 bp, Homo sapiens
acagtcttgtatta

SEQ ID NO: 2653554 - DNA, 15 bp, Homo sapiens
acagtcttgtattaa

SEQ ID NO: 2653555 - DNA, 21 bp, Homo sapiens
acagtgaaaatgtaagctgtt

SEQ ID NO: 2653556 - DNA, 14 bp, Homo sapiens
acagtgatctccat

SEQ ID NO: 2653557 - DNA, 22 bp, Homo sapiens
acagtgatctccatatgttaca

SEQ ID NO: 2653558 - DNA, 24 bp, Homo sapiens
acagtgatgctgtgctatgaattt

SEQ ID NO: 2653559 - DNA, 21 bp, Homo sapiens
acagtgcctgggaatgtatta

SEQ ID NO: 2653560 - DNA, 17 bp, Homo sapiens
acagtgccttcaataaa

SEQ ID NO: 2653561 - DNA, 20 bp, Homo sapiens
acagtgccttcaataaatgg

SEQ ID NO: 2653562 - DNA, 21 bp, Homo sapiens
acagtgcttcagcctgaggct

SEQ ID NO: 2653563 - DNA, 20 bp, Homo sapiens
acagtgcttgccacagagcg

SEQ ID NO: 2653564 - DNA, 21 bp, Homo sapiens
acagtggctcacgcctgtaat

SEQ ID NO: 2653565 - DNA, 14 bp, Homo sapiens
acagtgggagccag

SEQ ID NO: 2653566 - DNA, 15 bp, Homo sapiens
acagtgggagccagg

SEQ ID NO: 2653567 - DNA, 13 bp, Homo sapiens
acagtggtggcag

SEQ ID NO: 2653568 - DNA, 12 bp, Homo sapiens
acagtgtacagt

SEQ ID NO: 2653569 - DNA, 13 bp, Homo sapiens
acagtgtacagtc

SEQ ID NO: 2653570 - DNA, 15 bp, Homo sapiens
acagtgtacagtctt

SEQ ID NO: 2653571 - DNA, 18 bp, Homo sapiens
acagtgtacagtcttgta

SEQ ID NO: 2653572 - DNA, 23 bp, Homo sapiens
acagtgtctgtatcggagacagt

SEQ ID NO: 2653573 - DNA, 18 bp, Homo sapiens
acagtgtgaagttagaat

SEQ ID NO: 2653574 - DNA, 19 bp, Homo sapiens
acagtgtgaagttagaatt

SEQ ID NO: 2653575 - DNA, 22 bp, Homo sapiens
acagtgtgaagttagaattcct

SEQ ID NO: 2653576 - DNA, 21 bp, Homo sapiens
acagtgttgaaaatgttcaga

SEQ ID NO: 2653577 - DNA, 9 bp, Homo sapiens
acagtgttt

SEQ ID NO: 2653578 - DNA, 15 bp, Homo sapiens
acagtgtttcccata

SEQ ID NO: 2653579 - DNA, 18 bp, Homo sapiens
acagtgtttcccataatt

SEQ ID NO: 2653580 - DNA, 19 bp, Homo sapiens
acagtgtttcgacagctga

SEQ ID NO: 2653581 - DNA, 14 bp, Homo sapiens
acagttaactttca

SEQ ID NO: 2653582 - DNA, 16 bp, Homo sapiens
acagttaactttcaga

SEQ ID NO: 2653583 - DNA, 13 bp, Homo sapiens
acagttactcaga

SEQ ID NO: 2653584 - DNA, 20 bp, Homo sapiens
acagttcaagaaagcttcaa

SEQ ID NO: 2653585 - DNA, 21 bp, Homo sapiens
acagttcagtggcagggctca

SEQ ID NO: 2653586 - DNA, 15 bp, Homo sapiens
acagttcatatgtac

SEQ ID NO: 2653587 - DNA, 15 bp, Homo sapiens
acagttgaaaaacag

SEQ ID NO: 2653588 - DNA, 22 bp, Homo sapiens
acagttgctgtcataagaatga

SEQ ID NO: 2653589 - DNA, 16 bp, Homo sapiens
acagttggccttcaga

SEQ ID NO: 2653590 - DNA, 15 bp, Homo sapiens
acagttgttggcctc

SEQ ID NO: 2653591 - DNA, 18 bp, Homo sapiens
acagtttcttagcttttt

SEQ ID NO: 2653592 - DNA, 20 bp, Homo sapiens
acagtttcttagctttttaa

SEQ ID NO: 2653593 - DNA, 15 bp, Homo sapiens
acagtttgaacaaaa

SEQ ID NO: 2653594 - DNA, 20 bp, Homo sapiens
acagtttgttagtatgaggc

SEQ ID NO: 2653595 - DNA, 14 bp, Homo sapiens
acagttttccatga

SEQ ID NO: 2653596 - DNA, 16 bp, Homo sapiens
acagttttccatgaaa

SEQ ID NO: 2653597 - DNA, 19 bp, Homo sapiens
acagttttccatgaaaacg

SEQ ID NO: 2653598 - DNA, 21 bp, Homo sapiens
acagttttccatgaaaacgtt

SEQ ID NO: 2653599 - DNA, 14 bp, Homo sapiens
acagttttccttct

SEQ ID NO: 2653600 - DNA, 19 bp, Homo sapiens
acagttttggttgctttaa

SEQ ID NO: 2653601 - DNA, 15 bp, Homo sapiens
acataacgtttttcc

SEQ ID NO: 2653602 - DNA, 16 bp, Homo sapiens
acataagataaatgtg

SEQ ID NO: 2653603 - DNA, 22 bp, Homo sapiens
acataagcggcgtaagtttaaa

SEQ ID NO: 2653604 - DNA, 21 bp, Homo sapiens
acataatgcgtgcataccact

SEQ ID NO: 2653605 - DNA, 18 bp, Homo sapiens
acataattttttattcaa

SEQ ID NO: 2653606 - DNA, 16 bp, Homo sapiens
acatacaattattttt

SEQ ID NO: 2653607 - DNA, 16 bp, Homo sapiens
acatacacacatatgt

SEQ ID NO: 2653608 - DNA, 21 bp, Homo sapiens
acatactaaccagcagaaatg

SEQ ID NO: 2653609 - DNA, 22 bp, Homo sapiens
acatactaaccagcagaaatgc

SEQ ID NO: 2653610 - DNA, 12 bp, Homo sapiens
acatactgctgt

SEQ ID NO: 2653611 - DNA, 22 bp, Homo sapiens
acatactttcatcctgactctg

SEQ ID NO: 2653612 - DNA, 14 bp, Homo sapiens
acatagaattaaca

SEQ ID NO: 2653613 - DNA, 20 bp, Homo sapiens
acatagagagggagaagaag

SEQ ID NO: 2653614 - DNA, 15 bp, Homo sapiens
acatagatgtccctt

SEQ ID NO: 2653615 - DNA, 20 bp, Homo sapiens
acatagcctatatttacagt

SEQ ID NO: 2653616 - DNA, 19 bp, Homo sapiens
acatagcgaatacaaaatt

SEQ ID NO: 2653617 - DNA, 21 bp, Homo sapiens
acatagcttacaagccagctg

SEQ ID NO: 2653618 - DNA, 15 bp, Homo sapiens
acatatgaaatttaa

SEQ ID NO: 2653619 - DNA, 13 bp, Homo sapiens
acatatgtgaata

SEQ ID NO: 2653620 - DNA, 16 bp, Homo sapiens
acatattgatttccgt

SEQ ID NO: 2653621 - DNA, 18 bp, Homo sapiens
acatattgatttccgtta

SEQ ID NO: 2653622 - DNA, 18 bp, Homo sapiens
acatatttccaagaagtt

SEQ ID NO: 2653623 - DNA, 15 bp, Homo sapiens
acatatttgtggaat

SEQ ID NO: 2653624 - DNA, 18 bp, Homo sapiens
acatcaacatcttggtca

SEQ ID NO: 2653625 - DNA, 13 bp, Homo sapiens
acatcaatgttca

SEQ ID NO: 2653626 - DNA, 18 bp, Homo sapiens
acatcaatgttcattgta

SEQ ID NO: 2653627 - DNA, 22 bp, Homo sapiens
acatcacccttaccatgtgcct

SEQ ID NO: 2653628 - DNA, 23 bp, Homo sapiens
acatcaccgacgcgtctcctgtt

SEQ ID NO: 2653629 - DNA, 24 bp, Homo sapiens
acccgaggctgcccactatggtca

SEQ ID NO: 2653630 - DNA, 12 bp, Homo sapiens
acccgatgctgc

SEQ ID NO: 2653631 - DNA, 13 bp, Homo sapiens
acccgatgctgct

SEQ ID NO: 2653632 - DNA, 18 bp, Homo sapiens
acccgcctctcccgtcag

SEQ ID NO: 2653633 - DNA, 16 bp, Homo sapiens
acccgctttcttgctg

SEQ ID NO: 2653634 - DNA, 22 bp, Homo sapiens
acccggagctaacactggcccc

SEQ ID NO: 2653635 - DNA, 23 bp, Homo sapiens
acccggagctaacactggcccct

SEQ ID NO: 2653636 - DNA, 12 bp, Homo sapiens
acccggaggcca

SEQ ID NO: 2653637 - DNA, 22 bp, Homo sapiens
acccggcaggctagaacctggc

SEQ ID NO: 2653638 - DNA, 20 bp, Homo sapiens
acccggcccctgctggttca

SEQ ID NO: 2653639 - DNA, 19 bp, Homo sapiens
acccgggaagggggctggg

SEQ ID NO: 2653640 - DNA, 15 bp, Homo sapiens
acccgggaggcagag

SEQ ID NO: 2653641 - DNA, 18 bp, Homo sapiens
acccgttctgctggcctg

SEQ ID NO: 2653642 - DNA, 22 bp, Homo sapiens
acccgttctgctggcctggatc

SEQ ID NO: 2653643 - DNA, 19 bp, Homo sapiens
accctaaaaagcagagctt

SEQ ID NO: 2653644 - DNA, 21 bp, Homo sapiens
accctagttctacctcaggca

SEQ ID NO: 2653645 - DNA, 17 bp, Homo sapiens
accctatatgtagtata

SEQ ID NO: 2653646 - DNA, 17 bp, Homo sapiens
accctcagcaccccttc

SEQ ID NO: 2653647 - DNA, 15 bp, Homo sapiens
accctcaggacaatg

SEQ ID NO: 2653648 - DNA, 20 bp, Homo sapiens
accctcaggcataggcctgg

SEQ ID NO: 2653649 - DNA, 13 bp, Homo sapiens
accctcatgctgt

SEQ ID NO: 2653650 - DNA, 14 bp, Homo sapiens
accctcatgttctt

SEQ ID NO: 2653651 - DNA, 16 bp, Homo sapiens
accctcccatggcacc

SEQ ID NO: 2653652 - DNA, 17 bp, Homo sapiens
accctcccatggcacct

SEQ ID NO: 2653653 - DNA, 14 bp, Homo sapiens
accctcccctctct

SEQ ID NO: 2653654 - DNA, 19 bp, Homo sapiens
accctcccctctcttgcac

SEQ ID NO: 2653655 - DNA, 20 bp, Homo sapiens
accctccctcagcccctctt

SEQ ID NO: 2653656 - DNA, 23 bp, Homo sapiens
accctccctccgatccttcctcc

SEQ ID NO: 2653657 - DNA, 12 bp, Homo sapiens
accctccctgga

SEQ ID NO: 2653658 - DNA, 14 bp, Homo sapiens
accctccctggagt

SEQ ID NO: 2653659 - DNA, 15 bp, Homo sapiens
accctccgccttcac

SEQ ID NO: 2653660 - DNA, 22 bp, Homo sapiens
accctccgccttcactccggtg

SEQ ID NO: 2653661 - DNA, 23 bp, Homo sapiens
accctcctgtcttcccagggtag

SEQ ID NO: 2653662 - DNA, 16 bp, Homo sapiens
accctcgggcccacct

SEQ ID NO: 2653663 - DNA, 17 bp, Homo sapiens
accctcgggcccacctg

SEQ ID NO: 2653664 - DNA, 18 bp, Homo sapiens
accctcgggcccacctgg

SEQ ID NO: 2653665 - DNA, 19 bp, Homo sapiens
accctctgaatggtccagg

SEQ ID NO: 2653666 - DNA, 21 bp, Homo sapiens
accctctgaatggtccagggt

SEQ ID NO: 2653667 - DNA, 11 bp, Homo sapiens
accctgagccc

SEQ ID NO: 2653668 - DNA, 17 bp, Homo sapiens
accctgagccccttcct

SEQ ID NO: 2653669 - DNA, 17 bp, Homo sapiens
accctgagctgaggcag

SEQ ID NO: 2653670 - DNA, 16 bp, Homo sapiens
accctgaggcccagag

SEQ ID NO: 2653671 - DNA, 17 bp, Homo sapiens
accctgaggcccagagg

SEQ ID NO: 2653672 - DNA, 18 bp, Homo sapiens
accctgcccctgccccgt

SEQ ID NO: 2653673 - DNA, 14 bp, Homo sapiens
accctgccctgtgg

SEQ ID NO: 2653674 - DNA, 15 bp, Homo sapiens
accctgccctgtggg

SEQ ID NO: 2653675 - DNA, 18 bp, Homo sapiens
accctgcgaaggggccct

SEQ ID NO: 2653676 - DNA, 13 bp, Homo sapiens
accctggagccca

SEQ ID NO: 2653677 - DNA, 16 bp, Homo sapiens
accctggatcagtcct

SEQ ID NO: 2653678 - DNA, 20 bp, Homo sapiens
accctgggctctgggagcag

SEQ ID NO: 2653679 - DNA, 17 bp, Homo sapiens
accctggggcctggacc

SEQ ID NO: 2653680 - DNA, 20 bp, Homo sapiens
accctgtactgttctgtgtc

SEQ ID NO: 2653681 - DNA, 19 bp, Homo sapiens
accctgtcccccagctctg

SEQ ID NO: 2653682 - DNA, 20 bp, Homo sapiens
accctgtcccccagctctgg

SEQ ID NO: 2653683 - DNA, 21 bp, Homo sapiens
accctgtcccccagctctggt

SEQ ID NO: 2653684 - DNA, 14 bp, Homo sapiens
accctgtctctact

SEQ ID NO: 2653685 - DNA, 20 bp, Homo sapiens
accctgtgatggggccctgc

SEQ ID NO: 2653686 - DNA, 22 bp, Homo sapiens
accctgtgatggggccctgcct

SEQ ID NO: 2653687 - DNA, 15 bp, Homo sapiens
accctgtgctggtgt

SEQ ID NO: 2653688 - DNA, 19 bp, Homo sapiens
accctgtgctggtgtcctg

SEQ ID NO: 2653689 - DNA, 23 bp, Homo sapiens
accctgtgctggtgtcctgacca

SEQ ID NO: 2653690 - DNA, 22 bp, Homo sapiens
acccttaccatgtgcctgatcc

SEQ ID NO: 2653691 - DNA, 18 bp, Homo sapiens
acccttaccccttagcct

SEQ ID NO: 2653692 - DNA, 19 bp, Homo sapiens
acccttaccccttagcctc

SEQ ID NO: 2653693 - DNA, 19 bp, Homo sapiens
acccttcccttgagccctc

SEQ ID NO: 2653694 - DNA, 15 bp, Homo sapiens
acccttctttcctct

SEQ ID NO: 2653695 - DNA, 11 bp, Homo sapiens
acccttggcct

SEQ ID NO: 2653696 - DNA, 16 bp, Homo sapiens
acccttgtggtcccac

SEQ ID NO: 2653697 - DNA, 23 bp, Homo sapiens
acccttgtggtcccaccccacac

SEQ ID NO: 2653698 - DNA, 20 bp, Homo sapiens
accctttgaattggacaata

SEQ ID NO: 2653699 - DNA, 12 bp, Homo sapiens
acccttttccag

SEQ ID NO: 2653700 - DNA, 12 bp, Homo sapiens
accgaaacagcg

SEQ ID NO: 2653701 - DNA, 23 bp, Homo sapiens
accgagcctctgtcactgcaggc

SEQ ID NO: 2653702 - DNA, 16 bp, Homo sapiens
accgaggcgcgggggc

SEQ ID NO: 2653703 - DNA, 17 bp, Homo sapiens
accgaggcgcgggggcc

SEQ ID NO: 2653704 - DNA, 17 bp, Homo sapiens
accgaggctggagctgg

SEQ ID NO: 2653705 - DNA, 18 bp, Homo sapiens
accgaggctggagctggc

SEQ ID NO: 2653706 - DNA, 14 bp, Homo sapiens
accgagtgaaccta

SEQ ID NO: 2653707 - DNA, 13 bp, Homo sapiens
accgatgctccag

SEQ ID NO: 2653708 - DNA, 15 bp, Homo sapiens
accgatgctccagcc

SEQ ID NO: 2653709 - DNA, 23 bp, Homo sapiens
accgatgctccagccaacccctg

SEQ ID NO: 2653710 - DNA, 20 bp, Homo sapiens
accgcagaagcctccccagc

SEQ ID NO: 2653711 - DNA, 17 bp, Homo sapiens
accgcagacaggaccag

SEQ ID NO: 2653712 - DNA, 12 bp, Homo sapiens
accgcaggaagc

SEQ ID NO: 2653713 - DNA, 13 bp, Homo sapiens
accgcaggaagct

SEQ ID NO: 2653714 - DNA, 19 bp, Homo sapiens
accgcaggaagctgctccg

SEQ ID NO: 2653715 - DNA, 21 bp, Homo sapiens
accgcagtcgtcgcacagtct

SEQ ID NO: 2653716 - DNA, 22 bp, Homo sapiens
accgcagtcgtcgcacagtctc

SEQ ID NO: 2653717 - DNA, 23 bp, Homo sapiens
accgcagtcgtcgcacagtctct

SEQ ID NO: 2653718 - DNA, 17 bp, Homo sapiens
accgccagatggggcct

SEQ ID NO: 2653719 - DNA, 17 bp, Homo sapiens
accgctccccagcccag

SEQ ID NO: 2653720 - DNA, 18 bp, Homo sapiens
accgctccccagcccagg

SEQ ID NO: 2653721 - DNA, 19 bp, Homo sapiens
accgctccccagcccaggg

SEQ ID NO: 2653722 - DNA, 20 bp, Homo sapiens
accgctccccagcccagggt

SEQ ID NO: 2653723 - DNA, 23 bp, Homo sapiens
accggagctttcaaagaaggaat

SEQ ID NO: 2653724 - DNA, 13 bp, Homo sapiens
accggatcctggg

SEQ ID NO: 2653725 - DNA, 14 bp, Homo sapiens
accggatcctgggt

SEQ ID NO: 2653726 - DNA, 15 bp, Homo sapiens
accggctggcctggc

SEQ ID NO: 2653727 - DNA, 21 bp, Homo sapiens
accgggctgggagctctgcag

SEQ ID NO: 2653728 - DNA, 16 bp, Homo sapiens
accgtccgccctgctc

SEQ ID NO: 2653729 - DNA, 17 bp, Homo sapiens
accgtggaccttcctgc

SEQ ID NO: 2653730 - DNA, 15 bp, Homo sapiens
accgtgggcggggcc

SEQ ID NO: 2653731 - DNA, 19 bp, Homo sapiens
accgtgggcggggccttgc

SEQ ID NO: 2653732 - DNA, 20 bp, Homo sapiens
accgtgggcggggccttgcg

SEQ ID NO: 2653733 - DNA, 13 bp, Homo sapiens
accgtttcttccc

SEQ ID NO: 2653734 - DNA, 19 bp, Homo sapiens
acctaaaatttgccctccc

SEQ ID NO: 2653735 - DNA, 18 bp, Homo sapiens
acctacagtgtacagtct

SEQ ID NO: 2653736 - DNA, 13 bp, Homo sapiens
acctacatgtatt

SEQ ID NO: 2653737 - DNA, 16 bp, Homo sapiens
acctacctcaggttgc

SEQ ID NO: 2653738 - DNA, 14 bp, Homo sapiens
acctagaagggcta

SEQ ID NO: 2653739 - DNA, 16 bp, Homo sapiens
acctagcgtcagtatt

SEQ ID NO: 2653740 - DNA, 20 bp, Homo sapiens
acctagggatgttctggccc

SEQ ID NO: 2653741 - DNA, 15 bp, Homo sapiens
acctagtagtcattt

SEQ ID NO: 2653742 - DNA, 13 bp, Homo sapiens
acctagtctaagg

SEQ ID NO: 2653743 - DNA, 18 bp, Homo sapiens
acctataaagtaaagcta

SEQ ID NO: 2653744 - DNA, 22 bp, Homo sapiens
acctatataataaagctactga

SEQ ID NO: 2653745 - DNA, 22 bp, Homo sapiens
acctatggtataatggttgact

SEQ ID NO: 2653746 - DNA, 23 bp, Homo sapiens
acctcaaacttccagtcaggtag

SEQ ID NO: 2653747 - DNA, 22 bp, Homo sapiens
acctcaacccccatttctattt

SEQ ID NO: 2653748 - DNA, 22 bp, Homo sapiens
acctcaactgcctactccaaaa

SEQ ID NO: 2653749 - DNA, 19 bp, Homo sapiens
acctcacccgaggctgccc

SEQ ID NO: 2653750 - DNA, 16 bp, Homo sapiens
acctcacgcacctccc

SEQ ID NO: 2653751 - DNA, 22 bp, Homo sapiens
acctcagacttaccaggaagca

SEQ ID NO: 2653752 - DNA, 15 bp, Homo sapiens
acctcagcctagacc

SEQ ID NO: 2653753 - DNA, 12 bp, Homo sapiens
acctcagcctcc

SEQ ID NO: 2653754 - DNA, 11 bp, Homo sapiens
acctcagcctg

SEQ ID NO: 2653755 - DNA, 16 bp, Homo sapiens
acctcagcctgtgctg

SEQ ID NO: 2653756 - DNA, 20 bp, Homo sapiens
acctcagccttccccttgcc

SEQ ID NO: 2653757 - DNA, 14 bp, Homo sapiens
acctcagctctggg

SEQ ID NO: 2653758 - DNA, 17 bp, Homo sapiens
acctcagctctgggaga

SEQ ID NO: 2653759 - DNA, 13 bp, Homo sapiens
acctcaggccagg

SEQ ID NO: 2653760 - DNA, 20 bp, Homo sapiens
acctcaggtgatccacccac

SEQ ID NO: 2653761 - DNA, 16 bp, Homo sapiens
acctcagttcccttgg

SEQ ID NO: 2653762 - DNA, 22 bp, Homo sapiens
acctcagttcccttggcctcag

SEQ ID NO: 2653763 - DNA, 23 bp, Homo sapiens
acctcagttcccttggcctcaga

SEQ ID NO: 2653764 - DNA, 21 bp, Homo sapiens
acctcatgcatctccacctgc

SEQ ID NO: 2653765 - DNA, 21 bp, Homo sapiens
acctccagaaacggccattca

SEQ ID NO: 2653766 - DNA, 13 bp, Homo sapiens
acctcccagccct

SEQ ID NO: 2653767 - DNA, 22 bp, Homo sapiens
acctcccagccctatggatgtg

SEQ ID NO: 2653768 - DNA, 22 bp, Homo sapiens
acctcccctccttgcctcctgt

SEQ ID NO: 2653769 - DNA, 10 bp, Homo sapiens
acctccctcc

SEQ ID NO: 2653770 - DNA, 15 bp, Homo sapiens
acctccctgaaccat

SEQ ID NO: 2653771 - DNA, 17 bp, Homo sapiens
acctccctgacccgtct

SEQ ID NO: 2653772 - DNA, 16 bp, Homo sapiens
acctccgcctcccggg

SEQ ID NO: 2653773 - DNA, 14 bp, Homo sapiens
actgtataaatagg

SEQ ID NO: 2653774 - DNA, 20 bp, Homo sapiens
actgtataaataggagagga

SEQ ID NO: 2653775 - DNA, 21 bp, Homo sapiens
actgtataaataggagaggat

SEQ ID NO: 2653776 - DNA, 23 bp, Homo sapiens
actgtataaataggagaggatga

SEQ ID NO: 2653777 - DNA, 13 bp, Homo sapiens
actgtatataaag

SEQ ID NO: 2653778 - DNA, 20 bp, Homo sapiens
actgtatcatgacaaagact

SEQ ID NO: 2653779 - DNA, 13 bp, Homo sapiens
actgtattaagag

SEQ ID NO: 2653780 - DNA, 21 bp, Homo sapiens
actgtattaagagtgaaaatt

SEQ ID NO: 2653781 - DNA, 17 bp, Homo sapiens
actgtatttgtgactaa

SEQ ID NO: 2653782 - DNA, 22 bp, Homo sapiens
actgtatttgtgactaattgta

SEQ ID NO: 2653783 - DNA, 15 bp, Homo sapiens
actgtcaaaataatt

SEQ ID NO: 2653784 - DNA, 17 bp, Homo sapiens
actgtcaccctccacct

SEQ ID NO: 2653785 - DNA, 23 bp, Homo sapiens
actgtcagctcccctcggagaag

SEQ ID NO: 2653786 - DNA, 14 bp, Homo sapiens
actgtccctcaaat

SEQ ID NO: 2653787 - DNA, 17 bp, Homo sapiens
actgtcctacccaccct

SEQ ID NO: 2653788 - DNA, 18 bp, Homo sapiens
actgtcctacccaccctc

SEQ ID NO: 2653789 - DNA, 23 bp, Homo sapiens
actgtcctacccaccctcctttc

SEQ ID NO: 2653790 - DNA, 23 bp, Homo sapiens
actgtcctgggcgccctggaagc

SEQ ID NO: 2653791 - DNA, 12 bp, Homo sapiens
actgtctcactg

SEQ ID NO: 2653792 - DNA, 21 bp, Homo sapiens
actgtctcgatgcaatgaaca

SEQ ID NO: 2653793 - DNA, 15 bp, Homo sapiens
actgtctctcctgat

SEQ ID NO: 2653794 - DNA, 16 bp, Homo sapiens
actgtgaagagaacca

SEQ ID NO: 2653795 - DNA, 14 bp, Homo sapiens
actgtgacaggcag

SEQ ID NO: 2653796 - DNA, 20 bp, Homo sapiens
actgtgatgccacacagagt

SEQ ID NO: 2653797 - DNA, 19 bp, Homo sapiens
actgtgcacatctgtgtct

SEQ ID NO: 2653798 - DNA, 21 bp, Homo sapiens
actgtgcagagtctagaagtt

SEQ ID NO: 2653799 - DNA, 18 bp, Homo sapiens
actgtgccatgtgccagg

SEQ ID NO: 2653800 - DNA, 12 bp, Homo sapiens
actgtgctaata

SEQ ID NO: 2653801 - DNA, 18 bp, Homo sapiens
actgtgctggagccacta

SEQ ID NO: 2653802 - DNA, 15 bp, Homo sapiens
actgtggaaaaatat

SEQ ID NO: 2653803 - DNA, 16 bp, Homo sapiens
actgtggaggaaggat

SEQ ID NO: 2653804 - DNA, 18 bp, Homo sapiens
actgtggaggaaggattg

SEQ ID NO: 2653805 - DNA, 15 bp, Homo sapiens
actgtggcacacgcc

SEQ ID NO: 2653806 - DNA, 12 bp, Homo sapiens
actgtgtataga

SEQ ID NO: 2653807 - DNA, 10 bp, Homo sapiens
actgtgtgtg

SEQ ID NO: 2653808 - DNA, 14 bp, Homo sapiens
actgtgttcattag

SEQ ID NO: 2653809 - DNA, 21 bp, Homo sapiens
actgttaatagttcaggtaac

SEQ ID NO: 2653810 - DNA, 20 bp, Homo sapiens
actgttagaaaatggacact

SEQ ID NO: 2653811 - DNA, 19 bp, Homo sapiens
actgttatgaaataaagaa

SEQ ID NO: 2653812 - DNA, 23 bp, Homo sapiens
actgttatgaaataaagaaattg

SEQ ID NO: 2653813 - DNA, 17 bp, Homo sapiens
actgttatttataatca

SEQ ID NO: 2653814 - DNA, 21 bp, Homo sapiens
actgttatttataatcacttt

SEQ ID NO: 2653815 - DNA, 15 bp, Homo sapiens
actgttccccctgtg

SEQ ID NO: 2653816 - DNA, 18 bp, Homo sapiens
actgttccctctgctcct

SEQ ID NO: 2653817 - DNA, 22 bp, Homo sapiens
actgttccctctgctcctggag

SEQ ID NO: 2653818 - DNA, 14 bp, Homo sapiens
actgttctctgccc

SEQ ID NO: 2653819 - DNA, 15 bp, Homo sapiens
actgttctctgccct

SEQ ID NO: 2653820 - DNA, 18 bp, Homo sapiens
actgttctctgccctcca

SEQ ID NO: 2653821 - DNA, 18 bp, Homo sapiens
actgttctcttcttgaac

SEQ ID NO: 2653822 - DNA, 15 bp, Homo sapiens
actgttctgtgtctt

SEQ ID NO: 2653823 - DNA, 23 bp, Homo sapiens
actgttgaaaattattttaaaca

SEQ ID NO: 2653824 - DNA, 17 bp, Homo sapiens
actgttgcccaggctgg

SEQ ID NO: 2653825 - DNA, 21 bp, Homo sapiens
actgttgctcaaatctattca

SEQ ID NO: 2653826 - DNA, 13 bp, Homo sapiens
actgttgtataaa

SEQ ID NO: 2653827 - DNA, 15 bp, Homo sapiens
actgttgtataaatt

SEQ ID NO: 2653828 - DNA, 13 bp, Homo sapiens
actgtttcaaact

SEQ ID NO: 2653829 - DNA, 19 bp, Homo sapiens
actgtttcaaactttacta

SEQ ID NO: 2653830 - DNA, 13 bp, Homo sapiens
actgtttctctgc

SEQ ID NO: 2653831 - DNA, 18 bp, Homo sapiens
actgtttgaggtttttaa

SEQ ID NO: 2653832 - DNA, 14 bp, Homo sapiens
actgtttttaccca

SEQ ID NO: 2653833 - DNA, 15 bp, Homo sapiens
actgtttttacccat

SEQ ID NO: 2653834 - DNA, 17 bp, Homo sapiens
acttaaaaaaatgacag

SEQ ID NO: 2653835 - DNA, 14 bp, Homo sapiens
acttaaaaaatgtc

SEQ ID NO: 2653836 - DNA, 13 bp, Homo sapiens
acttaaaaatggt

SEQ ID NO: 2653837 - DNA, 22 bp, Homo sapiens
acttaaaaatggtttaaatggt

SEQ ID NO: 2653838 - DNA, 14 bp, Homo sapiens
acttaaaaatgtaa

SEQ ID NO: 2653839 - DNA, 17 bp, Homo sapiens
acttaaaaatgtaaata

SEQ ID NO: 2653840 - DNA, 20 bp, Homo sapiens
acttaaaatattcctgcatt

SEQ ID NO: 2653841 - DNA, 13 bp, Homo sapiens
acttaaaatattt

SEQ ID NO: 2653842 - DNA, 15 bp, Homo sapiens
acttaaagatttatc

SEQ ID NO: 2653843 - DNA, 16 bp, Homo sapiens
acttaaataatgtgaa

SEQ ID NO: 2653844 - DNA, 18 bp, Homo sapiens
acttaaataatgtgaaac

SEQ ID NO: 2653845 - DNA, 20 bp, Homo sapiens
acttaaataatgtgaaactg

SEQ ID NO: 2653846 - DNA, 19 bp, Homo sapiens
acttaacggctccaggatt

SEQ ID NO: 2653847 - DNA, 17 bp, Homo sapiens
acttaataatgtgtaca

SEQ ID NO: 2653848 - DNA, 15 bp, Homo sapiens
acttaatctaaatgg

SEQ ID NO: 2653849 - DNA, 17 bp, Homo sapiens
acttaatctaaatggaa

SEQ ID NO: 2653850 - DNA, 19 bp, Homo sapiens
acttaatctaaatggaacc

SEQ ID NO: 2653851 - DNA, 13 bp, Homo sapiens
acttaatgaatga

SEQ ID NO: 2653852 - DNA, 14 bp, Homo sapiens
acttaattgctaca

SEQ ID NO: 2653853 - DNA, 14 bp, Homo sapiens
acttactgtacatg

SEQ ID NO: 2653854 - DNA, 15 bp, Homo sapiens
acttactgtacatga

SEQ ID NO: 2653855 - DNA, 18 bp, Homo sapiens
acttagatctccaggaga

SEQ ID NO: 2653856 - DNA, 16 bp, Homo sapiens
acttagctatcagaag

SEQ ID NO: 2653857 - DNA, 20 bp, Homo sapiens
acttatcatccacattgttt

SEQ ID NO: 2653858 - DNA, 21 bp, Homo sapiens
acttattggaactctgcttga

SEQ ID NO: 2653859 - DNA, 15 bp, Homo sapiens
acttattttctctgt

SEQ ID NO: 2653860 - DNA, 19 bp, Homo sapiens
acttatttttgacagtgtt

SEQ ID NO: 2653861 - DNA, 15 bp, Homo sapiens
acttatttttttctg

SEQ ID NO: 2653862 - DNA, 19 bp, Homo sapiens
acttatttttttctgattg

SEQ ID NO: 2653863 - DNA, 17 bp, Homo sapiens
acttcaaaagtattttc

SEQ ID NO: 2653864 - DNA, 15 bp, Homo sapiens
acttcaatgatagta

SEQ ID NO: 2653865 - DNA, 16 bp, Homo sapiens
acttcacacacaggca

SEQ ID NO: 2653866 - DNA, 20 bp, Homo sapiens
acttcacagagtgtgctgga

SEQ ID NO: 2653867 - DNA, 22 bp, Homo sapiens
acttcacagagtgtgctggagg

SEQ ID NO: 2653868 - DNA, 17 bp, Homo sapiens
acttcactttaattctc

SEQ ID NO: 2653869 - DNA, 21 bp, Homo sapiens
acttcagacatagaattaaca

SEQ ID NO: 2653870 - DNA, 16 bp, Homo sapiens
acttcagagagctggt

SEQ ID NO: 2653871 - DNA, 20 bp, Homo sapiens
acttcagagagctggtagtt

SEQ ID NO: 2653872 - DNA, 11 bp, Homo sapiens
acttcagctga

SEQ ID NO: 2653873 - DNA, 16 bp, Homo sapiens
acttcagctgactttt

SEQ ID NO: 2653874 - DNA, 19 bp, Homo sapiens
acttcagggcagggctctg

SEQ ID NO: 2653875 - DNA, 20 bp, Homo sapiens
acttcagggcagggctctga

SEQ ID NO: 2653876 - DNA, 15 bp, Homo sapiens
acttcattcttgaaa

SEQ ID NO: 2653877 - DNA, 20 bp, Homo sapiens
acttccaaacctgacagatg

SEQ ID NO: 2653878 - DNA, 21 bp, Homo sapiens
acttccaaatcccctaagcag

SEQ ID NO: 2653879 - DNA, 16 bp, Homo sapiens
acttccaccagcctgc

SEQ ID NO: 2653880 - DNA, 17 bp, Homo sapiens
acttccactgccatcct

SEQ ID NO: 2653881 - DNA, 17 bp, Homo sapiens
acttccataatctggac

SEQ ID NO: 2653882 - DNA, 16 bp, Homo sapiens
acttccatacagctct

SEQ ID NO: 2653883 - DNA, 17 bp, Homo sapiens
acttccatacagctcta

SEQ ID NO: 2653884 - DNA, 18 bp, Homo sapiens
acttccatggccctcatt

SEQ ID NO: 2653885 - DNA, 22 bp, Homo sapiens
acttcccagttcaggagtccca

SEQ ID NO: 2653886 - DNA, 24 bp, Homo sapiens
acttcccagttcaggagtcccaag

SEQ ID NO: 2653887 - DNA, 15 bp, Homo sapiens
acttcctgtgacttc

SEQ ID NO: 2653888 - DNA, 17 bp, Homo sapiens
acttcctgtttgggccc

SEQ ID NO: 2653889 - DNA, 18 bp, Homo sapiens
acttcctgtttgggcccc

SEQ ID NO: 2653890 - DNA, 21 bp, Homo sapiens
acttcctgtttgggcccctct

SEQ ID NO: 2653891 - DNA, 16 bp, Homo sapiens
acttccttgctctccc

SEQ ID NO: 2653892 - DNA, 15 bp, Homo sapiens
acttcgactcaggat

SEQ ID NO: 2653893 - DNA, 14 bp, Homo sapiens
acttcgactgtgac

SEQ ID NO: 2653894 - DNA, 22 bp, Homo sapiens
acttcgtgggatctgcccctcc

SEQ ID NO: 2653895 - DNA, 15 bp, Homo sapiens
acttctaaatgaagt

SEQ ID NO: 2653896 - DNA, 17 bp, Homo sapiens
acttctaaatgcatatc

SEQ ID NO: 2653897 - DNA, 13 bp, Homo sapiens
acttctaagtaaa

SEQ ID NO: 2653898 - DNA, 18 bp, Homo sapiens
acttctaagtaaaaccac

SEQ ID NO: 2653899 - DNA, 15 bp, Homo sapiens
acttctaatatattt

SEQ ID NO: 2653900 - DNA, 23 bp, Homo sapiens
acttctacttctgcccttgccaa

SEQ ID NO: 2653901 - DNA, 14 bp, Homo sapiens
acttctccaccctg

SEQ ID NO: 2653902 - DNA, 13 bp, Homo sapiens
acttctccagcct

SEQ ID NO: 2653903 - DNA, 17 bp, Homo sapiens
acttctctgaagggagg

SEQ ID NO: 2653904 - DNA, 20 bp, Homo sapiens
acttctgccatattctgttg

SEQ ID NO: 2653905 - DNA, 16 bp, Homo sapiens
acttctgctttccaca

SEQ ID NO: 2653906 - DNA, 19 bp, Homo sapiens
acttctgctttccacacct

SEQ ID NO: 2653907 - DNA, 22 bp, Homo sapiens
acttctgggcttcatctggcaa

SEQ ID NO: 2653908 - DNA, 21 bp, Homo sapiens
acttctgtcttcacaacagat

SEQ ID NO: 2653909 - DNA, 20 bp, Homo sapiens
acttcttcagagctgacaca

SEQ ID NO: 2653910 - DNA, 18 bp, Homo sapiens
acttctttgctttgccca

SEQ ID NO: 2653911 - DNA, 20 bp, Homo sapiens
acttctttgctttgcccagc

SEQ ID NO: 2653912 - DNA, 15 bp, Homo sapiens
acttcttttcacatt

SEQ ID NO: 2653913 - DNA, 18 bp, Homo sapiens
acttcttttcacattctt

SEQ ID NO: 2653914 - DNA, 21 bp, Homo sapiens
acttcttttcacattcttata

SEQ ID NO: 2653915 - DNA, 20 bp, Homo sapiens
acttgacagaacactgtctt

SEQ ID NO: 2653916 - DNA, 19 bp, Homo sapiens
acttgagggcccagagcag

SEQ ID NO: 2653917 - DNA, 15 bp, Homo sapiens
acttgagttttattt

SEQ ID NO: 2653918 - DNA, 18 bp, Homo sapiens
agacatggagactcctgc

SEQ ID NO: 2653919 - DNA, 19 bp, Homo sapiens
agacatggggaggaaggac

SEQ ID NO: 2653920 - DNA, 17 bp, Homo sapiens
agacatgtggtgggaca

SEQ ID NO: 2653921 - DNA, 15 bp, Homo sapiens
agacattaaatctat

SEQ ID NO: 2653922 - DNA, 16 bp, Homo sapiens
agacattgtcaataaa

SEQ ID NO: 2653923 - DNA, 13 bp, Homo sapiens
agaccaaaataaa

SEQ ID NO: 2653924 - DNA, 17 bp, Homo sapiens
agaccaaggcgggagca

SEQ ID NO: 2653925 - DNA, 23 bp, Homo sapiens
agaccaaggcgggagcatctctt

SEQ ID NO: 2653926 - DNA, 20 bp, Homo sapiens
agaccacagggttcaaaatg

SEQ ID NO: 2653927 - DNA, 14 bp, Homo sapiens
agaccaccccgcct

SEQ ID NO: 2653928 - DNA, 14 bp, Homo sapiens
agaccacgtttcta

SEQ ID NO: 2653929 - DNA, 16 bp, Homo sapiens
agaccagactgtggag

SEQ ID NO: 2653930 - DNA, 17 bp, Homo sapiens
agaccagactgtggaga

SEQ ID NO: 2653931 - DNA, 14 bp, Homo sapiens
agaccagcctggcc

SEQ ID NO: 2653932 - DNA, 16 bp, Homo sapiens
agaccaggcaaagcaa

SEQ ID NO: 2653933 - DNA, 18 bp, Homo sapiens
agaccagttgggagcact

SEQ ID NO: 2653934 - DNA, 20 bp, Homo sapiens
agaccagttgggagcactgg

SEQ ID NO: 2653935 - DNA, 21 bp, Homo sapiens
agaccagttgggagcactgga

SEQ ID NO: 2653936 - DNA, 16 bp, Homo sapiens
agaccatgcagagcgc

SEQ ID NO: 2653937 - DNA, 17 bp, Homo sapiens
agacccaaaaggcagaa

SEQ ID NO: 2653938 - DNA, 15 bp, Homo sapiens
agaccccacccaagc

SEQ ID NO: 2653939 - DNA, 13 bp, Homo sapiens
agacccccacccc

SEQ ID NO: 2653940 - DNA, 19 bp, Homo sapiens
agacccccggaacaagcct

SEQ ID NO: 2653941 - DNA, 22 bp, Homo sapiens
agacccctctggccaggatgga

SEQ ID NO: 2653942 - DNA, 15 bp, Homo sapiens
agacccgaggaaact

SEQ ID NO: 2653943 - DNA, 20 bp, Homo sapiens
agacccttgtggtcccaccc

SEQ ID NO: 2653944 - DNA, 17 bp, Homo sapiens
agaccgaactgttgtat

SEQ ID NO: 2653945 - DNA, 20 bp, Homo sapiens
agaccgaactgttgtataaa

SEQ ID NO: 2653946 - DNA, 21 bp, Homo sapiens
agaccgagcgctttctggaaa

SEQ ID NO: 2653947 - DNA, 16 bp, Homo sapiens
agaccgagtgaaccta

SEQ ID NO: 2653948 - DNA, 19 bp, Homo sapiens
agacctaacgagaaataga

SEQ ID NO: 2653949 - DNA, 14 bp, Homo sapiens
agacctagggagga

SEQ ID NO: 2653950 - DNA, 16 bp, Homo sapiens
agacctattcctcctg

SEQ ID NO: 2653951 - DNA, 11 bp, Homo sapiens
agacctcagcc

SEQ ID NO: 2653952 - DNA, 12 bp, Homo sapiens
agacctcagcct

SEQ ID NO: 2653953 - DNA, 15 bp, Homo sapiens
agacctcatcaggat

SEQ ID NO: 2653954 - DNA, 16 bp, Homo sapiens
agacctcatcaggatg

SEQ ID NO: 2653955 - DNA, 19 bp, Homo sapiens
agacctgacaagcactgct

SEQ ID NO: 2653956 - DNA, 13 bp, Homo sapiens
agacctggagccc

SEQ ID NO: 2653957 - DNA, 22 bp, Homo sapiens
agacctggagcccctgggtggg

SEQ ID NO: 2653958 - DNA, 13 bp, Homo sapiens
agacctgtaatca

SEQ ID NO: 2653959 - DNA, 16 bp, Homo sapiens
agaccttcaccaaaca

SEQ ID NO: 2653960 - DNA, 13 bp, Homo sapiens
agaccttccataa

SEQ ID NO: 2653961 - DNA, 22 bp, Homo sapiens
agaccttccataatgctactgt

SEQ ID NO: 2653962 - DNA, 11 bp, Homo sapiens
agaccttctcc

SEQ ID NO: 2653963 - DNA, 18 bp, Homo sapiens
agaccttctccttcacct

SEQ ID NO: 2653964 - DNA, 21 bp, Homo sapiens
agaccttctccttcacctttg

SEQ ID NO: 2653965 - DNA, 20 bp, Homo sapiens
agacctttgaggatatcaaa

SEQ ID NO: 2653966 - DNA, 12 bp, Homo sapiens
agaccttttcaa

SEQ ID NO: 2653967 - DNA, 21 bp, Homo sapiens
agacgacaaggaaaggcaaat

SEQ ID NO: 2653968 - DNA, 20 bp, Homo sapiens
agacgaggccctcgggccca

SEQ ID NO: 2653969 - DNA, 23 bp, Homo sapiens
agacgaggccctcgggcccagcc

SEQ ID NO: 2653970 - DNA, 20 bp, Homo sapiens
agacgccggggacagaggcc

SEQ ID NO: 2653971 - DNA, 22 bp, Homo sapiens
agacgccggggacagaggcctg

SEQ ID NO: 2653972 - DNA, 20 bp, Homo sapiens
agacgctgtgctgccctgcc

SEQ ID NO: 2653973 - DNA, 21 bp, Homo sapiens
agacgctgtgctgccctgccc

SEQ ID NO: 2653974 - DNA, 20 bp, Homo sapiens
agacgtacgtatcagcggcc

SEQ ID NO: 2653975 - DNA, 14 bp, Homo sapiens
agacgtgtttgtgt

SEQ ID NO: 2653976 - DNA, 13 bp, Homo sapiens
agactaagccctg

SEQ ID NO: 2653977 - DNA, 14 bp, Homo sapiens
agactaagccctgt

SEQ ID NO: 2653978 - DNA, 16 bp, Homo sapiens
agactagattgccttt

SEQ ID NO: 2653979 - DNA, 19 bp, Homo sapiens
agactagattgcctttgtt

SEQ ID NO: 2653980 - DNA, 15 bp, Homo sapiens
agactatcagcccaa

SEQ ID NO: 2653981 - DNA, 15 bp, Homo sapiens
agactatctaaatgt

SEQ ID NO: 2653982 - DNA, 12 bp, Homo sapiens
agactattcaaa

SEQ ID NO: 2653983 - DNA, 21 bp, Homo sapiens
agactattcaaacagtctcag

SEQ ID NO: 2653984 - DNA, 21 bp, Homo sapiens
agactcaaggttcccagagat

SEQ ID NO: 2653985 - DNA, 16 bp, Homo sapiens
agactcagggccccag

SEQ ID NO: 2653986 - DNA, 12 bp, Homo sapiens
agactcagtgtt

SEQ ID NO: 2653987 - DNA, 13 bp, Homo sapiens
agactcagtgttc

SEQ ID NO: 2653988 - DNA, 17 bp, Homo sapiens
agactcagtttgtcaga

SEQ ID NO: 2653989 - DNA, 21 bp, Homo sapiens
agactcagtttgtcagacttt

SEQ ID NO: 2653990 - DNA, 16 bp, Homo sapiens
agactccaaagaaatg

SEQ ID NO: 2653991 - DNA, 22 bp, Homo sapiens
agactccaaagaaatgtaaggg

SEQ ID NO: 2653992 - DNA, 16 bp, Homo sapiens
agactcccaagctgga

SEQ ID NO: 2653993 - DNA, 22 bp, Homo sapiens
agactcctaggcaggacatgct

SEQ ID NO: 2653994 - DNA, 19 bp, Homo sapiens
agactcctgcaggcagcca

SEQ ID NO: 2653995 - DNA, 20 bp, Homo sapiens
agactcctgcaggcagccag

SEQ ID NO: 2653996 - DNA, 15 bp, Homo sapiens
agactcctgccctgt

SEQ ID NO: 2653997 - DNA, 17 bp, Homo sapiens
agactctacagaggcca

SEQ ID NO: 2653998 - DNA, 13 bp, Homo sapiens
agactctaccaga

SEQ ID NO: 2653999 - DNA, 14 bp, Homo sapiens
agactctggtcttc

SEQ ID NO: 2654000 - DNA, 18 bp, Homo sapiens
agactctgtctcaaaaaa

SEQ ID NO: 2654001 - DNA, 18 bp, Homo sapiens
agactctgtctcagtcca

SEQ ID NO: 2654002 - DNA, 18 bp, Homo sapiens
agactgaacttaccgtga

SEQ ID NO: 2654003 - DNA, 12 bp, Homo sapiens
agactgaccaat

SEQ ID NO: 2654004 - DNA, 19 bp, Homo sapiens
agactgctgggactggcca

SEQ ID NO: 2654005 - DNA, 22 bp, Homo sapiens
agactgctgggactggccaggt

SEQ ID NO: 2654006 - DNA, 22 bp, Homo sapiens
agactgcttcccatcctaccct

SEQ ID NO: 2654007 - DNA, 11 bp, Homo sapiens
agactggaagg

SEQ ID NO: 2654008 - DNA, 16 bp, Homo sapiens
agactggatactgccc

SEQ ID NO: 2654009 - DNA, 18 bp, Homo sapiens
agactggcacagttttct

SEQ ID NO: 2654010 - DNA, 21 bp, Homo sapiens
agactggcacagttttctgag

SEQ ID NO: 2654011 - DNA, 14 bp, Homo sapiens
agactggctggctg

SEQ ID NO: 2654012 - DNA, 11 bp, Homo sapiens
agactggcttt

SEQ ID NO: 2654013 - DNA, 22 bp, Homo sapiens
agactggcttttattaatgcac

SEQ ID NO: 2654014 - DNA, 12 bp, Homo sapiens
agactgggctga

SEQ ID NO: 2654015 - DNA, 18 bp, Homo sapiens
agactggtcctgtgtgca

SEQ ID NO: 2654016 - DNA, 15 bp, Homo sapiens
agactgtacaaagta

SEQ ID NO: 2654017 - DNA, 20 bp, Homo sapiens
agactgtaggaagagtagca

SEQ ID NO: 2654018 - DNA, 21 bp, Homo sapiens
agactgtcagcttccaaacat

SEQ ID NO: 2654019 - DNA, 23 bp, Homo sapiens
agactgttgctcaaatctattca

SEQ ID NO: 2654020 - DNA, 17 bp, Homo sapiens
agacttaatagaaacat

SEQ ID NO: 2654021 - DNA, 21 bp, Homo sapiens
agacttccaaacctgacagat

SEQ ID NO: 2654022 - DNA, 16 bp, Homo sapiens
agacttcgactcagga

SEQ ID NO: 2654023 - DNA, 20 bp, Homo sapiens
agacttcgactcaggatcca

SEQ ID NO: 2654024 - DNA, 12 bp, Homo sapiens
agacttctgctt

SEQ ID NO: 2654025 - DNA, 18 bp, Homo sapiens
agacttctgctttccaca

SEQ ID NO: 2654026 - DNA, 12 bp, Homo sapiens
agactttggaaa

SEQ ID NO: 2654027 - DNA, 17 bp, Homo sapiens
agactttggaaagactt

SEQ ID NO: 2654028 - DNA, 19 bp, Homo sapiens
agactttttttaaatagta

SEQ ID NO: 2654029 - DNA, 22 bp, Homo sapiens
agagaaaaaatattttcctgcc

SEQ ID NO: 2654030 - DNA, 11 bp, Homo sapiens
agagaaaagaa

SEQ ID NO: 2654031 - DNA, 12 bp, Homo sapiens
agagaaaataaa

SEQ ID NO: 2654032 - DNA, 15 bp, Homo sapiens
agagaaaataaaaag

SEQ ID NO: 2654033 - DNA, 16 bp, Homo sapiens
agagaaaataaaaagt

SEQ ID NO: 2654034 - DNA, 19 bp, Homo sapiens
agagaaaataaaaagttaa

SEQ ID NO: 2654035 - DNA, 13 bp, Homo sapiens
agagaaagagaga

SEQ ID NO: 2654036 - DNA, 14 bp, Homo sapiens
agagaaatatgaag

SEQ ID NO: 2654037 - DNA, 21 bp, Homo sapiens
agagaaccgagcaaagatcaa

SEQ ID NO: 2654038 - DNA, 20 bp, Homo sapiens
agagaacctcacgcacctcc

SEQ ID NO: 2654039 - DNA, 12 bp, Homo sapiens
agagaagaatga

SEQ ID NO: 2654040 - DNA, 15 bp, Homo sapiens
agagaagaatgagcc

SEQ ID NO: 2654041 - DNA, 16 bp, Homo sapiens
agagaagacccttctc

SEQ ID NO: 2654042 - DNA, 21 bp, Homo sapiens
agagaagagattgtggtttca

SEQ ID NO: 2654043 - DNA, 12 bp, Homo sapiens
agagaagaggct

SEQ ID NO: 2654044 - DNA, 17 bp, Homo sapiens
agagaagccccttcccc

SEQ ID NO: 2654045 - DNA, 23 bp, Homo sapiens
agagaagccccttccccatggga

SEQ ID NO: 2654046 - DNA, 13 bp, Homo sapiens
agagaagcctgtg

SEQ ID NO: 2654047 - DNA, 12 bp, Homo sapiens
agagaaggagcc

SEQ ID NO: 2654048 - DNA, 17 bp, Homo sapiens
agagaagtgacagggaa

SEQ ID NO: 2654049 - DNA, 18 bp, Homo sapiens
agagaagtgacagggaag

SEQ ID NO: 2654050 - DNA, 20 bp, Homo sapiens
agagaagtgacagggaagct

SEQ ID NO: 2654051 - DNA, 15 bp, Homo sapiens
agagaatcaacattt

SEQ ID NO: 2654052 - DNA, 17 bp, Homo sapiens
agagaatggaaaacaga

SEQ ID NO: 2654053 - DNA, 16 bp, Homo sapiens
agagaatgtctgatct

SEQ ID NO: 2654054 - DNA, 22 bp, Homo sapiens
agagaatttctaccatttcaga

SEQ ID NO: 2654055 - DNA, 21 bp, Homo sapiens
agagacaaacacctcccagga

SEQ ID NO: 2654056 - DNA, 14 bp, Homo sapiens
agagaccatccctg

SEQ ID NO: 2654057 - DNA, 21 bp, Homo sapiens
agagaccatccctgaaggccc

SEQ ID NO: 2654058 - DNA, 20 bp, Homo sapiens
agagactcagggccccagca

SEQ ID NO: 2654059 - DNA, 14 bp, Homo sapiens
agagactcctgcag

SEQ ID NO: 2654060 - DNA, 17 bp, Homo sapiens
agagactcctgcaggca

SEQ ID NO: 2654061 - DNA, 21 bp, Homo sapiens
agagactccttgagagaccag

SEQ ID NO: 2654062 - DNA, 22 bp, Homo sapiens
agagactctggcctccacagtt

SEQ ID NO: 2654063 - DNA, 15 bp, Homo sapiens
agccaagctccttgg

SEQ ID NO: 2654064 - DNA, 22 bp, Homo sapiens
agccaaggccgaagctctggct

SEQ ID NO: 2654065 - DNA, 18 bp, Homo sapiens
agccaagggttcagagac

SEQ ID NO: 2654066 - DNA, 23 bp, Homo sapiens
agccaaggtgggctgagccctgg

SEQ ID NO: 2654067 - DNA, 23 bp, Homo sapiens
agccaagtcagctttgccttcca

SEQ ID NO: 2654068 - DNA, 13 bp, Homo sapiens
agccaagtccaga

SEQ ID NO: 2654069 - DNA, 15 bp, Homo sapiens
agccaagtccagatt

SEQ ID NO: 2654070 - DNA, 14 bp, Homo sapiens
agccaatcccctcc

SEQ ID NO: 2654071 - DNA, 19 bp, Homo sapiens
agccacaaaataaatgttg

SEQ ID NO: 2654072 - DNA, 19 bp, Homo sapiens
agccacaagaaatttgatt

SEQ ID NO: 2654073 - DNA, 12 bp, Homo sapiens
agccacacacac

SEQ ID NO: 2654074 - DNA, 16 bp, Homo sapiens
agccacacacacagaa

SEQ ID NO: 2654075 - DNA, 18 bp, Homo sapiens
agccacacacacagaaaa

SEQ ID NO: 2654076 - DNA, 19 bp, Homo sapiens
agccacacacacagaaaat

SEQ ID NO: 2654077 - DNA, 21 bp, Homo sapiens
agccacacacacagaaaatat

SEQ ID NO: 2654078 - DNA, 23 bp, Homo sapiens
agccacacacacagaaaatatac

SEQ ID NO: 2654079 - DNA, 18 bp, Homo sapiens
agccacattcctgatgct

SEQ ID NO: 2654080 - DNA, 16 bp, Homo sapiens
agccaccatctttgca

SEQ ID NO: 2654081 - DNA, 14 bp, Homo sapiens
agccaccccgggct

SEQ ID NO: 2654082 - DNA, 12 bp, Homo sapiens
agccacctctcc

SEQ ID NO: 2654083 - DNA, 14 bp, Homo sapiens
agccacctctcttt

SEQ ID NO: 2654084 - DNA, 14 bp, Homo sapiens
agccacggccaggc

SEQ ID NO: 2654085 - DNA, 15 bp, Homo sapiens
agccacggccaggcc

SEQ ID NO: 2654086 - DNA, 13 bp, Homo sapiens
agccactaactag

SEQ ID NO: 2654087 - DNA, 15 bp, Homo sapiens
agccactcctctgac

SEQ ID NO: 2654088 - DNA, 19 bp, Homo sapiens
agccactcgggaggctgag

SEQ ID NO: 2654089 - DNA, 12 bp, Homo sapiens
agccactgaagc

SEQ ID NO: 2654090 - DNA, 14 bp, Homo sapiens
agccactgtgctga

SEQ ID NO: 2654091 - DNA, 18 bp, Homo sapiens
agccactgtgctgaattc

SEQ ID NO: 2654092 - DNA, 17 bp, Homo sapiens
agccacttaaaatgttc

SEQ ID NO: 2654093 - DNA, 21 bp, Homo sapiens
agccacttaccttcaataaag

SEQ ID NO: 2654094 - DNA, 15 bp, Homo sapiens
agccagaagctgagc

SEQ ID NO: 2654095 - DNA, 21 bp, Homo sapiens
agccagacagcaacggggagg

SEQ ID NO: 2654096 - DNA, 16 bp, Homo sapiens
agccagactctggtct

SEQ ID NO: 2654097 - DNA, 19 bp, Homo sapiens
agccagactggcacagttt

SEQ ID NO: 2654098 - DNA, 11 bp, Homo sapiens
agccagagaag

SEQ ID NO: 2654099 - DNA, 15 bp, Homo sapiens
agccagagaagtgac

SEQ ID NO: 2654100 - DNA, 21 bp, Homo sapiens
agccagagaagtgacagggaa

SEQ ID NO: 2654101 - DNA, 15 bp, Homo sapiens
agccagagttcctgc

SEQ ID NO: 2654102 - DNA, 22 bp, Homo sapiens
agccagatggactccagcctgc

SEQ ID NO: 2654103 - DNA, 16 bp, Homo sapiens
agccagctgccgacca

SEQ ID NO: 2654104 - DNA, 18 bp, Homo sapiens
agccagctttccctgcct

SEQ ID NO: 2654105 - DNA, 23 bp, Homo sapiens
agccaggagcaaatgtttctgca

SEQ ID NO: 2654106 - DNA, 14 bp, Homo sapiens
agccaggatcatgg

SEQ ID NO: 2654107 - DNA, 15 bp, Homo sapiens
agccaggatcatggt

SEQ ID NO: 2654108 - DNA, 18 bp, Homo sapiens
agccaggatcatggtgta

SEQ ID NO: 2654109 - DNA, 23 bp, Homo sapiens
agccaggatcatggtgtaataag

SEQ ID NO: 2654110 - DNA, 22 bp, Homo sapiens
agccaggcctgggtctgtgtct

SEQ ID NO: 2654111 - DNA, 18 bp, Homo sapiens
agccaggcgggctcaagg

SEQ ID NO: 2654112 - DNA, 20 bp, Homo sapiens
agccaggctgccaaggccag

SEQ ID NO: 2654113 - DNA, 21 bp, Homo sapiens
agccaggctgccaaggccaga

SEQ ID NO: 2654114 - DNA, 13 bp, Homo sapiens
agccagggccagg

SEQ ID NO: 2654115 - DNA, 14 bp, Homo sapiens
agccagggccaggg

SEQ ID NO: 2654116 - DNA, 17 bp, Homo sapiens
agccagggccaggggtc

SEQ ID NO: 2654117 - DNA, 23 bp, Homo sapiens
agccagggctatgggagcagctt

SEQ ID NO: 2654118 - DNA, 21 bp, Homo sapiens
agccagtaaatgggggtgcat

SEQ ID NO: 2654119 - DNA, 23 bp, Homo sapiens
agccagtaaatgggggtgcattt

SEQ ID NO: 2654120 - DNA, 13 bp, Homo sapiens
agccagtctttac

SEQ ID NO: 2654121 - DNA, 17 bp, Homo sapiens
agccagtgactccagga

SEQ ID NO: 2654122 - DNA, 18 bp, Homo sapiens
agccagtgactccaggag

SEQ ID NO: 2654123 - DNA, 19 bp, Homo sapiens
agccagtgactccaggaga

SEQ ID NO: 2654124 - DNA, 22 bp, Homo sapiens
agccagtgactccaggagagga

SEQ ID NO: 2654125 - DNA, 21 bp, Homo sapiens
agccatataagtttgaaggaa

SEQ ID NO: 2654126 - DNA, 22 bp, Homo sapiens
agccatctccatcttgaaggaa

SEQ ID NO: 2654127 - DNA, 15 bp, Homo sapiens
agccatcttggtaaa

SEQ ID NO: 2654128 - DNA, 15 bp, Homo sapiens
agccatgctgggaag

SEQ ID NO: 2654129 - DNA, 17 bp, Homo sapiens
agccatgggaccaaacc

SEQ ID NO: 2654130 - DNA, 20 bp, Homo sapiens
agccattaccatggagacaa

SEQ ID NO: 2654131 - DNA, 23 bp, Homo sapiens
agccattcctggtacccagccat

SEQ ID NO: 2654132 - DNA, 17 bp, Homo sapiens
agccattctgactcata

SEQ ID NO: 2654133 - DNA, 17 bp, Homo sapiens
agccattgtcttcggaa

SEQ ID NO: 2654134 - DNA, 14 bp, Homo sapiens
agccatttcttgtt

SEQ ID NO: 2654135 - DNA, 17 bp, Homo sapiens
agccattttgtgaatgg

SEQ ID NO: 2654136 - DNA, 19 bp, Homo sapiens
agccattttgtgaatggat

SEQ ID NO: 2654137 - DNA, 16 bp, Homo sapiens
agcccaaagctgttgg

SEQ ID NO: 2654138 - DNA, 15 bp, Homo sapiens
agcccaatattataa

SEQ ID NO: 2654139 - DNA, 16 bp, Homo sapiens
agcccaatgaaatgaa

SEQ ID NO: 2654140 - DNA, 15 bp, Homo sapiens
agcccacacttgaga

SEQ ID NO: 2654141 - DNA, 17 bp, Homo sapiens
agcccacacttgagagg

SEQ ID NO: 2654142 - DNA, 13 bp, Homo sapiens
agcccacccccct

SEQ ID NO: 2654143 - DNA, 23 bp, Homo sapiens
agcccacccctcaacacctctgc

SEQ ID NO: 2654144 - DNA, 17 bp, Homo sapiens
agcccaccctcctgtct

SEQ ID NO: 2654145 - DNA, 21 bp, Homo sapiens
agcccaccctcctgtcttccc

SEQ ID NO: 2654146 - DNA, 23 bp, Homo sapiens
agcccaccctcctgtcttcccag

SEQ ID NO: 2654147 - DNA, 13 bp, Homo sapiens
agcccaccttggc

SEQ ID NO: 2654148 - DNA, 17 bp, Homo sapiens
agcccacgcccccactg

SEQ ID NO: 2654149 - DNA, 14 bp, Homo sapiens
agcccacttctgcc

SEQ ID NO: 2654150 - DNA, 17 bp, Homo sapiens
agcccagaaaaggacag

SEQ ID NO: 2654151 - DNA, 13 bp, Homo sapiens
agcccagaggtaa

SEQ ID NO: 2654152 - DNA, 18 bp, Homo sapiens
agcccagatcagctccta

SEQ ID NO: 2654153 - DNA, 22 bp, Homo sapiens
agcccagatgttttacgtctgg

SEQ ID NO: 2654154 - DNA, 18 bp, Homo sapiens
agcccaggaaaggctcca

SEQ ID NO: 2654155 - DNA, 20 bp, Homo sapiens
agcccaggaaaggctccagg

SEQ ID NO: 2654156 - DNA, 21 bp, Homo sapiens
agcccaggaaaggctccagga

SEQ ID NO: 2654157 - DNA, 19 bp, Homo sapiens
agcccagggagcggaaagc

SEQ ID NO: 2654158 - DNA, 23 bp, Homo sapiens
agcccagggagcggaaagcagct

SEQ ID NO: 2654159 - DNA, 19 bp, Homo sapiens
agcccagggttcccccagc

SEQ ID NO: 2654160 - DNA, 23 bp, Homo sapiens
agcccagggttcccccagccctg

SEQ ID NO: 2654161 - DNA, 13 bp, Homo sapiens
agcccatcaatta

SEQ ID NO: 2654162 - DNA, 17 bp, Homo sapiens
agcccattcattccatt

SEQ ID NO: 2654163 - DNA, 23 bp, Homo sapiens
agcccattcattccattctggaa

SEQ ID NO: 2654164 - DNA, 21 bp, Homo sapiens
agccccaaaactctcctctgc

SEQ ID NO: 2654165 - DNA, 22 bp, Homo sapiens
agccccaaaactctcctctgct

SEQ ID NO: 2654166 - DNA, 19 bp, Homo sapiens
agccccaagtcctgaagag

SEQ ID NO: 2654167 - DNA, 20 bp, Homo sapiens
agccccacactggggtgccg

SEQ ID NO: 2654168 - DNA, 11 bp, Homo sapiens
agccccagccc

SEQ ID NO: 2654169 - DNA, 12 bp, Homo sapiens
agccccagcccc

SEQ ID NO: 2654170 - DNA, 12 bp, Homo sapiens
agccccagctga

SEQ ID NO: 2654171 - DNA, 16 bp, Homo sapiens
agccccaggcaggctg

SEQ ID NO: 2654172 - DNA, 20 bp, Homo sapiens
agccccaggcaggctgtgcg

SEQ ID NO: 2654173 - DNA, 15 bp, Homo sapiens
agccccaggcctctg

SEQ ID NO: 2654174 - DNA, 21 bp, Homo sapiens
agccccaggcctctgtgtcct

SEQ ID NO: 2654175 - DNA, 18 bp, Homo sapiens
agccccagggtcttccct

SEQ ID NO: 2654176 - DNA, 22 bp, Homo sapiens
agccccagggtcttccctacct

SEQ ID NO: 2654177 - DNA, 20 bp, Homo sapiens
agccccagtgccaagcacag

SEQ ID NO: 2654178 - DNA, 16 bp, Homo sapiens
agccccagtgcccaca

SEQ ID NO: 2654179 - DNA, 17 bp, Homo sapiens
agccccatcagctccag

SEQ ID NO: 2654180 - DNA, 11 bp, Homo sapiens
agccccatcct

SEQ ID NO: 2654181 - DNA, 15 bp, Homo sapiens
agccccatcctctgt

SEQ ID NO: 2654182 - DNA, 16 bp, Homo sapiens
agccccattcctggga

SEQ ID NO: 2654183 - DNA, 18 bp, Homo sapiens
agccccattctgcctgcc

SEQ ID NO: 2654184 - DNA, 22 bp, Homo sapiens
agccccattctgcctgcccagg

SEQ ID NO: 2654185 - DNA, 19 bp, Homo sapiens
agcccccacccacttccct

SEQ ID NO: 2654186 - DNA, 18 bp, Homo sapiens
agcccccccaacactgtg

SEQ ID NO: 2654187 - DNA, 19 bp, Homo sapiens
agcccccccaacactgtgc

SEQ ID NO: 2654188 - DNA, 13 bp, Homo sapiens
agcccccccttcc

SEQ ID NO: 2654189 - DNA, 16 bp, Homo sapiens
agcccccttgacaccg

SEQ ID NO: 2654190 - DNA, 14 bp, Homo sapiens
agccccgaggcctt

SEQ ID NO: 2654191 - DNA, 17 bp, Homo sapiens
agccccgaggccttctc

SEQ ID NO: 2654192 - DNA, 16 bp, Homo sapiens
agccccggccctgggc

SEQ ID NO: 2654193 - DNA, 21 bp, Homo sapiens
agccccggccctgggctcgga

SEQ ID NO: 2654194 - DNA, 13 bp, Homo sapiens
agcccctcccacc

SEQ ID NO: 2654195 - DNA, 21 bp, Homo sapiens
agcccctcttgccccccaccc

SEQ ID NO: 2654196 - DNA, 22 bp, Homo sapiens
agcccctggatgcagcctcaca

SEQ ID NO: 2654197 - DNA, 12 bp, Homo sapiens
agcccctgggtg

SEQ ID NO: 2654198 - DNA, 22 bp, Homo sapiens
agcccctttttcatatgttgct

SEQ ID NO: 2654199 - DNA, 15 bp, Homo sapiens
agcccgaatacaaac

SEQ ID NO: 2654200 - DNA, 15 bp, Homo sapiens
agcccgcacccccac

SEQ ID NO: 2654201 - DNA, 21 bp, Homo sapiens
agcccgcacccccaccctttg

SEQ ID NO: 2654202 - DNA, 12 bp, Homo sapiens
agcccgcctgcc

SEQ ID NO: 2654203 - DNA, 16 bp, Homo sapiens
agcccgcctgccagtc

SEQ ID NO: 2654204 - DNA, 22 bp, Homo sapiens
agcccgcctgccagtcctagct

SEQ ID NO: 2654205 - DNA, 15 bp, Homo sapiens
agcccgcggggacat

SEQ ID NO: 2654206 - DNA, 19 bp, Homo sapiens
agcccgctgagtggactgg

SEQ ID NO: 2654207 - DNA, 12 bp, Homo sapiens
agcttctccagg

SEQ ID NO: 2654208 - DNA, 15 bp, Homo sapiens
agcttctccaggctc

SEQ ID NO: 2654209 - DNA, 14 bp, Homo sapiens
agcttctctgtgaa

SEQ ID NO: 2654210 - DNA, 14 bp, Homo sapiens
agcttctggtactc

SEQ ID NO: 2654211 - DNA, 18 bp, Homo sapiens
agcttcttaaatgagaag

SEQ ID NO: 2654212 - DNA, 17 bp, Homo sapiens
agcttgaaactgagatg

SEQ ID NO: 2654213 - DNA, 22 bp, Homo sapiens
agcttgaaagttttcagaacct

SEQ ID NO: 2654214 - DNA, 13 bp, Homo sapiens
agcttgagcctga

SEQ ID NO: 2654215 - DNA, 18 bp, Homo sapiens
agcttgagggttgggctg

SEQ ID NO: 2654216 - DNA, 14 bp, Homo sapiens
agcttgccccggcc

SEQ ID NO: 2654217 - DNA, 19 bp, Homo sapiens
agcttgccctgttaaaaga

SEQ ID NO: 2654218 - DNA, 17 bp, Homo sapiens
agcttggaaaggaccag

SEQ ID NO: 2654219 - DNA, 17 bp, Homo sapiens
agcttggaagagcctgc

SEQ ID NO: 2654220 - DNA, 12 bp, Homo sapiens
agcttggcagcc

SEQ ID NO: 2654221 - DNA, 13 bp, Homo sapiens
agcttggcagccg

SEQ ID NO: 2654222 - DNA, 17 bp, Homo sapiens
agcttggcagccgagct

SEQ ID NO: 2654223 - DNA, 20 bp, Homo sapiens
agcttggcagccgagctcgt

SEQ ID NO: 2654224 - DNA, 14 bp, Homo sapiens
agcttggccagaag

SEQ ID NO: 2654225 - DNA, 23 bp, Homo sapiens
agcttggctgtagaaggagacag

SEQ ID NO: 2654226 - DNA, 16 bp, Homo sapiens
agcttgggcccagctg

SEQ ID NO: 2654227 - DNA, 21 bp, Homo sapiens
agcttgggcccagctgggctc

SEQ ID NO: 2654228 - DNA, 23 bp, Homo sapiens
agcttgggcccagctgggctctg

SEQ ID NO: 2654229 - DNA, 18 bp, Homo sapiens
agcttgggtttttgttac

SEQ ID NO: 2654230 - DNA, 18 bp, Homo sapiens
agcttgtaaatagctcag

SEQ ID NO: 2654231 - DNA, 14 bp, Homo sapiens
agcttgtggagccc

SEQ ID NO: 2654232 - DNA, 17 bp, Homo sapiens
agcttgtggagccccac

SEQ ID NO: 2654233 - DNA, 18 bp, Homo sapiens
agcttgtggagccccaca

SEQ ID NO: 2654234 - DNA, 20 bp, Homo sapiens
agcttgtgtatccattatca

SEQ ID NO: 2654235 - DNA, 16 bp, Homo sapiens
agcttgttatttataa

SEQ ID NO: 2654236 - DNA, 19 bp, Homo sapiens
agctttaaactcagggaca

SEQ ID NO: 2654237 - DNA, 17 bp, Homo sapiens
agctttaccctcaggca

SEQ ID NO: 2654238 - DNA, 14 bp, Homo sapiens
agctttatacgtgt

SEQ ID NO: 2654239 - DNA, 23 bp, Homo sapiens
agctttatcaccagagagggact

SEQ ID NO: 2654240 - DNA, 16 bp, Homo sapiens
agctttgaaaattcag

SEQ ID NO: 2654241 - DNA, 10 bp, Homo sapiens
agctttgcta

SEQ ID NO: 2654242 - DNA, 21 bp, Homo sapiens
agctttgctctttggtagaaa

SEQ ID NO: 2654243 - DNA, 22 bp, Homo sapiens
agctttgtttgttgtcagctga

SEQ ID NO: 2654244 - DNA, 22 bp, Homo sapiens
agctttttaattgttgtttctt

SEQ ID NO: 2654245 - DNA, 16 bp, Homo sapiens
aggaaaagcaaattga

SEQ ID NO: 2654246 - DNA, 20 bp, Homo sapiens
aggaaaagcggacatcagct

SEQ ID NO: 2654247 - DNA, 16 bp, Homo sapiens
aggaaaatagtaatgt

SEQ ID NO: 2654248 - DNA, 14 bp, Homo sapiens
aggaaacaacagct

SEQ ID NO: 2654249 - DNA, 12 bp, Homo sapiens
aggaaacagtta

SEQ ID NO: 2654250 - DNA, 20 bp, Homo sapiens
aggaaaccacagctgctgga

SEQ ID NO: 2654251 - DNA, 23 bp, Homo sapiens
aggaaactcacctgctggcccct

SEQ ID NO: 2654252 - DNA, 20 bp, Homo sapiens
aggaaactcctgacagtctt

SEQ ID NO: 2654253 - DNA, 12 bp, Homo sapiens
aggaaactctta

SEQ ID NO: 2654254 - DNA, 17 bp, Homo sapiens
aggaaactcttatctca

SEQ ID NO: 2654255 - DNA, 20 bp, Homo sapiens
aggaaagaatgaaagagtaa

SEQ ID NO: 2654256 - DNA, 18 bp, Homo sapiens
aggaaaggccagctggca

SEQ ID NO: 2654257 - DNA, 15 bp, Homo sapiens
aggaaaggctccagg

SEQ ID NO: 2654258 - DNA, 19 bp, Homo sapiens
aggaaagggggtcccagtg

SEQ ID NO: 2654259 - DNA, 19 bp, Homo sapiens
aggaaataaaacctttcaa

SEQ ID NO: 2654260 - DNA, 20 bp, Homo sapiens
aggaaatatatatgtgtgtg

SEQ ID NO: 2654261 - DNA, 19 bp, Homo sapiens
aggaaatcaaatatgcaaa

SEQ ID NO: 2654262 - DNA, 22 bp, Homo sapiens
aggaaatcaaatatgcaaagca

SEQ ID NO: 2654263 - DNA, 16 bp, Homo sapiens
aggaaatctcacccca

SEQ ID NO: 2654264 - DNA, 23 bp, Homo sapiens
aggaacacccgactcctcaaaag

SEQ ID NO: 2654265 - DNA, 12 bp, Homo sapiens
aggaacactcct

SEQ ID NO: 2654266 - DNA, 21 bp, Homo sapiens
aggaacagctatgggagcccc

SEQ ID NO: 2654267 - DNA, 19 bp, Homo sapiens
aggaacccttacagtagga

SEQ ID NO: 2654268 - DNA, 16 bp, Homo sapiens
aggaactctggcttcc

SEQ ID NO: 2654269 - DNA, 19 bp, Homo sapiens
aggaactctggcttccagg

SEQ ID NO: 2654270 - DNA, 16 bp, Homo sapiens
aggaactgctgggctt

SEQ ID NO: 2654271 - DNA, 22 bp, Homo sapiens
aggaactgctgggcttggcagc

SEQ ID NO: 2654272 - DNA, 15 bp, Homo sapiens
aggaactgtccagag

SEQ ID NO: 2654273 - DNA, 17 bp, Homo sapiens
aggaactgtccagagag

SEQ ID NO: 2654274 - DNA, 18 bp, Homo sapiens
aggaactgtccagagagc

SEQ ID NO: 2654275 - DNA, 19 bp, Homo sapiens
aggaactgtccagagagca

SEQ ID NO: 2654276 - DNA, 20 bp, Homo sapiens
aggaactgtccagagagcaa

SEQ ID NO: 2654277 - DNA, 23 bp, Homo sapiens
aggaagaattttaaaaatgaatc

SEQ ID NO: 2654278 - DNA, 14 bp, Homo sapiens
aggaagagaaacca

SEQ ID NO: 2654279 - DNA, 12 bp, Homo sapiens
aggaagagcagg

SEQ ID NO: 2654280 - DNA, 21 bp, Homo sapiens
aggaagagtagcatttcattc

SEQ ID NO: 2654281 - DNA, 19 bp, Homo sapiens
aggaagcaacgaagggaaa

SEQ ID NO: 2654282 - DNA, 18 bp, Homo sapiens
aggaagccacagctggtg

SEQ ID NO: 2654283 - DNA, 20 bp, Homo sapiens
aggaagctcagactggttga

SEQ ID NO: 2654284 - DNA, 16 bp, Homo sapiens
aggaagctcagggcct

SEQ ID NO: 2654285 - DNA, 17 bp, Homo sapiens
aggaagctgctccgtgc

SEQ ID NO: 2654286 - DNA, 18 bp, Homo sapiens
aggaaggaaacccagctc

SEQ ID NO: 2654287 - DNA, 15 bp, Homo sapiens
aggaaggagagcctg

SEQ ID NO: 2654288 - DNA, 17 bp, Homo sapiens
aggaaggatgagcattt

SEQ ID NO: 2654289 - DNA, 15 bp, Homo sapiens
aggaaggattgtaaa

SEQ ID NO: 2654290 - DNA, 17 bp, Homo sapiens
aggaaggattgtaaaaa

SEQ ID NO: 2654291 - DNA, 19 bp, Homo sapiens
aggaaggcaggaagagagc

SEQ ID NO: 2654292 - DNA, 15 bp, Homo sapiens
aggaaggctgagagg

SEQ ID NO: 2654293 - DNA, 14 bp, Homo sapiens
aggaaggtagaaat

SEQ ID NO: 2654294 - DNA, 17 bp, Homo sapiens
aggaagtgaaaataggt

SEQ ID NO: 2654295 - DNA, 16 bp, Homo sapiens
aggaagtgtaacagct

SEQ ID NO: 2654296 - DNA, 13 bp, Homo sapiens
aggaataaataaa

SEQ ID NO: 2654297 - DNA, 21 bp, Homo sapiens
aggaataaataaaaatggata

SEQ ID NO: 2654298 - DNA, 22 bp, Homo sapiens
aggaataattatttatttaata

SEQ ID NO: 2654299 - DNA, 22 bp, Homo sapiens
aggaatacctgtccccctgaca

SEQ ID NO: 2654300 - DNA, 22 bp, Homo sapiens
aggaatatgacggaagaacata

SEQ ID NO: 2654301 - DNA, 20 bp, Homo sapiens
aggaatcaagagctgccctc

SEQ ID NO: 2654302 - DNA, 21 bp, Homo sapiens
aggaatcaagagctgccctcc

SEQ ID NO: 2654303 - DNA, 22 bp, Homo sapiens
aggaatcatgtcaggcctgtgt

SEQ ID NO: 2654304 - DNA, 23 bp, Homo sapiens
aggaatcatgtcaggcctgtgtg

SEQ ID NO: 2654305 - DNA, 21 bp, Homo sapiens
aggaatccactcccaggcagc

SEQ ID NO: 2654306 - DNA, 19 bp, Homo sapiens
aggaatcgaggaaccagag

SEQ ID NO: 2654307 - DNA, 20 bp, Homo sapiens
aggaatcgaggaaccagagc

SEQ ID NO: 2654308 - DNA, 12 bp, Homo sapiens
aggaatgctccc

SEQ ID NO: 2654309 - DNA, 23 bp, Homo sapiens
aggaattaagttagggaatggca

SEQ ID NO: 2654310 - DNA, 20 bp, Homo sapiens
aggaattccccaaagaatgt

SEQ ID NO: 2654311 - DNA, 19 bp, Homo sapiens
aggaattgacccacaagaa

SEQ ID NO: 2654312 - DNA, 18 bp, Homo sapiens
aggacaaaaatgaactga

SEQ ID NO: 2654313 - DNA, 16 bp, Homo sapiens
aggacaacgaggaagc

SEQ ID NO: 2654314 - DNA, 16 bp, Homo sapiens
aggacaatttcaaaaa

SEQ ID NO: 2654315 - DNA, 18 bp, Homo sapiens
aggacactaaccacgctg

SEQ ID NO: 2654316 - DNA, 19 bp, Homo sapiens
aggacactaaccacgctgg

SEQ ID NO: 2654317 - DNA, 23 bp, Homo sapiens
aggacactaaccacgctggacct

SEQ ID NO: 2654318 - DNA, 15 bp, Homo sapiens
aggacagtgcttcag

SEQ ID NO: 2654319 - DNA, 21 bp, Homo sapiens
aggacagtgcttcagcctgag

SEQ ID NO: 2654320 - DNA, 20 bp, Homo sapiens
aggacatccccccgccaaaa

SEQ ID NO: 2654321 - DNA, 18 bp, Homo sapiens
aggacatgaaactccacc

SEQ ID NO: 2654322 - DNA, 15 bp, Homo sapiens
aggacatgtttttgt

SEQ ID NO: 2654323 - DNA, 23 bp, Homo sapiens
aggacatgtttttgttttctttg

SEQ ID NO: 2654324 - DNA, 16 bp, Homo sapiens
aggacattccaagaca

SEQ ID NO: 2654325 - DNA, 17 bp, Homo sapiens
aggacattccaagacag

SEQ ID NO: 2654326 - DNA, 23 bp, Homo sapiens
aggacattgcggacagccacggc

SEQ ID NO: 2654327 - DNA, 14 bp, Homo sapiens
aggaccagctgggg

SEQ ID NO: 2654328 - DNA, 15 bp, Homo sapiens
aggaccagctggggc

SEQ ID NO: 2654329 - DNA, 23 bp, Homo sapiens
aggaccaggactatagcccaggt

SEQ ID NO: 2654330 - DNA, 19 bp, Homo sapiens
aggaccaggactccctcct

SEQ ID NO: 2654331 - DNA, 21 bp, Homo sapiens
aggaccaggactccctcctca

SEQ ID NO: 2654332 - DNA, 18 bp, Homo sapiens
aggaccagggcagggcca

SEQ ID NO: 2654333 - DNA, 19 bp, Homo sapiens
aggaccagtcaacctgggc

SEQ ID NO: 2654334 - DNA, 12 bp, Homo sapiens
aggacccagacc

SEQ ID NO: 2654335 - DNA, 13 bp, Homo sapiens
aggacccagaccc

SEQ ID NO: 2654336 - DNA, 14 bp, Homo sapiens
aggacccagaccca

SEQ ID NO: 2654337 - DNA, 15 bp, Homo sapiens
aggacccagacccag

SEQ ID NO: 2654338 - DNA, 15 bp, Homo sapiens
aggacccagaggaag

SEQ ID NO: 2654339 - DNA, 15 bp, Homo sapiens
aggacccccttcccc

SEQ ID NO: 2654340 - DNA, 16 bp, Homo sapiens
aggacccccttcccct

SEQ ID NO: 2654341 - DNA, 13 bp, Homo sapiens
aggacccctcacc

SEQ ID NO: 2654342 - DNA, 19 bp, Homo sapiens
aggacctgggacctcccct

SEQ ID NO: 2654343 - DNA, 16 bp, Homo sapiens
aggacctgtggccaag

SEQ ID NO: 2654344 - DNA, 15 bp, Homo sapiens
aggacgccacccagc

SEQ ID NO: 2654345 - DNA, 17 bp, Homo sapiens
aggactcagctccccag

SEQ ID NO: 2654346 - DNA, 19 bp, Homo sapiens
aggactcagctccccagag

SEQ ID NO: 2654347 - DNA, 17 bp, Homo sapiens
aggactccacccatcct

SEQ ID NO: 2654348 - DNA, 16 bp, Homo sapiens
aggactccccaggcca

SEQ ID NO: 2654349 - DNA, 18 bp, Homo sapiens
aggactccccaggccagg

SEQ ID NO: 2654350 - DNA, 13 bp, Homo sapiens
aggactccctcct

SEQ ID NO: 2654351 - DNA, 17 bp, Homo sapiens
agggcagggcatctcct

SEQ ID NO: 2654352 - DNA, 12 bp, Homo sapiens
agggcagggcca

SEQ ID NO: 2654353 - DNA, 12 bp, Homo sapiens
agggcagggccc

SEQ ID NO: 2654354 - DNA, 15 bp, Homo sapiens
agggcagggctctga

SEQ ID NO: 2654355 - DNA, 19 bp, Homo sapiens
agggcatctccaggaaggc

SEQ ID NO: 2654356 - DNA, 22 bp, Homo sapiens
agggcatctccaggaaggcggg

SEQ ID NO: 2654357 - DNA, 14 bp, Homo sapiens
agggcatctcctgt

SEQ ID NO: 2654358 - DNA, 16 bp, Homo sapiens
agggcatctcctgtgc

SEQ ID NO: 2654359 - DNA, 18 bp, Homo sapiens
agggcatgcattttgcag

SEQ ID NO: 2654360 - DNA, 17 bp, Homo sapiens
agggcatgcgcacaagg

SEQ ID NO: 2654361 - DNA, 22 bp, Homo sapiens
agggcatttgagaaatgcatat

SEQ ID NO: 2654362 - DNA, 14 bp, Homo sapiens
agggccactctgcc

SEQ ID NO: 2654363 - DNA, 14 bp, Homo sapiens
agggccaggcaggt

SEQ ID NO: 2654364 - DNA, 19 bp, Homo sapiens
agggccagggccctgcaga

SEQ ID NO: 2654365 - DNA, 22 bp, Homo sapiens
agggccagggccctgcagaggg

SEQ ID NO: 2654366 - DNA, 16 bp, Homo sapiens
agggccagtcctgcct

SEQ ID NO: 2654367 - DNA, 18 bp, Homo sapiens
agggccatgctgaaggga

SEQ ID NO: 2654368 - DNA, 22 bp, Homo sapiens
agggcccaagtccctgttttct

SEQ ID NO: 2654369 - DNA, 11 bp, Homo sapiens
agggcccagag

SEQ ID NO: 2654370 - DNA, 18 bp, Homo sapiens
agggcccagagagggtgg

SEQ ID NO: 2654371 - DNA, 14 bp, Homo sapiens
agggcccagagcag

SEQ ID NO: 2654372 - DNA, 14 bp, Homo sapiens
agggccccagcact

SEQ ID NO: 2654373 - DNA, 18 bp, Homo sapiens
agggccccagcactaaag

SEQ ID NO: 2654374 - DNA, 14 bp, Homo sapiens
agggcccctctgcc

SEQ ID NO: 2654375 - DNA, 15 bp, Homo sapiens
agggcccctctgccc

SEQ ID NO: 2654376 - DNA, 19 bp, Homo sapiens
agggcccctctgcccagct

SEQ ID NO: 2654377 - DNA, 21 bp, Homo sapiens
agggcccctctgcccagcttg

SEQ ID NO: 2654378 - DNA, 23 bp, Homo sapiens
agggcccctctgcccagcttggg

SEQ ID NO: 2654379 - DNA, 15 bp, Homo sapiens
agggccctgagctga

SEQ ID NO: 2654380 - DNA, 18 bp, Homo sapiens
agggccctgagctgaggg

SEQ ID NO: 2654381 - DNA, 13 bp, Homo sapiens
agggccctgcaga

SEQ ID NO: 2654382 - DNA, 15 bp, Homo sapiens
agggcctgcaaggga

SEQ ID NO: 2654383 - DNA, 21 bp, Homo sapiens
agggcgaccccgtcacagcct

SEQ ID NO: 2654384 - DNA, 13 bp, Homo sapiens
agggcgagactcc

SEQ ID NO: 2654385 - DNA, 13 bp, Homo sapiens
agggcgaggggag

SEQ ID NO: 2654386 - DNA, 23 bp, Homo sapiens
agggcgaggggagggtggcaggt

SEQ ID NO: 2654387 - DNA, 19 bp, Homo sapiens
agggcgggaggatgttctg

SEQ ID NO: 2654388 - DNA, 18 bp, Homo sapiens
agggctaccctgagctga

SEQ ID NO: 2654389 - DNA, 21 bp, Homo sapiens
agggctagaacctagaagggc

SEQ ID NO: 2654390 - DNA, 18 bp, Homo sapiens
agggctagaacctggaag

SEQ ID NO: 2654391 - DNA, 21 bp, Homo sapiens
agggctagaacctggaggggc

SEQ ID NO: 2654392 - DNA, 22 bp, Homo sapiens
agggctagaacctgtagagcta

SEQ ID NO: 2654393 - DNA, 20 bp, Homo sapiens
agggctagaatctggagagc

SEQ ID NO: 2654394 - DNA, 16 bp, Homo sapiens
agggctagcatccctg

SEQ ID NO: 2654395 - DNA, 22 bp, Homo sapiens
agggctcagcggggacagctcc

SEQ ID NO: 2654396 - DNA, 23 bp, Homo sapiens
agggctcagcggggacagctcct

SEQ ID NO: 2654397 - DNA, 14 bp, Homo sapiens
agggctcctgcctt

SEQ ID NO: 2654398 - DNA, 23 bp, Homo sapiens
agggctctaaaaaaagccccaaa

SEQ ID NO: 2654399 - DNA, 14 bp, Homo sapiens
agggctctgaccag

SEQ ID NO: 2654400 - DNA, 15 bp, Homo sapiens
agggctctgaccagt

SEQ ID NO: 2654401 - DNA, 17 bp, Homo sapiens
agggctgctagacggag

SEQ ID NO: 2654402 - DNA, 22 bp, Homo sapiens
agggctggaatctggagagcta

SEQ ID NO: 2654403 - DNA, 15 bp, Homo sapiens
agggctggcccagcc

SEQ ID NO: 2654404 - DNA, 17 bp, Homo sapiens
agggctggcccagccct

SEQ ID NO: 2654405 - DNA, 18 bp, Homo sapiens
agggctggcccagccctg

SEQ ID NO: 2654406 - DNA, 19 bp, Homo sapiens
agggctggcccagccctgc

SEQ ID NO: 2654407 - DNA, 23 bp, Homo sapiens
agggctggcccagccctgctggc

SEQ ID NO: 2654408 - DNA, 13 bp, Homo sapiens
agggcttctgcac

SEQ ID NO: 2654409 - DNA, 15 bp, Homo sapiens
agggcttctgcaccc

SEQ ID NO: 2654410 - DNA, 19 bp, Homo sapiens
agggcttctgcaccctcca

SEQ ID NO: 2654411 - DNA, 22 bp, Homo sapiens
agggcttctgcaccctccaccc

SEQ ID NO: 2654412 - DNA, 20 bp, Homo sapiens
aggggaaaccagtgtagcct

SEQ ID NO: 2654413 - DNA, 21 bp, Homo sapiens
aggggaaaccagtgtagcctt

SEQ ID NO: 2654414 - DNA, 18 bp, Homo sapiens
aggggaagagtgtactgg

SEQ ID NO: 2654415 - DNA, 13 bp, Homo sapiens
aggggaatgtttg

SEQ ID NO: 2654416 - DNA, 19 bp, Homo sapiens
aggggaggatcactggagc

SEQ ID NO: 2654417 - DNA, 19 bp, Homo sapiens
aggggagggtggcaggtga

SEQ ID NO: 2654418 - DNA, 21 bp, Homo sapiens
aggggatagagagagaccact

SEQ ID NO: 2654419 - DNA, 17 bp, Homo sapiens
aggggatataggagagg

SEQ ID NO: 2654420 - DNA, 14 bp, Homo sapiens
aggggatgggaggt

SEQ ID NO: 2654421 - DNA, 19 bp, Homo sapiens
aggggattgaagccctcca

SEQ ID NO: 2654422 - DNA, 19 bp, Homo sapiens
aggggcacttcattgagag

SEQ ID NO: 2654423 - DNA, 12 bp, Homo sapiens
aggggcaggctg

SEQ ID NO: 2654424 - DNA, 13 bp, Homo sapiens
aggggcaggctga

SEQ ID NO: 2654425 - DNA, 15 bp, Homo sapiens
aggggcatctgcccc

SEQ ID NO: 2654426 - DNA, 16 bp, Homo sapiens
aggggcatctgcccct

SEQ ID NO: 2654427 - DNA, 21 bp, Homo sapiens
aggggcatctgcccctccccc

SEQ ID NO: 2654428 - DNA, 23 bp, Homo sapiens
aggggcatgtattggcctggagg

SEQ ID NO: 2654429 - DNA, 14 bp, Homo sapiens
aggggccagaggct

SEQ ID NO: 2654430 - DNA, 15 bp, Homo sapiens
aggggccagaggctc

SEQ ID NO: 2654431 - DNA, 22 bp, Homo sapiens
aggggcccaaggcggcccctcc

SEQ ID NO: 2654432 - DNA, 19 bp, Homo sapiens
aggggcccagtcctggcct

SEQ ID NO: 2654433 - DNA, 17 bp, Homo sapiens
aggggccccgtgtcctg

SEQ ID NO: 2654434 - DNA, 20 bp, Homo sapiens
aggggcctcttatgggctgg

SEQ ID NO: 2654435 - DNA, 14 bp, Homo sapiens
aggggcgctggccc

SEQ ID NO: 2654436 - DNA, 18 bp, Homo sapiens
aggggcgctggcccagcc

SEQ ID NO: 2654437 - DNA, 23 bp, Homo sapiens
aggggcgctggcccagccggcct

SEQ ID NO: 2654438 - DNA, 14 bp, Homo sapiens
aggggcgtgtggct

SEQ ID NO: 2654439 - DNA, 17 bp, Homo sapiens
aggggcgtgtggctcac

SEQ ID NO: 2654440 - DNA, 20 bp, Homo sapiens
aggggctagaacctagagaa

SEQ ID NO: 2654441 - DNA, 15 bp, Homo sapiens
aggggctcaggaaaa

SEQ ID NO: 2654442 - DNA, 17 bp, Homo sapiens
aggggctctcagctcag

SEQ ID NO: 2654443 - DNA, 19 bp, Homo sapiens
aggggctggccttcctgcc

SEQ ID NO: 2654444 - DNA, 14 bp, Homo sapiens
aggggctttctgga

SEQ ID NO: 2654445 - DNA, 20 bp, Homo sapiens
aggggctttctggagaggag

SEQ ID NO: 2654446 - DNA, 22 bp, Homo sapiens
agggggaaggtggggtcctgga

SEQ ID NO: 2654447 - DNA, 13 bp, Homo sapiens
agggggctgggac

SEQ ID NO: 2654448 - DNA, 21 bp, Homo sapiens
aggggggttgtgaggcctggc

SEQ ID NO: 2654449 - DNA, 20 bp, Homo sapiens
agggggtcccagtgggaggg

SEQ ID NO: 2654450 - DNA, 15 bp, Homo sapiens
agggggtggcctccc

SEQ ID NO: 2654451 - DNA, 20 bp, Homo sapiens
agggggtggcctcccaactc

SEQ ID NO: 2654452 - DNA, 16 bp, Homo sapiens
agggggtttgggggct

SEQ ID NO: 2654453 - DNA, 17 bp, Homo sapiens
aggggtaggcagagcct

SEQ ID NO: 2654454 - DNA, 14 bp, Homo sapiens
aggggtcagggacc

SEQ ID NO: 2654455 - DNA, 24 bp, Homo sapiens
aggggtcagggaccaaggacccct

SEQ ID NO: 2654456 - DNA, 15 bp, Homo sapiens
aggggtcccagccac

SEQ ID NO: 2654457 - DNA, 19 bp, Homo sapiens
aggggtcccagccaccccg

SEQ ID NO: 2654458 - DNA, 16 bp, Homo sapiens
aggggtctccctggag

SEQ ID NO: 2654459 - DNA, 11 bp, Homo sapiens
aggggtgcccc

SEQ ID NO: 2654460 - DNA, 13 bp, Homo sapiens
aggggtgccccct

SEQ ID NO: 2654461 - DNA, 23 bp, Homo sapiens
aggggtgccccctcctctcccat

SEQ ID NO: 2654462 - DNA, 17 bp, Homo sapiens
aggggtggagactgctt

SEQ ID NO: 2654463 - DNA, 15 bp, Homo sapiens
aggggtggtcctgac

SEQ ID NO: 2654464 - DNA, 18 bp, Homo sapiens
aggggtggtcctgactca

SEQ ID NO: 2654465 - DNA, 18 bp, Homo sapiens
aggggttgcagtgagcgg

SEQ ID NO: 2654466 - DNA, 17 bp, Homo sapiens
aggggtttggtctggga

SEQ ID NO: 2654467 - DNA, 14 bp, Homo sapiens
agggtagcccgcct

SEQ ID NO: 2654468 - DNA, 17 bp, Homo sapiens
agggtagtctggtttct

SEQ ID NO: 2654469 - DNA, 18 bp, Homo sapiens
agggtatcaggtgctgcc

SEQ ID NO: 2654470 - DNA, 19 bp, Homo sapiens
agggtatcaggtgctgcca

SEQ ID NO: 2654471 - DNA, 21 bp, Homo sapiens
agggtatctggtgactttcct

SEQ ID NO: 2654472 - DNA, 19 bp, Homo sapiens
agggtcagacgcctgagga

SEQ ID NO: 2654473 - DNA, 21 bp, Homo sapiens
agggtcaggaaggatgagcat

SEQ ID NO: 2654474 - DNA, 15 bp, Homo sapiens
agggtcaggagaggg

SEQ ID NO: 2654475 - DNA, 22 bp, Homo sapiens
agggtcatatcactcaggccct

SEQ ID NO: 2654476 - DNA, 12 bp, Homo sapiens
agggtcccaagc

SEQ ID NO: 2654477 - DNA, 13 bp, Homo sapiens
agggtcccaagct

SEQ ID NO: 2654478 - DNA, 15 bp, Homo sapiens
agggtccccacctgg

SEQ ID NO: 2654479 - DNA, 12 bp, Homo sapiens
agggtccctggt

SEQ ID NO: 2654480 - DNA, 20 bp, Homo sapiens
agggtccctggtggcagctc

SEQ ID NO: 2654481 - DNA, 22 bp, Homo sapiens
agggtccctggtggcagctcac

SEQ ID NO: 2654482 - DNA, 17 bp, Homo sapiens
agggtcctggctcctga

SEQ ID NO: 2654483 - DNA, 20 bp, Homo sapiens
agggtcctggctcctgaggg

SEQ ID NO: 2654484 - DNA, 20 bp, Homo sapiens
agggtcctttagtacctgaa

SEQ ID NO: 2654485 - DNA, 20 bp, Homo sapiens
agggtctcactatgttgccc

SEQ ID NO: 2654486 - DNA, 22 bp, Homo sapiens
agggtctcactctgtcgcccag

SEQ ID NO: 2654487 - DNA, 18 bp, Homo sapiens
agggtctctagtgctgtg

SEQ ID NO: 2654488 - DNA, 13 bp, Homo sapiens
agggtctctgctg

SEQ ID NO: 2654489 - DNA, 13 bp, Homo sapiens
agggtcttttcat

SEQ ID NO: 2654490 - DNA, 14 bp, Homo sapiens
agggtgatgccagg

SEQ ID NO: 2654491 - DNA, 15 bp, Homo sapiens
agggtggcatcccag

SEQ ID NO: 2654492 - DNA, 11 bp, Homo sapiens
agggtggccct

SEQ ID NO: 2654493 - DNA, 15 bp, Homo sapiens
agggtgggagtgggc

SEQ ID NO: 2654494 - DNA, 16 bp, Homo sapiens
agggtggtgacctctg

SEQ ID NO: 2654495 - DNA, 17 bp, Homo sapiens
agtgacctgaggaagcg

SEQ ID NO: 2654496 - DNA, 17 bp, Homo sapiens
agtgactgttcaagagc

SEQ ID NO: 2654497 - DNA, 14 bp, Homo sapiens
agtgagaaaaagct

SEQ ID NO: 2654498 - DNA, 19 bp, Homo sapiens
agtgagaaaaagctcctgt

SEQ ID NO: 2654499 - DNA, 16 bp, Homo sapiens
agtgagaagctttgcc

SEQ ID NO: 2654500 - DNA, 21 bp, Homo sapiens
agtgagaccctgtctcaaaaa

SEQ ID NO: 2654501 - DNA, 13 bp, Homo sapiens
agtgagagggcat

SEQ ID NO: 2654502 - DNA, 14 bp, Homo sapiens
agtgagagggcatg

SEQ ID NO: 2654503 - DNA, 14 bp, Homo sapiens
agtgagcactaagg

SEQ ID NO: 2654504 - DNA, 15 bp, Homo sapiens
agtgagcactcccaa

SEQ ID NO: 2654505 - DNA, 16 bp, Homo sapiens
agtgagccgagattgt

SEQ ID NO: 2654506 - DNA, 17 bp, Homo sapiens
agtgagctctatgggca

SEQ ID NO: 2654507 - DNA, 14 bp, Homo sapiens
agtgaggaaggcag

SEQ ID NO: 2654508 - DNA, 21 bp, Homo sapiens
agtgaggaatagttgagcccc

SEQ ID NO: 2654509 - DNA, 14 bp, Homo sapiens
agtgaggatgtctg

SEQ ID NO: 2654510 - DNA, 15 bp, Homo sapiens
agtgaggcccaggga

SEQ ID NO: 2654511 - DNA, 22 bp, Homo sapiens
agtgagggtcagagaggagtca

SEQ ID NO: 2654512 - DNA, 21 bp, Homo sapiens
agtgagggtttctgagctgct

SEQ ID NO: 2654513 - DNA, 15 bp, Homo sapiens
agtgagtctgtcagc

SEQ ID NO: 2654514 - DNA, 23 bp, Homo sapiens
agtgagttgatagcacagaccct

SEQ ID NO: 2654515 - DNA, 18 bp, Homo sapiens
agtgagttgttgccctgg

SEQ ID NO: 2654516 - DNA, 20 bp, Homo sapiens
agtgatagagctaaccctta

SEQ ID NO: 2654517 - DNA, 19 bp, Homo sapiens
agtgatcaataaaatgtga

SEQ ID NO: 2654518 - DNA, 18 bp, Homo sapiens
agtgatcctcccacctca

SEQ ID NO: 2654519 - DNA, 22 bp, Homo sapiens
agtgatcctcccacctcagcct

SEQ ID NO: 2654520 - DNA, 24 bp, Homo sapiens
agtgatcctcccacctcagcctcc

SEQ ID NO: 2654521 - DNA, 13 bp, Homo sapiens
agtgatctccata

SEQ ID NO: 2654522 - DNA, 14 bp, Homo sapiens
agtgatctccatat

SEQ ID NO: 2654523 - DNA, 16 bp, Homo sapiens
agtgatgtaccatgaa

SEQ ID NO: 2654524 - DNA, 14 bp, Homo sapiens
agtgattctcctgc

SEQ ID NO: 2654525 - DNA, 20 bp, Homo sapiens
agtgattctcctgcctcagc

SEQ ID NO: 2654526 - DNA, 16 bp, Homo sapiens
agtgattgtatgaatt

SEQ ID NO: 2654527 - DNA, 13 bp, Homo sapiens
agtgatttctaga

SEQ ID NO: 2654528 - DNA, 15 bp, Homo sapiens
agtgcaagcccctgc

SEQ ID NO: 2654529 - DNA, 17 bp, Homo sapiens
agtgcaagcccctgctc

SEQ ID NO: 2654530 - DNA, 18 bp, Homo sapiens
agtgcaagcccctgctcc

SEQ ID NO: 2654531 - DNA, 18 bp, Homo sapiens
agtgcaatgacacagtct

SEQ ID NO: 2654532 - DNA, 23 bp, Homo sapiens
agtgcaatggcgtgatctcggct

SEQ ID NO: 2654533 - DNA, 14 bp, Homo sapiens
agtgcagctgattt

SEQ ID NO: 2654534 - DNA, 16 bp, Homo sapiens
agtgcagctgatttta

SEQ ID NO: 2654535 - DNA, 15 bp, Homo sapiens
agtgcaggctggcac

SEQ ID NO: 2654536 - DNA, 14 bp, Homo sapiens
agtgcatattcctt

SEQ ID NO: 2654537 - DNA, 18 bp, Homo sapiens
agtgcatattcctttcta

SEQ ID NO: 2654538 - DNA, 14 bp, Homo sapiens
agtgcatccaaagg

SEQ ID NO: 2654539 - DNA, 21 bp, Homo sapiens
agtgcatccaaaggtgctcag

SEQ ID NO: 2654540 - DNA, 21 bp, Homo sapiens
agtgccaacaatcctagtgct

SEQ ID NO: 2654541 - DNA, 14 bp, Homo sapiens
agtgccaagcacag

SEQ ID NO: 2654542 - DNA, 23 bp, Homo sapiens
agtgccaggactccccaggccag

SEQ ID NO: 2654543 - DNA, 18 bp, Homo sapiens
agtgccaggatggaatga

SEQ ID NO: 2654544 - DNA, 20 bp, Homo sapiens
agtgccagtcttgtgtctgc

SEQ ID NO: 2654545 - DNA, 13 bp, Homo sapiens
agtgcccctgctg

SEQ ID NO: 2654546 - DNA, 20 bp, Homo sapiens
agtgcccctgctgcctcccc

SEQ ID NO: 2654547 - DNA, 21 bp, Homo sapiens
agtgccctccacagccgcagc

SEQ ID NO: 2654548 - DNA, 17 bp, Homo sapiens
agtgcctgggaatgtat

SEQ ID NO: 2654549 - DNA, 20 bp, Homo sapiens
agtgccttaatagtagggta

SEQ ID NO: 2654550 - DNA, 20 bp, Homo sapiens
agtgccttcaataaatggta

SEQ ID NO: 2654551 - DNA, 15 bp, Homo sapiens
agtgccttccataat

SEQ ID NO: 2654552 - DNA, 15 bp, Homo sapiens
agtgcgagtatgtgt

SEQ ID NO: 2654553 - DNA, 13 bp, Homo sapiens
agtgcgtgtgtag

SEQ ID NO: 2654554 - DNA, 20 bp, Homo sapiens
agtgctaaaaatgggacttc

SEQ ID NO: 2654555 - DNA, 11 bp, Homo sapiens
agtgctccctc

SEQ ID NO: 2654556 - DNA, 14 bp, Homo sapiens
agtgctccctcaca

SEQ ID NO: 2654557 - DNA, 12 bp, Homo sapiens
agtgctcgcttt

SEQ ID NO: 2654558 - DNA, 11 bp, Homo sapiens
agtgctctgat

SEQ ID NO: 2654559 - DNA, 16 bp, Homo sapiens
agtgctctgatccctc

SEQ ID NO: 2654560 - DNA, 21 bp, Homo sapiens
agtgctctgatccctctacag

SEQ ID NO: 2654561 - DNA, 12 bp, Homo sapiens
agtgctgcattt

SEQ ID NO: 2654562 - DNA, 17 bp, Homo sapiens
agtgctgcatttaaaag

SEQ ID NO: 2654563 - DNA, 17 bp, Homo sapiens
agtgctgggattacagg

SEQ ID NO: 2654564 - DNA, 20 bp, Homo sapiens
agtgctgggattacaggcat

SEQ ID NO: 2654565 - DNA, 19 bp, Homo sapiens
agtgctgggattacaggtg

SEQ ID NO: 2654566 - DNA, 20 bp, Homo sapiens
agtgctgggattacaggtgt

SEQ ID NO: 2654567 - DNA, 12 bp, Homo sapiens
agtgctgtaaaa

SEQ ID NO: 2654568 - DNA, 21 bp, Homo sapiens
agtgctgtctgatctgtgctt

SEQ ID NO: 2654569 - DNA, 12 bp, Homo sapiens
agtgctgtgaaa

SEQ ID NO: 2654570 - DNA, 16 bp, Homo sapiens
agtgctgtgaaaaaaa

SEQ ID NO: 2654571 - DNA, 14 bp, Homo sapiens
agtgctgtggcctg

SEQ ID NO: 2654572 - DNA, 18 bp, Homo sapiens
agtgctgtggcctgggca

SEQ ID NO: 2654573 - DNA, 17 bp, Homo sapiens
agtgcttcagcctgagg

SEQ ID NO: 2654574 - DNA, 18 bp, Homo sapiens
agtgcttcagcctgaggc

SEQ ID NO: 2654575 - DNA, 20 bp, Homo sapiens
agtgcttcagcctgaggctg

SEQ ID NO: 2654576 - DNA, 16 bp, Homo sapiens
agtgcttccaaggatg

SEQ ID NO: 2654577 - DNA, 16 bp, Homo sapiens
agtgcttccaaggcag

SEQ ID NO: 2654578 - DNA, 19 bp, Homo sapiens
agtgctttccttttttaaa

SEQ ID NO: 2654579 - DNA, 13 bp, Homo sapiens
agtgctttgtaat

SEQ ID NO: 2654580 - DNA, 16 bp, Homo sapiens
agtggaagaagaggga

SEQ ID NO: 2654581 - DNA, 21 bp, Homo sapiens
agtggaatagtatcctccagg

SEQ ID NO: 2654582 - DNA, 23 bp, Homo sapiens
agtggaatagtatcctccaggtt

SEQ ID NO: 2654583 - DNA, 18 bp, Homo sapiens
agtggactctttggtggc

SEQ ID NO: 2654584 - DNA, 18 bp, Homo sapiens
agtggactggcccctggg

SEQ ID NO: 2654585 - DNA, 17 bp, Homo sapiens
agtggactttccacccc

SEQ ID NO: 2654586 - DNA, 16 bp, Homo sapiens
agtggagaattatata

SEQ ID NO: 2654587 - DNA, 23 bp, Homo sapiens
agtggaggttaaggctgaggaaa

SEQ ID NO: 2654588 - DNA, 23 bp, Homo sapiens
agtggatctccaaggaccaggtt

SEQ ID NO: 2654589 - DNA, 12 bp, Homo sapiens
agtggcagctgc

SEQ ID NO: 2654590 - DNA, 20 bp, Homo sapiens
agtggcagctgcttttgtct

SEQ ID NO: 2654591 - DNA, 18 bp, Homo sapiens
agtggcatggctccagtc

SEQ ID NO: 2654592 - DNA, 16 bp, Homo sapiens
agtggcccccacagaa

SEQ ID NO: 2654593 - DNA, 22 bp, Homo sapiens
agtggcctcaaccctccctcag

SEQ ID NO: 2654594 - DNA, 13 bp, Homo sapiens
agtggcctggcca

SEQ ID NO: 2654595 - DNA, 14 bp, Homo sapiens
agtggcctggccag

SEQ ID NO: 2654596 - DNA, 15 bp, Homo sapiens
agtggcctggccagg

SEQ ID NO: 2654597 - DNA, 18 bp, Homo sapiens
agtggcctggccaggagc

SEQ ID NO: 2654598 - DNA, 20 bp, Homo sapiens
agtggcctggccaggagctc

SEQ ID NO: 2654599 - DNA, 14 bp, Homo sapiens
agtggctcacgcct

SEQ ID NO: 2654600 - DNA, 13 bp, Homo sapiens
agtggctgctgcc

SEQ ID NO: 2654601 - DNA, 17 bp, Homo sapiens
agtggctgctgcccagg

SEQ ID NO: 2654602 - DNA, 19 bp, Homo sapiens
agtggctgctgcccaggcc

SEQ ID NO: 2654603 - DNA, 22 bp, Homo sapiens
agtggctgctgcccaggcccag

SEQ ID NO: 2654604 - DNA, 16 bp, Homo sapiens
agtggctggatctgtg

SEQ ID NO: 2654605 - DNA, 15 bp, Homo sapiens
agtggcttcaaaata

SEQ ID NO: 2654606 - DNA, 17 bp, Homo sapiens
agtggcttcatctgtca

SEQ ID NO: 2654607 - DNA, 19 bp, Homo sapiens
agtggcttcattagagcag

SEQ ID NO: 2654608 - DNA, 20 bp, Homo sapiens
agtggcttcattagagcagg

SEQ ID NO: 2654609 - DNA, 21 bp, Homo sapiens
agtggcttcattagagcaggc

SEQ ID NO: 2654610 - DNA, 22 bp, Homo sapiens
agtggcttcattagagcaggcg

SEQ ID NO: 2654611 - DNA, 17 bp, Homo sapiens
agtgggacagagtctgg

SEQ ID NO: 2654612 - DNA, 13 bp, Homo sapiens
agtgggaggggca

SEQ ID NO: 2654613 - DNA, 15 bp, Homo sapiens
agtgggaggggcagg

SEQ ID NO: 2654614 - DNA, 17 bp, Homo sapiens
agtgggctgcatctggg

SEQ ID NO: 2654615 - DNA, 15 bp, Homo sapiens
agtggggacagagca

SEQ ID NO: 2654616 - DNA, 18 bp, Homo sapiens
agtgggggatcacagcct

SEQ ID NO: 2654617 - DNA, 16 bp, Homo sapiens
agtggggtaggttggg

SEQ ID NO: 2654618 - DNA, 19 bp, Homo sapiens
agtggggttatctctgtgt

SEQ ID NO: 2654619 - DNA, 13 bp, Homo sapiens
agtgggtgaataa

SEQ ID NO: 2654620 - DNA, 15 bp, Homo sapiens
agtgggttattctgg

SEQ ID NO: 2654621 - DNA, 16 bp, Homo sapiens
agtgggttattctgga

SEQ ID NO: 2654622 - DNA, 15 bp, Homo sapiens
agtggtatagaaatg

SEQ ID NO: 2654623 - DNA, 23 bp, Homo sapiens
agtggtcaaaccgcactcaccca

SEQ ID NO: 2654624 - DNA, 18 bp, Homo sapiens
agtggtctttctggagag

SEQ ID NO: 2654625 - DNA, 20 bp, Homo sapiens
agtggtctttctggagaggt

SEQ ID NO: 2654626 - DNA, 15 bp, Homo sapiens
agtggtctttgtaag

SEQ ID NO: 2654627 - DNA, 17 bp, Homo sapiens
agtggtctttgtaagag

SEQ ID NO: 2654628 - DNA, 21 bp, Homo sapiens
agtggtctttgtaagagtgta

SEQ ID NO: 2654629 - DNA, 24 bp, Homo sapiens
agtggtctttgtaagagtgtagaa

SEQ ID NO: 2654630 - DNA, 13 bp, Homo sapiens
agtggtgctcagt

SEQ ID NO: 2654631 - DNA, 15 bp, Homo sapiens
agtggtgctcagttg

SEQ ID NO: 2654632 - DNA, 15 bp, Homo sapiens
agtggtggcagggcc

SEQ ID NO: 2654633 - DNA, 18 bp, Homo sapiens
agtggtggcagggcctag

SEQ ID NO: 2654634 - DNA, 18 bp, Homo sapiens
agtggtggttttctgttc

SEQ ID NO: 2654635 - DNA, 19 bp, Homo sapiens
agtggtggttttctgttct

SEQ ID NO: 2654636 - DNA, 23 bp, Homo sapiens
agtggtggttttctgttctttct

SEQ ID NO: 2654637 - DNA, 11 bp, Homo sapiens
agtgtaaaata

SEQ ID NO: 2654638 - DNA, 18 bp, Homo sapiens
agtgtaaaatattttgaa

SEQ ID NO: 2654639 - DNA, 21 bp, Homo sapiens
agtgtaaaatattttgaatca

SEQ ID NO: 2654640 - DNA, 23 bp, Homo sapiens
atacagtgttattttctttgaaa

SEQ ID NO: 2654641 - DNA, 20 bp, Homo sapiens
atacataaacaagaccacgt

SEQ ID NO: 2654642 - DNA, 22 bp, Homo sapiens
atacatatgagtgtggaagccg

SEQ ID NO: 2654643 - DNA, 14 bp, Homo sapiens
atacatatttccaa

SEQ ID NO: 2654644 - DNA, 21 bp, Homo sapiens
atacatttctcctttgataaa

SEQ ID NO: 2654645 - DNA, 18 bp, Homo sapiens
ataccaaaattatttcag

SEQ ID NO: 2654646 - DNA, 14 bp, Homo sapiens
ataccaagtattta

SEQ ID NO: 2654647 - DNA, 19 bp, Homo sapiens
ataccaatgaaaaaatgta

SEQ ID NO: 2654648 - DNA, 20 bp, Homo sapiens
ataccaatgcttttatcaaa

SEQ ID NO: 2654649 - DNA, 17 bp, Homo sapiens
ataccacttttgttctt

SEQ ID NO: 2654650 - DNA, 18 bp, Homo sapiens
ataccacttttgttcttg

SEQ ID NO: 2654651 - DNA, 22 bp, Homo sapiens
ataccagcgaggaggctccaga

SEQ ID NO: 2654652 - DNA, 18 bp, Homo sapiens
ataccagcttagatttta

SEQ ID NO: 2654653 - DNA, 16 bp, Homo sapiens
ataccaggttgaaaga

SEQ ID NO: 2654654 - DNA, 19 bp, Homo sapiens
ataccagtgaaccaaagag

SEQ ID NO: 2654655 - DNA, 20 bp, Homo sapiens
ataccattttttaaggaaac

SEQ ID NO: 2654656 - DNA, 18 bp, Homo sapiens
atacccaaatcctctcca

SEQ ID NO: 2654657 - DNA, 23 bp, Homo sapiens
atacccaaatcctctccagctat

SEQ ID NO: 2654658 - DNA, 12 bp, Homo sapiens
atacccaccccc

SEQ ID NO: 2654659 - DNA, 13 bp, Homo sapiens
atacccaccccca

SEQ ID NO: 2654660 - DNA, 14 bp, Homo sapiens
atacccacccccac

SEQ ID NO: 2654661 - DNA, 16 bp, Homo sapiens
atacccacccccaccc

SEQ ID NO: 2654662 - DNA, 16 bp, Homo sapiens
ataccccatcattcat

SEQ ID NO: 2654663 - DNA, 13 bp, Homo sapiens
atacccccctctg

SEQ ID NO: 2654664 - DNA, 17 bp, Homo sapiens
atacctacatgtatttg

SEQ ID NO: 2654665 - DNA, 14 bp, Homo sapiens
atacctctgtgtgc

SEQ ID NO: 2654666 - DNA, 16 bp, Homo sapiens
atacctctgtgtgctc

SEQ ID NO: 2654667 - DNA, 17 bp, Homo sapiens
atacctctgtgtgctcc

SEQ ID NO: 2654668 - DNA, 13 bp, Homo sapiens
atacctgtccccc

SEQ ID NO: 2654669 - DNA, 14 bp, Homo sapiens
atacctgtccccct

SEQ ID NO: 2654670 - DNA, 16 bp, Homo sapiens
atacctgtccccctga

SEQ ID NO: 2654671 - DNA, 13 bp, Homo sapiens
atacgactttatt

SEQ ID NO: 2654672 - DNA, 16 bp, Homo sapiens
atacgcactacatgtg

SEQ ID NO: 2654673 - DNA, 21 bp, Homo sapiens
atacgcctgtagtcctagcca

SEQ ID NO: 2654674 - DNA, 16 bp, Homo sapiens
atacgtacacatttta

SEQ ID NO: 2654675 - DNA, 18 bp, Homo sapiens
atactaaaaatcatgaga

SEQ ID NO: 2654676 - DNA, 14 bp, Homo sapiens
atactaagaaaaga

SEQ ID NO: 2654677 - DNA, 20 bp, Homo sapiens
atactacagtttgttagtat

SEQ ID NO: 2654678 - DNA, 16 bp, Homo sapiens
atactagttgtgacct

SEQ ID NO: 2654679 - DNA, 20 bp, Homo sapiens
atactagttgtgaccttagt

SEQ ID NO: 2654680 - DNA, 15 bp, Homo sapiens
atactcataatgtga

SEQ ID NO: 2654681 - DNA, 16 bp, Homo sapiens
atactcataatgtgaa

SEQ ID NO: 2654682 - DNA, 15 bp, Homo sapiens
atactcatgtgtatg

SEQ ID NO: 2654683 - DNA, 16 bp, Homo sapiens
atactcattaggatgg

SEQ ID NO: 2654684 - DNA, 13 bp, Homo sapiens
atactctgtcaga

SEQ ID NO: 2654685 - DNA, 14 bp, Homo sapiens
atactctgtcagat

SEQ ID NO: 2654686 - DNA, 15 bp, Homo sapiens
atactctgtcagatg

SEQ ID NO: 2654687 - DNA, 22 bp, Homo sapiens
atactgagggaccaactgggcc

SEQ ID NO: 2654688 - DNA, 23 bp, Homo sapiens
atactgcaattaaagtgatactg

SEQ ID NO: 2654689 - DNA, 18 bp, Homo sapiens
atactgccagatgctgat

SEQ ID NO: 2654690 - DNA, 19 bp, Homo sapiens
atactgccagatgctgatg

SEQ ID NO: 2654691 - DNA, 21 bp, Homo sapiens
atactgccagatgctgatgtt

SEQ ID NO: 2654692 - DNA, 22 bp, Homo sapiens
atactgcccggggcagctgcca

SEQ ID NO: 2654693 - DNA, 15 bp, Homo sapiens
atactgtaaagaaag

SEQ ID NO: 2654694 - DNA, 13 bp, Homo sapiens
atactgtattaag

SEQ ID NO: 2654695 - DNA, 22 bp, Homo sapiens
atactgtattaagagtgaaaat

SEQ ID NO: 2654696 - DNA, 20 bp, Homo sapiens
atactgtgctggagccacta

SEQ ID NO: 2654697 - DNA, 15 bp, Homo sapiens
atactgttgtgcgca

SEQ ID NO: 2654698 - DNA, 20 bp, Homo sapiens
atactgtttgaggtttttaa

SEQ ID NO: 2654699 - DNA, 21 bp, Homo sapiens
atacttaaatggaaaaaatga

SEQ ID NO: 2654700 - DNA, 15 bp, Homo sapiens
atacttatctctctg

SEQ ID NO: 2654701 - DNA, 22 bp, Homo sapiens
atacttcagctcacacatgaga

SEQ ID NO: 2654702 - DNA, 16 bp, Homo sapiens
atactttaaaggaaaa

SEQ ID NO: 2654703 - DNA, 15 bp, Homo sapiens
atactttttttcaca

SEQ ID NO: 2654704 - DNA, 16 bp, Homo sapiens
atagaaaaaccctgcc

SEQ ID NO: 2654705 - DNA, 17 bp, Homo sapiens
atagaaaactgaaaatc

SEQ ID NO: 2654706 - DNA, 21 bp, Homo sapiens
atagaactcagttttaactag

SEQ ID NO: 2654707 - DNA, 15 bp, Homo sapiens
atagaactctgggct

SEQ ID NO: 2654708 - DNA, 14 bp, Homo sapiens
atagaactgaatga

SEQ ID NO: 2654709 - DNA, 15 bp, Homo sapiens
atagaagaactgcaa

SEQ ID NO: 2654710 - DNA, 18 bp, Homo sapiens
atagaataaaatataatt

SEQ ID NO: 2654711 - DNA, 19 bp, Homo sapiens
atagaatataattatcgga

SEQ ID NO: 2654712 - DNA, 22 bp, Homo sapiens
atagaatatttattacctctga

SEQ ID NO: 2654713 - DNA, 17 bp, Homo sapiens
atagaattaacacatga

SEQ ID NO: 2654714 - DNA, 14 bp, Homo sapiens
atagaatttccaat

SEQ ID NO: 2654715 - DNA, 14 bp, Homo sapiens
atagagctgtatta

SEQ ID NO: 2654716 - DNA, 14 bp, Homo sapiens
atagagggccaaga

SEQ ID NO: 2654717 - DNA, 15 bp, Homo sapiens
atagaggtgagggaa

SEQ ID NO: 2654718 - DNA, 13 bp, Homo sapiens
atagagtcttgct

SEQ ID NO: 2654719 - DNA, 12 bp, Homo sapiens
atagatgggaat

SEQ ID NO: 2654720 - DNA, 13 bp, Homo sapiens
atagatgggaatg

SEQ ID NO: 2654721 - DNA, 22 bp, Homo sapiens
atagatgggtctggctgagctg

SEQ ID NO: 2654722 - DNA, 13 bp, Homo sapiens
atagatgtgtgga

SEQ ID NO: 2654723 - DNA, 14 bp, Homo sapiens
atagatgtgtggac

SEQ ID NO: 2654724 - DNA, 16 bp, Homo sapiens
atagcaaacttggaat

SEQ ID NO: 2654725 - DNA, 17 bp, Homo sapiens
atagcaagattgcttaa

SEQ ID NO: 2654726 - DNA, 14 bp, Homo sapiens
atagcacagaccct

SEQ ID NO: 2654727 - DNA, 15 bp, Homo sapiens
atagcacagaccctg

SEQ ID NO: 2654728 - DNA, 14 bp, Homo sapiens
atagcagattttaa

SEQ ID NO: 2654729 - DNA, 22 bp, Homo sapiens
atagcagattttaattttgaat

SEQ ID NO: 2654730 - DNA, 13 bp, Homo sapiens
atagcatgtaatg

SEQ ID NO: 2654731 - DNA, 15 bp, Homo sapiens
atagcattaactaat

SEQ ID NO: 2654732 - DNA, 16 bp, Homo sapiens
atagcattgtgaactg

SEQ ID NO: 2654733 - DNA, 21 bp, Homo sapiens
atagcatttttgatttatgca

SEQ ID NO: 2654734 - DNA, 21 bp, Homo sapiens
atagccacttaccttcaataa

SEQ ID NO: 2654735 - DNA, 23 bp, Homo sapiens
atagccacttaccttcaataaag

SEQ ID NO: 2654736 - DNA, 13 bp, Homo sapiens
atagcccagacac

SEQ ID NO: 2654737 - DNA, 19 bp, Homo sapiens
atagcctatatttacagtg

SEQ ID NO: 2654738 - DNA, 23 bp, Homo sapiens
atagctaacattttaaataaaag

SEQ ID NO: 2654739 - DNA, 21 bp, Homo sapiens
atagctaagaaataaaactgt

SEQ ID NO: 2654740 - DNA, 20 bp, Homo sapiens
atagctatttttatggaatt

SEQ ID NO: 2654741 - DNA, 22 bp, Homo sapiens
atagctcaggtgtccctgcact

SEQ ID NO: 2654742 - DNA, 22 bp, Homo sapiens
atagctcagtttatccaaggtg

SEQ ID NO: 2654743 - DNA, 23 bp, Homo sapiens
atagctccccgcttctgcctgca

SEQ ID NO: 2654744 - DNA, 17 bp, Homo sapiens
atagctgggactacagg

SEQ ID NO: 2654745 - DNA, 17 bp, Homo sapiens
atagctgtattgaatca

SEQ ID NO: 2654746 - DNA, 22 bp, Homo sapiens
atagctgtattgaatcatgtag

SEQ ID NO: 2654747 - DNA, 22 bp, Homo sapiens
atagcttacaagccagctggag

SEQ ID NO: 2654748 - DNA, 22 bp, Homo sapiens
atagcttcaccccaatcccagc

SEQ ID NO: 2654749 - DNA, 19 bp, Homo sapiens
atagcttgcgcattctcat

SEQ ID NO: 2654750 - DNA, 21 bp, Homo sapiens
atagctttattttttaagtat

SEQ ID NO: 2654751 - DNA, 22 bp, Homo sapiens
atagctttattttttaagtatt

SEQ ID NO: 2654752 - DNA, 14 bp, Homo sapiens
atagcttttattgt

SEQ ID NO: 2654753 - DNA, 18 bp, Homo sapiens
atagcttttattgtataa

SEQ ID NO: 2654754 - DNA, 19 bp, Homo sapiens
ataggaaaagtacatttaa

SEQ ID NO: 2654755 - DNA, 21 bp, Homo sapiens
ataggaaagtatttttttaag

SEQ ID NO: 2654756 - DNA, 16 bp, Homo sapiens
ataggaacatatgaaa

SEQ ID NO: 2654757 - DNA, 18 bp, Homo sapiens
ataggaacatatgaaaat

SEQ ID NO: 2654758 - DNA, 19 bp, Homo sapiens
ataggagaggatgagagcc

SEQ ID NO: 2654759 - DNA, 16 bp, Homo sapiens
ataggagcctgctggt

SEQ ID NO: 2654760 - DNA, 23 bp, Homo sapiens
ataggatcatttgttggaatgaa

SEQ ID NO: 2654761 - DNA, 14 bp, Homo sapiens
ataggcctgggtgc

SEQ ID NO: 2654762 - DNA, 11 bp, Homo sapiens
ataggctctgc

SEQ ID NO: 2654763 - DNA, 13 bp, Homo sapiens
ataggctggagaa

SEQ ID NO: 2654764 - DNA, 18 bp, Homo sapiens
ataggctggagaagctca

SEQ ID NO: 2654765 - DNA, 14 bp, Homo sapiens
atagggctgagctc

SEQ ID NO: 2654766 - DNA, 16 bp, Homo sapiens
ataggtcactggctct

SEQ ID NO: 2654767 - DNA, 21 bp, Homo sapiens
ataggtcactggctctccaag

SEQ ID NO: 2654768 - DNA, 14 bp, Homo sapiens
ataggtgctacaaa

SEQ ID NO: 2654769 - DNA, 15 bp, Homo sapiens
ataggtgctacaaaa

SEQ ID NO: 2654770 - DNA, 23 bp, Homo sapiens
ataggtgctacaaaaacacagca

SEQ ID NO: 2654771 - DNA, 19 bp, Homo sapiens
ataggttttgtttgctatc

SEQ ID NO: 2654772 - DNA, 18 bp, Homo sapiens
atagtaaaagataacaag

SEQ ID NO: 2654773 - DNA, 14 bp, Homo sapiens
atagtactggcatg

SEQ ID NO: 2654774 - DNA, 17 bp, Homo sapiens
atagtagcatacattta

SEQ ID NO: 2654775 - DNA, 13 bp, Homo sapiens
atagtagtatgat

SEQ ID NO: 2654776 - DNA, 16 bp, Homo sapiens
atagtatatctggaca

SEQ ID NO: 2654777 - DNA, 17 bp, Homo sapiens
atagtatatctggacaa

SEQ ID NO: 2654778 - DNA, 18 bp, Homo sapiens
atagtatggtggctgggt

SEQ ID NO: 2654779 - DNA, 22 bp, Homo sapiens
atagtattccattgtgtgagtg

SEQ ID NO: 2654780 - DNA, 22 bp, Homo sapiens
atagtcaagaaaaattattgta

SEQ ID NO: 2654781 - DNA, 20 bp, Homo sapiens
atagtgatgtaatcttgaat

SEQ ID NO: 2654782 - DNA, 20 bp, Homo sapiens
atagtgctcgctttctatgt

SEQ ID NO: 2654783 - DNA, 23 bp, Homo sapiens
atagtgctcgctttctatgtagt

SEQ ID NO: 2654784 - DNA, 20 bp, Homo sapiens
atcctatcagcctgtctctt

SEQ ID NO: 2654785 - DNA, 23 bp, Homo sapiens
atcctatcagcctgtctcttcca

SEQ ID NO: 2654786 - DNA, 14 bp, Homo sapiens
atcctatgtgattt

SEQ ID NO: 2654787 - DNA, 16 bp, Homo sapiens
atcctatgtgatttta

SEQ ID NO: 2654788 - DNA, 17 bp, Homo sapiens
atcctatgtgattttaa

SEQ ID NO: 2654789 - DNA, 18 bp, Homo sapiens
atcctattctcaccagga

SEQ ID NO: 2654790 - DNA, 20 bp, Homo sapiens
atcctattctcaccaggaag

SEQ ID NO: 2654791 - DNA, 16 bp, Homo sapiens
atcctcaaacactgca

SEQ ID NO: 2654792 - DNA, 15 bp, Homo sapiens
atcctcaatccagct

SEQ ID NO: 2654793 - DNA, 17 bp, Homo sapiens
atcctcatacccacccc

SEQ ID NO: 2654794 - DNA, 18 bp, Homo sapiens
atcctcatacccaccccc

SEQ ID NO: 2654795 - DNA, 20 bp, Homo sapiens
atcctcatatggcccagtgt

SEQ ID NO: 2654796 - DNA, 21 bp, Homo sapiens
atcctcatatggcccagtgtc

SEQ ID NO: 2654797 - DNA, 23 bp, Homo sapiens
atcctcatttggggtagctagag

SEQ ID NO: 2654798 - DNA, 11 bp, Homo sapiens
atcctccaggt

SEQ ID NO: 2654799 - DNA, 15 bp, Homo sapiens
atcctccaggttttt

SEQ ID NO: 2654800 - DNA, 19 bp, Homo sapiens
atcctccaggtttttcaat

SEQ ID NO: 2654801 - DNA, 21 bp, Homo sapiens
atcctccaggtttttcaatta

SEQ ID NO: 2654802 - DNA, 23 bp, Homo sapiens
atcctccaggtttttcaattaaa

SEQ ID NO: 2654803 - DNA, 15 bp, Homo sapiens
atcctcccacctcag

SEQ ID NO: 2654804 - DNA, 18 bp, Homo sapiens
atcctcccacctcagcct

SEQ ID NO: 2654805 - DNA, 19 bp, Homo sapiens
atcctcccacctcagcctc

SEQ ID NO: 2654806 - DNA, 20 bp, Homo sapiens
atcctctgtaaactttttgt

SEQ ID NO: 2654807 - DNA, 17 bp, Homo sapiens
atcctctgtacagagcc

SEQ ID NO: 2654808 - DNA, 18 bp, Homo sapiens
atcctctgtacagagccc

SEQ ID NO: 2654809 - DNA, 20 bp, Homo sapiens
atcctctgtacagagcccac

SEQ ID NO: 2654810 - DNA, 14 bp, Homo sapiens
atcctcttcctctg

SEQ ID NO: 2654811 - DNA, 17 bp, Homo sapiens
atcctcttcctctgagg

SEQ ID NO: 2654812 - DNA, 22 bp, Homo sapiens
atcctcttctgcttaggagaga

SEQ ID NO: 2654813 - DNA, 14 bp, Homo sapiens
atcctgaaatttca

SEQ ID NO: 2654814 - DNA, 14 bp, Homo sapiens
atcctgactctgcc

SEQ ID NO: 2654815 - DNA, 13 bp, Homo sapiens
atcctgcccctga

SEQ ID NO: 2654816 - DNA, 20 bp, Homo sapiens
atcctggcacccggcccctg

SEQ ID NO: 2654817 - DNA, 24 bp, Homo sapiens
atcctggctctttggagatcaagg

SEQ ID NO: 2654818 - DNA, 16 bp, Homo sapiens
atcctggggctccctt

SEQ ID NO: 2654819 - DNA, 19 bp, Homo sapiens
atcctgtctttaaggaaaa

SEQ ID NO: 2654820 - DNA, 21 bp, Homo sapiens
atcctgtctttaaggaaaaaa

SEQ ID NO: 2654821 - DNA, 15 bp, Homo sapiens
atcctgtctttctga

SEQ ID NO: 2654822 - DNA, 16 bp, Homo sapiens
atcctgtgaagtaagg

SEQ ID NO: 2654823 - DNA, 15 bp, Homo sapiens
atcctgtgacatgta

SEQ ID NO: 2654824 - DNA, 13 bp, Homo sapiens
atcctgtgggtga

SEQ ID NO: 2654825 - DNA, 13 bp, Homo sapiens
atccttacaagtt

SEQ ID NO: 2654826 - DNA, 17 bp, Homo sapiens
atccttcctcacaccag

SEQ ID NO: 2654827 - DNA, 16 bp, Homo sapiens
atccttgagtcaaaaa

SEQ ID NO: 2654828 - DNA, 14 bp, Homo sapiens
atccttgtttcaaa

SEQ ID NO: 2654829 - DNA, 17 bp, Homo sapiens
atcctttaaatccttcc

SEQ ID NO: 2654830 - DNA, 14 bp, Homo sapiens
atcctttccagcat

SEQ ID NO: 2654831 - DNA, 18 bp, Homo sapiens
atccttttatgttattta

SEQ ID NO: 2654832 - DNA, 15 bp, Homo sapiens
atccttttctgcaga

SEQ ID NO: 2654833 - DNA, 17 bp, Homo sapiens
atcgaaataacaatgtt

SEQ ID NO: 2654834 - DNA, 20 bp, Homo sapiens
atcgaaataacaatgttaag

SEQ ID NO: 2654835 - DNA, 13 bp, Homo sapiens
atcgatggccttg

SEQ ID NO: 2654836 - DNA, 20 bp, Homo sapiens
atcgcaccactgtgtattta

SEQ ID NO: 2654837 - DNA, 22 bp, Homo sapiens
atcgcatcattgcactctagcc

SEQ ID NO: 2654838 - DNA, 22 bp, Homo sapiens
atcgcggcggagctggccccgc

SEQ ID NO: 2654839 - DNA, 13 bp, Homo sapiens
atcggagacagtg

SEQ ID NO: 2654840 - DNA, 23 bp, Homo sapiens
atcggaggcttgtcagagctggg

SEQ ID NO: 2654841 - DNA, 16 bp, Homo sapiens
atcgggaacagtgttt

SEQ ID NO: 2654842 - DNA, 21 bp, Homo sapiens
atcgggaacagtgtttcccat

SEQ ID NO: 2654843 - DNA, 16 bp, Homo sapiens
atcgtaaccagccaga

SEQ ID NO: 2654844 - DNA, 16 bp, Homo sapiens
atcgtaatgtacagat

SEQ ID NO: 2654845 - DNA, 18 bp, Homo sapiens
atcgtaatgtacagatgg

SEQ ID NO: 2654846 - DNA, 15 bp, Homo sapiens
atcgtatagctgtat

SEQ ID NO: 2654847 - DNA, 23 bp, Homo sapiens
atcgtatagctgtattgaatcat

SEQ ID NO: 2654848 - DNA, 19 bp, Homo sapiens
atcgtccagcgaccttcct

SEQ ID NO: 2654849 - DNA, 23 bp, Homo sapiens
atcgtctctccctccctttgaaa

SEQ ID NO: 2654850 - DNA, 20 bp, Homo sapiens
atcgtgacgctgaataaatg

SEQ ID NO: 2654851 - DNA, 22 bp, Homo sapiens
atcgttagtatctaacatgtat

SEQ ID NO: 2654852 - DNA, 16 bp, Homo sapiens
atcgttatgtgtgtat

SEQ ID NO: 2654853 - DNA, 21 bp, Homo sapiens
atcgttatgtgtgtatatgta

SEQ ID NO: 2654854 - DNA, 14 bp, Homo sapiens
atcgttctctgcct

SEQ ID NO: 2654855 - DNA, 23 bp, Homo sapiens
atctaaagtgtgttgttgcttta

SEQ ID NO: 2654856 - DNA, 15 bp, Homo sapiens
atctaaatgttgaaa

SEQ ID NO: 2654857 - DNA, 21 bp, Homo sapiens
atctaaattgaataatggtac

SEQ ID NO: 2654858 - DNA, 18 bp, Homo sapiens
atctaagcagcatttctg

SEQ ID NO: 2654859 - DNA, 21 bp, Homo sapiens
atctaagcagcatttctgaag

SEQ ID NO: 2654860 - DNA, 16 bp, Homo sapiens
atctaagcctttccat

SEQ ID NO: 2654861 - DNA, 20 bp, Homo sapiens
atctaaggatgtcacagggc

SEQ ID NO: 2654862 - DNA, 21 bp, Homo sapiens
atctaatagcgggttactttc

SEQ ID NO: 2654863 - DNA, 22 bp, Homo sapiens
atctaatagcgggttactttca

SEQ ID NO: 2654864 - DNA, 18 bp, Homo sapiens
atctaatatgtaacaagc

SEQ ID NO: 2654865 - DNA, 16 bp, Homo sapiens
atctactcagaaattt

SEQ ID NO: 2654866 - DNA, 21 bp, Homo sapiens
atctagaatgtgttttctgaa

SEQ ID NO: 2654867 - DNA, 18 bp, Homo sapiens
atctagagcttgatgcca

SEQ ID NO: 2654868 - DNA, 19 bp, Homo sapiens
atctagatactgtatcatg

SEQ ID NO: 2654869 - DNA, 22 bp, Homo sapiens
atctagcaatcacaacactggc

SEQ ID NO: 2654870 - DNA, 17 bp, Homo sapiens
atctaggaagactttgg

SEQ ID NO: 2654871 - DNA, 19 bp, Homo sapiens
atctaggaagactttggaa

SEQ ID NO: 2654872 - DNA, 12 bp, Homo sapiens
atctaggtttaa

SEQ ID NO: 2654873 - DNA, 13 bp, Homo sapiens
atctaggtttaac

SEQ ID NO: 2654874 - DNA, 22 bp, Homo sapiens
atctaggtttaactcagatcac

SEQ ID NO: 2654875 - DNA, 13 bp, Homo sapiens
atctatatataat

SEQ ID NO: 2654876 - DNA, 14 bp, Homo sapiens
atctatatataatt

SEQ ID NO: 2654877 - DNA, 23 bp, Homo sapiens
atctatatgtacttgtcaaagaa

SEQ ID NO: 2654878 - DNA, 22 bp, Homo sapiens
atctatcaatagtcaagaaaaa

SEQ ID NO: 2654879 - DNA, 20 bp, Homo sapiens
atctatctgcttatgcagtt

SEQ ID NO: 2654880 - DNA, 18 bp, Homo sapiens
atctatcttatatagttt

SEQ ID NO: 2654881 - DNA, 15 bp, Homo sapiens
atctatgaagtatat

SEQ ID NO: 2654882 - DNA, 19 bp, Homo sapiens
atctatgaagtatataatg

SEQ ID NO: 2654883 - DNA, 16 bp, Homo sapiens
atctattatactgtat

SEQ ID NO: 2654884 - DNA, 22 bp, Homo sapiens
atctattcagacaagcaacagg

SEQ ID NO: 2654885 - DNA, 13 bp, Homo sapiens
atctatttaagta

SEQ ID NO: 2654886 - DNA, 15 bp, Homo sapiens
atctatttctgagaa

SEQ ID NO: 2654887 - DNA, 19 bp, Homo sapiens
atctcaaaactgcactgtc

SEQ ID NO: 2654888 - DNA, 14 bp, Homo sapiens
atctcaaatttcta

SEQ ID NO: 2654889 - DNA, 14 bp, Homo sapiens
atctcagggcctgg

SEQ ID NO: 2654890 - DNA, 16 bp, Homo sapiens
atctcaggggccagag

SEQ ID NO: 2654891 - DNA, 23 bp, Homo sapiens
atctcaggggccagaggaactgt

SEQ ID NO: 2654892 - DNA, 17 bp, Homo sapiens
atctcaggggctgtttg

SEQ ID NO: 2654893 - DNA, 20 bp, Homo sapiens
atctcaggggctgtttgagg

SEQ ID NO: 2654894 - DNA, 21 bp, Homo sapiens
atctcaggggctgtttgagga

SEQ ID NO: 2654895 - DNA, 16 bp, Homo sapiens
atctcagtcatgcata

SEQ ID NO: 2654896 - DNA, 17 bp, Homo sapiens
atctcataggttgccaa

SEQ ID NO: 2654897 - DNA, 19 bp, Homo sapiens
atctcataggttgccaata

SEQ ID NO: 2654898 - DNA, 17 bp, Homo sapiens
atctccaaaataaaact

SEQ ID NO: 2654899 - DNA, 15 bp, Homo sapiens
atctccaagaatgct

SEQ ID NO: 2654900 - DNA, 16 bp, Homo sapiens
atctccaagaatgctg

SEQ ID NO: 2654901 - DNA, 17 bp, Homo sapiens
atctccaagaatgctga

SEQ ID NO: 2654902 - DNA, 18 bp, Homo sapiens
atctccaagaccagagat

SEQ ID NO: 2654903 - DNA, 12 bp, Homo sapiens
atctccaggatt

SEQ ID NO: 2654904 - DNA, 19 bp, Homo sapiens
atctccagggagtcccctc

SEQ ID NO: 2654905 - DNA, 14 bp, Homo sapiens
atctccatggcttc

SEQ ID NO: 2654906 - DNA, 17 bp, Homo sapiens
atctccatggcttcctc

SEQ ID NO: 2654907 - DNA, 20 bp, Homo sapiens
atctcccagataatgtgaaa

SEQ ID NO: 2654908 - DNA, 14 bp, Homo sapiens
atctccccactcta

SEQ ID NO: 2654909 - DNA, 12 bp, Homo sapiens
atctcccccagc

SEQ ID NO: 2654910 - DNA, 13 bp, Homo sapiens
atctcccccagcc

SEQ ID NO: 2654911 - DNA, 17 bp, Homo sapiens
atctcccccagccccat

SEQ ID NO: 2654912 - DNA, 21 bp, Homo sapiens
atctcccccagccccatcctc

SEQ ID NO: 2654913 - DNA, 16 bp, Homo sapiens
atctcctgccttcctc

SEQ ID NO: 2654914 - DNA, 20 bp, Homo sapiens
atctcctgccttcctcctgg

SEQ ID NO: 2654915 - DNA, 19 bp, Homo sapiens
atctcctgtgcatgggtga

SEQ ID NO: 2654916 - DNA, 21 bp, Homo sapiens
atctcgccacccctccttcct

SEQ ID NO: 2654917 - DNA, 14 bp, Homo sapiens
atctcgtgggagag

SEQ ID NO: 2654918 - DNA, 15 bp, Homo sapiens
atctcgtgggagagc

SEQ ID NO: 2654919 - DNA, 17 bp, Homo sapiens
atctcgtttcaaaaaca

SEQ ID NO: 2654920 - DNA, 13 bp, Homo sapiens
atctctatttaat

SEQ ID NO: 2654921 - DNA, 14 bp, Homo sapiens
atctctatttaata

SEQ ID NO: 2654922 - DNA, 17 bp, Homo sapiens
atctctatttaatattt

SEQ ID NO: 2654923 - DNA, 18 bp, Homo sapiens
atctctatttaatattta

SEQ ID NO: 2654924 - DNA, 16 bp, Homo sapiens
atctctcaggagcaca

SEQ ID NO: 2654925 - DNA, 17 bp, Homo sapiens
atctctcaggagcacag

SEQ ID NO: 2654926 - DNA, 21 bp, Homo sapiens
atctctcaggagcacaggcag

SEQ ID NO: 2654927 - DNA, 22 bp, Homo sapiens
atctctcaggagcacaggcagc

SEQ ID NO: 2654928 - DNA, 19 bp, Homo sapiens
atggaaccgcaggaagctg

SEQ ID NO: 2654929 - DNA, 20 bp, Homo sapiens
atggaaccgcaggaagctgc

SEQ ID NO: 2654930 - DNA, 19 bp, Homo sapiens
atggaacttctaatatatt

SEQ ID NO: 2654931 - DNA, 14 bp, Homo sapiens
atggaagacacatt

SEQ ID NO: 2654932 - DNA, 17 bp, Homo sapiens
atggaagattttaaatt

SEQ ID NO: 2654933 - DNA, 14 bp, Homo sapiens
atggaataacatgt

SEQ ID NO: 2654934 - DNA, 16 bp, Homo sapiens
atggaatacagtgtta

SEQ ID NO: 2654935 - DNA, 22 bp, Homo sapiens
atggaatacagtgttattttct

SEQ ID NO: 2654936 - DNA, 21 bp, Homo sapiens
atggacaccccttatccagga

SEQ ID NO: 2654937 - DNA, 11 bp, Homo sapiens
atggacactcc

SEQ ID NO: 2654938 - DNA, 13 bp, Homo sapiens
atggacactccag

SEQ ID NO: 2654939 - DNA, 15 bp, Homo sapiens
atggacactccagtg

SEQ ID NO: 2654940 - DNA, 19 bp, Homo sapiens
atggacactccagtgccag

SEQ ID NO: 2654941 - DNA, 20 bp, Homo sapiens
atggacagaagaaggcagca

SEQ ID NO: 2654942 - DNA, 18 bp, Homo sapiens
atggacagggcatgccac

SEQ ID NO: 2654943 - DNA, 13 bp, Homo sapiens
atggacccaatgc

SEQ ID NO: 2654944 - DNA, 21 bp, Homo sapiens
atggacggtgctccaggcagg

SEQ ID NO: 2654945 - DNA, 21 bp, Homo sapiens
atggactccagcctgcctggc

SEQ ID NO: 2654946 - DNA, 18 bp, Homo sapiens
atggactctacactgtga

SEQ ID NO: 2654947 - DNA, 13 bp, Homo sapiens
atggagagagggg

SEQ ID NO: 2654948 - DNA, 23 bp, Homo sapiens
atggagagctggagcctggtgcc

SEQ ID NO: 2654949 - DNA, 16 bp, Homo sapiens
atggaggatggagaga

SEQ ID NO: 2654950 - DNA, 16 bp, Homo sapiens
atggagggaataatac

SEQ ID NO: 2654951 - DNA, 18 bp, Homo sapiens
atggaggggtggtcctga

SEQ ID NO: 2654952 - DNA, 20 bp, Homo sapiens
atggaggggtggtcctgact

SEQ ID NO: 2654953 - DNA, 20 bp, Homo sapiens
atggagtccagggaagagaa

SEQ ID NO: 2654954 - DNA, 11 bp, Homo sapiens
atggagtgacg

SEQ ID NO: 2654955 - DNA, 16 bp, Homo sapiens
atggagtgtacaagta

SEQ ID NO: 2654956 - DNA, 18 bp, Homo sapiens
atggagtgtgtattgttc

SEQ ID NO: 2654957 - DNA, 18 bp, Homo sapiens
atggataacctatatgat

SEQ ID NO: 2654958 - DNA, 21 bp, Homo sapiens
atggatgattcagaaattgga

SEQ ID NO: 2654959 - DNA, 20 bp, Homo sapiens
atggatgtggggtccccatc

SEQ ID NO: 2654960 - DNA, 22 bp, Homo sapiens
atggatgttttagccattgttg

SEQ ID NO: 2654961 - DNA, 17 bp, Homo sapiens
atggattctcagatatt

SEQ ID NO: 2654962 - DNA, 22 bp, Homo sapiens
atggattctcagatatttatat

SEQ ID NO: 2654963 - DNA, 20 bp, Homo sapiens
atggattgataattgcattc

SEQ ID NO: 2654964 - DNA, 22 bp, Homo sapiens
atggattggattatttaataac

SEQ ID NO: 2654965 - DNA, 17 bp, Homo sapiens
atggatttgatgctgtt

SEQ ID NO: 2654966 - DNA, 16 bp, Homo sapiens
atggcaattttgtaac

SEQ ID NO: 2654967 - DNA, 23 bp, Homo sapiens
atggcacatcagcacgatttctg

SEQ ID NO: 2654968 - DNA, 19 bp, Homo sapiens
atggcagaagacaccagag

SEQ ID NO: 2654969 - DNA, 22 bp, Homo sapiens
atggcagaagacaccagagcag

SEQ ID NO: 2654970 - DNA, 13 bp, Homo sapiens
atggcagaaggca

SEQ ID NO: 2654971 - DNA, 19 bp, Homo sapiens
atggcagagtttgtgtgtt

SEQ ID NO: 2654972 - DNA, 20 bp, Homo sapiens
atggcagagtttgtgtgttg

SEQ ID NO: 2654973 - DNA, 23 bp, Homo sapiens
atggcagagtttgtgtgttgtct

SEQ ID NO: 2654974 - DNA, 14 bp, Homo sapiens
atggcagctgccac

SEQ ID NO: 2654975 - DNA, 20 bp, Homo sapiens
atggcagctgtttaaatgtt

SEQ ID NO: 2654976 - DNA, 15 bp, Homo sapiens
atggcatcacctcca

SEQ ID NO: 2654977 - DNA, 17 bp, Homo sapiens
atggcatccaagagtgc

SEQ ID NO: 2654978 - DNA, 17 bp, Homo sapiens
atggcatcctgtgaagt

SEQ ID NO: 2654979 - DNA, 16 bp, Homo sapiens
atggccaccttttcag

SEQ ID NO: 2654980 - DNA, 14 bp, Homo sapiens
atggcccagtgtca

SEQ ID NO: 2654981 - DNA, 11 bp, Homo sapiens
atggcccctct

SEQ ID NO: 2654982 - DNA, 18 bp, Homo sapiens
atggcccttcccactgga

SEQ ID NO: 2654983 - DNA, 13 bp, Homo sapiens
atggcctcagctg

SEQ ID NO: 2654984 - DNA, 19 bp, Homo sapiens
atggcctgccttgaagcca

SEQ ID NO: 2654985 - DNA, 20 bp, Homo sapiens
atggcctgccttgaagccac

SEQ ID NO: 2654986 - DNA, 17 bp, Homo sapiens
atggcgtgatctcggct

SEQ ID NO: 2654987 - DNA, 14 bp, Homo sapiens
atggctatatggca

SEQ ID NO: 2654988 - DNA, 20 bp, Homo sapiens
atggctcactatgaatctat

SEQ ID NO: 2654989 - DNA, 17 bp, Homo sapiens
atggctccagaaatgtc

SEQ ID NO: 2654990 - DNA, 23 bp, Homo sapiens
atggctccagtctgctgccctcc

SEQ ID NO: 2654991 - DNA, 21 bp, Homo sapiens
atggctgaaggaaaccagtgc

SEQ ID NO: 2654992 - DNA, 22 bp, Homo sapiens
atggctgaaggaaaccagtgca

SEQ ID NO: 2654993 - DNA, 12 bp, Homo sapiens
atggctgctgaa

SEQ ID NO: 2654994 - DNA, 19 bp, Homo sapiens
atggctgctgaagctgcct

SEQ ID NO: 2654995 - DNA, 22 bp, Homo sapiens
atggctgggaactgcagacctg

SEQ ID NO: 2654996 - DNA, 17 bp, Homo sapiens
atggctgtgcctctgcc

SEQ ID NO: 2654997 - DNA, 18 bp, Homo sapiens
atggctgtgcctctgcct

SEQ ID NO: 2654998 - DNA, 19 bp, Homo sapiens
atggctgtgcctctgcctg

SEQ ID NO: 2654999 - DNA, 16 bp, Homo sapiens
atggcttaatgtttat

SEQ ID NO: 2655000 - DNA, 19 bp, Homo sapiens
atggcttatccagctggtg

SEQ ID NO: 2655001 - DNA, 12 bp, Homo sapiens
atggcttcctcc

SEQ ID NO: 2655002 - DNA, 14 bp, Homo sapiens
atggcttctaacaa

SEQ ID NO: 2655003 - DNA, 18 bp, Homo sapiens
atggcttgccacagctct

SEQ ID NO: 2655004 - DNA, 17 bp, Homo sapiens
atggcttttgtgcatta

SEQ ID NO: 2655005 - DNA, 14 bp, Homo sapiens
atgggaagacatga

SEQ ID NO: 2655006 - DNA, 17 bp, Homo sapiens
atgggaagacgaggccc

SEQ ID NO: 2655007 - DNA, 14 bp, Homo sapiens
atgggaatgaagct

SEQ ID NO: 2655008 - DNA, 15 bp, Homo sapiens
atgggaatgaagctt

SEQ ID NO: 2655009 - DNA, 16 bp, Homo sapiens
atgggaatgaagcttg

SEQ ID NO: 2655010 - DNA, 14 bp, Homo sapiens
atgggagctcctct

SEQ ID NO: 2655011 - DNA, 22 bp, Homo sapiens
atgggagctcctctcctggagg

SEQ ID NO: 2655012 - DNA, 21 bp, Homo sapiens
atgggagctggttagaaatgc

SEQ ID NO: 2655013 - DNA, 18 bp, Homo sapiens
atgggatggtggagggcc

SEQ ID NO: 2655014 - DNA, 23 bp, Homo sapiens
atgggattcagtgcttcttaaag

SEQ ID NO: 2655015 - DNA, 22 bp, Homo sapiens
atgggcatggggtgggcctctg

SEQ ID NO: 2655016 - DNA, 23 bp, Homo sapiens
atgggcatggggtgggcctctgg

SEQ ID NO: 2655017 - DNA, 17 bp, Homo sapiens
atgggctaatgaagatc

SEQ ID NO: 2655018 - DNA, 19 bp, Homo sapiens
atgggctgcagcagaggca

SEQ ID NO: 2655019 - DNA, 16 bp, Homo sapiens
atgggcttagagcagt

SEQ ID NO: 2655020 - DNA, 20 bp, Homo sapiens
atggggatagatgtgtggac

SEQ ID NO: 2655021 - DNA, 16 bp, Homo sapiens
atggggatcacagaga

SEQ ID NO: 2655022 - DNA, 17 bp, Homo sapiens
atggggatcacagagac

SEQ ID NO: 2655023 - DNA, 12 bp, Homo sapiens
atggggatgcag

SEQ ID NO: 2655024 - DNA, 13 bp, Homo sapiens
atggggccctgcc

SEQ ID NO: 2655025 - DNA, 14 bp, Homo sapiens
atggggccctgcct

SEQ ID NO: 2655026 - DNA, 17 bp, Homo sapiens
atggggctcccgcccgt

SEQ ID NO: 2655027 - DNA, 24 bp, Homo sapiens
atggggctgcaccggctggcctgg

SEQ ID NO: 2655028 - DNA, 22 bp, Homo sapiens
atgggggaaagcacaggtgggc

SEQ ID NO: 2655029 - DNA, 19 bp, Homo sapiens
atgggggaggggggaagga

SEQ ID NO: 2655030 - DNA, 21 bp, Homo sapiens
atgggggagtctgaagcagat

SEQ ID NO: 2655031 - DNA, 17 bp, Homo sapiens
atgggggcactgaggac

SEQ ID NO: 2655032 - DNA, 16 bp, Homo sapiens
atggggggccaacacc

SEQ ID NO: 2655033 - DNA, 16 bp, Homo sapiens
atgggggtagcagctg

SEQ ID NO: 2655034 - DNA, 17 bp, Homo sapiens
atgggggtagcagctgg

SEQ ID NO: 2655035 - DNA, 14 bp, Homo sapiens
atgggggtgcattt

SEQ ID NO: 2655036 - DNA, 21 bp, Homo sapiens
atggggtgatgctgggctggc

SEQ ID NO: 2655037 - DNA, 19 bp, Homo sapiens
atggggtgggcctctggtt

SEQ ID NO: 2655038 - DNA, 19 bp, Homo sapiens
atggggtggggtagggctg

SEQ ID NO: 2655039 - DNA, 21 bp, Homo sapiens
atggggttggctgggcccaga

SEQ ID NO: 2655040 - DNA, 17 bp, Homo sapiens
atgggtagagaaacact

SEQ ID NO: 2655041 - DNA, 15 bp, Homo sapiens
atgggtgcttggagg

SEQ ID NO: 2655042 - DNA, 23 bp, Homo sapiens
atgggtgcttggaggaaggaaac

SEQ ID NO: 2655043 - DNA, 13 bp, Homo sapiens
atggtactattta

SEQ ID NO: 2655044 - DNA, 20 bp, Homo sapiens
atggtcaacacttaagggtt

SEQ ID NO: 2655045 - DNA, 13 bp, Homo sapiens
atggtcagctccc

SEQ ID NO: 2655046 - DNA, 20 bp, Homo sapiens
atggtcagctcccttctctg

SEQ ID NO: 2655047 - DNA, 13 bp, Homo sapiens
atggtcccatcca

SEQ ID NO: 2655048 - DNA, 17 bp, Homo sapiens
atggtcccatccaggca

SEQ ID NO: 2655049 - DNA, 18 bp, Homo sapiens
atggtcccatccaggcag

SEQ ID NO: 2655050 - DNA, 19 bp, Homo sapiens
atggtcctggggctctgtg

SEQ ID NO: 2655051 - DNA, 14 bp, Homo sapiens
atggtctcagaaac

SEQ ID NO: 2655052 - DNA, 14 bp, Homo sapiens
atggtgaaaatgta

SEQ ID NO: 2655053 - DNA, 16 bp, Homo sapiens
atggtgaaaatgtact

SEQ ID NO: 2655054 - DNA, 17 bp, Homo sapiens
atggtgaaatttattag

SEQ ID NO: 2655055 - DNA, 18 bp, Homo sapiens
atggtgagatgcagctgg

SEQ ID NO: 2655056 - DNA, 17 bp, Homo sapiens
atggtgatgaaatgtaa

SEQ ID NO: 2655057 - DNA, 12 bp, Homo sapiens
atggtggctggg

SEQ ID NO: 2655058 - DNA, 15 bp, Homo sapiens
atggtggctgggttg

SEQ ID NO: 2655059 - DNA, 21 bp, Homo sapiens
atggtggtgcatgtctgcaaa

SEQ ID NO: 2655060 - DNA, 12 bp, Homo sapiens
atggtgtaataa

SEQ ID NO: 2655061 - DNA, 18 bp, Homo sapiens
atggtgtaataagacata

SEQ ID NO: 2655062 - DNA, 18 bp, Homo sapiens
atggtgtacataatgtat

SEQ ID NO: 2655063 - DNA, 15 bp, Homo sapiens
atggttacaatcatt

SEQ ID NO: 2655064 - DNA, 19 bp, Homo sapiens
atggttacaatcattgctg

SEQ ID NO: 2655065 - DNA, 14 bp, Homo sapiens
atggttataaaagt

SEQ ID NO: 2655066 - DNA, 16 bp, Homo sapiens
atggttataaaagtga

SEQ ID NO: 2655067 - DNA, 18 bp, Homo sapiens
atggttccatgcctgagg

SEQ ID NO: 2655068 - DNA, 20 bp, Homo sapiens
atggttccatgcctgagggt

SEQ ID NO: 2655069 - DNA, 17 bp, Homo sapiens
atggttgccttaaagaa

SEQ ID NO: 2655070 - DNA, 18 bp, Homo sapiens
atggtttgcaaggaagcc

SEQ ID NO: 2655071 - DNA, 15 bp, Homo sapiens
atggttttcaaaata

SEQ ID NO: 2655072 - DNA, 17 bp, Homo sapiens
attcaattcctctggga

SEQ ID NO: 2655073 - DNA, 15 bp, Homo sapiens
attcacacctgactc

SEQ ID NO: 2655074 - DNA, 20 bp, Homo sapiens
attcacatctaacctcatct

SEQ ID NO: 2655075 - DNA, 16 bp, Homo sapiens
attcaccccctttcct

SEQ ID NO: 2655076 - DNA, 23 bp, Homo sapiens
attcaccttccagtgtctcggag

SEQ ID NO: 2655077 - DNA, 15 bp, Homo sapiens
attcactgcccccag

SEQ ID NO: 2655078 - DNA, 13 bp, Homo sapiens
attcagaaattgg

SEQ ID NO: 2655079 - DNA, 16 bp, Homo sapiens
attcagacagctgcct

SEQ ID NO: 2655080 - DNA, 17 bp, Homo sapiens
attcagacagctgcctg

SEQ ID NO: 2655081 - DNA, 14 bp, Homo sapiens
attcagattttaaa

SEQ ID NO: 2655082 - DNA, 14 bp, Homo sapiens
attcagcactgatt

SEQ ID NO: 2655083 - DNA, 19 bp, Homo sapiens
attcagcactgatttcaca

SEQ ID NO: 2655084 - DNA, 18 bp, Homo sapiens
attcagctctgcaagaat

SEQ ID NO: 2655085 - DNA, 20 bp, Homo sapiens
attcagcttcatttgtgtca

SEQ ID NO: 2655086 - DNA, 12 bp, Homo sapiens
attcaggaagct

SEQ ID NO: 2655087 - DNA, 13 bp, Homo sapiens
attcaggaagctc

SEQ ID NO: 2655088 - DNA, 22 bp, Homo sapiens
attcaggaagctcagggcctgg

SEQ ID NO: 2655089 - DNA, 21 bp, Homo sapiens
attcaggacttaacggctcca

SEQ ID NO: 2655090 - DNA, 22 bp, Homo sapiens
attcaggacttaacggctccag

SEQ ID NO: 2655091 - DNA, 18 bp, Homo sapiens
attcaggtatgttgcctt

SEQ ID NO: 2655092 - DNA, 23 bp, Homo sapiens
attcaggtatgttgcctttatgg

SEQ ID NO: 2655093 - DNA, 19 bp, Homo sapiens
attcagtaataactctacc

SEQ ID NO: 2655094 - DNA, 17 bp, Homo sapiens
attcagtgctgtggcct

SEQ ID NO: 2655095 - DNA, 17 bp, Homo sapiens
attcagttcccagaatc

SEQ ID NO: 2655096 - DNA, 11 bp, Homo sapiens
attcataataa

SEQ ID NO: 2655097 - DNA, 19 bp, Homo sapiens
attcatagcagcttattca

SEQ ID NO: 2655098 - DNA, 22 bp, Homo sapiens
attcatagcagcttattcacaa

SEQ ID NO: 2655099 - DNA, 13 bp, Homo sapiens
attcatattgaat

SEQ ID NO: 2655100 - DNA, 19 bp, Homo sapiens
attcatatttacttcttat

SEQ ID NO: 2655101 - DNA, 16 bp, Homo sapiens
attcatattttctttc

SEQ ID NO: 2655102 - DNA, 20 bp, Homo sapiens
attcatattttctttcaaaa

SEQ ID NO: 2655103 - DNA, 17 bp, Homo sapiens
attcatgaacttcgcat

SEQ ID NO: 2655104 - DNA, 21 bp, Homo sapiens
attcatgctactgccaacctg

SEQ ID NO: 2655105 - DNA, 17 bp, Homo sapiens
attcatggcctggggga

SEQ ID NO: 2655106 - DNA, 16 bp, Homo sapiens
attcattgtataaaaa

SEQ ID NO: 2655107 - DNA, 19 bp, Homo sapiens
attcattgtataaaaatag

SEQ ID NO: 2655108 - DNA, 10 bp, Homo sapiens
attcatttaa

SEQ ID NO: 2655109 - DNA, 14 bp, Homo sapiens
attcatttaaaatg

SEQ ID NO: 2655110 - DNA, 16 bp, Homo sapiens
attcatttaaaatgat

SEQ ID NO: 2655111 - DNA, 22 bp, Homo sapiens
attcatttcaaagggagagaga

SEQ ID NO: 2655112 - DNA, 17 bp, Homo sapiens
attccaaccccaactcc

SEQ ID NO: 2655113 - DNA, 11 bp, Homo sapiens
attccaacctt

SEQ ID NO: 2655114 - DNA, 13 bp, Homo sapiens
attccaagacagt

SEQ ID NO: 2655115 - DNA, 23 bp, Homo sapiens
attccagactgcttccaattttc

SEQ ID NO: 2655116 - DNA, 19 bp, Homo sapiens
attccagagcgtgtagtga

SEQ ID NO: 2655117 - DNA, 12 bp, Homo sapiens
attccagaggaa

SEQ ID NO: 2655118 - DNA, 16 bp, Homo sapiens
attccatattcatgta

SEQ ID NO: 2655119 - DNA, 17 bp, Homo sapiens
attccatatttattcaa

SEQ ID NO: 2655120 - DNA, 11 bp, Homo sapiens
attccatcctt

SEQ ID NO: 2655121 - DNA, 19 bp, Homo sapiens
attccatgaatcgcttctc

SEQ ID NO: 2655122 - DNA, 21 bp, Homo sapiens
attccatgaatcgcttctctt

SEQ ID NO: 2655123 - DNA, 16 bp, Homo sapiens
attccatgaatgtatc

SEQ ID NO: 2655124 - DNA, 21 bp, Homo sapiens
attccattctggaagtgactt

SEQ ID NO: 2655125 - DNA, 16 bp, Homo sapiens
attccattctggattt

SEQ ID NO: 2655126 - DNA, 16 bp, Homo sapiens
attccattgtgtgagt

SEQ ID NO: 2655127 - DNA, 18 bp, Homo sapiens
attcccaagctctgctcc

SEQ ID NO: 2655128 - DNA, 15 bp, Homo sapiens
attcccatctgtcac

SEQ ID NO: 2655129 - DNA, 20 bp, Homo sapiens
attcccattttgcaaaattt

SEQ ID NO: 2655130 - DNA, 22 bp, Homo sapiens
attccccaccctgaaagccctg

SEQ ID NO: 2655131 - DNA, 16 bp, Homo sapiens
attccccaggaggcca

SEQ ID NO: 2655132 - DNA, 19 bp, Homo sapiens
attccccaggaggccagcc

SEQ ID NO: 2655133 - DNA, 14 bp, Homo sapiens
attccccattcttc

SEQ ID NO: 2655134 - DNA, 17 bp, Homo sapiens
attccccattgcctcct

SEQ ID NO: 2655135 - DNA, 23 bp, Homo sapiens
attccccctggccaccacccccc

SEQ ID NO: 2655136 - DNA, 20 bp, Homo sapiens
attccctagaaacttccaaa

SEQ ID NO: 2655137 - DNA, 21 bp, Homo sapiens
attccctagaaacttccaaat

SEQ ID NO: 2655138 - DNA, 15 bp, Homo sapiens
attccctctctctga

SEQ ID NO: 2655139 - DNA, 13 bp, Homo sapiens
attccctggcctt

SEQ ID NO: 2655140 - DNA, 19 bp, Homo sapiens
attccctggcctttcatat

SEQ ID NO: 2655141 - DNA, 21 bp, Homo sapiens
attccgacaaccgatgctcca

SEQ ID NO: 2655142 - DNA, 16 bp, Homo sapiens
attccgtagccagctg

SEQ ID NO: 2655143 - DNA, 23 bp, Homo sapiens
attccgtagccagctgctcccca

SEQ ID NO: 2655144 - DNA, 21 bp, Homo sapiens
attcctattgtgatttgactg

SEQ ID NO: 2655145 - DNA, 22 bp, Homo sapiens
attcctcctgggcccctcatct

SEQ ID NO: 2655146 - DNA, 13 bp, Homo sapiens
attcctgaaagaa

SEQ ID NO: 2655147 - DNA, 17 bp, Homo sapiens
attcctgaatgaaatat

SEQ ID NO: 2655148 - DNA, 16 bp, Homo sapiens
attcctgacccaggcc

SEQ ID NO: 2655149 - DNA, 21 bp, Homo sapiens
attcctgacccaggccgcagc

SEQ ID NO: 2655150 - DNA, 16 bp, Homo sapiens
attcctgatatgattt

SEQ ID NO: 2655151 - DNA, 19 bp, Homo sapiens
attcctgatatgatttaaa

SEQ ID NO: 2655152 - DNA, 21 bp, Homo sapiens
attcctgatgcttcttcagag

SEQ ID NO: 2655153 - DNA, 15 bp, Homo sapiens
attcctgcctgtctc

SEQ ID NO: 2655154 - DNA, 13 bp, Homo sapiens
attcctgggcaca

SEQ ID NO: 2655155 - DNA, 20 bp, Homo sapiens
attcctggtacccagccatc

SEQ ID NO: 2655156 - DNA, 18 bp, Homo sapiens
attcctgtagcatcttct

SEQ ID NO: 2655157 - DNA, 13 bp, Homo sapiens
attcctgtatgtt

SEQ ID NO: 2655158 - DNA, 16 bp, Homo sapiens
attccttaaataaact

SEQ ID NO: 2655159 - DNA, 24 bp, Homo sapiens
attccttagcttagacctcagcct

SEQ ID NO: 2655160 - DNA, 15 bp, Homo sapiens
attccttcagggtga

SEQ ID NO: 2655161 - DNA, 14 bp, Homo sapiens
attccttctttgat

SEQ ID NO: 2655162 - DNA, 17 bp, Homo sapiens
attccttctttgataat

SEQ ID NO: 2655163 - DNA, 20 bp, Homo sapiens
attccttctttgataatgtt

SEQ ID NO: 2655164 - DNA, 22 bp, Homo sapiens
attccttctttgataatgttaa

SEQ ID NO: 2655165 - DNA, 20 bp, Homo sapiens
attcgcccaaagccagacag

SEQ ID NO: 2655166 - DNA, 21 bp, Homo sapiens
attcgcccaaagccagacagc

SEQ ID NO: 2655167 - DNA, 18 bp, Homo sapiens
attctaaatgaatgttta

SEQ ID NO: 2655168 - DNA, 19 bp, Homo sapiens
attctaacttttttgctat

SEQ ID NO: 2655169 - DNA, 13 bp, Homo sapiens
attctaatgtctt

SEQ ID NO: 2655170 - DNA, 13 bp, Homo sapiens
attctacacagag

SEQ ID NO: 2655171 - DNA, 15 bp, Homo sapiens
attctagctttgagc

SEQ ID NO: 2655172 - DNA, 15 bp, Homo sapiens
attctatatgaattt

SEQ ID NO: 2655173 - DNA, 23 bp, Homo sapiens
attctatatgaatttaaatataa

SEQ ID NO: 2655174 - DNA, 15 bp, Homo sapiens
attctatttgctggg

SEQ ID NO: 2655175 - DNA, 16 bp, Homo sapiens
attctcaagccctgca

SEQ ID NO: 2655176 - DNA, 23 bp, Homo sapiens
attctcagatatttatattttta

SEQ ID NO: 2655177 - DNA, 20 bp, Homo sapiens
attctcagggtctctgctgc

SEQ ID NO: 2655178 - DNA, 21 bp, Homo sapiens
attctcagggtctctgctgcc

SEQ ID NO: 2655179 - DNA, 16 bp, Homo sapiens
attctccacctgccag

SEQ ID NO: 2655180 - DNA, 13 bp, Homo sapiens
attctcctgcctc

SEQ ID NO: 2655181 - DNA, 15 bp, Homo sapiens
attctcctgcctcag

SEQ ID NO: 2655182 - DNA, 18 bp, Homo sapiens
attctcctgcctcagcct

SEQ ID NO: 2655183 - DNA, 20 bp, Homo sapiens
attctcctgcctcagcctcc

SEQ ID NO: 2655184 - DNA, 22 bp, Homo sapiens
attctcctgcctgtagcagtga

SEQ ID NO: 2655185 - DNA, 18 bp, Homo sapiens
attctccttgtgttacta

SEQ ID NO: 2655186 - DNA, 19 bp, Homo sapiens
attctccttgtgttactaa

SEQ ID NO: 2655187 - DNA, 23 bp, Homo sapiens
attctctagtttgattaaattct

SEQ ID NO: 2655188 - DNA, 19 bp, Homo sapiens
attctctcctgtacctctt

SEQ ID NO: 2655189 - DNA, 21 bp, Homo sapiens
attctctcctgtacctcttga

SEQ ID NO: 2655190 - DNA, 15 bp, Homo sapiens
attctctctcctgta

SEQ ID NO: 2655191 - DNA, 11 bp, Homo sapiens
attctctgagc

SEQ ID NO: 2655192 - DNA, 13 bp, Homo sapiens
attctctgagctg

SEQ ID NO: 2655193 - DNA, 17 bp, Homo sapiens
attctctgagctgtgca

SEQ ID NO: 2655194 - DNA, 13 bp, Homo sapiens
attctctgtctca

SEQ ID NO: 2655195 - DNA, 15 bp, Homo sapiens
attctcttatccaac

SEQ ID NO: 2655196 - DNA, 14 bp, Homo sapiens
attctgattacaca

SEQ ID NO: 2655197 - DNA, 13 bp, Homo sapiens
attctgattccac

SEQ ID NO: 2655198 - DNA, 22 bp, Homo sapiens
attctgcaagcacatctgcatt

SEQ ID NO: 2655199 - DNA, 22 bp, Homo sapiens
attctgcagcatgacctgtgac

SEQ ID NO: 2655200 - DNA, 14 bp, Homo sapiens
attctgcctgccca

SEQ ID NO: 2655201 - DNA, 15 bp, Homo sapiens
attctgcctgcccag

SEQ ID NO: 2655202 - DNA, 17 bp, Homo sapiens
attctgcctgcccaggc

SEQ ID NO: 2655203 - DNA, 19 bp, Homo sapiens
attctgcctgcccaggccc

SEQ ID NO: 2655204 - DNA, 17 bp, Homo sapiens
attctggataaagccac

SEQ ID NO: 2655205 - DNA, 17 bp, Homo sapiens
attctgtagattctgtg

SEQ ID NO: 2655206 - DNA, 20 bp, Homo sapiens
attctgtcgccttagcatgt

SEQ ID NO: 2655207 - DNA, 21 bp, Homo sapiens
attctgtcgccttagcatgtt

SEQ ID NO: 2655208 - DNA, 17 bp, Homo sapiens
attctgtggaacaagcc

SEQ ID NO: 2655209 - DNA, 17 bp, Homo sapiens
attctgtgtgttttcat

SEQ ID NO: 2655210 - DNA, 22 bp, Homo sapiens
attctgtgtgttttcataataa

SEQ ID NO: 2655211 - DNA, 21 bp, Homo sapiens
attctgttggccagtgtgaca

SEQ ID NO: 2655212 - DNA, 12 bp, Homo sapiens
attctgtttctt

SEQ ID NO: 2655213 - DNA, 20 bp, Homo sapiens
attcttaaaatatatttcag

SEQ ID NO: 2655214 - DNA, 22 bp, Homo sapiens
attcttaagggaacttccacat

SEQ ID NO: 2655215 - DNA, 21 bp, Homo sapiens
attcttacaaacatgtggtta

SEQ ID NO: 2655216 - DNA, 16 bp, Homo sapiens
attcttataaatatga

SEQ ID NO: 2655217 - DNA, 14 bp, Homo sapiens
attcttatgcttat

SEQ ID NO: 2655218 - DNA, 20 bp, Homo sapiens
attcttccctatctttgcca

SEQ ID NO: 2655219 - DNA, 12 bp, Homo sapiens
attcttcctagt

SEQ ID NO: 2655220 - DNA, 17 bp, Homo sapiens
attcttcctagttttct

SEQ ID NO: 2655221 - DNA, 14 bp, Homo sapiens
attcttctgcctca

SEQ ID NO: 2655222 - DNA, 11 bp, Homo sapiens
attcttctgct

SEQ ID NO: 2655223 - DNA, 12 bp, Homo sapiens
attcttctgctt

SEQ ID NO: 2655224 - DNA, 22 bp, Homo sapiens
attcttctgtacgtctgacagg

SEQ ID NO: 2655225 - DNA, 22 bp, Homo sapiens
attcttcttccaacgtggccca

SEQ ID NO: 2655226 - DNA, 16 bp, Homo sapiens
attcttgaaagctgtg

SEQ ID NO: 2655227 - DNA, 17 bp, Homo sapiens
attcttggttgaggaaa

SEQ ID NO: 2655228 - DNA, 20 bp, Homo sapiens
attcttggttggctggcctt

SEQ ID NO: 2655229 - DNA, 21 bp, Homo sapiens
attctttatacaacagtgcta

SEQ ID NO: 2655230 - DNA, 17 bp, Homo sapiens
attctttgatgttaaca

SEQ ID NO: 2655231 - DNA, 21 bp, Homo sapiens
attctttgatgttaacacatt

SEQ ID NO: 2655232 - DNA, 18 bp, Homo sapiens
attgaaaaaatagagcct

SEQ ID NO: 2655233 - DNA, 19 bp, Homo sapiens
attgaaaaaatagagcctg

SEQ ID NO: 2655234 - DNA, 21 bp, Homo sapiens
attgaaattgtacatatttgt

SEQ ID NO: 2655235 - DNA, 15 bp, Homo sapiens
attgaactctttgaa

SEQ ID NO: 2655236 - DNA, 22 bp, Homo sapiens
attgaagcattttataaatcgc

SEQ ID NO: 2655237 - DNA, 16 bp, Homo sapiens
attgaatctatttaag

SEQ ID NO: 2655238 - DNA, 18 bp, Homo sapiens
attgaatctatttaagta

SEQ ID NO: 2655239 - DNA, 16 bp, Homo sapiens
attgaatgtttccaac

SEQ ID NO: 2655240 - DNA, 13 bp, Homo sapiens
attgaattatctt

SEQ ID NO: 2655241 - DNA, 20 bp, Homo sapiens
attgacaataatttcaggtt

SEQ ID NO: 2655242 - DNA, 15 bp, Homo sapiens
attgacacttaaaaa

SEQ ID NO: 2655243 - DNA, 18 bp, Homo sapiens
attgacagatcaagctgt

SEQ ID NO: 2655244 - DNA, 20 bp, Homo sapiens
attgagaagttttgtacaga

SEQ ID NO: 2655245 - DNA, 13 bp, Homo sapiens
attgagaatttta

SEQ ID NO: 2655246 - DNA, 17 bp, Homo sapiens
attgagaattttaaatt

SEQ ID NO: 2655247 - DNA, 14 bp, Homo sapiens
attgagagttttgt

SEQ ID NO: 2655248 - DNA, 16 bp, Homo sapiens
attgagagttttgtct

SEQ ID NO: 2655249 - DNA, 19 bp, Homo sapiens
attgagattagagggaggt

SEQ ID NO: 2655250 - DNA, 15 bp, Homo sapiens
attgagctctctcat

SEQ ID NO: 2655251 - DNA, 21 bp, Homo sapiens
attgagtatcctttcagtgtt

SEQ ID NO: 2655252 - DNA, 22 bp, Homo sapiens
attgataagagggcacacactg

SEQ ID NO: 2655253 - DNA, 16 bp, Homo sapiens
attgataattgcattc

SEQ ID NO: 2655254 - DNA, 15 bp, Homo sapiens
attgatatgaaaaat

SEQ ID NO: 2655255 - DNA, 16 bp, Homo sapiens
attgatatgaaaaata

SEQ ID NO: 2655256 - DNA, 17 bp, Homo sapiens
attgatatgaaaaatat

SEQ ID NO: 2655257 - DNA, 18 bp, Homo sapiens
attgatcattttcccccc

SEQ ID NO: 2655258 - DNA, 23 bp, Homo sapiens
attgatcggagcctcctctctca

SEQ ID NO: 2655259 - DNA, 13 bp, Homo sapiens
attgatggggaag

SEQ ID NO: 2655260 - DNA, 21 bp, Homo sapiens
attgatttccgttaaaatacc

SEQ ID NO: 2655261 - DNA, 15 bp, Homo sapiens
attgatttctgcctt

SEQ ID NO: 2655262 - DNA, 20 bp, Homo sapiens
attgatttctgccttccttg

SEQ ID NO: 2655263 - DNA, 16 bp, Homo sapiens
attgcactccagcctg

SEQ ID NO: 2655264 - DNA, 17 bp, Homo sapiens
attgcactccagcctgg

SEQ ID NO: 2655265 - DNA, 19 bp, Homo sapiens
attgcactccagcctgggc

SEQ ID NO: 2655266 - DNA, 23 bp, Homo sapiens
attgcactctaaaaggttcaggg

SEQ ID NO: 2655267 - DNA, 20 bp, Homo sapiens
attgcatctgggtagctgta

SEQ ID NO: 2655268 - DNA, 15 bp, Homo sapiens
attgcatgtgactct

SEQ ID NO: 2655269 - DNA, 14 bp, Homo sapiens
attgccaccaggag

SEQ ID NO: 2655270 - DNA, 15 bp, Homo sapiens
attgccaccaggaga

SEQ ID NO: 2655271 - DNA, 21 bp, Homo sapiens
attgcccacgctggagtgcag

SEQ ID NO: 2655272 - DNA, 22 bp, Homo sapiens
attgcccccagggcacttcaca

SEQ ID NO: 2655273 - DNA, 13 bp, Homo sapiens
attgcctcctcct

SEQ ID NO: 2655274 - DNA, 18 bp, Homo sapiens
attgccttaactggagcc

SEQ ID NO: 2655275 - DNA, 19 bp, Homo sapiens
attgcgccattgcactcca

SEQ ID NO: 2655276 - DNA, 13 bp, Homo sapiens
attgctaaatgta

SEQ ID NO: 2655277 - DNA, 18 bp, Homo sapiens
attgctgaaaatggtatt

SEQ ID NO: 2655278 - DNA, 20 bp, Homo sapiens
attgctgccccatcagtgct

SEQ ID NO: 2655279 - DNA, 21 bp, Homo sapiens
attgctgccccatcagtgctc

SEQ ID NO: 2655280 - DNA, 21 bp, Homo sapiens
attgctggttctatttaatgg

SEQ ID NO: 2655281 - DNA, 13 bp, Homo sapiens
attgcttacattt

SEQ ID NO: 2655282 - DNA, 14 bp, Homo sapiens
attgcttacatttt

SEQ ID NO: 2655283 - DNA, 16 bp, Homo sapiens
attgcttgaaagaaaa

SEQ ID NO: 2655284 - DNA, 18 bp, Homo sapiens
attgcttgagctcaggag

SEQ ID NO: 2655285 - DNA, 15 bp, Homo sapiens
attgcttgatacttt

SEQ ID NO: 2655286 - DNA, 14 bp, Homo sapiens
attgcttgcacaaa

SEQ ID NO: 2655287 - DNA, 17 bp, Homo sapiens
attgctttctgaaatta

SEQ ID NO: 2655288 - DNA, 23 bp, Homo sapiens
attgctttgaagcagttgtgtca

SEQ ID NO: 2655289 - DNA, 20 bp, Homo sapiens
attgctttttctaatgtggt

SEQ ID NO: 2655290 - DNA, 18 bp, Homo sapiens
attggagagtaaaaactg

SEQ ID NO: 2655291 - DNA, 23 bp, Homo sapiens
attggaggaaagcaaccggtgga

SEQ ID NO: 2655292 - DNA, 19 bp, Homo sapiens
attggattattcatttaaa

SEQ ID NO: 2655293 - DNA, 18 bp, Homo sapiens
attggattatttaataac

SEQ ID NO: 2655294 - DNA, 22 bp, Homo sapiens
attggattatttaataacatta

SEQ ID NO: 2655295 - DNA, 13 bp, Homo sapiens
attgggaaatctt

SEQ ID NO: 2655296 - DNA, 20 bp, Homo sapiens
attgggaaggggacccccgc

SEQ ID NO: 2655297 - DNA, 19 bp, Homo sapiens
attgggggctggtgccagc

SEQ ID NO: 2655298 - DNA, 19 bp, Homo sapiens
attgggtcctgggtctttc

SEQ ID NO: 2655299 - DNA, 18 bp, Homo sapiens
attgggtgggtaaattca

SEQ ID NO: 2655300 - DNA, 20 bp, Homo sapiens
attgtaaaaaaaaatgcctt

SEQ ID NO: 2655301 - DNA, 23 bp, Homo sapiens
attgtaaaaaaaaatgcctttga

SEQ ID NO: 2655302 - DNA, 15 bp, Homo sapiens
attgtaaacatgtgt

SEQ ID NO: 2655303 - DNA, 15 bp, Homo sapiens
attgtaaatgtgctt

SEQ ID NO: 2655304 - DNA, 17 bp, Homo sapiens
attgtaaatgtgctttt

SEQ ID NO: 2655305 - DNA, 18 bp, Homo sapiens
attgtaacgttgctgtgg

SEQ ID NO: 2655306 - DNA, 20 bp, Homo sapiens
attgtaacgttgctgtggga

SEQ ID NO: 2655307 - DNA, 21 bp, Homo sapiens
attgtaacgttgctgtgggaa

SEQ ID NO: 2655308 - DNA, 12 bp, Homo sapiens
attgtaagaaat

SEQ ID NO: 2655309 - DNA, 14 bp, Homo sapiens
attgtaagaaatac

SEQ ID NO: 2655310 - DNA, 21 bp, Homo sapiens
attgtaagaaatactgtacaa

SEQ ID NO: 2655311 - DNA, 15 bp, Homo sapiens
attgtaatgttactg

SEQ ID NO: 2655312 - DNA, 12 bp, Homo sapiens
attgtacacttt

SEQ ID NO: 2655313 - DNA, 20 bp, Homo sapiens
attgtacatatttgtggaat

SEQ ID NO: 2655314 - DNA, 12 bp, Homo sapiens
attgtacctctc

SEQ ID NO: 2655315 - DNA, 14 bp, Homo sapiens
attgtagttaatga

SEQ ID NO: 2655316 - DNA, 14 bp, Homo sapiens
attgtataaaaata

SEQ ID NO: 2655317 - DNA, 15 bp, Homo sapiens
attgtataacaggtt

SEQ ID NO: 2655318 - DNA, 17 bp, Homo sapiens
attgtataacaggttat

SEQ ID NO: 2655319 - DNA, 18 bp, Homo sapiens
attgtataacaggttatt

SEQ ID NO: 2655320 - DNA, 21 bp, Homo sapiens
attgtataagattagaatgaa

SEQ ID NO: 2655321 - DNA, 13 bp, Homo sapiens
attgtatatatgt

SEQ ID NO: 2655322 - DNA, 14 bp, Homo sapiens
attgtatctagtgc

SEQ ID NO: 2655323 - DNA, 18 bp, Homo sapiens
attgtatctagtgcagct

SEQ ID NO: 2655324 - DNA, 19 bp, Homo sapiens
attgtatctagtgcagctg

SEQ ID NO: 2655325 - DNA, 21 bp, Homo sapiens
attgtatctagtgcagctgat

SEQ ID NO: 2655326 - DNA, 13 bp, Homo sapiens
attgtatgatgtg

SEQ ID NO: 2655327 - DNA, 14 bp, Homo sapiens
attgtatttattcc

SEQ ID NO: 2655328 - DNA, 13 bp, Homo sapiens
attgtcagctact

SEQ ID NO: 2655329 - DNA, 19 bp, Homo sapiens
attgtccccgacccttgcc

SEQ ID NO: 2655330 - DNA, 16 bp, Homo sapiens
attgtgatttgactgt

SEQ ID NO: 2655331 - DNA, 20 bp, Homo sapiens
attgtggctcctatctgtgt

SEQ ID NO: 2655332 - DNA, 13 bp, Homo sapiens
attgtgggaaggg

SEQ ID NO: 2655333 - DNA, 23 bp, Homo sapiens
attgtgtaacaattttaatgcta

SEQ ID NO: 2655334 - DNA, 23 bp, Homo sapiens
attgtgtctcttggtcctgctgc

SEQ ID NO: 2655335 - DNA, 16 bp, Homo sapiens
attgtgtgttatttaa

SEQ ID NO: 2655336 - DNA, 13 bp, Homo sapiens
attgttaaaataa

SEQ ID NO: 2655337 - DNA, 12 bp, Homo sapiens
attgttccaaga

SEQ ID NO: 2655338 - DNA, 16 bp, Homo sapiens
attgttccaagacatt

SEQ ID NO: 2655339 - DNA, 17 bp, Homo sapiens
attgttccaagacattg

SEQ ID NO: 2655340 - DNA, 20 bp, Homo sapiens
attgttccaagacattgtca

SEQ ID NO: 2655341 - DNA, 16 bp, Homo sapiens
attgttcccagtgaca

SEQ ID NO: 2655342 - DNA, 19 bp, Homo sapiens
attgttcccagtgacactt

SEQ ID NO: 2655343 - DNA, 17 bp, Homo sapiens
attgttgacagttctga

SEQ ID NO: 2655344 - DNA, 18 bp, Homo sapiens
attgttgacagttctgaa

SEQ ID NO: 2655345 - DNA, 20 bp, Homo sapiens
attgttgaggtggtctgaat

SEQ ID NO: 2655346 - DNA, 18 bp, Homo sapiens
attgttggcacatcctat

SEQ ID NO: 2655347 - DNA, 12 bp, Homo sapiens
attgttgtttct

SEQ ID NO: 2655348 - DNA, 20 bp, Homo sapiens
attgttgtttctttctagtg

SEQ ID NO: 2655349 - DNA, 19 bp, Homo sapiens
attgttgtttgccatactt

SEQ ID NO: 2655350 - DNA, 19 bp, Homo sapiens
attgtttcaaaataaaaac

SEQ ID NO: 2655351 - DNA, 13 bp, Homo sapiens
attgtttcaattg

SEQ ID NO: 2655352 - DNA, 20 bp, Homo sapiens
attgtttctttaagaaagta

SEQ ID NO: 2655353 - DNA, 13 bp, Homo sapiens
attgtttgaaaca

SEQ ID NO: 2655354 - DNA, 23 bp, Homo sapiens
attgtttgcttattgttccaaga

SEQ ID NO: 2655355 - DNA, 20 bp, Homo sapiens
attgtttgtctgtcttcata

SEQ ID NO: 2655356 - DNA, 13 bp, Homo sapiens
attgttttatcat

SEQ ID NO: 2655357 - DNA, 10 bp, Homo sapiens
attgttttca

SEQ ID NO: 2655358 - DNA, 17 bp, Homo sapiens
atttaaaaaaaaacctg

SEQ ID NO: 2655359 - DNA, 14 bp, Homo sapiens
atttaaaaaaaatc

SEQ ID NO: 2655360 - DNA, 15 bp, Homo sapiens
atttaaaaaataact

SEQ ID NO: 2655361 - DNA, 15 bp, Homo sapiens
caacaggaggacaat

SEQ ID NO: 2655362 - DNA, 16 bp, Homo sapiens
caacaggaggacaatt

SEQ ID NO: 2655363 - DNA, 12 bp, Homo sapiens
caacaggctggg

SEQ ID NO: 2655364 - DNA, 13 bp, Homo sapiens
caacaggctgggc

SEQ ID NO: 2655365 - DNA, 17 bp, Homo sapiens
caacaggctgggcttca

SEQ ID NO: 2655366 - DNA, 20 bp, Homo sapiens
caacaggctgggcttcagtg

SEQ ID NO: 2655367 - DNA, 23 bp, Homo sapiens
caacaggctgggcttcagtggca

SEQ ID NO: 2655368 - DNA, 12 bp, Homo sapiens
caacagtgagtc

SEQ ID NO: 2655369 - DNA, 12 bp, Homo sapiens
caacagtgctaa

SEQ ID NO: 2655370 - DNA, 17 bp, Homo sapiens
caacagtgctaaaaatg

SEQ ID NO: 2655371 - DNA, 12 bp, Homo sapiens
caacagtgtgaa

SEQ ID NO: 2655372 - DNA, 22 bp, Homo sapiens
caacagtgtgaagttagaattc

SEQ ID NO: 2655373 - DNA, 23 bp, Homo sapiens
caacagtgtgaagttagaattcc

SEQ ID NO: 2655374 - DNA, 14 bp, Homo sapiens
caacagttccttca

SEQ ID NO: 2655375 - DNA, 19 bp, Homo sapiens
caacatactcccatctgtg

SEQ ID NO: 2655376 - DNA, 16 bp, Homo sapiens
caacatcaatgttcat

SEQ ID NO: 2655377 - DNA, 22 bp, Homo sapiens
caacatcttggtcagatttgaa

SEQ ID NO: 2655378 - DNA, 18 bp, Homo sapiens
caacatggtgaaaccccg

SEQ ID NO: 2655379 - DNA, 15 bp, Homo sapiens
caacatggtgtctgg

SEQ ID NO: 2655380 - DNA, 16 bp, Homo sapiens
caacatggtgtctgga

SEQ ID NO: 2655381 - DNA, 20 bp, Homo sapiens
caacatgtagctgagtttaa

SEQ ID NO: 2655382 - DNA, 20 bp, Homo sapiens
caacattaaaacaatattgt

SEQ ID NO: 2655383 - DNA, 17 bp, Homo sapiens
caacatttctcaataat

SEQ ID NO: 2655384 - DNA, 18 bp, Homo sapiens
caaccaagtcatgtgcat

SEQ ID NO: 2655385 - DNA, 20 bp, Homo sapiens
caaccaagtcatgtgcattt

SEQ ID NO: 2655386 - DNA, 14 bp, Homo sapiens
caaccaccgctccc

SEQ ID NO: 2655387 - DNA, 19 bp, Homo sapiens
caaccaccgctccccagcc

SEQ ID NO: 2655388 - DNA, 19 bp, Homo sapiens
caacccaaggactgaggga

SEQ ID NO: 2655389 - DNA, 22 bp, Homo sapiens
caacccaaggactgagggactc

SEQ ID NO: 2655390 - DNA, 23 bp, Homo sapiens
caaccccacacgctcctccctct

SEQ ID NO: 2655391 - DNA, 13 bp, Homo sapiens
caaccccagttct

SEQ ID NO: 2655392 - DNA, 17 bp, Homo sapiens
caaccccagttctgctc

SEQ ID NO: 2655393 - DNA, 22 bp, Homo sapiens
caaccccagttctgctcctctc

SEQ ID NO: 2655394 - DNA, 12 bp, Homo sapiens
caacccccaccc

SEQ ID NO: 2655395 - DNA, 17 bp, Homo sapiens
caacccccaccccacac

SEQ ID NO: 2655396 - DNA, 14 bp, Homo sapiens
caacccccagcctg

SEQ ID NO: 2655397 - DNA, 15 bp, Homo sapiens
caacccccagcctgc

SEQ ID NO: 2655398 - DNA, 16 bp, Homo sapiens
caacccccagcctgct

SEQ ID NO: 2655399 - DNA, 17 bp, Homo sapiens
caacccccagcctgcta

SEQ ID NO: 2655400 - DNA, 19 bp, Homo sapiens
caaccctccctcagcccct

SEQ ID NO: 2655401 - DNA, 11 bp, Homo sapiens
caaccctgccc

SEQ ID NO: 2655402 - DNA, 14 bp, Homo sapiens
caaccctgcccctg

SEQ ID NO: 2655403 - DNA, 15 bp, Homo sapiens
caaccctgcccctgc

SEQ ID NO: 2655404 - DNA, 22 bp, Homo sapiens
caaccctgcccctgccccgtca

SEQ ID NO: 2655405 - DNA, 23 bp, Homo sapiens
caaccctggagagttcaatggct

SEQ ID NO: 2655406 - DNA, 19 bp, Homo sapiens
caaccctggcattatgtcc

SEQ ID NO: 2655407 - DNA, 20 bp, Homo sapiens
caacccttaccccttagcct

SEQ ID NO: 2655408 - DNA, 22 bp, Homo sapiens
caacccttaccccttagcctcc

SEQ ID NO: 2655409 - DNA, 13 bp, Homo sapiens
caacccttcccca

SEQ ID NO: 2655410 - DNA, 18 bp, Homo sapiens
caaccgttggaaacataa

SEQ ID NO: 2655411 - DNA, 19 bp, Homo sapiens
caacctgattgtgtctctt

SEQ ID NO: 2655412 - DNA, 21 bp, Homo sapiens
caacctgcctgacatttggag

SEQ ID NO: 2655413 - DNA, 11 bp, Homo sapiens
caacctggaga

SEQ ID NO: 2655414 - DNA, 16 bp, Homo sapiens
caacctgggtccaaat

SEQ ID NO: 2655415 - DNA, 19 bp, Homo sapiens
caacctgggtccaaataaa

SEQ ID NO: 2655416 - DNA, 20 bp, Homo sapiens
caacctgggtccaaataaaa

SEQ ID NO: 2655417 - DNA, 17 bp, Homo sapiens
caaccttagatgttcta

SEQ ID NO: 2655418 - DNA, 18 bp, Homo sapiens
caaccttagatgttctaa

SEQ ID NO: 2655419 - DNA, 12 bp, Homo sapiens
caacgaggaagc

SEQ ID NO: 2655420 - DNA, 13 bp, Homo sapiens
caacgtggcccag

SEQ ID NO: 2655421 - DNA, 19 bp, Homo sapiens
caacgtggcccagagaagc

SEQ ID NO: 2655422 - DNA, 20 bp, Homo sapiens
caacgtggcccagagaagcc

SEQ ID NO: 2655423 - DNA, 21 bp, Homo sapiens
caactagacattctgtcgcct

SEQ ID NO: 2655424 - DNA, 19 bp, Homo sapiens
caactatgatttggaaaat

SEQ ID NO: 2655425 - DNA, 22 bp, Homo sapiens
caactatgatttggaaaataaa

SEQ ID NO: 2655426 - DNA, 13 bp, Homo sapiens
caactcaccccag

SEQ ID NO: 2655427 - DNA, 17 bp, Homo sapiens
caactcttgcaggtctc

SEQ ID NO: 2655428 - DNA, 19 bp, Homo sapiens
caactgaccagcctccatg

SEQ ID NO: 2655429 - DNA, 16 bp, Homo sapiens
caactgaggcagacag

SEQ ID NO: 2655430 - DNA, 16 bp, Homo sapiens
caactgcattggcttt

SEQ ID NO: 2655431 - DNA, 14 bp, Homo sapiens
caactgcctactcc

SEQ ID NO: 2655432 - DNA, 18 bp, Homo sapiens
caactgcctactccaaaa

SEQ ID NO: 2655433 - DNA, 12 bp, Homo sapiens
caactgctgctt

SEQ ID NO: 2655434 - DNA, 19 bp, Homo sapiens
caactgttatgaaataaag

SEQ ID NO: 2655435 - DNA, 19 bp, Homo sapiens
caactgttgtaactaggct

SEQ ID NO: 2655436 - DNA, 14 bp, Homo sapiens
caacttactactga

SEQ ID NO: 2655437 - DNA, 19 bp, Homo sapiens
caacttcatgtcaacttct

SEQ ID NO: 2655438 - DNA, 14 bp, Homo sapiens
caacttctggctcc

SEQ ID NO: 2655439 - DNA, 21 bp, Homo sapiens
caacttgagggcccagagcag

SEQ ID NO: 2655440 - DNA, 18 bp, Homo sapiens
caacttggcttcctttct

SEQ ID NO: 2655441 - DNA, 22 bp, Homo sapiens
caacttgtaaatacaccacctc

SEQ ID NO: 2655442 - DNA, 22 bp, Homo sapiens
caacttgtctttttctggactg

SEQ ID NO: 2655443 - DNA, 21 bp, Homo sapiens
caactttgtggatgtcttcct

SEQ ID NO: 2655444 - DNA, 22 bp, Homo sapiens
caagaaagaaacccgacagagg

SEQ ID NO: 2655445 - DNA, 15 bp, Homo sapiens
caagaaatgaaagca

SEQ ID NO: 2655446 - DNA, 13 bp, Homo sapiens
caagaagaccaga

SEQ ID NO: 2655447 - DNA, 20 bp, Homo sapiens
caagaagcaggctacactga

SEQ ID NO: 2655448 - DNA, 15 bp, Homo sapiens
caagaagcctttcct

SEQ ID NO: 2655449 - DNA, 22 bp, Homo sapiens
caagaagctttaatatttaaat

SEQ ID NO: 2655450 - DNA, 14 bp, Homo sapiens
caagaagtgattag

SEQ ID NO: 2655451 - DNA, 18 bp, Homo sapiens
caagaataatcacgcttt

SEQ ID NO: 2655452 - DNA, 21 bp, Homo sapiens
caagaataatcacgctttcct

SEQ ID NO: 2655453 - DNA, 22 bp, Homo sapiens
caagaataatcacgctttcctg

SEQ ID NO: 2655454 - DNA, 13 bp, Homo sapiens
caagaatgctgaa

SEQ ID NO: 2655455 - DNA, 15 bp, Homo sapiens
caagaatgctgaaac

SEQ ID NO: 2655456 - DNA, 21 bp, Homo sapiens
caagaattggaagctgccctg

SEQ ID NO: 2655457 - DNA, 21 bp, Homo sapiens
caagacagatgccccagagct

SEQ ID NO: 2655458 - DNA, 11 bp, Homo sapiens
caagacattgt

SEQ ID NO: 2655459 - DNA, 17 bp, Homo sapiens
caagacattgtcaataa

SEQ ID NO: 2655460 - DNA, 19 bp, Homo sapiens
caagacccttgtggtccca

SEQ ID NO: 2655461 - DNA, 14 bp, Homo sapiens
caagacctgttggt

SEQ ID NO: 2655462 - DNA, 13 bp, Homo sapiens
caagaccttctcc

SEQ ID NO: 2655463 - DNA, 14 bp, Homo sapiens
caagaccttctcct

SEQ ID NO: 2655464 - DNA, 21 bp, Homo sapiens
caagaccttctccttcacctt

SEQ ID NO: 2655465 - DNA, 14 bp, Homo sapiens
caagactgttgctc

SEQ ID NO: 2655466 - DNA, 17 bp, Homo sapiens
caagactgttgctcaaa

SEQ ID NO: 2655467 - DNA, 18 bp, Homo sapiens
caagactgttgctcaaat

SEQ ID NO: 2655468 - DNA, 20 bp, Homo sapiens
caagacttggcaacagaagc

SEQ ID NO: 2655469 - DNA, 14 bp, Homo sapiens
caagagagaaagaa

SEQ ID NO: 2655470 - DNA, 13 bp, Homo sapiens
caagagagatgtt

SEQ ID NO: 2655471 - DNA, 15 bp, Homo sapiens
caagagagatgtttt

SEQ ID NO: 2655472 - DNA, 23 bp, Homo sapiens
caagagatgaagagtgagagggc

SEQ ID NO: 2655473 - DNA, 16 bp, Homo sapiens
caagagcagaggcagc

SEQ ID NO: 2655474 - DNA, 15 bp, Homo sapiens
caagagcagcctgtg

SEQ ID NO: 2655475 - DNA, 17 bp, Homo sapiens
caagagcagcctgtggc

SEQ ID NO: 2655476 - DNA, 18 bp, Homo sapiens
caagagcagcctgtggca

SEQ ID NO: 2655477 - DNA, 20 bp, Homo sapiens
caagagcagcctgtggcatc

SEQ ID NO: 2655478 - DNA, 20 bp, Homo sapiens
caagagccatgtagaagctg

SEQ ID NO: 2655479 - DNA, 22 bp, Homo sapiens
caagagcccccttgacaccggg

SEQ ID NO: 2655480 - DNA, 21 bp, Homo sapiens
caagaggggtggagactgctt

SEQ ID NO: 2655481 - DNA, 17 bp, Homo sapiens
caagagggtctgaggaa

SEQ ID NO: 2655482 - DNA, 16 bp, Homo sapiens
caagatacctaaaaga

SEQ ID NO: 2655483 - DNA, 21 bp, Homo sapiens
caagatattttaaaatctgtc

SEQ ID NO: 2655484 - DNA, 18 bp, Homo sapiens
caagatcatgtaccccaa

SEQ ID NO: 2655485 - DNA, 22 bp, Homo sapiens
caagatcctgtctttaaggaaa

SEQ ID NO: 2655486 - DNA, 12 bp, Homo sapiens
caagatctttca

SEQ ID NO: 2655487 - DNA, 15 bp, Homo sapiens
caagatctttcagga

SEQ ID NO: 2655488 - DNA, 15 bp, Homo sapiens
caagatgtcagactg

SEQ ID NO: 2655489 - DNA, 19 bp, Homo sapiens
caagatgtcctccttgttc

SEQ ID NO: 2655490 - DNA, 14 bp, Homo sapiens
caagattaaatgta

SEQ ID NO: 2655491 - DNA, 12 bp, Homo sapiens
caagattagaag

SEQ ID NO: 2655492 - DNA, 20 bp, Homo sapiens
caagattagaagctgaaaac

SEQ ID NO: 2655493 - DNA, 19 bp, Homo sapiens
caagattcacacctgactc

SEQ ID NO: 2655494 - DNA, 17 bp, Homo sapiens
caagattctgaaacatt

SEQ ID NO: 2655495 - DNA, 12 bp, Homo sapiens
caagatttcaga

SEQ ID NO: 2655496 - DNA, 14 bp, Homo sapiens
caagcaaaatcatg

SEQ ID NO: 2655497 - DNA, 19 bp, Homo sapiens
caagcaacctgggtccaaa

SEQ ID NO: 2655498 - DNA, 22 bp, Homo sapiens
caagcaacctgggtccaaataa

SEQ ID NO: 2655499 - DNA, 23 bp, Homo sapiens
caagcaagctcccaagggatggt

SEQ ID NO: 2655500 - DNA, 17 bp, Homo sapiens
caagcacagtgcctgca

SEQ ID NO: 2655501 - DNA, 15 bp, Homo sapiens
caagcacagtggtgg

SEQ ID NO: 2655502 - DNA, 21 bp, Homo sapiens
caagcacagtggtggcagggc

SEQ ID NO: 2655503 - DNA, 13 bp, Homo sapiens
caagcacctcctg

SEQ ID NO: 2655504 - DNA, 13 bp, Homo sapiens
caagcactgtgct

SEQ ID NO: 2655505 - DNA, 17 bp, Homo sapiens
caagcactgtgctcagg

SEQ ID NO: 2655506 - DNA, 15 bp, Homo sapiens
caattgaatggtcag

SEQ ID NO: 2655507 - DNA, 17 bp, Homo sapiens
caattgcatctcccaga

SEQ ID NO: 2655508 - DNA, 16 bp, Homo sapiens
caattggttaatcttt

SEQ ID NO: 2655509 - DNA, 18 bp, Homo sapiens
caattgtgagccaccacg

SEQ ID NO: 2655510 - DNA, 21 bp, Homo sapiens
caattgtgagccaccacgtcc

SEQ ID NO: 2655511 - DNA, 14 bp, Homo sapiens
caattgttgacagt

SEQ ID NO: 2655512 - DNA, 21 bp, Homo sapiens
caattgttgacagttctgaag

SEQ ID NO: 2655513 - DNA, 24 bp, Homo sapiens
caattgttgacagttctgaagaat

SEQ ID NO: 2655514 - DNA, 16 bp, Homo sapiens
caatttaaacccattt

SEQ ID NO: 2655515 - DNA, 22 bp, Homo sapiens
caatttaaacccattttagtca

SEQ ID NO: 2655516 - DNA, 21 bp, Homo sapiens
caatttatatttaataaaatt

SEQ ID NO: 2655517 - DNA, 23 bp, Homo sapiens
caatttattaaaatgattgtaaa

SEQ ID NO: 2655518 - DNA, 21 bp, Homo sapiens
caatttcctttatatttagtg

SEQ ID NO: 2655519 - DNA, 14 bp, Homo sapiens
caatttctccccag

SEQ ID NO: 2655520 - DNA, 19 bp, Homo sapiens
caatttgtaaaaacagcat

SEQ ID NO: 2655521 - DNA, 23 bp, Homo sapiens
caatttgtaattgcttacatttt

SEQ ID NO: 2655522 - DNA, 17 bp, Homo sapiens
caattttctcccaggaa

SEQ ID NO: 2655523 - DNA, 11 bp, Homo sapiens
caattttgtaa

SEQ ID NO: 2655524 - DNA, 11 bp, Homo sapiens
caatttttcca

SEQ ID NO: 2655525 - DNA, 16 bp, Homo sapiens
caatttttgccttcat

SEQ ID NO: 2655526 - DNA, 21 bp, Homo sapiens
caattttttatcatgcatgtc

SEQ ID NO: 2655527 - DNA, 21 bp, Homo sapiens
caatttttttaattttgtatt

SEQ ID NO: 2655528 - DNA, 12 bp, Homo sapiens
cacaaaaatgaa

SEQ ID NO: 2655529 - DNA, 18 bp, Homo sapiens
cacaaaagttagctgagc

SEQ ID NO: 2655530 - DNA, 15 bp, Homo sapiens
cacaaaccatgcaaa

SEQ ID NO: 2655531 - DNA, 13 bp, Homo sapiens
cacaaactcacca

SEQ ID NO: 2655532 - DNA, 13 bp, Homo sapiens
cacaaaggagagc

SEQ ID NO: 2655533 - DNA, 23 bp, Homo sapiens
cacaaatatttattttctttctg

SEQ ID NO: 2655534 - DNA, 17 bp, Homo sapiens
cacaaattattaatgaa

SEQ ID NO: 2655535 - DNA, 17 bp, Homo sapiens
cacaaccctgttttata

SEQ ID NO: 2655536 - DNA, 20 bp, Homo sapiens
cacaagaaatgaaagcaggg

SEQ ID NO: 2655537 - DNA, 21 bp, Homo sapiens
cacaagaaatgaaagcaggga

SEQ ID NO: 2655538 - DNA, 23 bp, Homo sapiens
cacaagaaatgaaagcagggact

SEQ ID NO: 2655539 - DNA, 16 bp, Homo sapiens
cacaagacccttgtgg

SEQ ID NO: 2655540 - DNA, 20 bp, Homo sapiens
cacaagagcccagcagggcc

SEQ ID NO: 2655541 - DNA, 21 bp, Homo sapiens
cacaagagcccagcagggcct

SEQ ID NO: 2655542 - DNA, 17 bp, Homo sapiens
cacaagccacagaagcc

SEQ ID NO: 2655543 - DNA, 17 bp, Homo sapiens
cacaagctccaagctcc

SEQ ID NO: 2655544 - DNA, 12 bp, Homo sapiens
cacaagctggaa

SEQ ID NO: 2655545 - DNA, 13 bp, Homo sapiens
cacaagctggaag

SEQ ID NO: 2655546 - DNA, 14 bp, Homo sapiens
cacaagctggaagc

SEQ ID NO: 2655547 - DNA, 19 bp, Homo sapiens
cacaaggctgaccaagaga

SEQ ID NO: 2655548 - DNA, 21 bp, Homo sapiens
cacaaggctgaccaagagaga

SEQ ID NO: 2655549 - DNA, 17 bp, Homo sapiens
cacaaggtgcaaatcaa

SEQ ID NO: 2655550 - DNA, 12 bp, Homo sapiens
cacaagtgaaaa

SEQ ID NO: 2655551 - DNA, 21 bp, Homo sapiens
cacaataaggtcaatgccaga

SEQ ID NO: 2655552 - DNA, 15 bp, Homo sapiens
cacaatattgaactt

SEQ ID NO: 2655553 - DNA, 23 bp, Homo sapiens
cacaatcctaacacattatcggg

SEQ ID NO: 2655554 - DNA, 19 bp, Homo sapiens
cacaatctgacattctcag

SEQ ID NO: 2655555 - DNA, 18 bp, Homo sapiens
cacaatcttaaggggcag

SEQ ID NO: 2655556 - DNA, 22 bp, Homo sapiens
cacaatgaaatgctctcctttc

SEQ ID NO: 2655557 - DNA, 13 bp, Homo sapiens
cacacaaaggtat

SEQ ID NO: 2655558 - DNA, 18 bp, Homo sapiens
cacacaaaggtataattt

SEQ ID NO: 2655559 - DNA, 16 bp, Homo sapiens
cacacaagaagaaggg

SEQ ID NO: 2655560 - DNA, 12 bp, Homo sapiens
cacacacacaca

SEQ ID NO: 2655561 - DNA, 15 bp, Homo sapiens
cacacacacacacag

SEQ ID NO: 2655562 - DNA, 15 bp, Homo sapiens
cacacacacacacat

SEQ ID NO: 2655563 - DNA, 13 bp, Homo sapiens
cacacacacacat

SEQ ID NO: 2655564 - DNA, 14 bp, Homo sapiens
cacacacacacatg

SEQ ID NO: 2655565 - DNA, 15 bp, Homo sapiens
cacacacacacatgc

SEQ ID NO: 2655566 - DNA, 13 bp, Homo sapiens
cacacacacagaa

SEQ ID NO: 2655567 - DNA, 13 bp, Homo sapiens
cacacacacagcc

SEQ ID NO: 2655568 - DNA, 14 bp, Homo sapiens
cacacacacaggag

SEQ ID NO: 2655569 - DNA, 13 bp, Homo sapiens
cacacacacatgc

SEQ ID NO: 2655570 - DNA, 15 bp, Homo sapiens
cacacacacatgcat

SEQ ID NO: 2655571 - DNA, 14 bp, Homo sapiens
cacacacacgcacg

SEQ ID NO: 2655572 - DNA, 16 bp, Homo sapiens
cacacacagaaaatat

SEQ ID NO: 2655573 - DNA, 12 bp, Homo sapiens
cacacacagagg

SEQ ID NO: 2655574 - DNA, 23 bp, Homo sapiens
cacacacagaggaagagcaggca

SEQ ID NO: 2655575 - DNA, 11 bp, Homo sapiens
cacacacagcc

SEQ ID NO: 2655576 - DNA, 15 bp, Homo sapiens
cacacacagctgggc

SEQ ID NO: 2655577 - DNA, 15 bp, Homo sapiens
cacacaccagagccc

SEQ ID NO: 2655578 - DNA, 16 bp, Homo sapiens
cacacaccagagccca

SEQ ID NO: 2655579 - DNA, 20 bp, Homo sapiens
cacacacctgtagtcccagc

SEQ ID NO: 2655580 - DNA, 15 bp, Homo sapiens
cacacacgcacgcac

SEQ ID NO: 2655581 - DNA, 17 bp, Homo sapiens
cacacacgcacgcacac

SEQ ID NO: 2655582 - DNA, 22 bp, Homo sapiens
cacacagaaaatatactgtaaa

SEQ ID NO: 2655583 - DNA, 15 bp, Homo sapiens
cacacagaaactctt

SEQ ID NO: 2655584 - DNA, 18 bp, Homo sapiens
cacacagaggaagagcag

SEQ ID NO: 2655585 - DNA, 21 bp, Homo sapiens
cacacagaggctgcctctccc

SEQ ID NO: 2655586 - DNA, 14 bp, Homo sapiens
cacacagagtggtc

SEQ ID NO: 2655587 - DNA, 15 bp, Homo sapiens
cacacagagtggtct

SEQ ID NO: 2655588 - DNA, 13 bp, Homo sapiens
cacacagccacac

SEQ ID NO: 2655589 - DNA, 21 bp, Homo sapiens
cacacagccacacacacagaa

SEQ ID NO: 2655590 - DNA, 19 bp, Homo sapiens
cacacagccaggtgccttg

SEQ ID NO: 2655591 - DNA, 18 bp, Homo sapiens
cacacaggacccccttcc

SEQ ID NO: 2655592 - DNA, 20 bp, Homo sapiens
cacacaggcaactgaggcag

SEQ ID NO: 2655593 - DNA, 19 bp, Homo sapiens
cacacaggggccacccggg

SEQ ID NO: 2655594 - DNA, 17 bp, Homo sapiens
cacacagtattaagtga

SEQ ID NO: 2655595 - DNA, 15 bp, Homo sapiens
cacacatacacacac

SEQ ID NO: 2655596 - DNA, 23 bp, Homo sapiens
cacacatataaacatcacacaca

SEQ ID NO: 2655597 - DNA, 21 bp, Homo sapiens
cacacatgagcatcaggccag

SEQ ID NO: 2655598 - DNA, 22 bp, Homo sapiens
cacacatgagcatcaggccagg

SEQ ID NO: 2655599 - DNA, 18 bp, Homo sapiens
cacacatggctaattttt

SEQ ID NO: 2655600 - DNA, 16 bp, Homo sapiens
cacacattttttaaat

SEQ ID NO: 2655601 - DNA, 12 bp, Homo sapiens
cacaccagagcc

SEQ ID NO: 2655602 - DNA, 12 bp, Homo sapiens
cacaccagccat

SEQ ID NO: 2655603 - DNA, 14 bp, Homo sapiens
cacaccaggctgtg

SEQ ID NO: 2655604 - DNA, 19 bp, Homo sapiens
cacaccaggctgtgggcct

SEQ ID NO: 2655605 - DNA, 20 bp, Homo sapiens
cacaccaggctgtgggcctc

SEQ ID NO: 2655606 - DNA, 21 bp, Homo sapiens
cacaccaggctgtgggcctca

SEQ ID NO: 2655607 - DNA, 22 bp, Homo sapiens
cacaccaggcttgcctgcaggc

SEQ ID NO: 2655608 - DNA, 22 bp, Homo sapiens
cacacccaccgtccgccctgct

SEQ ID NO: 2655609 - DNA, 23 bp, Homo sapiens
cacacccccaccccttgctctca

SEQ ID NO: 2655610 - DNA, 21 bp, Homo sapiens
cacaccctcccccgccactcc

SEQ ID NO: 2655611 - DNA, 17 bp, Homo sapiens
cacaccgggcactcaga

SEQ ID NO: 2655612 - DNA, 20 bp, Homo sapiens
cacaccgtgtaaaccaaagc

SEQ ID NO: 2655613 - DNA, 15 bp, Homo sapiens
cacacctcagaggct

SEQ ID NO: 2655614 - DNA, 13 bp, Homo sapiens
cacacctcagttc

SEQ ID NO: 2655615 - DNA, 17 bp, Homo sapiens
cacacctcagttccctt

SEQ ID NO: 2655616 - DNA, 17 bp, Homo sapiens
cacacctccctgaacca

SEQ ID NO: 2655617 - DNA, 11 bp, Homo sapiens
cacacctgagc

SEQ ID NO: 2655618 - DNA, 14 bp, Homo sapiens
cacacgcacacaca

SEQ ID NO: 2655619 - DNA, 23 bp, Homo sapiens
cacacgcacacacacacacagga

SEQ ID NO: 2655620 - DNA, 14 bp, Homo sapiens
cacacgcacgcaca

SEQ ID NO: 2655621 - DNA, 15 bp, Homo sapiens
cacacgcacgcacac

SEQ ID NO: 2655622 - DNA, 21 bp, Homo sapiens
cacacgcacgcacacacacaa

SEQ ID NO: 2655623 - DNA, 14 bp, Homo sapiens
cacacgcaggaact

SEQ ID NO: 2655624 - DNA, 19 bp, Homo sapiens
cacacgcaggaactcccag

SEQ ID NO: 2655625 - DNA, 22 bp, Homo sapiens
cacacgcaggaactcccagcaa

SEQ ID NO: 2655626 - DNA, 22 bp, Homo sapiens
cacacgctcctccctctgaggc

SEQ ID NO: 2655627 - DNA, 22 bp, Homo sapiens
cacacggacactcaaaagctgg

SEQ ID NO: 2655628 - DNA, 18 bp, Homo sapiens
cacacggaggcatctgca

SEQ ID NO: 2655629 - DNA, 21 bp, Homo sapiens
cacactaacctgggttccctt

SEQ ID NO: 2655630 - DNA, 12 bp, Homo sapiens
cacactcactgc

SEQ ID NO: 2655631 - DNA, 16 bp, Homo sapiens
cacactccaagatatg

SEQ ID NO: 2655632 - DNA, 22 bp, Homo sapiens
cacactccaagatatggacaca

SEQ ID NO: 2655633 - DNA, 13 bp, Homo sapiens
cacactgaggcag

SEQ ID NO: 2655634 - DNA, 18 bp, Homo sapiens
cacactgaggcagggaag

SEQ ID NO: 2655635 - DNA, 23 bp, Homo sapiens
cacactgctaggtgggccagccc

SEQ ID NO: 2655636 - DNA, 19 bp, Homo sapiens
cacactggggtgccgcctg

SEQ ID NO: 2655637 - DNA, 21 bp, Homo sapiens
cacactgggtgcccaagctca

SEQ ID NO: 2655638 - DNA, 16 bp, Homo sapiens
cacacttccaccagcc

SEQ ID NO: 2655639 - DNA, 19 bp, Homo sapiens
cacacttccaccagcctgc

SEQ ID NO: 2655640 - DNA, 13 bp, Homo sapiens
cacacttcctgtc

SEQ ID NO: 2655641 - DNA, 14 bp, Homo sapiens
cacacttcctgtcc

SEQ ID NO: 2655642 - DNA, 15 bp, Homo sapiens
cacacttcctgtcca

SEQ ID NO: 2655643 - DNA, 15 bp, Homo sapiens
cacacttctgtgaga

SEQ ID NO: 2655644 - DNA, 19 bp, Homo sapiens
cacacttgagaggatgaat

SEQ ID NO: 2655645 - DNA, 21 bp, Homo sapiens
cacacttgagaggatgaatgt

SEQ ID NO: 2655646 - DNA, 21 bp, Homo sapiens
cacacttggcccaagtggcag

SEQ ID NO: 2655647 - DNA, 15 bp, Homo sapiens
cacacttgttccagc

SEQ ID NO: 2655648 - DNA, 16 bp, Homo sapiens
cacacttgttccagct

SEQ ID NO: 2655649 - DNA, 21 bp, Homo sapiens
cacagacatactaaccagcag

SEQ ID NO: 2655650 - DNA, 18 bp, Homo sapiens
cacagacattctgccagg

SEQ ID NO: 2655651 - DNA, 15 bp, Homo sapiens
caccacagacacaca

SEQ ID NO: 2655652 - DNA, 13 bp, Homo sapiens
caccacagcaggt

SEQ ID NO: 2655653 - DNA, 15 bp, Homo sapiens
caccaccccccactc

SEQ ID NO: 2655654 - DNA, 20 bp, Homo sapiens
caccaccccccactctgtgc

SEQ ID NO: 2655655 - DNA, 22 bp, Homo sapiens
caccaccctagtcccttcccct

SEQ ID NO: 2655656 - DNA, 16 bp, Homo sapiens
caccacctcactcctg

SEQ ID NO: 2655657 - DNA, 17 bp, Homo sapiens
caccacctcactcctgt

SEQ ID NO: 2655658 - DNA, 14 bp, Homo sapiens
caccacctccctca

SEQ ID NO: 2655659 - DNA, 12 bp, Homo sapiens
caccacctctcc

SEQ ID NO: 2655660 - DNA, 16 bp, Homo sapiens
caccacggccactggc

SEQ ID NO: 2655661 - DNA, 19 bp, Homo sapiens
caccactacattctgttaa

SEQ ID NO: 2655662 - DNA, 18 bp, Homo sapiens
caccactgcactccagcc

SEQ ID NO: 2655663 - DNA, 13 bp, Homo sapiens
caccactggccac

SEQ ID NO: 2655664 - DNA, 16 bp, Homo sapiens
caccactggccaccag

SEQ ID NO: 2655665 - DNA, 21 bp, Homo sapiens
caccactggccaccaggctgg

SEQ ID NO: 2655666 - DNA, 12 bp, Homo sapiens
caccagaataaa

SEQ ID NO: 2655667 - DNA, 14 bp, Homo sapiens
caccagagagggac

SEQ ID NO: 2655668 - DNA, 12 bp, Homo sapiens
caccagagcaga

SEQ ID NO: 2655669 - DNA, 18 bp, Homo sapiens
caccagagcagatgcaga

SEQ ID NO: 2655670 - DNA, 17 bp, Homo sapiens
caccagagcccaccttg

SEQ ID NO: 2655671 - DNA, 20 bp, Homo sapiens
caccagaggctgcagaaggc

SEQ ID NO: 2655672 - DNA, 21 bp, Homo sapiens
caccagaggctgcagaaggcc

SEQ ID NO: 2655673 - DNA, 12 bp, Homo sapiens
caccagcagcct

SEQ ID NO: 2655674 - DNA, 14 bp, Homo sapiens
caccagcagcctgg

SEQ ID NO: 2655675 - DNA, 20 bp, Homo sapiens
caccagccaggctctgtgct

SEQ ID NO: 2655676 - DNA, 15 bp, Homo sapiens
caccagcccggcctg

SEQ ID NO: 2655677 - DNA, 21 bp, Homo sapiens
caccagcgtttgaggggctgg

SEQ ID NO: 2655678 - DNA, 15 bp, Homo sapiens
caccagctcctccct

SEQ ID NO: 2655679 - DNA, 17 bp, Homo sapiens
caccagctcctcccttg

SEQ ID NO: 2655680 - DNA, 15 bp, Homo sapiens
caccagctgcctctt

SEQ ID NO: 2655681 - DNA, 16 bp, Homo sapiens
caccagctgcctcttc

SEQ ID NO: 2655682 - DNA, 19 bp, Homo sapiens
caccagcttctccaggctc

SEQ ID NO: 2655683 - DNA, 16 bp, Homo sapiens
caccaggagaaccact

SEQ ID NO: 2655684 - DNA, 21 bp, Homo sapiens
caccaggatggcccttcccac

SEQ ID NO: 2655685 - DNA, 22 bp, Homo sapiens
caccaggcacctcacagaaatg

SEQ ID NO: 2655686 - DNA, 16 bp, Homo sapiens
caccaggccgtcctcc

SEQ ID NO: 2655687 - DNA, 21 bp, Homo sapiens
caccaggccgtcctcccgggc

SEQ ID NO: 2655688 - DNA, 14 bp, Homo sapiens
caccaggctgctca

SEQ ID NO: 2655689 - DNA, 15 bp, Homo sapiens
caccaggctggcgca

SEQ ID NO: 2655690 - DNA, 17 bp, Homo sapiens
caccaggctggcgcagc

SEQ ID NO: 2655691 - DNA, 18 bp, Homo sapiens
caccaggctggcgcagcc

SEQ ID NO: 2655692 - DNA, 23 bp, Homo sapiens
caccaggctggcgcagccaaggc

SEQ ID NO: 2655693 - DNA, 20 bp, Homo sapiens
caccaggcttgcctgcaggc

SEQ ID NO: 2655694 - DNA, 23 bp, Homo sapiens
caccagggttgaccccagaggat

SEQ ID NO: 2655695 - DNA, 17 bp, Homo sapiens
caccagtcactgtccct

SEQ ID NO: 2655696 - DNA, 13 bp, Homo sapiens
caccagtgtcccc

SEQ ID NO: 2655697 - DNA, 18 bp, Homo sapiens
caccagttcctttcaatg

SEQ ID NO: 2655698 - DNA, 16 bp, Homo sapiens
caccatattcagtgct

SEQ ID NO: 2655699 - DNA, 16 bp, Homo sapiens
caccatcaagccacca

SEQ ID NO: 2655700 - DNA, 17 bp, Homo sapiens
caccatcaagccaccaa

SEQ ID NO: 2655701 - DNA, 18 bp, Homo sapiens
caccatcatgtctggcta

SEQ ID NO: 2655702 - DNA, 13 bp, Homo sapiens
caccatcctgctg

SEQ ID NO: 2655703 - DNA, 22 bp, Homo sapiens
caccatctcaggccacctgccc

SEQ ID NO: 2655704 - DNA, 21 bp, Homo sapiens
caccatgccaggctaattttt

SEQ ID NO: 2655705 - DNA, 17 bp, Homo sapiens
caccatttggcaatgcc

SEQ ID NO: 2655706 - DNA, 19 bp, Homo sapiens
cacccaagagattgttgtt

SEQ ID NO: 2655707 - DNA, 21 bp, Homo sapiens
cacccaagcttggcagccgag

SEQ ID NO: 2655708 - DNA, 15 bp, Homo sapiens
cacccaagggcctgg

SEQ ID NO: 2655709 - DNA, 20 bp, Homo sapiens
cacccaagggcctggcctga

SEQ ID NO: 2655710 - DNA, 23 bp, Homo sapiens
cacccacacactcgcccgcccac

SEQ ID NO: 2655711 - DNA, 22 bp, Homo sapiens
cacccaccgtccgccctgctcc

SEQ ID NO: 2655712 - DNA, 13 bp, Homo sapiens
cacccacctcagc

SEQ ID NO: 2655713 - DNA, 16 bp, Homo sapiens
cacccacctcagcctc

SEQ ID NO: 2655714 - DNA, 18 bp, Homo sapiens
cacccacctcagcctccc

SEQ ID NO: 2655715 - DNA, 12 bp, Homo sapiens
cacccagcccac

SEQ ID NO: 2655716 - DNA, 12 bp, Homo sapiens
cacccagccctg

SEQ ID NO: 2655717 - DNA, 19 bp, Homo sapiens
cacccagccctggtctcag

SEQ ID NO: 2655718 - DNA, 23 bp, Homo sapiens
cacccaggagccccgaggccttc

SEQ ID NO: 2655719 - DNA, 20 bp, Homo sapiens
cacccaggctggagtacagt

SEQ ID NO: 2655720 - DNA, 20 bp, Homo sapiens
cacccagtgagcactcccaa

SEQ ID NO: 2655721 - DNA, 23 bp, Homo sapiens
cacccatcctatcagcctgtctc

SEQ ID NO: 2655722 - DNA, 18 bp, Homo sapiens
cacccatctgttttttgt

SEQ ID NO: 2655723 - DNA, 15 bp, Homo sapiens
cacccatgaatcaaa

SEQ ID NO: 2655724 - DNA, 13 bp, Homo sapiens
cacccatgggctc

SEQ ID NO: 2655725 - DNA, 17 bp, Homo sapiens
cacccatgtttctctgg

SEQ ID NO: 2655726 - DNA, 12 bp, Homo sapiens
caccccagcccc

SEQ ID NO: 2655727 - DNA, 13 bp, Homo sapiens
caccccagcccca

SEQ ID NO: 2655728 - DNA, 19 bp, Homo sapiens
caccccagcctaagatgaa

SEQ ID NO: 2655729 - DNA, 12 bp, Homo sapiens
caccccatccca

SEQ ID NO: 2655730 - DNA, 21 bp, Homo sapiens
caccccatcccacaccctgga

SEQ ID NO: 2655731 - DNA, 15 bp, Homo sapiens
caccccatgccaaag

SEQ ID NO: 2655732 - DNA, 22 bp, Homo sapiens
caccccatgctgttgattgcta

SEQ ID NO: 2655733 - DNA, 13 bp, Homo sapiens
cacccccagctca

SEQ ID NO: 2655734 - DNA, 17 bp, Homo sapiens
cacccccagctgcttgt

SEQ ID NO: 2655735 - DNA, 14 bp, Homo sapiens
caccccccaagctg

SEQ ID NO: 2655736 - DNA, 18 bp, Homo sapiens
caccccccacactcactc

SEQ ID NO: 2655737 - DNA, 18 bp, Homo sapiens
cacccccttctctgctcc

SEQ ID NO: 2655738 - DNA, 14 bp, Homo sapiens
caccccctttcctg

SEQ ID NO: 2655739 - DNA, 16 bp, Homo sapiens
caccccgcctgccctc

SEQ ID NO: 2655740 - DNA, 15 bp, Homo sapiens
caccccggccacctg

SEQ ID NO: 2655741 - DNA, 16 bp, Homo sapiens
caccccggccacctgc

SEQ ID NO: 2655742 - DNA, 15 bp, Homo sapiens
caccccgggctctct

SEQ ID NO: 2655743 - DNA, 12 bp, Homo sapiens
cacccctcactc

SEQ ID NO: 2655744 - DNA, 13 bp, Homo sapiens
cacccctccagga

SEQ ID NO: 2655745 - DNA, 10 bp, Homo sapiens
cacccctccc

SEQ ID NO: 2655746 - DNA, 13 bp, Homo sapiens
cacccctccccat

SEQ ID NO: 2655747 - DNA, 14 bp, Homo sapiens
cacccctccttcct

SEQ ID NO: 2655748 - DNA, 14 bp, Homo sapiens
cacccctgcctcca

SEQ ID NO: 2655749 - DNA, 20 bp, Homo sapiens
cacccctgcctccaccctct

SEQ ID NO: 2655750 - DNA, 22 bp, Homo sapiens
cacccctgcctccaccctctga

SEQ ID NO: 2655751 - DNA, 22 bp, Homo sapiens
cacccctgtgctccgtgcctcc

SEQ ID NO: 2655752 - DNA, 18 bp, Homo sapiens
caccccttatccaggact

SEQ ID NO: 2655753 - DNA, 15 bp, Homo sapiens
caccccttccatgtg

SEQ ID NO: 2655754 - DNA, 12 bp, Homo sapiens
caccccttcccc

SEQ ID NO: 2655755 - DNA, 16 bp, Homo sapiens
caccccttcctgtccc

SEQ ID NO: 2655756 - DNA, 15 bp, Homo sapiens
cacccgactcctcaa

SEQ ID NO: 2655757 - DNA, 15 bp, Homo sapiens
cacccgaggctgccc

SEQ ID NO: 2655758 - DNA, 13 bp, Homo sapiens
cacccgatgctgc

SEQ ID NO: 2655759 - DNA, 14 bp, Homo sapiens
cacccgatgctgct

SEQ ID NO: 2655760 - DNA, 19 bp, Homo sapiens
cacccgatgctgctttccc

SEQ ID NO: 2655761 - DNA, 19 bp, Homo sapiens
cacccgctaagagggaggg

SEQ ID NO: 2655762 - DNA, 16 bp, Homo sapiens
cacccgtggagatggg

SEQ ID NO: 2655763 - DNA, 16 bp, Homo sapiens
caccctacctgtgcct

SEQ ID NO: 2655764 - DNA, 18 bp, Homo sapiens
caccctagtcccttcccc

SEQ ID NO: 2655765 - DNA, 16 bp, Homo sapiens
caccctagtttccctg

SEQ ID NO: 2655766 - DNA, 16 bp, Homo sapiens
caccctcagcacccct

SEQ ID NO: 2655767 - DNA, 16 bp, Homo sapiens
caccctcatgctgtgt

SEQ ID NO: 2655768 - DNA, 22 bp, Homo sapiens
caccctccctccgatccttcct

SEQ ID NO: 2655769 - DNA, 14 bp, Homo sapiens
caccctccctggag

SEQ ID NO: 2655770 - DNA, 18 bp, Homo sapiens
caccctcctgtcttccca

SEQ ID NO: 2655771 - DNA, 20 bp, Homo sapiens
caccctcctgtcttcccagg

SEQ ID NO: 2655772 - DNA, 22 bp, Homo sapiens
caccctcctgtcttcccagggt

SEQ ID NO: 2655773 - DNA, 12 bp, Homo sapiens
caccctcctttc

SEQ ID NO: 2655774 - DNA, 18 bp, Homo sapiens
caccctctgagctttgca

SEQ ID NO: 2655775 - DNA, 22 bp, Homo sapiens
caccctctgagctttgcatgtt

SEQ ID NO: 2655776 - DNA, 12 bp, Homo sapiens
caccctgctctc

SEQ ID NO: 2655777 - DNA, 11 bp, Homo sapiens
caccctggaat

SEQ ID NO: 2655778 - DNA, 21 bp, Homo sapiens
caccctggaggatttcatctc

SEQ ID NO: 2655779 - DNA, 21 bp, Homo sapiens
caccctgggctctgggagcag

SEQ ID NO: 2655780 - DNA, 15 bp, Homo sapiens
caccctggggagaaa

SEQ ID NO: 2655781 - DNA, 16 bp, Homo sapiens
caccctggggagaaag

SEQ ID NO: 2655782 - DNA, 13 bp, Homo sapiens
caccctggggcct

SEQ ID NO: 2655783 - DNA, 15 bp, Homo sapiens
caccctggggcctgg

SEQ ID NO: 2655784 - DNA, 19 bp, Homo sapiens
caccctggggcctggacct

SEQ ID NO: 2655785 - DNA, 20 bp, Homo sapiens
caccctggggcctggacctg

SEQ ID NO: 2655786 - DNA, 17 bp, Homo sapiens
caccctgtactgttctg

SEQ ID NO: 2655787 - DNA, 21 bp, Homo sapiens
caccctgtactgttctgtgtc

SEQ ID NO: 2655788 - DNA, 23 bp, Homo sapiens
caccctgtccaaactgcctaagc

SEQ ID NO: 2655789 - DNA, 21 bp, Homo sapiens
caccctgtgatggggccctgc

SEQ ID NO: 2655790 - DNA, 14 bp, Homo sapiens
cacccttcccctcc

SEQ ID NO: 2655791 - DNA, 22 bp, Homo sapiens
cacccttcccctccttctccct

SEQ ID NO: 2655792 - DNA, 15 bp, Homo sapiens
cacccttctttcctc

SEQ ID NO: 2655793 - DNA, 16 bp, Homo sapiens
cacccttctttcctct

SEQ ID NO: 2655794 - DNA, 17 bp, Homo sapiens
cacccttggaggctgtc

SEQ ID NO: 2655795 - DNA, 22 bp, Homo sapiens
cacccttggaggctgtcttctc

SEQ ID NO: 2655796 - DNA, 15 bp, Homo sapiens
cacccttggcctgtc

SEQ ID NO: 2655797 - DNA, 18 bp, Homo sapiens
cagagagggcaggcatga

SEQ ID NO: 2655798 - DNA, 16 bp, Homo sapiens
cagagagggtgggagt

SEQ ID NO: 2655799 - DNA, 20 bp, Homo sapiens
cagagagggtgggagtgggc

SEQ ID NO: 2655800 - DNA, 20 bp, Homo sapiens
cagagagggtggtgacctct

SEQ ID NO: 2655801 - DNA, 12 bp, Homo sapiens
cagagagtccca

SEQ ID NO: 2655802 - DNA, 23 bp, Homo sapiens
cagagagtcccactgcctcaggt

SEQ ID NO: 2655803 - DNA, 14 bp, Homo sapiens
cagagagtcctctg

SEQ ID NO: 2655804 - DNA, 18 bp, Homo sapiens
cagagagtcctctggatg

SEQ ID NO: 2655805 - DNA, 19 bp, Homo sapiens
cagagagtcctctggatgg

SEQ ID NO: 2655806 - DNA, 18 bp, Homo sapiens
cagagcacagcagcccct

SEQ ID NO: 2655807 - DNA, 16 bp, Homo sapiens
cagagcaccttagaca

SEQ ID NO: 2655808 - DNA, 18 bp, Homo sapiens
cagagcaccttagacagt

SEQ ID NO: 2655809 - DNA, 23 bp, Homo sapiens
cagagcaccttagacagtccctg

SEQ ID NO: 2655810 - DNA, 11 bp, Homo sapiens
cagagcagaga

SEQ ID NO: 2655811 - DNA, 14 bp, Homo sapiens
cagagcagagacca

SEQ ID NO: 2655812 - DNA, 15 bp, Homo sapiens
cagagcagagaccat

SEQ ID NO: 2655813 - DNA, 13 bp, Homo sapiens
cagagcagcagtg

SEQ ID NO: 2655814 - DNA, 19 bp, Homo sapiens
cagagcaggaggcccctgg

SEQ ID NO: 2655815 - DNA, 15 bp, Homo sapiens
cagagcaggggcagg

SEQ ID NO: 2655816 - DNA, 23 bp, Homo sapiens
cagagcaggggtccttggtgtga

SEQ ID NO: 2655817 - DNA, 21 bp, Homo sapiens
cagagcattacgtgagccagg

SEQ ID NO: 2655818 - DNA, 22 bp, Homo sapiens
cagagcattacgtgagccaggt

SEQ ID NO: 2655819 - DNA, 21 bp, Homo sapiens
cagagcatttccaacaccaca

SEQ ID NO: 2655820 - DNA, 17 bp, Homo sapiens
cagagccatgctgggaa

SEQ ID NO: 2655821 - DNA, 19 bp, Homo sapiens
cagagcccaccttggctca

SEQ ID NO: 2655822 - DNA, 17 bp, Homo sapiens
cagagcccacgccccca

SEQ ID NO: 2655823 - DNA, 13 bp, Homo sapiens
cagagccccacac

SEQ ID NO: 2655824 - DNA, 20 bp, Homo sapiens
cagagccccacacggaggca

SEQ ID NO: 2655825 - DNA, 12 bp, Homo sapiens
cagagcctgcag

SEQ ID NO: 2655826 - DNA, 19 bp, Homo sapiens
cagagcgcccctccctagt

SEQ ID NO: 2655827 - DNA, 20 bp, Homo sapiens
cagagcgccgtgagttctca

SEQ ID NO: 2655828 - DNA, 21 bp, Homo sapiens
cagagcgccgtgagttctcag

SEQ ID NO: 2655829 - DNA, 16 bp, Homo sapiens
cagagctacttgggcc

SEQ ID NO: 2655830 - DNA, 12 bp, Homo sapiens
cagagctcacaa

SEQ ID NO: 2655831 - DNA, 15 bp, Homo sapiens
cagagctctccagct

SEQ ID NO: 2655832 - DNA, 10 bp, Homo sapiens
cagagctggg

SEQ ID NO: 2655833 - DNA, 13 bp, Homo sapiens
cagagctgggagg

SEQ ID NO: 2655834 - DNA, 20 bp, Homo sapiens
cagagctgggaggcatggcc

SEQ ID NO: 2655835 - DNA, 20 bp, Homo sapiens
cagagctgtttatggcctca

SEQ ID NO: 2655836 - DNA, 23 bp, Homo sapiens
cagagcttccctgactcattctg

SEQ ID NO: 2655837 - DNA, 15 bp, Homo sapiens
cagagcttggactgg

SEQ ID NO: 2655838 - DNA, 16 bp, Homo sapiens
cagagcttggactgga

SEQ ID NO: 2655839 - DNA, 19 bp, Homo sapiens
cagaggaactgtccagaga

SEQ ID NO: 2655840 - DNA, 21 bp, Homo sapiens
cagaggaactgtccagagagc

SEQ ID NO: 2655841 - DNA, 18 bp, Homo sapiens
cagaggaaggggccagag

SEQ ID NO: 2655842 - DNA, 21 bp, Homo sapiens
cagaggaaggggccagaggct

SEQ ID NO: 2655843 - DNA, 13 bp, Homo sapiens
cagaggacagatc

SEQ ID NO: 2655844 - DNA, 22 bp, Homo sapiens
cagaggactcacttgcccacac

SEQ ID NO: 2655845 - DNA, 17 bp, Homo sapiens
cagaggagtacaggtga

SEQ ID NO: 2655846 - DNA, 16 bp, Homo sapiens
cagaggatggccagtg

SEQ ID NO: 2655847 - DNA, 21 bp, Homo sapiens
cagaggattgctgccccatca

SEQ ID NO: 2655848 - DNA, 21 bp, Homo sapiens
cagaggccatgggcctcctgt

SEQ ID NO: 2655849 - DNA, 20 bp, Homo sapiens
cagaggccctcgctgccagc

SEQ ID NO: 2655850 - DNA, 20 bp, Homo sapiens
cagaggctattattttcact

SEQ ID NO: 2655851 - DNA, 14 bp, Homo sapiens
cagaggctgcccca

SEQ ID NO: 2655852 - DNA, 23 bp, Homo sapiens
cagaggctgcctctcccatcact

SEQ ID NO: 2655853 - DNA, 19 bp, Homo sapiens
cagagggactttgtataga

SEQ ID NO: 2655854 - DNA, 23 bp, Homo sapiens
cagagggaggaatcgaggaacca

SEQ ID NO: 2655855 - DNA, 14 bp, Homo sapiens
cagagggagtgaca

SEQ ID NO: 2655856 - DNA, 13 bp, Homo sapiens
cagagggcccagg

SEQ ID NO: 2655857 - DNA, 19 bp, Homo sapiens
cagagggggtggcctccca

SEQ ID NO: 2655858 - DNA, 15 bp, Homo sapiens
cagaggggtaggcag

SEQ ID NO: 2655859 - DNA, 15 bp, Homo sapiens
cagaggtaacagaac

SEQ ID NO: 2655860 - DNA, 16 bp, Homo sapiens
cagaggtaacagaaca

SEQ ID NO: 2655861 - DNA, 22 bp, Homo sapiens
cagaggtaacagaacagcttca

SEQ ID NO: 2655862 - DNA, 23 bp, Homo sapiens
cagaggtaacagaacagcttcag

SEQ ID NO: 2655863 - DNA, 15 bp, Homo sapiens
cagaggtctctgccg

SEQ ID NO: 2655864 - DNA, 14 bp, Homo sapiens
cagaggtggccaga

SEQ ID NO: 2655865 - DNA, 14 bp, Homo sapiens
cagaggtgggcagg

SEQ ID NO: 2655866 - DNA, 17 bp, Homo sapiens
cagaggtgggcaggtgg

SEQ ID NO: 2655867 - DNA, 21 bp, Homo sapiens
cagaggttatctgtcccaggt

SEQ ID NO: 2655868 - DNA, 13 bp, Homo sapiens
cagagtatgaaca

SEQ ID NO: 2655869 - DNA, 21 bp, Homo sapiens
cagagtcacacgggggcagct

SEQ ID NO: 2655870 - DNA, 15 bp, Homo sapiens
cagagtcagcagaac

SEQ ID NO: 2655871 - DNA, 21 bp, Homo sapiens
cagagtctcactgttgcccag

SEQ ID NO: 2655872 - DNA, 20 bp, Homo sapiens
cagagtgagacccagccctc

SEQ ID NO: 2655873 - DNA, 20 bp, Homo sapiens
cagagtgagactctgtctca

SEQ ID NO: 2655874 - DNA, 23 bp, Homo sapiens
cagagtgcaagcccctgctccag

SEQ ID NO: 2655875 - DNA, 12 bp, Homo sapiens
cagagtggcctg

SEQ ID NO: 2655876 - DNA, 15 bp, Homo sapiens
cagagtggtctttct

SEQ ID NO: 2655877 - DNA, 18 bp, Homo sapiens
cagagtgtgctggaggac

SEQ ID NO: 2655878 - DNA, 14 bp, Homo sapiens
cagagttcactata

SEQ ID NO: 2655879 - DNA, 20 bp, Homo sapiens
cagagttcactataaatggt

SEQ ID NO: 2655880 - DNA, 24 bp, Homo sapiens
cagagttccccatgcagacatgag

SEQ ID NO: 2655881 - DNA, 19 bp, Homo sapiens
cagagttgttacattttta

SEQ ID NO: 2655882 - DNA, 22 bp, Homo sapiens
cagagtttgtgtgttgtcttga

SEQ ID NO: 2655883 - DNA, 16 bp, Homo sapiens
cagataaaattataga

SEQ ID NO: 2655884 - DNA, 14 bp, Homo sapiens
cagataaacagtag

SEQ ID NO: 2655885 - DNA, 14 bp, Homo sapiens
cagataactgttat

SEQ ID NO: 2655886 - DNA, 19 bp, Homo sapiens
cagataactgttatttata

SEQ ID NO: 2655887 - DNA, 16 bp, Homo sapiens
cagataatgtgaaaat

SEQ ID NO: 2655888 - DNA, 17 bp, Homo sapiens
cagatacaatgtattta

SEQ ID NO: 2655889 - DNA, 22 bp, Homo sapiens
cagatacaggaaaagctgctga

SEQ ID NO: 2655890 - DNA, 17 bp, Homo sapiens
cagatacatggttgtga

SEQ ID NO: 2655891 - DNA, 14 bp, Homo sapiens
cagataccagcccc

SEQ ID NO: 2655892 - DNA, 16 bp, Homo sapiens
cagataccagcccctg

SEQ ID NO: 2655893 - DNA, 23 bp, Homo sapiens
cagatataaatggctggttttta

SEQ ID NO: 2655894 - DNA, 20 bp, Homo sapiens
cagatatatatcatattggt

SEQ ID NO: 2655895 - DNA, 14 bp, Homo sapiens
cagatatatttttc

SEQ ID NO: 2655896 - DNA, 15 bp, Homo sapiens
cagatatatttttca

SEQ ID NO: 2655897 - DNA, 15 bp, Homo sapiens
cagatattttttcag

SEQ ID NO: 2655898 - DNA, 18 bp, Homo sapiens
cagatcacagcttcagcc

SEQ ID NO: 2655899 - DNA, 22 bp, Homo sapiens
cagatcacagcttcagccagga

SEQ ID NO: 2655900 - DNA, 21 bp, Homo sapiens
cagatcaccagcccggcctgc

SEQ ID NO: 2655901 - DNA, 13 bp, Homo sapiens
cagatcactactg

SEQ ID NO: 2655902 - DNA, 20 bp, Homo sapiens
cagatcagctcctaaccctt

SEQ ID NO: 2655903 - DNA, 14 bp, Homo sapiens
cagatcctcttggt

SEQ ID NO: 2655904 - DNA, 18 bp, Homo sapiens
cagatccttgtttcaaac

SEQ ID NO: 2655905 - DNA, 13 bp, Homo sapiens
cagatctgtgccc

SEQ ID NO: 2655906 - DNA, 15 bp, Homo sapiens
cagatctgtgcccca

SEQ ID NO: 2655907 - DNA, 19 bp, Homo sapiens
cagatgagaaactcttgag

SEQ ID NO: 2655908 - DNA, 18 bp, Homo sapiens
cagatgcaaagaggcaag

SEQ ID NO: 2655909 - DNA, 14 bp, Homo sapiens
cagatgcaatgact

SEQ ID NO: 2655910 - DNA, 14 bp, Homo sapiens
cagatgcaccagcc

SEQ ID NO: 2655911 - DNA, 16 bp, Homo sapiens
cagatgcaccagccct

SEQ ID NO: 2655912 - DNA, 22 bp, Homo sapiens
cagatgcccagagggcccaggc

SEQ ID NO: 2655913 - DNA, 18 bp, Homo sapiens
cagatgccccagagctgt

SEQ ID NO: 2655914 - DNA, 14 bp, Homo sapiens
cagatgcctccacc

SEQ ID NO: 2655915 - DNA, 15 bp, Homo sapiens
cagatgctgatgttc

SEQ ID NO: 2655916 - DNA, 21 bp, Homo sapiens
cagatgctgatgttcagtgta

SEQ ID NO: 2655917 - DNA, 13 bp, Homo sapiens
cagatgcttctgg

SEQ ID NO: 2655918 - DNA, 14 bp, Homo sapiens
cagatgctttcctg

SEQ ID NO: 2655919 - DNA, 14 bp, Homo sapiens
cagatggaaccgca

SEQ ID NO: 2655920 - DNA, 18 bp, Homo sapiens
cagatggactccagcctg

SEQ ID NO: 2655921 - DNA, 21 bp, Homo sapiens
cagatggatttgcctgtgcca

SEQ ID NO: 2655922 - DNA, 21 bp, Homo sapiens
cagatggggctcccgcccgtg

SEQ ID NO: 2655923 - DNA, 14 bp, Homo sapiens
cagatgggggaaag

SEQ ID NO: 2655924 - DNA, 15 bp, Homo sapiens
cagatgtcttctgcc

SEQ ID NO: 2655925 - DNA, 22 bp, Homo sapiens
cagatgtcttctgcctgttata

SEQ ID NO: 2655926 - DNA, 20 bp, Homo sapiens
cagatgtggtaactgttaaa

SEQ ID NO: 2655927 - DNA, 19 bp, Homo sapiens
cagattcacactgtctggt

SEQ ID NO: 2655928 - DNA, 23 bp, Homo sapiens
cagattccaggcgatgtgcaagt

SEQ ID NO: 2655929 - DNA, 15 bp, Homo sapiens
cagattctttcctga

SEQ ID NO: 2655930 - DNA, 20 bp, Homo sapiens
cagattctttcctgaggctg

SEQ ID NO: 2655931 - DNA, 14 bp, Homo sapiens
cagattgaaaagga

SEQ ID NO: 2655932 - DNA, 20 bp, Homo sapiens
cagattgcaacaggctgggc

SEQ ID NO: 2655933 - DNA, 12 bp, Homo sapiens
cagattgcatgt

SEQ ID NO: 2655934 - DNA, 13 bp, Homo sapiens
cagattgcatgtg

SEQ ID NO: 2655935 - DNA, 18 bp, Homo sapiens
cagattgcatgtgactct

SEQ ID NO: 2655936 - DNA, 17 bp, Homo sapiens
cagatttacactgggag

SEQ ID NO: 2655937 - DNA, 20 bp, Homo sapiens
cagatttgctaatttatcct

SEQ ID NO: 2655938 - DNA, 14 bp, Homo sapiens
cagatttgggctgg

SEQ ID NO: 2655939 - DNA, 12 bp, Homo sapiens
cagatttgtgaa

SEQ ID NO: 2655940 - DNA, 15 bp, Homo sapiens
cagatttgtgaactc

SEQ ID NO: 2655941 - DNA, 23 bp, Homo sapiens
caggacttaacggctccaggatt

SEQ ID NO: 2655942 - DNA, 20 bp, Homo sapiens
caggacttggtctgatttca

SEQ ID NO: 2655943 - DNA, 22 bp, Homo sapiens
caggagaaggccaattcctata

SEQ ID NO: 2655944 - DNA, 15 bp, Homo sapiens
caggagacaggaagg

SEQ ID NO: 2655945 - DNA, 15 bp, Homo sapiens
caggagaggagagcc

SEQ ID NO: 2655946 - DNA, 16 bp, Homo sapiens
caggagaggagagcca

SEQ ID NO: 2655947 - DNA, 20 bp, Homo sapiens
caggagaggagagccagaga

SEQ ID NO: 2655948 - DNA, 12 bp, Homo sapiens
caggagaggagc

SEQ ID NO: 2655949 - DNA, 20 bp, Homo sapiens
caggagatggaagttgcagt

SEQ ID NO: 2655950 - DNA, 19 bp, Homo sapiens
caggagcaaatgtttctgc

SEQ ID NO: 2655951 - DNA, 22 bp, Homo sapiens
caggagcaaatgtttctgcagt

SEQ ID NO: 2655952 - DNA, 16 bp, Homo sapiens
caggagcacaggcagc

SEQ ID NO: 2655953 - DNA, 18 bp, Homo sapiens
caggagcacaggcagctg

SEQ ID NO: 2655954 - DNA, 23 bp, Homo sapiens
caggagcacaggcagctggatga

SEQ ID NO: 2655955 - DNA, 19 bp, Homo sapiens
caggagcagccacattcct

SEQ ID NO: 2655956 - DNA, 15 bp, Homo sapiens
caggagcagcctcag

SEQ ID NO: 2655957 - DNA, 16 bp, Homo sapiens
caggagccccgaggcc

SEQ ID NO: 2655958 - DNA, 18 bp, Homo sapiens
caggagccccgaggcctt

SEQ ID NO: 2655959 - DNA, 15 bp, Homo sapiens
caggagcctgtgcct

SEQ ID NO: 2655960 - DNA, 15 bp, Homo sapiens
caggagctcttcagg

SEQ ID NO: 2655961 - DNA, 20 bp, Homo sapiens
caggagctcttcaggcctcc

SEQ ID NO: 2655962 - DNA, 14 bp, Homo sapiens
caggagctgggatc

SEQ ID NO: 2655963 - DNA, 13 bp, Homo sapiens
caggaggacaatt

SEQ ID NO: 2655964 - DNA, 23 bp, Homo sapiens
caggaggagactagatttatgaa

SEQ ID NO: 2655965 - DNA, 19 bp, Homo sapiens
caggaggatcacttgagtc

SEQ ID NO: 2655966 - DNA, 13 bp, Homo sapiens
caggaggccagcc

SEQ ID NO: 2655967 - DNA, 17 bp, Homo sapiens
caggaggctgaggcagg

SEQ ID NO: 2655968 - DNA, 20 bp, Homo sapiens
caggaggctgaggcaggagg

SEQ ID NO: 2655969 - DNA, 12 bp, Homo sapiens
caggagggccct

SEQ ID NO: 2655970 - DNA, 17 bp, Homo sapiens
caggagtcccaaggaaa

SEQ ID NO: 2655971 - DNA, 24 bp, Homo sapiens
caggagtcccaaggaaagccccag

SEQ ID NO: 2655972 - DNA, 13 bp, Homo sapiens
caggagtccctgg

SEQ ID NO: 2655973 - DNA, 15 bp, Homo sapiens
caggagtccctggta

SEQ ID NO: 2655974 - DNA, 17 bp, Homo sapiens
caggagtgggttgattt

SEQ ID NO: 2655975 - DNA, 19 bp, Homo sapiens
caggagttaaaaagggcag

SEQ ID NO: 2655976 - DNA, 17 bp, Homo sapiens
caggagttagaggccag

SEQ ID NO: 2655977 - DNA, 18 bp, Homo sapiens
caggagttagaggccagc

SEQ ID NO: 2655978 - DNA, 21 bp, Homo sapiens
caggagttcaataaatgtctg

SEQ ID NO: 2655979 - DNA, 16 bp, Homo sapiens
caggagttggaagtgt

SEQ ID NO: 2655980 - DNA, 22 bp, Homo sapiens
caggagtttgaggctgcagcga

SEQ ID NO: 2655981 - DNA, 18 bp, Homo sapiens
caggataataaagtgttt

SEQ ID NO: 2655982 - DNA, 14 bp, Homo sapiens
caggatcagtctga

SEQ ID NO: 2655983 - DNA, 15 bp, Homo sapiens
caggatgaacccagg

SEQ ID NO: 2655984 - DNA, 16 bp, Homo sapiens
caggatgaacccagga

SEQ ID NO: 2655985 - DNA, 17 bp, Homo sapiens
caggatgcccagggcca

SEQ ID NO: 2655986 - DNA, 15 bp, Homo sapiens
caggatggaggggtg

SEQ ID NO: 2655987 - DNA, 23 bp, Homo sapiens
caggatggaggggtggtcctgac

SEQ ID NO: 2655988 - DNA, 16 bp, Homo sapiens
caggatggcctggcca

SEQ ID NO: 2655989 - DNA, 17 bp, Homo sapiens
caggatggcctggccag

SEQ ID NO: 2655990 - DNA, 21 bp, Homo sapiens
caggatgggggctggcctctg

SEQ ID NO: 2655991 - DNA, 13 bp, Homo sapiens
caggattgaagag

SEQ ID NO: 2655992 - DNA, 21 bp, Homo sapiens
caggatttcgtgggtctgttt

SEQ ID NO: 2655993 - DNA, 21 bp, Homo sapiens
caggatttgaactcagatctg

SEQ ID NO: 2655994 - DNA, 14 bp, Homo sapiens
caggcaagcacctc

SEQ ID NO: 2655995 - DNA, 19 bp, Homo sapiens
caggcaatgctggctgttg

SEQ ID NO: 2655996 - DNA, 21 bp, Homo sapiens
caggcaccccctggagagaag

SEQ ID NO: 2655997 - DNA, 16 bp, Homo sapiens
caggcacccttctttc

SEQ ID NO: 2655998 - DNA, 16 bp, Homo sapiens
caggcaccgagaatgt

SEQ ID NO: 2655999 - DNA, 17 bp, Homo sapiens
caggcaccgagaatgtt

SEQ ID NO: 2656000 - DNA, 19 bp, Homo sapiens
caggcaccttagtggcttt

SEQ ID NO: 2656001 - DNA, 20 bp, Homo sapiens
caggcactcaatgcagccag

SEQ ID NO: 2656002 - DNA, 14 bp, Homo sapiens
caggcagagaatca

SEQ ID NO: 2656003 - DNA, 17 bp, Homo sapiens
caggcagatctgtgccc

SEQ ID NO: 2656004 - DNA, 19 bp, Homo sapiens
caggcagatctgtgcccca

SEQ ID NO: 2656005 - DNA, 15 bp, Homo sapiens
caggcagcacagaga

SEQ ID NO: 2656006 - DNA, 14 bp, Homo sapiens
caggcagcagagac

SEQ ID NO: 2656007 - DNA, 14 bp, Homo sapiens
caggcagccaggcc

SEQ ID NO: 2656008 - DNA, 14 bp, Homo sapiens
caggcagcgccaag

SEQ ID NO: 2656009 - DNA, 15 bp, Homo sapiens
caggcagctggatga

SEQ ID NO: 2656010 - DNA, 18 bp, Homo sapiens
caggcagctggatgagac

SEQ ID NO: 2656011 - DNA, 22 bp, Homo sapiens
caggcagctttttctctcccac

SEQ ID NO: 2656012 - DNA, 18 bp, Homo sapiens
caggcaggaagggcagga

SEQ ID NO: 2656013 - DNA, 23 bp, Homo sapiens
caggcaggctaaggcgtggagct

SEQ ID NO: 2656014 - DNA, 12 bp, Homo sapiens
caggcaggctgt

SEQ ID NO: 2656015 - DNA, 18 bp, Homo sapiens
caggcagtcgggggctgg

SEQ ID NO: 2656016 - DNA, 19 bp, Homo sapiens
caggcagtcgggggctggc

SEQ ID NO: 2656017 - DNA, 21 bp, Homo sapiens
caggcagtcgggggctggcct

SEQ ID NO: 2656018 - DNA, 14 bp, Homo sapiens
caggcataggcctg

SEQ ID NO: 2656019 - DNA, 14 bp, Homo sapiens
caggcatgcctgtg

SEQ ID NO: 2656020 - DNA, 17 bp, Homo sapiens
caggcatggtggcccac

SEQ ID NO: 2656021 - DNA, 13 bp, Homo sapiens
caggcattcccca

SEQ ID NO: 2656022 - DNA, 18 bp, Homo sapiens
caggcattccccaggagg

SEQ ID NO: 2656023 - DNA, 22 bp, Homo sapiens
caggcattccccaggaggccag

SEQ ID NO: 2656024 - DNA, 24 bp, Homo sapiens
caggcattccccaggaggccagcc

SEQ ID NO: 2656025 - DNA, 18 bp, Homo sapiens
caggcatttgactgaaga

SEQ ID NO: 2656026 - DNA, 23 bp, Homo sapiens
caggcatttgactgaagatgcag

SEQ ID NO: 2656027 - DNA, 19 bp, Homo sapiens
caggccaagagcagaggca

SEQ ID NO: 2656028 - DNA, 17 bp, Homo sapiens
caggccacctgccccct

SEQ ID NO: 2656029 - DNA, 21 bp, Homo sapiens
caggccacctgcccccttctc

SEQ ID NO: 2656030 - DNA, 23 bp, Homo sapiens
caggccacctgcccccttctccc

SEQ ID NO: 2656031 - DNA, 13 bp, Homo sapiens
caggccagaggga

SEQ ID NO: 2656032 - DNA, 15 bp, Homo sapiens
caggccagagggagt

SEQ ID NO: 2656033 - DNA, 19 bp, Homo sapiens
caggccagagggagtgaca

SEQ ID NO: 2656034 - DNA, 21 bp, Homo sapiens
caggccagagggagtgacaga

SEQ ID NO: 2656035 - DNA, 23 bp, Homo sapiens
caggccagagggagtgacagagg

SEQ ID NO: 2656036 - DNA, 15 bp, Homo sapiens
caggccagctgcctc

SEQ ID NO: 2656037 - DNA, 11 bp, Homo sapiens
caggccaggcc

SEQ ID NO: 2656038 - DNA, 16 bp, Homo sapiens
caggccaggccaccag

SEQ ID NO: 2656039 - DNA, 14 bp, Homo sapiens
caggccaggccagc

SEQ ID NO: 2656040 - DNA, 18 bp, Homo sapiens
caggccaggccctctgcc

SEQ ID NO: 2656041 - DNA, 20 bp, Homo sapiens
caggccaggccctctgccca

SEQ ID NO: 2656042 - DNA, 16 bp, Homo sapiens
caggccaggtgcagtg

SEQ ID NO: 2656043 - DNA, 22 bp, Homo sapiens
caggccagtaagggaaatagaa

SEQ ID NO: 2656044 - DNA, 15 bp, Homo sapiens
caggccatggaggca

SEQ ID NO: 2656045 - DNA, 10 bp, Homo sapiens
caggcccagc

SEQ ID NO: 2656046 - DNA, 12 bp, Homo sapiens
caggcccagcat

SEQ ID NO: 2656047 - DNA, 19 bp, Homo sapiens
caggcccagcattgctggt

SEQ ID NO: 2656048 - DNA, 22 bp, Homo sapiens
caggcccagcattgctggttct

SEQ ID NO: 2656049 - DNA, 19 bp, Homo sapiens
caggccccaaaaccacagc

SEQ ID NO: 2656050 - DNA, 13 bp, Homo sapiens
caggcccccaagc

SEQ ID NO: 2656051 - DNA, 18 bp, Homo sapiens
caggcccccaagcctgca

SEQ ID NO: 2656052 - DNA, 15 bp, Homo sapiens
caggcccccaccact

SEQ ID NO: 2656053 - DNA, 18 bp, Homo sapiens
caggccccgaggacccag

SEQ ID NO: 2656054 - DNA, 20 bp, Homo sapiens
caggccccgaggacccagac

SEQ ID NO: 2656055 - DNA, 19 bp, Homo sapiens
caggcccctgccaccctgg

SEQ ID NO: 2656056 - DNA, 18 bp, Homo sapiens
caggcccggctccaggct

SEQ ID NO: 2656057 - DNA, 13 bp, Homo sapiens
caggccctctgcc

SEQ ID NO: 2656058 - DNA, 14 bp, Homo sapiens
caggccctctgccc

SEQ ID NO: 2656059 - DNA, 16 bp, Homo sapiens
caggccctctgcccac

SEQ ID NO: 2656060 - DNA, 19 bp, Homo sapiens
caggccctctgcccactcc

SEQ ID NO: 2656061 - DNA, 20 bp, Homo sapiens
caggccctctgcccactccc

SEQ ID NO: 2656062 - DNA, 18 bp, Homo sapiens
caggccgagaagccagtg

SEQ ID NO: 2656063 - DNA, 19 bp, Homo sapiens
caggccggggtggagcatg

SEQ ID NO: 2656064 - DNA, 22 bp, Homo sapiens
caggccggtgtgggctgtgtcg

SEQ ID NO: 2656065 - DNA, 13 bp, Homo sapiens
caggcctccctct

SEQ ID NO: 2656066 - DNA, 14 bp, Homo sapiens
caggcctccctctc

SEQ ID NO: 2656067 - DNA, 15 bp, Homo sapiens
caggcctccctctct

SEQ ID NO: 2656068 - DNA, 22 bp, Homo sapiens
caggcctccctctctcttctgc

SEQ ID NO: 2656069 - DNA, 15 bp, Homo sapiens
caggcctcttggcag

SEQ ID NO: 2656070 - DNA, 12 bp, Homo sapiens
caggcctgtgtg

SEQ ID NO: 2656071 - DNA, 17 bp, Homo sapiens
caggccttatctccaag

SEQ ID NO: 2656072 - DNA, 20 bp, Homo sapiens
caggcgatccacctgtctca

SEQ ID NO: 2656073 - DNA, 22 bp, Homo sapiens
caggcgtagatcaccagaataa

SEQ ID NO: 2656074 - DNA, 19 bp, Homo sapiens
caggctaaggcgtggagct

SEQ ID NO: 2656075 - DNA, 13 bp, Homo sapiens
caggctacactga

SEQ ID NO: 2656076 - DNA, 14 bp, Homo sapiens
caggctactgtcag

SEQ ID NO: 2656077 - DNA, 16 bp, Homo sapiens
caggctagagtgcagt

SEQ ID NO: 2656078 - DNA, 13 bp, Homo sapiens
caggctccttcct

SEQ ID NO: 2656079 - DNA, 14 bp, Homo sapiens
caggctccttcctg

SEQ ID NO: 2656080 - DNA, 17 bp, Homo sapiens
caggctccttcctgtct

SEQ ID NO: 2656081 - DNA, 19 bp, Homo sapiens
caggctcctttagcgccca

SEQ ID NO: 2656082 - DNA, 20 bp, Homo sapiens
caggctcctttagcgcccag

SEQ ID NO: 2656083 - DNA, 21 bp, Homo sapiens
caggctcctttagcgcccagt

SEQ ID NO: 2656084 - DNA, 13 bp, Homo sapiens
caggctctcaaca

SEQ ID NO: 2656085 - DNA, 13 bp, Homo sapiens
caggctctgccct

SEQ ID NO: 2656086 - DNA, 18 bp, Homo sapiens
cagttgaaaaacagctga

SEQ ID NO: 2656087 - DNA, 19 bp, Homo sapiens
cagttgaaaaacagctgag

SEQ ID NO: 2656088 - DNA, 23 bp, Homo sapiens
cagttgaaaagactccaaagaaa

SEQ ID NO: 2656089 - DNA, 16 bp, Homo sapiens
cagttgggtggatgcc

SEQ ID NO: 2656090 - DNA, 18 bp, Homo sapiens
cagttgggtggatgcctg

SEQ ID NO: 2656091 - DNA, 19 bp, Homo sapiens
cagttggtcccccttccat

SEQ ID NO: 2656092 - DNA, 14 bp, Homo sapiens
cagttgtagaatgt

SEQ ID NO: 2656093 - DNA, 19 bp, Homo sapiens
cagttgtagaatgtattgt

SEQ ID NO: 2656094 - DNA, 21 bp, Homo sapiens
cagttgtagaatgtattgtac

SEQ ID NO: 2656095 - DNA, 14 bp, Homo sapiens
cagttgttggcctc

SEQ ID NO: 2656096 - DNA, 13 bp, Homo sapiens
cagttgtttgatg

SEQ ID NO: 2656097 - DNA, 15 bp, Homo sapiens
cagtttatcattcaa

SEQ ID NO: 2656098 - DNA, 15 bp, Homo sapiens
cagtttctgtcctgc

SEQ ID NO: 2656099 - DNA, 16 bp, Homo sapiens
cagtttgtcacatgaa

SEQ ID NO: 2656100 - DNA, 23 bp, Homo sapiens
cagtttgtgtgtcttaattatta

SEQ ID NO: 2656101 - DNA, 15 bp, Homo sapiens
cagttttatcatttt

SEQ ID NO: 2656102 - DNA, 14 bp, Homo sapiens
cagttttccatgaa

SEQ ID NO: 2656103 - DNA, 19 bp, Homo sapiens
cagttttccatgaaaacgt

SEQ ID NO: 2656104 - DNA, 11 bp, Homo sapiens
cagttttcctt

SEQ ID NO: 2656105 - DNA, 15 bp, Homo sapiens
cagttttctgagaaa

SEQ ID NO: 2656106 - DNA, 19 bp, Homo sapiens
cagttttctgagaaagact

SEQ ID NO: 2656107 - DNA, 20 bp, Homo sapiens
cagttttctgagaaagacta

SEQ ID NO: 2656108 - DNA, 15 bp, Homo sapiens
cagtttttattgctt

SEQ ID NO: 2656109 - DNA, 20 bp, Homo sapiens
cataaaataaagtatatata

SEQ ID NO: 2656110 - DNA, 12 bp, Homo sapiens
cataaaccttaa

SEQ ID NO: 2656111 - DNA, 14 bp, Homo sapiens
cataaactgtgtgc

SEQ ID NO: 2656112 - DNA, 15 bp, Homo sapiens
cataaactgtgtgca

SEQ ID NO: 2656113 - DNA, 16 bp, Homo sapiens
cataaacttcatggtc

SEQ ID NO: 2656114 - DNA, 20 bp, Homo sapiens
cataaatatgcagtgatatg

SEQ ID NO: 2656115 - DNA, 14 bp, Homo sapiens
cataacaattcctc

SEQ ID NO: 2656116 - DNA, 17 bp, Homo sapiens
cataacaattcctctac

SEQ ID NO: 2656117 - DNA, 15 bp, Homo sapiens
cataacgtttttcct

SEQ ID NO: 2656118 - DNA, 16 bp, Homo sapiens
cataacgtttttcctt

SEQ ID NO: 2656119 - DNA, 11 bp, Homo sapiens
cataactgaaa

SEQ ID NO: 2656120 - DNA, 11 bp, Homo sapiens
cataagaccat

SEQ ID NO: 2656121 - DNA, 20 bp, Homo sapiens
cataagaccctaagcctcct

SEQ ID NO: 2656122 - DNA, 14 bp, Homo sapiens
cataagataaatgt

SEQ ID NO: 2656123 - DNA, 17 bp, Homo sapiens
cataagatatttttcat

SEQ ID NO: 2656124 - DNA, 22 bp, Homo sapiens
cataagctatagacccgaggaa

SEQ ID NO: 2656125 - DNA, 17 bp, Homo sapiens
cataaggaaactgggtt

SEQ ID NO: 2656126 - DNA, 15 bp, Homo sapiens
cataaggtttcgttt

SEQ ID NO: 2656127 - DNA, 15 bp, Homo sapiens
cataagtatttcaaa

SEQ ID NO: 2656128 - DNA, 12 bp, Homo sapiens
cataagtttctg

SEQ ID NO: 2656129 - DNA, 23 bp, Homo sapiens
cataatagacttcccactctagg

SEQ ID NO: 2656130 - DNA, 18 bp, Homo sapiens
cataatcacaacccttca

SEQ ID NO: 2656131 - DNA, 21 bp, Homo sapiens
cataatctggactcctctgtc

SEQ ID NO: 2656132 - DNA, 23 bp, Homo sapiens
cataatctggactcctctgtcca

SEQ ID NO: 2656133 - DNA, 14 bp, Homo sapiens
cataatgcgtgcat

SEQ ID NO: 2656134 - DNA, 16 bp, Homo sapiens
cataatgctactgtct

SEQ ID NO: 2656135 - DNA, 17 bp, Homo sapiens
cataatgtgaagtgtta

SEQ ID NO: 2656136 - DNA, 19 bp, Homo sapiens
cataatgtgaagtgttaat

SEQ ID NO: 2656137 - DNA, 16 bp, Homo sapiens
cataattcttgtatat

SEQ ID NO: 2656138 - DNA, 14 bp, Homo sapiens
cataattttcttca

SEQ ID NO: 2656139 - DNA, 15 bp, Homo sapiens
catacaattccaaac

SEQ ID NO: 2656140 - DNA, 12 bp, Homo sapiens
catacacacaca

SEQ ID NO: 2656141 - DNA, 22 bp, Homo sapiens
catacacacacacacacagcca

SEQ ID NO: 2656142 - DNA, 17 bp, Homo sapiens
catacatttataatgtt

SEQ ID NO: 2656143 - DNA, 17 bp, Homo sapiens
cataccaacacgagcag

SEQ ID NO: 2656144 - DNA, 13 bp, Homo sapiens
cataccacttttg

SEQ ID NO: 2656145 - DNA, 14 bp, Homo sapiens
cataccacttttgt

SEQ ID NO: 2656146 - DNA, 18 bp, Homo sapiens
catacccacccccaccca

SEQ ID NO: 2656147 - DNA, 18 bp, Homo sapiens
catacctgctggtgcaga

SEQ ID NO: 2656148 - DNA, 19 bp, Homo sapiens
catacctttattgtgatct

SEQ ID NO: 2656149 - DNA, 18 bp, Homo sapiens
catacgtacacattttat

SEQ ID NO: 2656150 - DNA, 16 bp, Homo sapiens
catactcccatctgtg

SEQ ID NO: 2656151 - DNA, 20 bp, Homo sapiens
catactgagggaccaactgg

SEQ ID NO: 2656152 - DNA, 17 bp, Homo sapiens
catactgtgctggagcc

SEQ ID NO: 2656153 - DNA, 13 bp, Homo sapiens
catacttatctct

SEQ ID NO: 2656154 - DNA, 18 bp, Homo sapiens
catacttatctctctgtg

SEQ ID NO: 2656155 - DNA, 22 bp, Homo sapiens
catacttatctctctgtgctgt

SEQ ID NO: 2656156 - DNA, 15 bp, Homo sapiens
catacttcaaaagta

SEQ ID NO: 2656157 - DNA, 12 bp, Homo sapiens
catactttgtct

SEQ ID NO: 2656158 - DNA, 18 bp, Homo sapiens
catactttgtctgaaaaa

SEQ ID NO: 2656159 - DNA, 21 bp, Homo sapiens
catagagagcaagacgctgtg

SEQ ID NO: 2656160 - DNA, 18 bp, Homo sapiens
catagagagggagaagaa

SEQ ID NO: 2656161 - DNA, 18 bp, Homo sapiens
catagagtttaacacaag

SEQ ID NO: 2656162 - DNA, 23 bp, Homo sapiens
catagatgtccctttcttggcca

SEQ ID NO: 2656163 - DNA, 14 bp, Homo sapiens
catagcaagacaca

SEQ ID NO: 2656164 - DNA, 23 bp, Homo sapiens
catagcaagattgcttaaaatag

SEQ ID NO: 2656165 - DNA, 14 bp, Homo sapiens
catagcacttcccc

SEQ ID NO: 2656166 - DNA, 20 bp, Homo sapiens
catagcagcttattcacaag

SEQ ID NO: 2656167 - DNA, 16 bp, Homo sapiens
catagcattaactaat

SEQ ID NO: 2656168 - DNA, 19 bp, Homo sapiens
catagcctaatccctgggc

SEQ ID NO: 2656169 - DNA, 21 bp, Homo sapiens
catagctaagaaataaaactg

SEQ ID NO: 2656170 - DNA, 15 bp, Homo sapiens
catagctcctgctcc

SEQ ID NO: 2656171 - DNA, 20 bp, Homo sapiens
catagctcctgctccacagc

SEQ ID NO: 2656172 - DNA, 21 bp, Homo sapiens
catagcttgataaagggccaa

SEQ ID NO: 2656173 - DNA, 17 bp, Homo sapiens
catagggtctcttcagg

SEQ ID NO: 2656174 - DNA, 14 bp, Homo sapiens
cataggtcactggc

SEQ ID NO: 2656175 - DNA, 21 bp, Homo sapiens
cataggtcactggctctccaa

SEQ ID NO: 2656176 - DNA, 16 bp, Homo sapiens
cataggtgatctcatt

SEQ ID NO: 2656177 - DNA, 20 bp, Homo sapiens
catagtagtatgatgataca

SEQ ID NO: 2656178 - DNA, 21 bp, Homo sapiens
catagtattccattgtgtgag

SEQ ID NO: 2656179 - DNA, 23 bp, Homo sapiens
catagtcatgtaagctgaaaata

SEQ ID NO: 2656180 - DNA, 22 bp, Homo sapiens
catagtggcttaaaacaacact

SEQ ID NO: 2656181 - DNA, 22 bp, Homo sapiens
catataacttatattgtaagaa

SEQ ID NO: 2656182 - DNA, 23 bp, Homo sapiens
catataacttatattgtaagaaa

SEQ ID NO: 2656183 - DNA, 15 bp, Homo sapiens
catataagtttgaag

SEQ ID NO: 2656184 - DNA, 22 bp, Homo sapiens
catataagtttgaaggaaacag

SEQ ID NO: 2656185 - DNA, 17 bp, Homo sapiens
catatatatctatctta

SEQ ID NO: 2656186 - DNA, 17 bp, Homo sapiens
catatatgaggacttgt

SEQ ID NO: 2656187 - DNA, 16 bp, Homo sapiens
catatcagtctctgag

SEQ ID NO: 2656188 - DNA, 13 bp, Homo sapiens
catatcagttgag

SEQ ID NO: 2656189 - DNA, 18 bp, Homo sapiens
catatcccctctcccccc

SEQ ID NO: 2656190 - DNA, 15 bp, Homo sapiens
catatcctgagccat

SEQ ID NO: 2656191 - DNA, 23 bp, Homo sapiens
catatcctgagccatcggtgaaa

SEQ ID NO: 2656192 - DNA, 19 bp, Homo sapiens
catatgacattcatgcctg

SEQ ID NO: 2656193 - DNA, 21 bp, Homo sapiens
catatgacattcatgcctggc

SEQ ID NO: 2656194 - DNA, 22 bp, Homo sapiens
catatgactcacatgatgcata

SEQ ID NO: 2656195 - DNA, 13 bp, Homo sapiens
catatgaggatgc

SEQ ID NO: 2656196 - DNA, 17 bp, Homo sapiens
catatgagtgtggaagc

SEQ ID NO: 2656197 - DNA, 17 bp, Homo sapiens
catatgcaccttgtgtc

SEQ ID NO: 2656198 - DNA, 20 bp, Homo sapiens
catatgcaccttgtgtctgt

SEQ ID NO: 2656199 - DNA, 20 bp, Homo sapiens
catatggactctgcacatga

SEQ ID NO: 2656200 - DNA, 14 bp, Homo sapiens
catatgtaaaataa

SEQ ID NO: 2656201 - DNA, 15 bp, Homo sapiens
catatgtaccatgta

SEQ ID NO: 2656202 - DNA, 21 bp, Homo sapiens
catatgtaccatgtacatgaa

SEQ ID NO: 2656203 - DNA, 15 bp, Homo sapiens
catatgttacactaa

SEQ ID NO: 2656204 - DNA, 15 bp, Homo sapiens
catatgttgctcagt

SEQ ID NO: 2656205 - DNA, 16 bp, Homo sapiens
catatgttgctcagtc

SEQ ID NO: 2656206 - DNA, 15 bp, Homo sapiens
catattcaggaagct

SEQ ID NO: 2656207 - DNA, 16 bp, Homo sapiens
catattccatatttat

SEQ ID NO: 2656208 - DNA, 13 bp, Homo sapiens
catattctgtctg

SEQ ID NO: 2656209 - DNA, 21 bp, Homo sapiens
catattgatttccgttaaaat

SEQ ID NO: 2656210 - DNA, 19 bp, Homo sapiens
catattgctttttctaatg

SEQ ID NO: 2656211 - DNA, 14 bp, Homo sapiens
catattggtattca

SEQ ID NO: 2656212 - DNA, 12 bp, Homo sapiens
catattgtacac

SEQ ID NO: 2656213 - DNA, 18 bp, Homo sapiens
catattgtgattctgcct

SEQ ID NO: 2656214 - DNA, 17 bp, Homo sapiens
catattgtggcacaagc

SEQ ID NO: 2656215 - DNA, 18 bp, Homo sapiens
catattgtggcacaagca

SEQ ID NO: 2656216 - DNA, 14 bp, Homo sapiens
catattgttattat

SEQ ID NO: 2656217 - DNA, 13 bp, Homo sapiens
catattgttgaaa

SEQ ID NO: 2656218 - DNA, 16 bp, Homo sapiens
catatttacttcttat

SEQ ID NO: 2656219 - DNA, 22 bp, Homo sapiens
catatttatagcaatccatgtt

SEQ ID NO: 2656220 - DNA, 19 bp, Homo sapiens
catattttgattattgtat

SEQ ID NO: 2656221 - DNA, 17 bp, Homo sapiens
catcaaactcttagtta

SEQ ID NO: 2656222 - DNA, 15 bp, Homo sapiens
catcaaatggaagac

SEQ ID NO: 2656223 - DNA, 16 bp, Homo sapiens
catcaagactggaagg

SEQ ID NO: 2656224 - DNA, 21 bp, Homo sapiens
catcaagcacagaaggaggag

SEQ ID NO: 2656225 - DNA, 23 bp, Homo sapiens
catcaagcacagaaggaggagga

SEQ ID NO: 2656226 - DNA, 18 bp, Homo sapiens
catcaaggcactgcctga

SEQ ID NO: 2656227 - DNA, 21 bp, Homo sapiens
catcaagttattgacaaactc

SEQ ID NO: 2656228 - DNA, 22 bp, Homo sapiens
catcaagttattgacaaactct

SEQ ID NO: 2656229 - DNA, 19 bp, Homo sapiens
catcaatattgtcattcct

SEQ ID NO: 2656230 - DNA, 18 bp, Homo sapiens
catcaatgaatgaatgaa

SEQ ID NO: 2656231 - DNA, 19 bp, Homo sapiens
catggagactcctgccctg

SEQ ID NO: 2656232 - DNA, 14 bp, Homo sapiens
catggagagctaga

SEQ ID NO: 2656233 - DNA, 14 bp, Homo sapiens
catggagagctgga

SEQ ID NO: 2656234 - DNA, 21 bp, Homo sapiens
catggagagctggagcctggt

SEQ ID NO: 2656235 - DNA, 12 bp, Homo sapiens
catggagctggc

SEQ ID NO: 2656236 - DNA, 17 bp, Homo sapiens
catggagtgtgtattgt

SEQ ID NO: 2656237 - DNA, 21 bp, Homo sapiens
catggagtgtgtattgttccc

SEQ ID NO: 2656238 - DNA, 22 bp, Homo sapiens
catggagtgtgtattgttccca

SEQ ID NO: 2656239 - DNA, 22 bp, Homo sapiens
catggatgttttagccattgtt

SEQ ID NO: 2656240 - DNA, 13 bp, Homo sapiens
catggcagaaggc

SEQ ID NO: 2656241 - DNA, 22 bp, Homo sapiens
catggcagaataatctttgggt

SEQ ID NO: 2656242 - DNA, 13 bp, Homo sapiens
catggcccctctg

SEQ ID NO: 2656243 - DNA, 15 bp, Homo sapiens
catggcccctgtgag

SEQ ID NO: 2656244 - DNA, 15 bp, Homo sapiens
catggccctcattaa

SEQ ID NO: 2656245 - DNA, 19 bp, Homo sapiens
catggcctatgcacatatg

SEQ ID NO: 2656246 - DNA, 21 bp, Homo sapiens
catggcctattatattaaaat

SEQ ID NO: 2656247 - DNA, 21 bp, Homo sapiens
catggcctcttcagatctcta

SEQ ID NO: 2656248 - DNA, 19 bp, Homo sapiens
catggcctttgcttgaaag

SEQ ID NO: 2656249 - DNA, 19 bp, Homo sapiens
catggcgtgtccctctcgg

SEQ ID NO: 2656250 - DNA, 14 bp, Homo sapiens
catggctccagtct

SEQ ID NO: 2656251 - DNA, 20 bp, Homo sapiens
catggctccagtctgctgcc

SEQ ID NO: 2656252 - DNA, 17 bp, Homo sapiens
catggcttaatgcttct

SEQ ID NO: 2656253 - DNA, 15 bp, Homo sapiens
catggcttaatgttt

SEQ ID NO: 2656254 - DNA, 13 bp, Homo sapiens
catggcttcctcc

SEQ ID NO: 2656255 - DNA, 15 bp, Homo sapiens
catggcttcctcctc

SEQ ID NO: 2656256 - DNA, 16 bp, Homo sapiens
catggcttcctcctcc

SEQ ID NO: 2656257 - DNA, 18 bp, Homo sapiens
catggcttcctcctccct

SEQ ID NO: 2656258 - DNA, 17 bp, Homo sapiens
catggcttcctcctgcg

SEQ ID NO: 2656259 - DNA, 18 bp, Homo sapiens
catgggaaaggggaagtt

SEQ ID NO: 2656260 - DNA, 14 bp, Homo sapiens
catgggaggctcac

SEQ ID NO: 2656261 - DNA, 24 bp, Homo sapiens
catgggcctggccacctctctcct

SEQ ID NO: 2656262 - DNA, 21 bp, Homo sapiens
catgggcttcactgtataaat

SEQ ID NO: 2656263 - DNA, 17 bp, Homo sapiens
catggggctgggcagct

SEQ ID NO: 2656264 - DNA, 15 bp, Homo sapiens
catggggtaggagga

SEQ ID NO: 2656265 - DNA, 20 bp, Homo sapiens
catggggttggctgggccca

SEQ ID NO: 2656266 - DNA, 16 bp, Homo sapiens
catggtcagccctagg

SEQ ID NO: 2656267 - DNA, 17 bp, Homo sapiens
catggtcggaaaacatg

SEQ ID NO: 2656268 - DNA, 11 bp, Homo sapiens
catggtgaaaa

SEQ ID NO: 2656269 - DNA, 19 bp, Homo sapiens
catggtgcagttgacagca

SEQ ID NO: 2656270 - DNA, 21 bp, Homo sapiens
catggtgggtccatgggcaga

SEQ ID NO: 2656271 - DNA, 22 bp, Homo sapiens
catggtgggtccatgggcagag

SEQ ID NO: 2656272 - DNA, 15 bp, Homo sapiens
catggtgtaataaga

SEQ ID NO: 2656273 - DNA, 16 bp, Homo sapiens
catggtgtaataagac

SEQ ID NO: 2656274 - DNA, 23 bp, Homo sapiens
catggtgtgaaagtcagatgccc

SEQ ID NO: 2656275 - DNA, 19 bp, Homo sapiens
catggttaaggtaaagtaa

SEQ ID NO: 2656276 - DNA, 14 bp, Homo sapiens
catggttgagaaat

SEQ ID NO: 2656277 - DNA, 16 bp, Homo sapiens
catgtaaaagagtcat

SEQ ID NO: 2656278 - DNA, 18 bp, Homo sapiens
catgtaaacaaaatttag

SEQ ID NO: 2656279 - DNA, 15 bp, Homo sapiens
catgtaaactgtgca

SEQ ID NO: 2656280 - DNA, 13 bp, Homo sapiens
catgtaacagaaa

SEQ ID NO: 2656281 - DNA, 17 bp, Homo sapiens
catgtaagctgaaaata

SEQ ID NO: 2656282 - DNA, 22 bp, Homo sapiens
catgtaataaaaagtatatgtt

SEQ ID NO: 2656283 - DNA, 23 bp, Homo sapiens
catgtaatataaagatgttaaaa

SEQ ID NO: 2656284 - DNA, 15 bp, Homo sapiens
catgtacaaaaccat

SEQ ID NO: 2656285 - DNA, 19 bp, Homo sapiens
catgtaccatttgcatggc

SEQ ID NO: 2656286 - DNA, 13 bp, Homo sapiens
catgtaccccaat

SEQ ID NO: 2656287 - DNA, 19 bp, Homo sapiens
catgtaccctaaggtcatt

SEQ ID NO: 2656288 - DNA, 22 bp, Homo sapiens
catgtactgagccttgtaattc

SEQ ID NO: 2656289 - DNA, 14 bp, Homo sapiens
catgtactgtagtt

SEQ ID NO: 2656290 - DNA, 19 bp, Homo sapiens
catgtagaagctgcatctt

SEQ ID NO: 2656291 - DNA, 19 bp, Homo sapiens
catgtagtatcaaatatta

SEQ ID NO: 2656292 - DNA, 22 bp, Homo sapiens
catgtagtatcaaatattagat

SEQ ID NO: 2656293 - DNA, 15 bp, Homo sapiens
catgtataatatttt

SEQ ID NO: 2656294 - DNA, 21 bp, Homo sapiens
catgtatcccaactcctataa

SEQ ID NO: 2656295 - DNA, 17 bp, Homo sapiens
catgtatgtcttggaca

SEQ ID NO: 2656296 - DNA, 14 bp, Homo sapiens
catgtattggcctg

SEQ ID NO: 2656297 - DNA, 15 bp, Homo sapiens
catgtattggcctgg

SEQ ID NO: 2656298 - DNA, 17 bp, Homo sapiens
catgtattggcctggag

SEQ ID NO: 2656299 - DNA, 18 bp, Homo sapiens
catgtattggcctggagg

SEQ ID NO: 2656300 - DNA, 23 bp, Homo sapiens
catgtatttatctctatttaata

SEQ ID NO: 2656301 - DNA, 13 bp, Homo sapiens
catgtcactgtgg

SEQ ID NO: 2656302 - DNA, 15 bp, Homo sapiens
catgtcactgtggtc

SEQ ID NO: 2656303 - DNA, 16 bp, Homo sapiens
catgtcaggcctgtgt

SEQ ID NO: 2656304 - DNA, 14 bp, Homo sapiens
catgtcctgtaaag

SEQ ID NO: 2656305 - DNA, 21 bp, Homo sapiens
catgtccttagcacagggggg

SEQ ID NO: 2656306 - DNA, 14 bp, Homo sapiens
catgtcgcctctgc

SEQ ID NO: 2656307 - DNA, 15 bp, Homo sapiens
catgtcgcctctgca

SEQ ID NO: 2656308 - DNA, 13 bp, Homo sapiens
catgtcggcctct

SEQ ID NO: 2656309 - DNA, 17 bp, Homo sapiens
catgtctattcagcttc

SEQ ID NO: 2656310 - DNA, 15 bp, Homo sapiens
catgtcttgtacatg

SEQ ID NO: 2656311 - DNA, 19 bp, Homo sapiens
catgtcttttcttgcatga

SEQ ID NO: 2656312 - DNA, 12 bp, Homo sapiens
catgtgaaacct

SEQ ID NO: 2656313 - DNA, 18 bp, Homo sapiens
catgtgaaacctttttta

SEQ ID NO: 2656314 - DNA, 22 bp, Homo sapiens
catgtgaaaccttttttaagat

SEQ ID NO: 2656315 - DNA, 12 bp, Homo sapiens
catgtgacacat

SEQ ID NO: 2656316 - DNA, 13 bp, Homo sapiens
catgtgactctga

SEQ ID NO: 2656317 - DNA, 16 bp, Homo sapiens
catgtgactctgaagc

SEQ ID NO: 2656318 - DNA, 19 bp, Homo sapiens
catgtgatccttttatgtt

SEQ ID NO: 2656319 - DNA, 14 bp, Homo sapiens
catgtgcacatgca

SEQ ID NO: 2656320 - DNA, 15 bp, Homo sapiens
catgtgcacatgcac

SEQ ID NO: 2656321 - DNA, 21 bp, Homo sapiens
catgtgccaggtttttggtct

SEQ ID NO: 2656322 - DNA, 19 bp, Homo sapiens
catgtgcctgatccagcct

SEQ ID NO: 2656323 - DNA, 20 bp, Homo sapiens
catgtgcctgatccagcctc

SEQ ID NO: 2656324 - DNA, 16 bp, Homo sapiens
catgtggaaagtgaat

SEQ ID NO: 2656325 - DNA, 17 bp, Homo sapiens
catgtggaatataaaga

SEQ ID NO: 2656326 - DNA, 12 bp, Homo sapiens
catgtggtggga

SEQ ID NO: 2656327 - DNA, 17 bp, Homo sapiens
catgtggttaatgccat

SEQ ID NO: 2656328 - DNA, 22 bp, Homo sapiens
catgtggttaatgccatggaca

SEQ ID NO: 2656329 - DNA, 20 bp, Homo sapiens
catgtggtttatagagggcc

SEQ ID NO: 2656330 - DNA, 20 bp, Homo sapiens
catgtgtacttaatttcttt

SEQ ID NO: 2656331 - DNA, 14 bp, Homo sapiens
catgtgtagcctgt

SEQ ID NO: 2656332 - DNA, 18 bp, Homo sapiens
catgtgtagcctgtgcat

SEQ ID NO: 2656333 - DNA, 18 bp, Homo sapiens
catgtgtatgggcaaaaa

SEQ ID NO: 2656334 - DNA, 12 bp, Homo sapiens
catgtgtatgtt

SEQ ID NO: 2656335 - DNA, 15 bp, Homo sapiens
catgtgtcctggttc

SEQ ID NO: 2656336 - DNA, 15 bp, Homo sapiens
catgtgtgagtgtgt

SEQ ID NO: 2656337 - DNA, 13 bp, Homo sapiens
catgtgtgcgtgt

SEQ ID NO: 2656338 - DNA, 20 bp, Homo sapiens
catgtgtgctcttcttcttt

SEQ ID NO: 2656339 - DNA, 14 bp, Homo sapiens
catgtgtggactca

SEQ ID NO: 2656340 - DNA, 12 bp, Homo sapiens
catgtgtgtcca

SEQ ID NO: 2656341 - DNA, 16 bp, Homo sapiens
catgtgttaagtattt

SEQ ID NO: 2656342 - DNA, 17 bp, Homo sapiens
catgttacataagataa

SEQ ID NO: 2656343 - DNA, 17 bp, Homo sapiens
catgttactgaccagca

SEQ ID NO: 2656344 - DNA, 20 bp, Homo sapiens
catgttcacaccgctgcact

SEQ ID NO: 2656345 - DNA, 16 bp, Homo sapiens
catgttccactaaccc

SEQ ID NO: 2656346 - DNA, 12 bp, Homo sapiens
catgttccttca

SEQ ID NO: 2656347 - DNA, 14 bp, Homo sapiens
catgttccttcaag

SEQ ID NO: 2656348 - DNA, 16 bp, Homo sapiens
catgttccttcaagat

SEQ ID NO: 2656349 - DNA, 20 bp, Homo sapiens
catgttccttcaagatcatg

SEQ ID NO: 2656350 - DNA, 23 bp, Homo sapiens
catgttccttcaagatcatgtac

SEQ ID NO: 2656351 - DNA, 14 bp, Homo sapiens
catgttctgctttc

SEQ ID NO: 2656352 - DNA, 13 bp, Homo sapiens
catgttcttaatt

SEQ ID NO: 2656353 - DNA, 18 bp, Homo sapiens
catgttcttaattcttag

SEQ ID NO: 2656354 - DNA, 13 bp, Homo sapiens
catgttggccagg

SEQ ID NO: 2656355 - DNA, 16 bp, Homo sapiens
catgttggccaggctg

SEQ ID NO: 2656356 - DNA, 19 bp, Homo sapiens
catgttggccaggctggtc

SEQ ID NO: 2656357 - DNA, 23 bp, Homo sapiens
catgtttgatgtatctgagcagg

SEQ ID NO: 2656358 - DNA, 12 bp, Homo sapiens
catgtttgtgat

SEQ ID NO: 2656359 - DNA, 20 bp, Homo sapiens
catgttttaacaaaaaccaa

SEQ ID NO: 2656360 - DNA, 18 bp, Homo sapiens
catgttttccagctcctc

SEQ ID NO: 2656361 - DNA, 21 bp, Homo sapiens
catgttttctgaaaatataac

SEQ ID NO: 2656362 - DNA, 17 bp, Homo sapiens
catgttttgataaagta

SEQ ID NO: 2656363 - DNA, 14 bp, Homo sapiens
catgttttgtgact

SEQ ID NO: 2656364 - DNA, 12 bp, Homo sapiens
cattaaaagaaa

SEQ ID NO: 2656365 - DNA, 17 bp, Homo sapiens
cattaaaagaaaataaa

SEQ ID NO: 2656366 - DNA, 21 bp, Homo sapiens
cattaaagcctgagtttgctt

SEQ ID NO: 2656367 - DNA, 20 bp, Homo sapiens
cattaacagttttccatgaa

SEQ ID NO: 2656368 - DNA, 22 bp, Homo sapiens
cattaacagttttccatgaaaa

SEQ ID NO: 2656369 - DNA, 16 bp, Homo sapiens
cattaactaatctatt

SEQ ID NO: 2656370 - DNA, 18 bp, Homo sapiens
cattaatcaatcatctgt

SEQ ID NO: 2656371 - DNA, 13 bp, Homo sapiens
cattaatgttaat

SEQ ID NO: 2656372 - DNA, 23 bp, Homo sapiens
cattaatgttaattcagcactga

SEQ ID NO: 2656373 - DNA, 13 bp, Homo sapiens
cattacagagagg

SEQ ID NO: 2656374 - DNA, 18 bp, Homo sapiens
cattacagagaggagaaa

SEQ ID NO: 2656375 - DNA, 20 bp, Homo sapiens
cattacagagaggagaaaca

SEQ ID NO: 2656376 - DNA, 13 bp, Homo sapiens
ccaccatcaagcc

SEQ ID NO: 2656377 - DNA, 18 bp, Homo sapiens
ccaccatcaccagacagg

SEQ ID NO: 2656378 - DNA, 16 bp, Homo sapiens
ccaccatgccaggcta

SEQ ID NO: 2656379 - DNA, 16 bp, Homo sapiens
ccacccaagggcctgg

SEQ ID NO: 2656380 - DNA, 19 bp, Homo sapiens
ccacccaagggcctggcct

SEQ ID NO: 2656381 - DNA, 20 bp, Homo sapiens
ccacccaagggcctggcctg

SEQ ID NO: 2656382 - DNA, 21 bp, Homo sapiens
ccacccaagggcctggcctga

SEQ ID NO: 2656383 - DNA, 12 bp, Homo sapiens
ccacccaggagg

SEQ ID NO: 2656384 - DNA, 15 bp, Homo sapiens
ccaccccacacacgc

SEQ ID NO: 2656385 - DNA, 23 bp, Homo sapiens
ccaccccatgtcaccggatcctg

SEQ ID NO: 2656386 - DNA, 14 bp, Homo sapiens
ccacccccacacct

SEQ ID NO: 2656387 - DNA, 18 bp, Homo sapiens
ccaccccccactctgtgc

SEQ ID NO: 2656388 - DNA, 12 bp, Homo sapiens
ccaccccctcaa

SEQ ID NO: 2656389 - DNA, 18 bp, Homo sapiens
ccacccccttctctgctc

SEQ ID NO: 2656390 - DNA, 16 bp, Homo sapiens
ccaccccgcctgccct

SEQ ID NO: 2656391 - DNA, 20 bp, Homo sapiens
ccaccccgggctctctgctg

SEQ ID NO: 2656392 - DNA, 19 bp, Homo sapiens
ccacccctcaacacctctg

SEQ ID NO: 2656393 - DNA, 14 bp, Homo sapiens
ccacccctccccat

SEQ ID NO: 2656394 - DNA, 16 bp, Homo sapiens
ccacccctgcctccac

SEQ ID NO: 2656395 - DNA, 18 bp, Homo sapiens
ccacccctgcctccaccc

SEQ ID NO: 2656396 - DNA, 15 bp, Homo sapiens
ccaccccttcctgtc

SEQ ID NO: 2656397 - DNA, 20 bp, Homo sapiens
ccaccccttgctctcaaccc

SEQ ID NO: 2656398 - DNA, 13 bp, Homo sapiens
ccacccgatgctg

SEQ ID NO: 2656399 - DNA, 21 bp, Homo sapiens
ccacccgttctgctggcctgg

SEQ ID NO: 2656400 - DNA, 22 bp, Homo sapiens
ccacccgttctgctggcctgga

SEQ ID NO: 2656401 - DNA, 19 bp, Homo sapiens
ccaccctcagcaccccttc

SEQ ID NO: 2656402 - DNA, 21 bp, Homo sapiens
ccaccctcccctctcttgcac

SEQ ID NO: 2656403 - DNA, 23 bp, Homo sapiens
ccaccctctgagctttgcatgtt

SEQ ID NO: 2656404 - DNA, 16 bp, Homo sapiens
ccaccctgaaagccct

SEQ ID NO: 2656405 - DNA, 18 bp, Homo sapiens
ccaccctgaaagccctga

SEQ ID NO: 2656406 - DNA, 12 bp, Homo sapiens
ccaccctgctct

SEQ ID NO: 2656407 - DNA, 12 bp, Homo sapiens
ccaccctgggac

SEQ ID NO: 2656408 - DNA, 13 bp, Homo sapiens
ccaccctgggacc

SEQ ID NO: 2656409 - DNA, 16 bp, Homo sapiens
ccaccctgggctctgg

SEQ ID NO: 2656410 - DNA, 18 bp, Homo sapiens
ccaccctgtcccccagct

SEQ ID NO: 2656411 - DNA, 19 bp, Homo sapiens
ccaccctgtcccccagctc

SEQ ID NO: 2656412 - DNA, 20 bp, Homo sapiens
ccacccttggaggctgtctt

SEQ ID NO: 2656413 - DNA, 12 bp, Homo sapiens
ccacccttggcc

SEQ ID NO: 2656414 - DNA, 14 bp, Homo sapiens
ccacccttggcctg

SEQ ID NO: 2656415 - DNA, 16 bp, Homo sapiens
ccacccttggcctgtc

SEQ ID NO: 2656416 - DNA, 22 bp, Homo sapiens
ccaccgaagtggactggcccct

SEQ ID NO: 2656417 - DNA, 17 bp, Homo sapiens
ccaccgcagacaggacc

SEQ ID NO: 2656418 - DNA, 17 bp, Homo sapiens
ccaccgctccccagccc

SEQ ID NO: 2656419 - DNA, 15 bp, Homo sapiens
ccaccgtccgccctg

SEQ ID NO: 2656420 - DNA, 20 bp, Homo sapiens
ccaccgtccgccctgctcct

SEQ ID NO: 2656421 - DNA, 21 bp, Homo sapiens
ccacctatctcgtgggagagc

SEQ ID NO: 2656422 - DNA, 14 bp, Homo sapiens
ccacctcagcctcc

SEQ ID NO: 2656423 - DNA, 15 bp, Homo sapiens
ccacctcagcctccc

SEQ ID NO: 2656424 - DNA, 13 bp, Homo sapiens
ccacctccagaaa

SEQ ID NO: 2656425 - DNA, 12 bp, Homo sapiens
ccacctccttct

SEQ ID NO: 2656426 - DNA, 17 bp, Homo sapiens
ccacctccttctctgtc

SEQ ID NO: 2656427 - DNA, 13 bp, Homo sapiens
ccacctctccaag

SEQ ID NO: 2656428 - DNA, 14 bp, Homo sapiens
ccacctctccaagg

SEQ ID NO: 2656429 - DNA, 24 bp, Homo sapiens
ccacctctctcctttgctgaggcc

SEQ ID NO: 2656430 - DNA, 18 bp, Homo sapiens
ccacctcttctcttcctg

SEQ ID NO: 2656431 - DNA, 20 bp, Homo sapiens
ccacctcttctcttcctgta

SEQ ID NO: 2656432 - DNA, 14 bp, Homo sapiens
ccacctgaggtggg

SEQ ID NO: 2656433 - DNA, 15 bp, Homo sapiens
ccacctgaggtgggc

SEQ ID NO: 2656434 - DNA, 16 bp, Homo sapiens
ccacctgaggtgggcc

SEQ ID NO: 2656435 - DNA, 21 bp, Homo sapiens
ccacctgaggtgggcccagga

SEQ ID NO: 2656436 - DNA, 14 bp, Homo sapiens
ccacctgcccatca

SEQ ID NO: 2656437 - DNA, 16 bp, Homo sapiens
ccacctgcccatcaca

SEQ ID NO: 2656438 - DNA, 12 bp, Homo sapiens
ccacctgccccc

SEQ ID NO: 2656439 - DNA, 18 bp, Homo sapiens
ccacctgcccccttctcc

SEQ ID NO: 2656440 - DNA, 20 bp, Homo sapiens
ccacctgcccccttctccca

SEQ ID NO: 2656441 - DNA, 21 bp, Homo sapiens
ccacctgcccccttctcccac

SEQ ID NO: 2656442 - DNA, 13 bp, Homo sapiens
ccacctggcctct

SEQ ID NO: 2656443 - DNA, 18 bp, Homo sapiens
ccacctggcctctgcact

SEQ ID NO: 2656444 - DNA, 20 bp, Homo sapiens
ccacctggcctctgcactcc

SEQ ID NO: 2656445 - DNA, 22 bp, Homo sapiens
ccacctgggcatatccaccacc

SEQ ID NO: 2656446 - DNA, 20 bp, Homo sapiens
ccacctgtcaaacaaagcca

SEQ ID NO: 2656447 - DNA, 12 bp, Homo sapiens
ccacctgtctca

SEQ ID NO: 2656448 - DNA, 16 bp, Homo sapiens
ccacctgtctcagcct

SEQ ID NO: 2656449 - DNA, 18 bp, Homo sapiens
ccacctgtctcagcctcc

SEQ ID NO: 2656450 - DNA, 23 bp, Homo sapiens
ccacctgtctcagcctcccagag

SEQ ID NO: 2656451 - DNA, 19 bp, Homo sapiens
ccaccttcaattcctgggc

SEQ ID NO: 2656452 - DNA, 13 bp, Homo sapiens
ccaccttggctca

SEQ ID NO: 2656453 - DNA, 15 bp, Homo sapiens
ccaccttggctcaag

SEQ ID NO: 2656454 - DNA, 16 bp, Homo sapiens
ccaccttggctcaagt

SEQ ID NO: 2656455 - DNA, 14 bp, Homo sapiens
ccaccttggctgca

SEQ ID NO: 2656456 - DNA, 16 bp, Homo sapiens
ccaccttggctgcagg

SEQ ID NO: 2656457 - DNA, 21 bp, Homo sapiens
ccaccttgttggagcctgcag

SEQ ID NO: 2656458 - DNA, 22 bp, Homo sapiens
ccaccttgttggagcctgcagg

SEQ ID NO: 2656459 - DNA, 23 bp, Homo sapiens
ccacctttcagataactgttatt

SEQ ID NO: 2656460 - DNA, 14 bp, Homo sapiens
ccacgactgtctcc

SEQ ID NO: 2656461 - DNA, 16 bp, Homo sapiens
ccacgagggtcaggac

SEQ ID NO: 2656462 - DNA, 17 bp, Homo sapiens
ccacgcccccactggtg

SEQ ID NO: 2656463 - DNA, 21 bp, Homo sapiens
ccacggagccactcctctgac

SEQ ID NO: 2656464 - DNA, 13 bp, Homo sapiens
ccacggccactgg

SEQ ID NO: 2656465 - DNA, 12 bp, Homo sapiens
ccacggccaggc

SEQ ID NO: 2656466 - DNA, 18 bp, Homo sapiens
ccacggccgctccagggg

SEQ ID NO: 2656467 - DNA, 17 bp, Homo sapiens
ccacggtctgttcttga

SEQ ID NO: 2656468 - DNA, 22 bp, Homo sapiens
ccacgtctgcgccgccgccgga

SEQ ID NO: 2656469 - DNA, 23 bp, Homo sapiens
ccacgttctgctcatcattctct

SEQ ID NO: 2656470 - DNA, 13 bp, Homo sapiens
ccacgtttctaaa

SEQ ID NO: 2656471 - DNA, 22 bp, Homo sapiens
ccactaaaagatcgcagtttgc

SEQ ID NO: 2656472 - DNA, 19 bp, Homo sapiens
ccactacactccagcctga

SEQ ID NO: 2656473 - DNA, 20 bp, Homo sapiens
ccactacactccagcctgag

SEQ ID NO: 2656474 - DNA, 22 bp, Homo sapiens
ccactacactccagcctgagca

SEQ ID NO: 2656475 - DNA, 22 bp, Homo sapiens
ccactacatgcagcccatgccc

SEQ ID NO: 2656476 - DNA, 14 bp, Homo sapiens
ccactacattctgt

SEQ ID NO: 2656477 - DNA, 17 bp, Homo sapiens
ccactacattctgttaa

SEQ ID NO: 2656478 - DNA, 16 bp, Homo sapiens
ccactaggactctgag

SEQ ID NO: 2656479 - DNA, 19 bp, Homo sapiens
ccactaggactctgaggct

SEQ ID NO: 2656480 - DNA, 18 bp, Homo sapiens
ccactcaagccaagcagc

SEQ ID NO: 2656481 - DNA, 18 bp, Homo sapiens
ccactcacacagccaggt

SEQ ID NO: 2656482 - DNA, 13 bp, Homo sapiens
ccactcaccccgg

SEQ ID NO: 2656483 - DNA, 13 bp, Homo sapiens
ccactcagcttcc

SEQ ID NO: 2656484 - DNA, 20 bp, Homo sapiens
ccactcaggccaacaagcca

SEQ ID NO: 2656485 - DNA, 13 bp, Homo sapiens
ccactcccaggca

SEQ ID NO: 2656486 - DNA, 15 bp, Homo sapiens
ccactcccaggcagc

SEQ ID NO: 2656487 - DNA, 15 bp, Homo sapiens
ccactccctgcaacc

SEQ ID NO: 2656488 - DNA, 17 bp, Homo sapiens
ccactccctgcaacctg

SEQ ID NO: 2656489 - DNA, 13 bp, Homo sapiens
ccactcctctgac

SEQ ID NO: 2656490 - DNA, 16 bp, Homo sapiens
ccactctaccctccca

SEQ ID NO: 2656491 - DNA, 22 bp, Homo sapiens
ccactctaggggtcaggctcca

SEQ ID NO: 2656492 - DNA, 21 bp, Homo sapiens
ccactctccttgctacccaga

SEQ ID NO: 2656493 - DNA, 16 bp, Homo sapiens
ccactgaagctgggat

SEQ ID NO: 2656494 - DNA, 15 bp, Homo sapiens
ccactgacagcctcc

SEQ ID NO: 2656495 - DNA, 13 bp, Homo sapiens
ccactgcacacac

SEQ ID NO: 2656496 - DNA, 18 bp, Homo sapiens
ccactgcacacacctcag

SEQ ID NO: 2656497 - DNA, 23 bp, Homo sapiens
ccactgcacagagctctccagct

SEQ ID NO: 2656498 - DNA, 18 bp, Homo sapiens
ccactgcaccccgtctca

SEQ ID NO: 2656499 - DNA, 14 bp, Homo sapiens
ccactgcactccag

SEQ ID NO: 2656500 - DNA, 19 bp, Homo sapiens
ccactgcccaccccctcaa

SEQ ID NO: 2656501 - DNA, 15 bp, Homo sapiens
ccactgcccgagctg

SEQ ID NO: 2656502 - DNA, 17 bp, Homo sapiens
ccactgcccgagctggt

SEQ ID NO: 2656503 - DNA, 18 bp, Homo sapiens
ccactgcccgagctggtg

SEQ ID NO: 2656504 - DNA, 22 bp, Homo sapiens
ccactgcccgagctggtgcatt

SEQ ID NO: 2656505 - DNA, 16 bp, Homo sapiens
ccactgcctactgcat

SEQ ID NO: 2656506 - DNA, 16 bp, Homo sapiens
ccactgcctcttcctc

SEQ ID NO: 2656507 - DNA, 11 bp, Homo sapiens
ccactgcctgc

SEQ ID NO: 2656508 - DNA, 16 bp, Homo sapiens
ccactgcctgcccacc

SEQ ID NO: 2656509 - DNA, 17 bp, Homo sapiens
ccactgcctgcccaccc

SEQ ID NO: 2656510 - DNA, 23 bp, Homo sapiens
ccactgcctgcccacccgtggag

SEQ ID NO: 2656511 - DNA, 13 bp, Homo sapiens
ccactgctctggt

SEQ ID NO: 2656512 - DNA, 16 bp, Homo sapiens
ccactgctgcttctcc

SEQ ID NO: 2656513 - DNA, 20 bp, Homo sapiens
ccactggacttgagcttggc

SEQ ID NO: 2656514 - DNA, 22 bp, Homo sapiens
ccactggacttgagcttggcag

SEQ ID NO: 2656515 - DNA, 12 bp, Homo sapiens
ccactggccacc

SEQ ID NO: 2656516 - DNA, 16 bp, Homo sapiens
ccactggccaccaggc

SEQ ID NO: 2656517 - DNA, 11 bp, Homo sapiens
ccactggggaa

SEQ ID NO: 2656518 - DNA, 12 bp, Homo sapiens
ccactggggaaa

SEQ ID NO: 2656519 - DNA, 22 bp, Homo sapiens
ccactgtcactgtttctctgct

SEQ ID NO: 2656520 - DNA, 15 bp, Homo sapiens
ccactgtcctgggcg

SEQ ID NO: 2656521 - DNA, 16 bp, Homo sapiens
ccaggggtctccctgg

SEQ ID NO: 2656522 - DNA, 19 bp, Homo sapiens
ccaggggtctccctggagt

SEQ ID NO: 2656523 - DNA, 14 bp, Homo sapiens
ccaggggtgggaca

SEQ ID NO: 2656524 - DNA, 23 bp, Homo sapiens
ccaggggtgggacaccctgtgat

SEQ ID NO: 2656525 - DNA, 20 bp, Homo sapiens
ccagggtagcccgcctgcca

SEQ ID NO: 2656526 - DNA, 17 bp, Homo sapiens
ccagggtcactgaaggc

SEQ ID NO: 2656527 - DNA, 13 bp, Homo sapiens
ccagggtccctgg

SEQ ID NO: 2656528 - DNA, 16 bp, Homo sapiens
ccagggtgagagctgc

SEQ ID NO: 2656529 - DNA, 17 bp, Homo sapiens
ccagggtgagagctgct

SEQ ID NO: 2656530 - DNA, 21 bp, Homo sapiens
ccagggttcccccagccctgt

SEQ ID NO: 2656531 - DNA, 22 bp, Homo sapiens
ccagggttcccccagccctgtg

SEQ ID NO: 2656532 - DNA, 16 bp, Homo sapiens
ccagggttgaccccag

SEQ ID NO: 2656533 - DNA, 22 bp, Homo sapiens
ccagggttgatcacactctggg

SEQ ID NO: 2656534 - DNA, 23 bp, Homo sapiens
ccaggtctcacgggcatgggcac

SEQ ID NO: 2656535 - DNA, 20 bp, Homo sapiens
ccaggtcttggagctgagcc

SEQ ID NO: 2656536 - DNA, 23 bp, Homo sapiens
ccaggtcttggagctgagcctct

SEQ ID NO: 2656537 - DNA, 19 bp, Homo sapiens
ccaggtgcacaagctccaa

SEQ ID NO: 2656538 - DNA, 12 bp, Homo sapiens
ccaggtgccttg

SEQ ID NO: 2656539 - DNA, 22 bp, Homo sapiens
ccaggtgctacacccttttcca

SEQ ID NO: 2656540 - DNA, 23 bp, Homo sapiens
ccaggtgtgcacgtggcatgtgg

SEQ ID NO: 2656541 - DNA, 16 bp, Homo sapiens
ccaggttctatttgga

SEQ ID NO: 2656542 - DNA, 15 bp, Homo sapiens
ccaggtttttcaatt

SEQ ID NO: 2656543 - DNA, 20 bp, Homo sapiens
ccaggtttttcaattaaacg

SEQ ID NO: 2656544 - DNA, 17 bp, Homo sapiens
ccaggtttttggtctga

SEQ ID NO: 2656545 - DNA, 17 bp, Homo sapiens
ccagtaaacagaggagt

SEQ ID NO: 2656546 - DNA, 20 bp, Homo sapiens
ccagtaaatgggggtgcatt

SEQ ID NO: 2656547 - DNA, 23 bp, Homo sapiens
ccagtaaatgggggtgcatttga

SEQ ID NO: 2656548 - DNA, 20 bp, Homo sapiens
ccagtacctcctgtctctgg

SEQ ID NO: 2656549 - DNA, 17 bp, Homo sapiens
ccagtacctttgtcaca

SEQ ID NO: 2656550 - DNA, 21 bp, Homo sapiens
ccagtagcttgggacaaatca

SEQ ID NO: 2656551 - DNA, 12 bp, Homo sapiens
ccagtcaccccg

SEQ ID NO: 2656552 - DNA, 13 bp, Homo sapiens
ccagtcaccccgg

SEQ ID NO: 2656553 - DNA, 12 bp, Homo sapiens
ccagtcagcctc

SEQ ID NO: 2656554 - DNA, 21 bp, Homo sapiens
ccagtccaaatgtcctccaga

SEQ ID NO: 2656555 - DNA, 14 bp, Homo sapiens
ccagtcccaggggc

SEQ ID NO: 2656556 - DNA, 16 bp, Homo sapiens
ccagtcctgcctggcc

SEQ ID NO: 2656557 - DNA, 18 bp, Homo sapiens
ccagtcctgcctggccag

SEQ ID NO: 2656558 - DNA, 22 bp, Homo sapiens
ccagtcctgcctggccaggcag

SEQ ID NO: 2656559 - DNA, 18 bp, Homo sapiens
ccagtcgatatctcactt

SEQ ID NO: 2656560 - DNA, 16 bp, Homo sapiens
ccagtctacccagaga

SEQ ID NO: 2656561 - DNA, 23 bp, Homo sapiens
ccagtctgctgccctccatcccg

SEQ ID NO: 2656562 - DNA, 19 bp, Homo sapiens
ccagtctggaatgcagtgg

SEQ ID NO: 2656563 - DNA, 20 bp, Homo sapiens
ccagtgacctgctgggtaaa

SEQ ID NO: 2656564 - DNA, 22 bp, Homo sapiens
ccagtgacctgctgggtaaact

SEQ ID NO: 2656565 - DNA, 12 bp, Homo sapiens
ccagtgactcca

SEQ ID NO: 2656566 - DNA, 15 bp, Homo sapiens
ccagtgactccagga

SEQ ID NO: 2656567 - DNA, 17 bp, Homo sapiens
ccagtgactttttctaa

SEQ ID NO: 2656568 - DNA, 19 bp, Homo sapiens
ccagtgagcactcccaagt

SEQ ID NO: 2656569 - DNA, 20 bp, Homo sapiens
ccagtgaggctctgcccttg

SEQ ID NO: 2656570 - DNA, 21 bp, Homo sapiens
ccagtgatgctaaaggttgta

SEQ ID NO: 2656571 - DNA, 15 bp, Homo sapiens
ccagtgcaacagcac

SEQ ID NO: 2656572 - DNA, 23 bp, Homo sapiens
ccagtgcccacaggatcagtctg

SEQ ID NO: 2656573 - DNA, 16 bp, Homo sapiens
ccagtgcgattctgga

SEQ ID NO: 2656574 - DNA, 16 bp, Homo sapiens
ccagtggctgctgccc

SEQ ID NO: 2656575 - DNA, 11 bp, Homo sapiens
ccagtgggagg

SEQ ID NO: 2656576 - DNA, 19 bp, Homo sapiens
ccagtgggaggggcaggct

SEQ ID NO: 2656577 - DNA, 21 bp, Homo sapiens
ccagtgggaggggcaggctga

SEQ ID NO: 2656578 - DNA, 22 bp, Homo sapiens
ccagtgtcaagttgtgcttgtt

SEQ ID NO: 2656579 - DNA, 15 bp, Homo sapiens
ccagtgtctgtcccg

SEQ ID NO: 2656580 - DNA, 12 bp, Homo sapiens
ccagtgtggaac

SEQ ID NO: 2656581 - DNA, 17 bp, Homo sapiens
ccagttatgtgaatgat

SEQ ID NO: 2656582 - DNA, 21 bp, Homo sapiens
ccagttcaggagtcccaagga

SEQ ID NO: 2656583 - DNA, 20 bp, Homo sapiens
ccagttcagtacctggagga

SEQ ID NO: 2656584 - DNA, 21 bp, Homo sapiens
ccagttcctttcaatggtttg

SEQ ID NO: 2656585 - DNA, 14 bp, Homo sapiens
ccagttctgctcct

SEQ ID NO: 2656586 - DNA, 18 bp, Homo sapiens
ccagttgatcaatgaata

SEQ ID NO: 2656587 - DNA, 20 bp, Homo sapiens
ccagttgggagcactggagt

SEQ ID NO: 2656588 - DNA, 18 bp, Homo sapiens
ccagttggtcccccttcc

SEQ ID NO: 2656589 - DNA, 17 bp, Homo sapiens
ccagtttaacctgatgc

SEQ ID NO: 2656590 - DNA, 15 bp, Homo sapiens
ccagtttctgcctct

SEQ ID NO: 2656591 - DNA, 22 bp, Homo sapiens
ccataaacacccatgaatcaaa

SEQ ID NO: 2656592 - DNA, 16 bp, Homo sapiens
ccataaccgctgattc

SEQ ID NO: 2656593 - DNA, 13 bp, Homo sapiens
ccatacagctcta

SEQ ID NO: 2656594 - DNA, 22 bp, Homo sapiens
ccataccacccaatgctgatgt

SEQ ID NO: 2656595 - DNA, 17 bp, Homo sapiens
ccatagagtttaacaca

SEQ ID NO: 2656596 - DNA, 21 bp, Homo sapiens
ccatagatgggtctggctgag

SEQ ID NO: 2656597 - DNA, 16 bp, Homo sapiens
ccatagctcctgctcc

SEQ ID NO: 2656598 - DNA, 16 bp, Homo sapiens
ccatataagtttgaag

SEQ ID NO: 2656599 - DNA, 19 bp, Homo sapiens
ccatataagtttgaaggaa

SEQ ID NO: 2656600 - DNA, 12 bp, Homo sapiens
ccatatgtgctt

SEQ ID NO: 2656601 - DNA, 19 bp, Homo sapiens
ccatattaccacagacata

SEQ ID NO: 2656602 - DNA, 22 bp, Homo sapiens
ccatattcagtgctgtggcctg

SEQ ID NO: 2656603 - DNA, 23 bp, Homo sapiens
ccatattctgttggccagtgtga

SEQ ID NO: 2656604 - DNA, 13 bp, Homo sapiens
ccatcaagccacc

SEQ ID NO: 2656605 - DNA, 15 bp, Homo sapiens
ccatcacatgaccac

SEQ ID NO: 2656606 - DNA, 12 bp, Homo sapiens
ccatcagtgctc

SEQ ID NO: 2656607 - DNA, 15 bp, Homo sapiens
ccatcataggaaggg

SEQ ID NO: 2656608 - DNA, 16 bp, Homo sapiens
ccatcatcccagctgc

SEQ ID NO: 2656609 - DNA, 13 bp, Homo sapiens
ccatcatctcctg

SEQ ID NO: 2656610 - DNA, 22 bp, Homo sapiens
ccatcatgtttacagaggacag

SEQ ID NO: 2656611 - DNA, 19 bp, Homo sapiens
ccatccagtgtctcacagc

SEQ ID NO: 2656612 - DNA, 14 bp, Homo sapiens
ccatcccagcccca

SEQ ID NO: 2656613 - DNA, 17 bp, Homo sapiens
ccatccccatcctccag

SEQ ID NO: 2656614 - DNA, 19 bp, Homo sapiens
ccatccccctgccctcgtg

SEQ ID NO: 2656615 - DNA, 15 bp, Homo sapiens
ccatccctgaaggcc

SEQ ID NO: 2656616 - DNA, 22 bp, Homo sapiens
ccatcctaatcatccaatgctc

SEQ ID NO: 2656617 - DNA, 23 bp, Homo sapiens
ccatcctaatcatccaatgctca

SEQ ID NO: 2656618 - DNA, 15 bp, Homo sapiens
ccatcctaccaatgc

SEQ ID NO: 2656619 - DNA, 20 bp, Homo sapiens
ccatcctaccaatgcatgca

SEQ ID NO: 2656620 - DNA, 18 bp, Homo sapiens
ccatcctaccctcgggcc

SEQ ID NO: 2656621 - DNA, 23 bp, Homo sapiens
ccatcctaccctcgggcccacct

SEQ ID NO: 2656622 - DNA, 14 bp, Homo sapiens
ccatcctccagctt

SEQ ID NO: 2656623 - DNA, 14 bp, Homo sapiens
ccatcctccccttc

SEQ ID NO: 2656624 - DNA, 17 bp, Homo sapiens
ccatcctccccttccct

SEQ ID NO: 2656625 - DNA, 20 bp, Homo sapiens
ccatcctctgtacagagccc

SEQ ID NO: 2656626 - DNA, 16 bp, Homo sapiens
ccatcgctgtcatctc

SEQ ID NO: 2656627 - DNA, 20 bp, Homo sapiens
ccatctaaatacctgccctg

SEQ ID NO: 2656628 - DNA, 20 bp, Homo sapiens
ccatctatgtcccttgctgt

SEQ ID NO: 2656629 - DNA, 14 bp, Homo sapiens
ccatctcacacatg

SEQ ID NO: 2656630 - DNA, 15 bp, Homo sapiens
ccatctcacacatga

SEQ ID NO: 2656631 - DNA, 17 bp, Homo sapiens
ccatctcacacatgagc

SEQ ID NO: 2656632 - DNA, 20 bp, Homo sapiens
ccatctcaggccacctgccc

SEQ ID NO: 2656633 - DNA, 20 bp, Homo sapiens
ccatctcatgtatcatctgg

SEQ ID NO: 2656634 - DNA, 19 bp, Homo sapiens
ccatctccaagaatgctga

SEQ ID NO: 2656635 - DNA, 22 bp, Homo sapiens
ccatctcgccacccctccttcc

SEQ ID NO: 2656636 - DNA, 14 bp, Homo sapiens
ccatctctccctcc

SEQ ID NO: 2656637 - DNA, 13 bp, Homo sapiens
ccatctctctggc

SEQ ID NO: 2656638 - DNA, 18 bp, Homo sapiens
ccatctctggatgcctga

SEQ ID NO: 2656639 - DNA, 13 bp, Homo sapiens
ccatctcttccta

SEQ ID NO: 2656640 - DNA, 20 bp, Homo sapiens
ccatctgcacccccctgggc

SEQ ID NO: 2656641 - DNA, 12 bp, Homo sapiens
ccatctgcccag

SEQ ID NO: 2656642 - DNA, 13 bp, Homo sapiens
ccatctgcccagg

SEQ ID NO: 2656643 - DNA, 20 bp, Homo sapiens
ccatctgcccaggggtgccc

SEQ ID NO: 2656644 - DNA, 22 bp, Homo sapiens
ccatctgcccaggggtgccccc

SEQ ID NO: 2656645 - DNA, 22 bp, Homo sapiens
ccatctgcgtgacaataaaaca

SEQ ID NO: 2656646 - DNA, 23 bp, Homo sapiens
ccatctgcgtgacaataaaacat

SEQ ID NO: 2656647 - DNA, 12 bp, Homo sapiens
ccatctgtgaat

SEQ ID NO: 2656648 - DNA, 14 bp, Homo sapiens
ccatcttggtaaat

SEQ ID NO: 2656649 - DNA, 17 bp, Homo sapiens
ccatcttggtaaatttc

SEQ ID NO: 2656650 - DNA, 20 bp, Homo sapiens
ccatgaaaacgttttattgt

SEQ ID NO: 2656651 - DNA, 21 bp, Homo sapiens
ccatgaaaacgttttattgtg

SEQ ID NO: 2656652 - DNA, 23 bp, Homo sapiens
ccatgaaaacgttttattgtgtt

SEQ ID NO: 2656653 - DNA, 17 bp, Homo sapiens
ccatgaagacaggacag

SEQ ID NO: 2656654 - DNA, 19 bp, Homo sapiens
ccatgaagacaggacagtg

SEQ ID NO: 2656655 - DNA, 14 bp, Homo sapiens
ccatgaagatgtag

SEQ ID NO: 2656656 - DNA, 16 bp, Homo sapiens
ccatgaatcaaagaca

SEQ ID NO: 2656657 - DNA, 15 bp, Homo sapiens
ccatgaatcgcttct

SEQ ID NO: 2656658 - DNA, 18 bp, Homo sapiens
ccatgaatcgcttctctt

SEQ ID NO: 2656659 - DNA, 14 bp, Homo sapiens
ccatgaccatactg

SEQ ID NO: 2656660 - DNA, 12 bp, Homo sapiens
ccatgacccacc

SEQ ID NO: 2656661 - DNA, 17 bp, Homo sapiens
ccatgagaagagggcct

SEQ ID NO: 2656662 - DNA, 22 bp, Homo sapiens
ccatgagaataagagaaagaaa

SEQ ID NO: 2656663 - DNA, 21 bp, Homo sapiens
ccatgagcaccccaaggctgc

SEQ ID NO: 2656664 - DNA, 22 bp, Homo sapiens
ccatgagcaccccaaggctgcg

SEQ ID NO: 2656665 - DNA, 14 bp, Homo sapiens
ccccagctgggagg

SEQ ID NO: 2656666 - DNA, 13 bp, Homo sapiens
ccccaggaggcca

SEQ ID NO: 2656667 - DNA, 14 bp, Homo sapiens
ccccaggaggccag

SEQ ID NO: 2656668 - DNA, 12 bp, Homo sapiens
ccccaggccagg

SEQ ID NO: 2656669 - DNA, 13 bp, Homo sapiens
ccccaggccaggc

SEQ ID NO: 2656670 - DNA, 22 bp, Homo sapiens
ccccaggccaggccaccaggat

SEQ ID NO: 2656671 - DNA, 21 bp, Homo sapiens
ccccagggcacttcacagagt

SEQ ID NO: 2656672 - DNA, 17 bp, Homo sapiens
ccccaggggaaaatgaa

SEQ ID NO: 2656673 - DNA, 18 bp, Homo sapiens
ccccaggggaaaatgaag

SEQ ID NO: 2656674 - DNA, 20 bp, Homo sapiens
ccccaggggaaagatgagct

SEQ ID NO: 2656675 - DNA, 19 bp, Homo sapiens
ccccagggtcttccctacc

SEQ ID NO: 2656676 - DNA, 14 bp, Homo sapiens
ccccagtcagcctc

SEQ ID NO: 2656677 - DNA, 15 bp, Homo sapiens
ccccagtcagcctct

SEQ ID NO: 2656678 - DNA, 17 bp, Homo sapiens
ccccagtcagcctctct

SEQ ID NO: 2656679 - DNA, 20 bp, Homo sapiens
ccccagtgcccacaggatca

SEQ ID NO: 2656680 - DNA, 14 bp, Homo sapiens
ccccagttctgctc

SEQ ID NO: 2656681 - DNA, 22 bp, Homo sapiens
ccccataattttttttttcctt

SEQ ID NO: 2656682 - DNA, 14 bp, Homo sapiens
ccccatcagtgctc

SEQ ID NO: 2656683 - DNA, 20 bp, Homo sapiens
ccccatcagtgctccctcac

SEQ ID NO: 2656684 - DNA, 13 bp, Homo sapiens
ccccatcattcat

SEQ ID NO: 2656685 - DNA, 15 bp, Homo sapiens
ccccatcctccagct

SEQ ID NO: 2656686 - DNA, 18 bp, Homo sapiens
ccccatcctccccttccc

SEQ ID NO: 2656687 - DNA, 19 bp, Homo sapiens
ccccatcctctgtacagag

SEQ ID NO: 2656688 - DNA, 21 bp, Homo sapiens
ccccatcctctgtacagagcc

SEQ ID NO: 2656689 - DNA, 14 bp, Homo sapiens
ccccatctctacta

SEQ ID NO: 2656690 - DNA, 14 bp, Homo sapiens
ccccatctgggtcc

SEQ ID NO: 2656691 - DNA, 13 bp, Homo sapiens
ccccatctgtgaa

SEQ ID NO: 2656692 - DNA, 13 bp, Homo sapiens
ccccatgccaaag

SEQ ID NO: 2656693 - DNA, 12 bp, Homo sapiens
ccccatgcctgt

SEQ ID NO: 2656694 - DNA, 17 bp, Homo sapiens
ccccatgcctgtccagc

SEQ ID NO: 2656695 - DNA, 22 bp, Homo sapiens
ccccatgggaagacgaggccct

SEQ ID NO: 2656696 - DNA, 19 bp, Homo sapiens
ccccatggtcagccctagg

SEQ ID NO: 2656697 - DNA, 23 bp, Homo sapiens
ccccatgtgtcctggttcccgtt

SEQ ID NO: 2656698 - DNA, 17 bp, Homo sapiens
ccccattagagtcagcc

SEQ ID NO: 2656699 - DNA, 13 bp, Homo sapiens
ccccattctgcct

SEQ ID NO: 2656700 - DNA, 21 bp, Homo sapiens
ccccattcttcctagttttct

SEQ ID NO: 2656701 - DNA, 20 bp, Homo sapiens
cccccaacactgtgccctgg

SEQ ID NO: 2656702 - DNA, 21 bp, Homo sapiens
cccccaacactgtgccctggt

SEQ ID NO: 2656703 - DNA, 23 bp, Homo sapiens
cccccaacactgtgccctggtgg

SEQ ID NO: 2656704 - DNA, 23 bp, Homo sapiens
cccccaaccaagtggctcccaca

SEQ ID NO: 2656705 - DNA, 14 bp, Homo sapiens
cccccacacacaca

SEQ ID NO: 2656706 - DNA, 17 bp, Homo sapiens
cccccacacctcagttc

SEQ ID NO: 2656707 - DNA, 16 bp, Homo sapiens
cccccacagtgctgtc

SEQ ID NO: 2656708 - DNA, 22 bp, Homo sapiens
cccccaccacggccactggcca

SEQ ID NO: 2656709 - DNA, 15 bp, Homo sapiens
cccccaccccttccc

SEQ ID NO: 2656710 - DNA, 12 bp, Homo sapiens
cccccacccttt

SEQ ID NO: 2656711 - DNA, 17 bp, Homo sapiens
cccccactgcctttgac

SEQ ID NO: 2656712 - DNA, 22 bp, Homo sapiens
cccccagaacctgtccttgcac

SEQ ID NO: 2656713 - DNA, 12 bp, Homo sapiens
cccccagcccca

SEQ ID NO: 2656714 - DNA, 13 bp, Homo sapiens
cccccagccctgt

SEQ ID NO: 2656715 - DNA, 12 bp, Homo sapiens
cccccagcctgc

SEQ ID NO: 2656716 - DNA, 23 bp, Homo sapiens
cccccagctttgctaccaaagca

SEQ ID NO: 2656717 - DNA, 16 bp, Homo sapiens
cccccaggctgctgga

SEQ ID NO: 2656718 - DNA, 22 bp, Homo sapiens
cccccatccccatcctccagct

SEQ ID NO: 2656719 - DNA, 12 bp, Homo sapiens
ccccccagcctc

SEQ ID NO: 2656720 - DNA, 13 bp, Homo sapiens
ccccccagcctct

SEQ ID NO: 2656721 - DNA, 11 bp, Homo sapiens
cccccccctcc

SEQ ID NO: 2656722 - DNA, 12 bp, Homo sapiens
cccccctctgtc

SEQ ID NO: 2656723 - DNA, 11 bp, Homo sapiens
ccccccttcca

SEQ ID NO: 2656724 - DNA, 12 bp, Homo sapiens
ccccccttccac

SEQ ID NO: 2656725 - DNA, 14 bp, Homo sapiens
cccccgccccctgc

SEQ ID NO: 2656726 - DNA, 16 bp, Homo sapiens
cccccgccccctgccc

SEQ ID NO: 2656727 - DNA, 23 bp, Homo sapiens
cccccgctgtaatgaaacacctt

SEQ ID NO: 2656728 - DNA, 24 bp, Homo sapiens
cccccgggtttggcgggccaagga

SEQ ID NO: 2656729 - DNA, 19 bp, Homo sapiens
ccccctcaaacctcctctt

SEQ ID NO: 2656730 - DNA, 18 bp, Homo sapiens
ccccctccaatcctgccc

SEQ ID NO: 2656731 - DNA, 13 bp, Homo sapiens
ccccctcccaggg

SEQ ID NO: 2656732 - DNA, 13 bp, Homo sapiens
ccccctcctctct

SEQ ID NO: 2656733 - DNA, 15 bp, Homo sapiens
ccccctccttgctct

SEQ ID NO: 2656734 - DNA, 12 bp, Homo sapiens
ccccctctgtcc

SEQ ID NO: 2656735 - DNA, 21 bp, Homo sapiens
ccccctgccccccagcctctg

SEQ ID NO: 2656736 - DNA, 19 bp, Homo sapiens
ccccctgccctcgtggcca

SEQ ID NO: 2656737 - DNA, 22 bp, Homo sapiens
ccccctgccctcgtggccagcc

SEQ ID NO: 2656738 - DNA, 18 bp, Homo sapiens
ccccctgctggctcttct

SEQ ID NO: 2656739 - DNA, 10 bp, Homo sapiens
ccccctgggc

SEQ ID NO: 2656740 - DNA, 19 bp, Homo sapiens
ccccctggtggacagtcct

SEQ ID NO: 2656741 - DNA, 21 bp, Homo sapiens
ccccctgtgcagccgctgagc

SEQ ID NO: 2656742 - DNA, 14 bp, Homo sapiens
cccccttccatgga

SEQ ID NO: 2656743 - DNA, 17 bp, Homo sapiens
cccccttctctgctcca

SEQ ID NO: 2656744 - DNA, 18 bp, Homo sapiens
cccccttgccagacatgt

SEQ ID NO: 2656745 - DNA, 18 bp, Homo sapiens
ccccctttcagatgtctt

SEQ ID NO: 2656746 - DNA, 18 bp, Homo sapiens
ccccctttgggcccaggg

SEQ ID NO: 2656747 - DNA, 17 bp, Homo sapiens
ccccgaggacccagacc

SEQ ID NO: 2656748 - DNA, 17 bp, Homo sapiens
ccccgcccagctgcacc

SEQ ID NO: 2656749 - DNA, 23 bp, Homo sapiens
ccccgcccagctgcacctgccag

SEQ ID NO: 2656750 - DNA, 14 bp, Homo sapiens
ccccgcccaggctt

SEQ ID NO: 2656751 - DNA, 16 bp, Homo sapiens
ccccgccccacattcc

SEQ ID NO: 2656752 - DNA, 16 bp, Homo sapiens
ccccggccccagccag

SEQ ID NO: 2656753 - DNA, 12 bp, Homo sapiens
ccccggccccct

SEQ ID NO: 2656754 - DNA, 13 bp, Homo sapiens
ccccggccccctg

SEQ ID NO: 2656755 - DNA, 13 bp, Homo sapiens
ccccggccctggg

SEQ ID NO: 2656756 - DNA, 15 bp, Homo sapiens
ccccggcggcgccgg

SEQ ID NO: 2656757 - DNA, 15 bp, Homo sapiens
ccccgggctctctgc

SEQ ID NO: 2656758 - DNA, 18 bp, Homo sapiens
ccccgggtttggcgggcc

SEQ ID NO: 2656759 - DNA, 23 bp, Homo sapiens
ccccgggtttggcgggccaagga

SEQ ID NO: 2656760 - DNA, 16 bp, Homo sapiens
ccccgtcacagcctca

SEQ ID NO: 2656761 - DNA, 14 bp, Homo sapiens
ccccgtctgtggct

SEQ ID NO: 2656762 - DNA, 20 bp, Homo sapiens
cccctaccactgtcttcttc

SEQ ID NO: 2656763 - DNA, 20 bp, Homo sapiens
cccctaccccacaccaggcc

SEQ ID NO: 2656764 - DNA, 22 bp, Homo sapiens
cccctaccccctcctctctgcc

SEQ ID NO: 2656765 - DNA, 21 bp, Homo sapiens
cccctagcttagagcctccct

SEQ ID NO: 2656766 - DNA, 15 bp, Homo sapiens
cccctcaacacctct

SEQ ID NO: 2656767 - DNA, 14 bp, Homo sapiens
cccctcacctcctc

SEQ ID NO: 2656768 - DNA, 15 bp, Homo sapiens
cccctcacctgggca

SEQ ID NO: 2656769 - DNA, 14 bp, Homo sapiens
cccctcactctggc

SEQ ID NO: 2656770 - DNA, 12 bp, Homo sapiens
cccctccactgt

SEQ ID NO: 2656771 - DNA, 15 bp, Homo sapiens
cccctccagcttgtg

SEQ ID NO: 2656772 - DNA, 11 bp, Homo sapiens
cccctccagga

SEQ ID NO: 2656773 - DNA, 11 bp, Homo sapiens
cccctcccacc

SEQ ID NO: 2656774 - DNA, 12 bp, Homo sapiens
cccctcccacca

SEQ ID NO: 2656775 - DNA, 14 bp, Homo sapiens
cccctcccagggcc

SEQ ID NO: 2656776 - DNA, 11 bp, Homo sapiens
cccctcccatt

SEQ ID NO: 2656777 - DNA, 20 bp, Homo sapiens
cccctccccattagctttca

SEQ ID NO: 2656778 - DNA, 21 bp, Homo sapiens
cccctcccccaacccccaccc

SEQ ID NO: 2656779 - DNA, 22 bp, Homo sapiens
cccctccctggctcccatgacc

SEQ ID NO: 2656780 - DNA, 12 bp, Homo sapiens
cccctccctggg

SEQ ID NO: 2656781 - DNA, 13 bp, Homo sapiens
cccctccctgggt

SEQ ID NO: 2656782 - DNA, 13 bp, Homo sapiens
cccctcctctctg

SEQ ID NO: 2656783 - DNA, 15 bp, Homo sapiens
cccctccttgcctcc

SEQ ID NO: 2656784 - DNA, 20 bp, Homo sapiens
cccctctccaggcgccggcg

SEQ ID NO: 2656785 - DNA, 17 bp, Homo sapiens
cccctctgcccagcttg

SEQ ID NO: 2656786 - DNA, 22 bp, Homo sapiens
cccctctgcccagcttgggccc

SEQ ID NO: 2656787 - DNA, 13 bp, Homo sapiens
cccctctggccag

SEQ ID NO: 2656788 - DNA, 14 bp, Homo sapiens
cccctctgtccagg

SEQ ID NO: 2656789 - DNA, 12 bp, Homo sapiens
cccctctgtctt

SEQ ID NO: 2656790 - DNA, 16 bp, Homo sapiens
cccctgaaacttattt

SEQ ID NO: 2656791 - DNA, 13 bp, Homo sapiens
cccctgcactcca

SEQ ID NO: 2656792 - DNA, 15 bp, Homo sapiens
cccctgccagggcag

SEQ ID NO: 2656793 - DNA, 19 bp, Homo sapiens
cccctgccagggcagggcc

SEQ ID NO: 2656794 - DNA, 17 bp, Homo sapiens
cccctgccccccagcct

SEQ ID NO: 2656795 - DNA, 23 bp, Homo sapiens
cccctgccctcccctctctgcac

SEQ ID NO: 2656796 - DNA, 23 bp, Homo sapiens
cccctgccctcgtggccagcccg

SEQ ID NO: 2656797 - DNA, 13 bp, Homo sapiens
cccctgccctgct

SEQ ID NO: 2656798 - DNA, 13 bp, Homo sapiens
cccctgccctggt

SEQ ID NO: 2656799 - DNA, 17 bp, Homo sapiens
cccctgccctggtccag

SEQ ID NO: 2656800 - DNA, 17 bp, Homo sapiens
cccctgccggccggggc

SEQ ID NO: 2656801 - DNA, 12 bp, Homo sapiens
cccctgcctcca

SEQ ID NO: 2656802 - DNA, 22 bp, Homo sapiens
cccctgcctccaccctctgagc

SEQ ID NO: 2656803 - DNA, 20 bp, Homo sapiens
cccctgctgcctccccaacc

SEQ ID NO: 2656804 - DNA, 21 bp, Homo sapiens
cccctgctggctcttctgccc

SEQ ID NO: 2656805 - DNA, 15 bp, Homo sapiens
cccctgctggttcag

SEQ ID NO: 2656806 - DNA, 11 bp, Homo sapiens
cccctggccca

SEQ ID NO: 2656807 - DNA, 16 bp, Homo sapiens
cccctggcccagcggc

SEQ ID NO: 2656808 - DNA, 22 bp, Homo sapiens
cccctggcccagcggcccctcc

SEQ ID NO: 2656809 - DNA, 12 bp, Homo sapiens
cccctggcctcc

SEQ ID NO: 2656810 - DNA, 13 bp, Homo sapiens
cccctggcctccg

SEQ ID NO: 2656811 - DNA, 15 bp, Homo sapiens
cccctgggctctgcc

SEQ ID NO: 2656812 - DNA, 15 bp, Homo sapiens
ccggagctttcaaag

SEQ ID NO: 2656813 - DNA, 17 bp, Homo sapiens
ccggaggtagaggttgt

SEQ ID NO: 2656814 - DNA, 15 bp, Homo sapiens
ccggatcctgggtgg

SEQ ID NO: 2656815 - DNA, 23 bp, Homo sapiens
ccggcaaccccagttctgctcct

SEQ ID NO: 2656816 - DNA, 18 bp, Homo sapiens
ccggcagggtcctagaaa

SEQ ID NO: 2656817 - DNA, 13 bp, Homo sapiens
ccggccaggccac

SEQ ID NO: 2656818 - DNA, 15 bp, Homo sapiens
ccggccccagccaga

SEQ ID NO: 2656819 - DNA, 16 bp, Homo sapiens
ccggccccagccagag

SEQ ID NO: 2656820 - DNA, 17 bp, Homo sapiens
ccggccccagccagagt

SEQ ID NO: 2656821 - DNA, 17 bp, Homo sapiens
ccggcccccagagcgcc

SEQ ID NO: 2656822 - DNA, 15 bp, Homo sapiens
ccggccccctggtct

SEQ ID NO: 2656823 - DNA, 22 bp, Homo sapiens
ccggccctgggctcggaggctg

SEQ ID NO: 2656824 - DNA, 23 bp, Homo sapiens
ccggcctcagcacccctgtctct

SEQ ID NO: 2656825 - DNA, 18 bp, Homo sapiens
ccggcctctctggcctcc

SEQ ID NO: 2656826 - DNA, 21 bp, Homo sapiens
ccggcctctctggcctcccac

SEQ ID NO: 2656827 - DNA, 22 bp, Homo sapiens
ccggcctctctggcctcccacc

SEQ ID NO: 2656828 - DNA, 21 bp, Homo sapiens
ccggcctgatgacagagcgag

SEQ ID NO: 2656829 - DNA, 16 bp, Homo sapiens
ccggcgggcgggccgg

SEQ ID NO: 2656830 - DNA, 14 bp, Homo sapiens
ccggcgtcagcctc

SEQ ID NO: 2656831 - DNA, 21 bp, Homo sapiens
ccggcgtcagcctccagcctc

SEQ ID NO: 2656832 - DNA, 12 bp, Homo sapiens
ccggctccaggc

SEQ ID NO: 2656833 - DNA, 13 bp, Homo sapiens
ccggctccaggct

SEQ ID NO: 2656834 - DNA, 19 bp, Homo sapiens
ccggctcccaccgaggcgc

SEQ ID NO: 2656835 - DNA, 23 bp, Homo sapiens
ccggctcgagcagtcctgcctca

SEQ ID NO: 2656836 - DNA, 12 bp, Homo sapiens
ccggctggcctg

SEQ ID NO: 2656837 - DNA, 23 bp, Homo sapiens
ccggctggttttgtaagatgctg

SEQ ID NO: 2656838 - DNA, 17 bp, Homo sapiens
ccgggacctggtgctgc

SEQ ID NO: 2656839 - DNA, 12 bp, Homo sapiens
ccgggactccag

SEQ ID NO: 2656840 - DNA, 12 bp, Homo sapiens
ccgggagagggg

SEQ ID NO: 2656841 - DNA, 19 bp, Homo sapiens
ccgggatatatattctctc

SEQ ID NO: 2656842 - DNA, 20 bp, Homo sapiens
ccgggcactcagaagacact

SEQ ID NO: 2656843 - DNA, 22 bp, Homo sapiens
ccgggcactcagaagacactga

SEQ ID NO: 2656844 - DNA, 14 bp, Homo sapiens
ccgggccctccctt

SEQ ID NO: 2656845 - DNA, 23 bp, Homo sapiens
ccgggccgaatcccctccctgtc

SEQ ID NO: 2656846 - DNA, 20 bp, Homo sapiens
ccgggcgcggtggctcacgc

SEQ ID NO: 2656847 - DNA, 22 bp, Homo sapiens
ccgggctctgcctcccatcacc

SEQ ID NO: 2656848 - DNA, 16 bp, Homo sapiens
ccgggctgcctgggct

SEQ ID NO: 2656849 - DNA, 21 bp, Homo sapiens
ccgggctgcctgggctgttgg

SEQ ID NO: 2656850 - DNA, 13 bp, Homo sapiens
ccgggctgggagc

SEQ ID NO: 2656851 - DNA, 15 bp, Homo sapiens
ccggggagcgcccgc

SEQ ID NO: 2656852 - DNA, 22 bp, Homo sapiens
ccggggagtttctttcctgcct

SEQ ID NO: 2656853 - DNA, 19 bp, Homo sapiens
ccggggcagctgccagaga

SEQ ID NO: 2656854 - DNA, 23 bp, Homo sapiens
ccggggtcctgtggcaggcagcg

SEQ ID NO: 2656855 - DNA, 21 bp, Homo sapiens
ccggggtggagcatgggcctg

SEQ ID NO: 2656856 - DNA, 20 bp, Homo sapiens
ccgggtgggcggcacagcct

SEQ ID NO: 2656857 - DNA, 20 bp, Homo sapiens
ccgggttctagtctcctttg

SEQ ID NO: 2656858 - DNA, 21 bp, Homo sapiens
ccgggtttggcgggccaagga

SEQ ID NO: 2656859 - DNA, 16 bp, Homo sapiens
ccggtctgcaagtcag

SEQ ID NO: 2656860 - DNA, 16 bp, Homo sapiens
ccggtgtgcctgcagc

SEQ ID NO: 2656861 - DNA, 15 bp, Homo sapiens
ccgtaacccaactct

SEQ ID NO: 2656862 - DNA, 12 bp, Homo sapiens
ccgtcagggccc

SEQ ID NO: 2656863 - DNA, 14 bp, Homo sapiens
ccgtcagggcccaa

SEQ ID NO: 2656864 - DNA, 21 bp, Homo sapiens
ccgtcatggcttaatgtttat

SEQ ID NO: 2656865 - DNA, 15 bp, Homo sapiens
ccgtcatgttcctca

SEQ ID NO: 2656866 - DNA, 21 bp, Homo sapiens
ccgtcgaggggctctcagctc

SEQ ID NO: 2656867 - DNA, 14 bp, Homo sapiens
ccgtctacctgagg

SEQ ID NO: 2656868 - DNA, 14 bp, Homo sapiens
ccgtctctctccca

SEQ ID NO: 2656869 - DNA, 14 bp, Homo sapiens
ccgtcttcagccta

SEQ ID NO: 2656870 - DNA, 18 bp, Homo sapiens
ccgtgacagactcctgag

SEQ ID NO: 2656871 - DNA, 22 bp, Homo sapiens
ccgtgacagactcctgaggaca

SEQ ID NO: 2656872 - DNA, 12 bp, Homo sapiens
ccgtgcccaggg

SEQ ID NO: 2656873 - DNA, 14 bp, Homo sapiens
ccgtgcctccacca

SEQ ID NO: 2656874 - DNA, 14 bp, Homo sapiens
ccgtggaccttcct

SEQ ID NO: 2656875 - DNA, 12 bp, Homo sapiens
ccgtgggcgggg

SEQ ID NO: 2656876 - DNA, 16 bp, Homo sapiens
ccgtgtaaaccaaagc

SEQ ID NO: 2656877 - DNA, 12 bp, Homo sapiens
ccgttattaaaa

SEQ ID NO: 2656878 - DNA, 18 bp, Homo sapiens
ccgttgatgttggctggg

SEQ ID NO: 2656879 - DNA, 23 bp, Homo sapiens
ccgttggaaacataaccattaca

SEQ ID NO: 2656880 - DNA, 23 bp, Homo sapiens
ccgtttcctttcatttactgtgg

SEQ ID NO: 2656881 - DNA, 12 bp, Homo sapiens
cctaaaacaaat

SEQ ID NO: 2656882 - DNA, 23 bp, Homo sapiens
cctaaaaggaaatctcaccccat

SEQ ID NO: 2656883 - DNA, 15 bp, Homo sapiens
cctaaaagtaaacat

SEQ ID NO: 2656884 - DNA, 18 bp, Homo sapiens
cctaaaataattggttct

SEQ ID NO: 2656885 - DNA, 15 bp, Homo sapiens
cctaaaattcagtgg

SEQ ID NO: 2656886 - DNA, 16 bp, Homo sapiens
cctaaaattcagtgga

SEQ ID NO: 2656887 - DNA, 14 bp, Homo sapiens
cctaaaatttgccc

SEQ ID NO: 2656888 - DNA, 22 bp, Homo sapiens
cctaaaatttgccctcccatcc

SEQ ID NO: 2656889 - DNA, 16 bp, Homo sapiens
cctaaaccaaaaactg

SEQ ID NO: 2656890 - DNA, 14 bp, Homo sapiens
cctaaactatcttt

SEQ ID NO: 2656891 - DNA, 13 bp, Homo sapiens
cctaacaccagcg

SEQ ID NO: 2656892 - DNA, 15 bp, Homo sapiens
cctaacgaagtatcc

SEQ ID NO: 2656893 - DNA, 22 bp, Homo sapiens
cctaaggaaaggaattggcatg

SEQ ID NO: 2656894 - DNA, 13 bp, Homo sapiens
cctaaggacacac

SEQ ID NO: 2656895 - DNA, 18 bp, Homo sapiens
cctaagtcctttatgtgg

SEQ ID NO: 2656896 - DNA, 20 bp, Homo sapiens
cctaagtttcagttgatttt

SEQ ID NO: 2656897 - DNA, 21 bp, Homo sapiens
cctaatccctgggcattgctt

SEQ ID NO: 2656898 - DNA, 22 bp, Homo sapiens
cctaatgacatcaccacagttt

SEQ ID NO: 2656899 - DNA, 17 bp, Homo sapiens
cctacaagagcagcctg

SEQ ID NO: 2656900 - DNA, 21 bp, Homo sapiens
cctacaagagcagcctgtggc

SEQ ID NO: 2656901 - DNA, 21 bp, Homo sapiens
cctacaccattatcttggaaa

SEQ ID NO: 2656902 - DNA, 17 bp, Homo sapiens
cctacagaggtctctgc

SEQ ID NO: 2656903 - DNA, 14 bp, Homo sapiens
cctacagccccttt

SEQ ID NO: 2656904 - DNA, 18 bp, Homo sapiens
cctacaggagtgagcact

SEQ ID NO: 2656905 - DNA, 15 bp, Homo sapiens
cctacagtgtacagt

SEQ ID NO: 2656906 - DNA, 22 bp, Homo sapiens
cctacatgtatttgtttgcata

SEQ ID NO: 2656907 - DNA, 19 bp, Homo sapiens
cctaccaatagattcccca

SEQ ID NO: 2656908 - DNA, 23 bp, Homo sapiens
cctaccaatagattccccattgc

SEQ ID NO: 2656909 - DNA, 12 bp, Homo sapiens
cctaccaatgca

SEQ ID NO: 2656910 - DNA, 16 bp, Homo sapiens
cctaccaatgcatgca

SEQ ID NO: 2656911 - DNA, 14 bp, Homo sapiens
cctaccacatgcca

SEQ ID NO: 2656912 - DNA, 18 bp, Homo sapiens
cctaccaccccttcctgt

SEQ ID NO: 2656913 - DNA, 18 bp, Homo sapiens
cctaccacctccccagcc

SEQ ID NO: 2656914 - DNA, 13 bp, Homo sapiens
cctaccactgtct

SEQ ID NO: 2656915 - DNA, 22 bp, Homo sapiens
cctaccagcgcccgctgggctg

SEQ ID NO: 2656916 - DNA, 22 bp, Homo sapiens
cctaccatcagggacaggatga

SEQ ID NO: 2656917 - DNA, 16 bp, Homo sapiens
cctacccacacctctg

SEQ ID NO: 2656918 - DNA, 13 bp, Homo sapiens
cctacccaccctc

SEQ ID NO: 2656919 - DNA, 18 bp, Homo sapiens
cctacccaccctcctttc

SEQ ID NO: 2656920 - DNA, 19 bp, Homo sapiens
cctaccccacaccaggccg

SEQ ID NO: 2656921 - DNA, 19 bp, Homo sapiens
cctaccccctcctctctgc

SEQ ID NO: 2656922 - DNA, 20 bp, Homo sapiens
cctaccgaaaccttgccttt

SEQ ID NO: 2656923 - DNA, 12 bp, Homo sapiens
cctacctcagcc

SEQ ID NO: 2656924 - DNA, 16 bp, Homo sapiens
cctacctcagcctaga

SEQ ID NO: 2656925 - DNA, 15 bp, Homo sapiens
cctacctcaggcagg

SEQ ID NO: 2656926 - DNA, 15 bp, Homo sapiens
cctacctgtgcctga

SEQ ID NO: 2656927 - DNA, 13 bp, Homo sapiens
cctacctgttcag

SEQ ID NO: 2656928 - DNA, 15 bp, Homo sapiens
cctacttcctgtgac

SEQ ID NO: 2656929 - DNA, 18 bp, Homo sapiens
cctagagaacgcagccct

SEQ ID NO: 2656930 - DNA, 20 bp, Homo sapiens
cctagagaacgcagccctag

SEQ ID NO: 2656931 - DNA, 15 bp, Homo sapiens
cctagagcacactgt

SEQ ID NO: 2656932 - DNA, 14 bp, Homo sapiens
cctagagcctgcct

SEQ ID NO: 2656933 - DNA, 23 bp, Homo sapiens
cctagaggtactttccacttgat

SEQ ID NO: 2656934 - DNA, 17 bp, Homo sapiens
cctagcacacacttttg

SEQ ID NO: 2656935 - DNA, 15 bp, Homo sapiens
cctagccattcctgg

SEQ ID NO: 2656936 - DNA, 16 bp, Homo sapiens
cctagccattcctggt

SEQ ID NO: 2656937 - DNA, 14 bp, Homo sapiens
cctagccgacctca

SEQ ID NO: 2656938 - DNA, 18 bp, Homo sapiens
cctagccttatcctctga

SEQ ID NO: 2656939 - DNA, 23 bp, Homo sapiens
cctaggcatttgctgaatacaga

SEQ ID NO: 2656940 - DNA, 17 bp, Homo sapiens
cctaggctccaccccat

SEQ ID NO: 2656941 - DNA, 18 bp, Homo sapiens
cctaggctccaccccatc

SEQ ID NO: 2656942 - DNA, 23 bp, Homo sapiens
cctagggaagggtggtggagcca

SEQ ID NO: 2656943 - DNA, 20 bp, Homo sapiens
cctagggatgttctggccct

SEQ ID NO: 2656944 - DNA, 17 bp, Homo sapiens
cctagggccactgaaga

SEQ ID NO: 2656945 - DNA, 14 bp, Homo sapiens
cctagggcctggtc

SEQ ID NO: 2656946 - DNA, 18 bp, Homo sapiens
cctaggggtcagggacca

SEQ ID NO: 2656947 - DNA, 14 bp, Homo sapiens
cctagtagtcattt

SEQ ID NO: 2656948 - DNA, 18 bp, Homo sapiens
cctagtcccttccacacc

SEQ ID NO: 2656949 - DNA, 19 bp, Homo sapiens
cctagtcccttccacaccc

SEQ ID NO: 2656950 - DNA, 15 bp, Homo sapiens
cctagtcccttcccc

SEQ ID NO: 2656951 - DNA, 21 bp, Homo sapiens
cctagtcccttcccctccctg

SEQ ID NO: 2656952 - DNA, 18 bp, Homo sapiens
cctagtctccctcacagc

SEQ ID NO: 2656953 - DNA, 19 bp, Homo sapiens
cctagtgaaggcttctctc

SEQ ID NO: 2656954 - DNA, 22 bp, Homo sapiens
cctagtgaaggcttctctctgt

SEQ ID NO: 2656955 - DNA, 19 bp, Homo sapiens
cctagtgacccggaggcca

SEQ ID NO: 2656956 - DNA, 17 bp, Homo sapiens
cctctgcagctgacctc

SEQ ID NO: 2656957 - DNA, 22 bp, Homo sapiens
cctctgcagctgacctctgttg

SEQ ID NO: 2656958 - DNA, 16 bp, Homo sapiens
cctctgcagtgccttg

SEQ ID NO: 2656959 - DNA, 17 bp, Homo sapiens
cctctgcccactccctg

SEQ ID NO: 2656960 - DNA, 19 bp, Homo sapiens
cctctgcccactccctgca

SEQ ID NO: 2656961 - DNA, 13 bp, Homo sapiens
cctctgcccagct

SEQ ID NO: 2656962 - DNA, 16 bp, Homo sapiens
cctctgcccagcttgg

SEQ ID NO: 2656963 - DNA, 18 bp, Homo sapiens
cctctgcccagcttgggc

SEQ ID NO: 2656964 - DNA, 23 bp, Homo sapiens
cctctgcccagcttgggcccagc

SEQ ID NO: 2656965 - DNA, 23 bp, Homo sapiens
cctctgcctctgacacacagctc

SEQ ID NO: 2656966 - DNA, 20 bp, Homo sapiens
cctctgcctgaagtcacaca

SEQ ID NO: 2656967 - DNA, 22 bp, Homo sapiens
cctctgcctgaagtcacacagt

SEQ ID NO: 2656968 - DNA, 17 bp, Homo sapiens
cctctgcctgcattctg

SEQ ID NO: 2656969 - DNA, 14 bp, Homo sapiens
cctctgcctgtccc

SEQ ID NO: 2656970 - DNA, 18 bp, Homo sapiens
cctctgcctgtccctctc

SEQ ID NO: 2656971 - DNA, 22 bp, Homo sapiens
cctctgctcctggagcctttga

SEQ ID NO: 2656972 - DNA, 21 bp, Homo sapiens
cctctgctctgaggcttccag

SEQ ID NO: 2656973 - DNA, 15 bp, Homo sapiens
cctctgctgccatgg

SEQ ID NO: 2656974 - DNA, 13 bp, Homo sapiens
cctctgctgctgg

SEQ ID NO: 2656975 - DNA, 14 bp, Homo sapiens
cctctgctgctggc

SEQ ID NO: 2656976 - DNA, 19 bp, Homo sapiens
cctctgctgctgtccctcc

SEQ ID NO: 2656977 - DNA, 20 bp, Homo sapiens
cctctgctgctgtccctccc

SEQ ID NO: 2656978 - DNA, 15 bp, Homo sapiens
cctctgcttctcacg

SEQ ID NO: 2656979 - DNA, 16 bp, Homo sapiens
cctctggactggctag

SEQ ID NO: 2656980 - DNA, 23 bp, Homo sapiens
cctctggcattagaattatttaa

SEQ ID NO: 2656981 - DNA, 15 bp, Homo sapiens
cctctggccaggatg

SEQ ID NO: 2656982 - DNA, 24 bp, Homo sapiens
cctctggctagaggccagccccac

SEQ ID NO: 2656983 - DNA, 16 bp, Homo sapiens
cctctgggcaggacct

SEQ ID NO: 2656984 - DNA, 16 bp, Homo sapiens
cctctgtacagagccc

SEQ ID NO: 2656985 - DNA, 17 bp, Homo sapiens
cctctgtacagagccca

SEQ ID NO: 2656986 - DNA, 19 bp, Homo sapiens
cctctgtcactgcaggcac

SEQ ID NO: 2656987 - DNA, 17 bp, Homo sapiens
cctctgtccaggcactg

SEQ ID NO: 2656988 - DNA, 20 bp, Homo sapiens
cctctgtccaggcactgaga

SEQ ID NO: 2656989 - DNA, 20 bp, Homo sapiens
cctctgtccagggccctgag

SEQ ID NO: 2656990 - DNA, 14 bp, Homo sapiens
cctctgtctgccct

SEQ ID NO: 2656991 - DNA, 19 bp, Homo sapiens
cctctgtgtccttccctgc

SEQ ID NO: 2656992 - DNA, 18 bp, Homo sapiens
cctctgttgtcctcccct

SEQ ID NO: 2656993 - DNA, 21 bp, Homo sapiens
cctctgtttgacaaacctcta

SEQ ID NO: 2656994 - DNA, 23 bp, Homo sapiens
cctcttaaagctgcctgtagtta

SEQ ID NO: 2656995 - DNA, 16 bp, Homo sapiens
cctcttatgggctggg

SEQ ID NO: 2656996 - DNA, 13 bp, Homo sapiens
cctcttcaccccc

SEQ ID NO: 2656997 - DNA, 12 bp, Homo sapiens
cctcttccagtc

SEQ ID NO: 2656998 - DNA, 14 bp, Homo sapiens
cctcttccagtctt

SEQ ID NO: 2656999 - DNA, 11 bp, Homo sapiens
cctcttcccca

SEQ ID NO: 2657000 - DNA, 12 bp, Homo sapiens
cctcttccccac

SEQ ID NO: 2657001 - DNA, 21 bp, Homo sapiens
cctcttccccttgcccttgcc

SEQ ID NO: 2657002 - DNA, 18 bp, Homo sapiens
cctcttccgtgacgtcac

SEQ ID NO: 2657003 - DNA, 14 bp, Homo sapiens
cctcttcctctgag

SEQ ID NO: 2657004 - DNA, 17 bp, Homo sapiens
cctcttctattttgtaa

SEQ ID NO: 2657005 - DNA, 12 bp, Homo sapiens
cctcttctcttc

SEQ ID NO: 2657006 - DNA, 14 bp, Homo sapiens
cctcttctcttcct

SEQ ID NO: 2657007 - DNA, 16 bp, Homo sapiens
cctcttctcttcctgt

SEQ ID NO: 2657008 - DNA, 17 bp, Homo sapiens
cctcttctcttcctgta

SEQ ID NO: 2657009 - DNA, 18 bp, Homo sapiens
cctcttctgacgtgcctt

SEQ ID NO: 2657010 - DNA, 14 bp, Homo sapiens
cctcttctgcatct

SEQ ID NO: 2657011 - DNA, 20 bp, Homo sapiens
cctcttctgcttaggagaga

SEQ ID NO: 2657012 - DNA, 19 bp, Homo sapiens
cctcttgagccttgaactt

SEQ ID NO: 2657013 - DNA, 14 bp, Homo sapiens
cctcttgccactgc

SEQ ID NO: 2657014 - DNA, 23 bp, Homo sapiens
cctcttgccactgcctcttcctc

SEQ ID NO: 2657015 - DNA, 16 bp, Homo sapiens
cctcttgcctcctgga

SEQ ID NO: 2657016 - DNA, 15 bp, Homo sapiens
cctcttggacctctg

SEQ ID NO: 2657017 - DNA, 18 bp, Homo sapiens
cctcttggacctctgctc

SEQ ID NO: 2657018 - DNA, 14 bp, Homo sapiens
cctctttggctccc

SEQ ID NO: 2657019 - DNA, 19 bp, Homo sapiens
cctctttggtctacactgt

SEQ ID NO: 2657020 - DNA, 14 bp, Homo sapiens
cctctttgtctaaa

SEQ ID NO: 2657021 - DNA, 22 bp, Homo sapiens
cctctttgtctaaaacaataaa

SEQ ID NO: 2657022 - DNA, 17 bp, Homo sapiens
cctgaaaacactgtgca

SEQ ID NO: 2657023 - DNA, 22 bp, Homo sapiens
cctgaaaatgtttttctgccag

SEQ ID NO: 2657024 - DNA, 13 bp, Homo sapiens
cctgaaagaggaa

SEQ ID NO: 2657025 - DNA, 18 bp, Homo sapiens
cctgaaagaggaatgaag

SEQ ID NO: 2657026 - DNA, 14 bp, Homo sapiens
cctgaaatttcacc

SEQ ID NO: 2657027 - DNA, 14 bp, Homo sapiens
cctgaaatttcaga

SEQ ID NO: 2657028 - DNA, 13 bp, Homo sapiens
cctgaacaagaat

SEQ ID NO: 2657029 - DNA, 17 bp, Homo sapiens
cctgaacaagaattgga

SEQ ID NO: 2657030 - DNA, 20 bp, Homo sapiens
cctgaagaggcgggccagcc

SEQ ID NO: 2657031 - DNA, 21 bp, Homo sapiens
cctgaagagtcctctgaatga

SEQ ID NO: 2657032 - DNA, 16 bp, Homo sapiens
cctgaagtcacacagt

SEQ ID NO: 2657033 - DNA, 21 bp, Homo sapiens
cctgaatccaaactaatccat

SEQ ID NO: 2657034 - DNA, 21 bp, Homo sapiens
cctgaatggttccatgcctga

SEQ ID NO: 2657035 - DNA, 18 bp, Homo sapiens
cctgaattctatttgctg

SEQ ID NO: 2657036 - DNA, 21 bp, Homo sapiens
cctgaattttgttgctgtttt

SEQ ID NO: 2657037 - DNA, 16 bp, Homo sapiens
cctgacaacactcatt

SEQ ID NO: 2657038 - DNA, 13 bp, Homo sapiens
cctgacactccct

SEQ ID NO: 2657039 - DNA, 14 bp, Homo sapiens
cctgacactttaat

SEQ ID NO: 2657040 - DNA, 15 bp, Homo sapiens
cctgacactttaatt

SEQ ID NO: 2657041 - DNA, 12 bp, Homo sapiens
cctgaccaccct

SEQ ID NO: 2657042 - DNA, 14 bp, Homo sapiens
cctgaccaccctcc

SEQ ID NO: 2657043 - DNA, 17 bp, Homo sapiens
cctgaccaccctcccct

SEQ ID NO: 2657044 - DNA, 20 bp, Homo sapiens
cctgaccacgctttctagct

SEQ ID NO: 2657045 - DNA, 18 bp, Homo sapiens
cctgacccaggccgcagc

SEQ ID NO: 2657046 - DNA, 12 bp, Homo sapiens
cctgacctccca

SEQ ID NO: 2657047 - DNA, 13 bp, Homo sapiens
cctgacctcccag

SEQ ID NO: 2657048 - DNA, 16 bp, Homo sapiens
cctgacctccctctaa

SEQ ID NO: 2657049 - DNA, 15 bp, Homo sapiens
cctgacctgaggctc

SEQ ID NO: 2657050 - DNA, 14 bp, Homo sapiens
cctgacctgtctca

SEQ ID NO: 2657051 - DNA, 16 bp, Homo sapiens
cctgacctgtctcacc

SEQ ID NO: 2657052 - DNA, 20 bp, Homo sapiens
cctgactcctctaagccact

SEQ ID NO: 2657053 - DNA, 21 bp, Homo sapiens
cctgactcgtctgactgtgtg

SEQ ID NO: 2657054 - DNA, 14 bp, Homo sapiens
cctgactctcagca

SEQ ID NO: 2657055 - DNA, 18 bp, Homo sapiens
cctgactctgaaatctga

SEQ ID NO: 2657056 - DNA, 14 bp, Homo sapiens
cctgactctgcccc

SEQ ID NO: 2657057 - DNA, 23 bp, Homo sapiens
cctgacttggggagatggagttc

SEQ ID NO: 2657058 - DNA, 15 bp, Homo sapiens
cctgagacaaatgga

SEQ ID NO: 2657059 - DNA, 18 bp, Homo sapiens
cctgagaccacagagaga

SEQ ID NO: 2657060 - DNA, 16 bp, Homo sapiens
cctgagacccctggcc

SEQ ID NO: 2657061 - DNA, 17 bp, Homo sapiens
cctgagacccctggcct

SEQ ID NO: 2657062 - DNA, 19 bp, Homo sapiens
cctgagacccctggcctcc

SEQ ID NO: 2657063 - DNA, 21 bp, Homo sapiens
cctgagcaacagagtgagacc

SEQ ID NO: 2657064 - DNA, 23 bp, Homo sapiens
cctgagcaacagagtgagaccct

SEQ ID NO: 2657065 - DNA, 13 bp, Homo sapiens
cctgagccaagct

SEQ ID NO: 2657066 - DNA, 12 bp, Homo sapiens
cctgagcccctt

SEQ ID NO: 2657067 - DNA, 13 bp, Homo sapiens
cctgagccccttc

SEQ ID NO: 2657068 - DNA, 15 bp, Homo sapiens
cctgagccccttcct

SEQ ID NO: 2657069 - DNA, 16 bp, Homo sapiens
cctgagccccttcctt

SEQ ID NO: 2657070 - DNA, 21 bp, Homo sapiens
cctgagctagaagctggagga

SEQ ID NO: 2657071 - DNA, 13 bp, Homo sapiens
cctgagctcactc

SEQ ID NO: 2657072 - DNA, 15 bp, Homo sapiens
cctgagctcggtgga

SEQ ID NO: 2657073 - DNA, 14 bp, Homo sapiens
cctgagctttctgc

SEQ ID NO: 2657074 - DNA, 16 bp, Homo sapiens
cctgagctttctgcta

SEQ ID NO: 2657075 - DNA, 18 bp, Homo sapiens
cctgaggaacccttacag

SEQ ID NO: 2657076 - DNA, 12 bp, Homo sapiens
cctgaggaagcg

SEQ ID NO: 2657077 - DNA, 23 bp, Homo sapiens
cctgaggaagcgtgaaggccgag

SEQ ID NO: 2657078 - DNA, 15 bp, Homo sapiens
cctgaggacagctgt

SEQ ID NO: 2657079 - DNA, 17 bp, Homo sapiens
cctgaggacagctgtcc

SEQ ID NO: 2657080 - DNA, 17 bp, Homo sapiens
cctgaggatgagctgga

SEQ ID NO: 2657081 - DNA, 12 bp, Homo sapiens
cctgaggcccag

SEQ ID NO: 2657082 - DNA, 14 bp, Homo sapiens
cctgaggcccagag

SEQ ID NO: 2657083 - DNA, 15 bp, Homo sapiens
cctgaggcccagagg

SEQ ID NO: 2657084 - DNA, 21 bp, Homo sapiens
cctgaggcccagagggcctgc

SEQ ID NO: 2657085 - DNA, 17 bp, Homo sapiens
cctgaggcccttctctc

SEQ ID NO: 2657086 - DNA, 20 bp, Homo sapiens
cctgaggcccttctctccag

SEQ ID NO: 2657087 - DNA, 23 bp, Homo sapiens
cctgaggcccttctctccagccc

SEQ ID NO: 2657088 - DNA, 14 bp, Homo sapiens
cctgaggctgggct

SEQ ID NO: 2657089 - DNA, 17 bp, Homo sapiens
cctgaggctgggctccc

SEQ ID NO: 2657090 - DNA, 16 bp, Homo sapiens
cctgagggcccctctg

SEQ ID NO: 2657091 - DNA, 19 bp, Homo sapiens
cctgagggcccctctgccc

SEQ ID NO: 2657092 - DNA, 21 bp, Homo sapiens
cctgagggcccctctgcccag

SEQ ID NO: 2657093 - DNA, 22 bp, Homo sapiens
cctgagggcccctctgcccagc

SEQ ID NO: 2657094 - DNA, 19 bp, Homo sapiens
cctgaggggcatctgcccc

SEQ ID NO: 2657095 - DNA, 13 bp, Homo sapiens
cctgagggtcccc

SEQ ID NO: 2657096 - DNA, 19 bp, Homo sapiens
cctgagggtccccacctgg

SEQ ID NO: 2657097 - DNA, 22 bp, Homo sapiens
cctgaggtcaggagttcaagac

SEQ ID NO: 2657098 - DNA, 20 bp, Homo sapiens
cctgaggtgaaagggagcta

SEQ ID NO: 2657099 - DNA, 16 bp, Homo sapiens
cctgaggtgggcccag

SEQ ID NO: 2657100 - DNA, 21 bp, Homo sapiens
cctgagtagctgggattacag

SEQ ID NO: 2657101 - DNA, 15 bp, Homo sapiens
ccttaccctcatgtt

SEQ ID NO: 2657102 - DNA, 14 bp, Homo sapiens
ccttacctcttccg

SEQ ID NO: 2657103 - DNA, 16 bp, Homo sapiens
ccttactcttcttgaa

SEQ ID NO: 2657104 - DNA, 22 bp, Homo sapiens
ccttactcttcttgaaatttta

SEQ ID NO: 2657105 - DNA, 18 bp, Homo sapiens
ccttagacagtccctgcc

SEQ ID NO: 2657106 - DNA, 19 bp, Homo sapiens
ccttagacagtccctgcca

SEQ ID NO: 2657107 - DNA, 16 bp, Homo sapiens
ccttagagacatcaaa

SEQ ID NO: 2657108 - DNA, 18 bp, Homo sapiens
ccttagattagctctgga

SEQ ID NO: 2657109 - DNA, 16 bp, Homo sapiens
ccttagcaaattctgt

SEQ ID NO: 2657110 - DNA, 20 bp, Homo sapiens
ccttagcagggaaacagcta

SEQ ID NO: 2657111 - DNA, 18 bp, Homo sapiens
ccttagcccccacccact

SEQ ID NO: 2657112 - DNA, 14 bp, Homo sapiens
ccttagcctccctg

SEQ ID NO: 2657113 - DNA, 17 bp, Homo sapiens
ccttagcttagacctca

SEQ ID NO: 2657114 - DNA, 19 bp, Homo sapiens
ccttagcttagacctcagc

SEQ ID NO: 2657115 - DNA, 20 bp, Homo sapiens
ccttagcttagacctcagcc

SEQ ID NO: 2657116 - DNA, 23 bp, Homo sapiens
ccttagcttagacctcagcctgt

SEQ ID NO: 2657117 - DNA, 16 bp, Homo sapiens
ccttaggcagggaagt

SEQ ID NO: 2657118 - DNA, 20 bp, Homo sapiens
ccttagtctcagtttgtgtg

SEQ ID NO: 2657119 - DNA, 13 bp, Homo sapiens
ccttagtcttctc

SEQ ID NO: 2657120 - DNA, 14 bp, Homo sapiens
ccttagtcttctca

SEQ ID NO: 2657121 - DNA, 20 bp, Homo sapiens
ccttagtggcttttttcctc

SEQ ID NO: 2657122 - DNA, 12 bp, Homo sapiens
ccttagtgtttc

SEQ ID NO: 2657123 - DNA, 14 bp, Homo sapiens
ccttagtgtttctg

SEQ ID NO: 2657124 - DNA, 20 bp, Homo sapiens
ccttatcaccagctgcctct

SEQ ID NO: 2657125 - DNA, 14 bp, Homo sapiens
ccttatccaggact

SEQ ID NO: 2657126 - DNA, 16 bp, Homo sapiens
ccttatcctctgatct

SEQ ID NO: 2657127 - DNA, 16 bp, Homo sapiens
ccttattgtacctctc

SEQ ID NO: 2657128 - DNA, 18 bp, Homo sapiens
ccttattttcaagaaact

SEQ ID NO: 2657129 - DNA, 22 bp, Homo sapiens
ccttcaagaccttcaccaaaca

SEQ ID NO: 2657130 - DNA, 19 bp, Homo sapiens
ccttcaagttagctcagga

SEQ ID NO: 2657131 - DNA, 15 bp, Homo sapiens
ccttcaattcctggg

SEQ ID NO: 2657132 - DNA, 19 bp, Homo sapiens
ccttcacctttgtccccac

SEQ ID NO: 2657133 - DNA, 20 bp, Homo sapiens
ccttcactccggtgtgcctg

SEQ ID NO: 2657134 - DNA, 14 bp, Homo sapiens
ccttcactgccttt

SEQ ID NO: 2657135 - DNA, 16 bp, Homo sapiens
ccttcagatggaaact

SEQ ID NO: 2657136 - DNA, 19 bp, Homo sapiens
ccttcagggtgatgccagg

SEQ ID NO: 2657137 - DNA, 20 bp, Homo sapiens
ccttcagggtgatgccaggt

SEQ ID NO: 2657138 - DNA, 21 bp, Homo sapiens
ccttcagtcttgaatttctaa

SEQ ID NO: 2657139 - DNA, 14 bp, Homo sapiens
ccttcatctccagg

SEQ ID NO: 2657140 - DNA, 14 bp, Homo sapiens
ccttcatctggaac

SEQ ID NO: 2657141 - DNA, 23 bp, Homo sapiens
ccttcattgccttaactggagcc

SEQ ID NO: 2657142 - DNA, 15 bp, Homo sapiens
ccttccactgagggc

SEQ ID NO: 2657143 - DNA, 17 bp, Homo sapiens
ccttccactgagggcag

SEQ ID NO: 2657144 - DNA, 16 bp, Homo sapiens
ccttccagcaccctgc

SEQ ID NO: 2657145 - DNA, 17 bp, Homo sapiens
ccttccagcaccctgca

SEQ ID NO: 2657146 - DNA, 15 bp, Homo sapiens
ccttccagctcctgt

SEQ ID NO: 2657147 - DNA, 16 bp, Homo sapiens
ccttccaggggtggga

SEQ ID NO: 2657148 - DNA, 15 bp, Homo sapiens
ccttccataattatg

SEQ ID NO: 2657149 - DNA, 17 bp, Homo sapiens
ccttccatggactttgt

SEQ ID NO: 2657150 - DNA, 21 bp, Homo sapiens
ccttccatgtcgcctctgcat

SEQ ID NO: 2657151 - DNA, 20 bp, Homo sapiens
ccttccatgtcggcctctaa

SEQ ID NO: 2657152 - DNA, 18 bp, Homo sapiens
ccttcccaaaggactcca

SEQ ID NO: 2657153 - DNA, 12 bp, Homo sapiens
ccttcccacctc

SEQ ID NO: 2657154 - DNA, 14 bp, Homo sapiens
ccttcccatcgctg

SEQ ID NO: 2657155 - DNA, 15 bp, Homo sapiens
ccttcccatcgctgt

SEQ ID NO: 2657156 - DNA, 15 bp, Homo sapiens
ccttcccatgccctg

SEQ ID NO: 2657157 - DNA, 12 bp, Homo sapiens
ccttccccactg

SEQ ID NO: 2657158 - DNA, 19 bp, Homo sapiens
ccttccccactgcacacac

SEQ ID NO: 2657159 - DNA, 20 bp, Homo sapiens
ccttccccactgcctgccca

SEQ ID NO: 2657160 - DNA, 13 bp, Homo sapiens
ccttccccagcct

SEQ ID NO: 2657161 - DNA, 13 bp, Homo sapiens
ccttccccatggg

SEQ ID NO: 2657162 - DNA, 16 bp, Homo sapiens
ccttccccctcccagg

SEQ ID NO: 2657163 - DNA, 14 bp, Homo sapiens
ccttccctgtccct

SEQ ID NO: 2657164 - DNA, 17 bp, Homo sapiens
ccttcccttctccatct

SEQ ID NO: 2657165 - DNA, 16 bp, Homo sapiens
ccttcctacagatagt

SEQ ID NO: 2657166 - DNA, 18 bp, Homo sapiens
ccttcctcatccacccca

SEQ ID NO: 2657167 - DNA, 19 bp, Homo sapiens
ccttcctcatccaccccat

SEQ ID NO: 2657168 - DNA, 12 bp, Homo sapiens
ccttcctcctgg

SEQ ID NO: 2657169 - DNA, 16 bp, Homo sapiens
ccttcctgccaccagt

SEQ ID NO: 2657170 - DNA, 19 bp, Homo sapiens
ccttcctggggcatctggc

SEQ ID NO: 2657171 - DNA, 16 bp, Homo sapiens
ccttcctgtcccacct

SEQ ID NO: 2657172 - DNA, 19 bp, Homo sapiens
ccttcctgtcttcctgcat

SEQ ID NO: 2657173 - DNA, 14 bp, Homo sapiens
ccttccttgctaat

SEQ ID NO: 2657174 - DNA, 18 bp, Homo sapiens
ccttccttgctctgcacc

SEQ ID NO: 2657175 - DNA, 17 bp, Homo sapiens
ccttcgcggtggaaggc

SEQ ID NO: 2657176 - DNA, 12 bp, Homo sapiens
ccttctacctgc

SEQ ID NO: 2657177 - DNA, 14 bp, Homo sapiens
ccttctccatctct

SEQ ID NO: 2657178 - DNA, 16 bp, Homo sapiens
ccttctccctcatttc

SEQ ID NO: 2657179 - DNA, 21 bp, Homo sapiens
ccttctcctccccacccgccc

SEQ ID NO: 2657180 - DNA, 16 bp, Homo sapiens
ccttctctccagcccc

SEQ ID NO: 2657181 - DNA, 18 bp, Homo sapiens
ccttctctccagcccctg

SEQ ID NO: 2657182 - DNA, 19 bp, Homo sapiens
ccttctctccagcccctgg

SEQ ID NO: 2657183 - DNA, 21 bp, Homo sapiens
ccttctctccagcccctggat

SEQ ID NO: 2657184 - DNA, 16 bp, Homo sapiens
ccttctctgaaggaca

SEQ ID NO: 2657185 - DNA, 14 bp, Homo sapiens
ccttctcttaattt

SEQ ID NO: 2657186 - DNA, 20 bp, Homo sapiens
ccttctgacccatgctgccc

SEQ ID NO: 2657187 - DNA, 22 bp, Homo sapiens
ccttctgacccatgctgccctg

SEQ ID NO: 2657188 - DNA, 18 bp, Homo sapiens
ccttctgaggacattcca

SEQ ID NO: 2657189 - DNA, 12 bp, Homo sapiens
ccttctgggaaa

SEQ ID NO: 2657190 - DNA, 17 bp, Homo sapiens
ccttctgtagttttatc

SEQ ID NO: 2657191 - DNA, 23 bp, Homo sapiens
ccttcttcacccagctaatctgt

SEQ ID NO: 2657192 - DNA, 19 bp, Homo sapiens
ccttcttctttttgctgtt

SEQ ID NO: 2657193 - DNA, 13 bp, Homo sapiens
ccttctttcctct

SEQ ID NO: 2657194 - DNA, 18 bp, Homo sapiens
ccttctttgataatgtta

SEQ ID NO: 2657195 - DNA, 20 bp, Homo sapiens
ccttctttgataatgttaaa

SEQ ID NO: 2657196 - DNA, 15 bp, Homo sapiens
ccttgaaaacactgt

SEQ ID NO: 2657197 - DNA, 21 bp, Homo sapiens
ccttgaaaacactgttctctg

SEQ ID NO: 2657198 - DNA, 15 bp, Homo sapiens
ccttgaaaatatttt

SEQ ID NO: 2657199 - DNA, 13 bp, Homo sapiens
ccttgaacactgg

SEQ ID NO: 2657200 - DNA, 16 bp, Homo sapiens
ccttgaaccacttccc

SEQ ID NO: 2657201 - DNA, 14 bp, Homo sapiens
ccttgaactgggta

SEQ ID NO: 2657202 - DNA, 16 bp, Homo sapiens
ccttgaactgggtact

SEQ ID NO: 2657203 - DNA, 17 bp, Homo sapiens
ccttgaactttgacctc

SEQ ID NO: 2657204 - DNA, 14 bp, Homo sapiens
ccttgaagccactg

SEQ ID NO: 2657205 - DNA, 17 bp, Homo sapiens
ccttgacagggcacacc

SEQ ID NO: 2657206 - DNA, 23 bp, Homo sapiens
ccttgacattgtagagcttctgg

SEQ ID NO: 2657207 - DNA, 12 bp, Homo sapiens
ccttgaccagca

SEQ ID NO: 2657208 - DNA, 21 bp, Homo sapiens
ccttgaccagcagatcccagc

SEQ ID NO: 2657209 - DNA, 20 bp, Homo sapiens
ccttgaccattctccacctg

SEQ ID NO: 2657210 - DNA, 21 bp, Homo sapiens
ccttgaggaaacaacagcttt

SEQ ID NO: 2657211 - DNA, 22 bp, Homo sapiens
ccttgaggaggggcaggtaaac

SEQ ID NO: 2657212 - DNA, 21 bp, Homo sapiens
ccttgagggtgcttgttccct

SEQ ID NO: 2657213 - DNA, 13 bp, Homo sapiens
ccttgaggtcttt

SEQ ID NO: 2657214 - DNA, 14 bp, Homo sapiens
ccttgagtggggtt

SEQ ID NO: 2657215 - DNA, 20 bp, Homo sapiens
ccttgagttgattcagctct

SEQ ID NO: 2657216 - DNA, 23 bp, Homo sapiens
ccttgagttgattcagctctgca

SEQ ID NO: 2657217 - DNA, 14 bp, Homo sapiens
ccttgatctgtata

SEQ ID NO: 2657218 - DNA, 19 bp, Homo sapiens
ccttgatggagatatttac

SEQ ID NO: 2657219 - DNA, 17 bp, Homo sapiens
ccttgcaacacacagac

SEQ ID NO: 2657220 - DNA, 22 bp, Homo sapiens
ccttgcaacacacagacacacg

SEQ ID NO: 2657221 - DNA, 19 bp, Homo sapiens
ccttgcacactcccctgca

SEQ ID NO: 2657222 - DNA, 14 bp, Homo sapiens
ccttgcacccctca

SEQ ID NO: 2657223 - DNA, 20 bp, Homo sapiens
ccttgcagcactcacacagg

SEQ ID NO: 2657224 - DNA, 17 bp, Homo sapiens
ccttgcagttcagcacc

SEQ ID NO: 2657225 - DNA, 17 bp, Homo sapiens
ccttgccaccccaccct

SEQ ID NO: 2657226 - DNA, 21 bp, Homo sapiens
ccttgccagggtttcgagaag

SEQ ID NO: 2657227 - DNA, 16 bp, Homo sapiens
ccttgcccagggctca

SEQ ID NO: 2657228 - DNA, 20 bp, Homo sapiens
ccttgcccagggctcagcct

SEQ ID NO: 2657229 - DNA, 21 bp, Homo sapiens
ccttgcccagggctcagcctg

SEQ ID NO: 2657230 - DNA, 19 bp, Homo sapiens
ccttgcccggattctggga

SEQ ID NO: 2657231 - DNA, 12 bp, Homo sapiens
ccttgccctgac

SEQ ID NO: 2657232 - DNA, 16 bp, Homo sapiens
ccttgccctgacctcc

SEQ ID NO: 2657233 - DNA, 23 bp, Homo sapiens
ccttgccctgacctcccagccct

SEQ ID NO: 2657234 - DNA, 18 bp, Homo sapiens
ccttgcccttgccctgac

SEQ ID NO: 2657235 - DNA, 17 bp, Homo sapiens
ccttgccgtctacctga

SEQ ID NO: 2657236 - DNA, 14 bp, Homo sapiens
ccttgctacccaga

SEQ ID NO: 2657237 - DNA, 14 bp, Homo sapiens
ccttgctacctcaa

SEQ ID NO: 2657238 - DNA, 20 bp, Homo sapiens
ccttgctctcccctgccctg

SEQ ID NO: 2657239 - DNA, 14 bp, Homo sapiens
ccttgctctccctc

SEQ ID NO: 2657240 - DNA, 17 bp, Homo sapiens
ccttgctctccctcttc

SEQ ID NO: 2657241 - DNA, 18 bp, Homo sapiens
ccttgcttatgacatcac

SEQ ID NO: 2657242 - DNA, 22 bp, Homo sapiens
ccttgcttggctgcttggcctt

SEQ ID NO: 2657243 - DNA, 19 bp, Homo sapiens
ccttggaaacctgccctgc

SEQ ID NO: 2657244 - DNA, 22 bp, Homo sapiens
ccttggaaacctgccctgcctg

SEQ ID NO: 2657245 - DNA, 12 bp, Homo sapiens
ccttggaggcca

SEQ ID NO: 2657246 - DNA, 13 bp, Homo sapiens
cgagtagctggga

SEQ ID NO: 2657247 - DNA, 14 bp, Homo sapiens
cgagtagctgggac

SEQ ID NO: 2657248 - DNA, 15 bp, Homo sapiens
cgagtagctgggact

SEQ ID NO: 2657249 - DNA, 16 bp, Homo sapiens
cgagtagctgggacta

SEQ ID NO: 2657250 - DNA, 13 bp, Homo sapiens
cgagtatgtgttt

SEQ ID NO: 2657251 - DNA, 20 bp, Homo sapiens
cgagtcaaaactcaaatgct

SEQ ID NO: 2657252 - DNA, 22 bp, Homo sapiens
cgagtcactgcctctccctggc

SEQ ID NO: 2657253 - DNA, 11 bp, Homo sapiens
cgagtgccagg

SEQ ID NO: 2657254 - DNA, 11 bp, Homo sapiens
cgagtgtgtgc

SEQ ID NO: 2657255 - DNA, 19 bp, Homo sapiens
cgagtgtgtgcatgtgtgt

SEQ ID NO: 2657256 - DNA, 15 bp, Homo sapiens
cgatccacctgtctc

SEQ ID NO: 2657257 - DNA, 22 bp, Homo sapiens
cgatccacctgtctcagcctcc

SEQ ID NO: 2657258 - DNA, 17 bp, Homo sapiens
cgatctcttattttaca

SEQ ID NO: 2657259 - DNA, 23 bp, Homo sapiens
cgatgaatttggagactctgtgg

SEQ ID NO: 2657260 - DNA, 22 bp, Homo sapiens
cgatgctccagccaacccctgt

SEQ ID NO: 2657261 - DNA, 18 bp, Homo sapiens
cgatgctgctttcccctg

SEQ ID NO: 2657262 - DNA, 22 bp, Homo sapiens
cgatgctgctttcccctgtggg

SEQ ID NO: 2657263 - DNA, 18 bp, Homo sapiens
cgatggctttgccagctt

SEQ ID NO: 2657264 - DNA, 17 bp, Homo sapiens
cgattattatctaaagt

SEQ ID NO: 2657265 - DNA, 16 bp, Homo sapiens
cgattcaccctgtcca

SEQ ID NO: 2657266 - DNA, 15 bp, Homo sapiens
cgattcatattgaat

SEQ ID NO: 2657267 - DNA, 19 bp, Homo sapiens
cgattcttctgcttcagcc

SEQ ID NO: 2657268 - DNA, 21 bp, Homo sapiens
cgattcttctgcttcagcctc

SEQ ID NO: 2657269 - DNA, 23 bp, Homo sapiens
cgattgcaggagtccctgccatc

SEQ ID NO: 2657270 - DNA, 15 bp, Homo sapiens
cgatttaattctctt

SEQ ID NO: 2657271 - DNA, 12 bp, Homo sapiens
cgatttctgttt

SEQ ID NO: 2657272 - DNA, 13 bp, Homo sapiens
cgattttgcctgt

SEQ ID NO: 2657273 - DNA, 13 bp, Homo sapiens
cgcacacacacaa

SEQ ID NO: 2657274 - DNA, 20 bp, Homo sapiens
cgcacacacacacacaggag

SEQ ID NO: 2657275 - DNA, 13 bp, Homo sapiens
cgcacagcagttc

SEQ ID NO: 2657276 - DNA, 13 bp, Homo sapiens
cgcacagtctctc

SEQ ID NO: 2657277 - DNA, 17 bp, Homo sapiens
cgcaccccccaagctgt

SEQ ID NO: 2657278 - DNA, 16 bp, Homo sapiens
cgcacctaccatcagg

SEQ ID NO: 2657279 - DNA, 18 bp, Homo sapiens
cgcacctcccatcctaat

SEQ ID NO: 2657280 - DNA, 14 bp, Homo sapiens
cgcacgcacacaca

SEQ ID NO: 2657281 - DNA, 15 bp, Homo sapiens
cgcacgcacacacac

SEQ ID NO: 2657282 - DNA, 16 bp, Homo sapiens
cgcacgcacacacaca

SEQ ID NO: 2657283 - DNA, 22 bp, Homo sapiens
cgcactacatgtggtttataga

SEQ ID NO: 2657284 - DNA, 18 bp, Homo sapiens
cgcactcacccatgtgcc

SEQ ID NO: 2657285 - DNA, 23 bp, Homo sapiens
cgcacttcgggaggtcgaggcag

SEQ ID NO: 2657286 - DNA, 13 bp, Homo sapiens
cgcagaagcagac

SEQ ID NO: 2657287 - DNA, 16 bp, Homo sapiens
cgcagacaggaccagg

SEQ ID NO: 2657288 - DNA, 14 bp, Homo sapiens
cgcagagaggccag

SEQ ID NO: 2657289 - DNA, 20 bp, Homo sapiens
cgcagctcttgcccttccct

SEQ ID NO: 2657290 - DNA, 23 bp, Homo sapiens
cgcagctcttgcccttccctgtc

SEQ ID NO: 2657291 - DNA, 13 bp, Homo sapiens
cgcaggaagctgc

SEQ ID NO: 2657292 - DNA, 15 bp, Homo sapiens
cgcaggaagctgctc

SEQ ID NO: 2657293 - DNA, 17 bp, Homo sapiens
cgcagtcaggggcagct

SEQ ID NO: 2657294 - DNA, 21 bp, Homo sapiens
cgcagtcgtcgcacagtctct

SEQ ID NO: 2657295 - DNA, 15 bp, Homo sapiens
cgcagtgcctctggt

SEQ ID NO: 2657296 - DNA, 18 bp, Homo sapiens
cgcatcaaaagacaattc

SEQ ID NO: 2657297 - DNA, 19 bp, Homo sapiens
cgcatcaaaagacaattct

SEQ ID NO: 2657298 - DNA, 14 bp, Homo sapiens
cgcatgcggcccag

SEQ ID NO: 2657299 - DNA, 18 bp, Homo sapiens
cgcatggagtgtgtattg

SEQ ID NO: 2657300 - DNA, 14 bp, Homo sapiens
cgcattctcatgga

SEQ ID NO: 2657301 - DNA, 18 bp, Homo sapiens
cgccacatggcttcctcc

SEQ ID NO: 2657302 - DNA, 17 bp, Homo sapiens
cgccacccctccttcct

SEQ ID NO: 2657303 - DNA, 18 bp, Homo sapiens
cgccagatggggcctctg

SEQ ID NO: 2657304 - DNA, 20 bp, Homo sapiens
cgccagattctttcctgagg

SEQ ID NO: 2657305 - DNA, 22 bp, Homo sapiens
cgccagattctttcctgaggct

SEQ ID NO: 2657306 - DNA, 15 bp, Homo sapiens
cgccagcgaacttga

SEQ ID NO: 2657307 - DNA, 11 bp, Homo sapiens
cgccagggccc

SEQ ID NO: 2657308 - DNA, 23 bp, Homo sapiens
cgccaggggaaaatcagcctgct

SEQ ID NO: 2657309 - DNA, 14 bp, Homo sapiens
cgccatcccagccc

SEQ ID NO: 2657310 - DNA, 18 bp, Homo sapiens
cgccattctcaagccctg

SEQ ID NO: 2657311 - DNA, 14 bp, Homo sapiens
cgccattgccacca

SEQ ID NO: 2657312 - DNA, 16 bp, Homo sapiens
cgccattgccaccagg

SEQ ID NO: 2657313 - DNA, 18 bp, Homo sapiens
cgccattgccaccaggag

SEQ ID NO: 2657314 - DNA, 14 bp, Homo sapiens
cgcccaacccttcc

SEQ ID NO: 2657315 - DNA, 15 bp, Homo sapiens
cgcccaacccttccc

SEQ ID NO: 2657316 - DNA, 23 bp, Homo sapiens
cgcccagctgcacctgccagcct

SEQ ID NO: 2657317 - DNA, 23 bp, Homo sapiens
cgcccaggatcagattgcatgtg

SEQ ID NO: 2657318 - DNA, 19 bp, Homo sapiens
cgcccagtctggaatgcag

SEQ ID NO: 2657319 - DNA, 19 bp, Homo sapiens
cgccccagataccagcccc

SEQ ID NO: 2657320 - DNA, 20 bp, Homo sapiens
cgccccagataccagcccct

SEQ ID NO: 2657321 - DNA, 21 bp, Homo sapiens
cgccccagatcaccagcccgg

SEQ ID NO: 2657322 - DNA, 12 bp, Homo sapiens
cgcccccacctc

SEQ ID NO: 2657323 - DNA, 19 bp, Homo sapiens
cgcccctcccacagcgctg

SEQ ID NO: 2657324 - DNA, 12 bp, Homo sapiens
cgcccgcgccct

SEQ ID NO: 2657325 - DNA, 17 bp, Homo sapiens
cgccctgctcctccctg

SEQ ID NO: 2657326 - DNA, 18 bp, Homo sapiens
cgccctgctcctccctgg

SEQ ID NO: 2657327 - DNA, 21 bp, Homo sapiens
cgccctgctcctccctggctg

SEQ ID NO: 2657328 - DNA, 22 bp, Homo sapiens
cgccctggaagccggcggccca

SEQ ID NO: 2657329 - DNA, 21 bp, Homo sapiens
cgccgcaaaccacactggact

SEQ ID NO: 2657330 - DNA, 22 bp, Homo sapiens
cgccgcaaaccacactggactc

SEQ ID NO: 2657331 - DNA, 16 bp, Homo sapiens
cgccggggacagaggc

SEQ ID NO: 2657332 - DNA, 17 bp, Homo sapiens
cgccggggacagaggcc

SEQ ID NO: 2657333 - DNA, 20 bp, Homo sapiens
cgccggggacagaggcctgc

SEQ ID NO: 2657334 - DNA, 17 bp, Homo sapiens
cgcctcaggaatgggct

SEQ ID NO: 2657335 - DNA, 19 bp, Homo sapiens
cgcctcaggaatgggctgt

SEQ ID NO: 2657336 - DNA, 13 bp, Homo sapiens
cgcctcccactgg

SEQ ID NO: 2657337 - DNA, 11 bp, Homo sapiens
cgcctcccagc

SEQ ID NO: 2657338 - DNA, 13 bp, Homo sapiens
cgcctctcccgtc

SEQ ID NO: 2657339 - DNA, 21 bp, Homo sapiens
cgcctctcccgtcagggccca

SEQ ID NO: 2657340 - DNA, 23 bp, Homo sapiens
cgcctgcccgtctctctcccatg

SEQ ID NO: 2657341 - DNA, 20 bp, Homo sapiens
cgcctgccctcatggcccct

SEQ ID NO: 2657342 - DNA, 13 bp, Homo sapiens
cgcctgccctccc

SEQ ID NO: 2657343 - DNA, 17 bp, Homo sapiens
cgcctgtagtcctagcc

SEQ ID NO: 2657344 - DNA, 20 bp, Homo sapiens
cgcctgtagtcctagccact

SEQ ID NO: 2657345 - DNA, 22 bp, Homo sapiens
cgccttcactccggtgtgcctg

SEQ ID NO: 2657346 - DNA, 22 bp, Homo sapiens
cgcgaaagtatcaccagggtgc

SEQ ID NO: 2657347 - DNA, 22 bp, Homo sapiens
cgcgccactacactccagcctg

SEQ ID NO: 2657348 - DNA, 23 bp, Homo sapiens
cgcgccactacactccagcctga

SEQ ID NO: 2657349 - DNA, 12 bp, Homo sapiens
cgcggccagccc

SEQ ID NO: 2657350 - DNA, 14 bp, Homo sapiens
cgcggccagccccg

SEQ ID NO: 2657351 - DNA, 15 bp, Homo sapiens
cgcggccagccccgg

SEQ ID NO: 2657352 - DNA, 15 bp, Homo sapiens
cgcggcggagctggc

SEQ ID NO: 2657353 - DNA, 17 bp, Homo sapiens
cgcggcggagctggccc

SEQ ID NO: 2657354 - DNA, 19 bp, Homo sapiens
cgcggtggctcacgcctgt

SEQ ID NO: 2657355 - DNA, 21 bp, Homo sapiens
cgcgtctcctgtttttctggg

SEQ ID NO: 2657356 - DNA, 19 bp, Homo sapiens
cgcgtgcacacaccagagc

SEQ ID NO: 2657357 - DNA, 16 bp, Homo sapiens
cgctaagagggaggga

SEQ ID NO: 2657358 - DNA, 21 bp, Homo sapiens
cgctaatcccgattcaccctg

SEQ ID NO: 2657359 - DNA, 16 bp, Homo sapiens
cgctacccgggaaggg

SEQ ID NO: 2657360 - DNA, 21 bp, Homo sapiens
cgctacccgggaagggggctg

SEQ ID NO: 2657361 - DNA, 15 bp, Homo sapiens
cgctagaggcctgag

SEQ ID NO: 2657362 - DNA, 17 bp, Homo sapiens
cgctagaggcctgagga

SEQ ID NO: 2657363 - DNA, 14 bp, Homo sapiens
cgctcctgtctgcc

SEQ ID NO: 2657364 - DNA, 17 bp, Homo sapiens
cgctcctgtctgccagc

SEQ ID NO: 2657365 - DNA, 13 bp, Homo sapiens
cgctcctgtgtct

SEQ ID NO: 2657366 - DNA, 12 bp, Homo sapiens
cgctctgcatgc

SEQ ID NO: 2657367 - DNA, 19 bp, Homo sapiens
cgctctgcatgcggcccag

SEQ ID NO: 2657368 - DNA, 16 bp, Homo sapiens
cgctctgctggcctgg

SEQ ID NO: 2657369 - DNA, 21 bp, Homo sapiens
cgctctgctggcctggccggc

SEQ ID NO: 2657370 - DNA, 15 bp, Homo sapiens
cgctctgtcacccag

SEQ ID NO: 2657371 - DNA, 19 bp, Homo sapiens
cgctctgttgcccaggctg

SEQ ID NO: 2657372 - DNA, 22 bp, Homo sapiens
cgctctgttgcccaggctggag

SEQ ID NO: 2657373 - DNA, 21 bp, Homo sapiens
cgctcttggcaggtactcagc

SEQ ID NO: 2657374 - DNA, 14 bp, Homo sapiens
cgctgaataaatgt

SEQ ID NO: 2657375 - DNA, 15 bp, Homo sapiens
cgctgaataaatgtc

SEQ ID NO: 2657376 - DNA, 13 bp, Homo sapiens
cgctgatatatgt

SEQ ID NO: 2657377 - DNA, 16 bp, Homo sapiens
cgctgattctcagggt

SEQ ID NO: 2657378 - DNA, 19 bp, Homo sapiens
cgctgcaacctgttgatag

SEQ ID NO: 2657379 - DNA, 18 bp, Homo sapiens
cgctggaggtggggcctg

SEQ ID NO: 2657380 - DNA, 18 bp, Homo sapiens
cgctggagtgcagtgagc

SEQ ID NO: 2657381 - DNA, 11 bp, Homo sapiens
cgctggcccag

SEQ ID NO: 2657382 - DNA, 23 bp, Homo sapiens
cgctggccgggaccccgagcctg

SEQ ID NO: 2657383 - DNA, 20 bp, Homo sapiens
cgctggggccagttggtccc

SEQ ID NO: 2657384 - DNA, 22 bp, Homo sapiens
cgctgggtggtaccctctggag

SEQ ID NO: 2657385 - DNA, 15 bp, Homo sapiens
cgctgtctccagacc

SEQ ID NO: 2657386 - DNA, 16 bp, Homo sapiens
cgctgtctccagaccc

SEQ ID NO: 2657387 - DNA, 16 bp, Homo sapiens
cgctgtgagcccctgg

SEQ ID NO: 2657388 - DNA, 14 bp, Homo sapiens
cgctgtgctgccct

SEQ ID NO: 2657389 - DNA, 23 bp, Homo sapiens
cgctgtgctgccctgcccacctg

SEQ ID NO: 2657390 - DNA, 20 bp, Homo sapiens
cgcttccggctcctgtgctt

SEQ ID NO: 2657391 - DNA, 15 bp, Homo sapiens
ctactcctctgcagt

SEQ ID NO: 2657392 - DNA, 20 bp, Homo sapiens
ctactcctctgcagtgcctt

SEQ ID NO: 2657393 - DNA, 22 bp, Homo sapiens
ctactctcaggatcaagaaagt

SEQ ID NO: 2657394 - DNA, 14 bp, Homo sapiens
ctactctgtgccag

SEQ ID NO: 2657395 - DNA, 12 bp, Homo sapiens
ctactctgtgtc

SEQ ID NO: 2657396 - DNA, 13 bp, Homo sapiens
ctactctgtgtca

SEQ ID NO: 2657397 - DNA, 21 bp, Homo sapiens
ctactctgtgtcaggtggggc

SEQ ID NO: 2657398 - DNA, 15 bp, Homo sapiens
ctactctgttccttc

SEQ ID NO: 2657399 - DNA, 16 bp, Homo sapiens
ctactctgttccttca

SEQ ID NO: 2657400 - DNA, 17 bp, Homo sapiens
ctactcttaagccatct

SEQ ID NO: 2657401 - DNA, 22 bp, Homo sapiens
ctactcttaagccatcttggta

SEQ ID NO: 2657402 - DNA, 16 bp, Homo sapiens
ctactgattgtttcat

SEQ ID NO: 2657403 - DNA, 14 bp, Homo sapiens
ctactgcagcttta

SEQ ID NO: 2657404 - DNA, 17 bp, Homo sapiens
ctactggtcttgtggaa

SEQ ID NO: 2657405 - DNA, 21 bp, Homo sapiens
ctactgtaagcaagaaaaata

SEQ ID NO: 2657406 - DNA, 20 bp, Homo sapiens
ctactgtggaaaaatattta

SEQ ID NO: 2657407 - DNA, 15 bp, Homo sapiens
ctactgtgttcctgg

SEQ ID NO: 2657408 - DNA, 19 bp, Homo sapiens
ctactgtgttcctggcaat

SEQ ID NO: 2657409 - DNA, 19 bp, Homo sapiens
ctacttaccatatgtgctt

SEQ ID NO: 2657410 - DNA, 17 bp, Homo sapiens
ctacttcctcctcccca

SEQ ID NO: 2657411 - DNA, 19 bp, Homo sapiens
ctacttcctcctccccact

SEQ ID NO: 2657412 - DNA, 20 bp, Homo sapiens
ctacttcctcctccccactt

SEQ ID NO: 2657413 - DNA, 22 bp, Homo sapiens
ctacttctttgctttgcccagc

SEQ ID NO: 2657414 - DNA, 22 bp, Homo sapiens
ctacttcttttgctcttagctg

SEQ ID NO: 2657415 - DNA, 12 bp, Homo sapiens
ctacttgggagg

SEQ ID NO: 2657416 - DNA, 21 bp, Homo sapiens
ctactttgactttttgcattt

SEQ ID NO: 2657417 - DNA, 22 bp, Homo sapiens
ctactttgtcctttttgttatt

SEQ ID NO: 2657418 - DNA, 18 bp, Homo sapiens
ctactttgtctaaaaata

SEQ ID NO: 2657419 - DNA, 19 bp, Homo sapiens
ctagaaattccccaccctg

SEQ ID NO: 2657420 - DNA, 18 bp, Homo sapiens
ctagaacctggaagggct

SEQ ID NO: 2657421 - DNA, 14 bp, Homo sapiens
ctagaacctggaga

SEQ ID NO: 2657422 - DNA, 18 bp, Homo sapiens
ctagaacctggagggctg

SEQ ID NO: 2657423 - DNA, 18 bp, Homo sapiens
ctagaactctccatctta

SEQ ID NO: 2657424 - DNA, 13 bp, Homo sapiens
ctagaaggccaca

SEQ ID NO: 2657425 - DNA, 20 bp, Homo sapiens
ctagaagggccagtcctgcc

SEQ ID NO: 2657426 - DNA, 22 bp, Homo sapiens
ctagaagggctagaacctggag

SEQ ID NO: 2657427 - DNA, 15 bp, Homo sapiens
ctagaagttactgaa

SEQ ID NO: 2657428 - DNA, 18 bp, Homo sapiens
ctagaagttactgaatgc

SEQ ID NO: 2657429 - DNA, 19 bp, Homo sapiens
ctagaagttactgaatgca

SEQ ID NO: 2657430 - DNA, 20 bp, Homo sapiens
ctagaatatcctacttctcc

SEQ ID NO: 2657431 - DNA, 20 bp, Homo sapiens
ctagaattccctctctctga

SEQ ID NO: 2657432 - DNA, 22 bp, Homo sapiens
ctagaattccctctctctgact

SEQ ID NO: 2657433 - DNA, 21 bp, Homo sapiens
ctagaatttatcacacttctg

SEQ ID NO: 2657434 - DNA, 13 bp, Homo sapiens
ctagaatttattc

SEQ ID NO: 2657435 - DNA, 22 bp, Homo sapiens
ctagaatttattcaattcctct

SEQ ID NO: 2657436 - DNA, 23 bp, Homo sapiens
ctagaatttattcaattcctctg

SEQ ID NO: 2657437 - DNA, 14 bp, Homo sapiens
ctagaatttcttta

SEQ ID NO: 2657438 - DNA, 19 bp, Homo sapiens
ctagaattttaagtgcttt

SEQ ID NO: 2657439 - DNA, 15 bp, Homo sapiens
ctagacaaccctgca

SEQ ID NO: 2657440 - DNA, 13 bp, Homo sapiens
ctagacactgcca

SEQ ID NO: 2657441 - DNA, 19 bp, Homo sapiens
ctagacgcttcatcccaca

SEQ ID NO: 2657442 - DNA, 12 bp, Homo sapiens
ctagactttctg

SEQ ID NO: 2657443 - DNA, 17 bp, Homo sapiens
ctagagatctggttttg

SEQ ID NO: 2657444 - DNA, 21 bp, Homo sapiens
ctagagatctggttttgctat

SEQ ID NO: 2657445 - DNA, 12 bp, Homo sapiens
ctagagcctgcc

SEQ ID NO: 2657446 - DNA, 15 bp, Homo sapiens
ctagagcctgcctgg

SEQ ID NO: 2657447 - DNA, 18 bp, Homo sapiens
ctagaggccagccccacc

SEQ ID NO: 2657448 - DNA, 19 bp, Homo sapiens
ctagaggccagccccaccc

SEQ ID NO: 2657449 - DNA, 23 bp, Homo sapiens
ctagaggccagccccacccagga

SEQ ID NO: 2657450 - DNA, 12 bp, Homo sapiens
ctagaggcctga

SEQ ID NO: 2657451 - DNA, 20 bp, Homo sapiens
ctagagggacctctcccagg

SEQ ID NO: 2657452 - DNA, 13 bp, Homo sapiens
ctagatactgtat

SEQ ID NO: 2657453 - DNA, 18 bp, Homo sapiens
ctagatccacacacagag

SEQ ID NO: 2657454 - DNA, 19 bp, Homo sapiens
ctagatccacacacagagg

SEQ ID NO: 2657455 - DNA, 21 bp, Homo sapiens
ctagatccacacacagaggaa

SEQ ID NO: 2657456 - DNA, 20 bp, Homo sapiens
ctagatgggcatggggtggg

SEQ ID NO: 2657457 - DNA, 21 bp, Homo sapiens
ctagattaccccctcattgtt

SEQ ID NO: 2657458 - DNA, 20 bp, Homo sapiens
ctagattctacatattcttt

SEQ ID NO: 2657459 - DNA, 24 bp, Homo sapiens
ctagattgagagaagagacaaaca

SEQ ID NO: 2657460 - DNA, 20 bp, Homo sapiens
ctagcaatcacaacactggc

SEQ ID NO: 2657461 - DNA, 15 bp, Homo sapiens
ctagcactggcctgc

SEQ ID NO: 2657462 - DNA, 16 bp, Homo sapiens
ctagcacttggagcca

SEQ ID NO: 2657463 - DNA, 17 bp, Homo sapiens
ctagcactttgggaggc

SEQ ID NO: 2657464 - DNA, 23 bp, Homo sapiens
ctagcagagcaggggcagggtga

SEQ ID NO: 2657465 - DNA, 18 bp, Homo sapiens
ctagcatacgtacacatt

SEQ ID NO: 2657466 - DNA, 20 bp, Homo sapiens
ctagccagcacttgtatata

SEQ ID NO: 2657467 - DNA, 15 bp, Homo sapiens
ctagccattcctggt

SEQ ID NO: 2657468 - DNA, 20 bp, Homo sapiens
ctagccattcctggtaccca

SEQ ID NO: 2657469 - DNA, 21 bp, Homo sapiens
ctagccattcctggtacccag

SEQ ID NO: 2657470 - DNA, 13 bp, Homo sapiens
ctagccgacctca

SEQ ID NO: 2657471 - DNA, 19 bp, Homo sapiens
ctagcctgtgcctctggga

SEQ ID NO: 2657472 - DNA, 21 bp, Homo sapiens
ctagcctgtgcctctgggact

SEQ ID NO: 2657473 - DNA, 17 bp, Homo sapiens
ctagccttatcctctga

SEQ ID NO: 2657474 - DNA, 18 bp, Homo sapiens
ctagccttatcctctgat

SEQ ID NO: 2657475 - DNA, 13 bp, Homo sapiens
ctagctcccctcc

SEQ ID NO: 2657476 - DNA, 14 bp, Homo sapiens
ctagctctgagcca

SEQ ID NO: 2657477 - DNA, 17 bp, Homo sapiens
ctagctgcacagggcag

SEQ ID NO: 2657478 - DNA, 21 bp, Homo sapiens
ctagctgcacagggcagctgg

SEQ ID NO: 2657479 - DNA, 14 bp, Homo sapiens
ctagctgctacaaa

SEQ ID NO: 2657480 - DNA, 15 bp, Homo sapiens
ctagctgctacaaag

SEQ ID NO: 2657481 - DNA, 16 bp, Homo sapiens
ctagctgctacaaaga

SEQ ID NO: 2657482 - DNA, 21 bp, Homo sapiens
ctagctgctacaaagaagaca

SEQ ID NO: 2657483 - DNA, 23 bp, Homo sapiens
ctagctgctacaaagaagacatg

SEQ ID NO: 2657484 - DNA, 22 bp, Homo sapiens
ctagctggtggtttcacggtgc

SEQ ID NO: 2657485 - DNA, 15 bp, Homo sapiens
ctagcttagagcctc

SEQ ID NO: 2657486 - DNA, 20 bp, Homo sapiens
ctagcttagagcctccctca

SEQ ID NO: 2657487 - DNA, 22 bp, Homo sapiens
ctagcttagagcctccctcaat

SEQ ID NO: 2657488 - DNA, 12 bp, Homo sapiens
ctaggaaaatac

SEQ ID NO: 2657489 - DNA, 16 bp, Homo sapiens
ctaggaatgaaatcct

SEQ ID NO: 2657490 - DNA, 17 bp, Homo sapiens
ctaggaatgaaatcctg

SEQ ID NO: 2657491 - DNA, 19 bp, Homo sapiens
ctaggagatatctgaggga

SEQ ID NO: 2657492 - DNA, 23 bp, Homo sapiens
ctaggagatatctgagggaggag

SEQ ID NO: 2657493 - DNA, 13 bp, Homo sapiens
ctaggagcactgt

SEQ ID NO: 2657494 - DNA, 18 bp, Homo sapiens
ctaggcatcccaggggac

SEQ ID NO: 2657495 - DNA, 19 bp, Homo sapiens
ctaggcatcccaggggacc

SEQ ID NO: 2657496 - DNA, 19 bp, Homo sapiens
ctaggcctggccagatgca

SEQ ID NO: 2657497 - DNA, 16 bp, Homo sapiens
ctaggcgagtgccagg

SEQ ID NO: 2657498 - DNA, 20 bp, Homo sapiens
ctaggcgagtgccaggactc

SEQ ID NO: 2657499 - DNA, 20 bp, Homo sapiens
ctaggctacaattttctccc

SEQ ID NO: 2657500 - DNA, 15 bp, Homo sapiens
ctaggctggagccca

SEQ ID NO: 2657501 - DNA, 17 bp, Homo sapiens
ctaggctggagcccagg

SEQ ID NO: 2657502 - DNA, 20 bp, Homo sapiens
ctaggctggagcccagggag

SEQ ID NO: 2657503 - DNA, 13 bp, Homo sapiens
ctaggctggggaa

SEQ ID NO: 2657504 - DNA, 23 bp, Homo sapiens
ctaggcttcagcatatttatagc

SEQ ID NO: 2657505 - DNA, 19 bp, Homo sapiens
ctagggaaaaaccagcgtg

SEQ ID NO: 2657506 - DNA, 21 bp, Homo sapiens
ctagggaaaaaccagcgtgtg

SEQ ID NO: 2657507 - DNA, 14 bp, Homo sapiens
ctagggaggacctt

SEQ ID NO: 2657508 - DNA, 16 bp, Homo sapiens
ctagggagtggtcttt

SEQ ID NO: 2657509 - DNA, 13 bp, Homo sapiens
ctagggatccctc

SEQ ID NO: 2657510 - DNA, 23 bp, Homo sapiens
ctagggatccctcatctgtccct

SEQ ID NO: 2657511 - DNA, 16 bp, Homo sapiens
ctagggattcaggctg

SEQ ID NO: 2657512 - DNA, 17 bp, Homo sapiens
ctagggattcaggctgc

SEQ ID NO: 2657513 - DNA, 18 bp, Homo sapiens
ctagggccaagcccagca

SEQ ID NO: 2657514 - DNA, 14 bp, Homo sapiens
ctaggtacttcagg

SEQ ID NO: 2657515 - DNA, 14 bp, Homo sapiens
ctaggtgacagagt

SEQ ID NO: 2657516 - DNA, 18 bp, Homo sapiens
ctaggtgacagagtgaga

SEQ ID NO: 2657517 - DNA, 18 bp, Homo sapiens
ctaggtgcccttggaggc

SEQ ID NO: 2657518 - DNA, 17 bp, Homo sapiens
ctaggtggcaaggctgt

SEQ ID NO: 2657519 - DNA, 17 bp, Homo sapiens
ctaggtgggccagcccc

SEQ ID NO: 2657520 - DNA, 15 bp, Homo sapiens
ctaggtttaactcag

SEQ ID NO: 2657521 - DNA, 16 bp, Homo sapiens
ctaggtttaactcaga

SEQ ID NO: 2657522 - DNA, 18 bp, Homo sapiens
ctagtaagtgccttccat

SEQ ID NO: 2657523 - DNA, 16 bp, Homo sapiens
ctagtactaactccta

SEQ ID NO: 2657524 - DNA, 14 bp, Homo sapiens
ctagtcccttcccc

SEQ ID NO: 2657525 - DNA, 20 bp, Homo sapiens
ctagtcccttcccctccctg

SEQ ID NO: 2657526 - DNA, 21 bp, Homo sapiens
ctagtcccttcccctccctgg

SEQ ID NO: 2657527 - DNA, 20 bp, Homo sapiens
ctagtcgtggagatgtcttc

SEQ ID NO: 2657528 - DNA, 20 bp, Homo sapiens
ctagtctcctttgcactgag

SEQ ID NO: 2657529 - DNA, 23 bp, Homo sapiens
ctagtctcctttgcactgagggc

SEQ ID NO: 2657530 - DNA, 18 bp, Homo sapiens
ctagtgaaagaggcagct

SEQ ID NO: 2657531 - DNA, 21 bp, Homo sapiens
ctagtgaaggcttctctctgt

SEQ ID NO: 2657532 - DNA, 14 bp, Homo sapiens
ctagtgacccggag

SEQ ID NO: 2657533 - DNA, 15 bp, Homo sapiens
ctagtgcagctgatt

SEQ ID NO: 2657534 - DNA, 19 bp, Homo sapiens
ctagtgcagctgattttaa

SEQ ID NO: 2657535 - DNA, 20 bp, Homo sapiens
ctagtgcagctgattttaac

SEQ ID NO: 2657536 - DNA, 22 bp, Homo sapiens
ctagtgcagctgattttaacaa

SEQ ID NO: 2657537 - DNA, 13 bp, Homo sapiens
ctagtgctgtgaa

SEQ ID NO: 2657538 - DNA, 14 bp, Homo sapiens
ctagtgctgtgaaa

SEQ ID NO: 2657539 - DNA, 13 bp, Homo sapiens
ctagtgctttcct

SEQ ID NO: 2657540 - DNA, 15 bp, Homo sapiens
ctagtggtctttgta

SEQ ID NO: 2657541 - DNA, 22 bp, Homo sapiens
ctagtggtctttgtaagagtgt

SEQ ID NO: 2657542 - DNA, 19 bp, Homo sapiens
ctagtgtggtgtttcctgg

SEQ ID NO: 2657543 - DNA, 23 bp, Homo sapiens
ctagtgtggtgtttcctggcact

SEQ ID NO: 2657544 - DNA, 12 bp, Homo sapiens
ctagttcatcca

SEQ ID NO: 2657545 - DNA, 20 bp, Homo sapiens
ctagttccaccatcaagcca

SEQ ID NO: 2657546 - DNA, 23 bp, Homo sapiens
ctagttgtttgattcagacagct

SEQ ID NO: 2657547 - DNA, 15 bp, Homo sapiens
ctagtttgattaaat

SEQ ID NO: 2657548 - DNA, 16 bp, Homo sapiens
ctagttttctcctccc

SEQ ID NO: 2657549 - DNA, 19 bp, Homo sapiens
ctagttttctcctcccagg

SEQ ID NO: 2657550 - DNA, 17 bp, Homo sapiens
ctataaacaattacatg

SEQ ID NO: 2657551 - DNA, 18 bp, Homo sapiens
ctataaatggtgtttttt

SEQ ID NO: 2657552 - DNA, 12 bp, Homo sapiens
ctataatgaagc

SEQ ID NO: 2657553 - DNA, 15 bp, Homo sapiens
ctataatgaagcttt

SEQ ID NO: 2657554 - DNA, 22 bp, Homo sapiens
ctataattccctatcttttagt

SEQ ID NO: 2657555 - DNA, 19 bp, Homo sapiens
ctatacgcagcgtgcttta

SEQ ID NO: 2657556 - DNA, 17 bp, Homo sapiens
ctatactgcatactttt

SEQ ID NO: 2657557 - DNA, 19 bp, Homo sapiens
ctatagacccgaggaaact

SEQ ID NO: 2657558 - DNA, 10 bp, Homo sapiens
ctatagcacc

SEQ ID NO: 2657559 - DNA, 23 bp, Homo sapiens
ctatagctcaggacctgggacct

SEQ ID NO: 2657560 - DNA, 16 bp, Homo sapiens
ctataggctggagaag

SEQ ID NO: 2657561 - DNA, 20 bp, Homo sapiens
ctataggtgctacaaaaaca

SEQ ID NO: 2657562 - DNA, 22 bp, Homo sapiens
ctataggtgctacaaaaacaca

SEQ ID NO: 2657563 - DNA, 21 bp, Homo sapiens
ctatatactcactttctagat

SEQ ID NO: 2657564 - DNA, 14 bp, Homo sapiens
ctatatagagatgt

SEQ ID NO: 2657565 - DNA, 22 bp, Homo sapiens
ctatatagtttattgacaataa

SEQ ID NO: 2657566 - DNA, 13 bp, Homo sapiens
ctatatataattc

SEQ ID NO: 2657567 - DNA, 16 bp, Homo sapiens
ctatatataattctgt

SEQ ID NO: 2657568 - DNA, 15 bp, Homo sapiens
ctatatatgtgtatg

SEQ ID NO: 2657569 - DNA, 13 bp, Homo sapiens
ctatatccatgta

SEQ ID NO: 2657570 - DNA, 14 bp, Homo sapiens
ctatatctatatat

SEQ ID NO: 2657571 - DNA, 15 bp, Homo sapiens
ctatatgaaaaacaa

SEQ ID NO: 2657572 - DNA, 16 bp, Homo sapiens
ctatatgaatttaaat

SEQ ID NO: 2657573 - DNA, 17 bp, Homo sapiens
ctatatgatttatagtt

SEQ ID NO: 2657574 - DNA, 19 bp, Homo sapiens
ctatatgatttatagtttg

SEQ ID NO: 2657575 - DNA, 13 bp, Homo sapiens
ctatatggcaaga

SEQ ID NO: 2657576 - DNA, 21 bp, Homo sapiens
ctatatgtagtataaagaaaa

SEQ ID NO: 2657577 - DNA, 18 bp, Homo sapiens
ctatatgtgaatcctctt

SEQ ID NO: 2657578 - DNA, 14 bp, Homo sapiens
ctatattgtacaca

SEQ ID NO: 2657579 - DNA, 23 bp, Homo sapiens
ctatattgttttcagtgtacatg

SEQ ID NO: 2657580 - DNA, 16 bp, Homo sapiens
ctatatttaacaagat

SEQ ID NO: 2657581 - DNA, 12 bp, Homo sapiens
ctatatttacag

SEQ ID NO: 2657582 - DNA, 13 bp, Homo sapiens
ctatatttagatt

SEQ ID NO: 2657583 - DNA, 16 bp, Homo sapiens
ctatcaaactgaagcc

SEQ ID NO: 2657584 - DNA, 21 bp, Homo sapiens
ctatcaaactgaagccagaaa

SEQ ID NO: 2657585 - DNA, 15 bp, Homo sapiens
ctatcacctcccctc

SEQ ID NO: 2657586 - DNA, 19 bp, Homo sapiens
ctatcacctcccctccttg

SEQ ID NO: 2657587 - DNA, 13 bp, Homo sapiens
ctatcagaagacc

SEQ ID NO: 2657588 - DNA, 14 bp, Homo sapiens
ctatcatggagtga

SEQ ID NO: 2657589 - DNA, 16 bp, Homo sapiens
ctatcatttttgtaca

SEQ ID NO: 2657590 - DNA, 15 bp, Homo sapiens
ctatccacagagagt

SEQ ID NO: 2657591 - DNA, 13 bp, Homo sapiens
ctatcctacccca

SEQ ID NO: 2657592 - DNA, 12 bp, Homo sapiens
ctatcctctgta

SEQ ID NO: 2657593 - DNA, 16 bp, Homo sapiens
ctatctaaccctccca

SEQ ID NO: 2657594 - DNA, 14 bp, Homo sapiens
ctatctcccccagc

SEQ ID NO: 2657595 - DNA, 15 bp, Homo sapiens
ctatctcccccagcc

SEQ ID NO: 2657596 - DNA, 17 bp, Homo sapiens
ctatctcccccagcccc

SEQ ID NO: 2657597 - DNA, 17 bp, Homo sapiens
ctatctcgtgggagagc

SEQ ID NO: 2657598 - DNA, 13 bp, Homo sapiens
ctatcttaatttt

SEQ ID NO: 2657599 - DNA, 21 bp, Homo sapiens
ctatcttatatagtttactat

SEQ ID NO: 2657600 - DNA, 17 bp, Homo sapiens
ctatcttgctctgtaat

SEQ ID NO: 2657601 - DNA, 15 bp, Homo sapiens
ctatctttgccaccc

SEQ ID NO: 2657602 - DNA, 18 bp, Homo sapiens
ctatctttgccaccctca

SEQ ID NO: 2657603 - DNA, 13 bp, Homo sapiens
ctatgaactacaa

SEQ ID NO: 2657604 - DNA, 14 bp, Homo sapiens
ctatgaatgggcaa

SEQ ID NO: 2657605 - DNA, 17 bp, Homo sapiens
ctatgactgctccccag

SEQ ID NO: 2657606 - DNA, 12 bp, Homo sapiens
ctatgcacatat

SEQ ID NO: 2657607 - DNA, 13 bp, Homo sapiens
ctatgcacatatg

SEQ ID NO: 2657608 - DNA, 12 bp, Homo sapiens
ctatgcatttga

SEQ ID NO: 2657609 - DNA, 14 bp, Homo sapiens
ctatgcatttgaaa

SEQ ID NO: 2657610 - DNA, 20 bp, Homo sapiens
ctatgccagctcagtcccat

SEQ ID NO: 2657611 - DNA, 21 bp, Homo sapiens
ctatgctggtaggctcctgcc

SEQ ID NO: 2657612 - DNA, 17 bp, Homo sapiens
ctatggaagcatattgt

SEQ ID NO: 2657613 - DNA, 22 bp, Homo sapiens
ctatggacggtgctccaggcag

SEQ ID NO: 2657614 - DNA, 15 bp, Homo sapiens
ctatggatggcttct

SEQ ID NO: 2657615 - DNA, 24 bp, Homo sapiens
ctatggatgtggggtccccatcat

SEQ ID NO: 2657616 - DNA, 22 bp, Homo sapiens
ctatgggactcaatgcactgac

SEQ ID NO: 2657617 - DNA, 15 bp, Homo sapiens
ctatgggagccccag

SEQ ID NO: 2657618 - DNA, 17 bp, Homo sapiens
ctatgggagccccaggg

SEQ ID NO: 2657619 - DNA, 20 bp, Homo sapiens
ctatggggatagatgtgtgg

SEQ ID NO: 2657620 - DNA, 21 bp, Homo sapiens
ctatggggatagatgtgtgga

SEQ ID NO: 2657621 - DNA, 21 bp, Homo sapiens
ctatgtaactgcattgagaac

SEQ ID NO: 2657622 - DNA, 22 bp, Homo sapiens
ctatgtaggaaagaccattttt

SEQ ID NO: 2657623 - DNA, 19 bp, Homo sapiens
ctatgtatcaatgagtaac

SEQ ID NO: 2657624 - DNA, 22 bp, Homo sapiens
ctatgtatttgcagttcacctg

SEQ ID NO: 2657625 - DNA, 15 bp, Homo sapiens
ctatgtcctaaggac

SEQ ID NO: 2657626 - DNA, 12 bp, Homo sapiens
ctatgtgacaat

SEQ ID NO: 2657627 - DNA, 20 bp, Homo sapiens
ctatgtgacttgcatcgtgg

SEQ ID NO: 2657628 - DNA, 11 bp, Homo sapiens
ctatgtgattt

SEQ ID NO: 2657629 - DNA, 22 bp, Homo sapiens
ctatgtgattttaactctgtct

SEQ ID NO: 2657630 - DNA, 15 bp, Homo sapiens
ctatgttgcccaggc

SEQ ID NO: 2657631 - DNA, 17 bp, Homo sapiens
ctatgttgcccaggcag

SEQ ID NO: 2657632 - DNA, 20 bp, Homo sapiens
ctatgtttttgttcaaagcc

SEQ ID NO: 2657633 - DNA, 15 bp, Homo sapiens
ctattaaaggaataa

SEQ ID NO: 2657634 - DNA, 23 bp, Homo sapiens
ctattaagaggcagaaaattgca

SEQ ID NO: 2657635 - DNA, 17 bp, Homo sapiens
ctattaagatttccaag

SEQ ID NO: 2657636 - DNA, 22 bp, Homo sapiens
ctattagccaggatcatggtgt

SEQ ID NO: 2657637 - DNA, 13 bp, Homo sapiens
ctattagccagtc

SEQ ID NO: 2657638 - DNA, 15 bp, Homo sapiens
ctattataatttaat

SEQ ID NO: 2657639 - DNA, 17 bp, Homo sapiens
ctattataatttaatgc

SEQ ID NO: 2657640 - DNA, 22 bp, Homo sapiens
ctattattttcactgtagaatg

SEQ ID NO: 2657641 - DNA, 11 bp, Homo sapiens
ctattcacaac

SEQ ID NO: 2657642 - DNA, 13 bp, Homo sapiens
ctattcagacaag

SEQ ID NO: 2657643 - DNA, 20 bp, Homo sapiens
ctattcccacacctccacag

SEQ ID NO: 2657644 - DNA, 17 bp, Homo sapiens
ctattccccagcagggt

SEQ ID NO: 2657645 - DNA, 16 bp, Homo sapiens
ctattctcaccaggaa

SEQ ID NO: 2657646 - DNA, 14 bp, Homo sapiens
ctattgacttcaat

SEQ ID NO: 2657647 - DNA, 15 bp, Homo sapiens
ctattgatgtacagt

SEQ ID NO: 2657648 - DNA, 12 bp, Homo sapiens
ctattgcccagg

SEQ ID NO: 2657649 - DNA, 16 bp, Homo sapiens
ctattgctgcttgagg

SEQ ID NO: 2657650 - DNA, 15 bp, Homo sapiens
ctattgggttcatta

SEQ ID NO: 2657651 - DNA, 16 bp, Homo sapiens
ctattgggttcattat

SEQ ID NO: 2657652 - DNA, 23 bp, Homo sapiens
ctattgggttcattattggaatt

SEQ ID NO: 2657653 - DNA, 14 bp, Homo sapiens
ctattgtcattaaa

SEQ ID NO: 2657654 - DNA, 17 bp, Homo sapiens
ctattgtgatttgactg

SEQ ID NO: 2657655 - DNA, 18 bp, Homo sapiens
ctattgtgatttgactgt

SEQ ID NO: 2657656 - DNA, 16 bp, Homo sapiens
ctattgttactctggt

SEQ ID NO: 2657657 - DNA, 20 bp, Homo sapiens
ctattgttactctggttctt

SEQ ID NO: 2657658 - DNA, 22 bp, Homo sapiens
ctatttaactggcttcagcctc

SEQ ID NO: 2657659 - DNA, 9 bp, Homo sapiens
ctatttaag

SEQ ID NO: 2657660 - DNA, 22 bp, Homo sapiens
ctatttagtttttgtaatttat

SEQ ID NO: 2657661 - DNA, 11 bp, Homo sapiens
ctatttatgaa

SEQ ID NO: 2657662 - DNA, 18 bp, Homo sapiens
ctatttatttactgagct

SEQ ID NO: 2657663 - DNA, 12 bp, Homo sapiens
ctatttggaatt

SEQ ID NO: 2657664 - DNA, 16 bp, Homo sapiens
ctatttggaatttata

SEQ ID NO: 2657665 - DNA, 12 bp, Homo sapiens
ctattttattcc

SEQ ID NO: 2657666 - DNA, 16 bp, Homo sapiens
ctatttttactgccac

SEQ ID NO: 2657667 - DNA, 17 bp, Homo sapiens
ctatttttactgccact

SEQ ID NO: 2657668 - DNA, 16 bp, Homo sapiens
ctatttttatttatat

SEQ ID NO: 2657669 - DNA, 22 bp, Homo sapiens
ctatttttgtcttatatatatt

SEQ ID NO: 2657670 - DNA, 18 bp, Homo sapiens
ctattttttattttactt

SEQ ID NO: 2657671 - DNA, 21 bp, Homo sapiens
ctattttttttctgttatata

SEQ ID NO: 2657672 - DNA, 17 bp, Homo sapiens
ctcaaaaaaagaaaaag

SEQ ID NO: 2657673 - DNA, 22 bp, Homo sapiens
ctcaaaacccatctgggctcct

SEQ ID NO: 2657674 - DNA, 18 bp, Homo sapiens
ctcaaaagctgggcaggt

SEQ ID NO: 2657675 - DNA, 16 bp, Homo sapiens
ctcaaaatgacagcca

SEQ ID NO: 2657676 - DNA, 13 bp, Homo sapiens
ctcaaacactgca

SEQ ID NO: 2657677 - DNA, 14 bp, Homo sapiens
ctcaaacactgcag

SEQ ID NO: 2657678 - DNA, 16 bp, Homo sapiens
ctcaaacactgcaggc

SEQ ID NO: 2657679 - DNA, 19 bp, Homo sapiens
ctcaaaccaaatcactgaa

SEQ ID NO: 2657680 - DNA, 15 bp, Homo sapiens
ctcccgtcagggccc

SEQ ID NO: 2657681 - DNA, 14 bp, Homo sapiens
ctccctaaactgta

SEQ ID NO: 2657682 - DNA, 22 bp, Homo sapiens
ctccctaccacctccccagcct

SEQ ID NO: 2657683 - DNA, 23 bp, Homo sapiens
ctccctagtgacccggaggccac

SEQ ID NO: 2657684 - DNA, 15 bp, Homo sapiens
ctccctcaaagcaca

SEQ ID NO: 2657685 - DNA, 18 bp, Homo sapiens
ctccctcaccctgagccc

SEQ ID NO: 2657686 - DNA, 13 bp, Homo sapiens
ctccctcagcccc

SEQ ID NO: 2657687 - DNA, 14 bp, Homo sapiens
ctccctcagcccct

SEQ ID NO: 2657688 - DNA, 15 bp, Homo sapiens
ctccctcagcccctc

SEQ ID NO: 2657689 - DNA, 16 bp, Homo sapiens
ctccctcagcccctct

SEQ ID NO: 2657690 - DNA, 14 bp, Homo sapiens
ctccctcagtgccc

SEQ ID NO: 2657691 - DNA, 18 bp, Homo sapiens
ctccctcccctgccctgg

SEQ ID NO: 2657692 - DNA, 14 bp, Homo sapiens
ctccctctcactgt

SEQ ID NO: 2657693 - DNA, 20 bp, Homo sapiens
ctccctctgaggctgtagga

SEQ ID NO: 2657694 - DNA, 22 bp, Homo sapiens
ctccctctgcctgaaccttcca

SEQ ID NO: 2657695 - DNA, 15 bp, Homo sapiens
ctccctcttctcaag

SEQ ID NO: 2657696 - DNA, 20 bp, Homo sapiens
ctccctcttctcaagtgcct

SEQ ID NO: 2657697 - DNA, 19 bp, Homo sapiens
ctccctgaaccatccctga

SEQ ID NO: 2657698 - DNA, 21 bp, Homo sapiens
ctccctggagccagactctgg

SEQ ID NO: 2657699 - DNA, 22 bp, Homo sapiens
ctccctggagtgcagtttccaa

SEQ ID NO: 2657700 - DNA, 22 bp, Homo sapiens
ctccctggagtgtggctgagga

SEQ ID NO: 2657701 - DNA, 13 bp, Homo sapiens
ctccctggctgcc

SEQ ID NO: 2657702 - DNA, 18 bp, Homo sapiens
ctccctggctgccctggc

SEQ ID NO: 2657703 - DNA, 20 bp, Homo sapiens
ctccctggctgccctggccc

SEQ ID NO: 2657704 - DNA, 19 bp, Homo sapiens
ctccctgtaacctcttcag

SEQ ID NO: 2657705 - DNA, 21 bp, Homo sapiens
ctccctgtaggaagtcatcct

SEQ ID NO: 2657706 - DNA, 19 bp, Homo sapiens
ctcccttcatgcatggaaa

SEQ ID NO: 2657707 - DNA, 21 bp, Homo sapiens
ctcccttctacctgccactca

SEQ ID NO: 2657708 - DNA, 21 bp, Homo sapiens
ctcccttggaaacctgccctg

SEQ ID NO: 2657709 - DNA, 17 bp, Homo sapiens
ctcccttggattgtccc

SEQ ID NO: 2657710 - DNA, 13 bp, Homo sapiens
ctcccttgggctc

SEQ ID NO: 2657711 - DNA, 18 bp, Homo sapiens
ctcccttgggctccctgt

SEQ ID NO: 2657712 - DNA, 21 bp, Homo sapiens
ctccctttttatatcccattt

SEQ ID NO: 2657713 - DNA, 18 bp, Homo sapiens
ctccctttttccttgtcc

SEQ ID NO: 2657714 - DNA, 20 bp, Homo sapiens
ctccctttttccttgtcccc

SEQ ID NO: 2657715 - DNA, 23 bp, Homo sapiens
ctccctttttccttgtccccaca

SEQ ID NO: 2657716 - DNA, 13 bp, Homo sapiens
ctccgccaggcga

SEQ ID NO: 2657717 - DNA, 23 bp, Homo sapiens
ctccgccaggcgagatggggtgg

SEQ ID NO: 2657718 - DNA, 18 bp, Homo sapiens
ctccgccttcactccggt

SEQ ID NO: 2657719 - DNA, 14 bp, Homo sapiens
ctccgctggaggtg

SEQ ID NO: 2657720 - DNA, 19 bp, Homo sapiens
ctccgctttctacccagcg

SEQ ID NO: 2657721 - DNA, 15 bp, Homo sapiens
ctccggcctcccctc

SEQ ID NO: 2657722 - DNA, 21 bp, Homo sapiens
ctccggcgtcagcctccagcc

SEQ ID NO: 2657723 - DNA, 21 bp, Homo sapiens
ctccggggagcgcccgcgccc

SEQ ID NO: 2657724 - DNA, 18 bp, Homo sapiens
ctccggtgtgcctgcagc

SEQ ID NO: 2657725 - DNA, 19 bp, Homo sapiens
ctccggtgtgcctgcagcc

SEQ ID NO: 2657726 - DNA, 23 bp, Homo sapiens
ctccggtgtgcctgcagccccgc

SEQ ID NO: 2657727 - DNA, 22 bp, Homo sapiens
ctccgtccagccgccattgcca

SEQ ID NO: 2657728 - DNA, 22 bp, Homo sapiens
ctccgtccaggagcctgtgcct

SEQ ID NO: 2657729 - DNA, 15 bp, Homo sapiens
ctccgtgcctccacc

SEQ ID NO: 2657730 - DNA, 22 bp, Homo sapiens
ctccgtgcctccaccaccactg

SEQ ID NO: 2657731 - DNA, 18 bp, Homo sapiens
ctcctaccctgcgcccag

SEQ ID NO: 2657732 - DNA, 22 bp, Homo sapiens
ctcctaccgaaaccttgccttt

SEQ ID NO: 2657733 - DNA, 12 bp, Homo sapiens
ctcctacctcag

SEQ ID NO: 2657734 - DNA, 15 bp, Homo sapiens
ctcctacctcagcct

SEQ ID NO: 2657735 - DNA, 16 bp, Homo sapiens
ctcctacctcagccta

SEQ ID NO: 2657736 - DNA, 20 bp, Homo sapiens
ctcctagagaacgcagccct

SEQ ID NO: 2657737 - DNA, 23 bp, Homo sapiens
ctcctagagacagaagcaggctg

SEQ ID NO: 2657738 - DNA, 17 bp, Homo sapiens
ctcctatcacctcccct

SEQ ID NO: 2657739 - DNA, 18 bp, Homo sapiens
ctcctatcacctcccctc

SEQ ID NO: 2657740 - DNA, 19 bp, Homo sapiens
ctcctatcacctcccctcc

SEQ ID NO: 2657741 - DNA, 17 bp, Homo sapiens
ctcctatgatctcaggt

SEQ ID NO: 2657742 - DNA, 14 bp, Homo sapiens
ctcctcaactcacc

SEQ ID NO: 2657743 - DNA, 21 bp, Homo sapiens
ctcctcacaacatggtgtctg

SEQ ID NO: 2657744 - DNA, 20 bp, Homo sapiens
ctcctcacccccagctttgc

SEQ ID NO: 2657745 - DNA, 18 bp, Homo sapiens
ctcctcacctctggactg

SEQ ID NO: 2657746 - DNA, 14 bp, Homo sapiens
ctcctcactccctt

SEQ ID NO: 2657747 - DNA, 21 bp, Homo sapiens
ctcctcactcccttcccataa

SEQ ID NO: 2657748 - DNA, 23 bp, Homo sapiens
ctcctcagggttgaggtccagcc

SEQ ID NO: 2657749 - DNA, 16 bp, Homo sapiens
ctcctcatccagggct

SEQ ID NO: 2657750 - DNA, 15 bp, Homo sapiens
ctcctcatcccgtgt

SEQ ID NO: 2657751 - DNA, 15 bp, Homo sapiens
ctcctcccatgttat

SEQ ID NO: 2657752 - DNA, 14 bp, Homo sapiens
ctcctccctctgag

SEQ ID NO: 2657753 - DNA, 13 bp, Homo sapiens
ctcctccctggct

SEQ ID NO: 2657754 - DNA, 14 bp, Homo sapiens
ctcctccctggctg

SEQ ID NO: 2657755 - DNA, 19 bp, Homo sapiens
ctcctccctggctgccctg

SEQ ID NO: 2657756 - DNA, 19 bp, Homo sapiens
ctcctccctttttccttgt

SEQ ID NO: 2657757 - DNA, 15 bp, Homo sapiens
ctcctcctcccccag

SEQ ID NO: 2657758 - DNA, 17 bp, Homo sapiens
ctcctctagctgtgggg

SEQ ID NO: 2657759 - DNA, 12 bp, Homo sapiens
ctcctctcccat

SEQ ID NO: 2657760 - DNA, 13 bp, Homo sapiens
ctcctctccccag

SEQ ID NO: 2657761 - DNA, 14 bp, Homo sapiens
ctcctctcccctac

SEQ ID NO: 2657762 - DNA, 15 bp, Homo sapiens
ctcctctcctggagg

SEQ ID NO: 2657763 - DNA, 12 bp, Homo sapiens
ctcctctgtcca

SEQ ID NO: 2657764 - DNA, 15 bp, Homo sapiens
ctcctctgtccaggc

SEQ ID NO: 2657765 - DNA, 18 bp, Homo sapiens
ctcctctgtccagggccc

SEQ ID NO: 2657766 - DNA, 16 bp, Homo sapiens
ctcctctgtctgccct

SEQ ID NO: 2657767 - DNA, 19 bp, Homo sapiens
ctcctcttaaaaaataaaa

SEQ ID NO: 2657768 - DNA, 18 bp, Homo sapiens
ctcctcttcaactgacca

SEQ ID NO: 2657769 - DNA, 14 bp, Homo sapiens
ctcctgacctgagg

SEQ ID NO: 2657770 - DNA, 17 bp, Homo sapiens
ctcctgagacccctggc

SEQ ID NO: 2657771 - DNA, 21 bp, Homo sapiens
ctcctgagacccctggcctcc

SEQ ID NO: 2657772 - DNA, 22 bp, Homo sapiens
ctcctgagacccctggcctccg

SEQ ID NO: 2657773 - DNA, 21 bp, Homo sapiens
ctcctgaggacagctgtcctc

SEQ ID NO: 2657774 - DNA, 16 bp, Homo sapiens
ctcctgaggggcatct

SEQ ID NO: 2657775 - DNA, 22 bp, Homo sapiens
ctcctgaggggcatctgcccct

SEQ ID NO: 2657776 - DNA, 11 bp, Homo sapiens
ctcctgcaggc

SEQ ID NO: 2657777 - DNA, 12 bp, Homo sapiens
ctcctgcctcag

SEQ ID NO: 2657778 - DNA, 14 bp, Homo sapiens
ctcctgcctcagcc

SEQ ID NO: 2657779 - DNA, 18 bp, Homo sapiens
ctcctgcctcgaactggc

SEQ ID NO: 2657780 - DNA, 18 bp, Homo sapiens
ctcctgccttcctcctgg

SEQ ID NO: 2657781 - DNA, 16 bp, Homo sapiens
ctcctgccttctgtcc

SEQ ID NO: 2657782 - DNA, 21 bp, Homo sapiens
ctcctgccttctgtcctggtg

SEQ ID NO: 2657783 - DNA, 18 bp, Homo sapiens
ctcctggaaaggctcagt

SEQ ID NO: 2657784 - DNA, 14 bp, Homo sapiens
ctcctggaaatatt

SEQ ID NO: 2657785 - DNA, 22 bp, Homo sapiens
ctcctggactgccttgaatatc

SEQ ID NO: 2657786 - DNA, 12 bp, Homo sapiens
ctcctggagcct

SEQ ID NO: 2657787 - DNA, 12 bp, Homo sapiens
ctcctgggccct

SEQ ID NO: 2657788 - DNA, 17 bp, Homo sapiens
ctcctgggccctctctg

SEQ ID NO: 2657789 - DNA, 16 bp, Homo sapiens
ctcctgggttgagctg

SEQ ID NO: 2657790 - DNA, 22 bp, Homo sapiens
ctcctgggttttgtattctctg

SEQ ID NO: 2657791 - DNA, 20 bp, Homo sapiens
ctcctgtaacatactggcct

SEQ ID NO: 2657792 - DNA, 23 bp, Homo sapiens
ctcctgtaacatactggcctgga

SEQ ID NO: 2657793 - DNA, 13 bp, Homo sapiens
ctcctgtcctccc

SEQ ID NO: 2657794 - DNA, 17 bp, Homo sapiens
ctcctgtctaactgctg

SEQ ID NO: 2657795 - DNA, 14 bp, Homo sapiens
ctcctgtctgccag

SEQ ID NO: 2657796 - DNA, 16 bp, Homo sapiens
ctcctgtctgccagcc

SEQ ID NO: 2657797 - DNA, 10 bp, Homo sapiens
ctcctgtctt

SEQ ID NO: 2657798 - DNA, 15 bp, Homo sapiens
ctcctgtcttcccag

SEQ ID NO: 2657799 - DNA, 17 bp, Homo sapiens
ctcctgtcttcccaggg

SEQ ID NO: 2657800 - DNA, 21 bp, Homo sapiens
ctcctgtcttcccagggtagc

SEQ ID NO: 2657801 - DNA, 17 bp, Homo sapiens
ctcctgtgcatgggtga

SEQ ID NO: 2657802 - DNA, 14 bp, Homo sapiens
ctcctgtgcccaca

SEQ ID NO: 2657803 - DNA, 11 bp, Homo sapiens
ctcctgtgtaa

SEQ ID NO: 2657804 - DNA, 13 bp, Homo sapiens
ctcctgtgtacag

SEQ ID NO: 2657805 - DNA, 14 bp, Homo sapiens
ctcctgtgtgtgcg

SEQ ID NO: 2657806 - DNA, 20 bp, Homo sapiens
ctcctgtgtgtgcgcctaca

SEQ ID NO: 2657807 - DNA, 23 bp, Homo sapiens
ctcctgtgtgtgcgcctacagga

SEQ ID NO: 2657808 - DNA, 17 bp, Homo sapiens
ctcctgttgcacccagc

SEQ ID NO: 2657809 - DNA, 22 bp, Homo sapiens
ctcctgttgcacccagccctgg

SEQ ID NO: 2657810 - DNA, 20 bp, Homo sapiens
ctccttaacactgagctgtc

SEQ ID NO: 2657811 - DNA, 16 bp, Homo sapiens
ctccttagtcttctca

SEQ ID NO: 2657812 - DNA, 16 bp, Homo sapiens
ctccttcacagatggg

SEQ ID NO: 2657813 - DNA, 14 bp, Homo sapiens
ctccttcacctttg

SEQ ID NO: 2657814 - DNA, 18 bp, Homo sapiens
ctccttccaacaggagct

SEQ ID NO: 2657815 - DNA, 16 bp, Homo sapiens
ctccttcccatcgctg

SEQ ID NO: 2657816 - DNA, 17 bp, Homo sapiens
ctccttcccatcgctgt

SEQ ID NO: 2657817 - DNA, 16 bp, Homo sapiens
ctccttcctgtcttcc

SEQ ID NO: 2657818 - DNA, 18 bp, Homo sapiens
ctccttccttcacctctg

SEQ ID NO: 2657819 - DNA, 17 bp, Homo sapiens
ctccttccttgaccagc

SEQ ID NO: 2657820 - DNA, 22 bp, Homo sapiens
ctccttccttgctgtcctaggc

SEQ ID NO: 2657821 - DNA, 13 bp, Homo sapiens
ctccttctccctt

SEQ ID NO: 2657822 - DNA, 21 bp, Homo sapiens
ctccttctctgtctcatgtgt

SEQ ID NO: 2657823 - DNA, 14 bp, Homo sapiens
ctccttctgtccta

SEQ ID NO: 2657824 - DNA, 21 bp, Homo sapiens
ctccttgaaaacactgttctc

SEQ ID NO: 2657825 - DNA, 18 bp, Homo sapiens
ctgaagaggcgggccagc

SEQ ID NO: 2657826 - DNA, 21 bp, Homo sapiens
ctgaagaggcgggccagccag

SEQ ID NO: 2657827 - DNA, 23 bp, Homo sapiens
ctgaagatataactattgcccag

SEQ ID NO: 2657828 - DNA, 23 bp, Homo sapiens
ctgaagatggcatcctgtgaagt

SEQ ID NO: 2657829 - DNA, 22 bp, Homo sapiens
ctgaagcagatgcaaagaggca

SEQ ID NO: 2657830 - DNA, 16 bp, Homo sapiens
ctgaagccaaagccaa

SEQ ID NO: 2657831 - DNA, 14 bp, Homo sapiens
ctgaagccattgtc

SEQ ID NO: 2657832 - DNA, 12 bp, Homo sapiens
ctgaagcctctg

SEQ ID NO: 2657833 - DNA, 15 bp, Homo sapiens
ctgaagcctctggga

SEQ ID NO: 2657834 - DNA, 15 bp, Homo sapiens
ctgaagcctgcagga

SEQ ID NO: 2657835 - DNA, 12 bp, Homo sapiens
ctgaagctgagg

SEQ ID NO: 2657836 - DNA, 22 bp, Homo sapiens
ctgaaggaataaattgctcctt

SEQ ID NO: 2657837 - DNA, 18 bp, Homo sapiens
ctgaaggccccgcccagg

SEQ ID NO: 2657838 - DNA, 19 bp, Homo sapiens
ctgaaggccccgcccaggc

SEQ ID NO: 2657839 - DNA, 21 bp, Homo sapiens
ctgaaggccccgcccaggctt

SEQ ID NO: 2657840 - DNA, 17 bp, Homo sapiens
ctgaaggtaaaattgaa

SEQ ID NO: 2657841 - DNA, 18 bp, Homo sapiens
ctgaagtcacacagtgag

SEQ ID NO: 2657842 - DNA, 21 bp, Homo sapiens
ctgaagtcacacagtgagtcg

SEQ ID NO: 2657843 - DNA, 22 bp, Homo sapiens
ctgaagtcacatcacaggacac

SEQ ID NO: 2657844 - DNA, 13 bp, Homo sapiens
ctgaagtgaaact

SEQ ID NO: 2657845 - DNA, 18 bp, Homo sapiens
ctgaagtgagcacagcct

SEQ ID NO: 2657846 - DNA, 17 bp, Homo sapiens
ctgaagtgcatccaaag

SEQ ID NO: 2657847 - DNA, 19 bp, Homo sapiens
ctgaagtgcatccaaaggt

SEQ ID NO: 2657848 - DNA, 15 bp, Homo sapiens
ctgaagtggactctt

SEQ ID NO: 2657849 - DNA, 21 bp, Homo sapiens
ctgaagtgtttcacgagagcc

SEQ ID NO: 2657850 - DNA, 16 bp, Homo sapiens
ctgaagttaacagaga

SEQ ID NO: 2657851 - DNA, 22 bp, Homo sapiens
ctgaagttggagtgagtgtggc

SEQ ID NO: 2657852 - DNA, 17 bp, Homo sapiens
ctgaataaatggtagta

SEQ ID NO: 2657853 - DNA, 12 bp, Homo sapiens
ctgaataaatgt

SEQ ID NO: 2657854 - DNA, 13 bp, Homo sapiens
ctgaataaatgtc

SEQ ID NO: 2657855 - DNA, 16 bp, Homo sapiens
ctgaatacaaagtgat

SEQ ID NO: 2657856 - DNA, 16 bp, Homo sapiens
ctgaatacagaggcaa

SEQ ID NO: 2657857 - DNA, 21 bp, Homo sapiens
ctgaatatttatatttcacta

SEQ ID NO: 2657858 - DNA, 22 bp, Homo sapiens
ctgaatcattctcgatttaact

SEQ ID NO: 2657859 - DNA, 22 bp, Homo sapiens
ctgaatgcttataggtggcctc

SEQ ID NO: 2657860 - DNA, 22 bp, Homo sapiens
ctgaatggaaggtttgtatatt

SEQ ID NO: 2657861 - DNA, 14 bp, Homo sapiens
ctgaatggtccagg

SEQ ID NO: 2657862 - DNA, 18 bp, Homo sapiens
ctgaatggtccagggttg

SEQ ID NO: 2657863 - DNA, 18 bp, Homo sapiens
ctgaatgttctgacatta

SEQ ID NO: 2657864 - DNA, 19 bp, Homo sapiens
ctgaatgttctgacattaa

SEQ ID NO: 2657865 - DNA, 22 bp, Homo sapiens
ctgaatgttctgacattaacag

SEQ ID NO: 2657866 - DNA, 18 bp, Homo sapiens
ctgaattagtccttgctt

SEQ ID NO: 2657867 - DNA, 20 bp, Homo sapiens
ctgaattagtccttgcttgg

SEQ ID NO: 2657868 - DNA, 16 bp, Homo sapiens
ctgaattctatttgct

SEQ ID NO: 2657869 - DNA, 23 bp, Homo sapiens
ctgaattctatttgctgggcttt

SEQ ID NO: 2657870 - DNA, 23 bp, Homo sapiens
ctgacaacactcattgacctgag

SEQ ID NO: 2657871 - DNA, 22 bp, Homo sapiens
ctgacaaccaccgctccccagc

SEQ ID NO: 2657872 - DNA, 13 bp, Homo sapiens
ctgacaacttgaa

SEQ ID NO: 2657873 - DNA, 16 bp, Homo sapiens
ctgacacaaacctgcc

SEQ ID NO: 2657874 - DNA, 18 bp, Homo sapiens
ctgacacacagctctgtc

SEQ ID NO: 2657875 - DNA, 19 bp, Homo sapiens
ctgacacacagctctgtcc

SEQ ID NO: 2657876 - DNA, 19 bp, Homo sapiens
ctgacacctttgcaggcat

SEQ ID NO: 2657877 - DNA, 22 bp, Homo sapiens
ctgacactggtattcctgcctc

SEQ ID NO: 2657878 - DNA, 19 bp, Homo sapiens
ctgacactttaattaccaa

SEQ ID NO: 2657879 - DNA, 12 bp, Homo sapiens
ctgacagacaca

SEQ ID NO: 2657880 - DNA, 16 bp, Homo sapiens
ctgacagacacaggcc

SEQ ID NO: 2657881 - DNA, 23 bp, Homo sapiens
ctgacaggcagcctggacataga

SEQ ID NO: 2657882 - DNA, 15 bp, Homo sapiens
ctgacagtcttgtgc

SEQ ID NO: 2657883 - DNA, 16 bp, Homo sapiens
ctgacatctgtgtttc

SEQ ID NO: 2657884 - DNA, 17 bp, Homo sapiens
ctgacattgttggccaa

SEQ ID NO: 2657885 - DNA, 14 bp, Homo sapiens
ctgaccaagagaga

SEQ ID NO: 2657886 - DNA, 17 bp, Homo sapiens
ctgaccaagagagaaag

SEQ ID NO: 2657887 - DNA, 13 bp, Homo sapiens
ctgaccacacttc

SEQ ID NO: 2657888 - DNA, 13 bp, Homo sapiens
ctgaccaccctcc

SEQ ID NO: 2657889 - DNA, 17 bp, Homo sapiens
ctgaccaccctcccctc

SEQ ID NO: 2657890 - DNA, 23 bp, Homo sapiens
ctgaccagcctccatgctgcctc

SEQ ID NO: 2657891 - DNA, 23 bp, Homo sapiens
ctgaccagtttaacctgatgcag

SEQ ID NO: 2657892 - DNA, 11 bp, Homo sapiens
ctgacccactg

SEQ ID NO: 2657893 - DNA, 12 bp, Homo sapiens
ctgacccactgc

SEQ ID NO: 2657894 - DNA, 13 bp, Homo sapiens
ctgacccactgct

SEQ ID NO: 2657895 - DNA, 21 bp, Homo sapiens
ctgacccagccccttgagaaa

SEQ ID NO: 2657896 - DNA, 15 bp, Homo sapiens
ctgacccagcctgtt

SEQ ID NO: 2657897 - DNA, 23 bp, Homo sapiens
ctgacccaggccgcagctcttgc

SEQ ID NO: 2657898 - DNA, 14 bp, Homo sapiens
ctgacccagtgaga

SEQ ID NO: 2657899 - DNA, 15 bp, Homo sapiens
ctgacccatgctgcc

SEQ ID NO: 2657900 - DNA, 19 bp, Homo sapiens
ctgacccatgctgccctgt

SEQ ID NO: 2657901 - DNA, 20 bp, Homo sapiens
ctgaccccaaacaccttcca

SEQ ID NO: 2657902 - DNA, 21 bp, Homo sapiens
ctgaccccaaacaccttccag

SEQ ID NO: 2657903 - DNA, 23 bp, Homo sapiens
ctgaccccaaagagcctggagaa

SEQ ID NO: 2657904 - DNA, 21 bp, Homo sapiens
ctgaccccagtggtatcctgt

SEQ ID NO: 2657905 - DNA, 14 bp, Homo sapiens
ctgaccctcctgtt

SEQ ID NO: 2657906 - DNA, 17 bp, Homo sapiens
ctgaccctcctgttgca

SEQ ID NO: 2657907 - DNA, 22 bp, Homo sapiens
ctgaccctcctgttgcacccag

SEQ ID NO: 2657908 - DNA, 23 bp, Homo sapiens
ctgaccctcctgttgcacccagc

SEQ ID NO: 2657909 - DNA, 20 bp, Homo sapiens
ctgaccgaaacagcgctggg

SEQ ID NO: 2657910 - DNA, 17 bp, Homo sapiens
ctgacctatcacttcca

SEQ ID NO: 2657911 - DNA, 13 bp, Homo sapiens
ctgacctccacag

SEQ ID NO: 2657912 - DNA, 15 bp, Homo sapiens
ctgacctccacagct

SEQ ID NO: 2657913 - DNA, 12 bp, Homo sapiens
ctgacctcccag

SEQ ID NO: 2657914 - DNA, 17 bp, Homo sapiens
ctgacctcccagcccta

SEQ ID NO: 2657915 - DNA, 20 bp, Homo sapiens
ctgacctccctctaatttat

SEQ ID NO: 2657916 - DNA, 21 bp, Homo sapiens
ctgacctgaggctcctgtgct

SEQ ID NO: 2657917 - DNA, 13 bp, Homo sapiens
ctgacctgcaggc

SEQ ID NO: 2657918 - DNA, 17 bp, Homo sapiens
ctgacctgtcatgcccc

SEQ ID NO: 2657919 - DNA, 19 bp, Homo sapiens
ctgacctgtcatgcccccc

SEQ ID NO: 2657920 - DNA, 20 bp, Homo sapiens
ctgaccttcctcgcagagag

SEQ ID NO: 2657921 - DNA, 18 bp, Homo sapiens
ctgacctttgtcatcttt

SEQ ID NO: 2657922 - DNA, 16 bp, Homo sapiens
ctgacggaagccaact

SEQ ID NO: 2657923 - DNA, 21 bp, Homo sapiens
ctgacggaagccaacttggct

SEQ ID NO: 2657924 - DNA, 23 bp, Homo sapiens
ctgactagaagggccagtcctgc

SEQ ID NO: 2657925 - DNA, 12 bp, Homo sapiens
ctgactcagggc

SEQ ID NO: 2657926 - DNA, 21 bp, Homo sapiens
ctgactcagggctcctgggtt

SEQ ID NO: 2657927 - DNA, 20 bp, Homo sapiens
ctgactcgtctgactgtgtg

SEQ ID NO: 2657928 - DNA, 21 bp, Homo sapiens
ctgactctaggtgcccttgga

SEQ ID NO: 2657929 - DNA, 14 bp, Homo sapiens
ctgactctcaaatc

SEQ ID NO: 2657930 - DNA, 14 bp, Homo sapiens
ctgactctctgtga

SEQ ID NO: 2657931 - DNA, 18 bp, Homo sapiens
ctgactctctgtgacctg

SEQ ID NO: 2657932 - DNA, 15 bp, Homo sapiens
ctgactctgaaatct

SEQ ID NO: 2657933 - DNA, 20 bp, Homo sapiens
ctgactctgccccctgctgg

SEQ ID NO: 2657934 - DNA, 21 bp, Homo sapiens
ctgactctgccccctgctggc

SEQ ID NO: 2657935 - DNA, 16 bp, Homo sapiens
ctgactgatgctttca

SEQ ID NO: 2657936 - DNA, 16 bp, Homo sapiens
ctgacttctaagtaaa

SEQ ID NO: 2657937 - DNA, 22 bp, Homo sapiens
ctgacttggggagatggagttc

SEQ ID NO: 2657938 - DNA, 15 bp, Homo sapiens
ctgactttgctcttt

SEQ ID NO: 2657939 - DNA, 16 bp, Homo sapiens
ctgactttgctctttc

SEQ ID NO: 2657940 - DNA, 18 bp, Homo sapiens
ctgagaaagactattcaa

SEQ ID NO: 2657941 - DNA, 20 bp, Homo sapiens
ctgagaaagactattcaaac

SEQ ID NO: 2657942 - DNA, 17 bp, Homo sapiens
ctgagaacactgtgaaa

SEQ ID NO: 2657943 - DNA, 18 bp, Homo sapiens
ctgagaaccctgcgtggg

SEQ ID NO: 2657944 - DNA, 17 bp, Homo sapiens
ctgagaaggtccttaat

SEQ ID NO: 2657945 - DNA, 22 bp, Homo sapiens
ctgagaatttaaaaataagaaa

SEQ ID NO: 2657946 - DNA, 17 bp, Homo sapiens
ctgagacaaatggaggc

SEQ ID NO: 2657947 - DNA, 18 bp, Homo sapiens
ctgagacagcccgggctc

SEQ ID NO: 2657948 - DNA, 19 bp, Homo sapiens
ctgagacagcccgggctct

SEQ ID NO: 2657949 - DNA, 22 bp, Homo sapiens
ctgagacagcccgggctctgcc

SEQ ID NO: 2657950 - DNA, 15 bp, Homo sapiens
ctgagacccctggcc

SEQ ID NO: 2657951 - DNA, 13 bp, Homo sapiens
ctgagagccccag

SEQ ID NO: 2657952 - DNA, 12 bp, Homo sapiens
ctgagaggccac

SEQ ID NO: 2657953 - DNA, 15 bp, Homo sapiens
ctgagagtttagttg

SEQ ID NO: 2657954 - DNA, 16 bp, Homo sapiens
ctgagatatgaacata

SEQ ID NO: 2657955 - DNA, 23 bp, Homo sapiens
ctgagatatgaacatattgttga

SEQ ID NO: 2657956 - DNA, 15 bp, Homo sapiens
ctgagcaaatgtggc

SEQ ID NO: 2657957 - DNA, 17 bp, Homo sapiens
ctgagcaaatgtggctc

SEQ ID NO: 2657958 - DNA, 23 bp, Homo sapiens
ctgagcaacagagtgagaccctg

SEQ ID NO: 2657959 - DNA, 14 bp, Homo sapiens
ctgagcaagagctg

SEQ ID NO: 2657960 - DNA, 19 bp, Homo sapiens
ctgagcacattctggctca

SEQ ID NO: 2657961 - DNA, 13 bp, Homo sapiens
ctgagcacctgct

SEQ ID NO: 2657962 - DNA, 20 bp, Homo sapiens
ctgagcagtgaatgattcag

SEQ ID NO: 2657963 - DNA, 22 bp, Homo sapiens
ctgagccaagctagaattccct

SEQ ID NO: 2657964 - DNA, 16 bp, Homo sapiens
ctgagccagtgtcagg

SEQ ID NO: 2657965 - DNA, 22 bp, Homo sapiens
ctgagccagtgtcaggaggaag

SEQ ID NO: 2657966 - DNA, 13 bp, Homo sapiens
ctgagcccctacc

SEQ ID NO: 2657967 - DNA, 14 bp, Homo sapiens
ctgagcccctaccc

SEQ ID NO: 2657968 - DNA, 14 bp, Homo sapiens
ctgattttaacaat

SEQ ID NO: 2657969 - DNA, 21 bp, Homo sapiens
ctgattttcaaagctttttcc

SEQ ID NO: 2657970 - DNA, 19 bp, Homo sapiens
ctgattttttttcctttta

SEQ ID NO: 2657971 - DNA, 20 bp, Homo sapiens
ctgattttttttccttttaa

SEQ ID NO: 2657972 - DNA, 14 bp, Homo sapiens
ctgcaaaatgagac

SEQ ID NO: 2657973 - DNA, 11 bp, Homo sapiens
ctgcaaaattt

SEQ ID NO: 2657974 - DNA, 20 bp, Homo sapiens
ctgcaaacctgacccctgct

SEQ ID NO: 2657975 - DNA, 20 bp, Homo sapiens
ctgcaaactcactgctcaag

SEQ ID NO: 2657976 - DNA, 23 bp, Homo sapiens
ctgcaaaggtaataatacagcca

SEQ ID NO: 2657977 - DNA, 12 bp, Homo sapiens
ctgcaacaggct

SEQ ID NO: 2657978 - DNA, 14 bp, Homo sapiens
ctgcaacctgattg

SEQ ID NO: 2657979 - DNA, 19 bp, Homo sapiens
ctgcaacctgattgtgtct

SEQ ID NO: 2657980 - DNA, 22 bp, Homo sapiens
ctgcaacctgattgtgtctctt

SEQ ID NO: 2657981 - DNA, 14 bp, Homo sapiens
ctgcaacttctgcc

SEQ ID NO: 2657982 - DNA, 18 bp, Homo sapiens
ctgcaagcagggctctgc

SEQ ID NO: 2657983 - DNA, 19 bp, Homo sapiens
ctgcaagccgactacacct

SEQ ID NO: 2657984 - DNA, 17 bp, Homo sapiens
ctgcaaggcctttctgt

SEQ ID NO: 2657985 - DNA, 22 bp, Homo sapiens
ctgcaatcttctcagaaggcaa

SEQ ID NO: 2657986 - DNA, 18 bp, Homo sapiens
ctgcaatgaagtctctga

SEQ ID NO: 2657987 - DNA, 21 bp, Homo sapiens
ctgcaatgggcactgggatga

SEQ ID NO: 2657988 - DNA, 20 bp, Homo sapiens
ctgcaattgcttaggatgtt

SEQ ID NO: 2657989 - DNA, 16 bp, Homo sapiens
ctgcacaaactcacca

SEQ ID NO: 2657990 - DNA, 13 bp, Homo sapiens
ctgcacaaagccc

SEQ ID NO: 2657991 - DNA, 13 bp, Homo sapiens
ctgcacaagctgc

SEQ ID NO: 2657992 - DNA, 18 bp, Homo sapiens
ctgcacaataaaaatgtt

SEQ ID NO: 2657993 - DNA, 23 bp, Homo sapiens
ctgcacagagctctccagctcca

SEQ ID NO: 2657994 - DNA, 20 bp, Homo sapiens
ctgcacagatggatttgcct

SEQ ID NO: 2657995 - DNA, 13 bp, Homo sapiens
ctgcacagcggcc

SEQ ID NO: 2657996 - DNA, 18 bp, Homo sapiens
ctgcacagggcagctggg

SEQ ID NO: 2657997 - DNA, 22 bp, Homo sapiens
ctgcacagggcagctgggccca

SEQ ID NO: 2657998 - DNA, 22 bp, Homo sapiens
ctgcacatgaatcccacccaca

SEQ ID NO: 2657999 - DNA, 23 bp, Homo sapiens
ctgcacatgaatcccacccacat

SEQ ID NO: 2658000 - DNA, 16 bp, Homo sapiens
ctgcacatgtcttgta

SEQ ID NO: 2658001 - DNA, 14 bp, Homo sapiens
ctgcacccccctgg

SEQ ID NO: 2658002 - DNA, 17 bp, Homo sapiens
ctgcacccccctgggct

SEQ ID NO: 2658003 - DNA, 17 bp, Homo sapiens
ctgcaccctcaggcagg

SEQ ID NO: 2658004 - DNA, 18 bp, Homo sapiens
ctgcaccctcaggcaggt

SEQ ID NO: 2658005 - DNA, 13 bp, Homo sapiens
ctgcaccctccac

SEQ ID NO: 2658006 - DNA, 16 bp, Homo sapiens
ctgcaccctccaccct

SEQ ID NO: 2658007 - DNA, 20 bp, Homo sapiens
ctgcaccctccaccctgtcc

SEQ ID NO: 2658008 - DNA, 23 bp, Homo sapiens
ctgcaccctggggcctggacctg

SEQ ID NO: 2658009 - DNA, 15 bp, Homo sapiens
ctgcaccggctggcc

SEQ ID NO: 2658010 - DNA, 16 bp, Homo sapiens
ctgcaccggctggcct

SEQ ID NO: 2658011 - DNA, 19 bp, Homo sapiens
ctgcaccggctggcctggc

SEQ ID NO: 2658012 - DNA, 20 bp, Homo sapiens
ctgcaccggctggcctggcc

SEQ ID NO: 2658013 - DNA, 22 bp, Homo sapiens
ctgcaccggctggcctggcccc

SEQ ID NO: 2658014 - DNA, 16 bp, Homo sapiens
ctgcacctgccagcct

SEQ ID NO: 2658015 - DNA, 17 bp, Homo sapiens
ctgcacctgccagcctg

SEQ ID NO: 2658016 - DNA, 13 bp, Homo sapiens
ctgcacctgtgca

SEQ ID NO: 2658017 - DNA, 16 bp, Homo sapiens
ctgcactaatttgatg

SEQ ID NO: 2658018 - DNA, 18 bp, Homo sapiens
ctgcactactcctctgca

SEQ ID NO: 2658019 - DNA, 20 bp, Homo sapiens
ctgcactactcctctgcagt

SEQ ID NO: 2658020 - DNA, 15 bp, Homo sapiens
ctgcactccagcctg

SEQ ID NO: 2658021 - DNA, 20 bp, Homo sapiens
ctgcactccagcctgagcga

SEQ ID NO: 2658022 - DNA, 17 bp, Homo sapiens
ctgcactccagcctggg

SEQ ID NO: 2658023 - DNA, 19 bp, Homo sapiens
ctgcactccagcctgggcg

SEQ ID NO: 2658024 - DNA, 18 bp, Homo sapiens
ctgcactccagcctgggt

SEQ ID NO: 2658025 - DNA, 19 bp, Homo sapiens
ctgcactccagcctgggtg

SEQ ID NO: 2658026 - DNA, 20 bp, Homo sapiens
ctgcactccagtctgggtga

SEQ ID NO: 2658027 - DNA, 15 bp, Homo sapiens
ctgcactcccctgct

SEQ ID NO: 2658028 - DNA, 17 bp, Homo sapiens
ctgcactcccctgctgg

SEQ ID NO: 2658029 - DNA, 19 bp, Homo sapiens
ctgcactcccctgctgggt

SEQ ID NO: 2658030 - DNA, 21 bp, Homo sapiens
ctgcactggagtccagtctct

SEQ ID NO: 2658031 - DNA, 12 bp, Homo sapiens
ctgcactgtcaa

SEQ ID NO: 2658032 - DNA, 16 bp, Homo sapiens
ctgcacttgcagactc

SEQ ID NO: 2658033 - DNA, 17 bp, Homo sapiens
ctgcacttgcagactct

SEQ ID NO: 2658034 - DNA, 13 bp, Homo sapiens
ctgcagaaggcca

SEQ ID NO: 2658035 - DNA, 15 bp, Homo sapiens
ctgcagaaggccaag

SEQ ID NO: 2658036 - DNA, 11 bp, Homo sapiens
ctgcagacctg

SEQ ID NO: 2658037 - DNA, 14 bp, Homo sapiens
ctgcagacctgtcc

SEQ ID NO: 2658038 - DNA, 18 bp, Homo sapiens
ctgcagacctgtcctcct

SEQ ID NO: 2658039 - DNA, 22 bp, Homo sapiens
ctgcagacctgtcctcctggtg

SEQ ID NO: 2658040 - DNA, 21 bp, Homo sapiens
ctgcagaggggaaaccagtgt

SEQ ID NO: 2658041 - DNA, 23 bp, Homo sapiens
ctgcagaggggaaaccagtgtag

SEQ ID NO: 2658042 - DNA, 20 bp, Homo sapiens
ctgcagatttgggctggaac

SEQ ID NO: 2658043 - DNA, 15 bp, Homo sapiens
ctgcagcaataaagc

SEQ ID NO: 2658044 - DNA, 16 bp, Homo sapiens
ctgcagcaataaagca

SEQ ID NO: 2658045 - DNA, 17 bp, Homo sapiens
ctgcagcaataaagcag

SEQ ID NO: 2658046 - DNA, 14 bp, Homo sapiens
ctgcagcagaggca

SEQ ID NO: 2658047 - DNA, 20 bp, Homo sapiens
ctgcagcatgttgctgagga

SEQ ID NO: 2658048 - DNA, 21 bp, Homo sapiens
ctgcagcatgttgctgaggag

SEQ ID NO: 2658049 - DNA, 12 bp, Homo sapiens
ctgcagcccagg

SEQ ID NO: 2658050 - DNA, 11 bp, Homo sapiens
ctgcagcctca

SEQ ID NO: 2658051 - DNA, 19 bp, Homo sapiens
ctgcagcctcaacctcctg

SEQ ID NO: 2658052 - DNA, 20 bp, Homo sapiens
ctgcagcctcaacctcctgg

SEQ ID NO: 2658053 - DNA, 18 bp, Homo sapiens
ctgcagcctttgcctccc

SEQ ID NO: 2658054 - DNA, 21 bp, Homo sapiens
ctgcagctttacatgcaattt

SEQ ID NO: 2658055 - DNA, 15 bp, Homo sapiens
ctgcaggcagccagg

SEQ ID NO: 2658056 - DNA, 16 bp, Homo sapiens
ctgcaggcagccaggc

SEQ ID NO: 2658057 - DNA, 11 bp, Homo sapiens
ctgcaggcagg

SEQ ID NO: 2658058 - DNA, 15 bp, Homo sapiens
ctgcaggccaagagc

SEQ ID NO: 2658059 - DNA, 23 bp, Homo sapiens
ctgcaggccaagagcagaggcag

SEQ ID NO: 2658060 - DNA, 17 bp, Homo sapiens
ctgcaggccaggccagc

SEQ ID NO: 2658061 - DNA, 23 bp, Homo sapiens
ctgcaggccaggccagctgcctc

SEQ ID NO: 2658062 - DNA, 22 bp, Homo sapiens
ctgcagggaaaattatttgcat

SEQ ID NO: 2658063 - DNA, 22 bp, Homo sapiens
ctgcagggagtccgaaagggac

SEQ ID NO: 2658064 - DNA, 16 bp, Homo sapiens
ctgcagggccaagcac

SEQ ID NO: 2658065 - DNA, 22 bp, Homo sapiens
ctgcagggccctcccttttccc

SEQ ID NO: 2658066 - DNA, 15 bp, Homo sapiens
ctgcagtagtctctg

SEQ ID NO: 2658067 - DNA, 19 bp, Homo sapiens
ctgcagtcacttcgtggga

SEQ ID NO: 2658068 - DNA, 21 bp, Homo sapiens
ctgcagtcagtcatgatggca

SEQ ID NO: 2658069 - DNA, 9 bp, Homo sapiens
ctgcagtga

SEQ ID NO: 2658070 - DNA, 13 bp, Homo sapiens
ctgcagttgccag

SEQ ID NO: 2658071 - DNA, 16 bp, Homo sapiens
ctgcagttgccagtca

SEQ ID NO: 2658072 - DNA, 14 bp, Homo sapiens
ctgcatacaatctg

SEQ ID NO: 2658073 - DNA, 20 bp, Homo sapiens
ctgcatactttttaaatgta

SEQ ID NO: 2658074 - DNA, 21 bp, Homo sapiens
ctgcatagtattccattgtgt

SEQ ID NO: 2658075 - DNA, 15 bp, Homo sapiens
ctgcatatgaaagga

SEQ ID NO: 2658076 - DNA, 13 bp, Homo sapiens
ctgcatcttgggg

SEQ ID NO: 2658077 - DNA, 19 bp, Homo sapiens
ctgcatcttggggacatct

SEQ ID NO: 2658078 - DNA, 21 bp, Homo sapiens
ctgcatcttggggacatctct

SEQ ID NO: 2658079 - DNA, 23 bp, Homo sapiens
ctgcatgcgagtgctcatttcag

SEQ ID NO: 2658080 - DNA, 15 bp, Homo sapiens
ctgcatgcggcccag

SEQ ID NO: 2658081 - DNA, 16 bp, Homo sapiens
ctgcatgcggcccagc

SEQ ID NO: 2658082 - DNA, 18 bp, Homo sapiens
ctgcatgcggcccagccc

SEQ ID NO: 2658083 - DNA, 22 bp, Homo sapiens
ctgcattcacccagacagctcc

SEQ ID NO: 2658084 - DNA, 20 bp, Homo sapiens
ctgcattcaggatcaaaccc

SEQ ID NO: 2658085 - DNA, 19 bp, Homo sapiens
ctgcattctgccgtgtgcc

SEQ ID NO: 2658086 - DNA, 17 bp, Homo sapiens
ctgcattgagaactgca

SEQ ID NO: 2658087 - DNA, 17 bp, Homo sapiens
ctgcatttaaaagatac

SEQ ID NO: 2658088 - DNA, 13 bp, Homo sapiens
ctgcatttctgag

SEQ ID NO: 2658089 - DNA, 13 bp, Homo sapiens
ctgcatttgtgaa

SEQ ID NO: 2658090 - DNA, 14 bp, Homo sapiens
ctgcatttgtgaaa

SEQ ID NO: 2658091 - DNA, 20 bp, Homo sapiens
ctgcattttattctggatgg

SEQ ID NO: 2658092 - DNA, 21 bp, Homo sapiens
ctgcattttgctattgtaaat

SEQ ID NO: 2658093 - DNA, 21 bp, Homo sapiens
ctgccaaggccagagtggcct

SEQ ID NO: 2658094 - DNA, 13 bp, Homo sapiens
ctgccacacaaac

SEQ ID NO: 2658095 - DNA, 22 bp, Homo sapiens
ctgccacagcctcccctgccag

SEQ ID NO: 2658096 - DNA, 23 bp, Homo sapiens
ctgccacagcctcccctgccagg

SEQ ID NO: 2658097 - DNA, 15 bp, Homo sapiens
ctgccaccaaaggcc

SEQ ID NO: 2658098 - DNA, 18 bp, Homo sapiens
ctgccaccaaaggccagg

SEQ ID NO: 2658099 - DNA, 22 bp, Homo sapiens
ctgccaccaaaggccagggtca

SEQ ID NO: 2658100 - DNA, 19 bp, Homo sapiens
ctgccaccctacctgttca

SEQ ID NO: 2658101 - DNA, 12 bp, Homo sapiens
ctgccaccctgg

SEQ ID NO: 2658102 - DNA, 16 bp, Homo sapiens
ctgccaccctggggag

SEQ ID NO: 2658103 - DNA, 20 bp, Homo sapiens
ctgccaccctggggagaaag

SEQ ID NO: 2658104 - DNA, 13 bp, Homo sapiens
ctgccacctccct

SEQ ID NO: 2658105 - DNA, 16 bp, Homo sapiens
ctgccacctccctgac

SEQ ID NO: 2658106 - DNA, 17 bp, Homo sapiens
ctgccacctccctgacc

SEQ ID NO: 2658107 - DNA, 18 bp, Homo sapiens
ctgccacctccctgaccc

SEQ ID NO: 2658108 - DNA, 15 bp, Homo sapiens
ctgccactcacacag

SEQ ID NO: 2658109 - DNA, 18 bp, Homo sapiens
ctgccactcacacagcca

SEQ ID NO: 2658110 - DNA, 21 bp, Homo sapiens
ctgccagaagatcccctcagg

SEQ ID NO: 2658111 - DNA, 16 bp, Homo sapiens
ctgccagatgctgatg

SEQ ID NO: 2658112 - DNA, 19 bp, Homo sapiens
cttgccttcttcacccagc

SEQ ID NO: 2658113 - DNA, 22 bp, Homo sapiens
cttgcggtatccgcccccaata

SEQ ID NO: 2658114 - DNA, 15 bp, Homo sapiens
cttgcgtatgtctgt

SEQ ID NO: 2658115 - DNA, 18 bp, Homo sapiens
cttgctaatcagtgtctc

SEQ ID NO: 2658116 - DNA, 20 bp, Homo sapiens
cttgctaatcagtgtctcac

SEQ ID NO: 2658117 - DNA, 16 bp, Homo sapiens
cttgctacctcaaggg

SEQ ID NO: 2658118 - DNA, 13 bp, Homo sapiens
cttgctatgatga

SEQ ID NO: 2658119 - DNA, 20 bp, Homo sapiens
cttgctctcccctgccctgc

SEQ ID NO: 2658120 - DNA, 20 bp, Homo sapiens
cttgctctccctcttctcaa

SEQ ID NO: 2658121 - DNA, 15 bp, Homo sapiens
cttgctctctggcct

SEQ ID NO: 2658122 - DNA, 13 bp, Homo sapiens
cttgctctgcacc

SEQ ID NO: 2658123 - DNA, 12 bp, Homo sapiens
cttgctctgctg

SEQ ID NO: 2658124 - DNA, 14 bp, Homo sapiens
cttgctctgctgac

SEQ ID NO: 2658125 - DNA, 16 bp, Homo sapiens
cttgctctgctgacag

SEQ ID NO: 2658126 - DNA, 17 bp, Homo sapiens
cttgctctgctgacaga

SEQ ID NO: 2658127 - DNA, 19 bp, Homo sapiens
cttgctgagaggggctgtc

SEQ ID NO: 2658128 - DNA, 17 bp, Homo sapiens
cttgctggttttctgga

SEQ ID NO: 2658129 - DNA, 21 bp, Homo sapiens
cttgcttgttgggattcctga

SEQ ID NO: 2658130 - DNA, 15 bp, Homo sapiens
cttggaaacctgccc

SEQ ID NO: 2658131 - DNA, 21 bp, Homo sapiens
cttggaaacctgccctgcctg

SEQ ID NO: 2658132 - DNA, 23 bp, Homo sapiens
cttggaaacctgccctgcctgag

SEQ ID NO: 2658133 - DNA, 21 bp, Homo sapiens
cttggaaactggatgaggtca

SEQ ID NO: 2658134 - DNA, 20 bp, Homo sapiens
cttggaaagcatcacctcag

SEQ ID NO: 2658135 - DNA, 21 bp, Homo sapiens
cttggaaagcatcacctcagg

SEQ ID NO: 2658136 - DNA, 23 bp, Homo sapiens
cttggaaagcatcacctcaggcc

SEQ ID NO: 2658137 - DNA, 15 bp, Homo sapiens
cttggaaaggaccag

SEQ ID NO: 2658138 - DNA, 21 bp, Homo sapiens
cttggaagtttcatatattgt

SEQ ID NO: 2658139 - DNA, 20 bp, Homo sapiens
cttggaatttgtaacctcag

SEQ ID NO: 2658140 - DNA, 22 bp, Homo sapiens
cttggaatttgtaacctcagct

SEQ ID NO: 2658141 - DNA, 14 bp, Homo sapiens
cttggacctctgct

SEQ ID NO: 2658142 - DNA, 15 bp, Homo sapiens
cttggacctctgctc

SEQ ID NO: 2658143 - DNA, 15 bp, Homo sapiens
cttggactcttgctc

SEQ ID NO: 2658144 - DNA, 18 bp, Homo sapiens
cttggagccccagtgcca

SEQ ID NO: 2658145 - DNA, 12 bp, Homo sapiens
cttggagctgag

SEQ ID NO: 2658146 - DNA, 13 bp, Homo sapiens
cttggagctgagc

SEQ ID NO: 2658147 - DNA, 15 bp, Homo sapiens
cttggaggctgtctt

SEQ ID NO: 2658148 - DNA, 24 bp, Homo sapiens
cttggagggttggtcctcttgcct

SEQ ID NO: 2658149 - DNA, 14 bp, Homo sapiens
cttggattgtcccc

SEQ ID NO: 2658150 - DNA, 20 bp, Homo sapiens
cttggattgtccccgaccct

SEQ ID NO: 2658151 - DNA, 24 bp, Homo sapiens
cttggattgtccccgacccttgcc

SEQ ID NO: 2658152 - DNA, 13 bp, Homo sapiens
cttggcaacagaa

SEQ ID NO: 2658153 - DNA, 15 bp, Homo sapiens
cttggcaacagaagc

SEQ ID NO: 2658154 - DNA, 20 bp, Homo sapiens
cttggcaacagaagcagttg

SEQ ID NO: 2658155 - DNA, 18 bp, Homo sapiens
cttggcagccgagctcgt

SEQ ID NO: 2658156 - DNA, 16 bp, Homo sapiens
cttggcatgccttcca

SEQ ID NO: 2658157 - DNA, 16 bp, Homo sapiens
cttggccttgggcttc

SEQ ID NO: 2658158 - DNA, 17 bp, Homo sapiens
cttggcggcagcagcca

SEQ ID NO: 2658159 - DNA, 19 bp, Homo sapiens
cttggcggcagcagccatc

SEQ ID NO: 2658160 - DNA, 23 bp, Homo sapiens
cttggctcaagtcctcttttctg

SEQ ID NO: 2658161 - DNA, 24 bp, Homo sapiens
cttggctcactgcaacttctgcct

SEQ ID NO: 2658162 - DNA, 14 bp, Homo sapiens
cttggctgcaggga

SEQ ID NO: 2658163 - DNA, 17 bp, Homo sapiens
cttggctgcagggagtc

SEQ ID NO: 2658164 - DNA, 16 bp, Homo sapiens
cttggctggtgcacct

SEQ ID NO: 2658165 - DNA, 17 bp, Homo sapiens
cttggctgtagaaggag

SEQ ID NO: 2658166 - DNA, 18 bp, Homo sapiens
cttggcttcctttcttgg

SEQ ID NO: 2658167 - DNA, 16 bp, Homo sapiens
cttggcttctcatacg

SEQ ID NO: 2658168 - DNA, 15 bp, Homo sapiens
cttggctttcatgtt

SEQ ID NO: 2658169 - DNA, 11 bp, Homo sapiens
cttgggaaata

SEQ ID NO: 2658170 - DNA, 19 bp, Homo sapiens
cttgggaaatatgaatgcc

SEQ ID NO: 2658171 - DNA, 22 bp, Homo sapiens
cttgggaggccccactggggaa

SEQ ID NO: 2658172 - DNA, 16 bp, Homo sapiens
cttgggccatagctcc

SEQ ID NO: 2658173 - DNA, 15 bp, Homo sapiens
cttgggcccagctgg

SEQ ID NO: 2658174 - DNA, 14 bp, Homo sapiens
cttgggccctcctg

SEQ ID NO: 2658175 - DNA, 16 bp, Homo sapiens
cttgggccctttgagt

SEQ ID NO: 2658176 - DNA, 17 bp, Homo sapiens
cttgggccctttgagtg

SEQ ID NO: 2658177 - DNA, 12 bp, Homo sapiens
cttgggcggctg

SEQ ID NO: 2658178 - DNA, 15 bp, Homo sapiens
cttgggcggctgaga

SEQ ID NO: 2658179 - DNA, 14 bp, Homo sapiens
cttgggctgagact

SEQ ID NO: 2658180 - DNA, 17 bp, Homo sapiens
cttgggctgagactgga

SEQ ID NO: 2658181 - DNA, 16 bp, Homo sapiens
cttggggaatttcctc

SEQ ID NO: 2658182 - DNA, 20 bp, Homo sapiens
cttggggcttgacttttgta

SEQ ID NO: 2658183 - DNA, 21 bp, Homo sapiens
cttggggcttgacttttgtat

SEQ ID NO: 2658184 - DNA, 23 bp, Homo sapiens
cttggggggctgaggtgggagga

SEQ ID NO: 2658185 - DNA, 23 bp, Homo sapiens
cttggggggtttttactccagtg

SEQ ID NO: 2658186 - DNA, 15 bp, Homo sapiens
cttgggtaggcggga

SEQ ID NO: 2658187 - DNA, 23 bp, Homo sapiens
cttgggtggagaagccattgtct

SEQ ID NO: 2658188 - DNA, 14 bp, Homo sapiens
cttggtcacataca

SEQ ID NO: 2658189 - DNA, 14 bp, Homo sapiens
cttggtcaccagct

SEQ ID NO: 2658190 - DNA, 17 bp, Homo sapiens
cttggtcctgctgcagt

SEQ ID NO: 2658191 - DNA, 23 bp, Homo sapiens
cttggtctcagtgtcaatgcagc

SEQ ID NO: 2658192 - DNA, 20 bp, Homo sapiens
cttggtctgatttcaggata

SEQ ID NO: 2658193 - DNA, 22 bp, Homo sapiens
cttggtgaatttttttttccta

SEQ ID NO: 2658194 - DNA, 17 bp, Homo sapiens
cttggtgtagttgaact

SEQ ID NO: 2658195 - DNA, 13 bp, Homo sapiens
cttggttccccca

SEQ ID NO: 2658196 - DNA, 16 bp, Homo sapiens
cttggttcccccactg

SEQ ID NO: 2658197 - DNA, 19 bp, Homo sapiens
cttggttcccccactgatc

SEQ ID NO: 2658198 - DNA, 17 bp, Homo sapiens
cttggttcccttgtgtg

SEQ ID NO: 2658199 - DNA, 14 bp, Homo sapiens
cttggttgaggaaa

SEQ ID NO: 2658200 - DNA, 15 bp, Homo sapiens
cttggttggctggcc

SEQ ID NO: 2658201 - DNA, 18 bp, Homo sapiens
cttggttgtctccacaca

SEQ ID NO: 2658202 - DNA, 17 bp, Homo sapiens
cttggtttccaaaggca

SEQ ID NO: 2658203 - DNA, 20 bp, Homo sapiens
cttggtttgtaaattaactt

SEQ ID NO: 2658204 - DNA, 16 bp, Homo sapiens
cttgtaaatagctcag

SEQ ID NO: 2658205 - DNA, 21 bp, Homo sapiens
cttgtaatgatatagccagaa

SEQ ID NO: 2658206 - DNA, 15 bp, Homo sapiens
cttgtaattctaaat

SEQ ID NO: 2658207 - DNA, 21 bp, Homo sapiens
cttgtaatttaaacaggccca

SEQ ID NO: 2658208 - DNA, 22 bp, Homo sapiens
cttgtaatttaaacaggcccag

SEQ ID NO: 2658209 - DNA, 23 bp, Homo sapiens
cttgtaatttaaacaggcccagc

SEQ ID NO: 2658210 - DNA, 22 bp, Homo sapiens
cttgtaatttttttaatttaca

SEQ ID NO: 2658211 - DNA, 12 bp, Homo sapiens
cttgtacaaaat

SEQ ID NO: 2658212 - DNA, 20 bp, Homo sapiens
cttgtacatgtgtagcctgt

SEQ ID NO: 2658213 - DNA, 23 bp, Homo sapiens
cttgtacatgtgtagcctgtgca

SEQ ID NO: 2658214 - DNA, 12 bp, Homo sapiens
cttgtatatttg

SEQ ID NO: 2658215 - DNA, 19 bp, Homo sapiens
cttgtatcaacactgttac

SEQ ID NO: 2658216 - DNA, 17 bp, Homo sapiens
cttgtattaaagacaga

SEQ ID NO: 2658217 - DNA, 23 bp, Homo sapiens
cttgtattaagttgttaataaaa

SEQ ID NO: 2658218 - DNA, 20 bp, Homo sapiens
cttgtatttaaatattaaat

SEQ ID NO: 2658219 - DNA, 15 bp, Homo sapiens
cttgtcactggtaga

SEQ ID NO: 2658220 - DNA, 15 bp, Homo sapiens
cttgtcccagaggct

SEQ ID NO: 2658221 - DNA, 17 bp, Homo sapiens
cttgtcccctgcctgtg

SEQ ID NO: 2658222 - DNA, 14 bp, Homo sapiens
cttgtcctttccct

SEQ ID NO: 2658223 - DNA, 20 bp, Homo sapiens
cttgtctcccagctcagggc

SEQ ID NO: 2658224 - DNA, 14 bp, Homo sapiens
cttgtctctgggct

SEQ ID NO: 2658225 - DNA, 14 bp, Homo sapiens
cttgtcttgttcac

SEQ ID NO: 2658226 - DNA, 15 bp, Homo sapiens
cttgtctttggaccc

SEQ ID NO: 2658227 - DNA, 21 bp, Homo sapiens
cttgtctttggaccctgaggc

SEQ ID NO: 2658228 - DNA, 22 bp, Homo sapiens
cttgtctttggaccctgaggcc

SEQ ID NO: 2658229 - DNA, 14 bp, Homo sapiens
cttgtgcctggctc

SEQ ID NO: 2658230 - DNA, 15 bp, Homo sapiens
cttgtgcctggctca

SEQ ID NO: 2658231 - DNA, 20 bp, Homo sapiens
cttgtgcttttcctatttgt

SEQ ID NO: 2658232 - DNA, 15 bp, Homo sapiens
cttgtggacacagct

SEQ ID NO: 2658233 - DNA, 21 bp, Homo sapiens
cttgtggacacagctcttctc

SEQ ID NO: 2658234 - DNA, 16 bp, Homo sapiens
cttgtggatgttttaa

SEQ ID NO: 2658235 - DNA, 22 bp, Homo sapiens
cttgtgtccctcctgggatctg

SEQ ID NO: 2658236 - DNA, 15 bp, Homo sapiens
cttgtgtctacagag

SEQ ID NO: 2658237 - DNA, 21 bp, Homo sapiens
cttgtgtgtgggctgtgagtg

SEQ ID NO: 2658238 - DNA, 21 bp, Homo sapiens
cttgttcgtgggtcatcggga

SEQ ID NO: 2658239 - DNA, 19 bp, Homo sapiens
cttgttggagcctgcaggg

SEQ ID NO: 2658240 - DNA, 21 bp, Homo sapiens
cttgttggatttttgtcttgt

SEQ ID NO: 2658241 - DNA, 18 bp, Homo sapiens
cttgttgggattcctgac

SEQ ID NO: 2658242 - DNA, 22 bp, Homo sapiens
cttgtttacagcactactctgt

SEQ ID NO: 2658243 - DNA, 22 bp, Homo sapiens
cttgtttcaattccacctgcaa

SEQ ID NO: 2658244 - DNA, 16 bp, Homo sapiens
cttgtttgctcacctg

SEQ ID NO: 2658245 - DNA, 14 bp, Homo sapiens
cttgttttcagttt

SEQ ID NO: 2658246 - DNA, 20 bp, Homo sapiens
ctttaaaagacaaatcaaag

SEQ ID NO: 2658247 - DNA, 21 bp, Homo sapiens
ctttaaacattggttcttgta

SEQ ID NO: 2658248 - DNA, 15 bp, Homo sapiens
ctttaaactcaggga

SEQ ID NO: 2658249 - DNA, 14 bp, Homo sapiens
ctttaaaggaaaaa

SEQ ID NO: 2658250 - DNA, 18 bp, Homo sapiens
ctttaaagggatggcaag

SEQ ID NO: 2658251 - DNA, 15 bp, Homo sapiens
ctttaaatctgtgat

SEQ ID NO: 2658252 - DNA, 23 bp, Homo sapiens
ctttaagacatactccttccatc

SEQ ID NO: 2658253 - DNA, 15 bp, Homo sapiens
ctttaagactgagca

SEQ ID NO: 2658254 - DNA, 19 bp, Homo sapiens
ctttaagcagctcttgcta

SEQ ID NO: 2658255 - DNA, 12 bp, Homo sapiens
ctttaaggaaaa

SEQ ID NO: 2658256 - DNA, 14 bp, Homo sapiens
gaaatatgaatgcc

SEQ ID NO: 2658257 - DNA, 15 bp, Homo sapiens
gaaatatgattttat

SEQ ID NO: 2658258 - DNA, 22 bp, Homo sapiens
gaaatatgattttatttgacaa

SEQ ID NO: 2658259 - DNA, 15 bp, Homo sapiens
gaaatatttagcaaa

SEQ ID NO: 2658260 - DNA, 19 bp, Homo sapiens
gaaatatttagcaaataat

SEQ ID NO: 2658261 - DNA, 18 bp, Homo sapiens
gaaatcaaatatgcaaag

SEQ ID NO: 2658262 - DNA, 20 bp, Homo sapiens
gaaatcaaatatgcaaagca

SEQ ID NO: 2658263 - DNA, 23 bp, Homo sapiens
gaaatcaaatatgcaaagcactg

SEQ ID NO: 2658264 - DNA, 21 bp, Homo sapiens
gaaatccctgtttaatattta

SEQ ID NO: 2658265 - DNA, 22 bp, Homo sapiens
gaaatccctgtttaatatttaa

SEQ ID NO: 2658266 - DNA, 19 bp, Homo sapiens
gaaatcttacagctgggtg

SEQ ID NO: 2658267 - DNA, 16 bp, Homo sapiens
gaaatgaaaacatgta

SEQ ID NO: 2658268 - DNA, 14 bp, Homo sapiens
gaaatgaataattt

SEQ ID NO: 2658269 - DNA, 19 bp, Homo sapiens
gaaatgaataatttcccaa

SEQ ID NO: 2658270 - DNA, 17 bp, Homo sapiens
gaaatgagaaggcagcc

SEQ ID NO: 2658271 - DNA, 19 bp, Homo sapiens
gaaatgagaaggcagccac

SEQ ID NO: 2658272 - DNA, 20 bp, Homo sapiens
gaaatgcattattttgaatg

SEQ ID NO: 2658273 - DNA, 15 bp, Homo sapiens
gaaatgctgggctga

SEQ ID NO: 2658274 - DNA, 16 bp, Homo sapiens
gaaatggctttgtgat

SEQ ID NO: 2658275 - DNA, 15 bp, Homo sapiens
gaaatgggcagagca

SEQ ID NO: 2658276 - DNA, 17 bp, Homo sapiens
gaaatggtatgagctga

SEQ ID NO: 2658277 - DNA, 22 bp, Homo sapiens
gaaatgttattttttaattatt

SEQ ID NO: 2658278 - DNA, 16 bp, Homo sapiens
gaaattagctgtgtga

SEQ ID NO: 2658279 - DNA, 19 bp, Homo sapiens
gaaattagctgtgtgaaat

SEQ ID NO: 2658280 - DNA, 21 bp, Homo sapiens
gaaattatgtatgtttacata

SEQ ID NO: 2658281 - DNA, 21 bp, Homo sapiens
gaaattcccttcatctggaac

SEQ ID NO: 2658282 - DNA, 16 bp, Homo sapiens
gaaattcctgtagcat

SEQ ID NO: 2658283 - DNA, 19 bp, Homo sapiens
gaaattcctgtagcatctt

SEQ ID NO: 2658284 - DNA, 13 bp, Homo sapiens
gaaattgacagat

SEQ ID NO: 2658285 - DNA, 17 bp, Homo sapiens
gaaattggaacagaatg

SEQ ID NO: 2658286 - DNA, 14 bp, Homo sapiens
gaaattggctggat

SEQ ID NO: 2658287 - DNA, 20 bp, Homo sapiens
gaaattgtctagcagagcag

SEQ ID NO: 2658288 - DNA, 22 bp, Homo sapiens
gaaattgtttaagtgttgtaaa

SEQ ID NO: 2658289 - DNA, 13 bp, Homo sapiens
gaaatttaaaaga

SEQ ID NO: 2658290 - DNA, 20 bp, Homo sapiens
gaaatttaattcatgtttct

SEQ ID NO: 2658291 - DNA, 21 bp, Homo sapiens
gaaatttaattcatgtttctt

SEQ ID NO: 2658292 - DNA, 11 bp, Homo sapiens
gaaatttgaat

SEQ ID NO: 2658293 - DNA, 21 bp, Homo sapiens
gaaatttgatttctattcaag

SEQ ID NO: 2658294 - DNA, 18 bp, Homo sapiens
gaaattttctagactttc

SEQ ID NO: 2658295 - DNA, 21 bp, Homo sapiens
gaaattttctagactttctgt

SEQ ID NO: 2658296 - DNA, 18 bp, Homo sapiens
gaaatttttattaaatta

SEQ ID NO: 2658297 - DNA, 17 bp, Homo sapiens
gaaatttttcagatgct

SEQ ID NO: 2658298 - DNA, 22 bp, Homo sapiens
gaacaaaggacagagtatgaac

SEQ ID NO: 2658299 - DNA, 18 bp, Homo sapiens
gaacaaatttacagagac

SEQ ID NO: 2658300 - DNA, 23 bp, Homo sapiens
gaacaaatttacagagacagaaa

SEQ ID NO: 2658301 - DNA, 16 bp, Homo sapiens
gaacaagcattctcct

SEQ ID NO: 2658302 - DNA, 13 bp, Homo sapiens
gaacaagcctaaa

SEQ ID NO: 2658303 - DNA, 21 bp, Homo sapiens
gaacaagttgtttcattgact

SEQ ID NO: 2658304 - DNA, 14 bp, Homo sapiens
gaacaatcaaagca

SEQ ID NO: 2658305 - DNA, 22 bp, Homo sapiens
gaacactaacctgaccgtgggc

SEQ ID NO: 2658306 - DNA, 16 bp, Homo sapiens
gaacactgggggaggg

SEQ ID NO: 2658307 - DNA, 17 bp, Homo sapiens
gaacactgggggagggg

SEQ ID NO: 2658308 - DNA, 15 bp, Homo sapiens
gaacacttttaataa

SEQ ID NO: 2658309 - DNA, 13 bp, Homo sapiens
gaacagaaatacc

SEQ ID NO: 2658310 - DNA, 19 bp, Homo sapiens
gaacagacaacagaagtca

SEQ ID NO: 2658311 - DNA, 15 bp, Homo sapiens
gaacagactggaagc

SEQ ID NO: 2658312 - DNA, 22 bp, Homo sapiens
gaacagactggaagcacagctt

SEQ ID NO: 2658313 - DNA, 21 bp, Homo sapiens
gaacagctatgggagccccag

SEQ ID NO: 2658314 - DNA, 16 bp, Homo sapiens
gaacagtgtttcccat

SEQ ID NO: 2658315 - DNA, 13 bp, Homo sapiens
gaacatacttcag

SEQ ID NO: 2658316 - DNA, 14 bp, Homo sapiens
gaacatccctgcca

SEQ ID NO: 2658317 - DNA, 17 bp, Homo sapiens
gaacatggacttgtata

SEQ ID NO: 2658318 - DNA, 16 bp, Homo sapiens
gaacatgtacactggt

SEQ ID NO: 2658319 - DNA, 23 bp, Homo sapiens
gaacattgcatataacttatatt

SEQ ID NO: 2658320 - DNA, 23 bp, Homo sapiens
gaaccagagccatggactctaca

SEQ ID NO: 2658321 - DNA, 21 bp, Homo sapiens
gaaccaggaaatggaacccca

SEQ ID NO: 2658322 - DNA, 19 bp, Homo sapiens
gaaccagtttcaggtgttt

SEQ ID NO: 2658323 - DNA, 16 bp, Homo sapiens
gaaccatgaagacagg

SEQ ID NO: 2658324 - DNA, 17 bp, Homo sapiens
gaaccatgaagacagga

SEQ ID NO: 2658325 - DNA, 16 bp, Homo sapiens
gaacccaagtccaagc

SEQ ID NO: 2658326 - DNA, 17 bp, Homo sapiens
gaacccaggacgcttct

SEQ ID NO: 2658327 - DNA, 14 bp, Homo sapiens
gaacccccctccca

SEQ ID NO: 2658328 - DNA, 17 bp, Homo sapiens
gaacccccctcccaccc

SEQ ID NO: 2658329 - DNA, 21 bp, Homo sapiens
gaacccctacatgaaacagaa

SEQ ID NO: 2658330 - DNA, 17 bp, Homo sapiens
gaaccccttcatcctct

SEQ ID NO: 2658331 - DNA, 13 bp, Homo sapiens
gaaccctgtgctg

SEQ ID NO: 2658332 - DNA, 14 bp, Homo sapiens
gaaccctgtgctgg

SEQ ID NO: 2658333 - DNA, 19 bp, Homo sapiens
gaacccttttggcccccga

SEQ ID NO: 2658334 - DNA, 23 bp, Homo sapiens
gaacccttttggcccccgagctg

SEQ ID NO: 2658335 - DNA, 19 bp, Homo sapiens
gaaccgagcaaagatcaaa

SEQ ID NO: 2658336 - DNA, 21 bp, Homo sapiens
gaaccgcagaagcctccccag

SEQ ID NO: 2658337 - DNA, 15 bp, Homo sapiens
gaaccgcaggaagct

SEQ ID NO: 2658338 - DNA, 15 bp, Homo sapiens
gaacctcatccagct

SEQ ID NO: 2658339 - DNA, 15 bp, Homo sapiens
gaacctcctctgtga

SEQ ID NO: 2658340 - DNA, 14 bp, Homo sapiens
gaacctcttcccca

SEQ ID NO: 2658341 - DNA, 12 bp, Homo sapiens
gaacctggaact

SEQ ID NO: 2658342 - DNA, 12 bp, Homo sapiens
gaacctggagag

SEQ ID NO: 2658343 - DNA, 17 bp, Homo sapiens
gaacctggaggggctag

SEQ ID NO: 2658344 - DNA, 16 bp, Homo sapiens
gaaccttgtgcctggc

SEQ ID NO: 2658345 - DNA, 17 bp, Homo sapiens
gaaccttgtgcctggct

SEQ ID NO: 2658346 - DNA, 14 bp, Homo sapiens
gaacgagaggggaa

SEQ ID NO: 2658347 - DNA, 23 bp, Homo sapiens
gaacgcagccctagagcctgcct

SEQ ID NO: 2658348 - DNA, 16 bp, Homo sapiens
gaacggggtccttcaa

SEQ ID NO: 2658349 - DNA, 17 bp, Homo sapiens
gaacggtaaatttctgt

SEQ ID NO: 2658350 - DNA, 16 bp, Homo sapiens
gaactaaactttcaca

SEQ ID NO: 2658351 - DNA, 17 bp, Homo sapiens
gaactaaactttcacac

SEQ ID NO: 2658352 - DNA, 18 bp, Homo sapiens
gaactaaactttcacacc

SEQ ID NO: 2658353 - DNA, 18 bp, Homo sapiens
gaactattccccagcagg

SEQ ID NO: 2658354 - DNA, 20 bp, Homo sapiens
gaactattccccagcagggt

SEQ ID NO: 2658355 - DNA, 15 bp, Homo sapiens
gaactcaactttgac

SEQ ID NO: 2658356 - DNA, 21 bp, Homo sapiens
gaactcacctggggctgctgg

SEQ ID NO: 2658357 - DNA, 14 bp, Homo sapiens
gaactcagccaagc

SEQ ID NO: 2658358 - DNA, 16 bp, Homo sapiens
gaactcagccaagcac

SEQ ID NO: 2658359 - DNA, 18 bp, Homo sapiens
gaactcagccaagcacag

SEQ ID NO: 2658360 - DNA, 20 bp, Homo sapiens
gaactcagccaagcacagtg

SEQ ID NO: 2658361 - DNA, 14 bp, Homo sapiens
gaactcattcctgc

SEQ ID NO: 2658362 - DNA, 22 bp, Homo sapiens
gaactcattcctgcctgtctcc

SEQ ID NO: 2658363 - DNA, 15 bp, Homo sapiens
gaactcctaaatcaa

SEQ ID NO: 2658364 - DNA, 13 bp, Homo sapiens
gaactcctggcct

SEQ ID NO: 2658365 - DNA, 16 bp, Homo sapiens
gaactctggcttccag

SEQ ID NO: 2658366 - DNA, 20 bp, Homo sapiens
gaactcttaatcaaatagca

SEQ ID NO: 2658367 - DNA, 15 bp, Homo sapiens
gaactcttagaaatg

SEQ ID NO: 2658368 - DNA, 18 bp, Homo sapiens
gaactcttagaaatgaag

SEQ ID NO: 2658369 - DNA, 16 bp, Homo sapiens
gaactgcagacctgtc

SEQ ID NO: 2658370 - DNA, 19 bp, Homo sapiens
gaactgcagacctgtcctc

SEQ ID NO: 2658371 - DNA, 21 bp, Homo sapiens
gaactgcatatgtttcgctga

SEQ ID NO: 2658372 - DNA, 17 bp, Homo sapiens
gaactgcctctttcctg

SEQ ID NO: 2658373 - DNA, 17 bp, Homo sapiens
gaactgctgggcttggc

SEQ ID NO: 2658374 - DNA, 20 bp, Homo sapiens
gaactgctgggcttggcagc

SEQ ID NO: 2658375 - DNA, 11 bp, Homo sapiens
gaactggctgc

SEQ ID NO: 2658376 - DNA, 15 bp, Homo sapiens
gaactgtccagagag

SEQ ID NO: 2658377 - DNA, 22 bp, Homo sapiens
gaactgtccagagagcaactct

SEQ ID NO: 2658378 - DNA, 14 bp, Homo sapiens
gaacttaaataatg

SEQ ID NO: 2658379 - DNA, 14 bp, Homo sapiens
gaacttctaatata

SEQ ID NO: 2658380 - DNA, 17 bp, Homo sapiens
gaacttctctcagactt

SEQ ID NO: 2658381 - DNA, 22 bp, Homo sapiens
gaacttgctgctgagtgcacca

SEQ ID NO: 2658382 - DNA, 17 bp, Homo sapiens
gaacttggaggcaccat

SEQ ID NO: 2658383 - DNA, 17 bp, Homo sapiens
gaacttgggccactgtg

SEQ ID NO: 2658384 - DNA, 23 bp, Homo sapiens
gaactttctcttcatactttttt

SEQ ID NO: 2658385 - DNA, 14 bp, Homo sapiens
gaactttgaaggac

SEQ ID NO: 2658386 - DNA, 13 bp, Homo sapiens
gaagaaaaaatac

SEQ ID NO: 2658387 - DNA, 18 bp, Homo sapiens
gaagaaaaaatacatttt

SEQ ID NO: 2658388 - DNA, 22 bp, Homo sapiens
gaagaaaactcctttagcaggt

SEQ ID NO: 2658389 - DNA, 20 bp, Homo sapiens
gaagaaaagtgggccagtgt

SEQ ID NO: 2658390 - DNA, 21 bp, Homo sapiens
gaagaaaggccatcagagcaa

SEQ ID NO: 2658391 - DNA, 15 bp, Homo sapiens
gaagaaagtggaaaa

SEQ ID NO: 2658392 - DNA, 13 bp, Homo sapiens
gaagaacatagaa

SEQ ID NO: 2658393 - DNA, 20 bp, Homo sapiens
gaagaacatccaaggagaaa

SEQ ID NO: 2658394 - DNA, 19 bp, Homo sapiens
gaagaatacaaacatattt

SEQ ID NO: 2658395 - DNA, 14 bp, Homo sapiens
gaagaatattcagg

SEQ ID NO: 2658396 - DNA, 17 bp, Homo sapiens
gaagaatattcaggact

SEQ ID NO: 2658397 - DNA, 14 bp, Homo sapiens
gaagaatgaacaaa

SEQ ID NO: 2658398 - DNA, 22 bp, Homo sapiens
gaagacaatgacttactgtaca

SEQ ID NO: 2658399 - DNA, 15 bp, Homo sapiens
gaagacaccagagca

SEQ ID NO: 2658400 - DNA, 15 bp, Homo sapiens
gacagtcttgtgctt

SEQ ID NO: 2658401 - DNA, 21 bp, Homo sapiens
gacagtgatctccatatgtta

SEQ ID NO: 2658402 - DNA, 13 bp, Homo sapiens
gacagtgcctggg

SEQ ID NO: 2658403 - DNA, 23 bp, Homo sapiens
gacagtgttgaaaatgttcagaa

SEQ ID NO: 2658404 - DNA, 14 bp, Homo sapiens
gacagttcaagaaa

SEQ ID NO: 2658405 - DNA, 15 bp, Homo sapiens
gacagttctgaagaa

SEQ ID NO: 2658406 - DNA, 23 bp, Homo sapiens
gacagtttcttagctttttaatt

SEQ ID NO: 2658407 - DNA, 16 bp, Homo sapiens
gacataacgtttttcc

SEQ ID NO: 2658408 - DNA, 21 bp, Homo sapiens
gacataacgtttttcctttaa

SEQ ID NO: 2658409 - DNA, 23 bp, Homo sapiens
gacataacgtttttcctttaaaa

SEQ ID NO: 2658410 - DNA, 20 bp, Homo sapiens
gacatattcatttggaaata

SEQ ID NO: 2658411 - DNA, 14 bp, Homo sapiens
gacatcaacagata

SEQ ID NO: 2658412 - DNA, 16 bp, Homo sapiens
gacatcacttgtacaa

SEQ ID NO: 2658413 - DNA, 19 bp, Homo sapiens
gacatcagtggcatggctc

SEQ ID NO: 2658414 - DNA, 22 bp, Homo sapiens
gacatccatgtttgtaaaacta

SEQ ID NO: 2658415 - DNA, 16 bp, Homo sapiens
gacatccgttgtgctt

SEQ ID NO: 2658416 - DNA, 23 bp, Homo sapiens
gacatcctcttctgcttaggaga

SEQ ID NO: 2658417 - DNA, 17 bp, Homo sapiens
gacatctcaggggccag

SEQ ID NO: 2658418 - DNA, 15 bp, Homo sapiens
gacatctctgcaccc

SEQ ID NO: 2658419 - DNA, 21 bp, Homo sapiens
gacatcttcaaagcttgaaga

SEQ ID NO: 2658420 - DNA, 16 bp, Homo sapiens
gacatgaatgcacact

SEQ ID NO: 2658421 - DNA, 14 bp, Homo sapiens
gacatgatcttctt

SEQ ID NO: 2658422 - DNA, 18 bp, Homo sapiens
gacatgctgaagccaaag

SEQ ID NO: 2658423 - DNA, 16 bp, Homo sapiens
gacatggacccggagc

SEQ ID NO: 2658424 - DNA, 17 bp, Homo sapiens
gacatggagactcctgc

SEQ ID NO: 2658425 - DNA, 14 bp, Homo sapiens
gacatgtgaaacct

SEQ ID NO: 2658426 - DNA, 18 bp, Homo sapiens
gacatgtgaaaccttttt

SEQ ID NO: 2658427 - DNA, 19 bp, Homo sapiens
gacatgtggaaagtgaatt

SEQ ID NO: 2658428 - DNA, 14 bp, Homo sapiens
gacatgtggtggga

SEQ ID NO: 2658429 - DNA, 16 bp, Homo sapiens
gacatgtggtgggaca

SEQ ID NO: 2658430 - DNA, 23 bp, Homo sapiens
gacatgttttagacaaatactca

SEQ ID NO: 2658431 - DNA, 14 bp, Homo sapiens
gacatgtttttgtt

SEQ ID NO: 2658432 - DNA, 12 bp, Homo sapiens
gacattaacagt

SEQ ID NO: 2658433 - DNA, 19 bp, Homo sapiens
gacattaacagttttccat

SEQ ID NO: 2658434 - DNA, 23 bp, Homo sapiens
gacattaacagttttccatgaaa

SEQ ID NO: 2658435 - DNA, 13 bp, Homo sapiens
gacattcatgcct

SEQ ID NO: 2658436 - DNA, 16 bp, Homo sapiens
gacattccaagacagt

SEQ ID NO: 2658437 - DNA, 17 bp, Homo sapiens
gacattctgccaggccc

SEQ ID NO: 2658438 - DNA, 11 bp, Homo sapiens
gacattctgtc

SEQ ID NO: 2658439 - DNA, 23 bp, Homo sapiens
gacattctgtcgccttagcatgt

SEQ ID NO: 2658440 - DNA, 14 bp, Homo sapiens
gacattgcggacag

SEQ ID NO: 2658441 - DNA, 15 bp, Homo sapiens
gacattgcggacagc

SEQ ID NO: 2658442 - DNA, 17 bp, Homo sapiens
gacattgcggacagcca

SEQ ID NO: 2658443 - DNA, 18 bp, Homo sapiens
gacattgtggcacattct

SEQ ID NO: 2658444 - DNA, 19 bp, Homo sapiens
gacattgttggccaaagcc

SEQ ID NO: 2658445 - DNA, 20 bp, Homo sapiens
gacatttctcttactgcaaa

SEQ ID NO: 2658446 - DNA, 15 bp, Homo sapiens
gacattttgccaaaa

SEQ ID NO: 2658447 - DNA, 13 bp, Homo sapiens
gaccaaaatcccc

SEQ ID NO: 2658448 - DNA, 19 bp, Homo sapiens
gaccaaaatccccttctca

SEQ ID NO: 2658449 - DNA, 22 bp, Homo sapiens
gaccaaattccttggcatgcct

SEQ ID NO: 2658450 - DNA, 23 bp, Homo sapiens
gaccaaattccttggcatgcctt

SEQ ID NO: 2658451 - DNA, 14 bp, Homo sapiens
gaccaactgggccc

SEQ ID NO: 2658452 - DNA, 19 bp, Homo sapiens
gaccaactgggcccaagac

SEQ ID NO: 2658453 - DNA, 14 bp, Homo sapiens
gaccaagagagaaa

SEQ ID NO: 2658454 - DNA, 18 bp, Homo sapiens
gaccaagagagaaagaag

SEQ ID NO: 2658455 - DNA, 12 bp, Homo sapiens
gaccaagcagga

SEQ ID NO: 2658456 - DNA, 16 bp, Homo sapiens
gaccaagcaggaagct

SEQ ID NO: 2658457 - DNA, 19 bp, Homo sapiens
gaccaaggacccctcacct

SEQ ID NO: 2658458 - DNA, 19 bp, Homo sapiens
gaccaatattgtacagttt

SEQ ID NO: 2658459 - DNA, 13 bp, Homo sapiens
gaccaattcaacc

SEQ ID NO: 2658460 - DNA, 20 bp, Homo sapiens
gaccacacctccctgaacca

SEQ ID NO: 2658461 - DNA, 23 bp, Homo sapiens
gaccacagcatcattttgcattc

SEQ ID NO: 2658462 - DNA, 23 bp, Homo sapiens
gaccacagggttcaaaatgtctg

SEQ ID NO: 2658463 - DNA, 23 bp, Homo sapiens
gaccacatctttatctgttcttg

SEQ ID NO: 2658464 - DNA, 16 bp, Homo sapiens
gaccaccacctcagag

SEQ ID NO: 2658465 - DNA, 19 bp, Homo sapiens
gaccaccccgcctgccctc

SEQ ID NO: 2658466 - DNA, 19 bp, Homo sapiens
gaccacccctgcctccacc

SEQ ID NO: 2658467 - DNA, 20 bp, Homo sapiens
gaccacccctgcctccaccc

SEQ ID NO: 2658468 - DNA, 15 bp, Homo sapiens
gaccaccctcccctc

SEQ ID NO: 2658469 - DNA, 19 bp, Homo sapiens
gaccaccctcccctctctt

SEQ ID NO: 2658470 - DNA, 17 bp, Homo sapiens
gaccacgggaagcatct

SEQ ID NO: 2658471 - DNA, 21 bp, Homo sapiens
gaccactgcagaagacagtat

SEQ ID NO: 2658472 - DNA, 22 bp, Homo sapiens
gaccagacaccttgacagggca

SEQ ID NO: 2658473 - DNA, 24 bp, Homo sapiens
gaccagacaccttgacagggcaca

SEQ ID NO: 2658474 - DNA, 18 bp, Homo sapiens
gaccagcagatcccagct

SEQ ID NO: 2658475 - DNA, 20 bp, Homo sapiens
gaccagcctccatgctgcct

SEQ ID NO: 2658476 - DNA, 21 bp, Homo sapiens
gaccagcctccatgctgcctc

SEQ ID NO: 2658477 - DNA, 22 bp, Homo sapiens
gaccagcctccatgctgcctcc

SEQ ID NO: 2658478 - DNA, 14 bp, Homo sapiens
gaccagcctccctg

SEQ ID NO: 2658479 - DNA, 13 bp, Homo sapiens
gaccagcctggcc

SEQ ID NO: 2658480 - DNA, 11 bp, Homo sapiens
gaccagctggg

SEQ ID NO: 2658481 - DNA, 13 bp, Homo sapiens
gaccagctggggc

SEQ ID NO: 2658482 - DNA, 23 bp, Homo sapiens
gaccagctggggcgtggggaggg

SEQ ID NO: 2658483 - DNA, 22 bp, Homo sapiens
gaccagcttttcccaaaagccc

SEQ ID NO: 2658484 - DNA, 14 bp, Homo sapiens
gaccaggactatag

SEQ ID NO: 2658485 - DNA, 14 bp, Homo sapiens
gaccaggactccct

SEQ ID NO: 2658486 - DNA, 14 bp, Homo sapiens
gaccagggcagggc

SEQ ID NO: 2658487 - DNA, 22 bp, Homo sapiens
gaccaggtcttggagctgagcc

SEQ ID NO: 2658488 - DNA, 21 bp, Homo sapiens
gaccaggttattttaaaaaga

SEQ ID NO: 2658489 - DNA, 18 bp, Homo sapiens
gaccagtcaacctgggca

SEQ ID NO: 2658490 - DNA, 19 bp, Homo sapiens
gaccataacagccaacagg

SEQ ID NO: 2658491 - DNA, 15 bp, Homo sapiens
gaccataatgttaca

SEQ ID NO: 2658492 - DNA, 19 bp, Homo sapiens
gaccatccactctaccctc

SEQ ID NO: 2658493 - DNA, 12 bp, Homo sapiens
gaccatccctga

SEQ ID NO: 2658494 - DNA, 13 bp, Homo sapiens
gaccatccctgaa

SEQ ID NO: 2658495 - DNA, 15 bp, Homo sapiens
gaccatccctgaagg

SEQ ID NO: 2658496 - DNA, 20 bp, Homo sapiens
gaccatccctgaaggccccg

SEQ ID NO: 2658497 - DNA, 20 bp, Homo sapiens
gaccattctccacctgccag

SEQ ID NO: 2658498 - DNA, 14 bp, Homo sapiens
gacccacccctgtg

SEQ ID NO: 2658499 - DNA, 18 bp, Homo sapiens
gacccacccctgtgctcc

SEQ ID NO: 2658500 - DNA, 23 bp, Homo sapiens
gacccacttcacacacaggcaac

SEQ ID NO: 2658501 - DNA, 10 bp, Homo sapiens
gacccagacc

SEQ ID NO: 2658502 - DNA, 14 bp, Homo sapiens
gacccagacccagt

SEQ ID NO: 2658503 - DNA, 20 bp, Homo sapiens
gacccagatcctcacaacca

SEQ ID NO: 2658504 - DNA, 17 bp, Homo sapiens
gacccagccctcatccc

SEQ ID NO: 2658505 - DNA, 16 bp, Homo sapiens
gacccaggcacctgca

SEQ ID NO: 2658506 - DNA, 14 bp, Homo sapiens
gacccaggctgggc

SEQ ID NO: 2658507 - DNA, 15 bp, Homo sapiens
gacccaggctgggca

SEQ ID NO: 2658508 - DNA, 23 bp, Homo sapiens
gacccagtgagattacagaggaa

SEQ ID NO: 2658509 - DNA, 14 bp, Homo sapiens
gacccatgctgccc

SEQ ID NO: 2658510 - DNA, 19 bp, Homo sapiens
gacccatgctgccctgtga

SEQ ID NO: 2658511 - DNA, 12 bp, Homo sapiens
gaccccacccaa

SEQ ID NO: 2658512 - DNA, 19 bp, Homo sapiens
gaccccacccaagcttggc

SEQ ID NO: 2658513 - DNA, 15 bp, Homo sapiens
gaccccagctgggag

SEQ ID NO: 2658514 - DNA, 21 bp, Homo sapiens
gaccccagctgggaggcaaga

SEQ ID NO: 2658515 - DNA, 16 bp, Homo sapiens
gaccccatctgtgaat

SEQ ID NO: 2658516 - DNA, 21 bp, Homo sapiens
gacccccaaccaagtggctcc

SEQ ID NO: 2658517 - DNA, 15 bp, Homo sapiens
gacccccacacctca

SEQ ID NO: 2658518 - DNA, 15 bp, Homo sapiens
gacccccaccccttc

SEQ ID NO: 2658519 - DNA, 19 bp, Homo sapiens
gacccccaccccttcccca

SEQ ID NO: 2658520 - DNA, 15 bp, Homo sapiens
gacccccgccccctg

SEQ ID NO: 2658521 - DNA, 18 bp, Homo sapiens
gacccccgccccctgccc

SEQ ID NO: 2658522 - DNA, 19 bp, Homo sapiens
gacccccgccccctgccct

SEQ ID NO: 2658523 - DNA, 14 bp, Homo sapiens
gacccccttcccct

SEQ ID NO: 2658524 - DNA, 13 bp, Homo sapiens
gacccctcacctt

SEQ ID NO: 2658525 - DNA, 14 bp, Homo sapiens
gacccctcaccttg

SEQ ID NO: 2658526 - DNA, 13 bp, Homo sapiens
gacccctccatgt

SEQ ID NO: 2658527 - DNA, 18 bp, Homo sapiens
gacccctccatgtgggct

SEQ ID NO: 2658528 - DNA, 12 bp, Homo sapiens
gacccctcctcc

SEQ ID NO: 2658529 - DNA, 16 bp, Homo sapiens
gacccctctggccagg

SEQ ID NO: 2658530 - DNA, 23 bp, Homo sapiens
gacccctgctcagtaaagcactt

SEQ ID NO: 2658531 - DNA, 13 bp, Homo sapiens
gacccctggcctc

SEQ ID NO: 2658532 - DNA, 14 bp, Homo sapiens
gacccctggcctcc

SEQ ID NO: 2658533 - DNA, 16 bp, Homo sapiens
gacccctggcctccgg

SEQ ID NO: 2658534 - DNA, 13 bp, Homo sapiens
gacccgctctgga

SEQ ID NO: 2658535 - DNA, 14 bp, Homo sapiens
gacccgctctggac

SEQ ID NO: 2658536 - DNA, 22 bp, Homo sapiens
gacccggagctaacactggccc

SEQ ID NO: 2658537 - DNA, 17 bp, Homo sapiens
gacccggaggccacatg

SEQ ID NO: 2658538 - DNA, 23 bp, Homo sapiens
gacccggaggccacatgagtccc

SEQ ID NO: 2658539 - DNA, 15 bp, Homo sapiens
gaccctcctgttgca

SEQ ID NO: 2658540 - DNA, 18 bp, Homo sapiens
gaccctcgtggccttccc

SEQ ID NO: 2658541 - DNA, 23 bp, Homo sapiens
gaccctctgaatggtccagggtt

SEQ ID NO: 2658542 - DNA, 18 bp, Homo sapiens
gaccctgaggcccagagg

SEQ ID NO: 2658543 - DNA, 21 bp, Homo sapiens
gaccctgaggcccagagggcc

SEQ ID NO: 2658544 - DNA, 13 bp, Homo sapiens
gaccctgccctgt

SEQ ID NO: 2658545 - DNA, 21 bp, Homo sapiens
gagccccttccttgctctgca

SEQ ID NO: 2658546 - DNA, 19 bp, Homo sapiens
gagcccgcacccccaccct

SEQ ID NO: 2658547 - DNA, 22 bp, Homo sapiens
gagcccgggagctgctgccctg

SEQ ID NO: 2658548 - DNA, 18 bp, Homo sapiens
gagcccgggctgcctggg

SEQ ID NO: 2658549 - DNA, 20 bp, Homo sapiens
gagcccgggctgcctgggct

SEQ ID NO: 2658550 - DNA, 15 bp, Homo sapiens
gagccctggtggcag

SEQ ID NO: 2658551 - DNA, 16 bp, Homo sapiens
gagccctggtggcagt

SEQ ID NO: 2658552 - DNA, 19 bp, Homo sapiens
gagccgagatcacgccact

SEQ ID NO: 2658553 - DNA, 20 bp, Homo sapiens
gagccgagatcacgccactg

SEQ ID NO: 2658554 - DNA, 14 bp, Homo sapiens
gagccgctggcaga

SEQ ID NO: 2658555 - DNA, 19 bp, Homo sapiens
gagccgctggcagaaggga

SEQ ID NO: 2658556 - DNA, 20 bp, Homo sapiens
gagccgctgtgagcccctgg

SEQ ID NO: 2658557 - DNA, 20 bp, Homo sapiens
gagccgggcctggggctcct

SEQ ID NO: 2658558 - DNA, 21 bp, Homo sapiens
gagccgggtctgcctcttctg

SEQ ID NO: 2658559 - DNA, 15 bp, Homo sapiens
gagcctcagcatcct

SEQ ID NO: 2658560 - DNA, 19 bp, Homo sapiens
gagcctcagcatcctggca

SEQ ID NO: 2658561 - DNA, 17 bp, Homo sapiens
gagcctcatccgaggca

SEQ ID NO: 2658562 - DNA, 13 bp, Homo sapiens
gagcctctgtcac

SEQ ID NO: 2658563 - DNA, 24 bp, Homo sapiens
gagcctctgtcactgcaggcactc

SEQ ID NO: 2658564 - DNA, 19 bp, Homo sapiens
gagcctgaattttgttgct

SEQ ID NO: 2658565 - DNA, 23 bp, Homo sapiens
gagcctgctggtcacagcctcct

SEQ ID NO: 2658566 - DNA, 10 bp, Homo sapiens
gagcctggca

SEQ ID NO: 2658567 - DNA, 23 bp, Homo sapiens
gagcctggctccgtccaggagcc

SEQ ID NO: 2658568 - DNA, 21 bp, Homo sapiens
gagcctgggaggtcaaggctg

SEQ ID NO: 2658569 - DNA, 12 bp, Homo sapiens
gagccttccagg

SEQ ID NO: 2658570 - DNA, 14 bp, Homo sapiens
gagccttccagggg

SEQ ID NO: 2658571 - DNA, 20 bp, Homo sapiens
gagccttccaggggtgggac

SEQ ID NO: 2658572 - DNA, 21 bp, Homo sapiens
gagcgagacttggtttcaaaa

SEQ ID NO: 2658573 - DNA, 16 bp, Homo sapiens
gagcgcatcaggcctg

SEQ ID NO: 2658574 - DNA, 21 bp, Homo sapiens
gagcgccgtgagttctcaggg

SEQ ID NO: 2658575 - DNA, 22 bp, Homo sapiens
gagcgtgggaggcgggagtgga

SEQ ID NO: 2658576 - DNA, 15 bp, Homo sapiens
gagctaacactggcc

SEQ ID NO: 2658577 - DNA, 19 bp, Homo sapiens
gagctaacactggccccta

SEQ ID NO: 2658578 - DNA, 17 bp, Homo sapiens
gagctacgcctgcctcc

SEQ ID NO: 2658579 - DNA, 20 bp, Homo sapiens
gagctacttgggccatagct

SEQ ID NO: 2658580 - DNA, 17 bp, Homo sapiens
gagctagaacctggagg

SEQ ID NO: 2658581 - DNA, 21 bp, Homo sapiens
gagctagaacctggagggcta

SEQ ID NO: 2658582 - DNA, 15 bp, Homo sapiens
gagctagcagcaggg

SEQ ID NO: 2658583 - DNA, 17 bp, Homo sapiens
gagctagcagcagggag

SEQ ID NO: 2658584 - DNA, 20 bp, Homo sapiens
gagctatttccattccagaa

SEQ ID NO: 2658585 - DNA, 16 bp, Homo sapiens
gagctcactcggcacc

SEQ ID NO: 2658586 - DNA, 17 bp, Homo sapiens
gagctcaggacactaat

SEQ ID NO: 2658587 - DNA, 22 bp, Homo sapiens
gagctccagacccccagcaacc

SEQ ID NO: 2658588 - DNA, 17 bp, Homo sapiens
gagctcctctcctggag

SEQ ID NO: 2658589 - DNA, 20 bp, Homo sapiens
gagctcgtgtatcctggggc

SEQ ID NO: 2658590 - DNA, 21 bp, Homo sapiens
gagctcgtgtatcctggggct

SEQ ID NO: 2658591 - DNA, 13 bp, Homo sapiens
gagctctccagct

SEQ ID NO: 2658592 - DNA, 15 bp, Homo sapiens
gagctctgcagccca

SEQ ID NO: 2658593 - DNA, 17 bp, Homo sapiens
gagctcttcaggcctcc

SEQ ID NO: 2658594 - DNA, 22 bp, Homo sapiens
gagctgaacccattttgagtga

SEQ ID NO: 2658595 - DNA, 23 bp, Homo sapiens
gagctgaacccattttgagtgac

SEQ ID NO: 2658596 - DNA, 18 bp, Homo sapiens
gagctgacacaaacctgc

SEQ ID NO: 2658597 - DNA, 17 bp, Homo sapiens
gagctgaggcaattcta

SEQ ID NO: 2658598 - DNA, 16 bp, Homo sapiens
gagctgaggcagcagt

SEQ ID NO: 2658599 - DNA, 13 bp, Homo sapiens
gagctgatccaga

SEQ ID NO: 2658600 - DNA, 16 bp, Homo sapiens
gagctgatccagagca

SEQ ID NO: 2658601 - DNA, 20 bp, Homo sapiens
gagctgatccagagcacaga

SEQ ID NO: 2658602 - DNA, 15 bp, Homo sapiens
gagctgcctgttcag

SEQ ID NO: 2658603 - DNA, 20 bp, Homo sapiens
gagctgcctgttcagctcca

SEQ ID NO: 2658604 - DNA, 12 bp, Homo sapiens
gagctgctggct

SEQ ID NO: 2658605 - DNA, 12 bp, Homo sapiens
gagctggagcct

SEQ ID NO: 2658606 - DNA, 20 bp, Homo sapiens
gagctggcaaaggtggctct

SEQ ID NO: 2658607 - DNA, 17 bp, Homo sapiens
gagctggccgtgggcct

SEQ ID NO: 2658608 - DNA, 16 bp, Homo sapiens
gagctggcgtctgtct

SEQ ID NO: 2658609 - DNA, 12 bp, Homo sapiens
gagctgggaggc

SEQ ID NO: 2658610 - DNA, 18 bp, Homo sapiens
gagctgggaggcatggcc

SEQ ID NO: 2658611 - DNA, 19 bp, Homo sapiens
gagctgggcagaaggccaa

SEQ ID NO: 2658612 - DNA, 12 bp, Homo sapiens
gagctggggaag

SEQ ID NO: 2658613 - DNA, 19 bp, Homo sapiens
gagctggggacctggtacc

SEQ ID NO: 2658614 - DNA, 18 bp, Homo sapiens
gagctgggtgtcaagagg

SEQ ID NO: 2658615 - DNA, 17 bp, Homo sapiens
gagctggtgcattacag

SEQ ID NO: 2658616 - DNA, 17 bp, Homo sapiens
gagctggtgcccggaga

SEQ ID NO: 2658617 - DNA, 17 bp, Homo sapiens
gagctgttcacagccag

SEQ ID NO: 2658618 - DNA, 20 bp, Homo sapiens
gagctgttcacagccagact

SEQ ID NO: 2658619 - DNA, 17 bp, Homo sapiens
gagctgtttactaggga

SEQ ID NO: 2658620 - DNA, 22 bp, Homo sapiens
gagctgtttatggcctcagctg

SEQ ID NO: 2658621 - DNA, 18 bp, Homo sapiens
gagcttagtgaaattact

SEQ ID NO: 2658622 - DNA, 14 bp, Homo sapiens
gagcttctctgtga

SEQ ID NO: 2658623 - DNA, 14 bp, Homo sapiens
gagcttctggcact

SEQ ID NO: 2658624 - DNA, 18 bp, Homo sapiens
gagcttttttctttaaga

SEQ ID NO: 2658625 - DNA, 23 bp, Homo sapiens
gaggaaactcacctgctggcccc

SEQ ID NO: 2658626 - DNA, 13 bp, Homo sapiens
gaggaaaggccag

SEQ ID NO: 2658627 - DNA, 19 bp, Homo sapiens
gaggaaaggccagctggca

SEQ ID NO: 2658628 - DNA, 23 bp, Homo sapiens
gaggaaaggccagctggcagcag

SEQ ID NO: 2658629 - DNA, 19 bp, Homo sapiens
gaggaaaggtttgagaagc

SEQ ID NO: 2658630 - DNA, 18 bp, Homo sapiens
gaggaactgtccagagag

SEQ ID NO: 2658631 - DNA, 19 bp, Homo sapiens
gaggaactgtccagagagc

SEQ ID NO: 2658632 - DNA, 21 bp, Homo sapiens
gaggaactgtccagagagcaa

SEQ ID NO: 2658633 - DNA, 20 bp, Homo sapiens
gaggaaggaaacccagctct

SEQ ID NO: 2658634 - DNA, 14 bp, Homo sapiens
gaggaaggattgta

SEQ ID NO: 2658635 - DNA, 17 bp, Homo sapiens
gaggaataattatttat

SEQ ID NO: 2658636 - DNA, 21 bp, Homo sapiens
gaggaatcatgtcaggcctgt

SEQ ID NO: 2658637 - DNA, 22 bp, Homo sapiens
gaggaatcatgtcaggcctgtg

SEQ ID NO: 2658638 - DNA, 14 bp, Homo sapiens
gaggaatccagacc

SEQ ID NO: 2658639 - DNA, 22 bp, Homo sapiens
gaggaattttctttgtgtagct

SEQ ID NO: 2658640 - DNA, 15 bp, Homo sapiens
gaggacaaccattcc

SEQ ID NO: 2658641 - DNA, 19 bp, Homo sapiens
gaggacaattcatgaactt

SEQ ID NO: 2658642 - DNA, 13 bp, Homo sapiens
gaggacagctgtc

SEQ ID NO: 2658643 - DNA, 23 bp, Homo sapiens
gaggacagggaggtgaccccagg

SEQ ID NO: 2658644 - DNA, 22 bp, Homo sapiens
gaggacagtatttgtggggagg

SEQ ID NO: 2658645 - DNA, 21 bp, Homo sapiens
gaggacatgtttttgttttct

SEQ ID NO: 2658646 - DNA, 19 bp, Homo sapiens
gaggaccagggcagggcca

SEQ ID NO: 2658647 - DNA, 15 bp, Homo sapiens
gaggaccttatctgt

SEQ ID NO: 2658648 - DNA, 20 bp, Homo sapiens
gaggacggtgcaacccaagg

SEQ ID NO: 2658649 - DNA, 18 bp, Homo sapiens
gaggactagaacctggag

SEQ ID NO: 2658650 - DNA, 18 bp, Homo sapiens
gaggactcacttgcccac

SEQ ID NO: 2658651 - DNA, 13 bp, Homo sapiens
gaggactgtattt

SEQ ID NO: 2658652 - DNA, 22 bp, Homo sapiens
gaggacttgtgtctctgtgctt

SEQ ID NO: 2658653 - DNA, 13 bp, Homo sapiens
gaggagagccaga

SEQ ID NO: 2658654 - DNA, 20 bp, Homo sapiens
gaggagaggggaagggccag

SEQ ID NO: 2658655 - DNA, 15 bp, Homo sapiens
gaggagcagtgcagg

SEQ ID NO: 2658656 - DNA, 18 bp, Homo sapiens
gaggagctcaggacacta

SEQ ID NO: 2658657 - DNA, 11 bp, Homo sapiens
gaggagctgct

SEQ ID NO: 2658658 - DNA, 13 bp, Homo sapiens
gaggagctgctgg

SEQ ID NO: 2658659 - DNA, 21 bp, Homo sapiens
gaggagcttgggggatgacta

SEQ ID NO: 2658660 - DNA, 14 bp, Homo sapiens
gaggaggaggaggt

SEQ ID NO: 2658661 - DNA, 18 bp, Homo sapiens
gaggaggccacctctcca

SEQ ID NO: 2658662 - DNA, 21 bp, Homo sapiens
gaggaggcctgggggcaggga

SEQ ID NO: 2658663 - DNA, 19 bp, Homo sapiens
gaggaggtaatgaattaaa

SEQ ID NO: 2658664 - DNA, 20 bp, Homo sapiens
gaggaggtttggggtctgcc

SEQ ID NO: 2658665 - DNA, 11 bp, Homo sapiens
gaggagttcaa

SEQ ID NO: 2658666 - DNA, 12 bp, Homo sapiens
gaggagttcaat

SEQ ID NO: 2658667 - DNA, 15 bp, Homo sapiens
gaggagttcaatgat

SEQ ID NO: 2658668 - DNA, 18 bp, Homo sapiens
gaggagttcaatgatcta

SEQ ID NO: 2658669 - DNA, 16 bp, Homo sapiens
gaggagtttcgaggta

SEQ ID NO: 2658670 - DNA, 19 bp, Homo sapiens
gaggatcacagtgctgaga

SEQ ID NO: 2658671 - DNA, 16 bp, Homo sapiens
gaggatcactggagcc

SEQ ID NO: 2658672 - DNA, 17 bp, Homo sapiens
gaggatcactggagccc

SEQ ID NO: 2658673 - DNA, 19 bp, Homo sapiens
gaggatcactggagcccag

SEQ ID NO: 2658674 - DNA, 13 bp, Homo sapiens
gaggatctcttga

SEQ ID NO: 2658675 - DNA, 13 bp, Homo sapiens
gaggatctggaga

SEQ ID NO: 2658676 - DNA, 14 bp, Homo sapiens
gaggatgagagccc

SEQ ID NO: 2658677 - DNA, 15 bp, Homo sapiens
gaggatgagagccca

SEQ ID NO: 2658678 - DNA, 13 bp, Homo sapiens
gaggatgagctgg

SEQ ID NO: 2658679 - DNA, 21 bp, Homo sapiens
gaggatgcagagtcagcagaa

SEQ ID NO: 2658680 - DNA, 12 bp, Homo sapiens
gaggatggagag

SEQ ID NO: 2658681 - DNA, 15 bp, Homo sapiens
gaggatggccagtgt

SEQ ID NO: 2658682 - DNA, 15 bp, Homo sapiens
gaggatgggaaggag

SEQ ID NO: 2658683 - DNA, 13 bp, Homo sapiens
gaggatgggctcg

SEQ ID NO: 2658684 - DNA, 14 bp, Homo sapiens
gaggatgggctcgc

SEQ ID NO: 2658685 - DNA, 12 bp, Homo sapiens
gaggatgttctg

SEQ ID NO: 2658686 - DNA, 20 bp, Homo sapiens
gaggattgcttgagctcagg

SEQ ID NO: 2658687 - DNA, 22 bp, Homo sapiens
gaggatttaagggatggaaaag

SEQ ID NO: 2658688 - DNA, 13 bp, Homo sapiens
gaggcaagagaat

SEQ ID NO: 2658689 - DNA, 15 bp, Homo sapiens
gatgagagcccagag

SEQ ID NO: 2658690 - DNA, 17 bp, Homo sapiens
gatgagcatcccaggat

SEQ ID NO: 2658691 - DNA, 15 bp, Homo sapiens
gatgagcatggagct

SEQ ID NO: 2658692 - DNA, 16 bp, Homo sapiens
gatgagcatggagctg

SEQ ID NO: 2658693 - DNA, 22 bp, Homo sapiens
gatgagcatttagggcaaggag

SEQ ID NO: 2658694 - DNA, 19 bp, Homo sapiens
gatgaggccgctagaggcc

SEQ ID NO: 2658695 - DNA, 21 bp, Homo sapiens
gatgaggccgctagaggcctg

SEQ ID NO: 2658696 - DNA, 14 bp, Homo sapiens
gatgaggcctcttg

SEQ ID NO: 2658697 - DNA, 23 bp, Homo sapiens
gatgaggcctcttggacctctgc

SEQ ID NO: 2658698 - DNA, 16 bp, Homo sapiens
gatgagtgagcatgcc

SEQ ID NO: 2658699 - DNA, 18 bp, Homo sapiens
gatgatacaagattagaa

SEQ ID NO: 2658700 - DNA, 19 bp, Homo sapiens
gatgatcagctgtttgtca

SEQ ID NO: 2658701 - DNA, 20 bp, Homo sapiens
gatgatcagctgtttgtcat

SEQ ID NO: 2658702 - DNA, 13 bp, Homo sapiens
gatgatcctaggc

SEQ ID NO: 2658703 - DNA, 15 bp, Homo sapiens
gatgatctaggaaga

SEQ ID NO: 2658704 - DNA, 14 bp, Homo sapiens
gatgatctttgcag

SEQ ID NO: 2658705 - DNA, 19 bp, Homo sapiens
gatgatgccaacctctgga

SEQ ID NO: 2658706 - DNA, 15 bp, Homo sapiens
gatgatggtgttttg

SEQ ID NO: 2658707 - DNA, 22 bp, Homo sapiens
gatgatggttgcaaaagactaa

SEQ ID NO: 2658708 - DNA, 22 bp, Homo sapiens
gatgattggaggggggaggtgg

SEQ ID NO: 2658709 - DNA, 14 bp, Homo sapiens
gatgcaaagaggca

SEQ ID NO: 2658710 - DNA, 15 bp, Homo sapiens
gatgcaaagaggcaa

SEQ ID NO: 2658711 - DNA, 16 bp, Homo sapiens
gatgcaaagaggcaag

SEQ ID NO: 2658712 - DNA, 17 bp, Homo sapiens
gatgcaaggaccaggac

SEQ ID NO: 2658713 - DNA, 21 bp, Homo sapiens
gatgcaatcggtttaaacatg

SEQ ID NO: 2658714 - DNA, 13 bp, Homo sapiens
gatgcaccagccc

SEQ ID NO: 2658715 - DNA, 15 bp, Homo sapiens
gatgcaccagccctt

SEQ ID NO: 2658716 - DNA, 23 bp, Homo sapiens
gatgcaccagcccttagcaggga

SEQ ID NO: 2658717 - DNA, 23 bp, Homo sapiens
gatgcagagagccattttgtgaa

SEQ ID NO: 2658718 - DNA, 21 bp, Homo sapiens
gatgcagcattttgtatttgt

SEQ ID NO: 2658719 - DNA, 14 bp, Homo sapiens
gatgcagcctcaca

SEQ ID NO: 2658720 - DNA, 17 bp, Homo sapiens
gatgcattaaaagaaaa

SEQ ID NO: 2658721 - DNA, 21 bp, Homo sapiens
gatgcattcttggttggctgg

SEQ ID NO: 2658722 - DNA, 17 bp, Homo sapiens
gatgccacacagagtgg

SEQ ID NO: 2658723 - DNA, 22 bp, Homo sapiens
gatgcccagagggcccaggcag

SEQ ID NO: 2658724 - DNA, 20 bp, Homo sapiens
gatgcccagggccactctgc

SEQ ID NO: 2658725 - DNA, 16 bp, Homo sapiens
gatgccccagagctgt

SEQ ID NO: 2658726 - DNA, 14 bp, Homo sapiens
gatgcctggtggca

SEQ ID NO: 2658727 - DNA, 15 bp, Homo sapiens
gatgcctggtggcag

SEQ ID NO: 2658728 - DNA, 17 bp, Homo sapiens
gatgcctggtggcagct

SEQ ID NO: 2658729 - DNA, 18 bp, Homo sapiens
gatgcctggtggcagctg

SEQ ID NO: 2658730 - DNA, 16 bp, Homo sapiens
gatgctccagccaacc

SEQ ID NO: 2658731 - DNA, 13 bp, Homo sapiens
gatgctccctccc

SEQ ID NO: 2658732 - DNA, 20 bp, Homo sapiens
gatgctccctcccctgccct

SEQ ID NO: 2658733 - DNA, 23 bp, Homo sapiens
gatgctccctcccctgccctggt

SEQ ID NO: 2658734 - DNA, 16 bp, Homo sapiens
gatgctccttgggccc

SEQ ID NO: 2658735 - DNA, 15 bp, Homo sapiens
gatgctgatgttcag

SEQ ID NO: 2658736 - DNA, 17 bp, Homo sapiens
gatgctgatgttcagtg

SEQ ID NO: 2658737 - DNA, 19 bp, Homo sapiens
gatgctgatgttcagtgta

SEQ ID NO: 2658738 - DNA, 16 bp, Homo sapiens
gatgctgcctgagtca

SEQ ID NO: 2658739 - DNA, 14 bp, Homo sapiens
gatgctggatgctc

SEQ ID NO: 2658740 - DNA, 20 bp, Homo sapiens
gatgctggatgtctgccaat

SEQ ID NO: 2658741 - DNA, 11 bp, Homo sapiens
gatgctgggat

SEQ ID NO: 2658742 - DNA, 17 bp, Homo sapiens
gatgctgggctggctcc

SEQ ID NO: 2658743 - DNA, 22 bp, Homo sapiens
gatgctgggctggctccctctt

SEQ ID NO: 2658744 - DNA, 23 bp, Homo sapiens
gatgctgggttggtgcacagtga

SEQ ID NO: 2658745 - DNA, 16 bp, Homo sapiens
gatgctgtgctatgaa

SEQ ID NO: 2658746 - DNA, 14 bp, Homo sapiens
gatgctgtttgaca

SEQ ID NO: 2658747 - DNA, 16 bp, Homo sapiens
gatgcttttctgtctc

SEQ ID NO: 2658748 - DNA, 21 bp, Homo sapiens
gatgcttttctgtctctgcct

SEQ ID NO: 2658749 - DNA, 22 bp, Homo sapiens
gatggaaaaaccacccccaaat

SEQ ID NO: 2658750 - DNA, 20 bp, Homo sapiens
gatggaacccttttggcccc

SEQ ID NO: 2658751 - DNA, 18 bp, Homo sapiens
gatggaaccgcaggaagc

SEQ ID NO: 2658752 - DNA, 20 bp, Homo sapiens
gatggaaccgcaggaagctg

SEQ ID NO: 2658753 - DNA, 22 bp, Homo sapiens
gatggagactccatgagaagcc

SEQ ID NO: 2658754 - DNA, 22 bp, Homo sapiens
gatggagactggtcctgtgtgc

SEQ ID NO: 2658755 - DNA, 15 bp, Homo sapiens
gatggagagagggga

SEQ ID NO: 2658756 - DNA, 16 bp, Homo sapiens
gatggagcgcacctgc

SEQ ID NO: 2658757 - DNA, 22 bp, Homo sapiens
gatggaggggtggtcctgactc

SEQ ID NO: 2658758 - DNA, 16 bp, Homo sapiens
gatggagttcttgtgc

SEQ ID NO: 2658759 - DNA, 18 bp, Homo sapiens
gatggagttcttgtgcca

SEQ ID NO: 2658760 - DNA, 12 bp, Homo sapiens
gatggattccaa

SEQ ID NO: 2658761 - DNA, 14 bp, Homo sapiens
gatggattctcaga

SEQ ID NO: 2658762 - DNA, 18 bp, Homo sapiens
gatggattctcagatatt

SEQ ID NO: 2658763 - DNA, 19 bp, Homo sapiens
gatggattctcagatattt

SEQ ID NO: 2658764 - DNA, 15 bp, Homo sapiens
gatggcagctgttta

SEQ ID NO: 2658765 - DNA, 13 bp, Homo sapiens
gatggcaggatgg

SEQ ID NO: 2658766 - DNA, 18 bp, Homo sapiens
gatggcaggatggcctgg

SEQ ID NO: 2658767 - DNA, 15 bp, Homo sapiens
gatggcatcctgtga

SEQ ID NO: 2658768 - DNA, 12 bp, Homo sapiens
gatggccagtgt

SEQ ID NO: 2658769 - DNA, 20 bp, Homo sapiens
gatggcctggccagggcctg

SEQ ID NO: 2658770 - DNA, 21 bp, Homo sapiens
gatggcctggccagggcctgg

SEQ ID NO: 2658771 - DNA, 14 bp, Homo sapiens
gatggcgggtgggg

SEQ ID NO: 2658772 - DNA, 19 bp, Homo sapiens
gatggcgtgggctgcgtga

SEQ ID NO: 2658773 - DNA, 21 bp, Homo sapiens
gatggctagtatcaaaagaaa

SEQ ID NO: 2658774 - DNA, 17 bp, Homo sapiens
gatggctgtgcctctgc

SEQ ID NO: 2658775 - DNA, 19 bp, Homo sapiens
gatggctgtgcctctgcct

SEQ ID NO: 2658776 - DNA, 20 bp, Homo sapiens
gatggctgtgcctctgcctg

SEQ ID NO: 2658777 - DNA, 14 bp, Homo sapiens
gatgggaatgaagc

SEQ ID NO: 2658778 - DNA, 22 bp, Homo sapiens
gatgggaatgaagcttgtgtat

SEQ ID NO: 2658779 - DNA, 22 bp, Homo sapiens
gatgggagctcctctcctggag

SEQ ID NO: 2658780 - DNA, 15 bp, Homo sapiens
gatgggagtgagaca

SEQ ID NO: 2658781 - DNA, 20 bp, Homo sapiens
gatgggcaacccccagcctg

SEQ ID NO: 2658782 - DNA, 21 bp, Homo sapiens
gatgggcatggggtgggcctc

SEQ ID NO: 2658783 - DNA, 18 bp, Homo sapiens
gatgggcttgttttcttg

SEQ ID NO: 2658784 - DNA, 14 bp, Homo sapiens
gatggggccctgcc

SEQ ID NO: 2658785 - DNA, 22 bp, Homo sapiens
gatggggccctgcctcctttgt

SEQ ID NO: 2658786 - DNA, 13 bp, Homo sapiens
gatggggcctctg

SEQ ID NO: 2658787 - DNA, 13 bp, Homo sapiens
gatggggctgcac

SEQ ID NO: 2658788 - DNA, 21 bp, Homo sapiens
gatgggtctggctgagctgaa

SEQ ID NO: 2658789 - DNA, 17 bp, Homo sapiens
gatggttattttctttt

SEQ ID NO: 2658790 - DNA, 18 bp, Homo sapiens
gatgtacagtctgtcatg

SEQ ID NO: 2658791 - DNA, 22 bp, Homo sapiens
gatgtacatttccaaattcaca

SEQ ID NO: 2658792 - DNA, 15 bp, Homo sapiens
gatgtagatttattt

SEQ ID NO: 2658793 - DNA, 17 bp, Homo sapiens
gatgtagatttatttca

SEQ ID NO: 2658794 - DNA, 18 bp, Homo sapiens
gatgtatttttgtaccct

SEQ ID NO: 2658795 - DNA, 12 bp, Homo sapiens
gatgtccagaag

SEQ ID NO: 2658796 - DNA, 22 bp, Homo sapiens
gatgtctgccaatttttgcctt

SEQ ID NO: 2658797 - DNA, 20 bp, Homo sapiens
gatgtcttcgtacagttctt

SEQ ID NO: 2658798 - DNA, 13 bp, Homo sapiens
gatgtcttctgcc

SEQ ID NO: 2658799 - DNA, 18 bp, Homo sapiens
gatgtcttctgcctgtta

SEQ ID NO: 2658800 - DNA, 16 bp, Homo sapiens
gatgtgaacacatcag

SEQ ID NO: 2658801 - DNA, 21 bp, Homo sapiens
gatgtgaattgcctgcagaga

SEQ ID NO: 2658802 - DNA, 22 bp, Homo sapiens
gatgtgaattgcctgcagagag

SEQ ID NO: 2658803 - DNA, 24 bp, Homo sapiens
gatgtgatttaatagtgttaatca

SEQ ID NO: 2658804 - DNA, 15 bp, Homo sapiens
gatgtgcctgggtgg

SEQ ID NO: 2658805 - DNA, 23 bp, Homo sapiens
gatgtgggagggagcagacagga

SEQ ID NO: 2658806 - DNA, 17 bp, Homo sapiens
gatgtgggtcaaggaat

SEQ ID NO: 2658807 - DNA, 15 bp, Homo sapiens
gatgtggtgaggcag

SEQ ID NO: 2658808 - DNA, 22 bp, Homo sapiens
gatgtggtgaggcaggctttgt

SEQ ID NO: 2658809 - DNA, 11 bp, Homo sapiens
gatgttaacac

SEQ ID NO: 2658810 - DNA, 18 bp, Homo sapiens
gatgttaacacattttgt

SEQ ID NO: 2658811 - DNA, 21 bp, Homo sapiens
gatgttaacacattttgtata

SEQ ID NO: 2658812 - DNA, 20 bp, Homo sapiens
gatgttcagattgctttgat

SEQ ID NO: 2658813 - DNA, 20 bp, Homo sapiens
gatgttcagtgtaatttctt

SEQ ID NO: 2658814 - DNA, 23 bp, Homo sapiens
gatgttcagtgtaatttctttgc

SEQ ID NO: 2658815 - DNA, 14 bp, Homo sapiens
gatgttcatttaga

SEQ ID NO: 2658816 - DNA, 19 bp, Homo sapiens
gatgttctaagtctttcca

SEQ ID NO: 2658817 - DNA, 14 bp, Homo sapiens
gatgttctgggaca

SEQ ID NO: 2658818 - DNA, 23 bp, Homo sapiens
gatgtttacaggtggacacacaa

SEQ ID NO: 2658819 - DNA, 13 bp, Homo sapiens
gatgtttgtggcc

SEQ ID NO: 2658820 - DNA, 14 bp, Homo sapiens
gatgtttgtggcct

SEQ ID NO: 2658821 - DNA, 13 bp, Homo sapiens
gatgttttaattc

SEQ ID NO: 2658822 - DNA, 21 bp, Homo sapiens
gatgtttttaaaagtttcaat

SEQ ID NO: 2658823 - DNA, 16 bp, Homo sapiens
gatgtttttcatgaaa

SEQ ID NO: 2658824 - DNA, 23 bp, Homo sapiens
gattacaagcgtgagccactgca

SEQ ID NO: 2658825 - DNA, 20 bp, Homo sapiens
gattacaggtgtgaaccacc

SEQ ID NO: 2658826 - DNA, 14 bp, Homo sapiens
gattacataatctg

SEQ ID NO: 2658827 - DNA, 15 bp, Homo sapiens
gattacattcagttg

SEQ ID NO: 2658828 - DNA, 21 bp, Homo sapiens
gattacccaagcaaaatcatg

SEQ ID NO: 2658829 - DNA, 17 bp, Homo sapiens
gattagaatgaaaattg

SEQ ID NO: 2658830 - DNA, 22 bp, Homo sapiens
gattagaatgaaaattgtatgt

SEQ ID NO: 2658831 - DNA, 18 bp, Homo sapiens
gattagaggcagatctgg

SEQ ID NO: 2658832 - DNA, 14 bp, Homo sapiens
gattagagggaggt

SEQ ID NO: 2658833 - DNA, 17 bp, Homo sapiens
gcaaactcactgctcaa

SEQ ID NO: 2658834 - DNA, 23 bp, Homo sapiens
gcaaactttgtatgtcatttcct

SEQ ID NO: 2658835 - DNA, 15 bp, Homo sapiens
gcaaagatcaaaata

SEQ ID NO: 2658836 - DNA, 12 bp, Homo sapiens
gcaaagcattga

SEQ ID NO: 2658837 - DNA, 14 bp, Homo sapiens
gcaaaggaaatacc

SEQ ID NO: 2658838 - DNA, 17 bp, Homo sapiens
gcaaaggagtagaaaga

SEQ ID NO: 2658839 - DNA, 20 bp, Homo sapiens
gcaaagggagcactgggttg

SEQ ID NO: 2658840 - DNA, 22 bp, Homo sapiens
gcaaagggctgaaagccatttg

SEQ ID NO: 2658841 - DNA, 23 bp, Homo sapiens
gcaaaggggtcccatagaggtga

SEQ ID NO: 2658842 - DNA, 17 bp, Homo sapiens
gcaaagtgagggccgag

SEQ ID NO: 2658843 - DNA, 19 bp, Homo sapiens
gcaaataatttcctggtgt

SEQ ID NO: 2658844 - DNA, 22 bp, Homo sapiens
gcaaatcagaaacttgtgaagt

SEQ ID NO: 2658845 - DNA, 15 bp, Homo sapiens
gcaaatcctatgtga

SEQ ID NO: 2658846 - DNA, 23 bp, Homo sapiens
gcaaatcctatgtgattttaact

SEQ ID NO: 2658847 - DNA, 21 bp, Homo sapiens
gcaaatgtcagatacaatgta

SEQ ID NO: 2658848 - DNA, 16 bp, Homo sapiens
gcaaatgtgacctgtg

SEQ ID NO: 2658849 - DNA, 17 bp, Homo sapiens
gcaacacaagctggaag

SEQ ID NO: 2658850 - DNA, 19 bp, Homo sapiens
gcaacacaagctggaagca

SEQ ID NO: 2658851 - DNA, 14 bp, Homo sapiens
gcaacagagtgaga

SEQ ID NO: 2658852 - DNA, 20 bp, Homo sapiens
gcaacagcactggctctctc

SEQ ID NO: 2658853 - DNA, 14 bp, Homo sapiens
gcaacaggctgggc

SEQ ID NO: 2658854 - DNA, 13 bp, Homo sapiens
gcaacaggtttta

SEQ ID NO: 2658855 - DNA, 18 bp, Homo sapiens
gcaacatctagcaaatgt

SEQ ID NO: 2658856 - DNA, 20 bp, Homo sapiens
gcaaccacaggcagcattta

SEQ ID NO: 2658857 - DNA, 16 bp, Homo sapiens
gcaacccaaggactga

SEQ ID NO: 2658858 - DNA, 20 bp, Homo sapiens
gcaacccaaggactgaggga

SEQ ID NO: 2658859 - DNA, 22 bp, Homo sapiens
gcaaccccagttctgctcctct

SEQ ID NO: 2658860 - DNA, 15 bp, Homo sapiens
gcaacccccagcctg

SEQ ID NO: 2658861 - DNA, 12 bp, Homo sapiens
gcaaccctccta

SEQ ID NO: 2658862 - DNA, 23 bp, Homo sapiens
gcaaccgtctgttatgctgtgac

SEQ ID NO: 2658863 - DNA, 17 bp, Homo sapiens
gcaagaaagaaacccga

SEQ ID NO: 2658864 - DNA, 21 bp, Homo sapiens
gcaagacgctgtgctgccctg

SEQ ID NO: 2658865 - DNA, 18 bp, Homo sapiens
gcaagactgttgctcaaa

SEQ ID NO: 2658866 - DNA, 17 bp, Homo sapiens
gcaagagagatgttttg

SEQ ID NO: 2658867 - DNA, 15 bp, Homo sapiens
gcaagatatttatat

SEQ ID NO: 2658868 - DNA, 18 bp, Homo sapiens
gcaagattctgaaacatt

SEQ ID NO: 2658869 - DNA, 14 bp, Homo sapiens
gcaagattgcttaa

SEQ ID NO: 2658870 - DNA, 18 bp, Homo sapiens
gcaagcacctcctgcctc

SEQ ID NO: 2658871 - DNA, 21 bp, Homo sapiens
gcaagcactgcatgggcaagc

SEQ ID NO: 2658872 - DNA, 20 bp, Homo sapiens
gcaagcatttatgtttattt

SEQ ID NO: 2658873 - DNA, 15 bp, Homo sapiens
gcaagcccctgctcc

SEQ ID NO: 2658874 - DNA, 13 bp, Homo sapiens
gcaagctcccaag

SEQ ID NO: 2658875 - DNA, 19 bp, Homo sapiens
gcaagctcccaagggatgg

SEQ ID NO: 2658876 - DNA, 13 bp, Homo sapiens
gcaagctgggtaa

SEQ ID NO: 2658877 - DNA, 14 bp, Homo sapiens
gcaaggaccaggac

SEQ ID NO: 2658878 - DNA, 20 bp, Homo sapiens
gcaaggaccaggactccctc

SEQ ID NO: 2658879 - DNA, 18 bp, Homo sapiens
gcaaggagatttacaact

SEQ ID NO: 2658880 - DNA, 11 bp, Homo sapiens
gcaaggcaggt

SEQ ID NO: 2658881 - DNA, 18 bp, Homo sapiens
gcaaggcaggtgcctcca

SEQ ID NO: 2658882 - DNA, 12 bp, Homo sapiens
gcaaggctgtgc

SEQ ID NO: 2658883 - DNA, 18 bp, Homo sapiens
gcaaggctgtgctccctg

SEQ ID NO: 2658884 - DNA, 15 bp, Homo sapiens
gcaagggccatgctg

SEQ ID NO: 2658885 - DNA, 16 bp, Homo sapiens
gcaaggggaaaatctc

SEQ ID NO: 2658886 - DNA, 20 bp, Homo sapiens
gcaaggtggctccagcacca

SEQ ID NO: 2658887 - DNA, 14 bp, Homo sapiens
gcaagtatgtgagt

SEQ ID NO: 2658888 - DNA, 19 bp, Homo sapiens
gcaagtcagaggatggcca

SEQ ID NO: 2658889 - DNA, 23 bp, Homo sapiens
gcaagtcagaggatggccagtgt

SEQ ID NO: 2658890 - DNA, 24 bp, Homo sapiens
gcaagtcagaggatggccagtgtc

SEQ ID NO: 2658891 - DNA, 20 bp, Homo sapiens
gcaagtgaatttttctctaa

SEQ ID NO: 2658892 - DNA, 16 bp, Homo sapiens
gcaagtgagagctggg

SEQ ID NO: 2658893 - DNA, 19 bp, Homo sapiens
gcaagtgattgggacagag

SEQ ID NO: 2658894 - DNA, 21 bp, Homo sapiens
gcaagtgtatgcacgtgtgca

SEQ ID NO: 2658895 - DNA, 16 bp, Homo sapiens
gcaagtgtctgtgtgc

SEQ ID NO: 2658896 - DNA, 12 bp, Homo sapiens
gcaagtgtgtgc

SEQ ID NO: 2658897 - DNA, 22 bp, Homo sapiens
gcaagtttctagctagaaatat

SEQ ID NO: 2658898 - DNA, 21 bp, Homo sapiens
gcaataaagcagcgtttctat

SEQ ID NO: 2658899 - DNA, 19 bp, Homo sapiens
gcaataatggtcccatcca

SEQ ID NO: 2658900 - DNA, 20 bp, Homo sapiens
gcaataatggtcccatccag

SEQ ID NO: 2658901 - DNA, 21 bp, Homo sapiens
gcaataatggtcccatccagg

SEQ ID NO: 2658902 - DNA, 20 bp, Homo sapiens
gcaatagtgtgttctgatta

SEQ ID NO: 2658903 - DNA, 14 bp, Homo sapiens
gcaatatgtaaata

SEQ ID NO: 2658904 - DNA, 13 bp, Homo sapiens
gcaatccatgtta

SEQ ID NO: 2658905 - DNA, 22 bp, Homo sapiens
gcaatccatgttagtttttact

SEQ ID NO: 2658906 - DNA, 14 bp, Homo sapiens
gcaatcctgtcttt

SEQ ID NO: 2658907 - DNA, 19 bp, Homo sapiens
gcaatctcggctcattgaa

SEQ ID NO: 2658908 - DNA, 16 bp, Homo sapiens
gcaatgaaaaattctc

SEQ ID NO: 2658909 - DNA, 18 bp, Homo sapiens
gcaatgacaggtaaatta

SEQ ID NO: 2658910 - DNA, 16 bp, Homo sapiens
gcaatgacatctcagg

SEQ ID NO: 2658911 - DNA, 11 bp, Homo sapiens
gcaatgcattt

SEQ ID NO: 2658912 - DNA, 14 bp, Homo sapiens
gcaatgctggctgt

SEQ ID NO: 2658913 - DNA, 23 bp, Homo sapiens
gcaatgctggctgttggctgggg

SEQ ID NO: 2658914 - DNA, 13 bp, Homo sapiens
gcaatggcagcct

SEQ ID NO: 2658915 - DNA, 14 bp, Homo sapiens
gcaatgggcactgg

SEQ ID NO: 2658916 - DNA, 20 bp, Homo sapiens
gcaatggtgttgccctgagt

SEQ ID NO: 2658917 - DNA, 14 bp, Homo sapiens
gcaattcccctctg

SEQ ID NO: 2658918 - DNA, 18 bp, Homo sapiens
gcaattgaattaaattag

SEQ ID NO: 2658919 - DNA, 15 bp, Homo sapiens
gcaattgcttaggat

SEQ ID NO: 2658920 - DNA, 23 bp, Homo sapiens
gcaatttaatattttgcacagtt

SEQ ID NO: 2658921 - DNA, 19 bp, Homo sapiens
gcaattttaattgattatt

SEQ ID NO: 2658922 - DNA, 18 bp, Homo sapiens
gcaattttgcatttgaat

SEQ ID NO: 2658923 - DNA, 14 bp, Homo sapiens
gcaattttgtaacg

SEQ ID NO: 2658924 - DNA, 23 bp, Homo sapiens
gcacaagcaaaagggtgtctgag

SEQ ID NO: 2658925 - DNA, 17 bp, Homo sapiens
gcacaagctccaagctc

SEQ ID NO: 2658926 - DNA, 18 bp, Homo sapiens
gcacaagctccaagctcc

SEQ ID NO: 2658927 - DNA, 17 bp, Homo sapiens
gcacaatattgaacttt

SEQ ID NO: 2658928 - DNA, 19 bp, Homo sapiens
gcacaatattgaacttttt

SEQ ID NO: 2658929 - DNA, 12 bp, Homo sapiens
gcacacacacaa

SEQ ID NO: 2658930 - DNA, 14 bp, Homo sapiens
gcacacacacacac

SEQ ID NO: 2658931 - DNA, 13 bp, Homo sapiens
gcacacacctgta

SEQ ID NO: 2658932 - DNA, 14 bp, Homo sapiens
gcacacatttttta

SEQ ID NO: 2658933 - DNA, 20 bp, Homo sapiens
gcacactcccctgcactgga

SEQ ID NO: 2658934 - DNA, 21 bp, Homo sapiens
gcacactcccctgcactggag

SEQ ID NO: 2658935 - DNA, 14 bp, Homo sapiens
gcacacttggccca

SEQ ID NO: 2658936 - DNA, 12 bp, Homo sapiens
gcacagaaggag

SEQ ID NO: 2658937 - DNA, 14 bp, Homo sapiens
gcacagaccctgcc

SEQ ID NO: 2658938 - DNA, 18 bp, Homo sapiens
gcacagaccctgccctgt

SEQ ID NO: 2658939 - DNA, 16 bp, Homo sapiens
gcacagagttgttaca

SEQ ID NO: 2658940 - DNA, 18 bp, Homo sapiens
gcacagagttgttacatt

SEQ ID NO: 2658941 - DNA, 15 bp, Homo sapiens
gcacagatggatttg

SEQ ID NO: 2658942 - DNA, 22 bp, Homo sapiens
gcacagatggatttgcctgtgc

SEQ ID NO: 2658943 - DNA, 16 bp, Homo sapiens
gcacagcagttccgga

SEQ ID NO: 2658944 - DNA, 15 bp, Homo sapiens
gcacagccaaggact

SEQ ID NO: 2658945 - DNA, 17 bp, Homo sapiens
gcacagcccaaagaagg

SEQ ID NO: 2658946 - DNA, 21 bp, Homo sapiens
gcacagcttcatttcctgtgt

SEQ ID NO: 2658947 - DNA, 14 bp, Homo sapiens
gcacaggcagctgg

SEQ ID NO: 2658948 - DNA, 15 bp, Homo sapiens
gcacagggcagctgg

SEQ ID NO: 2658949 - DNA, 17 bp, Homo sapiens
gcacagggcagctgggc

SEQ ID NO: 2658950 - DNA, 19 bp, Homo sapiens
gcacagggcagctgggccc

SEQ ID NO: 2658951 - DNA, 21 bp, Homo sapiens
gcacaggtgggcttcccagtg

SEQ ID NO: 2658952 - DNA, 22 bp, Homo sapiens
gcacagtggtggcagggcctag

SEQ ID NO: 2658953 - DNA, 17 bp, Homo sapiens
gcacagtgttaaatgaa

SEQ ID NO: 2658954 - DNA, 15 bp, Homo sapiens
gcacagtttgaacaa

SEQ ID NO: 2658955 - DNA, 20 bp, Homo sapiens
gcacatcagcacgatttctg

SEQ ID NO: 2658956 - DNA, 20 bp, Homo sapiens
gcacatcctatgcaatatat

SEQ ID NO: 2658957 - DNA, 22 bp, Homo sapiens
gcacatgcagatggggctcccg

SEQ ID NO: 2658958 - DNA, 22 bp, Homo sapiens
gcacatggaggagcttggggga

SEQ ID NO: 2658959 - DNA, 20 bp, Homo sapiens
gcacatgtcttgtacatgtg

SEQ ID NO: 2658960 - DNA, 12 bp, Homo sapiens
gcacatgtgtgc

SEQ ID NO: 2658961 - DNA, 19 bp, Homo sapiens
gcaccaaaataagaaaaga

SEQ ID NO: 2658962 - DNA, 22 bp, Homo sapiens
gcaccaccgagagaggctggga

SEQ ID NO: 2658963 - DNA, 16 bp, Homo sapiens
gcaccagcttctccag

SEQ ID NO: 2658964 - DNA, 18 bp, Homo sapiens
gcaccatccgccagggcc

SEQ ID NO: 2658965 - DNA, 19 bp, Homo sapiens
gcacccacaagtgccactg

SEQ ID NO: 2658966 - DNA, 13 bp, Homo sapiens
gcacccccaccct

SEQ ID NO: 2658967 - DNA, 18 bp, Homo sapiens
gcacccccaccctttggg

SEQ ID NO: 2658968 - DNA, 13 bp, Homo sapiens
gcacccccctggg

SEQ ID NO: 2658969 - DNA, 13 bp, Homo sapiens
gcacccctcccat

SEQ ID NO: 2658970 - DNA, 13 bp, Homo sapiens
gcacccctgtctc

SEQ ID NO: 2658971 - DNA, 19 bp, Homo sapiens
gcacccggcccctgctggt

SEQ ID NO: 2658972 - DNA, 15 bp, Homo sapiens
gcaccctcaggcagg

SEQ ID NO: 2658973 - DNA, 16 bp, Homo sapiens
gcaccctcaggcaggt

SEQ ID NO: 2658974 - DNA, 13 bp, Homo sapiens
gcaccctccaccc

SEQ ID NO: 2658975 - DNA, 16 bp, Homo sapiens
gcaccctccaccctgt

SEQ ID NO: 2658976 - DNA, 17 bp, Homo sapiens
gcaccctccaccctgtc

SEQ ID NO: 2658977 - DNA, 18 bp, Homo sapiens
gcaccctccaccctgtcc

SEQ ID NO: 2658978 - DNA, 18 bp, Homo sapiens
gccaatggaacctccttt

SEQ ID NO: 2658979 - DNA, 20 bp, Homo sapiens
gccaatggaacctcctttct

SEQ ID NO: 2658980 - DNA, 13 bp, Homo sapiens
gccaattcctata

SEQ ID NO: 2658981 - DNA, 23 bp, Homo sapiens
gccaatttttgccttcattacct

SEQ ID NO: 2658982 - DNA, 18 bp, Homo sapiens
gccacacaaacgtttact

SEQ ID NO: 2658983 - DNA, 19 bp, Homo sapiens
gccacacaaacgtttactt

SEQ ID NO: 2658984 - DNA, 11 bp, Homo sapiens
gccacacacac

SEQ ID NO: 2658985 - DNA, 14 bp, Homo sapiens
gccacacacacaga

SEQ ID NO: 2658986 - DNA, 19 bp, Homo sapiens
gccacacacacagaaaata

SEQ ID NO: 2658987 - DNA, 20 bp, Homo sapiens
gccacacacacagaaaatat

SEQ ID NO: 2658988 - DNA, 22 bp, Homo sapiens
gccacacacacagaaaatatac

SEQ ID NO: 2658989 - DNA, 18 bp, Homo sapiens
gccacactattaccatga

SEQ ID NO: 2658990 - DNA, 14 bp, Homo sapiens
gccacagaagccag

SEQ ID NO: 2658991 - DNA, 13 bp, Homo sapiens
gccacagagaaag

SEQ ID NO: 2658992 - DNA, 20 bp, Homo sapiens
gccacagagaaagtacttct

SEQ ID NO: 2658993 - DNA, 23 bp, Homo sapiens
gccacagagaaagtacttctcca

SEQ ID NO: 2658994 - DNA, 23 bp, Homo sapiens
gccacagaggactcacttgccca

SEQ ID NO: 2658995 - DNA, 11 bp, Homo sapiens
gccacagctct

SEQ ID NO: 2658996 - DNA, 20 bp, Homo sapiens
gccacatgagtcccagtggg

SEQ ID NO: 2658997 - DNA, 21 bp, Homo sapiens
gccacatggcttcctcctgcg

SEQ ID NO: 2658998 - DNA, 22 bp, Homo sapiens
gccacatggcttcctcctgcgc

SEQ ID NO: 2658999 - DNA, 17 bp, Homo sapiens
gccaccaaaggccaggg

SEQ ID NO: 2659000 - DNA, 19 bp, Homo sapiens
gccaccaacatactcccat

SEQ ID NO: 2659001 - DNA, 20 bp, Homo sapiens
gccaccaacatactcccatc

SEQ ID NO: 2659002 - DNA, 22 bp, Homo sapiens
gccaccaactcttgcaggtctc

SEQ ID NO: 2659003 - DNA, 22 bp, Homo sapiens
gccaccaagagggacgcctggg

SEQ ID NO: 2659004 - DNA, 12 bp, Homo sapiens
gccaccaggatg

SEQ ID NO: 2659005 - DNA, 16 bp, Homo sapiens
gccaccaggctggcgc

SEQ ID NO: 2659006 - DNA, 19 bp, Homo sapiens
gccaccaggctggcgcagc

SEQ ID NO: 2659007 - DNA, 15 bp, Homo sapiens
gccaccatcctgctg

SEQ ID NO: 2659008 - DNA, 16 bp, Homo sapiens
gccaccatggccagcc

SEQ ID NO: 2659009 - DNA, 15 bp, Homo sapiens
gccaccccaccctcc

SEQ ID NO: 2659010 - DNA, 13 bp, Homo sapiens
gccaccctcatgc

SEQ ID NO: 2659011 - DNA, 19 bp, Homo sapiens
gccaccctggggagaaagt

SEQ ID NO: 2659012 - DNA, 17 bp, Homo sapiens
gccaccgcgcctggccg

SEQ ID NO: 2659013 - DNA, 15 bp, Homo sapiens
gccacctatctcgtg

SEQ ID NO: 2659014 - DNA, 18 bp, Homo sapiens
gccacctctccaagggct

SEQ ID NO: 2659015 - DNA, 21 bp, Homo sapiens
gccacctgaggtgggcccagg

SEQ ID NO: 2659016 - DNA, 23 bp, Homo sapiens
gccacctgaggtgggcccaggac

SEQ ID NO: 2659017 - DNA, 14 bp, Homo sapiens
gccacctgcggtgc

SEQ ID NO: 2659018 - DNA, 15 bp, Homo sapiens
gccacgattgcagga

SEQ ID NO: 2659019 - DNA, 14 bp, Homo sapiens
gccacggccaggcc

SEQ ID NO: 2659020 - DNA, 17 bp, Homo sapiens
gccacggccaggccaga

SEQ ID NO: 2659021 - DNA, 18 bp, Homo sapiens
gccacggccaggccagag

SEQ ID NO: 2659022 - DNA, 22 bp, Homo sapiens
gccacgggtctgtgttcgactc

SEQ ID NO: 2659023 - DNA, 23 bp, Homo sapiens
gccacgtgtttgtgctgtggtgt

SEQ ID NO: 2659024 - DNA, 17 bp, Homo sapiens
gccactacactccagcc

SEQ ID NO: 2659025 - DNA, 18 bp, Homo sapiens
gccactcacacagccagg

SEQ ID NO: 2659026 - DNA, 13 bp, Homo sapiens
gccactcctctga

SEQ ID NO: 2659027 - DNA, 21 bp, Homo sapiens
gccactcctctgactcagggc

SEQ ID NO: 2659028 - DNA, 15 bp, Homo sapiens
gccactcctgaaccc

SEQ ID NO: 2659029 - DNA, 13 bp, Homo sapiens
gccactctgcctc

SEQ ID NO: 2659030 - DNA, 15 bp, Homo sapiens
gccactctgcctctg

SEQ ID NO: 2659031 - DNA, 17 bp, Homo sapiens
gccactctgcctctgcc

SEQ ID NO: 2659032 - DNA, 13 bp, Homo sapiens
gccactcttccaa

SEQ ID NO: 2659033 - DNA, 17 bp, Homo sapiens
gccactgaagctgggat

SEQ ID NO: 2659034 - DNA, 19 bp, Homo sapiens
gccactgaagctgggattc

SEQ ID NO: 2659035 - DNA, 15 bp, Homo sapiens
gccactgcacagagc

SEQ ID NO: 2659036 - DNA, 22 bp, Homo sapiens
gccactgcacagagctctccag

SEQ ID NO: 2659037 - DNA, 17 bp, Homo sapiens
gccactgcaccgggcca

SEQ ID NO: 2659038 - DNA, 20 bp, Homo sapiens
gccactgcaccgggccacag

SEQ ID NO: 2659039 - DNA, 21 bp, Homo sapiens
gccactgcactatagcctagg

SEQ ID NO: 2659040 - DNA, 13 bp, Homo sapiens
gccactgcctctt

SEQ ID NO: 2659041 - DNA, 16 bp, Homo sapiens
gccactgcctcttcct

SEQ ID NO: 2659042 - DNA, 13 bp, Homo sapiens
gccactgctgctt

SEQ ID NO: 2659043 - DNA, 19 bp, Homo sapiens
gccactgtgaagagaacca

SEQ ID NO: 2659044 - DNA, 18 bp, Homo sapiens
gccacttaaaatgttcac

SEQ ID NO: 2659045 - DNA, 19 bp, Homo sapiens
gccacttaccttcaataaa

SEQ ID NO: 2659046 - DNA, 22 bp, Homo sapiens
gccacttaccttcaataaagta

SEQ ID NO: 2659047 - DNA, 23 bp, Homo sapiens
gccacttaccttcaataaagtat

SEQ ID NO: 2659048 - DNA, 10 bp, Homo sapiens
gccagaaaaa

SEQ ID NO: 2659049 - DNA, 17 bp, Homo sapiens
gccagaagatcccctca

SEQ ID NO: 2659050 - DNA, 12 bp, Homo sapiens
gccagaagctga

SEQ ID NO: 2659051 - DNA, 14 bp, Homo sapiens
gccagacatgtggt

SEQ ID NO: 2659052 - DNA, 13 bp, Homo sapiens
gccagactctggt

SEQ ID NO: 2659053 - DNA, 18 bp, Homo sapiens
gccagactggcacagttt

SEQ ID NO: 2659054 - DNA, 16 bp, Homo sapiens
gccagagaagtgacag

SEQ ID NO: 2659055 - DNA, 18 bp, Homo sapiens
gccagaggaactgtccag

SEQ ID NO: 2659056 - DNA, 20 bp, Homo sapiens
gccagaggaactgtccagag

SEQ ID NO: 2659057 - DNA, 24 bp, Homo sapiens
gccagaggaactgtccagagagca

SEQ ID NO: 2659058 - DNA, 18 bp, Homo sapiens
gccagagggagtgacaga

SEQ ID NO: 2659059 - DNA, 23 bp, Homo sapiens
gccagagggagtgacagaggcag

SEQ ID NO: 2659060 - DNA, 14 bp, Homo sapiens
gccagagtggcctg

SEQ ID NO: 2659061 - DNA, 24 bp, Homo sapiens
gccagagttcctgcggagtgaaga

SEQ ID NO: 2659062 - DNA, 14 bp, Homo sapiens
gccagatgcaccag

SEQ ID NO: 2659063 - DNA, 15 bp, Homo sapiens
gccagatgctgatgt

SEQ ID NO: 2659064 - DNA, 24 bp, Homo sapiens
gccagatgctgatgttcagtgtaa

SEQ ID NO: 2659065 - DNA, 14 bp, Homo sapiens
gccagatggggcct

SEQ ID NO: 2659066 - DNA, 13 bp, Homo sapiens
gccagcaactgaa

SEQ ID NO: 2659067 - DNA, 20 bp, Homo sapiens
gccagcacagaaacagagga

SEQ ID NO: 2659068 - DNA, 19 bp, Homo sapiens
gccagcagccagctctcag

SEQ ID NO: 2659069 - DNA, 21 bp, Homo sapiens
gccagcagccagctctcagcc

SEQ ID NO: 2659070 - DNA, 14 bp, Homo sapiens
gccagccagcagcc

SEQ ID NO: 2659071 - DNA, 22 bp, Homo sapiens
gccagccagtgacctgaggaag

SEQ ID NO: 2659072 - DNA, 18 bp, Homo sapiens
gccagccccacccaggag

SEQ ID NO: 2659073 - DNA, 21 bp, Homo sapiens
gccagccgtgatgctcaggct

SEQ ID NO: 2659074 - DNA, 16 bp, Homo sapiens
gccagcctggcttctg

SEQ ID NO: 2659075 - DNA, 17 bp, Homo sapiens
gccagcctggcttctgg

SEQ ID NO: 2659076 - DNA, 20 bp, Homo sapiens
gccagccttgaccattctcc

SEQ ID NO: 2659077 - DNA, 22 bp, Homo sapiens
gccagccttgaccattctccac

SEQ ID NO: 2659078 - DNA, 12 bp, Homo sapiens
gccagcgaactt

SEQ ID NO: 2659079 - DNA, 22 bp, Homo sapiens
gccagcgtcctcctctgtgacc

SEQ ID NO: 2659080 - DNA, 16 bp, Homo sapiens
gccagctcagtcccat

SEQ ID NO: 2659081 - DNA, 14 bp, Homo sapiens
gccagctctcagcc

SEQ ID NO: 2659082 - DNA, 23 bp, Homo sapiens
gccagctctgtatcaggacccag

SEQ ID NO: 2659083 - DNA, 17 bp, Homo sapiens
gccagctgccccagcca

SEQ ID NO: 2659084 - DNA, 16 bp, Homo sapiens
gccagctgctccccag

SEQ ID NO: 2659085 - DNA, 15 bp, Homo sapiens
gccagctttccctgc

SEQ ID NO: 2659086 - DNA, 22 bp, Homo sapiens
gccaggaccagtcaacctgggc

SEQ ID NO: 2659087 - DNA, 17 bp, Homo sapiens
gccaggactccccaggc

SEQ ID NO: 2659088 - DNA, 23 bp, Homo sapiens
gccaggagctgggcagaaggcca

SEQ ID NO: 2659089 - DNA, 19 bp, Homo sapiens
gccaggagtttgagaccag

SEQ ID NO: 2659090 - DNA, 22 bp, Homo sapiens
gccaggatcatggtgtaataag

SEQ ID NO: 2659091 - DNA, 24 bp, Homo sapiens
gccaggatcatggtgtaataagac

SEQ ID NO: 2659092 - DNA, 14 bp, Homo sapiens
gccaggatggaatg

SEQ ID NO: 2659093 - DNA, 21 bp, Homo sapiens
gccaggcaccccctggagaga

SEQ ID NO: 2659094 - DNA, 21 bp, Homo sapiens
gccaggcagatctgtgcccca

SEQ ID NO: 2659095 - DNA, 23 bp, Homo sapiens
gccaggcagatctgtgccccatg

SEQ ID NO: 2659096 - DNA, 16 bp, Homo sapiens
gccaggccaccaggat

SEQ ID NO: 2659097 - DNA, 20 bp, Homo sapiens
gccaggccacctccagaaac

SEQ ID NO: 2659098 - DNA, 19 bp, Homo sapiens
gccaggcccccaagcctgc

SEQ ID NO: 2659099 - DNA, 15 bp, Homo sapiens
gccaggccctctgcc

SEQ ID NO: 2659100 - DNA, 20 bp, Homo sapiens
gccaggccctctgcccactc

SEQ ID NO: 2659101 - DNA, 21 bp, Homo sapiens
gccaggccctctgcccactcc

SEQ ID NO: 2659102 - DNA, 21 bp, Homo sapiens
gccaggcctgggtctgtgtct

SEQ ID NO: 2659103 - DNA, 15 bp, Homo sapiens
gccaggctccttcct

SEQ ID NO: 2659104 - DNA, 21 bp, Homo sapiens
gccaggctccttcctgtcttc

SEQ ID NO: 2659105 - DNA, 16 bp, Homo sapiens
gccaggctctgtgctg

SEQ ID NO: 2659106 - DNA, 14 bp, Homo sapiens
gccaggctgccaag

SEQ ID NO: 2659107 - DNA, 15 bp, Homo sapiens
gccaggctggtctca

SEQ ID NO: 2659108 - DNA, 21 bp, Homo sapiens
gccagggagacagagctcaca

SEQ ID NO: 2659109 - DNA, 15 bp, Homo sapiens
gccagggcagagtga

SEQ ID NO: 2659110 - DNA, 19 bp, Homo sapiens
gccagggcagggccccagg

SEQ ID NO: 2659111 - DNA, 16 bp, Homo sapiens
gccagggccctgcaga

SEQ ID NO: 2659112 - DNA, 16 bp, Homo sapiens
gccagggcctggaaga

SEQ ID NO: 2659113 - DNA, 22 bp, Homo sapiens
gccagggctatagctcaggacc

SEQ ID NO: 2659114 - DNA, 23 bp, Homo sapiens
gccaggggaaaatcagcctgctc

SEQ ID NO: 2659115 - DNA, 20 bp, Homo sapiens
gccagggtggtcttgatctc

SEQ ID NO: 2659116 - DNA, 21 bp, Homo sapiens
gccagggtttcgagaagctgc

SEQ ID NO: 2659117 - DNA, 14 bp, Homo sapiens
gccaggtgccttgg

SEQ ID NO: 2659118 - DNA, 15 bp, Homo sapiens
gccaggtgccttgga

SEQ ID NO: 2659119 - DNA, 18 bp, Homo sapiens
gccaggttctatttggaa

SEQ ID NO: 2659120 - DNA, 19 bp, Homo sapiens
gccaggttctatttggaat

SEQ ID NO: 2659121 - DNA, 20 bp, Homo sapiens
gcctattatattaaaatatg

SEQ ID NO: 2659122 - DNA, 22 bp, Homo sapiens
gcctattcccacacctccacag

SEQ ID NO: 2659123 - DNA, 14 bp, Homo sapiens
gcctcaaccctccc

SEQ ID NO: 2659124 - DNA, 23 bp, Homo sapiens
gcctcaaccctccctcagcccct

SEQ ID NO: 2659125 - DNA, 16 bp, Homo sapiens
gcctcaacctcctggg

SEQ ID NO: 2659126 - DNA, 22 bp, Homo sapiens
gcctcaagtgattctcctgcct

SEQ ID NO: 2659127 - DNA, 17 bp, Homo sapiens
gcctcaatgtgaccagg

SEQ ID NO: 2659128 - DNA, 13 bp, Homo sapiens
gcctcacagtcct

SEQ ID NO: 2659129 - DNA, 15 bp, Homo sapiens
gcctcaccccctcgg

SEQ ID NO: 2659130 - DNA, 15 bp, Homo sapiens
gcctcagccattcac

SEQ ID NO: 2659131 - DNA, 22 bp, Homo sapiens
gcctcagcctcccaaagtgctg

SEQ ID NO: 2659132 - DNA, 16 bp, Homo sapiens
gcctcagcctcctgag

SEQ ID NO: 2659133 - DNA, 18 bp, Homo sapiens
gcctcagcctcctgagta

SEQ ID NO: 2659134 - DNA, 14 bp, Homo sapiens
gcctcagctgcctc

SEQ ID NO: 2659135 - DNA, 20 bp, Homo sapiens
gcctcagtaagacgacaagg

SEQ ID NO: 2659136 - DNA, 22 bp, Homo sapiens
gcctcagtaagtatctggagga

SEQ ID NO: 2659137 - DNA, 22 bp, Homo sapiens
gcctcagtctcccttctcccat

SEQ ID NO: 2659138 - DNA, 12 bp, Homo sapiens
gcctcagtgcca

SEQ ID NO: 2659139 - DNA, 14 bp, Homo sapiens
gcctcagtgccact

SEQ ID NO: 2659140 - DNA, 22 bp, Homo sapiens
gcctcagtggactttccacccc

SEQ ID NO: 2659141 - DNA, 22 bp, Homo sapiens
gcctcatatttaaagacaggga

SEQ ID NO: 2659142 - DNA, 17 bp, Homo sapiens
gcctcatccgaggcagg

SEQ ID NO: 2659143 - DNA, 22 bp, Homo sapiens
gcctcatgtccactggttcttc

SEQ ID NO: 2659144 - DNA, 21 bp, Homo sapiens
gcctcattactttaccacccc

SEQ ID NO: 2659145 - DNA, 22 bp, Homo sapiens
gcctccaaatgccaacttgtcc

SEQ ID NO: 2659146 - DNA, 23 bp, Homo sapiens
gcctccaaggaggggctgtaaaa

SEQ ID NO: 2659147 - DNA, 23 bp, Homo sapiens
gcctccaccaccactggccacca

SEQ ID NO: 2659148 - DNA, 14 bp, Homo sapiens
gcctccaccctctg

SEQ ID NO: 2659149 - DNA, 15 bp, Homo sapiens
gcctccaccctctga

SEQ ID NO: 2659150 - DNA, 12 bp, Homo sapiens
gcctccagcctc

SEQ ID NO: 2659151 - DNA, 14 bp, Homo sapiens
gcctccagcctctg

SEQ ID NO: 2659152 - DNA, 16 bp, Homo sapiens
gcctccaggtgtgcac

SEQ ID NO: 2659153 - DNA, 17 bp, Homo sapiens
gcctcccaaagtgctgg

SEQ ID NO: 2659154 - DNA, 13 bp, Homo sapiens
gcctcccaactca

SEQ ID NO: 2659155 - DNA, 16 bp, Homo sapiens
gcctcccaactcaccc

SEQ ID NO: 2659156 - DNA, 18 bp, Homo sapiens
gcctcccaactcacccca

SEQ ID NO: 2659157 - DNA, 22 bp, Homo sapiens
gcctcccaactcaccccagccc

SEQ ID NO: 2659158 - DNA, 17 bp, Homo sapiens
gcctcccacccccatct

SEQ ID NO: 2659159 - DNA, 21 bp, Homo sapiens
gcctcccacccgatgctgctt

SEQ ID NO: 2659160 - DNA, 12 bp, Homo sapiens
gcctcccactgg

SEQ ID NO: 2659161 - DNA, 14 bp, Homo sapiens
gcctcccactgggg

SEQ ID NO: 2659162 - DNA, 13 bp, Homo sapiens
gcctcccagcctg

SEQ ID NO: 2659163 - DNA, 14 bp, Homo sapiens
gcctcccagcctgg

SEQ ID NO: 2659164 - DNA, 16 bp, Homo sapiens
gcctcccatcacccgc

SEQ ID NO: 2659165 - DNA, 21 bp, Homo sapiens
gcctccccaaccctgcccctg

SEQ ID NO: 2659166 - DNA, 12 bp, Homo sapiens
gcctccccacct

SEQ ID NO: 2659167 - DNA, 15 bp, Homo sapiens
gcctcccctgccagg

SEQ ID NO: 2659168 - DNA, 18 bp, Homo sapiens
gcctcccctgccagggca

SEQ ID NO: 2659169 - DNA, 16 bp, Homo sapiens
gcctcccctgtgcagt

SEQ ID NO: 2659170 - DNA, 19 bp, Homo sapiens
gcctcccgaatagctggga

SEQ ID NO: 2659171 - DNA, 15 bp, Homo sapiens
gcctcccgagtagct

SEQ ID NO: 2659172 - DNA, 23 bp, Homo sapiens
gcctcccgagtagctgggactac

SEQ ID NO: 2659173 - DNA, 16 bp, Homo sapiens
gcctccctctctcttc

SEQ ID NO: 2659174 - DNA, 21 bp, Homo sapiens
gcctccctctctcttctgctc

SEQ ID NO: 2659175 - DNA, 20 bp, Homo sapiens
gcctccctctgacctgcagg

SEQ ID NO: 2659176 - DNA, 22 bp, Homo sapiens
gcctcccttcatgcatggaaat

SEQ ID NO: 2659177 - DNA, 12 bp, Homo sapiens
gcctccggcctc

SEQ ID NO: 2659178 - DNA, 14 bp, Homo sapiens
gcctcctcaccccc

SEQ ID NO: 2659179 - DNA, 18 bp, Homo sapiens
gcctcctcacccccagct

SEQ ID NO: 2659180 - DNA, 15 bp, Homo sapiens
gcctcctcatcccgt

SEQ ID NO: 2659181 - DNA, 22 bp, Homo sapiens
gcctcctcatcccgtgttctcc

SEQ ID NO: 2659182 - DNA, 17 bp, Homo sapiens
gcctcctcccttagctc

SEQ ID NO: 2659183 - DNA, 23 bp, Homo sapiens
gcctcctctctcagtttttatat

SEQ ID NO: 2659184 - DNA, 16 bp, Homo sapiens
gcctcctctgtccagg

SEQ ID NO: 2659185 - DNA, 14 bp, Homo sapiens
gcctcctgcctgcc

SEQ ID NO: 2659186 - DNA, 13 bp, Homo sapiens
gcctcctgtgtgt

SEQ ID NO: 2659187 - DNA, 19 bp, Homo sapiens
gcctcctgtgtgtgcgcct

SEQ ID NO: 2659188 - DNA, 16 bp, Homo sapiens
gcctccttccacctcc

SEQ ID NO: 2659189 - DNA, 18 bp, Homo sapiens
gcctccttccacctccct

SEQ ID NO: 2659190 - DNA, 20 bp, Homo sapiens
gcctccttccttgctgtcct

SEQ ID NO: 2659191 - DNA, 21 bp, Homo sapiens
gcctcctttgtgaggaagccg

SEQ ID NO: 2659192 - DNA, 15 bp, Homo sapiens
gcctcggagcctcat

SEQ ID NO: 2659193 - DNA, 23 bp, Homo sapiens
gcctcggagcctcatccgaggca

SEQ ID NO: 2659194 - DNA, 17 bp, Homo sapiens
gcctctaaccccaggcc

SEQ ID NO: 2659195 - DNA, 13 bp, Homo sapiens
gcctctagggacc

SEQ ID NO: 2659196 - DNA, 18 bp, Homo sapiens
gcctctagggacccctcc

SEQ ID NO: 2659197 - DNA, 20 bp, Homo sapiens
gcctctagggacccctcctc

SEQ ID NO: 2659198 - DNA, 18 bp, Homo sapiens
gcctctcatcaactgaat

SEQ ID NO: 2659199 - DNA, 19 bp, Homo sapiens
gcctctcatcaactgaatg

SEQ ID NO: 2659200 - DNA, 13 bp, Homo sapiens
gcctctcccctga

SEQ ID NO: 2659201 - DNA, 13 bp, Homo sapiens
gcctctcccgtca

SEQ ID NO: 2659202 - DNA, 17 bp, Homo sapiens
gcctctcccgtcagggc

SEQ ID NO: 2659203 - DNA, 14 bp, Homo sapiens
gcctctctggcctc

SEQ ID NO: 2659204 - DNA, 17 bp, Homo sapiens
gcctctctggcctccca

SEQ ID NO: 2659205 - DNA, 18 bp, Homo sapiens
gcctctctggcctcccac

SEQ ID NO: 2659206 - DNA, 20 bp, Homo sapiens
gcctctctggcctcccaccc

SEQ ID NO: 2659207 - DNA, 18 bp, Homo sapiens
gcctctgacacacagctc

SEQ ID NO: 2659208 - DNA, 15 bp, Homo sapiens
gcctctgcactcccc

SEQ ID NO: 2659209 - DNA, 16 bp, Homo sapiens
gcctctgcactcccct

SEQ ID NO: 2659210 - DNA, 17 bp, Homo sapiens
gcctctgcactcccctg

SEQ ID NO: 2659211 - DNA, 12 bp, Homo sapiens
gcctctgcattc

SEQ ID NO: 2659212 - DNA, 12 bp, Homo sapiens
gcctctgcctct

SEQ ID NO: 2659213 - DNA, 18 bp, Homo sapiens
gcctctgcctctgacaca

SEQ ID NO: 2659214 - DNA, 13 bp, Homo sapiens
gcctctgcctgtc

SEQ ID NO: 2659215 - DNA, 18 bp, Homo sapiens
gcctctggctagaggcca

SEQ ID NO: 2659216 - DNA, 14 bp, Homo sapiens
gcctctgggactgg

SEQ ID NO: 2659217 - DNA, 17 bp, Homo sapiens
gcctctggtctgggtgc

SEQ ID NO: 2659218 - DNA, 14 bp, Homo sapiens
gcctctgtgtcctt

SEQ ID NO: 2659219 - DNA, 22 bp, Homo sapiens
gcctcttaaagctgcctgtagt

SEQ ID NO: 2659220 - DNA, 12 bp, Homo sapiens
gcctcttctcta

SEQ ID NO: 2659221 - DNA, 15 bp, Homo sapiens
gcctcttctgggagg

SEQ ID NO: 2659222 - DNA, 18 bp, Homo sapiens
gcctcttctgggagggca

SEQ ID NO: 2659223 - DNA, 21 bp, Homo sapiens
gcctcttcttcttcagaagac

SEQ ID NO: 2659224 - DNA, 17 bp, Homo sapiens
gcctcttggacctctgc

SEQ ID NO: 2659225 - DNA, 21 bp, Homo sapiens
gcctcttggacctctgctctg

SEQ ID NO: 2659226 - DNA, 14 bp, Homo sapiens
gcctcttgggttca

SEQ ID NO: 2659227 - DNA, 19 bp, Homo sapiens
gcctctttgtctaaaacaa

SEQ ID NO: 2659228 - DNA, 18 bp, Homo sapiens
gcctcttttctctgtgct

SEQ ID NO: 2659229 - DNA, 15 bp, Homo sapiens
gcctgaaccttccat

SEQ ID NO: 2659230 - DNA, 20 bp, Homo sapiens
gcctgaagagtcctctgaat

SEQ ID NO: 2659231 - DNA, 15 bp, Homo sapiens
gcctgaagtcacaca

SEQ ID NO: 2659232 - DNA, 22 bp, Homo sapiens
gcctgacatttggagtgttccc

SEQ ID NO: 2659233 - DNA, 13 bp, Homo sapiens
gcctgagatggtc

SEQ ID NO: 2659234 - DNA, 13 bp, Homo sapiens
gcctgaggctgag

SEQ ID NO: 2659235 - DNA, 13 bp, Homo sapiens
gcctgaggctggg

SEQ ID NO: 2659236 - DNA, 20 bp, Homo sapiens
gcctgagggcccctctgccc

SEQ ID NO: 2659237 - DNA, 21 bp, Homo sapiens
gcctgagggcccctctgccca

SEQ ID NO: 2659238 - DNA, 16 bp, Homo sapiens
gcctgagtctcctgtg

SEQ ID NO: 2659239 - DNA, 15 bp, Homo sapiens
gcctgagtgcctggc

SEQ ID NO: 2659240 - DNA, 21 bp, Homo sapiens
gcctgatccagcctctcccct

SEQ ID NO: 2659241 - DNA, 12 bp, Homo sapiens
gcctgatgacag

SEQ ID NO: 2659242 - DNA, 14 bp, Homo sapiens
gcctgatggacctg

SEQ ID NO: 2659243 - DNA, 19 bp, Homo sapiens
gcctgattgccaagctcag

SEQ ID NO: 2659244 - DNA, 20 bp, Homo sapiens
gcctgattgccaagctcagg

SEQ ID NO: 2659245 - DNA, 21 bp, Homo sapiens
gcctgcaaactcactgctcaa

SEQ ID NO: 2659246 - DNA, 11 bp, Homo sapiens
gcctgcagaga

SEQ ID NO: 2659247 - DNA, 18 bp, Homo sapiens
gcctgcagagagaagcct

SEQ ID NO: 2659248 - DNA, 22 bp, Homo sapiens
gcctgcagggtggtgctgggac

SEQ ID NO: 2659249 - DNA, 23 bp, Homo sapiens
gcctgcagggtggtgctgggact

SEQ ID NO: 2659250 - DNA, 16 bp, Homo sapiens
gcctgcaggtgctgct

SEQ ID NO: 2659251 - DNA, 19 bp, Homo sapiens
gcctgcaggtgctgctgcg

SEQ ID NO: 2659252 - DNA, 13 bp, Homo sapiens
gcctgcattctgc

SEQ ID NO: 2659253 - DNA, 14 bp, Homo sapiens
gcctgccagtccta

SEQ ID NO: 2659254 - DNA, 16 bp, Homo sapiens
gcctgccagtcctagc

SEQ ID NO: 2659255 - DNA, 18 bp, Homo sapiens
gcctgccagtcctagctg

SEQ ID NO: 2659256 - DNA, 11 bp, Homo sapiens
gcctgcccagg

SEQ ID NO: 2659257 - DNA, 17 bp, Homo sapiens
gcctgcccaggcccctg

SEQ ID NO: 2659258 - DNA, 17 bp, Homo sapiens
gcctgccccaaacaaat

SEQ ID NO: 2659259 - DNA, 16 bp, Homo sapiens
gcctgcccccctcatc

SEQ ID NO: 2659260 - DNA, 15 bp, Homo sapiens
gcctgcccctcccag

SEQ ID NO: 2659261 - DNA, 18 bp, Homo sapiens
gcctgcccctcccagaac

SEQ ID NO: 2659262 - DNA, 14 bp, Homo sapiens
gcctgccctcaggg

SEQ ID NO: 2659263 - DNA, 22 bp, Homo sapiens
gcctgccctcatggcccctctg

SEQ ID NO: 2659264 - DNA, 21 bp, Homo sapiens
gcctgccctccccagagcact

SEQ ID NO: 2659265 - DNA, 16 bp, Homo sapiens
gcctgcctggcaggct

SEQ ID NO: 2659266 - DNA, 16 bp, Homo sapiens
gctcgagcatgcctgg

SEQ ID NO: 2659267 - DNA, 15 bp, Homo sapiens
gctcggaggctgccc

SEQ ID NO: 2659268 - DNA, 14 bp, Homo sapiens
gctcggtggaccca

SEQ ID NO: 2659269 - DNA, 17 bp, Homo sapiens
gctcggtggacccaggg

SEQ ID NO: 2659270 - DNA, 18 bp, Homo sapiens
gctcggtggacccaggga

SEQ ID NO: 2659271 - DNA, 16 bp, Homo sapiens
gctcgtgtatcctggg

SEQ ID NO: 2659272 - DNA, 17 bp, Homo sapiens
gctctacatcttctgcc

SEQ ID NO: 2659273 - DNA, 19 bp, Homo sapiens
gctctactgaggtgctatg

SEQ ID NO: 2659274 - DNA, 16 bp, Homo sapiens
gctctagacaaccctg

SEQ ID NO: 2659275 - DNA, 14 bp, Homo sapiens
gctctagcctgggc

SEQ ID NO: 2659276 - DNA, 21 bp, Homo sapiens
gctctagcctgggcaacaaca

SEQ ID NO: 2659277 - DNA, 19 bp, Homo sapiens
gctctatcttgctctgtaa

SEQ ID NO: 2659278 - DNA, 18 bp, Homo sapiens
gctctcaagttatcaggg

SEQ ID NO: 2659279 - DNA, 22 bp, Homo sapiens
gctctccaagtctcagtggctt

SEQ ID NO: 2659280 - DNA, 17 bp, Homo sapiens
gctctccaagtgccaga

SEQ ID NO: 2659281 - DNA, 18 bp, Homo sapiens
gctctccaagtgccagag

SEQ ID NO: 2659282 - DNA, 19 bp, Homo sapiens
gctctccaagtgccagagg

SEQ ID NO: 2659283 - DNA, 13 bp, Homo sapiens
gctctccagctcc

SEQ ID NO: 2659284 - DNA, 15 bp, Homo sapiens
gctctccagctccaa

SEQ ID NO: 2659285 - DNA, 17 bp, Homo sapiens
gctctcccatttcctga

SEQ ID NO: 2659286 - DNA, 14 bp, Homo sapiens
gctctccctcttct

SEQ ID NO: 2659287 - DNA, 16 bp, Homo sapiens
gctctccctcttctca

SEQ ID NO: 2659288 - DNA, 19 bp, Homo sapiens
gctctccgaccagacacct

SEQ ID NO: 2659289 - DNA, 19 bp, Homo sapiens
gctctcctcagaagaaaga

SEQ ID NO: 2659290 - DNA, 15 bp, Homo sapiens
gctctcctcttgcca

SEQ ID NO: 2659291 - DNA, 22 bp, Homo sapiens
gctctcctcttgccactgcctc

SEQ ID NO: 2659292 - DNA, 16 bp, Homo sapiens
gctctcctttctttct

SEQ ID NO: 2659293 - DNA, 19 bp, Homo sapiens
gctctctgtgggctggcag

SEQ ID NO: 2659294 - DNA, 16 bp, Homo sapiens
gctctgacagaaagca

SEQ ID NO: 2659295 - DNA, 20 bp, Homo sapiens
gctctgacagaaagcagata

SEQ ID NO: 2659296 - DNA, 16 bp, Homo sapiens
gctctgaggcttccag

SEQ ID NO: 2659297 - DNA, 20 bp, Homo sapiens
gctctgaggcttccagagag

SEQ ID NO: 2659298 - DNA, 21 bp, Homo sapiens
gctctgaggcttccagagagt

SEQ ID NO: 2659299 - DNA, 21 bp, Homo sapiens
gctctgatcatccactgtgcc

SEQ ID NO: 2659300 - DNA, 23 bp, Homo sapiens
gctctgcaattcccctctgctgc

SEQ ID NO: 2659301 - DNA, 12 bp, Homo sapiens
gctctgcacaga

SEQ ID NO: 2659302 - DNA, 18 bp, Homo sapiens
gctctgcacagatggatt

SEQ ID NO: 2659303 - DNA, 18 bp, Homo sapiens
gctctgcagcccagggac

SEQ ID NO: 2659304 - DNA, 14 bp, Homo sapiens
gctctgcaggcacc

SEQ ID NO: 2659305 - DNA, 18 bp, Homo sapiens
gctctgcaggcaccttag

SEQ ID NO: 2659306 - DNA, 22 bp, Homo sapiens
gctctgccaacttcttcagagc

SEQ ID NO: 2659307 - DNA, 23 bp, Homo sapiens
gctctgccaccctacctgttcag

SEQ ID NO: 2659308 - DNA, 21 bp, Homo sapiens
gctctgcccatcctgcccctg

SEQ ID NO: 2659309 - DNA, 21 bp, Homo sapiens
gctctgccccagaggcctctc

SEQ ID NO: 2659310 - DNA, 13 bp, Homo sapiens
gctctgcctccca

SEQ ID NO: 2659311 - DNA, 22 bp, Homo sapiens
gctctgcgtgtcacctgtgctt

SEQ ID NO: 2659312 - DNA, 13 bp, Homo sapiens
gctctgctcctct

SEQ ID NO: 2659313 - DNA, 15 bp, Homo sapiens
gctctgctggcctgg

SEQ ID NO: 2659314 - DNA, 17 bp, Homo sapiens
gctctgctggcctggcc

SEQ ID NO: 2659315 - DNA, 21 bp, Homo sapiens
gctctggaaaatgtgacccag

SEQ ID NO: 2659316 - DNA, 16 bp, Homo sapiens
gctctggaccagcctg

SEQ ID NO: 2659317 - DNA, 21 bp, Homo sapiens
gctctggctgaaccctgtgct

SEQ ID NO: 2659318 - DNA, 22 bp, Homo sapiens
gctctggctgaaccctgtgctg

SEQ ID NO: 2659319 - DNA, 15 bp, Homo sapiens
gctctgggagaggat

SEQ ID NO: 2659320 - DNA, 21 bp, Homo sapiens
gctctgggatagctgacccag

SEQ ID NO: 2659321 - DNA, 18 bp, Homo sapiens
gctctggtgacaccagcc

SEQ ID NO: 2659322 - DNA, 19 bp, Homo sapiens
gctctgtatcaggacccag

SEQ ID NO: 2659323 - DNA, 14 bp, Homo sapiens
gctctgtgctgacc

SEQ ID NO: 2659324 - DNA, 16 bp, Homo sapiens
gctctgtgctgaccct

SEQ ID NO: 2659325 - DNA, 19 bp, Homo sapiens
gctctgtgctgaccctcct

SEQ ID NO: 2659326 - DNA, 15 bp, Homo sapiens
gctcttcaggcctcc

SEQ ID NO: 2659327 - DNA, 15 bp, Homo sapiens
gctcttccaggctgg

SEQ ID NO: 2659328 - DNA, 16 bp, Homo sapiens
gctcttccaggctggg

SEQ ID NO: 2659329 - DNA, 18 bp, Homo sapiens
gctcttccaggctgggag

SEQ ID NO: 2659330 - DNA, 22 bp, Homo sapiens
gctcttccaggctgggagagcc

SEQ ID NO: 2659331 - DNA, 12 bp, Homo sapiens
gctcttctccag

SEQ ID NO: 2659332 - DNA, 23 bp, Homo sapiens
gctcttctgcccaattggaggaa

SEQ ID NO: 2659333 - DNA, 22 bp, Homo sapiens
gctcttgatacccccctctgtc

SEQ ID NO: 2659334 - DNA, 23 bp, Homo sapiens
gctcttgatacccccctctgtct

SEQ ID NO: 2659335 - DNA, 17 bp, Homo sapiens
gctcttgcccttccctg

SEQ ID NO: 2659336 - DNA, 13 bp, Homo sapiens
gctcttgctaatc

SEQ ID NO: 2659337 - DNA, 21 bp, Homo sapiens
gctctttatgaatgaaaaaac

SEQ ID NO: 2659338 - DNA, 17 bp, Homo sapiens
gctctttctactctgaa

SEQ ID NO: 2659339 - DNA, 13 bp, Homo sapiens
gctctttctgggc

SEQ ID NO: 2659340 - DNA, 21 bp, Homo sapiens
gctctttgaaatagtctgtgt

SEQ ID NO: 2659341 - DNA, 23 bp, Homo sapiens
gctctttgaaatagtctgtgtga

SEQ ID NO: 2659342 - DNA, 13 bp, Homo sapiens
gctctttggtaga

SEQ ID NO: 2659343 - DNA, 23 bp, Homo sapiens
gctgaaagaacatggacttgtat

SEQ ID NO: 2659344 - DNA, 13 bp, Homo sapiens
gctgaaagccatt

SEQ ID NO: 2659345 - DNA, 20 bp, Homo sapiens
gctgaaatactgaggggtct

SEQ ID NO: 2659346 - DNA, 15 bp, Homo sapiens
gctgaaattttatat

SEQ ID NO: 2659347 - DNA, 17 bp, Homo sapiens
gctgaaattttatatgc

SEQ ID NO: 2659348 - DNA, 15 bp, Homo sapiens
gctgaacattgcata

SEQ ID NO: 2659349 - DNA, 17 bp, Homo sapiens
gctgaaccctgtgctgg

SEQ ID NO: 2659350 - DNA, 18 bp, Homo sapiens
gctgaagatggcatcctg

SEQ ID NO: 2659351 - DNA, 17 bp, Homo sapiens
gctgaagctgcctgctt

SEQ ID NO: 2659352 - DNA, 19 bp, Homo sapiens
gctgaaggaaaccagtgca

SEQ ID NO: 2659353 - DNA, 21 bp, Homo sapiens
gctgaaggactgtgacaggca

SEQ ID NO: 2659354 - DNA, 23 bp, Homo sapiens
gctgaaggactgtgacaggcagc

SEQ ID NO: 2659355 - DNA, 12 bp, Homo sapiens
gctgaaggctcg

SEQ ID NO: 2659356 - DNA, 14 bp, Homo sapiens
gctgaataaatgtc

SEQ ID NO: 2659357 - DNA, 16 bp, Homo sapiens
gctgaataaatgtctt

SEQ ID NO: 2659358 - DNA, 17 bp, Homo sapiens
gctgaataaatgtcttt

SEQ ID NO: 2659359 - DNA, 18 bp, Homo sapiens
gctgaataaatgtctttt

SEQ ID NO: 2659360 - DNA, 19 bp, Homo sapiens
gctgacaaccaccgctccc

SEQ ID NO: 2659361 - DNA, 23 bp, Homo sapiens
gctgacaaccaccgctccccagc

SEQ ID NO: 2659362 - DNA, 20 bp, Homo sapiens
gctgacacaaacctgcctgg

SEQ ID NO: 2659363 - DNA, 21 bp, Homo sapiens
gctgacacaaacctgcctggg

SEQ ID NO: 2659364 - DNA, 15 bp, Homo sapiens
gctgacagacacagg

SEQ ID NO: 2659365 - DNA, 17 bp, Homo sapiens
gctgacagacacaggcc

SEQ ID NO: 2659366 - DNA, 20 bp, Homo sapiens
gctgacagacacaggcccgg

SEQ ID NO: 2659367 - DNA, 21 bp, Homo sapiens
gctgacattgtggcacattct

SEQ ID NO: 2659368 - DNA, 15 bp, Homo sapiens
gctgaccaagagaga

SEQ ID NO: 2659369 - DNA, 16 bp, Homo sapiens
gctgaccaagagagaa

SEQ ID NO: 2659370 - DNA, 13 bp, Homo sapiens
gctgacccagcct

SEQ ID NO: 2659371 - DNA, 22 bp, Homo sapiens
gctgaccctcctgttgcaccca

SEQ ID NO: 2659372 - DNA, 15 bp, Homo sapiens
gctgacctccacagc

SEQ ID NO: 2659373 - DNA, 17 bp, Homo sapiens
gctgacctccacagctt

SEQ ID NO: 2659374 - DNA, 14 bp, Homo sapiens
gctgacctctgttg

SEQ ID NO: 2659375 - DNA, 22 bp, Homo sapiens
gctgacctctgttgtcctcccc

SEQ ID NO: 2659376 - DNA, 23 bp, Homo sapiens
gctgaccttcctcgcagagaggc

SEQ ID NO: 2659377 - DNA, 17 bp, Homo sapiens
gctgacgaacttccatg

SEQ ID NO: 2659378 - DNA, 15 bp, Homo sapiens
gctgactagaagggc

SEQ ID NO: 2659379 - DNA, 14 bp, Homo sapiens
gctgagactgcggg

SEQ ID NO: 2659380 - DNA, 14 bp, Homo sapiens
gctgagagactttt

SEQ ID NO: 2659381 - DNA, 16 bp, Homo sapiens
gctgagaggagagaga

SEQ ID NO: 2659382 - DNA, 13 bp, Homo sapiens
gctgagaggggct

SEQ ID NO: 2659383 - DNA, 20 bp, Homo sapiens
gctgagcccctaccccacac

SEQ ID NO: 2659384 - DNA, 15 bp, Homo sapiens
gctgagccctggcag

SEQ ID NO: 2659385 - DNA, 14 bp, Homo sapiens
gctgagctctctgt

SEQ ID NO: 2659386 - DNA, 15 bp, Homo sapiens
gctgaggaaaggcca

SEQ ID NO: 2659387 - DNA, 17 bp, Homo sapiens
gctgaggaaaggccagc

SEQ ID NO: 2659388 - DNA, 21 bp, Homo sapiens
gctgaggaaaggccagctggc

SEQ ID NO: 2659389 - DNA, 22 bp, Homo sapiens
gctgaggaaaggccagctggca

SEQ ID NO: 2659390 - DNA, 16 bp, Homo sapiens
gctgaggagtgaggaa

SEQ ID NO: 2659391 - DNA, 18 bp, Homo sapiens
gctgaggagtgaggaata

SEQ ID NO: 2659392 - DNA, 14 bp, Homo sapiens
gctgaggcctctca

SEQ ID NO: 2659393 - DNA, 15 bp, Homo sapiens
gctgaggcgggagaa

SEQ ID NO: 2659394 - DNA, 23 bp, Homo sapiens
gctgaggggggccgtgcccaggg

SEQ ID NO: 2659395 - DNA, 18 bp, Homo sapiens
gctgagggtgagtgggtg

SEQ ID NO: 2659396 - DNA, 15 bp, Homo sapiens
gctgaggtgggagga

SEQ ID NO: 2659397 - DNA, 15 bp, Homo sapiens
gctgagtctgaaggc

SEQ ID NO: 2659398 - DNA, 18 bp, Homo sapiens
gctgagtctgaaggctgg

SEQ ID NO: 2659399 - DNA, 13 bp, Homo sapiens
gctgagttggtgt

SEQ ID NO: 2659400 - DNA, 17 bp, Homo sapiens
gctgatatatgtgtttt

SEQ ID NO: 2659401 - DNA, 16 bp, Homo sapiens
gctgatcgtgctaaat

SEQ ID NO: 2659402 - DNA, 14 bp, Homo sapiens
gctgatgttcagtg

SEQ ID NO: 2659403 - DNA, 21 bp, Homo sapiens
gctgatgttcagtgtaatttc

SEQ ID NO: 2659404 - DNA, 13 bp, Homo sapiens
gctgattctcagg

SEQ ID NO: 2659405 - DNA, 20 bp, Homo sapiens
gctgattctcagggtctctg

SEQ ID NO: 2659406 - DNA, 20 bp, Homo sapiens
gctgattttaacaataacta

SEQ ID NO: 2659407 - DNA, 22 bp, Homo sapiens
gctgcaaagggtatcaggtgct

SEQ ID NO: 2659408 - DNA, 23 bp, Homo sapiens
gctgcaaagggtatcaggtgctg

SEQ ID NO: 2659409 - DNA, 14 bp, Homo sapiens
gctgcaaggccttt

SEQ ID NO: 2659410 - DNA, 16 bp, Homo sapiens
gcttctggtactctcc

SEQ ID NO: 2659411 - DNA, 15 bp, Homo sapiens
gcttcttaaagagtt

SEQ ID NO: 2659412 - DNA, 14 bp, Homo sapiens
gcttcttaaatgag

SEQ ID NO: 2659413 - DNA, 22 bp, Homo sapiens
gcttcttaatcttttcacaaat

SEQ ID NO: 2659414 - DNA, 12 bp, Homo sapiens
gcttcttcagag

SEQ ID NO: 2659415 - DNA, 21 bp, Homo sapiens
gcttcttcagagactcctgca

SEQ ID NO: 2659416 - DNA, 21 bp, Homo sapiens
gcttgaagatcgttagtatct

SEQ ID NO: 2659417 - DNA, 15 bp, Homo sapiens
gcttgacttttgtat

SEQ ID NO: 2659418 - DNA, 12 bp, Homo sapiens
gcttgagcccag

SEQ ID NO: 2659419 - DNA, 16 bp, Homo sapiens
gcttgagcccaggagt

SEQ ID NO: 2659420 - DNA, 16 bp, Homo sapiens
gcttgagggttgggct

SEQ ID NO: 2659421 - DNA, 19 bp, Homo sapiens
gcttgcactttgtaacatg

SEQ ID NO: 2659422 - DNA, 21 bp, Homo sapiens
gcttgcagtagattttcttta

SEQ ID NO: 2659423 - DNA, 14 bp, Homo sapiens
gcttgccacagagc

SEQ ID NO: 2659424 - DNA, 15 bp, Homo sapiens
gcttgccacagctct

SEQ ID NO: 2659425 - DNA, 12 bp, Homo sapiens
gcttgccccggc

SEQ ID NO: 2659426 - DNA, 17 bp, Homo sapiens
gcttgccctggtgcctc

SEQ ID NO: 2659427 - DNA, 18 bp, Homo sapiens
gcttgccctgttaaaaga

SEQ ID NO: 2659428 - DNA, 22 bp, Homo sapiens
gcttgcctagggcctggtccat

SEQ ID NO: 2659429 - DNA, 23 bp, Homo sapiens
gcttggaagagcctgcaggtgct

SEQ ID NO: 2659430 - DNA, 16 bp, Homo sapiens
gcttggacggctgggc

SEQ ID NO: 2659431 - DNA, 18 bp, Homo sapiens
gcttggagcagaggggct

SEQ ID NO: 2659432 - DNA, 13 bp, Homo sapiens
gcttggcagccga

SEQ ID NO: 2659433 - DNA, 13 bp, Homo sapiens
gcttgggtggaga

SEQ ID NO: 2659434 - DNA, 16 bp, Homo sapiens
gcttgggtggagaagc

SEQ ID NO: 2659435 - DNA, 17 bp, Homo sapiens
gcttgggtggagaagcc

SEQ ID NO: 2659436 - DNA, 19 bp, Homo sapiens
gcttgggtggagaagccat

SEQ ID NO: 2659437 - DNA, 20 bp, Homo sapiens
gcttgggtggagaagccatt

SEQ ID NO: 2659438 - DNA, 16 bp, Homo sapiens
gcttgtacataatgcg

SEQ ID NO: 2659439 - DNA, 19 bp, Homo sapiens
gcttgtacataatgcgtgc

SEQ ID NO: 2659440 - DNA, 18 bp, Homo sapiens
gcttgtcattaccagacg

SEQ ID NO: 2659441 - DNA, 21 bp, Homo sapiens
gcttgtccaacccgaggcccg

SEQ ID NO: 2659442 - DNA, 16 bp, Homo sapiens
gcttgtcccctcctca

SEQ ID NO: 2659443 - DNA, 22 bp, Homo sapiens
gcttgtcccctcctcactccct

SEQ ID NO: 2659444 - DNA, 19 bp, Homo sapiens
gcttgtgtatccattatca

SEQ ID NO: 2659445 - DNA, 20 bp, Homo sapiens
gcttgtgtatccattatcat

SEQ ID NO: 2659446 - DNA, 22 bp, Homo sapiens
gcttgtgtatccattatcatgt

SEQ ID NO: 2659447 - DNA, 21 bp, Homo sapiens
gcttgtgtgtttcacttttag

SEQ ID NO: 2659448 - DNA, 18 bp, Homo sapiens
gcttgttgggattcctga

SEQ ID NO: 2659449 - DNA, 13 bp, Homo sapiens
gcttgtttacagc

SEQ ID NO: 2659450 - DNA, 20 bp, Homo sapiens
gcttgtttacagcactactc

SEQ ID NO: 2659451 - DNA, 23 bp, Homo sapiens
gcttgttttcttgccaatgaggt

SEQ ID NO: 2659452 - DNA, 12 bp, Homo sapiens
gctttacatgca

SEQ ID NO: 2659453 - DNA, 22 bp, Homo sapiens
gctttattcttcagatacaaac

SEQ ID NO: 2659454 - DNA, 21 bp, Homo sapiens
gctttattttttaagtattta

SEQ ID NO: 2659455 - DNA, 23 bp, Homo sapiens
gctttattttttaagtatttata

SEQ ID NO: 2659456 - DNA, 21 bp, Homo sapiens
gctttcaattccgtagccagc

SEQ ID NO: 2659457 - DNA, 15 bp, Homo sapiens
gctttcagcctctgg

SEQ ID NO: 2659458 - DNA, 12 bp, Homo sapiens
gctttcatgatt

SEQ ID NO: 2659459 - DNA, 12 bp, Homo sapiens
gctttcatgtaa

SEQ ID NO: 2659460 - DNA, 21 bp, Homo sapiens
gctttcatgtaaactgtgcac

SEQ ID NO: 2659461 - DNA, 14 bp, Homo sapiens
gctttccagctcac

SEQ ID NO: 2659462 - DNA, 12 bp, Homo sapiens
gctttcccctgt

SEQ ID NO: 2659463 - DNA, 15 bp, Homo sapiens
gctttcccctgtggg

SEQ ID NO: 2659464 - DNA, 17 bp, Homo sapiens
gctttcccctgtgggga

SEQ ID NO: 2659465 - DNA, 15 bp, Homo sapiens
gctttccctgcctct

SEQ ID NO: 2659466 - DNA, 17 bp, Homo sapiens
gctttccttttttaaaa

SEQ ID NO: 2659467 - DNA, 16 bp, Homo sapiens
gctttcgaactgctag

SEQ ID NO: 2659468 - DNA, 19 bp, Homo sapiens
gctttctacccagcgagcc

SEQ ID NO: 2659469 - DNA, 22 bp, Homo sapiens
gctttctggaaaagaggagttt

SEQ ID NO: 2659470 - DNA, 13 bp, Homo sapiens
gctttctggagag

SEQ ID NO: 2659471 - DNA, 22 bp, Homo sapiens
gctttctgttgtcattgctgtt

SEQ ID NO: 2659472 - DNA, 17 bp, Homo sapiens
gctttcttgctggttgt

SEQ ID NO: 2659473 - DNA, 20 bp, Homo sapiens
gctttgcatgttccactaac

SEQ ID NO: 2659474 - DNA, 22 bp, Homo sapiens
gctttgcattcctacaaagatg

SEQ ID NO: 2659475 - DNA, 21 bp, Homo sapiens
gctttgcattttaaaaatgaa

SEQ ID NO: 2659476 - DNA, 14 bp, Homo sapiens
gctttgccagctgc

SEQ ID NO: 2659477 - DNA, 15 bp, Homo sapiens
gctttgccagctgct

SEQ ID NO: 2659478 - DNA, 18 bp, Homo sapiens
gctttgccttccacgctg

SEQ ID NO: 2659479 - DNA, 17 bp, Homo sapiens
gctttggacctaatcca

SEQ ID NO: 2659480 - DNA, 22 bp, Homo sapiens
gctttgggaatgtttttagctg

SEQ ID NO: 2659481 - DNA, 22 bp, Homo sapiens
gcttttcctcaaagggagagag

SEQ ID NO: 2659482 - DNA, 12 bp, Homo sapiens
gcttttgtgcat

SEQ ID NO: 2659483 - DNA, 20 bp, Homo sapiens
gctttttaattgttgtttct

SEQ ID NO: 2659484 - DNA, 13 bp, Homo sapiens
gctttttccagag

SEQ ID NO: 2659485 - DNA, 20 bp, Homo sapiens
gctttttgaggtggcacttt

SEQ ID NO: 2659486 - DNA, 16 bp, Homo sapiens
gctttttgtcttttct

SEQ ID NO: 2659487 - DNA, 15 bp, Homo sapiens
gctttttttttctct

SEQ ID NO: 2659488 - DNA, 24 bp, Homo sapiens
gctttttttttctctttctctcct

SEQ ID NO: 2659489 - DNA, 14 bp, Homo sapiens
ggaaaaaaatgact

SEQ ID NO: 2659490 - DNA, 19 bp, Homo sapiens
ggaaaaaccacccccaaat

SEQ ID NO: 2659491 - DNA, 13 bp, Homo sapiens
ggaaaaatagcct

SEQ ID NO: 2659492 - DNA, 15 bp, Homo sapiens
ggaaaaatagcctgc

SEQ ID NO: 2659493 - DNA, 15 bp, Homo sapiens
ggaaaaatccagaaa

SEQ ID NO: 2659494 - DNA, 17 bp, Homo sapiens
ggaaaaatgagagaagg

SEQ ID NO: 2659495 - DNA, 15 bp, Homo sapiens
ggaaaacattccatc

SEQ ID NO: 2659496 - DNA, 22 bp, Homo sapiens
ggaaaagagcgcatcaggcctg

SEQ ID NO: 2659497 - DNA, 21 bp, Homo sapiens
ggaaaagaggagtttcgaggt

SEQ ID NO: 2659498 - DNA, 21 bp, Homo sapiens
ggaaaagggtcttgggaaata

SEQ ID NO: 2659499 - DNA, 15 bp, Homo sapiens
ggaaaagtacattta

SEQ ID NO: 2659500 - DNA, 15 bp, Homo sapiens
ggaaaatcagcctgc

SEQ ID NO: 2659501 - DNA, 14 bp, Homo sapiens
ggaaaatgcattgt

SEQ ID NO: 2659502 - DNA, 14 bp, Homo sapiens
ggaaacaaagctta

SEQ ID NO: 2659503 - DNA, 22 bp, Homo sapiens
ggaaacaaagcttagcaggaga

SEQ ID NO: 2659504 - DNA, 13 bp, Homo sapiens
ggaaacagaggct

SEQ ID NO: 2659505 - DNA, 15 bp, Homo sapiens
ggaaaccacagctgc

SEQ ID NO: 2659506 - DNA, 16 bp, Homo sapiens
ggaaaccacagctgct

SEQ ID NO: 2659507 - DNA, 18 bp, Homo sapiens
ggaaaccacagctgctgg

SEQ ID NO: 2659508 - DNA, 21 bp, Homo sapiens
ggaaaccacagctgctggaga

SEQ ID NO: 2659509 - DNA, 17 bp, Homo sapiens
ggaaacctgccctgcct

SEQ ID NO: 2659510 - DNA, 22 bp, Homo sapiens
ggaaacctgccctgcctgaggg

SEQ ID NO: 2659511 - DNA, 17 bp, Homo sapiens
ggaaactcttatctcag

SEQ ID NO: 2659512 - DNA, 12 bp, Homo sapiens
ggaaactgaatg

SEQ ID NO: 2659513 - DNA, 13 bp, Homo sapiens
ggaaactgccagc

SEQ ID NO: 2659514 - DNA, 17 bp, Homo sapiens
ggaaactggatgaggtc

SEQ ID NO: 2659515 - DNA, 15 bp, Homo sapiens
ggaaagaaagttgca

SEQ ID NO: 2659516 - DNA, 17 bp, Homo sapiens
ggaaagagtaggaagac

SEQ ID NO: 2659517 - DNA, 14 bp, Homo sapiens
ggaaagcagctcaa

SEQ ID NO: 2659518 - DNA, 15 bp, Homo sapiens
ggaaagcagctcaaa

SEQ ID NO: 2659519 - DNA, 19 bp, Homo sapiens
ggaaagcagctcaaaggca

SEQ ID NO: 2659520 - DNA, 22 bp, Homo sapiens
ggaaagcagctcaaaggcacag

SEQ ID NO: 2659521 - DNA, 18 bp, Homo sapiens
ggaaagccagtgactcca

SEQ ID NO: 2659522 - DNA, 19 bp, Homo sapiens
ggaaagccagtgactccag

SEQ ID NO: 2659523 - DNA, 23 bp, Homo sapiens
ggaaagctcagctactgattttt

SEQ ID NO: 2659524 - DNA, 16 bp, Homo sapiens
ggaaaggatattttct

SEQ ID NO: 2659525 - DNA, 18 bp, Homo sapiens
ggaaaggccagctggcag

SEQ ID NO: 2659526 - DNA, 22 bp, Homo sapiens
ggaaaggccagctggcagcaga

SEQ ID NO: 2659527 - DNA, 19 bp, Homo sapiens
ggaaaggctcagtctcagg

SEQ ID NO: 2659528 - DNA, 13 bp, Homo sapiens
ggaaaggctccag

SEQ ID NO: 2659529 - DNA, 21 bp, Homo sapiens
ggaaaggggcaggccagagct

SEQ ID NO: 2659530 - DNA, 20 bp, Homo sapiens
ggaaagggtgctgcttccct

SEQ ID NO: 2659531 - DNA, 13 bp, Homo sapiens
ggaaagtgaattt

SEQ ID NO: 2659532 - DNA, 18 bp, Homo sapiens
ggaaagtgaatttgaatg

SEQ ID NO: 2659533 - DNA, 19 bp, Homo sapiens
ggaaagtgaatttgaatga

SEQ ID NO: 2659534 - DNA, 13 bp, Homo sapiens
ggaaagtgtaaag

SEQ ID NO: 2659535 - DNA, 17 bp, Homo sapiens
ggaaagtgtaaagcatt

SEQ ID NO: 2659536 - DNA, 18 bp, Homo sapiens
ggaaagtgtaaagcattc

SEQ ID NO: 2659537 - DNA, 19 bp, Homo sapiens
ggaaagtgtaaagcattcc

SEQ ID NO: 2659538 - DNA, 15 bp, Homo sapiens
ggaaataaaaccttt

SEQ ID NO: 2659539 - DNA, 20 bp, Homo sapiens
ggaaatatttagcaaataat

SEQ ID NO: 2659540 - DNA, 15 bp, Homo sapiens
ggaaatggaatactg

SEQ ID NO: 2659541 - DNA, 16 bp, Homo sapiens
ggaaatgggcagagca

SEQ ID NO: 2659542 - DNA, 22 bp, Homo sapiens
ggaaatgggcagagcagagacc

SEQ ID NO: 2659543 - DNA, 20 bp, Homo sapiens
ggaaattcccttcatctgga

SEQ ID NO: 2659544 - DNA, 13 bp, Homo sapiens
ggaacacctcctc

SEQ ID NO: 2659545 - DNA, 15 bp, Homo sapiens
ggaacactccttcac

SEQ ID NO: 2659546 - DNA, 12 bp, Homo sapiens
ggaacagaagga

SEQ ID NO: 2659547 - DNA, 13 bp, Homo sapiens
ggaacagaaggat

SEQ ID NO: 2659548 - DNA, 16 bp, Homo sapiens
ggaacagaatgtttta

SEQ ID NO: 2659549 - DNA, 18 bp, Homo sapiens
ggaacagacaacagaagt

SEQ ID NO: 2659550 - DNA, 20 bp, Homo sapiens
ggaacagacaacagaagtca

SEQ ID NO: 2659551 - DNA, 17 bp, Homo sapiens
ggaacagactggaagca

SEQ ID NO: 2659552 - DNA, 19 bp, Homo sapiens
ggaacagctatgggagccc

SEQ ID NO: 2659553 - DNA, 16 bp, Homo sapiens
ggaacaggaaactgat

SEQ ID NO: 2659554 - DNA, 22 bp, Homo sapiens
ggaacatcatcaaggcactgcc

SEQ ID NO: 2659555 - DNA, 14 bp, Homo sapiens
ggacctctgctctg

SEQ ID NO: 2659556 - DNA, 19 bp, Homo sapiens
ggacctgcctcctgcctgc

SEQ ID NO: 2659557 - DNA, 17 bp, Homo sapiens
ggacctggtaccctcct

SEQ ID NO: 2659558 - DNA, 12 bp, Homo sapiens
ggaccttcctgc

SEQ ID NO: 2659559 - DNA, 18 bp, Homo sapiens
ggaccttgaactgggtac

SEQ ID NO: 2659560 - DNA, 20 bp, Homo sapiens
ggacgctacccgggaagggg

SEQ ID NO: 2659561 - DNA, 14 bp, Homo sapiens
ggacggtgctccag

SEQ ID NO: 2659562 - DNA, 15 bp, Homo sapiens
ggacggtgctccagg

SEQ ID NO: 2659563 - DNA, 17 bp, Homo sapiens
ggacggtgctccaggca

SEQ ID NO: 2659564 - DNA, 14 bp, Homo sapiens
ggacgttccagccg

SEQ ID NO: 2659565 - DNA, 24 bp, Homo sapiens
ggactaacttgtctttggaccctg

SEQ ID NO: 2659566 - DNA, 19 bp, Homo sapiens
ggactaagcctacctgctc

SEQ ID NO: 2659567 - DNA, 21 bp, Homo sapiens
ggactagagggacctctccca

SEQ ID NO: 2659568 - DNA, 15 bp, Homo sapiens
ggactcaatgcactg

SEQ ID NO: 2659569 - DNA, 19 bp, Homo sapiens
ggactcaatttctccccag

SEQ ID NO: 2659570 - DNA, 15 bp, Homo sapiens
ggactcacttgccca

SEQ ID NO: 2659571 - DNA, 13 bp, Homo sapiens
ggactcagccctg

SEQ ID NO: 2659572 - DNA, 14 bp, Homo sapiens
ggactcagccctga

SEQ ID NO: 2659573 - DNA, 17 bp, Homo sapiens
ggactcaggatgcccag

SEQ ID NO: 2659574 - DNA, 19 bp, Homo sapiens
ggactcaggatgcccaggg

SEQ ID NO: 2659575 - DNA, 24 bp, Homo sapiens
ggactcatttcattcctaacacag

SEQ ID NO: 2659576 - DNA, 11 bp, Homo sapiens
ggactccaccc

SEQ ID NO: 2659577 - DNA, 17 bp, Homo sapiens
ggactccccaggccagg

SEQ ID NO: 2659578 - DNA, 17 bp, Homo sapiens
ggactctcagtctctga

SEQ ID NO: 2659579 - DNA, 13 bp, Homo sapiens
ggactctgaggct

SEQ ID NO: 2659580 - DNA, 13 bp, Homo sapiens
ggactctgcacat

SEQ ID NO: 2659581 - DNA, 19 bp, Homo sapiens
ggactctttggtggctttg

SEQ ID NO: 2659582 - DNA, 16 bp, Homo sapiens
ggactgaaaacctctc

SEQ ID NO: 2659583 - DNA, 18 bp, Homo sapiens
ggactgaaaacctctcct

SEQ ID NO: 2659584 - DNA, 14 bp, Homo sapiens
ggactgaagcctgc

SEQ ID NO: 2659585 - DNA, 17 bp, Homo sapiens
ggactgaagcctgcagg

SEQ ID NO: 2659586 - DNA, 16 bp, Homo sapiens
ggactgacacccatgt

SEQ ID NO: 2659587 - DNA, 21 bp, Homo sapiens
ggactgagggactctgaagcc

SEQ ID NO: 2659588 - DNA, 22 bp, Homo sapiens
ggactgcaagcagggctctgcc

SEQ ID NO: 2659589 - DNA, 19 bp, Homo sapiens
ggactgctaaataaaattt

SEQ ID NO: 2659590 - DNA, 18 bp, Homo sapiens
ggactggaaccagggaga

SEQ ID NO: 2659591 - DNA, 15 bp, Homo sapiens
ggactggagtggagc

SEQ ID NO: 2659592 - DNA, 16 bp, Homo sapiens
ggactggcccctgggt

SEQ ID NO: 2659593 - DNA, 23 bp, Homo sapiens
ggactggctagagtcctcactcc

SEQ ID NO: 2659594 - DNA, 11 bp, Homo sapiens
ggactgggagg

SEQ ID NO: 2659595 - DNA, 12 bp, Homo sapiens
ggactgggaggt

SEQ ID NO: 2659596 - DNA, 17 bp, Homo sapiens
ggactggggatgtggga

SEQ ID NO: 2659597 - DNA, 13 bp, Homo sapiens
ggactgggtttgg

SEQ ID NO: 2659598 - DNA, 15 bp, Homo sapiens
ggactgtatttgtga

SEQ ID NO: 2659599 - DNA, 19 bp, Homo sapiens
ggactgtgacaggcagcag

SEQ ID NO: 2659600 - DNA, 21 bp, Homo sapiens
ggactgtgacaggcagcagag

SEQ ID NO: 2659601 - DNA, 19 bp, Homo sapiens
ggacttaacggctccagga

SEQ ID NO: 2659602 - DNA, 15 bp, Homo sapiens
ggacttccttgctct

SEQ ID NO: 2659603 - DNA, 18 bp, Homo sapiens
ggacttccttgctctccc

SEQ ID NO: 2659604 - DNA, 11 bp, Homo sapiens
ggacttctttt

SEQ ID NO: 2659605 - DNA, 15 bp, Homo sapiens
ggacttggaagctcc

SEQ ID NO: 2659606 - DNA, 15 bp, Homo sapiens
ggacttgtatatttg

SEQ ID NO: 2659607 - DNA, 20 bp, Homo sapiens
ggacttgtatatttgtacaa

SEQ ID NO: 2659608 - DNA, 20 bp, Homo sapiens
ggactttccaccccctccct

SEQ ID NO: 2659609 - DNA, 9 bp, Homo sapiens
ggactttgt

SEQ ID NO: 2659610 - DNA, 21 bp, Homo sapiens
ggagaactcctagggtggctg

SEQ ID NO: 2659611 - DNA, 11 bp, Homo sapiens
ggagaagccat

SEQ ID NO: 2659612 - DNA, 18 bp, Homo sapiens
ggagaagcggctggcagc

SEQ ID NO: 2659613 - DNA, 13 bp, Homo sapiens
ggagaagctgatg

SEQ ID NO: 2659614 - DNA, 16 bp, Homo sapiens
ggagaagctgatgctt

SEQ ID NO: 2659615 - DNA, 21 bp, Homo sapiens
ggagaagggatggaggtcaca

SEQ ID NO: 2659616 - DNA, 17 bp, Homo sapiens
ggagaatcatgtgaacc

SEQ ID NO: 2659617 - DNA, 22 bp, Homo sapiens
ggagaatgtcagtatgtggaag

SEQ ID NO: 2659618 - DNA, 15 bp, Homo sapiens
ggagacaagaaatcc

SEQ ID NO: 2659619 - DNA, 18 bp, Homo sapiens
ggagacagtgatctccat

SEQ ID NO: 2659620 - DNA, 18 bp, Homo sapiens
ggagaccatgcagagcgc

SEQ ID NO: 2659621 - DNA, 10 bp, Homo sapiens
ggagactaga

SEQ ID NO: 2659622 - DNA, 18 bp, Homo sapiens
ggagactcctaggcagga

SEQ ID NO: 2659623 - DNA, 21 bp, Homo sapiens
ggagactcctaggcaggacat

SEQ ID NO: 2659624 - DNA, 12 bp, Homo sapiens
ggagactcctgc

SEQ ID NO: 2659625 - DNA, 17 bp, Homo sapiens
ggagactcctgccctgt

SEQ ID NO: 2659626 - DNA, 20 bp, Homo sapiens
ggagactctgtggggccttg

SEQ ID NO: 2659627 - DNA, 22 bp, Homo sapiens
ggagactgctgagtcaacccaa

SEQ ID NO: 2659628 - DNA, 14 bp, Homo sapiens
ggagactgcttccc

SEQ ID NO: 2659629 - DNA, 13 bp, Homo sapiens
ggagactgggctg

SEQ ID NO: 2659630 - DNA, 18 bp, Homo sapiens
ggagagaccgagtgaacc

SEQ ID NO: 2659631 - DNA, 15 bp, Homo sapiens
ggagagacctcatca

SEQ ID NO: 2659632 - DNA, 14 bp, Homo sapiens
ggagagagactcca

SEQ ID NO: 2659633 - DNA, 11 bp, Homo sapiens
ggagagcagcg

SEQ ID NO: 2659634 - DNA, 12 bp, Homo sapiens
ggagagcaggct

SEQ ID NO: 2659635 - DNA, 20 bp, Homo sapiens
ggagagccagaacctggagg

SEQ ID NO: 2659636 - DNA, 21 bp, Homo sapiens
ggagagccagaacctggaggg

SEQ ID NO: 2659637 - DNA, 13 bp, Homo sapiens
ggagagccagaga

SEQ ID NO: 2659638 - DNA, 20 bp, Homo sapiens
ggagagctagaacccggcag

SEQ ID NO: 2659639 - DNA, 20 bp, Homo sapiens
ggagagctagaacctggaga

SEQ ID NO: 2659640 - DNA, 15 bp, Homo sapiens
ggagagctagcagca

SEQ ID NO: 2659641 - DNA, 22 bp, Homo sapiens
ggagagctggagcctggtgccc

SEQ ID NO: 2659642 - DNA, 12 bp, Homo sapiens
ggagaggagagc

SEQ ID NO: 2659643 - DNA, 21 bp, Homo sapiens
ggagaggatgagagcccagag

SEQ ID NO: 2659644 - DNA, 22 bp, Homo sapiens
ggagaggatgagagcccagagg

SEQ ID NO: 2659645 - DNA, 18 bp, Homo sapiens
ggagaggggaagggccag

SEQ ID NO: 2659646 - DNA, 14 bp, Homo sapiens
ggagaggtgccagc

SEQ ID NO: 2659647 - DNA, 15 bp, Homo sapiens
ggagaggtgccagca

SEQ ID NO: 2659648 - DNA, 16 bp, Homo sapiens
ggagaggtgccagcaa

SEQ ID NO: 2659649 - DNA, 17 bp, Homo sapiens
ggagagtacagtgagcc

SEQ ID NO: 2659650 - DNA, 14 bp, Homo sapiens
ggagatagggaaag

SEQ ID NO: 2659651 - DNA, 23 bp, Homo sapiens
ggagatgaaatcttacagctggg

SEQ ID NO: 2659652 - DNA, 19 bp, Homo sapiens
ggagatgaagcaaacacat

SEQ ID NO: 2659653 - DNA, 20 bp, Homo sapiens
ggagatggaagttgcagtga

SEQ ID NO: 2659654 - DNA, 18 bp, Homo sapiens
ggagcaaatgtttctgca

SEQ ID NO: 2659655 - DNA, 15 bp, Homo sapiens
ggagcacaggcagct

SEQ ID NO: 2659656 - DNA, 18 bp, Homo sapiens
ggagcactggagtgcagg

SEQ ID NO: 2659657 - DNA, 20 bp, Homo sapiens
ggagcagacaggaggaatca

SEQ ID NO: 2659658 - DNA, 21 bp, Homo sapiens
ggagcagccacattcctgatg

SEQ ID NO: 2659659 - DNA, 15 bp, Homo sapiens
ggagcaggggcgtgg

SEQ ID NO: 2659660 - DNA, 12 bp, Homo sapiens
ggagcagtgtct

SEQ ID NO: 2659661 - DNA, 13 bp, Homo sapiens
ggagcagtgtctt

SEQ ID NO: 2659662 - DNA, 14 bp, Homo sapiens
ggagcatctgactc

SEQ ID NO: 2659663 - DNA, 19 bp, Homo sapiens
ggagcatttggagagaagg

SEQ ID NO: 2659664 - DNA, 23 bp, Homo sapiens
ggagccaagggttcagagactca

SEQ ID NO: 2659665 - DNA, 13 bp, Homo sapiens
ggagccagggctg

SEQ ID NO: 2659666 - DNA, 20 bp, Homo sapiens
ggagccccagccccctttgg

SEQ ID NO: 2659667 - DNA, 18 bp, Homo sapiens
ggagccccagctaccctt

SEQ ID NO: 2659668 - DNA, 13 bp, Homo sapiens
ggagccccaggcc

SEQ ID NO: 2659669 - DNA, 14 bp, Homo sapiens
ggagccccaggcct

SEQ ID NO: 2659670 - DNA, 20 bp, Homo sapiens
ggagccccagggtcttccct

SEQ ID NO: 2659671 - DNA, 16 bp, Homo sapiens
ggagccccgaggcctt

SEQ ID NO: 2659672 - DNA, 22 bp, Homo sapiens
ggagccccgaggccttctctga

SEQ ID NO: 2659673 - DNA, 22 bp, Homo sapiens
ggagcccctgggtgggtggtgg

SEQ ID NO: 2659674 - DNA, 14 bp, Homo sapiens
ggagcccgcacccc

SEQ ID NO: 2659675 - DNA, 17 bp, Homo sapiens
ggagccgggtctgcctc

SEQ ID NO: 2659676 - DNA, 20 bp, Homo sapiens
ggagcctcatccgaggcagg

SEQ ID NO: 2659677 - DNA, 21 bp, Homo sapiens
ggagcctcatccgaggcaggg

SEQ ID NO: 2659678 - DNA, 16 bp, Homo sapiens
ggagcctgcagggtgg

SEQ ID NO: 2659679 - DNA, 22 bp, Homo sapiens
ggagcctgcagggtggtgctgg

SEQ ID NO: 2659680 - DNA, 23 bp, Homo sapiens
ggagcgcacctgccccctggtgg

SEQ ID NO: 2659681 - DNA, 16 bp, Homo sapiens
ggagcggaaagcagct

SEQ ID NO: 2659682 - DNA, 13 bp, Homo sapiens
ggagcgggacctg

SEQ ID NO: 2659683 - DNA, 17 bp, Homo sapiens
ggagctcctctcctgga

SEQ ID NO: 2659684 - DNA, 21 bp, Homo sapiens
ggagctcctctcctggaggat

SEQ ID NO: 2659685 - DNA, 12 bp, Homo sapiens
ggagctggcccc

SEQ ID NO: 2659686 - DNA, 21 bp, Homo sapiens
ggagcttctctgatgtgatat

SEQ ID NO: 2659687 - DNA, 18 bp, Homo sapiens
ggaggaacactgcactct

SEQ ID NO: 2659688 - DNA, 19 bp, Homo sapiens
ggaggaagcaggttgaggg

SEQ ID NO: 2659689 - DNA, 13 bp, Homo sapiens
ggaggaaggattg

SEQ ID NO: 2659690 - DNA, 21 bp, Homo sapiens
ggaggaaggcttacacccaca

SEQ ID NO: 2659691 - DNA, 19 bp, Homo sapiens
ggaggaatcgaggaaccag

SEQ ID NO: 2659692 - DNA, 20 bp, Homo sapiens
ggaggaatcgaggaaccaga

SEQ ID NO: 2659693 - DNA, 16 bp, Homo sapiens
ggaggaatgctccccc

SEQ ID NO: 2659694 - DNA, 17 bp, Homo sapiens
ggaggaatgctccccca

SEQ ID NO: 2659695 - DNA, 20 bp, Homo sapiens
ggaggaccagggcagggcca

SEQ ID NO: 2659696 - DNA, 16 bp, Homo sapiens
ggaggactagaacctg

SEQ ID NO: 2659697 - DNA, 19 bp, Homo sapiens
ggaggactagaacctggag

SEQ ID NO: 2659698 - DNA, 22 bp, Homo sapiens
ggaggactagaacctggagggc

SEQ ID NO: 2659699 - DNA, 13 bp, Homo sapiens
ggaggagagaaga

SEQ ID NO: 2659700 - DNA, 20 bp, Homo sapiens
ggccctcgggcccagccccc

SEQ ID NO: 2659701 - DNA, 13 bp, Homo sapiens
ggccctctacccc

SEQ ID NO: 2659702 - DNA, 14 bp, Homo sapiens
ggccctctctgctc

SEQ ID NO: 2659703 - DNA, 21 bp, Homo sapiens
ggccctctgcccactccctgc

SEQ ID NO: 2659704 - DNA, 22 bp, Homo sapiens
ggccctgcaaaaggactctcag

SEQ ID NO: 2659705 - DNA, 13 bp, Homo sapiens
ggccctgcctcct

SEQ ID NO: 2659706 - DNA, 15 bp, Homo sapiens
ggccctgcctccttt

SEQ ID NO: 2659707 - DNA, 21 bp, Homo sapiens
ggccctgggctcggaggctgc

SEQ ID NO: 2659708 - DNA, 12 bp, Homo sapiens
ggccctgtgcct

SEQ ID NO: 2659709 - DNA, 17 bp, Homo sapiens
ggccctgtgccttggtg

SEQ ID NO: 2659710 - DNA, 19 bp, Homo sapiens
ggcccttctctccagcccc

SEQ ID NO: 2659711 - DNA, 20 bp, Homo sapiens
ggcccttctctccagcccct

SEQ ID NO: 2659712 - DNA, 21 bp, Homo sapiens
ggcccttctctccagcccctg

SEQ ID NO: 2659713 - DNA, 22 bp, Homo sapiens
ggcccttctctccagcccctgg

SEQ ID NO: 2659714 - DNA, 14 bp, Homo sapiens
ggccgaagctctgg

SEQ ID NO: 2659715 - DNA, 18 bp, Homo sapiens
ggccgaagctctggctga

SEQ ID NO: 2659716 - DNA, 20 bp, Homo sapiens
ggccgcagctcttgcccttc

SEQ ID NO: 2659717 - DNA, 13 bp, Homo sapiens
ggccgcctcaccc

SEQ ID NO: 2659718 - DNA, 14 bp, Homo sapiens
ggccgcctcacccc

SEQ ID NO: 2659719 - DNA, 14 bp, Homo sapiens
ggccgctagaggcc

SEQ ID NO: 2659720 - DNA, 15 bp, Homo sapiens
ggccgctagaggcct

SEQ ID NO: 2659721 - DNA, 16 bp, Homo sapiens
ggccgctagatgggca

SEQ ID NO: 2659722 - DNA, 20 bp, Homo sapiens
ggccggagtcagtgccaggt

SEQ ID NO: 2659723 - DNA, 23 bp, Homo sapiens
ggccgggaccccgagcctggctc

SEQ ID NO: 2659724 - DNA, 21 bp, Homo sapiens
ggccggtctgcaagtcagagg

SEQ ID NO: 2659725 - DNA, 12 bp, Homo sapiens
ggccgtcaggac

SEQ ID NO: 2659726 - DNA, 19 bp, Homo sapiens
ggccgtcaggacccaccat

SEQ ID NO: 2659727 - DNA, 14 bp, Homo sapiens
ggccgtcctcccgg

SEQ ID NO: 2659728 - DNA, 19 bp, Homo sapiens
ggccgttgatgttggctgg

SEQ ID NO: 2659729 - DNA, 23 bp, Homo sapiens
ggcctagatccacacacagagga

SEQ ID NO: 2659730 - DNA, 20 bp, Homo sapiens
ggcctagcatacgtacacat

SEQ ID NO: 2659731 - DNA, 22 bp, Homo sapiens
ggcctagcatacgtacacattt

SEQ ID NO: 2659732 - DNA, 16 bp, Homo sapiens
ggcctagctgctacaa

SEQ ID NO: 2659733 - DNA, 20 bp, Homo sapiens
ggcctagctgctacaaagaa

SEQ ID NO: 2659734 - DNA, 21 bp, Homo sapiens
ggcctagctgctacaaagaag

SEQ ID NO: 2659735 - DNA, 15 bp, Homo sapiens
ggcctagtcccttcc

SEQ ID NO: 2659736 - DNA, 21 bp, Homo sapiens
ggcctatgcacatatggactc

SEQ ID NO: 2659737 - DNA, 19 bp, Homo sapiens
ggcctattatattaaaata

SEQ ID NO: 2659738 - DNA, 18 bp, Homo sapiens
ggcctcaaaggcccgctc

SEQ ID NO: 2659739 - DNA, 19 bp, Homo sapiens
ggcctcaaaggcccgctct

SEQ ID NO: 2659740 - DNA, 19 bp, Homo sapiens
ggcctcaaccctccctcag

SEQ ID NO: 2659741 - DNA, 15 bp, Homo sapiens
ggcctcagctgcctc

SEQ ID NO: 2659742 - DNA, 17 bp, Homo sapiens
ggcctcagctgcctcac

SEQ ID NO: 2659743 - DNA, 22 bp, Homo sapiens
ggcctcccaactcaccccagcc

SEQ ID NO: 2659744 - DNA, 16 bp, Homo sapiens
ggcctcccacagactc

SEQ ID NO: 2659745 - DNA, 17 bp, Homo sapiens
ggcctcccacagactca

SEQ ID NO: 2659746 - DNA, 13 bp, Homo sapiens
ggcctcccacccg

SEQ ID NO: 2659747 - DNA, 20 bp, Homo sapiens
ggcctcccacccgatgctgc

SEQ ID NO: 2659748 - DNA, 19 bp, Homo sapiens
ggcctccggcgtcagcctc

SEQ ID NO: 2659749 - DNA, 22 bp, Homo sapiens
ggcctcctcacaacatggtgtc

SEQ ID NO: 2659750 - DNA, 16 bp, Homo sapiens
ggcctcgggacacctg

SEQ ID NO: 2659751 - DNA, 16 bp, Homo sapiens
ggcctctaaccccagg

SEQ ID NO: 2659752 - DNA, 18 bp, Homo sapiens
ggcctctaaccccaggcc

SEQ ID NO: 2659753 - DNA, 19 bp, Homo sapiens
ggcctctccttgtggcctg

SEQ ID NO: 2659754 - DNA, 13 bp, Homo sapiens
ggcctctctggcc

SEQ ID NO: 2659755 - DNA, 16 bp, Homo sapiens
ggcctctctggcctcc

SEQ ID NO: 2659756 - DNA, 17 bp, Homo sapiens
ggcctctctggcctccc

SEQ ID NO: 2659757 - DNA, 19 bp, Homo sapiens
ggcctctctggcctcccac

SEQ ID NO: 2659758 - DNA, 22 bp, Homo sapiens
ggcctctgcactcccctgctgg

SEQ ID NO: 2659759 - DNA, 14 bp, Homo sapiens
ggcctctgtgtcct

SEQ ID NO: 2659760 - DNA, 19 bp, Homo sapiens
ggcctcttccgtgacgtca

SEQ ID NO: 2659761 - DNA, 13 bp, Homo sapiens
ggcctcttggcag

SEQ ID NO: 2659762 - DNA, 12 bp, Homo sapiens
ggcctgagctgg

SEQ ID NO: 2659763 - DNA, 22 bp, Homo sapiens
ggcctgaggatgagctggaagg

SEQ ID NO: 2659764 - DNA, 14 bp, Homo sapiens
ggcctgatgacaga

SEQ ID NO: 2659765 - DNA, 18 bp, Homo sapiens
ggcctgatgacagagcga

SEQ ID NO: 2659766 - DNA, 18 bp, Homo sapiens
ggcctgccttgaagccac

SEQ ID NO: 2659767 - DNA, 17 bp, Homo sapiens
ggcctgctcccagcagc

SEQ ID NO: 2659768 - DNA, 18 bp, Homo sapiens
ggcctgctcccagcagcc

SEQ ID NO: 2659769 - DNA, 13 bp, Homo sapiens
ggcctggacctgc

SEQ ID NO: 2659770 - DNA, 21 bp, Homo sapiens
ggcctggacctgcctcctgcc

SEQ ID NO: 2659771 - DNA, 22 bp, Homo sapiens
ggcctggacctgcctcctgcct

SEQ ID NO: 2659772 - DNA, 16 bp, Homo sapiens
ggcctggccacctctc

SEQ ID NO: 2659773 - DNA, 17 bp, Homo sapiens
ggcctggccacctctct

SEQ ID NO: 2659774 - DNA, 12 bp, Homo sapiens
ggcctggccaga

SEQ ID NO: 2659775 - DNA, 15 bp, Homo sapiens
ggcctggccagatgc

SEQ ID NO: 2659776 - DNA, 16 bp, Homo sapiens
ggcctggccagatgca

SEQ ID NO: 2659777 - DNA, 21 bp, Homo sapiens
ggcctggccagatgcaccagc

SEQ ID NO: 2659778 - DNA, 14 bp, Homo sapiens
ggcctggccaggag

SEQ ID NO: 2659779 - DNA, 13 bp, Homo sapiens
ggcctggccaggc

SEQ ID NO: 2659780 - DNA, 17 bp, Homo sapiens
ggcctggccagggcctg

SEQ ID NO: 2659781 - DNA, 14 bp, Homo sapiens
ggcctggggctcct

SEQ ID NO: 2659782 - DNA, 15 bp, Homo sapiens
ggccttccccagcct

SEQ ID NO: 2659783 - DNA, 12 bp, Homo sapiens
ggccttctctga

SEQ ID NO: 2659784 - DNA, 12 bp, Homo sapiens
ggccttgtccca

SEQ ID NO: 2659785 - DNA, 21 bp, Homo sapiens
ggcgaggggagggtggcaggt

SEQ ID NO: 2659786 - DNA, 16 bp, Homo sapiens
ggcgagtgccaggact

SEQ ID NO: 2659787 - DNA, 14 bp, Homo sapiens
ggcgcagccaaggc

SEQ ID NO: 2659788 - DNA, 17 bp, Homo sapiens
ggcgcagccaaggccga

SEQ ID NO: 2659789 - DNA, 13 bp, Homo sapiens
ggcgcccctgcca

SEQ ID NO: 2659790 - DNA, 15 bp, Homo sapiens
ggcgcccctgccacc

SEQ ID NO: 2659791 - DNA, 20 bp, Homo sapiens
ggcgccgcaaaccacactgg

SEQ ID NO: 2659792 - DNA, 13 bp, Homo sapiens
ggcgcctctgcaa

SEQ ID NO: 2659793 - DNA, 18 bp, Homo sapiens
ggcgcctgtagtcccagc

SEQ ID NO: 2659794 - DNA, 22 bp, Homo sapiens
ggcgcgcacctgtaatcccagc

SEQ ID NO: 2659795 - DNA, 13 bp, Homo sapiens
ggcgctggcccag

SEQ ID NO: 2659796 - DNA, 18 bp, Homo sapiens
ggcgctggcccagccggc

SEQ ID NO: 2659797 - DNA, 15 bp, Homo sapiens
ggcggacgttccagc

SEQ ID NO: 2659798 - DNA, 19 bp, Homo sapiens
ggcggagagtacagtgagc

SEQ ID NO: 2659799 - DNA, 14 bp, Homo sapiens
ggcggagctggccc

SEQ ID NO: 2659800 - DNA, 12 bp, Homo sapiens
ggcggcagcagc

SEQ ID NO: 2659801 - DNA, 23 bp, Homo sapiens
ggcggctgagagccccagctgac

SEQ ID NO: 2659802 - DNA, 21 bp, Homo sapiens
ggcgggagtggagtggaagaa

SEQ ID NO: 2659803 - DNA, 13 bp, Homo sapiens
ggcgtcagcctcc

SEQ ID NO: 2659804 - DNA, 14 bp, Homo sapiens
ggcgtcagcctcca

SEQ ID NO: 2659805 - DNA, 16 bp, Homo sapiens
ggcgtcagcctccagc

SEQ ID NO: 2659806 - DNA, 19 bp, Homo sapiens
ggcgtcagcctccagcctc

SEQ ID NO: 2659807 - DNA, 12 bp, Homo sapiens
ggcgtgatctcg

SEQ ID NO: 2659808 - DNA, 19 bp, Homo sapiens
ggcgtgcagtggtgcgatc

SEQ ID NO: 2659809 - DNA, 19 bp, Homo sapiens
ggcgtggtcactgctgtca

SEQ ID NO: 2659810 - DNA, 17 bp, Homo sapiens
ggctaactatatttgct

SEQ ID NO: 2659811 - DNA, 19 bp, Homo sapiens
ggctaagagtgtcctagga

SEQ ID NO: 2659812 - DNA, 16 bp, Homo sapiens
ggctaatgtactgcat

SEQ ID NO: 2659813 - DNA, 15 bp, Homo sapiens
ggctaattaaataaa

SEQ ID NO: 2659814 - DNA, 23 bp, Homo sapiens
ggctacaattttctcccaggaag

SEQ ID NO: 2659815 - DNA, 15 bp, Homo sapiens
ggctactgcagcttt

SEQ ID NO: 2659816 - DNA, 18 bp, Homo sapiens
ggctagaacctggagggc

SEQ ID NO: 2659817 - DNA, 22 bp, Homo sapiens
ggctagaacctgtagagctaga

SEQ ID NO: 2659818 - DNA, 18 bp, Homo sapiens
ggctagaatatcctactt

SEQ ID NO: 2659819 - DNA, 16 bp, Homo sapiens
ggctagaggttcaaag

SEQ ID NO: 2659820 - DNA, 17 bp, Homo sapiens
ggctagaggttcaaaga

SEQ ID NO: 2659821 - DNA, 22 bp, Homo sapiens
ggctagaggttcaaagatattt

SEQ ID NO: 2659822 - DNA, 22 bp, Homo sapiens
ggctaggacccctccatgtggg

SEQ ID NO: 2659823 - DNA, 20 bp, Homo sapiens
ggctatagctacaggaagca

SEQ ID NO: 2659824 - DNA, 12 bp, Homo sapiens
ggctatgcattt

SEQ ID NO: 2659825 - DNA, 14 bp, Homo sapiens
ggctatgcatttga

SEQ ID NO: 2659826 - DNA, 15 bp, Homo sapiens
ggctatgcatttgaa

SEQ ID NO: 2659827 - DNA, 19 bp, Homo sapiens
ggctatgtatggaatacag

SEQ ID NO: 2659828 - DNA, 15 bp, Homo sapiens
ggctcaagtcctctt

SEQ ID NO: 2659829 - DNA, 23 bp, Homo sapiens
ggctcacgcctatgatcccagca

SEQ ID NO: 2659830 - DNA, 22 bp, Homo sapiens
ggctcacgcctgtaatcccagc

SEQ ID NO: 2659831 - DNA, 13 bp, Homo sapiens
ggctcacgtgtgt

SEQ ID NO: 2659832 - DNA, 18 bp, Homo sapiens
ggctcactatggtgccaa

SEQ ID NO: 2659833 - DNA, 19 bp, Homo sapiens
ggctcactatggtgccaat

SEQ ID NO: 2659834 - DNA, 23 bp, Homo sapiens
ggctcagcaaaagatgcttctca

SEQ ID NO: 2659835 - DNA, 21 bp, Homo sapiens
ggctcagcggggacagctcct

SEQ ID NO: 2659836 - DNA, 22 bp, Homo sapiens
ggctcagcggggacagctcctt

SEQ ID NO: 2659837 - DNA, 23 bp, Homo sapiens
ggctcagcggggacagctccttc

SEQ ID NO: 2659838 - DNA, 22 bp, Homo sapiens
ggctcaggatttcgtgggtctg

SEQ ID NO: 2659839 - DNA, 19 bp, Homo sapiens
ggctcaggtggggtcactc

SEQ ID NO: 2659840 - DNA, 20 bp, Homo sapiens
ggctcaggtggggtcactct

SEQ ID NO: 2659841 - DNA, 17 bp, Homo sapiens
ggctcagtctcaggagc

SEQ ID NO: 2659842 - DNA, 20 bp, Homo sapiens
ggctcatagggaagacctgc

SEQ ID NO: 2659843 - DNA, 13 bp, Homo sapiens
ggctccagagggc

SEQ ID NO: 2659844 - DNA, 19 bp, Homo sapiens
ggggctggtagctcaggtg

SEQ ID NO: 2659845 - DNA, 15 bp, Homo sapiens
ggggctttctggaga

SEQ ID NO: 2659846 - DNA, 18 bp, Homo sapiens
gggggacagggctggccc

SEQ ID NO: 2659847 - DNA, 22 bp, Homo sapiens
gggggacagggctggcccagcc

SEQ ID NO: 2659848 - DNA, 17 bp, Homo sapiens
gggggatcacagcctct

SEQ ID NO: 2659849 - DNA, 15 bp, Homo sapiens
gggggccatgagctc

SEQ ID NO: 2659850 - DNA, 12 bp, Homo sapiens
gggggcctcagt

SEQ ID NO: 2659851 - DNA, 17 bp, Homo sapiens
gggggcctcagtgccac

SEQ ID NO: 2659852 - DNA, 16 bp, Homo sapiens
gggggtccacccagca

SEQ ID NO: 2659853 - DNA, 18 bp, Homo sapiens
gggggtttttactccagt

SEQ ID NO: 2659854 - DNA, 19 bp, Homo sapiens
ggggtagctagaggaacca

SEQ ID NO: 2659855 - DNA, 22 bp, Homo sapiens
ggggtatttaccacagcagctg

SEQ ID NO: 2659856 - DNA, 18 bp, Homo sapiens
ggggtccacccagcaaag

SEQ ID NO: 2659857 - DNA, 23 bp, Homo sapiens
ggggtctgtgtgtttatgtgtgt

SEQ ID NO: 2659858 - DNA, 13 bp, Homo sapiens
ggggtgccgcctg

SEQ ID NO: 2659859 - DNA, 14 bp, Homo sapiens
ggggtgccgcctgc

SEQ ID NO: 2659860 - DNA, 17 bp, Homo sapiens
ggggtgccgcctgcccg

SEQ ID NO: 2659861 - DNA, 15 bp, Homo sapiens
ggggttatctctgtg

SEQ ID NO: 2659862 - DNA, 23 bp, Homo sapiens
ggggttcccttttttggctgctg

SEQ ID NO: 2659863 - DNA, 21 bp, Homo sapiens
ggggttgggattgggggctgg

SEQ ID NO: 2659864 - DNA, 17 bp, Homo sapiens
ggggttgtgaggcctgg

SEQ ID NO: 2659865 - DNA, 23 bp, Homo sapiens
ggggttttcgaagctcagcccac

SEQ ID NO: 2659866 - DNA, 22 bp, Homo sapiens
gggtaaaattccttagcttaga

SEQ ID NO: 2659867 - DNA, 15 bp, Homo sapiens
gggtacccactgctc

SEQ ID NO: 2659868 - DNA, 15 bp, Homo sapiens
gggtagcagctggac

SEQ ID NO: 2659869 - DNA, 17 bp, Homo sapiens
gggtagcagctggacta

SEQ ID NO: 2659870 - DNA, 22 bp, Homo sapiens
gggtagcagctggactacccac

SEQ ID NO: 2659871 - DNA, 15 bp, Homo sapiens
gggtagctagaggaa

SEQ ID NO: 2659872 - DNA, 23 bp, Homo sapiens
gggtagctgtaaggcatgaagga

SEQ ID NO: 2659873 - DNA, 12 bp, Homo sapiens
gggtaggcggga

SEQ ID NO: 2659874 - DNA, 19 bp, Homo sapiens
gggtcagacgcctgaggaa

SEQ ID NO: 2659875 - DNA, 17 bp, Homo sapiens
gggtcagccagggccag

SEQ ID NO: 2659876 - DNA, 19 bp, Homo sapiens
gggtcagccagggccaggg

SEQ ID NO: 2659877 - DNA, 19 bp, Homo sapiens
gggtcaggaaggatgagca

SEQ ID NO: 2659878 - DNA, 12 bp, Homo sapiens
gggtcaggctcc

SEQ ID NO: 2659879 - DNA, 16 bp, Homo sapiens
gggtccagggagcagg

SEQ ID NO: 2659880 - DNA, 12 bp, Homo sapiens
gggtccatgggc

SEQ ID NO: 2659881 - DNA, 23 bp, Homo sapiens
gggtcccaagctgggccccagcc

SEQ ID NO: 2659882 - DNA, 14 bp, Homo sapiens
gggtcccagtggga

SEQ ID NO: 2659883 - DNA, 16 bp, Homo sapiens
gggtcccagtgggagg

SEQ ID NO: 2659884 - DNA, 17 bp, Homo sapiens
gggtcccagtgggaggg

SEQ ID NO: 2659885 - DNA, 17 bp, Homo sapiens
gggtccccatcatccca

SEQ ID NO: 2659886 - DNA, 16 bp, Homo sapiens
gggtccctgctgtgtt

SEQ ID NO: 2659887 - DNA, 20 bp, Homo sapiens
gggtcctgtggcaggcagcg

SEQ ID NO: 2659888 - DNA, 23 bp, Homo sapiens
gggtctcactatgttgcccaggc

SEQ ID NO: 2659889 - DNA, 14 bp, Homo sapiens
gggtctcactctgt

SEQ ID NO: 2659890 - DNA, 13 bp, Homo sapiens
gggtctctgctgc

SEQ ID NO: 2659891 - DNA, 14 bp, Homo sapiens
gggtctctgctgcc

SEQ ID NO: 2659892 - DNA, 15 bp, Homo sapiens
gggtctctgctgccg

SEQ ID NO: 2659893 - DNA, 18 bp, Homo sapiens
gggtctctgctgccgccc

SEQ ID NO: 2659894 - DNA, 21 bp, Homo sapiens
gggtctgaggaatccagaccc

SEQ ID NO: 2659895 - DNA, 15 bp, Homo sapiens
gggtctggctgagct

SEQ ID NO: 2659896 - DNA, 21 bp, Homo sapiens
gggtctggtctcctcagcctc

SEQ ID NO: 2659897 - DNA, 15 bp, Homo sapiens
gggtctgtgtctctt

SEQ ID NO: 2659898 - DNA, 13 bp, Homo sapiens
gggtgacaagata

SEQ ID NO: 2659899 - DNA, 16 bp, Homo sapiens
gggtgatttcagagag

SEQ ID NO: 2659900 - DNA, 21 bp, Homo sapiens
gggtgccccccttgccagaca

SEQ ID NO: 2659901 - DNA, 12 bp, Homo sapiens
gggtgccccctc

SEQ ID NO: 2659902 - DNA, 15 bp, Homo sapiens
gggtgccccctcctc

SEQ ID NO: 2659903 - DNA, 14 bp, Homo sapiens
gggtggagaagcca

SEQ ID NO: 2659904 - DNA, 23 bp, Homo sapiens
gggtggagactgcttcccatcct

SEQ ID NO: 2659905 - DNA, 13 bp, Homo sapiens
gggtggatgcctg

SEQ ID NO: 2659906 - DNA, 23 bp, Homo sapiens
gggtggatttgggttggaagtga

SEQ ID NO: 2659907 - DNA, 15 bp, Homo sapiens
gggtggcaccagcag

SEQ ID NO: 2659908 - DNA, 15 bp, Homo sapiens
gggtgggacaccctg

SEQ ID NO: 2659909 - DNA, 18 bp, Homo sapiens
gggtgggacaccctgtga

SEQ ID NO: 2659910 - DNA, 13 bp, Homo sapiens
gggtgggcctctg

SEQ ID NO: 2659911 - DNA, 12 bp, Homo sapiens
gggtggtgacct

SEQ ID NO: 2659912 - DNA, 18 bp, Homo sapiens
gggtggtgctgggactga

SEQ ID NO: 2659913 - DNA, 18 bp, Homo sapiens
gggtgtaacaggtctcct

SEQ ID NO: 2659914 - DNA, 20 bp, Homo sapiens
gggttcagaaatgctgcctg

SEQ ID NO: 2659915 - DNA, 21 bp, Homo sapiens
gggttcataggtcactggctc

SEQ ID NO: 2659916 - DNA, 17 bp, Homo sapiens
gggttcattattggaat

SEQ ID NO: 2659917 - DNA, 21 bp, Homo sapiens
gggttccctttccttccatcc

SEQ ID NO: 2659918 - DNA, 12 bp, Homo sapiens
gggttctaccca

SEQ ID NO: 2659919 - DNA, 23 bp, Homo sapiens
gggttgaaaattcaaaaagtgtt

SEQ ID NO: 2659920 - DNA, 21 bp, Homo sapiens
gggttggagcagtagctggag

SEQ ID NO: 2659921 - DNA, 20 bp, Homo sapiens
gggttggctgggcccagaag

SEQ ID NO: 2659922 - DNA, 14 bp, Homo sapiens
gggttgggcccaga

SEQ ID NO: 2659923 - DNA, 22 bp, Homo sapiens
gggttgggcccagatctggtcc

SEQ ID NO: 2659924 - DNA, 19 bp, Homo sapiens
gggttggtgcacagtgatt

SEQ ID NO: 2659925 - DNA, 14 bp, Homo sapiens
gggttgtgaggcct

SEQ ID NO: 2659926 - DNA, 22 bp, Homo sapiens
gggtttctgagctgctctgaat

SEQ ID NO: 2659927 - DNA, 20 bp, Homo sapiens
gggtttggaccccagctggg

SEQ ID NO: 2659928 - DNA, 21 bp, Homo sapiens
gggtttggaccccagctggga

SEQ ID NO: 2659929 - DNA, 13 bp, Homo sapiens
gggttttaatgta

SEQ ID NO: 2659930 - DNA, 20 bp, Homo sapiens
gggttttgccatgttggcca

SEQ ID NO: 2659931 - DNA, 23 bp, Homo sapiens
ggtaaaagtgtgagcagtgagtt

SEQ ID NO: 2659932 - DNA, 15 bp, Homo sapiens
ggtaaagactggctt

SEQ ID NO: 2659933 - DNA, 16 bp, Homo sapiens
ggtaacagaacagctt

SEQ ID NO: 2659934 - DNA, 18 bp, Homo sapiens
ggtaacagaacagcttca

SEQ ID NO: 2659935 - DNA, 14 bp, Homo sapiens
ggtaacaggcagat

SEQ ID NO: 2659936 - DNA, 22 bp, Homo sapiens
ggtaacatcctttctattgaaa

SEQ ID NO: 2659937 - DNA, 18 bp, Homo sapiens
ggtaactagggaagataa

SEQ ID NO: 2659938 - DNA, 17 bp, Homo sapiens
ggtaccagataaaatta

SEQ ID NO: 2659939 - DNA, 12 bp, Homo sapiens
ggtacccagcca

SEQ ID NO: 2659940 - DNA, 20 bp, Homo sapiens
ggtacttcaggggcacttca

SEQ ID NO: 2659941 - DNA, 16 bp, Homo sapiens
ggtacttgtggacaca

SEQ ID NO: 2659942 - DNA, 17 bp, Homo sapiens
ggtacttgtggacacag

SEQ ID NO: 2659943 - DNA, 20 bp, Homo sapiens
ggtacttgtggacacagctc

SEQ ID NO: 2659944 - DNA, 21 bp, Homo sapiens
ggtacttgtggacacagctct

SEQ ID NO: 2659945 - DNA, 22 bp, Homo sapiens
ggtagaaatatctgaaaatgta

SEQ ID NO: 2659946 - DNA, 17 bp, Homo sapiens
ggtagaggatgaggaaa

SEQ ID NO: 2659947 - DNA, 14 bp, Homo sapiens
ggtagatgttcaga

SEQ ID NO: 2659948 - DNA, 16 bp, Homo sapiens
ggtagcccgcctgcca

SEQ ID NO: 2659949 - DNA, 17 bp, Homo sapiens
ggtagctagaggaacca

SEQ ID NO: 2659950 - DNA, 15 bp, Homo sapiens
ggtagctgcccctgg

SEQ ID NO: 2659951 - DNA, 12 bp, Homo sapiens
ggtagctgtaag

SEQ ID NO: 2659952 - DNA, 15 bp, Homo sapiens
ggtatcaagaaagtc

SEQ ID NO: 2659953 - DNA, 19 bp, Homo sapiens
ggtatcattttctgcattt

SEQ ID NO: 2659954 - DNA, 14 bp, Homo sapiens
ggtatgagctgagg

SEQ ID NO: 2659955 - DNA, 14 bp, Homo sapiens
ggtatgcaatcaaa

SEQ ID NO: 2659956 - DNA, 15 bp, Homo sapiens
ggtatggaactctct

SEQ ID NO: 2659957 - DNA, 20 bp, Homo sapiens
ggtattacactgtatttgta

SEQ ID NO: 2659958 - DNA, 18 bp, Homo sapiens
ggtatttttgccctgagt

SEQ ID NO: 2659959 - DNA, 23 bp, Homo sapiens
ggtcaacatcttttacattctgc

SEQ ID NO: 2659960 - DNA, 20 bp, Homo sapiens
ggtcaagtaagaagacatga

SEQ ID NO: 2659961 - DNA, 20 bp, Homo sapiens
ggtcaatacagtacaggcag

SEQ ID NO: 2659962 - DNA, 15 bp, Homo sapiens
ggtcacagcctcctc

SEQ ID NO: 2659963 - DNA, 16 bp, Homo sapiens
ggtcacaggactctgc

SEQ ID NO: 2659964 - DNA, 21 bp, Homo sapiens
ggtcacattcaggaagatgaa

SEQ ID NO: 2659965 - DNA, 20 bp, Homo sapiens
ggtcactctggcagctcaga

SEQ ID NO: 2659966 - DNA, 21 bp, Homo sapiens
ggtcactcttcctgcaaggac

SEQ ID NO: 2659967 - DNA, 13 bp, Homo sapiens
ggtcactggaact

SEQ ID NO: 2659968 - DNA, 17 bp, Homo sapiens
ggtcactggctctccaa

SEQ ID NO: 2659969 - DNA, 20 bp, Homo sapiens
ggtcagagactgctgtgttt

SEQ ID NO: 2659970 - DNA, 13 bp, Homo sapiens
ggtcagagcctgc

SEQ ID NO: 2659971 - DNA, 15 bp, Homo sapiens
ggtcagagcctgcag

SEQ ID NO: 2659972 - DNA, 13 bp, Homo sapiens
ggtcagccagggc

SEQ ID NO: 2659973 - DNA, 15 bp, Homo sapiens
ggtcagccagggcca

SEQ ID NO: 2659974 - DNA, 18 bp, Homo sapiens
ggtcagctcccttctctg

SEQ ID NO: 2659975 - DNA, 22 bp, Homo sapiens
ggtcaggaaggatgagcattta

SEQ ID NO: 2659976 - DNA, 22 bp, Homo sapiens
ggtcaggagaggggcagaacag

SEQ ID NO: 2659977 - DNA, 19 bp, Homo sapiens
ggtcagtgaggcccaggga

SEQ ID NO: 2659978 - DNA, 24 bp, Homo sapiens
ggtcagtgtccaaagcagggtctg

SEQ ID NO: 2659979 - DNA, 16 bp, Homo sapiens
ggtcatagcagtgctt

SEQ ID NO: 2659980 - DNA, 15 bp, Homo sapiens
ggtcatggtggtgca

SEQ ID NO: 2659981 - DNA, 19 bp, Homo sapiens
ggtccacccaggagccccg

SEQ ID NO: 2659982 - DNA, 22 bp, Homo sapiens
ggtccacccaggagccccgagg

SEQ ID NO: 2659983 - DNA, 19 bp, Homo sapiens
ggtccagccctggctgaag

SEQ ID NO: 2659984 - DNA, 20 bp, Homo sapiens
ggtccagccctggctgaagg

SEQ ID NO: 2659985 - DNA, 23 bp, Homo sapiens
ggtccagccctggctgaaggact

SEQ ID NO: 2659986 - DNA, 11 bp, Homo sapiens
ggtccaggaga

SEQ ID NO: 2659987 - DNA, 20 bp, Homo sapiens
ggtccaggggcccctccagc

SEQ ID NO: 2659988 - DNA, 18 bp, Homo sapiens
gtataggtagatgttcag

SEQ ID NO: 2659989 - DNA, 13 bp, Homo sapiens
gtatagtgtaaaa

SEQ ID NO: 2659990 - DNA, 20 bp, Homo sapiens
gtatatatatgccatgatgg

SEQ ID NO: 2659991 - DNA, 22 bp, Homo sapiens
gtatatatctgcttcagtggag

SEQ ID NO: 2659992 - DNA, 12 bp, Homo sapiens
gtatatatgtgt

SEQ ID NO: 2659993 - DNA, 18 bp, Homo sapiens
gtatatatgtgtgtttaa

SEQ ID NO: 2659994 - DNA, 19 bp, Homo sapiens
gtatatatgtgtgtttaaa

SEQ ID NO: 2659995 - DNA, 13 bp, Homo sapiens
gtatatattccca

SEQ ID NO: 2659996 - DNA, 19 bp, Homo sapiens
gtatatcagaaaagggaag

SEQ ID NO: 2659997 - DNA, 17 bp, Homo sapiens
gtatatctggacaagcc

SEQ ID NO: 2659998 - DNA, 21 bp, Homo sapiens
gtatatctggacaagccaact

SEQ ID NO: 2659999 - DNA, 13 bp, Homo sapiens
gtatatgtctcag

SEQ ID NO: 2660000 - DNA, 16 bp, Homo sapiens
gtatattatgtattta

SEQ ID NO: 2660001 - DNA, 18 bp, Homo sapiens
gtatcaatccttgttcag

SEQ ID NO: 2660002 - DNA, 14 bp, Homo sapiens
gtatcagaggccta

SEQ ID NO: 2660003 - DNA, 22 bp, Homo sapiens
gtatcaggtgctgccatccagg

SEQ ID NO: 2660004 - DNA, 24 bp, Homo sapiens
gtatcatctggataggagcctgct

SEQ ID NO: 2660005 - DNA, 14 bp, Homo sapiens
gtatccactttgca

SEQ ID NO: 2660006 - DNA, 15 bp, Homo sapiens
gtatccctactgtaa

SEQ ID NO: 2660007 - DNA, 13 bp, Homo sapiens
gtatcctccaggt

SEQ ID NO: 2660008 - DNA, 14 bp, Homo sapiens
gtatcctccaggtt

SEQ ID NO: 2660009 - DNA, 14 bp, Homo sapiens
gtatcggagacagt

SEQ ID NO: 2660010 - DNA, 15 bp, Homo sapiens
gtatcgtatagctgt

SEQ ID NO: 2660011 - DNA, 14 bp, Homo sapiens
gtatctagcaatca

SEQ ID NO: 2660012 - DNA, 24 bp, Homo sapiens
gtatctagcaatcacaacactggc

SEQ ID NO: 2660013 - DNA, 15 bp, Homo sapiens
gtatctagtgcagct

SEQ ID NO: 2660014 - DNA, 18 bp, Homo sapiens
gtatctagtgcagctgat

SEQ ID NO: 2660015 - DNA, 13 bp, Homo sapiens
gtatctccaggat

SEQ ID NO: 2660016 - DNA, 12 bp, Homo sapiens
gtatctggtgac

SEQ ID NO: 2660017 - DNA, 16 bp, Homo sapiens
gtatctgtatctctct

SEQ ID NO: 2660018 - DNA, 23 bp, Homo sapiens
gtatcttgtttttccactactgc

SEQ ID NO: 2660019 - DNA, 12 bp, Homo sapiens
gtatgagctgag

SEQ ID NO: 2660020 - DNA, 20 bp, Homo sapiens
gtatgagtcaatgtgcagtg

SEQ ID NO: 2660021 - DNA, 13 bp, Homo sapiens
gtatgatgtgttg

SEQ ID NO: 2660022 - DNA, 16 bp, Homo sapiens
gtatgcatgtgaagaa

SEQ ID NO: 2660023 - DNA, 16 bp, Homo sapiens
gtatgctttgaatgta

SEQ ID NO: 2660024 - DNA, 13 bp, Homo sapiens
gtatggaaataaa

SEQ ID NO: 2660025 - DNA, 18 bp, Homo sapiens
gtatggagctcagagagg

SEQ ID NO: 2660026 - DNA, 15 bp, Homo sapiens
gtatgggtgtgtgtt

SEQ ID NO: 2660027 - DNA, 14 bp, Homo sapiens
gtatgtcatttcct

SEQ ID NO: 2660028 - DNA, 17 bp, Homo sapiens
gtatgtcatttccttca

SEQ ID NO: 2660029 - DNA, 13 bp, Homo sapiens
gtatgtgtgtaga

SEQ ID NO: 2660030 - DNA, 16 bp, Homo sapiens
gtatgtgtgtgtatgc

SEQ ID NO: 2660031 - DNA, 18 bp, Homo sapiens
gtatgttgtccaattgtt

SEQ ID NO: 2660032 - DNA, 16 bp, Homo sapiens
gtatgttttagcatgt

SEQ ID NO: 2660033 - DNA, 19 bp, Homo sapiens
gtatgtttttgtgtatttg

SEQ ID NO: 2660034 - DNA, 23 bp, Homo sapiens
gtatgtttttgtgtatttgttaa

SEQ ID NO: 2660035 - DNA, 22 bp, Homo sapiens
gtattaagttgttaataaaagt

SEQ ID NO: 2660036 - DNA, 22 bp, Homo sapiens
gtattacactgtatttgtatct

SEQ ID NO: 2660037 - DNA, 12 bp, Homo sapiens
gtattataaatt

SEQ ID NO: 2660038 - DNA, 18 bp, Homo sapiens
gtattataaattatgttt

SEQ ID NO: 2660039 - DNA, 19 bp, Homo sapiens
gtattataaattatgttta

SEQ ID NO: 2660040 - DNA, 20 bp, Homo sapiens
gtattataaattatgtttat

SEQ ID NO: 2660041 - DNA, 14 bp, Homo sapiens
gtattatacctttt

SEQ ID NO: 2660042 - DNA, 18 bp, Homo sapiens
gtattccttaaataaact

SEQ ID NO: 2660043 - DNA, 18 bp, Homo sapiens
gtattctctcctgtacct

SEQ ID NO: 2660044 - DNA, 21 bp, Homo sapiens
gtattctctcctgtacctctt

SEQ ID NO: 2660045 - DNA, 13 bp, Homo sapiens
gtattctctgagc

SEQ ID NO: 2660046 - DNA, 15 bp, Homo sapiens
gtattcttatttaat

SEQ ID NO: 2660047 - DNA, 11 bp, Homo sapiens
gtattctttga

SEQ ID NO: 2660048 - DNA, 14 bp, Homo sapiens
gtattctttgatgt

SEQ ID NO: 2660049 - DNA, 16 bp, Homo sapiens
gtattctttgatgtta

SEQ ID NO: 2660050 - DNA, 9 bp, Homo sapiens
gtatttaac

SEQ ID NO: 2660051 - DNA, 13 bp, Homo sapiens
gtatttaattttg

SEQ ID NO: 2660052 - DNA, 16 bp, Homo sapiens
gtatttaattttgaca

SEQ ID NO: 2660053 - DNA, 13 bp, Homo sapiens
gtatttataaata

SEQ ID NO: 2660054 - DNA, 12 bp, Homo sapiens
gtatttatatat

SEQ ID NO: 2660055 - DNA, 13 bp, Homo sapiens
gtatttatcttta

SEQ ID NO: 2660056 - DNA, 13 bp, Homo sapiens
gtatttattccat

SEQ ID NO: 2660057 - DNA, 19 bp, Homo sapiens
gtatttattttcctcccca

SEQ ID NO: 2660058 - DNA, 11 bp, Homo sapiens
gtatttgtgac

SEQ ID NO: 2660059 - DNA, 18 bp, Homo sapiens
gtatttgtgactaattgt

SEQ ID NO: 2660060 - DNA, 13 bp, Homo sapiens
gtattttaatcac

SEQ ID NO: 2660061 - DNA, 14 bp, Homo sapiens
gtattttactaata

SEQ ID NO: 2660062 - DNA, 16 bp, Homo sapiens
gtattttcctgtaaaa

SEQ ID NO: 2660063 - DNA, 15 bp, Homo sapiens
gtatttttttactaa

SEQ ID NO: 2660064 - DNA, 23 bp, Homo sapiens
gtatttttttatcttgggactgg

SEQ ID NO: 2660065 - DNA, 20 bp, Homo sapiens
gtcaaacaaactctctgaac

SEQ ID NO: 2660066 - DNA, 16 bp, Homo sapiens
gtcaaacaaagccaga

SEQ ID NO: 2660067 - DNA, 15 bp, Homo sapiens
gtcaacctcctggac

SEQ ID NO: 2660068 - DNA, 19 bp, Homo sapiens
gtcaacctgggcaaagcct

SEQ ID NO: 2660069 - DNA, 12 bp, Homo sapiens
gtcaacttctgg

SEQ ID NO: 2660070 - DNA, 17 bp, Homo sapiens
gtcaacttctggctcct

SEQ ID NO: 2660071 - DNA, 11 bp, Homo sapiens
gtcaagcactc

SEQ ID NO: 2660072 - DNA, 14 bp, Homo sapiens
gtcaagtaagaaga

SEQ ID NO: 2660073 - DNA, 14 bp, Homo sapiens
gtcaagtctctgct

SEQ ID NO: 2660074 - DNA, 18 bp, Homo sapiens
gtcaagtgaaaaaggagg

SEQ ID NO: 2660075 - DNA, 19 bp, Homo sapiens
gtcaatacagtacaggcag

SEQ ID NO: 2660076 - DNA, 20 bp, Homo sapiens
gtcaatacagtacaggcagc

SEQ ID NO: 2660077 - DNA, 18 bp, Homo sapiens
gtcaatattaaatacaga

SEQ ID NO: 2660078 - DNA, 22 bp, Homo sapiens
gtcaatattaaatacagacact

SEQ ID NO: 2660079 - DNA, 23 bp, Homo sapiens
gtcaatattaaatacagacacta

SEQ ID NO: 2660080 - DNA, 22 bp, Homo sapiens
gtcaatccaagagtctgatgat

SEQ ID NO: 2660081 - DNA, 15 bp, Homo sapiens
gtcaatcctgtgggt

SEQ ID NO: 2660082 - DNA, 16 bp, Homo sapiens
gtcaatcctgtgggtg

SEQ ID NO: 2660083 - DNA, 15 bp, Homo sapiens
gtcaatgcagccccc

SEQ ID NO: 2660084 - DNA, 22 bp, Homo sapiens
gtcaatttccctgactcctcta

SEQ ID NO: 2660085 - DNA, 21 bp, Homo sapiens
gtcacacagtattacttctgc

SEQ ID NO: 2660086 - DNA, 22 bp, Homo sapiens
gtcacacagtattacttctgct

SEQ ID NO: 2660087 - DNA, 13 bp, Homo sapiens
gtcacaccagcca

SEQ ID NO: 2660088 - DNA, 14 bp, Homo sapiens
gtcacagcctcctc

SEQ ID NO: 2660089 - DNA, 13 bp, Homo sapiens
gtcacaggaagta

SEQ ID NO: 2660090 - DNA, 12 bp, Homo sapiens
gtcacaggcagg

SEQ ID NO: 2660091 - DNA, 15 bp, Homo sapiens
gtcacaggcaggtcc

SEQ ID NO: 2660092 - DNA, 16 bp, Homo sapiens
gtcacaggcaggtcca

SEQ ID NO: 2660093 - DNA, 18 bp, Homo sapiens
gtcacagggcctggggag

SEQ ID NO: 2660094 - DNA, 14 bp, Homo sapiens
gtcacatacaatta

SEQ ID NO: 2660095 - DNA, 15 bp, Homo sapiens
gtcacatcacaggac

SEQ ID NO: 2660096 - DNA, 13 bp, Homo sapiens
gtcacatgaaaca

SEQ ID NO: 2660097 - DNA, 21 bp, Homo sapiens
gtcacatggcctatgcacata

SEQ ID NO: 2660098 - DNA, 23 bp, Homo sapiens
gtcacatggcctatgcacatatg

SEQ ID NO: 2660099 - DNA, 22 bp, Homo sapiens
gtcaccaaatcagctgctacta

SEQ ID NO: 2660100 - DNA, 15 bp, Homo sapiens
gtcaccaagcccagt

SEQ ID NO: 2660101 - DNA, 13 bp, Homo sapiens
gtcaccacctctc

SEQ ID NO: 2660102 - DNA, 17 bp, Homo sapiens
gtcaccatctcaggcca

SEQ ID NO: 2660103 - DNA, 21 bp, Homo sapiens
gtcaccatctcaggccacctg

SEQ ID NO: 2660104 - DNA, 18 bp, Homo sapiens
gtcaccccggccacctgc

SEQ ID NO: 2660105 - DNA, 15 bp, Homo sapiens
gtcacccctccagga

SEQ ID NO: 2660106 - DNA, 17 bp, Homo sapiens
gtcaccggatcctgggt

SEQ ID NO: 2660107 - DNA, 20 bp, Homo sapiens
gtcaccgtggaccttcctgc

SEQ ID NO: 2660108 - DNA, 14 bp, Homo sapiens
gtcactactcacag

SEQ ID NO: 2660109 - DNA, 12 bp, Homo sapiens
gtcactcctggg

SEQ ID NO: 2660110 - DNA, 13 bp, Homo sapiens
gtcactcctgggg

SEQ ID NO: 2660111 - DNA, 17 bp, Homo sapiens
gtcactctggcagctca

SEQ ID NO: 2660112 - DNA, 17 bp, Homo sapiens
gtcactgagacagcccg

SEQ ID NO: 2660113 - DNA, 20 bp, Homo sapiens
gtcactgcctctccctggcc

SEQ ID NO: 2660114 - DNA, 12 bp, Homo sapiens
gtcactgctgtc

SEQ ID NO: 2660115 - DNA, 19 bp, Homo sapiens
gtcactggaccactgggca

SEQ ID NO: 2660116 - DNA, 14 bp, Homo sapiens
gtcactggctctcc

SEQ ID NO: 2660117 - DNA, 16 bp, Homo sapiens
gtcactggctctccaa

SEQ ID NO: 2660118 - DNA, 21 bp, Homo sapiens
gtcactggtagaccaaaataa

SEQ ID NO: 2660119 - DNA, 17 bp, Homo sapiens
gtcactgtccctcaaat

SEQ ID NO: 2660120 - DNA, 14 bp, Homo sapiens
gtcactgtggtcct

SEQ ID NO: 2660121 - DNA, 15 bp, Homo sapiens
gtcactgtttctctg

SEQ ID NO: 2660122 - DNA, 16 bp, Homo sapiens
gtcactgtttctctgc

SEQ ID NO: 2660123 - DNA, 18 bp, Homo sapiens
gtcacttactgtttctgt

SEQ ID NO: 2660124 - DNA, 17 bp, Homo sapiens
gtcagacgcctgaggaa

SEQ ID NO: 2660125 - DNA, 14 bp, Homo sapiens
gtcagactgctggg

SEQ ID NO: 2660126 - DNA, 18 bp, Homo sapiens
gtcagactggctggctgc

SEQ ID NO: 2660127 - DNA, 14 bp, Homo sapiens
gtcagagcctgcag

SEQ ID NO: 2660128 - DNA, 20 bp, Homo sapiens
gtcagaggatggccagtgtc

SEQ ID NO: 2660129 - DNA, 21 bp, Homo sapiens
gtcagaggatggccagtgtct

SEQ ID NO: 2660130 - DNA, 15 bp, Homo sapiens
gtcagatacaatgta

SEQ ID NO: 2660131 - DNA, 13 bp, Homo sapiens
gtcagccctaggg

SEQ ID NO: 2660132 - DNA, 16 bp, Homo sapiens
gtcagccgagccgggc

SEQ ID NO: 2660133 - DNA, 20 bp, Homo sapiens
gtcagccgagccgggcctgg

SEQ ID NO: 2660134 - DNA, 15 bp, Homo sapiens
gtcagccgggccctg

SEQ ID NO: 2660135 - DNA, 17 bp, Homo sapiens
gtgagacccccacacct

SEQ ID NO: 2660136 - DNA, 22 bp, Homo sapiens
gtgagaccctgtctcaaaaaaa

SEQ ID NO: 2660137 - DNA, 16 bp, Homo sapiens
gtgagactctgtctca

SEQ ID NO: 2660138 - DNA, 15 bp, Homo sapiens
gtgagatgcagctgg

SEQ ID NO: 2660139 - DNA, 21 bp, Homo sapiens
gtgagcaagaagtcaaagtaa

SEQ ID NO: 2660140 - DNA, 17 bp, Homo sapiens
gtgagcccatggccctc

SEQ ID NO: 2660141 - DNA, 17 bp, Homo sapiens
gtgagcccctggtcctg

SEQ ID NO: 2660142 - DNA, 11 bp, Homo sapiens
gtgaggaagcc

SEQ ID NO: 2660143 - DNA, 16 bp, Homo sapiens
gtgaggaagccgctgg

SEQ ID NO: 2660144 - DNA, 19 bp, Homo sapiens
gtgaggaagccgctggggc

SEQ ID NO: 2660145 - DNA, 18 bp, Homo sapiens
gtgaggagctgctggctt

SEQ ID NO: 2660146 - DNA, 21 bp, Homo sapiens
gtgaggatggcctctgctaag

SEQ ID NO: 2660147 - DNA, 17 bp, Homo sapiens
gtgaggatgggaaggag

SEQ ID NO: 2660148 - DNA, 19 bp, Homo sapiens
gtgaggatgggaaggaggg

SEQ ID NO: 2660149 - DNA, 18 bp, Homo sapiens
gtgaggatgtcactcaga

SEQ ID NO: 2660150 - DNA, 15 bp, Homo sapiens
gtgaggatgtctggg

SEQ ID NO: 2660151 - DNA, 15 bp, Homo sapiens
gtgaggcaggctttg

SEQ ID NO: 2660152 - DNA, 13 bp, Homo sapiens
gtgaggcccctgg

SEQ ID NO: 2660153 - DNA, 11 bp, Homo sapiens
gtgaggcctgg

SEQ ID NO: 2660154 - DNA, 13 bp, Homo sapiens
gtgaggcctggcc

SEQ ID NO: 2660155 - DNA, 16 bp, Homo sapiens
gtgaggcctggccagg

SEQ ID NO: 2660156 - DNA, 13 bp, Homo sapiens
gtgaggccttgct

SEQ ID NO: 2660157 - DNA, 12 bp, Homo sapiens
gtgaggctctgc

SEQ ID NO: 2660158 - DNA, 13 bp, Homo sapiens
gtgaggctctgcc

SEQ ID NO: 2660159 - DNA, 14 bp, Homo sapiens
gtgaggctctgccc

SEQ ID NO: 2660160 - DNA, 15 bp, Homo sapiens
gtgaggctctgccct

SEQ ID NO: 2660161 - DNA, 17 bp, Homo sapiens
gtgaggctctgcccttg

SEQ ID NO: 2660162 - DNA, 14 bp, Homo sapiens
gtgaggtgcccagc

SEQ ID NO: 2660163 - DNA, 16 bp, Homo sapiens
gtgagtaagagctggt

SEQ ID NO: 2660164 - DNA, 16 bp, Homo sapiens
gtgagtgtggctcccc

SEQ ID NO: 2660165 - DNA, 23 bp, Homo sapiens
gtgagtgtgtccaagtgtgtgtg

SEQ ID NO: 2660166 - DNA, 17 bp, Homo sapiens
gtgagttacagcgagag

SEQ ID NO: 2660167 - DNA, 20 bp, Homo sapiens
gtgatacccatagcttccat

SEQ ID NO: 2660168 - DNA, 17 bp, Homo sapiens
gtgatcaataaaatgtg

SEQ ID NO: 2660169 - DNA, 18 bp, Homo sapiens
gtgatcaataaaatgtga

SEQ ID NO: 2660170 - DNA, 19 bp, Homo sapiens
gtgatcaataaaatgtgat

SEQ ID NO: 2660171 - DNA, 20 bp, Homo sapiens
gtgatccacccacctcagcc

SEQ ID NO: 2660172 - DNA, 23 bp, Homo sapiens
gtgatccacccacctcagcctcc

SEQ ID NO: 2660173 - DNA, 14 bp, Homo sapiens
gtgatcctcccacc

SEQ ID NO: 2660174 - DNA, 22 bp, Homo sapiens
gtgatcctcccacctcagcctc

SEQ ID NO: 2660175 - DNA, 14 bp, Homo sapiens
gtgatccttttatg

SEQ ID NO: 2660176 - DNA, 14 bp, Homo sapiens
gtgatctcatttaa

SEQ ID NO: 2660177 - DNA, 18 bp, Homo sapiens
gtgatgccaggttctatt

SEQ ID NO: 2660178 - DNA, 19 bp, Homo sapiens
gtgatggggccctgcctcc

SEQ ID NO: 2660179 - DNA, 14 bp, Homo sapiens
gtgatgtcatctgt

SEQ ID NO: 2660180 - DNA, 10 bp, Homo sapiens
gtgatgtgtc

SEQ ID NO: 2660181 - DNA, 17 bp, Homo sapiens
gtgattaccagggactg

SEQ ID NO: 2660182 - DNA, 22 bp, Homo sapiens
gtgattagagggaggagaatga

SEQ ID NO: 2660183 - DNA, 16 bp, Homo sapiens
gtgattatttcacttt

SEQ ID NO: 2660184 - DNA, 16 bp, Homo sapiens
gtgattcaatctgtaa

SEQ ID NO: 2660185 - DNA, 23 bp, Homo sapiens
gtgattcaatctgtaaactgtgt

SEQ ID NO: 2660186 - DNA, 22 bp, Homo sapiens
gtgattcaattcaacactccct

SEQ ID NO: 2660187 - DNA, 20 bp, Homo sapiens
gtgattcacagtgtgaatct

SEQ ID NO: 2660188 - DNA, 17 bp, Homo sapiens
gtgattctcctgcctca

SEQ ID NO: 2660189 - DNA, 19 bp, Homo sapiens
gtgatttaagacacttttt

SEQ ID NO: 2660190 - DNA, 13 bp, Homo sapiens
gtgatttgactgt

SEQ ID NO: 2660191 - DNA, 22 bp, Homo sapiens
gtgatttgactgtttttaccca

SEQ ID NO: 2660192 - DNA, 16 bp, Homo sapiens
gtgattttaactctgt

SEQ ID NO: 2660193 - DNA, 17 bp, Homo sapiens
gtgattttaactctgtc

SEQ ID NO: 2660194 - DNA, 18 bp, Homo sapiens
gtgattttaactctgtct

SEQ ID NO: 2660195 - DNA, 19 bp, Homo sapiens
gtgattttaactctgtctt

SEQ ID NO: 2660196 - DNA, 16 bp, Homo sapiens
gtgattttgctgtaga

SEQ ID NO: 2660197 - DNA, 13 bp, Homo sapiens
gtgatttttgtaa

SEQ ID NO: 2660198 - DNA, 14 bp, Homo sapiens
gtgatttttttctt

SEQ ID NO: 2660199 - DNA, 21 bp, Homo sapiens
gtgcaaaaagctgagtatggt

SEQ ID NO: 2660200 - DNA, 20 bp, Homo sapiens
gtgcaaaacagcgtttaaga

SEQ ID NO: 2660201 - DNA, 22 bp, Homo sapiens
gtgcaaagttccctacttcctg

SEQ ID NO: 2660202 - DNA, 15 bp, Homo sapiens
gtgcaacagcactgg

SEQ ID NO: 2660203 - DNA, 23 bp, Homo sapiens
gtgcaacagcactggctctctcc

SEQ ID NO: 2660204 - DNA, 19 bp, Homo sapiens
gtgcaagagactctggcct

SEQ ID NO: 2660205 - DNA, 20 bp, Homo sapiens
gtgcaagtatgtgagtgtgt

SEQ ID NO: 2660206 - DNA, 15 bp, Homo sapiens
gtgcaagtgtgtgca

SEQ ID NO: 2660207 - DNA, 20 bp, Homo sapiens
gtgcacaaatatttattttc

SEQ ID NO: 2660208 - DNA, 16 bp, Homo sapiens
gtgcacaagctccaag

SEQ ID NO: 2660209 - DNA, 17 bp, Homo sapiens
gtgcacacaccagagcc

SEQ ID NO: 2660210 - DNA, 21 bp, Homo sapiens
gtgcacacaccagagcccacc

SEQ ID NO: 2660211 - DNA, 13 bp, Homo sapiens
gtgcacagtgatt

SEQ ID NO: 2660212 - DNA, 19 bp, Homo sapiens
gtgcacccatgggctctga

SEQ ID NO: 2660213 - DNA, 18 bp, Homo sapiens
gtgcacgtacacacacat

SEQ ID NO: 2660214 - DNA, 13 bp, Homo sapiens
gtgcactgtcact

SEQ ID NO: 2660215 - DNA, 17 bp, Homo sapiens
gtgcagcatatgaggat

SEQ ID NO: 2660216 - DNA, 22 bp, Homo sapiens
gtgcagccccgcctccaggcca

SEQ ID NO: 2660217 - DNA, 19 bp, Homo sapiens
gtgcagcccgtgtggcccc

SEQ ID NO: 2660218 - DNA, 20 bp, Homo sapiens
gtgcagcccgtgtggcccct

SEQ ID NO: 2660219 - DNA, 21 bp, Homo sapiens
gtgcagcccgtgtggcccctt

SEQ ID NO: 2660220 - DNA, 14 bp, Homo sapiens
gtgcagctgatttt

SEQ ID NO: 2660221 - DNA, 15 bp, Homo sapiens
gtgcagcttctgtcc

SEQ ID NO: 2660222 - DNA, 23 bp, Homo sapiens
gtgcagggaggaggtggcagccc

SEQ ID NO: 2660223 - DNA, 19 bp, Homo sapiens
gtgcagtggcccccacaga

SEQ ID NO: 2660224 - DNA, 19 bp, Homo sapiens
gtgcagttgacagcaggtg

SEQ ID NO: 2660225 - DNA, 21 bp, Homo sapiens
gtgcataccacttttgttctt

SEQ ID NO: 2660226 - DNA, 22 bp, Homo sapiens
gtgcataccacttttgttcttg

SEQ ID NO: 2660227 - DNA, 13 bp, Homo sapiens
gtgcatattgtac

SEQ ID NO: 2660228 - DNA, 18 bp, Homo sapiens
gtgcatgcagcatctaag

SEQ ID NO: 2660229 - DNA, 13 bp, Homo sapiens
gtgcatgggtgaa

SEQ ID NO: 2660230 - DNA, 23 bp, Homo sapiens
gtgcattacagagaggagaaaca

SEQ ID NO: 2660231 - DNA, 20 bp, Homo sapiens
gtgcatttgaggtctgttct

SEQ ID NO: 2660232 - DNA, 22 bp, Homo sapiens
gtgcatttgaggtctgttcttt

SEQ ID NO: 2660233 - DNA, 13 bp, Homo sapiens
gtgccaacactca

SEQ ID NO: 2660234 - DNA, 22 bp, Homo sapiens
gtgccaatggaacctcctttct

SEQ ID NO: 2660235 - DNA, 23 bp, Homo sapiens
gtgccactgcccgagctggtgca

SEQ ID NO: 2660236 - DNA, 14 bp, Homo sapiens
gtgccagaggtggg

SEQ ID NO: 2660237 - DNA, 16 bp, Homo sapiens
gtgccagaggtgggca

SEQ ID NO: 2660238 - DNA, 17 bp, Homo sapiens
gtgccagaggtgggcag

SEQ ID NO: 2660239 - DNA, 20 bp, Homo sapiens
gtgccagaggtgggcaggtg

SEQ ID NO: 2660240 - DNA, 21 bp, Homo sapiens
gtgccagcaactgaataaata

SEQ ID NO: 2660241 - DNA, 13 bp, Homo sapiens
gtgccaggaccag

SEQ ID NO: 2660242 - DNA, 21 bp, Homo sapiens
gtgccaggactccccaggcca

SEQ ID NO: 2660243 - DNA, 17 bp, Homo sapiens
gtgccatagtcacatgg

SEQ ID NO: 2660244 - DNA, 16 bp, Homo sapiens
gtgccatgtgccaggt

SEQ ID NO: 2660245 - DNA, 20 bp, Homo sapiens
gtgcccacaggatcagtctg

SEQ ID NO: 2660246 - DNA, 19 bp, Homo sapiens
gtgcccaggggcccacagg

SEQ ID NO: 2660247 - DNA, 17 bp, Homo sapiens
gtgcccatccctggaag

SEQ ID NO: 2660248 - DNA, 16 bp, Homo sapiens
gtgccccatgcctgtc

SEQ ID NO: 2660249 - DNA, 18 bp, Homo sapiens
gtgccccatgcctgtcca

SEQ ID NO: 2660250 - DNA, 14 bp, Homo sapiens
gtgccccctctacc

SEQ ID NO: 2660251 - DNA, 13 bp, Homo sapiens
gtgcccctagctt

SEQ ID NO: 2660252 - DNA, 13 bp, Homo sapiens
gtgcccctgctgc

SEQ ID NO: 2660253 - DNA, 20 bp, Homo sapiens
gtgcccctgctgcctcccca

SEQ ID NO: 2660254 - DNA, 16 bp, Homo sapiens
gtgcccttggaggcca

SEQ ID NO: 2660255 - DNA, 15 bp, Homo sapiens
gtgccgacagaagga

SEQ ID NO: 2660256 - DNA, 23 bp, Homo sapiens
gtgccgcctgcccgtctctctcc

SEQ ID NO: 2660257 - DNA, 14 bp, Homo sapiens
gtgcctcattgctt

SEQ ID NO: 2660258 - DNA, 15 bp, Homo sapiens
gtgcctccaccacca

SEQ ID NO: 2660259 - DNA, 17 bp, Homo sapiens
gtgcctccaccaccact

SEQ ID NO: 2660260 - DNA, 18 bp, Homo sapiens
gtgcctccttccacctcc

SEQ ID NO: 2660261 - DNA, 13 bp, Homo sapiens
gtgcctctgcctg

SEQ ID NO: 2660262 - DNA, 12 bp, Homo sapiens
gtgcctctggga

SEQ ID NO: 2660263 - DNA, 22 bp, Homo sapiens
gtgcctggacatttgccttgct

SEQ ID NO: 2660264 - DNA, 15 bp, Homo sapiens
gtgcctggcctggca

SEQ ID NO: 2660265 - DNA, 19 bp, Homo sapiens
gtgcctggcctggcacaca

SEQ ID NO: 2660266 - DNA, 12 bp, Homo sapiens
gtgcctggctca

SEQ ID NO: 2660267 - DNA, 20 bp, Homo sapiens
gtgcctggctcagagccagt

SEQ ID NO: 2660268 - DNA, 17 bp, Homo sapiens
gtgcctgggaatgtatt

SEQ ID NO: 2660269 - DNA, 20 bp, Homo sapiens
gtgcctgtcccacccccacc

SEQ ID NO: 2660270 - DNA, 20 bp, Homo sapiens
gtgcctgtctgttacactgg

SEQ ID NO: 2660271 - DNA, 12 bp, Homo sapiens
gtgccttccaac

SEQ ID NO: 2660272 - DNA, 12 bp, Homo sapiens
gtgccttccata

SEQ ID NO: 2660273 - DNA, 23 bp, Homo sapiens
gtgccttcctgtttttcacattt

SEQ ID NO: 2660274 - DNA, 20 bp, Homo sapiens
gtgccttcgcggtggaaggc

SEQ ID NO: 2660275 - DNA, 14 bp, Homo sapiens
gtgccttttatagc

SEQ ID NO: 2660276 - DNA, 18 bp, Homo sapiens
gtgccttttatagctatt

SEQ ID NO: 2660277 - DNA, 16 bp, Homo sapiens
gtgccttttgcacccc

SEQ ID NO: 2660278 - DNA, 21 bp, Homo sapiens
gtgccttttgcacccctccca

SEQ ID NO: 2660279 - DNA, 15 bp, Homo sapiens
gtgcgattctggata

SEQ ID NO: 2660280 - DNA, 16 bp, Homo sapiens
gttcatgccaccatgg

SEQ ID NO: 2660281 - DNA, 14 bp, Homo sapiens
gttcatgtttgctt

SEQ ID NO: 2660282 - DNA, 24 bp, Homo sapiens
gttcatgtttgcttcataaatgaa

SEQ ID NO: 2660283 - DNA, 14 bp, Homo sapiens
gttcattgtaatgt

SEQ ID NO: 2660284 - DNA, 23 bp, Homo sapiens
gttcattgtaatgttactgatca

SEQ ID NO: 2660285 - DNA, 17 bp, Homo sapiens
gttccaagacattgtca

SEQ ID NO: 2660286 - DNA, 21 bp, Homo sapiens
gttccaagacattgtcaataa

SEQ ID NO: 2660287 - DNA, 20 bp, Homo sapiens
gttccaccatcaagccacca

SEQ ID NO: 2660288 - DNA, 16 bp, Homo sapiens
gttccacgtgttttat

SEQ ID NO: 2660289 - DNA, 13 bp, Homo sapiens
gttccactgagct

SEQ ID NO: 2660290 - DNA, 14 bp, Homo sapiens
gttccactgagctc

SEQ ID NO: 2660291 - DNA, 15 bp, Homo sapiens
gttccactgagctcc

SEQ ID NO: 2660292 - DNA, 16 bp, Homo sapiens
gttccactgagctcca

SEQ ID NO: 2660293 - DNA, 15 bp, Homo sapiens
gttccatgcctgagg

SEQ ID NO: 2660294 - DNA, 17 bp, Homo sapiens
gttccatgcctgagggt

SEQ ID NO: 2660295 - DNA, 20 bp, Homo sapiens
gttccatggcctcttcagat

SEQ ID NO: 2660296 - DNA, 19 bp, Homo sapiens
gttccattgtttggagaca

SEQ ID NO: 2660297 - DNA, 14 bp, Homo sapiens
gttcccacttggag

SEQ ID NO: 2660298 - DNA, 15 bp, Homo sapiens
gttcccagaatcaaa

SEQ ID NO: 2660299 - DNA, 16 bp, Homo sapiens
gttcccatttcagctg

SEQ ID NO: 2660300 - DNA, 14 bp, Homo sapiens
gttccccatgcaga

SEQ ID NO: 2660301 - DNA, 15 bp, Homo sapiens
gttcccccagccctg

SEQ ID NO: 2660302 - DNA, 19 bp, Homo sapiens
gttcccgtttctccaccta

SEQ ID NO: 2660303 - DNA, 20 bp, Homo sapiens
gttccctacttcctgtgact

SEQ ID NO: 2660304 - DNA, 16 bp, Homo sapiens
gttccctctgctcctg

SEQ ID NO: 2660305 - DNA, 13 bp, Homo sapiens
gttcccttggcct

SEQ ID NO: 2660306 - DNA, 14 bp, Homo sapiens
gttcccttggcctc

SEQ ID NO: 2660307 - DNA, 15 bp, Homo sapiens
gttcccttggcctca

SEQ ID NO: 2660308 - DNA, 19 bp, Homo sapiens
gttccctttccttccatcc

SEQ ID NO: 2660309 - DNA, 22 bp, Homo sapiens
gttccctttccttccatcccta

SEQ ID NO: 2660310 - DNA, 22 bp, Homo sapiens
gttccctttgacgccatcccag

SEQ ID NO: 2660311 - DNA, 19 bp, Homo sapiens
gttccggattggcttgtgt

SEQ ID NO: 2660312 - DNA, 14 bp, Homo sapiens
gttcctattgtcat

SEQ ID NO: 2660313 - DNA, 12 bp, Homo sapiens
gttcctggcaat

SEQ ID NO: 2660314 - DNA, 13 bp, Homo sapiens
gttccttagacct

SEQ ID NO: 2660315 - DNA, 22 bp, Homo sapiens
gttcgacgagacggtcgagcag

SEQ ID NO: 2660316 - DNA, 17 bp, Homo sapiens
gttcgagaccagcctgg

SEQ ID NO: 2660317 - DNA, 18 bp, Homo sapiens
gttcgagaccagcctggc

SEQ ID NO: 2660318 - DNA, 13 bp, Homo sapiens
gttcgtagctttc

SEQ ID NO: 2660319 - DNA, 17 bp, Homo sapiens
gttcgtggaaagggtgc

SEQ ID NO: 2660320 - DNA, 17 bp, Homo sapiens
gttctaaagatggaaaa

SEQ ID NO: 2660321 - DNA, 23 bp, Homo sapiens
gttctaaagatggaaaaaccacc

SEQ ID NO: 2660322 - DNA, 16 bp, Homo sapiens
gttctacactcatctt

SEQ ID NO: 2660323 - DNA, 16 bp, Homo sapiens
gttctacccaggtgct

SEQ ID NO: 2660324 - DNA, 21 bp, Homo sapiens
gttctagtctcctttgcactg

SEQ ID NO: 2660325 - DNA, 14 bp, Homo sapiens
gttctagtctctct

SEQ ID NO: 2660326 - DNA, 16 bp, Homo sapiens
gttctcacacccaccg

SEQ ID NO: 2660327 - DNA, 13 bp, Homo sapiens
gttctcagggctc

SEQ ID NO: 2660328 - DNA, 14 bp, Homo sapiens
gttctcagggctcc

SEQ ID NO: 2660329 - DNA, 16 bp, Homo sapiens
gttctctcctccccaa

SEQ ID NO: 2660330 - DNA, 12 bp, Homo sapiens
gttctctgccct

SEQ ID NO: 2660331 - DNA, 13 bp, Homo sapiens
gttctctgccctc

SEQ ID NO: 2660332 - DNA, 15 bp, Homo sapiens
gttctctgccctcca

SEQ ID NO: 2660333 - DNA, 18 bp, Homo sapiens
gttctctgccctccaaga

SEQ ID NO: 2660334 - DNA, 20 bp, Homo sapiens
gttctgaatatgctgctcat

SEQ ID NO: 2660335 - DNA, 16 bp, Homo sapiens
gttctgacattaacag

SEQ ID NO: 2660336 - DNA, 14 bp, Homo sapiens
gttctgagtgtttt

SEQ ID NO: 2660337 - DNA, 19 bp, Homo sapiens
gttctgatcctagttccac

SEQ ID NO: 2660338 - DNA, 13 bp, Homo sapiens
gttctgattagaa

SEQ ID NO: 2660339 - DNA, 23 bp, Homo sapiens
gttctgctcatcattctctgtct

SEQ ID NO: 2660340 - DNA, 14 bp, Homo sapiens
gttctgctcctctc

SEQ ID NO: 2660341 - DNA, 22 bp, Homo sapiens
gttctgctcctctccaggcacc

SEQ ID NO: 2660342 - DNA, 14 bp, Homo sapiens
gttctgctggcctg

SEQ ID NO: 2660343 - DNA, 15 bp, Homo sapiens
gttctggccctcacc

SEQ ID NO: 2660344 - DNA, 12 bp, Homo sapiens
gttctggctctt

SEQ ID NO: 2660345 - DNA, 12 bp, Homo sapiens
gttctgggacac

SEQ ID NO: 2660346 - DNA, 14 bp, Homo sapiens
gttctgggacacag

SEQ ID NO: 2660347 - DNA, 15 bp, Homo sapiens
gttctgggacacagt

SEQ ID NO: 2660348 - DNA, 15 bp, Homo sapiens
gttctggtgaggcct

SEQ ID NO: 2660349 - DNA, 18 bp, Homo sapiens
gttctggtgtgaactaaa

SEQ ID NO: 2660350 - DNA, 17 bp, Homo sapiens
gttctgtctcatatgat

SEQ ID NO: 2660351 - DNA, 17 bp, Homo sapiens
gttctgtggaaagtgta

SEQ ID NO: 2660352 - DNA, 19 bp, Homo sapiens
gttctgtggaaagtgtaaa

SEQ ID NO: 2660353 - DNA, 23 bp, Homo sapiens
gttctgtggttttcccctccctg

SEQ ID NO: 2660354 - DNA, 16 bp, Homo sapiens
gttcttaagacgtgat

SEQ ID NO: 2660355 - DNA, 13 bp, Homo sapiens
gttcttaattctt

SEQ ID NO: 2660356 - DNA, 17 bp, Homo sapiens
gttcttaattgcactct

SEQ ID NO: 2660357 - DNA, 22 bp, Homo sapiens
gttcttacctgtatgtctccag

SEQ ID NO: 2660358 - DNA, 14 bp, Homo sapiens
gttcttcatctaag

SEQ ID NO: 2660359 - DNA, 14 bp, Homo sapiens
gttcttcgggaaga

SEQ ID NO: 2660360 - DNA, 15 bp, Homo sapiens
gttcttgaagcagta

SEQ ID NO: 2660361 - DNA, 19 bp, Homo sapiens
gttcttggggccctacacc

SEQ ID NO: 2660362 - DNA, 14 bp, Homo sapiens
gttcttggtttgta

SEQ ID NO: 2660363 - DNA, 15 bp, Homo sapiens
gttcttggtttgtaa

SEQ ID NO: 2660364 - DNA, 18 bp, Homo sapiens
gttcttgtattaagaatg

SEQ ID NO: 2660365 - DNA, 14 bp, Homo sapiens
gttctttaatttat

SEQ ID NO: 2660366 - DNA, 15 bp, Homo sapiens
gttctttaggagatt

SEQ ID NO: 2660367 - DNA, 18 bp, Homo sapiens
gttctttccaaagtacac

SEQ ID NO: 2660368 - DNA, 17 bp, Homo sapiens
gttctttcttcctctgc

SEQ ID NO: 2660369 - DNA, 19 bp, Homo sapiens
gttctttcttcctctgctg

SEQ ID NO: 2660370 - DNA, 13 bp, Homo sapiens
gttcttttaaagg

SEQ ID NO: 2660371 - DNA, 21 bp, Homo sapiens
gttgaactgatagttactgtt

SEQ ID NO: 2660372 - DNA, 15 bp, Homo sapiens
gttgaagaggaaggg

SEQ ID NO: 2660373 - DNA, 22 bp, Homo sapiens
gttgaagctaagatttagagat

SEQ ID NO: 2660374 - DNA, 13 bp, Homo sapiens
gttgaagctctgg

SEQ ID NO: 2660375 - DNA, 19 bp, Homo sapiens
gttgaatgacaacagaagc

SEQ ID NO: 2660376 - DNA, 12 bp, Homo sapiens
gttgacagcagg

SEQ ID NO: 2660377 - DNA, 14 bp, Homo sapiens
gttgaccccagagg

SEQ ID NO: 2660378 - DNA, 20 bp, Homo sapiens
gttgacttattttctctgtg

SEQ ID NO: 2660379 - DNA, 15 bp, Homo sapiens
gttgactttagggac

SEQ ID NO: 2660380 - DNA, 16 bp, Homo sapiens
gttgagccccaagtcc

SEQ ID NO: 2660381 - DNA, 15 bp, Homo sapiens
gttgagcccctggag

SEQ ID NO: 2660382 - DNA, 18 bp, Homo sapiens
gttgaggggctcctggaa

SEQ ID NO: 2660383 - DNA, 23 bp, Homo sapiens
gttgaggtggtctgaatgttctg

SEQ ID NO: 2660384 - DNA, 21 bp, Homo sapiens
gttgagttcaggtagctgccc

SEQ ID NO: 2660385 - DNA, 22 bp, Homo sapiens
gttgatagcaagtgaatttttc

SEQ ID NO: 2660386 - DNA, 20 bp, Homo sapiens
gttgatatttcgaaagctgc

SEQ ID NO: 2660387 - DNA, 23 bp, Homo sapiens
gttgatgatctttgcagacaggc

SEQ ID NO: 2660388 - DNA, 17 bp, Homo sapiens
gttgatgttggctggga

SEQ ID NO: 2660389 - DNA, 13 bp, Homo sapiens
gttgattgctaaa

SEQ ID NO: 2660390 - DNA, 18 bp, Homo sapiens
gttgattgctaaatgtaa

SEQ ID NO: 2660391 - DNA, 18 bp, Homo sapiens
gttgatttctttccagag

SEQ ID NO: 2660392 - DNA, 15 bp, Homo sapiens
gttgcaaactcagcc

SEQ ID NO: 2660393 - DNA, 22 bp, Homo sapiens
gttgcaatagaacagagaaaga

SEQ ID NO: 2660394 - DNA, 13 bp, Homo sapiens
gttgcacccagcc

SEQ ID NO: 2660395 - DNA, 20 bp, Homo sapiens
gttgcacccagccctggtct

SEQ ID NO: 2660396 - DNA, 15 bp, Homo sapiens
gttgcaggacctcag

SEQ ID NO: 2660397 - DNA, 20 bp, Homo sapiens
gttgcatgtcgtgaccaact

SEQ ID NO: 2660398 - DNA, 17 bp, Homo sapiens
gttgccaaacagccaca

SEQ ID NO: 2660399 - DNA, 18 bp, Homo sapiens
gttgcccaggcaggtctt

SEQ ID NO: 2660400 - DNA, 14 bp, Homo sapiens
gttgcccaggctgg

SEQ ID NO: 2660401 - DNA, 16 bp, Homo sapiens
gttgcccaggctggcg

SEQ ID NO: 2660402 - DNA, 18 bp, Homo sapiens
gttgcgtaactggctgtg

SEQ ID NO: 2660403 - DNA, 22 bp, Homo sapiens
gttgctaagaagcgagcactga

SEQ ID NO: 2660404 - DNA, 22 bp, Homo sapiens
gttgctcagtctccctttccct

SEQ ID NO: 2660405 - DNA, 17 bp, Homo sapiens
gttgctggttgctgtgt

SEQ ID NO: 2660406 - DNA, 14 bp, Homo sapiens
gttgctgtgggaac

SEQ ID NO: 2660407 - DNA, 15 bp, Homo sapiens
gttgcttacaatttt

SEQ ID NO: 2660408 - DNA, 20 bp, Homo sapiens
gttggaaaagaatacagaaa

SEQ ID NO: 2660409 - DNA, 22 bp, Homo sapiens
gttggaagctagctcccctcct

SEQ ID NO: 2660410 - DNA, 15 bp, Homo sapiens
gttggacccgctctg

SEQ ID NO: 2660411 - DNA, 14 bp, Homo sapiens
gttggagcctgcag

SEQ ID NO: 2660412 - DNA, 18 bp, Homo sapiens
gttggatttataaatgct

SEQ ID NO: 2660413 - DNA, 15 bp, Homo sapiens
gttggcactcacaga

SEQ ID NO: 2660414 - DNA, 13 bp, Homo sapiens
gttggccaggctg

SEQ ID NO: 2660415 - DNA, 15 bp, Homo sapiens
gttggccaggctggt

SEQ ID NO: 2660416 - DNA, 19 bp, Homo sapiens
gttggccaggctggtctca

SEQ ID NO: 2660417 - DNA, 14 bp, Homo sapiens
gttggccagtgtga

SEQ ID NO: 2660418 - DNA, 13 bp, Homo sapiens
gttggcccctgcc

SEQ ID NO: 2660419 - DNA, 14 bp, Homo sapiens
gttggcccctgccc

SEQ ID NO: 2660420 - DNA, 20 bp, Homo sapiens
gttggctgacttccacacct

SEQ ID NO: 2660421 - DNA, 17 bp, Homo sapiens
gttggctgggcccagaa

SEQ ID NO: 2660422 - DNA, 23 bp, Homo sapiens
gttggctgggggcctcagtgcca

SEQ ID NO: 2660423 - DNA, 21 bp, Homo sapiens
gttgggaatgaggcttgctga

SEQ ID NO: 2660424 - DNA, 14 bp, Homo sapiens
gttgggagaatgtc

SEQ ID NO: 2660425 - DNA, 14 bp, Homo sapiens
gttgggagcactgg

SEQ ID NO: 2660426 - DNA, 15 bp, Homo sapiens
taacaatgttaagga

SEQ ID NO: 2660427 - DNA, 15 bp, Homo sapiens
taacaatttccttta

SEQ ID NO: 2660428 - DNA, 18 bp, Homo sapiens
taacaattttaatgctat

SEQ ID NO: 2660429 - DNA, 17 bp, Homo sapiens
taacacaagccacagaa

SEQ ID NO: 2660430 - DNA, 23 bp, Homo sapiens
taacacaagtcctgtgaatttct

SEQ ID NO: 2660431 - DNA, 13 bp, Homo sapiens
taacacacagcta

SEQ ID NO: 2660432 - DNA, 14 bp, Homo sapiens
taacacacagctcc

SEQ ID NO: 2660433 - DNA, 17 bp, Homo sapiens
taacacagcatgtgtat

SEQ ID NO: 2660434 - DNA, 23 bp, Homo sapiens
taacacattttgtataattgtat

SEQ ID NO: 2660435 - DNA, 17 bp, Homo sapiens
taacacctgatgtgtac

SEQ ID NO: 2660436 - DNA, 13 bp, Homo sapiens
taacactggcccc

SEQ ID NO: 2660437 - DNA, 21 bp, Homo sapiens
taacagaaagggcaacaataa

SEQ ID NO: 2660438 - DNA, 14 bp, Homo sapiens
taacagaaatgtac

SEQ ID NO: 2660439 - DNA, 17 bp, Homo sapiens
taacagaacagcttcag

SEQ ID NO: 2660440 - DNA, 18 bp, Homo sapiens
taacagaacagcttcagg

SEQ ID NO: 2660441 - DNA, 22 bp, Homo sapiens
taacagaacagcttcaggttat

SEQ ID NO: 2660442 - DNA, 12 bp, Homo sapiens
taacagatgcaa

SEQ ID NO: 2660443 - DNA, 12 bp, Homo sapiens
taacagctgtgg

SEQ ID NO: 2660444 - DNA, 22 bp, Homo sapiens
taacaggctcaatattcctgaa

SEQ ID NO: 2660445 - DNA, 14 bp, Homo sapiens
taacaggcttctgg

SEQ ID NO: 2660446 - DNA, 23 bp, Homo sapiens
taacagggtctctagtgctgtga

SEQ ID NO: 2660447 - DNA, 19 bp, Homo sapiens
taacaggtctcctcttaaa

SEQ ID NO: 2660448 - DNA, 16 bp, Homo sapiens
taacaggttattttag

SEQ ID NO: 2660449 - DNA, 23 bp, Homo sapiens
taacaggttattttagtttctgt

SEQ ID NO: 2660450 - DNA, 15 bp, Homo sapiens
taacagtaacgcagg

SEQ ID NO: 2660451 - DNA, 14 bp, Homo sapiens
taacagtcatttaa

SEQ ID NO: 2660452 - DNA, 14 bp, Homo sapiens
taacagttcatgtt

SEQ ID NO: 2660453 - DNA, 13 bp, Homo sapiens
taacagttttcca

SEQ ID NO: 2660454 - DNA, 15 bp, Homo sapiens
taacagttttccatg

SEQ ID NO: 2660455 - DNA, 19 bp, Homo sapiens
taacagttttccatgaaaa

SEQ ID NO: 2660456 - DNA, 20 bp, Homo sapiens
taacagttttccatgaaaac

SEQ ID NO: 2660457 - DNA, 16 bp, Homo sapiens
taacataatttgtaca

SEQ ID NO: 2660458 - DNA, 19 bp, Homo sapiens
taacataatttgtacatat

SEQ ID NO: 2660459 - DNA, 14 bp, Homo sapiens
taacatataatgtt

SEQ ID NO: 2660460 - DNA, 23 bp, Homo sapiens
taacatataatgttgttatttaa

SEQ ID NO: 2660461 - DNA, 18 bp, Homo sapiens
taacatggacatgatctt

SEQ ID NO: 2660462 - DNA, 18 bp, Homo sapiens
taacatggtgtgcttctt

SEQ ID NO: 2660463 - DNA, 16 bp, Homo sapiens
taacatttcaagggca

SEQ ID NO: 2660464 - DNA, 21 bp, Homo sapiens
taacattttaaataaaagaaa

SEQ ID NO: 2660465 - DNA, 20 bp, Homo sapiens
taaccaaaaagaccagacta

SEQ ID NO: 2660466 - DNA, 18 bp, Homo sapiens
taaccacatcaatattgt

SEQ ID NO: 2660467 - DNA, 22 bp, Homo sapiens
taaccacatcaatattgtcatt

SEQ ID NO: 2660468 - DNA, 24 bp, Homo sapiens
taaccacatcaatattgtcattcc

SEQ ID NO: 2660469 - DNA, 16 bp, Homo sapiens
taaccacttcagctga

SEQ ID NO: 2660470 - DNA, 19 bp, Homo sapiens
taaccagcagaaatgcctt

SEQ ID NO: 2660471 - DNA, 23 bp, Homo sapiens
taaccagtgttgtggatttaaca

SEQ ID NO: 2660472 - DNA, 14 bp, Homo sapiens
taacccaactctcc

SEQ ID NO: 2660473 - DNA, 16 bp, Homo sapiens
taacccaactctcctg

SEQ ID NO: 2660474 - DNA, 14 bp, Homo sapiens
taaccccaggcccc

SEQ ID NO: 2660475 - DNA, 23 bp, Homo sapiens
taacccgctcatcactggatgaa

SEQ ID NO: 2660476 - DNA, 20 bp, Homo sapiens
taacctatatgatttatagt

SEQ ID NO: 2660477 - DNA, 20 bp, Homo sapiens
taacctatgatattttctgt

SEQ ID NO: 2660478 - DNA, 14 bp, Homo sapiens
taacctcagctctg

SEQ ID NO: 2660479 - DNA, 17 bp, Homo sapiens
taacctcagctctggga

SEQ ID NO: 2660480 - DNA, 19 bp, Homo sapiens
taacctcagctctgggaga

SEQ ID NO: 2660481 - DNA, 20 bp, Homo sapiens
taacctgaccgtgggcgggg

SEQ ID NO: 2660482 - DNA, 23 bp, Homo sapiens
taacctggtgctggatattttca

SEQ ID NO: 2660483 - DNA, 14 bp, Homo sapiens
taacgacttcaggg

SEQ ID NO: 2660484 - DNA, 17 bp, Homo sapiens
taacgccctatttttgc

SEQ ID NO: 2660485 - DNA, 15 bp, Homo sapiens
taacgtaaatacaca

SEQ ID NO: 2660486 - DNA, 16 bp, Homo sapiens
taacgttgctgtggga

SEQ ID NO: 2660487 - DNA, 18 bp, Homo sapiens
taacgtttttcctttaaa

SEQ ID NO: 2660488 - DNA, 14 bp, Homo sapiens
taactaaaaggtat

SEQ ID NO: 2660489 - DNA, 14 bp, Homo sapiens
taactaaattaaca

SEQ ID NO: 2660490 - DNA, 12 bp, Homo sapiens
taactactgtgt

SEQ ID NO: 2660491 - DNA, 17 bp, Homo sapiens
taactactgtgttcctg

SEQ ID NO: 2660492 - DNA, 15 bp, Homo sapiens
taactaggctcagag

SEQ ID NO: 2660493 - DNA, 16 bp, Homo sapiens
taactaggctcagaga

SEQ ID NO: 2660494 - DNA, 17 bp, Homo sapiens
taactagtcctttacta

SEQ ID NO: 2660495 - DNA, 17 bp, Homo sapiens
taactatatttgctttt

SEQ ID NO: 2660496 - DNA, 19 bp, Homo sapiens
taactattttattttctaa

SEQ ID NO: 2660497 - DNA, 15 bp, Homo sapiens
taactcatcataaaa

SEQ ID NO: 2660498 - DNA, 16 bp, Homo sapiens
taactcatcataaaat

SEQ ID NO: 2660499 - DNA, 17 bp, Homo sapiens
taactcatcataaaata

SEQ ID NO: 2660500 - DNA, 14 bp, Homo sapiens
taactccagtgaag

SEQ ID NO: 2660501 - DNA, 14 bp, Homo sapiens
taactccttcttgt

SEQ ID NO: 2660502 - DNA, 22 bp, Homo sapiens
taactctaattcccattttgca

SEQ ID NO: 2660503 - DNA, 14 bp, Homo sapiens
taactctgtcttca

SEQ ID NO: 2660504 - DNA, 15 bp, Homo sapiens
taactctgtcttcac

SEQ ID NO: 2660505 - DNA, 17 bp, Homo sapiens
taactgcattgagaact

SEQ ID NO: 2660506 - DNA, 16 bp, Homo sapiens
taactgcatttttaga

SEQ ID NO: 2660507 - DNA, 13 bp, Homo sapiens
taactggtataga

SEQ ID NO: 2660508 - DNA, 17 bp, Homo sapiens
taacttaaaaatgtaaa

SEQ ID NO: 2660509 - DNA, 18 bp, Homo sapiens
taacttacccttagggag

SEQ ID NO: 2660510 - DNA, 23 bp, Homo sapiens
taacttatatcatcagcatacct

SEQ ID NO: 2660511 - DNA, 18 bp, Homo sapiens
taacttatattgtaagaa

SEQ ID NO: 2660512 - DNA, 19 bp, Homo sapiens
taacttatattgtaagaaa

SEQ ID NO: 2660513 - DNA, 20 bp, Homo sapiens
taacttatattgtaagaaat

SEQ ID NO: 2660514 - DNA, 13 bp, Homo sapiens
taacttcacatat

SEQ ID NO: 2660515 - DNA, 21 bp, Homo sapiens
taacttcacatattgatttcc

SEQ ID NO: 2660516 - DNA, 17 bp, Homo sapiens
taacttccaatttacat

SEQ ID NO: 2660517 - DNA, 18 bp, Homo sapiens
taacttcttaaaagttgt

SEQ ID NO: 2660518 - DNA, 16 bp, Homo sapiens
taacttggagccccag

SEQ ID NO: 2660519 - DNA, 16 bp, Homo sapiens
taacttgtctaaataa

SEQ ID NO: 2660520 - DNA, 17 bp, Homo sapiens
taacttgtctaaataag

SEQ ID NO: 2660521 - DNA, 20 bp, Homo sapiens
taacttgtctttggaccctg

SEQ ID NO: 2660522 - DNA, 15 bp, Homo sapiens
taactttaagtttca

SEQ ID NO: 2660523 - DNA, 22 bp, Homo sapiens
taactttaattctctttcaaag

SEQ ID NO: 2660524 - DNA, 16 bp, Homo sapiens
taactttatgtgtaaa

SEQ ID NO: 2660525 - DNA, 16 bp, Homo sapiens
taactttctgaaataa

SEQ ID NO: 2660526 - DNA, 15 bp, Homo sapiens
taacttttataaact

SEQ ID NO: 2660527 - DNA, 20 bp, Homo sapiens
taacttttataaactttacc

SEQ ID NO: 2660528 - DNA, 22 bp, Homo sapiens
taacttttataaactttacctt

SEQ ID NO: 2660529 - DNA, 19 bp, Homo sapiens
taagaaaaaggatgcacag

SEQ ID NO: 2660530 - DNA, 23 bp, Homo sapiens
taagaaaaaggatgcacagagtt

SEQ ID NO: 2660531 - DNA, 20 bp, Homo sapiens
taagaaacaactctttgaga

SEQ ID NO: 2660532 - DNA, 16 bp, Homo sapiens
taagaaataaaactgt

SEQ ID NO: 2660533 - DNA, 12 bp, Homo sapiens
taagaagagact

SEQ ID NO: 2660534 - DNA, 19 bp, Homo sapiens
taagaagagactgggaaga

SEQ ID NO: 2660535 - DNA, 19 bp, Homo sapiens
taagaagctgttgtacatt

SEQ ID NO: 2660536 - DNA, 13 bp, Homo sapiens
taagaatgaaata

SEQ ID NO: 2660537 - DNA, 21 bp, Homo sapiens
taagaatgaaatactgtttga

SEQ ID NO: 2660538 - DNA, 17 bp, Homo sapiens
taagaatggttgcctta

SEQ ID NO: 2660539 - DNA, 17 bp, Homo sapiens
taagaattattttgatg

SEQ ID NO: 2660540 - DNA, 16 bp, Homo sapiens
taagacataacgtttt

SEQ ID NO: 2660541 - DNA, 15 bp, Homo sapiens
taagactgtgtattc

SEQ ID NO: 2660542 - DNA, 20 bp, Homo sapiens
taagactttgggataggaaa

SEQ ID NO: 2660543 - DNA, 13 bp, Homo sapiens
taagagacagtca

SEQ ID NO: 2660544 - DNA, 15 bp, Homo sapiens
taagagcaccttcct

SEQ ID NO: 2660545 - DNA, 22 bp, Homo sapiens
taagagccatttaggggccact

SEQ ID NO: 2660546 - DNA, 17 bp, Homo sapiens
taagagctggtgtctga

SEQ ID NO: 2660547 - DNA, 14 bp, Homo sapiens
taagaggctgataa

SEQ ID NO: 2660548 - DNA, 22 bp, Homo sapiens
taagagggagggagggctccag

SEQ ID NO: 2660549 - DNA, 23 bp, Homo sapiens
taagagggattagggagagaaga

SEQ ID NO: 2660550 - DNA, 17 bp, Homo sapiens
taagagggcacacactg

SEQ ID NO: 2660551 - DNA, 14 bp, Homo sapiens
taagagtgctgggc

SEQ ID NO: 2660552 - DNA, 19 bp, Homo sapiens
taagagtgggggagagcag

SEQ ID NO: 2660553 - DNA, 12 bp, Homo sapiens
taagagtgtaga

SEQ ID NO: 2660554 - DNA, 19 bp, Homo sapiens
taagagtgtagaagcattc

SEQ ID NO: 2660555 - DNA, 23 bp, Homo sapiens
taagagtgtagaagcattccttc

SEQ ID NO: 2660556 - DNA, 21 bp, Homo sapiens
taagagttagtttctttggga

SEQ ID NO: 2660557 - DNA, 14 bp, Homo sapiens
taagataaatgtgc

SEQ ID NO: 2660558 - DNA, 18 bp, Homo sapiens
taagataatagtttacat

SEQ ID NO: 2660559 - DNA, 13 bp, Homo sapiens
taagataattata

SEQ ID NO: 2660560 - DNA, 21 bp, Homo sapiens
taagatatgggacatttttga

SEQ ID NO: 2660561 - DNA, 18 bp, Homo sapiens
taagatcgttctctgcct

SEQ ID NO: 2660562 - DNA, 15 bp, Homo sapiens
taagatgacattgct

SEQ ID NO: 2660563 - DNA, 16 bp, Homo sapiens
taagatgacattgcta

SEQ ID NO: 2660564 - DNA, 11 bp, Homo sapiens
taagatgctgg

SEQ ID NO: 2660565 - DNA, 15 bp, Homo sapiens
taagattagaatgaa

SEQ ID NO: 2660566 - DNA, 19 bp, Homo sapiens
taagatttagagatgaatt

SEQ ID NO: 2660567 - DNA, 16 bp, Homo sapiens
taagatttttctcaaa

SEQ ID NO: 2660568 - DNA, 18 bp, Homo sapiens
taagatttttctcaaagt

SEQ ID NO: 2660569 - DNA, 21 bp, Homo sapiens
taagatttttctcaaagtttt

SEQ ID NO: 2660570 - DNA, 17 bp, Homo sapiens
taagcactacataaact

SEQ ID NO: 2660571 - DNA, 16 bp, Homo sapiens
taccctgagctgaggc

SEQ ID NO: 2660572 - DNA, 18 bp, Homo sapiens
taccctgagctgaggcag

SEQ ID NO: 2660573 - DNA, 23 bp, Homo sapiens
taccctgcgcccagtccttccac

SEQ ID NO: 2660574 - DNA, 17 bp, Homo sapiens
taccctttttctccagc

SEQ ID NO: 2660575 - DNA, 17 bp, Homo sapiens
taccgaaaccttgcctt

SEQ ID NO: 2660576 - DNA, 18 bp, Homo sapiens
taccgaaaccttgccttt

SEQ ID NO: 2660577 - DNA, 19 bp, Homo sapiens
taccgaaaccttgcctttc

SEQ ID NO: 2660578 - DNA, 22 bp, Homo sapiens
tacctaaaaggaaatctcaccc

SEQ ID NO: 2660579 - DNA, 15 bp, Homo sapiens
tacctaaacagatat

SEQ ID NO: 2660580 - DNA, 22 bp, Homo sapiens
tacctaacgaagtatccttcag

SEQ ID NO: 2660581 - DNA, 21 bp, Homo sapiens
tacctactttgactttttgca

SEQ ID NO: 2660582 - DNA, 16 bp, Homo sapiens
tacctatcatcttaag

SEQ ID NO: 2660583 - DNA, 17 bp, Homo sapiens
tacctcaacctatggta

SEQ ID NO: 2660584 - DNA, 16 bp, Homo sapiens
tacctcaggcagctca

SEQ ID NO: 2660585 - DNA, 14 bp, Homo sapiens
tacctcaggcagga

SEQ ID NO: 2660586 - DNA, 15 bp, Homo sapiens
tacctcaggcaggaa

SEQ ID NO: 2660587 - DNA, 20 bp, Homo sapiens
tacctcaggttgctggttgc

SEQ ID NO: 2660588 - DNA, 23 bp, Homo sapiens
tacctctcttatagaatatttat

SEQ ID NO: 2660589 - DNA, 14 bp, Homo sapiens
tacctctgatacct

SEQ ID NO: 2660590 - DNA, 14 bp, Homo sapiens
tacctcttattgca

SEQ ID NO: 2660591 - DNA, 21 bp, Homo sapiens
tacctcttgagccttgaactt

SEQ ID NO: 2660592 - DNA, 17 bp, Homo sapiens
tacctgacactcccttg

SEQ ID NO: 2660593 - DNA, 13 bp, Homo sapiens
tacctgaggggcc

SEQ ID NO: 2660594 - DNA, 18 bp, Homo sapiens
tacctgatcaatgacaga

SEQ ID NO: 2660595 - DNA, 19 bp, Homo sapiens
tacctgatcaatgacagag

SEQ ID NO: 2660596 - DNA, 19 bp, Homo sapiens
tacctgccactcacacagc

SEQ ID NO: 2660597 - DNA, 20 bp, Homo sapiens
tacctgccactcacacagcc

SEQ ID NO: 2660598 - DNA, 16 bp, Homo sapiens
tacctgccctgacatg

SEQ ID NO: 2660599 - DNA, 23 bp, Homo sapiens
tacctgctctccaagtctcagtg

SEQ ID NO: 2660600 - DNA, 17 bp, Homo sapiens
tacctggaggaggagca

SEQ ID NO: 2660601 - DNA, 18 bp, Homo sapiens
tacctgggtgattacata

SEQ ID NO: 2660602 - DNA, 13 bp, Homo sapiens
tacctgttcctta

SEQ ID NO: 2660603 - DNA, 22 bp, Homo sapiens
taccttactgtggaggaaggat

SEQ ID NO: 2660604 - DNA, 16 bp, Homo sapiens
taccttagattagctc

SEQ ID NO: 2660605 - DNA, 20 bp, Homo sapiens
taccttagattagctctgga

SEQ ID NO: 2660606 - DNA, 17 bp, Homo sapiens
taccttcaataaagtat

SEQ ID NO: 2660607 - DNA, 22 bp, Homo sapiens
taccttggttcccccactgatc

SEQ ID NO: 2660608 - DNA, 20 bp, Homo sapiens
tacctttgtattctctcctg

SEQ ID NO: 2660609 - DNA, 21 bp, Homo sapiens
taccttttaacacctgatgtg

SEQ ID NO: 2660610 - DNA, 21 bp, Homo sapiens
taccttttgaggagccccagc

SEQ ID NO: 2660611 - DNA, 13 bp, Homo sapiens
taccttttttata

SEQ ID NO: 2660612 - DNA, 16 bp, Homo sapiens
taccttttttatacat

SEQ ID NO: 2660613 - DNA, 19 bp, Homo sapiens
taccttttttatacataaa

SEQ ID NO: 2660614 - DNA, 21 bp, Homo sapiens
taccttttttgataaagtttc

SEQ ID NO: 2660615 - DNA, 22 bp, Homo sapiens
tacgcagcgtgctttaaaaaat

SEQ ID NO: 2660616 - DNA, 17 bp, Homo sapiens
tacgcccaacccttccc

SEQ ID NO: 2660617 - DNA, 13 bp, Homo sapiens
tacgctctccttt

SEQ ID NO: 2660618 - DNA, 21 bp, Homo sapiens
tacgctctcctttctttctaa

SEQ ID NO: 2660619 - DNA, 14 bp, Homo sapiens
tacgtacacatttt

SEQ ID NO: 2660620 - DNA, 21 bp, Homo sapiens
tacgtctgggagaaattgaca

SEQ ID NO: 2660621 - DNA, 15 bp, Homo sapiens
tacgtgtagctatat

SEQ ID NO: 2660622 - DNA, 15 bp, Homo sapiens
tacgtgtgatttttc

SEQ ID NO: 2660623 - DNA, 16 bp, Homo sapiens
tacgttattgttgact

SEQ ID NO: 2660624 - DNA, 18 bp, Homo sapiens
tacgttcctattgtcatt

SEQ ID NO: 2660625 - DNA, 22 bp, Homo sapiens
tacgttcctattgtcattaaag

SEQ ID NO: 2660626 - DNA, 20 bp, Homo sapiens
tacgtttgtatgtgtgtaga

SEQ ID NO: 2660627 - DNA, 14 bp, Homo sapiens
tactaaaaatacaa

SEQ ID NO: 2660628 - DNA, 18 bp, Homo sapiens
tactaaaaatacaaaaaa

SEQ ID NO: 2660629 - DNA, 19 bp, Homo sapiens
tactaaccagcagaaatgc

SEQ ID NO: 2660630 - DNA, 22 bp, Homo sapiens
tactaagctttgccagctgctg

SEQ ID NO: 2660631 - DNA, 23 bp, Homo sapiens
tactaaggagtaatctgtgtaca

SEQ ID NO: 2660632 - DNA, 15 bp, Homo sapiens
tactaatagacaatt

SEQ ID NO: 2660633 - DNA, 17 bp, Homo sapiens
tactaatagacaattta

SEQ ID NO: 2660634 - DNA, 20 bp, Homo sapiens
tactaatagacaatttatta

SEQ ID NO: 2660635 - DNA, 21 bp, Homo sapiens
tactaatagacaatttattat

SEQ ID NO: 2660636 - DNA, 14 bp, Homo sapiens
tactaatgatgttt

SEQ ID NO: 2660637 - DNA, 16 bp, Homo sapiens
tactaattttctagat

SEQ ID NO: 2660638 - DNA, 18 bp, Homo sapiens
tactacacattcaataag

SEQ ID NO: 2660639 - DNA, 21 bp, Homo sapiens
tactacagttgttttttgaaa

SEQ ID NO: 2660640 - DNA, 14 bp, Homo sapiens
tactacagtttgtt

SEQ ID NO: 2660641 - DNA, 17 bp, Homo sapiens
tactactgaatctctaa

SEQ ID NO: 2660642 - DNA, 14 bp, Homo sapiens
tactagatgtcttt

SEQ ID NO: 2660643 - DNA, 19 bp, Homo sapiens
tactagttacacatcttca

SEQ ID NO: 2660644 - DNA, 14 bp, Homo sapiens
tactatatttatgg

SEQ ID NO: 2660645 - DNA, 23 bp, Homo sapiens
tactatggccctggcctagcata

SEQ ID NO: 2660646 - DNA, 12 bp, Homo sapiens
tactatgtatca

SEQ ID NO: 2660647 - DNA, 14 bp, Homo sapiens
tactatgtatcaat

SEQ ID NO: 2660648 - DNA, 16 bp, Homo sapiens
tactatgtatcaatga

SEQ ID NO: 2660649 - DNA, 12 bp, Homo sapiens
tactatttaaag

SEQ ID NO: 2660650 - DNA, 13 bp, Homo sapiens
tactatttttact

SEQ ID NO: 2660651 - DNA, 14 bp, Homo sapiens
tactatttttactg

SEQ ID NO: 2660652 - DNA, 18 bp, Homo sapiens
tactatttttactgccac

SEQ ID NO: 2660653 - DNA, 19 bp, Homo sapiens
tactatttttactgccact

SEQ ID NO: 2660654 - DNA, 15 bp, Homo sapiens
tactcaagcccgcgg

SEQ ID NO: 2660655 - DNA, 14 bp, Homo sapiens
tactcaatggattt

SEQ ID NO: 2660656 - DNA, 21 bp, Homo sapiens
tactcacagtctctttaatct

SEQ ID NO: 2660657 - DNA, 20 bp, Homo sapiens
tactcataatgtgaagtgtt

SEQ ID NO: 2660658 - DNA, 16 bp, Homo sapiens
tactcatgatcttgtg

SEQ ID NO: 2660659 - DNA, 12 bp, Homo sapiens
tactcatgtgta

SEQ ID NO: 2660660 - DNA, 21 bp, Homo sapiens
tactccagtgccaacaatcct

SEQ ID NO: 2660661 - DNA, 15 bp, Homo sapiens
tactccccttgagct

SEQ ID NO: 2660662 - DNA, 15 bp, Homo sapiens
tactcctacctcagc

SEQ ID NO: 2660663 - DNA, 16 bp, Homo sapiens
tactcctacctcagcc

SEQ ID NO: 2660664 - DNA, 21 bp, Homo sapiens
tactcctctgcagtgccttgg

SEQ ID NO: 2660665 - DNA, 12 bp, Homo sapiens
tactcctgcaaa

SEQ ID NO: 2660666 - DNA, 14 bp, Homo sapiens
tactcctgcaaaat

SEQ ID NO: 2660667 - DNA, 17 bp, Homo sapiens
tactcctgcaaaatttt

SEQ ID NO: 2660668 - DNA, 22 bp, Homo sapiens
tactctaccctcttagaaaaac

SEQ ID NO: 2660669 - DNA, 16 bp, Homo sapiens
tactctcccatggctt

SEQ ID NO: 2660670 - DNA, 12 bp, Homo sapiens
tactctcctaga

SEQ ID NO: 2660671 - DNA, 22 bp, Homo sapiens
tactctgaagggcatcatgcat

SEQ ID NO: 2660672 - DNA, 15 bp, Homo sapiens
tactctgtcagatgg

SEQ ID NO: 2660673 - DNA, 12 bp, Homo sapiens
tactctgtgtca

SEQ ID NO: 2660674 - DNA, 21 bp, Homo sapiens
tactctgtgtcaggtggggca

SEQ ID NO: 2660675 - DNA, 19 bp, Homo sapiens
tactctgttccttcacatc

SEQ ID NO: 2660676 - DNA, 15 bp, Homo sapiens
tactcttaagccatc

SEQ ID NO: 2660677 - DNA, 21 bp, Homo sapiens
tactcttaagccatcttggta

SEQ ID NO: 2660678 - DNA, 22 bp, Homo sapiens
tactcttaagccatcttggtaa

SEQ ID NO: 2660679 - DNA, 21 bp, Homo sapiens
tactcttaagtttctcagctc

SEQ ID NO: 2660680 - DNA, 18 bp, Homo sapiens
tactcttaggaagagaaa

SEQ ID NO: 2660681 - DNA, 14 bp, Homo sapiens
tactcttcttgaaa

SEQ ID NO: 2660682 - DNA, 18 bp, Homo sapiens
tactcttcttgaaatttt

SEQ ID NO: 2660683 - DNA, 17 bp, Homo sapiens
tactctttgagatagaa

SEQ ID NO: 2660684 - DNA, 20 bp, Homo sapiens
tactgaaaggttaccctgta

SEQ ID NO: 2660685 - DNA, 22 bp, Homo sapiens
tactgaacaatcaaagcacttg

SEQ ID NO: 2660686 - DNA, 23 bp, Homo sapiens
tactgacactttgccagaaagca

SEQ ID NO: 2660687 - DNA, 17 bp, Homo sapiens
tactgagagtgaacaaa

SEQ ID NO: 2660688 - DNA, 15 bp, Homo sapiens
tactgattgtttcat

SEQ ID NO: 2660689 - DNA, 13 bp, Homo sapiens
tactgatttttgt

SEQ ID NO: 2660690 - DNA, 19 bp, Homo sapiens
tactgcaattaaagtgata

SEQ ID NO: 2660691 - DNA, 13 bp, Homo sapiens
tactgcatacttt

SEQ ID NO: 2660692 - DNA, 15 bp, Homo sapiens
tactgcatacttttt

SEQ ID NO: 2660693 - DNA, 18 bp, Homo sapiens
tactgcatactttttaaa

SEQ ID NO: 2660694 - DNA, 14 bp, Homo sapiens
tactgccactcttt

SEQ ID NO: 2660695 - DNA, 14 bp, Homo sapiens
tactgccagatgct

SEQ ID NO: 2660696 - DNA, 20 bp, Homo sapiens
tactgccattcacttcataa

SEQ ID NO: 2660697 - DNA, 19 bp, Homo sapiens
tactgcccaggcctgcctg

SEQ ID NO: 2660698 - DNA, 20 bp, Homo sapiens
tactgcccaggcctgcctgt

SEQ ID NO: 2660699 - DNA, 22 bp, Homo sapiens
tactgcccaggcctgcctgttc

SEQ ID NO: 2660700 - DNA, 22 bp, Homo sapiens
tactgcccggggcagctgccag

SEQ ID NO: 2660701 - DNA, 20 bp, Homo sapiens
tactgtaaagaaagagagaa

SEQ ID NO: 2660702 - DNA, 23 bp, Homo sapiens
tactgtaaagaaagagagaaaat

SEQ ID NO: 2660703 - DNA, 17 bp, Homo sapiens
tactgtaatttgtgata

SEQ ID NO: 2660704 - DNA, 18 bp, Homo sapiens
tactgtaatttgtgatac

SEQ ID NO: 2660705 - DNA, 20 bp, Homo sapiens
tactgtaatttgtgatacaa

SEQ ID NO: 2660706 - DNA, 19 bp, Homo sapiens
tactgtacaatgactttat

SEQ ID NO: 2660707 - DNA, 22 bp, Homo sapiens
tactgtacatgaaaacacattt

SEQ ID NO: 2660708 - DNA, 21 bp, Homo sapiens
tactgtatcatgacaaagact

SEQ ID NO: 2660709 - DNA, 17 bp, Homo sapiens
tactgtattttgtattg

SEQ ID NO: 2660710 - DNA, 23 bp, Homo sapiens
tactgtattttgtattgtttcaa

SEQ ID NO: 2660711 - DNA, 23 bp, Homo sapiens
tactgtcagctcccctcggagaa

SEQ ID NO: 2660712 - DNA, 14 bp, Homo sapiens
tactgtctcactga

SEQ ID NO: 2660713 - DNA, 22 bp, Homo sapiens
tactgtctcactgaaacattta

SEQ ID NO: 2660714 - DNA, 22 bp, Homo sapiens
tatagctacaggaagcacccca

SEQ ID NO: 2660715 - DNA, 11 bp, Homo sapiens
tatagctatta

SEQ ID NO: 2660716 - DNA, 22 bp, Homo sapiens
tatagctattactgtctggttt

SEQ ID NO: 2660717 - DNA, 13 bp, Homo sapiens
tatagctgtattg

SEQ ID NO: 2660718 - DNA, 20 bp, Homo sapiens
tatagctgtattgaatcatg

SEQ ID NO: 2660719 - DNA, 12 bp, Homo sapiens
tataggagagga

SEQ ID NO: 2660720 - DNA, 15 bp, Homo sapiens
tataggatcatttgt

SEQ ID NO: 2660721 - DNA, 14 bp, Homo sapiens
tataggctggagaa

SEQ ID NO: 2660722 - DNA, 18 bp, Homo sapiens
tatagtatatctggacaa

SEQ ID NO: 2660723 - DNA, 13 bp, Homo sapiens
tatagtgatgtaa

SEQ ID NO: 2660724 - DNA, 13 bp, Homo sapiens
tatagtgtaaaat

SEQ ID NO: 2660725 - DNA, 21 bp, Homo sapiens
tatagtgtaaaataagaatga

SEQ ID NO: 2660726 - DNA, 17 bp, Homo sapiens
tatagtttactatttta

SEQ ID NO: 2660727 - DNA, 13 bp, Homo sapiens
tatagtttcagat

SEQ ID NO: 2660728 - DNA, 18 bp, Homo sapiens
tatataaaaagaaaagat

SEQ ID NO: 2660729 - DNA, 19 bp, Homo sapiens
tatataaaaagaaaagata

SEQ ID NO: 2660730 - DNA, 21 bp, Homo sapiens
tatataaaatattttcataca

SEQ ID NO: 2660731 - DNA, 18 bp, Homo sapiens
tatataaatggttaaaag

SEQ ID NO: 2660732 - DNA, 23 bp, Homo sapiens
tatataaattttttttgtttcat

SEQ ID NO: 2660733 - DNA, 15 bp, Homo sapiens
tatataatggtttca

SEQ ID NO: 2660734 - DNA, 16 bp, Homo sapiens
tatataattctgtaca

SEQ ID NO: 2660735 - DNA, 20 bp, Homo sapiens
tatatacaacctgcttgggt

SEQ ID NO: 2660736 - DNA, 14 bp, Homo sapiens
tatatacagtaact

SEQ ID NO: 2660737 - DNA, 22 bp, Homo sapiens
tatatacagtaactttatgtgt

SEQ ID NO: 2660738 - DNA, 15 bp, Homo sapiens
tatatacatatatat

SEQ ID NO: 2660739 - DNA, 21 bp, Homo sapiens
tatatacatttatgaattaaa

SEQ ID NO: 2660740 - DNA, 19 bp, Homo sapiens
tatatagagatgtttttaa

SEQ ID NO: 2660741 - DNA, 21 bp, Homo sapiens
tatataggttttgtttgctat

SEQ ID NO: 2660742 - DNA, 24 bp, Homo sapiens
tatataggttttgtttgctatctt

SEQ ID NO: 2660743 - DNA, 18 bp, Homo sapiens
tatatataattctgtaca

SEQ ID NO: 2660744 - DNA, 13 bp, Homo sapiens
tatatatacagta

SEQ ID NO: 2660745 - DNA, 13 bp, Homo sapiens
tatatatagaatc

SEQ ID NO: 2660746 - DNA, 22 bp, Homo sapiens
tatatatgtgtgtttaaataaa

SEQ ID NO: 2660747 - DNA, 22 bp, Homo sapiens
tatatattggtaacatcctttc

SEQ ID NO: 2660748 - DNA, 22 bp, Homo sapiens
tatatatttttggttgtcaata

SEQ ID NO: 2660749 - DNA, 11 bp, Homo sapiens
tatatcagcct

SEQ ID NO: 2660750 - DNA, 20 bp, Homo sapiens
tatatccaaaagctttttat

SEQ ID NO: 2660751 - DNA, 14 bp, Homo sapiens
tatatccatgtact

SEQ ID NO: 2660752 - DNA, 19 bp, Homo sapiens
tatatccatgtactgtagt

SEQ ID NO: 2660753 - DNA, 18 bp, Homo sapiens
tatatctaaattgaataa

SEQ ID NO: 2660754 - DNA, 13 bp, Homo sapiens
tatatctgctgtc

SEQ ID NO: 2660755 - DNA, 17 bp, Homo sapiens
tatatctgcttcagtgg

SEQ ID NO: 2660756 - DNA, 14 bp, Homo sapiens
tatatctgtatata

SEQ ID NO: 2660757 - DNA, 12 bp, Homo sapiens
tatatcttgttt

SEQ ID NO: 2660758 - DNA, 14 bp, Homo sapiens
tatatctttttcca

SEQ ID NO: 2660759 - DNA, 19 bp, Homo sapiens
tatatgaggacttgtgtct

SEQ ID NO: 2660760 - DNA, 21 bp, Homo sapiens
tatatgcacttataattttcc

SEQ ID NO: 2660761 - DNA, 16 bp, Homo sapiens
tatatgcttactgata

SEQ ID NO: 2660762 - DNA, 21 bp, Homo sapiens
tatatgcttactgatatattt

SEQ ID NO: 2660763 - DNA, 13 bp, Homo sapiens
tatatggataatg

SEQ ID NO: 2660764 - DNA, 18 bp, Homo sapiens
tatatggatgattcagaa

SEQ ID NO: 2660765 - DNA, 22 bp, Homo sapiens
tatatgtgaatcctcttcttta

SEQ ID NO: 2660766 - DNA, 16 bp, Homo sapiens
tatatgtgatgatcta

SEQ ID NO: 2660767 - DNA, 19 bp, Homo sapiens
tatatgtttttgaaggcag

SEQ ID NO: 2660768 - DNA, 20 bp, Homo sapiens
tatattatcatgcaaatgct

SEQ ID NO: 2660769 - DNA, 22 bp, Homo sapiens
tatattatttctaggaagaatt

SEQ ID NO: 2660770 - DNA, 21 bp, Homo sapiens
tatattccatatattagcatt

SEQ ID NO: 2660771 - DNA, 18 bp, Homo sapiens
tatattcccaatagcaac

SEQ ID NO: 2660772 - DNA, 17 bp, Homo sapiens
tatattggtaacatcct

SEQ ID NO: 2660773 - DNA, 19 bp, Homo sapiens
tatattgtaagaaatactg

SEQ ID NO: 2660774 - DNA, 15 bp, Homo sapiens
tatatttaacaagat

SEQ ID NO: 2660775 - DNA, 18 bp, Homo sapiens
tatatttagttatagttt

SEQ ID NO: 2660776 - DNA, 21 bp, Homo sapiens
tatatttataactcatcataa

SEQ ID NO: 2660777 - DNA, 22 bp, Homo sapiens
tatatttataactcatcataaa

SEQ ID NO: 2660778 - DNA, 14 bp, Homo sapiens
tatatttctttgtt

SEQ ID NO: 2660779 - DNA, 20 bp, Homo sapiens
tatatttgtaaatttatgtg

SEQ ID NO: 2660780 - DNA, 16 bp, Homo sapiens
tatattttacaatttt

SEQ ID NO: 2660781 - DNA, 21 bp, Homo sapiens
tatattttatacattaacttc

SEQ ID NO: 2660782 - DNA, 13 bp, Homo sapiens
tatattttgggaa

SEQ ID NO: 2660783 - DNA, 17 bp, Homo sapiens
tatatttttaagataat

SEQ ID NO: 2660784 - DNA, 18 bp, Homo sapiens
tatatttttggttgtcaa

SEQ ID NO: 2660785 - DNA, 14 bp, Homo sapiens
tatcaaaagaaaga

SEQ ID NO: 2660786 - DNA, 23 bp, Homo sapiens
tatcaaatattagatgtgattta

SEQ ID NO: 2660787 - DNA, 12 bp, Homo sapiens
tatcaagaaagt

SEQ ID NO: 2660788 - DNA, 21 bp, Homo sapiens
tatcaagtattataccttttt

SEQ ID NO: 2660789 - DNA, 20 bp, Homo sapiens
tatcaatagtcaagaaaaat

SEQ ID NO: 2660790 - DNA, 13 bp, Homo sapiens
tatcacacttctg

SEQ ID NO: 2660791 - DNA, 18 bp, Homo sapiens
tatcacatgtatgttttg

SEQ ID NO: 2660792 - DNA, 14 bp, Homo sapiens
tatcacctcatggc

SEQ ID NO: 2660793 - DNA, 16 bp, Homo sapiens
tatcacctcccctcct

SEQ ID NO: 2660794 - DNA, 20 bp, Homo sapiens
tatcacctcccctccttgcc

SEQ ID NO: 2660795 - DNA, 21 bp, Homo sapiens
tatcagaagaccacaaaaatt

SEQ ID NO: 2660796 - DNA, 19 bp, Homo sapiens
tatcagacactctggctgg

SEQ ID NO: 2660797 - DNA, 20 bp, Homo sapiens
tatcagacactctggctggt

SEQ ID NO: 2660798 - DNA, 14 bp, Homo sapiens
tatcagcacgtgtg

SEQ ID NO: 2660799 - DNA, 13 bp, Homo sapiens
tatcagcctgtct

SEQ ID NO: 2660800 - DNA, 14 bp, Homo sapiens
tatcagcttcagaa

SEQ ID NO: 2660801 - DNA, 22 bp, Homo sapiens
tatcagtcataactaaataaag

SEQ ID NO: 2660802 - DNA, 14 bp, Homo sapiens
tatcagtctctgag

SEQ ID NO: 2660803 - DNA, 16 bp, Homo sapiens
tatcagtgacagagtt

SEQ ID NO: 2660804 - DNA, 14 bp, Homo sapiens
tatcagttgcaata

SEQ ID NO: 2660805 - DNA, 21 bp, Homo sapiens
tatcagttgcaataatacttc

SEQ ID NO: 2660806 - DNA, 21 bp, Homo sapiens
tatcatcagcatacctttatt

SEQ ID NO: 2660807 - DNA, 16 bp, Homo sapiens
tatcatccacattgtt

SEQ ID NO: 2660808 - DNA, 17 bp, Homo sapiens
tatcatgacaaagactg

SEQ ID NO: 2660809 - DNA, 17 bp, Homo sapiens
tatcatgcaaatgctgt

SEQ ID NO: 2660810 - DNA, 17 bp, Homo sapiens
tatcatgcatgtcctgt

SEQ ID NO: 2660811 - DNA, 14 bp, Homo sapiens
tatcatgtgtaatc

SEQ ID NO: 2660812 - DNA, 19 bp, Homo sapiens
tatcatgtgtaatcaataa

SEQ ID NO: 2660813 - DNA, 14 bp, Homo sapiens
tatcattttctgca

SEQ ID NO: 2660814 - DNA, 15 bp, Homo sapiens
tatcatttttgtaca

SEQ ID NO: 2660815 - DNA, 22 bp, Homo sapiens
tatccacagagagtcccactgc

SEQ ID NO: 2660816 - DNA, 21 bp, Homo sapiens
tatccaggtaatccaagatat

SEQ ID NO: 2660817 - DNA, 14 bp, Homo sapiens
tatccatgtactgt

SEQ ID NO: 2660818 - DNA, 16 bp, Homo sapiens
tatccatgtactgtag

SEQ ID NO: 2660819 - DNA, 15 bp, Homo sapiens
tatccatttctcatg

SEQ ID NO: 2660820 - DNA, 15 bp, Homo sapiens
tatcctacaacaaga

SEQ ID NO: 2660821 - DNA, 19 bp, Homo sapiens
tatcctccaggtttttcaa

SEQ ID NO: 2660822 - DNA, 17 bp, Homo sapiens
tatcctgaaatttcaga

SEQ ID NO: 2660823 - DNA, 22 bp, Homo sapiens
tatcctggggctcccttcatct

SEQ ID NO: 2660824 - DNA, 22 bp, Homo sapiens
tatcctttgtggcaccttttct

SEQ ID NO: 2660825 - DNA, 18 bp, Homo sapiens
tatcgaaataacaatgtt

SEQ ID NO: 2660826 - DNA, 21 bp, Homo sapiens
tatcgaaataacaatgttaag

SEQ ID NO: 2660827 - DNA, 14 bp, Homo sapiens
tatcggaagcagtg

SEQ ID NO: 2660828 - DNA, 17 bp, Homo sapiens
tatcgggaacagtgttt

SEQ ID NO: 2660829 - DNA, 19 bp, Homo sapiens
tatcgtcactgcttaactt

SEQ ID NO: 2660830 - DNA, 15 bp, Homo sapiens
tatctaaatgttgaa

SEQ ID NO: 2660831 - DNA, 13 bp, Homo sapiens
tatctaaattgaa

SEQ ID NO: 2660832 - DNA, 17 bp, Homo sapiens
tatctaaattgaataat

SEQ ID NO: 2660833 - DNA, 20 bp, Homo sapiens
tatctaaattgaataatggt

SEQ ID NO: 2660834 - DNA, 15 bp, Homo sapiens
tatctaatacctctg

SEQ ID NO: 2660835 - DNA, 16 bp, Homo sapiens
tatctacccagaatta

SEQ ID NO: 2660836 - DNA, 20 bp, Homo sapiens
tatctagcaatcacaacact

SEQ ID NO: 2660837 - DNA, 23 bp, Homo sapiens
tatctagtgcagctgattttaac

SEQ ID NO: 2660838 - DNA, 20 bp, Homo sapiens
tatctatatataattctgta

SEQ ID NO: 2660839 - DNA, 14 bp, Homo sapiens
tatctatatttttg

SEQ ID NO: 2660840 - DNA, 15 bp, Homo sapiens
tatctcagggcctgg

SEQ ID NO: 2660841 - DNA, 15 bp, Homo sapiens
tatctccaagaccag

SEQ ID NO: 2660842 - DNA, 14 bp, Homo sapiens
tatctcccccagcc

SEQ ID NO: 2660843 - DNA, 18 bp, Homo sapiens
tatctcccccagccccat

SEQ ID NO: 2660844 - DNA, 16 bp, Homo sapiens
tatctctatttaatat

SEQ ID NO: 2660845 - DNA, 18 bp, Homo sapiens
tatctctatttaatattt

SEQ ID NO: 2660846 - DNA, 13 bp, Homo sapiens
tatctctctgtgc

SEQ ID NO: 2660847 - DNA, 20 bp, Homo sapiens
tatctgaaaatgtatgtgta

SEQ ID NO: 2660848 - DNA, 23 bp, Homo sapiens
tatctgagggaggaggccacctc

SEQ ID NO: 2660849 - DNA, 13 bp, Homo sapiens
tatctgaggtcac

SEQ ID NO: 2660850 - DNA, 11 bp, Homo sapiens
tatctgctgtc

SEQ ID NO: 2660851 - DNA, 22 bp, Homo sapiens
tatctggtcaacctcctggaca

SEQ ID NO: 2660852 - DNA, 18 bp, Homo sapiens
tatctgtaagttttgaat

SEQ ID NO: 2660853 - DNA, 23 bp, Homo sapiens
tatctgtagtgagatagcattgt

SEQ ID NO: 2660854 - DNA, 15 bp, Homo sapiens
tatctgtatttaatt

SEQ ID NO: 2660855 - DNA, 17 bp, Homo sapiens
tatctgtatttaatttt

SEQ ID NO: 2660856 - DNA, 22 bp, Homo sapiens
tatctgtatttaattttgacac

SEQ ID NO: 2660857 - DNA, 23 bp, Homo sapiens
tatctgtcatttgagcagggctc

SEQ ID NO: 2660858 - DNA, 17 bp, Homo sapiens
tcaagcaagatttcaga

SEQ ID NO: 2660859 - DNA, 14 bp, Homo sapiens
tcaagccaagcagc

SEQ ID NO: 2660860 - DNA, 17 bp, Homo sapiens
tcaagccaagcagccaa

SEQ ID NO: 2660861 - DNA, 19 bp, Homo sapiens
tcaagccaagcagccaagc

SEQ ID NO: 2660862 - DNA, 17 bp, Homo sapiens
tcaagccaatcccctcc

SEQ ID NO: 2660863 - DNA, 12 bp, Homo sapiens
tcaagccctgca

SEQ ID NO: 2660864 - DNA, 13 bp, Homo sapiens
tcaagccctgcag

SEQ ID NO: 2660865 - DNA, 19 bp, Homo sapiens
tcaagcttcagtttcctgg

SEQ ID NO: 2660866 - DNA, 18 bp, Homo sapiens
tcaaggaataatgggctt

SEQ ID NO: 2660867 - DNA, 21 bp, Homo sapiens
tcaagggaatgtaactgctga

SEQ ID NO: 2660868 - DNA, 16 bp, Homo sapiens
tcaagtaagaagacat

SEQ ID NO: 2660869 - DNA, 11 bp, Homo sapiens
tcaagtattat

SEQ ID NO: 2660870 - DNA, 15 bp, Homo sapiens
tcaagtattatacct

SEQ ID NO: 2660871 - DNA, 15 bp, Homo sapiens
tcaagtgaaaaagga

SEQ ID NO: 2660872 - DNA, 17 bp, Homo sapiens
tcaagttattgtacagc

SEQ ID NO: 2660873 - DNA, 14 bp, Homo sapiens
tcaataaaatcatg

SEQ ID NO: 2660874 - DNA, 16 bp, Homo sapiens
tcaataaaatgtgatt

SEQ ID NO: 2660875 - DNA, 17 bp, Homo sapiens
tcaataaacgatttaat

SEQ ID NO: 2660876 - DNA, 18 bp, Homo sapiens
tcaataaacgatttaatt

SEQ ID NO: 2660877 - DNA, 17 bp, Homo sapiens
tcaataaagtatctaca

SEQ ID NO: 2660878 - DNA, 15 bp, Homo sapiens
tcaataaatggtata

SEQ ID NO: 2660879 - DNA, 20 bp, Homo sapiens
tcaataagcatcaaactctt

SEQ ID NO: 2660880 - DNA, 14 bp, Homo sapiens
tcaataagccttgt

SEQ ID NO: 2660881 - DNA, 14 bp, Homo sapiens
tcaatagtcaagaa

SEQ ID NO: 2660882 - DNA, 15 bp, Homo sapiens
tcaatattaaataca

SEQ ID NO: 2660883 - DNA, 11 bp, Homo sapiens
tcaatatttat

SEQ ID NO: 2660884 - DNA, 16 bp, Homo sapiens
tcaatattttccatga

SEQ ID NO: 2660885 - DNA, 17 bp, Homo sapiens
tcaatattttccatgaa

SEQ ID NO: 2660886 - DNA, 18 bp, Homo sapiens
tcaatattttccatgaaa

SEQ ID NO: 2660887 - DNA, 21 bp, Homo sapiens
tcaatcagtataattctgtac

SEQ ID NO: 2660888 - DNA, 22 bp, Homo sapiens
tcaatcagtataattctgtact

SEQ ID NO: 2660889 - DNA, 16 bp, Homo sapiens
tcaatcatctgtgtga

SEQ ID NO: 2660890 - DNA, 20 bp, Homo sapiens
tcaatcatctgtgtgaaaat

SEQ ID NO: 2660891 - DNA, 15 bp, Homo sapiens
tcaatccagctatgt

SEQ ID NO: 2660892 - DNA, 20 bp, Homo sapiens
tcaatctcccgctgctgctg

SEQ ID NO: 2660893 - DNA, 14 bp, Homo sapiens
tcaatctgtaaact

SEQ ID NO: 2660894 - DNA, 15 bp, Homo sapiens
tcaatgacagagcct

SEQ ID NO: 2660895 - DNA, 12 bp, Homo sapiens
tcaatgatctag

SEQ ID NO: 2660896 - DNA, 13 bp, Homo sapiens
tcaatgcagccag

SEQ ID NO: 2660897 - DNA, 15 bp, Homo sapiens
tcaatgcagccagac

SEQ ID NO: 2660898 - DNA, 17 bp, Homo sapiens
tcaatgctataactatg

SEQ ID NO: 2660899 - DNA, 17 bp, Homo sapiens
tcaatgggcaatgacag

SEQ ID NO: 2660900 - DNA, 15 bp, Homo sapiens
tcaatgtgattctaa

SEQ ID NO: 2660901 - DNA, 18 bp, Homo sapiens
tcaatgtgattctaatgt

SEQ ID NO: 2660902 - DNA, 13 bp, Homo sapiens
tcaatgtgcagtg

SEQ ID NO: 2660903 - DNA, 14 bp, Homo sapiens
tcaatgttcattgt

SEQ ID NO: 2660904 - DNA, 13 bp, Homo sapiens
tcaattaaacgga

SEQ ID NO: 2660905 - DNA, 13 bp, Homo sapiens
tcaattaaatgta

SEQ ID NO: 2660906 - DNA, 15 bp, Homo sapiens
tcaattcctctggga

SEQ ID NO: 2660907 - DNA, 13 bp, Homo sapiens
tcaattcctgggc

SEQ ID NO: 2660908 - DNA, 19 bp, Homo sapiens
tcaattcttccctatcttt

SEQ ID NO: 2660909 - DNA, 12 bp, Homo sapiens
tcaatttaaaaa

SEQ ID NO: 2660910 - DNA, 13 bp, Homo sapiens
tcaatttaaaaaa

SEQ ID NO: 2660911 - DNA, 13 bp, Homo sapiens
tcaatttccaaga

SEQ ID NO: 2660912 - DNA, 20 bp, Homo sapiens
tcaatttttcttatttcatt

SEQ ID NO: 2660913 - DNA, 22 bp, Homo sapiens
tcacaaaattttattcctatat

SEQ ID NO: 2660914 - DNA, 11 bp, Homo sapiens
tcacaaataaa

SEQ ID NO: 2660915 - DNA, 20 bp, Homo sapiens
tcacaaatcctaaaagaagc

SEQ ID NO: 2660916 - DNA, 15 bp, Homo sapiens
tcacaagaagaccag

SEQ ID NO: 2660917 - DNA, 18 bp, Homo sapiens
tcacaagacccaaaaggc

SEQ ID NO: 2660918 - DNA, 22 bp, Homo sapiens
tcacaatgaaatgctctccttt

SEQ ID NO: 2660919 - DNA, 10 bp, Homo sapiens
tcacacacac

SEQ ID NO: 2660920 - DNA, 18 bp, Homo sapiens
tcacacagccaggtgcct

SEQ ID NO: 2660921 - DNA, 22 bp, Homo sapiens
tcacacagtgagtcgaggacag

SEQ ID NO: 2660922 - DNA, 23 bp, Homo sapiens
tcacacagtgagtcgaggacagg

SEQ ID NO: 2660923 - DNA, 11 bp, Homo sapiens
tcacaccagcc

SEQ ID NO: 2660924 - DNA, 21 bp, Homo sapiens
tcacaccaggcttgcctgcag

SEQ ID NO: 2660925 - DNA, 24 bp, Homo sapiens
tcacacccaccgtccgccctgctc

SEQ ID NO: 2660926 - DNA, 15 bp, Homo sapiens
tcacacctagcgtca

SEQ ID NO: 2660927 - DNA, 13 bp, Homo sapiens
tcacacctgactc

SEQ ID NO: 2660928 - DNA, 20 bp, Homo sapiens
tcacacctgactctgaaatc

SEQ ID NO: 2660929 - DNA, 23 bp, Homo sapiens
tcacacctgactctgaaatctga

SEQ ID NO: 2660930 - DNA, 19 bp, Homo sapiens
tcacacgaggggccccgtg

SEQ ID NO: 2660931 - DNA, 17 bp, Homo sapiens
tcacacgggggcagctg

SEQ ID NO: 2660932 - DNA, 13 bp, Homo sapiens
tcacactctgggt

SEQ ID NO: 2660933 - DNA, 19 bp, Homo sapiens
tcacacttccaccagcctg

SEQ ID NO: 2660934 - DNA, 16 bp, Homo sapiens
tcacagaaatgagatc

SEQ ID NO: 2660935 - DNA, 23 bp, Homo sapiens
tcacagaaatgagatcaggctct

SEQ ID NO: 2660936 - DNA, 22 bp, Homo sapiens
tcacagagacattcctccgagc

SEQ ID NO: 2660937 - DNA, 23 bp, Homo sapiens
tcacagatgtgtgattcacagtg

SEQ ID NO: 2660938 - DNA, 23 bp, Homo sapiens
tcacagccctgcttaccagataa

SEQ ID NO: 2660939 - DNA, 20 bp, Homo sapiens
tcacagcctcaagtcactcc

SEQ ID NO: 2660940 - DNA, 15 bp, Homo sapiens
tcacagcctcctctg

SEQ ID NO: 2660941 - DNA, 17 bp, Homo sapiens
tcacagcctcctctgtc

SEQ ID NO: 2660942 - DNA, 19 bp, Homo sapiens
tcacagcctcctctgtctg

SEQ ID NO: 2660943 - DNA, 13 bp, Homo sapiens
tcacagctgcttt

SEQ ID NO: 2660944 - DNA, 16 bp, Homo sapiens
tcacagcttcagccag

SEQ ID NO: 2660945 - DNA, 19 bp, Homo sapiens
tcacaggcaggtccagggt

SEQ ID NO: 2660946 - DNA, 23 bp, Homo sapiens
tcacagggactgaaaacctctcc

SEQ ID NO: 2660947 - DNA, 18 bp, Homo sapiens
tcacagggcagagccggg

SEQ ID NO: 2660948 - DNA, 14 bp, Homo sapiens
tcacagggccaact

SEQ ID NO: 2660949 - DNA, 14 bp, Homo sapiens
tcacagggttgggc

SEQ ID NO: 2660950 - DNA, 23 bp, Homo sapiens
tcacagggttgggcccagatctg

SEQ ID NO: 2660951 - DNA, 24 bp, Homo sapiens
tcacagggttgggcccagatctgg

SEQ ID NO: 2660952 - DNA, 22 bp, Homo sapiens
tcacagtccttaccagcagagc

SEQ ID NO: 2660953 - DNA, 13 bp, Homo sapiens
tcacagtgtgttt

SEQ ID NO: 2660954 - DNA, 11 bp, Homo sapiens
tcacagtgttt

SEQ ID NO: 2660955 - DNA, 23 bp, Homo sapiens
tcacagtgtttgcaatggtgttg

SEQ ID NO: 2660956 - DNA, 22 bp, Homo sapiens
tcacagttggctggatgaaatt

SEQ ID NO: 2660957 - DNA, 18 bp, Homo sapiens
tcacatagagatcatcct

SEQ ID NO: 2660958 - DNA, 15 bp, Homo sapiens
tcacatagatgtccc

SEQ ID NO: 2660959 - DNA, 17 bp, Homo sapiens
tcacatagatgtccctt

SEQ ID NO: 2660960 - DNA, 15 bp, Homo sapiens
tcacatatctgtcat

SEQ ID NO: 2660961 - DNA, 16 bp, Homo sapiens
tcacatattgatttcc

SEQ ID NO: 2660962 - DNA, 18 bp, Homo sapiens
tcacatattgatttccgt

SEQ ID NO: 2660963 - DNA, 18 bp, Homo sapiens
tcacatcctgtgtttcta

SEQ ID NO: 2660964 - DNA, 16 bp, Homo sapiens
tcacatggcctatgca

SEQ ID NO: 2660965 - DNA, 13 bp, Homo sapiens
tcacatgtatgtt

SEQ ID NO: 2660966 - DNA, 17 bp, Homo sapiens
tcacattcttataaata

SEQ ID NO: 2660967 - DNA, 23 bp, Homo sapiens
tcacattgtaactgaacttcagg

SEQ ID NO: 2660968 - DNA, 19 bp, Homo sapiens
tcacatttattctgctcac

SEQ ID NO: 2660969 - DNA, 11 bp, Homo sapiens
tcacattttcc

SEQ ID NO: 2660970 - DNA, 17 bp, Homo sapiens
tcaccaaagtatttttt

SEQ ID NO: 2660971 - DNA, 20 bp, Homo sapiens
tcaccaaatcagctgctact

SEQ ID NO: 2660972 - DNA, 23 bp, Homo sapiens
tcaccacaccaaacctctcttat

SEQ ID NO: 2660973 - DNA, 21 bp, Homo sapiens
tcaccacttcaatagatcaaa

SEQ ID NO: 2660974 - DNA, 16 bp, Homo sapiens
tcaccagagagggact

SEQ ID NO: 2660975 - DNA, 15 bp, Homo sapiens
tcaccagctcctccc

SEQ ID NO: 2660976 - DNA, 17 bp, Homo sapiens
tcaccagctgcctcttc

SEQ ID NO: 2660977 - DNA, 17 bp, Homo sapiens
tcaccagtgtcccctcc

SEQ ID NO: 2660978 - DNA, 20 bp, Homo sapiens
tcaccagtgtcccctccact

SEQ ID NO: 2660979 - DNA, 16 bp, Homo sapiens
tcaccatctcaggcca

SEQ ID NO: 2660980 - DNA, 21 bp, Homo sapiens
tcaccatgttggccaggctgg

SEQ ID NO: 2660981 - DNA, 22 bp, Homo sapiens
tcaccatttgattatgtagcaa

SEQ ID NO: 2660982 - DNA, 17 bp, Homo sapiens
tcacccagacagctccc

SEQ ID NO: 2660983 - DNA, 16 bp, Homo sapiens
tcacccagccccaggg

SEQ ID NO: 2660984 - DNA, 21 bp, Homo sapiens
tcaccccagtggccactcagc

SEQ ID NO: 2660985 - DNA, 13 bp, Homo sapiens
tcaccccatccca

SEQ ID NO: 2660986 - DNA, 16 bp, Homo sapiens
tcacccccttctccat

SEQ ID NO: 2660987 - DNA, 19 bp, Homo sapiens
tcacccgaggctgcccact

SEQ ID NO: 2660988 - DNA, 19 bp, Homo sapiens
tcacccgctaagagggagg

SEQ ID NO: 2660989 - DNA, 17 bp, Homo sapiens
tcaccctacctgtgcct

SEQ ID NO: 2660990 - DNA, 18 bp, Homo sapiens
tcaccctcgtttccagtg

SEQ ID NO: 2660991 - DNA, 13 bp, Homo sapiens
tcaccctgagccc

SEQ ID NO: 2660992 - DNA, 19 bp, Homo sapiens
tcaccctgagccccttcct

SEQ ID NO: 2660993 - DNA, 13 bp, Homo sapiens
tcaccctgtccaa

SEQ ID NO: 2660994 - DNA, 18 bp, Homo sapiens
tcacccttaccatgtgcc

SEQ ID NO: 2660995 - DNA, 16 bp, Homo sapiens
tcaccgagtgggggca

SEQ ID NO: 2660996 - DNA, 18 bp, Homo sapiens
tcaccggggtggtttagt

SEQ ID NO: 2660997 - DNA, 17 bp, Homo sapiens
tcaccgtgggctccctg

SEQ ID NO: 2660998 - DNA, 18 bp, Homo sapiens
tcaccgtgggctccctga

SEQ ID NO: 2660999 - DNA, 18 bp, Homo sapiens
tcacctcaggccaggtgc

SEQ ID NO: 2661000 - DNA, 23 bp, Homo sapiens
tcacctccggtcgtgtctctggt

SEQ ID NO: 2661001 - DNA, 18 bp, Homo sapiens
tcacctctggactggcta

SEQ ID NO: 2661002 - DNA, 17 bp, Homo sapiens
tcacctcttaaagaaaa

SEQ ID NO: 2661003 - DNA, 11 bp, Homo sapiens
tccaagtgtgc

SEQ ID NO: 2661004 - DNA, 15 bp, Homo sapiens
tccaagtgtgcatat

SEQ ID NO: 2661005 - DNA, 19 bp, Homo sapiens
tccaagtgtgcatattgta

SEQ ID NO: 2661006 - DNA, 16 bp, Homo sapiens
tccaatcctatgtttt

SEQ ID NO: 2661007 - DNA, 18 bp, Homo sapiens
tccaatcctgccccctga

SEQ ID NO: 2661008 - DNA, 17 bp, Homo sapiens
tccaatgtttagcaaat

SEQ ID NO: 2661009 - DNA, 19 bp, Homo sapiens
tccaatgtttagcaaatac

SEQ ID NO: 2661010 - DNA, 15 bp, Homo sapiens
tccaattaaggattt

SEQ ID NO: 2661011 - DNA, 22 bp, Homo sapiens
tccaatttgtaaaaacagcatt

SEQ ID NO: 2661012 - DNA, 20 bp, Homo sapiens
tccacaaaataaccaatcct

SEQ ID NO: 2661013 - DNA, 18 bp, Homo sapiens
tccacaagttaaataaat

SEQ ID NO: 2661014 - DNA, 22 bp, Homo sapiens
tccacacacagaggaagagcag

SEQ ID NO: 2661015 - DNA, 19 bp, Homo sapiens
tccacacacgcaggaactc

SEQ ID NO: 2661016 - DNA, 12 bp, Homo sapiens
tccacaccccca

SEQ ID NO: 2661017 - DNA, 21 bp, Homo sapiens
tccacaccctctcccaggacc

SEQ ID NO: 2661018 - DNA, 22 bp, Homo sapiens
tccacacctggcactgctgtgc

SEQ ID NO: 2661019 - DNA, 14 bp, Homo sapiens
tccacagctacctc

SEQ ID NO: 2661020 - DNA, 23 bp, Homo sapiens
tccacagcttcccctctctcctc

SEQ ID NO: 2661021 - DNA, 12 bp, Homo sapiens
tccacatcctcc

SEQ ID NO: 2661022 - DNA, 17 bp, Homo sapiens
tccacattgttttaaaa

SEQ ID NO: 2661023 - DNA, 13 bp, Homo sapiens
tccaccaccactg

SEQ ID NO: 2661024 - DNA, 22 bp, Homo sapiens
tccaccaccactggccaccagg

SEQ ID NO: 2661025 - DNA, 21 bp, Homo sapiens
tccaccatggggtcctaccaa

SEQ ID NO: 2661026 - DNA, 13 bp, Homo sapiens
tccacccacctca

SEQ ID NO: 2661027 - DNA, 12 bp, Homo sapiens
tccacccagcaa

SEQ ID NO: 2661028 - DNA, 17 bp, Homo sapiens
tccacccaggagccccg

SEQ ID NO: 2661029 - DNA, 22 bp, Homo sapiens
tccacccatcctaccaatgcat

SEQ ID NO: 2661030 - DNA, 22 bp, Homo sapiens
tccaccccccagaacctgtcct

SEQ ID NO: 2661031 - DNA, 12 bp, Homo sapiens
tccaccctgctc

SEQ ID NO: 2661032 - DNA, 14 bp, Homo sapiens
tccaccctgctctc

SEQ ID NO: 2661033 - DNA, 17 bp, Homo sapiens
tccaccctgtcccccag

SEQ ID NO: 2661034 - DNA, 18 bp, Homo sapiens
tccaccctgtcccccagc

SEQ ID NO: 2661035 - DNA, 20 bp, Homo sapiens
tccaccctgtcccccagctc

SEQ ID NO: 2661036 - DNA, 16 bp, Homo sapiens
tccacccttggcctgt

SEQ ID NO: 2661037 - DNA, 17 bp, Homo sapiens
tccacccttggcctgtc

SEQ ID NO: 2661038 - DNA, 20 bp, Homo sapiens
tccacccttggcctgtctca

SEQ ID NO: 2661039 - DNA, 12 bp, Homo sapiens
tccacctccttc

SEQ ID NO: 2661040 - DNA, 12 bp, Homo sapiens
tccacctgccag

SEQ ID NO: 2661041 - DNA, 21 bp, Homo sapiens
tccacctgccagggacagagg

SEQ ID NO: 2661042 - DNA, 13 bp, Homo sapiens
tccacctgtctca

SEQ ID NO: 2661043 - DNA, 18 bp, Homo sapiens
tccaccttcccatgccct

SEQ ID NO: 2661044 - DNA, 19 bp, Homo sapiens
tccaccttcccatgccctg

SEQ ID NO: 2661045 - DNA, 17 bp, Homo sapiens
tccacgactgtctccat

SEQ ID NO: 2661046 - DNA, 16 bp, Homo sapiens
tccacgctgtctccag

SEQ ID NO: 2661047 - DNA, 18 bp, Homo sapiens
tccacgctgtctccagac

SEQ ID NO: 2661048 - DNA, 23 bp, Homo sapiens
tccacgctgtctccagaccccca

SEQ ID NO: 2661049 - DNA, 14 bp, Homo sapiens
tccacggagccact

SEQ ID NO: 2661050 - DNA, 16 bp, Homo sapiens
tccactaaccccgggc

SEQ ID NO: 2661051 - DNA, 13 bp, Homo sapiens
tccactactgcta

SEQ ID NO: 2661052 - DNA, 14 bp, Homo sapiens
tccactcccaggca

SEQ ID NO: 2661053 - DNA, 19 bp, Homo sapiens
tccactcccaggcagccct

SEQ ID NO: 2661054 - DNA, 17 bp, Homo sapiens
tccactctccttgctac

SEQ ID NO: 2661055 - DNA, 19 bp, Homo sapiens
tccactctccttgctaccc

SEQ ID NO: 2661056 - DNA, 15 bp, Homo sapiens
tccactgagggcagt

SEQ ID NO: 2661057 - DNA, 16 bp, Homo sapiens
tccactggacttgagc

SEQ ID NO: 2661058 - DNA, 22 bp, Homo sapiens
tccactggccggagtcagtgcc

SEQ ID NO: 2661059 - DNA, 21 bp, Homo sapiens
tccactgtgccatgtgccagg

SEQ ID NO: 2661060 - DNA, 18 bp, Homo sapiens
tccactttcagtgaaagc

SEQ ID NO: 2661061 - DNA, 16 bp, Homo sapiens
tccactttgttcttta

SEQ ID NO: 2661062 - DNA, 18 bp, Homo sapiens
tccagaagaatattcagg

SEQ ID NO: 2661063 - DNA, 22 bp, Homo sapiens
tccagaagaatattcaggactt

SEQ ID NO: 2661064 - DNA, 17 bp, Homo sapiens
tccagaagcctctggct

SEQ ID NO: 2661065 - DNA, 23 bp, Homo sapiens
tccagaatatctgggattctact

SEQ ID NO: 2661066 - DNA, 13 bp, Homo sapiens
tccagacacatgt

SEQ ID NO: 2661067 - DNA, 12 bp, Homo sapiens
tccagaccccca

SEQ ID NO: 2661068 - DNA, 13 bp, Homo sapiens
tccagacccccac

SEQ ID NO: 2661069 - DNA, 14 bp, Homo sapiens
tccagacccccacc

SEQ ID NO: 2661070 - DNA, 20 bp, Homo sapiens
tccagacccccaccccttcc

SEQ ID NO: 2661071 - DNA, 15 bp, Homo sapiens
tccagacccccagca

SEQ ID NO: 2661072 - DNA, 21 bp, Homo sapiens
tccagaccttgttcacactct

SEQ ID NO: 2661073 - DNA, 21 bp, Homo sapiens
tccagagagagaagtgcccct

SEQ ID NO: 2661074 - DNA, 18 bp, Homo sapiens
tccagagagtcctctgga

SEQ ID NO: 2661075 - DNA, 22 bp, Homo sapiens
tccagattttttacagctgcct

SEQ ID NO: 2661076 - DNA, 13 bp, Homo sapiens
tccagccaacccc

SEQ ID NO: 2661077 - DNA, 13 bp, Homo sapiens
tccagccagggct

SEQ ID NO: 2661078 - DNA, 16 bp, Homo sapiens
tccagcccctggatgc

SEQ ID NO: 2661079 - DNA, 17 bp, Homo sapiens
tccagcccctggatgca

SEQ ID NO: 2661080 - DNA, 19 bp, Homo sapiens
tccagcccctggatgcagc

SEQ ID NO: 2661081 - DNA, 21 bp, Homo sapiens
tccagcccctggatgcagcct

SEQ ID NO: 2661082 - DNA, 15 bp, Homo sapiens
tccagccctggctga

SEQ ID NO: 2661083 - DNA, 16 bp, Homo sapiens
tccagccgccattgcc

SEQ ID NO: 2661084 - DNA, 19 bp, Homo sapiens
tccagccgccattgccacc

SEQ ID NO: 2661085 - DNA, 20 bp, Homo sapiens
tccagccgccattgccacca

SEQ ID NO: 2661086 - DNA, 15 bp, Homo sapiens
tccagcctctcccct

SEQ ID NO: 2661087 - DNA, 12 bp, Homo sapiens
tccagcctctgt

SEQ ID NO: 2661088 - DNA, 13 bp, Homo sapiens
tccagcctggctc

SEQ ID NO: 2661089 - DNA, 12 bp, Homo sapiens
tccagcctgggc

SEQ ID NO: 2661090 - DNA, 16 bp, Homo sapiens
tccagctcaccagccc

SEQ ID NO: 2661091 - DNA, 23 bp, Homo sapiens
tccagctcaccagccccagtgcc

SEQ ID NO: 2661092 - DNA, 21 bp, Homo sapiens
tccagctcaccccccacactc

SEQ ID NO: 2661093 - DNA, 23 bp, Homo sapiens
tccagctcctcatccagggctct

SEQ ID NO: 2661094 - DNA, 23 bp, Homo sapiens
tccagcttctggtactctcctag

SEQ ID NO: 2661095 - DNA, 16 bp, Homo sapiens
tccagcttgtggagcc

SEQ ID NO: 2661096 - DNA, 18 bp, Homo sapiens
tccagcttgtggagcccc

SEQ ID NO: 2661097 - DNA, 22 bp, Homo sapiens
tccaggaatgcctcctccctgg

SEQ ID NO: 2661098 - DNA, 20 bp, Homo sapiens
tccaggagaaggccaattcc

SEQ ID NO: 2661099 - DNA, 14 bp, Homo sapiens
tccaggagcctggc

SEQ ID NO: 2661100 - DNA, 23 bp, Homo sapiens
tccaggagcctggctccgtccag

SEQ ID NO: 2661101 - DNA, 18 bp, Homo sapiens
tccaggagcctgtgcctc

SEQ ID NO: 2661102 - DNA, 15 bp, Homo sapiens
tccaggatccagaag

SEQ ID NO: 2661103 - DNA, 19 bp, Homo sapiens
tccaggattgaagagcatt

SEQ ID NO: 2661104 - DNA, 22 bp, Homo sapiens
tccaggcagtcgggggctggcc

SEQ ID NO: 2661105 - DNA, 23 bp, Homo sapiens
tccaggctctttggggtcagcca

SEQ ID NO: 2661106 - DNA, 17 bp, Homo sapiens
tccaggctgggagagcc

SEQ ID NO: 2661107 - DNA, 23 bp, Homo sapiens
tccaggctgggagagccttccag

SEQ ID NO: 2661108 - DNA, 17 bp, Homo sapiens
tccagggaagctggccg

SEQ ID NO: 2661109 - DNA, 13 bp, Homo sapiens
tccagggctctga

SEQ ID NO: 2661110 - DNA, 19 bp, Homo sapiens
tccaggggcccctccagct

SEQ ID NO: 2661111 - DNA, 15 bp, Homo sapiens
tccaggtatctccag

SEQ ID NO: 2661112 - DNA, 16 bp, Homo sapiens
tccaggtatctccagg

SEQ ID NO: 2661113 - DNA, 17 bp, Homo sapiens
tccaggtatctccagga

SEQ ID NO: 2661114 - DNA, 16 bp, Homo sapiens
tccaggtctcacgggc

SEQ ID NO: 2661115 - DNA, 15 bp, Homo sapiens
tccaggtgcacaagc

SEQ ID NO: 2661116 - DNA, 22 bp, Homo sapiens
tccaggtgcacaagctccaagc

SEQ ID NO: 2661117 - DNA, 15 bp, Homo sapiens
tccaggtttttcaat

SEQ ID NO: 2661118 - DNA, 17 bp, Homo sapiens
tccaggtttttcaatta

SEQ ID NO: 2661119 - DNA, 19 bp, Homo sapiens
tccaggtttttcaattaaa

SEQ ID NO: 2661120 - DNA, 20 bp, Homo sapiens
tccaggtttttcaattaaac

SEQ ID NO: 2661121 - DNA, 17 bp, Homo sapiens
tccagtacctttgtcac

SEQ ID NO: 2661122 - DNA, 19 bp, Homo sapiens
tccagtattcttgtcaaaa

SEQ ID NO: 2661123 - DNA, 13 bp, Homo sapiens
tccagtcaacaaa

SEQ ID NO: 2661124 - DNA, 22 bp, Homo sapiens
tccagtcaacaaactatttctt

SEQ ID NO: 2661125 - DNA, 23 bp, Homo sapiens
tccagtccaaggaaaccacagct

SEQ ID NO: 2661126 - DNA, 16 bp, Homo sapiens
tccagtctgctgccct

SEQ ID NO: 2661127 - DNA, 20 bp, Homo sapiens
tccagtctgctgccctccat

SEQ ID NO: 2661128 - DNA, 22 bp, Homo sapiens
tccagtctgctgccctccatcc

SEQ ID NO: 2661129 - DNA, 14 bp, Homo sapiens
tccagtgagacagc

SEQ ID NO: 2661130 - DNA, 19 bp, Homo sapiens
tccagtgaggctctgccct

SEQ ID NO: 2661131 - DNA, 23 bp, Homo sapiens
tccagtgaggctctgcccttggt

SEQ ID NO: 2661132 - DNA, 18 bp, Homo sapiens
tccagtgcaacactgaag

SEQ ID NO: 2661133 - DNA, 20 bp, Homo sapiens
tccagtggtccatggaatgc

SEQ ID NO: 2661134 - DNA, 15 bp, Homo sapiens
tccagtggttgctgt

SEQ ID NO: 2661135 - DNA, 19 bp, Homo sapiens
tccagttaaaaaaaatttt

SEQ ID NO: 2661136 - DNA, 18 bp, Homo sapiens
tccagttaattacatcct

SEQ ID NO: 2661137 - DNA, 16 bp, Homo sapiens
tccagttcatgagaat

SEQ ID NO: 2661138 - DNA, 16 bp, Homo sapiens
tccataaggaatgtag

SEQ ID NO: 2661139 - DNA, 20 bp, Homo sapiens
tccataatgtataaagaaca

SEQ ID NO: 2661140 - DNA, 13 bp, Homo sapiens
tccatacagctct

SEQ ID NO: 2661141 - DNA, 14 bp, Homo sapiens
tccatacagctcta

SEQ ID NO: 2661142 - DNA, 15 bp, Homo sapiens
tccatagagagcaag

SEQ ID NO: 2661143 - DNA, 20 bp, Homo sapiens
tccatagagagcaagacgct

SEQ ID NO: 2661144 - DNA, 21 bp, Homo sapiens
tccatagcctaatccctgggc

SEQ ID NO: 2661145 - DNA, 18 bp, Homo sapiens
tccatagtagtatgatga

SEQ ID NO: 2661146 - DNA, 12 bp, Homo sapiens
tccatataaata

SEQ ID NO: 2661147 - DNA, 13 bp, Homo sapiens
tcctcacccccag

SEQ ID NO: 2661148 - DNA, 20 bp, Homo sapiens
tcctcacccccagctttgct

SEQ ID NO: 2661149 - DNA, 13 bp, Homo sapiens
tcctcacctctgg

SEQ ID NO: 2661150 - DNA, 16 bp, Homo sapiens
tcctcacctctggact

SEQ ID NO: 2661151 - DNA, 13 bp, Homo sapiens
tcctcactcccag

SEQ ID NO: 2661152 - DNA, 19 bp, Homo sapiens
tcctcactcccttcccata

SEQ ID NO: 2661153 - DNA, 22 bp, Homo sapiens
tcctcacttccatacagctcta

SEQ ID NO: 2661154 - DNA, 20 bp, Homo sapiens
tcctcagagaatttctacca

SEQ ID NO: 2661155 - DNA, 18 bp, Homo sapiens
tcctcatacccaccccca

SEQ ID NO: 2661156 - DNA, 21 bp, Homo sapiens
tcctcatatggcccagtgtca

SEQ ID NO: 2661157 - DNA, 22 bp, Homo sapiens
tcctcatcccgtgttctccttt

SEQ ID NO: 2661158 - DNA, 17 bp, Homo sapiens
tcctcatgttctgcttt

SEQ ID NO: 2661159 - DNA, 18 bp, Homo sapiens
tcctcattagcattttgc

SEQ ID NO: 2661160 - DNA, 21 bp, Homo sapiens
tcctcatttggggtagctaga

SEQ ID NO: 2661161 - DNA, 18 bp, Homo sapiens
tcctccaaaggcccccta

SEQ ID NO: 2661162 - DNA, 21 bp, Homo sapiens
tcctccaagacactgtggact

SEQ ID NO: 2661163 - DNA, 21 bp, Homo sapiens
tcctccacgttctgctcatca

SEQ ID NO: 2661164 - DNA, 22 bp, Homo sapiens
tcctccacgttctgctcatcat

SEQ ID NO: 2661165 - DNA, 16 bp, Homo sapiens
tcctccagaagcctct

SEQ ID NO: 2661166 - DNA, 18 bp, Homo sapiens
tcctccagaagcctctgg

SEQ ID NO: 2661167 - DNA, 19 bp, Homo sapiens
tcctccagaagcctctggc

SEQ ID NO: 2661168 - DNA, 13 bp, Homo sapiens
tcctccaggtgca

SEQ ID NO: 2661169 - DNA, 22 bp, Homo sapiens
tcctccaggtgcacaagctcca

SEQ ID NO: 2661170 - DNA, 21 bp, Homo sapiens
tcctccaggtttttcaattaa

SEQ ID NO: 2661171 - DNA, 23 bp, Homo sapiens
tcctccaggtttttcaattaaac

SEQ ID NO: 2661172 - DNA, 15 bp, Homo sapiens
tcctcccatcccctg

SEQ ID NO: 2661173 - DNA, 19 bp, Homo sapiens
tcctcccatcccctggact

SEQ ID NO: 2661174 - DNA, 19 bp, Homo sapiens
tcctccccaaggagacaca

SEQ ID NO: 2661175 - DNA, 21 bp, Homo sapiens
tcctccccacttgtccgctgg

SEQ ID NO: 2661176 - DNA, 13 bp, Homo sapiens
tcctccccttccc

SEQ ID NO: 2661177 - DNA, 14 bp, Homo sapiens
tcctccccttccct

SEQ ID NO: 2661178 - DNA, 13 bp, Homo sapiens
tcctccccttggg

SEQ ID NO: 2661179 - DNA, 16 bp, Homo sapiens
tcctcccgggccctcc

SEQ ID NO: 2661180 - DNA, 21 bp, Homo sapiens
tcctcccgggccctcccttgg

SEQ ID NO: 2661181 - DNA, 12 bp, Homo sapiens
tcctccctggct

SEQ ID NO: 2661182 - DNA, 22 bp, Homo sapiens
tcctccctggctgccctggccc

SEQ ID NO: 2661183 - DNA, 19 bp, Homo sapiens
tcctccctgggcagaaagt

SEQ ID NO: 2661184 - DNA, 20 bp, Homo sapiens
tcctcccttgggttctgata

SEQ ID NO: 2661185 - DNA, 14 bp, Homo sapiens
tcctccgtccagcc

SEQ ID NO: 2661186 - DNA, 15 bp, Homo sapiens
tcctcctcccccaga

SEQ ID NO: 2661187 - DNA, 12 bp, Homo sapiens
tcctcctgccca

SEQ ID NO: 2661188 - DNA, 14 bp, Homo sapiens
tcctcctgggccct

SEQ ID NO: 2661189 - DNA, 16 bp, Homo sapiens
tcctcctgggccctct

SEQ ID NO: 2661190 - DNA, 20 bp, Homo sapiens
tcctcctgggccctctctgc

SEQ ID NO: 2661191 - DNA, 20 bp, Homo sapiens
tcctcctggtgggtccaggg

SEQ ID NO: 2661192 - DNA, 21 bp, Homo sapiens
tcctcctggtgggtccagggg

SEQ ID NO: 2661193 - DNA, 16 bp, Homo sapiens
tcctcctgtgtacagg

SEQ ID NO: 2661194 - DNA, 13 bp, Homo sapiens
tcctcgcaagctg

SEQ ID NO: 2661195 - DNA, 14 bp, Homo sapiens
tcctcgcaagctgg

SEQ ID NO: 2661196 - DNA, 16 bp, Homo sapiens
tcctcgcaagctgggt

SEQ ID NO: 2661197 - DNA, 14 bp, Homo sapiens
tcctcgcagagagg

SEQ ID NO: 2661198 - DNA, 23 bp, Homo sapiens
tcctcgcagagaggccaggtgca

SEQ ID NO: 2661199 - DNA, 19 bp, Homo sapiens
tcctctactaacaatcagc

SEQ ID NO: 2661200 - DNA, 20 bp, Homo sapiens
tcctctcaaccacctttcag

SEQ ID NO: 2661201 - DNA, 14 bp, Homo sapiens
tcctctccaggcac

SEQ ID NO: 2661202 - DNA, 14 bp, Homo sapiens
tcctctcccatccc

SEQ ID NO: 2661203 - DNA, 15 bp, Homo sapiens
tcctctcccatcccc

SEQ ID NO: 2661204 - DNA, 17 bp, Homo sapiens
tcctctcccatccccct

SEQ ID NO: 2661205 - DNA, 18 bp, Homo sapiens
tcctctcccatccccctg

SEQ ID NO: 2661206 - DNA, 18 bp, Homo sapiens
tcctctcccctaccactg

SEQ ID NO: 2661207 - DNA, 13 bp, Homo sapiens
tcctctcctggag

SEQ ID NO: 2661208 - DNA, 16 bp, Homo sapiens
tcctctcctggaggat

SEQ ID NO: 2661209 - DNA, 11 bp, Homo sapiens
tcctctctgcc

SEQ ID NO: 2661210 - DNA, 15 bp, Homo sapiens
tcctctgactcaggg

SEQ ID NO: 2661211 - DNA, 16 bp, Homo sapiens
tcctctgcagctgacc

SEQ ID NO: 2661212 - DNA, 17 bp, Homo sapiens
tcctctgcagctgacct

SEQ ID NO: 2661213 - DNA, 20 bp, Homo sapiens
tcctctgcagctgacctctg

SEQ ID NO: 2661214 - DNA, 13 bp, Homo sapiens
tcctctgcagtgc

SEQ ID NO: 2661215 - DNA, 10 bp, Homo sapiens
tcctctgcct

SEQ ID NO: 2661216 - DNA, 12 bp, Homo sapiens
tcctctgctgct

SEQ ID NO: 2661217 - DNA, 19 bp, Homo sapiens
tcctctggatggcaccaga

SEQ ID NO: 2661218 - DNA, 20 bp, Homo sapiens
tcctctgggcaggacctcag

SEQ ID NO: 2661219 - DNA, 18 bp, Homo sapiens
tcctctgtacagagccca

SEQ ID NO: 2661220 - DNA, 19 bp, Homo sapiens
tcctctgtacagagcccac

SEQ ID NO: 2661221 - DNA, 12 bp, Homo sapiens
tcctctgtgaag

SEQ ID NO: 2661222 - DNA, 20 bp, Homo sapiens
tcctctgtgaccaatgtctt

SEQ ID NO: 2661223 - DNA, 15 bp, Homo sapiens
tcctcttccccttgc

SEQ ID NO: 2661224 - DNA, 16 bp, Homo sapiens
tcctcttccccttgcc

SEQ ID NO: 2661225 - DNA, 19 bp, Homo sapiens
tcctcttccccttgccctt

SEQ ID NO: 2661226 - DNA, 12 bp, Homo sapiens
tcctcttcctct

SEQ ID NO: 2661227 - DNA, 13 bp, Homo sapiens
tcctcttcctctg

SEQ ID NO: 2661228 - DNA, 15 bp, Homo sapiens
tcctcttctgacgtg

SEQ ID NO: 2661229 - DNA, 23 bp, Homo sapiens
tcctcttctgcttaggagagacc

SEQ ID NO: 2661230 - DNA, 13 bp, Homo sapiens
tcctcttctttat

SEQ ID NO: 2661231 - DNA, 13 bp, Homo sapiens
tcctgaagctgag

SEQ ID NO: 2661232 - DNA, 22 bp, Homo sapiens
tcctgaatccaaactaatccat

SEQ ID NO: 2661233 - DNA, 15 bp, Homo sapiens
tcctgaattctattt

SEQ ID NO: 2661234 - DNA, 22 bp, Homo sapiens
tcctgaatttattattgttctt

SEQ ID NO: 2661235 - DNA, 13 bp, Homo sapiens
tcctgacacttta

SEQ ID NO: 2661236 - DNA, 19 bp, Homo sapiens
tcctgaccaccctcccctc

SEQ ID NO: 2661237 - DNA, 20 bp, Homo sapiens
tcctgaccaccctcccctct

SEQ ID NO: 2661238 - DNA, 15 bp, Homo sapiens
tcctgacccaggccg

SEQ ID NO: 2661239 - DNA, 20 bp, Homo sapiens
tcctgacctgtctcaccatg

SEQ ID NO: 2661240 - DNA, 15 bp, Homo sapiens
tcctgactctgcccc

SEQ ID NO: 2661241 - DNA, 22 bp, Homo sapiens
tcctgactctgccccctgctgg

SEQ ID NO: 2661242 - DNA, 23 bp, Homo sapiens
tcctgactctgccccctgctggc

SEQ ID NO: 2661243 - DNA, 23 bp, Homo sapiens
tcctgagaataagaaagtttcac

SEQ ID NO: 2661244 - DNA, 16 bp, Homo sapiens
tcctgagaccacagag

SEQ ID NO: 2661245 - DNA, 14 bp, Homo sapiens
tcctgagacccctg

SEQ ID NO: 2661246 - DNA, 20 bp, Homo sapiens
tcctgagacccctggcctcc

SEQ ID NO: 2661247 - DNA, 15 bp, Homo sapiens
tcctgagcttggcca

SEQ ID NO: 2661248 - DNA, 20 bp, Homo sapiens
tcctgagcttggccagaagg

SEQ ID NO: 2661249 - DNA, 18 bp, Homo sapiens
tcctgaggacagctgtcc

SEQ ID NO: 2661250 - DNA, 15 bp, Homo sapiens
tcctgaggctgggct

SEQ ID NO: 2661251 - DNA, 16 bp, Homo sapiens
tcctgaggctgggctc

SEQ ID NO: 2661252 - DNA, 17 bp, Homo sapiens
tcctgaggctgggctcc

SEQ ID NO: 2661253 - DNA, 23 bp, Homo sapiens
tcctgatatgatttaaaacatgt

SEQ ID NO: 2661254 - DNA, 24 bp, Homo sapiens
tcctgatatgatttaaaacatgta

SEQ ID NO: 2661255 - DNA, 19 bp, Homo sapiens
tcctgatggtcagctccct

SEQ ID NO: 2661256 - DNA, 20 bp, Homo sapiens
tcctgcaatgaagtctctga

SEQ ID NO: 2661257 - DNA, 22 bp, Homo sapiens
tcctgcaatgaagtctctgaag

SEQ ID NO: 2661258 - DNA, 20 bp, Homo sapiens
tcctgcacagttttctggct

SEQ ID NO: 2661259 - DNA, 16 bp, Homo sapiens
tcctgcaggcagccag

SEQ ID NO: 2661260 - DNA, 19 bp, Homo sapiens
tcctgcaggccaggccagc

SEQ ID NO: 2661261 - DNA, 20 bp, Homo sapiens
tcctgcaggccaggccagct

SEQ ID NO: 2661262 - DNA, 16 bp, Homo sapiens
tcctgcatttgtgaaa

SEQ ID NO: 2661263 - DNA, 14 bp, Homo sapiens
tcctgccaccagtc

SEQ ID NO: 2661264 - DNA, 21 bp, Homo sapiens
tcctgccccctgaaacttatt

SEQ ID NO: 2661265 - DNA, 18 bp, Homo sapiens
tcctgcccctgagcccat

SEQ ID NO: 2661266 - DNA, 12 bp, Homo sapiens
tcctgccctgtt

SEQ ID NO: 2661267 - DNA, 14 bp, Homo sapiens
tcctgcctccgcct

SEQ ID NO: 2661268 - DNA, 16 bp, Homo sapiens
tcctgcctggccaggc

SEQ ID NO: 2661269 - DNA, 16 bp, Homo sapiens
tcctgccttcctcctg

SEQ ID NO: 2661270 - DNA, 23 bp, Homo sapiens
tcctgccttcctcctgggccctc

SEQ ID NO: 2661271 - DNA, 13 bp, Homo sapiens
tcctgccttctgt

SEQ ID NO: 2661272 - DNA, 22 bp, Homo sapiens
tcctgccttctgtcctggtgtc

SEQ ID NO: 2661273 - DNA, 22 bp, Homo sapiens
tcctgccttcttctttttgctg

SEQ ID NO: 2661274 - DNA, 19 bp, Homo sapiens
tcctgcggagtgaagaggg

SEQ ID NO: 2661275 - DNA, 23 bp, Homo sapiens
tcctgcggagtgaagaggggcag

SEQ ID NO: 2661276 - DNA, 21 bp, Homo sapiens
tcctgctacaacttcagcagt

SEQ ID NO: 2661277 - DNA, 18 bp, Homo sapiens
tcctgctactctgttcct

SEQ ID NO: 2661278 - DNA, 15 bp, Homo sapiens
tcctgctcatattgt

SEQ ID NO: 2661279 - DNA, 16 bp, Homo sapiens
tcctgctcatattgtg

SEQ ID NO: 2661280 - DNA, 18 bp, Homo sapiens
tcctgctccacagccatc

SEQ ID NO: 2661281 - DNA, 21 bp, Homo sapiens
tcctgctgcagttgccagtca

SEQ ID NO: 2661282 - DNA, 18 bp, Homo sapiens
tcctggaagccagctttc

SEQ ID NO: 2661283 - DNA, 19 bp, Homo sapiens
tcctggacactcagacctg

SEQ ID NO: 2661284 - DNA, 21 bp, Homo sapiens
tcctggacatcctcttctgct

SEQ ID NO: 2661285 - DNA, 14 bp, Homo sapiens
tcctggacattttt

SEQ ID NO: 2661286 - DNA, 18 bp, Homo sapiens
tcctggagcctttgaata

SEQ ID NO: 2661287 - DNA, 21 bp, Homo sapiens
tcctggagggaagcactgcct

SEQ ID NO: 2661288 - DNA, 20 bp, Homo sapiens
tcctggcacccggcccctgc

SEQ ID NO: 2661289 - DNA, 22 bp, Homo sapiens
tcctggcacccggcccctgctg

SEQ ID NO: 2661290 - DNA, 17 bp, Homo sapiens
tcctggcactgcttcca

SEQ ID NO: 2661291 - DNA, 21 bp, Homo sapiens
tcgcatcaaaagacaattctt

SEQ ID NO: 2661292 - DNA, 22 bp, Homo sapiens
tcgcatcaaaagacaattcttt

SEQ ID NO: 2661293 - DNA, 18 bp, Homo sapiens
tcgccacccctccttcct

SEQ ID NO: 2661294 - DNA, 13 bp, Homo sapiens
tcgccatgccggg

SEQ ID NO: 2661295 - DNA, 12 bp, Homo sapiens
tcgcccaggaga

SEQ ID NO: 2661296 - DNA, 18 bp, Homo sapiens
tcgccccagatcaccagc

SEQ ID NO: 2661297 - DNA, 20 bp, Homo sapiens
tcgccccagatcaccagccc

SEQ ID NO: 2661298 - DNA, 11 bp, Homo sapiens
tcgcccgccca

SEQ ID NO: 2661299 - DNA, 15 bp, Homo sapiens
tcgcccgcccactgt

SEQ ID NO: 2661300 - DNA, 17 bp, Homo sapiens
tcgcccgcccactgtcc

SEQ ID NO: 2661301 - DNA, 21 bp, Homo sapiens
tcgcccgcccactgtcctggg

SEQ ID NO: 2661302 - DNA, 12 bp, Homo sapiens
tcgcctgtaatc

SEQ ID NO: 2661303 - DNA, 20 bp, Homo sapiens
tcgccttagcatgtttgctg

SEQ ID NO: 2661304 - DNA, 21 bp, Homo sapiens
tcgccttagcatgtttgctga

SEQ ID NO: 2661305 - DNA, 18 bp, Homo sapiens
tcgcggcggagctggccc

SEQ ID NO: 2661306 - DNA, 19 bp, Homo sapiens
tcgcggcggagctggcccc

SEQ ID NO: 2661307 - DNA, 16 bp, Homo sapiens
tcgcgtgccctcgctg

SEQ ID NO: 2661308 - DNA, 12 bp, Homo sapiens
tcgctcctgtgt

SEQ ID NO: 2661309 - DNA, 14 bp, Homo sapiens
tcgctcctgtgtct

SEQ ID NO: 2661310 - DNA, 22 bp, Homo sapiens
tcgctctgtcacccaggctgga

SEQ ID NO: 2661311 - DNA, 23 bp, Homo sapiens
tcgctggactctcagtctctgag

SEQ ID NO: 2661312 - DNA, 16 bp, Homo sapiens
tcgctgtggttgtttt

SEQ ID NO: 2661313 - DNA, 18 bp, Homo sapiens
tcggaaaacatgctacac

SEQ ID NO: 2661314 - DNA, 16 bp, Homo sapiens
tcggaagcagtgcctt

SEQ ID NO: 2661315 - DNA, 22 bp, Homo sapiens
tcggactaagcctacctgctct

SEQ ID NO: 2661316 - DNA, 12 bp, Homo sapiens
tcggagaagagc

SEQ ID NO: 2661317 - DNA, 14 bp, Homo sapiens
tcggagaagagctg

SEQ ID NO: 2661318 - DNA, 14 bp, Homo sapiens
tcggaggctgcccc

SEQ ID NO: 2661319 - DNA, 22 bp, Homo sapiens
tcggaggcttgtcagagctggg

SEQ ID NO: 2661320 - DNA, 20 bp, Homo sapiens
tcggcctctaaccccaggcc

SEQ ID NO: 2661321 - DNA, 22 bp, Homo sapiens
tcggcctctaaccccaggcccc

SEQ ID NO: 2661322 - DNA, 14 bp, Homo sapiens
tcgggaacagtgtt

SEQ ID NO: 2661323 - DNA, 23 bp, Homo sapiens
tcgggaagagaggagttcaatga

SEQ ID NO: 2661324 - DNA, 14 bp, Homo sapiens
tcgggagcagtgtc

SEQ ID NO: 2661325 - DNA, 19 bp, Homo sapiens
tcgggagcagtgtcttcca

SEQ ID NO: 2661326 - DNA, 16 bp, Homo sapiens
tcgggaggctgagaca

SEQ ID NO: 2661327 - DNA, 17 bp, Homo sapiens
tcgggaggtcgaggcag

SEQ ID NO: 2661328 - DNA, 19 bp, Homo sapiens
tcgggaggtcgaggcagga

SEQ ID NO: 2661329 - DNA, 17 bp, Homo sapiens
tcgggcccacctggcca

SEQ ID NO: 2661330 - DNA, 12 bp, Homo sapiens
tcgggcccagcc

SEQ ID NO: 2661331 - DNA, 17 bp, Homo sapiens
tcggggcatgctggggc

SEQ ID NO: 2661332 - DNA, 13 bp, Homo sapiens
tcgggggctggcc

SEQ ID NO: 2661333 - DNA, 21 bp, Homo sapiens
tcggtaagttgaatggcctgc

SEQ ID NO: 2661334 - DNA, 19 bp, Homo sapiens
tcggtttctaacttggagc

SEQ ID NO: 2661335 - DNA, 20 bp, Homo sapiens
tcgtaaccagccagatcctc

SEQ ID NO: 2661336 - DNA, 15 bp, Homo sapiens
tcgtacagaaagctg

SEQ ID NO: 2661337 - DNA, 21 bp, Homo sapiens
tcgtatagctgtattgaatca

SEQ ID NO: 2661338 - DNA, 23 bp, Homo sapiens
tcgtcatcatttttccttccctt

SEQ ID NO: 2661339 - DNA, 16 bp, Homo sapiens
tcgtcgcacagtctct

SEQ ID NO: 2661340 - DNA, 16 bp, Homo sapiens
tcgtctgactgtgtgt

SEQ ID NO: 2661341 - DNA, 18 bp, Homo sapiens
tcgtctgtttataaacat

SEQ ID NO: 2661342 - DNA, 16 bp, Homo sapiens
tcgtcttaactcacca

SEQ ID NO: 2661343 - DNA, 20 bp, Homo sapiens
tcgtgacgctgaataaatgt

SEQ ID NO: 2661344 - DNA, 15 bp, Homo sapiens
tcgtgataaactttg

SEQ ID NO: 2661345 - DNA, 20 bp, Homo sapiens
tcgtgcctccttccacctcc

SEQ ID NO: 2661346 - DNA, 23 bp, Homo sapiens
tcgtgcctccttccacctccctc

SEQ ID NO: 2661347 - DNA, 23 bp, Homo sapiens
tcgtggaaagggtgctgcttccc

SEQ ID NO: 2661348 - DNA, 21 bp, Homo sapiens
tcgtggagacagggcatttga

SEQ ID NO: 2661349 - DNA, 17 bp, Homo sapiens
tcgtggagatgtcttcg

SEQ ID NO: 2661350 - DNA, 20 bp, Homo sapiens
tcgtggcagataatcagcct

SEQ ID NO: 2661351 - DNA, 22 bp, Homo sapiens
tcgtggcagataatcagcctct

SEQ ID NO: 2661352 - DNA, 23 bp, Homo sapiens
tcgtgggagagagacgtgtacat

SEQ ID NO: 2661353 - DNA, 19 bp, Homo sapiens
tcgtgggtctgttttcctt

SEQ ID NO: 2661354 - DNA, 22 bp, Homo sapiens
tcgtgggtgtgtgtagccaagg

SEQ ID NO: 2661355 - DNA, 22 bp, Homo sapiens
tcgtggtgatcaattaaatgta

SEQ ID NO: 2661356 - DNA, 13 bp, Homo sapiens
tcgtgtatcctgg

SEQ ID NO: 2661357 - DNA, 12 bp, Homo sapiens
tcgtttcaaaaa

SEQ ID NO: 2661358 - DNA, 19 bp, Homo sapiens
tcgtttcaaaaacacagtg

SEQ ID NO: 2661359 - DNA, 17 bp, Homo sapiens
tcgtttgaatcacagta

SEQ ID NO: 2661360 - DNA, 14 bp, Homo sapiens
tctaaaaacaccaa

SEQ ID NO: 2661361 - DNA, 18 bp, Homo sapiens
tctaaacaagaatcagtc

SEQ ID NO: 2661362 - DNA, 13 bp, Homo sapiens
tctaaacattaat

SEQ ID NO: 2661363 - DNA, 21 bp, Homo sapiens
tctaaactggattcacagctc

SEQ ID NO: 2661364 - DNA, 20 bp, Homo sapiens
tctaaagagtttattttaag

SEQ ID NO: 2661365 - DNA, 18 bp, Homo sapiens
tctaaagccttaagtctt

SEQ ID NO: 2661366 - DNA, 17 bp, Homo sapiens
tctaaaggctacctttg

SEQ ID NO: 2661367 - DNA, 19 bp, Homo sapiens
tctaaaggctacctttgta

SEQ ID NO: 2661368 - DNA, 17 bp, Homo sapiens
tctaaatacctgccctg

SEQ ID NO: 2661369 - DNA, 13 bp, Homo sapiens
tctaaatatttcc

SEQ ID NO: 2661370 - DNA, 21 bp, Homo sapiens
tctaaatctccaaaataaaac

SEQ ID NO: 2661371 - DNA, 17 bp, Homo sapiens
tctaaattgaataatgg

SEQ ID NO: 2661372 - DNA, 13 bp, Homo sapiens
tctaacaatgaca

SEQ ID NO: 2661373 - DNA, 16 bp, Homo sapiens
tctaaccccaggcccc

SEQ ID NO: 2661374 - DNA, 20 bp, Homo sapiens
tctaacctcatcttcttcac

SEQ ID NO: 2661375 - DNA, 15 bp, Homo sapiens
tctaacctgatggca

SEQ ID NO: 2661376 - DNA, 15 bp, Homo sapiens
tctaactcagaaaca

SEQ ID NO: 2661377 - DNA, 15 bp, Homo sapiens
tctaacttcaccata

SEQ ID NO: 2661378 - DNA, 22 bp, Homo sapiens
tctaacttcaccatattaccac

SEQ ID NO: 2661379 - DNA, 20 bp, Homo sapiens
tctaagagaacaatgtgcta

SEQ ID NO: 2661380 - DNA, 14 bp, Homo sapiens
tctaaggttctcat

SEQ ID NO: 2661381 - DNA, 14 bp, Homo sapiens
tctaagtaaaacca

SEQ ID NO: 2661382 - DNA, 15 bp, Homo sapiens
tctaagtaaaaccac

SEQ ID NO: 2661383 - DNA, 20 bp, Homo sapiens
tctaagtaaaaccacagcag

SEQ ID NO: 2661384 - DNA, 21 bp, Homo sapiens
tctaagtaaaaccacagcagt

SEQ ID NO: 2661385 - DNA, 23 bp, Homo sapiens
tctaagtaaaaccacagcagttg

SEQ ID NO: 2661386 - DNA, 19 bp, Homo sapiens
tctaagtcaatccaagagt

SEQ ID NO: 2661387 - DNA, 13 bp, Homo sapiens
tctaagtctttcc

SEQ ID NO: 2661388 - DNA, 16 bp, Homo sapiens
tctaatacctctgtgt

SEQ ID NO: 2661389 - DNA, 20 bp, Homo sapiens
tctaatacctctgtgtgctc

SEQ ID NO: 2661390 - DNA, 19 bp, Homo sapiens
tctaatagaactcagtttt

SEQ ID NO: 2661391 - DNA, 22 bp, Homo sapiens
tctaatagaactcagttttaac

SEQ ID NO: 2661392 - DNA, 21 bp, Homo sapiens
tctaatagcgggttactttca

SEQ ID NO: 2661393 - DNA, 15 bp, Homo sapiens
tctaatatattttta

SEQ ID NO: 2661394 - DNA, 20 bp, Homo sapiens
tctaatatggcaaaaatggc

SEQ ID NO: 2661395 - DNA, 14 bp, Homo sapiens
tctaatatgtaaca

SEQ ID NO: 2661396 - DNA, 19 bp, Homo sapiens
tctaattcccattttgcaa

SEQ ID NO: 2661397 - DNA, 21 bp, Homo sapiens
tctaattcccattttgcaaaa

SEQ ID NO: 2661398 - DNA, 22 bp, Homo sapiens
tctaatttcaaaaatataactt

SEQ ID NO: 2661399 - DNA, 21 bp, Homo sapiens
tctacactgtgctgagtctga

SEQ ID NO: 2661400 - DNA, 17 bp, Homo sapiens
tctacagacttctccag

SEQ ID NO: 2661401 - DNA, 18 bp, Homo sapiens
tctacagacttctccaga

SEQ ID NO: 2661402 - DNA, 17 bp, Homo sapiens
tctacagagcttccctg

SEQ ID NO: 2661403 - DNA, 17 bp, Homo sapiens
tctacatcttctgcctt

SEQ ID NO: 2661404 - DNA, 19 bp, Homo sapiens
tctacatcttttttcacaa

SEQ ID NO: 2661405 - DNA, 17 bp, Homo sapiens
tctaccagactgtgtat

SEQ ID NO: 2661406 - DNA, 22 bp, Homo sapiens
tctaccagcctccctatttttt

SEQ ID NO: 2661407 - DNA, 14 bp, Homo sapiens
tctaccatttcaga

SEQ ID NO: 2661408 - DNA, 15 bp, Homo sapiens
tctaccatttcagag

SEQ ID NO: 2661409 - DNA, 14 bp, Homo sapiens
tctacccaggtgct

SEQ ID NO: 2661410 - DNA, 15 bp, Homo sapiens
tctacccatattaca

SEQ ID NO: 2661411 - DNA, 15 bp, Homo sapiens
tctacctcttggctg

SEQ ID NO: 2661412 - DNA, 16 bp, Homo sapiens
tctacctgccactcac

SEQ ID NO: 2661413 - DNA, 19 bp, Homo sapiens
tctactcctacctcagcct

SEQ ID NO: 2661414 - DNA, 19 bp, Homo sapiens
tctactccttgtaaagact

SEQ ID NO: 2661415 - DNA, 18 bp, Homo sapiens
tctactctcccatggctt

SEQ ID NO: 2661416 - DNA, 16 bp, Homo sapiens
tctactcttaagccat

SEQ ID NO: 2661417 - DNA, 17 bp, Homo sapiens
tctactcttaagccatc

SEQ ID NO: 2661418 - DNA, 21 bp, Homo sapiens
tctactcttaagtttctcagc

SEQ ID NO: 2661419 - DNA, 22 bp, Homo sapiens
tctactcttaagtttctcagct

SEQ ID NO: 2661420 - DNA, 15 bp, Homo sapiens
tctactctttttgtt

SEQ ID NO: 2661421 - DNA, 14 bp, Homo sapiens
tctactttattaat

SEQ ID NO: 2661422 - DNA, 12 bp, Homo sapiens
tctactttgaag

SEQ ID NO: 2661423 - DNA, 15 bp, Homo sapiens
tctagaacacaggca

SEQ ID NO: 2661424 - DNA, 16 bp, Homo sapiens
tctagaacacaggcaa

SEQ ID NO: 2661425 - DNA, 21 bp, Homo sapiens
tctagaacatccctgccagct

SEQ ID NO: 2661426 - DNA, 16 bp, Homo sapiens
tctagaagttgtttgt

SEQ ID NO: 2661427 - DNA, 20 bp, Homo sapiens
tctagaatgtgttttctgaa

SEQ ID NO: 2661428 - DNA, 19 bp, Homo sapiens
tctagaattttaagtgctt

SEQ ID NO: 2661429 - DNA, 17 bp, Homo sapiens
tctagacaaccctgcaa

SEQ ID NO: 2661430 - DNA, 13 bp, Homo sapiens
tctagactttctg

SEQ ID NO: 2661431 - DNA, 15 bp, Homo sapiens
tctagactttctgtt

SEQ ID NO: 2661432 - DNA, 17 bp, Homo sapiens
tctagagcttgatgcca

SEQ ID NO: 2661433 - DNA, 21 bp, Homo sapiens
tctagattaccccctcattgt

SEQ ID NO: 2661434 - DNA, 12 bp, Homo sapiens
tctagcctgggc

SEQ ID NO: 2661435 - DNA, 15 bp, Homo sapiens
tctgctgccctccat

SEQ ID NO: 2661436 - DNA, 18 bp, Homo sapiens
tctgctgccctccatccc

SEQ ID NO: 2661437 - DNA, 18 bp, Homo sapiens
tctgctgctgtccctccc

SEQ ID NO: 2661438 - DNA, 18 bp, Homo sapiens
tctgctggataaaatgag

SEQ ID NO: 2661439 - DNA, 22 bp, Homo sapiens
tctgctggataaaatgaggttc

SEQ ID NO: 2661440 - DNA, 20 bp, Homo sapiens
tctgctggcccagccaaacc

SEQ ID NO: 2661441 - DNA, 14 bp, Homo sapiens
tctgctggcctgga

SEQ ID NO: 2661442 - DNA, 17 bp, Homo sapiens
tctgctgtccagacagc

SEQ ID NO: 2661443 - DNA, 22 bp, Homo sapiens
tctgcttacaattccctgctgt

SEQ ID NO: 2661444 - DNA, 13 bp, Homo sapiens
tctgcttcagcct

SEQ ID NO: 2661445 - DNA, 15 bp, Homo sapiens
tctgcttcagcctcc

SEQ ID NO: 2661446 - DNA, 18 bp, Homo sapiens
tctgcttgatttttgcct

SEQ ID NO: 2661447 - DNA, 22 bp, Homo sapiens
tctgctttggggtttatcagaa

SEQ ID NO: 2661448 - DNA, 23 bp, Homo sapiens
tctgctttttaaagaatgctctt

SEQ ID NO: 2661449 - DNA, 22 bp, Homo sapiens
tctggaatacatgaaatataga

SEQ ID NO: 2661450 - DNA, 15 bp, Homo sapiens
tctggaatgtaatca

SEQ ID NO: 2661451 - DNA, 16 bp, Homo sapiens
tctggaatgtaatcaa

SEQ ID NO: 2661452 - DNA, 12 bp, Homo sapiens
tctggacaagcc

SEQ ID NO: 2661453 - DNA, 23 bp, Homo sapiens
tctggacaagccaacttgtaaat

SEQ ID NO: 2661454 - DNA, 14 bp, Homo sapiens
tctggacaggcatg

SEQ ID NO: 2661455 - DNA, 23 bp, Homo sapiens
tctggaccaaccctgtttcctga

SEQ ID NO: 2661456 - DNA, 14 bp, Homo sapiens
tctggaccccatct

SEQ ID NO: 2661457 - DNA, 13 bp, Homo sapiens
tctggactgaagc

SEQ ID NO: 2661458 - DNA, 17 bp, Homo sapiens
tctggactgaagcctgc

SEQ ID NO: 2661459 - DNA, 23 bp, Homo sapiens
tctggagaagctcccaggaacaa

SEQ ID NO: 2661460 - DNA, 22 bp, Homo sapiens
tctggagagctagaacctggag

SEQ ID NO: 2661461 - DNA, 13 bp, Homo sapiens
tctggagcccttg

SEQ ID NO: 2661462 - DNA, 16 bp, Homo sapiens
tctggagcccttgggt

SEQ ID NO: 2661463 - DNA, 19 bp, Homo sapiens
tctggaggttgataacttt

SEQ ID NO: 2661464 - DNA, 20 bp, Homo sapiens
tctggaggttgataactttg

SEQ ID NO: 2661465 - DNA, 16 bp, Homo sapiens
tctggataggagcctg

SEQ ID NO: 2661466 - DNA, 13 bp, Homo sapiens
tctggattcccag

SEQ ID NO: 2661467 - DNA, 22 bp, Homo sapiens
tctggcacacagtaggtgctca

SEQ ID NO: 2661468 - DNA, 14 bp, Homo sapiens
tctggcagctcaga

SEQ ID NO: 2661469 - DNA, 15 bp, Homo sapiens
tctggcagctcagag

SEQ ID NO: 2661470 - DNA, 18 bp, Homo sapiens
tctggcagctcagagagg

SEQ ID NO: 2661471 - DNA, 18 bp, Homo sapiens
tctggcagttctggaatg

SEQ ID NO: 2661472 - DNA, 11 bp, Homo sapiens
tctggccaggc

SEQ ID NO: 2661473 - DNA, 11 bp, Homo sapiens
tctggcctcca

SEQ ID NO: 2661474 - DNA, 15 bp, Homo sapiens
tctggcctcccaccc

SEQ ID NO: 2661475 - DNA, 16 bp, Homo sapiens
tctggcctcccacccg

SEQ ID NO: 2661476 - DNA, 17 bp, Homo sapiens
tctggctatgcatttga

SEQ ID NO: 2661477 - DNA, 23 bp, Homo sapiens
tctggctcttccaggctgggaga

SEQ ID NO: 2661478 - DNA, 18 bp, Homo sapiens
tctggctgaacactggca

SEQ ID NO: 2661479 - DNA, 13 bp, Homo sapiens
tctggctgaaccc

SEQ ID NO: 2661480 - DNA, 23 bp, Homo sapiens
tctggcttccagaaaaccccagc

SEQ ID NO: 2661481 - DNA, 24 bp, Homo sapiens
tctggcttccaggtatctccagga

SEQ ID NO: 2661482 - DNA, 22 bp, Homo sapiens
tctgggaaatggcttgaagcca

SEQ ID NO: 2661483 - DNA, 15 bp, Homo sapiens
tctgggacttccttg

SEQ ID NO: 2661484 - DNA, 17 bp, Homo sapiens
tctgggacttccttgct

SEQ ID NO: 2661485 - DNA, 21 bp, Homo sapiens
tctgggagggcagcagggcta

SEQ ID NO: 2661486 - DNA, 16 bp, Homo sapiens
tctgggagtccccttt

SEQ ID NO: 2661487 - DNA, 18 bp, Homo sapiens
tctgggcaggacctcaga

SEQ ID NO: 2661488 - DNA, 20 bp, Homo sapiens
tctgggcaggactcagctcc

SEQ ID NO: 2661489 - DNA, 19 bp, Homo sapiens
tctgggccaagttcctcta

SEQ ID NO: 2661490 - DNA, 17 bp, Homo sapiens
tctgggctgctacccag

SEQ ID NO: 2661491 - DNA, 15 bp, Homo sapiens
tctggggcagggtta

SEQ ID NO: 2661492 - DNA, 17 bp, Homo sapiens
tctggggttatgatggc

SEQ ID NO: 2661493 - DNA, 16 bp, Homo sapiens
tctggtagatagaaat

SEQ ID NO: 2661494 - DNA, 18 bp, Homo sapiens
tctggtagatagaaataa

SEQ ID NO: 2661495 - DNA, 20 bp, Homo sapiens
tctggtagatttttaacgaa

SEQ ID NO: 2661496 - DNA, 13 bp, Homo sapiens
tctggtcccttgc

SEQ ID NO: 2661497 - DNA, 14 bp, Homo sapiens
tctggtcccttgca

SEQ ID NO: 2661498 - DNA, 14 bp, Homo sapiens
tctggtctgggtgc

SEQ ID NO: 2661499 - DNA, 17 bp, Homo sapiens
tctggtgaagctcactt

SEQ ID NO: 2661500 - DNA, 16 bp, Homo sapiens
tctggtggtctctgct

SEQ ID NO: 2661501 - DNA, 13 bp, Homo sapiens
tctggtgtctgct

SEQ ID NO: 2661502 - DNA, 22 bp, Homo sapiens
tctggtttgactccgctggagg

SEQ ID NO: 2661503 - DNA, 18 bp, Homo sapiens
tctgtaaactcaaaactt

SEQ ID NO: 2661504 - DNA, 12 bp, Homo sapiens
tctgtaaactgt

SEQ ID NO: 2661505 - DNA, 19 bp, Homo sapiens
tctgtaaactgtgtattcc

SEQ ID NO: 2661506 - DNA, 20 bp, Homo sapiens
tctgtaatctcgtttcaaaa

SEQ ID NO: 2661507 - DNA, 23 bp, Homo sapiens
tctgtacaatgaacccccatgat

SEQ ID NO: 2661508 - DNA, 17 bp, Homo sapiens
tctgtacacgtgtcctg

SEQ ID NO: 2661509 - DNA, 17 bp, Homo sapiens
tctgtacgtctgacagg

SEQ ID NO: 2661510 - DNA, 17 bp, Homo sapiens
tctgtagagggccctgg

SEQ ID NO: 2661511 - DNA, 18 bp, Homo sapiens
tctgtagagggccctggt

SEQ ID NO: 2661512 - DNA, 14 bp, Homo sapiens
tctgtagctcctca

SEQ ID NO: 2661513 - DNA, 17 bp, Homo sapiens
tctgtagggctggacct

SEQ ID NO: 2661514 - DNA, 21 bp, Homo sapiens
tctgtagttttatcacatgta

SEQ ID NO: 2661515 - DNA, 22 bp, Homo sapiens
tctgtagttttatcacatgtat

SEQ ID NO: 2661516 - DNA, 18 bp, Homo sapiens
tctgtatcggagacagtg

SEQ ID NO: 2661517 - DNA, 20 bp, Homo sapiens
tctgtatttccccaacatgt

SEQ ID NO: 2661518 - DNA, 17 bp, Homo sapiens
tctgtcacccaggctgg

SEQ ID NO: 2661519 - DNA, 20 bp, Homo sapiens
tctgtcatttgagcagggct

SEQ ID NO: 2661520 - DNA, 15 bp, Homo sapiens
tctgtccaaaggagg

SEQ ID NO: 2661521 - DNA, 16 bp, Homo sapiens
tctgtccaaaggaggc

SEQ ID NO: 2661522 - DNA, 19 bp, Homo sapiens
tctgtccaaaggaggctgg

SEQ ID NO: 2661523 - DNA, 19 bp, Homo sapiens
tctgtccagggccctgagc

SEQ ID NO: 2661524 - DNA, 20 bp, Homo sapiens
tctgtccagggccctgagct

SEQ ID NO: 2661525 - DNA, 21 bp, Homo sapiens
tctgtcccacttggcatcagc

SEQ ID NO: 2661526 - DNA, 13 bp, Homo sapiens
tctgtcccaggtt

SEQ ID NO: 2661527 - DNA, 19 bp, Homo sapiens
tctgtcccggggtcctgtg

SEQ ID NO: 2661528 - DNA, 20 bp, Homo sapiens
tctgtcccggggtcctgtgg

SEQ ID NO: 2661529 - DNA, 14 bp, Homo sapiens
tctgtcctactctg

SEQ ID NO: 2661530 - DNA, 12 bp, Homo sapiens
tctgtcctgctg

SEQ ID NO: 2661531 - DNA, 14 bp, Homo sapiens
tctgtcctggtgtc

SEQ ID NO: 2661532 - DNA, 19 bp, Homo sapiens
tctgtccttttggcactga

SEQ ID NO: 2661533 - DNA, 21 bp, Homo sapiens
tctgtccttttggcactgaga

SEQ ID NO: 2661534 - DNA, 14 bp, Homo sapiens
tctgtcgcccagtc

SEQ ID NO: 2661535 - DNA, 18 bp, Homo sapiens
tctgtcgccttagcatgt

SEQ ID NO: 2661536 - DNA, 15 bp, Homo sapiens
tctgtctcatatgat

SEQ ID NO: 2661537 - DNA, 13 bp, Homo sapiens
tctgtctcatcca

SEQ ID NO: 2661538 - DNA, 17 bp, Homo sapiens
tctgtctcatccatcat

SEQ ID NO: 2661539 - DNA, 19 bp, Homo sapiens
tctgtctccttaacactga

SEQ ID NO: 2661540 - DNA, 12 bp, Homo sapiens
tctgtctctgcc

SEQ ID NO: 2661541 - DNA, 18 bp, Homo sapiens
tctgtctggagtgacaga

SEQ ID NO: 2661542 - DNA, 17 bp, Homo sapiens
tctgtcttcaagggctt

SEQ ID NO: 2661543 - DNA, 15 bp, Homo sapiens
tctgtcttcacctga

SEQ ID NO: 2661544 - DNA, 19 bp, Homo sapiens
tctgtcttggctttcatgt

SEQ ID NO: 2661545 - DNA, 15 bp, Homo sapiens
tctgtgaaaggaaag

SEQ ID NO: 2661546 - DNA, 21 bp, Homo sapiens
tctgtgaaaggaaagagggag

SEQ ID NO: 2661547 - DNA, 22 bp, Homo sapiens
tctgtgaaaggaaagagggagg

SEQ ID NO: 2661548 - DNA, 17 bp, Homo sapiens
tctgtgaacgatttaga

SEQ ID NO: 2661549 - DNA, 21 bp, Homo sapiens
tctgtgaacgatttagaaaga

SEQ ID NO: 2661550 - DNA, 13 bp, Homo sapiens
tctgtgaataagc

SEQ ID NO: 2661551 - DNA, 19 bp, Homo sapiens
tctgtgaccaatgtcttga

SEQ ID NO: 2661552 - DNA, 19 bp, Homo sapiens
tctgtgagattcattcatg

SEQ ID NO: 2661553 - DNA, 20 bp, Homo sapiens
tctgtgagcatcacagtttt

SEQ ID NO: 2661554 - DNA, 19 bp, Homo sapiens
tctgtgcacgcagtggcct

SEQ ID NO: 2661555 - DNA, 22 bp, Homo sapiens
tctgtgcatggtggcaccagcg

SEQ ID NO: 2661556 - DNA, 15 bp, Homo sapiens
tctgtgcctgaatat

SEQ ID NO: 2661557 - DNA, 23 bp, Homo sapiens
tctgtgctgaccctcctgttgca

SEQ ID NO: 2661558 - DNA, 22 bp, Homo sapiens
tctgtgctttgactcacctgtt

SEQ ID NO: 2661559 - DNA, 14 bp, Homo sapiens
tctgtggaaagtgt

SEQ ID NO: 2661560 - DNA, 15 bp, Homo sapiens
tctgtggaaagtgta

SEQ ID NO: 2661561 - DNA, 22 bp, Homo sapiens
tctgtggaaagtgtaaagcatt

SEQ ID NO: 2661562 - DNA, 19 bp, Homo sapiens
tctgtgggtgacccaggtc

SEQ ID NO: 2661563 - DNA, 21 bp, Homo sapiens
tctgtggttttcccctccctg

SEQ ID NO: 2661564 - DNA, 15 bp, Homo sapiens
tctgtgtccttccct

SEQ ID NO: 2661565 - DNA, 17 bp, Homo sapiens
tctgtgtccttccctgc

SEQ ID NO: 2661566 - DNA, 18 bp, Homo sapiens
tctgtgtccttccctgca

SEQ ID NO: 2661567 - DNA, 18 bp, Homo sapiens
tctgtgtgatgaactttc

SEQ ID NO: 2661568 - DNA, 21 bp, Homo sapiens
tctgtgtgcacaaatatttat

SEQ ID NO: 2661569 - DNA, 22 bp, Homo sapiens
tctgtgtgtgtgtatgtggggg

SEQ ID NO: 2661570 - DNA, 15 bp, Homo sapiens
tctgtgtttttgaaa

SEQ ID NO: 2661571 - DNA, 18 bp, Homo sapiens
tctgttatataaatggtt

SEQ ID NO: 2661572 - DNA, 18 bp, Homo sapiens
tctgttatttagactcat

SEQ ID NO: 2661573 - DNA, 20 bp, Homo sapiens
tctgttctacatagatgctt

SEQ ID NO: 2661574 - DNA, 15 bp, Homo sapiens
tctgttctgtggaaa

SEQ ID NO: 2661575 - DNA, 16 bp, Homo sapiens
tctgttctgtggaaag

SEQ ID NO: 2661576 - DNA, 14 bp, Homo sapiens
tctgttcttgctac

SEQ ID NO: 2661577 - DNA, 13 bp, Homo sapiens
tctgttctttcca

SEQ ID NO: 2661578 - DNA, 22 bp, Homo sapiens
tctgttctttccaaagtacact

SEQ ID NO: 2661579 - DNA, 14 bp, Homo sapiens
tgaataaatacctc

SEQ ID NO: 2661580 - DNA, 17 bp, Homo sapiens
tgaataaatacctctta

SEQ ID NO: 2661581 - DNA, 14 bp, Homo sapiens
tgaataaatgtctt

SEQ ID NO: 2661582 - DNA, 19 bp, Homo sapiens
tgaataaattctataggaa

SEQ ID NO: 2661583 - DNA, 22 bp, Homo sapiens
tgaataagccattctgactcat

SEQ ID NO: 2661584 - DNA, 20 bp, Homo sapiens
tgaataatggtaccagataa

SEQ ID NO: 2661585 - DNA, 23 bp, Homo sapiens
tgaatacaaacaatggaaactga

SEQ ID NO: 2661586 - DNA, 15 bp, Homo sapiens
tgaatacaaagtgat

SEQ ID NO: 2661587 - DNA, 15 bp, Homo sapiens
tgaatataaacacta

SEQ ID NO: 2661588 - DNA, 16 bp, Homo sapiens
tgaatataaacactat

SEQ ID NO: 2661589 - DNA, 18 bp, Homo sapiens
tgaatatattataatctt

SEQ ID NO: 2661590 - DNA, 20 bp, Homo sapiens
tgaatatgaacggtgagcat

SEQ ID NO: 2661591 - DNA, 19 bp, Homo sapiens
tgaatatgattagtaaaga

SEQ ID NO: 2661592 - DNA, 18 bp, Homo sapiens
tgaatattgttcatattg

SEQ ID NO: 2661593 - DNA, 20 bp, Homo sapiens
tgaatatttatatttcacta

SEQ ID NO: 2661594 - DNA, 21 bp, Homo sapiens
tgaatatttccatatggattt

SEQ ID NO: 2661595 - DNA, 15 bp, Homo sapiens
tgaatcaataatata

SEQ ID NO: 2661596 - DNA, 22 bp, Homo sapiens
tgaatcaataatatattttctg

SEQ ID NO: 2661597 - DNA, 15 bp, Homo sapiens
tgaatcacctagggg

SEQ ID NO: 2661598 - DNA, 14 bp, Homo sapiens
tgaatccatgcttg

SEQ ID NO: 2661599 - DNA, 14 bp, Homo sapiens
tgaatctatttaag

SEQ ID NO: 2661600 - DNA, 16 bp, Homo sapiens
tgaatctatttaagta

SEQ ID NO: 2661601 - DNA, 19 bp, Homo sapiens
tgaatctttccaataaacc

SEQ ID NO: 2661602 - DNA, 11 bp, Homo sapiens
tgaatgaaaaa

SEQ ID NO: 2661603 - DNA, 16 bp, Homo sapiens
tgaatgaaacccccac

SEQ ID NO: 2661604 - DNA, 20 bp, Homo sapiens
tgaatgaaacccccacacac

SEQ ID NO: 2661605 - DNA, 22 bp, Homo sapiens
tgaatgaaacccccacacacac

SEQ ID NO: 2661606 - DNA, 15 bp, Homo sapiens
tgaatgaaccttctg

SEQ ID NO: 2661607 - DNA, 19 bp, Homo sapiens
tgaatgaggtcccaggcag

SEQ ID NO: 2661608 - DNA, 15 bp, Homo sapiens
tgaatgatctctctg

SEQ ID NO: 2661609 - DNA, 18 bp, Homo sapiens
tgaatgatctctctgaat

SEQ ID NO: 2661610 - DNA, 23 bp, Homo sapiens
tgaatgatgatcctaggcatttg

SEQ ID NO: 2661611 - DNA, 23 bp, Homo sapiens
tgaatgcccacaggcaaatgcat

SEQ ID NO: 2661612 - DNA, 20 bp, Homo sapiens
tgaatgcccccagctggccc

SEQ ID NO: 2661613 - DNA, 19 bp, Homo sapiens
tgaatgcttataggtggcc

SEQ ID NO: 2661614 - DNA, 18 bp, Homo sapiens
tgaatgctttttgaatgt

SEQ ID NO: 2661615 - DNA, 23 bp, Homo sapiens
tgaatgctttttgaatgttattt

SEQ ID NO: 2661616 - DNA, 14 bp, Homo sapiens
tgaatggattggat

SEQ ID NO: 2661617 - DNA, 17 bp, Homo sapiens
tgaatggattggattat

SEQ ID NO: 2661618 - DNA, 22 bp, Homo sapiens
tgaatggattggattatttaat

SEQ ID NO: 2661619 - DNA, 23 bp, Homo sapiens
tgaatggattggattatttaata

SEQ ID NO: 2661620 - DNA, 15 bp, Homo sapiens
tgaatggcctgcctt

SEQ ID NO: 2661621 - DNA, 17 bp, Homo sapiens
tgaatggcctgccttga

SEQ ID NO: 2661622 - DNA, 20 bp, Homo sapiens
tgaatgggcaaaactgaatt

SEQ ID NO: 2661623 - DNA, 17 bp, Homo sapiens
tgaatgggtccattttg

SEQ ID NO: 2661624 - DNA, 13 bp, Homo sapiens
tgaatggtatgga

SEQ ID NO: 2661625 - DNA, 13 bp, Homo sapiens
tgaatggtcagcg

SEQ ID NO: 2661626 - DNA, 21 bp, Homo sapiens
tgaatggtcagcgttgcatgt

SEQ ID NO: 2661627 - DNA, 15 bp, Homo sapiens
tgaatggtgttgtat

SEQ ID NO: 2661628 - DNA, 19 bp, Homo sapiens
tgaatggttccatgcctga

SEQ ID NO: 2661629 - DNA, 22 bp, Homo sapiens
tgaatggttccatgcctgaggg

SEQ ID NO: 2661630 - DNA, 15 bp, Homo sapiens
tgaatgtatcaggaa

SEQ ID NO: 2661631 - DNA, 16 bp, Homo sapiens
tgaatgtatcaggaaa

SEQ ID NO: 2661632 - DNA, 20 bp, Homo sapiens
tgaatgtctaaggtcacaca

SEQ ID NO: 2661633 - DNA, 15 bp, Homo sapiens
tgaatgtcttttgaa

SEQ ID NO: 2661634 - DNA, 14 bp, Homo sapiens
tgaatgtgtcacta

SEQ ID NO: 2661635 - DNA, 14 bp, Homo sapiens
tgaatgttatttgt

SEQ ID NO: 2661636 - DNA, 23 bp, Homo sapiens
tgaatgttatttgttattttcag

SEQ ID NO: 2661637 - DNA, 16 bp, Homo sapiens
tgaatgttctgacatt

SEQ ID NO: 2661638 - DNA, 11 bp, Homo sapiens
tgaattaaaac

SEQ ID NO: 2661639 - DNA, 15 bp, Homo sapiens
tgaattaaagtaatt

SEQ ID NO: 2661640 - DNA, 21 bp, Homo sapiens
tgaattaatgacagagccagt

SEQ ID NO: 2661641 - DNA, 16 bp, Homo sapiens
tgaattagtccttgct

SEQ ID NO: 2661642 - DNA, 21 bp, Homo sapiens
tgaattatcttggttgaaaat

SEQ ID NO: 2661643 - DNA, 18 bp, Homo sapiens
tgaattgtaactgttctt

SEQ ID NO: 2661644 - DNA, 19 bp, Homo sapiens
tgaatttaaatataattct

SEQ ID NO: 2661645 - DNA, 19 bp, Homo sapiens
tgaatttaataatctgtag

SEQ ID NO: 2661646 - DNA, 15 bp, Homo sapiens
tgaatttattattgt

SEQ ID NO: 2661647 - DNA, 21 bp, Homo sapiens
tgaatttcttcactgttgaaa

SEQ ID NO: 2661648 - DNA, 23 bp, Homo sapiens
tgaatttcttcactgttgaaaat

SEQ ID NO: 2661649 - DNA, 23 bp, Homo sapiens
tgaatttcttttgccgttattaa

SEQ ID NO: 2661650 - DNA, 15 bp, Homo sapiens
tgaatttgaatgaaa

SEQ ID NO: 2661651 - DNA, 15 bp, Homo sapiens
tgaatttggagactc

SEQ ID NO: 2661652 - DNA, 20 bp, Homo sapiens
tgaatttggagactctgtgg

SEQ ID NO: 2661653 - DNA, 20 bp, Homo sapiens
tgaatttggcctgcactaat

SEQ ID NO: 2661654 - DNA, 15 bp, Homo sapiens
tgaattttctgtgtt

SEQ ID NO: 2661655 - DNA, 14 bp, Homo sapiens
tgaattttgttgct

SEQ ID NO: 2661656 - DNA, 21 bp, Homo sapiens
tgaatttttttcatcttctct

SEQ ID NO: 2661657 - DNA, 23 bp, Homo sapiens
tgaatttttttcatcttctctgg

SEQ ID NO: 2661658 - DNA, 16 bp, Homo sapiens
tgaatttttttttcct

SEQ ID NO: 2661659 - DNA, 19 bp, Homo sapiens
tgaatttttttttcctagc

SEQ ID NO: 2661660 - DNA, 20 bp, Homo sapiens
tgaatttttttttcctagcc

SEQ ID NO: 2661661 - DNA, 18 bp, Homo sapiens
tgacaaaaattcaactca

SEQ ID NO: 2661662 - DNA, 18 bp, Homo sapiens
tgacaaaatttgttgaaa

SEQ ID NO: 2661663 - DNA, 23 bp, Homo sapiens
tgacaacactcattgacctgagg

SEQ ID NO: 2661664 - DNA, 19 bp, Homo sapiens
tgacaaccaccgctcccca

SEQ ID NO: 2661665 - DNA, 15 bp, Homo sapiens
tgacaagcactgcta

SEQ ID NO: 2661666 - DNA, 13 bp, Homo sapiens
tgacaagccccag

SEQ ID NO: 2661667 - DNA, 22 bp, Homo sapiens
tgacaagctcctggtcttgaga

SEQ ID NO: 2661668 - DNA, 15 bp, Homo sapiens
tgacaaggccccaga

SEQ ID NO: 2661669 - DNA, 22 bp, Homo sapiens
tgacaaggccccagagactcag

SEQ ID NO: 2661670 - DNA, 20 bp, Homo sapiens
tgacaagtcattttaacttt

SEQ ID NO: 2661671 - DNA, 13 bp, Homo sapiens
tgacaataaaaca

SEQ ID NO: 2661672 - DNA, 16 bp, Homo sapiens
tgacaattttgtacaa

SEQ ID NO: 2661673 - DNA, 16 bp, Homo sapiens
tgacacaaacctgcct

SEQ ID NO: 2661674 - DNA, 17 bp, Homo sapiens
tgacacaaacctgcctg

SEQ ID NO: 2661675 - DNA, 18 bp, Homo sapiens
tgacacaaacctgcctgg

SEQ ID NO: 2661676 - DNA, 20 bp, Homo sapiens
tgacacacagctctgtcctg

SEQ ID NO: 2661677 - DNA, 16 bp, Homo sapiens
tgacacaggatgaagg

SEQ ID NO: 2661678 - DNA, 22 bp, Homo sapiens
tgacacatatgcaccttgtgtc

SEQ ID NO: 2661679 - DNA, 24 bp, Homo sapiens
tgacaccagctgttctgtcccttg

SEQ ID NO: 2661680 - DNA, 13 bp, Homo sapiens
tgacacccatgtt

SEQ ID NO: 2661681 - DNA, 19 bp, Homo sapiens
tgacacccatgtttctctg

SEQ ID NO: 2661682 - DNA, 21 bp, Homo sapiens
tgacactagcccaatgaaatg

SEQ ID NO: 2661683 - DNA, 18 bp, Homo sapiens
tgacactatatctgtata

SEQ ID NO: 2661684 - DNA, 14 bp, Homo sapiens
tgacagaacactgt

SEQ ID NO: 2661685 - DNA, 21 bp, Homo sapiens
tgacagaacactgtcttgaag

SEQ ID NO: 2661686 - DNA, 14 bp, Homo sapiens
tgacagacacaggc

SEQ ID NO: 2661687 - DNA, 16 bp, Homo sapiens
tgacagacacaggccc

SEQ ID NO: 2661688 - DNA, 17 bp, Homo sapiens
tgacagacacaggcccg

SEQ ID NO: 2661689 - DNA, 19 bp, Homo sapiens
tgacagactcctgaggaca

SEQ ID NO: 2661690 - DNA, 21 bp, Homo sapiens
tgacagagcaagactctgtct

SEQ ID NO: 2661691 - DNA, 16 bp, Homo sapiens
tgacagaggcagcccc

SEQ ID NO: 2661692 - DNA, 19 bp, Homo sapiens
tgacagagtgagactctgt

SEQ ID NO: 2661693 - DNA, 15 bp, Homo sapiens
tgacagatcaagctg

SEQ ID NO: 2661694 - DNA, 16 bp, Homo sapiens
tgacagatcaagctgt

SEQ ID NO: 2661695 - DNA, 17 bp, Homo sapiens
tgacagcctcccacccc

SEQ ID NO: 2661696 - DNA, 22 bp, Homo sapiens
tgacagcctcccacccccatct

SEQ ID NO: 2661697 - DNA, 17 bp, Homo sapiens
tgacaggcaatgctggc

SEQ ID NO: 2661698 - DNA, 19 bp, Homo sapiens
tgacaggcaatgctggctg

SEQ ID NO: 2661699 - DNA, 14 bp, Homo sapiens
tgacaggcagcaga

SEQ ID NO: 2661700 - DNA, 18 bp, Homo sapiens
tgacaggcagcctggaca

SEQ ID NO: 2661701 - DNA, 19 bp, Homo sapiens
tgacagggaagctacaggt

SEQ ID NO: 2661702 - DNA, 21 bp, Homo sapiens
tgacagtggccgcccaaggcc

SEQ ID NO: 2661703 - DNA, 17 bp, Homo sapiens
tgacatcaccacagttt

SEQ ID NO: 2661704 - DNA, 13 bp, Homo sapiens
tgacatcacttgt

SEQ ID NO: 2661705 - DNA, 18 bp, Homo sapiens
tgacatcacttgtacaaa

SEQ ID NO: 2661706 - DNA, 23 bp, Homo sapiens
tgacatcagtggcatggctccag

SEQ ID NO: 2661707 - DNA, 18 bp, Homo sapiens
tgacatctcaggggccag

SEQ ID NO: 2661708 - DNA, 14 bp, Homo sapiens
tgacatctctgcaa

SEQ ID NO: 2661709 - DNA, 16 bp, Homo sapiens
tgacatctgtgtttca

SEQ ID NO: 2661710 - DNA, 16 bp, Homo sapiens
tgacatcttcaaagct

SEQ ID NO: 2661711 - DNA, 12 bp, Homo sapiens
tgacatgaaaaa

SEQ ID NO: 2661712 - DNA, 16 bp, Homo sapiens
tgacatgtccctacac

SEQ ID NO: 2661713 - DNA, 13 bp, Homo sapiens
tgacatgtctttt

SEQ ID NO: 2661714 - DNA, 12 bp, Homo sapiens
tgacatgtgaaa

SEQ ID NO: 2661715 - DNA, 13 bp, Homo sapiens
tgacatgtgaaac

SEQ ID NO: 2661716 - DNA, 15 bp, Homo sapiens
tgacatgtgaaacct

SEQ ID NO: 2661717 - DNA, 16 bp, Homo sapiens
tgacatgtgaaacctt

SEQ ID NO: 2661718 - DNA, 14 bp, Homo sapiens
tgacatgtggaaag

SEQ ID NO: 2661719 - DNA, 18 bp, Homo sapiens
tgacatgttatatatttt

SEQ ID NO: 2661720 - DNA, 19 bp, Homo sapiens
tgacattaacagttttcca

SEQ ID NO: 2661721 - DNA, 22 bp, Homo sapiens
tgacattaacagttttccatga

SEQ ID NO: 2661722 - DNA, 15 bp, Homo sapiens
tgacattcaaggcat

SEQ ID NO: 2661723 - DNA, 14 bp, Homo sapiens
tgatcacggctcac

SEQ ID NO: 2661724 - DNA, 21 bp, Homo sapiens
tgatcagagccgtggtccttt

SEQ ID NO: 2661725 - DNA, 16 bp, Homo sapiens
tgatcagctgtttgtc

SEQ ID NO: 2661726 - DNA, 15 bp, Homo sapiens
tgatcataagtctaa

SEQ ID NO: 2661727 - DNA, 20 bp, Homo sapiens
tgatcataggtatttcaaaa

SEQ ID NO: 2661728 - DNA, 13 bp, Homo sapiens
tgatcatccactg

SEQ ID NO: 2661729 - DNA, 13 bp, Homo sapiens
tgatcatgcattg

SEQ ID NO: 2661730 - DNA, 19 bp, Homo sapiens
tgatcattttccccccact

SEQ ID NO: 2661731 - DNA, 21 bp, Homo sapiens
tgatcattttccccccactct

SEQ ID NO: 2661732 - DNA, 14 bp, Homo sapiens
tgatccaactaatg

SEQ ID NO: 2661733 - DNA, 13 bp, Homo sapiens
tgatccaagctgg

SEQ ID NO: 2661734 - DNA, 17 bp, Homo sapiens
tgatccaagctggtccc

SEQ ID NO: 2661735 - DNA, 15 bp, Homo sapiens
tgatccacccacctc

SEQ ID NO: 2661736 - DNA, 19 bp, Homo sapiens
tgatccacccacctcagcc

SEQ ID NO: 2661737 - DNA, 15 bp, Homo sapiens
tgatccagagcacag

SEQ ID NO: 2661738 - DNA, 22 bp, Homo sapiens
tgatcctaatgaatgcataaaa

SEQ ID NO: 2661739 - DNA, 20 bp, Homo sapiens
tgatcctcccacctcagcct

SEQ ID NO: 2661740 - DNA, 15 bp, Homo sapiens
tgatccttacaagtt

SEQ ID NO: 2661741 - DNA, 15 bp, Homo sapiens
tgatcgtgacgctga

SEQ ID NO: 2661742 - DNA, 16 bp, Homo sapiens
tgatcgtgacgctgaa

SEQ ID NO: 2661743 - DNA, 20 bp, Homo sapiens
tgatcgtgacgctgaataaa

SEQ ID NO: 2661744 - DNA, 19 bp, Homo sapiens
tgatctaggtttaactcag

SEQ ID NO: 2661745 - DNA, 21 bp, Homo sapiens
tgatctaggtttaactcagat

SEQ ID NO: 2661746 - DNA, 22 bp, Homo sapiens
tgatctaggtttaactcagatc

SEQ ID NO: 2661747 - DNA, 17 bp, Homo sapiens
tgatctccatggcttcc

SEQ ID NO: 2661748 - DNA, 17 bp, Homo sapiens
tgatctggtttgactcc

SEQ ID NO: 2661749 - DNA, 11 bp, Homo sapiens
tgatctgtgct

SEQ ID NO: 2661750 - DNA, 17 bp, Homo sapiens
tgatctttaaaatacac

SEQ ID NO: 2661751 - DNA, 18 bp, Homo sapiens
tgatctttgcagacaggc

SEQ ID NO: 2661752 - DNA, 15 bp, Homo sapiens
tgatgaaaaatagca

SEQ ID NO: 2661753 - DNA, 18 bp, Homo sapiens
tgatgaaatgtaaatact

SEQ ID NO: 2661754 - DNA, 18 bp, Homo sapiens
tgatgaagaaaagtgggc

SEQ ID NO: 2661755 - DNA, 21 bp, Homo sapiens
tgatgatcagctgtttgtcat

SEQ ID NO: 2661756 - DNA, 14 bp, Homo sapiens
tgatgatcctaggc

SEQ ID NO: 2661757 - DNA, 22 bp, Homo sapiens
tgatgatctttgcagacaggca

SEQ ID NO: 2661758 - DNA, 17 bp, Homo sapiens
tgatgcatgcactgttc

SEQ ID NO: 2661759 - DNA, 18 bp, Homo sapiens
tgatgcattaaaagaaaa

SEQ ID NO: 2661760 - DNA, 15 bp, Homo sapiens
tgatgccaagttgtt

SEQ ID NO: 2661761 - DNA, 14 bp, Homo sapiens
tgatgcctccctgt

SEQ ID NO: 2661762 - DNA, 15 bp, Homo sapiens
tgatgctcaggcttg

SEQ ID NO: 2661763 - DNA, 16 bp, Homo sapiens
tgatgctccctcccct

SEQ ID NO: 2661764 - DNA, 20 bp, Homo sapiens
tgatgctccctcccctgccc

SEQ ID NO: 2661765 - DNA, 21 bp, Homo sapiens
tgatgctccctcccctgccct

SEQ ID NO: 2661766 - DNA, 15 bp, Homo sapiens
tgatgctggatgctc

SEQ ID NO: 2661767 - DNA, 20 bp, Homo sapiens
tgatgctggatgctccttcc

SEQ ID NO: 2661768 - DNA, 16 bp, Homo sapiens
tgatgcttcttcagag

SEQ ID NO: 2661769 - DNA, 17 bp, Homo sapiens
tgatgcttcttcagaga

SEQ ID NO: 2661770 - DNA, 19 bp, Homo sapiens
tgatgcttcttcagagact

SEQ ID NO: 2661771 - DNA, 18 bp, Homo sapiens
tgatggaaatatttattt

SEQ ID NO: 2661772 - DNA, 15 bp, Homo sapiens
tgatggcaattttgt

SEQ ID NO: 2661773 - DNA, 17 bp, Homo sapiens
tgatggcaattttgtaa

SEQ ID NO: 2661774 - DNA, 22 bp, Homo sapiens
tgatggcaccactgcactccag

SEQ ID NO: 2661775 - DNA, 19 bp, Homo sapiens
tgatgggaaagcattgtaa

SEQ ID NO: 2661776 - DNA, 19 bp, Homo sapiens
tgatgggagagtagatggt

SEQ ID NO: 2661777 - DNA, 19 bp, Homo sapiens
tgatggggccctgcctcct

SEQ ID NO: 2661778 - DNA, 15 bp, Homo sapiens
tgatggtcagctccc

SEQ ID NO: 2661779 - DNA, 21 bp, Homo sapiens
tgatggtcagctcccttctct

SEQ ID NO: 2661780 - DNA, 17 bp, Homo sapiens
tgatggtgatgaaatgt

SEQ ID NO: 2661781 - DNA, 21 bp, Homo sapiens
tgatgtaaccgattcatctct

SEQ ID NO: 2661782 - DNA, 19 bp, Homo sapiens
tgatgtacagtctgtcatg

SEQ ID NO: 2661783 - DNA, 23 bp, Homo sapiens
tgatgtccagaagaatattcagg

SEQ ID NO: 2661784 - DNA, 18 bp, Homo sapiens
tgatgtgggtcaaggaat

SEQ ID NO: 2661785 - DNA, 16 bp, Homo sapiens
tgatgtgttatctctt

SEQ ID NO: 2661786 - DNA, 11 bp, Homo sapiens
tgatgttaaca

SEQ ID NO: 2661787 - DNA, 21 bp, Homo sapiens
tgatgttaacacattttgtat

SEQ ID NO: 2661788 - DNA, 15 bp, Homo sapiens
tgatgttcagtgtaa

SEQ ID NO: 2661789 - DNA, 20 bp, Homo sapiens
tgatgttcagtgtaatttct

SEQ ID NO: 2661790 - DNA, 15 bp, Homo sapiens
tgatgttggctggga

SEQ ID NO: 2661791 - DNA, 17 bp, Homo sapiens
tgatgtttgtggcctca

SEQ ID NO: 2661792 - DNA, 19 bp, Homo sapiens
tgattaaattcttgcaaag

SEQ ID NO: 2661793 - DNA, 20 bp, Homo sapiens
tgattaaattcttgcaaagt

SEQ ID NO: 2661794 - DNA, 14 bp, Homo sapiens
tgattacacaaaac

SEQ ID NO: 2661795 - DNA, 13 bp, Homo sapiens
tgattacacagtt

SEQ ID NO: 2661796 - DNA, 18 bp, Homo sapiens
tgattacaccagcctcgt

SEQ ID NO: 2661797 - DNA, 16 bp, Homo sapiens
tgattattactggcaa

SEQ ID NO: 2661798 - DNA, 14 bp, Homo sapiens
tgattattcagtgt

SEQ ID NO: 2661799 - DNA, 13 bp, Homo sapiens
tgattattgtatt

SEQ ID NO: 2661800 - DNA, 15 bp, Homo sapiens
tgattattgtattta

SEQ ID NO: 2661801 - DNA, 18 bp, Homo sapiens
tgattattgtatttattc

SEQ ID NO: 2661802 - DNA, 15 bp, Homo sapiens
tgattatttcacttt

SEQ ID NO: 2661803 - DNA, 23 bp, Homo sapiens
tgattatttcactttagatgctg

SEQ ID NO: 2661804 - DNA, 21 bp, Homo sapiens
tgattcaatctgtaaactgtg

SEQ ID NO: 2661805 - DNA, 13 bp, Homo sapiens
tgattcactgcat

SEQ ID NO: 2661806 - DNA, 14 bp, Homo sapiens
tgattcagaaattg

SEQ ID NO: 2661807 - DNA, 16 bp, Homo sapiens
tgattcagaaattgga

SEQ ID NO: 2661808 - DNA, 13 bp, Homo sapiens
tgattcagacagc

SEQ ID NO: 2661809 - DNA, 18 bp, Homo sapiens
tgattcagacagctgcct

SEQ ID NO: 2661810 - DNA, 21 bp, Homo sapiens
tgattcagacagctgcctggg

SEQ ID NO: 2661811 - DNA, 14 bp, Homo sapiens
tgattcagctctgc

SEQ ID NO: 2661812 - DNA, 17 bp, Homo sapiens
tgattcataataaatat

SEQ ID NO: 2661813 - DNA, 19 bp, Homo sapiens
tgattcccaagctctgctc

SEQ ID NO: 2661814 - DNA, 22 bp, Homo sapiens
tgattccttgatggagatattt

SEQ ID NO: 2661815 - DNA, 11 bp, Homo sapiens
tgattctcagg

SEQ ID NO: 2661816 - DNA, 15 bp, Homo sapiens
tgattctcagggtct

SEQ ID NO: 2661817 - DNA, 20 bp, Homo sapiens
tgattctcagggtctctgct

SEQ ID NO: 2661818 - DNA, 20 bp, Homo sapiens
tgattcttgagtttagtgat

SEQ ID NO: 2661819 - DNA, 14 bp, Homo sapiens
tgattctttgttac

SEQ ID NO: 2661820 - DNA, 19 bp, Homo sapiens
tgattctttgttacaggca

SEQ ID NO: 2661821 - DNA, 18 bp, Homo sapiens
tgattctttttaaagtgt

SEQ ID NO: 2661822 - DNA, 18 bp, Homo sapiens
tgattgccaagctcagga

SEQ ID NO: 2661823 - DNA, 15 bp, Homo sapiens
tgattgctaaatgta

SEQ ID NO: 2661824 - DNA, 19 bp, Homo sapiens
tgattgctaaatgtaacag

SEQ ID NO: 2661825 - DNA, 21 bp, Homo sapiens
tgattggaggggggaggtggg

SEQ ID NO: 2661826 - DNA, 15 bp, Homo sapiens
tgattggattattca

SEQ ID NO: 2661827 - DNA, 18 bp, Homo sapiens
tgattggattattcattt

SEQ ID NO: 2661828 - DNA, 21 bp, Homo sapiens
tgattggattattcatttaaa

SEQ ID NO: 2661829 - DNA, 12 bp, Homo sapiens
tgattgggaata

SEQ ID NO: 2661830 - DNA, 17 bp, Homo sapiens
tgattgggacagaggtt

SEQ ID NO: 2661831 - DNA, 22 bp, Homo sapiens
tgattgggactggggctgaagg

SEQ ID NO: 2661832 - DNA, 12 bp, Homo sapiens
tgattgtaaaat

SEQ ID NO: 2661833 - DNA, 14 bp, Homo sapiens
tgattgtcagctac

SEQ ID NO: 2661834 - DNA, 16 bp, Homo sapiens
tgatttaaaacatgta

SEQ ID NO: 2661835 - DNA, 18 bp, Homo sapiens
tgatttaagacacttttt

SEQ ID NO: 2661836 - DNA, 15 bp, Homo sapiens
tgatttaataaaata

SEQ ID NO: 2661837 - DNA, 20 bp, Homo sapiens
tgatttaataaaataattct

SEQ ID NO: 2661838 - DNA, 13 bp, Homo sapiens
tgatttaatagtg

SEQ ID NO: 2661839 - DNA, 17 bp, Homo sapiens
tgatttaatagtgttaa

SEQ ID NO: 2661840 - DNA, 21 bp, Homo sapiens
tgatttaatagtgttaatcaa

SEQ ID NO: 2661841 - DNA, 21 bp, Homo sapiens
tgatttagaactgtatgtcag

SEQ ID NO: 2661842 - DNA, 22 bp, Homo sapiens
tgatttatagtttgtacatgca

SEQ ID NO: 2661843 - DNA, 13 bp, Homo sapiens
tgatttatgcatg

SEQ ID NO: 2661844 - DNA, 20 bp, Homo sapiens
tgatttcagcacctacagtg

SEQ ID NO: 2661845 - DNA, 15 bp, Homo sapiens
tgatttcattaatac

SEQ ID NO: 2661846 - DNA, 22 bp, Homo sapiens
tgatttccgttaaaataccagc

SEQ ID NO: 2661847 - DNA, 17 bp, Homo sapiens
tgatttctgccttcctt

SEQ ID NO: 2661848 - DNA, 15 bp, Homo sapiens
tgatttctttccaga

SEQ ID NO: 2661849 - DNA, 23 bp, Homo sapiens
tgatttgactgtttttacccata

SEQ ID NO: 2661850 - DNA, 12 bp, Homo sapiens
tgatttggaaaa

SEQ ID NO: 2661851 - DNA, 19 bp, Homo sapiens
tgatttgttttcctcttaa

SEQ ID NO: 2661852 - DNA, 17 bp, Homo sapiens
tgattttaacaataact

SEQ ID NO: 2661853 - DNA, 17 bp, Homo sapiens
tgattttaactctgtct

SEQ ID NO: 2661854 - DNA, 19 bp, Homo sapiens
tgattttacaattgaaatg

SEQ ID NO: 2661855 - DNA, 20 bp, Homo sapiens
tgattttcaaagctttttcc

SEQ ID NO: 2661856 - DNA, 15 bp, Homo sapiens
tgattttgaaatcat

SEQ ID NO: 2661857 - DNA, 14 bp, Homo sapiens
tgattttgctgtag

SEQ ID NO: 2661858 - DNA, 22 bp, Homo sapiens
tgatttttaccgtttcttccct

SEQ ID NO: 2661859 - DNA, 20 bp, Homo sapiens
tgatttttagatgagattgt

SEQ ID NO: 2661860 - DNA, 13 bp, Homo sapiens
tgatttttctgga

SEQ ID NO: 2661861 - DNA, 18 bp, Homo sapiens
tgatttttgtaagacaat

SEQ ID NO: 2661862 - DNA, 16 bp, Homo sapiens
tgattttttttccttt

SEQ ID NO: 2661863 - DNA, 19 bp, Homo sapiens
tgcaaaacagcgtttaaga

SEQ ID NO: 2661864 - DNA, 23 bp, Homo sapiens
tgcaaaacagcgtttaagactgt

SEQ ID NO: 2661865 - DNA, 23 bp, Homo sapiens
tgcaaaaggttcactaaagcagt

SEQ ID NO: 2661866 - DNA, 15 bp, Homo sapiens
tgcaaaatttccagt

SEQ ID NO: 2661867 - DNA, 21 bp, Homo sapiens
tgcaaaatttccagtaccttt

SEQ ID NO: 2661868 - DNA, 15 bp, Homo sapiens
tgccaccatcctgct

SEQ ID NO: 2661869 - DNA, 18 bp, Homo sapiens
tgccaccatggccagcca

SEQ ID NO: 2661870 - DNA, 12 bp, Homo sapiens
tgccacccacca

SEQ ID NO: 2661871 - DNA, 20 bp, Homo sapiens
tgccaccccaccctccctgg

SEQ ID NO: 2661872 - DNA, 13 bp, Homo sapiens
tgccaccctacct

SEQ ID NO: 2661873 - DNA, 16 bp, Homo sapiens
tgccactaaattgaca

SEQ ID NO: 2661874 - DNA, 20 bp, Homo sapiens
tgccactaaattgacactta

SEQ ID NO: 2661875 - DNA, 11 bp, Homo sapiens
tgccactcaca

SEQ ID NO: 2661876 - DNA, 16 bp, Homo sapiens
tgccactcacacagcc

SEQ ID NO: 2661877 - DNA, 17 bp, Homo sapiens
tgccactcattcctgta

SEQ ID NO: 2661878 - DNA, 18 bp, Homo sapiens
tgccactcattcctgtag

SEQ ID NO: 2661879 - DNA, 17 bp, Homo sapiens
tgccactgcccgagctg

SEQ ID NO: 2661880 - DNA, 20 bp, Homo sapiens
tgccacttcactccagcctg

SEQ ID NO: 2661881 - DNA, 19 bp, Homo sapiens
tgccactttgcaaaggagc

SEQ ID NO: 2661882 - DNA, 18 bp, Homo sapiens
tgccagaagatcccctca

SEQ ID NO: 2661883 - DNA, 20 bp, Homo sapiens
tgccagaagatcccctcagg

SEQ ID NO: 2661884 - DNA, 13 bp, Homo sapiens
tgccagacatgtg

SEQ ID NO: 2661885 - DNA, 19 bp, Homo sapiens
tgccagaggtgggcaggtg

SEQ ID NO: 2661886 - DNA, 14 bp, Homo sapiens
tgccagatgctgat

SEQ ID NO: 2661887 - DNA, 18 bp, Homo sapiens
tgccagcaactgaataaa

SEQ ID NO: 2661888 - DNA, 23 bp, Homo sapiens
tgccagcaatgacatctcagggg

SEQ ID NO: 2661889 - DNA, 11 bp, Homo sapiens
tgccagccaca

SEQ ID NO: 2661890 - DNA, 16 bp, Homo sapiens
tgccagccagcagcca

SEQ ID NO: 2661891 - DNA, 17 bp, Homo sapiens
tgccagccagcagccag

SEQ ID NO: 2661892 - DNA, 22 bp, Homo sapiens
tgccagccagcagccagctctc

SEQ ID NO: 2661893 - DNA, 23 bp, Homo sapiens
tgccagccagcagccagctctca

SEQ ID NO: 2661894 - DNA, 19 bp, Homo sapiens
tgccagccgtgatgctcag

SEQ ID NO: 2661895 - DNA, 20 bp, Homo sapiens
tgccagccgtgatgctcagg

SEQ ID NO: 2661896 - DNA, 15 bp, Homo sapiens
tgccagcctggcttc

SEQ ID NO: 2661897 - DNA, 17 bp, Homo sapiens
tgccagcctggcttctg

SEQ ID NO: 2661898 - DNA, 23 bp, Homo sapiens
tgccagcctggcttctggagccc

SEQ ID NO: 2661899 - DNA, 18 bp, Homo sapiens
tgccagccttcctctgca

SEQ ID NO: 2661900 - DNA, 19 bp, Homo sapiens
tgccagctacttcctcctc

SEQ ID NO: 2661901 - DNA, 17 bp, Homo sapiens
tgccagctcagtcccat

SEQ ID NO: 2661902 - DNA, 18 bp, Homo sapiens
tgccagcttatctcaggg

SEQ ID NO: 2661903 - DNA, 12 bp, Homo sapiens
tgccaggactcc

SEQ ID NO: 2661904 - DNA, 23 bp, Homo sapiens
tgccaggactccccaggccaggc

SEQ ID NO: 2661905 - DNA, 11 bp, Homo sapiens
tgccagggagc

SEQ ID NO: 2661906 - DNA, 18 bp, Homo sapiens
tgccaggttttctgggtg

SEQ ID NO: 2661907 - DNA, 17 bp, Homo sapiens
tgccaggtttttggtct

SEQ ID NO: 2661908 - DNA, 14 bp, Homo sapiens
tgccagtcaccccg

SEQ ID NO: 2661909 - DNA, 19 bp, Homo sapiens
tgccagtccccctgcccca

SEQ ID NO: 2661910 - DNA, 23 bp, Homo sapiens
tgccagtctcactgtgggaaggc

SEQ ID NO: 2661911 - DNA, 13 bp, Homo sapiens
tgccataattact

SEQ ID NO: 2661912 - DNA, 15 bp, Homo sapiens
tgccatactttgtct

SEQ ID NO: 2661913 - DNA, 22 bp, Homo sapiens
tgccatactttgtctgaaaaat

SEQ ID NO: 2661914 - DNA, 18 bp, Homo sapiens
tgccatagtcacatggcc

SEQ ID NO: 2661915 - DNA, 15 bp, Homo sapiens
tgccatattctgttg

SEQ ID NO: 2661916 - DNA, 13 bp, Homo sapiens
tgccatattttca

SEQ ID NO: 2661917 - DNA, 14 bp, Homo sapiens
tgccatattttcac

SEQ ID NO: 2661918 - DNA, 23 bp, Homo sapiens
tgccatcatctcctgccttcctc

SEQ ID NO: 2661919 - DNA, 20 bp, Homo sapiens
tgccatccaggttcagcttg

SEQ ID NO: 2661920 - DNA, 11 bp, Homo sapiens
tgccatcctca

SEQ ID NO: 2661921 - DNA, 19 bp, Homo sapiens
tgccatcctcaaacactgc

SEQ ID NO: 2661922 - DNA, 23 bp, Homo sapiens
tgccatggacagaagaaggcagc

SEQ ID NO: 2661923 - DNA, 18 bp, Homo sapiens
tgccatgggcttcactgt

SEQ ID NO: 2661924 - DNA, 18 bp, Homo sapiens
tgccatgttggccaggct

SEQ ID NO: 2661925 - DNA, 19 bp, Homo sapiens
tgccatgttggccaggctg

SEQ ID NO: 2661926 - DNA, 16 bp, Homo sapiens
tgccattcacttcata

SEQ ID NO: 2661927 - DNA, 21 bp, Homo sapiens
tgccatttgcaccctccgcct

SEQ ID NO: 2661928 - DNA, 14 bp, Homo sapiens
tgcccaactgttat

SEQ ID NO: 2661929 - DNA, 14 bp, Homo sapiens
tgcccaagggaaag

SEQ ID NO: 2661930 - DNA, 13 bp, Homo sapiens
tgcccaccccctc

SEQ ID NO: 2661931 - DNA, 15 bp, Homo sapiens
tgcccaccccctcaa

SEQ ID NO: 2661932 - DNA, 19 bp, Homo sapiens
tgcccacctgcccatcaca

SEQ ID NO: 2661933 - DNA, 21 bp, Homo sapiens
tgcccactccctgcaacctga

SEQ ID NO: 2661934 - DNA, 21 bp, Homo sapiens
tgcccagaactggactcagga

SEQ ID NO: 2661935 - DNA, 19 bp, Homo sapiens
tgcccagaataagttattg

SEQ ID NO: 2661936 - DNA, 21 bp, Homo sapiens
tgcccagaataagttattgca

SEQ ID NO: 2661937 - DNA, 18 bp, Homo sapiens
tgcccagacccctctggc

SEQ ID NO: 2661938 - DNA, 18 bp, Homo sapiens
tgcccagagggcccaggc

SEQ ID NO: 2661939 - DNA, 19 bp, Homo sapiens
tgcccagagggcccaggca

SEQ ID NO: 2661940 - DNA, 20 bp, Homo sapiens
tgcccagagggcccaggcag

SEQ ID NO: 2661941 - DNA, 21 bp, Homo sapiens
tgcccagccccttctgaccca

SEQ ID NO: 2661942 - DNA, 14 bp, Homo sapiens
tgcccagctagctg

SEQ ID NO: 2661943 - DNA, 13 bp, Homo sapiens
tgcccagctctcg

SEQ ID NO: 2661944 - DNA, 18 bp, Homo sapiens
tgcccagcttgggcccag

SEQ ID NO: 2661945 - DNA, 14 bp, Homo sapiens
tgcccaggcaggtc

SEQ ID NO: 2661946 - DNA, 16 bp, Homo sapiens
tgcccaggcaggtctt

SEQ ID NO: 2661947 - DNA, 20 bp, Homo sapiens
tgcccaggcaggtcttgaac

SEQ ID NO: 2661948 - DNA, 14 bp, Homo sapiens
tgcccaggcccaga

SEQ ID NO: 2661949 - DNA, 15 bp, Homo sapiens
tgcccaggcccctgc

SEQ ID NO: 2661950 - DNA, 20 bp, Homo sapiens
tgcccaggcccctgccaccc

SEQ ID NO: 2661951 - DNA, 17 bp, Homo sapiens
tgcccaggcctgcctgt

SEQ ID NO: 2661952 - DNA, 11 bp, Homo sapiens
tgcccaggctg

SEQ ID NO: 2661953 - DNA, 20 bp, Homo sapiens
tgcccaggctggagtgcaat

SEQ ID NO: 2661954 - DNA, 13 bp, Homo sapiens
tgcccaggctggc

SEQ ID NO: 2661955 - DNA, 17 bp, Homo sapiens
tgcccaggctggtctca

SEQ ID NO: 2661956 - DNA, 22 bp, Homo sapiens
tgcccagggccactctgcctct

SEQ ID NO: 2661957 - DNA, 14 bp, Homo sapiens
tgcccagggctcag

SEQ ID NO: 2661958 - DNA, 15 bp, Homo sapiens
tgcccagggctcagc

SEQ ID NO: 2661959 - DNA, 21 bp, Homo sapiens
tgcccagggctcagcctggtg

SEQ ID NO: 2661960 - DNA, 15 bp, Homo sapiens
tgcccaggggagccc

SEQ ID NO: 2661961 - DNA, 18 bp, Homo sapiens
tgcccaggggtgccccct

SEQ ID NO: 2661962 - DNA, 22 bp, Homo sapiens
tgcccaggggtgccccctcctc

SEQ ID NO: 2661963 - DNA, 23 bp, Homo sapiens
tgcccaggggtgccccctcctct

SEQ ID NO: 2661964 - DNA, 17 bp, Homo sapiens
tgcccagtttcagggct

SEQ ID NO: 2661965 - DNA, 16 bp, Homo sapiens
tgcccagtttctgcct

SEQ ID NO: 2661966 - DNA, 19 bp, Homo sapiens
tgcccagtttctgcctctg

SEQ ID NO: 2661967 - DNA, 20 bp, Homo sapiens
tgccccaaacaaatatgcaa

SEQ ID NO: 2661968 - DNA, 14 bp, Homo sapiens
tgccccagagctgt

SEQ ID NO: 2661969 - DNA, 17 bp, Homo sapiens
tgccccagagctgttta

SEQ ID NO: 2661970 - DNA, 13 bp, Homo sapiens
tgccccagaggcc

SEQ ID NO: 2661971 - DNA, 12 bp, Homo sapiens
tgccccagccag

SEQ ID NO: 2661972 - DNA, 16 bp, Homo sapiens
tgccccagctctggct

SEQ ID NO: 2661973 - DNA, 18 bp, Homo sapiens
tgccccagctctggcttc

SEQ ID NO: 2661974 - DNA, 16 bp, Homo sapiens
tgccccatcagtgctc

SEQ ID NO: 2661975 - DNA, 18 bp, Homo sapiens
tgccccatcagtgctccc

SEQ ID NO: 2661976 - DNA, 20 bp, Homo sapiens
tgccccatcagtgctccctc

SEQ ID NO: 2661977 - DNA, 15 bp, Homo sapiens
tgcccccagggcact

SEQ ID NO: 2661978 - DNA, 14 bp, Homo sapiens
tgccccccacccca

SEQ ID NO: 2661979 - DNA, 16 bp, Homo sapiens
tgccccccaccccagc

SEQ ID NO: 2661980 - DNA, 14 bp, Homo sapiens
tgccccccagcctc

SEQ ID NO: 2661981 - DNA, 15 bp, Homo sapiens
tgccccccagcctct

SEQ ID NO: 2661982 - DNA, 19 bp, Homo sapiens
tgccccccagcctctggca

SEQ ID NO: 2661983 - DNA, 22 bp, Homo sapiens
tgcccccctcaaacctcctctt

SEQ ID NO: 2661984 - DNA, 23 bp, Homo sapiens
tgcccccctcaaacctcctcttc

SEQ ID NO: 2661985 - DNA, 16 bp, Homo sapiens
tgccccctcctctccc

SEQ ID NO: 2661986 - DNA, 17 bp, Homo sapiens
tgccccctcctctccca

SEQ ID NO: 2661987 - DNA, 16 bp, Homo sapiens
tgccccctgctggctc

SEQ ID NO: 2661988 - DNA, 22 bp, Homo sapiens
tgccccctgctggctcttctgc

SEQ ID NO: 2661989 - DNA, 22 bp, Homo sapiens
tgccccctggtggacagtcctg

SEQ ID NO: 2661990 - DNA, 13 bp, Homo sapiens
tgcccccttctcc

SEQ ID NO: 2661991 - DNA, 16 bp, Homo sapiens
tgccccctttcagatg

SEQ ID NO: 2661992 - DNA, 18 bp, Homo sapiens
tgccccctttcagatgtc

SEQ ID NO: 2661993 - DNA, 21 bp, Homo sapiens
tgccccctttcagatgtcttc

SEQ ID NO: 2661994 - DNA, 22 bp, Homo sapiens
tgccccggccccggccccagcc

SEQ ID NO: 2661995 - DNA, 23 bp, Homo sapiens
tgccccggccccggccccagcca

SEQ ID NO: 2661996 - DNA, 16 bp, Homo sapiens
tgcccctagcttagag

SEQ ID NO: 2661997 - DNA, 23 bp, Homo sapiens
tgcccctagcttagagcctccct

SEQ ID NO: 2661998 - DNA, 21 bp, Homo sapiens
tgcccctcccagaacacactc

SEQ ID NO: 2661999 - DNA, 22 bp, Homo sapiens
tgcccctcccccaacccccacc

SEQ ID NO: 2662000 - DNA, 23 bp, Homo sapiens
tgcccctcccccaacccccaccc

SEQ ID NO: 2662001 - DNA, 17 bp, Homo sapiens
tgcccctccctgcttca

SEQ ID NO: 2662002 - DNA, 16 bp, Homo sapiens
tgcccctgctgcctcc

SEQ ID NO: 2662003 - DNA, 13 bp, Homo sapiens
tgcccgagctggt

SEQ ID NO: 2662004 - DNA, 16 bp, Homo sapiens
tgcccgagctggtgca

SEQ ID NO: 2662005 - DNA, 21 bp, Homo sapiens
tgcccggagattggacggcct

SEQ ID NO: 2662006 - DNA, 18 bp, Homo sapiens
tgcccggattctgggagg

SEQ ID NO: 2662007 - DNA, 18 bp, Homo sapiens
tgcccggggcagctgcca

SEQ ID NO: 2662008 - DNA, 20 bp, Homo sapiens
tgcccggggcagctgccaga

SEQ ID NO: 2662009 - DNA, 23 bp, Homo sapiens
tgcccggggcagctgccagagaa

SEQ ID NO: 2662010 - DNA, 21 bp, Homo sapiens
tgcccgtctctctcccatgga

SEQ ID NO: 2662011 - DNA, 13 bp, Homo sapiens
tgcccgtcttcag

SEQ ID NO: 2662012 - DNA, 23 bp, Homo sapiens
tggagagttcaatggctgctgaa

SEQ ID NO: 2662013 - DNA, 16 bp, Homo sapiens
tggagatgggatgctt

SEQ ID NO: 2662014 - DNA, 21 bp, Homo sapiens
tggagcaaagtgagggccgag

SEQ ID NO: 2662015 - DNA, 15 bp, Homo sapiens
tggagcagaatcagt

SEQ ID NO: 2662016 - DNA, 17 bp, Homo sapiens
tggagcagaccaccccg

SEQ ID NO: 2662017 - DNA, 16 bp, Homo sapiens
tggagcagaggggctg

SEQ ID NO: 2662018 - DNA, 17 bp, Homo sapiens
tggagcagaggggctga

SEQ ID NO: 2662019 - DNA, 15 bp, Homo sapiens
tggagcatctgactc

SEQ ID NO: 2662020 - DNA, 16 bp, Homo sapiens
tggagcatctgactca

SEQ ID NO: 2662021 - DNA, 17 bp, Homo sapiens
tggagcatgggcctggc

SEQ ID NO: 2662022 - DNA, 18 bp, Homo sapiens
tggagcatgggcctggcc

SEQ ID NO: 2662023 - DNA, 17 bp, Homo sapiens
tggagccaagggttcag

SEQ ID NO: 2662024 - DNA, 16 bp, Homo sapiens
tggagccaagtccaga

SEQ ID NO: 2662025 - DNA, 16 bp, Homo sapiens
tggagccactaactag

SEQ ID NO: 2662026 - DNA, 14 bp, Homo sapiens
tggagccccacact

SEQ ID NO: 2662027 - DNA, 13 bp, Homo sapiens
tggagcccctggg

SEQ ID NO: 2662028 - DNA, 17 bp, Homo sapiens
tggagcccgcaccccca

SEQ ID NO: 2662029 - DNA, 22 bp, Homo sapiens
tggagcccgcacccccaccctt

SEQ ID NO: 2662030 - DNA, 15 bp, Homo sapiens
tggagcccttgggtt

SEQ ID NO: 2662031 - DNA, 14 bp, Homo sapiens
tggagcctggtgcc

SEQ ID NO: 2662032 - DNA, 16 bp, Homo sapiens
tggagcgcacctgccc

SEQ ID NO: 2662033 - DNA, 21 bp, Homo sapiens
tggagcgcacctgccccctgg

SEQ ID NO: 2662034 - DNA, 13 bp, Homo sapiens
tggaggaaagcaa

SEQ ID NO: 2662035 - DNA, 20 bp, Homo sapiens
tggaggaaggaaacccagct

SEQ ID NO: 2662036 - DNA, 23 bp, Homo sapiens
tggaggaaggaaacccagctctg

SEQ ID NO: 2662037 - DNA, 13 bp, Homo sapiens
tggaggaaggatt

SEQ ID NO: 2662038 - DNA, 17 bp, Homo sapiens
tggaggaatgctccccc

SEQ ID NO: 2662039 - DNA, 21 bp, Homo sapiens
tggaggactagaacctggagg

SEQ ID NO: 2662040 - DNA, 15 bp, Homo sapiens
tggaggagagaagaa

SEQ ID NO: 2662041 - DNA, 14 bp, Homo sapiens
tggaggagcaaagg

SEQ ID NO: 2662042 - DNA, 19 bp, Homo sapiens
tggaggagctcaggacact

SEQ ID NO: 2662043 - DNA, 15 bp, Homo sapiens
tggaggaggcctggg

SEQ ID NO: 2662044 - DNA, 18 bp, Homo sapiens
tggaggaggcctgggggc

SEQ ID NO: 2662045 - DNA, 23 bp, Homo sapiens
tggaggaggcctgggggcaggga

SEQ ID NO: 2662046 - DNA, 13 bp, Homo sapiens
tggaggctgtctt

SEQ ID NO: 2662047 - DNA, 20 bp, Homo sapiens
tggagggaatgaacctggag

SEQ ID NO: 2662048 - DNA, 21 bp, Homo sapiens
tggagggaatgaacctggagg

SEQ ID NO: 2662049 - DNA, 21 bp, Homo sapiens
tggagggcgtgggagcgtggg

SEQ ID NO: 2662050 - DNA, 20 bp, Homo sapiens
tggagggctagaacctggag

SEQ ID NO: 2662051 - DNA, 21 bp, Homo sapiens
tggagggctagaacctggaga

SEQ ID NO: 2662052 - DNA, 22 bp, Homo sapiens
tggagggctagaacctggagaa

SEQ ID NO: 2662053 - DNA, 22 bp, Homo sapiens
tggagggctagaatctggagag

SEQ ID NO: 2662054 - DNA, 23 bp, Homo sapiens
tggagggctagaatctggagagc

SEQ ID NO: 2662055 - DNA, 23 bp, Homo sapiens
tggaggggggaggtgggatcctc

SEQ ID NO: 2662056 - DNA, 20 bp, Homo sapiens
tggaggggtggtcctgactc

SEQ ID NO: 2662057 - DNA, 13 bp, Homo sapiens
tggaggggtgtgg

SEQ ID NO: 2662058 - DNA, 16 bp, Homo sapiens
tggagggtcccaagct

SEQ ID NO: 2662059 - DNA, 18 bp, Homo sapiens
tggagggtcccaagctgg

SEQ ID NO: 2662060 - DNA, 21 bp, Homo sapiens
tggagggtcccaagctgggcc

SEQ ID NO: 2662061 - DNA, 22 bp, Homo sapiens
tggagggtcccaagctgggccc

SEQ ID NO: 2662062 - DNA, 20 bp, Homo sapiens
tggagggtgggagagcccag

SEQ ID NO: 2662063 - DNA, 19 bp, Homo sapiens
tggaggtggggcctggagc

SEQ ID NO: 2662064 - DNA, 14 bp, Homo sapiens
tggaggttgataac

SEQ ID NO: 2662065 - DNA, 17 bp, Homo sapiens
tggaggttgataacttt

SEQ ID NO: 2662066 - DNA, 21 bp, Homo sapiens
tggaggttgcagtgagccaag

SEQ ID NO: 2662067 - DNA, 16 bp, Homo sapiens
tggagtataatattca

SEQ ID NO: 2662068 - DNA, 19 bp, Homo sapiens
tggagtcccctcacctcct

SEQ ID NO: 2662069 - DNA, 17 bp, Homo sapiens
tggagtgcaatgacaca

SEQ ID NO: 2662070 - DNA, 17 bp, Homo sapiens
tggagtgcagggaggag

SEQ ID NO: 2662071 - DNA, 22 bp, Homo sapiens
tggagtttttgtttggagagca

SEQ ID NO: 2662072 - DNA, 16 bp, Homo sapiens
tggatatagttttact

SEQ ID NO: 2662073 - DNA, 18 bp, Homo sapiens
tggatatatgtttttgaa

SEQ ID NO: 2662074 - DNA, 22 bp, Homo sapiens
tggatattttcaaattgtatct

SEQ ID NO: 2662075 - DNA, 13 bp, Homo sapiens
tggatcctagcct

SEQ ID NO: 2662076 - DNA, 15 bp, Homo sapiens
tggatctccccactc

SEQ ID NO: 2662077 - DNA, 20 bp, Homo sapiens
tggatgagacttccaaacct

SEQ ID NO: 2662078 - DNA, 12 bp, Homo sapiens
tggatgatgttt

SEQ ID NO: 2662079 - DNA, 21 bp, Homo sapiens
tggatgcagcctcacagtcct

SEQ ID NO: 2662080 - DNA, 18 bp, Homo sapiens
tggatgcctggtggcagc

SEQ ID NO: 2662081 - DNA, 19 bp, Homo sapiens
tggatgcctggtggcagct

SEQ ID NO: 2662082 - DNA, 22 bp, Homo sapiens
tggattaaacttaatctaaatg

SEQ ID NO: 2662083 - DNA, 17 bp, Homo sapiens
tggattaattaaatgca

SEQ ID NO: 2662084 - DNA, 20 bp, Homo sapiens
tggattactgccattcactt

SEQ ID NO: 2662085 - DNA, 13 bp, Homo sapiens
tggattattcatt

SEQ ID NO: 2662086 - DNA, 17 bp, Homo sapiens
tggattattcatttaaa

SEQ ID NO: 2662087 - DNA, 18 bp, Homo sapiens
tggattcattacagctta

SEQ ID NO: 2662088 - DNA, 17 bp, Homo sapiens
tggattccaaccccaac

SEQ ID NO: 2662089 - DNA, 12 bp, Homo sapiens
tggattctcaga

SEQ ID NO: 2662090 - DNA, 15 bp, Homo sapiens
tggattctcagatat

SEQ ID NO: 2662091 - DNA, 15 bp, Homo sapiens
tggattggattattt

SEQ ID NO: 2662092 - DNA, 17 bp, Homo sapiens
tggattggattatttaa

SEQ ID NO: 2662093 - DNA, 15 bp, Homo sapiens
tggatttaacagaaa

SEQ ID NO: 2662094 - DNA, 20 bp, Homo sapiens
tggatttaacagaaatgtac

SEQ ID NO: 2662095 - DNA, 20 bp, Homo sapiens
tggatttataaatgctattt

SEQ ID NO: 2662096 - DNA, 17 bp, Homo sapiens
tggcaaacttcagactg

SEQ ID NO: 2662097 - DNA, 17 bp, Homo sapiens
tggcaaagacagaagcc

SEQ ID NO: 2662098 - DNA, 22 bp, Homo sapiens
tggcaaagggagcagaactgaa

SEQ ID NO: 2662099 - DNA, 12 bp, Homo sapiens
tggcaacagaag

SEQ ID NO: 2662100 - DNA, 15 bp, Homo sapiens
tggcaacagaagcag

SEQ ID NO: 2662101 - DNA, 15 bp, Homo sapiens
tggcaagaaagctgg

SEQ ID NO: 2662102 - DNA, 19 bp, Homo sapiens
tggcaagaaagctggtaaa

SEQ ID NO: 2662103 - DNA, 15 bp, Homo sapiens
tggcaagcccctgcc

SEQ ID NO: 2662104 - DNA, 20 bp, Homo sapiens
tggcaaggctgtgctccctg

SEQ ID NO: 2662105 - DNA, 23 bp, Homo sapiens
tggcaaggctgtgctccctggtt

SEQ ID NO: 2662106 - DNA, 18 bp, Homo sapiens
tggcaatagtgggccctc

SEQ ID NO: 2662107 - DNA, 18 bp, Homo sapiens
tggcaatagtgtgttctg

SEQ ID NO: 2662108 - DNA, 13 bp, Homo sapiens
tggcaatatagaa

SEQ ID NO: 2662109 - DNA, 19 bp, Homo sapiens
tggcaatgccatcatctcc

SEQ ID NO: 2662110 - DNA, 22 bp, Homo sapiens
tggcacacacctgtagtcccag

SEQ ID NO: 2662111 - DNA, 18 bp, Homo sapiens
tggcacagcccaaagaag

SEQ ID NO: 2662112 - DNA, 20 bp, Homo sapiens
tggcacagcccaaagaagga

SEQ ID NO: 2662113 - DNA, 18 bp, Homo sapiens
tggcacagttttctgaga

SEQ ID NO: 2662114 - DNA, 19 bp, Homo sapiens
tggcacagttttctgagaa

SEQ ID NO: 2662115 - DNA, 20 bp, Homo sapiens
tggcacatcagcacgatttc

SEQ ID NO: 2662116 - DNA, 18 bp, Homo sapiens
tggcacatttaagagaca

SEQ ID NO: 2662117 - DNA, 18 bp, Homo sapiens
tggcaccactgcactcca

SEQ ID NO: 2662118 - DNA, 21 bp, Homo sapiens
tggcaccactgcactccagcc

SEQ ID NO: 2662119 - DNA, 19 bp, Homo sapiens
tggcaccagaggctgcaga

SEQ ID NO: 2662120 - DNA, 20 bp, Homo sapiens
tggcacccggcccctgctgg

SEQ ID NO: 2662121 - DNA, 21 bp, Homo sapiens
tggcacccggcccctgctggt

SEQ ID NO: 2662122 - DNA, 22 bp, Homo sapiens
tggcaccttcagactttgcttc

SEQ ID NO: 2662123 - DNA, 14 bp, Homo sapiens
tggcacggtggtac

SEQ ID NO: 2662124 - DNA, 16 bp, Homo sapiens
tggcactataatgtaa

SEQ ID NO: 2662125 - DNA, 21 bp, Homo sapiens
tggcactataatgtaagctct

SEQ ID NO: 2662126 - DNA, 22 bp, Homo sapiens
tggcactataatgtaagctcta

SEQ ID NO: 2662127 - DNA, 18 bp, Homo sapiens
tggcactcacagacctgg

SEQ ID NO: 2662128 - DNA, 19 bp, Homo sapiens
tggcactgactgggcatag

SEQ ID NO: 2662129 - DNA, 14 bp, Homo sapiens
tggcactgagcccc

SEQ ID NO: 2662130 - DNA, 15 bp, Homo sapiens
tggcactgagccccc

SEQ ID NO: 2662131 - DNA, 16 bp, Homo sapiens
tggcactgagcccccc

SEQ ID NO: 2662132 - DNA, 16 bp, Homo sapiens
tggcactgcttccagt

SEQ ID NO: 2662133 - DNA, 13 bp, Homo sapiens
tggcactggatgc

SEQ ID NO: 2662134 - DNA, 18 bp, Homo sapiens
tggcactggatgcagaaa

SEQ ID NO: 2662135 - DNA, 20 bp, Homo sapiens
tggcactggcattgtccctg

SEQ ID NO: 2662136 - DNA, 17 bp, Homo sapiens
tggcactggggcacttg

SEQ ID NO: 2662137 - DNA, 20 bp, Homo sapiens
tggcactggggcacttggca

SEQ ID NO: 2662138 - DNA, 21 bp, Homo sapiens
tggcactttttcatttgccta

SEQ ID NO: 2662139 - DNA, 14 bp, Homo sapiens
tggcagaactgagc

SEQ ID NO: 2662140 - DNA, 20 bp, Homo sapiens
tggcagaactgagctcctct

SEQ ID NO: 2662141 - DNA, 19 bp, Homo sapiens
tggcagaataatctttggg

SEQ ID NO: 2662142 - DNA, 18 bp, Homo sapiens
tggcagaatgctagctct

SEQ ID NO: 2662143 - DNA, 12 bp, Homo sapiens
tggcagacagac

SEQ ID NO: 2662144 - DNA, 19 bp, Homo sapiens
tggcagataatcagcctct

SEQ ID NO: 2662145 - DNA, 20 bp, Homo sapiens
tggcagataatcagcctctt

SEQ ID NO: 2662146 - DNA, 14 bp, Homo sapiens
tggcagcagagtgt

SEQ ID NO: 2662147 - DNA, 12 bp, Homo sapiens
tggcagccctgt

SEQ ID NO: 2662148 - DNA, 17 bp, Homo sapiens
tggcagccctgtaggga

SEQ ID NO: 2662149 - DNA, 17 bp, Homo sapiens
tggcagctctccagtca

SEQ ID NO: 2662150 - DNA, 21 bp, Homo sapiens
tggcagctgcggtccacccag

SEQ ID NO: 2662151 - DNA, 16 bp, Homo sapiens
tggcaggaccaggact

SEQ ID NO: 2662152 - DNA, 17 bp, Homo sapiens
tggcaggaccaggacta

SEQ ID NO: 2662153 - DNA, 15 bp, Homo sapiens
tggcagggctcagga

SEQ ID NO: 2662154 - DNA, 22 bp, Homo sapiens
tggcatacgcctgtagtcctag

SEQ ID NO: 2662155 - DNA, 14 bp, Homo sapiens
tgggttgactttca

SEQ ID NO: 2662156 - DNA, 22 bp, Homo sapiens
tgggtttcacaagtgaaaaaca

SEQ ID NO: 2662157 - DNA, 15 bp, Homo sapiens
tgggtttttgttacc

SEQ ID NO: 2662158 - DNA, 21 bp, Homo sapiens
tggtaacatcctttctattga

SEQ ID NO: 2662159 - DNA, 18 bp, Homo sapiens
tggtacccagccatctgc

SEQ ID NO: 2662160 - DNA, 14 bp, Homo sapiens
tggtaccctctgga

SEQ ID NO: 2662161 - DNA, 18 bp, Homo sapiens
tggtacggagatgtttca

SEQ ID NO: 2662162 - DNA, 17 bp, Homo sapiens
tggtactcattaaaaaa

SEQ ID NO: 2662163 - DNA, 19 bp, Homo sapiens
tggtacttttatgatgtat

SEQ ID NO: 2662164 - DNA, 17 bp, Homo sapiens
tggtagaccaaaataaa

SEQ ID NO: 2662165 - DNA, 13 bp, Homo sapiens
tggtagagattca

SEQ ID NO: 2662166 - DNA, 12 bp, Homo sapiens
tggtagctcagg

SEQ ID NO: 2662167 - DNA, 21 bp, Homo sapiens
tggtagcttttcccttctttt

SEQ ID NO: 2662168 - DNA, 13 bp, Homo sapiens
tggtaggaactgc

SEQ ID NO: 2662169 - DNA, 17 bp, Homo sapiens
tggtaggactgtagaaa

SEQ ID NO: 2662170 - DNA, 13 bp, Homo sapiens
tggtatagaaatg

SEQ ID NO: 2662171 - DNA, 19 bp, Homo sapiens
tggtatatccaaaagcttt

SEQ ID NO: 2662172 - DNA, 15 bp, Homo sapiens
tggtatcaagaaagt

SEQ ID NO: 2662173 - DNA, 23 bp, Homo sapiens
tggtatctgttctttaatttatt

SEQ ID NO: 2662174 - DNA, 15 bp, Homo sapiens
tggtatgagctgagg

SEQ ID NO: 2662175 - DNA, 16 bp, Homo sapiens
tggtatgagctgaggg

SEQ ID NO: 2662176 - DNA, 17 bp, Homo sapiens
tggtcaaaagctggatt

SEQ ID NO: 2662177 - DNA, 14 bp, Homo sapiens
tggtcaaaccgcac

SEQ ID NO: 2662178 - DNA, 20 bp, Homo sapiens
tggtcaaaccgcactcaccc

SEQ ID NO: 2662179 - DNA, 20 bp, Homo sapiens
tggtcacaggactctgcctc

SEQ ID NO: 2662180 - DNA, 18 bp, Homo sapiens
tggtcaccaaatcagctg

SEQ ID NO: 2662181 - DNA, 20 bp, Homo sapiens
tggtcaccaaatcagctgct

SEQ ID NO: 2662182 - DNA, 23 bp, Homo sapiens
tggtcaccaaatcagctgctact

SEQ ID NO: 2662183 - DNA, 14 bp, Homo sapiens
tggtcaccagctcc

SEQ ID NO: 2662184 - DNA, 15 bp, Homo sapiens
tggtcaccagctcct

SEQ ID NO: 2662185 - DNA, 22 bp, Homo sapiens
tggtcagatttgaactcttcaa

SEQ ID NO: 2662186 - DNA, 19 bp, Homo sapiens
tggtcagccctagggtgga

SEQ ID NO: 2662187 - DNA, 16 bp, Homo sapiens
tggtcatctttttctc

SEQ ID NO: 2662188 - DNA, 17 bp, Homo sapiens
tggtccagggaagctgg

SEQ ID NO: 2662189 - DNA, 19 bp, Homo sapiens
tggtccagggaagctggcc

SEQ ID NO: 2662190 - DNA, 17 bp, Homo sapiens
tggtccatggaatgctt

SEQ ID NO: 2662191 - DNA, 15 bp, Homo sapiens
tggtcccaccccaca

SEQ ID NO: 2662192 - DNA, 13 bp, Homo sapiens
tggtcccatccag

SEQ ID NO: 2662193 - DNA, 16 bp, Homo sapiens
tggtcccatccaggca

SEQ ID NO: 2662194 - DNA, 18 bp, Homo sapiens
tggtcccccttccatgga

SEQ ID NO: 2662195 - DNA, 14 bp, Homo sapiens
tggtccctgggagg

SEQ ID NO: 2662196 - DNA, 12 bp, Homo sapiens
tggtccctgggg

SEQ ID NO: 2662197 - DNA, 22 bp, Homo sapiens
tggtcctgactcaacatgttac

SEQ ID NO: 2662198 - DNA, 14 bp, Homo sapiens
tggtcctgagacct

SEQ ID NO: 2662199 - DNA, 13 bp, Homo sapiens
tggtcctgctgca

SEQ ID NO: 2662200 - DNA, 15 bp, Homo sapiens
tggtcctgctgcagt

SEQ ID NO: 2662201 - DNA, 14 bp, Homo sapiens
tggtcggaaaacat

SEQ ID NO: 2662202 - DNA, 16 bp, Homo sapiens
tggtctacactgtgct

SEQ ID NO: 2662203 - DNA, 17 bp, Homo sapiens
tggtctacactgtgctg

SEQ ID NO: 2662204 - DNA, 18 bp, Homo sapiens
tggtctacactgtgctga

SEQ ID NO: 2662205 - DNA, 19 bp, Homo sapiens
tggtctcagcagcgaccac

SEQ ID NO: 2662206 - DNA, 16 bp, Homo sapiens
tggtctctaggctggg

SEQ ID NO: 2662207 - DNA, 18 bp, Homo sapiens
tggtctctaggctgggga

SEQ ID NO: 2662208 - DNA, 17 bp, Homo sapiens
tggtctgaatgttctga

SEQ ID NO: 2662209 - DNA, 21 bp, Homo sapiens
tggtctgaatgttctgacatt

SEQ ID NO: 2662210 - DNA, 18 bp, Homo sapiens
tggtctgacccactgctt

SEQ ID NO: 2662211 - DNA, 22 bp, Homo sapiens
tggtctgaggggcaactgagtc

SEQ ID NO: 2662212 - DNA, 15 bp, Homo sapiens
tggtctgcaggcagg

SEQ ID NO: 2662213 - DNA, 19 bp, Homo sapiens
tggtctgggacttccttgc

SEQ ID NO: 2662214 - DNA, 12 bp, Homo sapiens
tggtctgtgtga

SEQ ID NO: 2662215 - DNA, 14 bp, Homo sapiens
tggtctttctggag

SEQ ID NO: 2662216 - DNA, 14 bp, Homo sapiens
tggtctttgtaaga

SEQ ID NO: 2662217 - DNA, 18 bp, Homo sapiens
tggtgaaatttattagtt

SEQ ID NO: 2662218 - DNA, 19 bp, Homo sapiens
tggtgaaatttattagtta

SEQ ID NO: 2662219 - DNA, 16 bp, Homo sapiens
tggtgacaccagcctt

SEQ ID NO: 2662220 - DNA, 18 bp, Homo sapiens
tggtgacaccagcctttc

SEQ ID NO: 2662221 - DNA, 17 bp, Homo sapiens
tggtgacccagtcagag

SEQ ID NO: 2662222 - DNA, 13 bp, Homo sapiens
tggtgacctctgc

SEQ ID NO: 2662223 - DNA, 16 bp, Homo sapiens
tggtgacctctgcctg

SEQ ID NO: 2662224 - DNA, 22 bp, Homo sapiens
tggtgacctctgcctgaagtca

SEQ ID NO: 2662225 - DNA, 23 bp, Homo sapiens
tggtgagaactactcagggaatg

SEQ ID NO: 2662226 - DNA, 17 bp, Homo sapiens
tggtgagatgcagctgg

SEQ ID NO: 2662227 - DNA, 20 bp, Homo sapiens
tggtgagatgcagctggaaa

SEQ ID NO: 2662228 - DNA, 17 bp, Homo sapiens
tggtgaggccttgctcc

SEQ ID NO: 2662229 - DNA, 18 bp, Homo sapiens
tggtgagtcttggcggca

SEQ ID NO: 2662230 - DNA, 20 bp, Homo sapiens
tggtgagtcttggcggcagc

SEQ ID NO: 2662231 - DNA, 15 bp, Homo sapiens
tggtgcacagtgatt

SEQ ID NO: 2662232 - DNA, 16 bp, Homo sapiens
tggtgcattacagaga

SEQ ID NO: 2662233 - DNA, 19 bp, Homo sapiens
tggtgcattacagagagga

SEQ ID NO: 2662234 - DNA, 20 bp, Homo sapiens
tggtgccaatggaacctcct

SEQ ID NO: 2662235 - DNA, 17 bp, Homo sapiens
tggtgccacaaataaaa

SEQ ID NO: 2662236 - DNA, 20 bp, Homo sapiens
tggtgccacaaataaaatgg

SEQ ID NO: 2662237 - DNA, 14 bp, Homo sapiens
tggtgccagccttc

SEQ ID NO: 2662238 - DNA, 18 bp, Homo sapiens
tggtgcctggcctggcac

SEQ ID NO: 2662239 - DNA, 22 bp, Homo sapiens
tggtgctataggctggagaagc

SEQ ID NO: 2662240 - DNA, 19 bp, Homo sapiens
tggtgctgctgctgctgtg

SEQ ID NO: 2662241 - DNA, 17 bp, Homo sapiens
tggtgctggatattttc

SEQ ID NO: 2662242 - DNA, 20 bp, Homo sapiens
tggtgctgtggccagggtga

SEQ ID NO: 2662243 - DNA, 16 bp, Homo sapiens
tggtggcactgagccc

SEQ ID NO: 2662244 - DNA, 12 bp, Homo sapiens
tggtggcagctc

SEQ ID NO: 2662245 - DNA, 16 bp, Homo sapiens
tggtggcagctcacct

SEQ ID NO: 2662246 - DNA, 15 bp, Homo sapiens
tggtggcagctgcgg

SEQ ID NO: 2662247 - DNA, 13 bp, Homo sapiens
tggtggggagggg

SEQ ID NO: 2662248 - DNA, 15 bp, Homo sapiens
tggtggggaggggcg

SEQ ID NO: 2662249 - DNA, 20 bp, Homo sapiens
tggtggggaggggcgctggc

SEQ ID NO: 2662250 - DNA, 18 bp, Homo sapiens
tggtgggggcctcggtgt

SEQ ID NO: 2662251 - DNA, 19 bp, Homo sapiens
tggtgggttcaggggactc

SEQ ID NO: 2662252 - DNA, 23 bp, Homo sapiens
tggtgtatcccccccctgtatag

SEQ ID NO: 2662253 - DNA, 17 bp, Homo sapiens
tggtgtcctgaccaccc

SEQ ID NO: 2662254 - DNA, 21 bp, Homo sapiens
tggtgtcctgaccaccctccc

SEQ ID NO: 2662255 - DNA, 18 bp, Homo sapiens
tggtgtgaccctctgaat

SEQ ID NO: 2662256 - DNA, 16 bp, Homo sapiens
tggtgtggcaaagcct

SEQ ID NO: 2662257 - DNA, 17 bp, Homo sapiens
tggtgttgcagaaggtt

SEQ ID NO: 2662258 - DNA, 15 bp, Homo sapiens
tggtgtttcctggca

SEQ ID NO: 2662259 - DNA, 17 bp, Homo sapiens
tggtgtttcctggcact

SEQ ID NO: 2662260 - DNA, 20 bp, Homo sapiens
tggtgttttggggatgagag

SEQ ID NO: 2662261 - DNA, 15 bp, Homo sapiens
tggttaagtctgttt

SEQ ID NO: 2662262 - DNA, 13 bp, Homo sapiens
tggttaatgccat

SEQ ID NO: 2662263 - DNA, 13 bp, Homo sapiens
tggttagaaatgc

SEQ ID NO: 2662264 - DNA, 18 bp, Homo sapiens
tggttaggcattgtggga

SEQ ID NO: 2662265 - DNA, 13 bp, Homo sapiens
tggttatttctct

SEQ ID NO: 2662266 - DNA, 16 bp, Homo sapiens
tggttcagctaagcta

SEQ ID NO: 2662267 - DNA, 16 bp, Homo sapiens
tggttccaagccctgg

SEQ ID NO: 2662268 - DNA, 17 bp, Homo sapiens
tggttccatgcctgagg

SEQ ID NO: 2662269 - DNA, 17 bp, Homo sapiens
tggttcctttctcagcc

SEQ ID NO: 2662270 - DNA, 15 bp, Homo sapiens
tggttctaatagaac

SEQ ID NO: 2662271 - DNA, 20 bp, Homo sapiens
tggttctgatgatgtgcctg

SEQ ID NO: 2662272 - DNA, 15 bp, Homo sapiens
tggttgatgggttct

SEQ ID NO: 2662273 - DNA, 13 bp, Homo sapiens
tggttgctgtgtg

SEQ ID NO: 2662274 - DNA, 14 bp, Homo sapiens
tggttgctttaata

SEQ ID NO: 2662275 - DNA, 16 bp, Homo sapiens
tggttggctggccttc

SEQ ID NO: 2662276 - DNA, 15 bp, Homo sapiens
tggttgggtcctcac

SEQ ID NO: 2662277 - DNA, 22 bp, Homo sapiens
tggttggtaacacaaattttca

SEQ ID NO: 2662278 - DNA, 21 bp, Homo sapiens
tggtttatagagggccaagac

SEQ ID NO: 2662279 - DNA, 21 bp, Homo sapiens
tggtttcacggtgccaggttt

SEQ ID NO: 2662280 - DNA, 15 bp, Homo sapiens
tggtttcagaaatgt

SEQ ID NO: 2662281 - DNA, 21 bp, Homo sapiens
tggtttccacgatgaaaaact

SEQ ID NO: 2662282 - DNA, 19 bp, Homo sapiens
tggtttcctcattcctgaa

SEQ ID NO: 2662283 - DNA, 16 bp, Homo sapiens
tggtttctagacttgt

SEQ ID NO: 2662284 - DNA, 17 bp, Homo sapiens
tggtttgagcttagtga

SEQ ID NO: 2662285 - DNA, 19 bp, Homo sapiens
tggtttgcagatgacaaaa

SEQ ID NO: 2662286 - DNA, 19 bp, Homo sapiens
tggtttggccatctctgga

SEQ ID NO: 2662287 - DNA, 12 bp, Homo sapiens
tggttttaacaa

SEQ ID NO: 2662288 - DNA, 14 bp, Homo sapiens
tggttttcccctcc

SEQ ID NO: 2662289 - DNA, 13 bp, Homo sapiens
tggttttctgttc

SEQ ID NO: 2662290 - DNA, 21 bp, Homo sapiens
tggtttttaaaaaactgctga

SEQ ID NO: 2662291 - DNA, 23 bp, Homo sapiens
tggtttttaaaaaactgctgact

SEQ ID NO: 2662292 - DNA, 16 bp, Homo sapiens
tggtttttcagttttc

SEQ ID NO: 2662293 - DNA, 18 bp, Homo sapiens
tgtaaaaaaaaatgcctt

SEQ ID NO: 2662294 - DNA, 24 bp, Homo sapiens
tgtaaaaacagcattgctttctga

SEQ ID NO: 2662295 - DNA, 17 bp, Homo sapiens
tgtaaaatagcttgtat

SEQ ID NO: 2662296 - DNA, 21 bp, Homo sapiens
tgtaaaatagcttgtatagtg

SEQ ID NO: 2662297 - DNA, 21 bp, Homo sapiens
tgtaaaatattttgaatcaat

SEQ ID NO: 2662298 - DNA, 14 bp, Homo sapiens
tgtaaaatgaaatt

SEQ ID NO: 2662299 - DNA, 23 bp, Homo sapiens
tgtaaaccacaaggctgttgcat

SEQ ID NO: 2662300 - DNA, 21 bp, Homo sapiens
tgtcccctcctcactcccttc

SEQ ID NO: 2662301 - DNA, 19 bp, Homo sapiens
tgtcccggggtcctgtggc

SEQ ID NO: 2662302 - DNA, 19 bp, Homo sapiens
tgtccctacacccctcccc

SEQ ID NO: 2662303 - DNA, 22 bp, Homo sapiens
tgtccctgcacttgcagactct

SEQ ID NO: 2662304 - DNA, 14 bp, Homo sapiens
tgtccctgtgccta

SEQ ID NO: 2662305 - DNA, 18 bp, Homo sapiens
tgtccctttcttggccag

SEQ ID NO: 2662306 - DNA, 13 bp, Homo sapiens
tgtccgagctttg

SEQ ID NO: 2662307 - DNA, 15 bp, Homo sapiens
tgtcctaaggacaca

SEQ ID NO: 2662308 - DNA, 20 bp, Homo sapiens
tgtcctacccaccctccttt

SEQ ID NO: 2662309 - DNA, 20 bp, Homo sapiens
tgtcctaggagtatcctcat

SEQ ID NO: 2662310 - DNA, 22 bp, Homo sapiens
tgtcctatgggagtcaagtgtg

SEQ ID NO: 2662311 - DNA, 16 bp, Homo sapiens
tgtcctccagaagcct

SEQ ID NO: 2662312 - DNA, 21 bp, Homo sapiens
tgtcctccagaagcctctggc

SEQ ID NO: 2662313 - DNA, 19 bp, Homo sapiens
tgtcctcccatcccctgga

SEQ ID NO: 2662314 - DNA, 14 bp, Homo sapiens
tgtcctccccttgg

SEQ ID NO: 2662315 - DNA, 19 bp, Homo sapiens
tgtcctctctggctgggga

SEQ ID NO: 2662316 - DNA, 19 bp, Homo sapiens
tgtcctcttctgcatcttg

SEQ ID NO: 2662317 - DNA, 23 bp, Homo sapiens
tgtcctcttctgcatcttgggga

SEQ ID NO: 2662318 - DNA, 23 bp, Homo sapiens
tgtcctcttgctcaaaaatctgt

SEQ ID NO: 2662319 - DNA, 16 bp, Homo sapiens
tgtcctgaccaccctc

SEQ ID NO: 2662320 - DNA, 17 bp, Homo sapiens
tgtcctgaccaccctcc

SEQ ID NO: 2662321 - DNA, 19 bp, Homo sapiens
tgtcctgaccaccctcccc

SEQ ID NO: 2662322 - DNA, 21 bp, Homo sapiens
tgtcctgaccaccctcccctc

SEQ ID NO: 2662323 - DNA, 19 bp, Homo sapiens
tgtcctgcctgtctgaagc

SEQ ID NO: 2662324 - DNA, 12 bp, Homo sapiens
tgtcctgctggt

SEQ ID NO: 2662325 - DNA, 16 bp, Homo sapiens
tgtcctgggcgccctg

SEQ ID NO: 2662326 - DNA, 18 bp, Homo sapiens
tgtcctgggcgccctgga

SEQ ID NO: 2662327 - DNA, 21 bp, Homo sapiens
tgtcctggtgtcacttactgt

SEQ ID NO: 2662328 - DNA, 22 bp, Homo sapiens
tgtcctgtaaaggttacaagcc

SEQ ID NO: 2662329 - DNA, 15 bp, Homo sapiens
tgtccttgtgtgttt

SEQ ID NO: 2662330 - DNA, 23 bp, Homo sapiens
tgtcctttcccttcagtaccctc

SEQ ID NO: 2662331 - DNA, 13 bp, Homo sapiens
tgtcgagacactt

SEQ ID NO: 2662332 - DNA, 22 bp, Homo sapiens
tgtcgatgtaggcattctggag

SEQ ID NO: 2662333 - DNA, 14 bp, Homo sapiens
tgtcgcgctcagca

SEQ ID NO: 2662334 - DNA, 12 bp, Homo sapiens
tgtcggcctcta

SEQ ID NO: 2662335 - DNA, 19 bp, Homo sapiens
tgtcggcctggtgttctgt

SEQ ID NO: 2662336 - DNA, 20 bp, Homo sapiens
tgtcgttgactttagggact

SEQ ID NO: 2662337 - DNA, 22 bp, Homo sapiens
tgtctaaggtcacacagtatta

SEQ ID NO: 2662338 - DNA, 12 bp, Homo sapiens
tgtctacagaga

SEQ ID NO: 2662339 - DNA, 14 bp, Homo sapiens
tgtctatgggactc

SEQ ID NO: 2662340 - DNA, 17 bp, Homo sapiens
tgtctcactgaaacatt

SEQ ID NO: 2662341 - DNA, 14 bp, Homo sapiens
tgtctcagcctccc

SEQ ID NO: 2662342 - DNA, 15 bp, Homo sapiens
tgtctcagcctccca

SEQ ID NO: 2662343 - DNA, 16 bp, Homo sapiens
tgtctcaggtccctgc

SEQ ID NO: 2662344 - DNA, 11 bp, Homo sapiens
tgtctcatcca

SEQ ID NO: 2662345 - DNA, 17 bp, Homo sapiens
tgtctcatccatcatca

SEQ ID NO: 2662346 - DNA, 23 bp, Homo sapiens
tgtctcatccccaggggtcccag

SEQ ID NO: 2662347 - DNA, 11 bp, Homo sapiens
tgtctccagac

SEQ ID NO: 2662348 - DNA, 17 bp, Homo sapiens
tgtctccagacccccac

SEQ ID NO: 2662349 - DNA, 20 bp, Homo sapiens
tgtctccagacccccacccc

SEQ ID NO: 2662350 - DNA, 20 bp, Homo sapiens
tgtctcgtggtaggactgta

SEQ ID NO: 2662351 - DNA, 21 bp, Homo sapiens
tgtctcgtggtaggactgtag

SEQ ID NO: 2662352 - DNA, 17 bp, Homo sapiens
tgtctctactaaaaata

SEQ ID NO: 2662353 - DNA, 22 bp, Homo sapiens
tgtctctgcctccctcaccctg

SEQ ID NO: 2662354 - DNA, 23 bp, Homo sapiens
tgtctctgggcttggggcttcct

SEQ ID NO: 2662355 - DNA, 21 bp, Homo sapiens
tgtctcttccatatgacctca

SEQ ID NO: 2662356 - DNA, 13 bp, Homo sapiens
tgtctcttctgag

SEQ ID NO: 2662357 - DNA, 16 bp, Homo sapiens
tgtctcttctgagcta

SEQ ID NO: 2662358 - DNA, 19 bp, Homo sapiens
tgtctcttggtcctgctgc

SEQ ID NO: 2662359 - DNA, 21 bp, Homo sapiens
tgtctcttggtcctgctgcag

SEQ ID NO: 2662360 - DNA, 22 bp, Homo sapiens
tgtctcttggtcctgctgcagt

SEQ ID NO: 2662361 - DNA, 17 bp, Homo sapiens
tgtctgagccctcaaag

SEQ ID NO: 2662362 - DNA, 19 bp, Homo sapiens
tgtctgattggctcaccca

SEQ ID NO: 2662363 - DNA, 18 bp, Homo sapiens
tgtctgccagccagcagc

SEQ ID NO: 2662364 - DNA, 19 bp, Homo sapiens
tgtctggctgaggatttca

SEQ ID NO: 2662365 - DNA, 23 bp, Homo sapiens
tgtctggctgaggatttcaagcc

SEQ ID NO: 2662366 - DNA, 21 bp, Homo sapiens
tgtctggtggtggcaccatct

SEQ ID NO: 2662367 - DNA, 16 bp, Homo sapiens
tgtctggttttaacaa

SEQ ID NO: 2662368 - DNA, 15 bp, Homo sapiens
tgtctgtacacgtgt

SEQ ID NO: 2662369 - DNA, 21 bp, Homo sapiens
tgtctgtacacgtgtcctgta

SEQ ID NO: 2662370 - DNA, 21 bp, Homo sapiens
tgtctgtagagggccctggtg

SEQ ID NO: 2662371 - DNA, 16 bp, Homo sapiens
tgtctgtcccggggtc

SEQ ID NO: 2662372 - DNA, 22 bp, Homo sapiens
tgtcttatatatatttctttgt

SEQ ID NO: 2662373 - DNA, 14 bp, Homo sapiens
tgtcttcacaacag

SEQ ID NO: 2662374 - DNA, 24 bp, Homo sapiens
tgtcttcacctgattcaactaaaa

SEQ ID NO: 2662375 - DNA, 22 bp, Homo sapiens
tgtcttcatacctacatgtatt

SEQ ID NO: 2662376 - DNA, 23 bp, Homo sapiens
tgtcttcatttcattgtatgatg

SEQ ID NO: 2662377 - DNA, 13 bp, Homo sapiens
tgtcttcccaggg

SEQ ID NO: 2662378 - DNA, 13 bp, Homo sapiens
tgtcttcctgcat

SEQ ID NO: 2662379 - DNA, 17 bp, Homo sapiens
tgtcttcctgcattcac

SEQ ID NO: 2662380 - DNA, 14 bp, Homo sapiens
tgtcttccttggag

SEQ ID NO: 2662381 - DNA, 20 bp, Homo sapiens
tgtcttcggaaaccttggtg

SEQ ID NO: 2662382 - DNA, 21 bp, Homo sapiens
tgtcttcggaaaccttggtgt

SEQ ID NO: 2662383 - DNA, 16 bp, Homo sapiens
tgtcttcgtacagttc

SEQ ID NO: 2662384 - DNA, 17 bp, Homo sapiens
tgtcttcgtacagttct

SEQ ID NO: 2662385 - DNA, 14 bp, Homo sapiens
tgtcttctgcctgt

SEQ ID NO: 2662386 - DNA, 15 bp, Homo sapiens
tgtcttctgcctgtt

SEQ ID NO: 2662387 - DNA, 17 bp, Homo sapiens
tgtcttctgcctgttat

SEQ ID NO: 2662388 - DNA, 18 bp, Homo sapiens
tgtcttctgcctgttata

SEQ ID NO: 2662389 - DNA, 16 bp, Homo sapiens
tgtcttcttctgtgct

SEQ ID NO: 2662390 - DNA, 19 bp, Homo sapiens
tgtcttgaaagattcaggt

SEQ ID NO: 2662391 - DNA, 18 bp, Homo sapiens
tgtcttgcaatggcagcc

SEQ ID NO: 2662392 - DNA, 20 bp, Homo sapiens
tgtcttgcaatggcagcctt

SEQ ID NO: 2662393 - DNA, 13 bp, Homo sapiens
tgtcttggacact

SEQ ID NO: 2662394 - DNA, 19 bp, Homo sapiens
tgtcttggctttcatgtta

SEQ ID NO: 2662395 - DNA, 22 bp, Homo sapiens
tgtcttgtacatgtgtagcctg

SEQ ID NO: 2662396 - DNA, 14 bp, Homo sapiens
tgtctttaaggaaa

SEQ ID NO: 2662397 - DNA, 19 bp, Homo sapiens
tgtctttaggcagcagctt

SEQ ID NO: 2662398 - DNA, 16 bp, Homo sapiens
tgtctttcagatacat

SEQ ID NO: 2662399 - DNA, 19 bp, Homo sapiens
tgtctttcagatacatggt

SEQ ID NO: 2662400 - DNA, 12 bp, Homo sapiens
tgtctttctgag

SEQ ID NO: 2662401 - DNA, 18 bp, Homo sapiens
tgtctttggaccctgagg

SEQ ID NO: 2662402 - DNA, 22 bp, Homo sapiens
tgtctttggaccctgaggccca

SEQ ID NO: 2662403 - DNA, 23 bp, Homo sapiens
tgtctttggaccctgaggcccag

SEQ ID NO: 2662404 - DNA, 19 bp, Homo sapiens
tgtctttgttggaaaagaa

SEQ ID NO: 2662405 - DNA, 21 bp, Homo sapiens
tgtcttttcttgcatgaggct

SEQ ID NO: 2662406 - DNA, 13 bp, Homo sapiens
tgtcttttgaata

SEQ ID NO: 2662407 - DNA, 18 bp, Homo sapiens
tgtcttttttttaatgtg

SEQ ID NO: 2662408 - DNA, 13 bp, Homo sapiens
tgtgaaaagaaaa

SEQ ID NO: 2662409 - DNA, 17 bp, Homo sapiens
tgtgaaaatcaaataca

SEQ ID NO: 2662410 - DNA, 22 bp, Homo sapiens
tgtgaaaatggtccaggagaag

SEQ ID NO: 2662411 - DNA, 21 bp, Homo sapiens
tgtgaaaggaaagagggaggt

SEQ ID NO: 2662412 - DNA, 20 bp, Homo sapiens
tgtgaaaggaagctccactg

SEQ ID NO: 2662413 - DNA, 20 bp, Homo sapiens
tgtgaacaaaagatgctctt

SEQ ID NO: 2662414 - DNA, 16 bp, Homo sapiens
tgtgaaccaccacacc

SEQ ID NO: 2662415 - DNA, 17 bp, Homo sapiens
tgtgaaccaccacaccc

SEQ ID NO: 2662416 - DNA, 17 bp, Homo sapiens
tgtgaaccgaggggctc

SEQ ID NO: 2662417 - DNA, 19 bp, Homo sapiens
tgtgaactaaactttcaca

SEQ ID NO: 2662418 - DNA, 20 bp, Homo sapiens
tgtgaacttggggaacaagg

SEQ ID NO: 2662419 - DNA, 12 bp, Homo sapiens
tgtgaagcattc

SEQ ID NO: 2662420 - DNA, 23 bp, Homo sapiens
tgtgaagtccttcacctcactga

SEQ ID NO: 2662421 - DNA, 13 bp, Homo sapiens
tgtgaagttagaa

SEQ ID NO: 2662422 - DNA, 12 bp, Homo sapiens
tgtgaataaatt

SEQ ID NO: 2662423 - DNA, 22 bp, Homo sapiens
tgtgaatagaactctgaaatga

SEQ ID NO: 2662424 - DNA, 20 bp, Homo sapiens
tgtgaatatggactcagttt

SEQ ID NO: 2662425 - DNA, 22 bp, Homo sapiens
tgtgaatggattggattattta

SEQ ID NO: 2662426 - DNA, 14 bp, Homo sapiens
tgtgaattcagatt

SEQ ID NO: 2662427 - DNA, 21 bp, Homo sapiens
tgtgacaaggattgctactgt

SEQ ID NO: 2662428 - DNA, 17 bp, Homo sapiens
tgtgacaggcagcagag

SEQ ID NO: 2662429 - DNA, 12 bp, Homo sapiens
tgtgacatgtaa

SEQ ID NO: 2662430 - DNA, 14 bp, Homo sapiens
tgtgaccagcactg

SEQ ID NO: 2662431 - DNA, 15 bp, Homo sapiens
tgtgaccaggggtga

SEQ ID NO: 2662432 - DNA, 17 bp, Homo sapiens
tgtgacccagcactgcc

SEQ ID NO: 2662433 - DNA, 16 bp, Homo sapiens
tgtgaccctctgaatg

SEQ ID NO: 2662434 - DNA, 15 bp, Homo sapiens
tgtgactaattgtat

SEQ ID NO: 2662435 - DNA, 18 bp, Homo sapiens
tgtgactaattgtataac

SEQ ID NO: 2662436 - DNA, 19 bp, Homo sapiens
tgtgactaattgtataaca

SEQ ID NO: 2662437 - DNA, 18 bp, Homo sapiens
tgtgactatatagagatg

SEQ ID NO: 2662438 - DNA, 20 bp, Homo sapiens
tgtgactatatagagatgtt

SEQ ID NO: 2662439 - DNA, 22 bp, Homo sapiens
tgtgactgatgttacatcacag

SEQ ID NO: 2662440 - DNA, 18 bp, Homo sapiens
tgtgacttcagctctgtt

SEQ ID NO: 2662441 - DNA, 15 bp, Homo sapiens
tgtgacttctccagg

SEQ ID NO: 2662442 - DNA, 19 bp, Homo sapiens
tgtgagacagtgggaaata

SEQ ID NO: 2662443 - DNA, 18 bp, Homo sapiens
ttaaaatgattgtaaaat

SEQ ID NO: 2662444 - DNA, 16 bp, Homo sapiens
ttaaaatgcaacatgt

SEQ ID NO: 2662445 - DNA, 23 bp, Homo sapiens
ttaaaatgtattcttaaattcat

SEQ ID NO: 2662446 - DNA, 13 bp, Homo sapiens
ttaaaatgttcac

SEQ ID NO: 2662447 - DNA, 20 bp, Homo sapiens
ttaaacaaaatagaagctgt

SEQ ID NO: 2662448 - DNA, 22 bp, Homo sapiens
ttaaacaaatgtatgattacat

SEQ ID NO: 2662449 - DNA, 13 bp, Homo sapiens
ttaaacacctcct

SEQ ID NO: 2662450 - DNA, 14 bp, Homo sapiens
ttaaacagcagtgt

SEQ ID NO: 2662451 - DNA, 23 bp, Homo sapiens
ttaaacagtgagcctgaattttg

SEQ ID NO: 2662452 - DNA, 18 bp, Homo sapiens
ttaaacattggttcttgt

SEQ ID NO: 2662453 - DNA, 20 bp, Homo sapiens
ttaaaccctggatcagtcct

SEQ ID NO: 2662454 - DNA, 14 bp, Homo sapiens
ttaaacgtgcagac

SEQ ID NO: 2662455 - DNA, 12 bp, Homo sapiens
ttaaactgtgta

SEQ ID NO: 2662456 - DNA, 20 bp, Homo sapiens
ttaaactgtgtggactgtga

SEQ ID NO: 2662457 - DNA, 21 bp, Homo sapiens
ttaaactgtgtggactgtgat

SEQ ID NO: 2662458 - DNA, 14 bp, Homo sapiens
ttaaacttctctga

SEQ ID NO: 2662459 - DNA, 18 bp, Homo sapiens
ttaaacttctctgaaggg

SEQ ID NO: 2662460 - DNA, 14 bp, Homo sapiens
ttaaagagaggtta

SEQ ID NO: 2662461 - DNA, 13 bp, Homo sapiens
ttaaagatgttcc

SEQ ID NO: 2662462 - DNA, 14 bp, Homo sapiens
ttaaagatttatca

SEQ ID NO: 2662463 - DNA, 14 bp, Homo sapiens
ttaaagcctcctca

SEQ ID NO: 2662464 - DNA, 19 bp, Homo sapiens
ttaaagctaaagtatctgt

SEQ ID NO: 2662465 - DNA, 14 bp, Homo sapiens
ttaaagctgcctgt

SEQ ID NO: 2662466 - DNA, 17 bp, Homo sapiens
ttaaagctgcctgtagt

SEQ ID NO: 2662467 - DNA, 17 bp, Homo sapiens
ttaaaggaaaaaatgtt

SEQ ID NO: 2662468 - DNA, 22 bp, Homo sapiens
ttaaaggaaggttctggtgtga

SEQ ID NO: 2662469 - DNA, 12 bp, Homo sapiens
ttaaaggagtta

SEQ ID NO: 2662470 - DNA, 15 bp, Homo sapiens
ttaaaggctgtggta

SEQ ID NO: 2662471 - DNA, 21 bp, Homo sapiens
ttaaaggggcagaaaaactct

SEQ ID NO: 2662472 - DNA, 23 bp, Homo sapiens
ttaaagtatgttattgcataatt

SEQ ID NO: 2662473 - DNA, 18 bp, Homo sapiens
ttaaagtcaggtccaatt

SEQ ID NO: 2662474 - DNA, 13 bp, Homo sapiens
ttaaataaaagaa

SEQ ID NO: 2662475 - DNA, 21 bp, Homo sapiens
ttaaataaagtatcatgcatt

SEQ ID NO: 2662476 - DNA, 13 bp, Homo sapiens
ttaaataaatcat

SEQ ID NO: 2662477 - DNA, 21 bp, Homo sapiens
ttaaataatgtgaaactggat

SEQ ID NO: 2662478 - DNA, 16 bp, Homo sapiens
ttaaatacagacacta

SEQ ID NO: 2662479 - DNA, 18 bp, Homo sapiens
ttaaatacagacactaag

SEQ ID NO: 2662480 - DNA, 19 bp, Homo sapiens
ttaaatacagacactaagt

SEQ ID NO: 2662481 - DNA, 20 bp, Homo sapiens
ttaaatacagacactaagtt

SEQ ID NO: 2662482 - DNA, 19 bp, Homo sapiens
ttaaatacgcactacatgt

SEQ ID NO: 2662483 - DNA, 16 bp, Homo sapiens
ttaaatataattctgt

SEQ ID NO: 2662484 - DNA, 19 bp, Homo sapiens
ttaaatataattctgtaaa

SEQ ID NO: 2662485 - DNA, 20 bp, Homo sapiens
ttaaatataattctgtaaat

SEQ ID NO: 2662486 - DNA, 21 bp, Homo sapiens
ttaaatatgttagcaaagagt

SEQ ID NO: 2662487 - DNA, 17 bp, Homo sapiens
ttaaatatttacatatg

SEQ ID NO: 2662488 - DNA, 18 bp, Homo sapiens
ttaaatatttacatatga

SEQ ID NO: 2662489 - DNA, 15 bp, Homo sapiens
ttaaatatttcaaga

SEQ ID NO: 2662490 - DNA, 15 bp, Homo sapiens
ttaaatctgtgatga

SEQ ID NO: 2662491 - DNA, 17 bp, Homo sapiens
ttaaatgcccagcccct

SEQ ID NO: 2662492 - DNA, 18 bp, Homo sapiens
ttaaatgcccagcccctt

SEQ ID NO: 2662493 - DNA, 21 bp, Homo sapiens
ttaaatgggtagagaaacact

SEQ ID NO: 2662494 - DNA, 17 bp, Homo sapiens
ttaaatgtaaagatatt

SEQ ID NO: 2662495 - DNA, 20 bp, Homo sapiens
ttaaattcttgcaaagtatc

SEQ ID NO: 2662496 - DNA, 17 bp, Homo sapiens
ttaaatttgtaagtttc

SEQ ID NO: 2662497 - DNA, 15 bp, Homo sapiens
ttaacaaaagcaaga

SEQ ID NO: 2662498 - DNA, 21 bp, Homo sapiens
ttaacaacaataacactgtct

SEQ ID NO: 2662499 - DNA, 22 bp, Homo sapiens
ttaacaacaataacactgtctc

SEQ ID NO: 2662500 - DNA, 19 bp, Homo sapiens
ttaacaataactactgtgt

SEQ ID NO: 2662501 - DNA, 21 bp, Homo sapiens
ttaacaataactactgtgttc

SEQ ID NO: 2662502 - DNA, 16 bp, Homo sapiens
ttaacaattccaaagg

SEQ ID NO: 2662503 - DNA, 17 bp, Homo sapiens
ttaacacctgatgtgta

SEQ ID NO: 2662504 - DNA, 18 bp, Homo sapiens
ttaacacctttaaagtgt

SEQ ID NO: 2662505 - DNA, 14 bp, Homo sapiens
ttaacagagacaga

SEQ ID NO: 2662506 - DNA, 22 bp, Homo sapiens
ttaacagggtctctagtgctgt

SEQ ID NO: 2662507 - DNA, 13 bp, Homo sapiens
ttaacagttttcc

SEQ ID NO: 2662508 - DNA, 14 bp, Homo sapiens
ttaacagttttcca

SEQ ID NO: 2662509 - DNA, 15 bp, Homo sapiens
ttaacattcatagag

SEQ ID NO: 2662510 - DNA, 14 bp, Homo sapiens
ttaacattctgtaa

SEQ ID NO: 2662511 - DNA, 19 bp, Homo sapiens
ttaaccaaaaagaccagac

SEQ ID NO: 2662512 - DNA, 17 bp, Homo sapiens
ttaaccacttcagctga

SEQ ID NO: 2662513 - DNA, 18 bp, Homo sapiens
ttaaccattaaaactgaa

SEQ ID NO: 2662514 - DNA, 21 bp, Homo sapiens
ttaacctatgatattttctgt

SEQ ID NO: 2662515 - DNA, 19 bp, Homo sapiens
ttaacggctccaggatttt

SEQ ID NO: 2662516 - DNA, 23 bp, Homo sapiens
ttaactaatatgggcattgtagt

SEQ ID NO: 2662517 - DNA, 21 bp, Homo sapiens
ttaactagaatttattcaatt

SEQ ID NO: 2662518 - DNA, 12 bp, Homo sapiens
ttaactcaatat

SEQ ID NO: 2662519 - DNA, 15 bp, Homo sapiens
ttaactcagatcact

SEQ ID NO: 2662520 - DNA, 12 bp, Homo sapiens
ttaactctgtct

SEQ ID NO: 2662521 - DNA, 22 bp, Homo sapiens
ttaacttaaattttaatttatt

SEQ ID NO: 2662522 - DNA, 18 bp, Homo sapiens
ttaacttagcttgaagga

SEQ ID NO: 2662523 - DNA, 13 bp, Homo sapiens
ttaacttttataa

SEQ ID NO: 2662524 - DNA, 16 bp, Homo sapiens
ttaacttttataaact

SEQ ID NO: 2662525 - DNA, 21 bp, Homo sapiens
ttaagaaaaaataacacacat

SEQ ID NO: 2662526 - DNA, 22 bp, Homo sapiens
ttaagaaagactatctaaatgt

SEQ ID NO: 2662527 - DNA, 14 bp, Homo sapiens
ttaagaagctgttg

SEQ ID NO: 2662528 - DNA, 18 bp, Homo sapiens
ttaagaagctgttgtaca

SEQ ID NO: 2662529 - DNA, 20 bp, Homo sapiens
ttaagaagctgttgtacatt

SEQ ID NO: 2662530 - DNA, 21 bp, Homo sapiens
ttaagaagctgttgtacattt

SEQ ID NO: 2662531 - DNA, 22 bp, Homo sapiens
ttaagagccatataagtttgaa

SEQ ID NO: 2662532 - DNA, 12 bp, Homo sapiens
ttaagagtgaaa

SEQ ID NO: 2662533 - DNA, 19 bp, Homo sapiens
ttaagataataatatatgt

SEQ ID NO: 2662534 - DNA, 14 bp, Homo sapiens
ttaagataattata

SEQ ID NO: 2662535 - DNA, 14 bp, Homo sapiens
ttaagatggattct

SEQ ID NO: 2662536 - DNA, 18 bp, Homo sapiens
ttaagatggattctcaga

SEQ ID NO: 2662537 - DNA, 15 bp, Homo sapiens
ttaagatttttctca

SEQ ID NO: 2662538 - DNA, 20 bp, Homo sapiens
ttaagatttttctcaaagtt

SEQ ID NO: 2662539 - DNA, 20 bp, Homo sapiens
ttaagcactacataaactga

SEQ ID NO: 2662540 - DNA, 16 bp, Homo sapiens
ttaagcagaagcatta

SEQ ID NO: 2662541 - DNA, 23 bp, Homo sapiens
ttaagcattgtttgcttattgtt

SEQ ID NO: 2662542 - DNA, 21 bp, Homo sapiens
ttaagccacttaaaatgttca

SEQ ID NO: 2662543 - DNA, 13 bp, Homo sapiens
ttaagccctgagg

SEQ ID NO: 2662544 - DNA, 14 bp, Homo sapiens
ttaaggaaactctt

SEQ ID NO: 2662545 - DNA, 21 bp, Homo sapiens
ttaaggaagacaatgtgaaaa

SEQ ID NO: 2662546 - DNA, 22 bp, Homo sapiens
ttaaggatgcttgtacataatg

SEQ ID NO: 2662547 - DNA, 13 bp, Homo sapiens
ttaaggattttat

SEQ ID NO: 2662548 - DNA, 23 bp, Homo sapiens
ttaaggctgaggaaaggccagct

SEQ ID NO: 2662549 - DNA, 15 bp, Homo sapiens
ttaagggttaagaaa

SEQ ID NO: 2662550 - DNA, 14 bp, Homo sapiens
ttaagtctgtttta

SEQ ID NO: 2662551 - DNA, 13 bp, Homo sapiens
ttaagtgaatgtc

SEQ ID NO: 2662552 - DNA, 15 bp, Homo sapiens
ttaagtttcaggata

SEQ ID NO: 2662553 - DNA, 22 bp, Homo sapiens
ttaataaacttttttttgagaa

SEQ ID NO: 2662554 - DNA, 13 bp, Homo sapiens
ttaataaagacag

SEQ ID NO: 2662555 - DNA, 14 bp, Homo sapiens
ttaataaagacagg

SEQ ID NO: 2662556 - DNA, 12 bp, Homo sapiens
ttaataacaatt

SEQ ID NO: 2662557 - DNA, 15 bp, Homo sapiens
ttaataacattacct

SEQ ID NO: 2662558 - DNA, 16 bp, Homo sapiens
ttaataacattacctt

SEQ ID NO: 2662559 - DNA, 20 bp, Homo sapiens
ttaataacattaccttactg

SEQ ID NO: 2662560 - DNA, 15 bp, Homo sapiens
ttaataagtttcact

SEQ ID NO: 2662561 - DNA, 24 bp, Homo sapiens
ttaataatcagcaagaatttgatc

SEQ ID NO: 2662562 - DNA, 15 bp, Homo sapiens
ttaataccacagctt

SEQ ID NO: 2662563 - DNA, 19 bp, Homo sapiens
ttaatagaatataattatc

SEQ ID NO: 2662564 - DNA, 18 bp, Homo sapiens
ttaatagcttttattgta

SEQ ID NO: 2662565 - DNA, 15 bp, Homo sapiens
ttaatagtgttaatc

SEQ ID NO: 2662566 - DNA, 15 bp, Homo sapiens
ttaatatagctattt

SEQ ID NO: 2662567 - DNA, 15 bp, Homo sapiens
ttaatatcatcagta

SEQ ID NO: 2662568 - DNA, 18 bp, Homo sapiens
ttaatattgatatgctta

SEQ ID NO: 2662569 - DNA, 15 bp, Homo sapiens
ttaatatttaaacag

SEQ ID NO: 2662570 - DNA, 20 bp, Homo sapiens
ttaatatttgctgacagctg

SEQ ID NO: 2662571 - DNA, 18 bp, Homo sapiens
ttaatcaatttaaaccca

SEQ ID NO: 2662572 - DNA, 15 bp, Homo sapiens
ttaatcatctataaa

SEQ ID NO: 2662573 - DNA, 17 bp, Homo sapiens
ttaatcatgaatgtgta

SEQ ID NO: 2662574 - DNA, 13 bp, Homo sapiens
ttaatcattaggt

SEQ ID NO: 2662575 - DNA, 22 bp, Homo sapiens
ttaatctggtttatttttgttc

SEQ ID NO: 2662576 - DNA, 14 bp, Homo sapiens
ttaatctttcctga

SEQ ID NO: 2662577 - DNA, 20 bp, Homo sapiens
ttaatcttttcacaaataaa

SEQ ID NO: 2662578 - DNA, 15 bp, Homo sapiens
ttaatgaaaataaga

SEQ ID NO: 2662579 - DNA, 14 bp, Homo sapiens
ttaatgaaaatgtc

SEQ ID NO: 2662580 - DNA, 15 bp, Homo sapiens
ttaatgaaaatgtca

SEQ ID NO: 2662581 - DNA, 18 bp, Homo sapiens
ttaatgaaagactgtaca

SEQ ID NO: 2662582 - DNA, 23 bp, Homo sapiens
ttaatgaaagactgtacaaagta

SEQ ID NO: 2662583 - DNA, 11 bp, Homo sapiens
ttaatgcactt

SEQ ID NO: 2662584 - DNA, 19 bp, Homo sapiens
ttaatggacatgagataat

SEQ ID NO: 2662585 - DNA, 22 bp, Homo sapiens
ttaatggacatgagataatgtt

SEQ ID NO: 2662586 - DNA, 17 bp, Homo sapiens
ttaatgtcacaggcagg

SEQ ID NO: 2662587 - DNA, 15 bp, Homo sapiens
ttaatgtttattcct

SEQ ID NO: 2662588 - DNA, 21 bp, Homo sapiens
ttatgtaataatgtgaatcat

SEQ ID NO: 2662589 - DNA, 17 bp, Homo sapiens
ttatgtccactgtgtat

SEQ ID NO: 2662590 - DNA, 10 bp, Homo sapiens
ttatgtgtgt

SEQ ID NO: 2662591 - DNA, 15 bp, Homo sapiens
ttatgttacatctgt

SEQ ID NO: 2662592 - DNA, 20 bp, Homo sapiens
ttatgttatttatatattgg

SEQ ID NO: 2662593 - DNA, 14 bp, Homo sapiens
ttattaaaatgatt

SEQ ID NO: 2662594 - DNA, 19 bp, Homo sapiens
ttattaaaatgattgtaaa

SEQ ID NO: 2662595 - DNA, 20 bp, Homo sapiens
ttattaaacgtatgcatgtg

SEQ ID NO: 2662596 - DNA, 19 bp, Homo sapiens
ttattaacaaattatgtta

SEQ ID NO: 2662597 - DNA, 21 bp, Homo sapiens
ttattaactaatatgggcatt

SEQ ID NO: 2662598 - DNA, 20 bp, Homo sapiens
ttattaagatggattctcag

SEQ ID NO: 2662599 - DNA, 21 bp, Homo sapiens
ttattaagatggattctcaga

SEQ ID NO: 2662600 - DNA, 14 bp, Homo sapiens
ttattaataaacat

SEQ ID NO: 2662601 - DNA, 13 bp, Homo sapiens
ttattaatgcact

SEQ ID NO: 2662602 - DNA, 18 bp, Homo sapiens
ttattacatctttcacat

SEQ ID NO: 2662603 - DNA, 15 bp, Homo sapiens
ttattacctctgata

SEQ ID NO: 2662604 - DNA, 18 bp, Homo sapiens
ttattactgtttgtcttc

SEQ ID NO: 2662605 - DNA, 14 bp, Homo sapiens
ttattattactgtt

SEQ ID NO: 2662606 - DNA, 16 bp, Homo sapiens
ttattattgaaattgt

SEQ ID NO: 2662607 - DNA, 19 bp, Homo sapiens
ttattcaattcctctggga

SEQ ID NO: 2662608 - DNA, 13 bp, Homo sapiens
ttattcagtgtca

SEQ ID NO: 2662609 - DNA, 13 bp, Homo sapiens
ttattcatttaaa

SEQ ID NO: 2662610 - DNA, 17 bp, Homo sapiens
ttattcatttaaaatga

SEQ ID NO: 2662611 - DNA, 18 bp, Homo sapiens
ttattcatttaaaatgat

SEQ ID NO: 2662612 - DNA, 20 bp, Homo sapiens
ttattcatttaaaatgatta

SEQ ID NO: 2662613 - DNA, 19 bp, Homo sapiens
ttattccctttcacaaaat

SEQ ID NO: 2662614 - DNA, 22 bp, Homo sapiens
ttattcctatatagtttattga

SEQ ID NO: 2662615 - DNA, 13 bp, Homo sapiens
ttattcctgtatg

SEQ ID NO: 2662616 - DNA, 13 bp, Homo sapiens
ttattctagatta

SEQ ID NO: 2662617 - DNA, 13 bp, Homo sapiens
ttattctggagtt

SEQ ID NO: 2662618 - DNA, 20 bp, Homo sapiens
ttattctgtagattctgtgg

SEQ ID NO: 2662619 - DNA, 16 bp, Homo sapiens
ttattctttttaaagt

SEQ ID NO: 2662620 - DNA, 18 bp, Homo sapiens
ttattgaatctatttaag

SEQ ID NO: 2662621 - DNA, 14 bp, Homo sapiens
ttattgacaataat

SEQ ID NO: 2662622 - DNA, 18 bp, Homo sapiens
ttattgacaataatttca

SEQ ID NO: 2662623 - DNA, 20 bp, Homo sapiens
ttattgcaataaaagtgctt

SEQ ID NO: 2662624 - DNA, 21 bp, Homo sapiens
ttattgcagtttatcattcaa

SEQ ID NO: 2662625 - DNA, 13 bp, Homo sapiens
ttattgcattata

SEQ ID NO: 2662626 - DNA, 23 bp, Homo sapiens
ttattgcttgatacttttgacaa

SEQ ID NO: 2662627 - DNA, 22 bp, Homo sapiens
ttattggaattaacctggtgct

SEQ ID NO: 2662628 - DNA, 15 bp, Homo sapiens
ttattggctgagata

SEQ ID NO: 2662629 - DNA, 12 bp, Homo sapiens
ttattgtacttg

SEQ ID NO: 2662630 - DNA, 18 bp, Homo sapiens
ttattgttccaagacatt

SEQ ID NO: 2662631 - DNA, 19 bp, Homo sapiens
ttattgttccaagacattg

SEQ ID NO: 2662632 - DNA, 17 bp, Homo sapiens
ttattgtttaaaatcat

SEQ ID NO: 2662633 - DNA, 14 bp, Homo sapiens
ttatttaataacat

SEQ ID NO: 2662634 - DNA, 15 bp, Homo sapiens
ttatttaataacatt

SEQ ID NO: 2662635 - DNA, 16 bp, Homo sapiens
ttatttaatgttatgt

SEQ ID NO: 2662636 - DNA, 17 bp, Homo sapiens
ttatttactaattttct

SEQ ID NO: 2662637 - DNA, 16 bp, Homo sapiens
ttatttaggctttgta

SEQ ID NO: 2662638 - DNA, 15 bp, Homo sapiens
ttatttatacactgt

SEQ ID NO: 2662639 - DNA, 14 bp, Homo sapiens
ttatttatgcctct

SEQ ID NO: 2662640 - DNA, 17 bp, Homo sapiens
ttatttattcagcttca

SEQ ID NO: 2662641 - DNA, 22 bp, Homo sapiens
ttatttattcagcttcatttgt

SEQ ID NO: 2662642 - DNA, 15 bp, Homo sapiens
ttatttattggagat

SEQ ID NO: 2662643 - DNA, 13 bp, Homo sapiens
ttatttatttaat

SEQ ID NO: 2662644 - DNA, 20 bp, Homo sapiens
ttatttcatcatattataca

SEQ ID NO: 2662645 - DNA, 11 bp, Homo sapiens
ttatttgcata

SEQ ID NO: 2662646 - DNA, 16 bp, Homo sapiens
ttatttgtgtaataga

SEQ ID NO: 2662647 - DNA, 16 bp, Homo sapiens
ttattttaaacaaaat

SEQ ID NO: 2662648 - DNA, 16 bp, Homo sapiens
ttattttatcctctgg

SEQ ID NO: 2662649 - DNA, 18 bp, Homo sapiens
ttattttattatgcatga

SEQ ID NO: 2662650 - DNA, 13 bp, Homo sapiens
ttattttcaagaa

SEQ ID NO: 2662651 - DNA, 18 bp, Homo sapiens
ttattttcaagaaactga

SEQ ID NO: 2662652 - DNA, 14 bp, Homo sapiens
ttattttcacctgt

SEQ ID NO: 2662653 - DNA, 16 bp, Homo sapiens
ttattttcctccccag

SEQ ID NO: 2662654 - DNA, 12 bp, Homo sapiens
ttattttgcaac

SEQ ID NO: 2662655 - DNA, 14 bp, Homo sapiens
ttatttttcatatt

SEQ ID NO: 2662656 - DNA, 19 bp, Homo sapiens
ttatttttcatattgtgcc

SEQ ID NO: 2662657 - DNA, 10 bp, Homo sapiens
ttatttttct

SEQ ID NO: 2662658 - DNA, 22 bp, Homo sapiens
ttatttttctaaggttctcata

SEQ ID NO: 2662659 - DNA, 14 bp, Homo sapiens
ttattttttacatt

SEQ ID NO: 2662660 - DNA, 18 bp, Homo sapiens
ttattttttacattatta

SEQ ID NO: 2662661 - DNA, 13 bp, Homo sapiens
ttattttttcaga

SEQ ID NO: 2662662 - DNA, 14 bp, Homo sapiens
ttattttttcagac

SEQ ID NO: 2662663 - DNA, 13 bp, Homo sapiens
ttatttttttctg

SEQ ID NO: 2662664 - DNA, 15 bp, Homo sapiens
ttatttttttctgat

SEQ ID NO: 2662665 - DNA, 13 bp, Homo sapiens
ttcaaaaagtgtt

SEQ ID NO: 2662666 - DNA, 18 bp, Homo sapiens
ttcaaaatgtctgtagct

SEQ ID NO: 2662667 - DNA, 18 bp, Homo sapiens
ttcaaacagtctcaggaa

SEQ ID NO: 2662668 - DNA, 17 bp, Homo sapiens
ttcaaagattcaaaatt

SEQ ID NO: 2662669 - DNA, 21 bp, Homo sapiens
ttcaaagccagcgtcctcctc

SEQ ID NO: 2662670 - DNA, 14 bp, Homo sapiens
ttcaaatgtgctgt

SEQ ID NO: 2662671 - DNA, 16 bp, Homo sapiens
ttcaaattcttctgaa

SEQ ID NO: 2662672 - DNA, 19 bp, Homo sapiens
ttcaaattcttctgaactc

SEQ ID NO: 2662673 - DNA, 13 bp, Homo sapiens
ttcaaatttcaca

SEQ ID NO: 2662674 - DNA, 19 bp, Homo sapiens
ttcaaccactgtaaaatga

SEQ ID NO: 2662675 - DNA, 12 bp, Homo sapiens
ttcaagaaactg

SEQ ID NO: 2662676 - DNA, 18 bp, Homo sapiens
ttcaaggtggccaaatta

SEQ ID NO: 2662677 - DNA, 21 bp, Homo sapiens
ttcaagtactgtaactgtgtc

SEQ ID NO: 2662678 - DNA, 17 bp, Homo sapiens
ttcaagttaaattttat

SEQ ID NO: 2662679 - DNA, 16 bp, Homo sapiens
ttcaagttagctcagg

SEQ ID NO: 2662680 - DNA, 14 bp, Homo sapiens
ttcaagttattgta

SEQ ID NO: 2662681 - DNA, 20 bp, Homo sapiens
ttcaagttattgtacagctg

SEQ ID NO: 2662682 - DNA, 12 bp, Homo sapiens
ttcaataaagta

SEQ ID NO: 2662683 - DNA, 11 bp, Homo sapiens
ttcaatattta

SEQ ID NO: 2662684 - DNA, 14 bp, Homo sapiens
ttcaatctgtaaac

SEQ ID NO: 2662685 - DNA, 18 bp, Homo sapiens
ttcaatctgtaaactgtg

SEQ ID NO: 2662686 - DNA, 12 bp, Homo sapiens
ttcaatgatcta

SEQ ID NO: 2662687 - DNA, 23 bp, Homo sapiens
ttcaatgatctaggtttaactca

SEQ ID NO: 2662688 - DNA, 22 bp, Homo sapiens
ttcaatggtttgcaaggaagcc

SEQ ID NO: 2662689 - DNA, 12 bp, Homo sapiens
ttcaattaaacg

SEQ ID NO: 2662690 - DNA, 14 bp, Homo sapiens
ttcaattaaacgga

SEQ ID NO: 2662691 - DNA, 16 bp, Homo sapiens
ttcaattaaacggatt

SEQ ID NO: 2662692 - DNA, 16 bp, Homo sapiens
ttcaattcctgggccc

SEQ ID NO: 2662693 - DNA, 17 bp, Homo sapiens
ttcaattgcatctccca

SEQ ID NO: 2662694 - DNA, 19 bp, Homo sapiens
ttcaattgcatctcccaga

SEQ ID NO: 2662695 - DNA, 16 bp, Homo sapiens
ttcaatttattcaaga

SEQ ID NO: 2662696 - DNA, 19 bp, Homo sapiens
ttcaatttattcaagaaaa

SEQ ID NO: 2662697 - DNA, 14 bp, Homo sapiens
ttcacacctgactc

SEQ ID NO: 2662698 - DNA, 15 bp, Homo sapiens
ttcacacttccacca

SEQ ID NO: 2662699 - DNA, 19 bp, Homo sapiens
ttcacacttccaccagcct

SEQ ID NO: 2662700 - DNA, 12 bp, Homo sapiens
ttcacagctcct

SEQ ID NO: 2662701 - DNA, 19 bp, Homo sapiens
ttcacaggcgaggcctgga

SEQ ID NO: 2662702 - DNA, 22 bp, Homo sapiens
ttcacagtgtttcgacagctga

SEQ ID NO: 2662703 - DNA, 13 bp, Homo sapiens
ttcacagtttttc

SEQ ID NO: 2662704 - DNA, 19 bp, Homo sapiens
ttcacataaaatagatttt

SEQ ID NO: 2662705 - DNA, 17 bp, Homo sapiens
ttcacatattgatttcc

SEQ ID NO: 2662706 - DNA, 19 bp, Homo sapiens
ttcacattcttataaatat

SEQ ID NO: 2662707 - DNA, 17 bp, Homo sapiens
ttcacatttttgtattt

SEQ ID NO: 2662708 - DNA, 17 bp, Homo sapiens
ttcaccccaatcccagc

SEQ ID NO: 2662709 - DNA, 13 bp, Homo sapiens
ttcaccccaccct

SEQ ID NO: 2662710 - DNA, 19 bp, Homo sapiens
ttcacctcactgaaaacat

SEQ ID NO: 2662711 - DNA, 21 bp, Homo sapiens
ttcacctgattcaactaaaaa

SEQ ID NO: 2662712 - DNA, 16 bp, Homo sapiens
ttcacctgtaaacctg

SEQ ID NO: 2662713 - DNA, 22 bp, Homo sapiens
ttcacctgtttttaagctgttt

SEQ ID NO: 2662714 - DNA, 23 bp, Homo sapiens
ttcacctgtttttaagctgtttc

SEQ ID NO: 2662715 - DNA, 14 bp, Homo sapiens
ttcacctttgtccc

SEQ ID NO: 2662716 - DNA, 19 bp, Homo sapiens
ttcacctttgtccccaccg

SEQ ID NO: 2662717 - DNA, 22 bp, Homo sapiens
ttcacctttgtccccaccgcag

SEQ ID NO: 2662718 - DNA, 20 bp, Homo sapiens
ttcacgaagtgttgcatgga

SEQ ID NO: 2662719 - DNA, 13 bp, Homo sapiens
ttcacggaagagc

SEQ ID NO: 2662720 - DNA, 17 bp, Homo sapiens
ttcacggaagagccttg

SEQ ID NO: 2662721 - DNA, 13 bp, Homo sapiens
ttcactccagcct

SEQ ID NO: 2662722 - DNA, 13 bp, Homo sapiens
ttcactctctgaa

SEQ ID NO: 2662723 - DNA, 13 bp, Homo sapiens
ttcactgctgcaa

SEQ ID NO: 2662724 - DNA, 15 bp, Homo sapiens
ttcactgtagaatga

SEQ ID NO: 2662725 - DNA, 18 bp, Homo sapiens
ttcactgtataaatagga

SEQ ID NO: 2662726 - DNA, 19 bp, Homo sapiens
ttcactgtataaataggag

SEQ ID NO: 2662727 - DNA, 15 bp, Homo sapiens
ttcacttatatgttc

SEQ ID NO: 2662728 - DNA, 13 bp, Homo sapiens
ttcactttaattc

SEQ ID NO: 2662729 - DNA, 17 bp, Homo sapiens
ttcactttagatgctga

SEQ ID NO: 2662730 - DNA, 19 bp, Homo sapiens
ttcagaaatgctgcctgcc

SEQ ID NO: 2662731 - DNA, 16 bp, Homo sapiens
ttcagaaccatccata

SEQ ID NO: 2662732 - DNA, 15 bp, Homo sapiens
ttcagaacctcttcc

SEQ ID NO: 2662733 - DNA, 16 bp, Homo sapiens
ttcagaacctcttccc

SEQ ID NO: 2662734 - DNA, 16 bp, Homo sapiens
ttcagaaggggagggg

SEQ ID NO: 2662735 - DNA, 11 bp, Homo sapiens
ttctctgctcc

SEQ ID NO: 2662736 - DNA, 14 bp, Homo sapiens
ttctctgctccacc

SEQ ID NO: 2662737 - DNA, 15 bp, Homo sapiens
ttctctgctccacca

SEQ ID NO: 2662738 - DNA, 22 bp, Homo sapiens
ttctctggaaaggggggagctg

SEQ ID NO: 2662739 - DNA, 19 bp, Homo sapiens
ttctctgtgtttgttccta

SEQ ID NO: 2662740 - DNA, 24 bp, Homo sapiens
ttctctgtgtttgttcctacagcc

SEQ ID NO: 2662741 - DNA, 15 bp, Homo sapiens
ttctcttaatttaat

SEQ ID NO: 2662742 - DNA, 14 bp, Homo sapiens
ttctcttactgcaa

SEQ ID NO: 2662743 - DNA, 23 bp, Homo sapiens
ttctcttactgcaaatgtcatca

SEQ ID NO: 2662744 - DNA, 13 bp, Homo sapiens
ttctcttcctgta

SEQ ID NO: 2662745 - DNA, 12 bp, Homo sapiens
ttctcttctctg

SEQ ID NO: 2662746 - DNA, 14 bp, Homo sapiens
ttctcttcttgaac

SEQ ID NO: 2662747 - DNA, 19 bp, Homo sapiens
ttctgaaaattaacactgc

SEQ ID NO: 2662748 - DNA, 17 bp, Homo sapiens
ttctgaataacatttgt

SEQ ID NO: 2662749 - DNA, 15 bp, Homo sapiens
ttctgaatatgctgc

SEQ ID NO: 2662750 - DNA, 11 bp, Homo sapiens
ttctgaatgta

SEQ ID NO: 2662751 - DNA, 14 bp, Homo sapiens
ttctgacattaaca

SEQ ID NO: 2662752 - DNA, 13 bp, Homo sapiens
ttctgaccacact

SEQ ID NO: 2662753 - DNA, 14 bp, Homo sapiens
ttctgaccacactt

SEQ ID NO: 2662754 - DNA, 22 bp, Homo sapiens
ttctgaccacacttcctgtcca

SEQ ID NO: 2662755 - DNA, 21 bp, Homo sapiens
ttctgacccatgctgccctgt

SEQ ID NO: 2662756 - DNA, 21 bp, Homo sapiens
ttctgaggacattccaagaca

SEQ ID NO: 2662757 - DNA, 20 bp, Homo sapiens
ttctgagtgtttttactaca

SEQ ID NO: 2662758 - DNA, 19 bp, Homo sapiens
ttctgagtttcattctcct

SEQ ID NO: 2662759 - DNA, 22 bp, Homo sapiens
ttctgatatgcagttttcctta

SEQ ID NO: 2662760 - DNA, 21 bp, Homo sapiens
ttctgattgtaacgttgctgt

SEQ ID NO: 2662761 - DNA, 17 bp, Homo sapiens
ttctgcaccctccaccc

SEQ ID NO: 2662762 - DNA, 20 bp, Homo sapiens
ttctgcagcatgacctgtga

SEQ ID NO: 2662763 - DNA, 15 bp, Homo sapiens
ttctgcagctgtttt

SEQ ID NO: 2662764 - DNA, 19 bp, Homo sapiens
ttctgcagtagtctctgtg

SEQ ID NO: 2662765 - DNA, 21 bp, Homo sapiens
ttctgcagtagtctctgtgct

SEQ ID NO: 2662766 - DNA, 23 bp, Homo sapiens
ttctgcatcagctgctgaaacaa

SEQ ID NO: 2662767 - DNA, 17 bp, Homo sapiens
ttctgcctgcccaggcc

SEQ ID NO: 2662768 - DNA, 21 bp, Homo sapiens
ttctgcctgttataactctgc

SEQ ID NO: 2662769 - DNA, 16 bp, Homo sapiens
ttctgccttctcatga

SEQ ID NO: 2662770 - DNA, 16 bp, Homo sapiens
ttctgctacctcactg

SEQ ID NO: 2662771 - DNA, 20 bp, Homo sapiens
ttctgctcatcattctctgt

SEQ ID NO: 2662772 - DNA, 13 bp, Homo sapiens
ttctgctccaccc

SEQ ID NO: 2662773 - DNA, 20 bp, Homo sapiens
ttctgctccacccttggcct

SEQ ID NO: 2662774 - DNA, 14 bp, Homo sapiens
ttctgctcctctcc

SEQ ID NO: 2662775 - DNA, 17 bp, Homo sapiens
ttctgctcctctccagg

SEQ ID NO: 2662776 - DNA, 12 bp, Homo sapiens
ttctgctggcct

SEQ ID NO: 2662777 - DNA, 15 bp, Homo sapiens
ttctggaatgtaatc

SEQ ID NO: 2662778 - DNA, 13 bp, Homo sapiens
ttctggagccctt

SEQ ID NO: 2662779 - DNA, 10 bp, Homo sapiens
ttctggagtt

SEQ ID NO: 2662780 - DNA, 13 bp, Homo sapiens
ttctggataaagc

SEQ ID NO: 2662781 - DNA, 20 bp, Homo sapiens
ttctggattttgtcaagcag

SEQ ID NO: 2662782 - DNA, 15 bp, Homo sapiens
ttctggcctcccaca

SEQ ID NO: 2662783 - DNA, 18 bp, Homo sapiens
ttctggctatgcatttga

SEQ ID NO: 2662784 - DNA, 16 bp, Homo sapiens
ttctggctctcccatt

SEQ ID NO: 2662785 - DNA, 15 bp, Homo sapiens
ttctggctcttccag

SEQ ID NO: 2662786 - DNA, 16 bp, Homo sapiens
ttctggctcttccagg

SEQ ID NO: 2662787 - DNA, 11 bp, Homo sapiens
ttctggctgcc

SEQ ID NO: 2662788 - DNA, 14 bp, Homo sapiens
ttctgggagggcag

SEQ ID NO: 2662789 - DNA, 17 bp, Homo sapiens
ttctggtagatagaaat

SEQ ID NO: 2662790 - DNA, 18 bp, Homo sapiens
ttctggtagatagaaata

SEQ ID NO: 2662791 - DNA, 17 bp, Homo sapiens
ttctgtaaaatgtctgt

SEQ ID NO: 2662792 - DNA, 19 bp, Homo sapiens
ttctgtaaactcaaaactt

SEQ ID NO: 2662793 - DNA, 17 bp, Homo sapiens
ttctgtaccaaagtgtt

SEQ ID NO: 2662794 - DNA, 18 bp, Homo sapiens
ttctgtactcaaatgtag

SEQ ID NO: 2662795 - DNA, 14 bp, Homo sapiens
ttctgtactgattt

SEQ ID NO: 2662796 - DNA, 20 bp, Homo sapiens
ttctgtactgatttttgtaa

SEQ ID NO: 2662797 - DNA, 16 bp, Homo sapiens
ttctgtaggttctgtg

SEQ ID NO: 2662798 - DNA, 21 bp, Homo sapiens
ttctgtatacaaccctggcat

SEQ ID NO: 2662799 - DNA, 17 bp, Homo sapiens
ttctgtccgagctttga

SEQ ID NO: 2662800 - DNA, 13 bp, Homo sapiens
ttctgtcctgctg

SEQ ID NO: 2662801 - DNA, 19 bp, Homo sapiens
ttctgtctctgcctccctc

SEQ ID NO: 2662802 - DNA, 19 bp, Homo sapiens
ttctgtgagacccccacac

SEQ ID NO: 2662803 - DNA, 13 bp, Homo sapiens
ttctgtgcctgaa

SEQ ID NO: 2662804 - DNA, 17 bp, Homo sapiens
ttctgtggaaagtgtaa

SEQ ID NO: 2662805 - DNA, 18 bp, Homo sapiens
ttctgtggaaagtgtaaa

SEQ ID NO: 2662806 - DNA, 22 bp, Homo sapiens
ttctgtggttttcccctccctg

SEQ ID NO: 2662807 - DNA, 23 bp, Homo sapiens
ttctgtgtctttcacagctcctc

SEQ ID NO: 2662808 - DNA, 22 bp, Homo sapiens
ttctgtgtgtgatgtgcatggg

SEQ ID NO: 2662809 - DNA, 13 bp, Homo sapiens
ttctgttctgtgg

SEQ ID NO: 2662810 - DNA, 21 bp, Homo sapiens
ttctgttctgtggaaagtgta

SEQ ID NO: 2662811 - DNA, 11 bp, Homo sapiens
ttctgttcttt

SEQ ID NO: 2662812 - DNA, 18 bp, Homo sapiens
ttctgtttagataataca

SEQ ID NO: 2662813 - DNA, 16 bp, Homo sapiens
ttctgttttgcctgaa

SEQ ID NO: 2662814 - DNA, 21 bp, Homo sapiens
ttctgttttgcctgaagttgg

SEQ ID NO: 2662815 - DNA, 17 bp, Homo sapiens
ttcttaaacaaatgtat

SEQ ID NO: 2662816 - DNA, 15 bp, Homo sapiens
ttcttaaataataaa

SEQ ID NO: 2662817 - DNA, 20 bp, Homo sapiens
ttcttaaggattgtgatatt

SEQ ID NO: 2662818 - DNA, 19 bp, Homo sapiens
ttcttaatcttttcacaaa

SEQ ID NO: 2662819 - DNA, 21 bp, Homo sapiens
ttcttaatcttttcacaaata

SEQ ID NO: 2662820 - DNA, 20 bp, Homo sapiens
ttcttaattgcactctaaaa

SEQ ID NO: 2662821 - DNA, 13 bp, Homo sapiens
ttcttacataatt

SEQ ID NO: 2662822 - DNA, 15 bp, Homo sapiens
ttcttacctgtatgt

SEQ ID NO: 2662823 - DNA, 21 bp, Homo sapiens
ttcttagactacatttagaga

SEQ ID NO: 2662824 - DNA, 19 bp, Homo sapiens
ttcttagctttttaattgt

SEQ ID NO: 2662825 - DNA, 13 bp, Homo sapiens
ttcttagtgactt

SEQ ID NO: 2662826 - DNA, 18 bp, Homo sapiens
ttcttagttctcactgtt

SEQ ID NO: 2662827 - DNA, 14 bp, Homo sapiens
ttcttagttgctgt

SEQ ID NO: 2662828 - DNA, 23 bp, Homo sapiens
ttcttagttgctgtatgtctcgt

SEQ ID NO: 2662829 - DNA, 23 bp, Homo sapiens
ttcttatgccatgttaatttcat

SEQ ID NO: 2662830 - DNA, 17 bp, Homo sapiens
ttcttatgttgcccagt

SEQ ID NO: 2662831 - DNA, 15 bp, Homo sapiens
ttcttattgctttta

SEQ ID NO: 2662832 - DNA, 14 bp, Homo sapiens
ttcttatttcatga

SEQ ID NO: 2662833 - DNA, 16 bp, Homo sapiens
ttcttatttcatgaaa

SEQ ID NO: 2662834 - DNA, 21 bp, Homo sapiens
ttcttcaacatcaatgttcat

SEQ ID NO: 2662835 - DNA, 14 bp, Homo sapiens
ttcttcagaagaca

SEQ ID NO: 2662836 - DNA, 21 bp, Homo sapiens
ttcttcataacaattttagga

SEQ ID NO: 2662837 - DNA, 17 bp, Homo sapiens
ttcttcatgcaatgaca

SEQ ID NO: 2662838 - DNA, 20 bp, Homo sapiens
ttcttcattcaatacaagtg

SEQ ID NO: 2662839 - DNA, 17 bp, Homo sapiens
ttcttcgggaagagagg

SEQ ID NO: 2662840 - DNA, 18 bp, Homo sapiens
ttcttctaggttctaaaa

SEQ ID NO: 2662841 - DNA, 14 bp, Homo sapiens
ttcttctctagctg

SEQ ID NO: 2662842 - DNA, 20 bp, Homo sapiens
ttcttctgaactcaaactga

SEQ ID NO: 2662843 - DNA, 15 bp, Homo sapiens
ttcttctgcttcagc

SEQ ID NO: 2662844 - DNA, 14 bp, Homo sapiens
ttcttcttcctgaa

SEQ ID NO: 2662845 - DNA, 20 bp, Homo sapiens
ttcttgaacactcatgctga

SEQ ID NO: 2662846 - DNA, 13 bp, Homo sapiens
ttcttgcaaagta

SEQ ID NO: 2662847 - DNA, 18 bp, Homo sapiens
ttcttggggccctacacc

SEQ ID NO: 2662848 - DNA, 14 bp, Homo sapiens
ttcttggtagagat

SEQ ID NO: 2662849 - DNA, 16 bp, Homo sapiens
ttcttggtagagattc

SEQ ID NO: 2662850 - DNA, 16 bp, Homo sapiens
ttcttggttgaggaaa

SEQ ID NO: 2662851 - DNA, 16 bp, Homo sapiens
ttcttggtttgtaaat

SEQ ID NO: 2662852 - DNA, 23 bp, Homo sapiens
ttcttggtttgtaaattaacttt

SEQ ID NO: 2662853 - DNA, 12 bp, Homo sapiens
ttcttgtattaa

SEQ ID NO: 2662854 - DNA, 14 bp, Homo sapiens
ttcttgtcaaaaaa

SEQ ID NO: 2662855 - DNA, 19 bp, Homo sapiens
ttcttgtctgattggctca

SEQ ID NO: 2662856 - DNA, 13 bp, Homo sapiens
ttctttaaaagaa

SEQ ID NO: 2662857 - DNA, 14 bp, Homo sapiens
ttctttacctgaga

SEQ ID NO: 2662858 - DNA, 20 bp, Homo sapiens
ttctttacctgagaccagtt

SEQ ID NO: 2662859 - DNA, 15 bp, Homo sapiens
ttctttaggagattt

SEQ ID NO: 2662860 - DNA, 18 bp, Homo sapiens
ttctttataattctactt

SEQ ID NO: 2662861 - DNA, 16 bp, Homo sapiens
ttctttatacaacagt

SEQ ID NO: 2662862 - DNA, 18 bp, Homo sapiens
ttctttatacaacagtgc

SEQ ID NO: 2662863 - DNA, 22 bp, Homo sapiens
ttctttcaagtgaatctaaaag

SEQ ID NO: 2662864 - DNA, 21 bp, Homo sapiens
ttctttccaaagtacactgtt

SEQ ID NO: 2662865 - DNA, 14 bp, Homo sapiens
ttctttccattatg

SEQ ID NO: 2662866 - DNA, 13 bp, Homo sapiens
ttctttcctgcct

SEQ ID NO: 2662867 - DNA, 15 bp, Homo sapiens
ttctttcttcctctg

SEQ ID NO: 2662868 - DNA, 17 bp, Homo sapiens
ttctttgataatgttaa

SEQ ID NO: 2662869 - DNA, 18 bp, Homo sapiens
ttctttgataatgttaaa

SEQ ID NO: 2662870 - DNA, 18 bp, Homo sapiens
ttctttgatgttaacaca

SEQ ID NO: 2662871 - DNA, 21 bp, Homo sapiens
ttctttgatgttaacacattt

SEQ ID NO: 2662872 - DNA, 17 bp, Homo sapiens
ttctttgcctgttcagt

SEQ ID NO: 2662873 - DNA, 22 bp, Homo sapiens
ttctttggtggagataaagatt

SEQ ID NO: 2662874 - DNA, 23 bp, Homo sapiens
ttcttttgcccttcacagtgttt

SEQ ID NO: 2662875 - DNA, 12 bp, Homo sapiens
ttcttttgtaaa

SEQ ID NO: 2662876 - DNA, 15 bp, Homo sapiens
ttctttttattgaat

SEQ ID NO: 2662877 - DNA, 15 bp, Homo sapiens
ttctttttattttct

SEQ ID NO: 2662878 - DNA, 13 bp, Homo sapiens
ttctttttgctgt

SEQ ID NO: 2662879 - DNA, 16 bp, Homo sapiens
ttgaaaagactccaaa

SEQ ID NO: 2662880 - DNA, 14 bp, Homo sapiens
tttaatattttgca

SEQ ID NO: 2662881 - DNA, 12 bp, Homo sapiens
tttaatcatgaa

SEQ ID NO: 2662882 - DNA, 13 bp, Homo sapiens
tttaatcatgaaa

SEQ ID NO: 2662883 - DNA, 19 bp, Homo sapiens
tttaatcatgaaattactt

SEQ ID NO: 2662884 - DNA, 14 bp, Homo sapiens
tttaatccagaatt

SEQ ID NO: 2662885 - DNA, 16 bp, Homo sapiens
tttaatgaaagactgt

SEQ ID NO: 2662886 - DNA, 20 bp, Homo sapiens
tttaatggccggctggaaat

SEQ ID NO: 2662887 - DNA, 21 bp, Homo sapiens
tttaatgggggtagcagctgg

SEQ ID NO: 2662888 - DNA, 14 bp, Homo sapiens
tttaatgtagccat

SEQ ID NO: 2662889 - DNA, 20 bp, Homo sapiens
tttaattaaatgctcatctg

SEQ ID NO: 2662890 - DNA, 22 bp, Homo sapiens
tttaattaatcatgaatgtgta

SEQ ID NO: 2662891 - DNA, 22 bp, Homo sapiens
tttaattaatgaaatatctgta

SEQ ID NO: 2662892 - DNA, 21 bp, Homo sapiens
tttaattaggggttgctaaga

SEQ ID NO: 2662893 - DNA, 23 bp, Homo sapiens
tttaattattatttatatatgta

SEQ ID NO: 2662894 - DNA, 17 bp, Homo sapiens
tttaattcaccaaagta

SEQ ID NO: 2662895 - DNA, 14 bp, Homo sapiens
tttaattcatgttt

SEQ ID NO: 2662896 - DNA, 16 bp, Homo sapiens
tttaattcatgtttct

SEQ ID NO: 2662897 - DNA, 22 bp, Homo sapiens
tttaattccatgaatcgcttct

SEQ ID NO: 2662898 - DNA, 21 bp, Homo sapiens
tttaattgttgtttctttcta

SEQ ID NO: 2662899 - DNA, 22 bp, Homo sapiens
tttaattttgacactatatctg

SEQ ID NO: 2662900 - DNA, 16 bp, Homo sapiens
tttacaaaaatataaa

SEQ ID NO: 2662901 - DNA, 12 bp, Homo sapiens
tttacaagaaaa

SEQ ID NO: 2662902 - DNA, 19 bp, Homo sapiens
tttacaagaaaaaatgaat

SEQ ID NO: 2662903 - DNA, 16 bp, Homo sapiens
tttacaataaataatc

SEQ ID NO: 2662904 - DNA, 15 bp, Homo sapiens
tttacaattgaaatg

SEQ ID NO: 2662905 - DNA, 16 bp, Homo sapiens
tttacaattgaaatga

SEQ ID NO: 2662906 - DNA, 21 bp, Homo sapiens
tttacacattcggctccctgg

SEQ ID NO: 2662907 - DNA, 15 bp, Homo sapiens
tttacagctgcctgc

SEQ ID NO: 2662908 - DNA, 20 bp, Homo sapiens
tttacagctttcatgattag

SEQ ID NO: 2662909 - DNA, 23 bp, Homo sapiens
tttacagtgaaaatgtaagctgt

SEQ ID NO: 2662910 - DNA, 15 bp, Homo sapiens
tttacatactgctgt

SEQ ID NO: 2662911 - DNA, 18 bp, Homo sapiens
tttacatggggttttcaa

SEQ ID NO: 2662912 - DNA, 13 bp, Homo sapiens
tttaccaccccca

SEQ ID NO: 2662913 - DNA, 15 bp, Homo sapiens
tttaccacccccaca

SEQ ID NO: 2662914 - DNA, 17 bp, Homo sapiens
tttacccatatcccctc

SEQ ID NO: 2662915 - DNA, 20 bp, Homo sapiens
tttacccttcttttctgact

SEQ ID NO: 2662916 - DNA, 18 bp, Homo sapiens
tttaccgtttcttccctg

SEQ ID NO: 2662917 - DNA, 15 bp, Homo sapiens
tttacctatgtaaca

SEQ ID NO: 2662918 - DNA, 16 bp, Homo sapiens
tttacctgtgaaatag

SEQ ID NO: 2662919 - DNA, 13 bp, Homo sapiens
tttacggacaccc

SEQ ID NO: 2662920 - DNA, 16 bp, Homo sapiens
tttactaagatgacat

SEQ ID NO: 2662921 - DNA, 21 bp, Homo sapiens
tttactaagatgacattgcta

SEQ ID NO: 2662922 - DNA, 20 bp, Homo sapiens
tttactaagccacaagaaat

SEQ ID NO: 2662923 - DNA, 19 bp, Homo sapiens
tttactaattttctagatt

SEQ ID NO: 2662924 - DNA, 13 bp, Homo sapiens
tttactattttac

SEQ ID NO: 2662925 - DNA, 13 bp, Homo sapiens
tttactccccttg

SEQ ID NO: 2662926 - DNA, 18 bp, Homo sapiens
tttactccccttgagctg

SEQ ID NO: 2662927 - DNA, 14 bp, Homo sapiens
tttactgagcttct

SEQ ID NO: 2662928 - DNA, 17 bp, Homo sapiens
tttactgagcttctctg

SEQ ID NO: 2662929 - DNA, 22 bp, Homo sapiens
tttactgccaaagggaaatatc

SEQ ID NO: 2662930 - DNA, 20 bp, Homo sapiens
tttactgtcaaaataatttt

SEQ ID NO: 2662931 - DNA, 17 bp, Homo sapiens
tttactgtgaaactggc

SEQ ID NO: 2662932 - DNA, 14 bp, Homo sapiens
tttacttaaagatt

SEQ ID NO: 2662933 - DNA, 15 bp, Homo sapiens
tttacttaaagattt

SEQ ID NO: 2662934 - DNA, 20 bp, Homo sapiens
tttacttaaagatttatcaa

SEQ ID NO: 2662935 - DNA, 16 bp, Homo sapiens
tttacttatcttatgc

SEQ ID NO: 2662936 - DNA, 17 bp, Homo sapiens
tttacttatcttatgcc

SEQ ID NO: 2662937 - DNA, 14 bp, Homo sapiens
tttacttcttatac

SEQ ID NO: 2662938 - DNA, 15 bp, Homo sapiens
tttacttttaaactg

SEQ ID NO: 2662939 - DNA, 17 bp, Homo sapiens
tttagaagaagtgtgtc

SEQ ID NO: 2662940 - DNA, 16 bp, Homo sapiens
tttagagcattgccat

SEQ ID NO: 2662941 - DNA, 18 bp, Homo sapiens
tttagagtagcatgagag

SEQ ID NO: 2662942 - DNA, 16 bp, Homo sapiens
tttagatcaaatactt

SEQ ID NO: 2662943 - DNA, 23 bp, Homo sapiens
tttagcaatttaatattttgcac

SEQ ID NO: 2662944 - DNA, 20 bp, Homo sapiens
tttagcatgacaagccccag

SEQ ID NO: 2662945 - DNA, 23 bp, Homo sapiens
tttagcatgacaagccccaggca

SEQ ID NO: 2662946 - DNA, 23 bp, Homo sapiens
tttagctactatatatgtgatga

SEQ ID NO: 2662947 - DNA, 13 bp, Homo sapiens
tttagggcagctt

SEQ ID NO: 2662948 - DNA, 19 bp, Homo sapiens
tttaggtctcttcccctct

SEQ ID NO: 2662949 - DNA, 21 bp, Homo sapiens
tttagtacctgaaaagtaact

SEQ ID NO: 2662950 - DNA, 15 bp, Homo sapiens
tttagtagagacagg

SEQ ID NO: 2662951 - DNA, 23 bp, Homo sapiens
tttagtagatattaccagttttc

SEQ ID NO: 2662952 - DNA, 11 bp, Homo sapiens
tttagttcttt

SEQ ID NO: 2662953 - DNA, 19 bp, Homo sapiens
tttagttgcagaaacattt

SEQ ID NO: 2662954 - DNA, 20 bp, Homo sapiens
tttagttgtatctcttttga

SEQ ID NO: 2662955 - DNA, 14 bp, Homo sapiens
tttagtttactcaa

SEQ ID NO: 2662956 - DNA, 23 bp, Homo sapiens
tttataaaagaataaaattgcac

SEQ ID NO: 2662957 - DNA, 18 bp, Homo sapiens
tttataaactttaccttt

SEQ ID NO: 2662958 - DNA, 21 bp, Homo sapiens
tttataactcatcataaaata

SEQ ID NO: 2662959 - DNA, 18 bp, Homo sapiens
tttatacaacagtgctaa

SEQ ID NO: 2662960 - DNA, 19 bp, Homo sapiens
tttatacaacagtgctaaa

SEQ ID NO: 2662961 - DNA, 20 bp, Homo sapiens
tttatagctattactgtctg

SEQ ID NO: 2662962 - DNA, 21 bp, Homo sapiens
tttatatatacagtaacttta

SEQ ID NO: 2662963 - DNA, 13 bp, Homo sapiens
tttatatatgtat

SEQ ID NO: 2662964 - DNA, 17 bp, Homo sapiens
tttatatcccattttta

SEQ ID NO: 2662965 - DNA, 14 bp, Homo sapiens
tttatatttagtta

SEQ ID NO: 2662966 - DNA, 18 bp, Homo sapiens
tttatcacacttctgtga

SEQ ID NO: 2662967 - DNA, 14 bp, Homo sapiens
tttatcacatgtat

SEQ ID NO: 2662968 - DNA, 19 bp, Homo sapiens
tttatcacatgtatgtttt

SEQ ID NO: 2662969 - DNA, 22 bp, Homo sapiens
tttatcatgcatgtcctgtaaa

SEQ ID NO: 2662970 - DNA, 14 bp, Homo sapiens
tttatcattcaagt

SEQ ID NO: 2662971 - DNA, 12 bp, Homo sapiens
tttatcattttc

SEQ ID NO: 2662972 - DNA, 19 bp, Homo sapiens
tttatcctgaaatttcaga

SEQ ID NO: 2662973 - DNA, 21 bp, Homo sapiens
tttatcgtcactgcttaactt

SEQ ID NO: 2662974 - DNA, 20 bp, Homo sapiens
tttatctaatacctctgtgt

SEQ ID NO: 2662975 - DNA, 13 bp, Homo sapiens
tttatctctattt

SEQ ID NO: 2662976 - DNA, 14 bp, Homo sapiens
tttatctctattta

SEQ ID NO: 2662977 - DNA, 17 bp, Homo sapiens
tttatctctatttaata

SEQ ID NO: 2662978 - DNA, 17 bp, Homo sapiens
tttatctgggattatgg

SEQ ID NO: 2662979 - DNA, 16 bp, Homo sapiens
tttatctgtagtaaac

SEQ ID NO: 2662980 - DNA, 19 bp, Homo sapiens
tttatctgtagtaaactat

SEQ ID NO: 2662981 - DNA, 21 bp, Homo sapiens
tttatcttggactgacattta

SEQ ID NO: 2662982 - DNA, 15 bp, Homo sapiens
tttatcttgggactg

SEQ ID NO: 2662983 - DNA, 18 bp, Homo sapiens
tttatgaaaggtttacat

SEQ ID NO: 2662984 - DNA, 21 bp, Homo sapiens
tttatgaaatggttaagaatt

SEQ ID NO: 2662985 - DNA, 19 bp, Homo sapiens
tttatgaagaaaaaataca

SEQ ID NO: 2662986 - DNA, 22 bp, Homo sapiens
tttatgaagaaaaaatacattt

SEQ ID NO: 2662987 - DNA, 17 bp, Homo sapiens
tttatgaaggcaaaaaa

SEQ ID NO: 2662988 - DNA, 17 bp, Homo sapiens
tttatgagccagacaaa

SEQ ID NO: 2662989 - DNA, 14 bp, Homo sapiens
tttatgatttaata

SEQ ID NO: 2662990 - DNA, 15 bp, Homo sapiens
tttatgcaaggaagg

SEQ ID NO: 2662991 - DNA, 18 bp, Homo sapiens
tttatgcaaggaaggaaa

SEQ ID NO: 2662992 - DNA, 22 bp, Homo sapiens
tttatggcctcagctgcctcac

SEQ ID NO: 2662993 - DNA, 22 bp, Homo sapiens
tttatgggtcagagttccgact

SEQ ID NO: 2662994 - DNA, 16 bp, Homo sapiens
tttatggtttctccag

SEQ ID NO: 2662995 - DNA, 18 bp, Homo sapiens
tttatgtctatttaagcc

SEQ ID NO: 2662996 - DNA, 12 bp, Homo sapiens
tttatgtgatgg

SEQ ID NO: 2662997 - DNA, 20 bp, Homo sapiens
tttatgttaagggaagaatt

SEQ ID NO: 2662998 - DNA, 13 bp, Homo sapiens
tttatgttattta

SEQ ID NO: 2662999 - DNA, 23 bp, Homo sapiens
tttattaaacagatttttacaaa

SEQ ID NO: 2663000 - DNA, 12 bp, Homo sapiens
tttattaagatg

SEQ ID NO: 2663001 - DNA, 15 bp, Homo sapiens
tttattaagatggat

SEQ ID NO: 2663002 - DNA, 16 bp, Homo sapiens
tttattaataaacatt

SEQ ID NO: 2663003 - DNA, 17 bp, Homo sapiens
tttattaatgcactttc

SEQ ID NO: 2663004 - DNA, 16 bp, Homo sapiens
tttattctttttaaag

SEQ ID NO: 2663005 - DNA, 13 bp, Homo sapiens
tttattgcttgtt

SEQ ID NO: 2663006 - DNA, 17 bp, Homo sapiens
tttatttaatgttatgt

SEQ ID NO: 2663007 - DNA, 11 bp, Homo sapiens
tttatttacta

SEQ ID NO: 2663008 - DNA, 16 bp, Homo sapiens
tttatttactgctagt

SEQ ID NO: 2663009 - DNA, 15 bp, Homo sapiens
tttatttatactatt

SEQ ID NO: 2663010 - DNA, 14 bp, Homo sapiens
tttatttatcagtg

SEQ ID NO: 2663011 - DNA, 15 bp, Homo sapiens
tttatttatcagtga

SEQ ID NO: 2663012 - DNA, 13 bp, Homo sapiens
tttatttatttat

SEQ ID NO: 2663013 - DNA, 20 bp, Homo sapiens
tttatttgtttgtgcatttg

SEQ ID NO: 2663014 - DNA, 21 bp, Homo sapiens
tttattttaaaacagaagaat

SEQ ID NO: 2663015 - DNA, 21 bp, Homo sapiens
tttcaaaaatataacttaaaa

SEQ ID NO: 2663016 - DNA, 16 bp, Homo sapiens
tttcaaacacaaatgc

SEQ ID NO: 2663017 - DNA, 13 bp, Homo sapiens
tttcaaatatcac

SEQ ID NO: 2663018 - DNA, 14 bp, Homo sapiens
tttcaaatgtgctg

SEQ ID NO: 2663019 - DNA, 21 bp, Homo sapiens
tttcaaattggagcttcatgg

SEQ ID NO: 2663020 - DNA, 14 bp, Homo sapiens
tttcaatgtgattc

SEQ ID NO: 2663021 - DNA, 22 bp, Homo sapiens
tttcaatgtgattctaatgtct

SEQ ID NO: 2663022 - DNA, 14 bp, Homo sapiens
tttcaattaaacgg

SEQ ID NO: 2663023 - DNA, 16 bp, Homo sapiens
tttcaattaaacggat

SEQ ID NO: 2663024 - DNA, 19 bp, Homo sapiens
tttcaattaaacggattat

SEQ ID NO: 2663025 - DNA, 20 bp, Homo sapiens
ttttctggtagatagaaata

SEQ ID NO: 2663026 - DNA, 15 bp, Homo sapiens
ttttctgtctctgcc

SEQ ID NO: 2663027 - DNA, 17 bp, Homo sapiens
ttttctgtgcctgaata

SEQ ID NO: 2663028 - DNA, 22 bp, Homo sapiens
ttttcttcaacatcaatgttca

SEQ ID NO: 2663029 - DNA, 18 bp, Homo sapiens
ttttcttcttccctccct

SEQ ID NO: 2663030 - DNA, 13 bp, Homo sapiens
ttttcttgtaatt

SEQ ID NO: 2663031 - DNA, 17 bp, Homo sapiens
ttttctttgaatgcttt

SEQ ID NO: 2663032 - DNA, 12 bp, Homo sapiens
ttttctttgtgt

SEQ ID NO: 2663033 - DNA, 15 bp, Homo sapiens
ttttgaaaagctatt

SEQ ID NO: 2663034 - DNA, 16 bp, Homo sapiens
ttttgaaaagctatta

SEQ ID NO: 2663035 - DNA, 20 bp, Homo sapiens
ttttgaactaataaaagcat

SEQ ID NO: 2663036 - DNA, 19 bp, Homo sapiens
ttttgaagtagtttgtata

SEQ ID NO: 2663037 - DNA, 13 bp, Homo sapiens
ttttgaatcaata

SEQ ID NO: 2663038 - DNA, 22 bp, Homo sapiens
ttttgaatgcttcctgacaatc

SEQ ID NO: 2663039 - DNA, 23 bp, Homo sapiens
ttttgacagtgttgaaaatgttc

SEQ ID NO: 2663040 - DNA, 24 bp, Homo sapiens
ttttgacagtgttgaaaatgttca

SEQ ID NO: 2663041 - DNA, 15 bp, Homo sapiens
ttttgacggatgatt

SEQ ID NO: 2663042 - DNA, 20 bp, Homo sapiens
ttttgacggatgattggatt

SEQ ID NO: 2663043 - DNA, 18 bp, Homo sapiens
ttttgataaagtagtaaa

SEQ ID NO: 2663044 - DNA, 15 bp, Homo sapiens
ttttgatagctttat

SEQ ID NO: 2663045 - DNA, 23 bp, Homo sapiens
ttttgatgaacaaaatttcctaa

SEQ ID NO: 2663046 - DNA, 15 bp, Homo sapiens
ttttgattattgtat

SEQ ID NO: 2663047 - DNA, 20 bp, Homo sapiens
ttttgatttgtactgaaaaa

SEQ ID NO: 2663048 - DNA, 17 bp, Homo sapiens
ttttgcaacctcgctgg

SEQ ID NO: 2663049 - DNA, 21 bp, Homo sapiens
ttttgcaacctcgctggactc

SEQ ID NO: 2663050 - DNA, 17 bp, Homo sapiens
ttttgcacccctcccat

SEQ ID NO: 2663051 - DNA, 18 bp, Homo sapiens
ttttgcatcattgtttta

SEQ ID NO: 2663052 - DNA, 16 bp, Homo sapiens
ttttgcatggcacttg

SEQ ID NO: 2663053 - DNA, 13 bp, Homo sapiens
ttttgcatttatg

SEQ ID NO: 2663054 - DNA, 19 bp, Homo sapiens
ttttgcatttgaataaagc

SEQ ID NO: 2663055 - DNA, 21 bp, Homo sapiens
ttttgctattagactgtagga

SEQ ID NO: 2663056 - DNA, 13 bp, Homo sapiens
ttttgctgtagaa

SEQ ID NO: 2663057 - DNA, 21 bp, Homo sapiens
ttttgctgttgtttctaaaca

SEQ ID NO: 2663058 - DNA, 20 bp, Homo sapiens
ttttggagaaggttatcaaa

SEQ ID NO: 2663059 - DNA, 15 bp, Homo sapiens
ttttggccaaagtgt

SEQ ID NO: 2663060 - DNA, 22 bp, Homo sapiens
ttttgggctcctttttctccct

SEQ ID NO: 2663061 - DNA, 18 bp, Homo sapiens
ttttggggatatgcttag

SEQ ID NO: 2663062 - DNA, 23 bp, Homo sapiens
ttttggggggcccccctccttgc

SEQ ID NO: 2663063 - DNA, 14 bp, Homo sapiens
ttttggtcattgta

SEQ ID NO: 2663064 - DNA, 20 bp, Homo sapiens
ttttggttgaataaactaga

SEQ ID NO: 2663065 - DNA, 16 bp, Homo sapiens
ttttggttgctttaat

SEQ ID NO: 2663066 - DNA, 18 bp, Homo sapiens
ttttgtaaactcaaaata

SEQ ID NO: 2663067 - DNA, 13 bp, Homo sapiens
ttttgtactgtaa

SEQ ID NO: 2663068 - DNA, 19 bp, Homo sapiens
ttttgtagagccagggtct

SEQ ID NO: 2663069 - DNA, 15 bp, Homo sapiens
ttttgtataattgta

SEQ ID NO: 2663070 - DNA, 18 bp, Homo sapiens
ttttgtgaaaatgtcaaa

SEQ ID NO: 2663071 - DNA, 24 bp, Homo sapiens
ttttgtgaaatgaaaacatgtaat

SEQ ID NO: 2663072 - DNA, 16 bp, Homo sapiens
ttttgtgatttagaac

SEQ ID NO: 2663073 - DNA, 20 bp, Homo sapiens
ttttgtgcattatctagata

SEQ ID NO: 2663074 - DNA, 16 bp, Homo sapiens
ttttgttcaaagccag

SEQ ID NO: 2663075 - DNA, 15 bp, Homo sapiens
ttttgttccacaagt

SEQ ID NO: 2663076 - DNA, 13 bp, Homo sapiens
ttttgtttgctat

SEQ ID NO: 2663077 - DNA, 16 bp, Homo sapiens
ttttgtttttgtctta

SEQ ID NO: 2663078 - DNA, 23 bp, Homo sapiens
tttttaaaaatcataaactgtgt

SEQ ID NO: 2663079 - DNA, 22 bp, Homo sapiens
tttttaaaagtttcaatgtgat

SEQ ID NO: 2663080 - DNA, 17 bp, Homo sapiens
tttttaaaatatttatt

SEQ ID NO: 2663081 - DNA, 18 bp, Homo sapiens
tttttaaagttactttgt

SEQ ID NO: 2663082 - DNA, 22 bp, Homo sapiens
tttttaactcaatattttccat

SEQ ID NO: 2663083 - DNA, 20 bp, Homo sapiens
tttttaagataataatatat

SEQ ID NO: 2663084 - DNA, 13 bp, Homo sapiens
tttttaagatttt

SEQ ID NO: 2663085 - DNA, 16 bp, Homo sapiens
tttttaagatttttct

SEQ ID NO: 2663086 - DNA, 18 bp, Homo sapiens
tttttaagtgctgcattt

SEQ ID NO: 2663087 - DNA, 23 bp, Homo sapiens
tttttaagtgctgcatttaaaag

SEQ ID NO: 2663088 - DNA, 17 bp, Homo sapiens
tttttaatcatgaaatt

SEQ ID NO: 2663089 - DNA, 17 bp, Homo sapiens
tttttaatgtgctgtgt

SEQ ID NO: 2663090 - DNA, 19 bp, Homo sapiens
tttttaattcaccaaagta

SEQ ID NO: 2663091 - DNA, 18 bp, Homo sapiens
tttttaattgttgtttct

SEQ ID NO: 2663092 - DNA, 12 bp, Homo sapiens
tttttaattttg

SEQ ID NO: 2663093 - DNA, 22 bp, Homo sapiens
tttttacccatatcccctctcc

SEQ ID NO: 2663094 - DNA, 19 bp, Homo sapiens
tttttaccgtttcttccct

SEQ ID NO: 2663095 - DNA, 15 bp, Homo sapiens
tttttagatcaaata

SEQ ID NO: 2663096 - DNA, 23 bp, Homo sapiens
tttttatacataaacaagaccac

SEQ ID NO: 2663097 - DNA, 17 bp, Homo sapiens
tttttatcatgcatgtc

SEQ ID NO: 2663098 - DNA, 12 bp, Homo sapiens
tttttcaattaa

SEQ ID NO: 2663099 - DNA, 15 bp, Homo sapiens
tttttcaattaaacg

SEQ ID NO: 2663100 - DNA, 17 bp, Homo sapiens
tttttcaattaaacgga

SEQ ID NO: 2663101 - DNA, 21 bp, Homo sapiens
tttttcaattaaacggattat

SEQ ID NO: 2663102 - DNA, 21 bp, Homo sapiens
tttttcagcagactatgaata

SEQ ID NO: 2663103 - DNA, 15 bp, Homo sapiens
tttttcagttttcag

SEQ ID NO: 2663104 - DNA, 13 bp, Homo sapiens
tttttcatattgt

SEQ ID NO: 2663105 - DNA, 18 bp, Homo sapiens
tttttcatgattttgaaa

SEQ ID NO: 2663106 - DNA, 10 bp, Homo sapiens
tttttcatgt

SEQ ID NO: 2663107 - DNA, 13 bp, Homo sapiens
tttttccaaaaaa

SEQ ID NO: 2663108 - DNA, 19 bp, Homo sapiens
tttttccaaaaaaatactg

SEQ ID NO: 2663109 - DNA, 14 bp, Homo sapiens
tttttccactttgt

SEQ ID NO: 2663110 - DNA, 14 bp, Homo sapiens
tttttccccaaagt

SEQ ID NO: 2663111 - DNA, 18 bp, Homo sapiens
tttttcctagccctctca

SEQ ID NO: 2663112 - DNA, 11 bp, Homo sapiens
tttttccttta

SEQ ID NO: 2663113 - DNA, 14 bp, Homo sapiens
tttttctccctctg

SEQ ID NO: 2663114 - DNA, 13 bp, Homo sapiens
tttttgaaaacat

SEQ ID NO: 2663115 - DNA, 14 bp, Homo sapiens
tttttgaaataata

SEQ ID NO: 2663116 - DNA, 19 bp, Homo sapiens
tttttgcaccccatgctgt

SEQ ID NO: 2663117 - DNA, 22 bp, Homo sapiens
tttttggaggggtttatgctca

SEQ ID NO: 2663118 - DNA, 18 bp, Homo sapiens
tttttggttgtcaatatt

SEQ ID NO: 2663119 - DNA, 13 bp, Homo sapiens
tttttgtcttttc

SEQ ID NO: 2663120 - DNA, 15 bp, Homo sapiens
tttttgtgtatttgt

SEQ ID NO: 2663121 - DNA, 22 bp, Homo sapiens
tttttgttccacaagttaaata

SEQ ID NO: 2663122 - DNA, 12 bp, Homo sapiens
ttttttactaat

SEQ ID NO: 2663123 - DNA, 11 bp, Homo sapiens
ttttttcagac

SEQ ID NO: 2663124 - DNA, 14 bp, Homo sapiens
ttttttcagaccga

SEQ ID NO: 2663125 - DNA, 20 bp, Homo sapiens
ttttttcatgttttaacaaa

SEQ ID NO: 2663126 - DNA, 12 bp, Homo sapiens
ttttttgaaaac

SEQ ID NO: 2663127 - DNA, 13 bp, Homo sapiens
ttttttttgacaa

SEQ ID NO: 2663128 - DNA, 15 bp, Homo sapiens
cttgggccctctggt

SEQ ID NO: 2663129 - DNA, 12 bp, Homo sapiens
cttgtaaataaa

SEQ ID NO: 2663130 - DNA, 15 bp, Homo sapiens
cttgtaaataaagcc

SEQ ID NO: 2663131 - DNA, 17 bp, Homo sapiens
cttgtaaataaagccct

SEQ ID NO: 2663132 - DNA, 19 bp, Homo sapiens
cttgtaaataaagccctgg

SEQ ID NO: 2663133 - DNA, 17 bp, Homo sapiens
cttgttaatgctttctg

SEQ ID NO: 2663134 - DNA, 19 bp, Homo sapiens
ctttagaaaggttttgagc

SEQ ID NO: 2663135 - DNA, 23 bp, Homo sapiens
ctttatgtacaggatgctttggt

SEQ ID NO: 2663136 - DNA, 20 bp, Homo sapiens
ctttcaatggtttgcaagga

SEQ ID NO: 2663137 - DNA, 15 bp, Homo sapiens
ctttcacaaaaaaga

SEQ ID NO: 2663138 - DNA, 15 bp, Homo sapiens
ctttcagtgaaagca

SEQ ID NO: 2663139 - DNA, 18 bp, Homo sapiens
ctttcatgagtttttccc

SEQ ID NO: 2663140 - DNA, 19 bp, Homo sapiens
ctttgaaagccccagaaat

SEQ ID NO: 2663141 - DNA, 20 bp, Homo sapiens
ctttgaaagccccagaaatc

SEQ ID NO: 2663142 - DNA, 17 bp, Homo sapiens
ctttgccaagacctttc

SEQ ID NO: 2663143 - DNA, 22 bp, Homo sapiens
ctttggagaagagtgtggagtc

SEQ ID NO: 2663144 - DNA, 21 bp, Homo sapiens
ctttggggcttttacaccagt

SEQ ID NO: 2663145 - DNA, 17 bp, Homo sapiens
ctttgttaagttctatt

SEQ ID NO: 2663146 - DNA, 14 bp, Homo sapiens
ctttgttctgctgt

SEQ ID NO: 2663147 - DNA, 20 bp, Homo sapiens
cttttaactcctcaattcca

SEQ ID NO: 2663148 - DNA, 20 bp, Homo sapiens
cttttactgaagcctttctt

SEQ ID NO: 2663149 - DNA, 18 bp, Homo sapiens
cttttcatatttgcacta

SEQ ID NO: 2663150 - DNA, 14 bp, Homo sapiens
cttttgaacccagg

SEQ ID NO: 2663151 - DNA, 18 bp, Homo sapiens
cttttgactttcattgga

SEQ ID NO: 2663152 - DNA, 13 bp, Homo sapiens
cttttgtgtctta

SEQ ID NO: 2663153 - DNA, 17 bp, Homo sapiens
cttttgttcccatcctc

SEQ ID NO: 2663154 - DNA, 15 bp, Homo sapiens
ctttttattgaatct

SEQ ID NO: 2663155 - DNA, 16 bp, Homo sapiens
cttttttctttttcct

SEQ ID NO: 2663156 - DNA, 22 bp, Homo sapiens
gaaaaagaaatgcaaaaatctc

SEQ ID NO: 2663157 - DNA, 22 bp, Homo sapiens
gaaaacaggacttaaaatgaca

SEQ ID NO: 2663158 - DNA, 13 bp, Homo sapiens
gaaaacctctcct

SEQ ID NO: 2663159 - DNA, 14 bp, Homo sapiens
gaaaagcagctctc

SEQ ID NO: 2663160 - DNA, 20 bp, Homo sapiens
gaaaatattttgatcttcaa

SEQ ID NO: 2663161 - DNA, 16 bp, Homo sapiens
gaaaatcatcaagaag

SEQ ID NO: 2663162 - DNA, 21 bp, Homo sapiens
gaaaatcatcaagaagggctg

SEQ ID NO: 2663163 - DNA, 20 bp, Homo sapiens
gaaaatgcaacaacatgtat

SEQ ID NO: 2663164 - DNA, 15 bp, Homo sapiens
gaaacaacagcttta

SEQ ID NO: 2663165 - DNA, 20 bp, Homo sapiens
gaaactgttcccacctgctg

SEQ ID NO: 2663166 - DNA, 21 bp, Homo sapiens
gaaactgttcccacctgctgg

SEQ ID NO: 2663167 - DNA, 22 bp, Homo sapiens
gaaactgttcccacctgctgga

SEQ ID NO: 2663168 - DNA, 14 bp, Homo sapiens
gaaagcaaagggct

SEQ ID NO: 2663169 - DNA, 20 bp, Homo sapiens
gaaaggggcagtttaaagca

SEQ ID NO: 2663170 - DNA, 16 bp, Homo sapiens
gaaagtgaaagtccag

SEQ ID NO: 2663171 - DNA, 20 bp, Homo sapiens
gaaatgagaggcatttcccc

SEQ ID NO: 2663172 - DNA, 14 bp, Homo sapiens
gaaattaggatgta

SEQ ID NO: 2663173 - DNA, 13 bp, Homo sapiens
gaacagaagaaaa

SEQ ID NO: 2663174 - DNA, 16 bp, Homo sapiens
gaacctatttctcttt

SEQ ID NO: 2663175 - DNA, 17 bp, Homo sapiens
gaacctatttctctttc

SEQ ID NO: 2663176 - DNA, 21 bp, Homo sapiens
gaacgatatgtagcagaaagg

SEQ ID NO: 2663177 - DNA, 22 bp, Homo sapiens
gaactagcatataattctatat

SEQ ID NO: 2663178 - DNA, 22 bp, Homo sapiens
gaactgaacaccattgaaggct

SEQ ID NO: 2663179 - DNA, 18 bp, Homo sapiens
gaactggagccatgggca

SEQ ID NO: 2663180 - DNA, 14 bp, Homo sapiens
gaagaagagccaca

SEQ ID NO: 2663181 - DNA, 14 bp, Homo sapiens
gaagacattgcacc

SEQ ID NO: 2663182 - DNA, 21 bp, Homo sapiens
gaagagagtccatatttcaat

SEQ ID NO: 2663183 - DNA, 12 bp, Homo sapiens
gaagagccacag

SEQ ID NO: 2663184 - DNA, 19 bp, Homo sapiens
gaagatctctgcagggccg

SEQ ID NO: 2663185 - DNA, 22 bp, Homo sapiens
gaagatctctgcagggccgcca

SEQ ID NO: 2663186 - DNA, 21 bp, Homo sapiens
gaagattcttcccattctcca

SEQ ID NO: 2663187 - DNA, 15 bp, Homo sapiens
gaagcaaacacatta

SEQ ID NO: 2663188 - DNA, 17 bp, Homo sapiens
gaagctggggttcatga

SEQ ID NO: 2663189 - DNA, 21 bp, Homo sapiens
gaagctgtcataaaaagacaa

SEQ ID NO: 2663190 - DNA, 18 bp, Homo sapiens
gaaggaaaaggcagggag

SEQ ID NO: 2663191 - DNA, 17 bp, Homo sapiens
gaaggcagcaggtggca

SEQ ID NO: 2663192 - DNA, 18 bp, Homo sapiens
gaaggcctcgcaggaaga

SEQ ID NO: 2663193 - DNA, 18 bp, Homo sapiens
gaaggggacccccgcccc

SEQ ID NO: 2663194 - DNA, 20 bp, Homo sapiens
gaaggggacccccgccccct

SEQ ID NO: 2663195 - DNA, 13 bp, Homo sapiens
gaagttatgggaa

SEQ ID NO: 2663196 - DNA, 19 bp, Homo sapiens
gaatatttggttttcctgt

SEQ ID NO: 2663197 - DNA, 18 bp, Homo sapiens
gaatctagggagggggaa

SEQ ID NO: 2663198 - DNA, 18 bp, Homo sapiens
gaatctctgaatttgaga

SEQ ID NO: 2663199 - DNA, 22 bp, Homo sapiens
gaatgcagtctgtccaggctcg

SEQ ID NO: 2663200 - DNA, 13 bp, Homo sapiens
gaatggcagctgc

SEQ ID NO: 2663201 - DNA, 16 bp, Homo sapiens
gaatggcagctgccac

SEQ ID NO: 2663202 - DNA, 18 bp, Homo sapiens
gaattaagttagggaatg

SEQ ID NO: 2663203 - DNA, 16 bp, Homo sapiens
gaattgagctgcagaa

SEQ ID NO: 2663204 - DNA, 16 bp, Homo sapiens
gaattttgttctctgg

SEQ ID NO: 2663205 - DNA, 18 bp, Homo sapiens
gacaaaatcatctttgtg

SEQ ID NO: 2663206 - DNA, 20 bp, Homo sapiens
gacaaagttccaaaatgcca

SEQ ID NO: 2663207 - DNA, 12 bp, Homo sapiens
gacacctttcat

SEQ ID NO: 2663208 - DNA, 23 bp, Homo sapiens
gacactgggaggccagtgagcca

SEQ ID NO: 2663209 - DNA, 23 bp, Homo sapiens
gacagcattttcctctgctttga

SEQ ID NO: 2663210 - DNA, 13 bp, Homo sapiens
gacagtggcagga

SEQ ID NO: 2663211 - DNA, 15 bp, Homo sapiens
gacagtggcaggaca

SEQ ID NO: 2663212 - DNA, 18 bp, Homo sapiens
gacagtggcaggacagga

SEQ ID NO: 2663213 - DNA, 21 bp, Homo sapiens
gccatgggcacaaagggccca

SEQ ID NO: 2663214 - DNA, 23 bp, Homo sapiens
gcccaaaatttattttataagaa

SEQ ID NO: 2663215 - DNA, 20 bp, Homo sapiens
gcccaaggttaaaaagttca

SEQ ID NO: 2663216 - DNA, 23 bp, Homo sapiens
gcccacaaaggcaaagggtccag

SEQ ID NO: 2663217 - DNA, 18 bp, Homo sapiens
gcccagcggacagtggca

SEQ ID NO: 2663218 - DNA, 20 bp, Homo sapiens
gcccagcggacagtggcagg

SEQ ID NO: 2663219 - DNA, 15 bp, Homo sapiens
gcccagtccttccac

SEQ ID NO: 2663220 - DNA, 18 bp, Homo sapiens
gcccagtccttccacctc

SEQ ID NO: 2663221 - DNA, 13 bp, Homo sapiens
gcccattctactt

SEQ ID NO: 2663222 - DNA, 14 bp, Homo sapiens
gcccattctacttg

SEQ ID NO: 2663223 - DNA, 15 bp, Homo sapiens
gcccattctacttgc

SEQ ID NO: 2663224 - DNA, 20 bp, Homo sapiens
gccccattcttttgtaattt

SEQ ID NO: 2663225 - DNA, 22 bp, Homo sapiens
gccccattcttttgtaatttaa

SEQ ID NO: 2663226 - DNA, 23 bp, Homo sapiens
gccccattcttttgtaatttaaa

SEQ ID NO: 2663227 - DNA, 14 bp, Homo sapiens
gcccccccttccac

SEQ ID NO: 2663228 - DNA, 15 bp, Homo sapiens
gcccccccttccact

SEQ ID NO: 2663229 - DNA, 15 bp, Homo sapiens
gccctaaaagcacac

SEQ ID NO: 2663230 - DNA, 15 bp, Homo sapiens
gccctaatgtctgta

SEQ ID NO: 2663231 - DNA, 12 bp, Homo sapiens
gccctcccaggc

SEQ ID NO: 2663232 - DNA, 19 bp, Homo sapiens
gccctcccctctctgcacc

SEQ ID NO: 2663233 - DNA, 17 bp, Homo sapiens
gccctcctaccctgcgc

SEQ ID NO: 2663234 - DNA, 18 bp, Homo sapiens
gccctcctaccctgcgcc

SEQ ID NO: 2663235 - DNA, 21 bp, Homo sapiens
ggccatgttgtgcctccctgg

SEQ ID NO: 2663236 - DNA, 18 bp, Homo sapiens
ggcccattctacttgctc

SEQ ID NO: 2663237 - DNA, 19 bp, Homo sapiens
ggcccattctacttgctct

SEQ ID NO: 2663238 - DNA, 22 bp, Homo sapiens
ggcccattctacttgctctgga

SEQ ID NO: 2663239 - DNA, 14 bp, Homo sapiens
ggccgggcagaggg

SEQ ID NO: 2663240 - DNA, 14 bp, Homo sapiens
ggcctcccacagac

SEQ ID NO: 2663241 - DNA, 19 bp, Homo sapiens
ggcctgaagagtcctctga

SEQ ID NO: 2663242 - DNA, 19 bp, Homo sapiens
ggccttgggccctctggtt

SEQ ID NO: 2663243 - DNA, 14 bp, Homo sapiens
ggcgcactgcctct

SEQ ID NO: 2663244 - DNA, 13 bp, Homo sapiens
ggcggagctggcc

SEQ ID NO: 2663245 - DNA, 15 bp, Homo sapiens
ggcggagctggcccc

SEQ ID NO: 2663246 - DNA, 20 bp, Homo sapiens
ggcggagctggccccgccgc

SEQ ID NO: 2663247 - DNA, 12 bp, Homo sapiens
ggctggcatgat

SEQ ID NO: 2663248 - DNA, 16 bp, Homo sapiens
ggcttacggccctggc

SEQ ID NO: 2663249 - DNA, 16 bp, Homo sapiens
ggcttctctgaggaag

SEQ ID NO: 2663250 - DNA, 18 bp, Homo sapiens
gggaaggggacccccgcc

SEQ ID NO: 2663251 - DNA, 22 bp, Homo sapiens
gggacaaagaggcctttaacca

SEQ ID NO: 2663252 - DNA, 14 bp, Homo sapiens
gggacccccgcccc

SEQ ID NO: 2663253 - DNA, 19 bp, Homo sapiens
gggacctataactgcccag

SEQ ID NO: 2663254 - DNA, 16 bp, Homo sapiens
gggacctctcccaggg

SEQ ID NO: 2663255 - DNA, 17 bp, Homo sapiens
gggacgaagaagagcca

SEQ ID NO: 2663256 - DNA, 20 bp, Homo sapiens
gggacgaagaagagccacag

SEQ ID NO: 2663257 - DNA, 16 bp, Homo sapiens
gggagctgcaggggca

SEQ ID NO: 2663258 - DNA, 17 bp, Homo sapiens
gggagggtcagccaggg

SEQ ID NO: 2663259 - DNA, 20 bp, Homo sapiens
gggatgacatgcactcagct

SEQ ID NO: 2663260 - DNA, 21 bp, Homo sapiens
gggcagcgggagcctccctgc

SEQ ID NO: 2663261 - DNA, 15 bp, Homo sapiens
gggcaggccagagct

SEQ ID NO: 2663262 - DNA, 22 bp, Homo sapiens
gggcgatcgcggcggagctggc

SEQ ID NO: 2663263 - DNA, 22 bp, Homo sapiens
gggcgccgcaaaccacactgga

SEQ ID NO: 2663264 - DNA, 17 bp, Homo sapiens
ggggcccatgaaagagg

SEQ ID NO: 2663265 - DNA, 21 bp, Homo sapiens
ggggcgatcgcggcggagctg

SEQ ID NO: 2663266 - DNA, 20 bp, Homo sapiens
gggtccaggattcctctttt

SEQ ID NO: 2663267 - DNA, 17 bp, Homo sapiens
gggtcgacttcgggctg

SEQ ID NO: 2663268 - DNA, 14 bp, Homo sapiens
gggtgaaggctggc

SEQ ID NO: 2663269 - DNA, 14 bp, Homo sapiens
ggtagacctgtctc

SEQ ID NO: 2663270 - DNA, 21 bp, Homo sapiens
ggtatgaccttctaggaagct

SEQ ID NO: 2663271 - DNA, 15 bp, Homo sapiens
ggtcagaaacaggac

SEQ ID NO: 2663272 - DNA, 18 bp, Homo sapiens
ggtcagaaacaggaccgg

SEQ ID NO: 2663273 - DNA, 14 bp, Homo sapiens
ggtccacagggcac

SEQ ID NO: 2663274 - DNA, 19 bp, Homo sapiens
ggtccaggattcctctttt

SEQ ID NO: 2663275 - DNA, 12 bp, Homo sapiens
ggtccagggagc

SEQ ID NO: 2663276 - DNA, 16 bp, Homo sapiens
ggtccagggagcaggc

SEQ ID NO: 2663277 - DNA, 17 bp, Homo sapiens
ggtcgacttcgggctgg

SEQ ID NO: 2663278 - DNA, 20 bp, Homo sapiens
ggtgagcggatcacaaggtc

SEQ ID NO: 2663279 - DNA, 13 bp, Homo sapiens
ggtgcagccagag

SEQ ID NO: 2663280 - DNA, 17 bp, Homo sapiens
ggtgcagccagaggcac

SEQ ID NO: 2663281 - DNA, 15 bp, Homo sapiens
ggtgctgtcctcagg

SEQ ID NO: 2663282 - DNA, 20 bp, Homo sapiens
ggtgctgtcctcaggtggcc

SEQ ID NO: 2663283 - DNA, 20 bp, Homo sapiens
ggtggccatgcctcagccct

SEQ ID NO: 2663284 - DNA, 18 bp, Homo sapiens
ggtgggcacccaccctgg

SEQ ID NO: 2663285 - DNA, 19 bp, Homo sapiens
ggttcctcgttctccctgg

SEQ ID NO: 2663286 - DNA, 17 bp, Homo sapiens
ggtttacagtctatttg

SEQ ID NO: 2663287 - DNA, 15 bp, Homo sapiens
ggtttgaatataaac

SEQ ID NO: 2663288 - DNA, 14 bp, Homo sapiens
ggtttgcaaggaag

SEQ ID NO: 2663289 - DNA, 21 bp, Homo sapiens
ggtttgccggtggtgcaggta

SEQ ID NO: 2663290 - DNA, 16 bp, Homo sapiens
gtaaacgctgtcccta

SEQ ID NO: 2663291 - DNA, 13 bp, Homo sapiens
gtaaataaagccc

SEQ ID NO: 2663292 - DNA, 14 bp, Homo sapiens
gtaaataaagccct

SEQ ID NO: 2663293 - DNA, 15 bp, Homo sapiens
gtaaataaagccctg

SEQ ID NO: 2663294 - DNA, 14 bp, Homo sapiens
gtaatctgagaaac

SEQ ID NO: 2663295 - DNA, 19 bp, Homo sapiens
gtaatctgagaaacaatga

SEQ ID NO: 2663296 - DNA, 21 bp, Homo sapiens
gtaccttcagaataagcttcc

SEQ ID NO: 2663297 - DNA, 15 bp, Homo sapiens
gtactacaatttaaa

SEQ ID NO: 2663298 - DNA, 18 bp, Homo sapiens
gtactaggatactgctgc

SEQ ID NO: 2663299 - DNA, 22 bp, Homo sapiens
gtactaggatactgctgcgtca

SEQ ID NO: 2663300 - DNA, 20 bp, Homo sapiens
gtactcatcatcaaccctaa

SEQ ID NO: 2663301 - DNA, 10 bp, Homo sapiens
gtactttgtg

SEQ ID NO: 2663302 - DNA, 17 bp, Homo sapiens
gtagaattatctaattt

SEQ ID NO: 2663303 - DNA, 21 bp, Homo sapiens
gtagacctgtctcctggcggt

SEQ ID NO: 2663304 - DNA, 14 bp, Homo sapiens
gtagcatttactgt

SEQ ID NO: 2663305 - DNA, 12 bp, Homo sapiens
gtataatatttt

SEQ ID NO: 2663306 - DNA, 19 bp, Homo sapiens
gtatgtttttgtgtatttg

SEQ ID NO: 2663307 - DNA, 23 bp, Homo sapiens
gtattgtttgggatcctattgaa

SEQ ID NO: 2663308 - DNA, 21 bp, Homo sapiens
gtattttagtaagagattcct

SEQ ID NO: 2663309 - DNA, 19 bp, Homo sapiens
gtattttataattctggga

SEQ ID NO: 2663310 - DNA, 15 bp, Homo sapiens
gtcactgctctggac

SEQ ID NO: 2663311 - DNA, 19 bp, Homo sapiens
gtcagaattagctgcttct

SEQ ID NO: 2663312 - DNA, 16 bp, Homo sapiens
gtcagccagggcctgc

SEQ ID NO: 2663313 - DNA, 20 bp, Homo sapiens
gtcatttttcagacctttta

SEQ ID NO: 2663314 - DNA, 20 bp, Homo sapiens
gtccagaaggagacaggcag

SEQ ID NO: 2663315 - DNA, 17 bp, Homo sapiens
gtccaggattcctcttt

SEQ ID NO: 2663316 - DNA, 12 bp, Homo sapiens
gtccccagagaa

SEQ ID NO: 2663317 - DNA, 16 bp, Homo sapiens
gtcctcaggtggccat

SEQ ID NO: 2663318 - DNA, 23 bp, Homo sapiens
gtcctcaggtggccatgcctcag

SEQ ID NO: 2663319 - DNA, 14 bp, Homo sapiens
gtcctccaagccag

SEQ ID NO: 2663320 - DNA, 13 bp, Homo sapiens
gtcctctgaatga

SEQ ID NO: 2663321 - DNA, 15 bp, Homo sapiens
gtccttctcattcat

SEQ ID NO: 2663322 - DNA, 15 bp, Homo sapiens
gtcgagtcaaaatgt

SEQ ID NO: 2663323 - DNA, 13 bp, Homo sapiens
gtctcctggcggt

SEQ ID NO: 2663324 - DNA, 12 bp, Homo sapiens
gtctgccagggc

SEQ ID NO: 2663325 - DNA, 15 bp, Homo sapiens
gtctgtatcagtgga

SEQ ID NO: 2663326 - DNA, 22 bp, Homo sapiens
gtctgtatcagtggatttccca

SEQ ID NO: 2663327 - DNA, 23 bp, Homo sapiens
gtctgtatcagtggatttcccat

SEQ ID NO: 2663328 - DNA, 22 bp, Homo sapiens
gtcttcaaccagggattgtttc

SEQ ID NO: 2663329 - DNA, 19 bp, Homo sapiens
gtctttgttaagttctatt

SEQ ID NO: 2663330 - DNA, 23 bp, Homo sapiens
gtgaaattcccaacaaacattga

SEQ ID NO: 2663331 - DNA, 19 bp, Homo sapiens
gtgaacaagcaaacccaga

SEQ ID NO: 2663332 - DNA, 17 bp, Homo sapiens
gtgaattgtttgaacct

SEQ ID NO: 2663333 - DNA, 20 bp, Homo sapiens
gtgatcttttgttcccatcc

SEQ ID NO: 2663334 - DNA, 13 bp, Homo sapiens
gtgcaaccaggga

SEQ ID NO: 2663335 - DNA, 14 bp, Homo sapiens
gtgcacaaagtggc

SEQ ID NO: 2663336 - DNA, 21 bp, Homo sapiens
gtgcacaaagtggcataaaaa

SEQ ID NO: 2663337 - DNA, 12 bp, Homo sapiens
gtgcagccagag

SEQ ID NO: 2663338 - DNA, 15 bp, Homo sapiens
tctgaactggagcca

SEQ ID NO: 2663339 - DNA, 15 bp, Homo sapiens
tctgagaaacaatga

SEQ ID NO: 2663340 - DNA, 18 bp, Homo sapiens
tctgagctctttgcacta

SEQ ID NO: 2663341 - DNA, 17 bp, Homo sapiens
tctgagtggcttcactc

SEQ ID NO: 2663342 - DNA, 22 bp, Homo sapiens
tctgagtggcttcactcctgct

SEQ ID NO: 2663343 - DNA, 18 bp, Homo sapiens
tctgcaccgtactgtgga

SEQ ID NO: 2663344 - DNA, 14 bp, Homo sapiens
tctggaaagcaaag

SEQ ID NO: 2663345 - DNA, 12 bp, Homo sapiens
tctggacctgcc

SEQ ID NO: 2663346 - DNA, 13 bp, Homo sapiens
tctgggagaaaat

SEQ ID NO: 2663347 - DNA, 19 bp, Homo sapiens
tctgggagtggggaagtga

SEQ ID NO: 2663348 - DNA, 17 bp, Homo sapiens
tctggttaggatggcag

SEQ ID NO: 2663349 - DNA, 17 bp, Homo sapiens
tctgtatcactctgtgt

SEQ ID NO: 2663350 - DNA, 15 bp, Homo sapiens
tctgtctaaaaaaca

SEQ ID NO: 2663351 - DNA, 17 bp, Homo sapiens
tcttaaacaaatgtatg

SEQ ID NO: 2663352 - DNA, 14 bp, Homo sapiens
tcttaatattctgg

SEQ ID NO: 2663353 - DNA, 23 bp, Homo sapiens
tcttatcaagagttgtgacaact

SEQ ID NO: 2663354 - DNA, 20 bp, Homo sapiens
tcttcaaccagggattgttt

SEQ ID NO: 2663355 - DNA, 13 bp, Homo sapiens
tcttcccattctc

SEQ ID NO: 2663356 - DNA, 15 bp, Homo sapiens
tcttcccattctcca

SEQ ID NO: 2663357 - DNA, 21 bp, Homo sapiens
tcttcttttagcagtaaaata

SEQ ID NO: 2663358 - DNA, 13 bp, Homo sapiens
tcttgtaaataaa

SEQ ID NO: 2663359 - DNA, 18 bp, Homo sapiens
tcttgtaaataaagccct

SEQ ID NO: 2663360 - DNA, 22 bp, Homo sapiens
tcttgtggctttgcaaccattt

SEQ ID NO: 2663361 - DNA, 15 bp, Homo sapiens
tctttatgttgagtc

SEQ ID NO: 2663362 - DNA, 12 bp, Homo sapiens
tctttcatgagt

SEQ ID NO: 2663363 - DNA, 14 bp, Homo sapiens
tctttcatgagttt

SEQ ID NO: 2663364 - DNA, 20 bp, Homo sapiens
tctttccctgcttaatgaaa

SEQ ID NO: 2663365 - DNA, 21 bp, Homo sapiens
tctttgccaagacctttcaaa

SEQ ID NO: 2663366 - DNA, 11 bp, Homo sapiens
tctttgtgaag

SEQ ID NO: 2663367 - DNA, 15 bp, Homo sapiens
tctttttattgaatc

SEQ ID NO: 2663368 - DNA, 9 bp, Homo sapiens
tgaaaaaga

SEQ ID NO: 2663369 - DNA, 14 bp, Homo sapiens
tgaaaattaacact

SEQ ID NO: 2663370 - DNA, 16 bp, Homo sapiens
tgaaatattttacagt

SEQ ID NO: 2663371 - DNA, 20 bp, Homo sapiens
tgaaatttttggttataaat

SEQ ID NO: 2663372 - DNA, 17 bp, Homo sapiens
tgaacaccattgaaggc

SEQ ID NO: 2663373 - DNA, 18 bp, Homo sapiens
tgaacagactgaccttga

SEQ ID NO: 2663374 - DNA, 16 bp, Homo sapiens
tgaacctatttctctt

SEQ ID NO: 2663375 - DNA, 11 bp, Homo sapiens
tgaagaagaga

SEQ ID NO: 2663376 - DNA, 23 bp, Homo sapiens
tgaagagtcctctgaatgaacct

SEQ ID NO: 2663377 - DNA, 14 bp, Homo sapiens
tgaagcaaacacat

SEQ ID NO: 2663378 - DNA, 20 bp, Homo sapiens
tgaaggctggcatgatccaa

SEQ ID NO: 2663379 - DNA, 22 bp, Homo sapiens
tgaaggggccaaggagggtgag

SEQ ID NO: 2663380 - DNA, 12 bp, Homo sapiens
tgaagtaccacc

SEQ ID NO: 2663381 - DNA, 15 bp, Homo sapiens
tgaatataaacacta

SEQ ID NO: 2663382 - DNA, 16 bp, Homo sapiens
tgaatataaacactat

SEQ ID NO: 2663383 - DNA, 22 bp, Homo sapiens
tgaatataatatatttgtgtat

SEQ ID NO: 2663384 - DNA, 14 bp, Homo sapiens
tgaatctatttaag

SEQ ID NO: 2663385 - DNA, 16 bp, Homo sapiens
tgaatctatttaagta

SEQ ID NO: 2663386 - DNA, 18 bp, Homo sapiens
tgaattttgttctctggg

SEQ ID NO: 2663387 - DNA, 20 bp, Homo sapiens
tgaattttgttctctgggag

SEQ ID NO: 2663388 - DNA, 20 bp, Homo sapiens
tgacacctttcataatcttt

SEQ ID NO: 2663389 - DNA, 23 bp, Homo sapiens
tgacacctttcataatctttgct

SEQ ID NO: 2663390 - DNA, 15 bp, Homo sapiens
tgacagaacactgtc

SEQ ID NO: 2663391 - DNA, 15 bp, Homo sapiens
tgacctggtccacag

SEQ ID NO: 2663392 - DNA, 15 bp, Homo sapiens
tgactaattcttgca

SEQ ID NO: 2663393 - DNA, 22 bp, Homo sapiens
tgactaattcttgcatattttg

SEQ ID NO: 2663394 - DNA, 15 bp, Homo sapiens
tgactcaagattccc

SEQ ID NO: 2663395 - DNA, 17 bp, Homo sapiens
tgactcaagattcccag

SEQ ID NO: 2663396 - DNA, 14 bp, Homo sapiens
tgactcacacctga

SEQ ID NO: 2663397 - DNA, 14 bp, Homo sapiens
tgagaaaaaaagaa

SEQ ID NO: 2663398 - DNA, 17 bp, Homo sapiens
tgagaactttatttcca

SEQ ID NO: 2663399 - DNA, 19 bp, Homo sapiens
tgagacacaggatgaagca

SEQ ID NO: 2663400 - DNA, 16 bp, Homo sapiens
tgagaggcatttcccc

SEQ ID NO: 2663401 - DNA, 14 bp, Homo sapiens
tgagagggccgggc

SEQ ID NO: 2663402 - DNA, 17 bp, Homo sapiens
tgagagggccgggcaga

SEQ ID NO: 2663403 - DNA, 18 bp, Homo sapiens
tgagatccttccttttga

SEQ ID NO: 2663404 - DNA, 18 bp, Homo sapiens
tgagcaatgtataacccc

SEQ ID NO: 2663405 - DNA, 23 bp, Homo sapiens
tgagctcccaggtgcagccagag

SEQ ID NO: 2663406 - DNA, 12 bp, Homo sapiens
tgagctgtcact

SEQ ID NO: 2663407 - DNA, 16 bp, Homo sapiens
tgaggaaacaacagct

SEQ ID NO: 2663408 - DNA, 15 bp, Homo sapiens
tgaggttgctttgtt

SEQ ID NO: 2663409 - DNA, 16 bp, Homo sapiens
tgagtcctagagctac

SEQ ID NO: 2663410 - DNA, 22 bp, Homo sapiens
tgagtggcttcactcctgctgt

SEQ ID NO: 2663411 - DNA, 23 bp, Homo sapiens
tgagttacaccagacctgttctg

SEQ ID NO: 2663412 - DNA, 23 bp, Homo sapiens
tgagttgacttgacagaacactg

SEQ ID NO: 2663413 - DNA, 20 bp, Homo sapiens
tgagttggtgttgacatgtg

SEQ ID NO: 2663414 - DNA, 23 bp, Homo sapiens
tgagttttcacctcgaattttgt

SEQ ID NO: 2663415 - DNA, 16 bp, Homo sapiens
tgatatttgtgcattt

SEQ ID NO: 2663416 - DNA, 18 bp, Homo sapiens
tgatcaaagccacactct

SEQ ID NO: 2663417 - DNA, 12 bp, Homo sapiens
tgatcaggacct

SEQ ID NO: 2663418 - DNA, 15 bp, Homo sapiens
tgatcttcaacaaat

SEQ ID NO: 2663419 - DNA, 24 bp, Homo sapiens
tgatgagctgtgcacaaagtggca

SEQ ID NO: 2663420 - DNA, 18 bp, Homo sapiens
tgatggcccattctactt

SEQ ID NO: 2663421 - DNA, 15 bp, Homo sapiens
tgcaacaacatgtat

SEQ ID NO: 2663422 - DNA, 20 bp, Homo sapiens
tgcaaggaagccacagctgg

SEQ ID NO: 2663423 - DNA, 13 bp, Homo sapiens
tgcaaggcaaaga

SEQ ID NO: 2663424 - DNA, 20 bp, Homo sapiens
tgcacaaagtggcataaaaa

SEQ ID NO: 2663425 - DNA, 14 bp, Homo sapiens
tgcactcagctctt

SEQ ID NO: 2663426 - DNA, 19 bp, Homo sapiens
tgcactccagcctgggtga

SEQ ID NO: 2663427 - DNA, 16 bp, Homo sapiens
tgcactctagcctggg

SEQ ID NO: 2663428 - DNA, 14 bp, Homo sapiens
tgcagacgcccaga

SEQ ID NO: 2663429 - DNA, 13 bp, Homo sapiens
tgcagccagaggc

SEQ ID NO: 2663430 - DNA, 15 bp, Homo sapiens
tgcaggtagacctgt

SEQ ID NO: 2663431 - DNA, 22 bp, Homo sapiens
tgcaggtagacctgtctcctgg

SEQ ID NO: 2663432 - DNA, 16 bp, Homo sapiens
tgcaggtgaaacccag

SEQ ID NO: 2663433 - DNA, 19 bp, Homo sapiens
tgcagtctgtccaggctcg

SEQ ID NO: 2663434 - DNA, 18 bp, Homo sapiens
tgcataccaacctgggca

SEQ ID NO: 2663435 - DNA, 17 bp, Homo sapiens
tgcatagagccacgtat

SEQ ID NO: 2663436 - DNA, 17 bp, Homo sapiens
tgcatgatgtttgccca

SEQ ID NO: 2663437 - DNA, 18 bp, Homo sapiens
tgcatgatgtttgcccaa

SEQ ID NO: 2663438 - DNA, 13 bp, Homo sapiens
tgcatggactgtg

SEQ ID NO: 2663439 - DNA, 17 bp, Homo sapiens
tgccacagtatattttt

SEQ ID NO: 2663440 - DNA, 18 bp, Homo sapiens
tgccatactgtatgcagt

SEQ ID NO: 2663441 - DNA, 18 bp, Homo sapiens
tgccatggacagaagaag

SEQ ID NO: 2663442 - DNA, 20 bp, Homo sapiens
tgccatggacagaagaaggc

SEQ ID NO: 2663443 - DNA, 17 bp, Homo sapiens
tgccattgcactccagc

SEQ ID NO: 2663444 - DNA, 19 bp, Homo sapiens
tgcccagcggacagtggca

SEQ ID NO: 2663445 - DNA, 21 bp, Homo sapiens
tgcccccgcatcccctgcctc

SEQ ID NO: 2663446 - DNA, 22 bp, Homo sapiens
tgccgttacttttcatatttgc

SEQ ID NO: 2663447 - DNA, 16 bp, Homo sapiens
tgcctcagccctgacc

SEQ ID NO: 2663448 - DNA, 16 bp, Homo sapiens
tgcctcaggcctctgt

SEQ ID NO: 2663449 - DNA, 18 bp, Homo sapiens
tgcctctcacagctgagt

SEQ ID NO: 2663450 - DNA, 20 bp, Homo sapiens
tgcgtcattacagggcacag

SEQ ID NO: 2663451 - DNA, 21 bp, Homo sapiens
tgctaatgtcaaacttgagtc

SEQ ID NO: 2663452 - DNA, 21 bp, Homo sapiens
tgctacaggggccagaagatg

SEQ ID NO: 2663453 - DNA, 19 bp, Homo sapiens
tgctactcaagtagcattt

SEQ ID NO: 2663454 - DNA, 16 bp, Homo sapiens
tgctagcacatgccct

SEQ ID NO: 2663455 - DNA, 20 bp, Homo sapiens
tgctagccggccactttgga

SEQ ID NO: 2663456 - DNA, 14 bp, Homo sapiens
ttactgtgtctttg

SEQ ID NO: 2663457 - DNA, 16 bp, Homo sapiens
ttacttttcatatttg

SEQ ID NO: 2663458 - DNA, 10 bp, Homo sapiens
ttagcctgga

SEQ ID NO: 2663459 - DNA, 16 bp, Homo sapiens
ttataagaaaaacttt

SEQ ID NO: 2663460 - DNA, 17 bp, Homo sapiens
ttataagaaaaactttt

SEQ ID NO: 2663461 - DNA, 21 bp, Homo sapiens
ttatacctgtgtattttttaa

SEQ ID NO: 2663462 - DNA, 23 bp, Homo sapiens
ttatcaagagttgtgacaacttc

SEQ ID NO: 2663463 - DNA, 15 bp, Homo sapiens
gtgtttttaactcaa

SEQ ID NO: 2663464 - DNA, 22 bp, Homo sapiens
gttaagtttttcccttcatctg

SEQ ID NO: 2663465 - DNA, 15 bp, Homo sapiens
gttaatgctttctga

SEQ ID NO: 2663466 - DNA, 17 bp, Homo sapiens
gttacacagtgtgaata

SEQ ID NO: 2663467 - DNA, 18 bp, Homo sapiens
gttacttttcatatttgc

SEQ ID NO: 2663468 - DNA, 15 bp, Homo sapiens
gttcaaacatttacc

SEQ ID NO: 2663469 - DNA, 20 bp, Homo sapiens
gttcatcctattctttcgaa

SEQ ID NO: 2663470 - DNA, 18 bp, Homo sapiens
gttcctcgttctccctgg

SEQ ID NO: 2663471 - DNA, 18 bp, Homo sapiens
gttcgacagtgaatattc

SEQ ID NO: 2663472 - DNA, 16 bp, Homo sapiens
gttctccctgggaggc

SEQ ID NO: 2663473 - DNA, 12 bp, Homo sapiens
gttctctgggag

SEQ ID NO: 2663474 - DNA, 15 bp, Homo sapiens
gttctctgggagaaa

SEQ ID NO: 2663475 - DNA, 16 bp, Homo sapiens
gttgaacctatttctc

SEQ ID NO: 2663476 - DNA, 23 bp, Homo sapiens
gttgtatacttccttatgcttct

SEQ ID NO: 2663477 - DNA, 21 bp, Homo sapiens
gtttacagtctatttgagact

SEQ ID NO: 2663478 - DNA, 13 bp, Homo sapiens
gtttgcaaggaag

SEQ ID NO: 2663479 - DNA, 15 bp, Homo sapiens
gtttgcaaggaagcc

SEQ ID NO: 2663480 - DNA, 19 bp, Homo sapiens
gtttgccggtggtgcaggt

SEQ ID NO: 2663481 - DNA, 22 bp, Homo sapiens
gttttaaagacctgacaccttt

SEQ ID NO: 2663482 - DNA, 19 bp, Homo sapiens
gttttaatttatactggca

SEQ ID NO: 2663483 - DNA, 20 bp, Homo sapiens
gttttccttttatttcttca

SEQ ID NO: 2663484 - DNA, 17 bp, Homo sapiens
gttttgtaaagtcccca

SEQ ID NO: 2663485 - DNA, 17 bp, Homo sapiens
taaaaaaagaagagaaa

SEQ ID NO: 2663486 - DNA, 15 bp, Homo sapiens
taaaaacaggcagct

SEQ ID NO: 2663487 - DNA, 21 bp, Homo sapiens
taaaacaggtagaattatcta

SEQ ID NO: 2663488 - DNA, 22 bp, Homo sapiens
taaaacaggtagaattatctaa

SEQ ID NO: 2663489 - DNA, 23 bp, Homo sapiens
taaaactttttatattttataca

SEQ ID NO: 2663490 - DNA, 14 bp, Homo sapiens
taaaataaatattg

SEQ ID NO: 2663491 - DNA, 18 bp, Homo sapiens
taaaatacggtacctggc

SEQ ID NO: 2663492 - DNA, 20 bp, Homo sapiens
taaaatctgatatgtattgt

SEQ ID NO: 2663493 - DNA, 22 bp, Homo sapiens
taaaatctgatatgtattgttt

SEQ ID NO: 2663494 - DNA, 23 bp, Homo sapiens
taaacccatattgtaaaacaggt

SEQ ID NO: 2663495 - DNA, 23 bp, Homo sapiens
taaagtcatggtcattgcaggaa

SEQ ID NO: 2663496 - DNA, 22 bp, Homo sapiens
taaataaaacattttcacacaa

SEQ ID NO: 2663497 - DNA, 22 bp, Homo sapiens
taaataactggaggaattttct

SEQ ID NO: 2663498 - DNA, 17 bp, Homo sapiens
taaatagcttttgtgtc

SEQ ID NO: 2663499 - DNA, 21 bp, Homo sapiens
taaatgtaccttcagaataag

SEQ ID NO: 2663500 - DNA, 14 bp, Homo sapiens
taaatttggcttct

SEQ ID NO: 2663501 - DNA, 14 bp, Homo sapiens
taacaatgtatttt

SEQ ID NO: 2663502 - DNA, 19 bp, Homo sapiens
taacacctgattaactgag

SEQ ID NO: 2663503 - DNA, 14 bp, Homo sapiens
taaccaatctacaa

SEQ ID NO: 2663504 - DNA, 22 bp, Homo sapiens
taaccaatctacaatctccctt

SEQ ID NO: 2663505 - DNA, 15 bp, Homo sapiens
taagaaaaacttttt

SEQ ID NO: 2663506 - DNA, 15 bp, Homo sapiens
taagctttgacactg

SEQ ID NO: 2663507 - DNA, 18 bp, Homo sapiens
taagtgaactattgtggg

SEQ ID NO: 2663508 - DNA, 16 bp, Homo sapiens
taagttgttatttcag

SEQ ID NO: 2663509 - DNA, 14 bp, Homo sapiens
taatactgtatttg

SEQ ID NO: 2663510 - DNA, 14 bp, Homo sapiens
taatctgagaaaca

SEQ ID NO: 2663511 - DNA, 14 bp, Homo sapiens
taatgatggcccat

SEQ ID NO: 2663512 - DNA, 15 bp, Homo sapiens
taatggtttgaatat

SEQ ID NO: 2663513 - DNA, 13 bp, Homo sapiens
taatgtcaaactt

SEQ ID NO: 2663514 - DNA, 22 bp, Homo sapiens
taatgtctgtatcactctgtgt

SEQ ID NO: 2663515 - DNA, 21 bp, Homo sapiens
taattaaataaaaatctgtgg

SEQ ID NO: 2663516 - DNA, 14 bp, Homo sapiens
taattcttattctt

SEQ ID NO: 2663517 - DNA, 13 bp, Homo sapiens
taatttataaaaa

SEQ ID NO: 2663518 - DNA, 16 bp, Homo sapiens
taatttataaaaaggt

SEQ ID NO: 2663519 - DNA, 19 bp, Homo sapiens
taatttatactggcatgct

SEQ ID NO: 2663520 - DNA, 15 bp, Homo sapiens
tacaacacaaagaga

SEQ ID NO: 2663521 - DNA, 19 bp, Homo sapiens
tacaagcccccccttccac

SEQ ID NO: 2663522 - DNA, 22 bp, Homo sapiens
tacaatctcccttcacaagttt

SEQ ID NO: 2663523 - DNA, 18 bp, Homo sapiens
tacaatgatgctatttgc

SEQ ID NO: 2663524 - DNA, 18 bp, Homo sapiens
tacacaccttatatttac

SEQ ID NO: 2663525 - DNA, 20 bp, Homo sapiens
tacacctttctcctttgtac

SEQ ID NO: 2663526 - DNA, 13 bp, Homo sapiens
tacaggggccaga

SEQ ID NO: 2663527 - DNA, 15 bp, Homo sapiens
tacaggggccagaag

SEQ ID NO: 2663528 - DNA, 22 bp, Homo sapiens
taccaatcatattaatacaatg

SEQ ID NO: 2663529 - DNA, 19 bp, Homo sapiens
tactcaagtagcatttact

SEQ ID NO: 2663530 - DNA, 20 bp, Homo sapiens
tactgggccatgttgtgcct

SEQ ID NO: 2663531 - DNA, 14 bp, Homo sapiens
tacttgctctggac

SEQ ID NO: 2663532 - DNA, 16 bp, Homo sapiens
tacttgctctggacct

SEQ ID NO: 2663533 - DNA, 14 bp, Homo sapiens
tacttgttataaac

SEQ ID NO: 2663534 - DNA, 19 bp, Homo sapiens
tacttttcatatttgcact

SEQ ID NO: 2663535 - DNA, 20 bp, Homo sapiens
tacttttcatatttgcacta

SEQ ID NO: 2663536 - DNA, 23 bp, Homo sapiens
tagaaagaatatttggttttcct

SEQ ID NO: 2663537 - DNA, 17 bp, Homo sapiens
tagaaagtgccagaaag

SEQ ID NO: 2663538 - DNA, 18 bp, Homo sapiens
tagaaagtgccagaaagt

SEQ ID NO: 2663539 - DNA, 18 bp, Homo sapiens
tagaacataaagcaaata

SEQ ID NO: 2663540 - DNA, 17 bp, Homo sapiens
tagaataataaatattt

SEQ ID NO: 2663541 - DNA, 22 bp, Homo sapiens
tagaattatctaatttataaaa

SEQ ID NO: 2663542 - DNA, 12 bp, Homo sapiens
tagagctttctt

SEQ ID NO: 2663543 - DNA, 21 bp, Homo sapiens
tagcacaacgtggtactattt

SEQ ID NO: 2663544 - DNA, 18 bp, Homo sapiens
tagcatataattctatat

SEQ ID NO: 2663545 - DNA, 16 bp, Homo sapiens
tagccggccactttgg

SEQ ID NO: 2663546 - DNA, 16 bp, Homo sapiens
taggaacttgagaact

SEQ ID NO: 2663547 - DNA, 14 bp, Homo sapiens
taggacccaagcag

SEQ ID NO: 2663548 - DNA, 21 bp, Homo sapiens
tagggaatggcacagcccaaa

SEQ ID NO: 2663549 - DNA, 23 bp, Homo sapiens
tagtagatgttctactttgttct

SEQ ID NO: 2663550 - DNA, 19 bp, Homo sapiens
tagtcagaattagctgctt

SEQ ID NO: 2663551 - DNA, 15 bp, Homo sapiens
tagttactatatgcc

SEQ ID NO: 2663552 - DNA, 19 bp, Homo sapiens
tagttgaaacgcagacact

SEQ ID NO: 2663553 - DNA, 14 bp, Homo sapiens
tataactgcccagc

SEQ ID NO: 2663554 - DNA, 13 bp, Homo sapiens
tataagaaaaact

SEQ ID NO: 2663555 - DNA, 15 bp, Homo sapiens
tataatactgtattt

SEQ ID NO: 2663556 - DNA, 12 bp, Homo sapiens
tatacacacagc

SEQ ID NO: 2663557 - DNA, 13 bp, Homo sapiens
tatactggcatgc

SEQ ID NO: 2663558 - DNA, 23 bp, Homo sapiens
tatacttgctttgtgttctttgt

SEQ ID NO: 2663559 - DNA, 23 bp, Homo sapiens
tatataatactgactgagaatat

SEQ ID NO: 2663560 - DNA, 15 bp, Homo sapiens
tatatacatatatat

SEQ ID NO: 2663561 - DNA, 20 bp, Homo sapiens
tatatgtatttaaaaaaatc

SEQ ID NO: 2663562 - DNA, 23 bp, Homo sapiens
tatatttagctccaaaccttcac

SEQ ID NO: 2663563 - DNA, 16 bp, Homo sapiens
tatatttgtgtattta

SEQ ID NO: 2663564 - DNA, 20 bp, Homo sapiens
tatatttgtgtatttaacag

SEQ ID NO: 2663565 - DNA, 22 bp, Homo sapiens
tatcaattggaaaggaagaaaa

SEQ ID NO: 2663566 - DNA, 15 bp, Homo sapiens
tatcccctctactct

SEQ ID NO: 2663567 - DNA, 20 bp, Homo sapiens
tatctgagctctttgcacta

SEQ ID NO: 2663568 - DNA, 22 bp, Homo sapiens
tatgccgttacttttcatattt

SEQ ID NO: 2663569 - DNA, 17 bp, Homo sapiens
tatgctaaaatacattt

SEQ ID NO: 2663570 - DNA, 15 bp, Homo sapiens
actgtactgggccat

SEQ ID NO: 2663571 - DNA, 16 bp, Homo sapiens
actgtcctccaagcca

SEQ ID NO: 2663572 - DNA, 21 bp, Homo sapiens
actgtgagctcccaggtgcag

SEQ ID NO: 2663573 - DNA, 16 bp, Homo sapiens
acttcaaactgagatc

SEQ ID NO: 2663574 - DNA, 19 bp, Homo sapiens
acttcacgctttcagcgaa

SEQ ID NO: 2663575 - DNA, 16 bp, Homo sapiens
acttcatgcaggtgaa

SEQ ID NO: 2663576 - DNA, 22 bp, Homo sapiens
acttcatggcctttgataaatg

SEQ ID NO: 2663577 - DNA, 22 bp, Homo sapiens
acttccatgtgagggttttcag

SEQ ID NO: 2663578 - DNA, 18 bp, Homo sapiens
acttgagttacaccagac

SEQ ID NO: 2663579 - DNA, 22 bp, Homo sapiens
acttgccgcgtcgccctcccag

SEQ ID NO: 2663580 - DNA, 12 bp, Homo sapiens
acttgctctgga

SEQ ID NO: 2663581 - DNA, 10 bp, Homo sapiens
actttgtgct

SEQ ID NO: 2663582 - DNA, 13 bp, Homo sapiens
actttgttctgct

SEQ ID NO: 2663583 - DNA, 19 bp, Homo sapiens
acttttcatatttgcacta

SEQ ID NO: 2663584 - DNA, 15 bp, Homo sapiens
actttttctttatgt

SEQ ID NO: 2663585 - DNA, 23 bp, Homo sapiens
acttttttgctatccagctattt

SEQ ID NO: 2663586 - DNA, 17 bp, Homo sapiens
acttttttttgtatgtt

SEQ ID NO: 2663587 - DNA, 19 bp, Homo sapiens
agaaaaaccagaggcagct

SEQ ID NO: 2663588 - DNA, 12 bp, Homo sapiens
agaaaatcatca

SEQ ID NO: 2663589 - DNA, 17 bp, Homo sapiens
agaaaatcatcaagaag

SEQ ID NO: 2663590 - DNA, 19 bp, Homo sapiens
agaaaatggaaccaggctt

SEQ ID NO: 2663591 - DNA, 22 bp, Homo sapiens
agaaactgttcccacctgctgg

SEQ ID NO: 2663592 - DNA, 14 bp, Homo sapiens
agaaatgcaaaaat

SEQ ID NO: 2663593 - DNA, 14 bp, Homo sapiens
agaacatgtagaaa

SEQ ID NO: 2663594 - DNA, 17 bp, Homo sapiens
agaacatgtagaaaaca

SEQ ID NO: 2663595 - DNA, 22 bp, Homo sapiens
agaagagccacagtgagggaga

SEQ ID NO: 2663596 - DNA, 16 bp, Homo sapiens
agaaggaaaaggcagg

SEQ ID NO: 2663597 - DNA, 18 bp, Homo sapiens
agaagggagctagccaga

SEQ ID NO: 2663598 - DNA, 19 bp, Homo sapiens
agaagggagctagccagag

SEQ ID NO: 2663599 - DNA, 19 bp, Homo sapiens
agaagtaggggaagacatg

SEQ ID NO: 2663600 - DNA, 18 bp, Homo sapiens
agaagtgaataactgcaa

SEQ ID NO: 2663601 - DNA, 16 bp, Homo sapiens
agaataataaatattt

SEQ ID NO: 2663602 - DNA, 16 bp, Homo sapiens
agaatataaaaaactt

SEQ ID NO: 2663603 - DNA, 13 bp, Homo sapiens
agaatctcttgaa

SEQ ID NO: 2663604 - DNA, 14 bp, Homo sapiens
agaattagctgctt

SEQ ID NO: 2663605 - DNA, 20 bp, Homo sapiens
agaattatctaatttataaa

SEQ ID NO: 2663606 - DNA, 18 bp, Homo sapiens
agacagtcctaacaatat

SEQ ID NO: 2663607 - DNA, 13 bp, Homo sapiens
agacctcagggca

SEQ ID NO: 2663608 - DNA, 19 bp, Homo sapiens
agacctgcagacgcccaga

SEQ ID NO: 2663609 - DNA, 16 bp, Homo sapiens
agacctggacacaggc

SEQ ID NO: 2663610 - DNA, 14 bp, Homo sapiens
agacctgtctcctg

SEQ ID NO: 2663611 - DNA, 15 bp, Homo sapiens
agacctgtctcctgg

SEQ ID NO: 2663612 - DNA, 12 bp, Homo sapiens
agactaaatgaa

SEQ ID NO: 2663613 - DNA, 20 bp, Homo sapiens
agactcgattcatattgaat

SEQ ID NO: 2663614 - DNA, 23 bp, Homo sapiens
agactcgattcatattgaatata

SEQ ID NO: 2663615 - DNA, 15 bp, Homo sapiens
agactgaggggtcga

SEQ ID NO: 2663616 - DNA, 17 bp, Homo sapiens
agactgatcaggacctc

SEQ ID NO: 2663617 - DNA, 17 bp, Homo sapiens
agactgttgtccctgca

SEQ ID NO: 2663618 - DNA, 16 bp, Homo sapiens
agagctttctttcaca

SEQ ID NO: 2663619 - DNA, 18 bp, Homo sapiens
agaggatgctgtgaaatt

SEQ ID NO: 2663620 - DNA, 17 bp, Homo sapiens
agaggcagcttctttgc

SEQ ID NO: 2663621 - DNA, 13 bp, Homo sapiens
agaggcatttccc

SEQ ID NO: 2663622 - DNA, 21 bp, Homo sapiens
agaggcctttaaccatggtgc

SEQ ID NO: 2663623 - DNA, 17 bp, Homo sapiens
agagggccgggcagagg

SEQ ID NO: 2663624 - DNA, 18 bp, Homo sapiens
agaggggcagatggaaag

SEQ ID NO: 2663625 - DNA, 16 bp, Homo sapiens
agagtttcaaccatga

SEQ ID NO: 2663626 - DNA, 22 bp, Homo sapiens
agatagggaaaaggggctcctt

SEQ ID NO: 2663627 - DNA, 19 bp, Homo sapiens
agatcttcaaacagaataa

SEQ ID NO: 2663628 - DNA, 18 bp, Homo sapiens
agatgaacagactgacct

SEQ ID NO: 2663629 - DNA, 10 bp, Homo sapiens
agatggaaag

SEQ ID NO: 2663630 - DNA, 17 bp, Homo sapiens
agatgggtgaaggctgg

SEQ ID NO: 2663631 - DNA, 21 bp, Homo sapiens
agatgggtgaaggctggcatg

SEQ ID NO: 2663632 - DNA, 22 bp, Homo sapiens
agatgtggttgcataaggtttt

SEQ ID NO: 2663633 - DNA, 12 bp, Homo sapiens
agattcccagga

SEQ ID NO: 2663634 - DNA, 19 bp, Homo sapiens
agattcccaggagttctgc

SEQ ID NO: 2663635 - DNA, 22 bp, Homo sapiens
agattcccaggagttctgctca

SEQ ID NO: 2663636 - DNA, 13 bp, Homo sapiens
agcaaacccagac

SEQ ID NO: 2663637 - DNA, 15 bp, Homo sapiens
agcaaacccagacgg

SEQ ID NO: 2663638 - DNA, 16 bp, Homo sapiens
agcaacagaaaaatgg

SEQ ID NO: 2663639 - DNA, 22 bp, Homo sapiens
agcaacattttacccacacaca

SEQ ID NO: 2663640 - DNA, 20 bp, Homo sapiens
agcacactcatcccctcact

SEQ ID NO: 2663641 - DNA, 19 bp, Homo sapiens
agcagatgcaatgactcag

SEQ ID NO: 2663642 - DNA, 14 bp, Homo sapiens
agcagctctcccct

SEQ ID NO: 2663643 - DNA, 22 bp, Homo sapiens
agcagctgaaatatgctggctg

SEQ ID NO: 2663644 - DNA, 23 bp, Homo sapiens
agcagctgaaatatgctggctgg

SEQ ID NO: 2663645 - DNA, 12 bp, Homo sapiens
agcatacaactt

SEQ ID NO: 2663646 - DNA, 16 bp, Homo sapiens
agcatttactgtgtct

SEQ ID NO: 2663647 - DNA, 22 bp, Homo sapiens
acaaatctaggaaaatattttg

SEQ ID NO: 2663648 - DNA, 18 bp, Homo sapiens
acaaatttttatttctaa

SEQ ID NO: 2663649 - DNA, 14 bp, Homo sapiens
acaacctgaaccta

SEQ ID NO: 2663650 - DNA, 18 bp, Homo sapiens
acaacctgaacctaggag

SEQ ID NO: 2663651 - DNA, 18 bp, Homo sapiens
acaagtggcaacctgctt

SEQ ID NO: 2663652 - DNA, 14 bp, Homo sapiens
acaataccttattt

SEQ ID NO: 2663653 - DNA, 17 bp, Homo sapiens
acaatgttaacattttt

SEQ ID NO: 2663654 - DNA, 14 bp, Homo sapiens
acaatttaaagcaa

SEQ ID NO: 2663655 - DNA, 23 bp, Homo sapiens
acacaatgtgtctttctttttgg

SEQ ID NO: 2663656 - DNA, 16 bp, Homo sapiens
acacaggcctgctctc

SEQ ID NO: 2663657 - DNA, 21 bp, Homo sapiens
acaccaggcttgcctgcaggc

SEQ ID NO: 2663658 - DNA, 17 bp, Homo sapiens
acacccagcccccacat

SEQ ID NO: 2663659 - DNA, 18 bp, Homo sapiens
acactcacctctaaaaca

SEQ ID NO: 2663660 - DNA, 23 bp, Homo sapiens
acactgcttgtgtttttaactca

SEQ ID NO: 2663661 - DNA, 14 bp, Homo sapiens
acactgggaaacag

SEQ ID NO: 2663662 - DNA, 15 bp, Homo sapiens
acactgggaggccag

SEQ ID NO: 2663663 - DNA, 11 bp, Homo sapiens
acagaaaaacc

SEQ ID NO: 2663664 - DNA, 22 bp, Homo sapiens
acagactcgattcatattgaat

SEQ ID NO: 2663665 - DNA, 19 bp, Homo sapiens
acagactgaccttgatgag

SEQ ID NO: 2663666 - DNA, 19 bp, Homo sapiens
acagactgttgtccctgca

SEQ ID NO: 2663667 - DNA, 20 bp, Homo sapiens
acagactgttgtccctgcac

SEQ ID NO: 2663668 - DNA, 15 bp, Homo sapiens
acagagcaagactct

SEQ ID NO: 2663669 - DNA, 12 bp, Homo sapiens
acagcaagtcag

SEQ ID NO: 2663670 - DNA, 19 bp, Homo sapiens
acagcattttcctctgctt

SEQ ID NO: 2663671 - DNA, 16 bp, Homo sapiens
acagcccaaagaagga

SEQ ID NO: 2663672 - DNA, 18 bp, Homo sapiens
acaggacttaaaatgaca

SEQ ID NO: 2663673 - DNA, 10 bp, Homo sapiens
acagggaggg

SEQ ID NO: 2663674 - DNA, 13 bp, Homo sapiens
acagggcacaggc

SEQ ID NO: 2663675 - DNA, 17 bp, Homo sapiens
acagggcacctgccacc

SEQ ID NO: 2663676 - DNA, 20 bp, Homo sapiens
acagggccctgttgaatttt

SEQ ID NO: 2663677 - DNA, 18 bp, Homo sapiens
acagtgagggagatccca

SEQ ID NO: 2663678 - DNA, 13 bp, Homo sapiens
acagtggcaggac

SEQ ID NO: 2663679 - DNA, 16 bp, Homo sapiens
acagtgtagcttgccc

SEQ ID NO: 2663680 - DNA, 13 bp, Homo sapiens
acagttttgtgaa

SEQ ID NO: 2663681 - DNA, 12 bp, Homo sapiens
acagtttttaaa

SEQ ID NO: 2663682 - DNA, 10 bp, Homo sapiens
acatacattg

SEQ ID NO: 2663683 - DNA, 16 bp, Homo sapiens
acatacctaagcaaac

SEQ ID NO: 2663684 - DNA, 19 bp, Homo sapiens
acatagcgaatacaaaatt

SEQ ID NO: 2663685 - DNA, 17 bp, Homo sapiens
acatgcactcagctctt

SEQ ID NO: 2663686 - DNA, 13 bp, Homo sapiens
acattcttaaaaa

SEQ ID NO: 2663687 - DNA, 15 bp, Homo sapiens
acattgggaagggga

SEQ ID NO: 2663688 - DNA, 23 bp, Homo sapiens
acattgggaaggggacccccgcc

SEQ ID NO: 2663689 - DNA, 21 bp, Homo sapiens
acatttgtagcatcctcttta

SEQ ID NO: 2663690 - DNA, 15 bp, Homo sapiens
acattttaatgcacc

SEQ ID NO: 2663691 - DNA, 15 bp, Homo sapiens
acattttcacacaat

SEQ ID NO: 2663692 - DNA, 20 bp, Homo sapiens
acattttcacacaatacaat

SEQ ID NO: 2663693 - DNA, 15 bp, Homo sapiens
accactcaaaggcca

SEQ ID NO: 2663694 - DNA, 18 bp, Homo sapiens
accactgcactctagcct

SEQ ID NO: 2663695 - DNA, 11 bp, Homo sapiens
accagcctggc

SEQ ID NO: 2663696 - DNA, 12 bp, Homo sapiens
accagcctggcc

SEQ ID NO: 2663697 - DNA, 15 bp, Homo sapiens
accagcctggccaac

SEQ ID NO: 2663698 - DNA, 18 bp, Homo sapiens
accaggcttgcctgcagg

SEQ ID NO: 2663699 - DNA, 18 bp, Homo sapiens
accagggattgtttctgt

SEQ ID NO: 2663700 - DNA, 23 bp, Homo sapiens
accatgcgacactgggaggccag

SEQ ID NO: 2663701 - DNA, 23 bp, Homo sapiens
accatttaaaaacaggcagctca

SEQ ID NO: 2663702 - DNA, 19 bp, Homo sapiens
acccaagacctcagggcac

SEQ ID NO: 2663703 - DNA, 17 bp, Homo sapiens
acccagcaacagaaaaa

SEQ ID NO: 2663704 - DNA, 16 bp, Homo sapiens
acccatattgtaaaac

SEQ ID NO: 2663705 - DNA, 15 bp, Homo sapiens
accccagtttttgtt

SEQ ID NO: 2663706 - DNA, 13 bp, Homo sapiens
acccccgccccct

SEQ ID NO: 2663707 - DNA, 14 bp, Homo sapiens
acccccgccccctg

SEQ ID NO: 2663708 - DNA, 22 bp, Homo sapiens
acccctccctcactcccacctg

SEQ ID NO: 2663709 - DNA, 22 bp, Homo sapiens
accctaaggtcattaccacagg

SEQ ID NO: 2663710 - DNA, 17 bp, Homo sapiens
accctggaaaatgaatc

SEQ ID NO: 2663711 - DNA, 23 bp, Homo sapiens
accctgggacctaggggcgccgc

SEQ ID NO: 2663712 - DNA, 15 bp, Homo sapiens
accctgggcctggca

SEQ ID NO: 2663713 - DNA, 19 bp, Homo sapiens
acccttctcctcttgtaaa

SEQ ID NO: 2663714 - DNA, 19 bp, Homo sapiens
accgaaaaactaaaaataa

SEQ ID NO: 2663715 - DNA, 15 bp, Homo sapiens
acctaggggcgccgc

SEQ ID NO: 2663716 - DNA, 16 bp, Homo sapiens
acctcaaccaatgcca

SEQ ID NO: 2663717 - DNA, 22 bp, Homo sapiens
acctcctttcaaggtaactgta

SEQ ID NO: 2663718 - DNA, 17 bp, Homo sapiens
acctctccctgaccctg

SEQ ID NO: 2663719 - DNA, 16 bp, Homo sapiens
acctcttaatattctg

SEQ ID NO: 2663720 - DNA, 14 bp, Homo sapiens
acctgaacctagga

SEQ ID NO: 2663721 - DNA, 16 bp, Homo sapiens
acctggtccacagggc

SEQ ID NO: 2663722 - DNA, 22 bp, Homo sapiens
accttcagtaacccccactgga

SEQ ID NO: 2663723 - DNA, 18 bp, Homo sapiens
accttctggcctcccaca

SEQ ID NO: 2663724 - DNA, 22 bp, Homo sapiens
accttctggcctcccacagact

SEQ ID NO: 2663725 - DNA, 15 bp, Homo sapiens
acctttcaaagccat

SEQ ID NO: 2663726 - DNA, 18 bp, Homo sapiens
acctttcaaagccatttt

SEQ ID NO: 2663727 - DNA, 18 bp, Homo sapiens
acctttcataatctttgc

SEQ ID NO: 2663728 - DNA, 12 bp, Homo sapiens
atcccctgcctc

SEQ ID NO: 2663729 - DNA, 16 bp, Homo sapiens
atccgtatatatcccc

SEQ ID NO: 2663730 - DNA, 13 bp, Homo sapiens
atcctcttctttt

SEQ ID NO: 2663731 - DNA, 19 bp, Homo sapiens
atccttccctgtctgccag

SEQ ID NO: 2663732 - DNA, 22 bp, Homo sapiens
atccttccctgtctgccagggc

SEQ ID NO: 2663733 - DNA, 22 bp, Homo sapiens
atccttttttaaaagtaaatgt

SEQ ID NO: 2663734 - DNA, 19 bp, Homo sapiens
atcgccagctgatgactca

SEQ ID NO: 2663735 - DNA, 14 bp, Homo sapiens
atctaatttataaa

SEQ ID NO: 2663736 - DNA, 19 bp, Homo sapiens
atctaggaaaatattttga

SEQ ID NO: 2663737 - DNA, 20 bp, Homo sapiens
atctaggaaaatattttgat

SEQ ID NO: 2663738 - DNA, 22 bp, Homo sapiens
atctaggaaaatattttgatct

SEQ ID NO: 2663739 - DNA, 16 bp, Homo sapiens
atctatttatcttcat

SEQ ID NO: 2663740 - DNA, 18 bp, Homo sapiens
atctccaagaccagagat

SEQ ID NO: 2663741 - DNA, 17 bp, Homo sapiens
atctccaccagtcattt

SEQ ID NO: 2663742 - DNA, 22 bp, Homo sapiens
atctccaccagtcatttttcag

SEQ ID NO: 2663743 - DNA, 14 bp, Homo sapiens
atctgatatgtatt

SEQ ID NO: 2663744 - DNA, 22 bp, Homo sapiens
atctggtaccagttgaaatttt

SEQ ID NO: 2663745 - DNA, 17 bp, Homo sapiens
atctggttaggatggca

SEQ ID NO: 2663746 - DNA, 17 bp, Homo sapiens
atctgtatcttttctct

SEQ ID NO: 2663747 - DNA, 16 bp, Homo sapiens
atcttttgttcccatc

SEQ ID NO: 2663748 - DNA, 20 bp, Homo sapiens
atgaaaatgcaacaacatgt

SEQ ID NO: 2663749 - DNA, 14 bp, Homo sapiens
atgaagcaaacaca

SEQ ID NO: 2663750 - DNA, 15 bp, Homo sapiens
atgaagcaaacacat

SEQ ID NO: 2663751 - DNA, 15 bp, Homo sapiens
atgaagttgtaggta

SEQ ID NO: 2663752 - DNA, 23 bp, Homo sapiens
atgacaaaatcatctttgtgaag

SEQ ID NO: 2663753 - DNA, 14 bp, Homo sapiens
atgaccagcaaata

SEQ ID NO: 2663754 - DNA, 17 bp, Homo sapiens
atgaccttctaggaagc

SEQ ID NO: 2663755 - DNA, 17 bp, Homo sapiens
atgactaattcttgcat

SEQ ID NO: 2663756 - DNA, 14 bp, Homo sapiens
atgagaactctgag

SEQ ID NO: 2663757 - DNA, 13 bp, Homo sapiens
atgagacacagga

SEQ ID NO: 2663758 - DNA, 14 bp, Homo sapiens
atgagacacaggat

SEQ ID NO: 2663759 - DNA, 18 bp, Homo sapiens
atgagctgtgcacaaagt

SEQ ID NO: 2663760 - DNA, 15 bp, Homo sapiens
atgatggcccattct

SEQ ID NO: 2663761 - DNA, 16 bp, Homo sapiens
atgatgtttgcccaaa

SEQ ID NO: 2663762 - DNA, 21 bp, Homo sapiens
atgcaacaacatgtataatat

SEQ ID NO: 2663763 - DNA, 17 bp, Homo sapiens
atgcaggtgaaacccag

SEQ ID NO: 2663764 - DNA, 18 bp, Homo sapiens
atgcaggtgaaacccagt

SEQ ID NO: 2663765 - DNA, 19 bp, Homo sapiens
atgcagtctgtccaggctc

SEQ ID NO: 2663766 - DNA, 20 bp, Homo sapiens
atgcagtctgtccaggctcg

SEQ ID NO: 2663767 - DNA, 18 bp, Homo sapiens
atgccaaaaaaagacagg

SEQ ID NO: 2663768 - DNA, 17 bp, Homo sapiens
atgccatggacagaaga

SEQ ID NO: 2663769 - DNA, 18 bp, Homo sapiens
atgccatggacagaagaa

SEQ ID NO: 2663770 - DNA, 19 bp, Homo sapiens
atgccatggacagaagaag

SEQ ID NO: 2663771 - DNA, 20 bp, Homo sapiens
atgcgacactgggaggccag

SEQ ID NO: 2663772 - DNA, 14 bp, Homo sapiens
atgctcagaccagc

SEQ ID NO: 2663773 - DNA, 18 bp, Homo sapiens
atgctttagaaaggtttt

SEQ ID NO: 2663774 - DNA, 22 bp, Homo sapiens
atgctttctgaagctttaccag

SEQ ID NO: 2663775 - DNA, 19 bp, Homo sapiens
atggaaaacgctctctact

SEQ ID NO: 2663776 - DNA, 21 bp, Homo sapiens
atggaaaacgctctctactct

SEQ ID NO: 2663777 - DNA, 17 bp, Homo sapiens
atggaaccaggcttgga

SEQ ID NO: 2663778 - DNA, 23 bp, Homo sapiens
atggcacagcccaaagaaggaaa

SEQ ID NO: 2663779 - DNA, 23 bp, Homo sapiens
atggcccattctacttgctctgg

SEQ ID NO: 2663780 - DNA, 18 bp, Homo sapiens
atggccgtgtagaagcat

SEQ ID NO: 2663781 - DNA, 21 bp, Homo sapiens
atggccgtgtagaagcatggt

SEQ ID NO: 2663782 - DNA, 18 bp, Homo sapiens
atggcctttgataaatgt

SEQ ID NO: 2663783 - DNA, 21 bp, Homo sapiens
atgggaaggtgggcgggcagg

SEQ ID NO: 2663784 - DNA, 19 bp, Homo sapiens
atgggtccaggattcctct

SEQ ID NO: 2663785 - DNA, 18 bp, Homo sapiens
atgggtgaaggctggcat

SEQ ID NO: 2663786 - DNA, 21 bp, Homo sapiens
atggtttgaatataaacacta

SEQ ID NO: 2663787 - DNA, 17 bp, Homo sapiens
atggtttgcaaggaagc

SEQ ID NO: 2663788 - DNA, 17 bp, Homo sapiens
atgtacaggatgctttg

SEQ ID NO: 2663789 - DNA, 21 bp, Homo sapiens
atgtagtcagaattagctgct

SEQ ID NO: 2663790 - DNA, 14 bp, Homo sapiens
atgtataatatttt

SEQ ID NO: 2663791 - DNA, 19 bp, Homo sapiens
atgtatgttcagaagaaat

SEQ ID NO: 2663792 - DNA, 23 bp, Homo sapiens
atgtattgtttgggatcctattg

SEQ ID NO: 2663793 - DNA, 23 bp, Homo sapiens
atgtgacattcttaaaaaaagaa

SEQ ID NO: 2663794 - DNA, 15 bp, Homo sapiens
atgtgctacaggggc

SEQ ID NO: 2663795 - DNA, 21 bp, Homo sapiens
atgtggttacacagtgtgaat

SEQ ID NO: 2663796 - DNA, 22 bp, Homo sapiens
atgttcctttggaagaaaaaat

SEQ ID NO: 2663797 - DNA, 23 bp, Homo sapiens
atgtttatttcataaagaattgt

SEQ ID NO: 2663798 - DNA, 13 bp, Homo sapiens
atgtttgcccaaa

SEQ ID NO: 2663799 - DNA, 11 bp, Homo sapiens
attaaaaccac

SEQ ID NO: 2663800 - DNA, 20 bp, Homo sapiens
attagatcttcaaacagaat

SEQ ID NO: 2663801 - DNA, 13 bp, Homo sapiens
attagctgcttct

SEQ ID NO: 2663802 - DNA, 21 bp, Homo sapiens
attagctgcttctatgtttca

SEQ ID NO: 2663803 - DNA, 12 bp, Homo sapiens
attcaataaaaa

SEQ ID NO: 2663804 - DNA, 18 bp, Homo sapiens
attcaataaaaaaaagaa

SEQ ID NO: 2663805 - DNA, 21 bp, Homo sapiens
attcaataaaaaaaagaaatg

SEQ ID NO: 2663806 - DNA, 16 bp, Homo sapiens
attcaatatcctttgc

SEQ ID NO: 2663807 - DNA, 19 bp, Homo sapiens
attcaatatcctttgcctc

SEQ ID NO: 2663808 - DNA, 11 bp, Homo sapiens
attcccaggag

SEQ ID NO: 2663809 - DNA, 18 bp, Homo sapiens
attcccaggagttctgct

SEQ ID NO: 2663810 - DNA, 20 bp, Homo sapiens
attcccttcgacagcatttt

SEQ ID NO: 2663811 - DNA, 12 bp, Homo sapiens
attcctcttttc

SEQ ID NO: 2663812 - DNA, 15 bp, Homo sapiens
attcctcttttctct

SEQ ID NO: 2663813 - DNA, 12 bp, Homo sapiens
attcctttccag

SEQ ID NO: 2663814 - DNA, 14 bp, Homo sapiens
attcgcttgagaaa

SEQ ID NO: 2663815 - DNA, 14 bp, Homo sapiens
attctccatttgtt

SEQ ID NO: 2663816 - DNA, 12 bp, Homo sapiens
attctggagtca

SEQ ID NO: 2663817 - DNA, 21 bp, Homo sapiens
attcttacaaacatgtggtta

SEQ ID NO: 2663818 - DNA, 16 bp, Homo sapiens
attcttcccattctcc

SEQ ID NO: 2663819 - DNA, 18 bp, Homo sapiens
attcttcccattctccat

SEQ ID NO: 2663820 - DNA, 13 bp, Homo sapiens
attcttgcatatt

SEQ ID NO: 2663821 - DNA, 16 bp, Homo sapiens
attcttttgtaattta

SEQ ID NO: 2663822 - DNA, 19 bp, Homo sapiens
attgaaggcttaaacccat

SEQ ID NO: 2663823 - DNA, 14 bp, Homo sapiens
attgaatctattta

SEQ ID NO: 2663824 - DNA, 13 bp, Homo sapiens
attgatatttgtg

SEQ ID NO: 2663825 - DNA, 16 bp, Homo sapiens
attgatatttgtgcat

SEQ ID NO: 2663826 - DNA, 18 bp, Homo sapiens
attgatatttgtgcattt

SEQ ID NO: 2663827 - DNA, 19 bp, Homo sapiens
attgtacacaccttatatt

SEQ ID NO: 2663828 - DNA, 15 bp, Homo sapiens
attgtctttttgtat

SEQ ID NO: 2663829 - DNA, 14 bp, Homo sapiens
atttaaaaaaatca

SEQ ID NO: 2663830 - DNA, 16 bp, Homo sapiens
atttacagagaagtga

SEQ ID NO: 2663831 - DNA, 12 bp, Homo sapiens
atttactgtttt

SEQ ID NO: 2663832 - DNA, 16 bp, Homo sapiens
atttataaaaaggtgt

SEQ ID NO: 2663833 - DNA, 21 bp, Homo sapiens
atttcaccactcaaaggccag

SEQ ID NO: 2663834 - DNA, 23 bp, Homo sapiens
atttcaccactcaaaggccagac

SEQ ID NO: 2663835 - DNA, 23 bp, Homo sapiens
atttcattttgtaacaaatgaac

SEQ ID NO: 2663836 - DNA, 15 bp, Homo sapiens
atttccaagagctga

SEQ ID NO: 2663837 - DNA, 21 bp, Homo sapiens
atttcccatcccctgtgggaa

SEQ ID NO: 2663838 - DNA, 23 bp, Homo sapiens
atttcccccaccccatttctctc

SEQ ID NO: 2663839 - DNA, 15 bp, Homo sapiens
atttccccttttgca

SEQ ID NO: 2663840 - DNA, 16 bp, Homo sapiens
atttctctttctttac

SEQ ID NO: 2663841 - DNA, 20 bp, Homo sapiens
atttgtcctctttacatgaa

SEQ ID NO: 2663842 - DNA, 16 bp, Homo sapiens
atttgtgcattttcta

SEQ ID NO: 2663843 - DNA, 21 bp, Homo sapiens
attttaagacgtgtttgtgtt

SEQ ID NO: 2663844 - DNA, 14 bp, Homo sapiens
attttataagaaaa

SEQ ID NO: 2663845 - DNA, 14 bp, Homo sapiens
attttataattctg

SEQ ID NO: 2663846 - DNA, 20 bp, Homo sapiens
attttatgccttttatttct

SEQ ID NO: 2663847 - DNA, 19 bp, Homo sapiens
attttcctctgctttgaaa

SEQ ID NO: 2663848 - DNA, 20 bp, Homo sapiens
aggcatccttcctcacacca

SEQ ID NO: 2663849 - DNA, 13 bp, Homo sapiens
aggccaggccagc

SEQ ID NO: 2663850 - DNA, 14 bp, Homo sapiens
aggccagtgagcca

SEQ ID NO: 2663851 - DNA, 13 bp, Homo sapiens
aggcctcgcagga

SEQ ID NO: 2663852 - DNA, 14 bp, Homo sapiens
aggcctttaaccat

SEQ ID NO: 2663853 - DNA, 14 bp, Homo sapiens
aggctcatttactg

SEQ ID NO: 2663854 - DNA, 15 bp, Homo sapiens
aggctcatttactgt

SEQ ID NO: 2663855 - DNA, 12 bp, Homo sapiens
aggctggcatga

SEQ ID NO: 2663856 - DNA, 18 bp, Homo sapiens
aggctgggcgtagtggct

SEQ ID NO: 2663857 - DNA, 15 bp, Homo sapiens
aggcttgcctgcagg

SEQ ID NO: 2663858 - DNA, 16 bp, Homo sapiens
agggaaaaggggctcc

SEQ ID NO: 2663859 - DNA, 13 bp, Homo sapiens
agggacaaagagg

SEQ ID NO: 2663860 - DNA, 21 bp, Homo sapiens
agggacgaagaagagccacag

SEQ ID NO: 2663861 - DNA, 22 bp, Homo sapiens
agggacgaagaagagccacagt

SEQ ID NO: 2663862 - DNA, 22 bp, Homo sapiens
agggagacctggacacaggcct

SEQ ID NO: 2663863 - DNA, 21 bp, Homo sapiens
agggagcaagtccttcccttt

SEQ ID NO: 2663864 - DNA, 17 bp, Homo sapiens
agggagcattttcctcc

SEQ ID NO: 2663865 - DNA, 17 bp, Homo sapiens
agggagctagccagagg

SEQ ID NO: 2663866 - DNA, 17 bp, Homo sapiens
agggagtgtactcccag

SEQ ID NO: 2663867 - DNA, 18 bp, Homo sapiens
agggagtgtactcccagg

SEQ ID NO: 2663868 - DNA, 20 bp, Homo sapiens
agggccgccagggagacctg

SEQ ID NO: 2663869 - DNA, 23 bp, Homo sapiens
agggccgccagggagacctggac

SEQ ID NO: 2663870 - DNA, 18 bp, Homo sapiens
agggccgggcagaggggc

SEQ ID NO: 2663871 - DNA, 20 bp, Homo sapiens
agggccgggcagaggggcag

SEQ ID NO: 2663872 - DNA, 19 bp, Homo sapiens
agggcgtggaaaggggcag

SEQ ID NO: 2663873 - DNA, 16 bp, Homo sapiens
agggctgcatgatgtt

SEQ ID NO: 2663874 - DNA, 19 bp, Homo sapiens
agggcttacggccctggcc

SEQ ID NO: 2663875 - DNA, 15 bp, Homo sapiens
aggggacccccgccc

SEQ ID NO: 2663876 - DNA, 15 bp, Homo sapiens
aggggaggccttcca

SEQ ID NO: 2663877 - DNA, 19 bp, Homo sapiens
aggggagggtcagccaggg

SEQ ID NO: 2663878 - DNA, 19 bp, Homo sapiens
aggggcagatggaaaggag

SEQ ID NO: 2663879 - DNA, 15 bp, Homo sapiens
agggtcagaaacagg

SEQ ID NO: 2663880 - DNA, 15 bp, Homo sapiens
agggtcagccagggc

SEQ ID NO: 2663881 - DNA, 18 bp, Homo sapiens
agggtcagccagggcctg

SEQ ID NO: 2663882 - DNA, 23 bp, Homo sapiens
agggtcagccagggcctgcgagg

SEQ ID NO: 2663883 - DNA, 20 bp, Homo sapiens
aggtgataaatgtcagtagt

SEQ ID NO: 2663884 - DNA, 14 bp, Homo sapiens
aggtgcagccagag

SEQ ID NO: 2663885 - DNA, 16 bp, Homo sapiens
aggtgcagccagaggc

SEQ ID NO: 2663886 - DNA, 20 bp, Homo sapiens
aggtggaggttgcagtgagc

SEQ ID NO: 2663887 - DNA, 12 bp, Homo sapiens
aggtggccatgc

SEQ ID NO: 2663888 - DNA, 19 bp, Homo sapiens
aggtggccatgcctcagcc

SEQ ID NO: 2663889 - DNA, 15 bp, Homo sapiens
aggtgtgattataaa

SEQ ID NO: 2663890 - DNA, 14 bp, Homo sapiens
aggtttctgaaaat

SEQ ID NO: 2663891 - DNA, 23 bp, Homo sapiens
aggtttctgaaaattaacactgc

SEQ ID NO: 2663892 - DNA, 18 bp, Homo sapiens
agtaaggagttcatttta

SEQ ID NO: 2663893 - DNA, 20 bp, Homo sapiens
agtaatctgagaaacaatga

SEQ ID NO: 2663894 - DNA, 22 bp, Homo sapiens
agtaccaccaaaaaagctgtat

SEQ ID NO: 2663895 - DNA, 20 bp, Homo sapiens
agtactggctgatggagtaa

SEQ ID NO: 2663896 - DNA, 21 bp, Homo sapiens
agtagaaagacagagctggga

SEQ ID NO: 2663897 - DNA, 20 bp, Homo sapiens
agtagcagtagatgcatgta

SEQ ID NO: 2663898 - DNA, 14 bp, Homo sapiens
agtagcatttactg

SEQ ID NO: 2663899 - DNA, 22 bp, Homo sapiens
agtagcatttactgtgtctttg

SEQ ID NO: 2663900 - DNA, 23 bp, Homo sapiens
agtcactgtgagctcccaggtgc

SEQ ID NO: 2663901 - DNA, 19 bp, Homo sapiens
agtcagaattagctgcttc

SEQ ID NO: 2663902 - DNA, 14 bp, Homo sapiens
agtcctctgaatga

SEQ ID NO: 2663903 - DNA, 12 bp, Homo sapiens
agtgaatattca

SEQ ID NO: 2663904 - DNA, 17 bp, Homo sapiens
agtgcaagcccctgctc

SEQ ID NO: 2663905 - DNA, 18 bp, Homo sapiens
agtgcaagcccctgctcc

SEQ ID NO: 2663906 - DNA, 19 bp, Homo sapiens
agtgccccattcttttgta

SEQ ID NO: 2663907 - DNA, 22 bp, Homo sapiens
agtggaaagacagcttctcatc

SEQ ID NO: 2663908 - DNA, 19 bp, Homo sapiens
agtggagaactgggcttgc

SEQ ID NO: 2663909 - DNA, 16 bp, Homo sapiens
agtggcaggacaggaa

SEQ ID NO: 2663910 - DNA, 17 bp, Homo sapiens
agtggctttaatgaata

SEQ ID NO: 2663911 - DNA, 18 bp, Homo sapiens
agtgtggagtcattctca

SEQ ID NO: 2663912 - DNA, 17 bp, Homo sapiens
agttagggaatggcaca

SEQ ID NO: 2663913 - DNA, 16 bp, Homo sapiens
agttcagccaccctga

SEQ ID NO: 2663914 - DNA, 18 bp, Homo sapiens
agttccaaaatgccaaat

SEQ ID NO: 2663915 - DNA, 21 bp, Homo sapiens
agttcgatgggcccaattctt

SEQ ID NO: 2663916 - DNA, 20 bp, Homo sapiens
agttgtgacaacttcctgag

SEQ ID NO: 2663917 - DNA, 23 bp, Homo sapiens
agtttatcgaccagtttgaatct

SEQ ID NO: 2663918 - DNA, 15 bp, Homo sapiens
agtttcaaccatgaa

SEQ ID NO: 2663919 - DNA, 19 bp, Homo sapiens
agtttccttccagcccaga

SEQ ID NO: 2663920 - DNA, 17 bp, Homo sapiens
agttttcacctcgaatt

SEQ ID NO: 2663921 - DNA, 18 bp, Homo sapiens
agttttcccttgaggaaa

SEQ ID NO: 2663922 - DNA, 22 bp, Homo sapiens
agtttttcccagctacaccttt

SEQ ID NO: 2663923 - DNA, 23 bp, Homo sapiens
agtttttcccagctacacctttc

SEQ ID NO: 2663924 - DNA, 12 bp, Homo sapiens
ataaagcaaata

SEQ ID NO: 2663925 - DNA, 24 bp, Homo sapiens
ataaagtgctgcggagcaagagga

SEQ ID NO: 2663926 - DNA, 13 bp, Homo sapiens
ataaataaaacat

SEQ ID NO: 2663927 - DNA, 15 bp, Homo sapiens
ataagaaaaactttt

SEQ ID NO: 2663928 - DNA, 19 bp, Homo sapiens
ataatgtaaacaatatcag

SEQ ID NO: 2663929 - DNA, 19 bp, Homo sapiens
ataattctgggaagcaaaa

SEQ ID NO: 2663930 - DNA, 15 bp, Homo sapiens
atacaacacaaagag

SEQ ID NO: 2663931 - DNA, 16 bp, Homo sapiens
atacaatgatgctatt

SEQ ID NO: 2663932 - DNA, 20 bp, Homo sapiens
atacctgggatactgtgccc

SEQ ID NO: 2663933 - DNA, 19 bp, Homo sapiens
atactgactgagaatataa

SEQ ID NO: 2663934 - DNA, 17 bp, Homo sapiens
atactgtctctttcatg

SEQ ID NO: 2663935 - DNA, 15 bp, Homo sapiens
atactgttgtgcgca

SEQ ID NO: 2663936 - DNA, 16 bp, Homo sapiens
atacttaagcaaaagt

SEQ ID NO: 2663937 - DNA, 21 bp, Homo sapiens
atacttccttatgcttctttc

SEQ ID NO: 2663938 - DNA, 12 bp, Homo sapiens
atacttgctttg

SEQ ID NO: 2663939 - DNA, 19 bp, Homo sapiens
atagaaagtgccagaaagt

SEQ ID NO: 2663940 - DNA, 21 bp, Homo sapiens
atagcttcaccccaatcccag

SEQ ID NO: 2663941 - DNA, 16 bp, Homo sapiens
atagtggggagacttc

SEQ ID NO: 2663942 - DNA, 13 bp, Homo sapiens
atataaacactat

SEQ ID NO: 2663943 - DNA, 15 bp, Homo sapiens
atataaacactatat

SEQ ID NO: 2663944 - DNA, 18 bp, Homo sapiens
atataaataaaacatttt

SEQ ID NO: 2663945 - DNA, 13 bp, Homo sapiens
atatatttgtgta

SEQ ID NO: 2663946 - DNA, 22 bp, Homo sapiens
atatatttgtgtatttaacagg

SEQ ID NO: 2663947 - DNA, 22 bp, Homo sapiens
atatccttctagatcatacaca

SEQ ID NO: 2663948 - DNA, 19 bp, Homo sapiens
atattgggttccattctca

SEQ ID NO: 2663949 - DNA, 16 bp, Homo sapiens
atattgtaaaacaggt

SEQ ID NO: 2663950 - DNA, 14 bp, Homo sapiens
atatttagctccaa

SEQ ID NO: 2663951 - DNA, 12 bp, Homo sapiens
atatttgcacta

SEQ ID NO: 2663952 - DNA, 19 bp, Homo sapiens
atatttggttttcctgtat

SEQ ID NO: 2663953 - DNA, 12 bp, Homo sapiens
atattttgatct

SEQ ID NO: 2663954 - DNA, 16 bp, Homo sapiens
atattttgatcttcaa

SEQ ID NO: 2663955 - DNA, 15 bp, Homo sapiens
atatttttaattaaa

SEQ ID NO: 2663956 - DNA, 23 bp, Homo sapiens
atattttttaaaaatctatattt

SEQ ID NO: 2663957 - DNA, 16 bp, Homo sapiens
atcaaagccacactct

SEQ ID NO: 2663958 - DNA, 23 bp, Homo sapiens
atcaatgtaccttttttggtagt

SEQ ID NO: 2663959 - DNA, 21 bp, Homo sapiens
atcactctgtgtctgagtggc

SEQ ID NO: 2663960 - DNA, 18 bp, Homo sapiens
atcagctccactttcagt

SEQ ID NO: 2663961 - DNA, 15 bp, Homo sapiens
atcagtggatttccc

SEQ ID NO: 2663962 - DNA, 14 bp, Homo sapiens
atcatcaagaaggg

SEQ ID NO: 2663963 - DNA, 18 bp, Homo sapiens
atcatcaagaagggctgc

SEQ ID NO: 2663964 - DNA, 21 bp, Homo sapiens
atcatcaagaagggctgcatg

SEQ ID NO: 2663965 - DNA, 15 bp, Homo sapiens
atcatctttgtgaag

SEQ ID NO: 2663966 - DNA, 22 bp, Homo sapiens
atcattcccttcgacagcattt

SEQ ID NO: 2663967 - DNA, 22 bp, Homo sapiens
atccacttctttcagcagactg

SEQ ID NO: 2663968 - DNA, 17 bp, Homo sapiens
gcccagccaggccccag

SEQ ID NO: 2663969 - DNA, 21 bp, Homo sapiens
gcccaggtgagtcctagagct

SEQ ID NO: 2663970 - DNA, 14 bp, Homo sapiens
gcccagtccttcca

SEQ ID NO: 2663971 - DNA, 22 bp, Homo sapiens
gcccattctacttgctctggac

SEQ ID NO: 2663972 - DNA, 22 bp, Homo sapiens
gccccaggcagggccaaccctt

SEQ ID NO: 2663973 - DNA, 20 bp, Homo sapiens
gcccccgcatcccctgcctc

SEQ ID NO: 2663974 - DNA, 15 bp, Homo sapiens
gcccctttacggaca

SEQ ID NO: 2663975 - DNA, 20 bp, Homo sapiens
gcccctttacggacaccccc

SEQ ID NO: 2663976 - DNA, 18 bp, Homo sapiens
gcccgcggggacattggg

SEQ ID NO: 2663977 - DNA, 19 bp, Homo sapiens
gccctcaaacttgactcta

SEQ ID NO: 2663978 - DNA, 21 bp, Homo sapiens
gccctcccaggctctcaacag

SEQ ID NO: 2663979 - DNA, 20 bp, Homo sapiens
gccctggccttgggccctct

SEQ ID NO: 2663980 - DNA, 17 bp, Homo sapiens
gccctgggatcactgtg

SEQ ID NO: 2663981 - DNA, 20 bp, Homo sapiens
gccctgttgaattttgttct

SEQ ID NO: 2663982 - DNA, 17 bp, Homo sapiens
gccgcaaaccacactgg

SEQ ID NO: 2663983 - DNA, 13 bp, Homo sapiens
gccgggcagaggg

SEQ ID NO: 2663984 - DNA, 16 bp, Homo sapiens
gcctaggccaggtgca

SEQ ID NO: 2663985 - DNA, 17 bp, Homo sapiens
gcctcagccctgaccct

SEQ ID NO: 2663986 - DNA, 14 bp, Homo sapiens
gcctccatcctagt

SEQ ID NO: 2663987 - DNA, 13 bp, Homo sapiens
gcctcccacagac

SEQ ID NO: 2663988 - DNA, 14 bp, Homo sapiens
gcctccctgcctca

SEQ ID NO: 2663989 - DNA, 15 bp, Homo sapiens
gcctcctggcccagg

SEQ ID NO: 2663990 - DNA, 17 bp, Homo sapiens
gcctctggaaagcaaag

SEQ ID NO: 2663991 - DNA, 20 bp, Homo sapiens
gcctgaagagtcctctgaat

SEQ ID NO: 2663992 - DNA, 17 bp, Homo sapiens
gccttgggccctctggt

SEQ ID NO: 2663993 - DNA, 15 bp, Homo sapiens
gccttgttgatgtgg

SEQ ID NO: 2663994 - DNA, 16 bp, Homo sapiens
gcctttggcagagttc

SEQ ID NO: 2663995 - DNA, 18 bp, Homo sapiens
gcgacactgggaggccag

SEQ ID NO: 2663996 - DNA, 17 bp, Homo sapiens
gcgcccagtccttccac

SEQ ID NO: 2663997 - DNA, 18 bp, Homo sapiens
gcgccgcaaaccacactg

SEQ ID NO: 2663998 - DNA, 19 bp, Homo sapiens
gcggacagtggcaggacag

SEQ ID NO: 2663999 - DNA, 16 bp, Homo sapiens
gcggacatcagctggt

SEQ ID NO: 2664000 - DNA, 12 bp, Homo sapiens
gcggagctggcc

SEQ ID NO: 2664001 - DNA, 14 bp, Homo sapiens
gcggagctggcccc

SEQ ID NO: 2664002 - DNA, 16 bp, Homo sapiens
gcggcggagctggccc

SEQ ID NO: 2664003 - DNA, 18 bp, Homo sapiens
gcggcggagctggccccg

SEQ ID NO: 2664004 - DNA, 14 bp, Homo sapiens
gcgggagcctccct

SEQ ID NO: 2664005 - DNA, 22 bp, Homo sapiens
gcgggcgcactgcctctcacag

SEQ ID NO: 2664006 - DNA, 18 bp, Homo sapiens
gcggtgctgtcctcaggt

SEQ ID NO: 2664007 - DNA, 15 bp, Homo sapiens
gcgtgatcaaagcca

SEQ ID NO: 2664008 - DNA, 20 bp, Homo sapiens
gcgtgatcaaagccacactc

SEQ ID NO: 2664009 - DNA, 20 bp, Homo sapiens
caggacctccaagccactga

SEQ ID NO: 2664010 - DNA, 16 bp, Homo sapiens
caggacgtgggctggg

SEQ ID NO: 2664011 - DNA, 20 bp, Homo sapiens
caggagaactcatgttattt

SEQ ID NO: 2664012 - DNA, 15 bp, Homo sapiens
caggagcacacccag

SEQ ID NO: 2664013 - DNA, 23 bp, Homo sapiens
caggagttcgagaccagcctggc

SEQ ID NO: 2664014 - DNA, 15 bp, Homo sapiens
caggagttctgctca

SEQ ID NO: 2664015 - DNA, 16 bp, Homo sapiens
caggagttctgctcat

SEQ ID NO: 2664016 - DNA, 14 bp, Homo sapiens
caggatgaagcatt

SEQ ID NO: 2664017 - DNA, 15 bp, Homo sapiens
caggatgaagcattt

SEQ ID NO: 2664018 - DNA, 16 bp, Homo sapiens
caggattcctcttttc

SEQ ID NO: 2664019 - DNA, 20 bp, Homo sapiens
caggattcctcttttctctg

SEQ ID NO: 2664020 - DNA, 22 bp, Homo sapiens
caggcagctcataagagccaca

SEQ ID NO: 2664021 - DNA, 20 bp, Homo sapiens
caggcagggccaacccttct

SEQ ID NO: 2664022 - DNA, 22 bp, Homo sapiens
caggcagggccaacccttctcc

SEQ ID NO: 2664023 - DNA, 15 bp, Homo sapiens
caggccagctgcctc

SEQ ID NO: 2664024 - DNA, 15 bp, Homo sapiens
caggcggtgggcacc

SEQ ID NO: 2664025 - DNA, 17 bp, Homo sapiens
caggcggtgggcaccca

SEQ ID NO: 2664026 - DNA, 14 bp, Homo sapiens
caggctctcaacag

SEQ ID NO: 2664027 - DNA, 15 bp, Homo sapiens
cagggaaaagcagct

SEQ ID NO: 2664028 - DNA, 19 bp, Homo sapiens
cagggacgaagaagagcca

SEQ ID NO: 2664029 - DNA, 21 bp, Homo sapiens
cagggagcaggcggtgggcac

SEQ ID NO: 2664030 - DNA, 18 bp, Homo sapiens
cagggagctgcaggggca

SEQ ID NO: 2664031 - DNA, 18 bp, Homo sapiens
cagggcacaggccatgga

SEQ ID NO: 2664032 - DNA, 16 bp, Homo sapiens
cagggccgccagggag

SEQ ID NO: 2664033 - DNA, 19 bp, Homo sapiens
caggggagggtcagccagg

SEQ ID NO: 2664034 - DNA, 22 bp, Homo sapiens
caggggagggtcagccagggcc

SEQ ID NO: 2664035 - DNA, 20 bp, Homo sapiens
caggtagaattatctaattt

SEQ ID NO: 2664036 - DNA, 19 bp, Homo sapiens
caggtagacctgtctcctg

SEQ ID NO: 2664037 - DNA, 19 bp, Homo sapiens
caggtattttataattctg

SEQ ID NO: 2664038 - DNA, 14 bp, Homo sapiens
caggtgaattgttt

SEQ ID NO: 2664039 - DNA, 20 bp, Homo sapiens
caggtgagtcctagagctac

SEQ ID NO: 2664040 - DNA, 23 bp, Homo sapiens
caggtgagtcctagagctacagg

SEQ ID NO: 2664041 - DNA, 19 bp, Homo sapiens
caggtggccatgcctcagc

SEQ ID NO: 2664042 - DNA, 19 bp, Homo sapiens
cagtaaaaaaaaaaaatgg

SEQ ID NO: 2664043 - DNA, 20 bp, Homo sapiens
cagtaaaatagctgagggaa

SEQ ID NO: 2664044 - DNA, 14 bp, Homo sapiens
cagtcaattaacaa

SEQ ID NO: 2664045 - DNA, 12 bp, Homo sapiens
cagtccttccac

SEQ ID NO: 2664046 - DNA, 17 bp, Homo sapiens
cagtgagcagagatcac

SEQ ID NO: 2664047 - DNA, 19 bp, Homo sapiens
cagtgcttgattgcgtgga

SEQ ID NO: 2664048 - DNA, 18 bp, Homo sapiens
cagtgtgaataaagtgct

SEQ ID NO: 2664049 - DNA, 21 bp, Homo sapiens
cagtgtgtcgagtcaaaatgt

SEQ ID NO: 2664050 - DNA, 24 bp, Homo sapiens
cagtgttggccatgatgacaacta

SEQ ID NO: 2664051 - DNA, 22 bp, Homo sapiens
cagttcatgtatgttcagaaga

SEQ ID NO: 2664052 - DNA, 15 bp, Homo sapiens
cagttcctttcaatg

SEQ ID NO: 2664053 - DNA, 22 bp, Homo sapiens
cagttggtgttcaaatagcact

SEQ ID NO: 2664054 - DNA, 13 bp, Homo sapiens
cataaagcaaata

SEQ ID NO: 2664055 - DNA, 20 bp, Homo sapiens
cataacagattttttttgga

SEQ ID NO: 2664056 - DNA, 22 bp, Homo sapiens
cataaccatgtgaaaaggcaaa

SEQ ID NO: 2664057 - DNA, 13 bp, Homo sapiens
cataatttcagct

SEQ ID NO: 2664058 - DNA, 15 bp, Homo sapiens
catacttaagcaaaa

SEQ ID NO: 2664059 - DNA, 18 bp, Homo sapiens
catatattgggttccatt

SEQ ID NO: 2664060 - DNA, 17 bp, Homo sapiens
catatccgtatatatcc

SEQ ID NO: 2664061 - DNA, 14 bp, Homo sapiens
catattaatacaat

SEQ ID NO: 2664062 - DNA, 23 bp, Homo sapiens
catattaatacaatgatgctatt

SEQ ID NO: 2664063 - DNA, 13 bp, Homo sapiens
catattgtaaaac

SEQ ID NO: 2664064 - DNA, 16 bp, Homo sapiens
catattgtaaaacagg

SEQ ID NO: 2664065 - DNA, 20 bp, Homo sapiens
catcaagaagggctgcatga

SEQ ID NO: 2664066 - DNA, 13 bp, Homo sapiens
catcccctgcctc

SEQ ID NO: 2664067 - DNA, 15 bp, Homo sapiens
catccttccctgtct

SEQ ID NO: 2664068 - DNA, 22 bp, Homo sapiens
catccttccctgtctgccaggg

SEQ ID NO: 2664069 - DNA, 13 bp, Homo sapiens
catcgcactgtgg

SEQ ID NO: 2664070 - DNA, 16 bp, Homo sapiens
catcgccagctgatga

SEQ ID NO: 2664071 - DNA, 21 bp, Homo sapiens
catcgccagctgatgactcaa

SEQ ID NO: 2664072 - DNA, 15 bp, Homo sapiens
ccctagtaaaaatac

SEQ ID NO: 2664073 - DNA, 15 bp, Homo sapiens
ccctgccctcccctc

SEQ ID NO: 2664074 - DNA, 16 bp, Homo sapiens
ccctgcctcaggcctc

SEQ ID NO: 2664075 - DNA, 22 bp, Homo sapiens
ccctggtgagagggccgggcag

SEQ ID NO: 2664076 - DNA, 18 bp, Homo sapiens
cccttctcctcttgtaaa

SEQ ID NO: 2664077 - DNA, 21 bp, Homo sapiens
ccgcaaaccacactggactcc

SEQ ID NO: 2664078 - DNA, 15 bp, Homo sapiens
ccgcatcccctgcct

SEQ ID NO: 2664079 - DNA, 16 bp, Homo sapiens
ccgcatcccctgcctc

SEQ ID NO: 2664080 - DNA, 16 bp, Homo sapiens
ccgccccctgccctcc

SEQ ID NO: 2664081 - DNA, 17 bp, Homo sapiens
ccgcgtcgccctcccag

SEQ ID NO: 2664082 - DNA, 19 bp, Homo sapiens
ccgcgtcgccctcccaggc

SEQ ID NO: 2664083 - DNA, 18 bp, Homo sapiens
cctaaaagcacactcatc

SEQ ID NO: 2664084 - DNA, 23 bp, Homo sapiens
cctaagcaaacccagtgtcagga

SEQ ID NO: 2664085 - DNA, 15 bp, Homo sapiens
cctaggccaggtgca

SEQ ID NO: 2664086 - DNA, 15 bp, Homo sapiens
cctattctttcgaaa

SEQ ID NO: 2664087 - DNA, 12 bp, Homo sapiens
cctatttctctt

SEQ ID NO: 2664088 - DNA, 15 bp, Homo sapiens
cctatttctctttct

SEQ ID NO: 2664089 - DNA, 16 bp, Homo sapiens
cctatttctctttctt

SEQ ID NO: 2664090 - DNA, 11 bp, Homo sapiens
cctcacacagc

SEQ ID NO: 2664091 - DNA, 14 bp, Homo sapiens
cctcagagtgcaag

SEQ ID NO: 2664092 - DNA, 15 bp, Homo sapiens
cctcagccctgaccc

SEQ ID NO: 2664093 - DNA, 16 bp, Homo sapiens
cctcagccctgaccct

SEQ ID NO: 2664094 - DNA, 18 bp, Homo sapiens
cctcagccctgaccctgt

SEQ ID NO: 2664095 - DNA, 14 bp, Homo sapiens
cctcaggcctctgt

SEQ ID NO: 2664096 - DNA, 18 bp, Homo sapiens
cctcaggtggccatgcct

SEQ ID NO: 2664097 - DNA, 13 bp, Homo sapiens
cctcccactgggg

SEQ ID NO: 2664098 - DNA, 15 bp, Homo sapiens
cctcccactggggtc

SEQ ID NO: 2664099 - DNA, 20 bp, Homo sapiens
cctccgcgtgatcaaagcca

SEQ ID NO: 2664100 - DNA, 13 bp, Homo sapiens
cctcgaattttgt

SEQ ID NO: 2664101 - DNA, 12 bp, Homo sapiens
cctcgcttggac

SEQ ID NO: 2664102 - DNA, 17 bp, Homo sapiens
cctcgttctccctggga

SEQ ID NO: 2664103 - DNA, 18 bp, Homo sapiens
cctcgttctccctgggag

SEQ ID NO: 2664104 - DNA, 12 bp, Homo sapiens
cctctcccaggg

SEQ ID NO: 2664105 - DNA, 21 bp, Homo sapiens
cctctccctgaccctgtatat

SEQ ID NO: 2664106 - DNA, 20 bp, Homo sapiens
cctctgaatgaaccttctgg

SEQ ID NO: 2664107 - DNA, 14 bp, Homo sapiens
cctctgctttgaaa

SEQ ID NO: 2664108 - DNA, 12 bp, Homo sapiens
cctcttgtaaat

SEQ ID NO: 2664109 - DNA, 21 bp, Homo sapiens
cctgaagagtcctctgaatga

SEQ ID NO: 2664110 - DNA, 17 bp, Homo sapiens
cctgaccctgtatatag

SEQ ID NO: 2664111 - DNA, 22 bp, Homo sapiens
cctgagggatctatacttgctt

SEQ ID NO: 2664112 - DNA, 19 bp, Homo sapiens
cctgataagcttcaaagct

SEQ ID NO: 2664113 - DNA, 18 bp, Homo sapiens
cctgcaggccaggccagc

SEQ ID NO: 2664114 - DNA, 19 bp, Homo sapiens
cctgcccccgcatcccctg

SEQ ID NO: 2664115 - DNA, 23 bp, Homo sapiens
cctgcccccgcatcccctgcctc

SEQ ID NO: 2664116 - DNA, 17 bp, Homo sapiens
cctgcctccatcctagt

SEQ ID NO: 2664117 - DNA, 19 bp, Homo sapiens
cctgcgagggcagcgggag

SEQ ID NO: 2664118 - DNA, 20 bp, Homo sapiens
cctgcgcccagtccttccac

SEQ ID NO: 2664119 - DNA, 21 bp, Homo sapiens
cctgctgtaaatttggcttct

SEQ ID NO: 2664120 - DNA, 20 bp, Homo sapiens
cctggacacaggcctgctct

SEQ ID NO: 2664121 - DNA, 15 bp, Homo sapiens
cctggactagaggga

SEQ ID NO: 2664122 - DNA, 15 bp, Homo sapiens
cctggaggagcagag

SEQ ID NO: 2664123 - DNA, 21 bp, Homo sapiens
cctggggtggggatagggagc

SEQ ID NO: 2664124 - DNA, 23 bp, Homo sapiens
cctgggtccaggggaggccttcc

SEQ ID NO: 2664125 - DNA, 16 bp, Homo sapiens
cctggtactcaagccc

SEQ ID NO: 2664126 - DNA, 21 bp, Homo sapiens
cctggtgagagggccgggcag

SEQ ID NO: 2664127 - DNA, 13 bp, Homo sapiens
cctgtatatagcc

SEQ ID NO: 2664128 - DNA, 16 bp, Homo sapiens
cctgtatatagcccag

SEQ ID NO: 2664129 - DNA, 15 bp, Homo sapiens
cctgtctgccagggc

SEQ ID NO: 2664130 - DNA, 23 bp, Homo sapiens
cctgttgaattttgttctctggg

SEQ ID NO: 2664131 - DNA, 16 bp, Homo sapiens
ccttatctccaagacc

SEQ ID NO: 2664132 - DNA, 19 bp, Homo sapiens
ccttatgcttctttcaaat

SEQ ID NO: 2664133 - DNA, 13 bp, Homo sapiens
ccttccagcccag

SEQ ID NO: 2664134 - DNA, 14 bp, Homo sapiens
ccttccagcccaga

SEQ ID NO: 2664135 - DNA, 18 bp, Homo sapiens
ccttccctgtctgccagg

SEQ ID NO: 2664136 - DNA, 16 bp, Homo sapiens
ccttcgacagcatttt

SEQ ID NO: 2664137 - DNA, 15 bp, Homo sapiens
ccttctcctcttgta

SEQ ID NO: 2664138 - DNA, 18 bp, Homo sapiens
ccttgagaagattcttcc

SEQ ID NO: 2664139 - DNA, 17 bp, Homo sapiens
ccttgggccctctggtt

SEQ ID NO: 2664140 - DNA, 17 bp, Homo sapiens
ccttgtctgaactggag

SEQ ID NO: 2664141 - DNA, 16 bp, Homo sapiens
cgaagaagagccacag

SEQ ID NO: 2664142 - DNA, 17 bp, Homo sapiens
cgaagaagagccacagt

SEQ ID NO: 2664143 - DNA, 13 bp, Homo sapiens
cgagaccagcctg

SEQ ID NO: 2664144 - DNA, 14 bp, Homo sapiens
cgagaccagcctgg

SEQ ID NO: 2664145 - DNA, 16 bp, Homo sapiens
cgcaaaccacactgga

SEQ ID NO: 2664146 - DNA, 23 bp, Homo sapiens
cgcaccgaaaaactaaaaataat

SEQ ID NO: 2664147 - DNA, 18 bp, Homo sapiens
cgcaggagcacacccagc

SEQ ID NO: 2664148 - DNA, 18 bp, Homo sapiens
cgcatcccctgcctccat

SEQ ID NO: 2664149 - DNA, 13 bp, Homo sapiens
cgccagctgatga

SEQ ID NO: 2664150 - DNA, 15 bp, Homo sapiens
cgccagctgatgact

SEQ ID NO: 2664151 - DNA, 20 bp, Homo sapiens
cgccagctgatgactcaaga

SEQ ID NO: 2664152 - DNA, 16 bp, Homo sapiens
cgccagggagacctgg

SEQ ID NO: 2664153 - DNA, 12 bp, Homo sapiens
cgccccctgccc

SEQ ID NO: 2664154 - DNA, 19 bp, Homo sapiens
cgccccctgccctcccctc

SEQ ID NO: 2664155 - DNA, 13 bp, Homo sapiens
cgccctcccaggc

SEQ ID NO: 2664156 - DNA, 19 bp, Homo sapiens
cgccgcaaaccacactgga

SEQ ID NO: 2664157 - DNA, 15 bp, Homo sapiens
cgccgcctggtactc

SEQ ID NO: 2664158 - DNA, 23 bp, Homo sapiens
cgctgtccctagtaaaaatacaa

SEQ ID NO: 2664159 - DNA, 13 bp, Homo sapiens
cgcttgagaaaaa

SEQ ID NO: 2664160 - DNA, 15 bp, Homo sapiens
cgggagcctccctgc

SEQ ID NO: 2664161 - DNA, 17 bp, Homo sapiens
cgggagcctccctgcct

SEQ ID NO: 2664162 - DNA, 18 bp, Homo sapiens
cgggcgcactgcctctca

SEQ ID NO: 2664163 - DNA, 22 bp, Homo sapiens
cggggagggtgacagtggccgc

SEQ ID NO: 2664164 - DNA, 17 bp, Homo sapiens
cggtgctgtcctcaggt

SEQ ID NO: 2664165 - DNA, 21 bp, Homo sapiens
cggtgctgtcctcaggtggcc

SEQ ID NO: 2664166 - DNA, 22 bp, Homo sapiens
cggtgctgtcctcaggtggcca

SEQ ID NO: 2664167 - DNA, 20 bp, Homo sapiens
cggtggctcacgcctgtaat

SEQ ID NO: 2664168 - DNA, 19 bp, Homo sapiens
cggtgggcacccaccctgg

SEQ ID NO: 2664169 - DNA, 21 bp, Homo sapiens
cggttcctcgttctccctggg

SEQ ID NO: 2664170 - DNA, 11 bp, Homo sapiens
cgtcaacaaat

SEQ ID NO: 2664171 - DNA, 22 bp, Homo sapiens
cgtgggctgggcccacaaaggc

SEQ ID NO: 2664172 - DNA, 12 bp, Homo sapiens
cgtgtttgtgtt

SEQ ID NO: 2664173 - DNA, 16 bp, Homo sapiens
ctaaaaaacaaaacaa

SEQ ID NO: 2664174 - DNA, 12 bp, Homo sapiens
ctaaaagcacac

SEQ ID NO: 2664175 - DNA, 22 bp, Homo sapiens
ctaagctggagtgcttatccct

SEQ ID NO: 2664176 - DNA, 12 bp, Homo sapiens
ctaatacaccag

SEQ ID NO: 2664177 - DNA, 18 bp, Homo sapiens
ctaatagactaaatgaaa

SEQ ID NO: 2664178 - DNA, 20 bp, Homo sapiens
ctaatagactaaatgaaatc

SEQ ID NO: 2664179 - DNA, 18 bp, Homo sapiens
ctaatgtctgtatcactc

SEQ ID NO: 2664180 - DNA, 13 bp, Homo sapiens
ctaatttataaaa

SEQ ID NO: 2664181 - DNA, 14 bp, Homo sapiens
ctaatttataaaaa

SEQ ID NO: 2664182 - DNA, 17 bp, Homo sapiens
ctaatttataaaaaggt

SEQ ID NO: 2664183 - DNA, 16 bp, Homo sapiens
ctacaaaaattaactg

SEQ ID NO: 2664184 - DNA, 18 bp, Homo sapiens
ctacacctttctcctttg

SEQ ID NO: 2664185 - DNA, 23 bp, Homo sapiens
ctacagaaaaaccagaggcagct

SEQ ID NO: 2664186 - DNA, 15 bp, Homo sapiens
ctacccgcagagttc

SEQ ID NO: 2664187 - DNA, 13 bp, Homo sapiens
ctaccctcacaat

SEQ ID NO: 2664188 - DNA, 17 bp, Homo sapiens
ctactcaagtagcattt

SEQ ID NO: 2664189 - DNA, 13 bp, Homo sapiens
ctggactccggcc

SEQ ID NO: 2664190 - DNA, 21 bp, Homo sapiens
ctggactgacctggtccacag

SEQ ID NO: 2664191 - DNA, 15 bp, Homo sapiens
ctggagtgaggaaaa

SEQ ID NO: 2664192 - DNA, 12 bp, Homo sapiens
ctggccccgccg

SEQ ID NO: 2664193 - DNA, 22 bp, Homo sapiens
ctggccccgccgcctggtactc

SEQ ID NO: 2664194 - DNA, 17 bp, Homo sapiens
ctggcctcccacagact

SEQ ID NO: 2664195 - DNA, 20 bp, Homo sapiens
ctggccttgggccctctggt

SEQ ID NO: 2664196 - DNA, 13 bp, Homo sapiens
ctggcttctctga

SEQ ID NO: 2664197 - DNA, 19 bp, Homo sapiens
ctggctttttattgtattt

SEQ ID NO: 2664198 - DNA, 12 bp, Homo sapiens
ctgggagaaaat

SEQ ID NO: 2664199 - DNA, 17 bp, Homo sapiens
ctgggagaaaatcatca

SEQ ID NO: 2664200 - DNA, 19 bp, Homo sapiens
ctgggagaaaatcatcaag

SEQ ID NO: 2664201 - DNA, 16 bp, Homo sapiens
ctgggcacacgcctcc

SEQ ID NO: 2664202 - DNA, 20 bp, Homo sapiens
ctgggccatgttgtgcctcc

SEQ ID NO: 2664203 - DNA, 18 bp, Homo sapiens
ctgggcctggcagctcag

SEQ ID NO: 2664204 - DNA, 20 bp, Homo sapiens
ctggggtggggatagggagc

SEQ ID NO: 2664205 - DNA, 23 bp, Homo sapiens
ctggtgagagggccgggcagagg

SEQ ID NO: 2664206 - DNA, 19 bp, Homo sapiens
ctggttaggatggcaggac

SEQ ID NO: 2664207 - DNA, 23 bp, Homo sapiens
ctgtaccatgtgctacaggggcc

SEQ ID NO: 2664208 - DNA, 15 bp, Homo sapiens
ctgtatcagtggatt

SEQ ID NO: 2664209 - DNA, 17 bp, Homo sapiens
ctgtcactgctctggac

SEQ ID NO: 2664210 - DNA, 24 bp, Homo sapiens
ctgtcactgctctggactgtgtgg

SEQ ID NO: 2664211 - DNA, 13 bp, Homo sapiens
ctgtccaggctcg

SEQ ID NO: 2664212 - DNA, 21 bp, Homo sapiens
ctgtccctagtaaaaatacaa

SEQ ID NO: 2664213 - DNA, 18 bp, Homo sapiens
ctgtcctcaggtggccat

SEQ ID NO: 2664214 - DNA, 17 bp, Homo sapiens
ctgtcctccaagccagc

SEQ ID NO: 2664215 - DNA, 18 bp, Homo sapiens
ctgtctaaaaaacaaaac

SEQ ID NO: 2664216 - DNA, 14 bp, Homo sapiens
ctgtctgccagggc

SEQ ID NO: 2664217 - DNA, 15 bp, Homo sapiens
ctgtgaattgagctg

SEQ ID NO: 2664218 - DNA, 19 bp, Homo sapiens
ctgtgaattgagctgcaga

SEQ ID NO: 2664219 - DNA, 22 bp, Homo sapiens
ctgtgattgggcgtagaagtgg

SEQ ID NO: 2664220 - DNA, 15 bp, Homo sapiens
ctgtgcctccatcag

SEQ ID NO: 2664221 - DNA, 21 bp, Homo sapiens
ctgtggggaaccaattgcttt

SEQ ID NO: 2664222 - DNA, 18 bp, Homo sapiens
ctgttgtcaccttcacct

SEQ ID NO: 2664223 - DNA, 17 bp, Homo sapiens
ctgttttgtaaagtccc

SEQ ID NO: 2664224 - DNA, 11 bp, Homo sapiens
cttacacccac

SEQ ID NO: 2664225 - DNA, 20 bp, Homo sapiens
cttacacccacagtggaaag

SEQ ID NO: 2664226 - DNA, 15 bp, Homo sapiens
cttacggccctggcc

SEQ ID NO: 2664227 - DNA, 17 bp, Homo sapiens
cttataggaaagcttga

SEQ ID NO: 2664228 - DNA, 19 bp, Homo sapiens
cttatcaagagttgtgaca

SEQ ID NO: 2664229 - DNA, 17 bp, Homo sapiens
cttatcccttctttttc

SEQ ID NO: 2664230 - DNA, 22 bp, Homo sapiens
cttcaaccagggattgtttctg

SEQ ID NO: 2664231 - DNA, 16 bp, Homo sapiens
cttcacctcctttcaa

SEQ ID NO: 2664232 - DNA, 21 bp, Homo sapiens
cttcacgtagaacattggtat

SEQ ID NO: 2664233 - DNA, 14 bp, Homo sapiens
cttcactcctgctg

SEQ ID NO: 2664234 - DNA, 15 bp, Homo sapiens
cttcactcctgctgt

SEQ ID NO: 2664235 - DNA, 17 bp, Homo sapiens
cttcactgtcctccaag

SEQ ID NO: 2664236 - DNA, 19 bp, Homo sapiens
cttccagggacgaagaaga

SEQ ID NO: 2664237 - DNA, 22 bp, Homo sapiens
cttccagggacgaagaagagcc

SEQ ID NO: 2664238 - DNA, 18 bp, Homo sapiens
cttccccaacacgcagga

SEQ ID NO: 2664239 - DNA, 22 bp, Homo sapiens
cttccccaccccagtttttgtt

SEQ ID NO: 2664240 - DNA, 17 bp, Homo sapiens
cttccttgcttaaggta

SEQ ID NO: 2664241 - DNA, 13 bp, Homo sapiens
cttccttggcttt

SEQ ID NO: 2664242 - DNA, 17 bp, Homo sapiens
cttcgacagcattttcc

SEQ ID NO: 2664243 - DNA, 19 bp, Homo sapiens
cttcgggctggccatctgg

SEQ ID NO: 2664244 - DNA, 13 bp, Homo sapiens
cttctaggaagct

SEQ ID NO: 2664245 - DNA, 16 bp, Homo sapiens
cttctatatattgtat

SEQ ID NO: 2664246 - DNA, 12 bp, Homo sapiens
cttctcagccac

SEQ ID NO: 2664247 - DNA, 17 bp, Homo sapiens
cttctcatcctgcaggc

SEQ ID NO: 2664248 - DNA, 19 bp, Homo sapiens
cttctggcctcccacagac

SEQ ID NO: 2664249 - DNA, 19 bp, Homo sapiens
cttctgttgtcaccttcac

SEQ ID NO: 2664250 - DNA, 21 bp, Homo sapiens
cttcttctacttcagtcttct

SEQ ID NO: 2664251 - DNA, 16 bp, Homo sapiens
cttgacagaacactgt

SEQ ID NO: 2664252 - DNA, 19 bp, Homo sapiens
cttgactctactgatctga

SEQ ID NO: 2664253 - DNA, 17 bp, Homo sapiens
cttgagaagattcttcc

SEQ ID NO: 2664254 - DNA, 13 bp, Homo sapiens
cttgaggaaacaa

SEQ ID NO: 2664255 - DNA, 20 bp, Homo sapiens
cttgaggaaacaacagcttt

SEQ ID NO: 2664256 - DNA, 18 bp, Homo sapiens
cttgccgcgtcgccctcc

SEQ ID NO: 2664257 - DNA, 15 bp, Homo sapiens
cttgctctggacctg

SEQ ID NO: 2664258 - DNA, 21 bp, Homo sapiens
cttggcacccaagacctcagg

SEQ ID NO: 2664259 - DNA, 17 bp, Homo sapiens
cttgggtcccagggaag

SEQ ID NO: 2664260 - DNA, 14 bp, Homo sapiens
cttgtagccttttg

SEQ ID NO: 2664261 - DNA, 22 bp, Homo sapiens
cttgtataggttttaaagacct

SEQ ID NO: 2664262 - DNA, 18 bp, Homo sapiens
cttgttaatgctttctga

SEQ ID NO: 2664263 - DNA, 22 bp, Homo sapiens
ctttacaagatgggtccaggat

SEQ ID NO: 2664264 - DNA, 18 bp, Homo sapiens
ctttacggacaccccctc

SEQ ID NO: 2664265 - DNA, 20 bp, Homo sapiens
ctttagaaaggttttgagca

SEQ ID NO: 2664266 - DNA, 21 bp, Homo sapiens
ctttatgtacaggatgctttg

SEQ ID NO: 2664267 - DNA, 21 bp, Homo sapiens
ctttcaatggtttgcaaggaa

SEQ ID NO: 2664268 - DNA, 16 bp, Homo sapiens
ctttcacaaaaaagaa

SEQ ID NO: 2664269 - DNA, 18 bp, Homo sapiens
ctttcataatctttgctt

SEQ ID NO: 2664270 - DNA, 17 bp, Homo sapiens
ctttgaggttgctttgt

SEQ ID NO: 2664271 - DNA, 15 bp, Homo sapiens
ctttggaagaaaaaa

SEQ ID NO: 2664272 - DNA, 14 bp, Homo sapiens
ctttggcagagttc

SEQ ID NO: 2664273 - DNA, 20 bp, Homo sapiens
ctttggggcttttacaccag

SEQ ID NO: 2664274 - DNA, 19 bp, Homo sapiens
ctttggttatatttagctc

SEQ ID NO: 2664275 - DNA, 14 bp, Homo sapiens
ctttgtactttgtg

SEQ ID NO: 2664276 - DNA, 16 bp, Homo sapiens
cttttagcagtaaaat

SEQ ID NO: 2664277 - DNA, 18 bp, Homo sapiens
cttttgaacccaggagtt

SEQ ID NO: 2664278 - DNA, 20 bp, Homo sapiens
cttttgaacccaggagttca

SEQ ID NO: 2664279 - DNA, 12 bp, Homo sapiens
cttttgtaattt

SEQ ID NO: 2664280 - DNA, 14 bp, Homo sapiens
ctttttattgaatc

SEQ ID NO: 2664281 - DNA, 19 bp, Homo sapiens
ctttttattgaatctattt

SEQ ID NO: 2664282 - DNA, 22 bp, Homo sapiens
ctttttgattacagtgtagctt

SEQ ID NO: 2664283 - DNA, 15 bp, Homo sapiens
ctttttttctactgt

SEQ ID NO: 2664284 - DNA, 15 bp, Homo sapiens
ctttttttctttggt

SEQ ID NO: 2664285 - DNA, 15 bp, Homo sapiens
cttttttttgtatgt

SEQ ID NO: 2664286 - DNA, 11 bp, Homo sapiens
gaaaaatggag

SEQ ID NO: 2664287 - DNA, 20 bp, Homo sapiens
gaaaacaggacttaaaatga

SEQ ID NO: 2664288 - DNA, 20 bp, Homo sapiens
gaaaagcggacatcagctgg

SEQ ID NO: 2664289 - DNA, 11 bp, Homo sapiens
gaaaaggcagg

SEQ ID NO: 2664290 - DNA, 19 bp, Homo sapiens
gaaaatattttgatcttca

SEQ ID NO: 2664291 - DNA, 15 bp, Homo sapiens
gaaaatcatcaagaa

SEQ ID NO: 2664292 - DNA, 20 bp, Homo sapiens
gaaaatcatcaagaagggct

SEQ ID NO: 2664293 - DNA, 18 bp, Homo sapiens
gaaaatgcaacaacatgt

SEQ ID NO: 2664294 - DNA, 13 bp, Homo sapiens
gaaaattaacact

SEQ ID NO: 2664295 - DNA, 17 bp, Homo sapiens
gaaagaatttcatatgc

SEQ ID NO: 2664296 - DNA, 16 bp, Homo sapiens
gaaagacagcttctca

SEQ ID NO: 2664297 - DNA, 14 bp, Homo sapiens
gaaagcgcagatgc

SEQ ID NO: 2664298 - DNA, 19 bp, Homo sapiens
gaaaggagcctaggccagg

SEQ ID NO: 2664299 - DNA, 22 bp, Homo sapiens
gaaaggagcctaggccaggtgc

SEQ ID NO: 2664300 - DNA, 13 bp, Homo sapiens
gaaaggttttgag

SEQ ID NO: 2664301 - DNA, 16 bp, Homo sapiens
gaaagtgccagaaagt

SEQ ID NO: 2664302 - DNA, 15 bp, Homo sapiens
gaaatatacacacag

SEQ ID NO: 2664303 - DNA, 17 bp, Homo sapiens
gaaatatacacacagca

SEQ ID NO: 2664304 - DNA, 14 bp, Homo sapiens
gaaatgcaaaaatc

SEQ ID NO: 2664305 - DNA, 19 bp, Homo sapiens
gaaattcaacgttaataat

SEQ ID NO: 2664306 - DNA, 23 bp, Homo sapiens
gaaattcaacgttaataattctg

SEQ ID NO: 2664307 - DNA, 13 bp, Homo sapiens
gatgccctgccct

SEQ ID NO: 2664308 - DNA, 13 bp, Homo sapiens
gatgctatttgca

SEQ ID NO: 2664309 - DNA, 15 bp, Homo sapiens
gatggatttgtatca

SEQ ID NO: 2664310 - DNA, 20 bp, Homo sapiens
gatggcccattctacttgct

SEQ ID NO: 2664311 - DNA, 23 bp, Homo sapiens
gatgttctactttgttctgctgt

SEQ ID NO: 2664312 - DNA, 14 bp, Homo sapiens
gatgtttgcccaaa

SEQ ID NO: 2664313 - DNA, 18 bp, Homo sapiens
gatgtttgcccaaaattt

SEQ ID NO: 2664314 - DNA, 18 bp, Homo sapiens
gattaatatggggatgca

SEQ ID NO: 2664315 - DNA, 15 bp, Homo sapiens
gattaattcctttcc

SEQ ID NO: 2664316 - DNA, 15 bp, Homo sapiens
gattcctgagccagt

SEQ ID NO: 2664317 - DNA, 22 bp, Homo sapiens
gatttcccatcccctgtgggaa

SEQ ID NO: 2664318 - DNA, 17 bp, Homo sapiens
gatttccccttttgcat

SEQ ID NO: 2664319 - DNA, 20 bp, Homo sapiens
gcaaaccacactggactccg

SEQ ID NO: 2664320 - DNA, 22 bp, Homo sapiens
gcaaagactattcccttctaac

SEQ ID NO: 2664321 - DNA, 22 bp, Homo sapiens
gcaaagggtccagaaggagaca

SEQ ID NO: 2664322 - DNA, 15 bp, Homo sapiens
gcaagcccctgctcc

SEQ ID NO: 2664323 - DNA, 16 bp, Homo sapiens
gcaagggttccctcaa

SEQ ID NO: 2664324 - DNA, 18 bp, Homo sapiens
gcaagggttccctcaaga

SEQ ID NO: 2664325 - DNA, 16 bp, Homo sapiens
gcaattcctgctccta

SEQ ID NO: 2664326 - DNA, 16 bp, Homo sapiens
gcacaaagggcccaga

SEQ ID NO: 2664327 - DNA, 14 bp, Homo sapiens
gcacaaagtggcat

SEQ ID NO: 2664328 - DNA, 17 bp, Homo sapiens
gcacacgcctcccactg

SEQ ID NO: 2664329 - DNA, 20 bp, Homo sapiens
gcacactcatcccctcactt

SEQ ID NO: 2664330 - DNA, 17 bp, Homo sapiens
gcacccaagacctcagg

SEQ ID NO: 2664331 - DNA, 21 bp, Homo sapiens
gcacccaagacctcagggcac

SEQ ID NO: 2664332 - DNA, 17 bp, Homo sapiens
gcacccaccctgggacc

SEQ ID NO: 2664333 - DNA, 15 bp, Homo sapiens
gcactaagatatttc

SEQ ID NO: 2664334 - DNA, 17 bp, Homo sapiens
gcactgaaaaaaaatct

SEQ ID NO: 2664335 - DNA, 16 bp, Homo sapiens
gcactgcctctcacag

SEQ ID NO: 2664336 - DNA, 19 bp, Homo sapiens
gcactgcctctcacagctg

SEQ ID NO: 2664337 - DNA, 19 bp, Homo sapiens
gcagaggggcagatggaaa

SEQ ID NO: 2664338 - DNA, 13 bp, Homo sapiens
gcagatgcaatga

SEQ ID NO: 2664339 - DNA, 19 bp, Homo sapiens
gcagatgcaatgactcagg

SEQ ID NO: 2664340 - DNA, 17 bp, Homo sapiens
gcagatggaaaggagcc

SEQ ID NO: 2664341 - DNA, 14 bp, Homo sapiens
gcagccagaggcac

SEQ ID NO: 2664342 - DNA, 15 bp, Homo sapiens
gcagctcagcttccc

SEQ ID NO: 2664343 - DNA, 15 bp, Homo sapiens
gcaggccaggccagc

SEQ ID NO: 2664344 - DNA, 14 bp, Homo sapiens
gcaggcggtgggca

SEQ ID NO: 2664345 - DNA, 13 bp, Homo sapiens
gcagtgagcagag

SEQ ID NO: 2664346 - DNA, 18 bp, Homo sapiens
gcagtggaggtagaatga

SEQ ID NO: 2664347 - DNA, 20 bp, Homo sapiens
gcagtggaggtagaatgact

SEQ ID NO: 2664348 - DNA, 23 bp, Homo sapiens
gcatatattgggttccattctca

SEQ ID NO: 2664349 - DNA, 14 bp, Homo sapiens
gcatattttgtaac

SEQ ID NO: 2664350 - DNA, 13 bp, Homo sapiens
gcatcccctgcct

SEQ ID NO: 2664351 - DNA, 17 bp, Homo sapiens
gcatcccctgcctccat

SEQ ID NO: 2664352 - DNA, 23 bp, Homo sapiens
gcatgatccaagcaagactgagg

SEQ ID NO: 2664353 - DNA, 16 bp, Homo sapiens
gcatgatctgaaaaat

SEQ ID NO: 2664354 - DNA, 13 bp, Homo sapiens
gcatgatgtttgc

SEQ ID NO: 2664355 - DNA, 22 bp, Homo sapiens
gcattgtgtgtgcagacttcag

SEQ ID NO: 2664356 - DNA, 23 bp, Homo sapiens
gcattttgtatttgtctaactgg

SEQ ID NO: 2664357 - DNA, 15 bp, Homo sapiens
gccaaaagctgctca

SEQ ID NO: 2664358 - DNA, 17 bp, Homo sapiens
gccaaggctctgtttat

SEQ ID NO: 2664359 - DNA, 19 bp, Homo sapiens
gccactgcataccaacctg

SEQ ID NO: 2664360 - DNA, 20 bp, Homo sapiens
gccagaagatgaacagactg

SEQ ID NO: 2664361 - DNA, 14 bp, Homo sapiens
gccagacctgcaga

SEQ ID NO: 2664362 - DNA, 19 bp, Homo sapiens
gccagcgggaatggcagct

SEQ ID NO: 2664363 - DNA, 16 bp, Homo sapiens
gccagctgatgactca

SEQ ID NO: 2664364 - DNA, 17 bp, Homo sapiens
gccagctgatgactcaa

SEQ ID NO: 2664365 - DNA, 13 bp, Homo sapiens
gccaggccagctg

SEQ ID NO: 2664366 - DNA, 13 bp, Homo sapiens
gccaggccccagg

SEQ ID NO: 2664367 - DNA, 14 bp, Homo sapiens
gccaggccccaggc

SEQ ID NO: 2664368 - DNA, 13 bp, Homo sapiens
gccagggcctgcg

SEQ ID NO: 2664369 - DNA, 19 bp, Homo sapiens
gccagtgatgctaaaggtt

SEQ ID NO: 2664370 - DNA, 20 bp, Homo sapiens
gccagtgatgctaaaggttg

SEQ ID NO: 2664371 - DNA, 23 bp, Homo sapiens
gccatctggttaggatggcagga

SEQ ID NO: 2664372 - DNA, 23 bp, Homo sapiens
gccatggatggaaaacgctctct

SEQ ID NO: 2664373 - DNA, 20 bp, Homo sapiens
gccatgttgtgcctccctgg

SEQ ID NO: 2664374 - DNA, 23 bp, Homo sapiens
gccatgttgtgcctccctggtga

SEQ ID NO: 2664375 - DNA, 16 bp, Homo sapiens
gccattgcactccagc

SEQ ID NO: 2664376 - DNA, 13 bp, Homo sapiens
gccattttgcatt

SEQ ID NO: 2664377 - DNA, 13 bp, Homo sapiens
gcccaaaatttat

SEQ ID NO: 2664378 - DNA, 22 bp, Homo sapiens
gcccaattcttacaaacatgtg

SEQ ID NO: 2664379 - DNA, 22 bp, Homo sapiens
gcccagattaaagtctttatcc

SEQ ID NO: 2664380 - DNA, 20 bp, Homo sapiens
gcccagattatgagacacag

SEQ ID NO: 2664381 - DNA, 15 bp, Homo sapiens
gcccagccaggcccc

SEQ ID NO: 2664382 - DNA, 16 bp, Homo sapiens
gcccagccaggcccca

SEQ ID NO: 2664383 - DNA, 15 bp, Homo sapiens
gttctctagaaagaa

SEQ ID NO: 2664384 - DNA, 21 bp, Homo sapiens
gttctctgggagaaaatcatc

SEQ ID NO: 2664385 - DNA, 17 bp, Homo sapiens
gttctgagagaaaaaga

SEQ ID NO: 2664386 - DNA, 19 bp, Homo sapiens
gttgacttgacagaacact

SEQ ID NO: 2664387 - DNA, 23 bp, Homo sapiens
gttgcttcttctacttcagtctt

SEQ ID NO: 2664388 - DNA, 18 bp, Homo sapiens
gttgtgcctccctggtga

SEQ ID NO: 2664389 - DNA, 14 bp, Homo sapiens
gtttaatttaaagc

SEQ ID NO: 2664390 - DNA, 19 bp, Homo sapiens
gtttacaagcccccccttc

SEQ ID NO: 2664391 - DNA, 12 bp, Homo sapiens
gtttagcctgga

SEQ ID NO: 2664392 - DNA, 13 bp, Homo sapiens
gtttattttaaga

SEQ ID NO: 2664393 - DNA, 23 bp, Homo sapiens
gtttccagtacacctttcagcca

SEQ ID NO: 2664394 - DNA, 16 bp, Homo sapiens
gtttcctgcaggccag

SEQ ID NO: 2664395 - DNA, 20 bp, Homo sapiens
gtttctgaaaattaacactg

SEQ ID NO: 2664396 - DNA, 21 bp, Homo sapiens
gtttctgaaaattaacactgc

SEQ ID NO: 2664397 - DNA, 19 bp, Homo sapiens
gtttctgtttaacttctta

SEQ ID NO: 2664398 - DNA, 19 bp, Homo sapiens
gtttgaatataaacactat

SEQ ID NO: 2664399 - DNA, 23 bp, Homo sapiens
gttttaggtctagcctatgtgga

SEQ ID NO: 2664400 - DNA, 20 bp, Homo sapiens
gttttcccttgaggaaacaa

SEQ ID NO: 2664401 - DNA, 12 bp, Homo sapiens
taaaaaaaagaa

SEQ ID NO: 2664402 - DNA, 16 bp, Homo sapiens
taaaaaaaagaaatga

SEQ ID NO: 2664403 - DNA, 23 bp, Homo sapiens
taaaaaacatgtggttacacagt

SEQ ID NO: 2664404 - DNA, 23 bp, Homo sapiens
taaaacacctaaataaccaatct

SEQ ID NO: 2664405 - DNA, 21 bp, Homo sapiens
taaaatctgatatgtattgtt

SEQ ID NO: 2664406 - DNA, 18 bp, Homo sapiens
taaagaaaatctctgtga

SEQ ID NO: 2664407 - DNA, 21 bp, Homo sapiens
taaataaaacattttcacaca

SEQ ID NO: 2664408 - DNA, 17 bp, Homo sapiens
taaatattgtctttttg

SEQ ID NO: 2664409 - DNA, 20 bp, Homo sapiens
taaatattgtctttttgtat

SEQ ID NO: 2664410 - DNA, 23 bp, Homo sapiens
taaatattgtctttttgtatgtc

SEQ ID NO: 2664411 - DNA, 10 bp, Homo sapiens
taaatattta

SEQ ID NO: 2664412 - DNA, 16 bp, Homo sapiens
taaatggaaactgaaa

SEQ ID NO: 2664413 - DNA, 18 bp, Homo sapiens
taaatggaaactgaaact

SEQ ID NO: 2664414 - DNA, 16 bp, Homo sapiens
taaatgttaagaaaaa

SEQ ID NO: 2664415 - DNA, 14 bp, Homo sapiens
taacaccagcattg

SEQ ID NO: 2664416 - DNA, 17 bp, Homo sapiens
taaccatggtgcttgtt

SEQ ID NO: 2664417 - DNA, 11 bp, Homo sapiens
aaaaaaagaca

SEQ ID NO: 2664418 - DNA, 12 bp, Homo sapiens
aaaaaagaaatg

SEQ ID NO: 2664419 - DNA, 14 bp, Homo sapiens
aaaaagaagtaggg

SEQ ID NO: 2664420 - DNA, 16 bp, Homo sapiens
aaaaagatgacccatt

SEQ ID NO: 2664421 - DNA, 12 bp, Homo sapiens
aaaaatctgttt

SEQ ID NO: 2664422 - DNA, 22 bp, Homo sapiens
aaaacaggtagaattatctaat

SEQ ID NO: 2664423 - DNA, 19 bp, Homo sapiens
aaaacattttcacacaata

SEQ ID NO: 2664424 - DNA, 23 bp, Homo sapiens
aaaactgaaagtgaaagtccaga

SEQ ID NO: 2664425 - DNA, 12 bp, Homo sapiens
aaaagaaatgaa

SEQ ID NO: 2664426 - DNA, 16 bp, Homo sapiens
aaaagcagctctcccc

SEQ ID NO: 2664427 - DNA, 22 bp, Homo sapiens
aaaagtcataaaatgtatcttc

SEQ ID NO: 2664428 - DNA, 19 bp, Homo sapiens
aaaatattttgatcttcaa

SEQ ID NO: 2664429 - DNA, 21 bp, Homo sapiens
aaaatattttgatcttcaaca

SEQ ID NO: 2664430 - DNA, 15 bp, Homo sapiens
aaaatcaaaacaaaa

SEQ ID NO: 2664431 - DNA, 18 bp, Homo sapiens
aaaatcaaaacaaaaaaa

SEQ ID NO: 2664432 - DNA, 18 bp, Homo sapiens
aaaatgtgccattttgca

SEQ ID NO: 2664433 - DNA, 16 bp, Homo sapiens
aaacaaaacaaaacaa

SEQ ID NO: 2664434 - DNA, 20 bp, Homo sapiens
aaacagactcgattcatatt

SEQ ID NO: 2664435 - DNA, 20 bp, Homo sapiens
aaacatgtggttacacagtg

SEQ ID NO: 2664436 - DNA, 14 bp, Homo sapiens
aaacattttcacac

SEQ ID NO: 2664437 - DNA, 22 bp, Homo sapiens
aaacattttcacacaatacaat

SEQ ID NO: 2664438 - DNA, 22 bp, Homo sapiens
aaacccatattgtaaaacaggt

SEQ ID NO: 2664439 - DNA, 19 bp, Homo sapiens
aaacgaagccatctttctt

SEQ ID NO: 2664440 - DNA, 18 bp, Homo sapiens
aaactaaggccctcttga

SEQ ID NO: 2664441 - DNA, 13 bp, Homo sapiens
aaactctctgaac

SEQ ID NO: 2664442 - DNA, 20 bp, Homo sapiens
aaactgttcccacctgctgg

SEQ ID NO: 2664443 - DNA, 22 bp, Homo sapiens
aaacttccagtgcaacactgaa

SEQ ID NO: 2664444 - DNA, 22 bp, Homo sapiens
aaagattactttttctttatgt

SEQ ID NO: 2664445 - DNA, 16 bp, Homo sapiens
aaagcaaaaagtgatg

SEQ ID NO: 2664446 - DNA, 20 bp, Homo sapiens
aaagcacactcatcccctca

SEQ ID NO: 2664447 - DNA, 18 bp, Homo sapiens
aaagcagctctcccctca

SEQ ID NO: 2664448 - DNA, 15 bp, Homo sapiens
aaagctgtattttga

SEQ ID NO: 2664449 - DNA, 13 bp, Homo sapiens
aaaggttttgagc

SEQ ID NO: 2664450 - DNA, 20 bp, Homo sapiens
aaagtgaaagtccagaaact

SEQ ID NO: 2664451 - DNA, 18 bp, Homo sapiens
acgctctctactctgctt

SEQ ID NO: 2664452 - DNA, 23 bp, Homo sapiens
acgctgtccctagtaaaaataca

SEQ ID NO: 2664453 - DNA, 17 bp, Homo sapiens
acgctttgggagaatgt

SEQ ID NO: 2664454 - DNA, 12 bp, Homo sapiens
acggccctggcc

SEQ ID NO: 2664455 - DNA, 22 bp, Homo sapiens
acggctccactaggacttcaaa

SEQ ID NO: 2664456 - DNA, 20 bp, Homo sapiens
acgtatgtttttgtgtattt

SEQ ID NO: 2664457 - DNA, 18 bp, Homo sapiens
actacagaaaaaccagag

SEQ ID NO: 2664458 - DNA, 22 bp, Homo sapiens
actagagggacctctcccaggg

SEQ ID NO: 2664459 - DNA, 11 bp, Homo sapiens
actattttatt

SEQ ID NO: 2664460 - DNA, 17 bp, Homo sapiens
actcaagattcccagga

SEQ ID NO: 2664461 - DNA, 18 bp, Homo sapiens
actcaagattcccaggag

SEQ ID NO: 2664462 - DNA, 15 bp, Homo sapiens
actcaagtagcattt

SEQ ID NO: 2664463 - DNA, 18 bp, Homo sapiens
actcaatattttccatga

SEQ ID NO: 2664464 - DNA, 23 bp, Homo sapiens
actcaatattttccatgaaaatg

SEQ ID NO: 2664465 - DNA, 15 bp, Homo sapiens
actcatgttattttt

SEQ ID NO: 2664466 - DNA, 19 bp, Homo sapiens
actctctgaacccctccct

SEQ ID NO: 2664467 - DNA, 16 bp, Homo sapiens
actctgggctccagag

SEQ ID NO: 2664468 - DNA, 22 bp, Homo sapiens
actctgtgtctgagtggcttca

SEQ ID NO: 2664469 - DNA, 16 bp, Homo sapiens
actgaaaacctctcct

SEQ ID NO: 2664470 - DNA, 16 bp, Homo sapiens
actgaaatatacacac

SEQ ID NO: 2664471 - DNA, 13 bp, Homo sapiens
actgaccttgatg

SEQ ID NO: 2664472 - DNA, 19 bp, Homo sapiens
actgaccttgatgagctgt

SEQ ID NO: 2664473 - DNA, 12 bp, Homo sapiens
actgatttcccc

SEQ ID NO: 2664474 - DNA, 17 bp, Homo sapiens
actgatttccccttttg

SEQ ID NO: 2664475 - DNA, 19 bp, Homo sapiens
actgatttccccttttgca

SEQ ID NO: 2664476 - DNA, 22 bp, Homo sapiens
actgatttccccttttgcattc

SEQ ID NO: 2664477 - DNA, 18 bp, Homo sapiens
actgcaccatttaaaaac

SEQ ID NO: 2664478 - DNA, 23 bp, Homo sapiens
actgcccagcggacagtggcagg

SEQ ID NO: 2664479 - DNA, 16 bp, Homo sapiens
actgcttgtgttttta

SEQ ID NO: 2664480 - DNA, 22 bp, Homo sapiens
actgggatgggaggagaggaca

SEQ ID NO: 2664481 - DNA, 12 bp, Homo sapiens
actgtacatgtg

SEQ ID NO: 2664482 - DNA, 21 bp, Homo sapiens
actgtaccatgtgctacaggg

SEQ ID NO: 2664483 - DNA, 18 bp, Homo sapiens
actgtgatgccctgccct

SEQ ID NO: 2664484 - DNA, 22 bp, Homo sapiens
actgtggggaaccaattgcttt

SEQ ID NO: 2664485 - DNA, 19 bp, Homo sapiens
actgttatcctatttagat

SEQ ID NO: 2664486 - DNA, 15 bp, Homo sapiens
actgttgtccctgca

SEQ ID NO: 2664487 - DNA, 16 bp, Homo sapiens
acttcccccaaattta

SEQ ID NO: 2664488 - DNA, 21 bp, Homo sapiens
acttcccccaaatttaaagaa

SEQ ID NO: 2664489 - DNA, 22 bp, Homo sapiens
acttcggcagatactgtctctt

SEQ ID NO: 2664490 - DNA, 14 bp, Homo sapiens
acttcgggctggcc

SEQ ID NO: 2664491 - DNA, 22 bp, Homo sapiens
acttcttggcttggtgaggaaa

SEQ ID NO: 2664492 - DNA, 15 bp, Homo sapiens
acttctttcagcaga

SEQ ID NO: 2664493 - DNA, 20 bp, Homo sapiens
acttgacagaacactgtctt

SEQ ID NO: 2664494 - DNA, 18 bp, Homo sapiens
acttgctctggacctgcc

SEQ ID NO: 2664495 - DNA, 19 bp, Homo sapiens
acttgctctggacctgccc

SEQ ID NO: 2664496 - DNA, 18 bp, Homo sapiens
actttcagtgaaagcatc

SEQ ID NO: 2664497 - DNA, 18 bp, Homo sapiens
actttcctcttcctgcct

SEQ ID NO: 2664498 - DNA, 21 bp, Homo sapiens
actttttatattttatacatt

SEQ ID NO: 2664499 - DNA, 14 bp, Homo sapiens
agaaaaagaaatgc

SEQ ID NO: 2664500 - DNA, 20 bp, Homo sapiens
agaaaatggaaccaggcttg

SEQ ID NO: 2664501 - DNA, 20 bp, Homo sapiens
agaaacgaagccatctttct

SEQ ID NO: 2664502 - DNA, 15 bp, Homo sapiens
agaaactgttcccac

SEQ ID NO: 2664503 - DNA, 21 bp, Homo sapiens
agaaactgttcccacctgctg

SEQ ID NO: 2664504 - DNA, 19 bp, Homo sapiens
agaaaggttttgagcatgg

SEQ ID NO: 2664505 - DNA, 23 bp, Homo sapiens
agaaattctgtcatagaaagtgc

SEQ ID NO: 2664506 - DNA, 16 bp, Homo sapiens
agaacacaaggtcatt

SEQ ID NO: 2664507 - DNA, 14 bp, Homo sapiens
agaacataaagcaa

SEQ ID NO: 2664508 - DNA, 16 bp, Homo sapiens
agaacataaagcaaat

SEQ ID NO: 2664509 - DNA, 19 bp, Homo sapiens
agaacatgtagaaaacaaa

SEQ ID NO: 2664510 - DNA, 15 bp, Homo sapiens
agaactttatttcca

SEQ ID NO: 2664511 - DNA, 22 bp, Homo sapiens
agaagaaaatggaaccaggctt

SEQ ID NO: 2664512 - DNA, 23 bp, Homo sapiens
agaagaaaatggaaccaggcttg

SEQ ID NO: 2664513 - DNA, 18 bp, Homo sapiens
agaagaaattctgtcata

SEQ ID NO: 2664514 - DNA, 22 bp, Homo sapiens
agaagaaattctgtcatagaaa

SEQ ID NO: 2664515 - DNA, 13 bp, Homo sapiens
agaagaaggcagc

SEQ ID NO: 2664516 - DNA, 22 bp, Homo sapiens
agaagagagtccatatttcaat

SEQ ID NO: 2664517 - DNA, 16 bp, Homo sapiens
agaagggctgcatgat

SEQ ID NO: 2664518 - DNA, 22 bp, Homo sapiens
agaaggtttggtccagcctggt

SEQ ID NO: 2664519 - DNA, 20 bp, Homo sapiens
agaataaaggtatgaaaggg

SEQ ID NO: 2664520 - DNA, 12 bp, Homo sapiens
agaataataaat

SEQ ID NO: 2664521 - DNA, 20 bp, Homo sapiens
agaatagttgaacctatttc

SEQ ID NO: 2664522 - DNA, 13 bp, Homo sapiens
agaatataatact

SEQ ID NO: 2664523 - DNA, 15 bp, Homo sapiens
agaattatctaattt

SEQ ID NO: 2664524 - DNA, 17 bp, Homo sapiens
agaattatctaatttat

SEQ ID NO: 2664525 - DNA, 18 bp, Homo sapiens
agaattatctaatttata

SEQ ID NO: 2664526 - DNA, 21 bp, Homo sapiens
agacacagtcatactgtcact

SEQ ID NO: 2664527 - DNA, 21 bp, Homo sapiens
agacactgaaatatacacaca

SEQ ID NO: 2664528 - DNA, 19 bp, Homo sapiens
agacatgcagcctaaggct

SEQ ID NO: 2664529 - DNA, 13 bp, Homo sapiens
agaccagcctggc

SEQ ID NO: 2664530 - DNA, 13 bp, Homo sapiens
agaccagctcttc

SEQ ID NO: 2664531 - DNA, 14 bp, Homo sapiens
agacctcagggcac

SEQ ID NO: 2664532 - DNA, 15 bp, Homo sapiens
agacctcagggcaca

SEQ ID NO: 2664533 - DNA, 19 bp, Homo sapiens
agacctgacacctttcata

SEQ ID NO: 2664534 - DNA, 16 bp, Homo sapiens
agacctgtctcctggc

SEQ ID NO: 2664535 - DNA, 13 bp, Homo sapiens
agactaaatgaaa

SEQ ID NO: 2664536 - DNA, 17 bp, Homo sapiens
agactatattgtacaca

SEQ ID NO: 2664537 - DNA, 13 bp, Homo sapiens
agactcaaatgct

SEQ ID NO: 2664538 - DNA, 15 bp, Homo sapiens
agactcatattactg

SEQ ID NO: 2664539 - DNA, 22 bp, Homo sapiens
agactcatattactggtaggaa

SEQ ID NO: 2664540 - DNA, 13 bp, Homo sapiens
agactctgtctaa

SEQ ID NO: 2664541 - DNA, 18 bp, Homo sapiens
agactctgtctaaaaaac

SEQ ID NO: 2664542 - DNA, 20 bp, Homo sapiens
agactgaccttgatgagctg

SEQ ID NO: 2664543 - DNA, 14 bp, Homo sapiens
agactgatcaggac

SEQ ID NO: 2664544 - DNA, 16 bp, Homo sapiens
agactgatcaggacct

SEQ ID NO: 2664545 - DNA, 19 bp, Homo sapiens
agactgttgtccctgcact

SEQ ID NO: 2664546 - DNA, 16 bp, Homo sapiens
agagaaaaagaaatgc

SEQ ID NO: 2664547 - DNA, 21 bp, Homo sapiens
agagaaaaagaaatgcaaaaa

SEQ ID NO: 2664548 - DNA, 15 bp, Homo sapiens
agagagaggcaatgg

SEQ ID NO: 2664549 - DNA, 21 bp, Homo sapiens
agagcaagactctgtctaaaa

SEQ ID NO: 2664550 - DNA, 17 bp, Homo sapiens
agagccacaggtcttta

SEQ ID NO: 2664551 - DNA, 20 bp, Homo sapiens
agagccacaggtctttatgt

SEQ ID NO: 2664552 - DNA, 11 bp, Homo sapiens
agagctgaggc

SEQ ID NO: 2664553 - DNA, 18 bp, Homo sapiens
agaggcaatggctccttc

SEQ ID NO: 2664554 - DNA, 13 bp, Homo sapiens
agaggcagaagaa

SEQ ID NO: 2664555 - DNA, 17 bp, Homo sapiens
agaggcagaagaaccct

SEQ ID NO: 2664556 - DNA, 14 bp, Homo sapiens
agaggcatttcccc

SEQ ID NO: 2664557 - DNA, 16 bp, Homo sapiens
agagggacctctccca

SEQ ID NO: 2664558 - DNA, 15 bp, Homo sapiens
agagggccgggcaga

SEQ ID NO: 2664559 - DNA, 12 bp, Homo sapiens
agatagggaaaa

SEQ ID NO: 2664560 - DNA, 15 bp, Homo sapiens
agatagggaaaaggg

SEQ ID NO: 2664561 - DNA, 13 bp, Homo sapiens
agatatgcaaaag

SEQ ID NO: 2664562 - DNA, 17 bp, Homo sapiens
agatctctgcagggccg

SEQ ID NO: 2664563 - DNA, 17 bp, Homo sapiens
agatgaagcaaacacat

SEQ ID NO: 2664564 - DNA, 18 bp, Homo sapiens
agatgaagcaaacacatt

SEQ ID NO: 2664565 - DNA, 20 bp, Homo sapiens
agatgcaatgactcaggaca

SEQ ID NO: 2664566 - DNA, 19 bp, Homo sapiens
agatgtaaagttattcttg

SEQ ID NO: 2664567 - DNA, 15 bp, Homo sapiens
agatgttctactttg

SEQ ID NO: 2664568 - DNA, 19 bp, Homo sapiens
agattatgagacacaggat

SEQ ID NO: 2664569 - DNA, 22 bp, Homo sapiens
cacatacaacacaaagagaaaa

SEQ ID NO: 2664570 - DNA, 19 bp, Homo sapiens
cacatgccctaatgtctgt

SEQ ID NO: 2664571 - DNA, 23 bp, Homo sapiens
cacattaagccttccacactcac

SEQ ID NO: 2664572 - DNA, 22 bp, Homo sapiens
caccactcaaaggccagacctg

SEQ ID NO: 2664573 - DNA, 18 bp, Homo sapiens
caccagttcctttcaatg

SEQ ID NO: 2664574 - DNA, 15 bp, Homo sapiens
caccattgaactgta

SEQ ID NO: 2664575 - DNA, 14 bp, Homo sapiens
caccattgaaggct

SEQ ID NO: 2664576 - DNA, 15 bp, Homo sapiens
caccattgaaggctt

SEQ ID NO: 2664577 - DNA, 14 bp, Homo sapiens
caccgaaaaactaa

SEQ ID NO: 2664578 - DNA, 23 bp, Homo sapiens
cacctcctttcaaggtaactgta

SEQ ID NO: 2664579 - DNA, 15 bp, Homo sapiens
cacctcgaattttgt

SEQ ID NO: 2664580 - DNA, 20 bp, Homo sapiens
cacctcgaattttgttttct

SEQ ID NO: 2664581 - DNA, 13 bp, Homo sapiens
cacctgtaatccc

SEQ ID NO: 2664582 - DNA, 20 bp, Homo sapiens
cacgcaggagcacacccagc

SEQ ID NO: 2664583 - DNA, 13 bp, Homo sapiens
cacgcctcccact

SEQ ID NO: 2664584 - DNA, 18 bp, Homo sapiens
cacgcctcccactggggt

SEQ ID NO: 2664585 - DNA, 22 bp, Homo sapiens
cacgcctcccactggggtccag

SEQ ID NO: 2664586 - DNA, 18 bp, Homo sapiens
cacgttttgttttgtgcc

SEQ ID NO: 2664587 - DNA, 15 bp, Homo sapiens
cactcaaaggccaga

SEQ ID NO: 2664588 - DNA, 16 bp, Homo sapiens
cactcctgctgtaaat

SEQ ID NO: 2664589 - DNA, 16 bp, Homo sapiens
cactcgcattgacaca

SEQ ID NO: 2664590 - DNA, 14 bp, Homo sapiens
cactctgggctcca

SEQ ID NO: 2664591 - DNA, 15 bp, Homo sapiens
cactctgggctccag

SEQ ID NO: 2664592 - DNA, 17 bp, Homo sapiens
cactcttctcagccact

SEQ ID NO: 2664593 - DNA, 14 bp, Homo sapiens
cactgcctctcaca

SEQ ID NO: 2664594 - DNA, 15 bp, Homo sapiens
cactggactccggcc

SEQ ID NO: 2664595 - DNA, 16 bp, Homo sapiens
cactggactccggccc

SEQ ID NO: 2664596 - DNA, 16 bp, Homo sapiens
cactggactgacctgg

SEQ ID NO: 2664597 - DNA, 18 bp, Homo sapiens
cactgggaaacagaggct

SEQ ID NO: 2664598 - DNA, 21 bp, Homo sapiens
cactgggaggccagtgagcca

SEQ ID NO: 2664599 - DNA, 19 bp, Homo sapiens
cactggggtccagggagca

SEQ ID NO: 2664600 - DNA, 14 bp, Homo sapiens
cactgtcctccaag

SEQ ID NO: 2664601 - DNA, 18 bp, Homo sapiens
cactgtcctccaagccag

SEQ ID NO: 2664602 - DNA, 23 bp, Homo sapiens
cacttttttttttaatctccacc

SEQ ID NO: 2664603 - DNA, 13 bp, Homo sapiens
cagaaaaaccaga

SEQ ID NO: 2664604 - DNA, 14 bp, Homo sapiens
cagaagaaggcagc

SEQ ID NO: 2664605 - DNA, 15 bp, Homo sapiens
cagaagaaggcagca

SEQ ID NO: 2664606 - DNA, 20 bp, Homo sapiens
cagaagatagcttcacccca

SEQ ID NO: 2664607 - DNA, 18 bp, Homo sapiens
cagaagatgaacagactg

SEQ ID NO: 2664608 - DNA, 20 bp, Homo sapiens
cagaagggagctagccagag

SEQ ID NO: 2664609 - DNA, 21 bp, Homo sapiens
cagaagggagctagccagagg

SEQ ID NO: 2664610 - DNA, 20 bp, Homo sapiens
cagaccttttaactcctcaa

SEQ ID NO: 2664611 - DNA, 22 bp, Homo sapiens
cagactcaaatgctcagaccag

SEQ ID NO: 2664612 - DNA, 20 bp, Homo sapiens
cagactcacaacctgaacct

SEQ ID NO: 2664613 - DNA, 16 bp, Homo sapiens
cagactcatattactg

SEQ ID NO: 2664614 - DNA, 22 bp, Homo sapiens
cagactcgattcatattgaata

SEQ ID NO: 2664615 - DNA, 13 bp, Homo sapiens
cagactgaccttg

SEQ ID NO: 2664616 - DNA, 13 bp, Homo sapiens
cagagaaagcgca

SEQ ID NO: 2664617 - DNA, 22 bp, Homo sapiens
cagagatagtggggagacttct

SEQ ID NO: 2664618 - DNA, 9 bp, Homo sapiens
cagagctgg

SEQ ID NO: 2664619 - DNA, 20 bp, Homo sapiens
cagagctgggatgtttctgt

SEQ ID NO: 2664620 - DNA, 14 bp, Homo sapiens
cagaggggcagatg

SEQ ID NO: 2664621 - DNA, 17 bp, Homo sapiens
cagaggggcagatggaa

SEQ ID NO: 2664622 - DNA, 18 bp, Homo sapiens
cagagtgcaagcccctgc

SEQ ID NO: 2664623 - DNA, 14 bp, Homo sapiens
cagatggaaaggag

SEQ ID NO: 2664624 - DNA, 14 bp, Homo sapiens
cagcaacagaaaaa

SEQ ID NO: 2664625 - DNA, 17 bp, Homo sapiens
cagcaacagaaaaatgg

SEQ ID NO: 2664626 - DNA, 19 bp, Homo sapiens
cagcattgatatttgtgca

SEQ ID NO: 2664627 - DNA, 23 bp, Homo sapiens
cagcattttcctctgctttgaaa

SEQ ID NO: 2664628 - DNA, 22 bp, Homo sapiens
cagcgggaatggcagctgccac

SEQ ID NO: 2664629 - DNA, 20 bp, Homo sapiens
cagcgggagcctccctgcct

SEQ ID NO: 2664630 - DNA, 18 bp, Homo sapiens
cagctacacctttctcct

SEQ ID NO: 2664631 - DNA, 13 bp, Homo sapiens
cagctatttttat

SEQ ID NO: 2664632 - DNA, 13 bp, Homo sapiens
cagctcagcttcc

SEQ ID NO: 2664633 - DNA, 14 bp, Homo sapiens
cagctcagcttccc

SEQ ID NO: 2664634 - DNA, 17 bp, Homo sapiens
cagctcttggctccact

SEQ ID NO: 2664635 - DNA, 23 bp, Homo sapiens
cagctgagtgaaaaatctgtgga

SEQ ID NO: 2664636 - DNA, 16 bp, Homo sapiens
cagctgatgactcaag

SEQ ID NO: 2664637 - DNA, 19 bp, Homo sapiens
cagcttctcatcctgcagg

SEQ ID NO: 2664638 - DNA, 23 bp, Homo sapiens
cagcttgatcaaaggcacacagc

SEQ ID NO: 2664639 - DNA, 17 bp, Homo sapiens
caggaaaaacccgtcaa

SEQ ID NO: 2664640 - DNA, 23 bp, Homo sapiens
caggacctccaagccactgagca

SEQ ID NO: 2664641 - DNA, 16 bp, Homo sapiens
caggagcacacccagc

SEQ ID NO: 2664642 - DNA, 21 bp, Homo sapiens
caggagttcgagaccagcctg

SEQ ID NO: 2664643 - DNA, 15 bp, Homo sapiens
caggatgctttggtt

SEQ ID NO: 2664644 - DNA, 14 bp, Homo sapiens
caggatggtaattc

SEQ ID NO: 2664645 - DNA, 14 bp, Homo sapiens
caggccaggccagc

SEQ ID NO: 2664646 - DNA, 16 bp, Homo sapiens
caggccttatctccaa

SEQ ID NO: 2664647 - DNA, 17 bp, Homo sapiens
caggccttatctccaag

SEQ ID NO: 2664648 - DNA, 22 bp, Homo sapiens
caggccttatctccaagaccag

SEQ ID NO: 2664649 - DNA, 13 bp, Homo sapiens
caggctctcaaca

SEQ ID NO: 2664650 - DNA, 18 bp, Homo sapiens
caggcttgcctgcaggca

SEQ ID NO: 2664651 - DNA, 20 bp, Homo sapiens
cagggactgaaaacctctcc

SEQ ID NO: 2664652 - DNA, 23 bp, Homo sapiens
cagggactgaaaacctctcctca

SEQ ID NO: 2664653 - DNA, 15 bp, Homo sapiens
cagggagctgcaggg

SEQ ID NO: 2664654 - DNA, 15 bp, Homo sapiens
cagggcacctgccac

SEQ ID NO: 2664655 - DNA, 14 bp, Homo sapiens
cagggccgccaggg

SEQ ID NO: 2664656 - DNA, 13 bp, Homo sapiens
cagggcctgcgag

SEQ ID NO: 2664657 - DNA, 18 bp, Homo sapiens
caggggagggtcagccag

SEQ ID NO: 2664658 - DNA, 19 bp, Homo sapiens
cagggtcagaaacaggacc

SEQ ID NO: 2664659 - DNA, 12 bp, Homo sapiens
cagggtccctgg

SEQ ID NO: 2664660 - DNA, 22 bp, Homo sapiens
caggtagaattatctaatttat

SEQ ID NO: 2664661 - DNA, 21 bp, Homo sapiens
caggtagacctgtctcctggc

SEQ ID NO: 2664662 - DNA, 22 bp, Homo sapiens
caggtgagtcctagagctacag

SEQ ID NO: 2664663 - DNA, 15 bp, Homo sapiens
caggtgcaaccaggg

SEQ ID NO: 2664664 - DNA, 13 bp, Homo sapiens
caggtggccatgc

SEQ ID NO: 2664665 - DNA, 15 bp, Homo sapiens
caggtggccatgcct

SEQ ID NO: 2664666 - DNA, 18 bp, Homo sapiens
cagtagcagtagatgcat

SEQ ID NO: 2664667 - DNA, 13 bp, Homo sapiens
cagtgagccactc

SEQ ID NO: 2664668 - DNA, 17 bp, Homo sapiens
cagtggcaggacaggaa

SEQ ID NO: 2664669 - DNA, 24 bp, Homo sapiens
cagtttgaatgcagtctgtccagg

SEQ ID NO: 2664670 - DNA, 23 bp, Homo sapiens
cataagagccacaggtctttatg

SEQ ID NO: 2664671 - DNA, 11 bp, Homo sapiens
cataaggtttt

SEQ ID NO: 2664672 - DNA, 17 bp, Homo sapiens
catactttaagtaggga

SEQ ID NO: 2664673 - DNA, 15 bp, Homo sapiens
catatcatgtacagt

SEQ ID NO: 2664674 - DNA, 17 bp, Homo sapiens
catattgtaaaacaggt

SEQ ID NO: 2664675 - DNA, 14 bp, Homo sapiens
catatttctttggc

SEQ ID NO: 2664676 - DNA, 14 bp, Homo sapiens
catatttgcactaa

SEQ ID NO: 2664677 - DNA, 13 bp, Homo sapiens
catcaagaagggc

SEQ ID NO: 2664678 - DNA, 17 bp, Homo sapiens
catcaagaagggctgca

SEQ ID NO: 2664679 - DNA, 21 bp, Homo sapiens
catcaagaagggctgcatgat

SEQ ID NO: 2664680 - DNA, 18 bp, Homo sapiens
catcagctaaacaccacg

SEQ ID NO: 2664681 - DNA, 12 bp, Homo sapiens
catcctgcaggc

SEQ ID NO: 2664682 - DNA, 21 bp, Homo sapiens
catccttccctgtctgccagg

SEQ ID NO: 2664683 - DNA, 13 bp, Homo sapiens
catcgccagacaa

SEQ ID NO: 2664684 - DNA, 20 bp, Homo sapiens
catcgccagctgatgactca

SEQ ID NO: 2664685 - DNA, 14 bp, Homo sapiens
catctttgtgaagg

SEQ ID NO: 2664686 - DNA, 22 bp, Homo sapiens
catctttgtgaaggcctcgcag

SEQ ID NO: 2664687 - DNA, 17 bp, Homo sapiens
ctggtaccagttgaaat

SEQ ID NO: 2664688 - DNA, 17 bp, Homo sapiens
ctggtcaaacaaactct

SEQ ID NO: 2664689 - DNA, 22 bp, Homo sapiens
ctggtccacagggcacctgcca

SEQ ID NO: 2664690 - DNA, 20 bp, Homo sapiens
ctggtctgatgacttgctta

SEQ ID NO: 2664691 - DNA, 19 bp, Homo sapiens
ctggtttgccggtggtgca

SEQ ID NO: 2664692 - DNA, 18 bp, Homo sapiens
ctgtaaatttggcttctg

SEQ ID NO: 2664693 - DNA, 18 bp, Homo sapiens
ctgtaatcccagcaattt

SEQ ID NO: 2664694 - DNA, 16 bp, Homo sapiens
ctgtatttgagaatat

SEQ ID NO: 2664695 - DNA, 12 bp, Homo sapiens
ctgtccaggctc

SEQ ID NO: 2664696 - DNA, 16 bp, Homo sapiens
ctgtcctcaggtggcc

SEQ ID NO: 2664697 - DNA, 17 bp, Homo sapiens
ctgtcctcaggtggcca

SEQ ID NO: 2664698 - DNA, 15 bp, Homo sapiens
ctgtcctccaagcca

SEQ ID NO: 2664699 - DNA, 14 bp, Homo sapiens
ctgtctaaaaaaca

SEQ ID NO: 2664700 - DNA, 13 bp, Homo sapiens
ctgtctcagggtg

SEQ ID NO: 2664701 - DNA, 22 bp, Homo sapiens
ctgtgaaattcccaacaaacat

SEQ ID NO: 2664702 - DNA, 23 bp, Homo sapiens
ctgtgaattgagctgcagaaacg

SEQ ID NO: 2664703 - DNA, 18 bp, Homo sapiens
ctgtgaccttgagaagat

SEQ ID NO: 2664704 - DNA, 16 bp, Homo sapiens
ctgtgattgtgcctac

SEQ ID NO: 2664705 - DNA, 18 bp, Homo sapiens
ctgtgcacaaagtggcat

SEQ ID NO: 2664706 - DNA, 15 bp, Homo sapiens
ctgtgcacggtggac

SEQ ID NO: 2664707 - DNA, 16 bp, Homo sapiens
ctgtgcctccatcagc

SEQ ID NO: 2664708 - DNA, 13 bp, Homo sapiens
ctgtgggaaatta

SEQ ID NO: 2664709 - DNA, 15 bp, Homo sapiens
ctgtgtctgagtggc

SEQ ID NO: 2664710 - DNA, 19 bp, Homo sapiens
ctgtgtctgagtggcttca

SEQ ID NO: 2664711 - DNA, 23 bp, Homo sapiens
ctgttcaatgtttttaaaaatct

SEQ ID NO: 2664712 - DNA, 17 bp, Homo sapiens
ctgttgtcaccttcacc

SEQ ID NO: 2664713 - DNA, 23 bp, Homo sapiens
ctgttttaatttatactggcatg

SEQ ID NO: 2664714 - DNA, 20 bp, Homo sapiens
cttaaaatacggtacctggc

SEQ ID NO: 2664715 - DNA, 14 bp, Homo sapiens
cttaatattctgga

SEQ ID NO: 2664716 - DNA, 19 bp, Homo sapiens
cttaatattctggagtcat

SEQ ID NO: 2664717 - DNA, 22 bp, Homo sapiens
cttaggtgtgattataaaatca

SEQ ID NO: 2664718 - DNA, 21 bp, Homo sapiens
cttataggaaagcttgagtaa

SEQ ID NO: 2664719 - DNA, 20 bp, Homo sapiens
cttatttaagtaactttaaa

SEQ ID NO: 2664720 - DNA, 21 bp, Homo sapiens
cttcaaactaggggacaaagc

SEQ ID NO: 2664721 - DNA, 14 bp, Homo sapiens
cttcaaccagggat

SEQ ID NO: 2664722 - DNA, 13 bp, Homo sapiens
cttcacacacaga

SEQ ID NO: 2664723 - DNA, 13 bp, Homo sapiens
cttcactcctgct

SEQ ID NO: 2664724 - DNA, 21 bp, Homo sapiens
cttcactgtcctccaagccag

SEQ ID NO: 2664725 - DNA, 20 bp, Homo sapiens
cttccacttttttttgtatg

SEQ ID NO: 2664726 - DNA, 14 bp, Homo sapiens
cttcccattctcca

SEQ ID NO: 2664727 - DNA, 15 bp, Homo sapiens
cttccttatgcttct

SEQ ID NO: 2664728 - DNA, 17 bp, Homo sapiens
cttccttatgcttcttt

SEQ ID NO: 2664729 - DNA, 17 bp, Homo sapiens
cttccttgtagcctttt

SEQ ID NO: 2664730 - DNA, 21 bp, Homo sapiens
cttccttgtagccttttgact

SEQ ID NO: 2664731 - DNA, 14 bp, Homo sapiens
cttcgacagcattt

SEQ ID NO: 2664732 - DNA, 18 bp, Homo sapiens
cttctcctcttgtaaata

SEQ ID NO: 2664733 - DNA, 21 bp, Homo sapiens
cttctgttgtcaccttcacct

SEQ ID NO: 2664734 - DNA, 23 bp, Homo sapiens
cttcttttagcagtaaaatagct

SEQ ID NO: 2664735 - DNA, 17 bp, Homo sapiens
cttgacagaacactgtc

SEQ ID NO: 2664736 - DNA, 18 bp, Homo sapiens
cttgaggaaacaacagct

SEQ ID NO: 2664737 - DNA, 13 bp, Homo sapiens
cttgagtaaaata

SEQ ID NO: 2664738 - DNA, 14 bp, Homo sapiens
cttgagtaaaataa

SEQ ID NO: 2664739 - DNA, 12 bp, Homo sapiens
cttgcctgcagg

SEQ ID NO: 2664740 - DNA, 13 bp, Homo sapiens
cttgctctggacc

SEQ ID NO: 2664741 - DNA, 14 bp, Homo sapiens
cttgctctggacct

SEQ ID NO: 2664742 - DNA, 17 bp, Homo sapiens
cttgctttgtgttcttt

SEQ ID NO: 2664743 - DNA, 18 bp, Homo sapiens
cttgctttgtgttctttg

SEQ ID NO: 2664744 - DNA, 22 bp, Homo sapiens
cttggaaccgtaggacccaagc

SEQ ID NO: 2664745 - DNA, 14 bp, Homo sapiens
cttgggccctctgg

SEQ ID NO: 2664746 - DNA, 16 bp, Homo sapiens
cttgtaaataaagccc

SEQ ID NO: 2664747 - DNA, 17 bp, Homo sapiens
cttgtagccttttgact

SEQ ID NO: 2664748 - DNA, 20 bp, Homo sapiens
cttgtctcccagctcagggc

SEQ ID NO: 2664749 - DNA, 12 bp, Homo sapiens
ctttaatataaa

SEQ ID NO: 2664750 - DNA, 21 bp, Homo sapiens
ctttattcaataaaaaaaaga

SEQ ID NO: 2664751 - DNA, 15 bp, Homo sapiens
ctttcaaagccattt

SEQ ID NO: 2664752 - DNA, 17 bp, Homo sapiens
ctttcaaagccatttta

SEQ ID NO: 2664753 - DNA, 17 bp, Homo sapiens
ctttcagcagactgatc

SEQ ID NO: 2664754 - DNA, 17 bp, Homo sapiens
ctttcagtgaaagcatc

SEQ ID NO: 2664755 - DNA, 22 bp, Homo sapiens
ctttcatgagtttttcccagct

SEQ ID NO: 2664756 - DNA, 22 bp, Homo sapiens
ctttcattcagcctttagaaat

SEQ ID NO: 2664757 - DNA, 19 bp, Homo sapiens
ctttccctgcttaatgaaa

SEQ ID NO: 2664758 - DNA, 23 bp, Homo sapiens
ctttctcctttgtactttgtgct

SEQ ID NO: 2664759 - DNA, 17 bp, Homo sapiens
ctttggaagaaaaaatc

SEQ ID NO: 2664760 - DNA, 12 bp, Homo sapiens
ctttggcttttt

SEQ ID NO: 2664761 - DNA, 20 bp, Homo sapiens
ctttggtttaatttaaagcc

SEQ ID NO: 2664762 - DNA, 19 bp, Homo sapiens
ctttgtgttctttgtgtca

SEQ ID NO: 2664763 - DNA, 17 bp, Homo sapiens
cttttatttcttaaaca

SEQ ID NO: 2664764 - DNA, 12 bp, Homo sapiens
cttttctctgcc

SEQ ID NO: 2664765 - DNA, 13 bp, Homo sapiens
cttttgcattctc

SEQ ID NO: 2664766 - DNA, 15 bp, Homo sapiens
cttttgcattctccc

SEQ ID NO: 2664767 - DNA, 13 bp, Homo sapiens
ctttttattgaat

SEQ ID NO: 2664768 - DNA, 21 bp, Homo sapiens
ctttttctttttttctttggt

SEQ ID NO: 2664769 - DNA, 13 bp, Homo sapiens
gaaaaagaaatgc

SEQ ID NO: 2664770 - DNA, 17 bp, Homo sapiens
gaaaagcagctctcccc

SEQ ID NO: 2664771 - DNA, 18 bp, Homo sapiens
gaaaagcggacatcagct

SEQ ID NO: 2664772 - DNA, 22 bp, Homo sapiens
gaaaatcatcaagaagggctgc

SEQ ID NO: 2664773 - DNA, 18 bp, Homo sapiens
gaaaatggaaccaggctt

SEQ ID NO: 2664774 - DNA, 12 bp, Homo sapiens
gaaacagaggct

SEQ ID NO: 2664775 - DNA, 21 bp, Homo sapiens
gaaaccattatgaagaagaga

SEQ ID NO: 2664776 - DNA, 20 bp, Homo sapiens
gaaacgaagccatctttctt

SEQ ID NO: 2664777 - DNA, 14 bp, Homo sapiens
gaaacgcagacact

SEQ ID NO: 2664778 - DNA, 14 bp, Homo sapiens
gaaagacagagctg

SEQ ID NO: 2664779 - DNA, 17 bp, Homo sapiens
gaaagacagcttctcat

SEQ ID NO: 2664780 - DNA, 15 bp, Homo sapiens
gaaagccccagaaat

SEQ ID NO: 2664781 - DNA, 16 bp, Homo sapiens
gaacaagcaaacccag

SEQ ID NO: 2664782 - DNA, 20 bp, Homo sapiens
gaacaatattgactttgtct

SEQ ID NO: 2664783 - DNA, 14 bp, Homo sapiens
gaacagaagaaaat

SEQ ID NO: 2664784 - DNA, 20 bp, Homo sapiens
gaacatgtagaaaacaaaat

SEQ ID NO: 2664785 - DNA, 18 bp, Homo sapiens
gaacctatttctctttct

SEQ ID NO: 2664786 - DNA, 14 bp, Homo sapiens
gaactttatttcca

SEQ ID NO: 2664787 - DNA, 19 bp, Homo sapiens
gaagaaaaaaggccttgaa

SEQ ID NO: 2664788 - DNA, 23 bp, Homo sapiens
gaagaaaatggaaccaggcttgg

SEQ ID NO: 2664789 - DNA, 21 bp, Homo sapiens
gaagacactgaaatatacaca

SEQ ID NO: 2664790 - DNA, 13 bp, Homo sapiens
gaagagccacagt

SEQ ID NO: 2664791 - DNA, 16 bp, Homo sapiens
gaagagtcctctgaat

SEQ ID NO: 2664792 - DNA, 17 bp, Homo sapiens
gaagcaaacacattaag

SEQ ID NO: 2664793 - DNA, 22 bp, Homo sapiens
gaagcatggtgccctggcttct

SEQ ID NO: 2664794 - DNA, 15 bp, Homo sapiens
gaagccatctttctt

SEQ ID NO: 2664795 - DNA, 19 bp, Homo sapiens
gaagctctcgggctaggaa

SEQ ID NO: 2664796 - DNA, 18 bp, Homo sapiens
gaagctcttgaagacact

SEQ ID NO: 2664797 - DNA, 20 bp, Homo sapiens
gaaggaaaaggcagggagcg

SEQ ID NO: 2664798 - DNA, 14 bp, Homo sapiens
gaaggcctcgcagg

SEQ ID NO: 2664799 - DNA, 15 bp, Homo sapiens
gaaggcctcgcagga

SEQ ID NO: 2664800 - DNA, 14 bp, Homo sapiens
gaaggctggcatga

SEQ ID NO: 2664801 - DNA, 22 bp, Homo sapiens
gaagggctgcatgatgtttgcc

SEQ ID NO: 2664802 - DNA, 16 bp, Homo sapiens
gaaggggacccccgcc

SEQ ID NO: 2664803 - DNA, 14 bp, Homo sapiens
gaatataaacacta

SEQ ID NO: 2664804 - DNA, 20 bp, Homo sapiens
gaatataatatatttgtgta

SEQ ID NO: 2664805 - DNA, 12 bp, Homo sapiens
gcttacggccct

SEQ ID NO: 2664806 - DNA, 20 bp, Homo sapiens
gcttcaccccaatcccagct

SEQ ID NO: 2664807 - DNA, 15 bp, Homo sapiens
gcttcactcctgctg

SEQ ID NO: 2664808 - DNA, 18 bp, Homo sapiens
gcttcactcctgctgtaa

SEQ ID NO: 2664809 - DNA, 17 bp, Homo sapiens
gcttctcatcctgcagg

SEQ ID NO: 2664810 - DNA, 18 bp, Homo sapiens
gcttctcatcctgcaggc

SEQ ID NO: 2664811 - DNA, 14 bp, Homo sapiens
gcttgcctgcaggc

SEQ ID NO: 2664812 - DNA, 21 bp, Homo sapiens
gctttctttcacaaaaaagaa

SEQ ID NO: 2664813 - DNA, 21 bp, Homo sapiens
gctttgaaagccccagaaatc

SEQ ID NO: 2664814 - DNA, 15 bp, Homo sapiens
gctttggagaagagt

SEQ ID NO: 2664815 - DNA, 21 bp, Homo sapiens
gcttttactgaagcctttctt

SEQ ID NO: 2664816 - DNA, 14 bp, Homo sapiens
ggaaaagcagctct

SEQ ID NO: 2664817 - DNA, 19 bp, Homo sapiens
ggaaaagcggacatcagct

SEQ ID NO: 2664818 - DNA, 14 bp, Homo sapiens
ggaaaatattttga

SEQ ID NO: 2664819 - DNA, 22 bp, Homo sapiens
ggaaacagactcgattcatatt

SEQ ID NO: 2664820 - DNA, 15 bp, Homo sapiens
ggaatggcacagccc

SEQ ID NO: 2664821 - DNA, 20 bp, Homo sapiens
ggaattcatctctctttaat

SEQ ID NO: 2664822 - DNA, 20 bp, Homo sapiens
ggaattttctccaatttttt

SEQ ID NO: 2664823 - DNA, 18 bp, Homo sapiens
ggacacaggcctgctctc

SEQ ID NO: 2664824 - DNA, 14 bp, Homo sapiens
ggacatcagctggt

SEQ ID NO: 2664825 - DNA, 19 bp, Homo sapiens
ggacccccgccccctgccc

SEQ ID NO: 2664826 - DNA, 22 bp, Homo sapiens
ggacccccgccccctgccctcc

SEQ ID NO: 2664827 - DNA, 12 bp, Homo sapiens
ggacctctccca

SEQ ID NO: 2664828 - DNA, 10 bp, Homo sapiens
ggacctgccc

SEQ ID NO: 2664829 - DNA, 11 bp, Homo sapiens
ggacctgcccc

SEQ ID NO: 2664830 - DNA, 16 bp, Homo sapiens
ggactagagctttctt

SEQ ID NO: 2664831 - DNA, 16 bp, Homo sapiens
ggactccggccctcct

SEQ ID NO: 2664832 - DNA, 19 bp, Homo sapiens
ggagatgaagcaaacacat

SEQ ID NO: 2664833 - DNA, 15 bp, Homo sapiens
ggagcacacccagcc

SEQ ID NO: 2664834 - DNA, 17 bp, Homo sapiens
ggagcacacccagcccc

SEQ ID NO: 2664835 - DNA, 15 bp, Homo sapiens
ggagcattgggacct

SEQ ID NO: 2664836 - DNA, 16 bp, Homo sapiens
ggagcctaggccaggt

SEQ ID NO: 2664837 - DNA, 14 bp, Homo sapiens
ggagcctccctgcc

SEQ ID NO: 2664838 - DNA, 15 bp, Homo sapiens
ggagcctccctgcct

SEQ ID NO: 2664839 - DNA, 14 bp, Homo sapiens
ggagctgcaggggc

SEQ ID NO: 2664840 - DNA, 20 bp, Homo sapiens
ggagctgcaggggcatggga

SEQ ID NO: 2664841 - DNA, 15 bp, Homo sapiens
ggagctggccccgcc

SEQ ID NO: 2664842 - DNA, 18 bp, Homo sapiens
ggagctggccccgccgcc

SEQ ID NO: 2664843 - DNA, 19 bp, Homo sapiens
ggagcttcctgtcctccca

SEQ ID NO: 2664844 - DNA, 21 bp, Homo sapiens
ggaggaaggcttacacccaca

SEQ ID NO: 2664845 - DNA, 17 bp, Homo sapiens
ggaggccagtgagccac

SEQ ID NO: 2664846 - DNA, 23 bp, Homo sapiens
ggaggtgaacaagcaaacccaga

SEQ ID NO: 2664847 - DNA, 20 bp, Homo sapiens
ggaggtggaggttgcagtga

SEQ ID NO: 2664848 - DNA, 19 bp, Homo sapiens
ggagtgagaggtctctctt

SEQ ID NO: 2664849 - DNA, 22 bp, Homo sapiens
ggagtgcttatcccttcttttt

SEQ ID NO: 2664850 - DNA, 22 bp, Homo sapiens
ggagtggggaagtgatcttttg

SEQ ID NO: 2664851 - DNA, 19 bp, Homo sapiens
ggagtgtactcccagggct

SEQ ID NO: 2664852 - DNA, 23 bp, Homo sapiens
ggatgtttctgtcacatcagctc

SEQ ID NO: 2664853 - DNA, 12 bp, Homo sapiens
ggcacacgcctc

SEQ ID NO: 2664854 - DNA, 22 bp, Homo sapiens
ggcacccaagacctcagggcac

SEQ ID NO: 2664855 - DNA, 22 bp, Homo sapiens
ggcacctgccaccctgggcctg

SEQ ID NO: 2664856 - DNA, 21 bp, Homo sapiens
ggcagagttctataatgtaaa

SEQ ID NO: 2664857 - DNA, 21 bp, Homo sapiens
ggcagcgtactcatcatcaac

SEQ ID NO: 2664858 - DNA, 13 bp, Homo sapiens
ggcagcttctttg

SEQ ID NO: 2664859 - DNA, 18 bp, Homo sapiens
ggcaggacgtgggctggg

SEQ ID NO: 2664860 - DNA, 18 bp, Homo sapiens
ggcagggccaacccttct

SEQ ID NO: 2664861 - DNA, 18 bp, Homo sapiens
ggcatgatccaagcaaga

SEQ ID NO: 2664862 - DNA, 17 bp, Homo sapiens
ggcatgctaaagccttc

SEQ ID NO: 2664863 - DNA, 14 bp, Homo sapiens
ggccagaagatgaa

SEQ ID NO: 2664864 - DNA, 15 bp, Homo sapiens
ggccagacctgcaga

SEQ ID NO: 2664865 - DNA, 22 bp, Homo sapiens
ggccagacctgcagacgcccag

SEQ ID NO: 2664866 - DNA, 17 bp, Homo sapiens
ggccaggccagctgcct

SEQ ID NO: 2664867 - DNA, 22 bp, Homo sapiens
ggccatgttgtgcctccctggt

SEQ ID NO: 2664868 - DNA, 14 bp, Homo sapiens
ggcccattctactt

SEQ ID NO: 2664869 - DNA, 16 bp, Homo sapiens
ggccctcctaccctgc

SEQ ID NO: 2664870 - DNA, 13 bp, Homo sapiens
ggccctggccttg

SEQ ID NO: 2664871 - DNA, 21 bp, Homo sapiens
ggcgatcgcggcggagctggc

SEQ ID NO: 2664872 - DNA, 16 bp, Homo sapiens
ggcgcactgcctctca

SEQ ID NO: 2664873 - DNA, 20 bp, Homo sapiens
ggcgccgcaaaccacactgg

SEQ ID NO: 2664874 - DNA, 14 bp, Homo sapiens
ggcggagctggccc

SEQ ID NO: 2664875 - DNA, 19 bp, Homo sapiens
ggctcctgagggagctcca

SEQ ID NO: 2664876 - DNA, 16 bp, Homo sapiens
ggctggagtgaggaaa

SEQ ID NO: 2664877 - DNA, 17 bp, Homo sapiens
ggcttacggccctggcc

SEQ ID NO: 2664878 - DNA, 15 bp, Homo sapiens
ggcttctctgaggaa

SEQ ID NO: 2664879 - DNA, 13 bp, Homo sapiens
ggcttgcctgcag

SEQ ID NO: 2664880 - DNA, 14 bp, Homo sapiens
ggcttgcctgcagg

SEQ ID NO: 2664881 - DNA, 15 bp, Homo sapiens
ggctttgcaaccatt

SEQ ID NO: 2664882 - DNA, 14 bp, Homo sapiens
gggaagagggggcg

SEQ ID NO: 2664883 - DNA, 16 bp, Homo sapiens
gggacaaagaggcctt

SEQ ID NO: 2664884 - DNA, 13 bp, Homo sapiens
gggacccccgccc

SEQ ID NO: 2664885 - DNA, 18 bp, Homo sapiens
gggacccccgccccctgc

SEQ ID NO: 2664886 - DNA, 19 bp, Homo sapiens
gggacccccgccccctgcc

SEQ ID NO: 2664887 - DNA, 17 bp, Homo sapiens
gggacctataactgccc

SEQ ID NO: 2664888 - DNA, 20 bp, Homo sapiens
gggagaaaatcatcaagaag

SEQ ID NO: 2664889 - DNA, 21 bp, Homo sapiens
gggagcaggcggtgggcaccc

SEQ ID NO: 2664890 - DNA, 12 bp, Homo sapiens
gggagcctccct

SEQ ID NO: 2664891 - DNA, 21 bp, Homo sapiens
gggagctccaactcagaaggg

SEQ ID NO: 2664892 - DNA, 19 bp, Homo sapiens
gggagtggggaagtgatct

SEQ ID NO: 2664893 - DNA, 17 bp, Homo sapiens
gggagtgtactcccagg

SEQ ID NO: 2664894 - DNA, 12 bp, Homo sapiens
gggcacccaccc

SEQ ID NO: 2664895 - DNA, 16 bp, Homo sapiens
gggcctgcgagggcag

SEQ ID NO: 2664896 - DNA, 18 bp, Homo sapiens
gggcgatcgcggcggagc

SEQ ID NO: 2664897 - DNA, 11 bp, Homo sapiens
gggctgcatga

SEQ ID NO: 2664898 - DNA, 20 bp, Homo sapiens
gggctgcatgatgtttgccc

SEQ ID NO: 2664899 - DNA, 16 bp, Homo sapiens
gggcttacggccctgg

SEQ ID NO: 2664900 - DNA, 18 bp, Homo sapiens
gggcttacggccctggcc

SEQ ID NO: 2664901 - DNA, 13 bp, Homo sapiens
ggggacccccgcc

SEQ ID NO: 2664902 - DNA, 13 bp, Homo sapiens
gggtccagaagga

SEQ ID NO: 2664903 - DNA, 18 bp, Homo sapiens
ggtattcgcttgagaaaa

SEQ ID NO: 2664904 - DNA, 17 bp, Homo sapiens
ggtcagaaacaggaccg

SEQ ID NO: 2664905 - DNA, 13 bp, Homo sapiens
ggtcagccagggc

SEQ ID NO: 2664906 - DNA, 21 bp, Homo sapiens
ggtccagaaggagacaggcag

SEQ ID NO: 2664907 - DNA, 13 bp, Homo sapiens
ggtgaaggctggc

SEQ ID NO: 2664908 - DNA, 20 bp, Homo sapiens
ggtgagagggccgggcagag

SEQ ID NO: 2664909 - DNA, 12 bp, Homo sapiens
ggtgcaggtaga

SEQ ID NO: 2664910 - DNA, 23 bp, Homo sapiens
ggtgctgtcctcaggtggccatg

SEQ ID NO: 2664911 - DNA, 15 bp, Homo sapiens
ggtggagttaatctt

SEQ ID NO: 2664912 - DNA, 17 bp, Homo sapiens
ggtggccatgcctcagc

SEQ ID NO: 2664913 - DNA, 17 bp, Homo sapiens
ggtgttgacatgtgctt

SEQ ID NO: 2664914 - DNA, 13 bp, Homo sapiens
ggtttctgaaaat

SEQ ID NO: 2664915 - DNA, 17 bp, Homo sapiens
ggtttgccggtggtgca

SEQ ID NO: 2664916 - DNA, 10 bp, Homo sapiens
ggttttcctg

SEQ ID NO: 2664917 - DNA, 12 bp, Homo sapiens
gtaaaaatacaa

SEQ ID NO: 2664918 - DNA, 14 bp, Homo sapiens
gtaaagtccccaga

SEQ ID NO: 2664919 - DNA, 18 bp, Homo sapiens
gtaaagtccccagagaaa

SEQ ID NO: 2664920 - DNA, 23 bp, Homo sapiens
gtaaagtccccagagaaagcgca

SEQ ID NO: 2664921 - DNA, 13 bp, Homo sapiens
gtaaatttggctt

SEQ ID NO: 2664922 - DNA, 15 bp, Homo sapiens
gtaaatttggcttct

SEQ ID NO: 2664923 - DNA, 16 bp, Homo sapiens
gtaaatttggcttctg

SEQ ID NO: 2664924 - DNA, 14 bp, Homo sapiens
tgaatataaacact

SEQ ID NO: 2664925 - DNA, 22 bp, Homo sapiens
tgacaactacagaaaaaccaga

SEQ ID NO: 2664926 - DNA, 17 bp, Homo sapiens
tgacagaacactgtctt

SEQ ID NO: 2664927 - DNA, 22 bp, Homo sapiens
tgacagagcaagactctgtcta

SEQ ID NO: 2664928 - DNA, 21 bp, Homo sapiens
tgacagtggccgcccaaggcc

SEQ ID NO: 2664929 - DNA, 18 bp, Homo sapiens
tgaccctgtatatagccc

SEQ ID NO: 2664930 - DNA, 19 bp, Homo sapiens
tgaccctgtatatagccca

SEQ ID NO: 2664931 - DNA, 18 bp, Homo sapiens
tgaccttgatgagctgtg

SEQ ID NO: 2664932 - DNA, 19 bp, Homo sapiens
tgaccttgatgagctgtgc

SEQ ID NO: 2664933 - DNA, 22 bp, Homo sapiens
tgaccttgatgagctgtgcaca

SEQ ID NO: 2664934 - DNA, 23 bp, Homo sapiens
tgactaattcttgcatattttgt

SEQ ID NO: 2664935 - DNA, 16 bp, Homo sapiens
tgactcaagattccca

SEQ ID NO: 2664936 - DNA, 21 bp, Homo sapiens
tgactcaagattcccaggagt

SEQ ID NO: 2664937 - DNA, 17 bp, Homo sapiens
tgacttgacagaacact

SEQ ID NO: 2664938 - DNA, 19 bp, Homo sapiens
tgacttgacagaacactgt

SEQ ID NO: 2664939 - DNA, 22 bp, Homo sapiens
tgagaagaaaatggaaccaggc

SEQ ID NO: 2664940 - DNA, 23 bp, Homo sapiens
tgagaagattcttcccattctcc

SEQ ID NO: 2664941 - DNA, 14 bp, Homo sapiens
tgagattaattcct

SEQ ID NO: 2664942 - DNA, 20 bp, Homo sapiens
tgagcggtgctgtcctcagg

SEQ ID NO: 2664943 - DNA, 21 bp, Homo sapiens
tgagcggtgctgtcctcaggt

SEQ ID NO: 2664944 - DNA, 15 bp, Homo sapiens
tgagctctttgcact

SEQ ID NO: 2664945 - DNA, 14 bp, Homo sapiens
tgagctgcagaaac

SEQ ID NO: 2664946 - DNA, 15 bp, Homo sapiens
tgagctgcagaaacg

SEQ ID NO: 2664947 - DNA, 17 bp, Homo sapiens
tgagctgcagaaacgaa

SEQ ID NO: 2664948 - DNA, 20 bp, Homo sapiens
tgagctgtgcacaaagtggc

SEQ ID NO: 2664949 - DNA, 23 bp, Homo sapiens
tgagggatctatacttgctttgt

SEQ ID NO: 2664950 - DNA, 23 bp, Homo sapiens
tgagtcacaaagaacatgtagaa

SEQ ID NO: 2664951 - DNA, 23 bp, Homo sapiens
tgagtggcttcactcctgctgta

SEQ ID NO: 2664952 - DNA, 16 bp, Homo sapiens
tgatagtggtggagtt

SEQ ID NO: 2664953 - DNA, 14 bp, Homo sapiens
tgatataaataaaa

SEQ ID NO: 2664954 - DNA, 19 bp, Homo sapiens
tgatatttgtgcattttct

SEQ ID NO: 2664955 - DNA, 14 bp, Homo sapiens
tgatctgaaaaata

SEQ ID NO: 2664956 - DNA, 19 bp, Homo sapiens
tgatctgtgaattgagctg

SEQ ID NO: 2664957 - DNA, 14 bp, Homo sapiens
tgatgactcaagat

SEQ ID NO: 2664958 - DNA, 13 bp, Homo sapiens
tgatgctatttgc

SEQ ID NO: 2664959 - DNA, 21 bp, Homo sapiens
tgatggcccattctacttgct

SEQ ID NO: 2664960 - DNA, 18 bp, Homo sapiens
tgatgtgggtcaaggaat

SEQ ID NO: 2664961 - DNA, 20 bp, Homo sapiens
tgattcacttcacgctttca

SEQ ID NO: 2664962 - DNA, 21 bp, Homo sapiens
tgcaaccagggagctgcaggg

SEQ ID NO: 2664963 - DNA, 19 bp, Homo sapiens
tgcaaggaagccacagctg

SEQ ID NO: 2664964 - DNA, 16 bp, Homo sapiens
tgcaatgactcaggac

SEQ ID NO: 2664965 - DNA, 14 bp, Homo sapiens
tgcacaaagtggca

SEQ ID NO: 2664966 - DNA, 17 bp, Homo sapiens
tgcactctttaagggag

SEQ ID NO: 2664967 - DNA, 22 bp, Homo sapiens
tgcactttctcatgatttacag

SEQ ID NO: 2664968 - DNA, 14 bp, Homo sapiens
tgcagccagaggca

SEQ ID NO: 2664969 - DNA, 15 bp, Homo sapiens
tgcagggacaaagag

SEQ ID NO: 2664970 - DNA, 11 bp, Homo sapiens
tgcataataaa

SEQ ID NO: 2664971 - DNA, 13 bp, Homo sapiens
tgcataatttcag

SEQ ID NO: 2664972 - DNA, 17 bp, Homo sapiens
tgcatatatacatatat

SEQ ID NO: 2664973 - DNA, 19 bp, Homo sapiens
tgcatgaaggtttctgaaa

SEQ ID NO: 2664974 - DNA, 15 bp, Homo sapiens
tgcatttgtatattt

SEQ ID NO: 2664975 - DNA, 20 bp, Homo sapiens
tgcccagcggacagtggcag

SEQ ID NO: 2664976 - DNA, 21 bp, Homo sapiens
tgcccagcggacagtggcagg

SEQ ID NO: 2664977 - DNA, 18 bp, Homo sapiens
tgccccattcttttgtaa

SEQ ID NO: 2664978 - DNA, 20 bp, Homo sapiens
tgcccccgcatcccctgcct

SEQ ID NO: 2664979 - DNA, 14 bp, Homo sapiens
tgccctcccctctc

SEQ ID NO: 2664980 - DNA, 17 bp, Homo sapiens
tgccctcccctctctgc

SEQ ID NO: 2664981 - DNA, 21 bp, Homo sapiens
tgccctcccctctctgcaccg

SEQ ID NO: 2664982 - DNA, 20 bp, Homo sapiens
tgccgcgtcgccctcccagg

SEQ ID NO: 2664983 - DNA, 19 bp, Homo sapiens
tgcctcagccctgaccctg

SEQ ID NO: 2664984 - DNA, 15 bp, Homo sapiens
tgcctccatcctagt

SEQ ID NO: 2664985 - DNA, 13 bp, Homo sapiens
tgcctccctggtg

SEQ ID NO: 2664986 - DNA, 22 bp, Homo sapiens
tgcctccctggtgagagggccg

SEQ ID NO: 2664987 - DNA, 22 bp, Homo sapiens
tgcctccgcgtgatcaaagcca

SEQ ID NO: 2664988 - DNA, 14 bp, Homo sapiens
tgcctttacttcag

SEQ ID NO: 2664989 - DNA, 17 bp, Homo sapiens
tgcctttggcagagttc

SEQ ID NO: 2664990 - DNA, 19 bp, Homo sapiens
tgcgacactgggaggccag

SEQ ID NO: 2664991 - DNA, 17 bp, Homo sapiens
tgcgcccagtccttcca

SEQ ID NO: 2664992 - DNA, 18 bp, Homo sapiens
tgcgcccagtccttccac

SEQ ID NO: 2664993 - DNA, 12 bp, Homo sapiens
tgctagcacatg

SEQ ID NO: 2664994 - DNA, 16 bp, Homo sapiens
tgctcagaccagctct

SEQ ID NO: 2664995 - DNA, 20 bp, Homo sapiens
tgctcaggagacctggagga

SEQ ID NO: 2664996 - DNA, 21 bp, Homo sapiens
tgctcattctaatgatggccc

SEQ ID NO: 2664997 - DNA, 12 bp, Homo sapiens
tgctctggacct

SEQ ID NO: 2664998 - DNA, 14 bp, Homo sapiens
tgctctggacctgc

SEQ ID NO: 2664999 - DNA, 15 bp, Homo sapiens
tgctctggacctgcc

SEQ ID NO: 2665000 - DNA, 20 bp, Homo sapiens
tgctctggacctgcccccgc

SEQ ID NO: 2665001 - DNA, 20 bp, Homo sapiens
tgctgcggagcaagaggagg

SEQ ID NO: 2665002 - DNA, 15 bp, Homo sapiens
tgctggttttaacaa

SEQ ID NO: 2665003 - DNA, 23 bp, Homo sapiens
tgcttccatggccgtgtagaagc

SEQ ID NO: 2665004 - DNA, 15 bp, Homo sapiens
tgctttctgaagctt

SEQ ID NO: 2665005 - DNA, 17 bp, Homo sapiens
tggaaaaaaaaaagaca

SEQ ID NO: 2665006 - DNA, 21 bp, Homo sapiens
tggaaactggatgaggtcata

SEQ ID NO: 2665007 - DNA, 15 bp, Homo sapiens
tggaaccaggcttgg

SEQ ID NO: 2665008 - DNA, 19 bp, Homo sapiens
tggaagggatggggtgcca

SEQ ID NO: 2665009 - DNA, 13 bp, Homo sapiens
tggacacaggcct

SEQ ID NO: 2665010 - DNA, 12 bp, Homo sapiens
tggacagaagaa

SEQ ID NO: 2665011 - DNA, 15 bp, Homo sapiens
tggacggctgggcac

SEQ ID NO: 2665012 - DNA, 17 bp, Homo sapiens
tggactccggccctcct

SEQ ID NO: 2665013 - DNA, 17 bp, Homo sapiens
tggactgacctggtcca

SEQ ID NO: 2665014 - DNA, 20 bp, Homo sapiens
tggaggagctcaggacacta

SEQ ID NO: 2665015 - DNA, 22 bp, Homo sapiens
tggaggagctcaggacactaat

SEQ ID NO: 2665016 - DNA, 14 bp, Homo sapiens
tggcacccaagacc

SEQ ID NO: 2665017 - DNA, 20 bp, Homo sapiens
tggcaggacgtgggctgggc

SEQ ID NO: 2665018 - DNA, 22 bp, Homo sapiens
tggccatgaagaggatgctgtg

SEQ ID NO: 2665019 - DNA, 20 bp, Homo sapiens
tggccatgcctcagccctga

SEQ ID NO: 2665020 - DNA, 21 bp, Homo sapiens
tggcccattctacttgctctg

SEQ ID NO: 2665021 - DNA, 23 bp, Homo sapiens
tggcccattctacttgctctgga

SEQ ID NO: 2665022 - DNA, 21 bp, Homo sapiens
tggcctgaagagtcctctgaa

SEQ ID NO: 2665023 - DNA, 14 bp, Homo sapiens
tggcttcactcctg

SEQ ID NO: 2665024 - DNA, 16 bp, Homo sapiens
tggcttctctgaggaa

SEQ ID NO: 2665025 - DNA, 24 bp, Homo sapiens
tgggacctccaccgttggtgttca

SEQ ID NO: 2665026 - DNA, 14 bp, Homo sapiens
tgggatgtttctgt

SEQ ID NO: 2665027 - DNA, 20 bp, Homo sapiens
tgggcacaaagggcccagat

SEQ ID NO: 2665028 - DNA, 18 bp, Homo sapiens
tgggccatgttgtgcctc

SEQ ID NO: 2665029 - DNA, 18 bp, Homo sapiens
tgggcccacaaaggcaaa

SEQ ID NO: 2665030 - DNA, 16 bp, Homo sapiens
tgggccctctggtttg

SEQ ID NO: 2665031 - DNA, 17 bp, Homo sapiens
tgggcgggcaggggagg

SEQ ID NO: 2665032 - DNA, 22 bp, Homo sapiens
tgggcgggcaggggagggtcag

SEQ ID NO: 2665033 - DNA, 21 bp, Homo sapiens
tgggggcggggtgggaaagat

SEQ ID NO: 2665034 - DNA, 13 bp, Homo sapiens
tgggtcaaggaat

SEQ ID NO: 2665035 - DNA, 20 bp, Homo sapiens
tgggtggggaggaaatagaa

SEQ ID NO: 2665036 - DNA, 21 bp, Homo sapiens
tggtcaggtatttcagttctt

SEQ ID NO: 2665037 - DNA, 13 bp, Homo sapiens
tggtccacagggc

SEQ ID NO: 2665038 - DNA, 15 bp, Homo sapiens
tggtccacagggcac

SEQ ID NO: 2665039 - DNA, 15 bp, Homo sapiens
tggtggtatctgagt

SEQ ID NO: 2665040 - DNA, 20 bp, Homo sapiens
tggttttaacaactgtgctt

SEQ ID NO: 2665041 - DNA, 21 bp, Homo sapiens
agaagaaggcagcaggtggca

SEQ ID NO: 2665042 - DNA, 13 bp, Homo sapiens
agaagagccacag

SEQ ID NO: 2665043 - DNA, 13 bp, Homo sapiens
agaagctaagctg

SEQ ID NO: 2665044 - DNA, 15 bp, Homo sapiens
agaagggctgcatga

SEQ ID NO: 2665045 - DNA, 20 bp, Homo sapiens
agaagggctgcatgatgttt

SEQ ID NO: 2665046 - DNA, 18 bp, Homo sapiens
agaagtaggggaagacat

SEQ ID NO: 2665047 - DNA, 21 bp, Homo sapiens
agaatagttgaacctatttct

SEQ ID NO: 2665048 - DNA, 23 bp, Homo sapiens
agaatagttgaacctatttctct

SEQ ID NO: 2665049 - DNA, 19 bp, Homo sapiens
agaatatttggttttcctg

SEQ ID NO: 2665050 - DNA, 19 bp, Homo sapiens
agaatcagtcttgcagctg

SEQ ID NO: 2665051 - DNA, 15 bp, Homo sapiens
agaatggggtgcatg

SEQ ID NO: 2665052 - DNA, 13 bp, Homo sapiens
agacacaggatga

SEQ ID NO: 2665053 - DNA, 13 bp, Homo sapiens
agacactgaaata

SEQ ID NO: 2665054 - DNA, 22 bp, Homo sapiens
agacactgaaatatacacacag

SEQ ID NO: 2665055 - DNA, 12 bp, Homo sapiens
agacattgcacc

SEQ ID NO: 2665056 - DNA, 12 bp, Homo sapiens
agaccagctctt

SEQ ID NO: 2665057 - DNA, 22 bp, Homo sapiens
agacccaacacatgggacctat

SEQ ID NO: 2665058 - DNA, 16 bp, Homo sapiens
agacctttcaaagcca

SEQ ID NO: 2665059 - DNA, 19 bp, Homo sapiens
agacctttcaaagccattt

SEQ ID NO: 2665060 - DNA, 20 bp, Homo sapiens
agactcacaacctgaaccta

SEQ ID NO: 2665061 - DNA, 11 bp, Homo sapiens
agactcctcag

SEQ ID NO: 2665062 - DNA, 21 bp, Homo sapiens
agactctgtctaaaaaacaaa

SEQ ID NO: 2665063 - DNA, 19 bp, Homo sapiens
agactgatcaggacctcca

SEQ ID NO: 2665064 - DNA, 13 bp, Homo sapiens
agagaaaaagaaa

SEQ ID NO: 2665065 - DNA, 14 bp, Homo sapiens
agagaaaaagaaat

SEQ ID NO: 2665066 - DNA, 20 bp, Homo sapiens
agagaaaaagaaatgcaaaa

SEQ ID NO: 2665067 - DNA, 12 bp, Homo sapiens
agagaaaaagag

SEQ ID NO: 2665068 - DNA, 22 bp, Homo sapiens
agagaggcagaagaaccctggc

SEQ ID NO: 2665069 - DNA, 18 bp, Homo sapiens
agagcaagactctgtcta

SEQ ID NO: 2665070 - DNA, 14 bp, Homo sapiens
agagctttctttca

SEQ ID NO: 2665071 - DNA, 18 bp, Homo sapiens
agaggataattagcatct

SEQ ID NO: 2665072 - DNA, 12 bp, Homo sapiens
agagtcctctga

SEQ ID NO: 2665073 - DNA, 13 bp, Homo sapiens
agataaagccaga

SEQ ID NO: 2665074 - DNA, 16 bp, Homo sapiens
agatctctgcagggcc

SEQ ID NO: 2665075 - DNA, 13 bp, Homo sapiens
agattcccaggag

SEQ ID NO: 2665076 - DNA, 16 bp, Homo sapiens
agattcccaggagttc

SEQ ID NO: 2665077 - DNA, 13 bp, Homo sapiens
agcaaacacatta

SEQ ID NO: 2665078 - DNA, 20 bp, Homo sapiens
agcaacattttacccacaca

SEQ ID NO: 2665079 - DNA, 17 bp, Homo sapiens
agcaagactgttagccc

SEQ ID NO: 2665080 - DNA, 14 bp, Homo sapiens
agcaagtcagggtt

SEQ ID NO: 2665081 - DNA, 23 bp, Homo sapiens
agcacatgccctaatgtctgtat

SEQ ID NO: 2665082 - DNA, 16 bp, Homo sapiens
agcagactgatcagga

SEQ ID NO: 2665083 - DNA, 18 bp, Homo sapiens
agcagactgatcaggacc

SEQ ID NO: 2665084 - DNA, 12 bp, Homo sapiens
agcagctctccc

SEQ ID NO: 2665085 - DNA, 15 bp, Homo sapiens
agcattgatatttgt

SEQ ID NO: 2665086 - DNA, 14 bp, Homo sapiens
agcattttcctctg

SEQ ID NO: 2665087 - DNA, 21 bp, Homo sapiens
agcattttcctctgctttgaa

SEQ ID NO: 2665088 - DNA, 17 bp, Homo sapiens
agccacaaccacataca

SEQ ID NO: 2665089 - DNA, 22 bp, Homo sapiens
agccacagtgagggagatccca

SEQ ID NO: 2665090 - DNA, 13 bp, Homo sapiens
agccagaggactg

SEQ ID NO: 2665091 - DNA, 22 bp, Homo sapiens
agccagcgggaatggcagctgc

SEQ ID NO: 2665092 - DNA, 23 bp, Homo sapiens
agccatgggcacaaagggcccag

SEQ ID NO: 2665093 - DNA, 14 bp, Homo sapiens
agcccaaagaagga

SEQ ID NO: 2665094 - DNA, 16 bp, Homo sapiens
agcccaaagaaggaaa

SEQ ID NO: 2665095 - DNA, 15 bp, Homo sapiens
agcccccccttccac

SEQ ID NO: 2665096 - DNA, 20 bp, Homo sapiens
agcccgcggggacattggga

SEQ ID NO: 2665097 - DNA, 15 bp, Homo sapiens
agccctgaccctgtg

SEQ ID NO: 2665098 - DNA, 16 bp, Homo sapiens
agccctgggatcactg

SEQ ID NO: 2665099 - DNA, 14 bp, Homo sapiens
agcctaggccaggt

SEQ ID NO: 2665100 - DNA, 14 bp, Homo sapiens
agcctccctgcctc

SEQ ID NO: 2665101 - DNA, 23 bp, Homo sapiens
agcctccctgcctcaggcctctg

SEQ ID NO: 2665102 - DNA, 15 bp, Homo sapiens
agcctttcttttgga

SEQ ID NO: 2665103 - DNA, 16 bp, Homo sapiens
agcggacagtggcagg

SEQ ID NO: 2665104 - DNA, 17 bp, Homo sapiens
agcggacagtggcagga

SEQ ID NO: 2665105 - DNA, 19 bp, Homo sapiens
agcggacatcagctggtca

SEQ ID NO: 2665106 - DNA, 18 bp, Homo sapiens
agcgtactcatcatcaac

SEQ ID NO: 2665107 - DNA, 17 bp, Homo sapiens
agctacccgcagagttc

SEQ ID NO: 2665108 - DNA, 12 bp, Homo sapiens
agctagccagag

SEQ ID NO: 2665109 - DNA, 22 bp, Homo sapiens
agctatttttatttgtttgtgc

SEQ ID NO: 2665110 - DNA, 18 bp, Homo sapiens
agctcataagagccacag

SEQ ID NO: 2665111 - DNA, 15 bp, Homo sapiens
agctcccaggtgcag

SEQ ID NO: 2665112 - DNA, 13 bp, Homo sapiens
agctcgctaaagt

SEQ ID NO: 2665113 - DNA, 16 bp, Homo sapiens
agctcttggctccact

SEQ ID NO: 2665114 - DNA, 14 bp, Homo sapiens
agctgaaagttggg

SEQ ID NO: 2665115 - DNA, 15 bp, Homo sapiens
agctgagtgaaaaat

SEQ ID NO: 2665116 - DNA, 21 bp, Homo sapiens
agctgctcagggaaaagcagc

SEQ ID NO: 2665117 - DNA, 19 bp, Homo sapiens
agctggccccgccgcctgg

SEQ ID NO: 2665118 - DNA, 17 bp, Homo sapiens
agctgggatgtttctgt

SEQ ID NO: 2665119 - DNA, 18 bp, Homo sapiens
agcttcaccccaatccca

SEQ ID NO: 2665120 - DNA, 22 bp, Homo sapiens
aggaaaaaaatcgtccagggag

SEQ ID NO: 2665121 - DNA, 20 bp, Homo sapiens
aggaaaagcggacatcagct

SEQ ID NO: 2665122 - DNA, 15 bp, Homo sapiens
aggaaaatattttga

SEQ ID NO: 2665123 - DNA, 22 bp, Homo sapiens
aggaaaatattttgatcttcaa

SEQ ID NO: 2665124 - DNA, 18 bp, Homo sapiens
aggaagacccaacacatg

SEQ ID NO: 2665125 - DNA, 19 bp, Homo sapiens
aggaattttctccaatttt

SEQ ID NO: 2665126 - DNA, 15 bp, Homo sapiens
aggacccaagcagag

SEQ ID NO: 2665127 - DNA, 15 bp, Homo sapiens
aggacgtgggctggg

SEQ ID NO: 2665128 - DNA, 19 bp, Homo sapiens
aggacgtgggctgggccca

SEQ ID NO: 2665129 - DNA, 20 bp, Homo sapiens
aggactgtgatgccctgccc

SEQ ID NO: 2665130 - DNA, 16 bp, Homo sapiens
aggagcttcctgtcct

SEQ ID NO: 2665131 - DNA, 20 bp, Homo sapiens
aggagcttcctgtcctccca

SEQ ID NO: 2665132 - DNA, 15 bp, Homo sapiens
aggagttctgctcat

SEQ ID NO: 2665133 - DNA, 13 bp, Homo sapiens
aggatcttttgaa

SEQ ID NO: 2665134 - DNA, 18 bp, Homo sapiens
aggatcttttgaacccag

SEQ ID NO: 2665135 - DNA, 15 bp, Homo sapiens
aggattcctcttttc

SEQ ID NO: 2665136 - DNA, 19 bp, Homo sapiens
aggattcctcttttctctg

SEQ ID NO: 2665137 - DNA, 16 bp, Homo sapiens
aggcaaagggtccaga

SEQ ID NO: 2665138 - DNA, 12 bp, Homo sapiens
aggcacctcaag

SEQ ID NO: 2665139 - DNA, 18 bp, Homo sapiens
aggccaaggcgggtggat

SEQ ID NO: 2665140 - DNA, 12 bp, Homo sapiens
aggccaggtgca

SEQ ID NO: 2665141 - DNA, 21 bp, Homo sapiens
aggccatccttccctgtctgc

SEQ ID NO: 2665142 - DNA, 14 bp, Homo sapiens
aggcctcctggccc

SEQ ID NO: 2665143 - DNA, 15 bp, Homo sapiens
aggcctctgtgccgc

SEQ ID NO: 2665144 - DNA, 19 bp, Homo sapiens
aggccttatctccaagacc

SEQ ID NO: 2665145 - DNA, 14 bp, Homo sapiens
aggcggtgggcacc

SEQ ID NO: 2665146 - DNA, 21 bp, Homo sapiens
aggctaaagcccagagacagc

SEQ ID NO: 2665147 - DNA, 18 bp, Homo sapiens
aggctctgtttatgcttt

SEQ ID NO: 2665148 - DNA, 14 bp, Homo sapiens
aggcttaaacccat

SEQ ID NO: 2665149 - DNA, 16 bp, Homo sapiens
aggcttgcctgcaggc

SEQ ID NO: 2665150 - DNA, 17 bp, Homo sapiens
aggcttgcctgcaggca

SEQ ID NO: 2665151 - DNA, 16 bp, Homo sapiens
agggaattgcagagta

SEQ ID NO: 2665152 - DNA, 13 bp, Homo sapiens
agggacctctccc

SEQ ID NO: 2665153 - DNA, 21 bp, Homo sapiens
agggagaagactatattgtac

SEQ ID NO: 2665154 - DNA, 21 bp, Homo sapiens
agggagacctggacacaggcc

SEQ ID NO: 2665155 - DNA, 19 bp, Homo sapiens
agggagcaagtccttccct

SEQ ID NO: 2665156 - DNA, 19 bp, Homo sapiens
agggagcaggcggtgggca

SEQ ID NO: 2665157 - DNA, 16 bp, Homo sapiens
agggagcgagggagaa

SEQ ID NO: 2665158 - DNA, 15 bp, Homo sapiens
agggagctgcagggg

SEQ ID NO: 2665159 - DNA, 19 bp, Homo sapiens
agggatctatacttgcttt

SEQ ID NO: 2665160 - DNA, 23 bp, Homo sapiens
agggcagcgggagcctccctgcc

SEQ ID NO: 2665161 - DNA, 16 bp, Homo sapiens
agggccaacccttctc

SEQ ID NO: 2665162 - DNA, 17 bp, Homo sapiens
agggccaacccttctcc

SEQ ID NO: 2665163 - DNA, 21 bp, Homo sapiens
agggccaacccttctcctctt

SEQ ID NO: 2665164 - DNA, 19 bp, Homo sapiens
agggctcctctccagtctg

SEQ ID NO: 2665165 - DNA, 18 bp, Homo sapiens
aggggacccccgccccct

SEQ ID NO: 2665166 - DNA, 22 bp, Homo sapiens
aggggacccccgccccctgccc

SEQ ID NO: 2665167 - DNA, 13 bp, Homo sapiens
aggggccagaaga

SEQ ID NO: 2665168 - DNA, 21 bp, Homo sapiens
aggggtcgacttcgggctggc

SEQ ID NO: 2665169 - DNA, 19 bp, Homo sapiens
agggtcagaaacaggaccg

SEQ ID NO: 2665170 - DNA, 19 bp, Homo sapiens
agggtcagccagggcctgc

SEQ ID NO: 2665171 - DNA, 19 bp, Homo sapiens
agggtccagaaggagacag

SEQ ID NO: 2665172 - DNA, 20 bp, Homo sapiens
aggtatgaccttctaggaag

SEQ ID NO: 2665173 - DNA, 23 bp, Homo sapiens
aggtatgaccttctaggaagctc

SEQ ID NO: 2665174 - DNA, 16 bp, Homo sapiens
aggtgggcgggcaggg

SEQ ID NO: 2665175 - DNA, 13 bp, Homo sapiens
agtaaaaatacaa

SEQ ID NO: 2665176 - DNA, 20 bp, Homo sapiens
agtaacccccactggactga

SEQ ID NO: 2665177 - DNA, 19 bp, Homo sapiens
agtacaccacaagggtcac

SEQ ID NO: 2665178 - DNA, 17 bp, Homo sapiens
agtaccaccaaaaaagc

SEQ ID NO: 2665179 - DNA, 20 bp, Homo sapiens
agtagaaagacagagctggg

SEQ ID NO: 2665180 - DNA, 17 bp, Homo sapiens
agtagatgttctacttt

SEQ ID NO: 2665181 - DNA, 15 bp, Homo sapiens
agtattaaaatttgg

SEQ ID NO: 2665182 - DNA, 14 bp, Homo sapiens
agtcaattaacaat

SEQ ID NO: 2665183 - DNA, 18 bp, Homo sapiens
agtcacaaagaacatgta

SEQ ID NO: 2665184 - DNA, 20 bp, Homo sapiens
agtcataaaatgtatcttcc

SEQ ID NO: 2665185 - DNA, 20 bp, Homo sapiens
agtccagaaactgttcccac

SEQ ID NO: 2665186 - DNA, 21 bp, Homo sapiens
agtccatatttcaatttccaa

SEQ ID NO: 2665187 - DNA, 13 bp, Homo sapiens
agtccccagagaa

SEQ ID NO: 2665188 - DNA, 12 bp, Homo sapiens
agtcctctgaat

SEQ ID NO: 2665189 - DNA, 11 bp, Homo sapiens
agtccttccac

SEQ ID NO: 2665190 - DNA, 16 bp, Homo sapiens
agtctgttttgtaaag

SEQ ID NO: 2665191 - DNA, 17 bp, Homo sapiens
agtcttgacgagtgtga

SEQ ID NO: 2665192 - DNA, 14 bp, Homo sapiens
agtgaaagcatcac

SEQ ID NO: 2665193 - DNA, 16 bp, Homo sapiens
agtgagggagatccca

SEQ ID NO: 2665194 - DNA, 20 bp, Homo sapiens
agtgatcttttgttcccatc

SEQ ID NO: 2665195 - DNA, 20 bp, Homo sapiens
agtgccccattcttttgtaa

SEQ ID NO: 2665196 - DNA, 17 bp, Homo sapiens
agtggcaggacaggaaa

SEQ ID NO: 2665197 - DNA, 19 bp, Homo sapiens
agtggcttcactcctgctg

SEQ ID NO: 2665198 - DNA, 20 bp, Homo sapiens
agtggcttcactcctgctgt

SEQ ID NO: 2665199 - DNA, 14 bp, Homo sapiens
agtgtactcccagg

SEQ ID NO: 2665200 - DNA, 20 bp, Homo sapiens
agtgtggagtcattctcatt

SEQ ID NO: 2665201 - DNA, 17 bp, Homo sapiens
agtgtttaacttgtcaa

SEQ ID NO: 2665202 - DNA, 21 bp, Homo sapiens
agttctgctcattctaatgat

SEQ ID NO: 2665203 - DNA, 22 bp, Homo sapiens
agttgacttgacagaacactgt

SEQ ID NO: 2665204 - DNA, 12 bp, Homo sapiens
ataaaaaggtgt

SEQ ID NO: 2665205 - DNA, 20 bp, Homo sapiens
ataaaacattttcacacaat

SEQ ID NO: 2665206 - DNA, 22 bp, Homo sapiens
ataaacatttgtagcatcctct

SEQ ID NO: 2665207 - DNA, 14 bp, Homo sapiens
ataaagcaaataga

SEQ ID NO: 2665208 - DNA, 18 bp, Homo sapiens
ataaagcaaatagacaca

SEQ ID NO: 2665209 - DNA, 23 bp, Homo sapiens
ataaagtgctgcggagcaagagg

SEQ ID NO: 2665210 - DNA, 23 bp, Homo sapiens
ataaatattgtctttttgtatgt

SEQ ID NO: 2665211 - DNA, 19 bp, Homo sapiens
ataacagattttttttgga

SEQ ID NO: 2665212 - DNA, 11 bp, Homo sapiens
ataagaaaaac

SEQ ID NO: 2665213 - DNA, 12 bp, Homo sapiens
ataagaaaaact

SEQ ID NO: 2665214 - DNA, 21 bp, Homo sapiens
ataagctaacaccagacagac

SEQ ID NO: 2665215 - DNA, 22 bp, Homo sapiens
ataatactatatttatactgta

SEQ ID NO: 2665216 - DNA, 14 bp, Homo sapiens
ataatatatttgtg

SEQ ID NO: 2665217 - DNA, 20 bp, Homo sapiens
ataatatttttaattaaata

SEQ ID NO: 2665218 - DNA, 18 bp, Homo sapiens
ataatcatctctgtcaca

SEQ ID NO: 2665219 - DNA, 15 bp, Homo sapiens
ataattgtatatatg

SEQ ID NO: 2665220 - DNA, 12 bp, Homo sapiens
atactggcatgc

SEQ ID NO: 2665221 - DNA, 21 bp, Homo sapiens
atagttgaacctatttctctt

SEQ ID NO: 2665222 - DNA, 14 bp, Homo sapiens
atataaaaaacttt

SEQ ID NO: 2665223 - DNA, 19 bp, Homo sapiens
atataaatgttaagaaaaa

SEQ ID NO: 2665224 - DNA, 13 bp, Homo sapiens
atatacacacagc

SEQ ID NO: 2665225 - DNA, 21 bp, Homo sapiens
atatatttgtgtatttaacag

SEQ ID NO: 2665226 - DNA, 13 bp, Homo sapiens
atatattttaatt

SEQ ID NO: 2665227 - DNA, 14 bp, Homo sapiens
atatcctttgcctc

SEQ ID NO: 2665228 - DNA, 14 bp, Homo sapiens
atattgtctttttg

SEQ ID NO: 2665229 - DNA, 23 bp, Homo sapiens
atatttccaggctgcatttgtat

SEQ ID NO: 2665230 - DNA, 16 bp, Homo sapiens
atatttggttttcctg

SEQ ID NO: 2665231 - DNA, 14 bp, Homo sapiens
atatttgtgcattt

SEQ ID NO: 2665232 - DNA, 21 bp, Homo sapiens
atatttgtgcattttctaaac

SEQ ID NO: 2665233 - DNA, 18 bp, Homo sapiens
atattttcattaaaagct

SEQ ID NO: 2665234 - DNA, 18 bp, Homo sapiens
atattttccatgaaaatg

SEQ ID NO: 2665235 - DNA, 15 bp, Homo sapiens
atattttgatcttca

SEQ ID NO: 2665236 - DNA, 19 bp, Homo sapiens
atattttgatcttcaacaa

SEQ ID NO: 2665237 - DNA, 22 bp, Homo sapiens
atattttgatcttcaacaaatt

SEQ ID NO: 2665238 - DNA, 17 bp, Homo sapiens
atattttttaaaaatct

SEQ ID NO: 2665239 - DNA, 14 bp, Homo sapiens
atcaagaagggctg

SEQ ID NO: 2665240 - DNA, 16 bp, Homo sapiens
atcaagaagggctgca

SEQ ID NO: 2665241 - DNA, 19 bp, Homo sapiens
atcaagaagggctgcatga

SEQ ID NO: 2665242 - DNA, 21 bp, Homo sapiens
atcaagagttgtgacaacttc

SEQ ID NO: 2665243 - DNA, 20 bp, Homo sapiens
atcactctgtgtctgagtgg

SEQ ID NO: 2665244 - DNA, 18 bp, Homo sapiens
atcagtggatttcccatc

SEQ ID NO: 2665245 - DNA, 16 bp, Homo sapiens
atcatcaagaagggct

SEQ ID NO: 2665246 - DNA, 17 bp, Homo sapiens
atcatcaagaagggctg

SEQ ID NO: 2665247 - DNA, 14 bp, Homo sapiens
atccacttctttca

SEQ ID NO: 2665248 - DNA, 13 bp, Homo sapiens
atcccctgcctcc

SEQ ID NO: 2665249 - DNA, 22 bp, Homo sapiens
atccctaggtcttgggagctct

SEQ ID NO: 2665250 - DNA, 13 bp, Homo sapiens
atcctattctttc

SEQ ID NO: 2665251 - DNA, 17 bp, Homo sapiens
atccttcctcacaccag

SEQ ID NO: 2665252 - DNA, 16 bp, Homo sapiens
atccttttttaaaagt

SEQ ID NO: 2665253 - DNA, 13 bp, Homo sapiens
atctaatttataa

SEQ ID NO: 2665254 - DNA, 16 bp, Homo sapiens
atctactttaataaat

SEQ ID NO: 2665255 - DNA, 16 bp, Homo sapiens
atctaggaaaatattt

SEQ ID NO: 2665256 - DNA, 17 bp, Homo sapiens
atctaggaaaatatttt

SEQ ID NO: 2665257 - DNA, 13 bp, Homo sapiens
atctatttaagta

SEQ ID NO: 2665258 - DNA, 21 bp, Homo sapiens
atctcaggttaagtgtgagta

SEQ ID NO: 2665259 - DNA, 22 bp, Homo sapiens
atcttatcaagagttgtgacaa

SEQ ID NO: 2665260 - DNA, 12 bp, Homo sapiens
atcttcaacaaa

SEQ ID NO: 2665261 - DNA, 21 bp, Homo sapiens
atcttgataccacctatatag

SEQ ID NO: 2665262 - DNA, 22 bp, Homo sapiens
atcttgtggctttgcaaccatt

SEQ ID NO: 2665263 - DNA, 12 bp, Homo sapiens
atctttgtgaag

SEQ ID NO: 2665264 - DNA, 14 bp, Homo sapiens
atgaaccttctggc

SEQ ID NO: 2665265 - DNA, 22 bp, Homo sapiens
atgaagatatttgctttaataa

SEQ ID NO: 2665266 - DNA, 17 bp, Homo sapiens
atgacaactacagaaaa

SEQ ID NO: 2665267 - DNA, 20 bp, Homo sapiens
atgactcaagattcccagga

SEQ ID NO: 2665268 - DNA, 22 bp, Homo sapiens
atgactcaagattcccaggagt

SEQ ID NO: 2665269 - DNA, 19 bp, Homo sapiens
atgactcaggacatccccc

SEQ ID NO: 2665270 - DNA, 19 bp, Homo sapiens
atgagttagaataataaat

SEQ ID NO: 2665271 - DNA, 15 bp, Homo sapiens
atgatcttttcaagt

SEQ ID NO: 2665272 - DNA, 12 bp, Homo sapiens
atgatggcccat

SEQ ID NO: 2665273 - DNA, 19 bp, Homo sapiens
atgatggcccattctactt

SEQ ID NO: 2665274 - DNA, 11 bp, Homo sapiens
atgcaaaaatc

SEQ ID NO: 2665275 - DNA, 24 bp, Homo sapiens
atgcacctgaatgttagatagtta

SEQ ID NO: 2665276 - DNA, 21 bp, Homo sapiens
atgcagcctaaggctgtatga

SEQ ID NO: 2665277 - DNA, 18 bp, Homo sapiens
atgcagtctgtccaggct

SEQ ID NO: 2665278 - DNA, 11 bp, Homo sapiens
ccacagggcac

SEQ ID NO: 2665279 - DNA, 19 bp, Homo sapiens
ccacagggcacctgccacc

SEQ ID NO: 2665280 - DNA, 13 bp, Homo sapiens
ccactggactgac

SEQ ID NO: 2665281 - DNA, 19 bp, Homo sapiens
ccactggggtccagggagc

SEQ ID NO: 2665282 - DNA, 22 bp, Homo sapiens
ccactggggtccagggagcagg

SEQ ID NO: 2665283 - DNA, 18 bp, Homo sapiens
ccagaagatgaacagact

SEQ ID NO: 2665284 - DNA, 19 bp, Homo sapiens
ccagaagatgaacagactg

SEQ ID NO: 2665285 - DNA, 23 bp, Homo sapiens
ccagaagatgaacagactgacct

SEQ ID NO: 2665286 - DNA, 21 bp, Homo sapiens
ccagacctgcagacgcccaga

SEQ ID NO: 2665287 - DNA, 15 bp, Homo sapiens
ccagacggctccact

SEQ ID NO: 2665288 - DNA, 19 bp, Homo sapiens
ccagaggcagcttctttgc

SEQ ID NO: 2665289 - DNA, 17 bp, Homo sapiens
ccagccaggccccaggc

SEQ ID NO: 2665290 - DNA, 18 bp, Homo sapiens
ccagcggacagtggcagg

SEQ ID NO: 2665291 - DNA, 21 bp, Homo sapiens
ccagcggacagtggcaggaca

SEQ ID NO: 2665292 - DNA, 17 bp, Homo sapiens
ccagctacacctttctc

SEQ ID NO: 2665293 - DNA, 18 bp, Homo sapiens
ccagctacacctttctcc

SEQ ID NO: 2665294 - DNA, 18 bp, Homo sapiens
ccagctcctcactcacct

SEQ ID NO: 2665295 - DNA, 16 bp, Homo sapiens
ccagctgatgactcaa

SEQ ID NO: 2665296 - DNA, 17 bp, Homo sapiens
ccagctgatgactcaag

SEQ ID NO: 2665297 - DNA, 22 bp, Homo sapiens
ccagctgatgactcaagattcc

SEQ ID NO: 2665298 - DNA, 23 bp, Homo sapiens
ccagctgatgactcaagattccc

SEQ ID NO: 2665299 - DNA, 12 bp, Homo sapiens
ccagctgcctcc

SEQ ID NO: 2665300 - DNA, 15 bp, Homo sapiens
ccaggattcctcttt

SEQ ID NO: 2665301 - DNA, 19 bp, Homo sapiens
ccaggcagggccaaccctt

SEQ ID NO: 2665302 - DNA, 18 bp, Homo sapiens
ccaggcgcaggggctcac

SEQ ID NO: 2665303 - DNA, 20 bp, Homo sapiens
ccagggacgaagaagagcca

SEQ ID NO: 2665304 - DNA, 23 bp, Homo sapiens
ccagggacgaagaagagccacag

SEQ ID NO: 2665305 - DNA, 18 bp, Homo sapiens
ccagggagacctggacac

SEQ ID NO: 2665306 - DNA, 23 bp, Homo sapiens
ccagggagacctggacacaggcc

SEQ ID NO: 2665307 - DNA, 21 bp, Homo sapiens
ccagggagcattttcctccat

SEQ ID NO: 2665308 - DNA, 10 bp, Homo sapiens
ccagggtcag

SEQ ID NO: 2665309 - DNA, 14 bp, Homo sapiens
ccaggtagaacaca

SEQ ID NO: 2665310 - DNA, 21 bp, Homo sapiens
ccagttcctttcaatggtttg

SEQ ID NO: 2665311 - DNA, 18 bp, Homo sapiens
ccatattgtaaaacaggt

SEQ ID NO: 2665312 - DNA, 16 bp, Homo sapiens
ccatcctcttctttta

SEQ ID NO: 2665313 - DNA, 17 bp, Homo sapiens
ccatcgccagctgatga

SEQ ID NO: 2665314 - DNA, 21 bp, Homo sapiens
ccatcgccagctgatgactca

SEQ ID NO: 2665315 - DNA, 21 bp, Homo sapiens
ccatgcctcagccctgaccct

SEQ ID NO: 2665316 - DNA, 23 bp, Homo sapiens
ccatgcctccccctagccatttt

SEQ ID NO: 2665317 - DNA, 17 bp, Homo sapiens
ccattatgaagaagaga

SEQ ID NO: 2665318 - DNA, 12 bp, Homo sapiens
ccattctacttg

SEQ ID NO: 2665319 - DNA, 22 bp, Homo sapiens
ccattctacttgctctggacct

SEQ ID NO: 2665320 - DNA, 17 bp, Homo sapiens
ccattctccatttgtta

SEQ ID NO: 2665321 - DNA, 21 bp, Homo sapiens
ccattgaaggcttaaacccat

SEQ ID NO: 2665322 - DNA, 19 bp, Homo sapiens
cccaatcccagctacctca

SEQ ID NO: 2665323 - DNA, 23 bp, Homo sapiens
cccaatcccagctacctcaacca

SEQ ID NO: 2665324 - DNA, 20 bp, Homo sapiens
cccagacacatcgcactgtg

SEQ ID NO: 2665325 - DNA, 21 bp, Homo sapiens
cccagacggctccactaggac

SEQ ID NO: 2665326 - DNA, 20 bp, Homo sapiens
cccagcggacagtggcagga

SEQ ID NO: 2665327 - DNA, 14 bp, Homo sapiens
cccagctacctcaa

SEQ ID NO: 2665328 - DNA, 18 bp, Homo sapiens
cccaggagttctgctcat

SEQ ID NO: 2665329 - DNA, 23 bp, Homo sapiens
cccaggcagggccaacccttctc

SEQ ID NO: 2665330 - DNA, 22 bp, Homo sapiens
cccagggcttacggccctggcc

SEQ ID NO: 2665331 - DNA, 16 bp, Homo sapiens
cccagtccttccacct

SEQ ID NO: 2665332 - DNA, 18 bp, Homo sapiens
cccatattgtaaaacagg

SEQ ID NO: 2665333 - DNA, 20 bp, Homo sapiens
cccatcctcttcttttagca

SEQ ID NO: 2665334 - DNA, 22 bp, Homo sapiens
cccatcgccagctgatgactca

SEQ ID NO: 2665335 - DNA, 14 bp, Homo sapiens
cccattctacttgc

SEQ ID NO: 2665336 - DNA, 17 bp, Homo sapiens
cccattctacttgctct

SEQ ID NO: 2665337 - DNA, 19 bp, Homo sapiens
cccattctacttgctctgg

SEQ ID NO: 2665338 - DNA, 14 bp, Homo sapiens
cccattcttttgta

SEQ ID NO: 2665339 - DNA, 17 bp, Homo sapiens
cccattcttttgtaatt

SEQ ID NO: 2665340 - DNA, 12 bp, Homo sapiens
ccccacctctcc

SEQ ID NO: 2665341 - DNA, 12 bp, Homo sapiens
ccccactggact

SEQ ID NO: 2665342 - DNA, 20 bp, Homo sapiens
ccccactggactgacctggt

SEQ ID NO: 2665343 - DNA, 23 bp, Homo sapiens
ccccatcgccagctgatgactca

SEQ ID NO: 2665344 - DNA, 12 bp, Homo sapiens
ccccccttccac

SEQ ID NO: 2665345 - DNA, 15 bp, Homo sapiens
cccccgcatcccctg

SEQ ID NO: 2665346 - DNA, 12 bp, Homo sapiens
cccccgccccct

SEQ ID NO: 2665347 - DNA, 17 bp, Homo sapiens
ccccgccccctgccctc

SEQ ID NO: 2665348 - DNA, 18 bp, Homo sapiens
ccccgccccctgccctcc

SEQ ID NO: 2665349 - DNA, 19 bp, Homo sapiens
cccctagccatttttactg

SEQ ID NO: 2665350 - DNA, 14 bp, Homo sapiens
cccgcatcccctgc

SEQ ID NO: 2665351 - DNA, 16 bp, Homo sapiens
cccgcatcccctgcct

SEQ ID NO: 2665352 - DNA, 14 bp, Homo sapiens
ccctaaaagcacac

SEQ ID NO: 2665353 - DNA, 21 bp, Homo sapiens
ccctcgcttggacggctgggc

SEQ ID NO: 2665354 - DNA, 23 bp, Homo sapiens
ccctcgcttggacggctgggcac

SEQ ID NO: 2665355 - DNA, 12 bp, Homo sapiens
ccctgaccctgt

SEQ ID NO: 2665356 - DNA, 12 bp, Homo sapiens
ccctgcctccat

SEQ ID NO: 2665357 - DNA, 22 bp, Homo sapiens
ccctggccttgggccctctggt

SEQ ID NO: 2665358 - DNA, 17 bp, Homo sapiens
ccctgtatatagcccag

SEQ ID NO: 2665359 - DNA, 22 bp, Homo sapiens
ccctgttgaattttgttctctg

SEQ ID NO: 2665360 - DNA, 22 bp, Homo sapiens
cccttgaggaaacaacagcttt

SEQ ID NO: 2665361 - DNA, 21 bp, Homo sapiens
ccctttattgaaaaaataaaa

SEQ ID NO: 2665362 - DNA, 20 bp, Homo sapiens
ccgaatgttgaggtggactc

SEQ ID NO: 2665363 - DNA, 14 bp, Homo sapiens
ccgcatcccctgcc

SEQ ID NO: 2665364 - DNA, 22 bp, Homo sapiens
ccgcatcccctgcctccatcct

SEQ ID NO: 2665365 - DNA, 20 bp, Homo sapiens
ccgccagggagacctggaca

SEQ ID NO: 2665366 - DNA, 17 bp, Homo sapiens
ccgccccctgccctccc

SEQ ID NO: 2665367 - DNA, 20 bp, Homo sapiens
ccgcggggacattgggaagg

SEQ ID NO: 2665368 - DNA, 12 bp, Homo sapiens
ccgggcagaggg

SEQ ID NO: 2665369 - DNA, 15 bp, Homo sapiens
ccgggcagaggggca

SEQ ID NO: 2665370 - DNA, 22 bp, Homo sapiens
ccgtagtagatgttctactttg

SEQ ID NO: 2665371 - DNA, 11 bp, Homo sapiens
ccgtcaacaaa

SEQ ID NO: 2665372 - DNA, 11 bp, Homo sapiens
cctaggccagg

SEQ ID NO: 2665373 - DNA, 16 bp, Homo sapiens
cctataactgcccagc

SEQ ID NO: 2665374 - DNA, 13 bp, Homo sapiens
cctatttctcttt

SEQ ID NO: 2665375 - DNA, 13 bp, Homo sapiens
cctcagccctgac

SEQ ID NO: 2665376 - DNA, 21 bp, Homo sapiens
cctcagccctgaccctgtgga

SEQ ID NO: 2665377 - DNA, 15 bp, Homo sapiens
cctcaggtggccatg

SEQ ID NO: 2665378 - DNA, 16 bp, Homo sapiens
cctcaggtggccatgc

SEQ ID NO: 2665379 - DNA, 19 bp, Homo sapiens
cctcagttcttgccacttt

SEQ ID NO: 2665380 - DNA, 13 bp, Homo sapiens
cctccatcctagt

SEQ ID NO: 2665381 - DNA, 15 bp, Homo sapiens
cctcccaggctctca

SEQ ID NO: 2665382 - DNA, 16 bp, Homo sapiens
cctcccctctctgcac

SEQ ID NO: 2665383 - DNA, 15 bp, Homo sapiens
cctccctgcctcagg

SEQ ID NO: 2665384 - DNA, 16 bp, Homo sapiens
cctcctaccctgcgcc

SEQ ID NO: 2665385 - DNA, 16 bp, Homo sapiens
cctcgttctccctggg

SEQ ID NO: 2665386 - DNA, 12 bp, Homo sapiens
cctctctgcacc

SEQ ID NO: 2665387 - DNA, 24 bp, Homo sapiens
cctctggtttgccggtggtgcagg

SEQ ID NO: 2665388 - DNA, 13 bp, Homo sapiens
cctcttgtaaata

SEQ ID NO: 2665389 - DNA, 14 bp, Homo sapiens
cctcttgtaaataa

SEQ ID NO: 2665390 - DNA, 17 bp, Homo sapiens
cctcttgtaaataaagc

SEQ ID NO: 2665391 - DNA, 13 bp, Homo sapiens
cctgactgtctcc

SEQ ID NO: 2665392 - DNA, 17 bp, Homo sapiens
cctgagcgcctgggtcc

SEQ ID NO: 2665393 - DNA, 13 bp, Homo sapiens
cctgagggagctc

SEQ ID NO: 2665394 - DNA, 15 bp, Homo sapiens
cctgagggagctcca

SEQ ID NO: 2665395 - DNA, 12 bp, Homo sapiens
cctgcaggccag

SEQ ID NO: 2665396 - DNA, 10 bp, Homo sapiens
gagaaaaaga

SEQ ID NO: 2665397 - DNA, 11 bp, Homo sapiens
gagaaaatcat

SEQ ID NO: 2665398 - DNA, 16 bp, Homo sapiens
gagaaaatcatcaaga

SEQ ID NO: 2665399 - DNA, 18 bp, Homo sapiens
gagacacaggatgaagca

SEQ ID NO: 2665400 - DNA, 12 bp, Homo sapiens
gagacaggcaga

SEQ ID NO: 2665401 - DNA, 14 bp, Homo sapiens
gagacaggcagagc

SEQ ID NO: 2665402 - DNA, 16 bp, Homo sapiens
gagacaggcagagctg

SEQ ID NO: 2665403 - DNA, 15 bp, Homo sapiens
gagagagaggcagaa

SEQ ID NO: 2665404 - DNA, 13 bp, Homo sapiens
gagagagctggag

SEQ ID NO: 2665405 - DNA, 19 bp, Homo sapiens
gagatcccatccccttgtc

SEQ ID NO: 2665406 - DNA, 15 bp, Homo sapiens
gagatgaagcaaaca

SEQ ID NO: 2665407 - DNA, 20 bp, Homo sapiens
gagatgaagcaaacacatta

SEQ ID NO: 2665408 - DNA, 15 bp, Homo sapiens
gagcacacccagccc

SEQ ID NO: 2665409 - DNA, 20 bp, Homo sapiens
gagcagagatcacaccactg

SEQ ID NO: 2665410 - DNA, 18 bp, Homo sapiens
gagcaggcggtgggcacc

SEQ ID NO: 2665411 - DNA, 14 bp, Homo sapiens
gagcctaggccagg

SEQ ID NO: 2665412 - DNA, 15 bp, Homo sapiens
gagcctaggccaggt

SEQ ID NO: 2665413 - DNA, 13 bp, Homo sapiens
gagcctccctgcc

SEQ ID NO: 2665414 - DNA, 19 bp, Homo sapiens
gagcctccctgcctcaggc

SEQ ID NO: 2665415 - DNA, 12 bp, Homo sapiens
gagctagccaga

SEQ ID NO: 2665416 - DNA, 13 bp, Homo sapiens
gagctagccagag

SEQ ID NO: 2665417 - DNA, 14 bp, Homo sapiens
gagctagccagagg

SEQ ID NO: 2665418 - DNA, 15 bp, Homo sapiens
gagctagccagagga

SEQ ID NO: 2665419 - DNA, 16 bp, Homo sapiens
gagctcccaggtgcag

SEQ ID NO: 2665420 - DNA, 16 bp, Homo sapiens
gagctggccccgccgc

SEQ ID NO: 2665421 - DNA, 14 bp, Homo sapiens
gaggcctttaacca

SEQ ID NO: 2665422 - DNA, 23 bp, Homo sapiens
gagggagctccaactcagaaggg

SEQ ID NO: 2665423 - DNA, 18 bp, Homo sapiens
gagggcagcgggagcctc

SEQ ID NO: 2665424 - DNA, 23 bp, Homo sapiens
gagggcagcgggagcctccctgc

SEQ ID NO: 2665425 - DNA, 21 bp, Homo sapiens
gaggggtcgacttcgggctgg

SEQ ID NO: 2665426 - DNA, 14 bp, Homo sapiens
gagggtcagccagg

SEQ ID NO: 2665427 - DNA, 16 bp, Homo sapiens
gagggtcagccagggc

SEQ ID NO: 2665428 - DNA, 15 bp, Homo sapiens
gagggtgagtgcaag

SEQ ID NO: 2665429 - DNA, 23 bp, Homo sapiens
gaggtgaacaagcaaacccagac

SEQ ID NO: 2665430 - DNA, 17 bp, Homo sapiens
gagtcctagagctacag

SEQ ID NO: 2665431 - DNA, 16 bp, Homo sapiens
gagtctgttttgtaaa

SEQ ID NO: 2665432 - DNA, 17 bp, Homo sapiens
gagtctgttttgtaaag

SEQ ID NO: 2665433 - DNA, 18 bp, Homo sapiens
gagttcgagaccagcctg

SEQ ID NO: 2665434 - DNA, 16 bp, Homo sapiens
gataaatacaaggccc

SEQ ID NO: 2665435 - DNA, 16 bp, Homo sapiens
gataagcttcaaagct

SEQ ID NO: 2665436 - DNA, 16 bp, Homo sapiens
gatagtattgtgcata

SEQ ID NO: 2665437 - DNA, 15 bp, Homo sapiens
gatataaataaaaca

SEQ ID NO: 2665438 - DNA, 17 bp, Homo sapiens
gatcaaaggcacacagc

SEQ ID NO: 2665439 - DNA, 16 bp, Homo sapiens
gatctatacttgcttt

SEQ ID NO: 2665440 - DNA, 16 bp, Homo sapiens
gatcttttcaagttaa

SEQ ID NO: 2665441 - DNA, 16 bp, Homo sapiens
gatgaagcaaacacat

SEQ ID NO: 2665442 - DNA, 21 bp, Homo sapiens
gatgcagcattttgtatttgt

SEQ ID NO: 2665443 - DNA, 14 bp, Homo sapiens
gatgctatttgcaa

SEQ ID NO: 2665444 - DNA, 19 bp, Homo sapiens
gatgctgtgaaattcccaa

SEQ ID NO: 2665445 - DNA, 18 bp, Homo sapiens
gatggcccattctacttg

SEQ ID NO: 2665446 - DNA, 23 bp, Homo sapiens
gatgggactagagctttctttca

SEQ ID NO: 2665447 - DNA, 13 bp, Homo sapiens
gatgtttgcccaa

SEQ ID NO: 2665448 - DNA, 21 bp, Homo sapiens
gattattttctacacatacat

SEQ ID NO: 2665449 - DNA, 19 bp, Homo sapiens
gatttccccttttgcattc

SEQ ID NO: 2665450 - DNA, 23 bp, Homo sapiens
gatttccccttttgcattctccc

SEQ ID NO: 2665451 - DNA, 22 bp, Homo sapiens
gatttttacgtttgaagacatt

SEQ ID NO: 2665452 - DNA, 18 bp, Homo sapiens
gcaaaccacactggactc

SEQ ID NO: 2665453 - DNA, 15 bp, Homo sapiens
gcaaacccagacggc

SEQ ID NO: 2665454 - DNA, 21 bp, Homo sapiens
gcaaagactattcccttctaa

SEQ ID NO: 2665455 - DNA, 17 bp, Homo sapiens
gcaaaggagtagaaaga

SEQ ID NO: 2665456 - DNA, 18 bp, Homo sapiens
gcaaagggtccagaagga

SEQ ID NO: 2665457 - DNA, 22 bp, Homo sapiens
gcaaagtgaagttgcttcttct

SEQ ID NO: 2665458 - DNA, 15 bp, Homo sapiens
gcaacagaaaaatgg

SEQ ID NO: 2665459 - DNA, 23 bp, Homo sapiens
gcaaccagggagctgcaggggca

SEQ ID NO: 2665460 - DNA, 13 bp, Homo sapiens
gcaagtcagggtt

SEQ ID NO: 2665461 - DNA, 14 bp, Homo sapiens
gcacacgcctccca

SEQ ID NO: 2665462 - DNA, 20 bp, Homo sapiens
gcaccatttaaaaacaggca

SEQ ID NO: 2665463 - DNA, 13 bp, Homo sapiens
gcacccaccctgg

SEQ ID NO: 2665464 - DNA, 20 bp, Homo sapiens
gcactctttaagggagtgta

SEQ ID NO: 2665465 - DNA, 13 bp, Homo sapiens
gcactgcctctca

SEQ ID NO: 2665466 - DNA, 21 bp, Homo sapiens
gcactgcctctcacagctgag

SEQ ID NO: 2665467 - DNA, 16 bp, Homo sapiens
gcagaaaattgcctaa

SEQ ID NO: 2665468 - DNA, 20 bp, Homo sapiens
gcagatgctagcacatgccc

SEQ ID NO: 2665469 - DNA, 20 bp, Homo sapiens
gcagatgtaaagttattctt

SEQ ID NO: 2665470 - DNA, 12 bp, Homo sapiens
gcagccagaggc

SEQ ID NO: 2665471 - DNA, 22 bp, Homo sapiens
gcagcgggagcctccctgcctc

SEQ ID NO: 2665472 - DNA, 20 bp, Homo sapiens
gcagctcataagagccacag

SEQ ID NO: 2665473 - DNA, 19 bp, Homo sapiens
gcagctgaaatatgctggc

SEQ ID NO: 2665474 - DNA, 17 bp, Homo sapiens
gcaggacgtgggctggg

SEQ ID NO: 2665475 - DNA, 16 bp, Homo sapiens
gcaggccaggccagct

SEQ ID NO: 2665476 - DNA, 17 bp, Homo sapiens
gcaggccaggccagctg

SEQ ID NO: 2665477 - DNA, 15 bp, Homo sapiens
gcaggcggtgggcac

SEQ ID NO: 2665478 - DNA, 16 bp, Homo sapiens
gcaggcggtgggcacc

SEQ ID NO: 2665479 - DNA, 23 bp, Homo sapiens
gcaggcggtgggcacccaccctg

SEQ ID NO: 2665480 - DNA, 15 bp, Homo sapiens
gcaggcttcaaacta

SEQ ID NO: 2665481 - DNA, 19 bp, Homo sapiens
gcagggccaacccttctcc

SEQ ID NO: 2665482 - DNA, 17 bp, Homo sapiens
gcaggtagacctgtctc

SEQ ID NO: 2665483 - DNA, 16 bp, Homo sapiens
gcaggtgaaacccagt

SEQ ID NO: 2665484 - DNA, 17 bp, Homo sapiens
gcaggtgaaacccagtc

SEQ ID NO: 2665485 - DNA, 17 bp, Homo sapiens
gcagtctgtccaggctc

SEQ ID NO: 2665486 - DNA, 11 bp, Homo sapiens
gcataataaat

SEQ ID NO: 2665487 - DNA, 14 bp, Homo sapiens
gcataataaatgct

SEQ ID NO: 2665488 - DNA, 23 bp, Homo sapiens
gcatccacttctttcagcagact

SEQ ID NO: 2665489 - DNA, 14 bp, Homo sapiens
gcatcccctgcctc

SEQ ID NO: 2665490 - DNA, 19 bp, Homo sapiens
gcatcctaaagataaagcc

SEQ ID NO: 2665491 - DNA, 20 bp, Homo sapiens
gcatcttgtggctttgcaac

SEQ ID NO: 2665492 - DNA, 18 bp, Homo sapiens
gcatgatccaagcaagac

SEQ ID NO: 2665493 - DNA, 22 bp, Homo sapiens
gcatgatccaagcaagactgag

SEQ ID NO: 2665494 - DNA, 22 bp, Homo sapiens
gcatgtaccctaaggtcattac

SEQ ID NO: 2665495 - DNA, 20 bp, Homo sapiens
gcattttcctccatcgcagt

SEQ ID NO: 2665496 - DNA, 14 bp, Homo sapiens
gcattttgtatttg

SEQ ID NO: 2665497 - DNA, 14 bp, Homo sapiens
gccaaaaaaagaca

SEQ ID NO: 2665498 - DNA, 13 bp, Homo sapiens
gccaacccttctc

SEQ ID NO: 2665499 - DNA, 20 bp, Homo sapiens
gccaaggagggtgagtgcaa

SEQ ID NO: 2665500 - DNA, 22 bp, Homo sapiens
gccacactctgggctccagagt

SEQ ID NO: 2665501 - DNA, 22 bp, Homo sapiens
gccagagctacccgcagagttc

SEQ ID NO: 2665502 - DNA, 14 bp, Homo sapiens
gccagctgatgact

SEQ ID NO: 2665503 - DNA, 19 bp, Homo sapiens
gccagctgatgactcaaga

SEQ ID NO: 2665504 - DNA, 13 bp, Homo sapiens
gccagctgcctcc

SEQ ID NO: 2665505 - DNA, 15 bp, Homo sapiens
gccagggagacctgg

SEQ ID NO: 2665506 - DNA, 19 bp, Homo sapiens
gccagggagacctggacac

SEQ ID NO: 2665507 - DNA, 21 bp, Homo sapiens
gccagggagacctggacacag

SEQ ID NO: 2665508 - DNA, 14 bp, Homo sapiens
gccagggcctgcga

SEQ ID NO: 2665509 - DNA, 16 bp, Homo sapiens
gccagggcctgcgagg

SEQ ID NO: 2665510 - DNA, 13 bp, Homo sapiens
gccatgcctcagc

SEQ ID NO: 2665511 - DNA, 17 bp, Homo sapiens
gccatgcctcagccctg

SEQ ID NO: 2665512 - DNA, 18 bp, Homo sapiens
gccatggacagaagaagg

SEQ ID NO: 2665513 - DNA, 21 bp, Homo sapiens
gccatgttgtgcctccctggt

SEQ ID NO: 2665514 - DNA, 22 bp, Homo sapiens
gccatgttgtgcctccctggtg

SEQ ID NO: 2665515 - DNA, 17 bp, Homo sapiens
tatttttatttgtttgt

SEQ ID NO: 2665516 - DNA, 21 bp, Homo sapiens
tcaaactaggggacaaagcaa

SEQ ID NO: 2665517 - DNA, 15 bp, Homo sapiens
tcaaagccacactct

SEQ ID NO: 2665518 - DNA, 18 bp, Homo sapiens
tcaaagctgctttattca

SEQ ID NO: 2665519 - DNA, 14 bp, Homo sapiens
tcaaatgctcagac

SEQ ID NO: 2665520 - DNA, 19 bp, Homo sapiens
tcaaatgctcagaccagct

SEQ ID NO: 2665521 - DNA, 22 bp, Homo sapiens
tcaaccctaaaaagcagagctt

SEQ ID NO: 2665522 - DNA, 15 bp, Homo sapiens
tcaacgttaataatt

SEQ ID NO: 2665523 - DNA, 14 bp, Homo sapiens
tcaagaagggctgc

SEQ ID NO: 2665524 - DNA, 15 bp, Homo sapiens
tcaagaagggctgca

SEQ ID NO: 2665525 - DNA, 17 bp, Homo sapiens
tcaagattcccaggagt

SEQ ID NO: 2665526 - DNA, 16 bp, Homo sapiens
tcaataaaaaaaagaa

SEQ ID NO: 2665527 - DNA, 14 bp, Homo sapiens
tcaatatcctttgc

SEQ ID NO: 2665528 - DNA, 16 bp, Homo sapiens
tcaatatcctttgcct

SEQ ID NO: 2665529 - DNA, 16 bp, Homo sapiens
tcaatattttccatga

SEQ ID NO: 2665530 - DNA, 18 bp, Homo sapiens
tcaatggtttgcaaggaa

SEQ ID NO: 2665531 - DNA, 23 bp, Homo sapiens
tcaatgtactaggatactgctgc

SEQ ID NO: 2665532 - DNA, 13 bp, Homo sapiens
tcaatttccaaga

SEQ ID NO: 2665533 - DNA, 20 bp, Homo sapiens
tcaatttccaagagctgagg

SEQ ID NO: 2665534 - DNA, 14 bp, Homo sapiens
tcacaaaaaagaag

SEQ ID NO: 2665535 - DNA, 19 bp, Homo sapiens
tcacaacctgaacctagga

SEQ ID NO: 2665536 - DNA, 17 bp, Homo sapiens
tcacaagtttttttact

SEQ ID NO: 2665537 - DNA, 19 bp, Homo sapiens
tcacacaatacaataagtt

SEQ ID NO: 2665538 - DNA, 23 bp, Homo sapiens
tcacacacagactcatattactg

SEQ ID NO: 2665539 - DNA, 23 bp, Homo sapiens
tcacaccaggcttgcctgcaggc

SEQ ID NO: 2665540 - DNA, 23 bp, Homo sapiens
tcacagggactgaaaacctctcc

SEQ ID NO: 2665541 - DNA, 20 bp, Homo sapiens
tcaccactcaaaggccagac

SEQ ID NO: 2665542 - DNA, 16 bp, Homo sapiens
tcaccttcagtaaccc

SEQ ID NO: 2665543 - DNA, 23 bp, Homo sapiens
tcacgttttgttttgtgccaacc

SEQ ID NO: 2665544 - DNA, 21 bp, Homo sapiens
tcactacgggggggagaagga

SEQ ID NO: 2665545 - DNA, 22 bp, Homo sapiens
tcactacgggggggagaaggaa

SEQ ID NO: 2665546 - DNA, 16 bp, Homo sapiens
tcactcctgctgtaaa

SEQ ID NO: 2665547 - DNA, 19 bp, Homo sapiens
tcactctgtgtctgagtgg

SEQ ID NO: 2665548 - DNA, 18 bp, Homo sapiens
tcactcttctcagccact

SEQ ID NO: 2665549 - DNA, 14 bp, Homo sapiens
tcagaccagctctt

SEQ ID NO: 2665550 - DNA, 18 bp, Homo sapiens
tcagacgcactcgcattg

SEQ ID NO: 2665551 - DNA, 23 bp, Homo sapiens
tcagagtgcaagcccctgctcca

SEQ ID NO: 2665552 - DNA, 20 bp, Homo sapiens
tcagccaccctgaggcctct

SEQ ID NO: 2665553 - DNA, 14 bp, Homo sapiens
tcagccagggcctg

SEQ ID NO: 2665554 - DNA, 16 bp, Homo sapiens
tcagccctgaccctgt

SEQ ID NO: 2665555 - DNA, 19 bp, Homo sapiens
tcagctcttggctccactg

SEQ ID NO: 2665556 - DNA, 13 bp, Homo sapiens
tcaggacactaat

SEQ ID NO: 2665557 - DNA, 18 bp, Homo sapiens
tcaggacctccaagccac

SEQ ID NO: 2665558 - DNA, 20 bp, Homo sapiens
tcaggacctccaagccactg

SEQ ID NO: 2665559 - DNA, 16 bp, Homo sapiens
tcaggaggaaggctta

SEQ ID NO: 2665560 - DNA, 23 bp, Homo sapiens
tcaggaggaaggcttacacccac

SEQ ID NO: 2665561 - DNA, 17 bp, Homo sapiens
tcagttaagtttttccc

SEQ ID NO: 2665562 - DNA, 18 bp, Homo sapiens
tcagttaagtttttccct

SEQ ID NO: 2665563 - DNA, 14 bp, Homo sapiens
tcataaagaattgt

SEQ ID NO: 2665564 - DNA, 14 bp, Homo sapiens
tcataatctttgct

SEQ ID NO: 2665565 - DNA, 15 bp, Homo sapiens
tcataatctttgctt

SEQ ID NO: 2665566 - DNA, 20 bp, Homo sapiens
tcatatgcaaagcatattaa

SEQ ID NO: 2665567 - DNA, 12 bp, Homo sapiens
tcatattgaata

SEQ ID NO: 2665568 - DNA, 14 bp, Homo sapiens
tcatatttgcacta

SEQ ID NO: 2665569 - DNA, 11 bp, Homo sapiens
tcatcaagaag

SEQ ID NO: 2665570 - DNA, 13 bp, Homo sapiens
tcatcaagaaggg

SEQ ID NO: 2665571 - DNA, 14 bp, Homo sapiens
tcatcatttttcct

SEQ ID NO: 2665572 - DNA, 12 bp, Homo sapiens
tcatcctgcagg

SEQ ID NO: 2665573 - DNA, 13 bp, Homo sapiens
tcatcctgcaggc

SEQ ID NO: 2665574 - DNA, 17 bp, Homo sapiens
tcatcgccagacaactg

SEQ ID NO: 2665575 - DNA, 13 bp, Homo sapiens
tcattaccacagg

SEQ ID NO: 2665576 - DNA, 18 bp, Homo sapiens
tcattcagcctttagaaa

SEQ ID NO: 2665577 - DNA, 21 bp, Homo sapiens
tcattcccttcgacagcattt

SEQ ID NO: 2665578 - DNA, 23 bp, Homo sapiens
tcattcccttcgacagcattttc

SEQ ID NO: 2665579 - DNA, 20 bp, Homo sapiens
tcattgaattataaaagcca

SEQ ID NO: 2665580 - DNA, 17 bp, Homo sapiens
tcattttgtaacaaatg

SEQ ID NO: 2665581 - DNA, 14 bp, Homo sapiens
tccaaaccttcaca

SEQ ID NO: 2665582 - DNA, 23 bp, Homo sapiens
tccacacaacatatccgtatata

SEQ ID NO: 2665583 - DNA, 15 bp, Homo sapiens
tccaccagtcatttt

SEQ ID NO: 2665584 - DNA, 18 bp, Homo sapiens
tccacctcgacgtttaca

SEQ ID NO: 2665585 - DNA, 19 bp, Homo sapiens
tccagaaggagacaggcag

SEQ ID NO: 2665586 - DNA, 21 bp, Homo sapiens
tccagctatttttatttgttt

SEQ ID NO: 2665587 - DNA, 19 bp, Homo sapiens
tccagggagcattttcctc

SEQ ID NO: 2665588 - DNA, 22 bp, Homo sapiens
tcccactggggtccagggagca

SEQ ID NO: 2665589 - DNA, 15 bp, Homo sapiens
tcccaggagttctgc

SEQ ID NO: 2665590 - DNA, 21 bp, Homo sapiens
tcccaggctctcaacagggga

SEQ ID NO: 2665591 - DNA, 16 bp, Homo sapiens
tcccattctccatttg

SEQ ID NO: 2665592 - DNA, 19 bp, Homo sapiens
tcccattctccatttgtta

SEQ ID NO: 2665593 - DNA, 20 bp, Homo sapiens
tccccatcgccagctgatga

SEQ ID NO: 2665594 - DNA, 23 bp, Homo sapiens
tccccgtatgagttagaataata

SEQ ID NO: 2665595 - DNA, 12 bp, Homo sapiens
tcccctgcctcc

SEQ ID NO: 2665596 - DNA, 13 bp, Homo sapiens
tcccctgcctcca

SEQ ID NO: 2665597 - DNA, 18 bp, Homo sapiens
tccctgcctcaggcctct

SEQ ID NO: 2665598 - DNA, 20 bp, Homo sapiens
tccctgcctcaggcctctgt

SEQ ID NO: 2665599 - DNA, 14 bp, Homo sapiens
tccctggggtgggg

SEQ ID NO: 2665600 - DNA, 16 bp, Homo sapiens
tccctgtaggattttt

SEQ ID NO: 2665601 - DNA, 15 bp, Homo sapiens
tcctaccctgcgccc

SEQ ID NO: 2665602 - DNA, 21 bp, Homo sapiens
tcctagttaatcatcattttt

SEQ ID NO: 2665603 - DNA, 21 bp, Homo sapiens
tcctattctttcgaaagaaga

SEQ ID NO: 2665604 - DNA, 13 bp, Homo sapiens
tcctcaggtggcc

SEQ ID NO: 2665605 - DNA, 18 bp, Homo sapiens
tcctcaggtggccatgcc

SEQ ID NO: 2665606 - DNA, 14 bp, Homo sapiens
tcctccaagccagc

SEQ ID NO: 2665607 - DNA, 21 bp, Homo sapiens
tcctcttgtaaataaagccct

SEQ ID NO: 2665608 - DNA, 14 bp, Homo sapiens
tcctgcaggccagg

SEQ ID NO: 2665609 - DNA, 20 bp, Homo sapiens
tcctgcaggccaggccagct

SEQ ID NO: 2665610 - DNA, 19 bp, Homo sapiens
tcctgtgcctccatcagct

SEQ ID NO: 2665611 - DNA, 12 bp, Homo sapiens
tccttccacctc

SEQ ID NO: 2665612 - DNA, 14 bp, Homo sapiens
tcgagtcaaaatgt

SEQ ID NO: 2665613 - DNA, 18 bp, Homo sapiens
tcgccagctgatgactca

SEQ ID NO: 2665614 - DNA, 19 bp, Homo sapiens
tcgccagctgatgactcaa

SEQ ID NO: 2665615 - DNA, 20 bp, Homo sapiens
tcgcggcggagctggccccg

SEQ ID NO: 2665616 - DNA, 23 bp, Homo sapiens
tctaatgatggcccattctactt

SEQ ID NO: 2665617 - DNA, 14 bp, Homo sapiens
tctaatttataaaa

SEQ ID NO: 2665618 - DNA, 19 bp, Homo sapiens
tctacttgctctggacctg

SEQ ID NO: 2665619 - DNA, 22 bp, Homo sapiens
tctacttgctctggacctgccc

SEQ ID NO: 2665620 - DNA, 15 bp, Homo sapiens
tctatttaagtaaaa

SEQ ID NO: 2665621 - DNA, 15 bp, Homo sapiens
tctatttatcttcat

SEQ ID NO: 2665622 - DNA, 22 bp, Homo sapiens
tctcaggttaagtgtgagtaat

SEQ ID NO: 2665623 - DNA, 20 bp, Homo sapiens
tctccaatttttttttcctt

SEQ ID NO: 2665624 - DNA, 19 bp, Homo sapiens
tctcccactagacaagtcc

SEQ ID NO: 2665625 - DNA, 18 bp, Homo sapiens
tctcccctcagagtgcaa

SEQ ID NO: 2665626 - DNA, 19 bp, Homo sapiens
tctcctttgtactttgtgc

SEQ ID NO: 2665627 - DNA, 13 bp, Homo sapiens
tctctaacaatgt

SEQ ID NO: 2665628 - DNA, 18 bp, Homo sapiens
tctctgccataaatgatt

SEQ ID NO: 2665629 - DNA, 14 bp, Homo sapiens
tctctgggagaaaa

SEQ ID NO: 2665630 - DNA, 18 bp, Homo sapiens
tctctgggagaaaatcat

SEQ ID NO: 2665631 - DNA, 19 bp, Homo sapiens
tctctgggagaaaatcatc

SEQ ID NO: 2665632 - DNA, 14 bp, Homo sapiens
tctgaactggagcc

SEQ ID NO: 2665633 - DNA, 11 bp, Homo sapiens
aaaaaaaagaa

SEQ ID NO: 2665634 - DNA, 12 bp, Homo sapiens
aaaaaaaagaat

SEQ ID NO: 2665635 - DNA, 11 bp, Homo sapiens
aaaaaaaatgg

SEQ ID NO: 2665636 - DNA, 11 bp, Homo sapiens
aaaaaaagaaa

SEQ ID NO: 2665637 - DNA, 14 bp, Homo sapiens
aaaaagacagggct

SEQ ID NO: 2665638 - DNA, 14 bp, Homo sapiens
aaaaatctatattt

SEQ ID NO: 2665639 - DNA, 12 bp, Homo sapiens
aaaacaggtaga

SEQ ID NO: 2665640 - DNA, 17 bp, Homo sapiens
aaaacaggtagaattat

SEQ ID NO: 2665641 - DNA, 21 bp, Homo sapiens
aaaacccagcaacagaaaaat

SEQ ID NO: 2665642 - DNA, 17 bp, Homo sapiens
aaaactttttatatttt

SEQ ID NO: 2665643 - DNA, 21 bp, Homo sapiens
aaaagcacactcatcccctca

SEQ ID NO: 2665644 - DNA, 18 bp, Homo sapiens
aaaagctgtattttgaaa

SEQ ID NO: 2665645 - DNA, 13 bp, Homo sapiens
aaaaggggctcct

SEQ ID NO: 2665646 - DNA, 14 bp, Homo sapiens
aaaaggtaaaactt

SEQ ID NO: 2665647 - DNA, 23 bp, Homo sapiens
aaaaggtaaaactttttatattt

SEQ ID NO: 2665648 - DNA, 21 bp, Homo sapiens
aaaataaatattgtctttttg

SEQ ID NO: 2665649 - DNA, 23 bp, Homo sapiens
aaaatcatcaagaagggctgcat

SEQ ID NO: 2665650 - DNA, 18 bp, Homo sapiens
aaaatgcaacaacatgta

SEQ ID NO: 2665651 - DNA, 23 bp, Homo sapiens
aaaatggcttcagaattaaaact

SEQ ID NO: 2665652 - DNA, 14 bp, Homo sapiens
aaaattaacactgc

SEQ ID NO: 2665653 - DNA, 21 bp, Homo sapiens
aaacacgcacttagtctctaa

SEQ ID NO: 2665654 - DNA, 14 bp, Homo sapiens
aaacataagtgcaa

SEQ ID NO: 2665655 - DNA, 13 bp, Homo sapiens
aaacattttcaca

SEQ ID NO: 2665656 - DNA, 19 bp, Homo sapiens
aaacccctaccctcacaat

SEQ ID NO: 2665657 - DNA, 13 bp, Homo sapiens
aaacgcagacact

SEQ ID NO: 2665658 - DNA, 19 bp, Homo sapiens
aaacgctctctactctgct

SEQ ID NO: 2665659 - DNA, 14 bp, Homo sapiens
aaactaaaaataat

SEQ ID NO: 2665660 - DNA, 22 bp, Homo sapiens
aaactgagatccttccttttga

SEQ ID NO: 2665661 - DNA, 20 bp, Homo sapiens
aaactttcctcttcctgcct

SEQ ID NO: 2665662 - DNA, 13 bp, Homo sapiens
aaagaaatgcaaa

SEQ ID NO: 2665663 - DNA, 14 bp, Homo sapiens
aaagaaatgcaaaa

SEQ ID NO: 2665664 - DNA, 23 bp, Homo sapiens
aaagaagtaggggaagacatgca

SEQ ID NO: 2665665 - DNA, 14 bp, Homo sapiens
aaagacagagctgg

SEQ ID NO: 2665666 - DNA, 17 bp, Homo sapiens
aaagagaaaaagaaatg

SEQ ID NO: 2665667 - DNA, 15 bp, Homo sapiens
aaagcagctctcccc

SEQ ID NO: 2665668 - DNA, 16 bp, Homo sapiens
aaagcatcacttggga

SEQ ID NO: 2665669 - DNA, 16 bp, Homo sapiens
aaagccattttaggct

SEQ ID NO: 2665670 - DNA, 15 bp, Homo sapiens
aaagcccagagacag

SEQ ID NO: 2665671 - DNA, 19 bp, Homo sapiens
aaagcggacatcagctggt

SEQ ID NO: 2665672 - DNA, 17 bp, Homo sapiens
aaagcttgagtaaaata

SEQ ID NO: 2665673 - DNA, 19 bp, Homo sapiens
aaagcttgagtaaaataaa

SEQ ID NO: 2665674 - DNA, 20 bp, Homo sapiens
aaaggccagacctgcagacg

SEQ ID NO: 2665675 - DNA, 22 bp, Homo sapiens
aaagtctctcattctaggcctc

SEQ ID NO: 2665676 - DNA, 12 bp, Homo sapiens
aaataaaacatt

SEQ ID NO: 2665677 - DNA, 12 bp, Homo sapiens
aaataaagccct

SEQ ID NO: 2665678 - DNA, 21 bp, Homo sapiens
aaataactggaggaattttct

SEQ ID NO: 2665679 - DNA, 23 bp, Homo sapiens
aaatatctgagctctttgcacta

SEQ ID NO: 2665680 - DNA, 17 bp, Homo sapiens
aaatattttgatcttca

SEQ ID NO: 2665681 - DNA, 13 bp, Homo sapiens
aaatcatcaagaa

SEQ ID NO: 2665682 - DNA, 16 bp, Homo sapiens
aaatctaggaaaatat

SEQ ID NO: 2665683 - DNA, 18 bp, Homo sapiens
aaatctaggaaaatattt

SEQ ID NO: 2665684 - DNA, 19 bp, Homo sapiens
aaatgaacgatatgtagca

SEQ ID NO: 2665685 - DNA, 21 bp, Homo sapiens
aaatgagttacctacatttta

SEQ ID NO: 2665686 - DNA, 16 bp, Homo sapiens
aaatgcaacaacatgt

SEQ ID NO: 2665687 - DNA, 22 bp, Homo sapiens
aaatggcttcagaattaaaact

SEQ ID NO: 2665688 - DNA, 18 bp, Homo sapiens
aaattaacagaaaaacag

SEQ ID NO: 2665689 - DNA, 14 bp, Homo sapiens
aaattactctttct

SEQ ID NO: 2665690 - DNA, 16 bp, Homo sapiens
aaattggttctttatt

SEQ ID NO: 2665691 - DNA, 21 bp, Homo sapiens
aaattgtgtgtgctctgcttc

SEQ ID NO: 2665692 - DNA, 18 bp, Homo sapiens
aaatttattttataagaa

SEQ ID NO: 2665693 - DNA, 9 bp, Homo sapiens
aacaaaaca

SEQ ID NO: 2665694 - DNA, 14 bp, Homo sapiens
aacaaacaaacaaa

SEQ ID NO: 2665695 - DNA, 23 bp, Homo sapiens
aacaaatctaggaaaatattttg

SEQ ID NO: 2665696 - DNA, 16 bp, Homo sapiens
aacaatgtattttctt

SEQ ID NO: 2665697 - DNA, 20 bp, Homo sapiens
aacacaaagagaaaaagaaa

SEQ ID NO: 2665698 - DNA, 19 bp, Homo sapiens
aacaccattgaaggcttaa

SEQ ID NO: 2665699 - DNA, 14 bp, Homo sapiens
aacactatatggca

SEQ ID NO: 2665700 - DNA, 14 bp, Homo sapiens
aacactgatttccc

SEQ ID NO: 2665701 - DNA, 22 bp, Homo sapiens
aacactgatttccccttttgca

SEQ ID NO: 2665702 - DNA, 23 bp, Homo sapiens
aacactgatttccccttttgcat

SEQ ID NO: 2665703 - DNA, 15 bp, Homo sapiens
aacatgaacaaattt

SEQ ID NO: 2665704 - DNA, 22 bp, Homo sapiens
aacatggtaaacgctgtcccta

SEQ ID NO: 2665705 - DNA, 14 bp, Homo sapiens
aacattcaggagct

SEQ ID NO: 2665706 - DNA, 17 bp, Homo sapiens
aacattttacccacaca

SEQ ID NO: 2665707 - DNA, 14 bp, Homo sapiens
aaccagaggcagct

SEQ ID NO: 2665708 - DNA, 20 bp, Homo sapiens
aaccagctggtctgggtgta

SEQ ID NO: 2665709 - DNA, 16 bp, Homo sapiens
aaccagggattgtttc

SEQ ID NO: 2665710 - DNA, 16 bp, Homo sapiens
aaccatggtgcttgtt

SEQ ID NO: 2665711 - DNA, 21 bp, Homo sapiens
aacccagacggctccactagg

SEQ ID NO: 2665712 - DNA, 17 bp, Homo sapiens
aacccagcaacagaaaa

SEQ ID NO: 2665713 - DNA, 23 bp, Homo sapiens
aacccagcaacagaaaaatggag

SEQ ID NO: 2665714 - DNA, 18 bp, Homo sapiens
aaccccgtcaacaaatct

SEQ ID NO: 2665715 - DNA, 21 bp, Homo sapiens
aaccctaaaaagcagagcttt

SEQ ID NO: 2665716 - DNA, 18 bp, Homo sapiens
aacccttctcctcttgta

SEQ ID NO: 2665717 - DNA, 19 bp, Homo sapiens
aaccttcacacacagactg

SEQ ID NO: 2665718 - DNA, 19 bp, Homo sapiens
aacgctctctactctgctt

SEQ ID NO: 2665719 - DNA, 17 bp, Homo sapiens
aactactgcaccattta

SEQ ID NO: 2665720 - DNA, 18 bp, Homo sapiens
aactagcttggaaactgg

SEQ ID NO: 2665721 - DNA, 13 bp, Homo sapiens
aactcaatatttt

SEQ ID NO: 2665722 - DNA, 21 bp, Homo sapiens
aactcaatattttccatgaaa

SEQ ID NO: 2665723 - DNA, 13 bp, Homo sapiens
aactgaaagtgaa

SEQ ID NO: 2665724 - DNA, 15 bp, Homo sapiens
aactgcaaagtgaag

SEQ ID NO: 2665725 - DNA, 22 bp, Homo sapiens
aactgtaccatgtgctacaggg

SEQ ID NO: 2665726 - DNA, 15 bp, Homo sapiens
aactgttcccacctg

SEQ ID NO: 2665727 - DNA, 18 bp, Homo sapiens
aactgttcccacctgctg

SEQ ID NO: 2665728 - DNA, 13 bp, Homo sapiens
aacttaacatgaa

SEQ ID NO: 2665729 - DNA, 19 bp, Homo sapiens
aactttcctcttcctgcct

SEQ ID NO: 2665730 - DNA, 23 bp, Homo sapiens
aagaaatatctgagctctttgca

SEQ ID NO: 2665731 - DNA, 16 bp, Homo sapiens
aagaaatgcaaaaatc

SEQ ID NO: 2665732 - DNA, 21 bp, Homo sapiens
aagaacaatattgactttgtc

SEQ ID NO: 2665733 - DNA, 17 bp, Homo sapiens
aagaacttctataattg

SEQ ID NO: 2665734 - DNA, 14 bp, Homo sapiens
aagaagagccacag

SEQ ID NO: 2665735 - DNA, 19 bp, Homo sapiens
aagaaggcagcaggtggca

SEQ ID NO: 2665736 - DNA, 11 bp, Homo sapiens
aagaagggctg

SEQ ID NO: 2665737 - DNA, 20 bp, Homo sapiens
aagaagggctgcatgatgtt

SEQ ID NO: 2665738 - DNA, 22 bp, Homo sapiens
aagacactgaaatatacacaca

SEQ ID NO: 2665739 - DNA, 22 bp, Homo sapiens
aagacagcttctcatcctgcag

SEQ ID NO: 2665740 - DNA, 21 bp, Homo sapiens
aagacagggctgataagctaa

SEQ ID NO: 2665741 - DNA, 23 bp, Homo sapiens
aagaccagagatagtggggagac

SEQ ID NO: 2665742 - DNA, 20 bp, Homo sapiens
aagacttgcatttaaatgtg

SEQ ID NO: 2665743 - DNA, 13 bp, Homo sapiens
aagagagaaacaa

SEQ ID NO: 2665744 - DNA, 21 bp, Homo sapiens
aagagtgtggagtcattctca

SEQ ID NO: 2665745 - DNA, 15 bp, Homo sapiens
aagatgaacagactg

SEQ ID NO: 2665746 - DNA, 17 bp, Homo sapiens
aagatgaacagactgac

SEQ ID NO: 2665747 - DNA, 14 bp, Homo sapiens
aagattcccaggag

SEQ ID NO: 2665748 - DNA, 17 bp, Homo sapiens
aagattcccaggagttc

SEQ ID NO: 2665749 - DNA, 14 bp, Homo sapiens
aagcaaaaagtgat

SEQ ID NO: 2665750 - DNA, 19 bp, Homo sapiens
aagcaaacccagacggctc

SEQ ID NO: 2665751 - DNA, 19 bp, Homo sapiens
aagccctgggatcactgtg

SEQ ID NO: 2665752 - DNA, 17 bp, Homo sapiens
aagctacaatctgttca

SEQ ID NO: 2665753 - DNA, 16 bp, Homo sapiens
aaggagcctaggccag

SEQ ID NO: 2665754 - DNA, 19 bp, Homo sapiens
aaggagcctaggccaggtg

SEQ ID NO: 2665755 - DNA, 21 bp, Homo sapiens
aaggagcctaggccaggtgca

SEQ ID NO: 2665756 - DNA, 20 bp, Homo sapiens
aaggccagacctgcagacgc

SEQ ID NO: 2665757 - DNA, 22 bp, Homo sapiens
aaggccatccttccctgtctgc

SEQ ID NO: 2665758 - DNA, 15 bp, Homo sapiens
aagggctgcatgatg

SEQ ID NO: 2665759 - DNA, 17 bp, Homo sapiens
aagggctgcatgatgtt

SEQ ID NO: 2665760 - DNA, 16 bp, Homo sapiens
aagggttccctcaaga

SEQ ID NO: 2665761 - DNA, 17 bp, Homo sapiens
aaggttgtattgcatat

SEQ ID NO: 2665762 - DNA, 13 bp, Homo sapiens
aagtaactttaaa

SEQ ID NO: 2665763 - DNA, 17 bp, Homo sapiens
aagtagcatttactgtg

SEQ ID NO: 2665764 - DNA, 14 bp, Homo sapiens
aagtattttattct

SEQ ID NO: 2665765 - DNA, 23 bp, Homo sapiens
aagtgtttaacttgtcaaaaaac

SEQ ID NO: 2665766 - DNA, 16 bp, Homo sapiens
aagttgggactctgga

SEQ ID NO: 2665767 - DNA, 20 bp, Homo sapiens
aagtttccttccagcccaga

SEQ ID NO: 2665768 - DNA, 22 bp, Homo sapiens
aagttttcccttgaggaaacaa

SEQ ID NO: 2665769 - DNA, 11 bp, Homo sapiens
aataaagccct

SEQ ID NO: 2665770 - DNA, 19 bp, Homo sapiens
aataaagttggtcttttga

SEQ ID NO: 2665771 - DNA, 21 bp, Homo sapiens
aatacaccaggtagaacacaa

SEQ ID NO: 2665772 - DNA, 22 bp, Homo sapiens
aatagttgaacctatttctctt

SEQ ID NO: 2665773 - DNA, 12 bp, Homo sapiens
aatataaatgtt

SEQ ID NO: 2665774 - DNA, 21 bp, Homo sapiens
aatatatttgtgtatttaaca

SEQ ID NO: 2665775 - DNA, 10 bp, Homo sapiens
aatattctgg

SEQ ID NO: 2665776 - DNA, 14 bp, Homo sapiens
aatattgactttgt

SEQ ID NO: 2665777 - DNA, 14 bp, Homo sapiens
aatcatcaagaagg

SEQ ID NO: 2665778 - DNA, 14 bp, Homo sapiens
aatcccagcaattt

SEQ ID NO: 2665779 - DNA, 11 bp, Homo sapiens
aatctatttaa

SEQ ID NO: 2665780 - DNA, 21 bp, Homo sapiens
aatctccaccagtcatttttc

SEQ ID NO: 2665781 - DNA, 21 bp, Homo sapiens
aatctgctggttttaacaact

SEQ ID NO: 2665782 - DNA, 18 bp, Homo sapiens
aatgagattaattccttt

SEQ ID NO: 2665783 - DNA, 19 bp, Homo sapiens
aatgagttacctacatttt

SEQ ID NO: 2665784 - DNA, 22 bp, Homo sapiens
aatgatggcccattctacttgc

SEQ ID NO: 2665785 - DNA, 13 bp, Homo sapiens
aatgcaaaaatct

SEQ ID NO: 2665786 - DNA, 21 bp, Homo sapiens
aatgccatggacagaagaagg

SEQ ID NO: 2665787 - DNA, 19 bp, Homo sapiens
aatgctttagaaaggtttt

SEQ ID NO: 2665788 - DNA, 18 bp, Homo sapiens
aatggataaaatctgata

SEQ ID NO: 2665789 - DNA, 22 bp, Homo sapiens
aatgtagtgaagggatgtatca

SEQ ID NO: 2665790 - DNA, 12 bp, Homo sapiens
aattaacactgc

SEQ ID NO: 2665791 - DNA, 14 bp, Homo sapiens
aattaacagaaaaa

SEQ ID NO: 2665792 - DNA, 15 bp, Homo sapiens
aattatctaatttat

SEQ ID NO: 2665793 - DNA, 18 bp, Homo sapiens
aattatctaatttataaa

SEQ ID NO: 2665794 - DNA, 14 bp, Homo sapiens
aattctaacttttt

SEQ ID NO: 2665795 - DNA, 17 bp, Homo sapiens
aattcttacaaacatgt

SEQ ID NO: 2665796 - DNA, 23 bp, Homo sapiens
aattcttattttttaaaaagcta

SEQ ID NO: 2665797 - DNA, 17 bp, Homo sapiens
aattcttgcatattttg

SEQ ID NO: 2665798 - DNA, 12 bp, Homo sapiens
aattgtttcaca

SEQ ID NO: 2665799 - DNA, 22 bp, Homo sapiens
aatttattttataagaaaaact

SEQ ID NO: 2665800 - DNA, 17 bp, Homo sapiens
aatttgagatacaaaca

SEQ ID NO: 2665801 - DNA, 21 bp, Homo sapiens
aatttgatagtattgtgcata

SEQ ID NO: 2665802 - DNA, 15 bp, Homo sapiens
aattttgttctctgg

SEQ ID NO: 2665803 - DNA, 17 bp, Homo sapiens
aattttgttctctggga

SEQ ID NO: 2665804 - DNA, 19 bp, Homo sapiens
aattttgttctctgggaga

SEQ ID NO: 2665805 - DNA, 24 bp, Homo sapiens
aattttgttctctgggagaaaatc

SEQ ID NO: 2665806 - DNA, 23 bp, Homo sapiens
acaaaaaaacctcttaatattct

SEQ ID NO: 2665807 - DNA, 12 bp, Homo sapiens
acaaaaaagaag

SEQ ID NO: 2665808 - DNA, 22 bp, Homo sapiens
acaaaaaggtaaaactttttat

SEQ ID NO: 2665809 - DNA, 12 bp, Homo sapiens
acaaaacaaaaa

SEQ ID NO: 2665810 - DNA, 14 bp, Homo sapiens
acaaacataagtgc

SEQ ID NO: 2665811 - DNA, 19 bp, Homo sapiens
acaaacatgtggttaatgc

SEQ ID NO: 2665812 - DNA, 14 bp, Homo sapiens
acaaagagaaaaag

SEQ ID NO: 2665813 - DNA, 21 bp, Homo sapiens
acaaatttttatttctaaaat

SEQ ID NO: 2665814 - DNA, 20 bp, Homo sapiens
acaactacagaaaaaccaga

SEQ ID NO: 2665815 - DNA, 18 bp, Homo sapiens
acaagcccccccttccac

SEQ ID NO: 2665816 - DNA, 20 bp, Homo sapiens
acaaggtcaggagttcgaga

SEQ ID NO: 2665817 - DNA, 15 bp, Homo sapiens
acaatattgactttg

SEQ ID NO: 2665818 - DNA, 18 bp, Homo sapiens
acaatattgactttgtct

SEQ ID NO: 2665819 - DNA, 21 bp, Homo sapiens
acaatctcccttcacaagttt

SEQ ID NO: 2665820 - DNA, 18 bp, Homo sapiens
acaatgatgctatttgca

SEQ ID NO: 2665821 - DNA, 13 bp, Homo sapiens
acaatttaaagca

SEQ ID NO: 2665822 - DNA, 20 bp, Homo sapiens
acaatttaaagcaaaggagt

SEQ ID NO: 2665823 - DNA, 14 bp, Homo sapiens
acacaatacaataa

SEQ ID NO: 2665824 - DNA, 16 bp, Homo sapiens
acacagactcatatta

SEQ ID NO: 2665825 - DNA, 21 bp, Homo sapiens
acacagactgttgtccctgca

SEQ ID NO: 2665826 - DNA, 12 bp, Homo sapiens
acacccagcccc

SEQ ID NO: 2665827 - DNA, 22 bp, Homo sapiens
acacctttctcctttgtacttt

SEQ ID NO: 2665828 - DNA, 14 bp, Homo sapiens
acacgcaggagcac

SEQ ID NO: 2665829 - DNA, 21 bp, Homo sapiens
acactgaaatatacacacagc

SEQ ID NO: 2665830 - DNA, 19 bp, Homo sapiens
acactgcttgtgtttttaa

SEQ ID NO: 2665831 - DNA, 16 bp, Homo sapiens
acactggactccggcc

SEQ ID NO: 2665832 - DNA, 20 bp, Homo sapiens
acactgggaggccagtgagc

SEQ ID NO: 2665833 - DNA, 13 bp, Homo sapiens
acactgtcttgaa

SEQ ID NO: 2665834 - DNA, 14 bp, Homo sapiens
acagaacactgtct

SEQ ID NO: 2665835 - DNA, 16 bp, Homo sapiens
acagaagaaggcagca

SEQ ID NO: 2665836 - DNA, 20 bp, Homo sapiens
acagaagaaggcagcaggtg

SEQ ID NO: 2665837 - DNA, 22 bp, Homo sapiens
acagactcacaacctgaaccta

SEQ ID NO: 2665838 - DNA, 14 bp, Homo sapiens
acagagctgggatg

SEQ ID NO: 2665839 - DNA, 18 bp, Homo sapiens
acagcccaaagaaggaaa

SEQ ID NO: 2665840 - DNA, 17 bp, Homo sapiens
acagctgagttgttgag

SEQ ID NO: 2665841 - DNA, 15 bp, Homo sapiens
acaggatgctttggt

SEQ ID NO: 2665842 - DNA, 13 bp, Homo sapiens
acaggcagagctg

SEQ ID NO: 2665843 - DNA, 22 bp, Homo sapiens
acagggactgaaaacctctcct

SEQ ID NO: 2665844 - DNA, 14 bp, Homo sapiens
acaggggccagaag

SEQ ID NO: 2665845 - DNA, 12 bp, Homo sapiens
acagtggcagga

SEQ ID NO: 2665846 - DNA, 19 bp, Homo sapiens
acagtgtgaataaagtgct

SEQ ID NO: 2665847 - DNA, 14 bp, Homo sapiens
acagtttttaaact

SEQ ID NO: 2665848 - DNA, 13 bp, Homo sapiens
acataaagcaaat

SEQ ID NO: 2665849 - DNA, 17 bp, Homo sapiens
acatacaacacaaagag

SEQ ID NO: 2665850 - DNA, 18 bp, Homo sapiens
acatacaacacaaagaga

SEQ ID NO: 2665851 - DNA, 22 bp, Homo sapiens
acatcagctggtcaaacaaact

SEQ ID NO: 2665852 - DNA, 15 bp, Homo sapiens
acatcgcactgtgga

SEQ ID NO: 2665853 - DNA, 12 bp, Homo sapiens
acatctgataac

SEQ ID NO: 2665854 - DNA, 18 bp, Homo sapiens
acatgcactcagctcttg

SEQ ID NO: 2665855 - DNA, 14 bp, Homo sapiens
acatgtataatatt

SEQ ID NO: 2665856 - DNA, 19 bp, Homo sapiens
acatgtataatatttttaa

SEQ ID NO: 2665857 - DNA, 23 bp, Homo sapiens
acatgtggttacacagtgtgaat

SEQ ID NO: 2665858 - DNA, 13 bp, Homo sapiens
acattcaggagct

SEQ ID NO: 2665859 - DNA, 16 bp, Homo sapiens
acattgttaaaataaa

SEQ ID NO: 2665860 - DNA, 18 bp, Homo sapiens
acatttaccaatcatatt

SEQ ID NO: 2665861 - DNA, 19 bp, Homo sapiens
acattttaatgcacctgaa

SEQ ID NO: 2665862 - DNA, 13 bp, Homo sapiens
acattttcacaca

SEQ ID NO: 2665863 - DNA, 17 bp, Homo sapiens
accaaggagatgaagca

SEQ ID NO: 2665864 - DNA, 21 bp, Homo sapiens
accaatgccaaaaaaagacag

SEQ ID NO: 2665865 - DNA, 15 bp, Homo sapiens
accaattgctttgtc

SEQ ID NO: 2665866 - DNA, 16 bp, Homo sapiens
accacactggactccg

SEQ ID NO: 2665867 - DNA, 22 bp, Homo sapiens
accacactggactccggccctc

SEQ ID NO: 2665868 - DNA, 13 bp, Homo sapiens
accagaggcagct

SEQ ID NO: 2665869 - DNA, 15 bp, Homo sapiens
accagtcatttttca

SEQ ID NO: 2665870 - DNA, 23 bp, Homo sapiens
accatgaagtctctaacaatgta

SEQ ID NO: 2665871 - DNA, 22 bp, Homo sapiens
accatgcgacactgggaggcca

SEQ ID NO: 2665872 - DNA, 15 bp, Homo sapiens
accattgaactgtac

SEQ ID NO: 2665873 - DNA, 16 bp, Homo sapiens
accattgaaggcttaa

SEQ ID NO: 2665874 - DNA, 14 bp, Homo sapiens
accatttaaaaaca

SEQ ID NO: 2665875 - DNA, 21 bp, Homo sapiens
acccagacggctccactagga

SEQ ID NO: 2665876 - DNA, 22 bp, Homo sapiens
acccagacggctccactaggac

SEQ ID NO: 2665877 - DNA, 20 bp, Homo sapiens
acccatattgtaaaacaggt

SEQ ID NO: 2665878 - DNA, 23 bp, Homo sapiens
acccatgcctccccctagccatt

SEQ ID NO: 2665879 - DNA, 14 bp, Homo sapiens
accccatttctctc

SEQ ID NO: 2665880 - DNA, 18 bp, Homo sapiens
acccccgccccctgccct

SEQ ID NO: 2665881 - DNA, 16 bp, Homo sapiens
accccctcgcttggac

SEQ ID NO: 2665882 - DNA, 21 bp, Homo sapiens
accctaatagactaaatgaaa

SEQ ID NO: 2665883 - DNA, 18 bp, Homo sapiens
accctgaggcctctggaa

SEQ ID NO: 2665884 - DNA, 16 bp, Homo sapiens
accctggcctgagaag

SEQ ID NO: 2665885 - DNA, 18 bp, Homo sapiens
accctgtatatagcccag

SEQ ID NO: 2665886 - DNA, 15 bp, Homo sapiens
acccttctcctcttg

SEQ ID NO: 2665887 - DNA, 17 bp, Homo sapiens
acccttctcctcttgta

SEQ ID NO: 2665888 - DNA, 16 bp, Homo sapiens
acctaaataaccaatc

SEQ ID NO: 2665889 - DNA, 17 bp, Homo sapiens
acctccaagccactgag

SEQ ID NO: 2665890 - DNA, 23 bp, Homo sapiens
acctctccctgaccctgtatata

SEQ ID NO: 2665891 - DNA, 14 bp, Homo sapiens
acctctcctcatgt

SEQ ID NO: 2665892 - DNA, 17 bp, Homo sapiens
acctggacacaggcctg

SEQ ID NO: 2665893 - DNA, 15 bp, Homo sapiens
acctggtccacaggg

SEQ ID NO: 2665894 - DNA, 18 bp, Homo sapiens
acctggtccacagggcac

SEQ ID NO: 2665895 - DNA, 14 bp, Homo sapiens
acctgtaatcccag

SEQ ID NO: 2665896 - DNA, 16 bp, Homo sapiens
acctgtaatcccagca

SEQ ID NO: 2665897 - DNA, 19 bp, Homo sapiens
acctgtaatcccagcactt

SEQ ID NO: 2665898 - DNA, 18 bp, Homo sapiens
acctgttttttttctttt

SEQ ID NO: 2665899 - DNA, 17 bp, Homo sapiens
accttcacacacagact

SEQ ID NO: 2665900 - DNA, 23 bp, Homo sapiens
accttcacacacagactgttgtc

SEQ ID NO: 2665901 - DNA, 20 bp, Homo sapiens
acctttctcctttgtacttt

SEQ ID NO: 2665902 - DNA, 23 bp, Homo sapiens
acctttctcctttgtactttgtg

SEQ ID NO: 2665903 - DNA, 15 bp, Homo sapiens
acgaagaagagccac

SEQ ID NO: 2665904 - DNA, 17 bp, Homo sapiens
acgaagaagagccacag

SEQ ID NO: 2665905 - DNA, 20 bp, Homo sapiens
acgccgccctaaaagcacac

SEQ ID NO: 2665906 - DNA, 22 bp, Homo sapiens
acggctgggcacacgcctccca

SEQ ID NO: 2665907 - DNA, 14 bp, Homo sapiens
acgttcctaagctg

SEQ ID NO: 2665908 - DNA, 16 bp, Homo sapiens
actaaaactacaaaaa

SEQ ID NO: 2665909 - DNA, 17 bp, Homo sapiens
actaactatcaaataga

SEQ ID NO: 2665910 - DNA, 14 bp, Homo sapiens
actaattcttgcat

SEQ ID NO: 2665911 - DNA, 17 bp, Homo sapiens
actacaatttaaagcaa

SEQ ID NO: 2665912 - DNA, 20 bp, Homo sapiens
actacgggggggagaaggaa

SEQ ID NO: 2665913 - DNA, 21 bp, Homo sapiens
actactcatacttaagcaaaa

SEQ ID NO: 2665914 - DNA, 15 bp, Homo sapiens
actagagctttcttt

SEQ ID NO: 2665915 - DNA, 20 bp, Homo sapiens
actagagggacctctcccag

SEQ ID NO: 2665916 - DNA, 21 bp, Homo sapiens
actagagggacctctcccagg

SEQ ID NO: 2665917 - DNA, 15 bp, Homo sapiens
actaggatactgctg

SEQ ID NO: 2665918 - DNA, 14 bp, Homo sapiens
actcaaaggccaga

SEQ ID NO: 2665919 - DNA, 23 bp, Homo sapiens
actcaagattcccaggagttctg

SEQ ID NO: 2665920 - DNA, 14 bp, Homo sapiens
actcaagcccgcgg

SEQ ID NO: 2665921 - DNA, 16 bp, Homo sapiens
actcaagtagcattta

SEQ ID NO: 2665922 - DNA, 21 bp, Homo sapiens
actcaatattttccatgaaaa

SEQ ID NO: 2665923 - DNA, 17 bp, Homo sapiens
actcagaagggagctag

SEQ ID NO: 2665924 - DNA, 22 bp, Homo sapiens
actcagctcttggctccactgg

SEQ ID NO: 2665925 - DNA, 13 bp, Homo sapiens
actccggccctcc

SEQ ID NO: 2665926 - DNA, 14 bp, Homo sapiens
actccggccctcct

SEQ ID NO: 2665927 - DNA, 17 bp, Homo sapiens
actcctcagttcttgcc

SEQ ID NO: 2665928 - DNA, 19 bp, Homo sapiens
actcgattcatattgaata

SEQ ID NO: 2665929 - DNA, 21 bp, Homo sapiens
actctctgaacccctccctcc

SEQ ID NO: 2665930 - DNA, 15 bp, Homo sapiens
actctgtctaaaaaa

SEQ ID NO: 2665931 - DNA, 21 bp, Homo sapiens
actctgtctaaaaaacaaaac

SEQ ID NO: 2665932 - DNA, 16 bp, Homo sapiens
actctgtgtctgagtg

SEQ ID NO: 2665933 - DNA, 15 bp, Homo sapiens
actgaaaacctctcc

SEQ ID NO: 2665934 - DNA, 21 bp, Homo sapiens
actgaacaccattgaaggctt

SEQ ID NO: 2665935 - DNA, 17 bp, Homo sapiens
actgacctggtccacag

SEQ ID NO: 2665936 - DNA, 21 bp, Homo sapiens
actgacctggtccacagggca

SEQ ID NO: 2665937 - DNA, 22 bp, Homo sapiens
actgacctggtccacagggcac

SEQ ID NO: 2665938 - DNA, 18 bp, Homo sapiens
actgatcaggacctccaa

SEQ ID NO: 2665939 - DNA, 20 bp, Homo sapiens
actgcataccaacctgggca

SEQ ID NO: 2665940 - DNA, 12 bp, Homo sapiens
actgcattttag

SEQ ID NO: 2665941 - DNA, 14 bp, Homo sapiens
actgcccagcggac

SEQ ID NO: 2665942 - DNA, 15 bp, Homo sapiens
actgcctctcacagc

SEQ ID NO: 2665943 - DNA, 16 bp, Homo sapiens
actgcctttggcagag

SEQ ID NO: 2665944 - DNA, 22 bp, Homo sapiens
actgctgcgtcattacagggca

SEQ ID NO: 2665945 - DNA, 15 bp, Homo sapiens
actggagccatgggc

SEQ ID NO: 2665946 - DNA, 10 bp, Homo sapiens
actggcatgc

SEQ ID NO: 2665947 - DNA, 20 bp, Homo sapiens
actgggccatgttgtgcctc

SEQ ID NO: 2665948 - DNA, 22 bp, Homo sapiens
actgtatctctaatacagtgtg

SEQ ID NO: 2665949 - DNA, 18 bp, Homo sapiens
actgtcctccaagccagc

SEQ ID NO: 2665950 - DNA, 23 bp, Homo sapiens
acttcatggcctttgataaatgt

SEQ ID NO: 2665951 - DNA, 20 bp, Homo sapiens
acttccagtgcaacactgaa

SEQ ID NO: 2665952 - DNA, 20 bp, Homo sapiens
acttcctgagggatctatac

SEQ ID NO: 2665953 - DNA, 18 bp, Homo sapiens
acttgacagaacactgtc

SEQ ID NO: 2665954 - DNA, 23 bp, Homo sapiens
acttgccgcgtcgccctcccagg

SEQ ID NO: 2665955 - DNA, 15 bp, Homo sapiens
acttgctctggacct

SEQ ID NO: 2665956 - DNA, 16 bp, Homo sapiens
acttgctctggacctg

SEQ ID NO: 2665957 - DNA, 21 bp, Homo sapiens
actttatttccaagttgttca

SEQ ID NO: 2665958 - DNA, 17 bp, Homo sapiens
actttttatattttata

SEQ ID NO: 2665959 - DNA, 13 bp, Homo sapiens
agaaaatcatcaa

SEQ ID NO: 2665960 - DNA, 13 bp, Homo sapiens
agaaacaggaccg

SEQ ID NO: 2665961 - DNA, 21 bp, Homo sapiens
agaaaggttttgagcatgggt

SEQ ID NO: 2665962 - DNA, 17 bp, Homo sapiens
agaacataaagcaaata

SEQ ID NO: 2665963 - DNA, 18 bp, Homo sapiens
agaacatgtagaaaacaa

SEQ ID NO: 2665964 - DNA, 22 bp, Homo sapiens
agaactgcctttggcagagttc

SEQ ID NO: 2665965 - DNA, 20 bp, Homo sapiens
agaagaaaatggaaccaggc

SEQ ID NO: 2665966 - DNA, 14 bp, Homo sapiens
agaagaaggcagca

SEQ ID NO: 2665967 - DNA, 11 bp, Homo sapiens
agaagagccac

SEQ ID NO: 2665968 - DNA, 14 bp, Homo sapiens
agaagagccacagt

SEQ ID NO: 2665969 - DNA, 22 bp, Homo sapiens
agaagattcttcccattctcca

SEQ ID NO: 2665970 - DNA, 15 bp, Homo sapiens
agaagcatacaactt

SEQ ID NO: 2665971 - DNA, 19 bp, Homo sapiens
agaagctctcgggctagga

SEQ ID NO: 2665972 - DNA, 16 bp, Homo sapiens
agaaggagacaggcag

SEQ ID NO: 2665973 - DNA, 13 bp, Homo sapiens
agaatctctttcg

SEQ ID NO: 2665974 - DNA, 16 bp, Homo sapiens
agaattagctgcttct

SEQ ID NO: 2665975 - DNA, 14 bp, Homo sapiens
agaattatctaatt

SEQ ID NO: 2665976 - DNA, 21 bp, Homo sapiens
agaattatctaatttataaaa

SEQ ID NO: 2665977 - DNA, 20 bp, Homo sapiens
agacactgaaatatacacac

SEQ ID NO: 2665978 - DNA, 12 bp, Homo sapiens
agacagagctgg

SEQ ID NO: 2665979 - DNA, 22 bp, Homo sapiens
agacagcttctcatcctgcagg

SEQ ID NO: 2665980 - DNA, 23 bp, Homo sapiens
agacagcttctcatcctgcaggc

SEQ ID NO: 2665981 - DNA, 15 bp, Homo sapiens
agaccagcctggcca

SEQ ID NO: 2665982 - DNA, 22 bp, Homo sapiens
agaccagcctggccagtatggt

SEQ ID NO: 2665983 - DNA, 18 bp, Homo sapiens
agacctggacacaggcct

SEQ ID NO: 2665984 - DNA, 19 bp, Homo sapiens
agacctggacacaggcctg

SEQ ID NO: 2665985 - DNA, 19 bp, Homo sapiens
agaccttttaactcctcaa

SEQ ID NO: 2665986 - DNA, 14 bp, Homo sapiens
agacgtgtttgtgt

SEQ ID NO: 2665987 - DNA, 17 bp, Homo sapiens
agactcctcagttcttg

SEQ ID NO: 2665988 - DNA, 23 bp, Homo sapiens
agactcctgactgtctcccggga

SEQ ID NO: 2665989 - DNA, 20 bp, Homo sapiens
agactctgtctaaaaaacaa

SEQ ID NO: 2665990 - DNA, 14 bp, Homo sapiens
agagaaagcgcaga

SEQ ID NO: 2665991 - DNA, 14 bp, Homo sapiens
agagagaggcagaa

SEQ ID NO: 2665992 - DNA, 15 bp, Homo sapiens
agagaggcaatggct

SEQ ID NO: 2665993 - DNA, 15 bp, Homo sapiens
agagcaagactctgt

SEQ ID NO: 2665994 - DNA, 12 bp, Homo sapiens
agagctttcttt

SEQ ID NO: 2665995 - DNA, 16 bp, Homo sapiens
agaggacaagggaaat

SEQ ID NO: 2665996 - DNA, 15 bp, Homo sapiens
agagggacctctccc

SEQ ID NO: 2665997 - DNA, 19 bp, Homo sapiens
agagggacctctcccaggg

SEQ ID NO: 2665998 - DNA, 18 bp, Homo sapiens
agagggccgggcagaggg

SEQ ID NO: 2665999 - DNA, 14 bp, Homo sapiens
agagtcctctgaat

SEQ ID NO: 2666000 - DNA, 20 bp, Homo sapiens
agagtgtggagtcattctca

SEQ ID NO: 2666001 - DNA, 20 bp, Homo sapiens
agagttgtgacaacttcctg

SEQ ID NO: 2666002 - DNA, 17 bp, Homo sapiens
agatactttgctagccg

SEQ ID NO: 2666003 - DNA, 15 bp, Homo sapiens
agatagttactatat

SEQ ID NO: 2666004 - DNA, 15 bp, Homo sapiens
agatccttccttttg

SEQ ID NO: 2666005 - DNA, 19 bp, Homo sapiens
agatgaagcaaacacatta

SEQ ID NO: 2666006 - DNA, 19 bp, Homo sapiens
agatgctagcacatgccct

SEQ ID NO: 2666007 - DNA, 21 bp, Homo sapiens
agatgtggttgcataaggttt

SEQ ID NO: 2666008 - DNA, 14 bp, Homo sapiens
agatgttctacttt

SEQ ID NO: 2666009 - DNA, 22 bp, Homo sapiens
agatgttctactttgttctgct

SEQ ID NO: 2666010 - DNA, 15 bp, Homo sapiens
agattaattcctttc

SEQ ID NO: 2666011 - DNA, 15 bp, Homo sapiens
agattcccaggagtt

SEQ ID NO: 2666012 - DNA, 19 bp, Homo sapiens
agattcttcccattctcca

SEQ ID NO: 2666013 - DNA, 23 bp, Homo sapiens
agattcttcccattctccatttg

SEQ ID NO: 2666014 - DNA, 23 bp, Homo sapiens
agcaaaggagtagaaagacagag

SEQ ID NO: 2666015 - DNA, 12 bp, Homo sapiens
agcaagaggagg

SEQ ID NO: 2666016 - DNA, 15 bp, Homo sapiens
agcaatgcctgccca

SEQ ID NO: 2666017 - DNA, 17 bp, Homo sapiens
agcagactgatcaggac

SEQ ID NO: 2666018 - DNA, 19 bp, Homo sapiens
agcagactgatcaggacct

SEQ ID NO: 2666019 - DNA, 20 bp, Homo sapiens
agcagaggataattagcatc

SEQ ID NO: 2666020 - DNA, 21 bp, Homo sapiens
agcatgctgtgattgtgccta

SEQ ID NO: 2666021 - DNA, 16 bp, Homo sapiens
agcatgggttcatcct

SEQ ID NO: 2666022 - DNA, 19 bp, Homo sapiens
agcattatgatgtgggtca

SEQ ID NO: 2666023 - DNA, 18 bp, Homo sapiens
agcattgatatttgtgca

SEQ ID NO: 2666024 - DNA, 19 bp, Homo sapiens
agcattgatatttgtgcat

SEQ ID NO: 2666025 - DNA, 23 bp, Homo sapiens
agcattgtgtgtgcagacttcag

SEQ ID NO: 2666026 - DNA, 20 bp, Homo sapiens
agcatttcgcgatggacaga

SEQ ID NO: 2666027 - DNA, 13 bp, Homo sapiens
agcattttcctct

SEQ ID NO: 2666028 - DNA, 18 bp, Homo sapiens
agcattttcctctgcttt

SEQ ID NO: 2666029 - DNA, 22 bp, Homo sapiens
agcattttcctctgctttgaaa

SEQ ID NO: 2666030 - DNA, 15 bp, Homo sapiens
agcattttgtatttg

SEQ ID NO: 2666031 - DNA, 16 bp, Homo sapiens
agccaaaacagatcca

SEQ ID NO: 2666032 - DNA, 16 bp, Homo sapiens
agccaaggctctgttt

SEQ ID NO: 2666033 - DNA, 21 bp, Homo sapiens
agccacactctgggctccaga

SEQ ID NO: 2666034 - DNA, 20 bp, Homo sapiens
agccacagtgagggagatcc

SEQ ID NO: 2666035 - DNA, 13 bp, Homo sapiens
agccactgaagta

SEQ ID NO: 2666036 - DNA, 15 bp, Homo sapiens
agccactgagcaatg

SEQ ID NO: 2666037 - DNA, 14 bp, Homo sapiens
agccagaggactgt

SEQ ID NO: 2666038 - DNA, 14 bp, Homo sapiens
agccaggccccagg

SEQ ID NO: 2666039 - DNA, 15 bp, Homo sapiens
agccaggccccaggc

SEQ ID NO: 2666040 - DNA, 15 bp, Homo sapiens
agccatttttactgt

SEQ ID NO: 2666041 - DNA, 13 bp, Homo sapiens
agcccccccttcc

SEQ ID NO: 2666042 - DNA, 15 bp, Homo sapiens
agcccgcggggacat

SEQ ID NO: 2666043 - DNA, 13 bp, Homo sapiens
agccctgaccctg

SEQ ID NO: 2666044 - DNA, 17 bp, Homo sapiens
agccctgaccctgtgga

SEQ ID NO: 2666045 - DNA, 12 bp, Homo sapiens
agcctccctgcc

SEQ ID NO: 2666046 - DNA, 13 bp, Homo sapiens
agcctccctgcct

SEQ ID NO: 2666047 - DNA, 14 bp, Homo sapiens
agcggacagtggca

SEQ ID NO: 2666048 - DNA, 15 bp, Homo sapiens
agcggacagtggcag

SEQ ID NO: 2666049 - DNA, 22 bp, Homo sapiens
agcggtgctgtcctcaggtggc

SEQ ID NO: 2666050 - DNA, 21 bp, Homo sapiens
agctacacctttctcctttgt

SEQ ID NO: 2666051 - DNA, 17 bp, Homo sapiens
agctagccagaggactg

SEQ ID NO: 2666052 - DNA, 19 bp, Homo sapiens
agctagccagaggactgtg

SEQ ID NO: 2666053 - DNA, 17 bp, Homo sapiens
agctattgatataaata

SEQ ID NO: 2666054 - DNA, 23 bp, Homo sapiens
agctattgatataaataaaacat

SEQ ID NO: 2666055 - DNA, 13 bp, Homo sapiens
agctccagttcga

SEQ ID NO: 2666056 - DNA, 21 bp, Homo sapiens
agctcccaggtgcagccagag

SEQ ID NO: 2666057 - DNA, 22 bp, Homo sapiens
agctcccaggtgcagccagagg

SEQ ID NO: 2666058 - DNA, 22 bp, Homo sapiens
agctgatgactcaagattccca

SEQ ID NO: 2666059 - DNA, 13 bp, Homo sapiens
agctggccccgcc

SEQ ID NO: 2666060 - DNA, 21 bp, Homo sapiens
agctggtggtatctgagttga

SEQ ID NO: 2666061 - DNA, 20 bp, Homo sapiens
agctgtgcacaaagtggcat

SEQ ID NO: 2666062 - DNA, 20 bp, Homo sapiens
agcttcaccccaatcccagc

SEQ ID NO: 2666063 - DNA, 14 bp, Homo sapiens
agcttccttggctt

SEQ ID NO: 2666064 - DNA, 13 bp, Homo sapiens
agctttaaaagaa

SEQ ID NO: 2666065 - DNA, 20 bp, Homo sapiens
agctttctttcacaaaaaag

SEQ ID NO: 2666066 - DNA, 22 bp, Homo sapiens
agctttgacactggaatgagtt

SEQ ID NO: 2666067 - DNA, 18 bp, Homo sapiens
aggaacttgagaacttta

SEQ ID NO: 2666068 - DNA, 20 bp, Homo sapiens
aggaagatctctgcagggcc

SEQ ID NO: 2666069 - DNA, 18 bp, Homo sapiens
aggaagccacagctggtg

SEQ ID NO: 2666070 - DNA, 16 bp, Homo sapiens
aggaattttctccaat

SEQ ID NO: 2666071 - DNA, 12 bp, Homo sapiens
aggacccaagca

SEQ ID NO: 2666072 - DNA, 13 bp, Homo sapiens
aggacccaagcag

SEQ ID NO: 2666073 - DNA, 15 bp, Homo sapiens
aggacctccaagcca

SEQ ID NO: 2666074 - DNA, 14 bp, Homo sapiens
aggactgtgatgcc

SEQ ID NO: 2666075 - DNA, 20 bp, Homo sapiens
aggagaatctcttgaacctg

SEQ ID NO: 2666076 - DNA, 18 bp, Homo sapiens
aggagcattttttaaaaa

SEQ ID NO: 2666077 - DNA, 22 bp, Homo sapiens
aggagctgactcacacctgaac

SEQ ID NO: 2666078 - DNA, 17 bp, Homo sapiens
aggagttatttgtaatg

SEQ ID NO: 2666079 - DNA, 18 bp, Homo sapiens
aggataattagcatctca

SEQ ID NO: 2666080 - DNA, 13 bp, Homo sapiens
aggatactgctgc

SEQ ID NO: 2666081 - DNA, 15 bp, Homo sapiens
aggatggcaggacgt

SEQ ID NO: 2666082 - DNA, 21 bp, Homo sapiens
aggatggtaattcttattctt

SEQ ID NO: 2666083 - DNA, 12 bp, Homo sapiens
aggccagacctg

SEQ ID NO: 2666084 - DNA, 13 bp, Homo sapiens
aggccagctgcct

SEQ ID NO: 2666085 - DNA, 15 bp, Homo sapiens
aggccaggccagctg

SEQ ID NO: 2666086 - DNA, 21 bp, Homo sapiens
aggcccctgtctcagggtgag

SEQ ID NO: 2666087 - DNA, 14 bp, Homo sapiens
aggcctcgcaggaa

SEQ ID NO: 2666088 - DNA, 17 bp, Homo sapiens
aggccttatctccaaga

SEQ ID NO: 2666089 - DNA, 14 bp, Homo sapiens
aggcttacacccac

SEQ ID NO: 2666090 - DNA, 17 bp, Homo sapiens
agggaaaaggggctcct

SEQ ID NO: 2666091 - DNA, 15 bp, Homo sapiens
agggacctctcccag

SEQ ID NO: 2666092 - DNA, 21 bp, Homo sapiens
agggacgctttgggagaatgt

SEQ ID NO: 2666093 - DNA, 15 bp, Homo sapiens
agggagctagccaga

SEQ ID NO: 2666094 - DNA, 16 bp, Homo sapiens
agggagctagccagag

SEQ ID NO: 2666095 - DNA, 22 bp, Homo sapiens
agggagctccaactcagaaggg

SEQ ID NO: 2666096 - DNA, 16 bp, Homo sapiens
agggagtgtactccca

SEQ ID NO: 2666097 - DNA, 17 bp, Homo sapiens
agggattgtttctgttt

SEQ ID NO: 2666098 - DNA, 16 bp, Homo sapiens
agggcacaaagatggg

SEQ ID NO: 2666099 - DNA, 19 bp, Homo sapiens
agggcacaggccatggatg

SEQ ID NO: 2666100 - DNA, 16 bp, Homo sapiens
agggccgggcagaggg

SEQ ID NO: 2666101 - DNA, 17 bp, Homo sapiens
agggcctgcgagggcag

SEQ ID NO: 2666102 - DNA, 12 bp, Homo sapiens
agggctgcatga

SEQ ID NO: 2666103 - DNA, 15 bp, Homo sapiens
agggctgcatgatgt

SEQ ID NO: 2666104 - DNA, 22 bp, Homo sapiens
agggctgcatgatgtttgccca

SEQ ID NO: 2666105 - DNA, 15 bp, Homo sapiens
agggcttacggccct

SEQ ID NO: 2666106 - DNA, 18 bp, Homo sapiens
agggcttacggccctggc

SEQ ID NO: 2666107 - DNA, 14 bp, Homo sapiens
aggggacccccgcc

SEQ ID NO: 2666108 - DNA, 19 bp, Homo sapiens
aggggacccccgccccctg

SEQ ID NO: 2666109 - DNA, 18 bp, Homo sapiens
aggggagggtcagccagg

SEQ ID NO: 2666110 - DNA, 15 bp, Homo sapiens
aggggcagatggaaa

SEQ ID NO: 2666111 - DNA, 17 bp, Homo sapiens
aggggccagaagatgaa

SEQ ID NO: 2666112 - DNA, 20 bp, Homo sapiens
aggggcgtgggagtggcctg

SEQ ID NO: 2666113 - DNA, 19 bp, Homo sapiens
aggggtcgacttcgggctg

SEQ ID NO: 2666114 - DNA, 12 bp, Homo sapiens
agggtccctggg

SEQ ID NO: 2666115 - DNA, 14 bp, Homo sapiens
agggttggagcagt

SEQ ID NO: 2666116 - DNA, 22 bp, Homo sapiens
aggtagaattatctaatttata

SEQ ID NO: 2666117 - DNA, 20 bp, Homo sapiens
aggtattcaatatcctttgc

SEQ ID NO: 2666118 - DNA, 15 bp, Homo sapiens
aggtcaggagttcga

SEQ ID NO: 2666119 - DNA, 15 bp, Homo sapiens
aggtgcaaccaggga

SEQ ID NO: 2666120 - DNA, 13 bp, Homo sapiens
aggtgcagccaga

SEQ ID NO: 2666121 - DNA, 15 bp, Homo sapiens
aggtgcagccagagg

SEQ ID NO: 2666122 - DNA, 18 bp, Homo sapiens
aggtgcagccagaggcac

SEQ ID NO: 2666123 - DNA, 18 bp, Homo sapiens
aggtggccatgcctcagc

SEQ ID NO: 2666124 - DNA, 18 bp, Homo sapiens
aggttgcagtgagcagag

SEQ ID NO: 2666125 - DNA, 15 bp, Homo sapiens
aggtttctgaaaatt

SEQ ID NO: 2666126 - DNA, 17 bp, Homo sapiens
aggtttggtccagcctg

SEQ ID NO: 2666127 - DNA, 19 bp, Homo sapiens
agtaaaaatacaaaaatta

SEQ ID NO: 2666128 - DNA, 18 bp, Homo sapiens
agtaacccccactggact

SEQ ID NO: 2666129 - DNA, 15 bp, Homo sapiens
agtacaattcttact

SEQ ID NO: 2666130 - DNA, 18 bp, Homo sapiens
agtaggggaagacatgca

SEQ ID NO: 2666131 - DNA, 15 bp, Homo sapiens
agtcatcattccctt

SEQ ID NO: 2666132 - DNA, 20 bp, Homo sapiens
agtcattctcattgaattat

SEQ ID NO: 2666133 - DNA, 17 bp, Homo sapiens
agtccaacaatgttgtt

SEQ ID NO: 2666134 - DNA, 23 bp, Homo sapiens
agtccatatttcaatttccaaga

SEQ ID NO: 2666135 - DNA, 23 bp, Homo sapiens
agtctgcgtctctgctttaaagt

SEQ ID NO: 2666136 - DNA, 17 bp, Homo sapiens
agtgaagtgagaagttc

SEQ ID NO: 2666137 - DNA, 19 bp, Homo sapiens
agtgaagttgcttcttcta

SEQ ID NO: 2666138 - DNA, 15 bp, Homo sapiens
agtgagccactccgg

SEQ ID NO: 2666139 - DNA, 22 bp, Homo sapiens
agtgagcggtgctgtcctcagg

SEQ ID NO: 2666140 - DNA, 13 bp, Homo sapiens
agtggcaggacag

SEQ ID NO: 2666141 - DNA, 13 bp, Homo sapiens
agtggcataaaaa

SEQ ID NO: 2666142 - DNA, 15 bp, Homo sapiens
agtgtactcccaggg

SEQ ID NO: 2666143 - DNA, 20 bp, Homo sapiens
agtgtgaagcttccttggct

SEQ ID NO: 2666144 - DNA, 18 bp, Homo sapiens
agtgtgaataaagtgctg

SEQ ID NO: 2666145 - DNA, 18 bp, Homo sapiens
agtgtgagtaatctgaga

SEQ ID NO: 2666146 - DNA, 15 bp, Homo sapiens
agttagaataataaa

SEQ ID NO: 2666147 - DNA, 22 bp, Homo sapiens
agttcatgtatgttcagaagaa

SEQ ID NO: 2666148 - DNA, 17 bp, Homo sapiens
agttcgagaccagcctg

SEQ ID NO: 2666149 - DNA, 19 bp, Homo sapiens
agttgaacctatttctctt

SEQ ID NO: 2666150 - DNA, 15 bp, Homo sapiens
agtttattttaagac

SEQ ID NO: 2666151 - DNA, 19 bp, Homo sapiens
ataaaaaaaagaaatgaaa

SEQ ID NO: 2666152 - DNA, 17 bp, Homo sapiens
ataaaatctgatatgta

SEQ ID NO: 2666153 - DNA, 14 bp, Homo sapiens
ataaagccctggga

SEQ ID NO: 2666154 - DNA, 20 bp, Homo sapiens
ataaatattgtctttttgta

SEQ ID NO: 2666155 - DNA, 21 bp, Homo sapiens
ataaatattgtctttttgtat

SEQ ID NO: 2666156 - DNA, 15 bp, Homo sapiens
ataaatgttaagaaa

SEQ ID NO: 2666157 - DNA, 16 bp, Homo sapiens
ataaccaatctacaat

SEQ ID NO: 2666158 - DNA, 20 bp, Homo sapiens
ataactgcaaagtgaagttg

SEQ ID NO: 2666159 - DNA, 22 bp, Homo sapiens
ataagttaactattttattttc

SEQ ID NO: 2666160 - DNA, 14 bp, Homo sapiens
ataatatttttaat

SEQ ID NO: 2666161 - DNA, 15 bp, Homo sapiens
ataatctatatgctg

SEQ ID NO: 2666162 - DNA, 21 bp, Homo sapiens
atacaatgatgctatttgcaa

SEQ ID NO: 2666163 - DNA, 23 bp, Homo sapiens
atacatatatgtatatatatgca

SEQ ID NO: 2666164 - DNA, 17 bp, Homo sapiens
atacattctgtaataca

SEQ ID NO: 2666165 - DNA, 16 bp, Homo sapiens
atagaaagtgccagaa

SEQ ID NO: 2666166 - DNA, 15 bp, Homo sapiens
atagactaaatgaaa

SEQ ID NO: 2666167 - DNA, 13 bp, Homo sapiens
atagatgtttcct

SEQ ID NO: 2666168 - DNA, 17 bp, Homo sapiens
atagcttttgtgtctta

SEQ ID NO: 2666169 - DNA, 17 bp, Homo sapiens
atataatatatttgtgt

SEQ ID NO: 2666170 - DNA, 20 bp, Homo sapiens
atataatatatttgtgtatt

SEQ ID NO: 2666171 - DNA, 16 bp, Homo sapiens
atatagcccagccagg

SEQ ID NO: 2666172 - DNA, 14 bp, Homo sapiens
atatatacatatat

SEQ ID NO: 2666173 - DNA, 13 bp, Homo sapiens
atatatattttaa

SEQ ID NO: 2666174 - DNA, 17 bp, Homo sapiens
atatattgggttccatt

SEQ ID NO: 2666175 - DNA, 21 bp, Homo sapiens
atatattgggttccattctca

SEQ ID NO: 2666176 - DNA, 16 bp, Homo sapiens
atatggggatgcagca

SEQ ID NO: 2666177 - DNA, 17 bp, Homo sapiens
atatgtagcagaaaggc

SEQ ID NO: 2666178 - DNA, 23 bp, Homo sapiens
atattctggagtcatcattccct

SEQ ID NO: 2666179 - DNA, 18 bp, Homo sapiens
atattgaatataatatat

SEQ ID NO: 2666180 - DNA, 21 bp, Homo sapiens
atattgaatataatatatttg

SEQ ID NO: 2666181 - DNA, 17 bp, Homo sapiens
atattgtctttttgtat

SEQ ID NO: 2666182 - DNA, 14 bp, Homo sapiens
atatttacgtatga

SEQ ID NO: 2666183 - DNA, 17 bp, Homo sapiens
atatttgtgcattttct

SEQ ID NO: 2666184 - DNA, 18 bp, Homo sapiens
atatttgtgcattttcta

SEQ ID NO: 2666185 - DNA, 17 bp, Homo sapiens
atatttgtgtatttaac

SEQ ID NO: 2666186 - DNA, 13 bp, Homo sapiens
atcaagaagggct

SEQ ID NO: 2666187 - DNA, 12 bp, Homo sapiens
atcatcaagaag

SEQ ID NO: 2666188 - DNA, 17 bp, Homo sapiens
atcatgaccagcaaata

SEQ ID NO: 2666189 - DNA, 19 bp, Homo sapiens
atcccccccacctctccct

SEQ ID NO: 2666190 - DNA, 18 bp, Homo sapiens
atcctcttcttttagcag

SEQ ID NO: 2666191 - DNA, 13 bp, Homo sapiens
atccttttttaaa

SEQ ID NO: 2666192 - DNA, 23 bp, Homo sapiens
atcgccagctgatgactcaagat

SEQ ID NO: 2666193 - DNA, 20 bp, Homo sapiens
atcgcggcggagctggcccc

SEQ ID NO: 2666194 - DNA, 12 bp, Homo sapiens
atcgtccaggga

SEQ ID NO: 2666195 - DNA, 13 bp, Homo sapiens
atcgtccagggag

SEQ ID NO: 2666196 - DNA, 19 bp, Homo sapiens
atctaatttataaaaaggt

SEQ ID NO: 2666197 - DNA, 23 bp, Homo sapiens
atctaatttataaaaaggtgttt

SEQ ID NO: 2666198 - DNA, 15 bp, Homo sapiens
atctatacttgcttt

SEQ ID NO: 2666199 - DNA, 18 bp, Homo sapiens
atctcccttcacaagttt

SEQ ID NO: 2666200 - DNA, 17 bp, Homo sapiens
atctctctttaatataa

SEQ ID NO: 2666201 - DNA, 19 bp, Homo sapiens
atctgaaaaatacttttgg

SEQ ID NO: 2666202 - DNA, 19 bp, Homo sapiens
atctgagctctttgcacta

SEQ ID NO: 2666203 - DNA, 18 bp, Homo sapiens
atctgatatgtattgttt

SEQ ID NO: 2666204 - DNA, 15 bp, Homo sapiens
atctgggcactgaag

SEQ ID NO: 2666205 - DNA, 13 bp, Homo sapiens
atcttcaacaaat

SEQ ID NO: 2666206 - DNA, 22 bp, Homo sapiens
atcttttcattgaacagcaaag

SEQ ID NO: 2666207 - DNA, 22 bp, Homo sapiens
atcttttgttcccatcctcttc

SEQ ID NO: 2666208 - DNA, 21 bp, Homo sapiens
atgaaccttctggcctcccac

SEQ ID NO: 2666209 - DNA, 17 bp, Homo sapiens
atgaaggtttctgaaaa

SEQ ID NO: 2666210 - DNA, 19 bp, Homo sapiens
atgaaggtttctgaaaatt

SEQ ID NO: 2666211 - DNA, 18 bp, Homo sapiens
atgaccttctaggaagct

SEQ ID NO: 2666212 - DNA, 15 bp, Homo sapiens
atgactcaagattcc

SEQ ID NO: 2666213 - DNA, 19 bp, Homo sapiens
atgactcaagattcccagg

SEQ ID NO: 2666214 - DNA, 23 bp, Homo sapiens
atgactcaagattcccaggagtt

SEQ ID NO: 2666215 - DNA, 23 bp, Homo sapiens
atgagaagaaaatggaaccaggc

SEQ ID NO: 2666216 - DNA, 17 bp, Homo sapiens
atgagattaattccttt

SEQ ID NO: 2666217 - DNA, 22 bp, Homo sapiens
atgagctgtgcacaaagtggca

SEQ ID NO: 2666218 - DNA, 17 bp, Homo sapiens
atgagtggctttaatga

SEQ ID NO: 2666219 - DNA, 23 bp, Homo sapiens
atgagttagaataataaatattt

SEQ ID NO: 2666220 - DNA, 13 bp, Homo sapiens
atgagtttttccc

SEQ ID NO: 2666221 - DNA, 17 bp, Homo sapiens
atgatccaagcaagact

SEQ ID NO: 2666222 - DNA, 16 bp, Homo sapiens
atgatgctatttgcaa

SEQ ID NO: 2666223 - DNA, 17 bp, Homo sapiens
atgatgctatttgcaat

SEQ ID NO: 2666224 - DNA, 19 bp, Homo sapiens
atgatgtgggtcaaggaat

SEQ ID NO: 2666225 - DNA, 21 bp, Homo sapiens
atgatgtttgcccaaaattta

SEQ ID NO: 2666226 - DNA, 19 bp, Homo sapiens
atgattaattaaatagctt

SEQ ID NO: 2666227 - DNA, 16 bp, Homo sapiens
atgatttacagagaag

SEQ ID NO: 2666228 - DNA, 14 bp, Homo sapiens
atgccgttactttt

SEQ ID NO: 2666229 - DNA, 22 bp, Homo sapiens
atgccgttacttttcatatttg

SEQ ID NO: 2666230 - DNA, 24 bp, Homo sapiens
atgcctcagccctgaccctgtgga

SEQ ID NO: 2666231 - DNA, 20 bp, Homo sapiens
atgcctccccctagccattt

SEQ ID NO: 2666232 - DNA, 23 bp, Homo sapiens
atgctaaaggttgtattgcatat

SEQ ID NO: 2666233 - DNA, 21 bp, Homo sapiens
atgctatttgcaattcctgct

SEQ ID NO: 2666234 - DNA, 13 bp, Homo sapiens
atgctgtgaaatt

SEQ ID NO: 2666235 - DNA, 14 bp, Homo sapiens
atgcttctttcaaa

SEQ ID NO: 2666236 - DNA, 16 bp, Homo sapiens
atggaaactgaaacta

SEQ ID NO: 2666237 - DNA, 16 bp, Homo sapiens
atggaaccaggcttgg

SEQ ID NO: 2666238 - DNA, 14 bp, Homo sapiens
atggcagctgccac

SEQ ID NO: 2666239 - DNA, 15 bp, Homo sapiens
atggcagtgtctttc

SEQ ID NO: 2666240 - DNA, 15 bp, Homo sapiens
atggcccattctact

SEQ ID NO: 2666241 - DNA, 24 bp, Homo sapiens
atggcccattctacttgctctgga

SEQ ID NO: 2666242 - DNA, 18 bp, Homo sapiens
atggctacctaaaaagat

SEQ ID NO: 2666243 - DNA, 18 bp, Homo sapiens
atgggaaggtgggcgggc

SEQ ID NO: 2666244 - DNA, 22 bp, Homo sapiens
atgggacaaagttccaaaatgc

SEQ ID NO: 2666245 - DNA, 18 bp, Homo sapiens
atgggcacaaagggccca

SEQ ID NO: 2666246 - DNA, 20 bp, Homo sapiens
atgggcacaaagggcccaga

SEQ ID NO: 2666247 - DNA, 21 bp, Homo sapiens
atgggtccaggattcctcttt

SEQ ID NO: 2666248 - DNA, 20 bp, Homo sapiens
atggtaattcttattctttc

SEQ ID NO: 2666249 - DNA, 22 bp, Homo sapiens
atggtttgaatataaacactat

SEQ ID NO: 2666250 - DNA, 18 bp, Homo sapiens
atggtttgcaaggaagcc

SEQ ID NO: 2666251 - DNA, 14 bp, Homo sapiens
atgtacaggatgct

SEQ ID NO: 2666252 - DNA, 22 bp, Homo sapiens
atgtatatattttttaaaaatc

SEQ ID NO: 2666253 - DNA, 14 bp, Homo sapiens
atgtatgattacat

SEQ ID NO: 2666254 - DNA, 15 bp, Homo sapiens
atgtgatttaaacaa

SEQ ID NO: 2666255 - DNA, 19 bp, Homo sapiens
atgtgctacaggggccaga

SEQ ID NO: 2666256 - DNA, 21 bp, Homo sapiens
atgtgctacaggggccagaag

SEQ ID NO: 2666257 - DNA, 16 bp, Homo sapiens
atgtgggtcaaggaat

SEQ ID NO: 2666258 - DNA, 18 bp, Homo sapiens
atgtgtttatgtgagctg

SEQ ID NO: 2666259 - DNA, 16 bp, Homo sapiens
atgttcagaagaaatt

SEQ ID NO: 2666260 - DNA, 13 bp, Homo sapiens
atgttgaggtgga

SEQ ID NO: 2666261 - DNA, 11 bp, Homo sapiens
attaaatagct

SEQ ID NO: 2666262 - DNA, 20 bp, Homo sapiens
attaatacaatgatgctatt

SEQ ID NO: 2666263 - DNA, 20 bp, Homo sapiens
attaatatggggatgcagca

SEQ ID NO: 2666264 - DNA, 18 bp, Homo sapiens
attagatcttcaaacaga

SEQ ID NO: 2666265 - DNA, 19 bp, Homo sapiens
attagatcttcaaacagaa

SEQ ID NO: 2666266 - DNA, 12 bp, Homo sapiens
attagctgcttc

SEQ ID NO: 2666267 - DNA, 18 bp, Homo sapiens
attagttttgcataattt

SEQ ID NO: 2666268 - DNA, 22 bp, Homo sapiens
attcaataaaaaaaagaaatga

SEQ ID NO: 2666269 - DNA, 14 bp, Homo sapiens
attcatattgaata

SEQ ID NO: 2666270 - DNA, 17 bp, Homo sapiens
attcatattgaatataa

SEQ ID NO: 2666271 - DNA, 12 bp, Homo sapiens
attcccaggagt

SEQ ID NO: 2666272 - DNA, 20 bp, Homo sapiens
attcccaggagttctgctca

SEQ ID NO: 2666273 - DNA, 21 bp, Homo sapiens
attcccaggagttctgctcat

SEQ ID NO: 2666274 - DNA, 19 bp, Homo sapiens
attctaacttttttgctat

SEQ ID NO: 2666275 - DNA, 17 bp, Homo sapiens
attctaatgatggccca

SEQ ID NO: 2666276 - DNA, 12 bp, Homo sapiens
attctacttgct

SEQ ID NO: 2666277 - DNA, 16 bp, Homo sapiens
attctacttgctctgg

SEQ ID NO: 2666278 - DNA, 18 bp, Homo sapiens
attctacttgctctggac

SEQ ID NO: 2666279 - DNA, 20 bp, Homo sapiens
attctacttgctctggacct

SEQ ID NO: 2666280 - DNA, 23 bp, Homo sapiens
attctacttgctctggacctgcc

SEQ ID NO: 2666281 - DNA, 18 bp, Homo sapiens
attctaggcctcctggcc

SEQ ID NO: 2666282 - DNA, 16 bp, Homo sapiens
attctccatttgttat

SEQ ID NO: 2666283 - DNA, 21 bp, Homo sapiens
attcttaagacttgcatttaa

SEQ ID NO: 2666284 - DNA, 16 bp, Homo sapiens
attcttacaaacatgt

SEQ ID NO: 2666285 - DNA, 17 bp, Homo sapiens
attcttcccattctcca

SEQ ID NO: 2666286 - DNA, 22 bp, Homo sapiens
attcttcccattctccatttgt

SEQ ID NO: 2666287 - DNA, 17 bp, Homo sapiens
attctttcgaaagaaga

SEQ ID NO: 2666288 - DNA, 17 bp, Homo sapiens
attcttttgtaatttaa

SEQ ID NO: 2666289 - DNA, 14 bp, Homo sapiens
attgaacagcaaag

SEQ ID NO: 2666290 - DNA, 15 bp, Homo sapiens
attgaaggcttaaac

SEQ ID NO: 2666291 - DNA, 23 bp, Homo sapiens
attgaatataatatatttgtgta

SEQ ID NO: 2666292 - DNA, 16 bp, Homo sapiens
attgaatctatttaag

SEQ ID NO: 2666293 - DNA, 19 bp, Homo sapiens
attgagctgcagaaacgaa

SEQ ID NO: 2666294 - DNA, 18 bp, Homo sapiens
attgatataaataaaaca

SEQ ID NO: 2666295 - DNA, 22 bp, Homo sapiens
attgatatttgtgcattttcta

SEQ ID NO: 2666296 - DNA, 16 bp, Homo sapiens
attgcatatatacata

SEQ ID NO: 2666297 - DNA, 12 bp, Homo sapiens
attgtttgaacc

SEQ ID NO: 2666298 - DNA, 17 bp, Homo sapiens
atttaacagggagggga

SEQ ID NO: 2666299 - DNA, 13 bp, Homo sapiens
atttagatatgca

SEQ ID NO: 2666300 - DNA, 21 bp, Homo sapiens
atttagtaggtgagttttcac

SEQ ID NO: 2666301 - DNA, 15 bp, Homo sapiens
atttatactggcatg

SEQ ID NO: 2666302 - DNA, 21 bp, Homo sapiens
atttcaatttccaagagctga

SEQ ID NO: 2666303 - DNA, 21 bp, Homo sapiens
atttcccccaccccatttctc

SEQ ID NO: 2666304 - DNA, 18 bp, Homo sapiens
atttctctttctttacaa

SEQ ID NO: 2666305 - DNA, 21 bp, Homo sapiens
atttcttaaacaaatgtatga

SEQ ID NO: 2666306 - DNA, 13 bp, Homo sapiens
atttcttcaccag

SEQ ID NO: 2666307 - DNA, 19 bp, Homo sapiens
atttgtaggggaactcatt

SEQ ID NO: 2666308 - DNA, 20 bp, Homo sapiens
attttaagacgtgtttgtgt

SEQ ID NO: 2666309 - DNA, 21 bp, Homo sapiens
attttaatgcacctgaatgtt

SEQ ID NO: 2666310 - DNA, 17 bp, Homo sapiens
attttataagaaaaact

SEQ ID NO: 2666311 - DNA, 15 bp, Homo sapiens
attttatacattaac

SEQ ID NO: 2666312 - DNA, 18 bp, Homo sapiens
attttcttcacctctgct

SEQ ID NO: 2666313 - DNA, 13 bp, Homo sapiens
attttgatcttca

SEQ ID NO: 2666314 - DNA, 16 bp, Homo sapiens
attttgatcttcaaca

SEQ ID NO: 2666315 - DNA, 20 bp, Homo sapiens
attttgatcttcaacaaatt

SEQ ID NO: 2666316 - DNA, 19 bp, Homo sapiens
attttgtaacttccatgtg

SEQ ID NO: 2666317 - DNA, 16 bp, Homo sapiens
attttgttctctggga

SEQ ID NO: 2666318 - DNA, 18 bp, Homo sapiens
attttgttctctgggaga

SEQ ID NO: 2666319 - DNA, 21 bp, Homo sapiens
attttgttctctgggagaaaa

SEQ ID NO: 2666320 - DNA, 20 bp, Homo sapiens
atttttcagaccttttaact

SEQ ID NO: 2666321 - DNA, 22 bp, Homo sapiens
attttttaaccccgtcaacaaa

SEQ ID NO: 2666322 - DNA, 21 bp, Homo sapiens
caaaaacccagcaacagaaaa

SEQ ID NO: 2666323 - DNA, 18 bp, Homo sapiens
caaaacagaggcacttaa

SEQ ID NO: 2666324 - DNA, 18 bp, Homo sapiens
caaaatggataaaatctg

SEQ ID NO: 2666325 - DNA, 20 bp, Homo sapiens
caaaatttattttataagaa

SEQ ID NO: 2666326 - DNA, 22 bp, Homo sapiens
caaaatttattttataagaaaa

SEQ ID NO: 2666327 - DNA, 23 bp, Homo sapiens
caaaatttattttataagaaaaa

SEQ ID NO: 2666328 - DNA, 15 bp, Homo sapiens
caaaccacactggac

SEQ ID NO: 2666329 - DNA, 24 bp, Homo sapiens
caaacccagacggctccactagga

SEQ ID NO: 2666330 - DNA, 22 bp, Homo sapiens
caaactaggggacaaagcaaaa

SEQ ID NO: 2666331 - DNA, 19 bp, Homo sapiens
caaagaggcctttaaccat

SEQ ID NO: 2666332 - DNA, 20 bp, Homo sapiens
caaagatgggtgaaggctgg

SEQ ID NO: 2666333 - DNA, 21 bp, Homo sapiens
caaagatgggtgaaggctggc

SEQ ID NO: 2666334 - DNA, 12 bp, Homo sapiens
caaagggcccag

SEQ ID NO: 2666335 - DNA, 22 bp, Homo sapiens
caaagggctcctctccagtctg

SEQ ID NO: 2666336 - DNA, 16 bp, Homo sapiens
caaagggtccagaagg

SEQ ID NO: 2666337 - DNA, 23 bp, Homo sapiens
caaatactcattttaggaaaaaa

SEQ ID NO: 2666338 - DNA, 21 bp, Homo sapiens
caaatgctaatgtcaaacttg

SEQ ID NO: 2666339 - DNA, 23 bp, Homo sapiens
caaattgtgtgtgctctgcttca

SEQ ID NO: 2666340 - DNA, 15 bp, Homo sapiens
caaattttatttgta

SEQ ID NO: 2666341 - DNA, 21 bp, Homo sapiens
caacaacatgtataatatttt

SEQ ID NO: 2666342 - DNA, 22 bp, Homo sapiens
caacaacatgtataatattttt

SEQ ID NO: 2666343 - DNA, 22 bp, Homo sapiens
caacacaaagagaaaaagaaat

SEQ ID NO: 2666344 - DNA, 23 bp, Homo sapiens
caacactgatttccccttttgca

SEQ ID NO: 2666345 - DNA, 13 bp, Homo sapiens
caacatgtataat

SEQ ID NO: 2666346 - DNA, 18 bp, Homo sapiens
caacatgtataatatttt

SEQ ID NO: 2666347 - DNA, 22 bp, Homo sapiens
caaccacatacaacacaaagag

SEQ ID NO: 2666348 - DNA, 19 bp, Homo sapiens
caaccagggagctgcaggg

SEQ ID NO: 2666349 - DNA, 17 bp, Homo sapiens
caactacagaaaaacca

SEQ ID NO: 2666350 - DNA, 15 bp, Homo sapiens
caacttaacatgaaa

SEQ ID NO: 2666351 - DNA, 20 bp, Homo sapiens
caagaagggctgcatgatgt

SEQ ID NO: 2666352 - DNA, 23 bp, Homo sapiens
caagacctcagggcacaaagatg

SEQ ID NO: 2666353 - DNA, 15 bp, Homo sapiens
caagattcccaggag

SEQ ID NO: 2666354 - DNA, 19 bp, Homo sapiens
caagattcccaggagttct

SEQ ID NO: 2666355 - DNA, 21 bp, Homo sapiens
caagattcccaggagttctgc

SEQ ID NO: 2666356 - DNA, 17 bp, Homo sapiens
caagcccccccttccac

SEQ ID NO: 2666357 - DNA, 19 bp, Homo sapiens
caaggagggtgagtgcaag

SEQ ID NO: 2666358 - DNA, 17 bp, Homo sapiens
caagttgttcaaacatt

SEQ ID NO: 2666359 - DNA, 21 bp, Homo sapiens
caataaaaaaaagaaatgaaa

SEQ ID NO: 2666360 - DNA, 13 bp, Homo sapiens
caatattttccat

SEQ ID NO: 2666361 - DNA, 15 bp, Homo sapiens
caatattttccatga

SEQ ID NO: 2666362 - DNA, 22 bp, Homo sapiens
caatattttccatgaaaatgca

SEQ ID NO: 2666363 - DNA, 20 bp, Homo sapiens
caatcatattaatacaatga

SEQ ID NO: 2666364 - DNA, 13 bp, Homo sapiens
caatgatgctatt

SEQ ID NO: 2666365 - DNA, 17 bp, Homo sapiens
caatggtttgcaaggaa

SEQ ID NO: 2666366 - DNA, 22 bp, Homo sapiens
caatgtactaggatactgctgc

SEQ ID NO: 2666367 - DNA, 14 bp, Homo sapiens
caatgttaacattt

SEQ ID NO: 2666368 - DNA, 17 bp, Homo sapiens
caatgtttttaaaaatc

SEQ ID NO: 2666369 - DNA, 18 bp, Homo sapiens
caattcttacaaacatgt

SEQ ID NO: 2666370 - DNA, 22 bp, Homo sapiens
caattgctttgtcatatagctg

SEQ ID NO: 2666371 - DNA, 17 bp, Homo sapiens
caatttccaagagctga

SEQ ID NO: 2666372 - DNA, 13 bp, Homo sapiens
cacaaagggccca

SEQ ID NO: 2666373 - DNA, 16 bp, Homo sapiens
cacaaagggcccagat

SEQ ID NO: 2666374 - DNA, 22 bp, Homo sapiens
cacacagactgttgtccctgca

SEQ ID NO: 2666375 - DNA, 21 bp, Homo sapiens
cacaccaggcttgcctgcagg

SEQ ID NO: 2666376 - DNA, 20 bp, Homo sapiens
cacacgcctcccactggggt

SEQ ID NO: 2666377 - DNA, 14 bp, Homo sapiens
cacactcatcccct

SEQ ID NO: 2666378 - DNA, 14 bp, Homo sapiens
cacagactcatatt

SEQ ID NO: 2666379 - DNA, 23 bp, Homo sapiens
cacagactgttgtccctgcactc

SEQ ID NO: 2666380 - DNA, 17 bp, Homo sapiens
cacattagactatccat

SEQ ID NO: 2666381 - DNA, 20 bp, Homo sapiens
caccaggcttgcctgcaggc

SEQ ID NO: 2666382 - DNA, 16 bp, Homo sapiens
caccagtcatttttca

SEQ ID NO: 2666383 - DNA, 13 bp, Homo sapiens
caccattgaaggc

SEQ ID NO: 2666384 - DNA, 17 bp, Homo sapiens
caccatttaaaaacagg

SEQ ID NO: 2666385 - DNA, 19 bp, Homo sapiens
caccctgaggcctctggaa

SEQ ID NO: 2666386 - DNA, 22 bp, Homo sapiens
cacctaaataaccaatctacaa

SEQ ID NO: 2666387 - DNA, 15 bp, Homo sapiens
cacctgctggagtga

SEQ ID NO: 2666388 - DNA, 18 bp, Homo sapiens
cacctgtaatcccagcac

SEQ ID NO: 2666389 - DNA, 23 bp, Homo sapiens
caccttcagtaacccccactgga

SEQ ID NO: 2666390 - DNA, 12 bp, Homo sapiens
cacgcaggagca

SEQ ID NO: 2666391 - DNA, 14 bp, Homo sapiens
cacgcctcccactg

SEQ ID NO: 2666392 - DNA, 23 bp, Homo sapiens
cacgcctgtaatcccagcaattt

SEQ ID NO: 2666393 - DNA, 11 bp, Homo sapiens
cactcctgctg

SEQ ID NO: 2666394 - DNA, 12 bp, Homo sapiens
cactcctgctgt

SEQ ID NO: 2666395 - DNA, 13 bp, Homo sapiens
cactcctgctgta

SEQ ID NO: 2666396 - DNA, 16 bp, Homo sapiens
cactctgggctccaga

SEQ ID NO: 2666397 - DNA, 15 bp, Homo sapiens
cactgatttcccctt

SEQ ID NO: 2666398 - DNA, 16 bp, Homo sapiens
cactgcctctcacagc

SEQ ID NO: 2666399 - DNA, 17 bp, Homo sapiens
cactggactgacctggt

SEQ ID NO: 2666400 - DNA, 14 bp, Homo sapiens
cactgggaggccag

SEQ ID NO: 2666401 - DNA, 17 bp, Homo sapiens
cactgtcctccaagcca

SEQ ID NO: 2666402 - DNA, 14 bp, Homo sapiens
cactgtcttgaaga

SEQ ID NO: 2666403 - DNA, 17 bp, Homo sapiens
cactgtgaccttgagaa

SEQ ID NO: 2666404 - DNA, 17 bp, Homo sapiens
cactgtgagctcccagg

SEQ ID NO: 2666405 - DNA, 17 bp, Homo sapiens
cacttcacgctttcagc

SEQ ID NO: 2666406 - DNA, 13 bp, Homo sapiens
cacttctcttcct

SEQ ID NO: 2666407 - DNA, 22 bp, Homo sapiens
cacttgccgcgtcgccctccca

SEQ ID NO: 2666408 - DNA, 17 bp, Homo sapiens
cactttcagtgaaagca

SEQ ID NO: 2666409 - DNA, 18 bp, Homo sapiens
cactttcagtgaaagcat

SEQ ID NO: 2666410 - DNA, 19 bp, Homo sapiens
cactttcagtgaaagcatc

SEQ ID NO: 2666411 - DNA, 20 bp, Homo sapiens
cactttggatttcatcagac

SEQ ID NO: 2666412 - DNA, 23 bp, Homo sapiens
cactttgggaggccaaggagggc

SEQ ID NO: 2666413 - DNA, 13 bp, Homo sapiens
cagaaacaggacc

SEQ ID NO: 2666414 - DNA, 19 bp, Homo sapiens
cagaagggagctagccaga

SEQ ID NO: 2666415 - DNA, 18 bp, Homo sapiens
cagaatggggtgcatgaa

SEQ ID NO: 2666416 - DNA, 13 bp, Homo sapiens
cagaccagctctt

SEQ ID NO: 2666417 - DNA, 23 bp, Homo sapiens
cagactcctgactgtctcccggg

SEQ ID NO: 2666418 - DNA, 18 bp, Homo sapiens
cagactgttgtccctgca

SEQ ID NO: 2666419 - DNA, 21 bp, Homo sapiens
cagaggactgtgatgccctgc

SEQ ID NO: 2666420 - DNA, 14 bp, Homo sapiens
cagatgcaatgact

SEQ ID NO: 2666421 - DNA, 21 bp, Homo sapiens
cagattatgagacacaggatg

SEQ ID NO: 2666422 - DNA, 20 bp, Homo sapiens
cagattttttttggactgtt

SEQ ID NO: 2666423 - DNA, 11 bp, Homo sapiens
cagcagactga

SEQ ID NO: 2666424 - DNA, 18 bp, Homo sapiens
cagcattgatatttgtgc

SEQ ID NO: 2666425 - DNA, 15 bp, Homo sapiens
cagcattttcctctg

SEQ ID NO: 2666426 - DNA, 21 bp, Homo sapiens
cagccagggcctgcgagggca

SEQ ID NO: 2666427 - DNA, 22 bp, Homo sapiens
cagccagggcctgcgagggcag

SEQ ID NO: 2666428 - DNA, 13 bp, Homo sapiens
cagccctgaccct

SEQ ID NO: 2666429 - DNA, 19 bp, Homo sapiens
cagcctggtttagcctgga

SEQ ID NO: 2666430 - DNA, 13 bp, Homo sapiens
cagcgaatgacaa

SEQ ID NO: 2666431 - DNA, 18 bp, Homo sapiens
cagcgggagcctccctgc

SEQ ID NO: 2666432 - DNA, 19 bp, Homo sapiens
cagcgggagcctccctgcc

SEQ ID NO: 2666433 - DNA, 21 bp, Homo sapiens
cagctacctcaaccaatgcca

SEQ ID NO: 2666434 - DNA, 12 bp, Homo sapiens
cagctctcccct

SEQ ID NO: 2666435 - DNA, 19 bp, Homo sapiens
cagctgaaatatgctggct

SEQ ID NO: 2666436 - DNA, 21 bp, Homo sapiens
cagctgaaatatgctggctgg

SEQ ID NO: 2666437 - DNA, 18 bp, Homo sapiens
cagcttctcatcctgcag

SEQ ID NO: 2666438 - DNA, 14 bp, Homo sapiens
caggacaggaaaaa

SEQ ID NO: 2666439 - DNA, 19 bp, Homo sapiens
caggacctccaagccactg

SEQ ID NO: 2666440 - DNA, 21 bp, Homo sapiens
caggagcacacccagccccca

SEQ ID NO: 2666441 - DNA, 23 bp, Homo sapiens
caggagcttcctgtcctcccagc

SEQ ID NO: 2666442 - DNA, 14 bp, Homo sapiens
caggagttctgctc

SEQ ID NO: 2666443 - DNA, 22 bp, Homo sapiens
caggagttctgctcattctaat

SEQ ID NO: 2666444 - DNA, 23 bp, Homo sapiens
caggcagctcataagagccacag

SEQ ID NO: 2666445 - DNA, 22 bp, Homo sapiens
caggcagctttttctctcccac

SEQ ID NO: 2666446 - DNA, 15 bp, Homo sapiens
caggcttgcctgcag

SEQ ID NO: 2666447 - DNA, 17 bp, Homo sapiens
caggcttgcctgcaggc

SEQ ID NO: 2666448 - DNA, 21 bp, Homo sapiens
cagggaaaagcagctctcccc

SEQ ID NO: 2666449 - DNA, 22 bp, Homo sapiens
cagggacgaagaagagccacag

SEQ ID NO: 2666450 - DNA, 21 bp, Homo sapiens
cagggagacctggacacaggc

SEQ ID NO: 2666451 - DNA, 14 bp, Homo sapiens
cagggagctgcagg

SEQ ID NO: 2666452 - DNA, 17 bp, Homo sapiens
cagggagctgcaggggc

SEQ ID NO: 2666453 - DNA, 16 bp, Homo sapiens
cagggaggggaagagg

SEQ ID NO: 2666454 - DNA, 18 bp, Homo sapiens
cagggattgtttctgttt

SEQ ID NO: 2666455 - DNA, 15 bp, Homo sapiens
cagggcacaggccat

SEQ ID NO: 2666456 - DNA, 18 bp, Homo sapiens
cagggccaacccttctcc

SEQ ID NO: 2666457 - DNA, 16 bp, Homo sapiens
cagggcttacggccct

SEQ ID NO: 2666458 - DNA, 20 bp, Homo sapiens
caggggagggtcagccaggg

SEQ ID NO: 2666459 - DNA, 18 bp, Homo sapiens
caggtagacctgtctcct

SEQ ID NO: 2666460 - DNA, 18 bp, Homo sapiens
caggtgcaaccagggagc

SEQ ID NO: 2666461 - DNA, 14 bp, Homo sapiens
caggtgcagccaga

SEQ ID NO: 2666462 - DNA, 16 bp, Homo sapiens
caggtgcagccagagg

SEQ ID NO: 2666463 - DNA, 17 bp, Homo sapiens
caggtgcagccagaggc

SEQ ID NO: 2666464 - DNA, 19 bp, Homo sapiens
caggtgcagccagaggcac

SEQ ID NO: 2666465 - DNA, 15 bp, Homo sapiens
cagtcaattaacaat

SEQ ID NO: 2666466 - DNA, 20 bp, Homo sapiens
cagtcatttttcagaccttt

SEQ ID NO: 2666467 - DNA, 15 bp, Homo sapiens
cagtctgatctgtga

SEQ ID NO: 2666468 - DNA, 18 bp, Homo sapiens
cagtcttgacgagtgtga

SEQ ID NO: 2666469 - DNA, 13 bp, Homo sapiens
cagtgaaagcatc

SEQ ID NO: 2666470 - DNA, 14 bp, Homo sapiens
cagtgaaagcatca

SEQ ID NO: 2666471 - DNA, 15 bp, Homo sapiens
cagttaagtttttcc

SEQ ID NO: 2666472 - DNA, 19 bp, Homo sapiens
cagttcttgccactttttt

SEQ ID NO: 2666473 - DNA, 17 bp, Homo sapiens
catacaacacaaagaga

SEQ ID NO: 2666474 - DNA, 22 bp, Homo sapiens
catatattgggttccattctca

SEQ ID NO: 2666475 - DNA, 13 bp, Homo sapiens
catatttgcacta

SEQ ID NO: 2666476 - DNA, 16 bp, Homo sapiens
catcaagaagggctgc

SEQ ID NO: 2666477 - DNA, 12 bp, Homo sapiens
catcattccctt

SEQ ID NO: 2666478 - DNA, 15 bp, Homo sapiens
catcccctgcctcca

SEQ ID NO: 2666479 - DNA, 14 bp, Homo sapiens
catcgcactgtgga

SEQ ID NO: 2666480 - DNA, 14 bp, Homo sapiens
catctctctttaat

SEQ ID NO: 2666481 - DNA, 17 bp, Homo sapiens
catctggttaggatggc

SEQ ID NO: 2666482 - DNA, 22 bp, Homo sapiens
catgaaaatgcaacaacatgta

SEQ ID NO: 2666483 - DNA, 16 bp, Homo sapiens
tgctctggacctgccc

SEQ ID NO: 2666484 - DNA, 16 bp, Homo sapiens
tgctgcggagcaagag

SEQ ID NO: 2666485 - DNA, 18 bp, Homo sapiens
tgctgtaaatttggcttc

SEQ ID NO: 2666486 - DNA, 19 bp, Homo sapiens
tgctgtaaatttggcttct

SEQ ID NO: 2666487 - DNA, 12 bp, Homo sapiens
tgctgtcctcag

SEQ ID NO: 2666488 - DNA, 19 bp, Homo sapiens
tgctgtcctcaggtggcca

SEQ ID NO: 2666489 - DNA, 15 bp, Homo sapiens
tgcttgtataggttt

SEQ ID NO: 2666490 - DNA, 17 bp, Homo sapiens
tgctttcactctttaga

SEQ ID NO: 2666491 - DNA, 20 bp, Homo sapiens
tgctttctgaagctttacca

SEQ ID NO: 2666492 - DNA, 23 bp, Homo sapiens
tgctttgaaagccccagaaatca

SEQ ID NO: 2666493 - DNA, 21 bp, Homo sapiens
tgcttttggggggcatatatt

SEQ ID NO: 2666494 - DNA, 18 bp, Homo sapiens
tggaaacattcaggagct

SEQ ID NO: 2666495 - DNA, 12 bp, Homo sapiens
tggaaagcaaag

SEQ ID NO: 2666496 - DNA, 15 bp, Homo sapiens
tggaaagcaaagggc

SEQ ID NO: 2666497 - DNA, 22 bp, Homo sapiens
tggaaaggagcctaggccaggt

SEQ ID NO: 2666498 - DNA, 22 bp, Homo sapiens
tggaaattaggatgtaaatctg

SEQ ID NO: 2666499 - DNA, 13 bp, Homo sapiens
tggaaccaggctt

SEQ ID NO: 2666500 - DNA, 15 bp, Homo sapiens
tggacacaggcctgc

SEQ ID NO: 2666501 - DNA, 19 bp, Homo sapiens
tggactgacctggtccaca

SEQ ID NO: 2666502 - DNA, 19 bp, Homo sapiens
tggaggagctcaggacact

SEQ ID NO: 2666503 - DNA, 15 bp, Homo sapiens
tggagtcattctcat

SEQ ID NO: 2666504 - DNA, 17 bp, Homo sapiens
tggccatgcctcagccc

SEQ ID NO: 2666505 - DNA, 18 bp, Homo sapiens
tggccatgcctcagccct

SEQ ID NO: 2666506 - DNA, 17 bp, Homo sapiens
tggcccaggtgagtcct

SEQ ID NO: 2666507 - DNA, 15 bp, Homo sapiens
tggcccattctactt

SEQ ID NO: 2666508 - DNA, 16 bp, Homo sapiens
tggcccattctacttg

SEQ ID NO: 2666509 - DNA, 20 bp, Homo sapiens
tggccccgccgcctggtact

SEQ ID NO: 2666510 - DNA, 21 bp, Homo sapiens
tggccccgccgcctggtactc

SEQ ID NO: 2666511 - DNA, 18 bp, Homo sapiens
tggcctcccacagactca

SEQ ID NO: 2666512 - DNA, 16 bp, Homo sapiens
tggctcacacctgtaa

SEQ ID NO: 2666513 - DNA, 16 bp, Homo sapiens
tggcttcactcctgct

SEQ ID NO: 2666514 - DNA, 19 bp, Homo sapiens
tggcttcactcctgctgta

SEQ ID NO: 2666515 - DNA, 23 bp, Homo sapiens
tggcttcactcctgctgtaaatt

SEQ ID NO: 2666516 - DNA, 15 bp, Homo sapiens
tggcttctctgagga

SEQ ID NO: 2666517 - DNA, 19 bp, Homo sapiens
tggcttctgttgtcacctt

SEQ ID NO: 2666518 - DNA, 15 bp, Homo sapiens
tgggaaacagaggct

SEQ ID NO: 2666519 - DNA, 19 bp, Homo sapiens
tgggaaggggacccccgcc

SEQ ID NO: 2666520 - DNA, 15 bp, Homo sapiens
tgggaatacctgtgg

SEQ ID NO: 2666521 - DNA, 18 bp, Homo sapiens
tgggactagagctttctt

SEQ ID NO: 2666522 - DNA, 18 bp, Homo sapiens
tgggagaatgtcagttca

SEQ ID NO: 2666523 - DNA, 12 bp, Homo sapiens
tgggaggcgggc

SEQ ID NO: 2666524 - DNA, 20 bp, Homo sapiens
tgggaggtggaggttgcagt

SEQ ID NO: 2666525 - DNA, 16 bp, Homo sapiens
tgggcaatatagcaag

SEQ ID NO: 2666526 - DNA, 19 bp, Homo sapiens
tgggcacaaagggcccaga

SEQ ID NO: 2666527 - DNA, 16 bp, Homo sapiens
tgggcacccaccctgg

SEQ ID NO: 2666528 - DNA, 12 bp, Homo sapiens
tgggcactgaag

SEQ ID NO: 2666529 - DNA, 16 bp, Homo sapiens
tggggaggaaatagaa

SEQ ID NO: 2666530 - DNA, 15 bp, Homo sapiens
tggggatataatact

SEQ ID NO: 2666531 - DNA, 20 bp, Homo sapiens
tgggtccaggattcctcttt

SEQ ID NO: 2666532 - DNA, 14 bp, Homo sapiens
tgggtgaaggctgg

SEQ ID NO: 2666533 - DNA, 19 bp, Homo sapiens
tggtaaacgctgtccctag

SEQ ID NO: 2666534 - DNA, 14 bp, Homo sapiens
tggtccagcctggt

SEQ ID NO: 2666535 - DNA, 22 bp, Homo sapiens
tggtctgggtgtagctcttaga

SEQ ID NO: 2666536 - DNA, 14 bp, Homo sapiens
tggtgaaacctcct

SEQ ID NO: 2666537 - DNA, 17 bp, Homo sapiens
tggttaaaaaaaagaat

SEQ ID NO: 2666538 - DNA, 15 bp, Homo sapiens
tggtttgcaaggaag

SEQ ID NO: 2666539 - DNA, 17 bp, Homo sapiens
tggtttgcaaggaagcc

SEQ ID NO: 2666540 - DNA, 15 bp, Homo sapiens
tgtaaagtccccaga

SEQ ID NO: 2666541 - DNA, 14 bp, Homo sapiens
tgtaaataaagccc

SEQ ID NO: 2666542 - DNA, 18 bp, Homo sapiens
tgtaaataaagccctggg

SEQ ID NO: 2666543 - DNA, 18 bp, Homo sapiens
tgtaaatttggcttctgt

SEQ ID NO: 2666544 - DNA, 12 bp, Homo sapiens
tgtactcccagg

SEQ ID NO: 2666545 - DNA, 18 bp, Homo sapiens
tgtagccttttgactttc

SEQ ID NO: 2666546 - DNA, 23 bp, Homo sapiens
tgtatcactctgtgtctgagtgg

SEQ ID NO: 2666547 - DNA, 19 bp, Homo sapiens
tgtatcagtggatttccca

SEQ ID NO: 2666548 - DNA, 18 bp, Homo sapiens
tgtatttgttaatggttt

SEQ ID NO: 2666549 - DNA, 16 bp, Homo sapiens
tgtattttttaaagct

SEQ ID NO: 2666550 - DNA, 17 bp, Homo sapiens
tgtcacagggactgaaa

SEQ ID NO: 2666551 - DNA, 22 bp, Homo sapiens
tgtcaggggcggggagggtgac

SEQ ID NO: 2666552 - DNA, 18 bp, Homo sapiens
tgtcatatagctggttat

SEQ ID NO: 2666553 - DNA, 19 bp, Homo sapiens
tgtcctcaggtggccatgc

SEQ ID NO: 2666554 - DNA, 16 bp, Homo sapiens
tgtctgagtggcttca

SEQ ID NO: 2666555 - DNA, 13 bp, Homo sapiens
tgtctgccagggc

SEQ ID NO: 2666556 - DNA, 13 bp, Homo sapiens
tgtgaaattccca

SEQ ID NO: 2666557 - DNA, 18 bp, Homo sapiens
tgtgaattgagctgcaga

SEQ ID NO: 2666558 - DNA, 19 bp, Homo sapiens
tgtgagctcccaggtgcag

SEQ ID NO: 2666559 - DNA, 16 bp, Homo sapiens
tgtgatgccctgccct

SEQ ID NO: 2666560 - DNA, 19 bp, Homo sapiens
tgtgcatagagccacgtat

SEQ ID NO: 2666561 - DNA, 13 bp, Homo sapiens
tgtgcattttcta

SEQ ID NO: 2666562 - DNA, 15 bp, Homo sapiens
tgtggaaaagaaaca

SEQ ID NO: 2666563 - DNA, 20 bp, Homo sapiens
tgtggaaaagaaacacgcac

SEQ ID NO: 2666564 - DNA, 22 bp, Homo sapiens
tgtggctattaaaactctttta

SEQ ID NO: 2666565 - DNA, 15 bp, Homo sapiens
tgtggttaatgccat

SEQ ID NO: 2666566 - DNA, 20 bp, Homo sapiens
tgtggttaatgccatggaca

SEQ ID NO: 2666567 - DNA, 13 bp, Homo sapiens
tgtgtatttaaca

SEQ ID NO: 2666568 - DNA, 18 bp, Homo sapiens
tgtgtatttaacagggag

SEQ ID NO: 2666569 - DNA, 17 bp, Homo sapiens
tgtgtttatgtgagctg

SEQ ID NO: 2666570 - DNA, 10 bp, Homo sapiens
tgtgtttgtt

SEQ ID NO: 2666571 - DNA, 17 bp, Homo sapiens
tgttaatggtttgaata

SEQ ID NO: 2666572 - DNA, 21 bp, Homo sapiens
tgttagcccaaggttaaaaag

SEQ ID NO: 2666573 - DNA, 17 bp, Homo sapiens
tgttcccacctgctgga

SEQ ID NO: 2666574 - DNA, 18 bp, Homo sapiens
tgttcccatcctcttctt

SEQ ID NO: 2666575 - DNA, 13 bp, Homo sapiens
tgttctctgggag

SEQ ID NO: 2666576 - DNA, 18 bp, Homo sapiens
tgttctgctgttctctag

SEQ ID NO: 2666577 - DNA, 16 bp, Homo sapiens
tgttgtgcctccctgg

SEQ ID NO: 2666578 - DNA, 22 bp, Homo sapiens
tgttttaatttatactggcatg

SEQ ID NO: 2666579 - DNA, 14 bp, Homo sapiens
tgttttcttgattt

SEQ ID NO: 2666580 - DNA, 12 bp, Homo sapiens
tgtttttaactc

SEQ ID NO: 2666581 - DNA, 12 bp, Homo sapiens
ttaaaaaaaaga

SEQ ID NO: 2666582 - DNA, 19 bp, Homo sapiens
ttaaagaagtatgggaaat

SEQ ID NO: 2666583 - DNA, 22 bp, Homo sapiens
ttaaagccacaaccacatacaa

SEQ ID NO: 2666584 - DNA, 15 bp, Homo sapiens
ttaaatagcttttgt

SEQ ID NO: 2666585 - DNA, 19 bp, Homo sapiens
ttaaatggaaactgaaact

SEQ ID NO: 2666586 - DNA, 13 bp, Homo sapiens
ttaacagggaggg

SEQ ID NO: 2666587 - DNA, 18 bp, Homo sapiens
ttaaccccgtcaacaaat

SEQ ID NO: 2666588 - DNA, 12 bp, Homo sapiens
ttaactcaatat

SEQ ID NO: 2666589 - DNA, 22 bp, Homo sapiens
ttaagggagtgtactcccaggg

SEQ ID NO: 2666590 - DNA, 20 bp, Homo sapiens
ttaagtttccttccagccca

SEQ ID NO: 2666591 - DNA, 15 bp, Homo sapiens
ttaatcttatcaaga

SEQ ID NO: 2666592 - DNA, 15 bp, Homo sapiens
ttaattaaatagctt

SEQ ID NO: 2666593 - DNA, 14 bp, Homo sapiens
ttaatttaaagcca

SEQ ID NO: 2666594 - DNA, 16 bp, Homo sapiens
ttaatttatactggca

SEQ ID NO: 2666595 - DNA, 20 bp, Homo sapiens
ttacagggcacaggccatgg

SEQ ID NO: 2666596 - DNA, 16 bp, Homo sapiens
ttacggacaccccctc

SEQ ID NO: 2666597 - DNA, 18 bp, Homo sapiens
catgaaggtttctgaaaa

SEQ ID NO: 2666598 - DNA, 12 bp, Homo sapiens
catgaccagcaa

SEQ ID NO: 2666599 - DNA, 21 bp, Homo sapiens
catgatgacaactacagaaaa

SEQ ID NO: 2666600 - DNA, 17 bp, Homo sapiens
catgatgtttgcccaaa

SEQ ID NO: 2666601 - DNA, 15 bp, Homo sapiens
catgcactcagctct

SEQ ID NO: 2666602 - DNA, 16 bp, Homo sapiens
catgcactcagctctt

SEQ ID NO: 2666603 - DNA, 19 bp, Homo sapiens
catgcctcagccctgaccc

SEQ ID NO: 2666604 - DNA, 15 bp, Homo sapiens
catggacagaagaag

SEQ ID NO: 2666605 - DNA, 21 bp, Homo sapiens
catgggcacaaagggcccaga

SEQ ID NO: 2666606 - DNA, 19 bp, Homo sapiens
catggtgcttgttaatgct

SEQ ID NO: 2666607 - DNA, 18 bp, Homo sapiens
catgtataatatttttaa

SEQ ID NO: 2666608 - DNA, 17 bp, Homo sapiens
catgtggttaatgccat

SEQ ID NO: 2666609 - DNA, 23 bp, Homo sapiens
catgtggttacacagtgtgaata

SEQ ID NO: 2666610 - DNA, 13 bp, Homo sapiens
catgttgtgcctc

SEQ ID NO: 2666611 - DNA, 23 bp, Homo sapiens
cattatgatgtgggtcaaggaat

SEQ ID NO: 2666612 - DNA, 16 bp, Homo sapiens
cattcaggagcttcct

SEQ ID NO: 2666613 - DNA, 13 bp, Homo sapiens
cattctacttgct

SEQ ID NO: 2666614 - DNA, 20 bp, Homo sapiens
cattctacttgctctggacc

SEQ ID NO: 2666615 - DNA, 21 bp, Homo sapiens
cattctacttgctctggacct

SEQ ID NO: 2666616 - DNA, 23 bp, Homo sapiens
cattctacttgctctggacctgc

SEQ ID NO: 2666617 - DNA, 14 bp, Homo sapiens
cattcttttgtaat

SEQ ID NO: 2666618 - DNA, 16 bp, Homo sapiens
cattcttttgtaattt

SEQ ID NO: 2666619 - DNA, 14 bp, Homo sapiens
cattgaacagcaaa

SEQ ID NO: 2666620 - DNA, 13 bp, Homo sapiens
cattgaaggctta

SEQ ID NO: 2666621 - DNA, 14 bp, Homo sapiens
cattgaaggcttaa

SEQ ID NO: 2666622 - DNA, 16 bp, Homo sapiens
cattgatatttgtgca

SEQ ID NO: 2666623 - DNA, 19 bp, Homo sapiens
cattgatatttgtgcattt

SEQ ID NO: 2666624 - DNA, 12 bp, Homo sapiens
cattgatgctga

SEQ ID NO: 2666625 - DNA, 23 bp, Homo sapiens
cattgggaaggggacccccgccc

SEQ ID NO: 2666626 - DNA, 14 bp, Homo sapiens
catttacaacccgg

SEQ ID NO: 2666627 - DNA, 16 bp, Homo sapiens
catttgtttgttttcc

SEQ ID NO: 2666628 - DNA, 15 bp, Homo sapiens
cattttcctctgctt

SEQ ID NO: 2666629 - DNA, 21 bp, Homo sapiens
catttttcagaccttttaact

SEQ ID NO: 2666630 - DNA, 16 bp, Homo sapiens
ccaaaatttattttat

SEQ ID NO: 2666631 - DNA, 18 bp, Homo sapiens
ccaaaccttcacacacag

SEQ ID NO: 2666632 - DNA, 21 bp, Homo sapiens
ccaaaccttcacacacagact

SEQ ID NO: 2666633 - DNA, 13 bp, Homo sapiens
ccaacacgcagga

SEQ ID NO: 2666634 - DNA, 14 bp, Homo sapiens
ccaactcagaaggg

SEQ ID NO: 2666635 - DNA, 23 bp, Homo sapiens
ccaaggagatgaagcaaacacat

SEQ ID NO: 2666636 - DNA, 15 bp, Homo sapiens
ccaatcatattaata

SEQ ID NO: 2666637 - DNA, 20 bp, Homo sapiens
ccacaaaggcaaagggtcca

SEQ ID NO: 2666638 - DNA, 14 bp, Homo sapiens
ccacactggactcc

SEQ ID NO: 2666639 - DNA, 14 bp, Homo sapiens
ccaccagtcatttt

SEQ ID NO: 2666640 - DNA, 13 bp, Homo sapiens
ccaccctgggacc

SEQ ID NO: 2666641 - DNA, 19 bp, Homo sapiens
ccactcaaaggccagacct

SEQ ID NO: 2666642 - DNA, 18 bp, Homo sapiens
ccactggactgacctggt

SEQ ID NO: 2666643 - DNA, 18 bp, Homo sapiens
ccactggggtccagggag

SEQ ID NO: 2666644 - DNA, 20 bp, Homo sapiens
ccagaagatgaacagactga

SEQ ID NO: 2666645 - DNA, 18 bp, Homo sapiens
ccagaaggagacaggcag

SEQ ID NO: 2666646 - DNA, 20 bp, Homo sapiens
ccagacctgcagacgcccag

SEQ ID NO: 2666647 - DNA, 20 bp, Homo sapiens
ccagacggctccactaggac

SEQ ID NO: 2666648 - DNA, 21 bp, Homo sapiens
ccagactcctgactgtctccc

SEQ ID NO: 2666649 - DNA, 22 bp, Homo sapiens
ccagaggactgtgatgccctgc

SEQ ID NO: 2666650 - DNA, 21 bp, Homo sapiens
ccagagtggggatgacatgca

SEQ ID NO: 2666651 - DNA, 11 bp, Homo sapiens
ccagcctggcc

SEQ ID NO: 2666652 - DNA, 23 bp, Homo sapiens
ccagcgggaatggcagctgccac

SEQ ID NO: 2666653 - DNA, 19 bp, Homo sapiens
ccagctacacctttctcct

SEQ ID NO: 2666654 - DNA, 20 bp, Homo sapiens
ccagctacacctttctcctt

SEQ ID NO: 2666655 - DNA, 15 bp, Homo sapiens
ccagctgatgactca

SEQ ID NO: 2666656 - DNA, 15 bp, Homo sapiens
ccaggagttctgctc

SEQ ID NO: 2666657 - DNA, 16 bp, Homo sapiens
ccaggagttctgctca

SEQ ID NO: 2666658 - DNA, 19 bp, Homo sapiens
ccagggagctgcaggggca

SEQ ID NO: 2666659 - DNA, 19 bp, Homo sapiens
ccagggtcagaaacaggac

SEQ ID NO: 2666660 - DNA, 20 bp, Homo sapiens
ccagtaaaaaaaaaaaatgg

SEQ ID NO: 2666661 - DNA, 23 bp, Homo sapiens
ccagttcctttcaatggtttgca

SEQ ID NO: 2666662 - DNA, 22 bp, Homo sapiens
ccatctggttaggatggcagga

SEQ ID NO: 2666663 - DNA, 22 bp, Homo sapiens
ccatgaaaatgcaacaacatgt

SEQ ID NO: 2666664 - DNA, 22 bp, Homo sapiens
ccatgcgacactgggaggccag

SEQ ID NO: 2666665 - DNA, 21 bp, Homo sapiens
ccatgtgagggttttcagcat

SEQ ID NO: 2666666 - DNA, 17 bp, Homo sapiens
ccattctacttgctctg

SEQ ID NO: 2666667 - DNA, 19 bp, Homo sapiens
ccattctacttgctctgga

SEQ ID NO: 2666668 - DNA, 20 bp, Homo sapiens
ccattctacttgctctggac

SEQ ID NO: 2666669 - DNA, 19 bp, Homo sapiens
ccattctcacctatccaca

SEQ ID NO: 2666670 - DNA, 15 bp, Homo sapiens
ccattcttttgtaat

SEQ ID NO: 2666671 - DNA, 18 bp, Homo sapiens
ccattcttttgtaattta

SEQ ID NO: 2666672 - DNA, 11 bp, Homo sapiens
ccattgaaggc

SEQ ID NO: 2666673 - DNA, 12 bp, Homo sapiens
ccattgaaggct

SEQ ID NO: 2666674 - DNA, 15 bp, Homo sapiens
ccatttaaaaacagg

SEQ ID NO: 2666675 - DNA, 11 bp, Homo sapiens
ccatttctctc

SEQ ID NO: 2666676 - DNA, 14 bp, Homo sapiens
ccatttgttatctg

SEQ ID NO: 2666677 - DNA, 15 bp, Homo sapiens
ccatttttactgtta

SEQ ID NO: 2666678 - DNA, 15 bp, Homo sapiens
cccacaaaggcaaag

SEQ ID NO: 2666679 - DNA, 13 bp, Homo sapiens
cccacacacagat

SEQ ID NO: 2666680 - DNA, 11 bp, Homo sapiens
cccagacacat

SEQ ID NO: 2666681 - DNA, 23 bp, Homo sapiens
cccagacacatcgcactgtggat

SEQ ID NO: 2666682 - DNA, 21 bp, Homo sapiens
cccagagaaagcgcagatgct

SEQ ID NO: 2666683 - DNA, 23 bp, Homo sapiens
cccagcggacagtggcaggacag

SEQ ID NO: 2666684 - DNA, 19 bp, Homo sapiens
cccagctactcgggaagct

SEQ ID NO: 2666685 - DNA, 15 bp, Homo sapiens
cccaggagttctgct

SEQ ID NO: 2666686 - DNA, 15 bp, Homo sapiens
cccaggcagggccaa

SEQ ID NO: 2666687 - DNA, 15 bp, Homo sapiens
cccagggaagttttg

SEQ ID NO: 2666688 - DNA, 20 bp, Homo sapiens
cccaggtgcagccagaggca

SEQ ID NO: 2666689 - DNA, 17 bp, Homo sapiens
cccagtccttccacctc

SEQ ID NO: 2666690 - DNA, 15 bp, Homo sapiens
cccatattgtaaaac

SEQ ID NO: 2666691 - DNA, 16 bp, Homo sapiens
cccatcccctgtggga

SEQ ID NO: 2666692 - DNA, 19 bp, Homo sapiens
cccatcctcttcttttagc

SEQ ID NO: 2666693 - DNA, 21 bp, Homo sapiens
cccatcgccagctgatgactc

SEQ ID NO: 2666694 - DNA, 23 bp, Homo sapiens
cccatcgccagctgatgactcaa

SEQ ID NO: 2666695 - DNA, 18 bp, Homo sapiens
cccattctacttgctctg

SEQ ID NO: 2666696 - DNA, 21 bp, Homo sapiens
cccattctacttgctctggac

SEQ ID NO: 2666697 - DNA, 23 bp, Homo sapiens
cccattctacttgctctggacct

SEQ ID NO: 2666698 - DNA, 22 bp, Homo sapiens
cccattcttttgtaatttaaat

SEQ ID NO: 2666699 - DNA, 19 bp, Homo sapiens
ccccatcgccagctgatga

SEQ ID NO: 2666700 - DNA, 22 bp, Homo sapiens
cccccacctctccctgaccctg

SEQ ID NO: 2666701 - DNA, 12 bp, Homo sapiens
cccccccttcca

SEQ ID NO: 2666702 - DNA, 16 bp, Homo sapiens
cccccgccccctgccc

SEQ ID NO: 2666703 - DNA, 21 bp, Homo sapiens
ccccgccccctgccctcccct

SEQ ID NO: 2666704 - DNA, 14 bp, Homo sapiens
cccctagccatttt

SEQ ID NO: 2666705 - DNA, 21 bp, Homo sapiens
cccctcgcttggacggctggg

SEQ ID NO: 2666706 - DNA, 23 bp, Homo sapiens
cccctgccctcccctctctgcac

SEQ ID NO: 2666707 - DNA, 17 bp, Homo sapiens
cccgcatcccctgcctc

SEQ ID NO: 2666708 - DNA, 18 bp, Homo sapiens
cccgcatcccctgcctcc

SEQ ID NO: 2666709 - DNA, 16 bp, Homo sapiens
cccgccccctgccctc

SEQ ID NO: 2666710 - DNA, 18 bp, Homo sapiens
cccgccgcctggtactca

SEQ ID NO: 2666711 - DNA, 21 bp, Homo sapiens
ccctaaggtcattaccacagg

SEQ ID NO: 2666712 - DNA, 17 bp, Homo sapiens
ccctcaagaggaagtga

SEQ ID NO: 2666713 - DNA, 15 bp, Homo sapiens
ccctcactctctaca

SEQ ID NO: 2666714 - DNA, 15 bp, Homo sapiens
ccctcagagtgcaag

SEQ ID NO: 2666715 - DNA, 17 bp, Homo sapiens
ccctcctaccctgcgcc

SEQ ID NO: 2666716 - DNA, 18 bp, Homo sapiens
ccctcctaccctgcgccc

SEQ ID NO: 2666717 - DNA, 19 bp, Homo sapiens
gccctcctaccctgcgccc

SEQ ID NO: 2666718 - DNA, 24 bp, Homo sapiens
gccctcctaccctgcgcccagtcc

SEQ ID NO: 2666719 - DNA, 16 bp, Homo sapiens
gccgcaaaccacactg

SEQ ID NO: 2666720 - DNA, 19 bp, Homo sapiens
gccgcaaaccacactggac

SEQ ID NO: 2666721 - DNA, 15 bp, Homo sapiens
gccgtagtagatgtt

SEQ ID NO: 2666722 - DNA, 22 bp, Homo sapiens
gccgtagtagatgttctacttt

SEQ ID NO: 2666723 - DNA, 15 bp, Homo sapiens
gcctcaggcctctgt

SEQ ID NO: 2666724 - DNA, 12 bp, Homo sapiens
gcctcccactgg

SEQ ID NO: 2666725 - DNA, 21 bp, Homo sapiens
gcctccccctagccattttta

SEQ ID NO: 2666726 - DNA, 15 bp, Homo sapiens
gcctccctggtgaga

SEQ ID NO: 2666727 - DNA, 19 bp, Homo sapiens
gcctcctggcccaggtgag

SEQ ID NO: 2666728 - DNA, 14 bp, Homo sapiens
gcctgcgagggcag

SEQ ID NO: 2666729 - DNA, 13 bp, Homo sapiens
gcctggcagctca

SEQ ID NO: 2666730 - DNA, 16 bp, Homo sapiens
gcctgggtccagggga

SEQ ID NO: 2666731 - DNA, 20 bp, Homo sapiens
gcctgggtgacaagagcgaa

SEQ ID NO: 2666732 - DNA, 14 bp, Homo sapiens
gcctgtaatcccag

SEQ ID NO: 2666733 - DNA, 23 bp, Homo sapiens
gccttatctccaagaccagagat

SEQ ID NO: 2666734 - DNA, 19 bp, Homo sapiens
gccttcctattttgcataa

SEQ ID NO: 2666735 - DNA, 16 bp, Homo sapiens
gccttttatttcttaa

SEQ ID NO: 2666736 - DNA, 12 bp, Homo sapiens
gccttttctatt

SEQ ID NO: 2666737 - DNA, 15 bp, Homo sapiens
gcgcaccgaaaaact

SEQ ID NO: 2666738 - DNA, 22 bp, Homo sapiens
gcgcccagtccttccacctcga

SEQ ID NO: 2666739 - DNA, 21 bp, Homo sapiens
gcgccgcaaaccacactggac

SEQ ID NO: 2666740 - DNA, 18 bp, Homo sapiens
gcggagcaagaggaggcc

SEQ ID NO: 2666741 - DNA, 17 bp, Homo sapiens
gcggagctggccccgcc

SEQ ID NO: 2666742 - DNA, 19 bp, Homo sapiens
gcggttcctcgttctccct

SEQ ID NO: 2666743 - DNA, 19 bp, Homo sapiens
gcgtgatcaaagccacact

SEQ ID NO: 2666744 - DNA, 14 bp, Homo sapiens
gctaaagccttcct

SEQ ID NO: 2666745 - DNA, 21 bp, Homo sapiens
gctaactagcttggaaactgg

SEQ ID NO: 2666746 - DNA, 13 bp, Homo sapiens
gctacacctttct

SEQ ID NO: 2666747 - DNA, 20 bp, Homo sapiens
gctacacctttctcctttgt

SEQ ID NO: 2666748 - DNA, 16 bp, Homo sapiens
gctacccgcagagttc

SEQ ID NO: 2666749 - DNA, 22 bp, Homo sapiens
gctattgatataaataaaacat

SEQ ID NO: 2666750 - DNA, 13 bp, Homo sapiens
gctcacctttgtt

SEQ ID NO: 2666751 - DNA, 14 bp, Homo sapiens
gctcattctaatga

SEQ ID NO: 2666752 - DNA, 14 bp, Homo sapiens
gctccaaaccttca

SEQ ID NO: 2666753 - DNA, 14 bp, Homo sapiens
gctcccaggtgcag

SEQ ID NO: 2666754 - DNA, 19 bp, Homo sapiens
gctcccaggtgcagccaga

SEQ ID NO: 2666755 - DNA, 22 bp, Homo sapiens
gctcccaggtgcagccagaggc

SEQ ID NO: 2666756 - DNA, 23 bp, Homo sapiens
gctctctttttctccagggtcag

SEQ ID NO: 2666757 - DNA, 11 bp, Homo sapiens
gctctggacct

SEQ ID NO: 2666758 - DNA, 14 bp, Homo sapiens
gctctggacctgcc

SEQ ID NO: 2666759 - DNA, 22 bp, Homo sapiens
gctctggacctgcccccgcatc

SEQ ID NO: 2666760 - DNA, 14 bp, Homo sapiens
gctgaggcaattct

SEQ ID NO: 2666761 - DNA, 13 bp, Homo sapiens
gctgagttggtgt

SEQ ID NO: 2666762 - DNA, 13 bp, Homo sapiens
gctgatgactcaa

SEQ ID NO: 2666763 - DNA, 17 bp, Homo sapiens
gctgcaggggcatggga

SEQ ID NO: 2666764 - DNA, 13 bp, Homo sapiens
gctgcatgatgtt

SEQ ID NO: 2666765 - DNA, 16 bp, Homo sapiens
gctgcggagcaagagg

SEQ ID NO: 2666766 - DNA, 23 bp, Homo sapiens
gctggccatctggttaggatggc

SEQ ID NO: 2666767 - DNA, 22 bp, Homo sapiens
gctgggcacacgcctcccactg

SEQ ID NO: 2666768 - DNA, 20 bp, Homo sapiens
gctgtaaatttggcttctgt

SEQ ID NO: 2666769 - DNA, 20 bp, Homo sapiens
gctgtcctcaggtggccatg

SEQ ID NO: 2666770 - DNA, 15 bp, Homo sapiens
gcttacggccctggc

SEQ ID NO: 2666771 - DNA, 16 bp, Homo sapiens
gcttacggccctggcc

SEQ ID NO: 2666772 - DNA, 19 bp, Homo sapiens
gcttacggccctggccttg

SEQ ID NO: 2666773 - DNA, 16 bp, Homo sapiens
gcttcactcctgctgt

SEQ ID NO: 2666774 - DNA, 13 bp, Homo sapiens
gcttctttgccaa

SEQ ID NO: 2666775 - DNA, 13 bp, Homo sapiens
gcttgcctgcagg

SEQ ID NO: 2666776 - DNA, 13 bp, Homo sapiens
gcttgttaatgct

SEQ ID NO: 2666777 - DNA, 21 bp, Homo sapiens
gcttgttaatgctttctgaag

SEQ ID NO: 2666778 - DNA, 13 bp, Homo sapiens
gctttaataatgt

SEQ ID NO: 2666779 - DNA, 19 bp, Homo sapiens
gctttgcaaccattttcat

SEQ ID NO: 2666780 - DNA, 17 bp, Homo sapiens
gcttttgtgtcttacat

SEQ ID NO: 2666781 - DNA, 13 bp, Homo sapiens
ggaaacagaggct

SEQ ID NO: 2666782 - DNA, 19 bp, Homo sapiens
ggaaaggagcctaggccag

SEQ ID NO: 2666783 - DNA, 20 bp, Homo sapiens
ggaacttattaaatggaaac

SEQ ID NO: 2666784 - DNA, 20 bp, Homo sapiens
ggaagacccaacacatggga

SEQ ID NO: 2666785 - DNA, 20 bp, Homo sapiens
ggaagatctctgcagggccg

SEQ ID NO: 2666786 - DNA, 16 bp, Homo sapiens
ggaaggggacccccgc

SEQ ID NO: 2666787 - DNA, 17 bp, Homo sapiens
ggaaggggacccccgcc

SEQ ID NO: 2666788 - DNA, 21 bp, Homo sapiens
ggaagttttgtggaggagctc

SEQ ID NO: 2666789 - DNA, 14 bp, Homo sapiens
ggacagaagaaggc

SEQ ID NO: 2666790 - DNA, 12 bp, Homo sapiens
ggacagtggcag

SEQ ID NO: 2666791 - DNA, 13 bp, Homo sapiens
ggacagtggcagg

SEQ ID NO: 2666792 - DNA, 18 bp, Homo sapiens
ggacatagcgaatacaaa

SEQ ID NO: 2666793 - DNA, 20 bp, Homo sapiens
ggacatccccccgccaaaag

SEQ ID NO: 2666794 - DNA, 17 bp, Homo sapiens
ggaccaaggagatgaag

SEQ ID NO: 2666795 - DNA, 23 bp, Homo sapiens
ggacccccgccccctgccctccc

SEQ ID NO: 2666796 - DNA, 22 bp, Homo sapiens
ggacctgcccccgcatcccctg

SEQ ID NO: 2666797 - DNA, 23 bp, Homo sapiens
ggacctgcccccgcatcccctgc

SEQ ID NO: 2666798 - DNA, 19 bp, Homo sapiens
ggacgaagaagagccacag

SEQ ID NO: 2666799 - DNA, 13 bp, Homo sapiens
ggacgtgggctgg

SEQ ID NO: 2666800 - DNA, 16 bp, Homo sapiens
ggactgaaaacctctc

SEQ ID NO: 2666801 - DNA, 17 bp, Homo sapiens
ggactgaaaacctctcc

SEQ ID NO: 2666802 - DNA, 13 bp, Homo sapiens
ggagcaagaggag

SEQ ID NO: 2666803 - DNA, 21 bp, Homo sapiens
ggagcaggcggtgggcaccca

SEQ ID NO: 2666804 - DNA, 16 bp, Homo sapiens
ggagcctccctgcctc

SEQ ID NO: 2666805 - DNA, 22 bp, Homo sapiens
ggagcctccctgcctcaggcct

SEQ ID NO: 2666806 - DNA, 12 bp, Homo sapiens
ggagctagccag

SEQ ID NO: 2666807 - DNA, 20 bp, Homo sapiens
ggagctccaactcagaaggg

SEQ ID NO: 2666808 - DNA, 12 bp, Homo sapiens
ggagctgcaggg

SEQ ID NO: 2666809 - DNA, 20 bp, Homo sapiens
ggagctggccccgccgcctg

SEQ ID NO: 2666810 - DNA, 17 bp, Homo sapiens
ggaggccttccagggac

SEQ ID NO: 2666811 - DNA, 19 bp, Homo sapiens
ggaggtggaggttgcagtg

SEQ ID NO: 2666812 - DNA, 19 bp, Homo sapiens
ggataattagcatctcagg

SEQ ID NO: 2666813 - DNA, 21 bp, Homo sapiens
ggatggcaggacgtgggctgg

SEQ ID NO: 2666814 - DNA, 22 bp, Homo sapiens
ggatggcaggacgtgggctggg

SEQ ID NO: 2666815 - DNA, 16 bp, Homo sapiens
gtgctacaggggccag

SEQ ID NO: 2666816 - DNA, 22 bp, Homo sapiens
gtggaccatcgctgtcatgagt

SEQ ID NO: 2666817 - DNA, 20 bp, Homo sapiens
gtggaggagctcaggacact

SEQ ID NO: 2666818 - DNA, 23 bp, Homo sapiens
gtggaggagctcaggacactaat

SEQ ID NO: 2666819 - DNA, 17 bp, Homo sapiens
gtggattatttcatttt

SEQ ID NO: 2666820 - DNA, 17 bp, Homo sapiens
gtggggaagtgatcttt

SEQ ID NO: 2666821 - DNA, 20 bp, Homo sapiens
gtggtgtttcctgcaggcca

SEQ ID NO: 2666822 - DNA, 21 bp, Homo sapiens
gtgtactcccagggcttacgg

SEQ ID NO: 2666823 - DNA, 17 bp, Homo sapiens
gtgtatttaacagggag

SEQ ID NO: 2666824 - DNA, 16 bp, Homo sapiens
gtgtgaataaagtgct

SEQ ID NO: 2666825 - DNA, 15 bp, Homo sapiens
gtgtgctctgcttca

SEQ ID NO: 2666826 - DNA, 17 bp, Homo sapiens
gtgtgggtacctgtatt

SEQ ID NO: 2666827 - DNA, 14 bp, Homo sapiens
tatttgcaattcct

SEQ ID NO: 2666828 - DNA, 22 bp, Homo sapiens
tatttgtaggggaactcatttg

SEQ ID NO: 2666829 - DNA, 13 bp, Homo sapiens
tatttgtgtattt

SEQ ID NO: 2666830 - DNA, 20 bp, Homo sapiens
tatttgttaatggtttgaat

SEQ ID NO: 2666831 - DNA, 22 bp, Homo sapiens
tatttgttaatggtttgaatat

SEQ ID NO: 2666832 - DNA, 15 bp, Homo sapiens
tattttataagaaaa

SEQ ID NO: 2666833 - DNA, 12 bp, Homo sapiens
tattttgatctt

SEQ ID NO: 2666834 - DNA, 14 bp, Homo sapiens
tattttgatcttca

SEQ ID NO: 2666835 - DNA, 17 bp, Homo sapiens
tatttttaattaaataa

SEQ ID NO: 2666836 - DNA, 12 bp, Homo sapiens
tattttttaaag

SEQ ID NO: 2666837 - DNA, 14 bp, Homo sapiens
tcaaaaaacaaaaa

SEQ ID NO: 2666838 - DNA, 14 bp, Homo sapiens
tcaacattctttgc

SEQ ID NO: 2666839 - DNA, 17 bp, Homo sapiens
tcaaccaatgccaaaaa

SEQ ID NO: 2666840 - DNA, 18 bp, Homo sapiens
tcaaccctaaaaagcaga

SEQ ID NO: 2666841 - DNA, 20 bp, Homo sapiens
tcaagaagggctgcatgatg

SEQ ID NO: 2666842 - DNA, 15 bp, Homo sapiens
tcaagattcccagga

SEQ ID NO: 2666843 - DNA, 16 bp, Homo sapiens
tcaagattcccaggag

SEQ ID NO: 2666844 - DNA, 22 bp, Homo sapiens
tcaagattcccaggagttctgc

SEQ ID NO: 2666845 - DNA, 24 bp, Homo sapiens
tcaagtacataaagtacataacaa

SEQ ID NO: 2666846 - DNA, 18 bp, Homo sapiens
tcaatattttccatgaaa

SEQ ID NO: 2666847 - DNA, 14 bp, Homo sapiens
tcaatgtttttaaa

SEQ ID NO: 2666848 - DNA, 18 bp, Homo sapiens
tcaatgtttttaaaaatc

SEQ ID NO: 2666849 - DNA, 13 bp, Homo sapiens
tcaattaacaata

SEQ ID NO: 2666850 - DNA, 23 bp, Homo sapiens
tcaattccaacactgatttcccc

SEQ ID NO: 2666851 - DNA, 19 bp, Homo sapiens
tcacacacagactgttgtc

SEQ ID NO: 2666852 - DNA, 22 bp, Homo sapiens
tcacacacagactgttgtccct

SEQ ID NO: 2666853 - DNA, 22 bp, Homo sapiens
tcacaccaggcttgcctgcagg

SEQ ID NO: 2666854 - DNA, 22 bp, Homo sapiens
tcaccactcaaaggccagacct

SEQ ID NO: 2666855 - DNA, 13 bp, Homo sapiens
tcactcctgctgt

SEQ ID NO: 2666856 - DNA, 14 bp, Homo sapiens
tcactcctgctgta

SEQ ID NO: 2666857 - DNA, 14 bp, Homo sapiens
tcactcttctcagc

SEQ ID NO: 2666858 - DNA, 14 bp, Homo sapiens
tcagaaacaggacc

SEQ ID NO: 2666859 - DNA, 21 bp, Homo sapiens
tcagaagggagctagccagag

SEQ ID NO: 2666860 - DNA, 13 bp, Homo sapiens
tcagcagactgat

SEQ ID NO: 2666861 - DNA, 19 bp, Homo sapiens
tcagccaccctgaggcctc

SEQ ID NO: 2666862 - DNA, 13 bp, Homo sapiens
tcagccctgaccc

SEQ ID NO: 2666863 - DNA, 18 bp, Homo sapiens
tcagctccactttcagtg

SEQ ID NO: 2666864 - DNA, 12 bp, Homo sapiens
tcaggacactaa

SEQ ID NO: 2666865 - DNA, 11 bp, Homo sapiens
tcaggcctctg

SEQ ID NO: 2666866 - DNA, 11 bp, Homo sapiens
tcaggtggcca

SEQ ID NO: 2666867 - DNA, 13 bp, Homo sapiens
tcaggtggccatg

SEQ ID NO: 2666868 - DNA, 17 bp, Homo sapiens
tcatcccctcacttgcc

SEQ ID NO: 2666869 - DNA, 20 bp, Homo sapiens
tcatctactcatttaaagta

SEQ ID NO: 2666870 - DNA, 16 bp, Homo sapiens
tcatctctctttaata

SEQ ID NO: 2666871 - DNA, 22 bp, Homo sapiens
tcattcccttcgacagcatttt

SEQ ID NO: 2666872 - DNA, 20 bp, Homo sapiens
tcattttgtaacaaatgaac

SEQ ID NO: 2666873 - DNA, 18 bp, Homo sapiens
tcatttttcagacctttt

SEQ ID NO: 2666874 - DNA, 22 bp, Homo sapiens
tccaaaccttcacacacagact

SEQ ID NO: 2666875 - DNA, 20 bp, Homo sapiens
tccaacactgatttcccctt

SEQ ID NO: 2666876 - DNA, 18 bp, Homo sapiens
tccactttcagtgaaagc

SEQ ID NO: 2666877 - DNA, 20 bp, Homo sapiens
tccagcctggtttagcctgg

SEQ ID NO: 2666878 - DNA, 18 bp, Homo sapiens
tccaggattcctcttttc

SEQ ID NO: 2666879 - DNA, 18 bp, Homo sapiens
tccagtgcaacactgaag

SEQ ID NO: 2666880 - DNA, 12 bp, Homo sapiens
tccatgaaaatg

SEQ ID NO: 2666881 - DNA, 16 bp, Homo sapiens
tccatgaaaatgcaac

SEQ ID NO: 2666882 - DNA, 21 bp, Homo sapiens
tccatgtgagggttttcagca

SEQ ID NO: 2666883 - DNA, 16 bp, Homo sapiens
tcccagctacaccttt

SEQ ID NO: 2666884 - DNA, 16 bp, Homo sapiens
tcccagctacctcaac

SEQ ID NO: 2666885 - DNA, 18 bp, Homo sapiens
tcccatcctcttctttta

SEQ ID NO: 2666886 - DNA, 19 bp, Homo sapiens
tccccatcgccagctgatg

SEQ ID NO: 2666887 - DNA, 14 bp, Homo sapiens
tcccctctctgcac

SEQ ID NO: 2666888 - DNA, 20 bp, Homo sapiens
tccccttgtctgaactggag

SEQ ID NO: 2666889 - DNA, 17 bp, Homo sapiens
tcccctttatgtacagg

SEQ ID NO: 2666890 - DNA, 17 bp, Homo sapiens
tccctgcctcaggcctc

SEQ ID NO: 2666891 - DNA, 21 bp, Homo sapiens
tccctggtgagagggccgggc

SEQ ID NO: 2666892 - DNA, 23 bp, Homo sapiens
tccctggtgagagggccgggcag

SEQ ID NO: 2666893 - DNA, 20 bp, Homo sapiens
tcccttccttgtagcctttt

SEQ ID NO: 2666894 - DNA, 17 bp, Homo sapiens
tcccttcgacagcattt

SEQ ID NO: 2666895 - DNA, 23 bp, Homo sapiens
tccggccctcctaccctgcgccc

SEQ ID NO: 2666896 - DNA, 19 bp, Homo sapiens
tcctattttgcataataaa

SEQ ID NO: 2666897 - DNA, 15 bp, Homo sapiens
tcctcacacacagac

SEQ ID NO: 2666898 - DNA, 17 bp, Homo sapiens
tcctcatgttctgcttt

SEQ ID NO: 2666899 - DNA, 17 bp, Homo sapiens
tcctccatcgcagtgtt

SEQ ID NO: 2666900 - DNA, 16 bp, Homo sapiens
tcctcgttctccctgg

SEQ ID NO: 2666901 - DNA, 15 bp, Homo sapiens
tcctctgctttgaaa

SEQ ID NO: 2666902 - DNA, 12 bp, Homo sapiens
tcctcttgtaaa

SEQ ID NO: 2666903 - DNA, 19 bp, Homo sapiens
tcctcttgtaaataaagcc

SEQ ID NO: 2666904 - DNA, 15 bp, Homo sapiens
tcctcttttctctgc

SEQ ID NO: 2666905 - DNA, 23 bp, Homo sapiens
tcctgactgtctcccgggactac

SEQ ID NO: 2666906 - DNA, 19 bp, Homo sapiens
tcctgcaggccaggccagc

SEQ ID NO: 2666907 - DNA, 22 bp, Homo sapiens
tcctgctgtaaatttggcttct

SEQ ID NO: 2666908 - DNA, 16 bp, Homo sapiens
tccttcctcacaccag

SEQ ID NO: 2666909 - DNA, 20 bp, Homo sapiens
tccttgtagccttttgactt

SEQ ID NO: 2666910 - DNA, 18 bp, Homo sapiens
tcctttcaaggtaactgt

SEQ ID NO: 2666911 - DNA, 13 bp, Homo sapiens
tcctttgtacttt

SEQ ID NO: 2666912 - DNA, 20 bp, Homo sapiens
tccttttaaatcttgatacc

SEQ ID NO: 2666913 - DNA, 24 bp, Homo sapiens
tccttttatttcttcaccagattt

SEQ ID NO: 2666914 - DNA, 14 bp, Homo sapiens
tccttttttaaaag

SEQ ID NO: 2666915 - DNA, 22 bp, Homo sapiens
tccttttttgttcctttttcct

SEQ ID NO: 2666916 - DNA, 22 bp, Homo sapiens
tcgaattttgttttcttgattt

SEQ ID NO: 2666917 - DNA, 17 bp, Homo sapiens
tcgagaccagcctggcc

SEQ ID NO: 2666918 - DNA, 18 bp, Homo sapiens
tcgagaccagcctggcca

SEQ ID NO: 2666919 - DNA, 15 bp, Homo sapiens
tcgattcatattgaa

SEQ ID NO: 2666920 - DNA, 17 bp, Homo sapiens
tcgattcatattgaata

SEQ ID NO: 2666921 - DNA, 20 bp, Homo sapiens
tcgcaggaagacccaacaca

SEQ ID NO: 2666922 - DNA, 13 bp, Homo sapiens
tcgttctccctgg

SEQ ID NO: 2666923 - DNA, 13 bp, Homo sapiens
tctaaaatgagtt

SEQ ID NO: 2666924 - DNA, 19 bp, Homo sapiens
tctaacaatgtattttctt

SEQ ID NO: 2666925 - DNA, 16 bp, Homo sapiens
tctaatgatggcccat

SEQ ID NO: 2666926 - DNA, 22 bp, Homo sapiens
tctactcatttaaagtatttta

SEQ ID NO: 2666927 - DNA, 16 bp, Homo sapiens
tctacttgctctggac

SEQ ID NO: 2666928 - DNA, 18 bp, Homo sapiens
tctacttgctctggacct

SEQ ID NO: 2666929 - DNA, 20 bp, Homo sapiens
tctacttgctctggacctgc

SEQ ID NO: 2666930 - DNA, 22 bp, Homo sapiens
tctaggaaaatattttgatctt

SEQ ID NO: 2666931 - DNA, 15 bp, Homo sapiens
tctatacttgctttg

SEQ ID NO: 2666932 - DNA, 23 bp, Homo sapiens
tctatattttgggaaaaaaacat

SEQ ID NO: 2666933 - DNA, 15 bp, Homo sapiens
tctcatcctgcaggc

SEQ ID NO: 2666934 - DNA, 18 bp, Homo sapiens
tctccagggtcagaaaca

SEQ ID NO: 2666935 - DNA, 15 bp, Homo sapiens
tctccctgaccctgt

SEQ ID NO: 2666936 - DNA, 14 bp, Homo sapiens
tctcctcttgtaaa

SEQ ID NO: 2666937 - DNA, 14 bp, Homo sapiens
tctctgctttaaag

SEQ ID NO: 2666938 - DNA, 13 bp, Homo sapiens
tctctgggagaaa

SEQ ID NO: 2666939 - DNA, 15 bp, Homo sapiens
tctctttcatgagtt

SEQ ID NO: 2666940 - DNA, 18 bp, Homo sapiens
tctctttctttacaagat

SEQ ID NO: 2666941 - DNA, 19 bp, Homo sapiens
tctgaaaattaacactgct

SEQ ID NO: 2666942 - DNA, 22 bp, Homo sapiens
aatcttatcaagagttgtgaca

SEQ ID NO: 2666943 - DNA, 20 bp, Homo sapiens
aatgactaattcttgcatat

SEQ ID NO: 2666944 - DNA, 20 bp, Homo sapiens
aatgactcaggacatccccc

SEQ ID NO: 2666945 - DNA, 17 bp, Homo sapiens
aatgatcttttcaagtt

SEQ ID NO: 2666946 - DNA, 14 bp, Homo sapiens
aatgatggcccatt

SEQ ID NO: 2666947 - DNA, 20 bp, Homo sapiens
aatgatggcccattctactt

SEQ ID NO: 2666948 - DNA, 15 bp, Homo sapiens
aatgcaacaacatgt

SEQ ID NO: 2666949 - DNA, 20 bp, Homo sapiens
aatgcagtctgtccaggctc

SEQ ID NO: 2666950 - DNA, 13 bp, Homo sapiens
aatgctttctgaa

SEQ ID NO: 2666951 - DNA, 17 bp, Homo sapiens
aatgctttctgaagctt

SEQ ID NO: 2666952 - DNA, 14 bp, Homo sapiens
aatggaaactgaaa

SEQ ID NO: 2666953 - DNA, 20 bp, Homo sapiens
aatggcacagcccaaagaag

SEQ ID NO: 2666954 - DNA, 22 bp, Homo sapiens
aatggtatttgaattaaatgtt

SEQ ID NO: 2666955 - DNA, 18 bp, Homo sapiens
aatggtttgcaaggaagc

SEQ ID NO: 2666956 - DNA, 22 bp, Homo sapiens
aatgtcacgttttgttttgtgc

SEQ ID NO: 2666957 - DNA, 23 bp, Homo sapiens
aatgtcacgttttgttttgtgcc

SEQ ID NO: 2666958 - DNA, 22 bp, Homo sapiens
aattaagttagggaatggcaca

SEQ ID NO: 2666959 - DNA, 19 bp, Homo sapiens
aattaccctttcattcagc

SEQ ID NO: 2666960 - DNA, 14 bp, Homo sapiens
aattagctgcttct

SEQ ID NO: 2666961 - DNA, 19 bp, Homo sapiens
aattatctaatttataaaa

SEQ ID NO: 2666962 - DNA, 15 bp, Homo sapiens
aattcttattctttc

SEQ ID NO: 2666963 - DNA, 19 bp, Homo sapiens
aattcttattttttaaaaa

SEQ ID NO: 2666964 - DNA, 21 bp, Homo sapiens
aattgtgtgtgctctgcttca

SEQ ID NO: 2666965 - DNA, 12 bp, Homo sapiens
aatttaaagcaa

SEQ ID NO: 2666966 - DNA, 16 bp, Homo sapiens
aatttataaaaaggtg

SEQ ID NO: 2666967 - DNA, 22 bp, Homo sapiens
aatttataaaaaggtgttttga

SEQ ID NO: 2666968 - DNA, 23 bp, Homo sapiens
aatttattttataagaaaaactt

SEQ ID NO: 2666969 - DNA, 21 bp, Homo sapiens
aatttcagcttctatatattg

SEQ ID NO: 2666970 - DNA, 18 bp, Homo sapiens
aatttggcttctgttgtc

SEQ ID NO: 2666971 - DNA, 15 bp, Homo sapiens
aattttataaacaaa

SEQ ID NO: 2666972 - DNA, 23 bp, Homo sapiens
aattttgttctctgggagaaaat

SEQ ID NO: 2666973 - DNA, 15 bp, Homo sapiens
aatttttttttcctt

SEQ ID NO: 2666974 - DNA, 11 bp, Homo sapiens
acaaaaaagtg

SEQ ID NO: 2666975 - DNA, 12 bp, Homo sapiens
acaaaacaaaac

SEQ ID NO: 2666976 - DNA, 22 bp, Homo sapiens
acaaactctctgaacccctccc

SEQ ID NO: 2666977 - DNA, 22 bp, Homo sapiens
acaaagatgggtgaaggctggc

SEQ ID NO: 2666978 - DNA, 14 bp, Homo sapiens
acaaagggcccaga

SEQ ID NO: 2666979 - DNA, 22 bp, Homo sapiens
acaaaggtgaaaattgtttgta

SEQ ID NO: 2666980 - DNA, 19 bp, Homo sapiens
acaaagtggcataaaaaac

SEQ ID NO: 2666981 - DNA, 18 bp, Homo sapiens
acaaatctaggaaaatat

SEQ ID NO: 2666982 - DNA, 16 bp, Homo sapiens
acaaatttttatttct

SEQ ID NO: 2666983 - DNA, 14 bp, Homo sapiens
acaacacaaagaga

SEQ ID NO: 2666984 - DNA, 22 bp, Homo sapiens
acaacatgtataatatttttaa

SEQ ID NO: 2666985 - DNA, 13 bp, Homo sapiens
acaacctgaacct

SEQ ID NO: 2666986 - DNA, 15 bp, Homo sapiens
acaactacagaaaaa

SEQ ID NO: 2666987 - DNA, 16 bp, Homo sapiens
acaagcaaacccagac

SEQ ID NO: 2666988 - DNA, 14 bp, Homo sapiens
acaagccccccctt

SEQ ID NO: 2666989 - DNA, 20 bp, Homo sapiens
acaatgactaattcttgcat

SEQ ID NO: 2666990 - DNA, 13 bp, Homo sapiens
acaatggcagatg

SEQ ID NO: 2666991 - DNA, 15 bp, Homo sapiens
acaatgtattttctt

SEQ ID NO: 2666992 - DNA, 22 bp, Homo sapiens
acaatgtgtctttctttttgga

SEQ ID NO: 2666993 - DNA, 22 bp, Homo sapiens
acacaaagagaaaaagaaatgc

SEQ ID NO: 2666994 - DNA, 17 bp, Homo sapiens
acacacagactcatatt

SEQ ID NO: 2666995 - DNA, 15 bp, Homo sapiens
acacagactcatatt

SEQ ID NO: 2666996 - DNA, 20 bp, Homo sapiens
acacagtgtgaataaagtgc

SEQ ID NO: 2666997 - DNA, 17 bp, Homo sapiens
acacctttctcctttgt

SEQ ID NO: 2666998 - DNA, 15 bp, Homo sapiens
acacgcaggagcaca

SEQ ID NO: 2666999 - DNA, 19 bp, Homo sapiens
acactcacctctaaaacag

SEQ ID NO: 2667000 - DNA, 15 bp, Homo sapiens
acactcacttctctt

SEQ ID NO: 2667001 - DNA, 17 bp, Homo sapiens
acactgaaatatacaca

SEQ ID NO: 2667002 - DNA, 22 bp, Homo sapiens
acactgaaatatacacacagca

SEQ ID NO: 2667003 - DNA, 21 bp, Homo sapiens
acactgaagctcttgaagaca

SEQ ID NO: 2667004 - DNA, 20 bp, Homo sapiens
acagactcaaatgctcagac

SEQ ID NO: 2667005 - DNA, 10 bp, Homo sapiens
acagagctgg

SEQ ID NO: 2667006 - DNA, 18 bp, Homo sapiens
acagagctgggatgtttc

SEQ ID NO: 2667007 - DNA, 21 bp, Homo sapiens
acagagctgggatgtttctgt

SEQ ID NO: 2667008 - DNA, 17 bp, Homo sapiens
acagaggctattgtccc

SEQ ID NO: 2667009 - DNA, 14 bp, Homo sapiens
acagcattttcctc

SEQ ID NO: 2667010 - DNA, 15 bp, Homo sapiens
acagcattttcctct

SEQ ID NO: 2667011 - DNA, 18 bp, Homo sapiens
acagcattttcctctgct

SEQ ID NO: 2667012 - DNA, 17 bp, Homo sapiens
acagcccaaagaaggaa

SEQ ID NO: 2667013 - DNA, 19 bp, Homo sapiens
acagcccaaagaaggaaaa

SEQ ID NO: 2667014 - DNA, 21 bp, Homo sapiens
acagcttctcatcctgcaggc

SEQ ID NO: 2667015 - DNA, 16 bp, Homo sapiens
acagggcacaggccat

SEQ ID NO: 2667016 - DNA, 17 bp, Homo sapiens
acaggggccagaagatg

SEQ ID NO: 2667017 - DNA, 22 bp, Homo sapiens
acaggtagaattatctaattta

SEQ ID NO: 2667018 - DNA, 18 bp, Homo sapiens
acagtggcaggacaggaa

SEQ ID NO: 2667019 - DNA, 20 bp, Homo sapiens
acagtggcaggacaggaaaa

SEQ ID NO: 2667020 - DNA, 15 bp, Homo sapiens
acataaagcaaatag

SEQ ID NO: 2667021 - DNA, 18 bp, Homo sapiens
acataaagcaaatagaca

SEQ ID NO: 2667022 - DNA, 21 bp, Homo sapiens
acataaagcaaatagacacag

SEQ ID NO: 2667023 - DNA, 18 bp, Homo sapiens
acatccccccgccaaaag

SEQ ID NO: 2667024 - DNA, 21 bp, Homo sapiens
acatggtaaacgctgtcccta

SEQ ID NO: 2667025 - DNA, 20 bp, Homo sapiens
acatgtataatatttttaat

SEQ ID NO: 2667026 - DNA, 19 bp, Homo sapiens
acattgggaaggggacccc

SEQ ID NO: 2667027 - DNA, 15 bp, Homo sapiens
acatttaccaatcat

SEQ ID NO: 2667028 - DNA, 19 bp, Homo sapiens
accaaaaactgaaagtgaa

SEQ ID NO: 2667029 - DNA, 21 bp, Homo sapiens
accacactggactccggccct

SEQ ID NO: 2667030 - DNA, 15 bp, Homo sapiens
accagcctgaccaaa

SEQ ID NO: 2667031 - DNA, 19 bp, Homo sapiens
accaggcttgcctgcaggc

SEQ ID NO: 2667032 - DNA, 19 bp, Homo sapiens
accagggagctgcaggggc

SEQ ID NO: 2667033 - DNA, 16 bp, Homo sapiens
accagggattgtttct

SEQ ID NO: 2667034 - DNA, 14 bp, Homo sapiens
accagtcatttttc

SEQ ID NO: 2667035 - DNA, 22 bp, Homo sapiens
accatgtgctacaggggccaga

SEQ ID NO: 2667036 - DNA, 13 bp, Homo sapiens
accattgaaggct

SEQ ID NO: 2667037 - DNA, 16 bp, Homo sapiens
accatttaaaaacagg

SEQ ID NO: 2667038 - DNA, 21 bp, Homo sapiens
accatttaaaaacaggcagct

SEQ ID NO: 2667039 - DNA, 17 bp, Homo sapiens
acccagacggctccact

SEQ ID NO: 2667040 - DNA, 15 bp, Homo sapiens
accccatttctctcc

SEQ ID NO: 2667041 - DNA, 19 bp, Homo sapiens
accctaaaaagcagagctt

SEQ ID NO: 2667042 - DNA, 12 bp, Homo sapiens
accctgggacct

SEQ ID NO: 2667043 - DNA, 20 bp, Homo sapiens
accctgtatatagcccagcc

SEQ ID NO: 2667044 - DNA, 12 bp, Homo sapiens
acctatccacac

SEQ ID NO: 2667045 - DNA, 11 bp, Homo sapiens
acctatttctc

SEQ ID NO: 2667046 - DNA, 14 bp, Homo sapiens
acctatttctcttt

SEQ ID NO: 2667047 - DNA, 22 bp, Homo sapiens
acctctccctgaccctgtatat

SEQ ID NO: 2667048 - DNA, 16 bp, Homo sapiens
acctgaactgaacacc

SEQ ID NO: 2667049 - DNA, 17 bp, Homo sapiens
acctgattaactgaggc

SEQ ID NO: 2667050 - DNA, 18 bp, Homo sapiens
acctgcccccgcatcccc

SEQ ID NO: 2667051 - DNA, 23 bp, Homo sapiens
acctgcccccgcatcccctgcct

SEQ ID NO: 2667052 - DNA, 14 bp, Homo sapiens
acctggacacaggc

SEQ ID NO: 2667053 - DNA, 21 bp, Homo sapiens
acctggctttttattgtattt

SEQ ID NO: 2667054 - DNA, 17 bp, Homo sapiens
acctggtccacagggca

SEQ ID NO: 2667055 - DNA, 17 bp, Homo sapiens
acctgtctcctggcggt

SEQ ID NO: 2667056 - DNA, 17 bp, Homo sapiens
accttatttaagtaact

SEQ ID NO: 2667057 - DNA, 20 bp, Homo sapiens
acctttcataatctttgctt

SEQ ID NO: 2667058 - DNA, 16 bp, Homo sapiens
acctttctcctttgta

SEQ ID NO: 2667059 - DNA, 17 bp, Homo sapiens
acgaagccatctttctt

SEQ ID NO: 2667060 - DNA, 14 bp, Homo sapiens
attcaaagaaatat

SEQ ID NO: 2667061 - DNA, 13 bp, Homo sapiens
attcacttcacgc

SEQ ID NO: 2667062 - DNA, 13 bp, Homo sapiens
attcatattgaat

SEQ ID NO: 2667063 - DNA, 17 bp, Homo sapiens
attcatctctctttaat

SEQ ID NO: 2667064 - DNA, 22 bp, Homo sapiens
attcatctctctttaatataaa

SEQ ID NO: 2667065 - DNA, 18 bp, Homo sapiens
attctaatgatggcccat

SEQ ID NO: 2667066 - DNA, 21 bp, Homo sapiens
attctaatgatggcccattct

SEQ ID NO: 2667067 - DNA, 19 bp, Homo sapiens
attctacttgctctggacc

SEQ ID NO: 2667068 - DNA, 21 bp, Homo sapiens
attctacttgctctggacctg

SEQ ID NO: 2667069 - DNA, 22 bp, Homo sapiens
attctacttgctctggacctgc

SEQ ID NO: 2667070 - DNA, 20 bp, Homo sapiens
attctaggcctcctggccca

SEQ ID NO: 2667071 - DNA, 18 bp, Homo sapiens
attctccatttgttatct

SEQ ID NO: 2667072 - DNA, 19 bp, Homo sapiens
attctccatttgttatctg

SEQ ID NO: 2667073 - DNA, 17 bp, Homo sapiens
attctgtcatagaaagt

SEQ ID NO: 2667074 - DNA, 15 bp, Homo sapiens
attcttaaaaaaaga

SEQ ID NO: 2667075 - DNA, 17 bp, Homo sapiens
attcttacaaacatgtg

SEQ ID NO: 2667076 - DNA, 18 bp, Homo sapiens
attcttattcaaagaaat

SEQ ID NO: 2667077 - DNA, 12 bp, Homo sapiens
attcttgcatat

SEQ ID NO: 2667078 - DNA, 10 bp, Homo sapiens
attgaatcta

SEQ ID NO: 2667079 - DNA, 15 bp, Homo sapiens
attggaacagtgaat

SEQ ID NO: 2667080 - DNA, 20 bp, Homo sapiens
attgggaaggggacccccgc

SEQ ID NO: 2667081 - DNA, 19 bp, Homo sapiens
attgtgtgtgctctgcttc

SEQ ID NO: 2667082 - DNA, 20 bp, Homo sapiens
attgtgtgtgctctgcttca

SEQ ID NO: 2667083 - DNA, 21 bp, Homo sapiens
attgtttgggatcctattgaa

SEQ ID NO: 2667084 - DNA, 22 bp, Homo sapiens
atttaaaaacaggcagctcata

SEQ ID NO: 2667085 - DNA, 16 bp, Homo sapiens
atttacctttttgaaa

SEQ ID NO: 2667086 - DNA, 15 bp, Homo sapiens
atttactgtgtcttt

SEQ ID NO: 2667087 - DNA, 16 bp, Homo sapiens
atttatactggcatgc

SEQ ID NO: 2667088 - DNA, 17 bp, Homo sapiens
atttatactgtatatat

SEQ ID NO: 2667089 - DNA, 23 bp, Homo sapiens
atttattggccccccgaccttgt

SEQ ID NO: 2667090 - DNA, 12 bp, Homo sapiens
atttcataaaga

SEQ ID NO: 2667091 - DNA, 21 bp, Homo sapiens
atttcattttgtaacaaatga

SEQ ID NO: 2667092 - DNA, 16 bp, Homo sapiens
atttccaagagctgag

SEQ ID NO: 2667093 - DNA, 22 bp, Homo sapiens
atttccccttttgcattctccc

SEQ ID NO: 2667094 - DNA, 13 bp, Homo sapiens
atttcttaaacaa

SEQ ID NO: 2667095 - DNA, 16 bp, Homo sapiens
atttcttcaccagatt

SEQ ID NO: 2667096 - DNA, 14 bp, Homo sapiens
atttgagaatataa

SEQ ID NO: 2667097 - DNA, 17 bp, Homo sapiens
atttggcttctgttgtc

SEQ ID NO: 2667098 - DNA, 18 bp, Homo sapiens
atttggtttagaacataa

SEQ ID NO: 2667099 - DNA, 14 bp, Homo sapiens
atttggttttcctg

SEQ ID NO: 2667100 - DNA, 16 bp, Homo sapiens
atttggttttcctgta

SEQ ID NO: 2667101 - DNA, 13 bp, Homo sapiens
attttataagaaa

SEQ ID NO: 2667102 - DNA, 22 bp, Homo sapiens
attttatttgtaggggaactca

SEQ ID NO: 2667103 - DNA, 15 bp, Homo sapiens
attttcattaaaagc

SEQ ID NO: 2667104 - DNA, 15 bp, Homo sapiens
attttccatgaaaat

SEQ ID NO: 2667105 - DNA, 17 bp, Homo sapiens
attttgtaacaaatgaa

SEQ ID NO: 2667106 - DNA, 14 bp, Homo sapiens
attttgttctctgg

SEQ ID NO: 2667107 - DNA, 21 bp, Homo sapiens
atttttacgtttgaagacatt

SEQ ID NO: 2667108 - DNA, 12 bp, Homo sapiens
caaaagctgctc

SEQ ID NO: 2667109 - DNA, 21 bp, Homo sapiens
caaaatttattttataagaaa

SEQ ID NO: 2667110 - DNA, 16 bp, Homo sapiens
caaacagaaaacatgt

SEQ ID NO: 2667111 - DNA, 18 bp, Homo sapiens
caaacatgtggttaatgc

SEQ ID NO: 2667112 - DNA, 20 bp, Homo sapiens
caaacatgtggttaatgcca

SEQ ID NO: 2667113 - DNA, 14 bp, Homo sapiens
caaaccacactgga

SEQ ID NO: 2667114 - DNA, 20 bp, Homo sapiens
caaacccagacggctccact

SEQ ID NO: 2667115 - DNA, 21 bp, Homo sapiens
caaagaacatgtagaaaacaa

SEQ ID NO: 2667116 - DNA, 19 bp, Homo sapiens
caaagaaggaaaaggcagg

SEQ ID NO: 2667117 - DNA, 15 bp, Homo sapiens
caaagagaaaaagaa

SEQ ID NO: 2667118 - DNA, 20 bp, Homo sapiens
caaagagaaaaagaaatgca

SEQ ID NO: 2667119 - DNA, 22 bp, Homo sapiens
caaagatgggtgaaggctggca

SEQ ID NO: 2667120 - DNA, 18 bp, Homo sapiens
caaaggccagacctgcag

SEQ ID NO: 2667121 - DNA, 14 bp, Homo sapiens
caaagggcccagat

SEQ ID NO: 2667122 - DNA, 22 bp, Homo sapiens
caaagggggaggctaaagccca

SEQ ID NO: 2667123 - DNA, 17 bp, Homo sapiens
caaagggtccagaagga

SEQ ID NO: 2667124 - DNA, 16 bp, Homo sapiens
caaagttccaaaatgc

SEQ ID NO: 2667125 - DNA, 20 bp, Homo sapiens
caaatctaggaaaatatttt

SEQ ID NO: 2667126 - DNA, 16 bp, Homo sapiens
caaattactctttctc

SEQ ID NO: 2667127 - DNA, 16 bp, Homo sapiens
caacacaaagagaaaa

SEQ ID NO: 2667128 - DNA, 16 bp, Homo sapiens
caacacgcaggagcac

SEQ ID NO: 2667129 - DNA, 21 bp, Homo sapiens
caacactgatttccccttttg

SEQ ID NO: 2667130 - DNA, 20 bp, Homo sapiens
caacactgggaaacagaggc

SEQ ID NO: 2667131 - DNA, 14 bp, Homo sapiens
caacagaaaaatgg

SEQ ID NO: 2667132 - DNA, 17 bp, Homo sapiens
caacatgtataatattt

SEQ ID NO: 2667133 - DNA, 14 bp, Homo sapiens
caacattctttgca

SEQ ID NO: 2667134 - DNA, 22 bp, Homo sapiens
caaccagggattgtttctgttt

SEQ ID NO: 2667135 - DNA, 10 bp, Homo sapiens
caacccttct

SEQ ID NO: 2667136 - DNA, 20 bp, Homo sapiens
caacccttctcctcttgtaa

SEQ ID NO: 2667137 - DNA, 12 bp, Homo sapiens
caacctgaacct

SEQ ID NO: 2667138 - DNA, 12 bp, Homo sapiens
caagaagggctg

SEQ ID NO: 2667139 - DNA, 17 bp, Homo sapiens
caagaagggctgcatga

SEQ ID NO: 2667140 - DNA, 24 bp, Homo sapiens
caagacctcagggcacaaagatgg

SEQ ID NO: 2667141 - DNA, 22 bp, Homo sapiens
caagactctgtctaaaaaacaa

SEQ ID NO: 2667142 - DNA, 23 bp, Homo sapiens
caagactctgtctaaaaaacaaa

SEQ ID NO: 2667143 - DNA, 14 bp, Homo sapiens
caagattcccagga

SEQ ID NO: 2667144 - DNA, 20 bp, Homo sapiens
caagattcccaggagttctg

SEQ ID NO: 2667145 - DNA, 14 bp, Homo sapiens
caagcccccccttc

SEQ ID NO: 2667146 - DNA, 15 bp, Homo sapiens
caaggccatccttcc

SEQ ID NO: 2667147 - DNA, 13 bp, Homo sapiens
caataaaaaaaag

SEQ ID NO: 2667148 - DNA, 19 bp, Homo sapiens
caataaaaaaaagaaatga

SEQ ID NO: 2667149 - DNA, 13 bp, Homo sapiens
caatatcctttgc

SEQ ID NO: 2667150 - DNA, 17 bp, Homo sapiens
caatattgactttgtct

SEQ ID NO: 2667151 - DNA, 16 bp, Homo sapiens
caatattttccatgaa

SEQ ID NO: 2667152 - DNA, 20 bp, Homo sapiens
caatattttccatgaaaatg

SEQ ID NO: 2667153 - DNA, 18 bp, Homo sapiens
caatgatgctatttgcaa

SEQ ID NO: 2667154 - DNA, 22 bp, Homo sapiens
caatgccaaaaaaagacagggc

SEQ ID NO: 2667155 - DNA, 14 bp, Homo sapiens
caatggcagatgta

SEQ ID NO: 2667156 - DNA, 19 bp, Homo sapiens
caatggctacctaaaaaga

SEQ ID NO: 2667157 - DNA, 18 bp, Homo sapiens
caatggcttactccagga

SEQ ID NO: 2667158 - DNA, 13 bp, Homo sapiens
caatggtttgcaa

SEQ ID NO: 2667159 - DNA, 20 bp, Homo sapiens
caatggtttgcaaggaagcc

SEQ ID NO: 2667160 - DNA, 21 bp, Homo sapiens
caatgtactaggatactgctg

SEQ ID NO: 2667161 - DNA, 20 bp, Homo sapiens
caatgtgtctttctttttgg

SEQ ID NO: 2667162 - DNA, 12 bp, Homo sapiens
caatttaaagca

SEQ ID NO: 2667163 - DNA, 17 bp, Homo sapiens
caatttcaaattactct

SEQ ID NO: 2667164 - DNA, 16 bp, Homo sapiens
caatttttttttcctt

SEQ ID NO: 2667165 - DNA, 20 bp, Homo sapiens
cacaaaggcaaagggtccag

SEQ ID NO: 2667166 - DNA, 13 bp, Homo sapiens
cacaaagtggcat

SEQ ID NO: 2667167 - DNA, 20 bp, Homo sapiens
cacacagactcatattactg

SEQ ID NO: 2667168 - DNA, 19 bp, Homo sapiens
cacacagcaagtcagggtt

SEQ ID NO: 2667169 - DNA, 22 bp, Homo sapiens
cacacctgtaatcccagcactt

SEQ ID NO: 2667170 - DNA, 17 bp, Homo sapiens
cacacgcctcccactgg

SEQ ID NO: 2667171 - DNA, 22 bp, Homo sapiens
cacagactgttgtccctgcact

SEQ ID NO: 2667172 - DNA, 19 bp, Homo sapiens
cacagcccaaagaaggaaa

SEQ ID NO: 2667173 - DNA, 22 bp, Homo sapiens
cacagggactgaaaacctctcc

SEQ ID NO: 2667174 - DNA, 23 bp, Homo sapiens
cacaggtatgaccttctaggaag

SEQ ID NO: 2667175 - DNA, 19 bp, Homo sapiens
cacagtgagggagatccca

SEQ ID NO: 2667176 - DNA, 13 bp, Homo sapiens
cacagtgtgaata

SEQ ID NO: 2667177 - DNA, 13 bp, Homo sapiens
cacatacaacaca

SEQ ID NO: 2667178 - DNA, 21 bp, Homo sapiens
gaatattttcattaaaagcta

SEQ ID NO: 2667179 - DNA, 17 bp, Homo sapiens
gaatgaaccttctggcc

SEQ ID NO: 2667180 - DNA, 12 bp, Homo sapiens
gaatgactcctt

SEQ ID NO: 2667181 - DNA, 20 bp, Homo sapiens
gaatgagattaattcctttc

SEQ ID NO: 2667182 - DNA, 18 bp, Homo sapiens
gaattttgttctctggga

SEQ ID NO: 2667183 - DNA, 18 bp, Homo sapiens
gacaaagttccaaaatgc

SEQ ID NO: 2667184 - DNA, 15 bp, Homo sapiens
gacaactacagaaaa

SEQ ID NO: 2667185 - DNA, 12 bp, Homo sapiens
gacacaggcctg

SEQ ID NO: 2667186 - DNA, 13 bp, Homo sapiens
gacaccccctcgc

SEQ ID NO: 2667187 - DNA, 16 bp, Homo sapiens
gacactgggaggccag

SEQ ID NO: 2667188 - DNA, 14 bp, Homo sapiens
gacagaacactgtc

SEQ ID NO: 2667189 - DNA, 15 bp, Homo sapiens
gacagaacactgtct

SEQ ID NO: 2667190 - DNA, 13 bp, Homo sapiens
gacagaagaaggc

SEQ ID NO: 2667191 - DNA, 23 bp, Homo sapiens
gacagacaacactgggaaacaga

SEQ ID NO: 2667192 - DNA, 23 bp, Homo sapiens
gacagactcacaacctgaaccta

SEQ ID NO: 2667193 - DNA, 21 bp, Homo sapiens
gacagcttctcatcctgcagg

SEQ ID NO: 2667194 - DNA, 22 bp, Homo sapiens
gacagcttctcatcctgcaggc

SEQ ID NO: 2667195 - DNA, 14 bp, Homo sapiens
gacatgcactcagc

SEQ ID NO: 2667196 - DNA, 16 bp, Homo sapiens
gaccaaggagatgaag

SEQ ID NO: 2667197 - DNA, 12 bp, Homo sapiens
gaccagcctggc

SEQ ID NO: 2667198 - DNA, 24 bp, Homo sapiens
gaccatgcgacactgggaggccag

SEQ ID NO: 2667199 - DNA, 16 bp, Homo sapiens
gacccccgccccctgc

SEQ ID NO: 2667200 - DNA, 17 bp, Homo sapiens
gaccctgtatatagccc

SEQ ID NO: 2667201 - DNA, 13 bp, Homo sapiens
gacctcagggcac

SEQ ID NO: 2667202 - DNA, 18 bp, Homo sapiens
gacctggtccacagggca

SEQ ID NO: 2667203 - DNA, 19 bp, Homo sapiens
gacctggtccacagggcac

SEQ ID NO: 2667204 - DNA, 15 bp, Homo sapiens
gaccttctaggaagc

SEQ ID NO: 2667205 - DNA, 12 bp, Homo sapiens
gacggctccact

SEQ ID NO: 2667206 - DNA, 13 bp, Homo sapiens
gacggctgggcac

SEQ ID NO: 2667207 - DNA, 18 bp, Homo sapiens
gacggctgggcacacgcc

SEQ ID NO: 2667208 - DNA, 14 bp, Homo sapiens
gacgtgtttgtgtt

SEQ ID NO: 2667209 - DNA, 18 bp, Homo sapiens
gactagagctttctttca

SEQ ID NO: 2667210 - DNA, 16 bp, Homo sapiens
gactcaagattcccag

SEQ ID NO: 2667211 - DNA, 18 bp, Homo sapiens
gactcaagattcccagga

SEQ ID NO: 2667212 - DNA, 18 bp, Homo sapiens
gactcacaacctgaacct

SEQ ID NO: 2667213 - DNA, 19 bp, Homo sapiens
gactcacaacctgaaccta

SEQ ID NO: 2667214 - DNA, 23 bp, Homo sapiens
gactcacacctgaactgaacacc

SEQ ID NO: 2667215 - DNA, 22 bp, Homo sapiens
gactccggccctcctaccctgc

SEQ ID NO: 2667216 - DNA, 17 bp, Homo sapiens
gactgaaaacctctcct

SEQ ID NO: 2667217 - DNA, 15 bp, Homo sapiens
gactgacctggtcca

SEQ ID NO: 2667218 - DNA, 23 bp, Homo sapiens
gactgacctggtccacagggcac

SEQ ID NO: 2667219 - DNA, 14 bp, Homo sapiens
gactgttgtccctg

SEQ ID NO: 2667220 - DNA, 16 bp, Homo sapiens
gactgttgtccctgca

SEQ ID NO: 2667221 - DNA, 20 bp, Homo sapiens
gactgttgtccctgcactct

SEQ ID NO: 2667222 - DNA, 16 bp, Homo sapiens
gacttgacagaacact

SEQ ID NO: 2667223 - DNA, 12 bp, Homo sapiens
gagaaaaagacc

SEQ ID NO: 2667224 - DNA, 23 bp, Homo sapiens
gagaagattcttcccattctcca

SEQ ID NO: 2667225 - DNA, 21 bp, Homo sapiens
gagaagctctcgggctaggaa

SEQ ID NO: 2667226 - DNA, 19 bp, Homo sapiens
gagacaggcagagctgctc

SEQ ID NO: 2667227 - DNA, 13 bp, Homo sapiens
gagaccagcctgg

SEQ ID NO: 2667228 - DNA, 14 bp, Homo sapiens
gagaccagcctggc

SEQ ID NO: 2667229 - DNA, 18 bp, Homo sapiens
gagagcccctcacacagc

SEQ ID NO: 2667230 - DNA, 20 bp, Homo sapiens
gagaggcagaagaaccctgg

SEQ ID NO: 2667231 - DNA, 18 bp, Homo sapiens
gagatgaagcaaacacat

SEQ ID NO: 2667232 - DNA, 20 bp, Homo sapiens
gagcaagggttccctcaaga

SEQ ID NO: 2667233 - DNA, 17 bp, Homo sapiens
gagcatgggttcatcct

SEQ ID NO: 2667234 - DNA, 16 bp, Homo sapiens
gagcctaggccaggtg

SEQ ID NO: 2667235 - DNA, 22 bp, Homo sapiens
gagctcccaggtgcagccagag

SEQ ID NO: 2667236 - DNA, 21 bp, Homo sapiens
gagctcttggaggtgtctgta

SEQ ID NO: 2667237 - DNA, 13 bp, Homo sapiens
gagctggccccgc

SEQ ID NO: 2667238 - DNA, 18 bp, Homo sapiens
gaggagctcaggacacta

SEQ ID NO: 2667239 - DNA, 18 bp, Homo sapiens
gaggcctctggaaagcaa

SEQ ID NO: 2667240 - DNA, 19 bp, Homo sapiens
gagggaacggaaataaagg

SEQ ID NO: 2667241 - DNA, 13 bp, Homo sapiens
gagggacctctcc

SEQ ID NO: 2667242 - DNA, 16 bp, Homo sapiens
gagggcagcgggagcc

SEQ ID NO: 2667243 - DNA, 18 bp, Homo sapiens
gagggtcagccagggcct

SEQ ID NO: 2667244 - DNA, 19 bp, Homo sapiens
gaggtagaatgactccttg

SEQ ID NO: 2667245 - DNA, 17 bp, Homo sapiens
gaggtgagcggatcaca

SEQ ID NO: 2667246 - DNA, 19 bp, Homo sapiens
gaggtggaggttgcagtga

SEQ ID NO: 2667247 - DNA, 20 bp, Homo sapiens
gaggtgggaggatcttttga

SEQ ID NO: 2667248 - DNA, 15 bp, Homo sapiens
gagtaatctgagaaa

SEQ ID NO: 2667249 - DNA, 20 bp, Homo sapiens
gagtagaaagacagagctgg

SEQ ID NO: 2667250 - DNA, 18 bp, Homo sapiens
gagtcaattggaaagact

SEQ ID NO: 2667251 - DNA, 23 bp, Homo sapiens
gagtgccccattcttttgtaatt

SEQ ID NO: 2667252 - DNA, 19 bp, Homo sapiens
gagtggcttcactcctgct

SEQ ID NO: 2667253 - DNA, 20 bp, Homo sapiens
gagtggcttcactcctgctg

SEQ ID NO: 2667254 - DNA, 15 bp, Homo sapiens
gagtgtactcccagg

SEQ ID NO: 2667255 - DNA, 17 bp, Homo sapiens
gatactgtctctttcat

SEQ ID NO: 2667256 - DNA, 23 bp, Homo sapiens
gatagtggggagacttcttggct

SEQ ID NO: 2667257 - DNA, 13 bp, Homo sapiens
gatataaataaaa

SEQ ID NO: 2667258 - DNA, 14 bp, Homo sapiens
gatatgcaaaagct

SEQ ID NO: 2667259 - DNA, 15 bp, Homo sapiens
gatatgcaaaagctg

SEQ ID NO: 2667260 - DNA, 15 bp, Homo sapiens
gatatgtgaaacaat

SEQ ID NO: 2667261 - DNA, 15 bp, Homo sapiens
gatctctgcagggcc

SEQ ID NO: 2667262 - DNA, 13 bp, Homo sapiens
gatcttcaacaaa

SEQ ID NO: 2667263 - DNA, 16 bp, Homo sapiens
gatcttcaacaaattg

SEQ ID NO: 2667264 - DNA, 18 bp, Homo sapiens
gatcttttgttcccatcc

SEQ ID NO: 2667265 - DNA, 15 bp, Homo sapiens
gatgaagcaaacaca

SEQ ID NO: 2667266 - DNA, 15 bp, Homo sapiens
gatgaagcatttaca

SEQ ID NO: 2667267 - DNA, 19 bp, Homo sapiens
gatgacaactacagaaaaa

SEQ ID NO: 2667268 - DNA, 20 bp, Homo sapiens
gatgacatgcactcagctct

SEQ ID NO: 2667269 - DNA, 23 bp, Homo sapiens
gatgactcaagattcccaggagt

SEQ ID NO: 2667270 - DNA, 12 bp, Homo sapiens
gatggacagact

SEQ ID NO: 2667271 - DNA, 20 bp, Homo sapiens
gatggcaggacgtgggctgg

SEQ ID NO: 2667272 - DNA, 16 bp, Homo sapiens
gatgggcccaattctt

SEQ ID NO: 2667273 - DNA, 16 bp, Homo sapiens
gatgggtgaaggctgg

SEQ ID NO: 2667274 - DNA, 21 bp, Homo sapiens
gatgggtgaaggctggcatga

SEQ ID NO: 2667275 - DNA, 17 bp, Homo sapiens
gatgtgggtcaaggaat

SEQ ID NO: 2667276 - DNA, 21 bp, Homo sapiens
gatgttctactttgttctgct

SEQ ID NO: 2667277 - DNA, 13 bp, Homo sapiens
gattcccaggagt

SEQ ID NO: 2667278 - DNA, 19 bp, Homo sapiens
gattcttcccattctccat

SEQ ID NO: 2667279 - DNA, 16 bp, Homo sapiens
gatttaaacaaacaaa

SEQ ID NO: 2667280 - DNA, 22 bp, Homo sapiens
gatttccccttttgcattctcc

SEQ ID NO: 2667281 - DNA, 17 bp, Homo sapiens
gcaacagaaaaatggag

SEQ ID NO: 2667282 - DNA, 17 bp, Homo sapiens
gcaaccagggagctgca

SEQ ID NO: 2667283 - DNA, 14 bp, Homo sapiens
gcaacctgcttcca

SEQ ID NO: 2667284 - DNA, 23 bp, Homo sapiens
gcaatttcaaattactctttctc

SEQ ID NO: 2667285 - DNA, 23 bp, Homo sapiens
gcacaaagatgggtgaaggctgg

SEQ ID NO: 2667286 - DNA, 13 bp, Homo sapiens
gcacaaagtggca

SEQ ID NO: 2667287 - DNA, 19 bp, Homo sapiens
gcacacgcctcccactggg

SEQ ID NO: 2667288 - DNA, 14 bp, Homo sapiens
gcacccaccctggg

SEQ ID NO: 2667289 - DNA, 14 bp, Homo sapiens
gcaccgtactgtgg

SEQ ID NO: 2667290 - DNA, 21 bp, Homo sapiens
gcacggaccatgcgacactgg

SEQ ID NO: 2667291 - DNA, 20 bp, Homo sapiens
gcacggtggacccagacaca

SEQ ID NO: 2667292 - DNA, 18 bp, Homo sapiens
gcactgtggattatttca

SEQ ID NO: 2667293 - DNA, 17 bp, Homo sapiens
gcagaaacgaagccatc

SEQ ID NO: 2667294 - DNA, 23 bp, Homo sapiens
gcagaaacgaagccatctttctt

SEQ ID NO: 2667295 - DNA, 18 bp, Homo sapiens
gcagactgatcaggacct

SEQ ID NO: 2667296 - DNA, 12 bp, Homo sapiens
taattctgggaa

SEQ ID NO: 2667297 - DNA, 20 bp, Homo sapiens
taattcttcaccttaggaat

SEQ ID NO: 2667298 - DNA, 15 bp, Homo sapiens
taattcttgcatatt

SEQ ID NO: 2667299 - DNA, 12 bp, Homo sapiens
taatttaaagcc

SEQ ID NO: 2667300 - DNA, 21 bp, Homo sapiens
taatttcagcttctatatatt

SEQ ID NO: 2667301 - DNA, 12 bp, Homo sapiens
taatttggcagg

SEQ ID NO: 2667302 - DNA, 15 bp, Homo sapiens
tacaagccccccctt

SEQ ID NO: 2667303 - DNA, 13 bp, Homo sapiens
tacacaatgtgtc

SEQ ID NO: 2667304 - DNA, 11 bp, Homo sapiens
tacacagtgtg

SEQ ID NO: 2667305 - DNA, 22 bp, Homo sapiens
tacacagtgtgaataaagtgct

SEQ ID NO: 2667306 - DNA, 17 bp, Homo sapiens
tacaggggttctggaaa

SEQ ID NO: 2667307 - DNA, 13 bp, Homo sapiens
tacagtctatttg

SEQ ID NO: 2667308 - DNA, 22 bp, Homo sapiens
tacctgtgtattttttaaagct

SEQ ID NO: 2667309 - DNA, 13 bp, Homo sapiens
tacgtatgagacg

SEQ ID NO: 2667310 - DNA, 15 bp, Homo sapiens
tactaggatactgct

SEQ ID NO: 2667311 - DNA, 21 bp, Homo sapiens
tactctgctttttttctactg

SEQ ID NO: 2667312 - DNA, 18 bp, Homo sapiens
tactgtggaaaagaaaca

SEQ ID NO: 2667313 - DNA, 23 bp, Homo sapiens
tactgtgtctttggtttgtgcta

SEQ ID NO: 2667314 - DNA, 15 bp, Homo sapiens
tacttgctctggacc

SEQ ID NO: 2667315 - DNA, 18 bp, Homo sapiens
tacttgctctggacctgc

SEQ ID NO: 2667316 - DNA, 20 bp, Homo sapiens
tacttgctctggacctgccc

SEQ ID NO: 2667317 - DNA, 22 bp, Homo sapiens
tacttgctctggacctgccccc

SEQ ID NO: 2667318 - DNA, 14 bp, Homo sapiens
tacttgctttgtgt

SEQ ID NO: 2667319 - DNA, 13 bp, Homo sapiens
tactttaataaat

SEQ ID NO: 2667320 - DNA, 14 bp, Homo sapiens
tactttgttctgct

SEQ ID NO: 2667321 - DNA, 22 bp, Homo sapiens
tactttgttctgctgttctcta

SEQ ID NO: 2667322 - DNA, 17 bp, Homo sapiens
tagaacataaagcaaat

SEQ ID NO: 2667323 - DNA, 19 bp, Homo sapiens
tagaattatctaatttata

SEQ ID NO: 2667324 - DNA, 14 bp, Homo sapiens
tagacctgtctcct

SEQ ID NO: 2667325 - DNA, 16 bp, Homo sapiens
tagacctgtctcctgg

SEQ ID NO: 2667326 - DNA, 22 bp, Homo sapiens
tagagtttcaaccatgaagtct

SEQ ID NO: 2667327 - DNA, 15 bp, Homo sapiens
tagatgttctacttt

SEQ ID NO: 2667328 - DNA, 12 bp, Homo sapiens
tagatgtttcct

SEQ ID NO: 2667329 - DNA, 15 bp, Homo sapiens
tagccagaggactgt

SEQ ID NO: 2667330 - DNA, 17 bp, Homo sapiens
tagccatttttactgtt

SEQ ID NO: 2667331 - DNA, 21 bp, Homo sapiens
tagcttcaccccaatcccagc

SEQ ID NO: 2667332 - DNA, 13 bp, Homo sapiens
taggaaaatattt

SEQ ID NO: 2667333 - DNA, 16 bp, Homo sapiens
taggctcatttactgt

SEQ ID NO: 2667334 - DNA, 20 bp, Homo sapiens
taggctcatttactgtttta

SEQ ID NO: 2667335 - DNA, 22 bp, Homo sapiens
tagggcaggagtgagaggtctc

SEQ ID NO: 2667336 - DNA, 15 bp, Homo sapiens
tataagaaaaacttt

SEQ ID NO: 2667337 - DNA, 15 bp, Homo sapiens
tataatatatttgtg

SEQ ID NO: 2667338 - DNA, 22 bp, Homo sapiens
tataatatatttgtgtatttaa

SEQ ID NO: 2667339 - DNA, 22 bp, Homo sapiens
tatagcccagccaggccccagg

SEQ ID NO: 2667340 - DNA, 16 bp, Homo sapiens
tatatttatactgtat

SEQ ID NO: 2667341 - DNA, 14 bp, Homo sapiens
tatattttaatttg

SEQ ID NO: 2667342 - DNA, 15 bp, Homo sapiens
tatctccaagaccag

SEQ ID NO: 2667343 - DNA, 15 bp, Homo sapiens
tatgaagaagagagt

SEQ ID NO: 2667344 - DNA, 16 bp, Homo sapiens
tatgaccttctaggaa

SEQ ID NO: 2667345 - DNA, 18 bp, Homo sapiens
tatgaccttctaggaagc

SEQ ID NO: 2667346 - DNA, 20 bp, Homo sapiens
tatgcctttgatgtattttc

SEQ ID NO: 2667347 - DNA, 13 bp, Homo sapiens
tatggcagtgtct

SEQ ID NO: 2667348 - DNA, 16 bp, Homo sapiens
tatggcagtgtctttc

SEQ ID NO: 2667349 - DNA, 16 bp, Homo sapiens
tatgttcagaagaaat

SEQ ID NO: 2667350 - DNA, 14 bp, Homo sapiens
tatgtttttgtgta

SEQ ID NO: 2667351 - DNA, 18 bp, Homo sapiens
tatgtttttgtgtatttg

SEQ ID NO: 2667352 - DNA, 15 bp, Homo sapiens
tatgttttttttctg

SEQ ID NO: 2667353 - DNA, 21 bp, Homo sapiens
tattaatacaatgatgctatt

SEQ ID NO: 2667354 - DNA, 23 bp, Homo sapiens
tattcaataaaaaaaagaaatga

SEQ ID NO: 2667355 - DNA, 16 bp, Homo sapiens
tattcaatatcctttg

SEQ ID NO: 2667356 - DNA, 16 bp, Homo sapiens
tattcatttttgttat

SEQ ID NO: 2667357 - DNA, 22 bp, Homo sapiens
tattcgcttgagaaaaaaagaa

SEQ ID NO: 2667358 - DNA, 11 bp, Homo sapiens
tattgaatcta

SEQ ID NO: 2667359 - DNA, 16 bp, Homo sapiens
tattgaatctatttaa

SEQ ID NO: 2667360 - DNA, 20 bp, Homo sapiens
tatttaagtaactttaaatt

SEQ ID NO: 2667361 - DNA, 15 bp, Homo sapiens
tatttctctttcttt

SEQ ID NO: 2667362 - DNA, 20 bp, Homo sapiens
tatttcttaaacaaatgtat

SEQ ID NO: 2667363 - DNA, 15 bp, Homo sapiens
tatttgtgtatttaa

SEQ ID NO: 2667364 - DNA, 18 bp, Homo sapiens
tatttgtgtatttaacag

SEQ ID NO: 2667365 - DNA, 14 bp, Homo sapiens
tattttataagaaa

SEQ ID NO: 2667366 - DNA, 17 bp, Homo sapiens
tattttataagaaaaac

SEQ ID NO: 2667367 - DNA, 16 bp, Homo sapiens
tattttatacattaac

SEQ ID NO: 2667368 - DNA, 16 bp, Homo sapiens
tattttccatgaaaat

SEQ ID NO: 2667369 - DNA, 16 bp, Homo sapiens
tattttgtaacttcca

SEQ ID NO: 2667370 - DNA, 14 bp, Homo sapiens
tcaaagaaatatct

SEQ ID NO: 2667371 - DNA, 12 bp, Homo sapiens
tcaaaggccaga

SEQ ID NO: 2667372 - DNA, 14 bp, Homo sapiens
tcaaaggccagacc

SEQ ID NO: 2667373 - DNA, 17 bp, Homo sapiens
tcaaccagggattgttt

SEQ ID NO: 2667374 - DNA, 20 bp, Homo sapiens
tcaaccagggattgtttctg

SEQ ID NO: 2667375 - DNA, 23 bp, Homo sapiens
tcaaccctaaaaagcagagcttt

SEQ ID NO: 2667376 - DNA, 18 bp, Homo sapiens
tcaagaagggctgcatga

SEQ ID NO: 2667377 - DNA, 19 bp, Homo sapiens
tcaagattcccaggagttc

SEQ ID NO: 2667378 - DNA, 20 bp, Homo sapiens
tcaagattcccaggagttct

SEQ ID NO: 2667379 - DNA, 16 bp, Homo sapiens
tcaagcccgcggggac

SEQ ID NO: 2667380 - DNA, 19 bp, Homo sapiens
tcaataaaaaaaagaaatg

SEQ ID NO: 2667381 - DNA, 17 bp, Homo sapiens
tcaatattttccatgaa

SEQ ID NO: 2667382 - DNA, 22 bp, Homo sapiens
tcaatgtactaggatactgctg

SEQ ID NO: 2667383 - DNA, 14 bp, Homo sapiens
tcacaacctgaacc

SEQ ID NO: 2667384 - DNA, 14 bp, Homo sapiens
tcacacacagactg

SEQ ID NO: 2667385 - DNA, 21 bp, Homo sapiens
tcacaccaggcttgcctgcag

SEQ ID NO: 2667386 - DNA, 20 bp, Homo sapiens
tcacacctgaactgaacacc

SEQ ID NO: 2667387 - DNA, 15 bp, Homo sapiens
tcacatgggacaaag

SEQ ID NO: 2667388 - DNA, 20 bp, Homo sapiens
tcacctctaaaacagtcctt

SEQ ID NO: 2667389 - DNA, 16 bp, Homo sapiens
tcacgcctgtaatccc

SEQ ID NO: 2667390 - DNA, 12 bp, Homo sapiens
tcactcctgctg

SEQ ID NO: 2667391 - DNA, 17 bp, Homo sapiens
tcactcttctcagccac

SEQ ID NO: 2667392 - DNA, 14 bp, Homo sapiens
tcactctttagaaa

SEQ ID NO: 2667393 - DNA, 19 bp, Homo sapiens
tcactgtcctccaagccag

SEQ ID NO: 2667394 - DNA, 16 bp, Homo sapiens
tcactgtgagctccca

SEQ ID NO: 2667395 - DNA, 17 bp, Homo sapiens
tcacttcacgctttcag

SEQ ID NO: 2667396 - DNA, 23 bp, Homo sapiens
tcagaagggagctagccagagga

SEQ ID NO: 2667397 - DNA, 18 bp, Homo sapiens
tcagaattagctgcttct

SEQ ID NO: 2667398 - DNA, 15 bp, Homo sapiens
tcaggcttgataata

SEQ ID NO: 2667399 - DNA, 18 bp, Homo sapiens
tcagggaaaagcagctct

SEQ ID NO: 2667400 - DNA, 23 bp, Homo sapiens
tcagggaaaagcagctctcccct

SEQ ID NO: 2667401 - DNA, 15 bp, Homo sapiens
tcagggtcatagcat

SEQ ID NO: 2667402 - DNA, 16 bp, Homo sapiens
tcaggtcaggagttcg

SEQ ID NO: 2667403 - DNA, 20 bp, Homo sapiens
tcagtcttctctcactttga

SEQ ID NO: 2667404 - DNA, 16 bp, Homo sapiens
tcatacttaagcaaaa

SEQ ID NO: 2667405 - DNA, 14 bp, Homo sapiens
tcatattgaatata

SEQ ID NO: 2667406 - DNA, 13 bp, Homo sapiens
tcatatttgcact

SEQ ID NO: 2667407 - DNA, 17 bp, Homo sapiens
tcatcaaccctaaaaag

SEQ ID NO: 2667408 - DNA, 16 bp, Homo sapiens
tcatcaagaagggctg

SEQ ID NO: 2667409 - DNA, 21 bp, Homo sapiens
tcatcaagaagggctgcatga

SEQ ID NO: 2667410 - DNA, 14 bp, Homo sapiens
tcatctttgtgaag

SEQ ID NO: 2667411 - DNA, 15 bp, Homo sapiens
tcatgaccagcaaat

SEQ ID NO: 2667412 - DNA, 19 bp, Homo sapiens
tcatgtatgttcagaagaa

SEQ ID NO: 2667413 - DNA, 22 bp, Homo sapiens
tcatgtatgttcagaagaaatt

SEQ ID NO: 2667414 - DNA, 20 bp, Homo sapiens
tcattcccttcgacagcatt

SEQ ID NO: 2667415 - DNA, 17 bp, Homo sapiens
tcattcgggctgggcgc

SEQ ID NO: 2667416 - DNA, 18 bp, Homo sapiens
tcattctaatgatggccc

SEQ ID NO: 2667417 - DNA, 18 bp, Homo sapiens
tcattgaattataaaagc

SEQ ID NO: 2667418 - DNA, 11 bp, Homo sapiens
tcatttactgt

SEQ ID NO: 2667419 - DNA, 13 bp, Homo sapiens
tccaaaccttcac

SEQ ID NO: 2667420 - DNA, 18 bp, Homo sapiens
tccaaaccttcacacaca

SEQ ID NO: 2667421 - DNA, 12 bp, Homo sapiens
tccaagagctga

SEQ ID NO: 2667422 - DNA, 14 bp, Homo sapiens
tccaccagtcattt

SEQ ID NO: 2667423 - DNA, 20 bp, Homo sapiens
tccacttctttcagcagact

SEQ ID NO: 2667424 - DNA, 20 bp, Homo sapiens
tccacttttttttgtatgtt

SEQ ID NO: 2667425 - DNA, 14 bp, Homo sapiens
tccagaaggagaca

SEQ ID NO: 2667426 - DNA, 15 bp, Homo sapiens
tccaggattcctctt

SEQ ID NO: 2667427 - DNA, 22 bp, Homo sapiens
tccaggattcctcttttctctg

SEQ ID NO: 2667428 - DNA, 21 bp, Homo sapiens
tccagggacgaagaagagcca

SEQ ID NO: 2667429 - DNA, 17 bp, Homo sapiens
tccatttgttatctggg

SEQ ID NO: 2667430 - DNA, 19 bp, Homo sapiens
tcccaacaaacattgatgc

SEQ ID NO: 2667431 - DNA, 12 bp, Homo sapiens
tcccagcaattt

SEQ ID NO: 2667432 - DNA, 18 bp, Homo sapiens
tcccaggagttctgctca

SEQ ID NO: 2667433 - DNA, 19 bp, Homo sapiens
tcccaggagttctgctcat

SEQ ID NO: 2667434 - DNA, 14 bp, Homo sapiens
tcccagggcttacg

SEQ ID NO: 2667435 - DNA, 15 bp, Homo sapiens
tcccatcccctgtgg

SEQ ID NO: 2667436 - DNA, 23 bp, Homo sapiens
tccccagagaaagcgcagatgct

SEQ ID NO: 2667437 - DNA, 19 bp, Homo sapiens
tcccccaccccatttctct

SEQ ID NO: 2667438 - DNA, 22 bp, Homo sapiens
tcccctgcccctttacggacac

SEQ ID NO: 2667439 - DNA, 17 bp, Homo sapiens
tcccctgcctccatcct

SEQ ID NO: 2667440 - DNA, 20 bp, Homo sapiens
tcccctttatgtacaggatg

SEQ ID NO: 2667441 - DNA, 18 bp, Homo sapiens
tccccttttgcattctcc

SEQ ID NO: 2667442 - DNA, 16 bp, Homo sapiens
tccctagtaaaaatac

SEQ ID NO: 2667443 - DNA, 16 bp, Homo sapiens
tccctgaccctgtata

SEQ ID NO: 2667444 - DNA, 17 bp, Homo sapiens
tccctgaccctgtatat

SEQ ID NO: 2667445 - DNA, 22 bp, Homo sapiens
tccctgaccctgtatatagccc

SEQ ID NO: 2667446 - DNA, 16 bp, Homo sapiens
tccctgcctcaggcct

SEQ ID NO: 2667447 - DNA, 19 bp, Homo sapiens
tccctggtgagagggccgg

SEQ ID NO: 2667448 - DNA, 23 bp, Homo sapiens
tcccttgaggaaacaacagcttt

SEQ ID NO: 2667449 - DNA, 21 bp, Homo sapiens
tccggccctcctaccctgcgc

SEQ ID NO: 2667450 - DNA, 20 bp, Homo sapiens
tcctcaattccaacactgat

SEQ ID NO: 2667451 - DNA, 16 bp, Homo sapiens
tcctcaggtggccatg

SEQ ID NO: 2667452 - DNA, 19 bp, Homo sapiens
tcctcgttctccctgggag

SEQ ID NO: 2667453 - DNA, 21 bp, Homo sapiens
tcctcgttctccctgggaggc

SEQ ID NO: 2667454 - DNA, 18 bp, Homo sapiens
tcctcttgtaaataaagc

SEQ ID NO: 2667455 - DNA, 20 bp, Homo sapiens
tcctcttgtaaataaagccc

SEQ ID NO: 2667456 - DNA, 19 bp, Homo sapiens
tccttgtagccttttgact

SEQ ID NO: 2667457 - DNA, 18 bp, Homo sapiens
tcctttgtactttgtgct

SEQ ID NO: 2667458 - DNA, 17 bp, Homo sapiens
tcgacagtgaatattca

SEQ ID NO: 2667459 - DNA, 13 bp, Homo sapiens
tcgagaccagcct

SEQ ID NO: 2667460 - DNA, 16 bp, Homo sapiens
tcgccagctgatgact

SEQ ID NO: 2667461 - DNA, 20 bp, Homo sapiens
tcgccagctgatgactcaag

SEQ ID NO: 2667462 - DNA, 13 bp, Homo sapiens
tcgccctcccagg

SEQ ID NO: 2667463 - DNA, 14 bp, Homo sapiens
tcgccctcccaggc

SEQ ID NO: 2667464 - DNA, 16 bp, Homo sapiens
tcgcggcggagctggc

SEQ ID NO: 2667465 - DNA, 12 bp, Homo sapiens
tcgtccagggag

SEQ ID NO: 2667466 - DNA, 21 bp, Homo sapiens
tctaaagagtttattttaaga

SEQ ID NO: 2667467 - DNA, 13 bp, Homo sapiens
tctaatttataaa

SEQ ID NO: 2667468 - DNA, 14 bp, Homo sapiens
tctacttgctctgg

SEQ ID NO: 2667469 - DNA, 17 bp, Homo sapiens
tctacttgctctggacc

SEQ ID NO: 2667470 - DNA, 21 bp, Homo sapiens
tctacttgctctggacctgcc

SEQ ID NO: 2667471 - DNA, 21 bp, Homo sapiens
tctaggaaaatattttgatct

SEQ ID NO: 2667472 - DNA, 19 bp, Homo sapiens
tctcatcgccagacaactg

SEQ ID NO: 2667473 - DNA, 20 bp, Homo sapiens
tctcattgaattataaaagc

SEQ ID NO: 2667474 - DNA, 13 bp, Homo sapiens
tctcccctcagag

SEQ ID NO: 2667475 - DNA, 13 bp, Homo sapiens
tctcctcttgtaa

SEQ ID NO: 2667476 - DNA, 23 bp, Homo sapiens
tctcctcttgtaaataaagccct

SEQ ID NO: 2667477 - DNA, 17 bp, Homo sapiens
tctcctgaagttcagcc

SEQ ID NO: 2667478 - DNA, 20 bp, Homo sapiens
tctcctttgtactttgtgct

SEQ ID NO: 2667479 - DNA, 19 bp, Homo sapiens
tctctaaagagtttatttt

SEQ ID NO: 2667480 - DNA, 11 bp, Homo sapiens
tctctgaaccc

SEQ ID NO: 2667481 - DNA, 18 bp, Homo sapiens
tctctgcaccgtactgtg

SEQ ID NO: 2667482 - DNA, 17 bp, Homo sapiens
tctctgggagaaaatca

SEQ ID NO: 2667483 - DNA, 22 bp, Homo sapiens
tctctgggagaaaatcatcaag

SEQ ID NO: 2667484 - DNA, 12 bp, Homo sapiens
tctctttcttta

SEQ ID NO: 2667485 - DNA, 13 bp, Homo sapiens
tctctttctttac

SEQ ID NO: 2667486 - DNA, 17 bp, Homo sapiens
tctgaaaattaacactg

SEQ ID NO: 2667487 - DNA, 18 bp, Homo sapiens
tctgaaaattaacactgc

SEQ ID NO: 2667488 - DNA, 20 bp, Homo sapiens
tctgaactggagccatgggc

SEQ ID NO: 2667489 - DNA, 21 bp, Homo sapiens
tctgaagctttaccagctgaa

SEQ ID NO: 2667490 - DNA, 20 bp, Homo sapiens
tctgcagggccgccagggag

SEQ ID NO: 2667491 - DNA, 19 bp, Homo sapiens
tctgcgtctctgctttaaa

SEQ ID NO: 2667492 - DNA, 20 bp, Homo sapiens
tctgcgtctctgctttaaag

SEQ ID NO: 2667493 - DNA, 16 bp, Homo sapiens
tctgcgtgcagggaca

SEQ ID NO: 2667494 - DNA, 17 bp, Homo sapiens
tctgctggttttaacaa

SEQ ID NO: 2667495 - DNA, 13 bp, Homo sapiens
tctggcctcccac

SEQ ID NO: 2667496 - DNA, 14 bp, Homo sapiens
tctggcctcccaca

SEQ ID NO: 2667497 - DNA, 14 bp, Homo sapiens
tctgtctaaaaaac

SEQ ID NO: 2667498 - DNA, 18 bp, Homo sapiens
tctgtgaattgagctgca

SEQ ID NO: 2667499 - DNA, 17 bp, Homo sapiens
tctgttgtcaccttcac

SEQ ID NO: 2667500 - DNA, 13 bp, Homo sapiens
tctgttttgtaaa

SEQ ID NO: 2667501 - DNA, 14 bp, Homo sapiens
tcttacaaacatgt

SEQ ID NO: 2667502 - DNA, 17 bp, Homo sapiens
tcttattttttaaaaag

SEQ ID NO: 2667503 - DNA, 12 bp, Homo sapiens
tcttcaacaaat

SEQ ID NO: 2667504 - DNA, 20 bp, Homo sapiens
tcttgacgagtgtgaagctt

SEQ ID NO: 2667505 - DNA, 17 bp, Homo sapiens
tcttgcatattttgtaa

SEQ ID NO: 2667506 - DNA, 15 bp, Homo sapiens
tctttgatccttctc

SEQ ID NO: 2667507 - DNA, 19 bp, Homo sapiens
tctttggtttaatttaaag

SEQ ID NO: 2667508 - DNA, 16 bp, Homo sapiens
tctttgtgaaggcctc

SEQ ID NO: 2667509 - DNA, 16 bp, Homo sapiens
tcttttcattgaacag

SEQ ID NO: 2667510 - DNA, 16 bp, Homo sapiens
tgaaaaggcaaaaagc

SEQ ID NO: 2667511 - DNA, 18 bp, Homo sapiens
tgaaaatgcaacaacatg

SEQ ID NO: 2667512 - DNA, 15 bp, Homo sapiens
tgaaaattaacactg

SEQ ID NO: 2667513 - DNA, 18 bp, Homo sapiens
tgaaaattaacactgctt

SEQ ID NO: 2667514 - DNA, 20 bp, Homo sapiens
tgaaacccagtcactgtgag

SEQ ID NO: 2667515 - DNA, 16 bp, Homo sapiens
tgaaagccccagaaat

SEQ ID NO: 2667516 - DNA, 17 bp, Homo sapiens
tgaaagccccagaaatc

SEQ ID NO: 2667517 - DNA, 16 bp, Homo sapiens
tgaaagtccagaaact

SEQ ID NO: 2667518 - DNA, 15 bp, Homo sapiens
tgaaatatacacaca

SEQ ID NO: 2667519 - DNA, 18 bp, Homo sapiens
tgaaatatgctggctgga

SEQ ID NO: 2667520 - DNA, 22 bp, Homo sapiens
tgaacagtttatcgaccagttt

SEQ ID NO: 2667521 - DNA, 22 bp, Homo sapiens
tgaacctaggagtgccccattc

SEQ ID NO: 2667522 - DNA, 12 bp, Homo sapiens
tgaactgaacac

SEQ ID NO: 2667523 - DNA, 13 bp, Homo sapiens
tgaactgaacacc

SEQ ID NO: 2667524 - DNA, 22 bp, Homo sapiens
tgaactgaacaccattgaaggc

SEQ ID NO: 2667525 - DNA, 17 bp, Homo sapiens
tgaagagtcctctgaat

SEQ ID NO: 2667526 - DNA, 13 bp, Homo sapiens
tgaagcaaacaca

SEQ ID NO: 2667527 - DNA, 15 bp, Homo sapiens
tgaagcaaacacatt

SEQ ID NO: 2667528 - DNA, 17 bp, Homo sapiens
tgaagcacagacccctt

SEQ ID NO: 2667529 - DNA, 18 bp, Homo sapiens
tgaagcctttcttttgga

SEQ ID NO: 2667530 - DNA, 18 bp, Homo sapiens
tgaaggcctcgcaggaag

SEQ ID NO: 2667531 - DNA, 16 bp, Homo sapiens
tgaagggatatgtgaa

SEQ ID NO: 2667532 - DNA, 13 bp, Homo sapiens
tgaaggtttctga

SEQ ID NO: 2667533 - DNA, 13 bp, Homo sapiens
tgaataaagtgct

SEQ ID NO: 2667534 - DNA, 16 bp, Homo sapiens
acagcaagtcagggtt

SEQ ID NO: 2667535 - DNA, 13 bp, Homo sapiens
acagcgctatgca

SEQ ID NO: 2667536 - DNA, 15 bp, Homo sapiens
acagctatatttctg

SEQ ID NO: 2667537 - DNA, 20 bp, Homo sapiens
acagcttctcatcctgcagg

SEQ ID NO: 2667538 - DNA, 12 bp, Homo sapiens
acagggagggga

SEQ ID NO: 2667539 - DNA, 15 bp, Homo sapiens
acagggcacctgcca

SEQ ID NO: 2667540 - DNA, 21 bp, Homo sapiens
acagggctgataagctaacac

SEQ ID NO: 2667541 - DNA, 12 bp, Homo sapiens
acaggggccaga

SEQ ID NO: 2667542 - DNA, 23 bp, Homo sapiens
acaggggccagaagatgaacaga

SEQ ID NO: 2667543 - DNA, 23 bp, Homo sapiens
acagtctatttgagactcctcag

SEQ ID NO: 2667544 - DNA, 18 bp, Homo sapiens
acatgtagaaaacaaaat

SEQ ID NO: 2667545 - DNA, 17 bp, Homo sapiens
acattaagccttccaca

SEQ ID NO: 2667546 - DNA, 22 bp, Homo sapiens
acattggtattcgcttgagaaa

SEQ ID NO: 2667547 - DNA, 16 bp, Homo sapiens
acatttacctttttga

SEQ ID NO: 2667548 - DNA, 21 bp, Homo sapiens
accaaaaaagctgtattttga

SEQ ID NO: 2667549 - DNA, 13 bp, Homo sapiens
accacactggact

SEQ ID NO: 2667550 - DNA, 20 bp, Homo sapiens
accagcctggccaacatggt

SEQ ID NO: 2667551 - DNA, 12 bp, Homo sapiens
accagctgaaag

SEQ ID NO: 2667552 - DNA, 20 bp, Homo sapiens
accagctgaaagttgggact

SEQ ID NO: 2667553 - DNA, 19 bp, Homo sapiens
accagggattgtttctgtt

SEQ ID NO: 2667554 - DNA, 16 bp, Homo sapiens
accagtcatttttcag

SEQ ID NO: 2667555 - DNA, 20 bp, Homo sapiens
accatgtttgtggctattaa

SEQ ID NO: 2667556 - DNA, 18 bp, Homo sapiens
accattatgaagaagaga

SEQ ID NO: 2667557 - DNA, 18 bp, Homo sapiens
acccaagacctcagggca

SEQ ID NO: 2667558 - DNA, 14 bp, Homo sapiens
accccaatcccagc

SEQ ID NO: 2667559 - DNA, 19 bp, Homo sapiens
accccatttctctcctcac

SEQ ID NO: 2667560 - DNA, 17 bp, Homo sapiens
acccccactggactgac

SEQ ID NO: 2667561 - DNA, 15 bp, Homo sapiens
acccccgccccctgc

SEQ ID NO: 2667562 - DNA, 19 bp, Homo sapiens
acccccgccccctgccctc

SEQ ID NO: 2667563 - DNA, 20 bp, Homo sapiens
acccccgccccctgccctcc

SEQ ID NO: 2667564 - DNA, 21 bp, Homo sapiens
acccccgccccctgccctccc

SEQ ID NO: 2667565 - DNA, 14 bp, Homo sapiens
accccgtcaacaaa

SEQ ID NO: 2667566 - DNA, 22 bp, Homo sapiens
accctgcgcccagtccttccac

SEQ ID NO: 2667567 - DNA, 22 bp, Homo sapiens
accctgggcctggcagctcagc

SEQ ID NO: 2667568 - DNA, 15 bp, Homo sapiens
accctgtatatagcc

SEQ ID NO: 2667569 - DNA, 21 bp, Homo sapiens
acccttctcctcttgtaaata

SEQ ID NO: 2667570 - DNA, 23 bp, Homo sapiens
acccttctcctcttgtaaataaa

SEQ ID NO: 2667571 - DNA, 22 bp, Homo sapiens
acctatttctctttctttacaa

SEQ ID NO: 2667572 - DNA, 22 bp, Homo sapiens
acctcaaagcacctgaacagtt

SEQ ID NO: 2667573 - DNA, 12 bp, Homo sapiens
acctcagggcac

SEQ ID NO: 2667574 - DNA, 18 bp, Homo sapiens
acctctaaaacagtcctt

SEQ ID NO: 2667575 - DNA, 13 bp, Homo sapiens
acctctcccaggg

SEQ ID NO: 2667576 - DNA, 22 bp, Homo sapiens
acctgattaactgaggcatcca

SEQ ID NO: 2667577 - DNA, 18 bp, Homo sapiens
acctgtgtattttttaaa

SEQ ID NO: 2667578 - DNA, 23 bp, Homo sapiens
accttaggaataatctcctgtta

SEQ ID NO: 2667579 - DNA, 22 bp, Homo sapiens
accttcactgtgaccttgagaa

SEQ ID NO: 2667580 - DNA, 14 bp, Homo sapiens
accttcagaataag

SEQ ID NO: 2667581 - DNA, 17 bp, Homo sapiens
accttgatgagctgtgc

SEQ ID NO: 2667582 - DNA, 19 bp, Homo sapiens
acctttcataatctttgct

SEQ ID NO: 2667583 - DNA, 21 bp, Homo sapiens
acctttcataatctttgcttt

SEQ ID NO: 2667584 - DNA, 19 bp, Homo sapiens
acctttctcctttgtactt

SEQ ID NO: 2667585 - DNA, 18 bp, Homo sapiens
acgcaaactttgagcctt

SEQ ID NO: 2667586 - DNA, 15 bp, Homo sapiens
acggacaccccctcg

SEQ ID NO: 2667587 - DNA, 14 bp, Homo sapiens
acggccctggcctt

SEQ ID NO: 2667588 - DNA, 23 bp, Homo sapiens
acggccctggccttgggccctct

SEQ ID NO: 2667589 - DNA, 11 bp, Homo sapiens
acggctgggca

SEQ ID NO: 2667590 - DNA, 23 bp, Homo sapiens
acgtgggctgggcccacaaaggc

SEQ ID NO: 2667591 - DNA, 18 bp, Homo sapiens
acgtttacaagccccccc

SEQ ID NO: 2667592 - DNA, 15 bp, Homo sapiens
actactgcaccattt

SEQ ID NO: 2667593 - DNA, 18 bp, Homo sapiens
actagagggacctctccc

SEQ ID NO: 2667594 - DNA, 21 bp, Homo sapiens
actagggtgagggttttctgt

SEQ ID NO: 2667595 - DNA, 15 bp, Homo sapiens
actattgcattttac

SEQ ID NO: 2667596 - DNA, 17 bp, Homo sapiens
actattttattttctaa

SEQ ID NO: 2667597 - DNA, 15 bp, Homo sapiens
actcaagattcccag

SEQ ID NO: 2667598 - DNA, 19 bp, Homo sapiens
actcaagattcccaggagt

SEQ ID NO: 2667599 - DNA, 21 bp, Homo sapiens
actcacaacctgaacctagga

SEQ ID NO: 2667600 - DNA, 21 bp, Homo sapiens
actcacacctgaactgaacac

SEQ ID NO: 2667601 - DNA, 16 bp, Homo sapiens
actcacatggctatgt

SEQ ID NO: 2667602 - DNA, 16 bp, Homo sapiens
actcacctctaaaaca

SEQ ID NO: 2667603 - DNA, 15 bp, Homo sapiens
actcatattactggt

SEQ ID NO: 2667604 - DNA, 22 bp, Homo sapiens
actcatattactggtaggaact

SEQ ID NO: 2667605 - DNA, 20 bp, Homo sapiens
actcatttaaagtattttat

SEQ ID NO: 2667606 - DNA, 15 bp, Homo sapiens
actccggccctccta

SEQ ID NO: 2667607 - DNA, 18 bp, Homo sapiens
actctctgaacccctccc

SEQ ID NO: 2667608 - DNA, 12 bp, Homo sapiens
actcttctcagc

SEQ ID NO: 2667609 - DNA, 20 bp, Homo sapiens
actgaacaccattgaaggct

SEQ ID NO: 2667610 - DNA, 22 bp, Homo sapiens
actgaacaccattgaaggctta

SEQ ID NO: 2667611 - DNA, 20 bp, Homo sapiens
actgagatccttccttttga

SEQ ID NO: 2667612 - DNA, 20 bp, Homo sapiens
actgatttccccttttgcat

SEQ ID NO: 2667613 - DNA, 22 bp, Homo sapiens
actgcataccaacctgggcaat

SEQ ID NO: 2667614 - DNA, 16 bp, Homo sapiens
actgcccagcggacag

SEQ ID NO: 2667615 - DNA, 22 bp, Homo sapiens
actgcctctcacagctgagttg

SEQ ID NO: 2667616 - DNA, 14 bp, Homo sapiens
actggactccggcc

SEQ ID NO: 2667617 - DNA, 16 bp, Homo sapiens
actggactccggccct

SEQ ID NO: 2667618 - DNA, 23 bp, Homo sapiens
actgtctgtgtttttttggcagt

SEQ ID NO: 2667619 - DNA, 24 bp, Homo sapiens
actgttttaatttatactggcatg

SEQ ID NO: 2667620 - DNA, 13 bp, Homo sapiens
acttaagcaaaag

SEQ ID NO: 2667621 - DNA, 11 bp, Homo sapiens
acttattaaat

SEQ ID NO: 2667622 - DNA, 18 bp, Homo sapiens
acttcaggcttgataata

SEQ ID NO: 2667623 - DNA, 20 bp, Homo sapiens
acttcaggcttgataatact

SEQ ID NO: 2667624 - DNA, 11 bp, Homo sapiens
acttcccccaa

SEQ ID NO: 2667625 - DNA, 18 bp, Homo sapiens
acttccttatgcttcttt

SEQ ID NO: 2667626 - DNA, 14 bp, Homo sapiens
acttctcttccttg

SEQ ID NO: 2667627 - DNA, 17 bp, Homo sapiens
acttgacagaacactgt

SEQ ID NO: 2667628 - DNA, 21 bp, Homo sapiens
acttgagttacaccagacctg

SEQ ID NO: 2667629 - DNA, 14 bp, Homo sapiens
acttgctctggacc

SEQ ID NO: 2667630 - DNA, 17 bp, Homo sapiens
acttgctctggacctgc

SEQ ID NO: 2667631 - DNA, 12 bp, Homo sapiens
actttatttcca

SEQ ID NO: 2667632 - DNA, 14 bp, Homo sapiens
actttcattggaaa

SEQ ID NO: 2667633 - DNA, 15 bp, Homo sapiens
agaaaaagaaatgca

SEQ ID NO: 2667634 - DNA, 23 bp, Homo sapiens
agaaaacacttaaaatgatcatt

SEQ ID NO: 2667635 - DNA, 19 bp, Homo sapiens
agaaaatcatcaagaaggg

SEQ ID NO: 2667636 - DNA, 22 bp, Homo sapiens
agaaaatggaaccaggcttgga

SEQ ID NO: 2667637 - DNA, 15 bp, Homo sapiens
agaaagacagagctg

SEQ ID NO: 2667638 - DNA, 18 bp, Homo sapiens
agaaagacagagctggga

SEQ ID NO: 2667639 - DNA, 20 bp, Homo sapiens
agaaaggggcagtttaaagc

SEQ ID NO: 2667640 - DNA, 16 bp, Homo sapiens
agaaatgcaaaaatct

SEQ ID NO: 2667641 - DNA, 21 bp, Homo sapiens
agaaattctgtcatagaaagt

SEQ ID NO: 2667642 - DNA, 17 bp, Homo sapiens
agaacaatattgacttt

SEQ ID NO: 2667643 - DNA, 19 bp, Homo sapiens
agaacaatattgactttgt

SEQ ID NO: 2667644 - DNA, 20 bp, Homo sapiens
agaacaatattgactttgtc

SEQ ID NO: 2667645 - DNA, 21 bp, Homo sapiens
agaacaatattgactttgtct

SEQ ID NO: 2667646 - DNA, 11 bp, Homo sapiens
agaacactggt

SEQ ID NO: 2667647 - DNA, 19 bp, Homo sapiens
agaacattggtattcgctt

SEQ ID NO: 2667648 - DNA, 19 bp, Homo sapiens
agaactcatgttatttttt

SEQ ID NO: 2667649 - DNA, 22 bp, Homo sapiens
agaactcatgttattttttaac

SEQ ID NO: 2667650 - DNA, 19 bp, Homo sapiens
agaagaaaatggaaccagg

SEQ ID NO: 2667651 - DNA, 20 bp, Homo sapiens
atgccgttacttttcatatt

SEQ ID NO: 2667652 - DNA, 20 bp, Homo sapiens
atgcctcagccctgaccctg

SEQ ID NO: 2667653 - DNA, 12 bp, Homo sapiens
atgctcagacca

SEQ ID NO: 2667654 - DNA, 23 bp, Homo sapiens
atggaaaggagcctaggccaggt

SEQ ID NO: 2667655 - DNA, 19 bp, Homo sapiens
atggacagaagaaggcagc

SEQ ID NO: 2667656 - DNA, 20 bp, Homo sapiens
atggacagaagaaggcagca

SEQ ID NO: 2667657 - DNA, 20 bp, Homo sapiens
atggcaggacgtgggctggg

SEQ ID NO: 2667658 - DNA, 12 bp, Homo sapiens
atggggatgcag

SEQ ID NO: 2667659 - DNA, 15 bp, Homo sapiens
atgggtgaaggctgg

SEQ ID NO: 2667660 - DNA, 16 bp, Homo sapiens
atgggtgaaggctggc

SEQ ID NO: 2667661 - DNA, 23 bp, Homo sapiens
atggtgcttgttaatgctttctg

SEQ ID NO: 2667662 - DNA, 20 bp, Homo sapiens
atgtacaataagaacttcta

SEQ ID NO: 2667663 - DNA, 20 bp, Homo sapiens
atgtacgatgagaaattcaa

SEQ ID NO: 2667664 - DNA, 20 bp, Homo sapiens
atgtactaggatactgctgc

SEQ ID NO: 2667665 - DNA, 13 bp, Homo sapiens
atgtgctacaggg

SEQ ID NO: 2667666 - DNA, 17 bp, Homo sapiens
atgtggattttttccta

SEQ ID NO: 2667667 - DNA, 13 bp, Homo sapiens
atgttctgctttc

SEQ ID NO: 2667668 - DNA, 13 bp, Homo sapiens
attactctttctc

SEQ ID NO: 2667669 - DNA, 13 bp, Homo sapiens
attatctaattta

SEQ ID NO: 2667670 - DNA, 14 bp, Homo sapiens
attatctaatttat

SEQ ID NO: 2667671 - DNA, 23 bp, Homo sapiens
attatgagacacaggatgaagca

SEQ ID NO: 2667672 - DNA, 16 bp, Homo sapiens
attcaaagaaatatct

SEQ ID NO: 2667673 - DNA, 12 bp, Homo sapiens
attcacttcacg

SEQ ID NO: 2667674 - DNA, 16 bp, Homo sapiens
attccaacactgattt

SEQ ID NO: 2667675 - DNA, 23 bp, Homo sapiens
attcccttcgacagcattttcct

SEQ ID NO: 2667676 - DNA, 17 bp, Homo sapiens
attcctcttttctctgc

SEQ ID NO: 2667677 - DNA, 23 bp, Homo sapiens
attctaatgatggcccattctac

SEQ ID NO: 2667678 - DNA, 13 bp, Homo sapiens
attctacttgctc

SEQ ID NO: 2667679 - DNA, 15 bp, Homo sapiens
attctacttgctctg

SEQ ID NO: 2667680 - DNA, 17 bp, Homo sapiens
attctacttgctctgga

SEQ ID NO: 2667681 - DNA, 19 bp, Homo sapiens
attctaggcctcctggccc

SEQ ID NO: 2667682 - DNA, 18 bp, Homo sapiens
attctgtcatagaaagtg

SEQ ID NO: 2667683 - DNA, 16 bp, Homo sapiens
attcttattttttaaa

SEQ ID NO: 2667684 - DNA, 14 bp, Homo sapiens
attcttgaagtcag

SEQ ID NO: 2667685 - DNA, 13 bp, Homo sapiens
attcttttgtaat

SEQ ID NO: 2667686 - DNA, 18 bp, Homo sapiens
attgaatctatttaagta

SEQ ID NO: 2667687 - DNA, 13 bp, Homo sapiens
attgactttgtct

SEQ ID NO: 2667688 - DNA, 17 bp, Homo sapiens
attgagctgcagaaacg

SEQ ID NO: 2667689 - DNA, 19 bp, Homo sapiens
attgatataaataaaacat

SEQ ID NO: 2667690 - DNA, 19 bp, Homo sapiens
attgatatttgtgcatttt

SEQ ID NO: 2667691 - DNA, 18 bp, Homo sapiens
attgggttccattctcac

SEQ ID NO: 2667692 - DNA, 14 bp, Homo sapiens
attgtaaaacaggt

SEQ ID NO: 2667693 - DNA, 15 bp, Homo sapiens
attgtatttgtttct

SEQ ID NO: 2667694 - DNA, 19 bp, Homo sapiens
attgtgtgtgcagacttca

SEQ ID NO: 2667695 - DNA, 22 bp, Homo sapiens
attgtgtgtgcagacttcagga

SEQ ID NO: 2667696 - DNA, 15 bp, Homo sapiens
atttaaacaaacaaa

SEQ ID NO: 2667697 - DNA, 16 bp, Homo sapiens
atttaagtaactttaa

SEQ ID NO: 2667698 - DNA, 21 bp, Homo sapiens
atttagctccaaaccttcaca

SEQ ID NO: 2667699 - DNA, 15 bp, Homo sapiens
atttattttataaga

SEQ ID NO: 2667700 - DNA, 16 bp, Homo sapiens
atttattttataagaa

SEQ ID NO: 2667701 - DNA, 20 bp, Homo sapiens
atttattttataagaaaaac

SEQ ID NO: 2667702 - DNA, 16 bp, Homo sapiens
atttccccttttgcat

SEQ ID NO: 2667703 - DNA, 21 bp, Homo sapiens
atttccccttttgcattctcc

SEQ ID NO: 2667704 - DNA, 17 bp, Homo sapiens
atttctaaaatataaga

SEQ ID NO: 2667705 - DNA, 21 bp, Homo sapiens
atttgagaatataaaaaactt

SEQ ID NO: 2667706 - DNA, 20 bp, Homo sapiens
atttgatagtattgtgcata

SEQ ID NO: 2667707 - DNA, 22 bp, Homo sapiens
atttgtaggggaactcatttgg

SEQ ID NO: 2667708 - DNA, 14 bp, Homo sapiens
atttgtgtatttaa

SEQ ID NO: 2667709 - DNA, 22 bp, Homo sapiens
atttgtgtatttaacagggagg

SEQ ID NO: 2667710 - DNA, 12 bp, Homo sapiens
atttgttaatgg

SEQ ID NO: 2667711 - DNA, 17 bp, Homo sapiens
atttgtttgttttcctt

SEQ ID NO: 2667712 - DNA, 19 bp, Homo sapiens
attttaagacgtgtttgtg

SEQ ID NO: 2667713 - DNA, 13 bp, Homo sapiens
attttataaacaa

SEQ ID NO: 2667714 - DNA, 15 bp, Homo sapiens
attttataagaaaaa

SEQ ID NO: 2667715 - DNA, 16 bp, Homo sapiens
attttataagaaaaac

SEQ ID NO: 2667716 - DNA, 20 bp, Homo sapiens
attttataagaaaaactttt

SEQ ID NO: 2667717 - DNA, 21 bp, Homo sapiens
attttatgccttttatttctt

SEQ ID NO: 2667718 - DNA, 20 bp, Homo sapiens
attttcacacaatacaataa

SEQ ID NO: 2667719 - DNA, 13 bp, Homo sapiens
attttcatttgtt

SEQ ID NO: 2667720 - DNA, 15 bp, Homo sapiens
attttcctctgcttt

SEQ ID NO: 2667721 - DNA, 19 bp, Homo sapiens
attttgatcttcaacaaat

SEQ ID NO: 2667722 - DNA, 15 bp, Homo sapiens
attttgcataataaa

SEQ ID NO: 2667723 - DNA, 12 bp, Homo sapiens
atttttatccat

SEQ ID NO: 2667724 - DNA, 12 bp, Homo sapiens
attttttaaagc

SEQ ID NO: 2667725 - DNA, 21 bp, Homo sapiens
attttttaaccccgtcaacaa

SEQ ID NO: 2667726 - DNA, 21 bp, Homo sapiens
attttttggttaagctttgac

SEQ ID NO: 2667727 - DNA, 15 bp, Homo sapiens
attttttttaaacaa

SEQ ID NO: 2667728 - DNA, 13 bp, Homo sapiens
caaaacaaaacaa

SEQ ID NO: 2667729 - DNA, 14 bp, Homo sapiens
caaaagctgctcag

SEQ ID NO: 2667730 - DNA, 15 bp, Homo sapiens
caaaatggataaaat

SEQ ID NO: 2667731 - DNA, 23 bp, Homo sapiens
caaacacattaagccttccacac

SEQ ID NO: 2667732 - DNA, 12 bp, Homo sapiens
caaaccttcaca

SEQ ID NO: 2667733 - DNA, 23 bp, Homo sapiens
caaacttccagtgcaacactgaa

SEQ ID NO: 2667734 - DNA, 22 bp, Homo sapiens
caaagaacatgtagaaaacaaa

SEQ ID NO: 2667735 - DNA, 21 bp, Homo sapiens
caaagagaaaaagaaatgcaa

SEQ ID NO: 2667736 - DNA, 19 bp, Homo sapiens
caaaggccagacctgcaga

SEQ ID NO: 2667737 - DNA, 20 bp, Homo sapiens
caaaggccagacctgcagac

SEQ ID NO: 2667738 - DNA, 21 bp, Homo sapiens
caaagggtccagaaggagaca

SEQ ID NO: 2667739 - DNA, 18 bp, Homo sapiens
caaagttccaaaatgcca

SEQ ID NO: 2667740 - DNA, 15 bp, Homo sapiens
caaatagcacttgac

SEQ ID NO: 2667741 - DNA, 23 bp, Homo sapiens
caaatctaggaaaatattttgat

SEQ ID NO: 2667742 - DNA, 17 bp, Homo sapiens
caaattttatttgtagg

SEQ ID NO: 2667743 - DNA, 22 bp, Homo sapiens
caacaaatctaggaaaatattt

SEQ ID NO: 2667744 - DNA, 12 bp, Homo sapiens
caacacaaagag

SEQ ID NO: 2667745 - DNA, 15 bp, Homo sapiens
caacacaaagagaaa

SEQ ID NO: 2667746 - DNA, 20 bp, Homo sapiens
caacacaaagagaaaaagaa

SEQ ID NO: 2667747 - DNA, 10 bp, Homo sapiens
caacagaaaa

SEQ ID NO: 2667748 - DNA, 17 bp, Homo sapiens
caaccagggagctgcag

SEQ ID NO: 2667749 - DNA, 21 bp, Homo sapiens
caacccttctcctcttgtaaa

SEQ ID NO: 2667750 - DNA, 16 bp, Homo sapiens
caacctgaacctagga

SEQ ID NO: 2667751 - DNA, 13 bp, Homo sapiens
caagaagggctgc

SEQ ID NO: 2667752 - DNA, 16 bp, Homo sapiens
caagaagggctgcatg

SEQ ID NO: 2667753 - DNA, 19 bp, Homo sapiens
caagaagggctgcatgatg

SEQ ID NO: 2667754 - DNA, 15 bp, Homo sapiens
caagacctcagggca

SEQ ID NO: 2667755 - DNA, 16 bp, Homo sapiens
caagacctcagggcac

SEQ ID NO: 2667756 - DNA, 16 bp, Homo sapiens
caagactgttagccct

SEQ ID NO: 2667757 - DNA, 13 bp, Homo sapiens
caagattcccagg

SEQ ID NO: 2667758 - DNA, 13 bp, Homo sapiens
caagcaagactga

SEQ ID NO: 2667759 - DNA, 22 bp, Homo sapiens
caagccagcgggaatggcagct

SEQ ID NO: 2667760 - DNA, 16 bp, Homo sapiens
caagcccccccttcca

SEQ ID NO: 2667761 - DNA, 18 bp, Homo sapiens
caagcccccccttccact

SEQ ID NO: 2667762 - DNA, 23 bp, Homo sapiens
caaggagatgaagcaaacacatt

SEQ ID NO: 2667763 - DNA, 23 bp, Homo sapiens
caaggccatccttccctgtctgc

SEQ ID NO: 2667764 - DNA, 16 bp, Homo sapiens
caaggcccagatgtgg

SEQ ID NO: 2667765 - DNA, 16 bp, Homo sapiens
caaggtaactgtactg

SEQ ID NO: 2667766 - DNA, 22 bp, Homo sapiens
caaggtaactgtactgggccat

SEQ ID NO: 2667767 - DNA, 21 bp, Homo sapiens
caaggttatatgcactttctc

SEQ ID NO: 2667768 - DNA, 16 bp, Homo sapiens
caagtagcatttactg

SEQ ID NO: 2667769 - DNA, 15 bp, Homo sapiens
cctgccaccctgggc

SEQ ID NO: 2667770 - DNA, 24 bp, Homo sapiens
cctgccaccctgggcctggcagct

SEQ ID NO: 2667771 - DNA, 20 bp, Homo sapiens
cctgcccccgcatcccctgc

SEQ ID NO: 2667772 - DNA, 14 bp, Homo sapiens
cctggatgttgctg

SEQ ID NO: 2667773 - DNA, 14 bp, Homo sapiens
cctggcagctcagc

SEQ ID NO: 2667774 - DNA, 18 bp, Homo sapiens
cctgtaatcccagcactt

SEQ ID NO: 2667775 - DNA, 22 bp, Homo sapiens
cctgtcctcccagctcctcact

SEQ ID NO: 2667776 - DNA, 16 bp, Homo sapiens
cctgtctcctggcggt

SEQ ID NO: 2667777 - DNA, 16 bp, Homo sapiens
cctgtgcctccatcag

SEQ ID NO: 2667778 - DNA, 21 bp, Homo sapiens
cctgttgaattttgttctctg

SEQ ID NO: 2667779 - DNA, 22 bp, Homo sapiens
ccttatctccaagaccagagat

SEQ ID NO: 2667780 - DNA, 22 bp, Homo sapiens
ccttcagtaacccccactggac

SEQ ID NO: 2667781 - DNA, 17 bp, Homo sapiens
ccttccttgtagccttt

SEQ ID NO: 2667782 - DNA, 15 bp, Homo sapiens
ccttcgacagcattt

SEQ ID NO: 2667783 - DNA, 17 bp, Homo sapiens
ccttctggcctcccaca

SEQ ID NO: 2667784 - DNA, 20 bp, Homo sapiens
ccttctggcctcccacagac

SEQ ID NO: 2667785 - DNA, 15 bp, Homo sapiens
cctttctcctttgta

SEQ ID NO: 2667786 - DNA, 15 bp, Homo sapiens
cctttggcagagttc

SEQ ID NO: 2667787 - DNA, 13 bp, Homo sapiens
ccttttatttctt

SEQ ID NO: 2667788 - DNA, 15 bp, Homo sapiens
cgaagaagagccaca

SEQ ID NO: 2667789 - DNA, 18 bp, Homo sapiens
cgaatgacaaaatcatct

SEQ ID NO: 2667790 - DNA, 16 bp, Homo sapiens
cgagaccagcctggcc

SEQ ID NO: 2667791 - DNA, 17 bp, Homo sapiens
cgagggcagcgggagcc

SEQ ID NO: 2667792 - DNA, 12 bp, Homo sapiens
cgcactgcctct

SEQ ID NO: 2667793 - DNA, 12 bp, Homo sapiens
cgcactgtggat

SEQ ID NO: 2667794 - DNA, 24 bp, Homo sapiens
cgcaggaagacccaacacatggga

SEQ ID NO: 2667795 - DNA, 15 bp, Homo sapiens
cgcatcccctgcctc

SEQ ID NO: 2667796 - DNA, 12 bp, Homo sapiens
cgcccaaggccc

SEQ ID NO: 2667797 - DNA, 14 bp, Homo sapiens
cgcccagtccttcc

SEQ ID NO: 2667798 - DNA, 15 bp, Homo sapiens
cgccccctgccctcc

SEQ ID NO: 2667799 - DNA, 14 bp, Homo sapiens
cgccgcctggtact

SEQ ID NO: 2667800 - DNA, 20 bp, Homo sapiens
cgccgcctggtactcaagcc

SEQ ID NO: 2667801 - DNA, 14 bp, Homo sapiens
cgcctcccactggg

SEQ ID NO: 2667802 - DNA, 22 bp, Homo sapiens
cgcggcggagctggccccgccg

SEQ ID NO: 2667803 - DNA, 15 bp, Homo sapiens
cgcggggacattggg

SEQ ID NO: 2667804 - DNA, 22 bp, Homo sapiens
cgctcacctttgtttagaacac

SEQ ID NO: 2667805 - DNA, 12 bp, Homo sapiens
cggacaccccct

SEQ ID NO: 2667806 - DNA, 21 bp, Homo sapiens
cggagctggccccgccgcctg

SEQ ID NO: 2667807 - DNA, 20 bp, Homo sapiens
cggccctcctaccctgcgcc

SEQ ID NO: 2667808 - DNA, 19 bp, Homo sapiens
cggcggagctggccccgcc

SEQ ID NO: 2667809 - DNA, 21 bp, Homo sapiens
cggcggagctggccccgccgc

SEQ ID NO: 2667810 - DNA, 19 bp, Homo sapiens
cgggagcctccctgcctca

SEQ ID NO: 2667811 - DNA, 16 bp, Homo sapiens
cgggcgcactgcctct

SEQ ID NO: 2667812 - DNA, 22 bp, Homo sapiens
cgggcgcactgcctctcacagc

SEQ ID NO: 2667813 - DNA, 18 bp, Homo sapiens
cggtgggcacccaccctg

SEQ ID NO: 2667814 - DNA, 11 bp, Homo sapiens
cgtccagggag

SEQ ID NO: 2667815 - DNA, 15 bp, Homo sapiens
cgtcgccctcccagg

SEQ ID NO: 2667816 - DNA, 22 bp, Homo sapiens
cgtgatcaaagccacactctgg

SEQ ID NO: 2667817 - DNA, 23 bp, Homo sapiens
cgtttacaagcccccccttccac

SEQ ID NO: 2667818 - DNA, 20 bp, Homo sapiens
cgtttgaagacattgcacca

SEQ ID NO: 2667819 - DNA, 19 bp, Homo sapiens
ctaaagagtttattttaag

SEQ ID NO: 2667820 - DNA, 15 bp, Homo sapiens
ctaacaccagacaga

SEQ ID NO: 2667821 - DNA, 17 bp, Homo sapiens
ctaatagactaaatgaa

SEQ ID NO: 2667822 - DNA, 13 bp, Homo sapiens
ctactaaaactac

SEQ ID NO: 2667823 - DNA, 20 bp, Homo sapiens
ctactcaagtagcatttact

SEQ ID NO: 2667824 - DNA, 18 bp, Homo sapiens
ctactgcaccatttaaaa

SEQ ID NO: 2667825 - DNA, 13 bp, Homo sapiens
ctacttgctctgg

SEQ ID NO: 2667826 - DNA, 16 bp, Homo sapiens
ctacttgctctggacc

SEQ ID NO: 2667827 - DNA, 21 bp, Homo sapiens
ctacttgctctggacctgccc

SEQ ID NO: 2667828 - DNA, 14 bp, Homo sapiens
ctagagctttcttt

SEQ ID NO: 2667829 - DNA, 21 bp, Homo sapiens
ctagagggacctctcccaggg

SEQ ID NO: 2667830 - DNA, 18 bp, Homo sapiens
ctagccggccactttgga

SEQ ID NO: 2667831 - DNA, 17 bp, Homo sapiens
ctaggaaaatattttga

SEQ ID NO: 2667832 - DNA, 20 bp, Homo sapiens
ctaggccaggtgcaaccagg

SEQ ID NO: 2667833 - DNA, 19 bp, Homo sapiens
ctaggcctcctggcccagg

SEQ ID NO: 2667834 - DNA, 13 bp, Homo sapiens
ctatattgtacac

SEQ ID NO: 2667835 - DNA, 14 bp, Homo sapiens
ctatattgtacaca

SEQ ID NO: 2667836 - DNA, 9 bp, Homo sapiens
ctatttaag

SEQ ID NO: 2667837 - DNA, 12 bp, Homo sapiens
ctatttctcttt

SEQ ID NO: 2667838 - DNA, 14 bp, Homo sapiens
ctatttctctttct

SEQ ID NO: 2667839 - DNA, 16 bp, Homo sapiens
ctatttgagactcctc

SEQ ID NO: 2667840 - DNA, 21 bp, Homo sapiens
ctatttgcaattcctgctcct

SEQ ID NO: 2667841 - DNA, 13 bp, Homo sapiens
ctcaaaggccaga

SEQ ID NO: 2667842 - DNA, 15 bp, Homo sapiens
ctcaagattcccagg

SEQ ID NO: 2667843 - DNA, 11 bp, Homo sapiens
ctcaatatttt

SEQ ID NO: 2667844 - DNA, 18 bp, Homo sapiens
ctcaatattttccatgaa

SEQ ID NO: 2667845 - DNA, 17 bp, Homo sapiens
ctcacaacctgaaccta

SEQ ID NO: 2667846 - DNA, 23 bp, Homo sapiens
ctcacaccaggcttgcctgcagg

SEQ ID NO: 2667847 - DNA, 15 bp, Homo sapiens
ctcacagctgagttg

SEQ ID NO: 2667848 - DNA, 15 bp, Homo sapiens
ctcagccctgaccct

SEQ ID NO: 2667849 - DNA, 17 bp, Homo sapiens
ctcagctcttggctcca

SEQ ID NO: 2667850 - DNA, 20 bp, Homo sapiens
ctcagggaaaagcagctctc

SEQ ID NO: 2667851 - DNA, 22 bp, Homo sapiens
ctcagggaaaagcagctctccc

SEQ ID NO: 2667852 - DNA, 13 bp, Homo sapiens
ctcatcctgcagg

SEQ ID NO: 2667853 - DNA, 14 bp, Homo sapiens
ctcatcctgcaggc

SEQ ID NO: 2667854 - DNA, 15 bp, Homo sapiens
ctcatgttctgcttt

SEQ ID NO: 2667855 - DNA, 16 bp, Homo sapiens
ctcatgttctgctttc

SEQ ID NO: 2667856 - DNA, 14 bp, Homo sapiens
ctcattctaatgat

SEQ ID NO: 2667857 - DNA, 14 bp, Homo sapiens
ctccaaaccttcac

SEQ ID NO: 2667858 - DNA, 15 bp, Homo sapiens
ctccaaaccttcaca

SEQ ID NO: 2667859 - DNA, 16 bp, Homo sapiens
ctccaactcagaaggg

SEQ ID NO: 2667860 - DNA, 18 bp, Homo sapiens
ctccaatttttttttcct

SEQ ID NO: 2667861 - DNA, 20 bp, Homo sapiens
ctccacaccattcaggtctt

SEQ ID NO: 2667862 - DNA, 23 bp, Homo sapiens
ctccagaagatagcttcacccca

SEQ ID NO: 2667863 - DNA, 20 bp, Homo sapiens
ctccagagtggggatgacat

SEQ ID NO: 2667864 - DNA, 19 bp, Homo sapiens
ctccagtctgatctgtgaa

SEQ ID NO: 2667865 - DNA, 17 bp, Homo sapiens
ctcccaggtgcagccag

SEQ ID NO: 2667866 - DNA, 16 bp, Homo sapiens
ctccccctagccattt

SEQ ID NO: 2667867 - DNA, 18 bp, Homo sapiens
ctccctgcctcaggcctc

SEQ ID NO: 2667868 - DNA, 21 bp, Homo sapiens
ctccggccctcctaccctgcg

SEQ ID NO: 2667869 - DNA, 14 bp, Homo sapiens
ctcctcttgtaaat

SEQ ID NO: 2667870 - DNA, 20 bp, Homo sapiens
ctcctttgtactttgtgctt

SEQ ID NO: 2667871 - DNA, 23 bp, Homo sapiens
ctcgacgtttacaagccccccct

SEQ ID NO: 2667872 - DNA, 13 bp, Homo sapiens
ctcgcaggaagac

SEQ ID NO: 2667873 - DNA, 16 bp, Homo sapiens
ctcgttctccctggga

SEQ ID NO: 2667874 - DNA, 21 bp, Homo sapiens
ctctaacaatgtattttcttc

SEQ ID NO: 2667875 - DNA, 18 bp, Homo sapiens
ctctcatcgccagacaac

SEQ ID NO: 2667876 - DNA, 11 bp, Homo sapiens
ctctcccaggg

SEQ ID NO: 2667877 - DNA, 13 bp, Homo sapiens
ctctgcagggccg

SEQ ID NO: 2667878 - DNA, 22 bp, Homo sapiens
ctctgcgtgcagggacaaagag

SEQ ID NO: 2667879 - DNA, 13 bp, Homo sapiens
ctctgctttgaaa

SEQ ID NO: 2667880 - DNA, 12 bp, Homo sapiens
ctctggacctgc

SEQ ID NO: 2667881 - DNA, 13 bp, Homo sapiens
ctctggacctgcc

SEQ ID NO: 2667882 - DNA, 12 bp, Homo sapiens
ctctgggagaaa

SEQ ID NO: 2667883 - DNA, 20 bp, Homo sapiens
ctctgggagaaaatcatcaa

SEQ ID NO: 2667884 - DNA, 14 bp, Homo sapiens
ctctgtgtctgagt

SEQ ID NO: 2667885 - DNA, 19 bp, Homo sapiens
ctcttcaggttgtaaaaaa

SEQ ID NO: 2667886 - DNA, 15 bp, Homo sapiens
ctcttctcagccact

SEQ ID NO: 2667887 - DNA, 21 bp, Homo sapiens
ctcttgaagacactgaaatat

SEQ ID NO: 2667888 - DNA, 14 bp, Homo sapiens
gccatttttactgt

SEQ ID NO: 2667889 - DNA, 22 bp, Homo sapiens
gcccagattatgagacacagga

SEQ ID NO: 2667890 - DNA, 17 bp, Homo sapiens
gcccagtccttccacct

SEQ ID NO: 2667891 - DNA, 17 bp, Homo sapiens
gcccattctacttgctc

SEQ ID NO: 2667892 - DNA, 19 bp, Homo sapiens
gcccattctacttgctctg

SEQ ID NO: 2667893 - DNA, 21 bp, Homo sapiens
gcccattctacttgctctgga

SEQ ID NO: 2667894 - DNA, 21 bp, Homo sapiens
gccccaggcagggccaaccct

SEQ ID NO: 2667895 - DNA, 11 bp, Homo sapiens
gccccctgccc

SEQ ID NO: 2667896 - DNA, 22 bp, Homo sapiens
gcccctttacggacaccccctc

SEQ ID NO: 2667897 - DNA, 22 bp, Homo sapiens
gccgcaaaccacactggactcc

SEQ ID NO: 2667898 - DNA, 19 bp, Homo sapiens
gccgcaccattgaactgta

SEQ ID NO: 2667899 - DNA, 14 bp, Homo sapiens
gccgcccaaggccc

SEQ ID NO: 2667900 - DNA, 13 bp, Homo sapiens
gccgcctggtact

SEQ ID NO: 2667901 - DNA, 18 bp, Homo sapiens
gccgcctggtactcaagc

SEQ ID NO: 2667902 - DNA, 14 bp, Homo sapiens
gcctaggccaggtg

SEQ ID NO: 2667903 - DNA, 13 bp, Homo sapiens
gcctcccactggg

SEQ ID NO: 2667904 - DNA, 18 bp, Homo sapiens
gcctccccctagccattt

SEQ ID NO: 2667905 - DNA, 15 bp, Homo sapiens
gcctctggaaagcaa

SEQ ID NO: 2667906 - DNA, 15 bp, Homo sapiens
gcctgataagcttca

SEQ ID NO: 2667907 - DNA, 20 bp, Homo sapiens
gcctggatgttgctgtgcac

SEQ ID NO: 2667908 - DNA, 20 bp, Homo sapiens
gcctggcagctcagcttccc

SEQ ID NO: 2667909 - DNA, 16 bp, Homo sapiens
gccttttgactttcat

SEQ ID NO: 2667910 - DNA, 13 bp, Homo sapiens
gcgcactgcctct

SEQ ID NO: 2667911 - DNA, 19 bp, Homo sapiens
gcgcccagtccttccacct

SEQ ID NO: 2667912 - DNA, 17 bp, Homo sapiens
gcgccgcaaaccacact

SEQ ID NO: 2667913 - DNA, 19 bp, Homo sapiens
gcgccgcaaaccacactgg

SEQ ID NO: 2667914 - DNA, 15 bp, Homo sapiens
gcggacagtggcagg

SEQ ID NO: 2667915 - DNA, 16 bp, Homo sapiens
gcggacagtggcagga

SEQ ID NO: 2667916 - DNA, 16 bp, Homo sapiens
gcggaggagagagagg

SEQ ID NO: 2667917 - DNA, 18 bp, Homo sapiens
gcgggcaggggagggtca

SEQ ID NO: 2667918 - DNA, 18 bp, Homo sapiens
gcggtgggcacccaccct

SEQ ID NO: 2667919 - DNA, 16 bp, Homo sapiens
gctaaagcccagagac

SEQ ID NO: 2667920 - DNA, 15 bp, Homo sapiens
gctacacctttctcc

SEQ ID NO: 2667921 - DNA, 22 bp, Homo sapiens
gctacccgcagagttctcagaa

SEQ ID NO: 2667922 - DNA, 19 bp, Homo sapiens
gctatttgcaattcctgct

SEQ ID NO: 2667923 - DNA, 16 bp, Homo sapiens
gctcagaccagctctt

SEQ ID NO: 2667924 - DNA, 17 bp, Homo sapiens
gctcctctccagtctga

SEQ ID NO: 2667925 - DNA, 17 bp, Homo sapiens
gctcctgagggagctcc

SEQ ID NO: 2667926 - DNA, 19 bp, Homo sapiens
gctcctgagggagctccaa

SEQ ID NO: 2667927 - DNA, 12 bp, Homo sapiens
gctctggacctg

SEQ ID NO: 2667928 - DNA, 15 bp, Homo sapiens
gctctggacctgccc

SEQ ID NO: 2667929 - DNA, 17 bp, Homo sapiens
gctctggacctgccccc

SEQ ID NO: 2667930 - DNA, 13 bp, Homo sapiens
gctctttgcacta

SEQ ID NO: 2667931 - DNA, 15 bp, Homo sapiens
gctgaggcaattcta

SEQ ID NO: 2667932 - DNA, 22 bp, Homo sapiens
gctgagtgaaaaatctgtggaa

SEQ ID NO: 2667933 - DNA, 21 bp, Homo sapiens
gctgagttgttgagtctgttt

SEQ ID NO: 2667934 - DNA, 22 bp, Homo sapiens
gctgatgactcaagattcccag

SEQ ID NO: 2667935 - DNA, 22 bp, Homo sapiens
gctgcatcccccccacctctcc

SEQ ID NO: 2667936 - DNA, 19 bp, Homo sapiens
gctgcatgatgtttgccca

SEQ ID NO: 2667937 - DNA, 15 bp, Homo sapiens
gctgcggagcaagag

SEQ ID NO: 2667938 - DNA, 20 bp, Homo sapiens
gctgctcagggaaaagcagc

SEQ ID NO: 2667939 - DNA, 21 bp, Homo sapiens
gctggcatgatccaagcaaga

SEQ ID NO: 2667940 - DNA, 22 bp, Homo sapiens
gctggccccgccgcctggtact

SEQ ID NO: 2667941 - DNA, 24 bp, Homo sapiens
gctggccccgccgcctggtactca

SEQ ID NO: 2667942 - DNA, 20 bp, Homo sapiens
gctgggcacacgcctcccac

SEQ ID NO: 2667943 - DNA, 17 bp, Homo sapiens
gctgtaaatttggcttc

SEQ ID NO: 2667944 - DNA, 19 bp, Homo sapiens
gctgtcctcaggtggccat

SEQ ID NO: 2667945 - DNA, 17 bp, Homo sapiens
gcttacggccctggcct

SEQ ID NO: 2667946 - DNA, 19 bp, Homo sapiens
gcttcaccccaatcccagc

SEQ ID NO: 2667947 - DNA, 17 bp, Homo sapiens
gcttcactcctgctgta

SEQ ID NO: 2667948 - DNA, 20 bp, Homo sapiens
gcttcactcctgctgtaaat

SEQ ID NO: 2667949 - DNA, 17 bp, Homo sapiens
gcttcagaattaaaact

SEQ ID NO: 2667950 - DNA, 21 bp, Homo sapiens
gcttcctgtcctcccagctcc

SEQ ID NO: 2667951 - DNA, 16 bp, Homo sapiens
gcttctgttgtcacct

SEQ ID NO: 2667952 - DNA, 17 bp, Homo sapiens
gcttctgttgtcacctt

SEQ ID NO: 2667953 - DNA, 19 bp, Homo sapiens
gcttctgttgtcaccttca

SEQ ID NO: 2667954 - DNA, 18 bp, Homo sapiens
gcttggaaactggatgag

SEQ ID NO: 2667955 - DNA, 16 bp, Homo sapiens
gcttggacggctgggc

SEQ ID NO: 2667956 - DNA, 23 bp, Homo sapiens
gcttgttaatgctttctgaagct

SEQ ID NO: 2667957 - DNA, 20 bp, Homo sapiens
gctttagaaaggttttgagc

SEQ ID NO: 2667958 - DNA, 15 bp, Homo sapiens
gctttgggagaatgt

SEQ ID NO: 2667959 - DNA, 18 bp, Homo sapiens
ggaaaagcagctctcccc

SEQ ID NO: 2667960 - DNA, 20 bp, Homo sapiens
ggaaaaggcagggagcgagg

SEQ ID NO: 2667961 - DNA, 12 bp, Homo sapiens
ggaaaatatttt

SEQ ID NO: 2667962 - DNA, 13 bp, Homo sapiens
ggaaacaacagct

SEQ ID NO: 2667963 - DNA, 17 bp, Homo sapiens
ggaaactggatgaggtc

SEQ ID NO: 2667964 - DNA, 21 bp, Homo sapiens
ggaaccgtaggacccaagcag

SEQ ID NO: 2667965 - DNA, 13 bp, Homo sapiens
ggaacttgagaac

SEQ ID NO: 2667966 - DNA, 18 bp, Homo sapiens
ggaagacccaacacatgg

SEQ ID NO: 2667967 - DNA, 22 bp, Homo sapiens
ggaaggggacccccgccccctg

SEQ ID NO: 2667968 - DNA, 19 bp, Homo sapiens
ggaaggtgggcgggcaggg

SEQ ID NO: 2667969 - DNA, 13 bp, Homo sapiens
ggacacaggcctg

SEQ ID NO: 2667970 - DNA, 14 bp, Homo sapiens
ggacagtggcagga

SEQ ID NO: 2667971 - DNA, 16 bp, Homo sapiens
ggacagtggcaggaca

SEQ ID NO: 2667972 - DNA, 17 bp, Homo sapiens
ggacagtggcaggacag

SEQ ID NO: 2667973 - DNA, 14 bp, Homo sapiens
ggacccccgccccc

SEQ ID NO: 2667974 - DNA, 20 bp, Homo sapiens
ggacccccgccccctgccct

SEQ ID NO: 2667975 - DNA, 14 bp, Homo sapiens
ggacctctcccagg

SEQ ID NO: 2667976 - DNA, 15 bp, Homo sapiens
ggacctctcccaggg

SEQ ID NO: 2667977 - DNA, 20 bp, Homo sapiens
ggacgaagaagagccacagt

SEQ ID NO: 2667978 - DNA, 15 bp, Homo sapiens
ggacggctgggcaca

SEQ ID NO: 2667979 - DNA, 21 bp, Homo sapiens
ggactagagggacctctccca

SEQ ID NO: 2667980 - DNA, 18 bp, Homo sapiens
ggagaaaatcatcaagaa

SEQ ID NO: 2667981 - DNA, 17 bp, Homo sapiens
ggagacaggcagagctg

SEQ ID NO: 2667982 - DNA, 21 bp, Homo sapiens
ggagacctggacacaggcctg

SEQ ID NO: 2667983 - DNA, 15 bp, Homo sapiens
ggagcaagaggaggc

SEQ ID NO: 2667984 - DNA, 12 bp, Homo sapiens
ggagctggcccc

SEQ ID NO: 2667985 - DNA, 16 bp, Homo sapiens
ggagctggccccgccg

SEQ ID NO: 2667986 - DNA, 16 bp, Homo sapiens
ggaggccagtgagcca

SEQ ID NO: 2667987 - DNA, 16 bp, Homo sapiens
ggaggtgtctgtatca

SEQ ID NO: 2667988 - DNA, 14 bp, Homo sapiens
ggataattagcatc

SEQ ID NO: 2667989 - DNA, 18 bp, Homo sapiens
ggatctatacttgctttg

SEQ ID NO: 2667990 - DNA, 13 bp, Homo sapiens
ggatgcagcatta

SEQ ID NO: 2667991 - DNA, 17 bp, Homo sapiens
ggcacaaagggcccaga

SEQ ID NO: 2667992 - DNA, 17 bp, Homo sapiens
ggcacacgcctcccact

SEQ ID NO: 2667993 - DNA, 19 bp, Homo sapiens
ggcacacgcctcccactgg

SEQ ID NO: 2667994 - DNA, 23 bp, Homo sapiens
ggcacaggccatggatggaaaac

SEQ ID NO: 2667995 - DNA, 14 bp, Homo sapiens
ggcaggacaggaaa

SEQ ID NO: 2667996 - DNA, 18 bp, Homo sapiens
ggcagtttaaagcacaat

SEQ ID NO: 2667997 - DNA, 14 bp, Homo sapiens
ggcatttcccccac

SEQ ID NO: 2667998 - DNA, 14 bp, Homo sapiens
ggccaaacaagtgt

SEQ ID NO: 2667999 - DNA, 13 bp, Homo sapiens
ggccaacatggta

SEQ ID NO: 2668000 - DNA, 22 bp, Homo sapiens
ggccagagctacccgcagagtt

SEQ ID NO: 2668001 - DNA, 15 bp, Homo sapiens
ggccaggccagctgc

SEQ ID NO: 2668002 - DNA, 21 bp, Homo sapiens
ggccatctggttaggatggca

SEQ ID NO: 2668003 - DNA, 14 bp, Homo sapiens
ggccatgcctcagc

SEQ ID NO: 2668004 - DNA, 16 bp, Homo sapiens
ggccatgttgtgcctc

SEQ ID NO: 2668005 - DNA, 15 bp, Homo sapiens
ggcccaggtgagtcc

SEQ ID NO: 2668006 - DNA, 22 bp, Homo sapiens
tctgctcaggagacctggagga

SEQ ID NO: 2668007 - DNA, 16 bp, Homo sapiens
tctgctggttttaaca

SEQ ID NO: 2668008 - DNA, 21 bp, Homo sapiens
tctgctgttctctagaaagaa

SEQ ID NO: 2668009 - DNA, 16 bp, Homo sapiens
tctgttgtcaccttca

SEQ ID NO: 2668010 - DNA, 18 bp, Homo sapiens
tctgttgtcaccttcacc

SEQ ID NO: 2668011 - DNA, 15 bp, Homo sapiens
tctgttttgtaaagt

SEQ ID NO: 2668012 - DNA, 22 bp, Homo sapiens
tcttaaggaacatctctgcttt

SEQ ID NO: 2668013 - DNA, 18 bp, Homo sapiens
tcttaatattctggagtc

SEQ ID NO: 2668014 - DNA, 18 bp, Homo sapiens
tcttattcaaagaaatat

SEQ ID NO: 2668015 - DNA, 14 bp, Homo sapiens
tcttattctttcgt

SEQ ID NO: 2668016 - DNA, 21 bp, Homo sapiens
tcttattctttcgttcagtta

SEQ ID NO: 2668017 - DNA, 20 bp, Homo sapiens
tcttcatttgaatgtcttct

SEQ ID NO: 2668018 - DNA, 22 bp, Homo sapiens
tcttgaatctagggagggggaa

SEQ ID NO: 2668019 - DNA, 15 bp, Homo sapiens
tctttcacaaaaaag

SEQ ID NO: 2668020 - DNA, 15 bp, Homo sapiens
tctttttttctttgg

SEQ ID NO: 2668021 - DNA, 23 bp, Homo sapiens
tgaaaatgcaacaacatgtataa

SEQ ID NO: 2668022 - DNA, 15 bp, Homo sapiens
tgaaagccccagaaa

SEQ ID NO: 2668023 - DNA, 19 bp, Homo sapiens
tgaaatgcagagtcaatga

SEQ ID NO: 2668024 - DNA, 20 bp, Homo sapiens
tgaacaccattgaaggctta

SEQ ID NO: 2668025 - DNA, 21 bp, Homo sapiens
tgaacctaggagtgccccatt

SEQ ID NO: 2668026 - DNA, 20 bp, Homo sapiens
tgaacgatatgtagcagaaa

SEQ ID NO: 2668027 - DNA, 13 bp, Homo sapiens
tgaagcctttctt

SEQ ID NO: 2668028 - DNA, 16 bp, Homo sapiens
tgaaggtttctgaaaa

SEQ ID NO: 2668029 - DNA, 18 bp, Homo sapiens
tgaaggtttctgaaaatt

SEQ ID NO: 2668030 - DNA, 13 bp, Homo sapiens
tgaatctttgtgc

SEQ ID NO: 2668031 - DNA, 15 bp, Homo sapiens
tgaatgaaccttctg

SEQ ID NO: 2668032 - DNA, 16 bp, Homo sapiens
tgaatgaaccttctgg

SEQ ID NO: 2668033 - DNA, 22 bp, Homo sapiens
tgaatgcagtctgtccaggctc

SEQ ID NO: 2668034 - DNA, 23 bp, Homo sapiens
tgaatgcagtctgtccaggctcg

SEQ ID NO: 2668035 - DNA, 15 bp, Homo sapiens
tgaattgtttgaacc

SEQ ID NO: 2668036 - DNA, 19 bp, Homo sapiens
tgaattttgttctctggga

SEQ ID NO: 2668037 - DNA, 22 bp, Homo sapiens
tgaattttgttctctgggagaa

SEQ ID NO: 2668038 - DNA, 15 bp, Homo sapiens
tgacaactacagaaa

SEQ ID NO: 2668039 - DNA, 18 bp, Homo sapiens
tgacatgcactcagctct

SEQ ID NO: 2668040 - DNA, 17 bp, Homo sapiens
tgaccctgtatatagcc

SEQ ID NO: 2668041 - DNA, 20 bp, Homo sapiens
tgaccctgtatatagcccag

SEQ ID NO: 2668042 - DNA, 20 bp, Homo sapiens
tgacctggtccacagggcac

SEQ ID NO: 2668043 - DNA, 19 bp, Homo sapiens
tgactcaagattcccagga

SEQ ID NO: 2668044 - DNA, 20 bp, Homo sapiens
tgactcaagattcccaggag

SEQ ID NO: 2668045 - DNA, 22 bp, Homo sapiens
tgactcaagattcccaggagtt

SEQ ID NO: 2668046 - DNA, 15 bp, Homo sapiens
tgactttcattggaa

SEQ ID NO: 2668047 - DNA, 22 bp, Homo sapiens
tgagaaattcaacgttaataat

SEQ ID NO: 2668048 - DNA, 20 bp, Homo sapiens
tgagaagaaaatggaaccag

SEQ ID NO: 2668049 - DNA, 16 bp, Homo sapiens
tgagacacaggatgaa

SEQ ID NO: 2668050 - DNA, 14 bp, Homo sapiens
tgagaggcatttcc

SEQ ID NO: 2668051 - DNA, 16 bp, Homo sapiens
tgagattaattccttt

SEQ ID NO: 2668052 - DNA, 21 bp, Homo sapiens
tgagctcccaggtgcagccag

SEQ ID NO: 2668053 - DNA, 16 bp, Homo sapiens
tgagctctttgcacta

SEQ ID NO: 2668054 - DNA, 14 bp, Homo sapiens
tgagggagatccca

SEQ ID NO: 2668055 - DNA, 23 bp, Homo sapiens
tgaggggtcgacttcgggctggc

SEQ ID NO: 2668056 - DNA, 16 bp, Homo sapiens
tgagtctgttttgtaa

SEQ ID NO: 2668057 - DNA, 18 bp, Homo sapiens
tgagtctgttttgtaaag

SEQ ID NO: 2668058 - DNA, 14 bp, Homo sapiens
tgatatccttctag

SEQ ID NO: 2668059 - DNA, 18 bp, Homo sapiens
tgatccaagcaagactga

SEQ ID NO: 2668060 - DNA, 20 bp, Homo sapiens
tgatgacaactacagaaaaa

SEQ ID NO: 2668061 - DNA, 15 bp, Homo sapiens
tgatgtttgcccaaa

SEQ ID NO: 2668062 - DNA, 19 bp, Homo sapiens
tgatgtttgcccaaaattt

SEQ ID NO: 2668063 - DNA, 19 bp, Homo sapiens
tgattaattaaatagcttt

SEQ ID NO: 2668064 - DNA, 17 bp, Homo sapiens
tgatttccccttttgca

SEQ ID NO: 2668065 - DNA, 23 bp, Homo sapiens
tgatttccccttttgcattctcc

SEQ ID NO: 2668066 - DNA, 20 bp, Homo sapiens
tgcaaccagggagctgcagg

SEQ ID NO: 2668067 - DNA, 15 bp, Homo sapiens
tgcacaaagtggcat

SEQ ID NO: 2668068 - DNA, 15 bp, Homo sapiens
tgcaggccaggccag

SEQ ID NO: 2668069 - DNA, 18 bp, Homo sapiens
tgcaggtagacctgtctc

SEQ ID NO: 2668070 - DNA, 18 bp, Homo sapiens
tgcataaggtttttatgc

SEQ ID NO: 2668071 - DNA, 19 bp, Homo sapiens
tgcataataaatgcttcag

SEQ ID NO: 2668072 - DNA, 12 bp, Homo sapiens
tgcataccaacc

SEQ ID NO: 2668073 - DNA, 14 bp, Homo sapiens
tgcataccaacctg

SEQ ID NO: 2668074 - DNA, 24 bp, Homo sapiens
tgcatattttgtaacttccatgtg

SEQ ID NO: 2668075 - DNA, 17 bp, Homo sapiens
tgcatcccccccacctc

SEQ ID NO: 2668076 - DNA, 13 bp, Homo sapiens
tgcatgaaggttt

SEQ ID NO: 2668077 - DNA, 14 bp, Homo sapiens
tgcatgatgtttgc

SEQ ID NO: 2668078 - DNA, 21 bp, Homo sapiens
tgcattctccctccttccctt

SEQ ID NO: 2668079 - DNA, 18 bp, Homo sapiens
tgcccagcggacagtggc

SEQ ID NO: 2668080 - DNA, 16 bp, Homo sapiens
tgccctaatgtctgta

SEQ ID NO: 2668081 - DNA, 18 bp, Homo sapiens
tgcccttggcacccaaga

SEQ ID NO: 2668082 - DNA, 16 bp, Homo sapiens
tgccgcgtcgccctcc

SEQ ID NO: 2668083 - DNA, 15 bp, Homo sapiens
tgcctagaggcccca

SEQ ID NO: 2668084 - DNA, 17 bp, Homo sapiens
tgctaaagccttcctat

SEQ ID NO: 2668085 - DNA, 22 bp, Homo sapiens
tgctaactagcttggaaactgg

SEQ ID NO: 2668086 - DNA, 15 bp, Homo sapiens
tgctacaggggccag

SEQ ID NO: 2668087 - DNA, 14 bp, Homo sapiens
tgctcagaccagct

SEQ ID NO: 2668088 - DNA, 19 bp, Homo sapiens
tgctcattctaatgatggc

SEQ ID NO: 2668089 - DNA, 12 bp, Homo sapiens
tgctctgcttca

SEQ ID NO: 2668090 - DNA, 13 bp, Homo sapiens
tgctctggacctg

SEQ ID NO: 2668091 - DNA, 14 bp, Homo sapiens
tgctgcatacattc

SEQ ID NO: 2668092 - DNA, 15 bp, Homo sapiens
tgctgcggagcaaga

SEQ ID NO: 2668093 - DNA, 23 bp, Homo sapiens
tgctgcgtcattacagggcacag

SEQ ID NO: 2668094 - DNA, 18 bp, Homo sapiens
tgctgtcctcaggtggcc

SEQ ID NO: 2668095 - DNA, 17 bp, Homo sapiens
tgctgtgaaattcccaa

SEQ ID NO: 2668096 - DNA, 14 bp, Homo sapiens
tgcttaatgaaaag

SEQ ID NO: 2668097 - DNA, 22 bp, Homo sapiens
tgcttccatggccgtgtagaag

SEQ ID NO: 2668098 - DNA, 20 bp, Homo sapiens
tgcttgttaatgctttctga

SEQ ID NO: 2668099 - DNA, 23 bp, Homo sapiens
tgctttctgaagctttaccagct

SEQ ID NO: 2668100 - DNA, 14 bp, Homo sapiens
tgctttgtgttctt

SEQ ID NO: 2668101 - DNA, 19 bp, Homo sapiens
tggaaagacagcttctcat

SEQ ID NO: 2668102 - DNA, 21 bp, Homo sapiens
tggaaaggagcctaggccagg

SEQ ID NO: 2668103 - DNA, 14 bp, Homo sapiens
tggacccagacaca

SEQ ID NO: 2668104 - DNA, 14 bp, Homo sapiens
tggagtcattctca

SEQ ID NO: 2668105 - DNA, 23 bp, Homo sapiens
tggatgcggaacccaaattacgt

SEQ ID NO: 2668106 - DNA, 13 bp, Homo sapiens
tggattatttcat

SEQ ID NO: 2668107 - DNA, 23 bp, Homo sapiens
tggatttcccatcccctgtggga

SEQ ID NO: 2668108 - DNA, 14 bp, Homo sapiens
tggcaacctgcttc

SEQ ID NO: 2668109 - DNA, 18 bp, Homo sapiens
tggcacagcccaaagaag

SEQ ID NO: 2668110 - DNA, 20 bp, Homo sapiens
tggcacagcccaaagaagga

SEQ ID NO: 2668111 - DNA, 13 bp, Homo sapiens
tggcaggacagga

SEQ ID NO: 2668112 - DNA, 16 bp, Homo sapiens
tggcatgatccaagca

SEQ ID NO: 2668113 - DNA, 17 bp, Homo sapiens
tggccatgatgacaact

SEQ ID NO: 2668114 - DNA, 14 bp, Homo sapiens
tggccatgcctcag

SEQ ID NO: 2668115 - DNA, 20 bp, Homo sapiens
tggcccattctacttgctct

SEQ ID NO: 2668116 - DNA, 18 bp, Homo sapiens
tggccttgggccctctgg

SEQ ID NO: 2668117 - DNA, 19 bp, Homo sapiens
tggctcacacctgtaatcc

SEQ ID NO: 2668118 - DNA, 20 bp, Homo sapiens
tggctgcatcccccccacct

SEQ ID NO: 2668119 - DNA, 18 bp, Homo sapiens
tggcttcactcctgctgt

SEQ ID NO: 2668120 - DNA, 22 bp, Homo sapiens
tgggaacttattaaatggaaac

SEQ ID NO: 2668121 - DNA, 22 bp, Homo sapiens
tgggaaggggacccccgccccc

SEQ ID NO: 2668122 - DNA, 23 bp, Homo sapiens
tgggacctataactgcccagcgg

SEQ ID NO: 2668123 - DNA, 15 bp, Homo sapiens
ggggacccccgcccc

SEQ ID NO: 2668124 - DNA, 20 bp, Homo sapiens
ggggagggtgacagtggccg

SEQ ID NO: 2668125 - DNA, 22 bp, Homo sapiens
ggggcgccgcaaaccacactgg

SEQ ID NO: 2668126 - DNA, 16 bp, Homo sapiens
gggtcagaaacaggac

SEQ ID NO: 2668127 - DNA, 18 bp, Homo sapiens
gggtcagaaacaggaccg

SEQ ID NO: 2668128 - DNA, 18 bp, Homo sapiens
gggtcagccagggcctgc

SEQ ID NO: 2668129 - DNA, 18 bp, Homo sapiens
gggtcatagatgtttcct

SEQ ID NO: 2668130 - DNA, 17 bp, Homo sapiens
gggtccagaaggagaca

SEQ ID NO: 2668131 - DNA, 16 bp, Homo sapiens
gggtccagggagcagg

SEQ ID NO: 2668132 - DNA, 17 bp, Homo sapiens
gggtccagggagcaggc

SEQ ID NO: 2668133 - DNA, 12 bp, Homo sapiens
gggtgaaggctg

SEQ ID NO: 2668134 - DNA, 13 bp, Homo sapiens
gggtgaaggctgg

SEQ ID NO: 2668135 - DNA, 20 bp, Homo sapiens
gggttcacctgggctgaggc

SEQ ID NO: 2668136 - DNA, 21 bp, Homo sapiens
gggttggagcagtagctggag

SEQ ID NO: 2668137 - DNA, 20 bp, Homo sapiens
ggtaccagttgaaatttttg

SEQ ID NO: 2668138 - DNA, 16 bp, Homo sapiens
ggtcatagcagtgctt

SEQ ID NO: 2668139 - DNA, 15 bp, Homo sapiens
ggtccacagggcacc

SEQ ID NO: 2668140 - DNA, 12 bp, Homo sapiens
ggtgacagtggc

SEQ ID NO: 2668141 - DNA, 19 bp, Homo sapiens
ggtgctgtcctcaggtggc

SEQ ID NO: 2668142 - DNA, 19 bp, Homo sapiens
ggtggcgggcacctgtaat

SEQ ID NO: 2668143 - DNA, 21 bp, Homo sapiens
ggtggtgcaggtagacctgtc

SEQ ID NO: 2668144 - DNA, 23 bp, Homo sapiens
ggtgtagctcttagaggaaggag

SEQ ID NO: 2668145 - DNA, 15 bp, Homo sapiens
ggttttctgttactt

SEQ ID NO: 2668146 - DNA, 19 bp, Homo sapiens
gtaaaagaaagaaagaaaa

SEQ ID NO: 2668147 - DNA, 19 bp, Homo sapiens
gtaaaataaatattgtctt

SEQ ID NO: 2668148 - DNA, 20 bp, Homo sapiens
gtaaaataaatattgtcttt

SEQ ID NO: 2668149 - DNA, 20 bp, Homo sapiens
gtaaacgctgtccctagtaa

SEQ ID NO: 2668150 - DNA, 16 bp, Homo sapiens
gtaaagtccccagaga

SEQ ID NO: 2668151 - DNA, 17 bp, Homo sapiens
gtaatctgagaaacaat

SEQ ID NO: 2668152 - DNA, 22 bp, Homo sapiens
gtagaacacaaggtcatttgct

SEQ ID NO: 2668153 - DNA, 22 bp, Homo sapiens
gtagaattatctaatttataaa

SEQ ID NO: 2668154 - DNA, 19 bp, Homo sapiens
gtagacctgtctcctggcg

SEQ ID NO: 2668155 - DNA, 16 bp, Homo sapiens
gtagatgttctacttt

SEQ ID NO: 2668156 - DNA, 15 bp, Homo sapiens
gtagcagtagatgca

SEQ ID NO: 2668157 - DNA, 20 bp, Homo sapiens
gtagcatttactgtgtcttt

SEQ ID NO: 2668158 - DNA, 16 bp, Homo sapiens
gtagccttttgacttt

SEQ ID NO: 2668159 - DNA, 15 bp, Homo sapiens
gtataatatttttaa

SEQ ID NO: 2668160 - DNA, 19 bp, Homo sapiens
gtatacttccttatgcttc

SEQ ID NO: 2668161 - DNA, 21 bp, Homo sapiens
gtatatattttttaaaaatct

SEQ ID NO: 2668162 - DNA, 21 bp, Homo sapiens
gtatcactctgtgtctgagtg

SEQ ID NO: 2668163 - DNA, 20 bp, Homo sapiens
gtcaaacaaactctctgaac

SEQ ID NO: 2668164 - DNA, 12 bp, Homo sapiens
gtcaacaaatct

SEQ ID NO: 2668165 - DNA, 10 bp, Homo sapiens
gtcagccagg

SEQ ID NO: 2668166 - DNA, 11 bp, Homo sapiens
gtccagaagga

SEQ ID NO: 2668167 - DNA, 23 bp, Homo sapiens
gtccccagagaaagcgcagatgc

SEQ ID NO: 2668168 - DNA, 17 bp, Homo sapiens
gtcctcaggtggccatg

SEQ ID NO: 2668169 - DNA, 15 bp, Homo sapiens
gtcctcccagctcct

SEQ ID NO: 2668170 - DNA, 17 bp, Homo sapiens
gtcctctgaatgaacct

SEQ ID NO: 2668171 - DNA, 20 bp, Homo sapiens
gtcctctttacatgaaacta

SEQ ID NO: 2668172 - DNA, 18 bp, Homo sapiens
gtcgacttcgggctggcc

SEQ ID NO: 2668173 - DNA, 18 bp, Homo sapiens
gtcgcgcaccgaaaaact

SEQ ID NO: 2668174 - DNA, 15 bp, Homo sapiens
gtctgagtggcttca

SEQ ID NO: 2668175 - DNA, 15 bp, Homo sapiens
gtctgttttgtaaag

SEQ ID NO: 2668176 - DNA, 20 bp, Homo sapiens
gtgaaagcatcacttgggat

SEQ ID NO: 2668177 - DNA, 18 bp, Homo sapiens
gtgaacttcttgaatcta

SEQ ID NO: 2668178 - DNA, 22 bp, Homo sapiens
gtgagctcccaggtgcagccag

SEQ ID NO: 2668179 - DNA, 19 bp, Homo sapiens
gtgagtcctagagctacag

SEQ ID NO: 2668180 - DNA, 23 bp, Homo sapiens
gtgcacaaagtggcataaaaaac

SEQ ID NO: 2668181 - DNA, 13 bp, Homo sapiens
gtgcagccagagg

SEQ ID NO: 2668182 - DNA, 17 bp, Homo sapiens
gtgcagggacaaagagg

SEQ ID NO: 2668183 - DNA, 15 bp, Homo sapiens
gtgcaggtagacctg

SEQ ID NO: 2668184 - DNA, 21 bp, Homo sapiens
gtgcaggtagacctgtctcct

SEQ ID NO: 2668185 - DNA, 17 bp, Homo sapiens
gtgccattttgcatttt

SEQ ID NO: 2668186 - DNA, 12 bp, Homo sapiens
gtgcctccctgg

SEQ ID NO: 2668187 - DNA, 23 bp, Homo sapiens
gtgctgagttggtgttgacatgt

SEQ ID NO: 2668188 - DNA, 18 bp, Homo sapiens
gtgctgtcctcaggtggc

SEQ ID NO: 2668189 - DNA, 18 bp, Homo sapiens
gtggaaatgcgcatgagt

SEQ ID NO: 2668190 - DNA, 14 bp, Homo sapiens
gtggcaacctgctt

SEQ ID NO: 2668191 - DNA, 17 bp, Homo sapiens
gtggctattaaaactct

SEQ ID NO: 2668192 - DNA, 19 bp, Homo sapiens
gtggctattaaaactcttt

SEQ ID NO: 2668193 - DNA, 20 bp, Homo sapiens
gtgggcacccaccctgggac

SEQ ID NO: 2668194 - DNA, 23 bp, Homo sapiens
gtgggcgggcaggggagggtcag

SEQ ID NO: 2668195 - DNA, 14 bp, Homo sapiens
gtgggtcaaggaat

SEQ ID NO: 2668196 - DNA, 23 bp, Homo sapiens
gtggttaatgccatggacagaag

SEQ ID NO: 2668197 - DNA, 13 bp, Homo sapiens
gtgtactcccagg

SEQ ID NO: 2668198 - DNA, 18 bp, Homo sapiens
gtgtatttaacagggagg

SEQ ID NO: 2668199 - DNA, 17 bp, Homo sapiens
gtgtgtgctctgcttca

SEQ ID NO: 2668200 - DNA, 13 bp, Homo sapiens
gtgttctttgtgt

SEQ ID NO: 2668201 - DNA, 14 bp, Homo sapiens
gttaagctttgaca

SEQ ID NO: 2668202 - DNA, 19 bp, Homo sapiens
gttcaaggccatccttccc

SEQ ID NO: 2668203 - DNA, 20 bp, Homo sapiens
gttcactcttctcagccact

SEQ ID NO: 2668204 - DNA, 12 bp, Homo sapiens
gttctctagaaa

SEQ ID NO: 2668205 - DNA, 19 bp, Homo sapiens
ttccagtgcaacactgaag

SEQ ID NO: 2668206 - DNA, 17 bp, Homo sapiens
ttccctgcttaatgaaa

SEQ ID NO: 2668207 - DNA, 15 bp, Homo sapiens
ttcctctgctttgaa

SEQ ID NO: 2668208 - DNA, 23 bp, Homo sapiens
ttcctgagggatctatacttgct

SEQ ID NO: 2668209 - DNA, 14 bp, Homo sapiens
ttcctgtcctccca

SEQ ID NO: 2668210 - DNA, 23 bp, Homo sapiens
ttcgacagcattttcctctgctt

SEQ ID NO: 2668211 - DNA, 14 bp, Homo sapiens
ttcgggctggccat

SEQ ID NO: 2668212 - DNA, 23 bp, Homo sapiens
ttctaatgatggcccattctact

SEQ ID NO: 2668213 - DNA, 13 bp, Homo sapiens
ttctacttgctct

SEQ ID NO: 2668214 - DNA, 23 bp, Homo sapiens
ttctacttgctctggacctgccc

SEQ ID NO: 2668215 - DNA, 19 bp, Homo sapiens
ttctataaaatactggtat

SEQ ID NO: 2668216 - DNA, 17 bp, Homo sapiens
ttctcctcttgtaaata

SEQ ID NO: 2668217 - DNA, 22 bp, Homo sapiens
ttctcctcttgtaaataaagcc

SEQ ID NO: 2668218 - DNA, 18 bp, Homo sapiens
ttctctgaggaagctggg

SEQ ID NO: 2668219 - DNA, 15 bp, Homo sapiens
ttctctgggagaaaa

SEQ ID NO: 2668220 - DNA, 23 bp, Homo sapiens
ttctctgggagaaaatcatcaag

SEQ ID NO: 2668221 - DNA, 16 bp, Homo sapiens
ttctctttctttacaa

SEQ ID NO: 2668222 - DNA, 19 bp, Homo sapiens
ttctgctcattctaatgat

SEQ ID NO: 2668223 - DNA, 18 bp, Homo sapiens
ttctgctggaaacagact

SEQ ID NO: 2668224 - DNA, 14 bp, Homo sapiens
tggactccggccct

SEQ ID NO: 2668225 - DNA, 13 bp, Homo sapiens
tggcaacctgctt

SEQ ID NO: 2668226 - DNA, 17 bp, Homo sapiens
tggcaagggttcacctg

SEQ ID NO: 2668227 - DNA, 23 bp, Homo sapiens
tggcacccaagacctcagggcac

SEQ ID NO: 2668228 - DNA, 22 bp, Homo sapiens
tggcagaatggggtgcatgaag

SEQ ID NO: 2668229 - DNA, 22 bp, Homo sapiens
tggcagatgtaaagttattctt

SEQ ID NO: 2668230 - DNA, 16 bp, Homo sapiens
tggcagctgccacgcc

SEQ ID NO: 2668231 - DNA, 16 bp, Homo sapiens
tggccaaacaagtgtt

SEQ ID NO: 2668232 - DNA, 15 bp, Homo sapiens
tggccatgcctcagc

SEQ ID NO: 2668233 - DNA, 17 bp, Homo sapiens
tggcccattctacttgc

SEQ ID NO: 2668234 - DNA, 22 bp, Homo sapiens
tggcccattctacttgctctgg

SEQ ID NO: 2668235 - DNA, 13 bp, Homo sapiens
tggccccgccgcc

SEQ ID NO: 2668236 - DNA, 15 bp, Homo sapiens
tggccccgccgcctg

SEQ ID NO: 2668237 - DNA, 18 bp, Homo sapiens
tggcttctctgaggaagc

SEQ ID NO: 2668238 - DNA, 14 bp, Homo sapiens
tggctttaatgaat

SEQ ID NO: 2668239 - DNA, 19 bp, Homo sapiens
tgggacctaggggcgccgc

SEQ ID NO: 2668240 - DNA, 15 bp, Homo sapiens
tgggagaaaatcatc

SEQ ID NO: 2668241 - DNA, 15 bp, Homo sapiens
tgggcaatatagcaa

SEQ ID NO: 2668242 - DNA, 22 bp, Homo sapiens
tgggcacacgcctcccactggg

SEQ ID NO: 2668243 - DNA, 14 bp, Homo sapiens
tgggcacccaccct

SEQ ID NO: 2668244 - DNA, 13 bp, Homo sapiens
tgggccctctggt

SEQ ID NO: 2668245 - DNA, 14 bp, Homo sapiens
tggggtccagggag

SEQ ID NO: 2668246 - DNA, 15 bp, Homo sapiens
tgggtgaaggctggc

SEQ ID NO: 2668247 - DNA, 21 bp, Homo sapiens
tgggttcatcctattctttcg

SEQ ID NO: 2668248 - DNA, 17 bp, Homo sapiens
tggtaattcttattctt

SEQ ID NO: 2668249 - DNA, 19 bp, Homo sapiens
tggtattcgcttgagaaaa

SEQ ID NO: 2668250 - DNA, 16 bp, Homo sapiens
tggtcaaacaaactct

SEQ ID NO: 2668251 - DNA, 21 bp, Homo sapiens
tggtcaaacaaactctctgaa

SEQ ID NO: 2668252 - DNA, 21 bp, Homo sapiens
tggtccacagggcacctgcca

SEQ ID NO: 2668253 - DNA, 20 bp, Homo sapiens
tggtcttaaggaacatctct

SEQ ID NO: 2668254 - DNA, 23 bp, Homo sapiens
tggtgcaggtagacctgtctcct

SEQ ID NO: 2668255 - DNA, 15 bp, Homo sapiens
tggtgggagggggag

SEQ ID NO: 2668256 - DNA, 20 bp, Homo sapiens
tggttaaaaaaaagaataaa

SEQ ID NO: 2668257 - DNA, 16 bp, Homo sapiens
tggttaagctttgaca

SEQ ID NO: 2668258 - DNA, 13 bp, Homo sapiens
tggttaatgccat

SEQ ID NO: 2668259 - DNA, 21 bp, Homo sapiens
tggtttgccggtggtgcaggt

SEQ ID NO: 2668260 - DNA, 12 bp, Homo sapiens
tgtaaaacaggt

SEQ ID NO: 2668261 - DNA, 22 bp, Homo sapiens
tgtaaaacaggtagaattatct

SEQ ID NO: 2668262 - DNA, 16 bp, Homo sapiens
tgtaaatctgctcagg

SEQ ID NO: 2668263 - DNA, 15 bp, Homo sapiens
tgtactgggccatgt

SEQ ID NO: 2668264 - DNA, 17 bp, Homo sapiens
tgtatgttttttttctg

SEQ ID NO: 2668265 - DNA, 16 bp, Homo sapiens
tgtatttaaaaaaatc

SEQ ID NO: 2668266 - DNA, 18 bp, Homo sapiens
tgtatttaacagggaggg

SEQ ID NO: 2668267 - DNA, 22 bp, Homo sapiens
tgtattttcttcacctctgcta

SEQ ID NO: 2668268 - DNA, 20 bp, Homo sapiens
tgtcacgttttgttttgtgc

SEQ ID NO: 2668269 - DNA, 17 bp, Homo sapiens
tgtcatagaaagtgcca

SEQ ID NO: 2668270 - DNA, 22 bp, Homo sapiens
tgtcatagaaagtgccagaaag

SEQ ID NO: 2668271 - DNA, 21 bp, Homo sapiens
tgtccctagtaaaaatacaaa

SEQ ID NO: 2668272 - DNA, 18 bp, Homo sapiens
tgtcctcaggtggccatg

SEQ ID NO: 2668273 - DNA, 13 bp, Homo sapiens
tgtctaaaaaaca

SEQ ID NO: 2668274 - DNA, 18 bp, Homo sapiens
tgtctaaaaaacaaaaca

SEQ ID NO: 2668275 - DNA, 22 bp, Homo sapiens
tgtgaagcacagaccccttcca

SEQ ID NO: 2668276 - DNA, 13 bp, Homo sapiens
tgtgactggtcag

SEQ ID NO: 2668277 - DNA, 16 bp, Homo sapiens
tgtgagtaatctgaga

SEQ ID NO: 2668278 - DNA, 17 bp, Homo sapiens
tgtgcaataatttacat

SEQ ID NO: 2668279 - DNA, 14 bp, Homo sapiens
tgtgcattttctaa

SEQ ID NO: 2668280 - DNA, 19 bp, Homo sapiens
tgtgccaacctattttgaa

SEQ ID NO: 2668281 - DNA, 16 bp, Homo sapiens
tgtgcctccctggtga

SEQ ID NO: 2668282 - DNA, 17 bp, Homo sapiens
tgtgctacaggggccag

SEQ ID NO: 2668283 - DNA, 16 bp, Homo sapiens
tgtggagtcattctca

SEQ ID NO: 2668284 - DNA, 20 bp, Homo sapiens
tgtgtttgttctttttattg

SEQ ID NO: 2668285 - DNA, 17 bp, Homo sapiens
tgttaacatttttggta

SEQ ID NO: 2668286 - DNA, 15 bp, Homo sapiens
tgttaatgctttctg

SEQ ID NO: 2668287 - DNA, 13 bp, Homo sapiens
tgttatcctattt

SEQ ID NO: 2668288 - DNA, 15 bp, Homo sapiens
tgttctctgggagaa

SEQ ID NO: 2668289 - DNA, 23 bp, Homo sapiens
tgttctgcccaatgcctttttga

SEQ ID NO: 2668290 - DNA, 22 bp, Homo sapiens
tgttggttaccctcctagcttt

SEQ ID NO: 2668291 - DNA, 18 bp, Homo sapiens
tgttgttccttttgaaag

SEQ ID NO: 2668292 - DNA, 22 bp, Homo sapiens
tgtttagaacactggtttaaag

SEQ ID NO: 2668293 - DNA, 14 bp, Homo sapiens
tgtttatgcttttg

SEQ ID NO: 2668294 - DNA, 12 bp, Homo sapiens
tgtttgcccaaa

SEQ ID NO: 2668295 - DNA, 12 bp, Homo sapiens
tgttttgtaaag

SEQ ID NO: 2668296 - DNA, 17 bp, Homo sapiens
tgttttgtcttacaaag

SEQ ID NO: 2668297 - DNA, 10 bp, Homo sapiens
tgtttttaaa

SEQ ID NO: 2668298 - DNA, 12 bp, Homo sapiens
tgtttttaaaag

SEQ ID NO: 2668299 - DNA, 22 bp, Homo sapiens
ttaaacaaatgtatgattacat

SEQ ID NO: 2668300 - DNA, 14 bp, Homo sapiens
ttaaagcaaaggag

SEQ ID NO: 2668301 - DNA, 19 bp, Homo sapiens
ttaacactgcttgtgtttt

SEQ ID NO: 2668302 - DNA, 14 bp, Homo sapiens
ttaacagaaaaaca

SEQ ID NO: 2668303 - DNA, 19 bp, Homo sapiens
ttaactattttattttcta

SEQ ID NO: 2668304 - DNA, 21 bp, Homo sapiens
ttaatacaatgatgctatttg

SEQ ID NO: 2668305 - DNA, 16 bp, Homo sapiens
ttaatatggggatgca

SEQ ID NO: 2668306 - DNA, 22 bp, Homo sapiens
ttaatatggggatgcagcatta

SEQ ID NO: 2668307 - DNA, 19 bp, Homo sapiens
ttaattaaatagcttttgt

SEQ ID NO: 2668308 - DNA, 12 bp, Homo sapiens
ttacaaacatgt

SEQ ID NO: 2668309 - DNA, 19 bp, Homo sapiens
ttacaacccggttcactct

SEQ ID NO: 2668310 - DNA, 19 bp, Homo sapiens
ttacaagcccccccttcca

SEQ ID NO: 2668311 - DNA, 20 bp, Homo sapiens
ttacaagcccccccttccac

SEQ ID NO: 2668312 - DNA, 18 bp, Homo sapiens
ttacatcaaggcttcaaa

SEQ ID NO: 2668313 - DNA, 14 bp, Homo sapiens
ttaccaatcatatt

SEQ ID NO: 2668314 - DNA, 23 bp, Homo sapiens
ttacctttttgaaaaagaaaaca

SEQ ID NO: 2668315 - DNA, 24 bp, Homo sapiens
ttactggtaggaacttgagaactt

SEQ ID NO: 2668316 - DNA, 19 bp, Homo sapiens
ttagaataataaatattta

SEQ ID NO: 2668317 - DNA, 19 bp, Homo sapiens
ttagcagtaaaatagctga

SEQ ID NO: 2668318 - DNA, 15 bp, Homo sapiens
ttaggatggcaggac

SEQ ID NO: 2668319 - DNA, 14 bp, Homo sapiens
ttatactggcatgc

SEQ ID NO: 2668320 - DNA, 18 bp, Homo sapiens
ttatactttgtaaagaca

SEQ ID NO: 2668321 - DNA, 22 bp, Homo sapiens
ttatcaagagttgtgacaactt

SEQ ID NO: 2668322 - DNA, 24 bp, Homo sapiens
ttatccttttttaaaagtaaatgt

SEQ ID NO: 2668323 - DNA, 17 bp, Homo sapiens
ttatctaatttataaaa

SEQ ID NO: 2668324 - DNA, 21 bp, Homo sapiens
ttatgatgtgggtcaaggaat

SEQ ID NO: 2668325 - DNA, 15 bp, Homo sapiens
ttatgccttttattt

SEQ ID NO: 2668326 - DNA, 16 bp, Homo sapiens
ttattaaatggaaact

SEQ ID NO: 2668327 - DNA, 18 bp, Homo sapiens
ttattgaatctatttaag

SEQ ID NO: 2668328 - DNA, 20 bp, Homo sapiens
ttattgaatctatttaagta

SEQ ID NO: 2668329 - DNA, 19 bp, Homo sapiens
ttatttcttaaacaaatgt

SEQ ID NO: 2668330 - DNA, 12 bp, Homo sapiens
ttattttaagac

SEQ ID NO: 2668331 - DNA, 21 bp, Homo sapiens
ttcaaaaaaaaaaaaaagaga

SEQ ID NO: 2668332 - DNA, 15 bp, Homo sapiens
ttcaaacatttacca

SEQ ID NO: 2668333 - DNA, 16 bp, Homo sapiens
ttcaaccatgaagtct

SEQ ID NO: 2668334 - DNA, 17 bp, Homo sapiens
ttcaagttaaattttat

SEQ ID NO: 2668335 - DNA, 17 bp, Homo sapiens
ttcacaaacagaaaaca

SEQ ID NO: 2668336 - DNA, 14 bp, Homo sapiens
ttcactcctgctgt

SEQ ID NO: 2668337 - DNA, 13 bp, Homo sapiens
ttcacttcacgct

SEQ ID NO: 2668338 - DNA, 13 bp, Homo sapiens
ttcagggtcatag

SEQ ID NO: 2668339 - DNA, 14 bp, Homo sapiens
ttcagtaggaactg

SEQ ID NO: 2668340 - DNA, 16 bp, Homo sapiens
ttcagtgaaagcatca

SEQ ID NO: 2668341 - DNA, 14 bp, Homo sapiens
ttcataatctttgc

SEQ ID NO: 2668342 - DNA, 15 bp, Homo sapiens
ttcatatttctttgg

SEQ ID NO: 2668343 - DNA, 15 bp, Homo sapiens
ttcattttatgaaga

SEQ ID NO: 2668344 - DNA, 22 bp, Homo sapiens
ttccaacactgatttccccttt

SEQ ID NO: 2668345 - DNA, 13 bp, Homo sapiens
tctttttattgaa

SEQ ID NO: 2668346 - DNA, 14 bp, Homo sapiens
tctttttattgaat

SEQ ID NO: 2668347 - DNA, 20 bp, Homo sapiens
tgaaaatgcaacaacatgta

SEQ ID NO: 2668348 - DNA, 21 bp, Homo sapiens
tgaaaatgcaacaacatgtat

SEQ ID NO: 2668349 - DNA, 16 bp, Homo sapiens
tgaaaattaacactgc

SEQ ID NO: 2668350 - DNA, 11 bp, Homo sapiens
tgaaacccagt

SEQ ID NO: 2668351 - DNA, 18 bp, Homo sapiens
tgaaagtccagaaactgt

SEQ ID NO: 2668352 - DNA, 16 bp, Homo sapiens
tgaaatatacacacag

SEQ ID NO: 2668353 - DNA, 17 bp, Homo sapiens
tgaaatatacacacagc

SEQ ID NO: 2668354 - DNA, 23 bp, Homo sapiens
tgaacaagcaaacccagacggct

SEQ ID NO: 2668355 - DNA, 17 bp, Homo sapiens
tgaacagactgaccttg

SEQ ID NO: 2668356 - DNA, 21 bp, Homo sapiens
tgaacgatatgtagcagaaag

SEQ ID NO: 2668357 - DNA, 16 bp, Homo sapiens
tgaagaggatgctgtg

SEQ ID NO: 2668358 - DNA, 12 bp, Homo sapiens
tgaagcttcctt

SEQ ID NO: 2668359 - DNA, 13 bp, Homo sapiens
tgaagctttacca

SEQ ID NO: 2668360 - DNA, 16 bp, Homo sapiens
tgaaggcctcgcagga

SEQ ID NO: 2668361 - DNA, 11 bp, Homo sapiens
tgaaggctggc

SEQ ID NO: 2668362 - DNA, 12 bp, Homo sapiens
tgaaggctggca

SEQ ID NO: 2668363 - DNA, 13 bp, Homo sapiens
tgaaggctggcat

SEQ ID NO: 2668364 - DNA, 16 bp, Homo sapiens
tgaaggctggcatgat

SEQ ID NO: 2668365 - DNA, 21 bp, Homo sapiens
tgaatataatatatttgtgta

SEQ ID NO: 2668366 - DNA, 19 bp, Homo sapiens
tgaatattttcattaaaag

SEQ ID NO: 2668367 - DNA, 21 bp, Homo sapiens
tgaatattttcattaaaagct

SEQ ID NO: 2668368 - DNA, 18 bp, Homo sapiens
tgaatctatttatcttca

SEQ ID NO: 2668369 - DNA, 18 bp, Homo sapiens
tgaattgagctgcagaaa

SEQ ID NO: 2668370 - DNA, 17 bp, Homo sapiens
tgaattttgttctctgg

SEQ ID NO: 2668371 - DNA, 16 bp, Homo sapiens
tgacaactacagaaaa

SEQ ID NO: 2668372 - DNA, 17 bp, Homo sapiens
attttgatcttcaacaa

SEQ ID NO: 2668373 - DNA, 19 bp, Homo sapiens
attttgcataataaatgct

SEQ ID NO: 2668374 - DNA, 15 bp, Homo sapiens
attttgttctctggg

SEQ ID NO: 2668375 - DNA, 22 bp, Homo sapiens
attttgttctctgggagaaaat

SEQ ID NO: 2668376 - DNA, 15 bp, Homo sapiens
attttttaaaaacta

SEQ ID NO: 2668377 - DNA, 23 bp, Homo sapiens
attttttaaaaatctatattttg

SEQ ID NO: 2668378 - DNA, 23 bp, Homo sapiens
attttttaaccccgtcaacaaat

SEQ ID NO: 2668379 - DNA, 23 bp, Homo sapiens
caaaaaaacctcttaatattctg

SEQ ID NO: 2668380 - DNA, 23 bp, Homo sapiens
caaaatggataaaatctgatatg

SEQ ID NO: 2668381 - DNA, 19 bp, Homo sapiens
caaaatttattttataaga

SEQ ID NO: 2668382 - DNA, 13 bp, Homo sapiens
caaacacattaag

SEQ ID NO: 2668383 - DNA, 20 bp, Homo sapiens
caaactaggggacaaagcaa

SEQ ID NO: 2668384 - DNA, 14 bp, Homo sapiens
caaactctctgaac

SEQ ID NO: 2668385 - DNA, 16 bp, Homo sapiens
caaagagaaaaagaaa

SEQ ID NO: 2668386 - DNA, 17 bp, Homo sapiens
caaagagaaaaagaaat

SEQ ID NO: 2668387 - DNA, 19 bp, Homo sapiens
caaagagaaaaagaaatgc

SEQ ID NO: 2668388 - DNA, 16 bp, Homo sapiens
caaaggagtagaaaga

SEQ ID NO: 2668389 - DNA, 21 bp, Homo sapiens
caaaggccagacctgcagacg

SEQ ID NO: 2668390 - DNA, 22 bp, Homo sapiens
caaaggccagacctgcagacgc

SEQ ID NO: 2668391 - DNA, 15 bp, Homo sapiens
caaatgctaatgtca

SEQ ID NO: 2668392 - DNA, 19 bp, Homo sapiens
caaattactctttctccat

SEQ ID NO: 2668393 - DNA, 13 bp, Homo sapiens
caacacaaagaga

SEQ ID NO: 2668394 - DNA, 23 bp, Homo sapiens
caacacaaagagaaaaagaaatg

SEQ ID NO: 2668395 - DNA, 15 bp, Homo sapiens
caacacgcaggagca

SEQ ID NO: 2668396 - DNA, 19 bp, Homo sapiens
caacatgtataatattttt

SEQ ID NO: 2668397 - DNA, 23 bp, Homo sapiens
caacatgtataatatttttaatt

SEQ ID NO: 2668398 - DNA, 23 bp, Homo sapiens
caacccttctcctcttgtaaata

SEQ ID NO: 2668399 - DNA, 15 bp, Homo sapiens
caacctattttgaag

SEQ ID NO: 2668400 - DNA, 16 bp, Homo sapiens
caacctattttgaagt

SEQ ID NO: 2668401 - DNA, 13 bp, Homo sapiens
caacctgaaccta

SEQ ID NO: 2668402 - DNA, 14 bp, Homo sapiens
caagaagggctgca

SEQ ID NO: 2668403 - DNA, 15 bp, Homo sapiens
caagaagggctgcat

SEQ ID NO: 2668404 - DNA, 12 bp, Homo sapiens
caagagctgagg

SEQ ID NO: 2668405 - DNA, 16 bp, Homo sapiens
caagattcccaggagt

SEQ ID NO: 2668406 - DNA, 14 bp, Homo sapiens
caagcaaacccaga

SEQ ID NO: 2668407 - DNA, 17 bp, Homo sapiens
caagcaaacccagacgg

SEQ ID NO: 2668408 - DNA, 14 bp, Homo sapiens
caagcaagactgag

SEQ ID NO: 2668409 - DNA, 21 bp, Homo sapiens
caagcccctgctccagaagat

SEQ ID NO: 2668410 - DNA, 13 bp, Homo sapiens
caaggagatgaag

SEQ ID NO: 2668411 - DNA, 20 bp, Homo sapiens
caaggagggtgagtgcaagg

SEQ ID NO: 2668412 - DNA, 17 bp, Homo sapiens
caaggccatccttccct

SEQ ID NO: 2668413 - DNA, 16 bp, Homo sapiens
caataaaaaaaagaaa

SEQ ID NO: 2668414 - DNA, 20 bp, Homo sapiens
caataaaaaaaagaaatgaa

SEQ ID NO: 2668415 - DNA, 13 bp, Homo sapiens
caatatagcaaga

SEQ ID NO: 2668416 - DNA, 14 bp, Homo sapiens
caatatcagacttt

SEQ ID NO: 2668417 - DNA, 15 bp, Homo sapiens
caatatcctttgcct

SEQ ID NO: 2668418 - DNA, 16 bp, Homo sapiens
caatattgactttgtc

SEQ ID NO: 2668419 - DNA, 11 bp, Homo sapiens
caatattttcc

SEQ ID NO: 2668420 - DNA, 17 bp, Homo sapiens
caatgatgctatttgca

SEQ ID NO: 2668421 - DNA, 19 bp, Homo sapiens
caatgatgctatttgcaat

SEQ ID NO: 2668422 - DNA, 23 bp, Homo sapiens
caatgtagtcagaattagctgct

SEQ ID NO: 2668423 - DNA, 17 bp, Homo sapiens
caatgttgttttaagac

SEQ ID NO: 2668424 - DNA, 17 bp, Homo sapiens
caattcttacaaacatg

SEQ ID NO: 2668425 - DNA, 19 bp, Homo sapiens
caattcttacaaacatgtg

SEQ ID NO: 2668426 - DNA, 12 bp, Homo sapiens
cacaaaaaagaa

SEQ ID NO: 2668427 - DNA, 18 bp, Homo sapiens
cacaaagagaaaaagaaa

SEQ ID NO: 2668428 - DNA, 14 bp, Homo sapiens
cacaacctgaacct

SEQ ID NO: 2668429 - DNA, 22 bp, Homo sapiens
cacaatctcattgaggagcatt

SEQ ID NO: 2668430 - DNA, 15 bp, Homo sapiens
cacacagactgttgt

SEQ ID NO: 2668431 - DNA, 22 bp, Homo sapiens
cacaccaggcttgcctgcaggc

SEQ ID NO: 2668432 - DNA, 19 bp, Homo sapiens
cacactggactccggccct

SEQ ID NO: 2668433 - DNA, 24 bp, Homo sapiens
cacatcagctccactttcagtgaa

SEQ ID NO: 2668434 - DNA, 18 bp, Homo sapiens
cacatggctatgttttag

SEQ ID NO: 2668435 - DNA, 15 bp, Homo sapiens
caccacgtcacttca

SEQ ID NO: 2668436 - DNA, 16 bp, Homo sapiens
caccattgaaggctta

SEQ ID NO: 2668437 - DNA, 14 bp, Homo sapiens
cacccaccctggga

SEQ ID NO: 2668438 - DNA, 23 bp, Homo sapiens
cacctaaataaccaatctacaat

SEQ ID NO: 2668439 - DNA, 23 bp, Homo sapiens
cacctcaagaagaagaggggcat

SEQ ID NO: 2668440 - DNA, 19 bp, Homo sapiens
cacctctccctgaccctgt

SEQ ID NO: 2668441 - DNA, 22 bp, Homo sapiens
cacctctgctactcaagtagca

SEQ ID NO: 2668442 - DNA, 19 bp, Homo sapiens
cacctgaactgaacaccat

SEQ ID NO: 2668443 - DNA, 15 bp, Homo sapiens
cacctgccaccctgg

SEQ ID NO: 2668444 - DNA, 20 bp, Homo sapiens
cacctgccaccctgggcctg

SEQ ID NO: 2668445 - DNA, 15 bp, Homo sapiens
caccttatatttacg

SEQ ID NO: 2668446 - DNA, 21 bp, Homo sapiens
cacctttgtttagaacactgg

SEQ ID NO: 2668447 - DNA, 15 bp, Homo sapiens
cacgcctcccactgg

SEQ ID NO: 2668448 - DNA, 15 bp, Homo sapiens
cactaatacaccagg

SEQ ID NO: 2668449 - DNA, 12 bp, Homo sapiens
cactcaaaggcc

SEQ ID NO: 2668450 - DNA, 20 bp, Homo sapiens
cactcaaaggccagacctgc

SEQ ID NO: 2668451 - DNA, 23 bp, Homo sapiens
cactcaaaggccagacctgcaga

SEQ ID NO: 2668452 - DNA, 17 bp, Homo sapiens
cactctgggctccagag

SEQ ID NO: 2668453 - DNA, 14 bp, Homo sapiens
cactcttctcagcc

SEQ ID NO: 2668454 - DNA, 17 bp, Homo sapiens
cactgagatctgtttga

SEQ ID NO: 2668455 - DNA, 16 bp, Homo sapiens
cactgcataccaacct

SEQ ID NO: 2668456 - DNA, 13 bp, Homo sapiens
cactgggaaacag

SEQ ID NO: 2668457 - DNA, 22 bp, Homo sapiens
cactgtgagctcccaggtgcag

SEQ ID NO: 2668458 - DNA, 18 bp, Homo sapiens
cacttcaggtcaggagtt

SEQ ID NO: 2668459 - DNA, 22 bp, Homo sapiens
cactttctcatgatttacagag

SEQ ID NO: 2668460 - DNA, 11 bp, Homo sapiens
cagaacactgt

SEQ ID NO: 2668461 - DNA, 15 bp, Homo sapiens
cagaagatgaacaga

SEQ ID NO: 2668462 - DNA, 13 bp, Homo sapiens
cagaaggagacag

SEQ ID NO: 2668463 - DNA, 22 bp, Homo sapiens
cagaaggagacaggcagagctg

SEQ ID NO: 2668464 - DNA, 14 bp, Homo sapiens
cagacgcccagatt

SEQ ID NO: 2668465 - DNA, 23 bp, Homo sapiens
cagactcaaatgctcagaccagc

SEQ ID NO: 2668466 - DNA, 19 bp, Homo sapiens
cagactcacaacctgaacc

SEQ ID NO: 2668467 - DNA, 22 bp, Homo sapiens
cagactgaccttgatgagctgt

SEQ ID NO: 2668468 - DNA, 17 bp, Homo sapiens
cagactgatcaggacct

SEQ ID NO: 2668469 - DNA, 16 bp, Homo sapiens
cagactgttgtccctg

SEQ ID NO: 2668470 - DNA, 20 bp, Homo sapiens
cagagctacccgcagagttc

SEQ ID NO: 2668471 - DNA, 20 bp, Homo sapiens
cagagtgcaagcccctgctc

SEQ ID NO: 2668472 - DNA, 13 bp, Homo sapiens
cagcaacagaaaa

SEQ ID NO: 2668473 - DNA, 15 bp, Homo sapiens
cagcaagtcagggtt

SEQ ID NO: 2668474 - DNA, 17 bp, Homo sapiens
cagcattgatatttgtg

SEQ ID NO: 2668475 - DNA, 21 bp, Homo sapiens
cagcattgatatttgtgcatt

SEQ ID NO: 2668476 - DNA, 22 bp, Homo sapiens
cagcattgatatttgtgcattt

SEQ ID NO: 2668477 - DNA, 15 bp, Homo sapiens
cagccaggccccagg

SEQ ID NO: 2668478 - DNA, 17 bp, Homo sapiens
cagcccaaagaaggaaa

SEQ ID NO: 2668479 - DNA, 17 bp, Homo sapiens
cagcccccacatcctgt

SEQ ID NO: 2668480 - DNA, 16 bp, Homo sapiens
cagccctgaccctgtg

SEQ ID NO: 2668481 - DNA, 20 bp, Homo sapiens
cagcggctcacgcctgtaat

SEQ ID NO: 2668482 - DNA, 16 bp, Homo sapiens
cagcgggaatggcagc

SEQ ID NO: 2668483 - DNA, 14 bp, Homo sapiens
cagctcataagagc

SEQ ID NO: 2668484 - DNA, 18 bp, Homo sapiens
cagctcttggctccactg

SEQ ID NO: 2668485 - DNA, 13 bp, Homo sapiens
cagctgatgactc

SEQ ID NO: 2668486 - DNA, 15 bp, Homo sapiens
cagctgatgactcaa

SEQ ID NO: 2668487 - DNA, 22 bp, Homo sapiens
cagctgatgactcaagattccc

SEQ ID NO: 2668488 - DNA, 19 bp, Homo sapiens
cagctggtggtatctgagt

SEQ ID NO: 2668489 - DNA, 21 bp, Homo sapiens
cagcttctcatcctgcaggca

SEQ ID NO: 2668490 - DNA, 19 bp, Homo sapiens
caggaagacccaacacatg

SEQ ID NO: 2668491 - DNA, 22 bp, Homo sapiens
caggaagacccaacacatggga

SEQ ID NO: 2668492 - DNA, 18 bp, Homo sapiens
ctactcaagtagcattta

SEQ ID NO: 2668493 - DNA, 20 bp, Homo sapiens
ctactcatacttaagcaaaa

SEQ ID NO: 2668494 - DNA, 21 bp, Homo sapiens
ctactcatacttaagcaaaag

SEQ ID NO: 2668495 - DNA, 23 bp, Homo sapiens
ctactgttttaatttatactggc

SEQ ID NO: 2668496 - DNA, 14 bp, Homo sapiens
ctacttgctctgga

SEQ ID NO: 2668497 - DNA, 17 bp, Homo sapiens
ctacttgctctggacct

SEQ ID NO: 2668498 - DNA, 22 bp, Homo sapiens
ctagagctttctttcacaaaaa

SEQ ID NO: 2668499 - DNA, 14 bp, Homo sapiens
ctagagggacctct

SEQ ID NO: 2668500 - DNA, 18 bp, Homo sapiens
ctagagggacctctccca

SEQ ID NO: 2668501 - DNA, 13 bp, Homo sapiens
ctagcacatgccc

SEQ ID NO: 2668502 - DNA, 15 bp, Homo sapiens
ctaggaaaatatttt

SEQ ID NO: 2668503 - DNA, 14 bp, Homo sapiens
ctaggatactgctg

SEQ ID NO: 2668504 - DNA, 16 bp, Homo sapiens
ctagtaaaaatacaaa

SEQ ID NO: 2668505 - DNA, 19 bp, Homo sapiens
ctatacttgctttgtgttc

SEQ ID NO: 2668506 - DNA, 18 bp, Homo sapiens
ctatgtggattttttcct

SEQ ID NO: 2668507 - DNA, 19 bp, Homo sapiens
ctatgtggattttttccta

SEQ ID NO: 2668508 - DNA, 21 bp, Homo sapiens
ctattgatataaataaaacat

SEQ ID NO: 2668509 - DNA, 14 bp, Homo sapiens
ctatttatcttcat

SEQ ID NO: 2668510 - DNA, 11 bp, Homo sapiens
ctatttgcaat

SEQ ID NO: 2668511 - DNA, 12 bp, Homo sapiens
ctattttgaagt

SEQ ID NO: 2668512 - DNA, 22 bp, Homo sapiens
ctcaaaggccagacctgcagac

SEQ ID NO: 2668513 - DNA, 20 bp, Homo sapiens
ctcaagaagaagaggggcat

SEQ ID NO: 2668514 - DNA, 13 bp, Homo sapiens
ctcaagattccca

SEQ ID NO: 2668515 - DNA, 17 bp, Homo sapiens
ctcaagattcccaggag

SEQ ID NO: 2668516 - DNA, 14 bp, Homo sapiens
ctcaagtagcattt

SEQ ID NO: 2668517 - DNA, 18 bp, Homo sapiens
ctcaagtagcatttactg

SEQ ID NO: 2668518 - DNA, 13 bp, Homo sapiens
ctcacagctgagt

SEQ ID NO: 2668519 - DNA, 23 bp, Homo sapiens
ctcaccccagactcctgactgtc

SEQ ID NO: 2668520 - DNA, 19 bp, Homo sapiens
ctcacctatccacacaaca

SEQ ID NO: 2668521 - DNA, 22 bp, Homo sapiens
ctcagaagggagctagccagag

SEQ ID NO: 2668522 - DNA, 15 bp, Homo sapiens
ctcagaccagctctt

SEQ ID NO: 2668523 - DNA, 16 bp, Homo sapiens
ctcagaccagctcttc

SEQ ID NO: 2668524 - DNA, 14 bp, Homo sapiens
ctcagccctgaccc

SEQ ID NO: 2668525 - DNA, 18 bp, Homo sapiens
ctcagctcttggctccac

SEQ ID NO: 2668526 - DNA, 22 bp, Homo sapiens
ctcagcttccccaacacgcagg

SEQ ID NO: 2668527 - DNA, 15 bp, Homo sapiens
ctcaggtggccatgc

SEQ ID NO: 2668528 - DNA, 18 bp, Homo sapiens
ctcaggtggccatgcctc

SEQ ID NO: 2668529 - DNA, 17 bp, Homo sapiens
ctcattgaattataaaa

SEQ ID NO: 2668530 - DNA, 14 bp, Homo sapiens
ctcatttaaagtat

SEQ ID NO: 2668531 - DNA, 13 bp, Homo sapiens
ctccaagccagcg

SEQ ID NO: 2668532 - DNA, 21 bp, Homo sapiens
ctccagggtcagaaacaggac

SEQ ID NO: 2668533 - DNA, 12 bp, Homo sapiens
ctcccaggctct

SEQ ID NO: 2668534 - DNA, 13 bp, Homo sapiens
ctcccaggctctc

SEQ ID NO: 2668535 - DNA, 16 bp, Homo sapiens
ctcccctcagagtgca

SEQ ID NO: 2668536 - DNA, 17 bp, Homo sapiens
ctccctgaccctgtata

SEQ ID NO: 2668537 - DNA, 19 bp, Homo sapiens
ctccctggtgagagggccg

SEQ ID NO: 2668538 - DNA, 15 bp, Homo sapiens
ctcctaccctgcgcc

SEQ ID NO: 2668539 - DNA, 17 bp, Homo sapiens
ctcctcactcaccttca

SEQ ID NO: 2668540 - DNA, 15 bp, Homo sapiens
ctcctcagttcttgc

SEQ ID NO: 2668541 - DNA, 12 bp, Homo sapiens
ctcctcttgtaa

SEQ ID NO: 2668542 - DNA, 14 bp, Homo sapiens
ctcctgctgtaaat

SEQ ID NO: 2668543 - DNA, 23 bp, Homo sapiens
ctcctgctgtaaatttggcttct

SEQ ID NO: 2668544 - DNA, 12 bp, Homo sapiens
ctcctggcccag

SEQ ID NO: 2668545 - DNA, 12 bp, Homo sapiens
ctcgcaggaaga

SEQ ID NO: 2668546 - DNA, 14 bp, Homo sapiens
ctcgcattgacaca

SEQ ID NO: 2668547 - DNA, 21 bp, Homo sapiens
ctctaaagagtttattttaag

SEQ ID NO: 2668548 - DNA, 14 bp, Homo sapiens
ctctactctgcttt

SEQ ID NO: 2668549 - DNA, 16 bp, Homo sapiens
ctctactcttacttcc

SEQ ID NO: 2668550 - DNA, 21 bp, Homo sapiens
ctctcccctcagagtgcaagc

SEQ ID NO: 2668551 - DNA, 16 bp, Homo sapiens
ctctcctcacacacag

SEQ ID NO: 2668552 - DNA, 22 bp, Homo sapiens
ctctctactaaaactacaaaaa

SEQ ID NO: 2668553 - DNA, 23 bp, Homo sapiens
ctctctactaaaactacaaaaat

SEQ ID NO: 2668554 - DNA, 19 bp, Homo sapiens
ctctgcagggccgccaggg

SEQ ID NO: 2668555 - DNA, 21 bp, Homo sapiens
ctctgtgtctgagtggcttca

SEQ ID NO: 2668556 - DNA, 13 bp, Homo sapiens
catgaaaatgcaa

SEQ ID NO: 2668557 - DNA, 21 bp, Homo sapiens
catgaagaggatgctgtgaaa

SEQ ID NO: 2668558 - DNA, 21 bp, Homo sapiens
catgatgtttgcccaaaattt

SEQ ID NO: 2668559 - DNA, 21 bp, Homo sapiens
catgcctccccctagccattt

SEQ ID NO: 2668560 - DNA, 14 bp, Homo sapiens
catggatggaaaac

SEQ ID NO: 2668561 - DNA, 19 bp, Homo sapiens
catgggcacaaagggccca

SEQ ID NO: 2668562 - DNA, 20 bp, Homo sapiens
catgtataatatttttaatt

SEQ ID NO: 2668563 - DNA, 20 bp, Homo sapiens
catgtgctacaggggccaga

SEQ ID NO: 2668564 - DNA, 16 bp, Homo sapiens
catgtggttacacagt

SEQ ID NO: 2668565 - DNA, 22 bp, Homo sapiens
cattatgatgtgggtcaaggaa

SEQ ID NO: 2668566 - DNA, 22 bp, Homo sapiens
cattctaatgatggcccattct

SEQ ID NO: 2668567 - DNA, 11 bp, Homo sapiens
cattctacttg

SEQ ID NO: 2668568 - DNA, 16 bp, Homo sapiens
cattctacttgctctg

SEQ ID NO: 2668569 - DNA, 17 bp, Homo sapiens
cattctacttgctctgg

SEQ ID NO: 2668570 - DNA, 13 bp, Homo sapiens
cattcttaaaaaa

SEQ ID NO: 2668571 - DNA, 12 bp, Homo sapiens
cattcttttgta

SEQ ID NO: 2668572 - DNA, 18 bp, Homo sapiens
cattcttttgtaatttaa

SEQ ID NO: 2668573 - DNA, 19 bp, Homo sapiens
cattcttttgtaatttaaa

SEQ ID NO: 2668574 - DNA, 17 bp, Homo sapiens
cattgaattataaaagc

SEQ ID NO: 2668575 - DNA, 15 bp, Homo sapiens
catttaaagtatttt

SEQ ID NO: 2668576 - DNA, 15 bp, Homo sapiens
catttacctttttga

SEQ ID NO: 2668577 - DNA, 21 bp, Homo sapiens
catttcccccaccccatttct

SEQ ID NO: 2668578 - DNA, 15 bp, Homo sapiens
catttctctcctcac

SEQ ID NO: 2668579 - DNA, 20 bp, Homo sapiens
catttgctaactagcttgga

SEQ ID NO: 2668580 - DNA, 12 bp, Homo sapiens
catttgtatatt

SEQ ID NO: 2668581 - DNA, 19 bp, Homo sapiens
cattttgtaacaaatgaac

SEQ ID NO: 2668582 - DNA, 20 bp, Homo sapiens
ccaaaaaagctgtattttga

SEQ ID NO: 2668583 - DNA, 23 bp, Homo sapiens
ccaaaaaagctgtattttgaaaa

SEQ ID NO: 2668584 - DNA, 21 bp, Homo sapiens
ccaaaatttattttataagaa

SEQ ID NO: 2668585 - DNA, 11 bp, Homo sapiens
ccaacccttct

SEQ ID NO: 2668586 - DNA, 24 bp, Homo sapiens
ccaacggcaagggaacaagtactt

SEQ ID NO: 2668587 - DNA, 17 bp, Homo sapiens
ccaagacctcagggcac

SEQ ID NO: 2668588 - DNA, 14 bp, Homo sapiens
ccaaggagatgaag

SEQ ID NO: 2668589 - DNA, 20 bp, Homo sapiens
ccaaggagggtgagtgcaag

SEQ ID NO: 2668590 - DNA, 13 bp, Homo sapiens
ccaatgccaaaaa

SEQ ID NO: 2668591 - DNA, 22 bp, Homo sapiens
ccacactggactccggccctcc

SEQ ID NO: 2668592 - DNA, 12 bp, Homo sapiens
ccaccctgggac

SEQ ID NO: 2668593 - DNA, 17 bp, Homo sapiens
ccacctctccctgaccc

SEQ ID NO: 2668594 - DNA, 15 bp, Homo sapiens
ccactcaaaggccag

SEQ ID NO: 2668595 - DNA, 22 bp, Homo sapiens
ccagaagatagcttcaccccaa

SEQ ID NO: 2668596 - DNA, 17 bp, Homo sapiens
ccagacagacaacactg

SEQ ID NO: 2668597 - DNA, 14 bp, Homo sapiens
ccagacctgcagac

SEQ ID NO: 2668598 - DNA, 16 bp, Homo sapiens
ccagacctgcagacgc

SEQ ID NO: 2668599 - DNA, 20 bp, Homo sapiens
ccagactcctgactgtctcc

SEQ ID NO: 2668600 - DNA, 20 bp, Homo sapiens
ccagagctacccgcagagtt

SEQ ID NO: 2668601 - DNA, 21 bp, Homo sapiens
ccagagctacccgcagagttc

SEQ ID NO: 2668602 - DNA, 20 bp, Homo sapiens
ccagaggactgtgatgccct

SEQ ID NO: 2668603 - DNA, 22 bp, Homo sapiens
ccagaggcacctcaagaagaag

SEQ ID NO: 2668604 - DNA, 18 bp, Homo sapiens
ccagaggcagcttctttg

SEQ ID NO: 2668605 - DNA, 23 bp, Homo sapiens
ccagatctacttggttgtcaagt

SEQ ID NO: 2668606 - DNA, 21 bp, Homo sapiens
ccagcagtcaattaacaataa

SEQ ID NO: 2668607 - DNA, 19 bp, Homo sapiens
ccagcggacagtggcagga

SEQ ID NO: 2668608 - DNA, 23 bp, Homo sapiens
ccaggcagggccaacccttctcc

SEQ ID NO: 2668609 - DNA, 15 bp, Homo sapiens
ccaggccagctgcct

SEQ ID NO: 2668610 - DNA, 18 bp, Homo sapiens
ccaggccttatctccaag

SEQ ID NO: 2668611 - DNA, 18 bp, Homo sapiens
ccaggcttgcctgcaggc

SEQ ID NO: 2668612 - DNA, 16 bp, Homo sapiens
gctagcacatgcccta

SEQ ID NO: 2668613 - DNA, 13 bp, Homo sapiens
gctagccagagga

SEQ ID NO: 2668614 - DNA, 15 bp, Homo sapiens
gctagccagaggact

SEQ ID NO: 2668615 - DNA, 19 bp, Homo sapiens
gctatccagctatttttat

SEQ ID NO: 2668616 - DNA, 22 bp, Homo sapiens
gctatttttatttgtttgtgca

SEQ ID NO: 2668617 - DNA, 14 bp, Homo sapiens
gctcacacctgtaa

SEQ ID NO: 2668618 - DNA, 15 bp, Homo sapiens
gctcagggaaaagca

SEQ ID NO: 2668619 - DNA, 17 bp, Homo sapiens
gctcagggaaaagcagc

SEQ ID NO: 2668620 - DNA, 15 bp, Homo sapiens
gctccaaaccttcac

SEQ ID NO: 2668621 - DNA, 22 bp, Homo sapiens
gctccaaaccttcacacacaga

SEQ ID NO: 2668622 - DNA, 20 bp, Homo sapiens
gctcccaggtgcagccagag

SEQ ID NO: 2668623 - DNA, 20 bp, Homo sapiens
gctcccctctgcacggacca

SEQ ID NO: 2668624 - DNA, 12 bp, Homo sapiens
gctctttgcact

SEQ ID NO: 2668625 - DNA, 17 bp, Homo sapiens
gctgactcacacctgaa

SEQ ID NO: 2668626 - DNA, 15 bp, Homo sapiens
gctgagcaaacatgt

SEQ ID NO: 2668627 - DNA, 18 bp, Homo sapiens
gctgagttgttgagtctg

SEQ ID NO: 2668628 - DNA, 17 bp, Homo sapiens
gctgcgtcattacaggg

SEQ ID NO: 2668629 - DNA, 21 bp, Homo sapiens
gctgctcagggaaaagcagct

SEQ ID NO: 2668630 - DNA, 20 bp, Homo sapiens
gctggaaacagactcgattc

SEQ ID NO: 2668631 - DNA, 13 bp, Homo sapiens
gctgtattttgaa

SEQ ID NO: 2668632 - DNA, 13 bp, Homo sapiens
gctgtcctcaggt

SEQ ID NO: 2668633 - DNA, 21 bp, Homo sapiens
gctgtcctcaggtggccatgc

SEQ ID NO: 2668634 - DNA, 18 bp, Homo sapiens
gctgtgcacaaagtggca

SEQ ID NO: 2668635 - DNA, 22 bp, Homo sapiens
gcttaaacccatattgtaaaac

SEQ ID NO: 2668636 - DNA, 22 bp, Homo sapiens
gcttcaacattctttgcaagat

SEQ ID NO: 2668637 - DNA, 16 bp, Homo sapiens
gcttcctgtcctccca

SEQ ID NO: 2668638 - DNA, 16 bp, Homo sapiens
gcttctcatcctgcag

SEQ ID NO: 2668639 - DNA, 22 bp, Homo sapiens
gcttctcatcctgcaggcagct

SEQ ID NO: 2668640 - DNA, 19 bp, Homo sapiens
gctttctgaagctttacca

SEQ ID NO: 2668641 - DNA, 20 bp, Homo sapiens
gctttggttatatttagctc

SEQ ID NO: 2668642 - DNA, 19 bp, Homo sapiens
ggaaaaaaatcgtccaggg

SEQ ID NO: 2668643 - DNA, 14 bp, Homo sapiens
ggaaaacgctctct

SEQ ID NO: 2668644 - DNA, 16 bp, Homo sapiens
ggaaacaacagcttta

SEQ ID NO: 2668645 - DNA, 13 bp, Homo sapiens
ggaaacagactcg

SEQ ID NO: 2668646 - DNA, 21 bp, Homo sapiens
ggaaaggagcctaggccaggt

SEQ ID NO: 2668647 - DNA, 21 bp, Homo sapiens
ggaaaggggcaggccagagct

SEQ ID NO: 2668648 - DNA, 14 bp, Homo sapiens
ggaaccaggcttgg

SEQ ID NO: 2668649 - DNA, 16 bp, Homo sapiens
ggaaccgtaggaccca

SEQ ID NO: 2668650 - DNA, 19 bp, Homo sapiens
ggaagatctctgcagggcc

SEQ ID NO: 2668651 - DNA, 20 bp, Homo sapiens
ggaatgagattaattccttt

SEQ ID NO: 2668652 - DNA, 15 bp, Homo sapiens
ggacaccccctcgct

SEQ ID NO: 2668653 - DNA, 23 bp, Homo sapiens
ggacagactcacaacctgaacct

SEQ ID NO: 2668654 - DNA, 23 bp, Homo sapiens
ggaccatgcgacactgggaggcc

SEQ ID NO: 2668655 - DNA, 15 bp, Homo sapiens
ggacccccgccccct

SEQ ID NO: 2668656 - DNA, 16 bp, Homo sapiens
ggacccccgccccctg

SEQ ID NO: 2668657 - DNA, 20 bp, Homo sapiens
ggaccgggtggaagggatgg

SEQ ID NO: 2668658 - DNA, 18 bp, Homo sapiens
ggactagagggacctctc

SEQ ID NO: 2668659 - DNA, 19 bp, Homo sapiens
ggactagagggacctctcc

SEQ ID NO: 2668660 - DNA, 18 bp, Homo sapiens
ggactgaaaacctctcct

SEQ ID NO: 2668661 - DNA, 12 bp, Homo sapiens
ggagacaggcag

SEQ ID NO: 2668662 - DNA, 14 bp, Homo sapiens
ggagcacacccagc

SEQ ID NO: 2668663 - DNA, 17 bp, Homo sapiens
ggagcctaggccaggtg

SEQ ID NO: 2668664 - DNA, 18 bp, Homo sapiens
ggagcctaggccaggtgc

SEQ ID NO: 2668665 - DNA, 18 bp, Homo sapiens
ggagcctccctgcctcag

SEQ ID NO: 2668666 - DNA, 15 bp, Homo sapiens
ggagctagccagagg

SEQ ID NO: 2668667 - DNA, 20 bp, Homo sapiens
ggaggatcttttgaacccag

SEQ ID NO: 2668668 - DNA, 20 bp, Homo sapiens
ggaggctaaagcccagagac

SEQ ID NO: 2668669 - DNA, 18 bp, Homo sapiens
ggagggggaatgtagtga

SEQ ID NO: 2668670 - DNA, 15 bp, Homo sapiens
ggagtgtactcccag

SEQ ID NO: 2668671 - DNA, 18 bp, Homo sapiens
ggagtgtactcccagggc

SEQ ID NO: 2668672 - DNA, 14 bp, Homo sapiens
ggagttctgctcat

SEQ ID NO: 2668673 - DNA, 21 bp, Homo sapiens
ggatgacatgcactcagctct

SEQ ID NO: 2668674 - DNA, 13 bp, Homo sapiens
ggattcctctttt

SEQ ID NO: 2668675 - DNA, 21 bp, Homo sapiens
ggcaatatagcaagatcccat

SEQ ID NO: 2668676 - DNA, 15 bp, Homo sapiens
ggcacacgcctccca

SEQ ID NO: 2668677 - DNA, 18 bp, Homo sapiens
ggcacacgcctcccactg

SEQ ID NO: 2668678 - DNA, 17 bp, Homo sapiens
ggcacaggccatggatg

SEQ ID NO: 2668679 - DNA, 18 bp, Homo sapiens
ggcacccaagacctcagg

SEQ ID NO: 2668680 - DNA, 23 bp, Homo sapiens
ggcactgaagggatatgtgaaac

SEQ ID NO: 2668681 - DNA, 20 bp, Homo sapiens
ggcaggggagggtcagccag

SEQ ID NO: 2668682 - DNA, 20 bp, Homo sapiens
ggcatccttcctcacaccag

SEQ ID NO: 2668683 - DNA, 16 bp, Homo sapiens
ggcatgatccaagcaa

SEQ ID NO: 2668684 - DNA, 11 bp, Homo sapiens
ggcatgctaaa

SEQ ID NO: 2668685 - DNA, 18 bp, Homo sapiens
ggccagacctgcagacgc

SEQ ID NO: 2668686 - DNA, 20 bp, Homo sapiens
ggccatccttccctgtctgc

SEQ ID NO: 2668687 - DNA, 21 bp, Homo sapiens
ggcccattctacttgctctgg

SEQ ID NO: 2668688 - DNA, 23 bp, Homo sapiens
ggcccattctacttgctctggac

SEQ ID NO: 2668689 - DNA, 18 bp, Homo sapiens
ggccccgccgcctggtac

SEQ ID NO: 2668690 - DNA, 17 bp, Homo sapiens
ggccctcctaccctgcg

SEQ ID NO: 2668691 - DNA, 21 bp, Homo sapiens
gaacaagcaaacccagacggc

SEQ ID NO: 2668692 - DNA, 16 bp, Homo sapiens
gaacaccattgaaggc

SEQ ID NO: 2668693 - DNA, 20 bp, Homo sapiens
gaacaccattgaaggcttaa

SEQ ID NO: 2668694 - DNA, 21 bp, Homo sapiens
gaacctatttctctttcttta

SEQ ID NO: 2668695 - DNA, 18 bp, Homo sapiens
gaaccttctggcctccca

SEQ ID NO: 2668696 - DNA, 18 bp, Homo sapiens
gaacgatatgtagcagaa

SEQ ID NO: 2668697 - DNA, 12 bp, Homo sapiens
gaactgaacacc

SEQ ID NO: 2668698 - DNA, 23 bp, Homo sapiens
gaactgaacaccattgaaggctt

SEQ ID NO: 2668699 - DNA, 17 bp, Homo sapiens
gaactggagccatgggc

SEQ ID NO: 2668700 - DNA, 24 bp, Homo sapiens
gaactttccacattcagagcttac

SEQ ID NO: 2668701 - DNA, 14 bp, Homo sapiens
gaagagtcctctga

SEQ ID NO: 2668702 - DNA, 14 bp, Homo sapiens
gaagctaagctgca

SEQ ID NO: 2668703 - DNA, 22 bp, Homo sapiens
gaagctgaggcaggtgaattgt

SEQ ID NO: 2668704 - DNA, 16 bp, Homo sapiens
gaaggagacaggcaga

SEQ ID NO: 2668705 - DNA, 18 bp, Homo sapiens
gaaggagacaggcagagc

SEQ ID NO: 2668706 - DNA, 18 bp, Homo sapiens
gaaggctggcatgatcca

SEQ ID NO: 2668707 - DNA, 17 bp, Homo sapiens
gaagggagctagccaga

SEQ ID NO: 2668708 - DNA, 14 bp, Homo sapiens
gaagggctgcatga

SEQ ID NO: 2668709 - DNA, 21 bp, Homo sapiens
gaaggggacccccgccccctg

SEQ ID NO: 2668710 - DNA, 12 bp, Homo sapiens
gaagtatgggaa

SEQ ID NO: 2668711 - DNA, 17 bp, Homo sapiens
gaagtgaataactgcaa

SEQ ID NO: 2668712 - DNA, 11 bp, Homo sapiens
gaataataaat

SEQ ID NO: 2668713 - DNA, 13 bp, Homo sapiens
gaatacctgtggt

SEQ ID NO: 2668714 - DNA, 13 bp, Homo sapiens
gaatataaacact

SEQ ID NO: 2668715 - DNA, 19 bp, Homo sapiens
gaatataatatatttgtgt

SEQ ID NO: 2668716 - DNA, 20 bp, Homo sapiens
gaatattttcattaaaagct

SEQ ID NO: 2668717 - DNA, 13 bp, Homo sapiens
gaatctatttaag

SEQ ID NO: 2668718 - DNA, 16 bp, Homo sapiens
gaatctatttaagtaa

SEQ ID NO: 2668719 - DNA, 15 bp, Homo sapiens
gaatgaaccttctgg

SEQ ID NO: 2668720 - DNA, 20 bp, Homo sapiens
gaatgcagtctgtccaggct

SEQ ID NO: 2668721 - DNA, 17 bp, Homo sapiens
gaatggcacagcccaaa

SEQ ID NO: 2668722 - DNA, 23 bp, Homo sapiens
gaatgttggttttaatacttgat

SEQ ID NO: 2668723 - DNA, 21 bp, Homo sapiens
gaattaagttagggaatggca

SEQ ID NO: 2668724 - DNA, 20 bp, Homo sapiens
gaattaccctttcattcagc

SEQ ID NO: 2668725 - DNA, 14 bp, Homo sapiens
gaattgcagagtac

SEQ ID NO: 2668726 - DNA, 17 bp, Homo sapiens
gaattttgttctctggg

SEQ ID NO: 2668727 - DNA, 20 bp, Homo sapiens
gaattttgttctctgggaga

SEQ ID NO: 2668728 - DNA, 19 bp, Homo sapiens
gaattttgttttcttgatt

SEQ ID NO: 2668729 - DNA, 20 bp, Homo sapiens
gacaaagaggcctttaacca

SEQ ID NO: 2668730 - DNA, 19 bp, Homo sapiens
gacaacactgggaaacaga

SEQ ID NO: 2668731 - DNA, 19 bp, Homo sapiens
gacaaggagaagagcaagg

SEQ ID NO: 2668732 - DNA, 16 bp, Homo sapiens
gacacaggatgaagca

SEQ ID NO: 2668733 - DNA, 23 bp, Homo sapiens
gacactgaaatatacacacagca

SEQ ID NO: 2668734 - DNA, 17 bp, Homo sapiens
gacactgggaggccagt

SEQ ID NO: 2668735 - DNA, 13 bp, Homo sapiens
gacagaacactgt

SEQ ID NO: 2668736 - DNA, 16 bp, Homo sapiens
gacagcattttcctct

SEQ ID NO: 2668737 - DNA, 20 bp, Homo sapiens
gacagcattttcctctgctt

SEQ ID NO: 2668738 - DNA, 14 bp, Homo sapiens
gacaggcagagctg

SEQ ID NO: 2668739 - DNA, 16 bp, Homo sapiens
gacagtgaatattcaa

SEQ ID NO: 2668740 - DNA, 23 bp, Homo sapiens
gacatccccccgccaaaagctgc

SEQ ID NO: 2668741 - DNA, 14 bp, Homo sapiens
gaccctgtggaagc

SEQ ID NO: 2668742 - DNA, 16 bp, Homo sapiens
gacctccaagccactg

SEQ ID NO: 2668743 - DNA, 17 bp, Homo sapiens
gacctggtccacagggc

SEQ ID NO: 2668744 - DNA, 13 bp, Homo sapiens
gaccttgatgagc

SEQ ID NO: 2668745 - DNA, 16 bp, Homo sapiens
gacgaagaagagccac

SEQ ID NO: 2668746 - DNA, 13 bp, Homo sapiens
gacgtgggctggg

SEQ ID NO: 2668747 - DNA, 14 bp, Homo sapiens
gactccggccctcc

SEQ ID NO: 2668748 - DNA, 16 bp, Homo sapiens
gactgaaaacctctcc

SEQ ID NO: 2668749 - DNA, 18 bp, Homo sapiens
gactgaaaacctctcctc

SEQ ID NO: 2668750 - DNA, 20 bp, Homo sapiens
gactgaaaacctctcctcat

SEQ ID NO: 2668751 - DNA, 15 bp, Homo sapiens
gactgatcaggacct

SEQ ID NO: 2668752 - DNA, 15 bp, Homo sapiens
gagaaaaagaaatgc

SEQ ID NO: 2668753 - DNA, 15 bp, Homo sapiens
gagaaaatcatcaag

SEQ ID NO: 2668754 - DNA, 18 bp, Homo sapiens
gagaaaatcatcaagaag

SEQ ID NO: 2668755 - DNA, 19 bp, Homo sapiens
gagaaagcgcagatgctag

SEQ ID NO: 2668756 - DNA, 19 bp, Homo sapiens
gagaagtgaataactgcaa

SEQ ID NO: 2668757 - DNA, 18 bp, Homo sapiens
gagaagttcatatttctt

SEQ ID NO: 2668758 - DNA, 19 bp, Homo sapiens
gagacagcttgatcaaagg

SEQ ID NO: 2668759 - DNA, 19 bp, Homo sapiens
gagacctggacacaggcct

SEQ ID NO: 2668760 - DNA, 20 bp, Homo sapiens
gagaggcaatggctccttca

SEQ ID NO: 2668761 - DNA, 13 bp, Homo sapiens
gagcaacatttta

SEQ ID NO: 2668762 - DNA, 15 bp, Homo sapiens
gagcaagaggaggcc

SEQ ID NO: 2668763 - DNA, 15 bp, Homo sapiens
ccctgaccctgtgga

SEQ ID NO: 2668764 - DNA, 14 bp, Homo sapiens
ccctgccctcccct

SEQ ID NO: 2668765 - DNA, 21 bp, Homo sapiens
ccctgcctcaggcctctgtgc

SEQ ID NO: 2668766 - DNA, 13 bp, Homo sapiens
ccctgcctccatc

SEQ ID NO: 2668767 - DNA, 18 bp, Homo sapiens
ccctgcctccatcctagt

SEQ ID NO: 2668768 - DNA, 16 bp, Homo sapiens
ccctgtctgccagggc

SEQ ID NO: 2668769 - DNA, 20 bp, Homo sapiens
cccttctcctcttgtaaata

SEQ ID NO: 2668770 - DNA, 17 bp, Homo sapiens
cccttttgcattctccc

SEQ ID NO: 2668771 - DNA, 16 bp, Homo sapiens
ccgcaaaccacactgg

SEQ ID NO: 2668772 - DNA, 17 bp, Homo sapiens
ccgcatcccctgcctcc

SEQ ID NO: 2668773 - DNA, 18 bp, Homo sapiens
ccgcatcccctgcctcca

SEQ ID NO: 2668774 - DNA, 21 bp, Homo sapiens
ccgccaaaagctgctcaggga

SEQ ID NO: 2668775 - DNA, 11 bp, Homo sapiens
ccgccccctgc

SEQ ID NO: 2668776 - DNA, 22 bp, Homo sapiens
ccgcctggtactcaagcccgcg

SEQ ID NO: 2668777 - DNA, 22 bp, Homo sapiens
ccgcgtgatcaaagccacactc

SEQ ID NO: 2668778 - DNA, 16 bp, Homo sapiens
cctaaaccaaaaactg

SEQ ID NO: 2668779 - DNA, 19 bp, Homo sapiens
cctaacatacctaagcaaa

SEQ ID NO: 2668780 - DNA, 13 bp, Homo sapiens
cctagaggcccca

SEQ ID NO: 2668781 - DNA, 20 bp, Homo sapiens
cctaggagtgccccattctt

SEQ ID NO: 2668782 - DNA, 21 bp, Homo sapiens
cctcagagtgcaagcccctgc

SEQ ID NO: 2668783 - DNA, 11 bp, Homo sapiens
cctcagggcac

SEQ ID NO: 2668784 - DNA, 11 bp, Homo sapiens
cctcaggtggc

SEQ ID NO: 2668785 - DNA, 21 bp, Homo sapiens
cctcaggtggccatgcctcag

SEQ ID NO: 2668786 - DNA, 20 bp, Homo sapiens
cctccctggtgagagggccg

SEQ ID NO: 2668787 - DNA, 20 bp, Homo sapiens
cctcgttctccctgggaggc

SEQ ID NO: 2668788 - DNA, 18 bp, Homo sapiens
cctctcctcatgttctgc

SEQ ID NO: 2668789 - DNA, 16 bp, Homo sapiens
cctctggaaagcaaag

SEQ ID NO: 2668790 - DNA, 20 bp, Homo sapiens
cctcttgtaaataaagccct

SEQ ID NO: 2668791 - DNA, 17 bp, Homo sapiens
cctgaactgaacaccat

SEQ ID NO: 2668792 - DNA, 21 bp, Homo sapiens
cctgaggcctctggaaagcaa

SEQ ID NO: 2668793 - DNA, 18 bp, Homo sapiens
cctgatttagatatgcaa

SEQ ID NO: 2668794 - DNA, 16 bp, Homo sapiens
cctgcaggccaggcca

SEQ ID NO: 2668795 - DNA, 21 bp, Homo sapiens
cctgccaccctgggcctggca

SEQ ID NO: 2668796 - DNA, 22 bp, Homo sapiens
cctgcccccgcatcccctgcct

SEQ ID NO: 2668797 - DNA, 13 bp, Homo sapiens
cctgccctcccct

SEQ ID NO: 2668798 - DNA, 19 bp, Homo sapiens
cctgcctcaggcctctgtg

SEQ ID NO: 2668799 - DNA, 14 bp, Homo sapiens
cctgcctccatcct

SEQ ID NO: 2668800 - DNA, 18 bp, Homo sapiens
cctgcgcccagtccttcc

SEQ ID NO: 2668801 - DNA, 22 bp, Homo sapiens
cctgcgcccagtccttccacct

SEQ ID NO: 2668802 - DNA, 19 bp, Homo sapiens
cctggtactcaagcccgcg

SEQ ID NO: 2668803 - DNA, 17 bp, Homo sapiens
cctggtccacagggcac

SEQ ID NO: 2668804 - DNA, 15 bp, Homo sapiens
cctggtttagcctgg

SEQ ID NO: 2668805 - DNA, 18 bp, Homo sapiens
cctgtaggatttttttct

SEQ ID NO: 2668806 - DNA, 21 bp, Homo sapiens
cctgtatatagcccagccagg

SEQ ID NO: 2668807 - DNA, 23 bp, Homo sapiens
cctgtatatagcccagccaggcc

SEQ ID NO: 2668808 - DNA, 13 bp, Homo sapiens
cctgtcctcccag

SEQ ID NO: 2668809 - DNA, 22 bp, Homo sapiens
cctgttgaattttgttctctgg

SEQ ID NO: 2668810 - DNA, 17 bp, Homo sapiens
cctgttttttttctttt

SEQ ID NO: 2668811 - DNA, 16 bp, Homo sapiens
ccttcagtaaccccca

SEQ ID NO: 2668812 - DNA, 16 bp, Homo sapiens
ccttctcctcttgtaa

SEQ ID NO: 2668813 - DNA, 17 bp, Homo sapiens
ccttctcctcttgtaaa

SEQ ID NO: 2668814 - DNA, 18 bp, Homo sapiens
ccttctggcctcccacag

SEQ ID NO: 2668815 - DNA, 21 bp, Homo sapiens
ccttgaggaaacaacagcttt

SEQ ID NO: 2668816 - DNA, 14 bp, Homo sapiens
cctttacggacacc

SEQ ID NO: 2668817 - DNA, 14 bp, Homo sapiens
cctttgataaatgt

SEQ ID NO: 2668818 - DNA, 12 bp, Homo sapiens
ccttttctattc

SEQ ID NO: 2668819 - DNA, 13 bp, Homo sapiens
ccttttttaaaag

SEQ ID NO: 2668820 - DNA, 13 bp, Homo sapiens
cgaaaaccaggcc

SEQ ID NO: 2668821 - DNA, 18 bp, Homo sapiens
cgaagaagagccacagtg

SEQ ID NO: 2668822 - DNA, 17 bp, Homo sapiens
cgacactgggaggccag

SEQ ID NO: 2668823 - DNA, 16 bp, Homo sapiens
cgacagcattttcctc

SEQ ID NO: 2668824 - DNA, 15 bp, Homo sapiens
cgagaccagcctggc

SEQ ID NO: 2668825 - DNA, 15 bp, Homo sapiens
cgcaaaccacactgg

SEQ ID NO: 2668826 - DNA, 18 bp, Homo sapiens
cgcaaaccacactggact

SEQ ID NO: 2668827 - DNA, 23 bp, Homo sapiens
cgcaggagcacacccagccccca

SEQ ID NO: 2668828 - DNA, 18 bp, Homo sapiens
cgccagctgatgactcaa

SEQ ID NO: 2668829 - DNA, 18 bp, Homo sapiens
cgccagggagacctggac

SEQ ID NO: 2668830 - DNA, 16 bp, Homo sapiens
cgcccagtccttccac

SEQ ID NO: 2668831 - DNA, 19 bp, Homo sapiens
cgcccccaccctgagcgcc

SEQ ID NO: 2668832 - DNA, 23 bp, Homo sapiens
cgccgcaaaccacactggactcc

SEQ ID NO: 2668833 - DNA, 13 bp, Homo sapiens
cgcctcccactgg

SEQ ID NO: 2668834 - DNA, 15 bp, Homo sapiens
cgcctcccactgggg

SEQ ID NO: 2668835 - DNA, 16 bp, Homo sapiens
cgcctcccactggggt

SEQ ID NO: 2668836 - DNA, 15 bp, Homo sapiens
cgcggcggagctggc

SEQ ID NO: 2668837 - DNA, 17 bp, Homo sapiens
cgcggcggagctggccc

SEQ ID NO: 2668838 - DNA, 18 bp, Homo sapiens
cgcggcggagctggcccc

SEQ ID NO: 2668839 - DNA, 14 bp, Homo sapiens
cggacaccccctcg

SEQ ID NO: 2668840 - DNA, 13 bp, Homo sapiens
cggacagtggcag

SEQ ID NO: 2668841 - DNA, 15 bp, Homo sapiens
cggacagtggcagga

SEQ ID NO: 2668842 - DNA, 14 bp, Homo sapiens
cggagcaagaggag

SEQ ID NO: 2668843 - DNA, 23 bp, Homo sapiens
cggccctcctaccctgcgcccag

SEQ ID NO: 2668844 - DNA, 13 bp, Homo sapiens
cggcggagctggc

SEQ ID NO: 2668845 - DNA, 15 bp, Homo sapiens
cggctccactaggac

SEQ ID NO: 2668846 - DNA, 12 bp, Homo sapiens
cggctgggcaca

SEQ ID NO: 2668847 - DNA, 23 bp, Homo sapiens
cgggcaggggagggtcagccagg

SEQ ID NO: 2668848 - DNA, 15 bp, Homo sapiens
cgggcgcactgcctc

SEQ ID NO: 2668849 - DNA, 15 bp, Homo sapiens
cggggagggtgacag

SEQ ID NO: 2668850 - DNA, 16 bp, Homo sapiens
cggtgctgtcctcagg

SEQ ID NO: 2668851 - DNA, 23 bp, Homo sapiens
cggtgggcacccaccctgggacc

SEQ ID NO: 2668852 - DNA, 19 bp, Homo sapiens
cggttcctcgttctccctg

SEQ ID NO: 2668853 - DNA, 20 bp, Homo sapiens
cgtatgagttagaataataa

SEQ ID NO: 2668854 - DNA, 12 bp, Homo sapiens
cgttctccctgg

SEQ ID NO: 2668855 - DNA, 13 bp, Homo sapiens
cgttctccctggg

SEQ ID NO: 2668856 - DNA, 16 bp, Homo sapiens
cgttttgttttgtgcc

SEQ ID NO: 2668857 - DNA, 11 bp, Homo sapiens
ctaaaaataat

SEQ ID NO: 2668858 - DNA, 19 bp, Homo sapiens
ctaaaactacaaaaattaa

SEQ ID NO: 2668859 - DNA, 18 bp, Homo sapiens
ctaaagagtttattttaa

SEQ ID NO: 2668860 - DNA, 19 bp, Homo sapiens
ctaaggtcattaccacagg

SEQ ID NO: 2668861 - DNA, 23 bp, Homo sapiens
ctaatgatggcccattctacttg

SEQ ID NO: 2668862 - DNA, 19 bp, Homo sapiens
ctaatgtgcctagttcttt

SEQ ID NO: 2668863 - DNA, 13 bp, Homo sapiens
ctacaggggccag

SEQ ID NO: 2668864 - DNA, 16 bp, Homo sapiens
ctacaggggccagaag

SEQ ID NO: 2668865 - DNA, 14 bp, Homo sapiens
ctactgcaccattt

SEQ ID NO: 2668866 - DNA, 19 bp, Homo sapiens
ctacttgctctggacctgc

SEQ ID NO: 2668867 - DNA, 21 bp, Homo sapiens
ctactttaataaatggttatt

SEQ ID NO: 2668868 - DNA, 20 bp, Homo sapiens
ctagagggacctctcccagg

SEQ ID NO: 2668869 - DNA, 16 bp, Homo sapiens
ctagcctatgtggatt

SEQ ID NO: 2668870 - DNA, 17 bp, Homo sapiens
ctaggacttcaaattgg

SEQ ID NO: 2668871 - DNA, 11 bp, Homo sapiens
ctaggccaggt

SEQ ID NO: 2668872 - DNA, 22 bp, Homo sapiens
ctaggccaggtgcaaccaggga

SEQ ID NO: 2668873 - DNA, 15 bp, Homo sapiens
ctagttgttatcaat

SEQ ID NO: 2668874 - DNA, 17 bp, Homo sapiens
ctatttctctttcttta

SEQ ID NO: 2668875 - DNA, 18 bp, Homo sapiens
ctcaactagcagatacag

SEQ ID NO: 2668876 - DNA, 14 bp, Homo sapiens
ctcaagattcccag

SEQ ID NO: 2668877 - DNA, 16 bp, Homo sapiens
ctcaagattcccagga

SEQ ID NO: 2668878 - DNA, 17 bp, Homo sapiens
ctcaagcccgcggggac

SEQ ID NO: 2668879 - DNA, 19 bp, Homo sapiens
ctcaatattttccatgaaa

SEQ ID NO: 2668880 - DNA, 16 bp, Homo sapiens
ctcacaacctgaacct

SEQ ID NO: 2668881 - DNA, 20 bp, Homo sapiens
ctcacaacctgaacctagga

SEQ ID NO: 2668882 - DNA, 16 bp, Homo sapiens
ctcacattacacacac

SEQ ID NO: 2668883 - DNA, 13 bp, Homo sapiens
ctcagccctgacc

SEQ ID NO: 2668884 - DNA, 17 bp, Homo sapiens
ctcagccctgaccctgt

SEQ ID NO: 2668885 - DNA, 17 bp, Homo sapiens
ctcagcttccccaacac

SEQ ID NO: 2668886 - DNA, 13 bp, Homo sapiens
ctcaggcctctgt

SEQ ID NO: 2668887 - DNA, 18 bp, Homo sapiens
ctcaggcctctgtgccgc

SEQ ID NO: 2668888 - DNA, 17 bp, Homo sapiens
ctcagggaaaagcagct

SEQ ID NO: 2668889 - DNA, 19 bp, Homo sapiens
ctcaggtggccatgcctca

SEQ ID NO: 2668890 - DNA, 20 bp, Homo sapiens
ctcaggtggccatgcctcag

SEQ ID NO: 2668891 - DNA, 17 bp, Homo sapiens
ctcatcgccagacaact

SEQ ID NO: 2668892 - DNA, 18 bp, Homo sapiens
ctcattctaatgatggcc

SEQ ID NO: 2668893 - DNA, 11 bp, Homo sapiens
ctcatttactg

SEQ ID NO: 2668894 - DNA, 19 bp, Homo sapiens
ctccaatttttttttcctt

SEQ ID NO: 2668895 - DNA, 18 bp, Homo sapiens
ctccacaccattcaggtc

SEQ ID NO: 2668896 - DNA, 14 bp, Homo sapiens
ctccagaagatagc

SEQ ID NO: 2668897 - DNA, 15 bp, Homo sapiens
ctccagaagatagct

SEQ ID NO: 2668898 - DNA, 20 bp, Homo sapiens
ctccagggtcagaaacagga

SEQ ID NO: 2668899 - DNA, 12 bp, Homo sapiens
ctccctgaccct

SEQ ID NO: 2668900 - DNA, 23 bp, Homo sapiens
ctccctgaccctgtatatagccc

SEQ ID NO: 2668901 - DNA, 18 bp, Homo sapiens
ctcctaccctgcgcccag

SEQ ID NO: 2668902 - DNA, 13 bp, Homo sapiens
ctcctcttgtaaa

SEQ ID NO: 2668903 - DNA, 13 bp, Homo sapiens
ctcctttgtactt

SEQ ID NO: 2668904 - DNA, 14 bp, Homo sapiens
ctcctttgtacttt

SEQ ID NO: 2668905 - DNA, 17 bp, Homo sapiens
ctcctttgtactttgtg

SEQ ID NO: 2668906 - DNA, 17 bp, Homo sapiens
ctcgattcatattgaat

SEQ ID NO: 2668907 - DNA, 22 bp, Homo sapiens
ctcgcttggacggctgggcaca

SEQ ID NO: 2668908 - DNA, 14 bp, Homo sapiens
ctcgttctccctgg

SEQ ID NO: 2668909 - DNA, 13 bp, Homo sapiens
ctctactctgctt

SEQ ID NO: 2668910 - DNA, 17 bp, Homo sapiens
ctctcacagctgagttg

SEQ ID NO: 2668911 - DNA, 12 bp, Homo sapiens
ctctccctgacc

SEQ ID NO: 2668912 - DNA, 14 bp, Homo sapiens
ctctccctgaccct

SEQ ID NO: 2668913 - DNA, 19 bp, Homo sapiens
ctctgaatttgagatacaa

SEQ ID NO: 2668914 - DNA, 18 bp, Homo sapiens
ctctgcaccgtactgtgg

SEQ ID NO: 2668915 - DNA, 13 bp, Homo sapiens
ctctggaaagcaa

SEQ ID NO: 2668916 - DNA, 14 bp, Homo sapiens
ctctgggagaaaat

SEQ ID NO: 2668917 - DNA, 20 bp, Homo sapiens
ctctgtgtctgagtggcttc

SEQ ID NO: 2668918 - DNA, 23 bp, Homo sapiens
ctcttagaggaaggagataggga

SEQ ID NO: 2668919 - DNA, 20 bp, Homo sapiens
ctcttgaagacactgaaata

SEQ ID NO: 2668920 - DNA, 14 bp, Homo sapiens
ctcttggctccact

SEQ ID NO: 2668921 - DNA, 12 bp, Homo sapiens
ctcttgtaaata

SEQ ID NO: 2668922 - DNA, 18 bp, Homo sapiens
ctcttgtaaataaagccc

SEQ ID NO: 2668923 - DNA, 23 bp, Homo sapiens
ctcttgtaaataaagccctggga

SEQ ID NO: 2668924 - DNA, 24 bp, Homo sapiens
ctcttgtaaataaagccctgggat

SEQ ID NO: 2668925 - DNA, 23 bp, Homo sapiens
ctctttagaaataatggtcattc

SEQ ID NO: 2668926 - DNA, 20 bp, Homo sapiens
ctgaacaccattgaaggctt

SEQ ID NO: 2668927 - DNA, 14 bp, Homo sapiens
ctgaagctttacca

SEQ ID NO: 2668928 - DNA, 21 bp, Homo sapiens
ctgaagggatatgtgaaacaa

SEQ ID NO: 2668929 - DNA, 18 bp, Homo sapiens
ctgaccctgtatatagcc

SEQ ID NO: 2668930 - DNA, 20 bp, Homo sapiens
ctgaccctgtatatagccca

SEQ ID NO: 2668931 - DNA, 22 bp, Homo sapiens
ctgaccctgtatatagcccagc

SEQ ID NO: 2668932 - DNA, 17 bp, Homo sapiens
ctgacctggtccacagg

SEQ ID NO: 2668933 - DNA, 16 bp, Homo sapiens
ctgaccttgatgagct

SEQ ID NO: 2668934 - DNA, 20 bp, Homo sapiens
ctgactgtctcccgggacta

SEQ ID NO: 2668935 - DNA, 23 bp, Homo sapiens
ctgagaaggtttggtccagcctg

SEQ ID NO: 2668936 - DNA, 23 bp, Homo sapiens
ctgagaatataatactgtatttg

SEQ ID NO: 2668937 - DNA, 17 bp, Homo sapiens
ctgagctctttgcacta

SEQ ID NO: 2668938 - DNA, 19 bp, Homo sapiens
ctgaggaagctggggttca

SEQ ID NO: 2668939 - DNA, 13 bp, Homo sapiens
ctgagtgaaaaat

SEQ ID NO: 2668940 - DNA, 14 bp, Homo sapiens
ctgagtgaaaaatc

SEQ ID NO: 2668941 - DNA, 16 bp, Homo sapiens
ctgagtggcttcactc

SEQ ID NO: 2668942 - DNA, 19 bp, Homo sapiens
ctgagtggcttcactcctg

SEQ ID NO: 2668943 - DNA, 21 bp, Homo sapiens
ctgagtggcttcactcctgct

SEQ ID NO: 2668944 - DNA, 22 bp, Homo sapiens
ctgagtggcttcactcctgctg

SEQ ID NO: 2668945 - DNA, 21 bp, Homo sapiens
ctgagttggtgttgacatgtg

SEQ ID NO: 2668946 - DNA, 20 bp, Homo sapiens
ctgagttgttgagtctgttt

SEQ ID NO: 2668947 - DNA, 14 bp, Homo sapiens
ctgataagcttcaa

SEQ ID NO: 2668948 - DNA, 15 bp, Homo sapiens
ctgatgactcaagat

SEQ ID NO: 2668949 - DNA, 13 bp, Homo sapiens
ctgatttcccctt

SEQ ID NO: 2668950 - DNA, 15 bp, Homo sapiens
ctgatttcccctttt

SEQ ID NO: 2668951 - DNA, 15 bp, Homo sapiens
ctgcagacgcccaga

SEQ ID NO: 2668952 - DNA, 17 bp, Homo sapiens
ctgcaggccaggccagc

SEQ ID NO: 2668953 - DNA, 16 bp, Homo sapiens
ctgcaggggcatggga

SEQ ID NO: 2668954 - DNA, 15 bp, Homo sapiens
ctgcataccaacctg

SEQ ID NO: 2668955 - DNA, 13 bp, Homo sapiens
ctgcatgatgttt

SEQ ID NO: 2668956 - DNA, 15 bp, Homo sapiens
ctgcatgatgtttgc

SEQ ID NO: 2668957 - DNA, 17 bp, Homo sapiens
ctgccaccctgggcctg

SEQ ID NO: 2668958 - DNA, 14 bp, Homo sapiens
ctgcccccgcatcc

SEQ ID NO: 2668959 - DNA, 15 bp, Homo sapiens
ctgcccccgcatccc

SEQ ID NO: 2668960 - DNA, 14 bp, Homo sapiens
ctgccctcccctct

SEQ ID NO: 2668961 - DNA, 20 bp, Homo sapiens
ctgccctcccctctctgcac

SEQ ID NO: 2668962 - DNA, 15 bp, Homo sapiens
ctgcctcaggcctct

SEQ ID NO: 2668963 - DNA, 23 bp, Homo sapiens
ctgcctccgcgtgatcaaagcca

SEQ ID NO: 2668964 - DNA, 18 bp, Homo sapiens
ctgcctggactagaggga

SEQ ID NO: 2668965 - DNA, 22 bp, Homo sapiens
ctgctcattctaatgatggccc

SEQ ID NO: 2668966 - DNA, 21 bp, Homo sapiens
ctgctcccctctgcacggacc

SEQ ID NO: 2668967 - DNA, 24 bp, Homo sapiens
ctgctctctttttctccagggtca

SEQ ID NO: 2668968 - DNA, 14 bp, Homo sapiens
ctgcttaatgaaaa

SEQ ID NO: 2668969 - DNA, 12 bp, Homo sapiens
ctggacctgccc

SEQ ID NO: 2668970 - DNA, 17 bp, Homo sapiens
ctggacctgcccccgca

SEQ ID NO: 2668971 - DNA, 18 bp, Homo sapiens
ctggagtcatcattccct

SEQ ID NO: 2668972 - DNA, 12 bp, Homo sapiens
ctggcagctcag

SEQ ID NO: 2668973 - DNA, 17 bp, Homo sapiens
ctggcagctcagcttcc

SEQ ID NO: 2668974 - DNA, 18 bp, Homo sapiens
ctggcatgatccaagcaa

SEQ ID NO: 2668975 - DNA, 14 bp, Homo sapiens
ctggccccgccgcc

SEQ ID NO: 2668976 - DNA, 23 bp, Homo sapiens
ctggccccgccgcctggtactca

SEQ ID NO: 2668977 - DNA, 16 bp, Homo sapiens
ctgggaaacagaggct

SEQ ID NO: 2668978 - DNA, 15 bp, Homo sapiens
ctgggagaaaatcat

SEQ ID NO: 2668979 - DNA, 21 bp, Homo sapiens
ctgggagaaaatcatcaagaa

SEQ ID NO: 2668980 - DNA, 14 bp, Homo sapiens
ctgggatgtttctg

SEQ ID NO: 2668981 - DNA, 17 bp, Homo sapiens
ctgggcacacgcctccc

SEQ ID NO: 2668982 - DNA, 22 bp, Homo sapiens
ctgggcacacgcctcccactgg

SEQ ID NO: 2668983 - DNA, 19 bp, Homo sapiens
ctgggccatgttgtgcctc

SEQ ID NO: 2668984 - DNA, 20 bp, Homo sapiens
ctgggcctggcagctcagct

SEQ ID NO: 2668985 - DNA, 23 bp, Homo sapiens
ctgggcgtagtggctcacacctg

SEQ ID NO: 2668986 - DNA, 15 bp, Homo sapiens
ctggggtccagggag

SEQ ID NO: 2668987 - DNA, 16 bp, Homo sapiens
ctggtaccagttgaaa

SEQ ID NO: 2668988 - DNA, 18 bp, Homo sapiens
ctggtcaaacaaactctc

SEQ ID NO: 2668989 - DNA, 23 bp, Homo sapiens
ctggtcaaacaaactctctgaac

SEQ ID NO: 2668990 - DNA, 22 bp, Homo sapiens
ctggtgagagggccgggcagag

SEQ ID NO: 2668991 - DNA, 18 bp, Homo sapiens
ctggttaggatggcagga

SEQ ID NO: 2668992 - DNA, 17 bp, Homo sapiens
ctgtaaatttggcttct

SEQ ID NO: 2668993 - DNA, 16 bp, Homo sapiens
ctgtatatagcccagc

SEQ ID NO: 2668994 - DNA, 14 bp, Homo sapiens
ctgtatcactctgt

SEQ ID NO: 2668995 - DNA, 16 bp, Homo sapiens
ctgtatcactctgtgt

SEQ ID NO: 2668996 - DNA, 13 bp, Homo sapiens
ctgtcactgtggg

SEQ ID NO: 2668997 - DNA, 12 bp, Homo sapiens
ctgtcctcaggt

SEQ ID NO: 2668998 - DNA, 15 bp, Homo sapiens
ctgtcctcaggtggc

SEQ ID NO: 2668999 - DNA, 12 bp, Homo sapiens
ctgtcctccaag

SEQ ID NO: 2669000 - DNA, 12 bp, Homo sapiens
ctgtctcctggc

SEQ ID NO: 2669001 - DNA, 14 bp, Homo sapiens
ctgtctctactaaa

SEQ ID NO: 2669002 - DNA, 14 bp, Homo sapiens
ctgtctgtgttttt

SEQ ID NO: 2669003 - DNA, 19 bp, Homo sapiens
ctgtgcacaaagtggcata

SEQ ID NO: 2669004 - DNA, 11 bp, Homo sapiens
ctgtgggaaat

SEQ ID NO: 2669005 - DNA, 13 bp, Homo sapiens
gacatcagctggt

SEQ ID NO: 2669006 - DNA, 23 bp, Homo sapiens
gacattcagtatataaaatatgt

SEQ ID NO: 2669007 - DNA, 18 bp, Homo sapiens
gacattgttaaaataaag

SEQ ID NO: 2669008 - DNA, 17 bp, Homo sapiens
gacccagacacatcgca

SEQ ID NO: 2669009 - DNA, 11 bp, Homo sapiens
gacccccgccc

SEQ ID NO: 2669010 - DNA, 19 bp, Homo sapiens
gaccctgtatatagcccag

SEQ ID NO: 2669011 - DNA, 17 bp, Homo sapiens
gacctataactgcccag

SEQ ID NO: 2669012 - DNA, 18 bp, Homo sapiens
gacctggacacaggcctg

SEQ ID NO: 2669013 - DNA, 15 bp, Homo sapiens
gacctgtctcctggc

SEQ ID NO: 2669014 - DNA, 14 bp, Homo sapiens
gaccttgatgagct

SEQ ID NO: 2669015 - DNA, 15 bp, Homo sapiens
gaccttgatgagctg

SEQ ID NO: 2669016 - DNA, 12 bp, Homo sapiens
gacggctgggca

SEQ ID NO: 2669017 - DNA, 20 bp, Homo sapiens
gacgtgggctgggcccacaa

SEQ ID NO: 2669018 - DNA, 12 bp, Homo sapiens
gactaattcttg

SEQ ID NO: 2669019 - DNA, 20 bp, Homo sapiens
gactagagggacctctccca

SEQ ID NO: 2669020 - DNA, 22 bp, Homo sapiens
gactcaaatgctcagaccagct

SEQ ID NO: 2669021 - DNA, 12 bp, Homo sapiens
gactcaagattc

SEQ ID NO: 2669022 - DNA, 17 bp, Homo sapiens
gactcaagattcccagg

SEQ ID NO: 2669023 - DNA, 19 bp, Homo sapiens
gactcaagattcccaggag

SEQ ID NO: 2669024 - DNA, 22 bp, Homo sapiens
gactcaagattcccaggagttc

SEQ ID NO: 2669025 - DNA, 13 bp, Homo sapiens
gactgttgtccct

SEQ ID NO: 2669026 - DNA, 18 bp, Homo sapiens
gacttgacagaacactgt

SEQ ID NO: 2669027 - DNA, 19 bp, Homo sapiens
gactttttttttttataat

SEQ ID NO: 2669028 - DNA, 14 bp, Homo sapiens
gagaaaaagaaatg

SEQ ID NO: 2669029 - DNA, 16 bp, Homo sapiens
gagaaaaagaaatgca

SEQ ID NO: 2669030 - DNA, 23 bp, Homo sapiens
gagaaaatcatcaagaagggctg

SEQ ID NO: 2669031 - DNA, 16 bp, Homo sapiens
gagaactttatttcca

SEQ ID NO: 2669032 - DNA, 11 bp, Homo sapiens
gagacacagga

SEQ ID NO: 2669033 - DNA, 17 bp, Homo sapiens
gagacacaggatgaagc

SEQ ID NO: 2669034 - DNA, 20 bp, Homo sapiens
gagacctggacacaggcctg

SEQ ID NO: 2669035 - DNA, 20 bp, Homo sapiens
gagactcctcagttcttgcc

SEQ ID NO: 2669036 - DNA, 18 bp, Homo sapiens
gagagaggcaatggctcc

SEQ ID NO: 2669037 - DNA, 15 bp, Homo sapiens
gagagcaacatttta

SEQ ID NO: 2669038 - DNA, 23 bp, Homo sapiens
gagagggccgggcagaggggcag

SEQ ID NO: 2669039 - DNA, 13 bp, Homo sapiens
gagcacacccagc

SEQ ID NO: 2669040 - DNA, 16 bp, Homo sapiens
gagcacacccagcccc

SEQ ID NO: 2669041 - DNA, 22 bp, Homo sapiens
gagcagagatcacaccactgca

SEQ ID NO: 2669042 - DNA, 15 bp, Homo sapiens
gagccactccggccc

SEQ ID NO: 2669043 - DNA, 17 bp, Homo sapiens
gagccatgggcacaaag

SEQ ID NO: 2669044 - DNA, 12 bp, Homo sapiens
gagcctccctgc

SEQ ID NO: 2669045 - DNA, 18 bp, Homo sapiens
gagctagccagaggactg

SEQ ID NO: 2669046 - DNA, 17 bp, Homo sapiens
gagctcaggacactaat

SEQ ID NO: 2669047 - DNA, 18 bp, Homo sapiens
gagctccaactcagaagg

SEQ ID NO: 2669048 - DNA, 21 bp, Homo sapiens
gagctcccaggtgcagccaga

SEQ ID NO: 2669049 - DNA, 14 bp, Homo sapiens
gagctctttgcact

SEQ ID NO: 2669050 - DNA, 19 bp, Homo sapiens
gagctgcaggggcatggga

SEQ ID NO: 2669051 - DNA, 17 bp, Homo sapiens
gagctggccccgccgcc

SEQ ID NO: 2669052 - DNA, 22 bp, Homo sapiens
gaggaaaaaaatcgtccaggga

SEQ ID NO: 2669053 - DNA, 18 bp, Homo sapiens
gaggaaacaacagcttta

SEQ ID NO: 2669054 - DNA, 14 bp, Homo sapiens
gaggcataaagact

SEQ ID NO: 2669055 - DNA, 15 bp, Homo sapiens
gaggccagtgagcca

SEQ ID NO: 2669056 - DNA, 16 bp, Homo sapiens
gaggccagtgagccac

SEQ ID NO: 2669057 - DNA, 11 bp, Homo sapiens
gaggccttcca

SEQ ID NO: 2669058 - DNA, 15 bp, Homo sapiens
gagggacctctccca

SEQ ID NO: 2669059 - DNA, 17 bp, Homo sapiens
gagggacctctcccagg

SEQ ID NO: 2669060 - DNA, 15 bp, Homo sapiens
gagggtcagccaggg

SEQ ID NO: 2669061 - DNA, 15 bp, Homo sapiens
gaggtagaatgactc

SEQ ID NO: 2669062 - DNA, 22 bp, Homo sapiens
gagtagaaagacagagctggga

SEQ ID NO: 2669063 - DNA, 21 bp, Homo sapiens
gagtgcaagcccctgctccag

SEQ ID NO: 2669064 - DNA, 22 bp, Homo sapiens
gagttagaataataaatattta

SEQ ID NO: 2669065 - DNA, 20 bp, Homo sapiens
gagttctgctcattctaatg

SEQ ID NO: 2669066 - DNA, 21 bp, Homo sapiens
gagttctgctcattctaatga

SEQ ID NO: 2669067 - DNA, 22 bp, Homo sapiens
gagtttttcccagctacacctt

SEQ ID NO: 2669068 - DNA, 17 bp, Homo sapiens
gatatgtgaaacaatgt

SEQ ID NO: 2669069 - DNA, 13 bp, Homo sapiens
gatatttgtgcat

SEQ ID NO: 2669070 - DNA, 15 bp, Homo sapiens
gatcttttgttccca

SEQ ID NO: 2669071 - DNA, 13 bp, Homo sapiens
gatgaacagactg

SEQ ID NO: 2669072 - DNA, 19 bp, Homo sapiens
gatgaagcaaacacattaa

SEQ ID NO: 2669073 - DNA, 18 bp, Homo sapiens
gatgacaactacagaaaa

SEQ ID NO: 2669074 - DNA, 14 bp, Homo sapiens
gatgactcaagatt

SEQ ID NO: 2669075 - DNA, 22 bp, Homo sapiens
gatgactcaagattcccaggag

SEQ ID NO: 2669076 - DNA, 13 bp, Homo sapiens
gatgctgtgaaat

SEQ ID NO: 2669077 - DNA, 19 bp, Homo sapiens
gatggcccattctacttgc

SEQ ID NO: 2669078 - DNA, 22 bp, Homo sapiens
gatggcccattctacttgctct

SEQ ID NO: 2669079 - DNA, 13 bp, Homo sapiens
gatggtaattctt

SEQ ID NO: 2669080 - DNA, 16 bp, Homo sapiens
gattcacttcacgctt

SEQ ID NO: 2669081 - DNA, 12 bp, Homo sapiens
gattcccaggag

SEQ ID NO: 2669082 - DNA, 19 bp, Homo sapiens
gattcccaggagttctgct

SEQ ID NO: 2669083 - DNA, 21 bp, Homo sapiens
gattcccaggagttctgctca

SEQ ID NO: 2669084 - DNA, 22 bp, Homo sapiens
gattgcgtggaattgtgctgag

SEQ ID NO: 2669085 - DNA, 16 bp, Homo sapiens
gatttagatatgcaaa

SEQ ID NO: 2669086 - DNA, 20 bp, Homo sapiens
gatttcccatcccctgtggg

SEQ ID NO: 2669087 - DNA, 16 bp, Homo sapiens
gatttccccttttgca

SEQ ID NO: 2669088 - DNA, 15 bp, Homo sapiens
gcaaaccacactgga

SEQ ID NO: 2669089 - DNA, 17 bp, Homo sapiens
gcaaaccacactggact

SEQ ID NO: 2669090 - DNA, 22 bp, Homo sapiens
gcaaaccacactggactccggc

SEQ ID NO: 2669091 - DNA, 23 bp, Homo sapiens
gcaaatgctaatgtcaaacttga

SEQ ID NO: 2669092 - DNA, 15 bp, Homo sapiens
gcaatgtttatttca

SEQ ID NO: 2669093 - DNA, 17 bp, Homo sapiens
gcacagcccaaagaagg

SEQ ID NO: 2669094 - DNA, 22 bp, Homo sapiens
gcactgaagggatatgtgaaac

SEQ ID NO: 2669095 - DNA, 14 bp, Homo sapiens
gcactgcctctcac

SEQ ID NO: 2669096 - DNA, 13 bp, Homo sapiens
gcagacgcccaga

SEQ ID NO: 2669097 - DNA, 17 bp, Homo sapiens
gcagagaagctctcggg

SEQ ID NO: 2669098 - DNA, 15 bp, Homo sapiens
gcagatactgtctct

SEQ ID NO: 2669099 - DNA, 20 bp, Homo sapiens
gcagcaggtggcagaatggg

SEQ ID NO: 2669100 - DNA, 16 bp, Homo sapiens
gcaggagcacacccag

SEQ ID NO: 2669101 - DNA, 17 bp, Homo sapiens
gcaggagcacacccagc

SEQ ID NO: 2669102 - DNA, 14 bp, Homo sapiens
gcagggacaaagag

SEQ ID NO: 2669103 - DNA, 15 bp, Homo sapiens
gcagggacaaagagg

SEQ ID NO: 2669104 - DNA, 19 bp, Homo sapiens
gcaggggagggtcagccag

SEQ ID NO: 2669105 - DNA, 19 bp, Homo sapiens
gcaggtagacctgtctcct

SEQ ID NO: 2669106 - DNA, 20 bp, Homo sapiens
gcaggtgaaacccagtcact

SEQ ID NO: 2669107 - DNA, 15 bp, Homo sapiens
gcaggtgaattgttt

SEQ ID NO: 2669108 - DNA, 22 bp, Homo sapiens
gcatccacttctttcagcagac

SEQ ID NO: 2669109 - DNA, 16 bp, Homo sapiens
gcatcccctgcctcca

SEQ ID NO: 2669110 - DNA, 19 bp, Homo sapiens
gcatgatccaagcaagact

SEQ ID NO: 2669111 - DNA, 18 bp, Homo sapiens
gcatgatctgaaaaatac

SEQ ID NO: 2669112 - DNA, 18 bp, Homo sapiens
gcatgatgtttgcccaaa

SEQ ID NO: 2669113 - DNA, 13 bp, Homo sapiens
gcattttcctctg

SEQ ID NO: 2669114 - DNA, 15 bp, Homo sapiens
gcattttcctctgct

SEQ ID NO: 2669115 - DNA, 18 bp, Homo sapiens
gcattttcctctgctttg

SEQ ID NO: 2669116 - DNA, 21 bp, Homo sapiens
gcattttcctctgctttgaaa

SEQ ID NO: 2669117 - DNA, 16 bp, Homo sapiens
gcattttctaaacaga

SEQ ID NO: 2669118 - DNA, 16 bp, Homo sapiens
gccaaaaaaagacagg

SEQ ID NO: 2669119 - DNA, 23 bp, Homo sapiens
gccaacccttctcctcttgtaaa

SEQ ID NO: 2669120 - DNA, 16 bp, Homo sapiens
gccaacctattttgaa

SEQ ID NO: 2669121 - DNA, 15 bp, Homo sapiens
gccacaggtctttat

SEQ ID NO: 2669122 - DNA, 18 bp, Homo sapiens
gccaccctgaggcctctg

SEQ ID NO: 2669123 - DNA, 23 bp, Homo sapiens
gccacttttttttttaatctcca

SEQ ID NO: 2669124 - DNA, 21 bp, Homo sapiens
gccagtaaaaaaaaaaaatgg

SEQ ID NO: 2669125 - DNA, 21 bp, Homo sapiens
gccatgcctcagccctgaccc

SEQ ID NO: 2669126 - DNA, 19 bp, Homo sapiens
ctgtgtattttttaaagct

SEQ ID NO: 2669127 - DNA, 23 bp, Homo sapiens
ctgtgtattttttaaagctacaa

SEQ ID NO: 2669128 - DNA, 17 bp, Homo sapiens
ctgttcccacctgctgg

SEQ ID NO: 2669129 - DNA, 14 bp, Homo sapiens
ctgttttgtaaagt

SEQ ID NO: 2669130 - DNA, 16 bp, Homo sapiens
ctgttttgtaaagtcc

SEQ ID NO: 2669131 - DNA, 21 bp, Homo sapiens
ctgttttgtaaagtccccaga

SEQ ID NO: 2669132 - DNA, 11 bp, Homo sapiens
cttaaaatgat

SEQ ID NO: 2669133 - DNA, 14 bp, Homo sapiens
cttaaacaaatgta

SEQ ID NO: 2669134 - DNA, 17 bp, Homo sapiens
cttacggccctggcctt

SEQ ID NO: 2669135 - DNA, 16 bp, Homo sapiens
cttatcccttcttttt

SEQ ID NO: 2669136 - DNA, 13 bp, Homo sapiens
cttatctccaaga

SEQ ID NO: 2669137 - DNA, 19 bp, Homo sapiens
cttattaaatggaaactga

SEQ ID NO: 2669138 - DNA, 19 bp, Homo sapiens
cttcactgtgaccttgaga

SEQ ID NO: 2669139 - DNA, 18 bp, Homo sapiens
cttcaggtcaggagttcg

SEQ ID NO: 2669140 - DNA, 22 bp, Homo sapiens
cttcagtaacccccactggact

SEQ ID NO: 2669141 - DNA, 13 bp, Homo sapiens
cttccagcccaga

SEQ ID NO: 2669142 - DNA, 14 bp, Homo sapiens
cttccatgtgaggg

SEQ ID NO: 2669143 - DNA, 13 bp, Homo sapiens
cttcccattctcc

SEQ ID NO: 2669144 - DNA, 20 bp, Homo sapiens
cttccttgtagccttttgac

SEQ ID NO: 2669145 - DNA, 15 bp, Homo sapiens
cttcgacagcatttt

SEQ ID NO: 2669146 - DNA, 15 bp, Homo sapiens
cttctcctcttgtaa

SEQ ID NO: 2669147 - DNA, 17 bp, Homo sapiens
cttctcctcttgtaaat

SEQ ID NO: 2669148 - DNA, 20 bp, Homo sapiens
cttctcctgaagttcagcca

SEQ ID NO: 2669149 - DNA, 16 bp, Homo sapiens
cttctggcctcccaca

SEQ ID NO: 2669150 - DNA, 15 bp, Homo sapiens
cttctgttgtcacct

SEQ ID NO: 2669151 - DNA, 20 bp, Homo sapiens
cttctgttgtcaccttcacc

SEQ ID NO: 2669152 - DNA, 11 bp, Homo sapiens
cttgaagtcag

SEQ ID NO: 2669153 - DNA, 16 bp, Homo sapiens
cttgagaaaaaaagaa

SEQ ID NO: 2669154 - DNA, 22 bp, Homo sapiens
cttgagaaaaaaagaatagttg

SEQ ID NO: 2669155 - DNA, 21 bp, Homo sapiens
cttgagaagattcttcccatt

SEQ ID NO: 2669156 - DNA, 16 bp, Homo sapiens
cttgctctggacctgc

SEQ ID NO: 2669157 - DNA, 18 bp, Homo sapiens
cttgctctggacctgccc

SEQ ID NO: 2669158 - DNA, 21 bp, Homo sapiens
cttggaaactggatgaggtca

SEQ ID NO: 2669159 - DNA, 15 bp, Homo sapiens
cttggaggtgtctgt

SEQ ID NO: 2669160 - DNA, 20 bp, Homo sapiens
cttggcttttactgaagcct

SEQ ID NO: 2669161 - DNA, 15 bp, Homo sapiens
ggattcctcttttct

SEQ ID NO: 2669162 - DNA, 18 bp, Homo sapiens
ggattcctcttttctctg

SEQ ID NO: 2669163 - DNA, 19 bp, Homo sapiens
ggcaaagggtccagaagga

SEQ ID NO: 2669164 - DNA, 13 bp, Homo sapiens
ggcacccaccctg

SEQ ID NO: 2669165 - DNA, 14 bp, Homo sapiens
ggcacccaccctgg

SEQ ID NO: 2669166 - DNA, 18 bp, Homo sapiens
ggcagagctgctcccctc

SEQ ID NO: 2669167 - DNA, 12 bp, Homo sapiens
ggcagctgccac

SEQ ID NO: 2669168 - DNA, 22 bp, Homo sapiens
ggcaggggagggtcagccaggg

SEQ ID NO: 2669169 - DNA, 22 bp, Homo sapiens
ggcatatattgggttccattct

SEQ ID NO: 2669170 - DNA, 15 bp, Homo sapiens
ggcatgatccaagca

SEQ ID NO: 2669171 - DNA, 18 bp, Homo sapiens
ggcatgggaaggtgggcg

SEQ ID NO: 2669172 - DNA, 16 bp, Homo sapiens
ggccaacccttctcct

SEQ ID NO: 2669173 - DNA, 20 bp, Homo sapiens
ggccaacccttctcctcttg

SEQ ID NO: 2669174 - DNA, 23 bp, Homo sapiens
ggccaacccttctcctcttgtaa

SEQ ID NO: 2669175 - DNA, 16 bp, Homo sapiens
ggccaaggagggtgag

SEQ ID NO: 2669176 - DNA, 21 bp, Homo sapiens
ggccagaagatgaacagactg

SEQ ID NO: 2669177 - DNA, 22 bp, Homo sapiens
ggccatctggttaggatggcag

SEQ ID NO: 2669178 - DNA, 20 bp, Homo sapiens
ttatcacaaaaaagaaaatg

SEQ ID NO: 2669179 - DNA, 17 bp, Homo sapiens
ttatgcatgtttgttgt

SEQ ID NO: 2669180 - DNA, 12 bp, Homo sapiens
ttatgcttttgg

SEQ ID NO: 2669181 - DNA, 23 bp, Homo sapiens
ttattcaataaaaaaaagaaatg

SEQ ID NO: 2669182 - DNA, 21 bp, Homo sapiens
ttcaaattgtgtgtgctctgc

SEQ ID NO: 2669183 - DNA, 22 bp, Homo sapiens
ttcaaccagggattgtttctgt

SEQ ID NO: 2669184 - DNA, 21 bp, Homo sapiens
ttcaataaaaaaaagaaatga

SEQ ID NO: 2669185 - DNA, 20 bp, Homo sapiens
ttcaatggtttgcaaggaag

SEQ ID NO: 2669186 - DNA, 23 bp, Homo sapiens
ttcaatggtttgcaaggaagcca

SEQ ID NO: 2669187 - DNA, 17 bp, Homo sapiens
ttcaccccaatcccagc

SEQ ID NO: 2669188 - DNA, 22 bp, Homo sapiens
ttcactgtgaccttgagaagat

SEQ ID NO: 2669189 - DNA, 13 bp, Homo sapiens
ttcagaagaaatt

SEQ ID NO: 2669190 - DNA, 21 bp, Homo sapiens
ttcagtaacccccactggact

SEQ ID NO: 2669191 - DNA, 14 bp, Homo sapiens
ttcatattgaatat

SEQ ID NO: 2669192 - DNA, 11 bp, Homo sapiens
ttccagaatcc

SEQ ID NO: 2669193 - DNA, 19 bp, Homo sapiens
ttccagtacacctttcagc

SEQ ID NO: 2669194 - DNA, 15 bp, Homo sapiens
ttccatgaaaatgca

SEQ ID NO: 2669195 - DNA, 22 bp, Homo sapiens
ttccatggccgtgtagaagcat

SEQ ID NO: 2669196 - DNA, 23 bp, Homo sapiens
ttccatgtgagggttttcagcat

SEQ ID NO: 2669197 - DNA, 21 bp, Homo sapiens
ttcccagctacacctttctcc

SEQ ID NO: 2669198 - DNA, 20 bp, Homo sapiens
ttcccaggagttctgctcat

SEQ ID NO: 2669199 - DNA, 21 bp, Homo sapiens
ttcctcacaccaggcttgcct

SEQ ID NO: 2669200 - DNA, 16 bp, Homo sapiens
ttcctcttttctctgc

SEQ ID NO: 2669201 - DNA, 21 bp, Homo sapiens
ttcctgcaggccaggccagct

SEQ ID NO: 2669202 - DNA, 20 bp, Homo sapiens
ttcctgtcctcccagctcct

SEQ ID NO: 2669203 - DNA, 16 bp, Homo sapiens
ttcctttatgttctca

SEQ ID NO: 2669204 - DNA, 17 bp, Homo sapiens
ttcctttggaagaaaaa

SEQ ID NO: 2669205 - DNA, 20 bp, Homo sapiens
ttcgatgggcccaattctta

SEQ ID NO: 2669206 - DNA, 14 bp, Homo sapiens
ttcgcttgagaaaa

SEQ ID NO: 2669207 - DNA, 16 bp, Homo sapiens
ttcgcttgagaaaaaa

SEQ ID NO: 2669208 - DNA, 20 bp, Homo sapiens
ttcggcagatactgtctctt

SEQ ID NO: 2669209 - DNA, 16 bp, Homo sapiens
ttctacttgctctgga

SEQ ID NO: 2669210 - DNA, 19 bp, Homo sapiens
ttctacttgctctggacct

SEQ ID NO: 2669211 - DNA, 20 bp, Homo sapiens
ttctcatgatttacagagaa

SEQ ID NO: 2669212 - DNA, 23 bp, Homo sapiens
ttctcattgaattataaaagcca

SEQ ID NO: 2669213 - DNA, 20 bp, Homo sapiens
ttctccctccttcccttcct

SEQ ID NO: 2669214 - DNA, 12 bp, Homo sapiens
ttctcctttgta

SEQ ID NO: 2669215 - DNA, 11 bp, Homo sapiens
ttctctttctt

SEQ ID NO: 2669216 - DNA, 22 bp, Homo sapiens
ttctctttctttacaagatggg

SEQ ID NO: 2669217 - DNA, 15 bp, Homo sapiens
ttctgctcattctaa

SEQ ID NO: 2669218 - DNA, 14 bp, Homo sapiens
ttctgctgttctct

SEQ ID NO: 2669219 - DNA, 13 bp, Homo sapiens
ttctgggaagcaa

SEQ ID NO: 2669220 - DNA, 22 bp, Homo sapiens
ttcttataggaaagcttgagta

SEQ ID NO: 2669221 - DNA, 17 bp, Homo sapiens
ttcttgcatattttgta

SEQ ID NO: 2669222 - DNA, 21 bp, Homo sapiens
ttctttccctgcttaatgaaa

SEQ ID NO: 2669223 - DNA, 19 bp, Homo sapiens
ttctttgtgtcaacatgaa

SEQ ID NO: 2669224 - DNA, 15 bp, Homo sapiens
ttgaacctatttctc

SEQ ID NO: 2669225 - DNA, 19 bp, Homo sapiens
ttgaacctatttctctttc

SEQ ID NO: 2669226 - DNA, 22 bp, Homo sapiens
ttgaagacactgaaatatacac

SEQ ID NO: 2669227 - DNA, 15 bp, Homo sapiens
ttgaatataaacact

SEQ ID NO: 2669228 - DNA, 19 bp, Homo sapiens
ttgaattaaatgttcatct

SEQ ID NO: 2669229 - DNA, 18 bp, Homo sapiens
ttgatatttgtgcatttt

SEQ ID NO: 2669230 - DNA, 11 bp, Homo sapiens
ttgatcttcaa

SEQ ID NO: 2669231 - DNA, 15 bp, Homo sapiens
ttgcaattcctgctc

SEQ ID NO: 2669232 - DNA, 12 bp, Homo sapiens
ttgcctgcaggc

SEQ ID NO: 2669233 - DNA, 14 bp, Homo sapiens
ttgctctggacctg

SEQ ID NO: 2669234 - DNA, 15 bp, Homo sapiens
ttgctctggacctgc

SEQ ID NO: 2669235 - DNA, 13 bp, Homo sapiens
ttgcttgttctct

SEQ ID NO: 2669236 - DNA, 16 bp, Homo sapiens
ttgctttgtgttcttt

SEQ ID NO: 2669237 - DNA, 16 bp, Homo sapiens
ttggggggcatatatt

SEQ ID NO: 2669238 - DNA, 22 bp, Homo sapiens
ttggttaagctttgacactgga

SEQ ID NO: 2669239 - DNA, 15 bp, Homo sapiens
ttgtaaaacaggtag

SEQ ID NO: 2669240 - DNA, 19 bp, Homo sapiens
ttgtacacaccttatattt

SEQ ID NO: 2669241 - DNA, 16 bp, Homo sapiens
ttgtagccttttgact

SEQ ID NO: 2669242 - DNA, 17 bp, Homo sapiens
ttgtcaccttcacctcc

SEQ ID NO: 2669243 - DNA, 14 bp, Homo sapiens
ttgtgtatttaaca

SEQ ID NO: 2669244 - DNA, 21 bp, Homo sapiens
ttgttcccatcctcttctttt

SEQ ID NO: 2669245 - DNA, 15 bp, Homo sapiens
ttgttctctgggaga

SEQ ID NO: 2669246 - DNA, 19 bp, Homo sapiens
ttgttctgctgttctctag

SEQ ID NO: 2669247 - DNA, 13 bp, Homo sapiens
ttgtttgttttcc

SEQ ID NO: 2669248 - DNA, 18 bp, Homo sapiens
tttaaccccgtcaacaaa

SEQ ID NO: 2669249 - DNA, 21 bp, Homo sapiens
tttaacctgccaacatacttt

SEQ ID NO: 2669250 - DNA, 19 bp, Homo sapiens
tttacccacacacagataa

SEQ ID NO: 2669251 - DNA, 18 bp, Homo sapiens
tttactgttatcctattt

SEQ ID NO: 2669252 - DNA, 12 bp, Homo sapiens
tttataagaaaa

SEQ ID NO: 2669253 - DNA, 14 bp, Homo sapiens
tttataagaaaaac

SEQ ID NO: 2669254 - DNA, 18 bp, Homo sapiens
tttataagaaaaactttt

SEQ ID NO: 2669255 - DNA, 13 bp, Homo sapiens
tttatactgtata

SEQ ID NO: 2669256 - DNA, 14 bp, Homo sapiens
tttcagcagactga

SEQ ID NO: 2669257 - DNA, 20 bp, Homo sapiens
tttcagcattgatatttgtg

SEQ ID NO: 2669258 - DNA, 16 bp, Homo sapiens
tttcatatttgcacta

SEQ ID NO: 2669259 - DNA, 20 bp, Homo sapiens
tttcccagctacacctttct

SEQ ID NO: 2669260 - DNA, 22 bp, Homo sapiens
tttccctgcttaatgaaaagct

SEQ ID NO: 2669261 - DNA, 13 bp, Homo sapiens
tttcctctgcttt

SEQ ID NO: 2669262 - DNA, 19 bp, Homo sapiens
tttctacttgttataaact

SEQ ID NO: 2669263 - DNA, 16 bp, Homo sapiens
tttctctcctcacaca

SEQ ID NO: 2669264 - DNA, 18 bp, Homo sapiens
tttctgaagctttaccag

SEQ ID NO: 2669265 - DNA, 19 bp, Homo sapiens
tttctgctggaaacagact

SEQ ID NO: 2669266 - DNA, 20 bp, Homo sapiens
tttgaatctatttatcttca

SEQ ID NO: 2669267 - DNA, 19 bp, Homo sapiens
tttgacgggaaacaaaact

SEQ ID NO: 2669268 - DNA, 12 bp, Homo sapiens
tttgatcttcaa

SEQ ID NO: 2669269 - DNA, 15 bp, Homo sapiens
tttgatcttcaacaa

SEQ ID NO: 2669270 - DNA, 22 bp, Homo sapiens
tttgggaaaaaaacatacacaa

SEQ ID NO: 2669271 - DNA, 17 bp, Homo sapiens
tttgtaaagtccccaga

SEQ ID NO: 2669272 - DNA, 10 bp, Homo sapiens
tttgtatgtt

SEQ ID NO: 2669273 - DNA, 24 bp, Homo sapiens
tttgtgaaggcctcgcaggaagac

SEQ ID NO: 2669274 - DNA, 13 bp, Homo sapiens
tttgtgtatttaa

SEQ ID NO: 2669275 - DNA, 14 bp, Homo sapiens
tttgttcccatcct

SEQ ID NO: 2669276 - DNA, 13 bp, Homo sapiens
ttttaattaaata

SEQ ID NO: 2669277 - DNA, 13 bp, Homo sapiens
ttttaatttgata

SEQ ID NO: 2669278 - DNA, 13 bp, Homo sapiens
ttttataagaaaa

SEQ ID NO: 2669279 - DNA, 13 bp, Homo sapiens
ttttatgcatgtt

SEQ ID NO: 2669280 - DNA, 22 bp, Homo sapiens
ttttctccaatttttttttcct

SEQ ID NO: 2669281 - DNA, 20 bp, Homo sapiens
ttttgcatctcacaaacata

SEQ ID NO: 2669282 - DNA, 15 bp, Homo sapiens
ttttgtaacaaatga

SEQ ID NO: 2669283 - DNA, 18 bp, Homo sapiens
ttttgtaacttccatgtg

SEQ ID NO: 2669284 - DNA, 22 bp, Homo sapiens
ttttgttcccatcctcttcttt

SEQ ID NO: 2669285 - DNA, 13 bp, Homo sapiens
tttttggacattt

SEQ ID NO: 2669286 - DNA, 13 bp, Homo sapiens
ttttttaaaaact

SEQ ID NO: 2669287 - DNA, 20 bp, Homo sapiens
ttttttaaccccgtcaacaa

SEQ ID NO: 2669288 - DNA, 23 bp, Homo sapiens
tatgttgagtcgcgcaccgaaaa

SEQ ID NO: 2669289 - DNA, 15 bp, Homo sapiens
tattagttttgcata

SEQ ID NO: 2669290 - DNA, 20 bp, Homo sapiens
tattcaataaaaaaaagaaa

SEQ ID NO: 2669291 - DNA, 22 bp, Homo sapiens
tattcaataaaaaaaagaaatg

SEQ ID NO: 2669292 - DNA, 17 bp, Homo sapiens
tattcgcttgagaaaaa

SEQ ID NO: 2669293 - DNA, 14 bp, Homo sapiens
tattgactttgtct

SEQ ID NO: 2669294 - DNA, 22 bp, Homo sapiens
tatttcaatttccaagagctga

SEQ ID NO: 2669295 - DNA, 21 bp, Homo sapiens
tgctcagggaaaagcagctct

SEQ ID NO: 2669296 - DNA, 13 bp, Homo sapiens
aaaaaaaaaccaa

SEQ ID NO: 2669297 - DNA, 10 bp, Homo sapiens
aaaaaaagaa

SEQ ID NO: 2669298 - DNA, 13 bp, Homo sapiens
aaaaaaagaataa

SEQ ID NO: 2669299 - DNA, 19 bp, Homo sapiens
aaaaactttgccagccatt

SEQ ID NO: 2669300 - DNA, 12 bp, Homo sapiens
aaaaagaaatga

SEQ ID NO: 2669301 - DNA, 13 bp, Homo sapiens
aaaacaggcagct

SEQ ID NO: 2669302 - DNA, 17 bp, Homo sapiens
aaaagaacaatattgac

SEQ ID NO: 2669303 - DNA, 13 bp, Homo sapiens
aaaagacagggct

SEQ ID NO: 2669304 - DNA, 17 bp, Homo sapiens
aaaagcagctctcccct

SEQ ID NO: 2669305 - DNA, 20 bp, Homo sapiens
aaaagctacagttttgtgaa

SEQ ID NO: 2669306 - DNA, 13 bp, Homo sapiens
aaaagctgctcag

SEQ ID NO: 2669307 - DNA, 18 bp, Homo sapiens
aaaatttattttataaga

SEQ ID NO: 2669308 - DNA, 20 bp, Homo sapiens
aaaatttattttataagaaa

SEQ ID NO: 2669309 - DNA, 21 bp, Homo sapiens
aaacatttaccaatcatatta

SEQ ID NO: 2669310 - DNA, 18 bp, Homo sapiens
aaacgaagccatctttct

SEQ ID NO: 2669311 - DNA, 23 bp, Homo sapiens
aaacttccagtgcaacactgaag

SEQ ID NO: 2669312 - DNA, 22 bp, Homo sapiens
aaagacagggctgataagctaa

SEQ ID NO: 2669313 - DNA, 19 bp, Homo sapiens
aaagatgggtgaaggctgg

SEQ ID NO: 2669314 - DNA, 14 bp, Homo sapiens
aaagccccagaaat

SEQ ID NO: 2669315 - DNA, 21 bp, Homo sapiens
aaagctgctcagggaaaagca

SEQ ID NO: 2669316 - DNA, 20 bp, Homo sapiens
aaaggagcctaggccaggtg

SEQ ID NO: 2669317 - DNA, 19 bp, Homo sapiens
aaaggttgttttgaaactg

SEQ ID NO: 2669318 - DNA, 19 bp, Homo sapiens
aaagtattttattcttatt

SEQ ID NO: 2669319 - DNA, 12 bp, Homo sapiens
aaagtccccaga

SEQ ID NO: 2669320 - DNA, 19 bp, Homo sapiens
aaagttattgtgatatcct

SEQ ID NO: 2669321 - DNA, 18 bp, Homo sapiens
aaataaaacattttcaca

SEQ ID NO: 2669322 - DNA, 22 bp, Homo sapiens
aaataaaacattttcacacaat

SEQ ID NO: 2669323 - DNA, 19 bp, Homo sapiens
aaataaagttggtcttttg

SEQ ID NO: 2669324 - DNA, 15 bp, Homo sapiens
aaatatacacacagc

SEQ ID NO: 2669325 - DNA, 22 bp, Homo sapiens
aaatattttgatcttcaacaaa

SEQ ID NO: 2669326 - DNA, 19 bp, Homo sapiens
aaatcatcaagaagggctg

SEQ ID NO: 2669327 - DNA, 23 bp, Homo sapiens
aaatcatgccattgcactccagc

SEQ ID NO: 2669328 - DNA, 22 bp, Homo sapiens
aaatgaacgatatgtagcagaa

SEQ ID NO: 2669329 - DNA, 23 bp, Homo sapiens
aaatgaacgatatgtagcagaaa

SEQ ID NO: 2669330 - DNA, 16 bp, Homo sapiens
aaatgcaaaaatctct

SEQ ID NO: 2669331 - DNA, 21 bp, Homo sapiens
aaatgctaatgtcaaacttga

SEQ ID NO: 2669332 - DNA, 18 bp, Homo sapiens
aaatgtatgattacatca

SEQ ID NO: 2669333 - DNA, 12 bp, Homo sapiens
aaattaacactg

SEQ ID NO: 2669334 - DNA, 15 bp, Homo sapiens
aaattactctttctc

SEQ ID NO: 2669335 - DNA, 21 bp, Homo sapiens
aaattaggatgtaaatctgct

SEQ ID NO: 2669336 - DNA, 22 bp, Homo sapiens
aaattagtaggctcatttactg

SEQ ID NO: 2669337 - DNA, 21 bp, Homo sapiens
aaattcaacgttaataattct

SEQ ID NO: 2669338 - DNA, 20 bp, Homo sapiens
aaattcccaacaaacattga

SEQ ID NO: 2669339 - DNA, 22 bp, Homo sapiens
aaattgtgtgtgctctgcttca

SEQ ID NO: 2669340 - DNA, 19 bp, Homo sapiens
aaatttattttataagaaa

SEQ ID NO: 2669341 - DNA, 18 bp, Homo sapiens
aacaaacattgatgctga

SEQ ID NO: 2669342 - DNA, 19 bp, Homo sapiens
aacaaatctaggaaaatat

SEQ ID NO: 2669343 - DNA, 21 bp, Homo sapiens
aacaaatctaggaaaatattt

SEQ ID NO: 2669344 - DNA, 19 bp, Homo sapiens
aacaaatgaacgatatgta

SEQ ID NO: 2669345 - DNA, 16 bp, Homo sapiens
aacaatattgtctgaa

SEQ ID NO: 2669346 - DNA, 17 bp, Homo sapiens
aacaccattgaaggctt

SEQ ID NO: 2669347 - DNA, 13 bp, Homo sapiens
aacacgcaggagc

SEQ ID NO: 2669348 - DNA, 14 bp, Homo sapiens
aacacgcaggagca

SEQ ID NO: 2669349 - DNA, 18 bp, Homo sapiens
aacactatatggcagtgt

SEQ ID NO: 2669350 - DNA, 20 bp, Homo sapiens
aacactatatggcagtgtct

SEQ ID NO: 2669351 - DNA, 14 bp, Homo sapiens
aacactgcttgtgt

SEQ ID NO: 2669352 - DNA, 17 bp, Homo sapiens
aacactgcttgtgtttt

SEQ ID NO: 2669353 - DNA, 16 bp, Homo sapiens
aacactgtcttgaaga

SEQ ID NO: 2669354 - DNA, 18 bp, Homo sapiens
aacagccactacattact

SEQ ID NO: 2669355 - DNA, 17 bp, Homo sapiens
aacaggaccgggtggaa

SEQ ID NO: 2669356 - DNA, 21 bp, Homo sapiens
aacagttaattagttaacagt

SEQ ID NO: 2669357 - DNA, 17 bp, Homo sapiens
aacatgtataatatttt

SEQ ID NO: 2669358 - DNA, 13 bp, Homo sapiens
aacattcaggagc

SEQ ID NO: 2669359 - DNA, 13 bp, Homo sapiens
aacattttcacac

SEQ ID NO: 2669360 - DNA, 20 bp, Homo sapiens
aaccatgaagtctctaacaa

SEQ ID NO: 2669361 - DNA, 15 bp, Homo sapiens
aaccattttcatttg

SEQ ID NO: 2669362 - DNA, 16 bp, Homo sapiens
aacccagcaacagaaa

SEQ ID NO: 2669363 - DNA, 17 bp, Homo sapiens
aacccatattgtaaaac

SEQ ID NO: 2669364 - DNA, 17 bp, Homo sapiens
aaccccgtcaacaaatc

SEQ ID NO: 2669365 - DNA, 23 bp, Homo sapiens
aacccttctcctcttgtaaataa

SEQ ID NO: 2669366 - DNA, 12 bp, Homo sapiens
aacctatttctc

SEQ ID NO: 2669367 - DNA, 15 bp, Homo sapiens
aacctatttctcttt

SEQ ID NO: 2669368 - DNA, 18 bp, Homo sapiens
aacctatttctctttctt

SEQ ID NO: 2669369 - DNA, 15 bp, Homo sapiens
aacctattttgaagt

SEQ ID NO: 2669370 - DNA, 21 bp, Homo sapiens
aacctctcctcatgttctgct

SEQ ID NO: 2669371 - DNA, 15 bp, Homo sapiens
aacgcagacactgag

SEQ ID NO: 2669372 - DNA, 12 bp, Homo sapiens
aactcagaaggg

SEQ ID NO: 2669373 - DNA, 12 bp, Homo sapiens
aactctctgaac

SEQ ID NO: 2669374 - DNA, 18 bp, Homo sapiens
aactgcaaagtgaagttg

SEQ ID NO: 2669375 - DNA, 22 bp, Homo sapiens
aacttcttataggaaagcttga

SEQ ID NO: 2669376 - DNA, 13 bp, Homo sapiens
aactttaaattat

SEQ ID NO: 2669377 - DNA, 13 bp, Homo sapiens
aactttatttcca

SEQ ID NO: 2669378 - DNA, 12 bp, Homo sapiens
aagaaaaacttt

SEQ ID NO: 2669379 - DNA, 21 bp, Homo sapiens
aagaagggctgcatgatgttt

SEQ ID NO: 2669380 - DNA, 22 bp, Homo sapiens
aagaagggctgcatgatgtttg

SEQ ID NO: 2669381 - DNA, 20 bp, Homo sapiens
aagaagtaggggaagacatg

SEQ ID NO: 2669382 - DNA, 14 bp, Homo sapiens
aagacactgaaata

SEQ ID NO: 2669383 - DNA, 21 bp, Homo sapiens
aagacactgaaatatacacac

SEQ ID NO: 2669384 - DNA, 17 bp, Homo sapiens
caagtagcatttactgt

SEQ ID NO: 2669385 - DNA, 12 bp, Homo sapiens
caatatagcaag

SEQ ID NO: 2669386 - DNA, 12 bp, Homo sapiens
caatatcctttg

SEQ ID NO: 2669387 - DNA, 20 bp, Homo sapiens
caatatcctttgcctcaagg

SEQ ID NO: 2669388 - DNA, 14 bp, Homo sapiens
caatattgactttg

SEQ ID NO: 2669389 - DNA, 19 bp, Homo sapiens
caatattttccatgaaaat

SEQ ID NO: 2669390 - DNA, 12 bp, Homo sapiens
caatcccagcta

SEQ ID NO: 2669391 - DNA, 17 bp, Homo sapiens
caatcccagctacctca

SEQ ID NO: 2669392 - DNA, 14 bp, Homo sapiens
caatgactaattct

SEQ ID NO: 2669393 - DNA, 21 bp, Homo sapiens
caatgactaattcttgcatat

SEQ ID NO: 2669394 - DNA, 16 bp, Homo sapiens
caatggtttgcaagga

SEQ ID NO: 2669395 - DNA, 18 bp, Homo sapiens
caatggtttgcaaggaag

SEQ ID NO: 2669396 - DNA, 19 bp, Homo sapiens
caatggtttgcaaggaagc

SEQ ID NO: 2669397 - DNA, 21 bp, Homo sapiens
caatgtttatttcataaagaa

SEQ ID NO: 2669398 - DNA, 18 bp, Homo sapiens
caatgtttttaaaaatct

SEQ ID NO: 2669399 - DNA, 13 bp, Homo sapiens
caatttaaagcaa

SEQ ID NO: 2669400 - DNA, 13 bp, Homo sapiens
cacaaaaaagaag

SEQ ID NO: 2669401 - DNA, 20 bp, Homo sapiens
cacaaagagaaaaagaaatg

SEQ ID NO: 2669402 - DNA, 22 bp, Homo sapiens
cacaaagatgggtgaaggctgg

SEQ ID NO: 2669403 - DNA, 15 bp, Homo sapiens
cacaaagggcccaga

SEQ ID NO: 2669404 - DNA, 13 bp, Homo sapiens
cacaatacaataa

SEQ ID NO: 2669405 - DNA, 21 bp, Homo sapiens
cacaataccttatttaagtaa

SEQ ID NO: 2669406 - DNA, 13 bp, Homo sapiens
cacactggactcc

SEQ ID NO: 2669407 - DNA, 20 bp, Homo sapiens
cacactggactccggccctc

SEQ ID NO: 2669408 - DNA, 18 bp, Homo sapiens
cacagactcaaatgctca

SEQ ID NO: 2669409 - DNA, 16 bp, Homo sapiens
cacaggatgaagcatt

SEQ ID NO: 2669410 - DNA, 22 bp, Homo sapiens
cacagtggaaagacagcttctc

SEQ ID NO: 2669411 - DNA, 22 bp, Homo sapiens
cacagtgtgaataaagtgctgc

SEQ ID NO: 2669412 - DNA, 18 bp, Homo sapiens
cacatgccctaatgtctg

SEQ ID NO: 2669413 - DNA, 20 bp, Homo sapiens
cacatgccctaatgtctgta

SEQ ID NO: 2669414 - DNA, 18 bp, Homo sapiens
caccactcaaaggccaga

SEQ ID NO: 2669415 - DNA, 16 bp, Homo sapiens
caccaggtagaacaca

SEQ ID NO: 2669416 - DNA, 13 bp, Homo sapiens
caccattcaggtc

SEQ ID NO: 2669417 - DNA, 20 bp, Homo sapiens
cacccaagacctcagggcac

SEQ ID NO: 2669418 - DNA, 13 bp, Homo sapiens
cacccaccctggg

SEQ ID NO: 2669419 - DNA, 14 bp, Homo sapiens
caccgtactgtgga

SEQ ID NO: 2669420 - DNA, 13 bp, Homo sapiens
cacctgaactgaa

SEQ ID NO: 2669421 - DNA, 17 bp, Homo sapiens
cacctgaactgaacacc

SEQ ID NO: 2669422 - DNA, 23 bp, Homo sapiens
cacctgccaccctgggcctggca

SEQ ID NO: 2669423 - DNA, 16 bp, Homo sapiens
cacctgtaatcccagc

SEQ ID NO: 2669424 - DNA, 10 bp, Homo sapiens
caccttcacc

SEQ ID NO: 2669425 - DNA, 22 bp, Homo sapiens
cacctttcataatctttgcttt

SEQ ID NO: 2669426 - DNA, 16 bp, Homo sapiens
cacctttctcctttgt

SEQ ID NO: 2669427 - DNA, 19 bp, Homo sapiens
cacgcaggagcacacccag

SEQ ID NO: 2669428 - DNA, 16 bp, Homo sapiens
cacgcctcccactggg

SEQ ID NO: 2669429 - DNA, 17 bp, Homo sapiens
cacgcctcccactgggg

SEQ ID NO: 2669430 - DNA, 22 bp, Homo sapiens
cacgcctgtaatcccagcactt

SEQ ID NO: 2669431 - DNA, 18 bp, Homo sapiens
cacgctttcagcgaatga

SEQ ID NO: 2669432 - DNA, 15 bp, Homo sapiens
cacgttttgttttgt

SEQ ID NO: 2669433 - DNA, 22 bp, Homo sapiens
cactcaaaggccagacctgcag

SEQ ID NO: 2669434 - DNA, 22 bp, Homo sapiens
cactcagctcttggctccactg

SEQ ID NO: 2669435 - DNA, 16 bp, Homo sapiens
cactcatcccctcact

SEQ ID NO: 2669436 - DNA, 17 bp, Homo sapiens
cactctgtgtctgagtg

SEQ ID NO: 2669437 - DNA, 23 bp, Homo sapiens
cactctgtgtctgagtggcttca

SEQ ID NO: 2669438 - DNA, 13 bp, Homo sapiens
cactcttctcagc

SEQ ID NO: 2669439 - DNA, 16 bp, Homo sapiens
cactgaaatatacaca

SEQ ID NO: 2669440 - DNA, 20 bp, Homo sapiens
cactgaaatatacacacagc

SEQ ID NO: 2669441 - DNA, 23 bp, Homo sapiens
cactgatttccccttttgcattc

SEQ ID NO: 2669442 - DNA, 15 bp, Homo sapiens
cactgcctctcacag

SEQ ID NO: 2669443 - DNA, 17 bp, Homo sapiens
cactgcctctcacagct

SEQ ID NO: 2669444 - DNA, 19 bp, Homo sapiens
cactggactccggccctcc

SEQ ID NO: 2669445 - DNA, 16 bp, Homo sapiens
cactgtgagctcccag

SEQ ID NO: 2669446 - DNA, 15 bp, Homo sapiens
cactgtgtgctattt

SEQ ID NO: 2669447 - DNA, 19 bp, Homo sapiens
cagaaactgttcccacctg

SEQ ID NO: 2669448 - DNA, 15 bp, Homo sapiens
cagaagaaccctggc

SEQ ID NO: 2669449 - DNA, 17 bp, Homo sapiens
cagaagctaagctgcag

SEQ ID NO: 2669450 - DNA, 17 bp, Homo sapiens
cagaaggagacaggcag

SEQ ID NO: 2669451 - DNA, 18 bp, Homo sapiens
cagaaggagacaggcaga

SEQ ID NO: 2669452 - DNA, 14 bp, Homo sapiens
cagaatacacttaa

SEQ ID NO: 2669453 - DNA, 19 bp, Homo sapiens
cagaatagatagcactgaa

SEQ ID NO: 2669454 - DNA, 20 bp, Homo sapiens
cagacctgcagacgcccaga

SEQ ID NO: 2669455 - DNA, 21 bp, Homo sapiens
cagactcacaacctgaaccta

SEQ ID NO: 2669456 - DNA, 16 bp, Homo sapiens
cagactgatcaggacc

SEQ ID NO: 2669457 - DNA, 15 bp, Homo sapiens
cagagaaagcgcaga

SEQ ID NO: 2669458 - DNA, 16 bp, Homo sapiens
cagagaaagcgcagat

SEQ ID NO: 2669459 - DNA, 17 bp, Homo sapiens
cagagaaagcgcagatg

SEQ ID NO: 2669460 - DNA, 19 bp, Homo sapiens
cagagaagctctcgggcta

SEQ ID NO: 2669461 - DNA, 14 bp, Homo sapiens
cagaggactgtgat

SEQ ID NO: 2669462 - DNA, 23 bp, Homo sapiens
cagagtgcaagcccctgctccag

SEQ ID NO: 2669463 - DNA, 16 bp, Homo sapiens
cagatggaaaggagcc

SEQ ID NO: 2669464 - DNA, 19 bp, Homo sapiens
cagattatgagacacagga

SEQ ID NO: 2669465 - DNA, 18 bp, Homo sapiens
cagcagactgatcaggac

SEQ ID NO: 2669466 - DNA, 21 bp, Homo sapiens
cagcatcttaccttcatatgc

SEQ ID NO: 2669467 - DNA, 20 bp, Homo sapiens
cagcattgatatttgtgcat

SEQ ID NO: 2669468 - DNA, 13 bp, Homo sapiens
cagcattttcctc

SEQ ID NO: 2669469 - DNA, 13 bp, Homo sapiens
cagccagaggcac

SEQ ID NO: 2669470 - DNA, 16 bp, Homo sapiens
cagccagggcctgcga

SEQ ID NO: 2669471 - DNA, 23 bp, Homo sapiens
cagccagggcctgcgagggcagc

SEQ ID NO: 2669472 - DNA, 23 bp, Homo sapiens
cagcgggaatggcagctgccacg

SEQ ID NO: 2669473 - DNA, 15 bp, Homo sapiens
cagcgtactcatcat

SEQ ID NO: 2669474 - DNA, 18 bp, Homo sapiens
cagctattgatataaata

SEQ ID NO: 2669475 - DNA, 16 bp, Homo sapiens
cagctcataagagcca

SEQ ID NO: 2669476 - DNA, 16 bp, Homo sapiens
cagctcttggctccac

SEQ ID NO: 2669477 - DNA, 22 bp, Homo sapiens
cagctgaaatatgctggctgga

SEQ ID NO: 2669478 - DNA, 18 bp, Homo sapiens
cagctgagtgaaaaatct

SEQ ID NO: 2669479 - DNA, 12 bp, Homo sapiens
cagctgagttgt

SEQ ID NO: 2669480 - DNA, 21 bp, Homo sapiens
cagctgatgactcaagattcc

SEQ ID NO: 2669481 - DNA, 23 bp, Homo sapiens
cagctgatgactcaagattccca

SEQ ID NO: 2669482 - DNA, 20 bp, Homo sapiens
cagcttctcatcctgcaggc

SEQ ID NO: 2669483 - DNA, 19 bp, Homo sapiens
cagcttgatcaaaggcaca

SEQ ID NO: 2669484 - DNA, 17 bp, Homo sapiens
caggacctccaagccac

SEQ ID NO: 2669485 - DNA, 17 bp, Homo sapiens
caggacgtgggctgggc

SEQ ID NO: 2669486 - DNA, 15 bp, Homo sapiens
caggacttaaaatga

SEQ ID NO: 2669487 - DNA, 19 bp, Homo sapiens
caggagcacacccagcccc

SEQ ID NO: 2669488 - DNA, 12 bp, Homo sapiens
caggagcttcct

SEQ ID NO: 2669489 - DNA, 17 bp, Homo sapiens
caggagttcgagaccag

SEQ ID NO: 2669490 - DNA, 20 bp, Homo sapiens
caggagttctgctcattcta

SEQ ID NO: 2669491 - DNA, 15 bp, Homo sapiens
caggatggtaattct

SEQ ID NO: 2669492 - DNA, 17 bp, Homo sapiens
caggattcctcttttct

SEQ ID NO: 2669493 - DNA, 22 bp, Homo sapiens
caggattcctcttttctctgcc

SEQ ID NO: 2669494 - DNA, 21 bp, Homo sapiens
caggcagctcataagagccac

SEQ ID NO: 2669495 - DNA, 19 bp, Homo sapiens
caggcagctttttctctcc

SEQ ID NO: 2669496 - DNA, 18 bp, Homo sapiens
caggccccaggcagggcc

SEQ ID NO: 2669497 - DNA, 21 bp, Homo sapiens
caggcggtgggcacccaccct

SEQ ID NO: 2669498 - DNA, 16 bp, Homo sapiens
caggcttgcctgcagg

SEQ ID NO: 2669499 - DNA, 17 bp, Homo sapiens
cagggaaaagcagctct

SEQ ID NO: 2669500 - DNA, 19 bp, Homo sapiens
cagggaaaagcagctctcc

SEQ ID NO: 2669501 - DNA, 20 bp, Homo sapiens
cagggaaaagcagctctccc

SEQ ID NO: 2669502 - DNA, 14 bp, Homo sapiens
ctcttgtaaataaa

SEQ ID NO: 2669503 - DNA, 20 bp, Homo sapiens
ctcttgtaaataaagccctg

SEQ ID NO: 2669504 - DNA, 14 bp, Homo sapiens
ctgaaaacctctcc

SEQ ID NO: 2669505 - DNA, 15 bp, Homo sapiens
ctgaaaacctctcct

SEQ ID NO: 2669506 - DNA, 18 bp, Homo sapiens
ctgaagctttaccagctg

SEQ ID NO: 2669507 - DNA, 19 bp, Homo sapiens
ctgaagggatatgtgaaac

SEQ ID NO: 2669508 - DNA, 17 bp, Homo sapiens
ctgacagtcatgcagtc

SEQ ID NO: 2669509 - DNA, 13 bp, Homo sapiens
ctgaccctgtata

SEQ ID NO: 2669510 - DNA, 15 bp, Homo sapiens
ctgaccctgtatata

SEQ ID NO: 2669511 - DNA, 21 bp, Homo sapiens
ctgaccctgtatatagcccag

SEQ ID NO: 2669512 - DNA, 13 bp, Homo sapiens
ctgaccctgtgga

SEQ ID NO: 2669513 - DNA, 22 bp, Homo sapiens
ctgagccagtgtcaggaggaag

SEQ ID NO: 2669514 - DNA, 13 bp, Homo sapiens
ctgagtggcttca

SEQ ID NO: 2669515 - DNA, 15 bp, Homo sapiens
ctgagtggcttcact

SEQ ID NO: 2669516 - DNA, 20 bp, Homo sapiens
ctgagttgacttgacagaac

SEQ ID NO: 2669517 - DNA, 20 bp, Homo sapiens
ctgatgactcaagattccca

SEQ ID NO: 2669518 - DNA, 14 bp, Homo sapiens
ctgatgacttgctt

SEQ ID NO: 2669519 - DNA, 23 bp, Homo sapiens
ctgcaggccaggccagctgcctc

SEQ ID NO: 2669520 - DNA, 16 bp, Homo sapiens
ctgcataccaacctgg

SEQ ID NO: 2669521 - DNA, 16 bp, Homo sapiens
ctgcatgatgtttgcc

SEQ ID NO: 2669522 - DNA, 20 bp, Homo sapiens
ctgcatgatgtttgcccaaa

SEQ ID NO: 2669523 - DNA, 16 bp, Homo sapiens
ctgcatttgtatattt

SEQ ID NO: 2669524 - DNA, 16 bp, Homo sapiens
ctgccaccctgggcct

SEQ ID NO: 2669525 - DNA, 11 bp, Homo sapiens
ctgccagggcc

SEQ ID NO: 2669526 - DNA, 16 bp, Homo sapiens
ctgcccccgcatcccc

SEQ ID NO: 2669527 - DNA, 20 bp, Homo sapiens
ctgcccccgcatcccctgcc

SEQ ID NO: 2669528 - DNA, 23 bp, Homo sapiens
ctgcccccgcatcccctgcctcc

SEQ ID NO: 2669529 - DNA, 10 bp, Homo sapiens
ctgccctccc

SEQ ID NO: 2669530 - DNA, 16 bp, Homo sapiens
ctgcctctcacagctg

SEQ ID NO: 2669531 - DNA, 15 bp, Homo sapiens
ctgcgagggcagcgg

SEQ ID NO: 2669532 - DNA, 19 bp, Homo sapiens
ctgcgcccagtccttccac

SEQ ID NO: 2669533 - DNA, 23 bp, Homo sapiens
ctgcgcccagtccttccacctcg

SEQ ID NO: 2669534 - DNA, 16 bp, Homo sapiens
ctgcggagcaagagga

SEQ ID NO: 2669535 - DNA, 20 bp, Homo sapiens
ctgcgtgcagggacaaagag

SEQ ID NO: 2669536 - DNA, 23 bp, Homo sapiens
ctgctactcaagtagcatttact

SEQ ID NO: 2669537 - DNA, 23 bp, Homo sapiens
ctgctcagggaaaagcagctctc

SEQ ID NO: 2669538 - DNA, 23 bp, Homo sapiens
ctgctcattctaatgatggccca

SEQ ID NO: 2669539 - DNA, 22 bp, Homo sapiens
ctgctgtaaatttggcttctgt

SEQ ID NO: 2669540 - DNA, 13 bp, Homo sapiens
ctggacacaggcc

SEQ ID NO: 2669541 - DNA, 14 bp, Homo sapiens
ctggacacaggcct

SEQ ID NO: 2669542 - DNA, 20 bp, Homo sapiens
ctggactagagggacctctc

SEQ ID NO: 2669543 - DNA, 18 bp, Homo sapiens
ctggactccggccctcct

SEQ ID NO: 2669544 - DNA, 14 bp, Homo sapiens
ctggactgacctgg

SEQ ID NO: 2669545 - DNA, 15 bp, Homo sapiens
ctggagccatgggca

SEQ ID NO: 2669546 - DNA, 19 bp, Homo sapiens
ctggcaatgtttatttcat

SEQ ID NO: 2669547 - DNA, 18 bp, Homo sapiens
ctggcatgctaaagcctt

SEQ ID NO: 2669548 - DNA, 17 bp, Homo sapiens
ctggccaacatggtaaa

SEQ ID NO: 2669549 - DNA, 22 bp, Homo sapiens
ctggccatctggttaggatggc

SEQ ID NO: 2669550 - DNA, 16 bp, Homo sapiens
ctggccccgccgcctg

SEQ ID NO: 2669551 - DNA, 14 bp, Homo sapiens
ctggcctcccacag

SEQ ID NO: 2669552 - DNA, 19 bp, Homo sapiens
ctggcctcccacagactca

SEQ ID NO: 2669553 - DNA, 11 bp, Homo sapiens
ctgggaaacag

SEQ ID NO: 2669554 - DNA, 15 bp, Homo sapiens
ctgggaaacagaggc

SEQ ID NO: 2669555 - DNA, 16 bp, Homo sapiens
ctgggagaaaatcatc

SEQ ID NO: 2669556 - DNA, 17 bp, Homo sapiens
ctgggaggcgggcgcac

SEQ ID NO: 2669557 - DNA, 19 bp, Homo sapiens
ctgggatgtttctgtcaca

SEQ ID NO: 2669558 - DNA, 23 bp, Homo sapiens
ctgggcacacgcctcccactggg

SEQ ID NO: 2669559 - DNA, 17 bp, Homo sapiens
ctgggcccacaaaggca

SEQ ID NO: 2669560 - DNA, 16 bp, Homo sapiens
ctggggtccagggagc

SEQ ID NO: 2669561 - DNA, 19 bp, Homo sapiens
ctgggtgacagagcaagac

SEQ ID NO: 2669562 - DNA, 14 bp, Homo sapiens
ctggtactcaagcc

SEQ ID NO: 2669563 - DNA, 17 bp, Homo sapiens
ctggtcaggtatttcag

SEQ ID NO: 2669564 - DNA, 13 bp, Homo sapiens
ctggtccacaggg

SEQ ID NO: 2669565 - DNA, 16 bp, Homo sapiens
ctggtccacagggcac

SEQ ID NO: 2669566 - DNA, 16 bp, Homo sapiens
ctggttaggatggcag

SEQ ID NO: 2669567 - DNA, 16 bp, Homo sapiens
ctgtactgggccatgt

SEQ ID NO: 2669568 - DNA, 20 bp, Homo sapiens
ctgtatcagtggatttccca

SEQ ID NO: 2669569 - DNA, 20 bp, Homo sapiens
ctgtattttgaaaatgcttt

SEQ ID NO: 2669570 - DNA, 14 bp, Homo sapiens
ctgtcatagaaagt

SEQ ID NO: 2669571 - DNA, 19 bp, Homo sapiens
ctgtccctagtaaaaatac

SEQ ID NO: 2669572 - DNA, 14 bp, Homo sapiens
ctgtgaaattccca

SEQ ID NO: 2669573 - DNA, 21 bp, Homo sapiens
ctgtgaattgagctgcagaaa

SEQ ID NO: 2669574 - DNA, 20 bp, Homo sapiens
ctgtgagctcccaggtgcag

SEQ ID NO: 2669575 - DNA, 14 bp, Homo sapiens
ctgtgatgccctgc

SEQ ID NO: 2669576 - DNA, 19 bp, Homo sapiens
ctgtggaaaagaaacacgc

SEQ ID NO: 2669577 - DNA, 22 bp, Homo sapiens
ctgtggaaaagaaacacgcact

SEQ ID NO: 2669578 - DNA, 18 bp, Homo sapiens
ctgtgtctgagtggcttc

SEQ ID NO: 2669579 - DNA, 20 bp, Homo sapiens
ctgtgtctttggtttgtgct

SEQ ID NO: 2669580 - DNA, 17 bp, Homo sapiens
ctgttatcctatttaga

SEQ ID NO: 2669581 - DNA, 22 bp, Homo sapiens
ctgttcaatgtttttaaaaatc

SEQ ID NO: 2669582 - DNA, 22 bp, Homo sapiens
ctgttgaattttgttctctggg

SEQ ID NO: 2669583 - DNA, 23 bp, Homo sapiens
ctgttgaattttgttctctggga

SEQ ID NO: 2669584 - DNA, 21 bp, Homo sapiens
ctgttgtcaccttcacctcct

SEQ ID NO: 2669585 - DNA, 23 bp, Homo sapiens
ctgttgtcaccttcacctccttt

SEQ ID NO: 2669586 - DNA, 15 bp, Homo sapiens
ctgtttatgcttttg

SEQ ID NO: 2669587 - DNA, 21 bp, Homo sapiens
cttaaggaacatctctgcttt

SEQ ID NO: 2669588 - DNA, 16 bp, Homo sapiens
cttacggccctggcct

SEQ ID NO: 2669589 - DNA, 14 bp, Homo sapiens
cttactccaggaga

SEQ ID NO: 2669590 - DNA, 23 bp, Homo sapiens
cttatcacaaaaaagaaaatgaa

SEQ ID NO: 2669591 - DNA, 14 bp, Homo sapiens
cttatctccaagac

SEQ ID NO: 2669592 - DNA, 16 bp, Homo sapiens
cttatctccaagacca

SEQ ID NO: 2669593 - DNA, 18 bp, Homo sapiens
cttcaccccaatcccagc

SEQ ID NO: 2669594 - DNA, 14 bp, Homo sapiens
cttcacctctgcta

SEQ ID NO: 2669595 - DNA, 18 bp, Homo sapiens
cttcactgtcctccaagc

SEQ ID NO: 2669596 - DNA, 20 bp, Homo sapiens
cttcagtaacccccactgga

SEQ ID NO: 2669597 - DNA, 22 bp, Homo sapiens
cttcatgcaggtgaaacccagt

SEQ ID NO: 2669598 - DNA, 21 bp, Homo sapiens
cttccacttttttttgtatgt

SEQ ID NO: 2669599 - DNA, 15 bp, Homo sapiens
cttccttttgaggga

SEQ ID NO: 2669600 - DNA, 21 bp, Homo sapiens
cttcgacagcattttcctctg

SEQ ID NO: 2669601 - DNA, 15 bp, Homo sapiens
cttctataattgtat

SEQ ID NO: 2669602 - DNA, 15 bp, Homo sapiens
cttctcatcctgcag

SEQ ID NO: 2669603 - DNA, 16 bp, Homo sapiens
cttctcatcctgcagg

SEQ ID NO: 2669604 - DNA, 14 bp, Homo sapiens
cttctcctcttgta

SEQ ID NO: 2669605 - DNA, 23 bp, Homo sapiens
cttctcctcttgtaaataaagcc

SEQ ID NO: 2669606 - DNA, 18 bp, Homo sapiens
cttctctctctaaaatga

SEQ ID NO: 2669607 - DNA, 14 bp, Homo sapiens
cttctggcctccca

SEQ ID NO: 2669608 - DNA, 15 bp, Homo sapiens
cttctggcctcccac

SEQ ID NO: 2669609 - DNA, 12 bp, Homo sapiens
cttcttttagca

SEQ ID NO: 2669610 - DNA, 14 bp, Homo sapiens
cttgacagaacact

SEQ ID NO: 2669611 - DNA, 15 bp, Homo sapiens
cttgagaaaaaaaga

SEQ ID NO: 2669612 - DNA, 19 bp, Homo sapiens
cttgagaactttatttcca

SEQ ID NO: 2669613 - DNA, 21 bp, Homo sapiens
cttgaggaaacaacagcttta

SEQ ID NO: 2669614 - DNA, 12 bp, Homo sapiens
cttgagtaaaat

SEQ ID NO: 2669615 - DNA, 16 bp, Homo sapiens
cttgagtcacaaagaa

SEQ ID NO: 2669616 - DNA, 21 bp, Homo sapiens
cttgatgagctgtgcacaaag

SEQ ID NO: 2669617 - DNA, 13 bp, Homo sapiens
cttgcatattttg

SEQ ID NO: 2669618 - DNA, 14 bp, Homo sapiens
cttgcattgcagag

SEQ ID NO: 2669619 - DNA, 21 bp, Homo sapiens
cttgccgcgtcgccctcccag

SEQ ID NO: 2669620 - DNA, 15 bp, Homo sapiens
ggcccattctacttg

SEQ ID NO: 2669621 - DNA, 14 bp, Homo sapiens
ggccccgccgcctg

SEQ ID NO: 2669622 - DNA, 15 bp, Homo sapiens
ggccccgccgcctgg

SEQ ID NO: 2669623 - DNA, 20 bp, Homo sapiens
ggccctcctaccctgcgccc

SEQ ID NO: 2669624 - DNA, 21 bp, Homo sapiens
ggccctcctaccctgcgccca

SEQ ID NO: 2669625 - DNA, 17 bp, Homo sapiens
ggcctcccacagactca

SEQ ID NO: 2669626 - DNA, 19 bp, Homo sapiens
ggcctcgcaggaagaccca

SEQ ID NO: 2669627 - DNA, 23 bp, Homo sapiens
ggcctgaagagtcctctgaatga

SEQ ID NO: 2669628 - DNA, 14 bp, Homo sapiens
ggcctggcagctca

SEQ ID NO: 2669629 - DNA, 16 bp, Homo sapiens
ggcctggcagctcagc

SEQ ID NO: 2669630 - DNA, 19 bp, Homo sapiens
ggcgccgcaaaccacactg

SEQ ID NO: 2669631 - DNA, 22 bp, Homo sapiens
ggcgccgcaaaccacactggac

SEQ ID NO: 2669632 - DNA, 23 bp, Homo sapiens
ggcggagctggccccgccgcctg

SEQ ID NO: 2669633 - DNA, 21 bp, Homo sapiens
ggcggtgggcacccaccctgg

SEQ ID NO: 2669634 - DNA, 22 bp, Homo sapiens
ggcggtgggcacccaccctggg

SEQ ID NO: 2669635 - DNA, 16 bp, Homo sapiens
ggctgcatgatgtttg

SEQ ID NO: 2669636 - DNA, 22 bp, Homo sapiens
ggctgcatgatgtttgcccaaa

SEQ ID NO: 2669637 - DNA, 14 bp, Homo sapiens
ggctggagtgagga

SEQ ID NO: 2669638 - DNA, 13 bp, Homo sapiens
ggcttacacccac

SEQ ID NO: 2669639 - DNA, 17 bp, Homo sapiens
ggcttcactcctgctgt

SEQ ID NO: 2669640 - DNA, 18 bp, Homo sapiens
ggcttttactgaagcctt

SEQ ID NO: 2669641 - DNA, 16 bp, Homo sapiens
gggaatggcacagccc

SEQ ID NO: 2669642 - DNA, 17 bp, Homo sapiens
gggacccccgccccctg

SEQ ID NO: 2669643 - DNA, 24 bp, Homo sapiens
gggacccccgccccctgccctccc

SEQ ID NO: 2669644 - DNA, 12 bp, Homo sapiens
gggacctctccc

SEQ ID NO: 2669645 - DNA, 21 bp, Homo sapiens
gggacgaagaagagccacagt

SEQ ID NO: 2669646 - DNA, 19 bp, Homo sapiens
gggactgaaaacctctcct

SEQ ID NO: 2669647 - DNA, 14 bp, Homo sapiens
gggagaaaatcatc

SEQ ID NO: 2669648 - DNA, 21 bp, Homo sapiens
gggagcctccctgcctcaggc

SEQ ID NO: 2669649 - DNA, 18 bp, Homo sapiens
gggagctagccagaggac

SEQ ID NO: 2669650 - DNA, 17 bp, Homo sapiens
gggaggccagtgagcca

SEQ ID NO: 2669651 - DNA, 16 bp, Homo sapiens
gggcacaaagggccca

SEQ ID NO: 2669652 - DNA, 17 bp, Homo sapiens
gggcacaaagggcccag

SEQ ID NO: 2669653 - DNA, 19 bp, Homo sapiens
gggcacacgcctcccactg

SEQ ID NO: 2669654 - DNA, 12 bp, Homo sapiens
gggcacctgcca

SEQ ID NO: 2669655 - DNA, 23 bp, Homo sapiens
gggcaggggagggtcagccaggg

SEQ ID NO: 2669656 - DNA, 17 bp, Homo sapiens
gggccatgttgtgcctc

SEQ ID NO: 2669657 - DNA, 16 bp, Homo sapiens
gggcctggcagctcag

SEQ ID NO: 2669658 - DNA, 18 bp, Homo sapiens
ggggacccccgccccctg

SEQ ID NO: 2669659 - DNA, 14 bp, Homo sapiens
ggggagggtgacag

SEQ ID NO: 2669660 - DNA, 17 bp, Homo sapiens
ggggtccagggagcagg

SEQ ID NO: 2669661 - DNA, 12 bp, Homo sapiens
gggtcaaggaat

SEQ ID NO: 2669662 - DNA, 16 bp, Homo sapiens
gggtcagccagggcct

SEQ ID NO: 2669663 - DNA, 18 bp, Homo sapiens
gggtccaggattcctctt

SEQ ID NO: 2669664 - DNA, 11 bp, Homo sapiens
ggtagaacaca

SEQ ID NO: 2669665 - DNA, 19 bp, Homo sapiens
ggtagacctgtctcctggc

SEQ ID NO: 2669666 - DNA, 22 bp, Homo sapiens
ggtagacctgtctcctggcggt

SEQ ID NO: 2669667 - DNA, 16 bp, Homo sapiens
ggtcagaaacaggacc

SEQ ID NO: 2669668 - DNA, 19 bp, Homo sapiens
ggtcagccagggcctgcga

SEQ ID NO: 2669669 - DNA, 20 bp, Homo sapiens
ggtccagaaggagacaggca

SEQ ID NO: 2669670 - DNA, 21 bp, Homo sapiens
ggtgagagggccgggcagagg

SEQ ID NO: 2669671 - DNA, 12 bp, Homo sapiens
ggtgcaaccagg

SEQ ID NO: 2669672 - DNA, 10 bp, Homo sapiens
ggtggccatg

SEQ ID NO: 2669673 - DNA, 17 bp, Homo sapiens
ggtgggcacccaccctg

SEQ ID NO: 2669674 - DNA, 18 bp, Homo sapiens
ggtttgaatataaacact

SEQ ID NO: 2669675 - DNA, 13 bp, Homo sapiens
gtaacaaatgaac

SEQ ID NO: 2669676 - DNA, 19 bp, Homo sapiens
gtactggctgatggagtaa

SEQ ID NO: 2669677 - DNA, 18 bp, Homo sapiens
gtagaaagacagagctgg

SEQ ID NO: 2669678 - DNA, 21 bp, Homo sapiens
gtagaaagacagagctgggat

SEQ ID NO: 2669679 - DNA, 16 bp, Homo sapiens
gtagcacatgtatgct

SEQ ID NO: 2669680 - DNA, 18 bp, Homo sapiens
gtaggacccaagcagaga

SEQ ID NO: 2669681 - DNA, 21 bp, Homo sapiens
gtagtcagaattagctgcttc

SEQ ID NO: 2669682 - DNA, 13 bp, Homo sapiens
gtatacttcctta

SEQ ID NO: 2669683 - DNA, 15 bp, Homo sapiens
gtatatagcccagcc

SEQ ID NO: 2669684 - DNA, 21 bp, Homo sapiens
gtatcagtggatttcccatcc

SEQ ID NO: 2669685 - DNA, 18 bp, Homo sapiens
gtatctactttaataaat

SEQ ID NO: 2669686 - DNA, 23 bp, Homo sapiens
gtatgtttttgtgtatttgttaa

SEQ ID NO: 2669687 - DNA, 21 bp, Homo sapiens
gtattagagtttcaaccatga

SEQ ID NO: 2669688 - DNA, 18 bp, Homo sapiens
gtattcaatatcctttgc

SEQ ID NO: 2669689 - DNA, 9 bp, Homo sapiens
gtatttaac

SEQ ID NO: 2669690 - DNA, 14 bp, Homo sapiens
gtatttgttaatgg

SEQ ID NO: 2669691 - DNA, 15 bp, Homo sapiens
gtcaatgtactagga

SEQ ID NO: 2669692 - DNA, 14 bp, Homo sapiens
gtccagaaggagac

SEQ ID NO: 2669693 - DNA, 17 bp, Homo sapiens
gtccagaaggagacagg

SEQ ID NO: 2669694 - DNA, 19 bp, Homo sapiens
gtccagaaggagacaggca

SEQ ID NO: 2669695 - DNA, 18 bp, Homo sapiens
gtccaggggaggccttcc

SEQ ID NO: 2669696 - DNA, 14 bp, Homo sapiens
gtccttccacctcg

SEQ ID NO: 2669697 - DNA, 15 bp, Homo sapiens
gtcgccctcccaggc

SEQ ID NO: 2669698 - DNA, 12 bp, Homo sapiens
gtctatttgaga

SEQ ID NO: 2669699 - DNA, 22 bp, Homo sapiens
gtctctttcatgagtttttccc

SEQ ID NO: 2669700 - DNA, 11 bp, Homo sapiens
gtctgccaggg

SEQ ID NO: 2669701 - DNA, 13 bp, Homo sapiens
gtctgccagggcc

SEQ ID NO: 2669702 - DNA, 16 bp, Homo sapiens
gtctgtatcactctgt

SEQ ID NO: 2669703 - DNA, 20 bp, Homo sapiens
gtctgtgtttttttggcagt

SEQ ID NO: 2669704 - DNA, 14 bp, Homo sapiens
gtctgttttgtaaa

SEQ ID NO: 2669705 - DNA, 23 bp, Homo sapiens
gtctgttttgtaaagtccccaga

SEQ ID NO: 2669706 - DNA, 17 bp, Homo sapiens
gtctttctttttggaca

SEQ ID NO: 2669707 - DNA, 15 bp, Homo sapiens
gtctttttaaaaata

SEQ ID NO: 2669708 - DNA, 12 bp, Homo sapiens
gtgaaattccca

SEQ ID NO: 2669709 - DNA, 12 bp, Homo sapiens
gtgaaggcctcg

SEQ ID NO: 2669710 - DNA, 13 bp, Homo sapiens
gtgaaggctggca

SEQ ID NO: 2669711 - DNA, 14 bp, Homo sapiens
gtgaaggctggcat

SEQ ID NO: 2669712 - DNA, 13 bp, Homo sapiens
gtgaataaagtgc

SEQ ID NO: 2669713 - DNA, 14 bp, Homo sapiens
gtgaataaagtgct

SEQ ID NO: 2669714 - DNA, 14 bp, Homo sapiens
gtgaattgtttgaa

SEQ ID NO: 2669715 - DNA, 22 bp, Homo sapiens
gtgacagagcaagactctgtct

SEQ ID NO: 2669716 - DNA, 13 bp, Homo sapiens
gtgatcaaagcca

SEQ ID NO: 2669717 - DNA, 15 bp, Homo sapiens
gtgcaagcccctgct

SEQ ID NO: 2669718 - DNA, 22 bp, Homo sapiens
gtgcaggtagacctgtctcctg

SEQ ID NO: 2669719 - DNA, 22 bp, Homo sapiens
gtgcatgaaggtttctgaaaat

SEQ ID NO: 2669720 - DNA, 20 bp, Homo sapiens
gtgctacaggggccagaaga

SEQ ID NO: 2669721 - DNA, 16 bp, Homo sapiens
gtggaggagctcagga

SEQ ID NO: 2669722 - DNA, 20 bp, Homo sapiens
gtggctattaaaactctttt

SEQ ID NO: 2669723 - DNA, 23 bp, Homo sapiens
gtgggaaagattactttttcttt

SEQ ID NO: 2669724 - DNA, 13 bp, Homo sapiens
gtggttacacagt

SEQ ID NO: 2669725 - DNA, 14 bp, Homo sapiens
gtggttacacagtg

SEQ ID NO: 2669726 - DNA, 11 bp, Homo sapiens
gtgtttgtgtt

SEQ ID NO: 2669727 - DNA, 16 bp, Homo sapiens
gttaagctttgacact

SEQ ID NO: 2669728 - DNA, 14 bp, Homo sapiens
gttaagttctattg

SEQ ID NO: 2669729 - DNA, 13 bp, Homo sapiens
gttaatgctttct

SEQ ID NO: 2669730 - DNA, 21 bp, Homo sapiens
gttacttttcatatttgcact

SEQ ID NO: 2669731 - DNA, 13 bp, Homo sapiens
gttagggaatggc

SEQ ID NO: 2669732 - DNA, 19 bp, Homo sapiens
gttatccatttaaaaatgg

SEQ ID NO: 2669733 - DNA, 18 bp, Homo sapiens
gttcaaggccatccttcc

SEQ ID NO: 2669734 - DNA, 23 bp, Homo sapiens
gttcccatcctcttcttttagca

SEQ ID NO: 2669735 - DNA, 20 bp, Homo sapiens
gttcctcgttctccctggga

SEQ ID NO: 2669736 - DNA, 14 bp, Homo sapiens
gttctctagaaaga

SEQ ID NO: 2669737 - DNA, 14 bp, Homo sapiens
gttctctgggagaa

SEQ ID NO: 2669738 - DNA, 20 bp, Homo sapiens
gttctctgggagaaaatcat

SEQ ID NO: 2669739 - DNA, 16 bp, Homo sapiens
tgggcacacgcctccc

SEQ ID NO: 2669740 - DNA, 21 bp, Homo sapiens
tgggcacacgcctcccactgg

SEQ ID NO: 2669741 - DNA, 20 bp, Homo sapiens
tgggcacccaccctgggacc

SEQ ID NO: 2669742 - DNA, 14 bp, Homo sapiens
tgggccctctggtt

SEQ ID NO: 2669743 - DNA, 16 bp, Homo sapiens
tgggctgggcccacaa

SEQ ID NO: 2669744 - DNA, 16 bp, Homo sapiens
tgggtgaaggctggca

SEQ ID NO: 2669745 - DNA, 19 bp, Homo sapiens
tgggtgaaggctggcatga

SEQ ID NO: 2669746 - DNA, 16 bp, Homo sapiens
tgggtgaggtaataaa

SEQ ID NO: 2669747 - DNA, 15 bp, Homo sapiens
tgggttccattctca

SEQ ID NO: 2669748 - DNA, 22 bp, Homo sapiens
tggtcaaacaaactctctgaac

SEQ ID NO: 2669749 - DNA, 14 bp, Homo sapiens
tggtccacagggca

SEQ ID NO: 2669750 - DNA, 21 bp, Homo sapiens
tggtgcaggtagacctgtctc

SEQ ID NO: 2669751 - DNA, 12 bp, Homo sapiens
tggttaggatgg

SEQ ID NO: 2669752 - DNA, 22 bp, Homo sapiens
tggttaggatggcaggacgtgg

SEQ ID NO: 2669753 - DNA, 15 bp, Homo sapiens
tggtttaatttaaag

SEQ ID NO: 2669754 - DNA, 13 bp, Homo sapiens
tggttttcctgta

SEQ ID NO: 2669755 - DNA, 13 bp, Homo sapiens
tgtaaaacaggta

SEQ ID NO: 2669756 - DNA, 14 bp, Homo sapiens
tgtaaaacaggtag

SEQ ID NO: 2669757 - DNA, 13 bp, Homo sapiens
tgtaaataaagcc

SEQ ID NO: 2669758 - DNA, 19 bp, Homo sapiens
tgtaatcccagctactcgg

SEQ ID NO: 2669759 - DNA, 19 bp, Homo sapiens
tgtacaggatgctttggtt

SEQ ID NO: 2669760 - DNA, 13 bp, Homo sapiens
tgtactttgtgct

SEQ ID NO: 2669761 - DNA, 15 bp, Homo sapiens
tgtataatattttta

SEQ ID NO: 2669762 - DNA, 19 bp, Homo sapiens
tgtatgttcagaagaaatt

SEQ ID NO: 2669763 - DNA, 19 bp, Homo sapiens
tgtattgcatatatacata

SEQ ID NO: 2669764 - DNA, 17 bp, Homo sapiens
tgtcaacatgaacaaat

SEQ ID NO: 2669765 - DNA, 17 bp, Homo sapiens
tgtcctccaagccagcg

SEQ ID NO: 2669766 - DNA, 14 bp, Homo sapiens
tgtctaaaaaacaa

SEQ ID NO: 2669767 - DNA, 14 bp, Homo sapiens
tgtctcacatggga

SEQ ID NO: 2669768 - DNA, 21 bp, Homo sapiens
tgtctcctggcggttcctcgt

SEQ ID NO: 2669769 - DNA, 19 bp, Homo sapiens
tgtgagtaatctgagaaac

SEQ ID NO: 2669770 - DNA, 14 bp, Homo sapiens
tgtgattgtgccta

SEQ ID NO: 2669771 - DNA, 14 bp, Homo sapiens
tgtgcacaaagtgg

SEQ ID NO: 2669772 - DNA, 17 bp, Homo sapiens
tgtgcacaaagtggcat

SEQ ID NO: 2669773 - DNA, 14 bp, Homo sapiens
tgtgctctgcttca

SEQ ID NO: 2669774 - DNA, 16 bp, Homo sapiens
tgtggattttttccta

SEQ ID NO: 2669775 - DNA, 15 bp, Homo sapiens
tgtgggtacctgtat

SEQ ID NO: 2669776 - DNA, 21 bp, Homo sapiens
tgtggtgtttcctgcaggcca

SEQ ID NO: 2669777 - DNA, 14 bp, Homo sapiens
tgtggttaatgcca

SEQ ID NO: 2669778 - DNA, 20 bp, Homo sapiens
tgtgtatttaacagggaggg

SEQ ID NO: 2669779 - DNA, 12 bp, Homo sapiens
tgtgtctgagtg

SEQ ID NO: 2669780 - DNA, 22 bp, Homo sapiens
tgtgtggagctcgctaaagtca

SEQ ID NO: 2669781 - DNA, 18 bp, Homo sapiens
tgtgtgtgcagacttcag

SEQ ID NO: 2669782 - DNA, 20 bp, Homo sapiens
tgttaacatttttggtagtc

SEQ ID NO: 2669783 - DNA, 14 bp, Homo sapiens
tgttcaaacattta

SEQ ID NO: 2669784 - DNA, 15 bp, Homo sapiens
tgttctactttgttc

SEQ ID NO: 2669785 - DNA, 17 bp, Homo sapiens
tgttctctgggagaaaa

SEQ ID NO: 2669786 - DNA, 14 bp, Homo sapiens
tgttctgctgttct

SEQ ID NO: 2669787 - DNA, 17 bp, Homo sapiens
tgttctttttattgaat

SEQ ID NO: 2669788 - DNA, 13 bp, Homo sapiens
tgttgtcaccttc

SEQ ID NO: 2669789 - DNA, 14 bp, Homo sapiens
tgttgttccttttg

SEQ ID NO: 2669790 - DNA, 15 bp, Homo sapiens
tgttgttccttttga

SEQ ID NO: 2669791 - DNA, 16 bp, Homo sapiens
tgtttaacttcttata

SEQ ID NO: 2669792 - DNA, 19 bp, Homo sapiens
tgtttattagttttgcata

SEQ ID NO: 2669793 - DNA, 21 bp, Homo sapiens
tgtttccagtacacctttcag

SEQ ID NO: 2669794 - DNA, 11 bp, Homo sapiens
tgtttgtgtgt

SEQ ID NO: 2669795 - DNA, 19 bp, Homo sapiens
tgttttgtaaagtccccag

SEQ ID NO: 2669796 - DNA, 12 bp, Homo sapiens
ttaaaaaaagaa

SEQ ID NO: 2669797 - DNA, 18 bp, Homo sapiens
ttaaaaaaagaagagaaa

SEQ ID NO: 2669798 - DNA, 12 bp, Homo sapiens
ttaaaaaaatca

SEQ ID NO: 2669799 - DNA, 18 bp, Homo sapiens
ttaaaaaaatcaaaacaa

SEQ ID NO: 2669800 - DNA, 14 bp, Homo sapiens
ttaaaagtaaatgt

SEQ ID NO: 2669801 - DNA, 12 bp, Homo sapiens
ttaaagtatttt

SEQ ID NO: 2669802 - DNA, 17 bp, Homo sapiens
ttaaccccgtcaacaaa

SEQ ID NO: 2669803 - DNA, 19 bp, Homo sapiens
ttaaccccgtcaacaaatc

SEQ ID NO: 2669804 - DNA, 16 bp, Homo sapiens
ttaacttgtcaaaaaa

SEQ ID NO: 2669805 - DNA, 16 bp, Homo sapiens
ttaagacgtgtttgtg

SEQ ID NO: 2669806 - DNA, 17 bp, Homo sapiens
ttaagacgtgtttgtgt

SEQ ID NO: 2669807 - DNA, 21 bp, Homo sapiens
ttaagtttccttccagcccag

SEQ ID NO: 2669808 - DNA, 15 bp, Homo sapiens
ttaattcctttccag

SEQ ID NO: 2669809 - DNA, 15 bp, Homo sapiens
ttacaaacatgtggt

SEQ ID NO: 2669810 - DNA, 17 bp, Homo sapiens
ttacaagcccccccttc

SEQ ID NO: 2669811 - DNA, 17 bp, Homo sapiens
ttacacagtgtgaataa

SEQ ID NO: 2669812 - DNA, 15 bp, Homo sapiens
ttacagtctatttga

SEQ ID NO: 2669813 - DNA, 18 bp, Homo sapiens
ttaccctcctagctttcc

SEQ ID NO: 2669814 - DNA, 18 bp, Homo sapiens
ttacggccctggccttgg

SEQ ID NO: 2669815 - DNA, 20 bp, Homo sapiens
ttactggtaggaacttgaga

SEQ ID NO: 2669816 - DNA, 13 bp, Homo sapiens
ttactgtgtcttt

SEQ ID NO: 2669817 - DNA, 21 bp, Homo sapiens
ttacttttcatatttgcacta

SEQ ID NO: 2669818 - DNA, 20 bp, Homo sapiens
ttagaacactggtttaaagg

SEQ ID NO: 2669819 - DNA, 14 bp, Homo sapiens
ttagcagtaaaata

SEQ ID NO: 2669820 - DNA, 16 bp, Homo sapiens
ttagcagtaaaatagc

SEQ ID NO: 2669821 - DNA, 12 bp, Homo sapiens
ttagctgcttct

SEQ ID NO: 2669822 - DNA, 20 bp, Homo sapiens
ttagctgcttctatgtttca

SEQ ID NO: 2669823 - DNA, 18 bp, Homo sapiens
ttagtctctaaagagttt

SEQ ID NO: 2669824 - DNA, 11 bp, Homo sapiens
ttatctaattt

SEQ ID NO: 2669825 - DNA, 16 bp, Homo sapiens
ttatctaatttataaa

SEQ ID NO: 2669826 - DNA, 15 bp, Homo sapiens
ttattcaaagaaata

SEQ ID NO: 2669827 - DNA, 22 bp, Homo sapiens
ttattttataagaaaaactttt

SEQ ID NO: 2669828 - DNA, 14 bp, Homo sapiens
ttcaaattgtgtgt

SEQ ID NO: 2669829 - DNA, 17 bp, Homo sapiens
ttcaaggccatccttcc

SEQ ID NO: 2669830 - DNA, 15 bp, Homo sapiens
ttcaatatcctttgc

SEQ ID NO: 2669831 - DNA, 20 bp, Homo sapiens
ttcaatgtttttaaaaatct

SEQ ID NO: 2669832 - DNA, 17 bp, Homo sapiens
ttcaatttccaagagct

SEQ ID NO: 2669833 - DNA, 20 bp, Homo sapiens
ttcacacacagactgttgtc

SEQ ID NO: 2669834 - DNA, 14 bp, Homo sapiens
ttcacgtagaacat

SEQ ID NO: 2669835 - DNA, 22 bp, Homo sapiens
ttcactgtcctccaagccagcg

SEQ ID NO: 2669836 - DNA, 16 bp, Homo sapiens
ttcagaataagcttcc

SEQ ID NO: 2669837 - DNA, 15 bp, Homo sapiens
ttcataaagaattgt

SEQ ID NO: 2669838 - DNA, 14 bp, Homo sapiens
ttcatatttgcact

SEQ ID NO: 2669839 - DNA, 21 bp, Homo sapiens
ttcatggcctttgataaatgt

SEQ ID NO: 2669840 - DNA, 12 bp, Homo sapiens
ttccaagagctg

SEQ ID NO: 2669841 - DNA, 18 bp, Homo sapiens
ttccacactcacctctaa

SEQ ID NO: 2669842 - DNA, 20 bp, Homo sapiens
ttccacttttttttgtatgt

SEQ ID NO: 2669843 - DNA, 21 bp, Homo sapiens
ttccagtgcaacactgaagct

SEQ ID NO: 2669844 - DNA, 24 bp, Homo sapiens
ttccatgaaaatgcaacaacatgt

SEQ ID NO: 2669845 - DNA, 19 bp, Homo sapiens
ttcccatcctcttctttta

SEQ ID NO: 2669846 - DNA, 13 bp, Homo sapiens
ttccccttttgca

SEQ ID NO: 2669847 - DNA, 13 bp, Homo sapiens
ttcctctgctttg

SEQ ID NO: 2669848 - DNA, 14 bp, Homo sapiens
ttccttccagccca

SEQ ID NO: 2669849 - DNA, 16 bp, Homo sapiens
ttccttgtagcctttt

SEQ ID NO: 2669850 - DNA, 19 bp, Homo sapiens
ttccttgtagccttttgac

SEQ ID NO: 2669851 - DNA, 18 bp, Homo sapiens
ttcctttccaggtatttt

SEQ ID NO: 2669852 - DNA, 16 bp, Homo sapiens
ttcctttggaagaaaa

SEQ ID NO: 2669853 - DNA, 23 bp, Homo sapiens
ttccttttgaaagaatcagtctt

SEQ ID NO: 2669854 - DNA, 15 bp, Homo sapiens
ttcgagaccagcctg

SEQ ID NO: 2669855 - DNA, 16 bp, Homo sapiens
ttcgagaccagcctgg

SEQ ID NO: 2669856 - DNA, 19 bp, Homo sapiens
ttcgagaccagcctggcca

SEQ ID NO: 2669857 - DNA, 21 bp, Homo sapiens
ttcgatgggcccaattcttac

SEQ ID NO: 2669858 - DNA, 15 bp, Homo sapiens
aaagttttcccttga

SEQ ID NO: 2669859 - DNA, 17 bp, Homo sapiens
aaatattgtctttttgt

SEQ ID NO: 2669860 - DNA, 18 bp, Homo sapiens
aaatcatcaagaagggct

SEQ ID NO: 2669861 - DNA, 20 bp, Homo sapiens
aaatctaggaaaatattttg

SEQ ID NO: 2669862 - DNA, 14 bp, Homo sapiens
aaatctatattttg

SEQ ID NO: 2669863 - DNA, 16 bp, Homo sapiens
aaatgatcttttcaag

SEQ ID NO: 2669864 - DNA, 19 bp, Homo sapiens
aaatgctaatgtcaaactt

SEQ ID NO: 2669865 - DNA, 23 bp, Homo sapiens
aaatggctgcatcccccccacct

SEQ ID NO: 2669866 - DNA, 20 bp, Homo sapiens
aaatgtaccttcagaataag

SEQ ID NO: 2669867 - DNA, 14 bp, Homo sapiens
aaatgtatcttcca

SEQ ID NO: 2669868 - DNA, 13 bp, Homo sapiens
aaattgtgtgtgc

SEQ ID NO: 2669869 - DNA, 23 bp, Homo sapiens
aaatttattttataagaaaaact

SEQ ID NO: 2669870 - DNA, 18 bp, Homo sapiens
aaatttggccaaacaagt

SEQ ID NO: 2669871 - DNA, 20 bp, Homo sapiens
aacaaatctaggaaaatatt

SEQ ID NO: 2669872 - DNA, 13 bp, Homo sapiens
aacaacatgtata

SEQ ID NO: 2669873 - DNA, 20 bp, Homo sapiens
aacaatgttgttttaagact

SEQ ID NO: 2669874 - DNA, 21 bp, Homo sapiens
aacacattaagccttccacac

SEQ ID NO: 2669875 - DNA, 15 bp, Homo sapiens
aacaccattgaaggc

SEQ ID NO: 2669876 - DNA, 21 bp, Homo sapiens
aacactatatggcagtgtctt

SEQ ID NO: 2669877 - DNA, 15 bp, Homo sapiens
aacactgatttcccc

SEQ ID NO: 2669878 - DNA, 12 bp, Homo sapiens
aacaggaccggg

SEQ ID NO: 2669879 - DNA, 19 bp, Homo sapiens
aacaggacttaaaatgaca

SEQ ID NO: 2669880 - DNA, 15 bp, Homo sapiens
aacattttacccaca

SEQ ID NO: 2669881 - DNA, 16 bp, Homo sapiens
aaccaatctacaatct

SEQ ID NO: 2669882 - DNA, 15 bp, Homo sapiens
aaccagggagctgca

SEQ ID NO: 2669883 - DNA, 15 bp, Homo sapiens
aaccagggattgttt

SEQ ID NO: 2669884 - DNA, 21 bp, Homo sapiens
aacccatattgtaaaacaggt

SEQ ID NO: 2669885 - DNA, 16 bp, Homo sapiens
aacccccactggactg

SEQ ID NO: 2669886 - DNA, 14 bp, Homo sapiens
aaccccgtcaacaa

SEQ ID NO: 2669887 - DNA, 16 bp, Homo sapiens
aaccccgtcaacaaat

SEQ ID NO: 2669888 - DNA, 20 bp, Homo sapiens
aacccttctcctcttgtaaa

SEQ ID NO: 2669889 - DNA, 19 bp, Homo sapiens
aacctaggagtgccccatt

SEQ ID NO: 2669890 - DNA, 19 bp, Homo sapiens
aactacagaaaaaccagag

SEQ ID NO: 2669891 - DNA, 16 bp, Homo sapiens
aactactgcaccattt

SEQ ID NO: 2669892 - DNA, 20 bp, Homo sapiens
aactactgcaccatttaaaa

SEQ ID NO: 2669893 - DNA, 14 bp, Homo sapiens
aactcaatattttc

SEQ ID NO: 2669894 - DNA, 20 bp, Homo sapiens
aactcaatattttccatgaa

SEQ ID NO: 2669895 - DNA, 22 bp, Homo sapiens
aactgaacaccattgaaggctt

SEQ ID NO: 2669896 - DNA, 18 bp, Homo sapiens
aactgagatccttccttt

SEQ ID NO: 2669897 - DNA, 16 bp, Homo sapiens
aactgtaccatgtgct

SEQ ID NO: 2669898 - DNA, 14 bp, Homo sapiens
aactgtactgggcc

SEQ ID NO: 2669899 - DNA, 13 bp, Homo sapiens
aactgttcccacc

SEQ ID NO: 2669900 - DNA, 21 bp, Homo sapiens
aacttattaaatggaaactga

SEQ ID NO: 2669901 - DNA, 18 bp, Homo sapiens
aacttgagaactttattt

SEQ ID NO: 2669902 - DNA, 21 bp, Homo sapiens
aacttgagaactttatttcca

SEQ ID NO: 2669903 - DNA, 22 bp, Homo sapiens
aacttgagaactttatttccaa

SEQ ID NO: 2669904 - DNA, 20 bp, Homo sapiens
aacttgtcaaaaaacaaaaa

SEQ ID NO: 2669905 - DNA, 11 bp, Homo sapiens
aagaaaaactt

SEQ ID NO: 2669906 - DNA, 15 bp, Homo sapiens
aagaacaatattgac

SEQ ID NO: 2669907 - DNA, 17 bp, Homo sapiens
aagaaggaaaaggcagg

SEQ ID NO: 2669908 - DNA, 15 bp, Homo sapiens
aagacagagctggga

SEQ ID NO: 2669909 - DNA, 14 bp, Homo sapiens
aagacatgcagcct

SEQ ID NO: 2669910 - DNA, 19 bp, Homo sapiens
aagacccaacacatgggac

SEQ ID NO: 2669911 - DNA, 15 bp, Homo sapiens
aagacctcagggcac

SEQ ID NO: 2669912 - DNA, 13 bp, Homo sapiens
aagacctttcaaa

SEQ ID NO: 2669913 - DNA, 23 bp, Homo sapiens
aagacgtgtttgtgtttgtgtgt

SEQ ID NO: 2669914 - DNA, 15 bp, Homo sapiens
aagagattcctgagc

SEQ ID NO: 2669915 - DNA, 17 bp, Homo sapiens
aagaggatgctgtgaaa

SEQ ID NO: 2669916 - DNA, 15 bp, Homo sapiens
aagagtcctctgaat

SEQ ID NO: 2669917 - DNA, 18 bp, Homo sapiens
aagatctctgcagggccg

SEQ ID NO: 2669918 - DNA, 18 bp, Homo sapiens
aagatgggtgaaggctgg

SEQ ID NO: 2669919 - DNA, 17 bp, Homo sapiens
aagattactttttcttt

SEQ ID NO: 2669920 - DNA, 21 bp, Homo sapiens
aagattcttcccattctccat

SEQ ID NO: 2669921 - DNA, 14 bp, Homo sapiens
aagcaaacacatta

SEQ ID NO: 2669922 - DNA, 16 bp, Homo sapiens
aagcaaacccagacgg

SEQ ID NO: 2669923 - DNA, 14 bp, Homo sapiens
aagcagagaagctc

SEQ ID NO: 2669924 - DNA, 17 bp, Homo sapiens
aagcagctctcccctca

SEQ ID NO: 2669925 - DNA, 20 bp, Homo sapiens
aagccagaagctaagctgca

SEQ ID NO: 2669926 - DNA, 15 bp, Homo sapiens
aagccatctttcttt

SEQ ID NO: 2669927 - DNA, 21 bp, Homo sapiens
aagctcttgaagacactgaaa

SEQ ID NO: 2669928 - DNA, 22 bp, Homo sapiens
aagctggggttcatgacaatgg

SEQ ID NO: 2669929 - DNA, 14 bp, Homo sapiens
aagctgtattttga

SEQ ID NO: 2669930 - DNA, 13 bp, Homo sapiens
aagcttccttggc

SEQ ID NO: 2669931 - DNA, 14 bp, Homo sapiens
aagctttgacactg

SEQ ID NO: 2669932 - DNA, 22 bp, Homo sapiens
aaggaagccacagctggtggta

SEQ ID NO: 2669933 - DNA, 16 bp, Homo sapiens
aaggagacaggcagag

SEQ ID NO: 2669934 - DNA, 19 bp, Homo sapiens
aaggagacaggcagagctg

SEQ ID NO: 2669935 - DNA, 17 bp, Homo sapiens
aaggagatagggaaaag

SEQ ID NO: 2669936 - DNA, 21 bp, Homo sapiens
aaggcaaagggtccagaagga

SEQ ID NO: 2669937 - DNA, 12 bp, Homo sapiens
aaggcaactggg

SEQ ID NO: 2669938 - DNA, 17 bp, Homo sapiens
aaggccagacctgcaga

SEQ ID NO: 2669939 - DNA, 18 bp, Homo sapiens
aaggccagacctgcagac

SEQ ID NO: 2669940 - DNA, 17 bp, Homo sapiens
aagggagctagccagag

SEQ ID NO: 2669941 - DNA, 13 bp, Homo sapiens
aagggctgcatga

SEQ ID NO: 2669942 - DNA, 20 bp, Homo sapiens
aagggctgcatgatgtttgc

SEQ ID NO: 2669943 - DNA, 16 bp, Homo sapiens
aaggggacccccgccc

SEQ ID NO: 2669944 - DNA, 18 bp, Homo sapiens
aaggttgttttgaaactg

SEQ ID NO: 2669945 - DNA, 16 bp, Homo sapiens
aaggtttctgaaaatt

SEQ ID NO: 2669946 - DNA, 18 bp, Homo sapiens
aaggtttggtccagcctg

SEQ ID NO: 2669947 - DNA, 18 bp, Homo sapiens
aagtaactttaaattatg

SEQ ID NO: 2669948 - DNA, 21 bp, Homo sapiens
aagtattgctgagtccaacaa

SEQ ID NO: 2669949 - DNA, 21 bp, Homo sapiens
aagtctctcattctaggcctc

SEQ ID NO: 2669950 - DNA, 19 bp, Homo sapiens
aagtgctgcggagcaagag

SEQ ID NO: 2669951 - DNA, 21 bp, Homo sapiens
aagtgctgcggagcaagagga

SEQ ID NO: 2669952 - DNA, 20 bp, Homo sapiens
aagttatgggaatacctgtg

SEQ ID NO: 2669953 - DNA, 21 bp, Homo sapiens
aagttctattggaaaaaccac

SEQ ID NO: 2669954 - DNA, 18 bp, Homo sapiens
aagttgttcaaacattta

SEQ ID NO: 2669955 - DNA, 21 bp, Homo sapiens
aagtttccttccagcccagaa

SEQ ID NO: 2669956 - DNA, 20 bp, Homo sapiens
aataaaaaaaagaaatgaaa

SEQ ID NO: 2669957 - DNA, 15 bp, Homo sapiens
aataaagccctggga

SEQ ID NO: 2669958 - DNA, 19 bp, Homo sapiens
aataaaggtatgaaagggt

SEQ ID NO: 2669959 - DNA, 21 bp, Homo sapiens
aataaatattgtctttttgta

SEQ ID NO: 2669960 - DNA, 14 bp, Homo sapiens
aataataaatattt

SEQ ID NO: 2669961 - DNA, 15 bp, Homo sapiens
aataataaatattta

SEQ ID NO: 2669962 - DNA, 20 bp, Homo sapiens
aatacaaaaattagccgagc

SEQ ID NO: 2669963 - DNA, 15 bp, Homo sapiens
aatagactaaatgaa

SEQ ID NO: 2669964 - DNA, 15 bp, Homo sapiens
aatagcttttgtgtc

SEQ ID NO: 2669965 - DNA, 13 bp, Homo sapiens
aatataaacacta

SEQ ID NO: 2669966 - DNA, 13 bp, Homo sapiens
aatatacacacag

SEQ ID NO: 2669967 - DNA, 14 bp, Homo sapiens
aatatatttgtgta

SEQ ID NO: 2669968 - DNA, 19 bp, Homo sapiens
aatatatttgtgtatttaa

SEQ ID NO: 2669969 - DNA, 12 bp, Homo sapiens
aatatcctttgc

SEQ ID NO: 2669970 - DNA, 14 bp, Homo sapiens
aatatgctggctgg

SEQ ID NO: 2669971 - DNA, 18 bp, Homo sapiens
aatatggtgtacattctt

SEQ ID NO: 2669972 - DNA, 21 bp, Homo sapiens
aatattgtctttttgtatgtc

SEQ ID NO: 2669973 - DNA, 19 bp, Homo sapiens
aatcatattaatacaatga

SEQ ID NO: 2669974 - DNA, 20 bp, Homo sapiens
aatctactgtggtgttttgt

SEQ ID NO: 2669975 - DNA, 12 bp, Homo sapiens
aatctatttaag

SEQ ID NO: 2669976 - DNA, 19 bp, Homo sapiens
agttagaataataaatatt

SEQ ID NO: 2669977 - DNA, 15 bp, Homo sapiens
agttcagccaccctg

SEQ ID NO: 2669978 - DNA, 19 bp, Homo sapiens
agttcgagaccagcctggc

SEQ ID NO: 2669979 - DNA, 15 bp, Homo sapiens
agttctgctcattct

SEQ ID NO: 2669980 - DNA, 17 bp, Homo sapiens
agttgaacctatttctc

SEQ ID NO: 2669981 - DNA, 18 bp, Homo sapiens
agttgtgacaacttcctg

SEQ ID NO: 2669982 - DNA, 22 bp, Homo sapiens
agtttgaatctatttatcttca

SEQ ID NO: 2669983 - DNA, 20 bp, Homo sapiens
agttttcccttgaggaaaca

SEQ ID NO: 2669984 - DNA, 13 bp, Homo sapiens
ataaaaaaaagaa

SEQ ID NO: 2669985 - DNA, 17 bp, Homo sapiens
ataaaaaaaagaaatga

SEQ ID NO: 2669986 - DNA, 18 bp, Homo sapiens
ataaaacattttcacaca

SEQ ID NO: 2669987 - DNA, 20 bp, Homo sapiens
ataaagccctgggatcactg

SEQ ID NO: 2669988 - DNA, 22 bp, Homo sapiens
ataaagtgctgcggagcaagag

SEQ ID NO: 2669989 - DNA, 11 bp, Homo sapiens
ataaatattta

SEQ ID NO: 2669990 - DNA, 16 bp, Homo sapiens
ataaatgttaagaaaa

SEQ ID NO: 2669991 - DNA, 20 bp, Homo sapiens
ataaccatgtgaaaaggcaa

SEQ ID NO: 2669992 - DNA, 13 bp, Homo sapiens
ataactgcccagc

SEQ ID NO: 2669993 - DNA, 23 bp, Homo sapiens
ataactgcccagcggacagtggc

SEQ ID NO: 2669994 - DNA, 19 bp, Homo sapiens
ataactggaggaattttct

SEQ ID NO: 2669995 - DNA, 14 bp, Homo sapiens
ataagaaaaacttt

SEQ ID NO: 2669996 - DNA, 16 bp, Homo sapiens
atacaacacaaagaga

SEQ ID NO: 2669997 - DNA, 22 bp, Homo sapiens
atacaatgatgctatttgcaat

SEQ ID NO: 2669998 - DNA, 24 bp, Homo sapiens
ataccaaatagcttctgttttgtt

SEQ ID NO: 2669999 - DNA, 13 bp, Homo sapiens
atacctaagcaaa

SEQ ID NO: 2670000 - DNA, 16 bp, Homo sapiens
atactggcatgctaaa

SEQ ID NO: 2670001 - DNA, 14 bp, Homo sapiens
atacttaagcaaaa

SEQ ID NO: 2670002 - DNA, 21 bp, Homo sapiens
atagacagaatagatagcact

SEQ ID NO: 2670003 - DNA, 22 bp, Homo sapiens
atagcatcttgtggctttgcaa

SEQ ID NO: 2670004 - DNA, 22 bp, Homo sapiens
atagcttcaccccaatcccagc

SEQ ID NO: 2670005 - DNA, 15 bp, Homo sapiens
atataaataaaacat

SEQ ID NO: 2670006 - DNA, 19 bp, Homo sapiens
atatatgtatatatatgca

SEQ ID NO: 2670007 - DNA, 17 bp, Homo sapiens
atatatttgtgtattta

SEQ ID NO: 2670008 - DNA, 20 bp, Homo sapiens
atatgcagtaaaagaaagaa

SEQ ID NO: 2670009 - DNA, 20 bp, Homo sapiens
atatggggatgcagcattat

SEQ ID NO: 2670010 - DNA, 22 bp, Homo sapiens
atattaaagagaaagcccgctt

SEQ ID NO: 2670011 - DNA, 17 bp, Homo sapiens
atattgtaaaacaggta

SEQ ID NO: 2670012 - DNA, 22 bp, Homo sapiens
atatttccaggctgcatttgta

SEQ ID NO: 2670013 - DNA, 11 bp, Homo sapiens
atattttaatt

SEQ ID NO: 2670014 - DNA, 16 bp, Homo sapiens
atattttccatgaaaa

SEQ ID NO: 2670015 - DNA, 17 bp, Homo sapiens
atattttgatcttcaac

SEQ ID NO: 2670016 - DNA, 14 bp, Homo sapiens
atcaaagccacact

SEQ ID NO: 2670017 - DNA, 20 bp, Homo sapiens
atcaagaagggctgcatgat

SEQ ID NO: 2670018 - DNA, 22 bp, Homo sapiens
atcaagaagggctgcatgatgt

SEQ ID NO: 2670019 - DNA, 16 bp, Homo sapiens
atcactctgtgtctga

SEQ ID NO: 2670020 - DNA, 22 bp, Homo sapiens
atcagctggtcaaacaaactct

SEQ ID NO: 2670021 - DNA, 16 bp, Homo sapiens
atcagtggatttccca

SEQ ID NO: 2670022 - DNA, 17 bp, Homo sapiens
atcagtggatttcccat

SEQ ID NO: 2670023 - DNA, 15 bp, Homo sapiens
atcagtgttggccat

SEQ ID NO: 2670024 - DNA, 20 bp, Homo sapiens
atcatcaagaagggctgcat

SEQ ID NO: 2670025 - DNA, 22 bp, Homo sapiens
atcatcaagaagggctgcatga

SEQ ID NO: 2670026 - DNA, 16 bp, Homo sapiens
atccaagcaagactga

SEQ ID NO: 2670027 - DNA, 21 bp, Homo sapiens
atcctattgaaccatgtttgt

SEQ ID NO: 2670028 - DNA, 20 bp, Homo sapiens
atcctcttcttttagcagta

SEQ ID NO: 2670029 - DNA, 21 bp, Homo sapiens
atcgccagctgatgactcaag

SEQ ID NO: 2670030 - DNA, 22 bp, Homo sapiens
atcgcggcggagctggccccgc

SEQ ID NO: 2670031 - DNA, 23 bp, Homo sapiens
atcgtccagggagcattttcctc

SEQ ID NO: 2670032 - DNA, 15 bp, Homo sapiens
atctaatttataaaa

SEQ ID NO: 2670033 - DNA, 13 bp, Homo sapiens
atctatattttgg

SEQ ID NO: 2670034 - DNA, 15 bp, Homo sapiens
atctattaaaaccac

SEQ ID NO: 2670035 - DNA, 21 bp, Homo sapiens
atctgagaaacaatgactaat

SEQ ID NO: 2670036 - DNA, 18 bp, Homo sapiens
atctgagctctttgcact

SEQ ID NO: 2670037 - DNA, 17 bp, Homo sapiens
atctgtgaattgagctg

SEQ ID NO: 2670038 - DNA, 14 bp, Homo sapiens
atcttcaacaaatt

SEQ ID NO: 2670039 - DNA, 20 bp, Homo sapiens
atctttctttggatgggact

SEQ ID NO: 2670040 - DNA, 13 bp, Homo sapiens
atctttgtgaagg

SEQ ID NO: 2670041 - DNA, 17 bp, Homo sapiens
atctttgtgaaggcctc

SEQ ID NO: 2670042 - DNA, 11 bp, Homo sapiens
atcttttgaac

SEQ ID NO: 2670043 - DNA, 17 bp, Homo sapiens
atgaaccttctggcctc

SEQ ID NO: 2670044 - DNA, 24 bp, Homo sapiens
atgaaccttctggcctcccacaga

SEQ ID NO: 2670045 - DNA, 19 bp, Homo sapiens
atgacattgttaaaataaa

SEQ ID NO: 2670046 - DNA, 16 bp, Homo sapiens
atgactaattcttgca

SEQ ID NO: 2670047 - DNA, 16 bp, Homo sapiens
atgactcaagattccc

SEQ ID NO: 2670048 - DNA, 21 bp, Homo sapiens
atgactcaagattcccaggag

SEQ ID NO: 2670049 - DNA, 21 bp, Homo sapiens
atgagaagaaaatggaaccag

SEQ ID NO: 2670050 - DNA, 15 bp, Homo sapiens
atgatccaagcaaga

SEQ ID NO: 2670051 - DNA, 14 bp, Homo sapiens
atgatctgaaaaat

SEQ ID NO: 2670052 - DNA, 20 bp, Homo sapiens
atgatgacaactacagaaaa

SEQ ID NO: 2670053 - DNA, 20 bp, Homo sapiens
atgatggcccattctacttg

SEQ ID NO: 2670054 - DNA, 21 bp, Homo sapiens
atgatggcccattctacttgc

SEQ ID NO: 2670055 - DNA, 11 bp, Homo sapiens
atgatgtttgc

SEQ ID NO: 2670056 - DNA, 14 bp, Homo sapiens
atgatgtttgccca

SEQ ID NO: 2670057 - DNA, 19 bp, Homo sapiens
atgatgtttgcccaaaatt

SEQ ID NO: 2670058 - DNA, 14 bp, Homo sapiens
atgcaacaacatgt

SEQ ID NO: 2670059 - DNA, 16 bp, Homo sapiens
atgcaacaacatgtat

SEQ ID NO: 2670060 - DNA, 14 bp, Homo sapiens
atgcactcagctct

SEQ ID NO: 2670061 - DNA, 13 bp, Homo sapiens
atgcctcagccct

SEQ ID NO: 2670062 - DNA, 14 bp, Homo sapiens
atgccttttatttc

SEQ ID NO: 2670063 - DNA, 14 bp, Homo sapiens
atgctatttgcaat

SEQ ID NO: 2670064 - DNA, 17 bp, Homo sapiens
atgctcagaccagctct

SEQ ID NO: 2670065 - DNA, 12 bp, Homo sapiens
atggatggaaaa

SEQ ID NO: 2670066 - DNA, 21 bp, Homo sapiens
atggatggaaaacgctctcta

SEQ ID NO: 2670067 - DNA, 21 bp, Homo sapiens
atggcaggacgtgggctgggc

SEQ ID NO: 2670068 - DNA, 17 bp, Homo sapiens
atggcccattctacttg

SEQ ID NO: 2670069 - DNA, 19 bp, Homo sapiens
atggcccattctacttgct

SEQ ID NO: 2670070 - DNA, 15 bp, Homo sapiens
atgggacctataact

SEQ ID NO: 2670071 - DNA, 22 bp, Homo sapiens
atgggacctataactgcccagc

SEQ ID NO: 2670072 - DNA, 14 bp, Homo sapiens
atgggtgaaggctg

SEQ ID NO: 2670073 - DNA, 17 bp, Homo sapiens
atgggtgaaggctggca

SEQ ID NO: 2670074 - DNA, 16 bp, Homo sapiens
atggtttgcaaggaag

SEQ ID NO: 2670075 - DNA, 20 bp, Homo sapiens
atgtacaggatgctttggtt

SEQ ID NO: 2670076 - DNA, 23 bp, Homo sapiens
atgtataatatttttaattaaat

SEQ ID NO: 2670077 - DNA, 20 bp, Homo sapiens
atgtatgttcagaagaaatt

SEQ ID NO: 2670078 - DNA, 23 bp, Homo sapiens
atgtattttcttcacctctgcta

SEQ ID NO: 2670079 - DNA, 23 bp, Homo sapiens
atgtcaggggcggggagggtgac

SEQ ID NO: 2670080 - DNA, 19 bp, Homo sapiens
atgtctgtatcactctgtg

SEQ ID NO: 2670081 - DNA, 18 bp, Homo sapiens
atgtgaaaaggcaaaaag

SEQ ID NO: 2670082 - DNA, 18 bp, Homo sapiens
atgtgacattcttaaaaa

SEQ ID NO: 2670083 - DNA, 23 bp, Homo sapiens
atgtgctacaggggccagaagat

SEQ ID NO: 2670084 - DNA, 17 bp, Homo sapiens
atgttcagaagaaattc

SEQ ID NO: 2670085 - DNA, 20 bp, Homo sapiens
atgttgctgtgcacggtgga

SEQ ID NO: 2670086 - DNA, 18 bp, Homo sapiens
atgttgtgcctccctggt

SEQ ID NO: 2670087 - DNA, 17 bp, Homo sapiens
atgtttttgtgtatttg

SEQ ID NO: 2670088 - DNA, 11 bp, Homo sapiens
attaacactgc

SEQ ID NO: 2670089 - DNA, 15 bp, Homo sapiens
attaagccttccaca

SEQ ID NO: 2670090 - DNA, 15 bp, Homo sapiens
attacagggcacagg

SEQ ID NO: 2670091 - DNA, 16 bp, Homo sapiens
attacagggcacaggc

SEQ ID NO: 2670092 - DNA, 21 bp, Homo sapiens
attatgatgtgggtcaaggaa

SEQ ID NO: 2670093 - DNA, 19 bp, Homo sapiens
ctagagggacctctcccag

SEQ ID NO: 2670094 - DNA, 23 bp, Homo sapiens
ctaggaagatctctgcagggccg

SEQ ID NO: 2670095 - DNA, 15 bp, Homo sapiens
ctaggatactgctgc

SEQ ID NO: 2670096 - DNA, 14 bp, Homo sapiens
ctaggccaggtgca

SEQ ID NO: 2670097 - DNA, 17 bp, Homo sapiens
ctaggcctcctggccca

SEQ ID NO: 2670098 - DNA, 18 bp, Homo sapiens
ctaggcctcctggcccag

SEQ ID NO: 2670099 - DNA, 15 bp, Homo sapiens
ctatattgtacacac

SEQ ID NO: 2670100 - DNA, 22 bp, Homo sapiens
ctatccatcatgaccagcaaat

SEQ ID NO: 2670101 - DNA, 16 bp, Homo sapiens
ctatgagctaaatgtc

SEQ ID NO: 2670102 - DNA, 13 bp, Homo sapiens
ctatgtcttgttt

SEQ ID NO: 2670103 - DNA, 17 bp, Homo sapiens
ctattcctgtaatgaaa

SEQ ID NO: 2670104 - DNA, 21 bp, Homo sapiens
ctattctttcgaaagaagaaa

SEQ ID NO: 2670105 - DNA, 16 bp, Homo sapiens
ctattggaaaaaccac

SEQ ID NO: 2670106 - DNA, 18 bp, Homo sapiens
ctatttgcaattcctgct

SEQ ID NO: 2670107 - DNA, 16 bp, Homo sapiens
ctcaaatgctcagacc

SEQ ID NO: 2670108 - DNA, 19 bp, Homo sapiens
ctcaaatgctcagaccagc

SEQ ID NO: 2670109 - DNA, 22 bp, Homo sapiens
ctcaaatgctcagaccagctct

SEQ ID NO: 2670110 - DNA, 19 bp, Homo sapiens
ctcaagaagaagaggggca

SEQ ID NO: 2670111 - DNA, 21 bp, Homo sapiens
ctcaagattcccaggagttct

SEQ ID NO: 2670112 - DNA, 15 bp, Homo sapiens
ctcaagtagcattta

SEQ ID NO: 2670113 - DNA, 20 bp, Homo sapiens
ctcaagtagcatttactgtg

SEQ ID NO: 2670114 - DNA, 13 bp, Homo sapiens
ctcaatattttcc

SEQ ID NO: 2670115 - DNA, 22 bp, Homo sapiens
ctcaatattttccatgaaaatg

SEQ ID NO: 2670116 - DNA, 15 bp, Homo sapiens
ctcacacctgaactg

SEQ ID NO: 2670117 - DNA, 16 bp, Homo sapiens
ctcacctctaaaacag

SEQ ID NO: 2670118 - DNA, 14 bp, Homo sapiens
ctcactcaccttca

SEQ ID NO: 2670119 - DNA, 21 bp, Homo sapiens
ctcagaagggagctagccaga

SEQ ID NO: 2670120 - DNA, 14 bp, Homo sapiens
ctcagaccagctct

SEQ ID NO: 2670121 - DNA, 13 bp, Homo sapiens
ctcagagtgcaag

SEQ ID NO: 2670122 - DNA, 20 bp, Homo sapiens
ctcagctcttggctccactg

SEQ ID NO: 2670123 - DNA, 23 bp, Homo sapiens
ctcagggaaaagcagctctcccc

SEQ ID NO: 2670124 - DNA, 12 bp, Homo sapiens
ctcaggtggcca

SEQ ID NO: 2670125 - DNA, 13 bp, Homo sapiens
ctcaggtggccat

SEQ ID NO: 2670126 - DNA, 21 bp, Homo sapiens
ctcaggtggccatgcctcagc

SEQ ID NO: 2670127 - DNA, 17 bp, Homo sapiens
ctcagttcttgccactt

SEQ ID NO: 2670128 - DNA, 20 bp, Homo sapiens
ctcattctaatgatggccca

SEQ ID NO: 2670129 - DNA, 21 bp, Homo sapiens
ctcattctaatgatggcccat

SEQ ID NO: 2670130 - DNA, 19 bp, Homo sapiens
ctcatttaaagtattttat

SEQ ID NO: 2670131 - DNA, 20 bp, Homo sapiens
ctcatttaaagtattttatt

SEQ ID NO: 2670132 - DNA, 16 bp, Homo sapiens
ctccaaaccttcacac

SEQ ID NO: 2670133 - DNA, 21 bp, Homo sapiens
ctccaaaccttcacacacaga

SEQ ID NO: 2670134 - DNA, 12 bp, Homo sapiens
ctccacagggcc

SEQ ID NO: 2670135 - DNA, 16 bp, Homo sapiens
ctccaccagtcatttt

SEQ ID NO: 2670136 - DNA, 23 bp, Homo sapiens
ctcccactggggtccagggagca

SEQ ID NO: 2670137 - DNA, 18 bp, Homo sapiens
ctcccaggtgcagccaga

SEQ ID NO: 2670138 - DNA, 23 bp, Homo sapiens
ctcccaggtgcagccagaggcac

SEQ ID NO: 2670139 - DNA, 21 bp, Homo sapiens
ctccccatcgccagctgatga

SEQ ID NO: 2670140 - DNA, 23 bp, Homo sapiens
ctccccatcgccagctgatgact

SEQ ID NO: 2670141 - DNA, 13 bp, Homo sapiens
ctcccctcagagt

SEQ ID NO: 2670142 - DNA, 14 bp, Homo sapiens
ctccctgaccctgt

SEQ ID NO: 2670143 - DNA, 16 bp, Homo sapiens
ctccctgaccctgtat

SEQ ID NO: 2670144 - DNA, 20 bp, Homo sapiens
ctcctcttgtaaataaagcc

SEQ ID NO: 2670145 - DNA, 21 bp, Homo sapiens
ctcctcttgtaaataaagccc

SEQ ID NO: 2670146 - DNA, 14 bp, Homo sapiens
ctcctggcccaggt

SEQ ID NO: 2670147 - DNA, 14 bp, Homo sapiens
ctccttcccttcct

SEQ ID NO: 2670148 - DNA, 12 bp, Homo sapiens
ctcgaattttgt

SEQ ID NO: 2670149 - DNA, 13 bp, Homo sapiens
ctctccctgaccc

SEQ ID NO: 2670150 - DNA, 20 bp, Homo sapiens
ctctccctgaccctgtatat

SEQ ID NO: 2670151 - DNA, 20 bp, Homo sapiens
ctctcctcatgttctgcttt

SEQ ID NO: 2670152 - DNA, 16 bp, Homo sapiens
ctctctgaacccctcc

SEQ ID NO: 2670153 - DNA, 18 bp, Homo sapiens
ctctctgcaccgtactgt

SEQ ID NO: 2670154 - DNA, 13 bp, Homo sapiens
ctctgaggaagct

SEQ ID NO: 2670155 - DNA, 23 bp, Homo sapiens
ctctgcgtgcagggacaaagagg

SEQ ID NO: 2670156 - DNA, 14 bp, Homo sapiens
ctctgctttaaagt

SEQ ID NO: 2670157 - DNA, 14 bp, Homo sapiens
ctctggacctgccc

SEQ ID NO: 2670158 - DNA, 21 bp, Homo sapiens
ctctggacctgcccccgcatc

SEQ ID NO: 2670159 - DNA, 12 bp, Homo sapiens
ctctggactgtg

SEQ ID NO: 2670160 - DNA, 18 bp, Homo sapiens
ctctgggagaaaatcatc

SEQ ID NO: 2670161 - DNA, 21 bp, Homo sapiens
ctctgggagaaaatcatcaag

SEQ ID NO: 2670162 - DNA, 13 bp, Homo sapiens
ctctgtttatgct

SEQ ID NO: 2670163 - DNA, 19 bp, Homo sapiens
ctcttggaggtgtctgtat

SEQ ID NO: 2670164 - DNA, 12 bp, Homo sapiens
ctctttgcacta

SEQ ID NO: 2670165 - DNA, 20 bp, Homo sapiens
ctgaaaacctctcctcatgt

SEQ ID NO: 2670166 - DNA, 16 bp, Homo sapiens
ctgaaaattaacactg

SEQ ID NO: 2670167 - DNA, 17 bp, Homo sapiens
ctgaaaattaacactgc

SEQ ID NO: 2670168 - DNA, 23 bp, Homo sapiens
ctgaaagtgaaagtccagaaact

SEQ ID NO: 2670169 - DNA, 18 bp, Homo sapiens
ctgaaatatacacacagc

SEQ ID NO: 2670170 - DNA, 13 bp, Homo sapiens
ctgaactgaacac

SEQ ID NO: 2670171 - DNA, 14 bp, Homo sapiens
ctgaagagtcctct

SEQ ID NO: 2670172 - DNA, 18 bp, Homo sapiens
ctgaagagtcctctgaat

SEQ ID NO: 2670173 - DNA, 19 bp, Homo sapiens
ctgaagttcagccaccctg

SEQ ID NO: 2670174 - DNA, 22 bp, Homo sapiens
ctgaatgaaccttctggcctcc

SEQ ID NO: 2670175 - DNA, 12 bp, Homo sapiens
ctgaccctgtat

SEQ ID NO: 2670176 - DNA, 18 bp, Homo sapiens
ctgacctggtccacaggg

SEQ ID NO: 2670177 - DNA, 21 bp, Homo sapiens
ctgacctggtccacagggcac

SEQ ID NO: 2670178 - DNA, 15 bp, Homo sapiens
ctgagcgcctgggtc

SEQ ID NO: 2670179 - DNA, 21 bp, Homo sapiens
ctgagtgaaaaatctgtggaa

SEQ ID NO: 2670180 - DNA, 14 bp, Homo sapiens
ctgatgactcaaga

SEQ ID NO: 2670181 - DNA, 18 bp, Homo sapiens
ctgatttccccttttgca

SEQ ID NO: 2670182 - DNA, 19 bp, Homo sapiens
ctgatttccccttttgcat

SEQ ID NO: 2670183 - DNA, 18 bp, Homo sapiens
ctgcaggccaggccagct

SEQ ID NO: 2670184 - DNA, 19 bp, Homo sapiens
ctgcagggccgccagggag

SEQ ID NO: 2670185 - DNA, 16 bp, Homo sapiens
ctgcagtgaggctgtg

SEQ ID NO: 2670186 - DNA, 17 bp, Homo sapiens
ctgccaacatactttaa

SEQ ID NO: 2670187 - DNA, 23 bp, Homo sapiens
ctgccaccctgggcctggcagct

SEQ ID NO: 2670188 - DNA, 22 bp, Homo sapiens
ctgcccagcggacagtggcagg

SEQ ID NO: 2670189 - DNA, 18 bp, Homo sapiens
ctgcccccgcatcccctg

SEQ ID NO: 2670190 - DNA, 21 bp, Homo sapiens
ctgcccccgcatcccctgcct

SEQ ID NO: 2670191 - DNA, 17 bp, Homo sapiens
ctgcctcaggcctctgt

SEQ ID NO: 2670192 - DNA, 14 bp, Homo sapiens
ctgcctctcacagc

SEQ ID NO: 2670193 - DNA, 22 bp, Homo sapiens
ctgcctctcacagctgagttgt

SEQ ID NO: 2670194 - DNA, 18 bp, Homo sapiens
ctgcctttggcagagttc

SEQ ID NO: 2670195 - DNA, 18 bp, Homo sapiens
ctgcgcccagtccttcca

SEQ ID NO: 2670196 - DNA, 20 bp, Homo sapiens
ctgctctctttttctccagg

SEQ ID NO: 2670197 - DNA, 17 bp, Homo sapiens
ctgctgtaaatttggct

SEQ ID NO: 2670198 - DNA, 19 bp, Homo sapiens
ctggaaacattcaggagct

SEQ ID NO: 2670199 - DNA, 15 bp, Homo sapiens
ctggacacaggcctg

SEQ ID NO: 2670200 - DNA, 23 bp, Homo sapiens
ctggactagagggacctctccca

SEQ ID NO: 2670201 - DNA, 15 bp, Homo sapiens
ctggactccggccct

SEQ ID NO: 2670202 - DNA, 21 bp, Homo sapiens
ctggagccatgggcacaaagg

SEQ ID NO: 2670203 - DNA, 13 bp, Homo sapiens
ctggcagctcagc

SEQ ID NO: 2670204 - DNA, 17 bp, Homo sapiens
ctggcatgatccaagca

SEQ ID NO: 2670205 - DNA, 13 bp, Homo sapiens
ctggcctcccaca

SEQ ID NO: 2670206 - DNA, 16 bp, Homo sapiens
ctggccttgggccctc

SEQ ID NO: 2670207 - DNA, 13 bp, Homo sapiens
ctggctggagtga

SEQ ID NO: 2670208 - DNA, 18 bp, Homo sapiens
ctgggagaaaatcatcaa

SEQ ID NO: 2670209 - DNA, 14 bp, Homo sapiens
ctgggaggccagtg

SEQ ID NO: 2670210 - DNA, 20 bp, Homo sapiens
ctgggatgggaggagaggac

SEQ ID NO: 2670211 - DNA, 15 bp, Homo sapiens
gtaattcttattctt

SEQ ID NO: 2670212 - DNA, 17 bp, Homo sapiens
gtaattcttattctttc

SEQ ID NO: 2670213 - DNA, 18 bp, Homo sapiens
gtacaggatgctttggtt

SEQ ID NO: 2670214 - DNA, 14 bp, Homo sapiens
gtacagttttattt

SEQ ID NO: 2670215 - DNA, 15 bp, Homo sapiens
gtaccaccaaaaaag

SEQ ID NO: 2670216 - DNA, 21 bp, Homo sapiens
gtaccatgtgctacaggggcc

SEQ ID NO: 2670217 - DNA, 12 bp, Homo sapiens
gtactacaattt

SEQ ID NO: 2670218 - DNA, 22 bp, Homo sapiens
gtagtcagaattagctgcttct

SEQ ID NO: 2670219 - DNA, 19 bp, Homo sapiens
gtatcaataccaaatagct

SEQ ID NO: 2670220 - DNA, 20 bp, Homo sapiens
gtattgtttgggatcctatt

SEQ ID NO: 2670221 - DNA, 20 bp, Homo sapiens
gtattttcttcacctctgct

SEQ ID NO: 2670222 - DNA, 13 bp, Homo sapiens
gtattttgaaaat

SEQ ID NO: 2670223 - DNA, 15 bp, Homo sapiens
gtattttttaaagct

SEQ ID NO: 2670224 - DNA, 22 bp, Homo sapiens
gtcaacaaatctaggaaaatat

SEQ ID NO: 2670225 - DNA, 23 bp, Homo sapiens
gtcacaaagaacatgtagaaaac

SEQ ID NO: 2670226 - DNA, 15 bp, Homo sapiens
gtcagaaacaggacc

SEQ ID NO: 2670227 - DNA, 13 bp, Homo sapiens
gtcagccagggcc

SEQ ID NO: 2670228 - DNA, 14 bp, Homo sapiens
gtcagccagggcct

SEQ ID NO: 2670229 - DNA, 23 bp, Homo sapiens
gtcaggagttcgagaccagcctg

SEQ ID NO: 2670230 - DNA, 19 bp, Homo sapiens
gtcatagatgtttccttgc

SEQ ID NO: 2670231 - DNA, 13 bp, Homo sapiens
gtccacagggcac

SEQ ID NO: 2670232 - DNA, 16 bp, Homo sapiens
gtccagaaggagacag

SEQ ID NO: 2670233 - DNA, 21 bp, Homo sapiens
gtccagggagcattttcctcc

SEQ ID NO: 2670234 - DNA, 14 bp, Homo sapiens
gtcctcaggtggcc

SEQ ID NO: 2670235 - DNA, 15 bp, Homo sapiens
gtcctcaggtggcca

SEQ ID NO: 2670236 - DNA, 23 bp, Homo sapiens
gtctagcctatgtggattttttc

SEQ ID NO: 2670237 - DNA, 23 bp, Homo sapiens
gtctgagtggcttcactcctgct

SEQ ID NO: 2670238 - DNA, 24 bp, Homo sapiens
gtgaaacccagtcactgtgagctc

SEQ ID NO: 2670239 - DNA, 20 bp, Homo sapiens
gtgaaggcctcgcaggaaga

SEQ ID NO: 2670240 - DNA, 12 bp, Homo sapiens
gtgaaggctggc

SEQ ID NO: 2670241 - DNA, 15 bp, Homo sapiens
gtgaagttgcttctt

SEQ ID NO: 2670242 - DNA, 16 bp, Homo sapiens
gtgatgccctgccctt

SEQ ID NO: 2670243 - DNA, 22 bp, Homo sapiens
gtgatgctaaaggttgtattgc

SEQ ID NO: 2670244 - DNA, 14 bp, Homo sapiens
gtgcagccagaggc

SEQ ID NO: 2670245 - DNA, 13 bp, Homo sapiens
gtgcctccctggt

SEQ ID NO: 2670246 - DNA, 15 bp, Homo sapiens
gtgcctccctggtga

SEQ ID NO: 2670247 - DNA, 19 bp, Homo sapiens
gtgctacaggggccagaag

SEQ ID NO: 2670248 - DNA, 19 bp, Homo sapiens
gtgctgcggagcaagagga

SEQ ID NO: 2670249 - DNA, 16 bp, Homo sapiens
gtgcttcaacattctt

SEQ ID NO: 2670250 - DNA, 13 bp, Homo sapiens
gtgctttatattt

SEQ ID NO: 2670251 - DNA, 15 bp, Homo sapiens
gtggagtcattctca

SEQ ID NO: 2670252 - DNA, 17 bp, Homo sapiens
gtggccgcccaaggccc

SEQ ID NO: 2670253 - DNA, 16 bp, Homo sapiens
gtggcttcactcctgc

SEQ ID NO: 2670254 - DNA, 17 bp, Homo sapiens
gtggcttcactcctgct

SEQ ID NO: 2670255 - DNA, 23 bp, Homo sapiens
gtggcttcactcctgctgtaaat

SEQ ID NO: 2670256 - DNA, 13 bp, Homo sapiens
gtgggagggggag

SEQ ID NO: 2670257 - DNA, 16 bp, Homo sapiens
gtgggcacccaccctg

SEQ ID NO: 2670258 - DNA, 16 bp, Homo sapiens
gtggggaggaaataga

SEQ ID NO: 2670259 - DNA, 13 bp, Homo sapiens
gtggttgtgatcc

SEQ ID NO: 2670260 - DNA, 23 bp, Homo sapiens
gtgtcaggatggtaattcttatt

SEQ ID NO: 2670261 - DNA, 17 bp, Homo sapiens
gtgtcgagtcaaaatgt

SEQ ID NO: 2670262 - DNA, 17 bp, Homo sapiens
gtgtctgagtggcttca

SEQ ID NO: 2670263 - DNA, 16 bp, Homo sapiens
gtgtgggtacctgtat

SEQ ID NO: 2670264 - DNA, 23 bp, Homo sapiens
gtgttcaaggccatccttccctg

SEQ ID NO: 2670265 - DNA, 21 bp, Homo sapiens
gttaactattttattttctaa

SEQ ID NO: 2670266 - DNA, 13 bp, Homo sapiens
gttactatatgcc

SEQ ID NO: 2670267 - DNA, 22 bp, Homo sapiens
gttacttttcatatttgcacta

SEQ ID NO: 2670268 - DNA, 20 bp, Homo sapiens
gttagaataataaatattta

SEQ ID NO: 2670269 - DNA, 15 bp, Homo sapiens
gttaggatggcagga

SEQ ID NO: 2670270 - DNA, 20 bp, Homo sapiens
gttattggccttttctattc

SEQ ID NO: 2670271 - DNA, 13 bp, Homo sapiens
gttcactcttctc

SEQ ID NO: 2670272 - DNA, 14 bp, Homo sapiens
gttcagaagaaatt

SEQ ID NO: 2670273 - DNA, 23 bp, Homo sapiens
gttcagccaccctgaggcctctg

SEQ ID NO: 2670274 - DNA, 12 bp, Homo sapiens
gttcatgacaat

SEQ ID NO: 2670275 - DNA, 21 bp, Homo sapiens
gttcccatcctcttcttttag

SEQ ID NO: 2670276 - DNA, 14 bp, Homo sapiens
gttcctcgttctcc

SEQ ID NO: 2670277 - DNA, 17 bp, Homo sapiens
gttcctcgttctccctg

SEQ ID NO: 2670278 - DNA, 16 bp, Homo sapiens
gttcgagaccagcctg

SEQ ID NO: 2670279 - DNA, 20 bp, Homo sapiens
gttcgagaccagcctggcca

SEQ ID NO: 2670280 - DNA, 13 bp, Homo sapiens
gttctctgggaga

SEQ ID NO: 2670281 - DNA, 16 bp, Homo sapiens
gttctctgggagaaaa

SEQ ID NO: 2670282 - DNA, 19 bp, Homo sapiens
gttctctgggagaaaatca

SEQ ID NO: 2670283 - DNA, 15 bp, Homo sapiens
gttgaacctatttct

SEQ ID NO: 2670284 - DNA, 18 bp, Homo sapiens
gttgaacctatttctctt

SEQ ID NO: 2670285 - DNA, 22 bp, Homo sapiens
gttgaattttgttctctgggag

SEQ ID NO: 2670286 - DNA, 20 bp, Homo sapiens
gttgacttgacagaacactg

SEQ ID NO: 2670287 - DNA, 23 bp, Homo sapiens
gttgtgacaacttcctgagggat

SEQ ID NO: 2670288 - DNA, 18 bp, Homo sapiens
gtttacaagccccccctt

SEQ ID NO: 2670289 - DNA, 17 bp, Homo sapiens
gtttccttccagcccag

SEQ ID NO: 2670290 - DNA, 14 bp, Homo sapiens
gtttctgtttaact

SEQ ID NO: 2670291 - DNA, 22 bp, Homo sapiens
gtttgcaaggaagccacagctg

SEQ ID NO: 2670292 - DNA, 23 bp, Homo sapiens
gtttgcccaaaatttattttata

SEQ ID NO: 2670293 - DNA, 18 bp, Homo sapiens
gtttgccggtggtgcagg

SEQ ID NO: 2670294 - DNA, 16 bp, Homo sapiens
gtttggtccagcctgg

SEQ ID NO: 2670295 - DNA, 22 bp, Homo sapiens
gttttaatttatactggcatgc

SEQ ID NO: 2670296 - DNA, 19 bp, Homo sapiens
gttttcagcattgatattt

SEQ ID NO: 2670297 - DNA, 18 bp, Homo sapiens
gttttcctgtataggaat

SEQ ID NO: 2670298 - DNA, 19 bp, Homo sapiens
gttttgtggaggagctcag

SEQ ID NO: 2670299 - DNA, 15 bp, Homo sapiens
taaaacattttcaca

SEQ ID NO: 2670300 - DNA, 17 bp, Homo sapiens
taaaacattttcacaca

SEQ ID NO: 2670301 - DNA, 19 bp, Homo sapiens
taaaagaaagaaagaaaaa

SEQ ID NO: 2670302 - DNA, 17 bp, Homo sapiens
taaaataaatattgtct

SEQ ID NO: 2670303 - DNA, 16 bp, Homo sapiens
taaaccaaaaactgaa

SEQ ID NO: 2670304 - DNA, 17 bp, Homo sapiens
taaagataaagccagaa

SEQ ID NO: 2670305 - DNA, 14 bp, Homo sapiens
taaagttattcttg

SEQ ID NO: 2670306 - DNA, 19 bp, Homo sapiens
taaagttattcttgaagtc

SEQ ID NO: 2670307 - DNA, 13 bp, Homo sapiens
taaatattgtctt

SEQ ID NO: 2670308 - DNA, 15 bp, Homo sapiens
taaatattgtctttt

SEQ ID NO: 2670309 - DNA, 16 bp, Homo sapiens
taaatattgtcttttt

SEQ ID NO: 2670310 - DNA, 11 bp, Homo sapiens
taaatggctgc

SEQ ID NO: 2670311 - DNA, 17 bp, Homo sapiens
taaatttggcttctgtt

SEQ ID NO: 2670312 - DNA, 12 bp, Homo sapiens
taacaaatgaac

SEQ ID NO: 2670313 - DNA, 16 bp, Homo sapiens
taacaatgtattttct

SEQ ID NO: 2670314 - DNA, 18 bp, Homo sapiens
taacacctgattaactga

SEQ ID NO: 2670315 - DNA, 15 bp, Homo sapiens
taaccaatctacaat

SEQ ID NO: 2670316 - DNA, 16 bp, Homo sapiens
taaccccgtcaacaaa

SEQ ID NO: 2670317 - DNA, 22 bp, Homo sapiens
taactcaatattttccatgaaa

SEQ ID NO: 2670318 - DNA, 17 bp, Homo sapiens
taactcctcaattccaa

SEQ ID NO: 2670319 - DNA, 19 bp, Homo sapiens
taactgcaaagtgaagttg

SEQ ID NO: 2670320 - DNA, 17 bp, Homo sapiens
taactgcccagcggaca

SEQ ID NO: 2670321 - DNA, 17 bp, Homo sapiens
taacttccatgtgaggg

SEQ ID NO: 2670322 - DNA, 10 bp, Homo sapiens
taagaaaaac

SEQ ID NO: 2670323 - DNA, 18 bp, Homo sapiens
taaggtcattaccacagg

SEQ ID NO: 2670324 - DNA, 21 bp, Homo sapiens
taagtttccttccagcccaga

SEQ ID NO: 2670325 - DNA, 12 bp, Homo sapiens
taataaatattt

SEQ ID NO: 2670326 - DNA, 12 bp, Homo sapiens
taatactatatt

SEQ ID NO: 2670327 - DNA, 14 bp, Homo sapiens
taatcccagcaatt

SEQ ID NO: 2670328 - DNA, 15 bp, Homo sapiens
taattaaatagcttt

SEQ ID NO: 2670329 - DNA, 19 bp, Homo sapiens
taattcctttccaggtatt

SEQ ID NO: 2670330 - DNA, 17 bp, Homo sapiens
tggttttaatacttgat

SEQ ID NO: 2670331 - DNA, 21 bp, Homo sapiens
tgtaaagttattcttgaagtc

SEQ ID NO: 2670332 - DNA, 13 bp, Homo sapiens
tgtaaatctgctc

SEQ ID NO: 2670333 - DNA, 16 bp, Homo sapiens
tgtaaatttggcttct

SEQ ID NO: 2670334 - DNA, 21 bp, Homo sapiens
tgtaaatttggcttctgttgt

SEQ ID NO: 2670335 - DNA, 19 bp, Homo sapiens
tgtaacttccatgtgaggg

SEQ ID NO: 2670336 - DNA, 15 bp, Homo sapiens
tgtaatcccagcact

SEQ ID NO: 2670337 - DNA, 21 bp, Homo sapiens
tgtaatcccagctactcgaga

SEQ ID NO: 2670338 - DNA, 20 bp, Homo sapiens
tgtaatcccagctactcggg

SEQ ID NO: 2670339 - DNA, 19 bp, Homo sapiens
tgtaccatgtgctacaggg

SEQ ID NO: 2670340 - DNA, 12 bp, Homo sapiens
tgtactacaatt

SEQ ID NO: 2670341 - DNA, 18 bp, Homo sapiens
tgtactaggatactgctg

SEQ ID NO: 2670342 - DNA, 11 bp, Homo sapiens
tgtactttgtg

SEQ ID NO: 2670343 - DNA, 11 bp, Homo sapiens
tgtagaaaaca

SEQ ID NO: 2670344 - DNA, 15 bp, Homo sapiens
tgtagaagcatggtg

SEQ ID NO: 2670345 - DNA, 12 bp, Homo sapiens
tgtagcagaaag

SEQ ID NO: 2670346 - DNA, 13 bp, Homo sapiens
tgtagcagaaagg

SEQ ID NO: 2670347 - DNA, 22 bp, Homo sapiens
tgtagtcagaattagctgcttc

SEQ ID NO: 2670348 - DNA, 17 bp, Homo sapiens
tgtattcccagttactt

SEQ ID NO: 2670349 - DNA, 20 bp, Homo sapiens
tgtatttgttaatggtttga

SEQ ID NO: 2670350 - DNA, 14 bp, Homo sapiens
tgtattttttaaag

SEQ ID NO: 2670351 - DNA, 17 bp, Homo sapiens
tgtattttttaaagcta

SEQ ID NO: 2670352 - DNA, 13 bp, Homo sapiens
tgtcaccttcacc

SEQ ID NO: 2670353 - DNA, 14 bp, Homo sapiens
tgtcaccttcacct

SEQ ID NO: 2670354 - DNA, 14 bp, Homo sapiens
tgtcctcaggtggc

SEQ ID NO: 2670355 - DNA, 18 bp, Homo sapiens
tgtcctcccagctcctca

SEQ ID NO: 2670356 - DNA, 11 bp, Homo sapiens
tgtctcctggc

SEQ ID NO: 2670357 - DNA, 13 bp, Homo sapiens
tgtctctttcatg

SEQ ID NO: 2670358 - DNA, 19 bp, Homo sapiens
tgtgaccttgagaagattc

SEQ ID NO: 2670359 - DNA, 23 bp, Homo sapiens
tgtgagctcccaggtgcagccag

SEQ ID NO: 2670360 - DNA, 13 bp, Homo sapiens
tgtgcagacttca

SEQ ID NO: 2670361 - DNA, 19 bp, Homo sapiens
tgtgcattttctaaacaga

SEQ ID NO: 2670362 - DNA, 21 bp, Homo sapiens
tgtgcattttctaaacagaga

SEQ ID NO: 2670363 - DNA, 16 bp, Homo sapiens
tgtgccattttgcatt

SEQ ID NO: 2670364 - DNA, 14 bp, Homo sapiens
tgtgcctccctggt

SEQ ID NO: 2670365 - DNA, 15 bp, Homo sapiens
tgtgctacaggggcc

SEQ ID NO: 2670366 - DNA, 20 bp, Homo sapiens
tgtgctacaggggccagaag

SEQ ID NO: 2670367 - DNA, 23 bp, Homo sapiens
tgtggggaaccaattgctttgtc

SEQ ID NO: 2670368 - DNA, 15 bp, Homo sapiens
tgtgggtcaaggaat

SEQ ID NO: 2670369 - DNA, 14 bp, Homo sapiens
tgtggtggttgtga

SEQ ID NO: 2670370 - DNA, 22 bp, Homo sapiens
tgtgtatttaacagggagggga

SEQ ID NO: 2670371 - DNA, 14 bp, Homo sapiens
tgtgtttttaaaag

SEQ ID NO: 2670372 - DNA, 19 bp, Homo sapiens
tgttatccttttttaaaag

SEQ ID NO: 2670373 - DNA, 20 bp, Homo sapiens
tgttatgtagtgtgcttttt

SEQ ID NO: 2670374 - DNA, 15 bp, Homo sapiens
tgttcagaagaaatt

SEQ ID NO: 2670375 - DNA, 22 bp, Homo sapiens
tgttcagaagaaattctgtcat

SEQ ID NO: 2670376 - DNA, 19 bp, Homo sapiens
tgttcccatcctcttcttt

SEQ ID NO: 2670377 - DNA, 20 bp, Homo sapiens
tgttcgacagtgaatattca

SEQ ID NO: 2670378 - DNA, 14 bp, Homo sapiens
tgttctctgggaga

SEQ ID NO: 2670379 - DNA, 16 bp, Homo sapiens
tgttctctgggagaaa

SEQ ID NO: 2670380 - DNA, 14 bp, Homo sapiens
tgttctttttattg

SEQ ID NO: 2670381 - DNA, 14 bp, Homo sapiens
tgttgacatgtgct

SEQ ID NO: 2670382 - DNA, 16 bp, Homo sapiens
tgtttcctgcaggcca

SEQ ID NO: 2670383 - DNA, 21 bp, Homo sapiens
tgtttgacgggaaacaaaact

SEQ ID NO: 2670384 - DNA, 17 bp, Homo sapiens
tgtttgtaagtgaagtg

SEQ ID NO: 2670385 - DNA, 13 bp, Homo sapiens
ttaaaaaaaagaa

SEQ ID NO: 2670386 - DNA, 20 bp, Homo sapiens
ttaaactaaggccctcttga

SEQ ID NO: 2670387 - DNA, 22 bp, Homo sapiens
ttaacttgtcaaaaaacaaaaa

SEQ ID NO: 2670388 - DNA, 13 bp, Homo sapiens
ttaagacgtgttt

SEQ ID NO: 2670389 - DNA, 18 bp, Homo sapiens
ttaagttagggaatggca

SEQ ID NO: 2670390 - DNA, 22 bp, Homo sapiens
ttaatctccaccagtcattttt

SEQ ID NO: 2670391 - DNA, 20 bp, Homo sapiens
ttaattaaatagcttttgtg

SEQ ID NO: 2670392 - DNA, 17 bp, Homo sapiens
ttacagtgtagcttgcc

SEQ ID NO: 2670393 - DNA, 16 bp, Homo sapiens
ttacccacacacagat

SEQ ID NO: 2670394 - DNA, 16 bp, Homo sapiens
ttactgaagcctttct

SEQ ID NO: 2670395 - DNA, 19 bp, Homo sapiens
ttataaaaaggtgttttga

SEQ ID NO: 2670396 - DNA, 14 bp, Homo sapiens
ttataagaaaaact

SEQ ID NO: 2670397 - DNA, 16 bp, Homo sapiens
ttatagccgaaatgat

SEQ ID NO: 2670398 - DNA, 20 bp, Homo sapiens
ttatgatgtgggtcaaggaa

SEQ ID NO: 2670399 - DNA, 12 bp, Homo sapiens
ttattagttttg

SEQ ID NO: 2670400 - DNA, 13 bp, Homo sapiens
ttattagttttgc

SEQ ID NO: 2670401 - DNA, 14 bp, Homo sapiens
ttatttctaaaata

SEQ ID NO: 2670402 - DNA, 13 bp, Homo sapiens
ttcaaagccattt

SEQ ID NO: 2670403 - DNA, 14 bp, Homo sapiens
ttcaaagccatttt

SEQ ID NO: 2670404 - DNA, 18 bp, Homo sapiens
ttcaaccagggattgttt

SEQ ID NO: 2670405 - DNA, 16 bp, Homo sapiens
ttcaaggccatccttc

SEQ ID NO: 2670406 - DNA, 23 bp, Homo sapiens
ttcaataaaaaaaagaaatgaaa

SEQ ID NO: 2670407 - DNA, 22 bp, Homo sapiens
ttcaatggtttgcaaggaagcc

SEQ ID NO: 2670408 - DNA, 19 bp, Homo sapiens
ttcaatttccaagagctga

SEQ ID NO: 2670409 - DNA, 15 bp, Homo sapiens
ttcatatttgcacta

SEQ ID NO: 2670410 - DNA, 16 bp, Homo sapiens
ttcatgagtttttccc

SEQ ID NO: 2670411 - DNA, 15 bp, Homo sapiens
ttcattaaaagctac

SEQ ID NO: 2670412 - DNA, 21 bp, Homo sapiens
ttcatttttgttatccttttt

SEQ ID NO: 2670413 - DNA, 16 bp, Homo sapiens
ttccaacactgatttc

SEQ ID NO: 2670414 - DNA, 13 bp, Homo sapiens
ttccaagagctga

SEQ ID NO: 2670415 - DNA, 15 bp, Homo sapiens
ttccagtgcaacact

SEQ ID NO: 2670416 - DNA, 13 bp, Homo sapiens
ttccattctcacc

SEQ ID NO: 2670417 - DNA, 19 bp, Homo sapiens
ttcccaggagttctgctca

SEQ ID NO: 2670418 - DNA, 23 bp, Homo sapiens
ttcccccaaatttaaagaagtat

SEQ ID NO: 2670419 - DNA, 21 bp, Homo sapiens
ttcccccaccccatttctctc

SEQ ID NO: 2670420 - DNA, 19 bp, Homo sapiens
ttcccttcgacagcatttt

SEQ ID NO: 2670421 - DNA, 18 bp, Homo sapiens
ttccttgtagccttttga

SEQ ID NO: 2670422 - DNA, 20 bp, Homo sapiens
ttccttgtagccttttgact

SEQ ID NO: 2670423 - DNA, 20 bp, Homo sapiens
ttccttttatttcttcacca

SEQ ID NO: 2670424 - DNA, 15 bp, Homo sapiens
ttccttttgaaagaa

SEQ ID NO: 2670425 - DNA, 16 bp, Homo sapiens
ttcgacagcattttcc

SEQ ID NO: 2670426 - DNA, 14 bp, Homo sapiens
ttcgagaccagcct

SEQ ID NO: 2670427 - DNA, 16 bp, Homo sapiens
ttctaatgatggccca

SEQ ID NO: 2670428 - DNA, 14 bp, Homo sapiens
ttctacttgctctg

SEQ ID NO: 2670429 - DNA, 22 bp, Homo sapiens
ttctacttgctctggacctgcc

SEQ ID NO: 2670430 - DNA, 15 bp, Homo sapiens
ttctcatcctgcagg

SEQ ID NO: 2670431 - DNA, 17 bp, Homo sapiens
ttctcatgatttacaga

SEQ ID NO: 2670432 - DNA, 13 bp, Homo sapiens
ttctcctcttgta

SEQ ID NO: 2670433 - DNA, 19 bp, Homo sapiens
ttctcctcttgtaaataaa

SEQ ID NO: 2670434 - DNA, 14 bp, Homo sapiens
ttctcctttgtact

SEQ ID NO: 2670435 - DNA, 17 bp, Homo sapiens
ttctcctttgtactttg

SEQ ID NO: 2670436 - DNA, 13 bp, Homo sapiens
ttctctgaggaag

SEQ ID NO: 2670437 - DNA, 19 bp, Homo sapiens
ttctctgggagaaaatcat

SEQ ID NO: 2670438 - DNA, 20 bp, Homo sapiens
ttctctgggagaaaatcatc

SEQ ID NO: 2670439 - DNA, 19 bp, Homo sapiens
ttctgaaaattaacactgc

SEQ ID NO: 2670440 - DNA, 14 bp, Homo sapiens
ttctggcctcccac

SEQ ID NO: 2670441 - DNA, 17 bp, Homo sapiens
ttctgtatctactttaa

SEQ ID NO: 2670442 - DNA, 12 bp, Homo sapiens
ttctgtttaact

SEQ ID NO: 2670443 - DNA, 15 bp, Homo sapiens
ttcttacaaacatgt

SEQ ID NO: 2670444 - DNA, 19 bp, Homo sapiens
ttgaaagccccagaaatca

SEQ ID NO: 2670445 - DNA, 17 bp, Homo sapiens
ttgaacccaggagttca

SEQ ID NO: 2670446 - DNA, 13 bp, Homo sapiens
ttgaacctatttc

SEQ ID NO: 2670447 - DNA, 16 bp, Homo sapiens
ttgaacctatttctct

SEQ ID NO: 2670448 - DNA, 16 bp, Homo sapiens
ttgaatataaacacta

SEQ ID NO: 2670449 - DNA, 11 bp, Homo sapiens
aaaaaaaagag

SEQ ID NO: 2670450 - DNA, 11 bp, Homo sapiens
aaaaaaaccaa

SEQ ID NO: 2670451 - DNA, 12 bp, Homo sapiens
aaaaaagaaaat

SEQ ID NO: 2670452 - DNA, 19 bp, Homo sapiens
aaaaacccagcaacagaaa

SEQ ID NO: 2670453 - DNA, 18 bp, Homo sapiens
aaaaattggttctttatt

SEQ ID NO: 2670454 - DNA, 20 bp, Homo sapiens
aaaacagtccttcaaacttc

SEQ ID NO: 2670455 - DNA, 19 bp, Homo sapiens
aaaaccaatgttttgcagt

SEQ ID NO: 2670456 - DNA, 11 bp, Homo sapiens
aaaaccaggcc

SEQ ID NO: 2670457 - DNA, 12 bp, Homo sapiens
aaaactctttta

SEQ ID NO: 2670458 - DNA, 20 bp, Homo sapiens
aaaactttttatattttata

SEQ ID NO: 2670459 - DNA, 22 bp, Homo sapiens
aaaagccagcaggcttcaaact

SEQ ID NO: 2670460 - DNA, 15 bp, Homo sapiens
aaaagtaaatgtaca

SEQ ID NO: 2670461 - DNA, 13 bp, Homo sapiens
aaaataaagttgg

SEQ ID NO: 2670462 - DNA, 23 bp, Homo sapiens
aaaataaatattgtctttttgta

SEQ ID NO: 2670463 - DNA, 15 bp, Homo sapiens
aaaatattttgatct

SEQ ID NO: 2670464 - DNA, 17 bp, Homo sapiens
aaaatattttgatcttc

SEQ ID NO: 2670465 - DNA, 12 bp, Homo sapiens
aaaatcatcaag

SEQ ID NO: 2670466 - DNA, 20 bp, Homo sapiens
aaaatcatcaagaagggctg

SEQ ID NO: 2670467 - DNA, 15 bp, Homo sapiens
aaaatctatattttg

SEQ ID NO: 2670468 - DNA, 16 bp, Homo sapiens
aaaatctgtggtggtc

SEQ ID NO: 2670469 - DNA, 21 bp, Homo sapiens
aaaatgagttacctacatttt

SEQ ID NO: 2670470 - DNA, 16 bp, Homo sapiens
aaaatggaaccaggct

SEQ ID NO: 2670471 - DNA, 22 bp, Homo sapiens
aaacaatgttaacatttttggt

SEQ ID NO: 2670472 - DNA, 21 bp, Homo sapiens
aaacaggacttaaaatgacat

SEQ ID NO: 2670473 - DNA, 12 bp, Homo sapiens
aaacaggcagct

SEQ ID NO: 2670474 - DNA, 20 bp, Homo sapiens
aaacatttaccaatcatatt

SEQ ID NO: 2670475 - DNA, 16 bp, Homo sapiens
aaacattttcacacaa

SEQ ID NO: 2670476 - DNA, 15 bp, Homo sapiens
aaaccaaaaactgaa

SEQ ID NO: 2670477 - DNA, 15 bp, Homo sapiens
aaaccagaggcagct

SEQ ID NO: 2670478 - DNA, 20 bp, Homo sapiens
aaaccattatgaagaagaga

SEQ ID NO: 2670479 - DNA, 11 bp, Homo sapiens
aaacctctcct

SEQ ID NO: 2670480 - DNA, 22 bp, Homo sapiens
aaacctctcctcatgttctgct

SEQ ID NO: 2670481 - DNA, 11 bp, Homo sapiens
aaaccttcaca

SEQ ID NO: 2670482 - DNA, 20 bp, Homo sapiens
aaaccttcacacacagactg

SEQ ID NO: 2670483 - DNA, 17 bp, Homo sapiens
aaactacaaaaattaac

SEQ ID NO: 2670484 - DNA, 20 bp, Homo sapiens
aaactaggggacaaagcaaa

SEQ ID NO: 2670485 - DNA, 19 bp, Homo sapiens
aaacttccagtgcaacact

SEQ ID NO: 2670486 - DNA, 21 bp, Homo sapiens
aaacttccagtgcaacactga

SEQ ID NO: 2670487 - DNA, 13 bp, Homo sapiens
aaagaaatatctg

SEQ ID NO: 2670488 - DNA, 20 bp, Homo sapiens
aaagatatatgaatatgaca

SEQ ID NO: 2670489 - DNA, 19 bp, Homo sapiens
aaagccacaaccacataca

SEQ ID NO: 2670490 - DNA, 17 bp, Homo sapiens
aaagctgtattttgaaa

SEQ ID NO: 2670491 - DNA, 13 bp, Homo sapiens
aaaggaagaaaaa

SEQ ID NO: 2670492 - DNA, 17 bp, Homo sapiens
aaaggccagacctgcag

SEQ ID NO: 2670493 - DNA, 16 bp, Homo sapiens
aaagtgccagaaagtg

SEQ ID NO: 2670494 - DNA, 14 bp, Homo sapiens
aaagtgctgcggag

SEQ ID NO: 2670495 - DNA, 14 bp, Homo sapiens
aaagttattcttga

SEQ ID NO: 2670496 - DNA, 18 bp, Homo sapiens
aaataaccaatctacaat

SEQ ID NO: 2670497 - DNA, 20 bp, Homo sapiens
aaatagatggatttgtatca

SEQ ID NO: 2670498 - DNA, 15 bp, Homo sapiens
aaatagcttctgttt

SEQ ID NO: 2670499 - DNA, 12 bp, Homo sapiens
aaatattgtctt

SEQ ID NO: 2670500 - DNA, 20 bp, Homo sapiens
aaatattgtctttttgtatg

SEQ ID NO: 2670501 - DNA, 23 bp, Homo sapiens
aaatattttgatcttcaacaaat

SEQ ID NO: 2670502 - DNA, 11 bp, Homo sapiens
aaatcatcaag

SEQ ID NO: 2670503 - DNA, 12 bp, Homo sapiens
aaatcatcaaga

SEQ ID NO: 2670504 - DNA, 14 bp, Homo sapiens
aaatcatcaagaag

SEQ ID NO: 2670505 - DNA, 23 bp, Homo sapiens
aaatcatcaagaagggctgcatg

SEQ ID NO: 2670506 - DNA, 14 bp, Homo sapiens
aaatctacagtaca

SEQ ID NO: 2670507 - DNA, 15 bp, Homo sapiens
aaatgcaaaaatctc

SEQ ID NO: 2670508 - DNA, 14 bp, Homo sapiens
aaatgctttagaaa

SEQ ID NO: 2670509 - DNA, 17 bp, Homo sapiens
aaatgtatatatgtata

SEQ ID NO: 2670510 - DNA, 21 bp, Homo sapiens
aaatgtcacgttttgttttgt

SEQ ID NO: 2670511 - DNA, 12 bp, Homo sapiens
agcattttcctc

SEQ ID NO: 2670512 - DNA, 15 bp, Homo sapiens
agcattttttaaaaa

SEQ ID NO: 2670513 - DNA, 21 bp, Homo sapiens
agccaaggctctgtttatgct

SEQ ID NO: 2670514 - DNA, 13 bp, Homo sapiens
agccacagctggt

SEQ ID NO: 2670515 - DNA, 22 bp, Homo sapiens
agccatgggcacaaagggccca

SEQ ID NO: 2670516 - DNA, 13 bp, Homo sapiens
agcccaaagaagg

SEQ ID NO: 2670517 - DNA, 18 bp, Homo sapiens
agccctgggatcactgtg

SEQ ID NO: 2670518 - DNA, 17 bp, Homo sapiens
agcccttgcattgcaga

SEQ ID NO: 2670519 - DNA, 12 bp, Homo sapiens
agcctaggccag

SEQ ID NO: 2670520 - DNA, 18 bp, Homo sapiens
agcctggtttagcctgga

SEQ ID NO: 2670521 - DNA, 16 bp, Homo sapiens
agccttccacactcac

SEQ ID NO: 2670522 - DNA, 20 bp, Homo sapiens
agcggacagtggcaggacag

SEQ ID NO: 2670523 - DNA, 20 bp, Homo sapiens
agcgggaatggcagctgcca

SEQ ID NO: 2670524 - DNA, 17 bp, Homo sapiens
agcgggagcctccctgc

SEQ ID NO: 2670525 - DNA, 19 bp, Homo sapiens
agctactcgggaagctgag

SEQ ID NO: 2670526 - DNA, 16 bp, Homo sapiens
agctcctcactcacct

SEQ ID NO: 2670527 - DNA, 19 bp, Homo sapiens
agctcttgaagacactgaa

SEQ ID NO: 2670528 - DNA, 17 bp, Homo sapiens
agctgaaagttgggact

SEQ ID NO: 2670529 - DNA, 20 bp, Homo sapiens
agctgaaatatgctggctgg

SEQ ID NO: 2670530 - DNA, 13 bp, Homo sapiens
agctgactcacac

SEQ ID NO: 2670531 - DNA, 11 bp, Homo sapiens
agctgatgact

SEQ ID NO: 2670532 - DNA, 21 bp, Homo sapiens
agctgcagaaacgaagccatc

SEQ ID NO: 2670533 - DNA, 14 bp, Homo sapiens
agctgcaggggcat

SEQ ID NO: 2670534 - DNA, 16 bp, Homo sapiens
agctgctcagggaaaa

SEQ ID NO: 2670535 - DNA, 14 bp, Homo sapiens
agctggccccgccg

SEQ ID NO: 2670536 - DNA, 19 bp, Homo sapiens
agctggggttcatgacaat

SEQ ID NO: 2670537 - DNA, 15 bp, Homo sapiens
agctgtgcacaaagt

SEQ ID NO: 2670538 - DNA, 12 bp, Homo sapiens
agcttcaaagct

SEQ ID NO: 2670539 - DNA, 19 bp, Homo sapiens
agcttctcatcctgcaggc

SEQ ID NO: 2670540 - DNA, 14 bp, Homo sapiens
agcttctttgccaa

SEQ ID NO: 2670541 - DNA, 15 bp, Homo sapiens
agctttaaaagaaaa

SEQ ID NO: 2670542 - DNA, 21 bp, Homo sapiens
aggaaaaaaatcgtccaggga

SEQ ID NO: 2670543 - DNA, 21 bp, Homo sapiens
aggaaagcttgagtaaaataa

SEQ ID NO: 2670544 - DNA, 21 bp, Homo sapiens
aggaagatctctgcagggccg

SEQ ID NO: 2670545 - DNA, 20 bp, Homo sapiens
aggacatccccccgccaaaa

SEQ ID NO: 2670546 - DNA, 21 bp, Homo sapiens
aggacctccaagccactgagc

SEQ ID NO: 2670547 - DNA, 16 bp, Homo sapiens
aggagaatctcttgaa

SEQ ID NO: 2670548 - DNA, 18 bp, Homo sapiens
aggagacaggcagagctg

SEQ ID NO: 2670549 - DNA, 14 bp, Homo sapiens
aggagacccacagg

SEQ ID NO: 2670550 - DNA, 11 bp, Homo sapiens
aggagcttcct

SEQ ID NO: 2670551 - DNA, 14 bp, Homo sapiens
aggatgctttggtt

SEQ ID NO: 2670552 - DNA, 19 bp, Homo sapiens
aggcaaagggtccagaagg

SEQ ID NO: 2670553 - DNA, 17 bp, Homo sapiens
aggcaaggttatatgca

SEQ ID NO: 2670554 - DNA, 18 bp, Homo sapiens
aggcatccttcctcacac

SEQ ID NO: 2670555 - DNA, 15 bp, Homo sapiens
acctttctcctttgt

SEQ ID NO: 2670556 - DNA, 18 bp, Homo sapiens
acgaagaagagccacagt

SEQ ID NO: 2670557 - DNA, 14 bp, Homo sapiens
acgcctcccactgg

SEQ ID NO: 2670558 - DNA, 15 bp, Homo sapiens
acgcctcccactggg

SEQ ID NO: 2670559 - DNA, 15 bp, Homo sapiens
acgctctctactctg

SEQ ID NO: 2670560 - DNA, 19 bp, Homo sapiens
acgctttcagcgaatgaca

SEQ ID NO: 2670561 - DNA, 16 bp, Homo sapiens
acggacaccccctcgc

SEQ ID NO: 2670562 - DNA, 18 bp, Homo sapiens
acgtgtactacaatttaa

SEQ ID NO: 2670563 - DNA, 22 bp, Homo sapiens
acgtttgaagacattgcaccag

SEQ ID NO: 2670564 - DNA, 22 bp, Homo sapiens
actaattcttgcatattttgta

SEQ ID NO: 2670565 - DNA, 22 bp, Homo sapiens
actacaatttaaagcaaaggag

SEQ ID NO: 2670566 - DNA, 19 bp, Homo sapiens
actagagggacctctccca

SEQ ID NO: 2670567 - DNA, 17 bp, Homo sapiens
actaggggacaaagcaa

SEQ ID NO: 2670568 - DNA, 15 bp, Homo sapiens
actatattgtacaca

SEQ ID NO: 2670569 - DNA, 18 bp, Homo sapiens
actcaaatgctcagacca

SEQ ID NO: 2670570 - DNA, 21 bp, Homo sapiens
actcaaatgctcagaccagct

SEQ ID NO: 2670571 - DNA, 23 bp, Homo sapiens
actcaaatgctcagaccagctct

SEQ ID NO: 2670572 - DNA, 16 bp, Homo sapiens
actcaagattcccagg

SEQ ID NO: 2670573 - DNA, 12 bp, Homo sapiens
actcaatatttt

SEQ ID NO: 2670574 - DNA, 15 bp, Homo sapiens
actcaatattttcca

SEQ ID NO: 2670575 - DNA, 22 bp, Homo sapiens
actcaatattttccatgaaaat

SEQ ID NO: 2670576 - DNA, 19 bp, Homo sapiens
actcacatggctatgtttt

SEQ ID NO: 2670577 - DNA, 20 bp, Homo sapiens
actcacatggctatgtttta

SEQ ID NO: 2670578 - DNA, 13 bp, Homo sapiens
actcatattactg

SEQ ID NO: 2670579 - DNA, 22 bp, Homo sapiens
actcctcagttcttgccacttt

SEQ ID NO: 2670580 - DNA, 14 bp, Homo sapiens
actcctgctgtaaa

SEQ ID NO: 2670581 - DNA, 14 bp, Homo sapiens
actctgggctccag

SEQ ID NO: 2670582 - DNA, 15 bp, Homo sapiens
actctgtgtctgagt

SEQ ID NO: 2670583 - DNA, 17 bp, Homo sapiens
actgaaaacctctcctc

SEQ ID NO: 2670584 - DNA, 15 bp, Homo sapiens
actgaaatatacaca

SEQ ID NO: 2670585 - DNA, 17 bp, Homo sapiens
actgaaatatacacaca

SEQ ID NO: 2670586 - DNA, 19 bp, Homo sapiens
actgaacaccattgaaggc

SEQ ID NO: 2670587 - DNA, 21 bp, Homo sapiens
actgatttccccttttgcatt

SEQ ID NO: 2670588 - DNA, 23 bp, Homo sapiens
actgatttccccttttgcattct

SEQ ID NO: 2670589 - DNA, 16 bp, Homo sapiens
actgcataccaacctg

SEQ ID NO: 2670590 - DNA, 19 bp, Homo sapiens
actgcctttggcagagttc

SEQ ID NO: 2670591 - DNA, 18 bp, Homo sapiens
actgcttgtgtttttaac

SEQ ID NO: 2670592 - DNA, 18 bp, Homo sapiens
actggactccggccctcc

SEQ ID NO: 2670593 - DNA, 19 bp, Homo sapiens
actggactccggccctcct

SEQ ID NO: 2670594 - DNA, 20 bp, Homo sapiens
actggtaggaacttgagaac

SEQ ID NO: 2670595 - DNA, 13 bp, Homo sapiens
aaattaacactgc

SEQ ID NO: 2670596 - DNA, 21 bp, Homo sapiens
aaattaacactgcttgtgttt

SEQ ID NO: 2670597 - DNA, 22 bp, Homo sapiens
aaatttattttataagaaaaac

SEQ ID NO: 2670598 - DNA, 16 bp, Homo sapiens
aacaaactctctgaac

SEQ ID NO: 2670599 - DNA, 20 bp, Homo sapiens
aacaatgactaattcttgca

SEQ ID NO: 2670600 - DNA, 21 bp, Homo sapiens
aacaatgactaattcttgcat

SEQ ID NO: 2670601 - DNA, 19 bp, Homo sapiens
aacagactcgattcatatt

SEQ ID NO: 2670602 - DNA, 11 bp, Homo sapiens
aacagggaggg

SEQ ID NO: 2670603 - DNA, 14 bp, Homo sapiens
aacataaagcaaat

SEQ ID NO: 2670604 - DNA, 19 bp, Homo sapiens
aacataaagcaaatagaca

SEQ ID NO: 2670605 - DNA, 13 bp, Homo sapiens
aacatttttggta

SEQ ID NO: 2670606 - DNA, 22 bp, Homo sapiens
aaccacatacaacacaaagaga

SEQ ID NO: 2670607 - DNA, 19 bp, Homo sapiens
aaccagggattgtttctgt

SEQ ID NO: 2670608 - DNA, 22 bp, Homo sapiens
aacccaaattacgtgtactaca

SEQ ID NO: 2670609 - DNA, 12 bp, Homo sapiens
aacccccactgg

SEQ ID NO: 2670610 - DNA, 20 bp, Homo sapiens
aacccccactggactgacct

SEQ ID NO: 2670611 - DNA, 15 bp, Homo sapiens
aaccccgtcaacaaa

SEQ ID NO: 2670612 - DNA, 11 bp, Homo sapiens
aacccttctcc

SEQ ID NO: 2670613 - DNA, 21 bp, Homo sapiens
aacccttctcctcttgtaaat

SEQ ID NO: 2670614 - DNA, 15 bp, Homo sapiens
aacctgaacctagga

SEQ ID NO: 2670615 - DNA, 12 bp, Homo sapiens
aaccttctggcc

SEQ ID NO: 2670616 - DNA, 12 bp, Homo sapiens
aactcaatattt

SEQ ID NO: 2670617 - DNA, 13 bp, Homo sapiens
aactcttttaaca

SEQ ID NO: 2670618 - DNA, 14 bp, Homo sapiens
aactcttttaacag

SEQ ID NO: 2670619 - DNA, 21 bp, Homo sapiens
aactgaacaccattgaaggct

SEQ ID NO: 2670620 - DNA, 23 bp, Homo sapiens
aactgaacaccattgaaggctta

SEQ ID NO: 2670621 - DNA, 12 bp, Homo sapiens
aacttttttggt

SEQ ID NO: 2670622 - DNA, 14 bp, Homo sapiens
aagaagagaaagaa

SEQ ID NO: 2670623 - DNA, 15 bp, Homo sapiens
aagaagagccacagt

SEQ ID NO: 2670624 - DNA, 16 bp, Homo sapiens
aagaagggctgcatga

SEQ ID NO: 2670625 - DNA, 23 bp, Homo sapiens
aagacaatggcttactccaggag

SEQ ID NO: 2670626 - DNA, 16 bp, Homo sapiens
aagacagagctgggat

SEQ ID NO: 2670627 - DNA, 17 bp, Homo sapiens
aagagaaaaagaaatgc

SEQ ID NO: 2670628 - DNA, 11 bp, Homo sapiens
aagagccacag

SEQ ID NO: 2670629 - DNA, 18 bp, Homo sapiens
aagagctgaggcaattct

SEQ ID NO: 2670630 - DNA, 22 bp, Homo sapiens
aagagtgtggagtcattctcat

SEQ ID NO: 2670631 - DNA, 23 bp, Homo sapiens
aagagtgtggagtcattctcatt

SEQ ID NO: 2670632 - DNA, 17 bp, Homo sapiens
aagataaagccagaagc

SEQ ID NO: 2670633 - DNA, 17 bp, Homo sapiens
aagatagcttcacccca

SEQ ID NO: 2670634 - DNA, 22 bp, Homo sapiens
aagatgggtccaggattcctct

SEQ ID NO: 2670635 - DNA, 19 bp, Homo sapiens
aagattcccaggagttctg

SEQ ID NO: 2670636 - DNA, 21 bp, Homo sapiens
aagattcccaggagttctgct

SEQ ID NO: 2670637 - DNA, 15 bp, Homo sapiens
aagattcttcccatt

SEQ ID NO: 2670638 - DNA, 23 bp, Homo sapiens
aagattcttcccattctccattt

SEQ ID NO: 2670639 - DNA, 12 bp, Homo sapiens
aagcaaacacat

SEQ ID NO: 2670640 - DNA, 13 bp, Homo sapiens
aagcaaacacatt

SEQ ID NO: 2670641 - DNA, 13 bp, Homo sapiens
aagcaaacccaga

SEQ ID NO: 2670642 - DNA, 13 bp, Homo sapiens
aagcaagactgag

SEQ ID NO: 2670643 - DNA, 21 bp, Homo sapiens
aagcacaatgtctcacatggg

SEQ ID NO: 2670644 - DNA, 19 bp, Homo sapiens
aagcacactcatcccctca

SEQ ID NO: 2670645 - DNA, 16 bp, Homo sapiens
aagcagagaagctctc

SEQ ID NO: 2670646 - DNA, 14 bp, Homo sapiens
aagcagctctcccc

SEQ ID NO: 2670647 - DNA, 15 bp, Homo sapiens
aagcatgtgtttgca

SEQ ID NO: 2670648 - DNA, 14 bp, Homo sapiens
aagccacagctggt

SEQ ID NO: 2670649 - DNA, 16 bp, Homo sapiens
aagcccccccttccac

SEQ ID NO: 2670650 - DNA, 14 bp, Homo sapiens
aagctgctttattc

SEQ ID NO: 2670651 - DNA, 15 bp, Homo sapiens
aagctttaccagctg

SEQ ID NO: 2670652 - DNA, 14 bp, Homo sapiens
aaggagacaggcag

SEQ ID NO: 2670653 - DNA, 15 bp, Homo sapiens
aaggagatgaagcaa

SEQ ID NO: 2670654 - DNA, 21 bp, Homo sapiens
aaggcccacgagcttgttctt

SEQ ID NO: 2670655 - DNA, 18 bp, Homo sapiens
aaggcctcgcaggaagac

SEQ ID NO: 2670656 - DNA, 15 bp, Homo sapiens
aaggcttaaacccat

SEQ ID NO: 2670657 - DNA, 15 bp, Homo sapiens
aagggatatgtgaaa

SEQ ID NO: 2670658 - DNA, 16 bp, Homo sapiens
aagtagcatttactgt

SEQ ID NO: 2670659 - DNA, 15 bp, Homo sapiens
aagtatgggaaatga

SEQ ID NO: 2670660 - DNA, 17 bp, Homo sapiens
aagtctctaacaatgta

SEQ ID NO: 2670661 - DNA, 13 bp, Homo sapiens
aagtgctgcggag

SEQ ID NO: 2670662 - DNA, 19 bp, Homo sapiens
aagtttccttccagcccag

SEQ ID NO: 2670663 - DNA, 18 bp, Homo sapiens
aataaagccttcaaactc

SEQ ID NO: 2670664 - DNA, 18 bp, Homo sapiens
aataaaggttgttttgaa

SEQ ID NO: 2670665 - DNA, 16 bp, Homo sapiens
aataaatattgtcttt

SEQ ID NO: 2670666 - DNA, 23 bp, Homo sapiens
aataaatattgtctttttgtatg

SEQ ID NO: 2670667 - DNA, 17 bp, Homo sapiens
aataaccaatctacaat

SEQ ID NO: 2670668 - DNA, 14 bp, Homo sapiens
aatataaacactat

SEQ ID NO: 2670669 - DNA, 14 bp, Homo sapiens
aatataatactgta

SEQ ID NO: 2670670 - DNA, 13 bp, Homo sapiens
aatatatttgtgt

SEQ ID NO: 2670671 - DNA, 24 bp, Homo sapiens
aatatatttgtgtatttaacaggg

SEQ ID NO: 2670672 - DNA, 13 bp, Homo sapiens
aatatcagacttt

SEQ ID NO: 2670673 - DNA, 16 bp, Homo sapiens
aatatgctggctggag

SEQ ID NO: 2670674 - DNA, 18 bp, Homo sapiens
aatatttggttttcctgt

SEQ ID NO: 2670675 - DNA, 21 bp, Homo sapiens
aatattttccatgaaaatgca

SEQ ID NO: 2670676 - DNA, 20 bp, Homo sapiens
aatattttgatcttcaacaa

SEQ ID NO: 2670677 - DNA, 21 bp, Homo sapiens
aatattttgatcttcaacaaa

SEQ ID NO: 2670678 - DNA, 12 bp, Homo sapiens
aatcatcaagaa

SEQ ID NO: 2670679 - DNA, 15 bp, Homo sapiens
aatcatctttgtgaa

SEQ ID NO: 2670680 - DNA, 16 bp, Homo sapiens
aatctaggaaaatatt

SEQ ID NO: 2670681 - DNA, 17 bp, Homo sapiens
aatctatttatcttcat

SEQ ID NO: 2670682 - DNA, 20 bp, Homo sapiens
aatctgatatgtattgtttg

SEQ ID NO: 2670683 - DNA, 17 bp, Homo sapiens
aatgaagttgtaggtaa

SEQ ID NO: 2670684 - DNA, 18 bp, Homo sapiens
aatgactaattcttgcat

SEQ ID NO: 2670685 - DNA, 22 bp, Homo sapiens
aatgagaagaaaatggaaccag

SEQ ID NO: 2670686 - DNA, 17 bp, Homo sapiens
aatgagattaattcctt

SEQ ID NO: 2670687 - DNA, 19 bp, Homo sapiens
aatgatgctatttgcaatt

SEQ ID NO: 2670688 - DNA, 13 bp, Homo sapiens
aatgatggcccat

SEQ ID NO: 2670689 - DNA, 17 bp, Homo sapiens
aatggcacagcccaaag

SEQ ID NO: 2670690 - DNA, 19 bp, Homo sapiens
aatggcacagcccaaagaa

SEQ ID NO: 2670691 - DNA, 17 bp, Homo sapiens
aatggtttgaatataaa

SEQ ID NO: 2670692 - DNA, 23 bp, Homo sapiens
aatggtttgaatataaacactat

SEQ ID NO: 2670693 - DNA, 19 bp, Homo sapiens
aatggtttgcaaggaagcc

SEQ ID NO: 2670694 - DNA, 18 bp, Homo sapiens
aatgtacgatgagaaatt

SEQ ID NO: 2670695 - DNA, 13 bp, Homo sapiens
aatgtattttctt

SEQ ID NO: 2670696 - DNA, 17 bp, Homo sapiens
aatgtgcctagttcttt

SEQ ID NO: 2670697 - DNA, 16 bp, Homo sapiens
aatgttaacatttttg

SEQ ID NO: 2670698 - DNA, 15 bp, Homo sapiens
aatgttagatagtta

SEQ ID NO: 2670699 - DNA, 15 bp, Homo sapiens
aattagctgcttcta

SEQ ID NO: 2670700 - DNA, 14 bp, Homo sapiens
aattataaaagcca

SEQ ID NO: 2670701 - DNA, 17 bp, Homo sapiens
aattcccaacaaacatt

SEQ ID NO: 2670702 - DNA, 15 bp, Homo sapiens
aattggttctttatt

SEQ ID NO: 2670703 - DNA, 16 bp, Homo sapiens
aattgtattttagtaa

SEQ ID NO: 2670704 - DNA, 20 bp, Homo sapiens
aatttaaagaagtatgggaa

SEQ ID NO: 2670705 - DNA, 15 bp, Homo sapiens
aatttaaagccacaa

SEQ ID NO: 2670706 - DNA, 16 bp, Homo sapiens
aatttattttataaga

SEQ ID NO: 2670707 - DNA, 17 bp, Homo sapiens
aatttattttataagaa

SEQ ID NO: 2670708 - DNA, 21 bp, Homo sapiens
aatttattttataagaaaaac

SEQ ID NO: 2670709 - DNA, 14 bp, Homo sapiens
aattttgttctctg

SEQ ID NO: 2670710 - DNA, 18 bp, Homo sapiens
aattttgttctctgggag

SEQ ID NO: 2670711 - DNA, 21 bp, Homo sapiens
aattttgttctctgggagaaa

SEQ ID NO: 2670712 - DNA, 19 bp, Homo sapiens
aattttgttttcttgattt

SEQ ID NO: 2670713 - DNA, 20 bp, Homo sapiens
acaaagagaaaaagaaatgc

SEQ ID NO: 2670714 - DNA, 21 bp, Homo sapiens
acaaagagaaaaagaaatgca

SEQ ID NO: 2670715 - DNA, 19 bp, Homo sapiens
acaaagttccaaaatgcca

SEQ ID NO: 2670716 - DNA, 15 bp, Homo sapiens
ttctggcctcccaca

SEQ ID NO: 2670717 - DNA, 17 bp, Homo sapiens
ttcttaaacaaatgtat

SEQ ID NO: 2670718 - DNA, 17 bp, Homo sapiens
ttcttcccattctccat

SEQ ID NO: 2670719 - DNA, 20 bp, Homo sapiens
ttcttgcatattttgtaact

SEQ ID NO: 2670720 - DNA, 12 bp, Homo sapiens
ttgaaggcttaa

SEQ ID NO: 2670721 - DNA, 20 bp, Homo sapiens
ttgaattttgttctctggga

SEQ ID NO: 2670722 - DNA, 14 bp, Homo sapiens
ttgacagaacactg

SEQ ID NO: 2670723 - DNA, 21 bp, Homo sapiens
ttgagaaaaaaagaatagttg

SEQ ID NO: 2670724 - DNA, 18 bp, Homo sapiens
ttgagaactttatttcca

SEQ ID NO: 2670725 - DNA, 12 bp, Homo sapiens
ttgagtaaaata

SEQ ID NO: 2670726 - DNA, 20 bp, Homo sapiens
ttgatttttacgtttgaaga

SEQ ID NO: 2670727 - DNA, 12 bp, Homo sapiens
ttgcaaggaagc

SEQ ID NO: 2670728 - DNA, 13 bp, Homo sapiens
ttgcaaggaagcc

SEQ ID NO: 2670729 - DNA, 14 bp, Homo sapiens
ttgcatatatacat

SEQ ID NO: 2670730 - DNA, 12 bp, Homo sapiens
ttgcattctccc

SEQ ID NO: 2670731 - DNA, 18 bp, Homo sapiens
ttgccgcgtcgccctccc

SEQ ID NO: 2670732 - DNA, 22 bp, Homo sapiens
ttgccgcgtcgccctcccaggc

SEQ ID NO: 2670733 - DNA, 16 bp, Homo sapiens
ttgccggtggtgcagg

SEQ ID NO: 2670734 - DNA, 13 bp, Homo sapiens
ttgctctggacct

SEQ ID NO: 2670735 - DNA, 16 bp, Homo sapiens
ttgctctggacctgcc

SEQ ID NO: 2670736 - DNA, 16 bp, Homo sapiens
ttggaagaaaaaatct

SEQ ID NO: 2670737 - DNA, 16 bp, Homo sapiens
ttgggttccattctca

SEQ ID NO: 2670738 - DNA, 13 bp, Homo sapiens
ttggtgttgacat

SEQ ID NO: 2670739 - DNA, 17 bp, Homo sapiens
ttggttaaaaaaaagaa

SEQ ID NO: 2670740 - DNA, 16 bp, Homo sapiens
ttggtttaatttaaag

SEQ ID NO: 2670741 - DNA, 18 bp, Homo sapiens
ttgtaaaaaaaaaaaaca

SEQ ID NO: 2670742 - DNA, 13 bp, Homo sapiens
ttgtaaaacaggt

SEQ ID NO: 2670743 - DNA, 16 bp, Homo sapiens
ttgtaaagtccccaga

SEQ ID NO: 2670744 - DNA, 17 bp, Homo sapiens
ttgtagcatcctcttta

SEQ ID NO: 2670745 - DNA, 15 bp, Homo sapiens
ttgtagccttttgac

SEQ ID NO: 2670746 - DNA, 17 bp, Homo sapiens
ttgtgcctccctggtga

SEQ ID NO: 2670747 - DNA, 22 bp, Homo sapiens
ttgtgtcaacatgaacaaattt

SEQ ID NO: 2670748 - DNA, 17 bp, Homo sapiens
ttgttaatattcatttt

SEQ ID NO: 2670749 - DNA, 13 bp, Homo sapiens
ttgttcaaacatt

SEQ ID NO: 2670750 - DNA, 20 bp, Homo sapiens
ttgttctctgggagaaaatc

SEQ ID NO: 2670751 - DNA, 15 bp, Homo sapiens
ttgttctttgttctt

SEQ ID NO: 2670752 - DNA, 12 bp, Homo sapiens
ttgtttctgttt

SEQ ID NO: 2670753 - DNA, 20 bp, Homo sapiens
tttaaaagttactcctttta

SEQ ID NO: 2670754 - DNA, 21 bp, Homo sapiens
tttaaccatggtgcttgttaa

SEQ ID NO: 2670755 - DNA, 16 bp, Homo sapiens
tttaaccccgtcaaca

SEQ ID NO: 2670756 - DNA, 17 bp, Homo sapiens
tttaaccccgtcaacaa

SEQ ID NO: 2670757 - DNA, 17 bp, Homo sapiens
tttaagacgtgtttgtg

SEQ ID NO: 2670758 - DNA, 22 bp, Homo sapiens
tttaagggagtgtactcccagg

SEQ ID NO: 2670759 - DNA, 21 bp, Homo sapiens
tttaatctccaccagtcattt

SEQ ID NO: 2670760 - DNA, 16 bp, Homo sapiens
tttacagtctatttga

SEQ ID NO: 2670761 - DNA, 18 bp, Homo sapiens
tttacagtctatttgaga

SEQ ID NO: 2670762 - DNA, 19 bp, Homo sapiens
tttactgttatcctattta

SEQ ID NO: 2670763 - DNA, 17 bp, Homo sapiens
tttataagaaaaacttt

SEQ ID NO: 2670764 - DNA, 17 bp, Homo sapiens
tttatactggcatgcta

SEQ ID NO: 2670765 - DNA, 20 bp, Homo sapiens
tttatttgtttgtgcatttg

SEQ ID NO: 2670766 - DNA, 19 bp, Homo sapiens
tttcaatttccaagagctg

SEQ ID NO: 2670767 - DNA, 12 bp, Homo sapiens
tttcagaccttt

SEQ ID NO: 2670768 - DNA, 13 bp, Homo sapiens
tttcagacctttt

SEQ ID NO: 2670769 - DNA, 14 bp, Homo sapiens
tttcccttcatctg

SEQ ID NO: 2670770 - DNA, 23 bp, Homo sapiens
tttccctttgaggttgctttgtt

SEQ ID NO: 2670771 - DNA, 17 bp, Homo sapiens
tttcctctgctttgaaa

SEQ ID NO: 2670772 - DNA, 15 bp, Homo sapiens
tttccttccagccca

SEQ ID NO: 2670773 - DNA, 22 bp, Homo sapiens
tttcgattcgttaagagagcaa

SEQ ID NO: 2670774 - DNA, 15 bp, Homo sapiens
tttctccagggtcag

SEQ ID NO: 2670775 - DNA, 16 bp, Homo sapiens
tttctcctttgtactt

SEQ ID NO: 2670776 - DNA, 14 bp, Homo sapiens
tttctctttcttta

SEQ ID NO: 2670777 - DNA, 19 bp, Homo sapiens
tttctgaaaattaacactg

SEQ ID NO: 2670778 - DNA, 15 bp, Homo sapiens
tttctgaagctttac

SEQ ID NO: 2670779 - DNA, 15 bp, Homo sapiens
tttctttcacaaaaa

SEQ ID NO: 2670780 - DNA, 18 bp, Homo sapiens
tttgaatataaacactat

SEQ ID NO: 2670781 - DNA, 14 bp, Homo sapiens
tttgactttcattg

SEQ ID NO: 2670782 - DNA, 14 bp, Homo sapiens
tttgcaaggaagcc

SEQ ID NO: 2670783 - DNA, 20 bp, Homo sapiens
tttgcactaagatatttcca

SEQ ID NO: 2670784 - DNA, 19 bp, Homo sapiens
tttgcataataaatgcttc

SEQ ID NO: 2670785 - DNA, 13 bp, Homo sapiens
tttgcattctccc

SEQ ID NO: 2670786 - DNA, 16 bp, Homo sapiens
tttggttaagctttga

SEQ ID NO: 2670787 - DNA, 18 bp, Homo sapiens
tttgtatgttttttttct

SEQ ID NO: 2670788 - DNA, 23 bp, Homo sapiens
tttgttcccatcctcttctttta

SEQ ID NO: 2670789 - DNA, 14 bp, Homo sapiens
tttgttctttttat

SEQ ID NO: 2670790 - DNA, 18 bp, Homo sapiens
ttttaaaagtaaatgtac

SEQ ID NO: 2670791 - DNA, 15 bp, Homo sapiens
ttttactgaagcctt

SEQ ID NO: 2670792 - DNA, 17 bp, Homo sapiens
ttttagggagctggtct

SEQ ID NO: 2670793 - DNA, 19 bp, Homo sapiens
ttttatgccttttatttct

SEQ ID NO: 2670794 - DNA, 23 bp, Homo sapiens
ttttcacacaatacaataagtta

SEQ ID NO: 2670795 - DNA, 19 bp, Homo sapiens
ttttcccagctacaccttt

SEQ ID NO: 2670796 - DNA, 23 bp, Homo sapiens
ttttctgttactttgttttttaa

SEQ ID NO: 2670797 - DNA, 20 bp, Homo sapiens
ttttgactttcattggaaat

SEQ ID NO: 2670798 - DNA, 13 bp, Homo sapiens
ttttgatcttcaa

SEQ ID NO: 2670799 - DNA, 18 bp, Homo sapiens
ttttgatcttcaacaaat

SEQ ID NO: 2670800 - DNA, 21 bp, Homo sapiens
ttttggttaagctttgacact

SEQ ID NO: 2670801 - DNA, 22 bp, Homo sapiens
ttttggttaagctttgacactg

SEQ ID NO: 2670802 - DNA, 13 bp, Homo sapiens
ttttgttctctgg

SEQ ID NO: 2670803 - DNA, 19 bp, Homo sapiens
tttttaaccccgtcaacaa

SEQ ID NO: 2670804 - DNA, 23 bp, Homo sapiens
tttttattgaatctatttaagta

SEQ ID NO: 2670805 - DNA, 19 bp, Homo sapiens
tttttcattgccaaaaact

SEQ ID NO: 2670806 - DNA, 19 bp, Homo sapiens
tttttcccagctacacctt

SEQ ID NO: 2670807 - DNA, 21 bp, Homo sapiens
tttttgaaaaagaaaacactt

SEQ ID NO: 2670808 - DNA, 13 bp, Homo sapiens
tgacagaacactg

SEQ ID NO: 2670809 - DNA, 14 bp, Homo sapiens
tgacagaacactgt

SEQ ID NO: 2670810 - DNA, 16 bp, Homo sapiens
tgacagaacactgtct

SEQ ID NO: 2670811 - DNA, 21 bp, Homo sapiens
tgacagaacactgtcttgaag

SEQ ID NO: 2670812 - DNA, 16 bp, Homo sapiens
tgacagtcatgcagtc

SEQ ID NO: 2670813 - DNA, 20 bp, Homo sapiens
tgaccaaaatggtgaaacct

SEQ ID NO: 2670814 - DNA, 17 bp, Homo sapiens
tgaccttctaggaagct

SEQ ID NO: 2670815 - DNA, 17 bp, Homo sapiens
tgaccttgatgagctgt

SEQ ID NO: 2670816 - DNA, 17 bp, Homo sapiens
tgactaattcttgcata

SEQ ID NO: 2670817 - DNA, 14 bp, Homo sapiens
tgactcaagattcc

SEQ ID NO: 2670818 - DNA, 18 bp, Homo sapiens
tgactcaagattcccagg

SEQ ID NO: 2670819 - DNA, 19 bp, Homo sapiens
tgactcacacctgaactga

SEQ ID NO: 2670820 - DNA, 17 bp, Homo sapiens
tgactttcattggaaat

SEQ ID NO: 2670821 - DNA, 11 bp, Homo sapiens
tgactttgtct

SEQ ID NO: 2670822 - DNA, 22 bp, Homo sapiens
tgagaagattcttcccattctc

SEQ ID NO: 2670823 - DNA, 17 bp, Homo sapiens
tgagcaatgtataaccc

SEQ ID NO: 2670824 - DNA, 23 bp, Homo sapiens
tgaggaaaaaaatcgtccaggga

SEQ ID NO: 2670825 - DNA, 18 bp, Homo sapiens
tgaggtcatagcagtgct

SEQ ID NO: 2670826 - DNA, 22 bp, Homo sapiens
tgagtaaaataaatattgtctt

SEQ ID NO: 2670827 - DNA, 14 bp, Homo sapiens
tgagtcaattggaa

SEQ ID NO: 2670828 - DNA, 17 bp, Homo sapiens
tgagtcgcgcaccgaaa

SEQ ID NO: 2670829 - DNA, 17 bp, Homo sapiens
tgagtctgttttgtaaa

SEQ ID NO: 2670830 - DNA, 19 bp, Homo sapiens
tgagtggcttcactcctgc

SEQ ID NO: 2670831 - DNA, 15 bp, Homo sapiens
tgatatgtattgttt

SEQ ID NO: 2670832 - DNA, 17 bp, Homo sapiens
tgatatttgtgcatttt

SEQ ID NO: 2670833 - DNA, 20 bp, Homo sapiens
tgatcaggacctccaagcca

SEQ ID NO: 2670834 - DNA, 14 bp, Homo sapiens
tgatcttcaacaaa

SEQ ID NO: 2670835 - DNA, 21 bp, Homo sapiens
tgatcttcaacaaattgccct

SEQ ID NO: 2670836 - DNA, 22 bp, Homo sapiens
tgatcttcaacaaattgccctt

SEQ ID NO: 2670837 - DNA, 15 bp, Homo sapiens
tgatgactcaagatt

SEQ ID NO: 2670838 - DNA, 22 bp, Homo sapiens
tgatgactcaagattcccagga

SEQ ID NO: 2670839 - DNA, 23 bp, Homo sapiens
tgatgactcaagattcccaggag

SEQ ID NO: 2670840 - DNA, 19 bp, Homo sapiens
tgatgagctgtgcacaaag

SEQ ID NO: 2670841 - DNA, 14 bp, Homo sapiens
tgatgccctgccct

SEQ ID NO: 2670842 - DNA, 20 bp, Homo sapiens
tgatgctatttgcaattcct

SEQ ID NO: 2670843 - DNA, 17 bp, Homo sapiens
tgatggcccattctact

SEQ ID NO: 2670844 - DNA, 19 bp, Homo sapiens
tgatggcccattctacttg

SEQ ID NO: 2670845 - DNA, 20 bp, Homo sapiens
tgatggcccattctacttgc

SEQ ID NO: 2670846 - DNA, 13 bp, Homo sapiens
tgcaacaacatgt

SEQ ID NO: 2670847 - DNA, 17 bp, Homo sapiens
tgcaaccagggagctgc

SEQ ID NO: 2670848 - DNA, 23 bp, Homo sapiens
tgcaagcccctgctccagaagat

SEQ ID NO: 2670849 - DNA, 19 bp, Homo sapiens
tgcaccatttaaaaacagg

SEQ ID NO: 2670850 - DNA, 11 bp, Homo sapiens
tgcagccagag

SEQ ID NO: 2670851 - DNA, 16 bp, Homo sapiens
tgcagggacaaagagg

SEQ ID NO: 2670852 - DNA, 19 bp, Homo sapiens
tgcatagagccacgtatgt

SEQ ID NO: 2670853 - DNA, 15 bp, Homo sapiens
tgcatcccccccacc

SEQ ID NO: 2670854 - DNA, 18 bp, Homo sapiens
tgcatgaaggtttctgaa

SEQ ID NO: 2670855 - DNA, 21 bp, Homo sapiens
tgcatgaaggtttctgaaaat

SEQ ID NO: 2670856 - DNA, 15 bp, Homo sapiens
tgcatgatgtttgcc

SEQ ID NO: 2670857 - DNA, 23 bp, Homo sapiens
tgcatgtttgttgtatacttcct

SEQ ID NO: 2670858 - DNA, 11 bp, Homo sapiens
tgcattctccc

SEQ ID NO: 2670859 - DNA, 20 bp, Homo sapiens
tgccaaaaaaagacagggct

SEQ ID NO: 2670860 - DNA, 17 bp, Homo sapiens
tgccaacctattttgaa

SEQ ID NO: 2670861 - DNA, 13 bp, Homo sapiens
tgccaagtttgtt

SEQ ID NO: 2670862 - DNA, 14 bp, Homo sapiens
tgccagtaaaaaaa

SEQ ID NO: 2670863 - DNA, 22 bp, Homo sapiens
tgccagtaaaaaaaaaaaatgg

SEQ ID NO: 2670864 - DNA, 23 bp, Homo sapiens
tgccatggacagaagaaggcagc

SEQ ID NO: 2670865 - DNA, 14 bp, Homo sapiens
tgccattttgcatt

SEQ ID NO: 2670866 - DNA, 19 bp, Homo sapiens
tgcccaaagttttattttt

SEQ ID NO: 2670867 - DNA, 22 bp, Homo sapiens
tgcccagcggacagtggcagga

SEQ ID NO: 2670868 - DNA, 12 bp, Homo sapiens
tgccccattctt

SEQ ID NO: 2670869 - DNA, 18 bp, Homo sapiens
tgcccccgcatcccctgc

SEQ ID NO: 2670870 - DNA, 22 bp, Homo sapiens
tgcccccgcatcccctgcctcc

SEQ ID NO: 2670871 - DNA, 21 bp, Homo sapiens
tgccgcgtcgccctcccaggc

SEQ ID NO: 2670872 - DNA, 20 bp, Homo sapiens
tgccgttacttttcatattt

SEQ ID NO: 2670873 - DNA, 15 bp, Homo sapiens
tgcctcagccctgac

SEQ ID NO: 2670874 - DNA, 18 bp, Homo sapiens
tgcctcaggcctctgtgc

SEQ ID NO: 2670875 - DNA, 12 bp, Homo sapiens
tgcctccatcct

SEQ ID NO: 2670876 - DNA, 14 bp, Homo sapiens
tgcctccctggtga

SEQ ID NO: 2670877 - DNA, 14 bp, Homo sapiens
tgcctctcacagct

SEQ ID NO: 2670878 - DNA, 17 bp, Homo sapiens
tgcctctcacagctgag

SEQ ID NO: 2670879 - DNA, 21 bp, Homo sapiens
tgcctctcacagctgagttgt

SEQ ID NO: 2670880 - DNA, 20 bp, Homo sapiens
tgctaactagcttggaaact

SEQ ID NO: 2670881 - DNA, 20 bp, Homo sapiens
tgctaggcccccgggtgtga

SEQ ID NO: 2670882 - DNA, 19 bp, Homo sapiens
tgctatccagctattttta

SEQ ID NO: 2670883 - DNA, 13 bp, Homo sapiens
tgctatttgcaat

SEQ ID NO: 2670884 - DNA, 17 bp, Homo sapiens
tgctcagaccagctctt

SEQ ID NO: 2670885 - DNA, 19 bp, Homo sapiens
tgctcagggaaaagcagct

SEQ ID NO: 2670886 - DNA, 22 bp, Homo sapiens
tgctcagggaaaagcagctctc

SEQ ID NO: 2670887 - DNA, 23 bp, Homo sapiens
tgctcattctaatgatggcccat

SEQ ID NO: 2670888 - DNA, 15 bp, Homo sapiens
tgctgagttggtgtt

SEQ ID NO: 2670889 - DNA, 16 bp, Homo sapiens
tgctggttttaacaac

SEQ ID NO: 2670890 - DNA, 20 bp, Homo sapiens
tgctgtaaatttggcttctg

SEQ ID NO: 2670891 - DNA, 14 bp, Homo sapiens
tgctgtcctcaggt

SEQ ID NO: 2670892 - DNA, 21 bp, Homo sapiens
tgctgtcctcaggtggccatg

SEQ ID NO: 2670893 - DNA, 12 bp, Homo sapiens
tgcttaatgaaa

SEQ ID NO: 2670894 - DNA, 21 bp, Homo sapiens
tgctttctgaagctttaccag

SEQ ID NO: 2670895 - DNA, 22 bp, Homo sapiens
tgctttgaaagccccagaaatc

SEQ ID NO: 2670896 - DNA, 16 bp, Homo sapiens
tggaaaaaaaaaagac

SEQ ID NO: 2670897 - DNA, 23 bp, Homo sapiens
tggaaagacagcttctcatcctg

SEQ ID NO: 2670898 - DNA, 14 bp, Homo sapiens
tggacatttacctt

SEQ ID NO: 2670899 - DNA, 11 bp, Homo sapiens
tggacctgccc

SEQ ID NO: 2670900 - DNA, 21 bp, Homo sapiens
tggactagagggacctctccc

SEQ ID NO: 2670901 - DNA, 16 bp, Homo sapiens
tcaacaaattgccctt

SEQ ID NO: 2670902 - DNA, 22 bp, Homo sapiens
tcaaccagggattgtttctgtt

SEQ ID NO: 2670903 - DNA, 13 bp, Homo sapiens
tcaagtagcattt

SEQ ID NO: 2670904 - DNA, 22 bp, Homo sapiens
tcaataaaaaaaagaaatgaaa

SEQ ID NO: 2670905 - DNA, 15 bp, Homo sapiens
tcaatattttccatg

SEQ ID NO: 2670906 - DNA, 17 bp, Homo sapiens
tcaatggtttgcaagga

SEQ ID NO: 2670907 - DNA, 19 bp, Homo sapiens
tcaatggtttgcaaggaag

SEQ ID NO: 2670908 - DNA, 18 bp, Homo sapiens
tcaatttccaagagctga

SEQ ID NO: 2670909 - DNA, 16 bp, Homo sapiens
tcacaacctgaaccta

SEQ ID NO: 2670910 - DNA, 18 bp, Homo sapiens
tcacaagggacgctttgg

SEQ ID NO: 2670911 - DNA, 20 bp, Homo sapiens
tcacaagggacgctttggga

SEQ ID NO: 2670912 - DNA, 23 bp, Homo sapiens
tcaccactcaaaggccagacctg

SEQ ID NO: 2670913 - DNA, 12 bp, Homo sapiens
tcacctctgcta

SEQ ID NO: 2670914 - DNA, 23 bp, Homo sapiens
tcactaccctaatagactaaatg

SEQ ID NO: 2670915 - DNA, 15 bp, Homo sapiens
tcactcctgctgtaa

SEQ ID NO: 2670916 - DNA, 19 bp, Homo sapiens
tcactcctgctgtaaattt

SEQ ID NO: 2670917 - DNA, 13 bp, Homo sapiens
tcactcttctcag

SEQ ID NO: 2670918 - DNA, 15 bp, Homo sapiens
tcactgtcctccaag

SEQ ID NO: 2670919 - DNA, 16 bp, Homo sapiens
tcactgtcctccaagc

SEQ ID NO: 2670920 - DNA, 12 bp, Homo sapiens
tcacttgagacc

SEQ ID NO: 2670921 - DNA, 12 bp, Homo sapiens
tcagaagaaatt

SEQ ID NO: 2670922 - DNA, 18 bp, Homo sapiens
tcagaccttttaactcct

SEQ ID NO: 2670923 - DNA, 18 bp, Homo sapiens
tcagcattgatatttgtg

SEQ ID NO: 2670924 - DNA, 16 bp, Homo sapiens
tcagggaaaagcagct

SEQ ID NO: 2670925 - DNA, 19 bp, Homo sapiens
tcagggaaaagcagctctc

SEQ ID NO: 2670926 - DNA, 15 bp, Homo sapiens
tcagtggatttccca

SEQ ID NO: 2670927 - DNA, 20 bp, Homo sapiens
tcagttcttgccactttttt

SEQ ID NO: 2670928 - DNA, 19 bp, Homo sapiens
tcatagaaagtgccagaaa

SEQ ID NO: 2670929 - DNA, 15 bp, Homo sapiens
tcatagatgtttcct

SEQ ID NO: 2670930 - DNA, 18 bp, Homo sapiens
tcatcaagaagggctgca

SEQ ID NO: 2670931 - DNA, 18 bp, Homo sapiens
tcatcctattctttcgaa

SEQ ID NO: 2670932 - DNA, 16 bp, Homo sapiens
tcatgaccagcaaata

SEQ ID NO: 2670933 - DNA, 21 bp, Homo sapiens
tcatgtatgttcagaagaaat

SEQ ID NO: 2670934 - DNA, 20 bp, Homo sapiens
tcatttgctaactagcttgg

SEQ ID NO: 2670935 - DNA, 19 bp, Homo sapiens
tcatttgtttgttttcctt

SEQ ID NO: 2670936 - DNA, 23 bp, Homo sapiens
tccaaaccttcacacacagactg

SEQ ID NO: 2670937 - DNA, 17 bp, Homo sapiens
tccaagccactgagcaa

SEQ ID NO: 2670938 - DNA, 15 bp, Homo sapiens
tccaagccagcggga

SEQ ID NO: 2670939 - DNA, 23 bp, Homo sapiens
tccacactcacctctaaaacagt

SEQ ID NO: 2670940 - DNA, 12 bp, Homo sapiens
tccacagggcac

SEQ ID NO: 2670941 - DNA, 16 bp, Homo sapiens
tccaccagtcattttt

SEQ ID NO: 2670942 - DNA, 18 bp, Homo sapiens
tccaccagtcatttttca

SEQ ID NO: 2670943 - DNA, 15 bp, Homo sapiens
tccatgaaaatgcaa

SEQ ID NO: 2670944 - DNA, 22 bp, Homo sapiens
tccatggccgtgtagaagcatg

SEQ ID NO: 2670945 - DNA, 19 bp, Homo sapiens
tccattctcacctatccac

SEQ ID NO: 2670946 - DNA, 19 bp, Homo sapiens
tccatttgttatctgggaa

SEQ ID NO: 2670947 - DNA, 17 bp, Homo sapiens
tcccaggtgcagccaga

SEQ ID NO: 2670948 - DNA, 17 bp, Homo sapiens
tccccagagaaagcgca

SEQ ID NO: 2670949 - DNA, 14 bp, Homo sapiens
tccccctagccatt

SEQ ID NO: 2670950 - DNA, 15 bp, Homo sapiens
tccccctagccattt

SEQ ID NO: 2670951 - DNA, 16 bp, Homo sapiens
tccccctagccatttt

SEQ ID NO: 2670952 - DNA, 15 bp, Homo sapiens
tcccctgcctccatc

SEQ ID NO: 2670953 - DNA, 11 bp, Homo sapiens
tccctgcctca

SEQ ID NO: 2670954 - DNA, 20 bp, Homo sapiens
tcctaccctgcgcccagtcc

SEQ ID NO: 2670955 - DNA, 14 bp, Homo sapiens
tcctatttagatgg

SEQ ID NO: 2670956 - DNA, 22 bp, Homo sapiens
tcctcaggtggccatgcctcag

SEQ ID NO: 2670957 - DNA, 23 bp, Homo sapiens
tcctcaggtggccatgcctcagc

SEQ ID NO: 2670958 - DNA, 12 bp, Homo sapiens
tcctccaagcca

SEQ ID NO: 2670959 - DNA, 15 bp, Homo sapiens
tcctcgttctccctg

SEQ ID NO: 2670960 - DNA, 17 bp, Homo sapiens
tcctctgctttgaaagc

SEQ ID NO: 2670961 - DNA, 23 bp, Homo sapiens
tcctgagccagtgtcaggaggaa

SEQ ID NO: 2670962 - DNA, 15 bp, Homo sapiens
tccttccagcccaga

SEQ ID NO: 2670963 - DNA, 21 bp, Homo sapiens
tccttcctcacaccaggcttg

SEQ ID NO: 2670964 - DNA, 15 bp, Homo sapiens
tccttgtagcctttt

SEQ ID NO: 2670965 - DNA, 19 bp, Homo sapiens
tcctttcaatggtttgcaa

SEQ ID NO: 2670966 - DNA, 14 bp, Homo sapiens
tcctttccaggtat

SEQ ID NO: 2670967 - DNA, 22 bp, Homo sapiens
tcgacagcattttcctctgctt

SEQ ID NO: 2670968 - DNA, 17 bp, Homo sapiens
tcgacttcgggctggcc

SEQ ID NO: 2670969 - DNA, 14 bp, Homo sapiens
tcgagaccagcctg

SEQ ID NO: 2670970 - DNA, 21 bp, Homo sapiens
tcgccagctgatgactcaaga

SEQ ID NO: 2670971 - DNA, 17 bp, Homo sapiens
tcgccctcccaggctct

SEQ ID NO: 2670972 - DNA, 18 bp, Homo sapiens
tcgcggcggagctggccc

SEQ ID NO: 2670973 - DNA, 19 bp, Homo sapiens
tcgcggcggagctggcccc

SEQ ID NO: 2670974 - DNA, 16 bp, Homo sapiens
tcggcagatactgtct

SEQ ID NO: 2670975 - DNA, 20 bp, Homo sapiens
tctaaagagtttattttaag

SEQ ID NO: 2670976 - DNA, 22 bp, Homo sapiens
tctaatgatggcccattctact

SEQ ID NO: 2670977 - DNA, 23 bp, Homo sapiens
tctacaatctcccttcacaagtt

SEQ ID NO: 2670978 - DNA, 23 bp, Homo sapiens
tctacaggtttgggtacaagtgg

SEQ ID NO: 2670979 - DNA, 13 bp, Homo sapiens
tctacttgctctg

SEQ ID NO: 2670980 - DNA, 15 bp, Homo sapiens
tctacttgctctgga

SEQ ID NO: 2670981 - DNA, 14 bp, Homo sapiens
tctactttaataaa

SEQ ID NO: 2670982 - DNA, 15 bp, Homo sapiens
tctactttaataaat

SEQ ID NO: 2670983 - DNA, 16 bp, Homo sapiens
tctaggaaaatatttt

SEQ ID NO: 2670984 - DNA, 20 bp, Homo sapiens
tctaggcctcctggcccagg

SEQ ID NO: 2670985 - DNA, 19 bp, Homo sapiens
tctatttatcttcatttga

SEQ ID NO: 2670986 - DNA, 12 bp, Homo sapiens
tctcacaaacat

SEQ ID NO: 2670987 - DNA, 13 bp, Homo sapiens
tctcatcctgcag

SEQ ID NO: 2670988 - DNA, 15 bp, Homo sapiens
tctcatgatttacag

SEQ ID NO: 2670989 - DNA, 22 bp, Homo sapiens
tctccaccagtcatttttcaga

SEQ ID NO: 2670990 - DNA, 21 bp, Homo sapiens
tctccagggtcagaaacagga

SEQ ID NO: 2670991 - DNA, 16 bp, Homo sapiens
tctcctcatgttctgc

SEQ ID NO: 2670992 - DNA, 15 bp, Homo sapiens
tctcctcttgtaaat

SEQ ID NO: 2670993 - DNA, 21 bp, Homo sapiens
tctcctcttgtaaataaagcc

SEQ ID NO: 2670994 - DNA, 21 bp, Homo sapiens
tctctaaagagtttattttaa

SEQ ID NO: 2670995 - DNA, 22 bp, Homo sapiens
tctctaaagagtttattttaag

SEQ ID NO: 2670996 - DNA, 18 bp, Homo sapiens
tctctacaggtttgggta

SEQ ID NO: 2670997 - DNA, 13 bp, Homo sapiens
tctctactctgct

SEQ ID NO: 2670998 - DNA, 18 bp, Homo sapiens
tctctgaggaagctgggg

SEQ ID NO: 2670999 - DNA, 21 bp, Homo sapiens
tctctgcgtgcagggacaaag

SEQ ID NO: 2671000 - DNA, 16 bp, Homo sapiens
tctctgggagaaaatc

SEQ ID NO: 2671001 - DNA, 21 bp, Homo sapiens
tctgagtggcttcactcctgc

SEQ ID NO: 2671002 - DNA, 15 bp, Homo sapiens
tctgctcattctaat

SEQ ID NO: 2671003 - DNA, 13 bp, Homo sapiens
tctggacctgccc

SEQ ID NO: 2671004 - DNA, 20 bp, Homo sapiens
tctgggagaaaatcatcaag

SEQ ID NO: 2671005 - DNA, 22 bp, Homo sapiens
tctgggagaaaatcatcaagaa

SEQ ID NO: 2671006 - DNA, 23 bp, Homo sapiens
tctgggagaaaatcatcaagaag

SEQ ID NO: 2671007 - DNA, 13 bp, Homo sapiens
tctgggctccaga

SEQ ID NO: 2671008 - DNA, 14 bp, Homo sapiens
tctgtatcttttct

SEQ ID NO: 2671009 - DNA, 16 bp, Homo sapiens
tctgtgtctgagtggc

SEQ ID NO: 2671010 - DNA, 16 bp, Homo sapiens
tctgtttatgcttttg

SEQ ID NO: 2671011 - DNA, 22 bp, Homo sapiens
tctgttttgtaaagtccccaga

SEQ ID NO: 2671012 - DNA, 21 bp, Homo sapiens
tcttatcacaaaaaagaaaat

SEQ ID NO: 2671013 - DNA, 14 bp, Homo sapiens
tcttcccattctcc

SEQ ID NO: 2671014 - DNA, 19 bp, Homo sapiens
tcttcccattctccatttg

SEQ ID NO: 2671015 - DNA, 14 bp, Homo sapiens
tcttctcagccact

SEQ ID NO: 2671016 - DNA, 17 bp, Homo sapiens
tcttggcttggtgagga

SEQ ID NO: 2671017 - DNA, 17 bp, Homo sapiens
tcttgtaaataaagccc

SEQ ID NO: 2671018 - DNA, 12 bp, Homo sapiens
tctttctttgga

SEQ ID NO: 2671019 - DNA, 17 bp, Homo sapiens
tctttgtgtcaacatga

SEQ ID NO: 2671020 - DNA, 15 bp, Homo sapiens
tcttttgtaatttaa

SEQ ID NO: 2671021 - DNA, 19 bp, Homo sapiens
ggccctcctaccctgcgcc

SEQ ID NO: 2671022 - DNA, 16 bp, Homo sapiens
ggccgggcagaggggc

SEQ ID NO: 2671023 - DNA, 16 bp, Homo sapiens
ggcctcccacagactc

SEQ ID NO: 2671024 - DNA, 21 bp, Homo sapiens
ggcctctggaaagcaaagggc

SEQ ID NO: 2671025 - DNA, 13 bp, Homo sapiens
ggcctgaagagtc

SEQ ID NO: 2671026 - DNA, 17 bp, Homo sapiens
ggcggagctggccccgc

SEQ ID NO: 2671027 - DNA, 16 bp, Homo sapiens
ggctcacacctgtaat

SEQ ID NO: 2671028 - DNA, 15 bp, Homo sapiens
ggctgatggagtaaa

SEQ ID NO: 2671029 - DNA, 22 bp, Homo sapiens
ggctggcatgatccaagcaaga

SEQ ID NO: 2671030 - DNA, 23 bp, Homo sapiens
ggcttaaacccatattgtaaaac

SEQ ID NO: 2671031 - DNA, 15 bp, Homo sapiens
ggcttcactcctgct

SEQ ID NO: 2671032 - DNA, 15 bp, Homo sapiens
ggcttgcctgcaggc

SEQ ID NO: 2671033 - DNA, 21 bp, Homo sapiens
ggctttgcaaccattttcatt

SEQ ID NO: 2671034 - DNA, 20 bp, Homo sapiens
ggcttttactgaagcctttc

SEQ ID NO: 2671035 - DNA, 13 bp, Homo sapiens
gggaaaagcagct

SEQ ID NO: 2671036 - DNA, 22 bp, Homo sapiens
gggaatggcacagcccaaagaa

SEQ ID NO: 2671037 - DNA, 15 bp, Homo sapiens
gggaatggcagctgc

SEQ ID NO: 2671038 - DNA, 15 bp, Homo sapiens
gggacaaagaggcct

SEQ ID NO: 2671039 - DNA, 15 bp, Homo sapiens
gggacattgggaagg

SEQ ID NO: 2671040 - DNA, 21 bp, Homo sapiens
gggacccccgccccctgccct

SEQ ID NO: 2671041 - DNA, 23 bp, Homo sapiens
gggacctctcccagggtccctgg

SEQ ID NO: 2671042 - DNA, 19 bp, Homo sapiens
gggacgaagaagagccaca

SEQ ID NO: 2671043 - DNA, 18 bp, Homo sapiens
gggactgaaaacctctcc

SEQ ID NO: 2671044 - DNA, 13 bp, Homo sapiens
gggagacctggac

SEQ ID NO: 2671045 - DNA, 15 bp, Homo sapiens
gggagcaggcggtgg

SEQ ID NO: 2671046 - DNA, 24 bp, Homo sapiens
gggagcaggcggtgggcacccacc

SEQ ID NO: 2671047 - DNA, 15 bp, Homo sapiens
gggagctagccagag

SEQ ID NO: 2671048 - DNA, 18 bp, Homo sapiens
gggagtgtactcccaggg

SEQ ID NO: 2671049 - DNA, 22 bp, Homo sapiens
gggatttcaccactcaaaggcc

SEQ ID NO: 2671050 - DNA, 15 bp, Homo sapiens
gggcacaaagggccc

SEQ ID NO: 2671051 - DNA, 15 bp, Homo sapiens
gggcacacgcctccc

SEQ ID NO: 2671052 - DNA, 14 bp, Homo sapiens
gggcacaggccatg

SEQ ID NO: 2671053 - DNA, 16 bp, Homo sapiens
gggcacaggccatgga

SEQ ID NO: 2671054 - DNA, 14 bp, Homo sapiens
gggccgccagggag

SEQ ID NO: 2671055 - DNA, 20 bp, Homo sapiens
gggccgccagggagacctgg

SEQ ID NO: 2671056 - DNA, 17 bp, Homo sapiens
gggccgggcagaggggc

SEQ ID NO: 2671057 - DNA, 16 bp, Homo sapiens
gggctgcatgatgttt

SEQ ID NO: 2671058 - DNA, 15 bp, Homo sapiens
ggggaattcatctct

SEQ ID NO: 2671059 - DNA, 18 bp, Homo sapiens
taacccccactggactga

SEQ ID NO: 2671060 - DNA, 17 bp, Homo sapiens
taaccccgtcaacaaat

SEQ ID NO: 2671061 - DNA, 11 bp, Homo sapiens
taagaaaaact

SEQ ID NO: 2671062 - DNA, 19 bp, Homo sapiens
taagaaaaacttttttggt

SEQ ID NO: 2671063 - DNA, 20 bp, Homo sapiens
taagaaaaacttttttggtt

SEQ ID NO: 2671064 - DNA, 15 bp, Homo sapiens
taagacgtgtttgtg

SEQ ID NO: 2671065 - DNA, 20 bp, Homo sapiens
taatacgaattgtttcacaa

SEQ ID NO: 2671066 - DNA, 17 bp, Homo sapiens
taatagactaaatgaaa

SEQ ID NO: 2671067 - DNA, 14 bp, Homo sapiens
taatatttttaatt

SEQ ID NO: 2671068 - DNA, 14 bp, Homo sapiens
taatcccagctact

SEQ ID NO: 2671069 - DNA, 22 bp, Homo sapiens
taatgatggcccattctacttg

SEQ ID NO: 2671070 - DNA, 18 bp, Homo sapiens
taatgtcaaacttgagtc

SEQ ID NO: 2671071 - DNA, 17 bp, Homo sapiens
taatgtgcctagttctt

SEQ ID NO: 2671072 - DNA, 23 bp, Homo sapiens
taatgttgttccttttgaaagaa

SEQ ID NO: 2671073 - DNA, 16 bp, Homo sapiens
taattagcatctcagg

SEQ ID NO: 2671074 - DNA, 19 bp, Homo sapiens
taattcttgcatattttgt

SEQ ID NO: 2671075 - DNA, 17 bp, Homo sapiens
tacaaacatgtggttaa

SEQ ID NO: 2671076 - DNA, 17 bp, Homo sapiens
tacaacacaaagagaaa

SEQ ID NO: 2671077 - DNA, 14 bp, Homo sapiens
tacaagccccccct

SEQ ID NO: 2671078 - DNA, 18 bp, Homo sapiens
tacacctttctcctttgt

SEQ ID NO: 2671079 - DNA, 15 bp, Homo sapiens
tacagagaagtgaat

SEQ ID NO: 2671080 - DNA, 23 bp, Homo sapiens
tacagagaagtgaataactgcaa

SEQ ID NO: 2671081 - DNA, 18 bp, Homo sapiens
taccaaatagcttctgtt

SEQ ID NO: 2671082 - DNA, 13 bp, Homo sapiens
taccaatcatatt

SEQ ID NO: 2671083 - DNA, 23 bp, Homo sapiens
taccctgcgcccagtccttccac

SEQ ID NO: 2671084 - DNA, 15 bp, Homo sapiens
tacctgtattcccag

SEQ ID NO: 2671085 - DNA, 13 bp, Homo sapiens
tacggacaccccc

SEQ ID NO: 2671086 - DNA, 14 bp, Homo sapiens
tacggacaccccct

SEQ ID NO: 2671087 - DNA, 16 bp, Homo sapiens
tacgtttgaagacatt

SEQ ID NO: 2671088 - DNA, 15 bp, Homo sapiens
tactcaagcccgcgg

SEQ ID NO: 2671089 - DNA, 21 bp, Homo sapiens
tactcaagtagcatttactgt

SEQ ID NO: 2671090 - DNA, 17 bp, Homo sapiens
tactcatttaaagtatt

SEQ ID NO: 2671091 - DNA, 17 bp, Homo sapiens
tactgactgagaatata

SEQ ID NO: 2671092 - DNA, 20 bp, Homo sapiens
tactgcaccatttaaaaaca

SEQ ID NO: 2671093 - DNA, 16 bp, Homo sapiens
tactgtggtgttttgt

SEQ ID NO: 2671094 - DNA, 22 bp, Homo sapiens
tacttccttatgcttctttcaa

SEQ ID NO: 2671095 - DNA, 17 bp, Homo sapiens
tagaaagacagagctgg

SEQ ID NO: 2671096 - DNA, 22 bp, Homo sapiens
tagaaaggggcagtttaaagca

SEQ ID NO: 2671097 - DNA, 16 bp, Homo sapiens
tagaacataaagcaaa

SEQ ID NO: 2671098 - DNA, 22 bp, Homo sapiens
tagaacataaagcaaatagaca

SEQ ID NO: 2671099 - DNA, 15 bp, Homo sapiens
tagaattatctaatt

SEQ ID NO: 2671100 - DNA, 16 bp, Homo sapiens
tagaattatctaattt

SEQ ID NO: 2671101 - DNA, 21 bp, Homo sapiens
tagaattatctaatttataaa

SEQ ID NO: 2671102 - DNA, 23 bp, Homo sapiens
tagaattatctaatttataaaaa

SEQ ID NO: 2671103 - DNA, 22 bp, Homo sapiens
tagacaagtccagcctggcaag

SEQ ID NO: 2671104 - DNA, 13 bp, Homo sapiens
tagactaaatgaa

SEQ ID NO: 2671105 - DNA, 20 bp, Homo sapiens
tagatactttgctagccggc

SEQ ID NO: 2671106 - DNA, 15 bp, Homo sapiens
tagcttggaaactgg

SEQ ID NO: 2671107 - DNA, 20 bp, Homo sapiens
tagcttggaaactggatgag

SEQ ID NO: 2671108 - DNA, 16 bp, Homo sapiens
tagcttttgtgtctta

SEQ ID NO: 2671109 - DNA, 19 bp, Homo sapiens
tagcttttgtgtcttacat

SEQ ID NO: 2671110 - DNA, 14 bp, Homo sapiens
taggatactgctgc

SEQ ID NO: 2671111 - DNA, 22 bp, Homo sapiens
taggccaggtgcaaccagggag

SEQ ID NO: 2671112 - DNA, 20 bp, Homo sapiens
taggtctagcctatgtggat

SEQ ID NO: 2671113 - DNA, 20 bp, Homo sapiens
tagtaggtgagttttcacct

SEQ ID NO: 2671114 - DNA, 17 bp, Homo sapiens
tagttgaacctatttct

SEQ ID NO: 2671115 - DNA, 12 bp, Homo sapiens
tagttttgcata

SEQ ID NO: 2671116 - DNA, 14 bp, Homo sapiens
tataaacactatat

SEQ ID NO: 2671117 - DNA, 11 bp, Homo sapiens
tataagaaaaa

SEQ ID NO: 2671118 - DNA, 22 bp, Homo sapiens
tataatatttttaattaaataa

SEQ ID NO: 2671119 - DNA, 23 bp, Homo sapiens
tatactggcatgctaaagccttc

SEQ ID NO: 2671120 - DNA, 18 bp, Homo sapiens
tataggttttaaagacct

SEQ ID NO: 2671121 - DNA, 17 bp, Homo sapiens
tatatgatttttatcca

SEQ ID NO: 2671122 - DNA, 21 bp, Homo sapiens
tatattttatacattaacttc

SEQ ID NO: 2671123 - DNA, 15 bp, Homo sapiens
tatgagacacaggat

SEQ ID NO: 2671124 - DNA, 18 bp, Homo sapiens
tatgatgtgggtcaagga

SEQ ID NO: 2671125 - DNA, 13 bp, Homo sapiens
tatgcttctttca

SEQ ID NO: 2671126 - DNA, 23 bp, Homo sapiens
tatgggaaatgagaggcatttcc

SEQ ID NO: 2671127 - DNA, 18 bp, Homo sapiens
tatgtacaggatgctttg

SEQ ID NO: 2671128 - DNA, 17 bp, Homo sapiens
tatgtatggtatccaag

SEQ ID NO: 2671129 - DNA, 18 bp, Homo sapiens
tattaaatggaaactgaa

SEQ ID NO: 2671130 - DNA, 14 bp, Homo sapiens
tattcttattcaaa

SEQ ID NO: 2671131 - DNA, 20 bp, Homo sapiens
tattgaatataatatatttg

SEQ ID NO: 2671132 - DNA, 21 bp, Homo sapiens
tattgaatataatatatttgt

SEQ ID NO: 2671133 - DNA, 22 bp, Homo sapiens
tattgaatataatatatttgtg

SEQ ID NO: 2671134 - DNA, 17 bp, Homo sapiens
tattgaatctatttaag

SEQ ID NO: 2671135 - DNA, 13 bp, Homo sapiens
tatttatcttcat

SEQ ID NO: 2671136 - DNA, 20 bp, Homo sapiens
tatttcagttttaaatgtac

SEQ ID NO: 2671137 - DNA, 16 bp, Homo sapiens
tatttctctttcttta

SEQ ID NO: 2671138 - DNA, 18 bp, Homo sapiens
tatttgcactaagatatt

SEQ ID NO: 2671139 - DNA, 13 bp, Homo sapiens
tatttgtgcattt

SEQ ID NO: 2671140 - DNA, 17 bp, Homo sapiens
tatttgtgtatttaaca

SEQ ID NO: 2671141 - DNA, 18 bp, Homo sapiens
tattttgatcttcaacaa

SEQ ID NO: 2671142 - DNA, 19 bp, Homo sapiens
tcaaacaaactctctgaac

SEQ ID NO: 2671143 - DNA, 22 bp, Homo sapiens
tcaaacttccagtgcaacactg

SEQ ID NO: 2671144 - DNA, 21 bp, Homo sapiens
tcaaatgctcagaccagctct

SEQ ID NO: 2671145 - DNA, 21 bp, Homo sapiens
ccagggacgaagaagagccac

SEQ ID NO: 2671146 - DNA, 17 bp, Homo sapiens
ccagggagacctggaca

SEQ ID NO: 2671147 - DNA, 19 bp, Homo sapiens
ccagggagcattttcctcc

SEQ ID NO: 2671148 - DNA, 20 bp, Homo sapiens
ccagggagcattttcctcca

SEQ ID NO: 2671149 - DNA, 13 bp, Homo sapiens
ccagggagctgca

SEQ ID NO: 2671150 - DNA, 15 bp, Homo sapiens
ccagggagctgcagg

SEQ ID NO: 2671151 - DNA, 22 bp, Homo sapiens
ccagggcttacggccctggcct

SEQ ID NO: 2671152 - DNA, 18 bp, Homo sapiens
ccagggtcagaaacagga

SEQ ID NO: 2671153 - DNA, 13 bp, Homo sapiens
ccagggtccctgg

SEQ ID NO: 2671154 - DNA, 14 bp, Homo sapiens
ccaggtgcagccag

SEQ ID NO: 2671155 - DNA, 16 bp, Homo sapiens
ccaggtgcagccagag

SEQ ID NO: 2671156 - DNA, 22 bp, Homo sapiens
ccagtataaaacacctaaataa

SEQ ID NO: 2671157 - DNA, 17 bp, Homo sapiens
ccagtccttccacctcg

SEQ ID NO: 2671158 - DNA, 21 bp, Homo sapiens
ccagtgatgctaaaggttgta

SEQ ID NO: 2671159 - DNA, 14 bp, Homo sapiens
ccagtgcaacactg

SEQ ID NO: 2671160 - DNA, 22 bp, Homo sapiens
ccagttcctttcaatggtttgc

SEQ ID NO: 2671161 - DNA, 20 bp, Homo sapiens
ccatccttccctgtctgcca

SEQ ID NO: 2671162 - DNA, 19 bp, Homo sapiens
ccatcgccagctgatgact

SEQ ID NO: 2671163 - DNA, 14 bp, Homo sapiens
ccatctttctttgg

SEQ ID NO: 2671164 - DNA, 19 bp, Homo sapiens
ccatgaagaggatgctgtg

SEQ ID NO: 2671165 - DNA, 22 bp, Homo sapiens
ccatgatgacaactacagaaaa

SEQ ID NO: 2671166 - DNA, 12 bp, Homo sapiens
ccatgcctcagc

SEQ ID NO: 2671167 - DNA, 15 bp, Homo sapiens
ccatgcctcagccct

SEQ ID NO: 2671168 - DNA, 16 bp, Homo sapiens
ccatgcctcagccctg

SEQ ID NO: 2671169 - DNA, 16 bp, Homo sapiens
ccatgcgacactggga

SEQ ID NO: 2671170 - DNA, 21 bp, Homo sapiens
ccatgggcacaaagggcccag

SEQ ID NO: 2671171 - DNA, 21 bp, Homo sapiens
ccatgtgaaaaggcaaaaagc

SEQ ID NO: 2671172 - DNA, 23 bp, Homo sapiens
ccatgtgctacaggggccagaag

SEQ ID NO: 2671173 - DNA, 17 bp, Homo sapiens
ccatgttgtgcctccct

SEQ ID NO: 2671174 - DNA, 20 bp, Homo sapiens
ccatgttgtgcctccctggt

SEQ ID NO: 2671175 - DNA, 22 bp, Homo sapiens
ccatgttgtgcctccctggtga

SEQ ID NO: 2671176 - DNA, 13 bp, Homo sapiens
ccattctccattt

SEQ ID NO: 2671177 - DNA, 16 bp, Homo sapiens
ccattcttttgtaatt

SEQ ID NO: 2671178 - DNA, 22 bp, Homo sapiens
ccattcttttgtaatttaaatg

SEQ ID NO: 2671179 - DNA, 15 bp, Homo sapiens
ccatttctctcctca

SEQ ID NO: 2671180 - DNA, 12 bp, Homo sapiens
cccaaagaagga

SEQ ID NO: 2671181 - DNA, 18 bp, Homo sapiens
cccaacacgcaggagcac

SEQ ID NO: 2671182 - DNA, 21 bp, Homo sapiens
cccaattcttacaaacatgtg

SEQ ID NO: 2671183 - DNA, 23 bp, Homo sapiens
cccacagactcaaatgctcagac

SEQ ID NO: 2671184 - DNA, 14 bp, Homo sapiens
cccaccctgggacc

SEQ ID NO: 2671185 - DNA, 21 bp, Homo sapiens
cccagccaggccccaggcagg

SEQ ID NO: 2671186 - DNA, 18 bp, Homo sapiens
cccagcggacagtggcag

SEQ ID NO: 2671187 - DNA, 22 bp, Homo sapiens
cccagctacctcaaccaatgcc

SEQ ID NO: 2671188 - DNA, 14 bp, Homo sapiens
cccaggagttctgc

SEQ ID NO: 2671189 - DNA, 21 bp, Homo sapiens
cccaggagttctgctcattct

SEQ ID NO: 2671190 - DNA, 15 bp, Homo sapiens
cccaggtgcagccag

SEQ ID NO: 2671191 - DNA, 19 bp, Homo sapiens
cccatattgtaaaacaggt

SEQ ID NO: 2671192 - DNA, 15 bp, Homo sapiens
cccattctacttgct

SEQ ID NO: 2671193 - DNA, 19 bp, Homo sapiens
ccccactggactgacctgg

SEQ ID NO: 2671194 - DNA, 22 bp, Homo sapiens
ccccagagaaagcgcagatgct

SEQ ID NO: 2671195 - DNA, 22 bp, Homo sapiens
ccccatcgccagctgatgactc

SEQ ID NO: 2671196 - DNA, 15 bp, Homo sapiens
ccccattcttttgta

SEQ ID NO: 2671197 - DNA, 11 bp, Homo sapiens
ccccccttcca

SEQ ID NO: 2671198 - DNA, 13 bp, Homo sapiens
ccccccttccact

SEQ ID NO: 2671199 - DNA, 14 bp, Homo sapiens
cccccgccccctgc

SEQ ID NO: 2671200 - DNA, 11 bp, Homo sapiens
cccccttccac

SEQ ID NO: 2671201 - DNA, 17 bp, Homo sapiens
ccccgcatcccctgcct

SEQ ID NO: 2671202 - DNA, 21 bp, Homo sapiens
cccctttatgtacaggatgct

SEQ ID NO: 2671203 - DNA, 19 bp, Homo sapiens
cccgcatcccctgcctcca

SEQ ID NO: 2671204 - DNA, 20 bp, Homo sapiens
cccgcatcccctgcctccat

SEQ ID NO: 2671205 - DNA, 22 bp, Homo sapiens
gagcaggcggtgggcacccacc

SEQ ID NO: 2671206 - DNA, 18 bp, Homo sapiens
gagccatgggcacaaagg

SEQ ID NO: 2671207 - DNA, 17 bp, Homo sapiens
gagcctaggccaggtgc

SEQ ID NO: 2671208 - DNA, 14 bp, Homo sapiens
gagcctccctgcct

SEQ ID NO: 2671209 - DNA, 15 bp, Homo sapiens
gagcctccctgcctc

SEQ ID NO: 2671210 - DNA, 19 bp, Homo sapiens
gagcggtgctgtcctcagg

SEQ ID NO: 2671211 - DNA, 18 bp, Homo sapiens
gagctacccgcagagttc

SEQ ID NO: 2671212 - DNA, 14 bp, Homo sapiens
gagctcaggacact

SEQ ID NO: 2671213 - DNA, 19 bp, Homo sapiens
gagctccaactcagaaggg

SEQ ID NO: 2671214 - DNA, 20 bp, Homo sapiens
gagctcccaggtgcagccag

SEQ ID NO: 2671215 - DNA, 17 bp, Homo sapiens
gagctgaggcaattcta

SEQ ID NO: 2671216 - DNA, 14 bp, Homo sapiens
gagctggccccgcc

SEQ ID NO: 2671217 - DNA, 19 bp, Homo sapiens
gagcttcctgtcctcccag

SEQ ID NO: 2671218 - DNA, 19 bp, Homo sapiens
gaggaggtaatgaattaaa

SEQ ID NO: 2671219 - DNA, 18 bp, Homo sapiens
gaggcaaggttatatgca

SEQ ID NO: 2671220 - DNA, 20 bp, Homo sapiens
gaggcccctgtctcagggtg

SEQ ID NO: 2671221 - DNA, 18 bp, Homo sapiens
gaggccgttgattcactt

SEQ ID NO: 2671222 - DNA, 14 bp, Homo sapiens
gagggacctctccc

SEQ ID NO: 2671223 - DNA, 18 bp, Homo sapiens
gagggacctctcccaggg

SEQ ID NO: 2671224 - DNA, 22 bp, Homo sapiens
gagggagcaagtccttcccttt

SEQ ID NO: 2671225 - DNA, 23 bp, Homo sapiens
gaggggcagatggaaaggagcct

SEQ ID NO: 2671226 - DNA, 22 bp, Homo sapiens
gaggtattcaatatcctttgcc

SEQ ID NO: 2671227 - DNA, 22 bp, Homo sapiens
gagtaaaataaatattgtcttt

SEQ ID NO: 2671228 - DNA, 23 bp, Homo sapiens
gagtaaaataaatattgtctttt

SEQ ID NO: 2671229 - DNA, 17 bp, Homo sapiens
gagtagaaagacagagc

SEQ ID NO: 2671230 - DNA, 22 bp, Homo sapiens
gagtcacaaagaacatgtagaa

SEQ ID NO: 2671231 - DNA, 13 bp, Homo sapiens
gagtcctctgaat

SEQ ID NO: 2671232 - DNA, 15 bp, Homo sapiens
gagtggcttcactcc

SEQ ID NO: 2671233 - DNA, 16 bp, Homo sapiens
gagttagaataataaa

SEQ ID NO: 2671234 - DNA, 21 bp, Homo sapiens
gagttagaataataaatattt

SEQ ID NO: 2671235 - DNA, 16 bp, Homo sapiens
gagttctgctcattct

SEQ ID NO: 2671236 - DNA, 23 bp, Homo sapiens
gagttgacttgacagaacactgt

SEQ ID NO: 2671237 - DNA, 23 bp, Homo sapiens
gatagcttcaccccaatcccagc

SEQ ID NO: 2671238 - DNA, 21 bp, Homo sapiens
gatcgcggcggagctggcccc

SEQ ID NO: 2671239 - DNA, 23 bp, Homo sapiens
gatctatacttgctttgtgttct

SEQ ID NO: 2671240 - DNA, 16 bp, Homo sapiens
gatctctgcagggccg

SEQ ID NO: 2671241 - DNA, 20 bp, Homo sapiens
gatctctgcagggccgccag

SEQ ID NO: 2671242 - DNA, 15 bp, Homo sapiens
gatcttcaacaaatt

SEQ ID NO: 2671243 - DNA, 24 bp, Homo sapiens
gatcttttgttcccatcctcttct

SEQ ID NO: 2671244 - DNA, 13 bp, Homo sapiens
gatgactcaagat

SEQ ID NO: 2671245 - DNA, 16 bp, Homo sapiens
gatgactcaagattcc

SEQ ID NO: 2671246 - DNA, 21 bp, Homo sapiens
gatgactcaagattcccagga

SEQ ID NO: 2671247 - DNA, 16 bp, Homo sapiens
gatgcagcattatgat

SEQ ID NO: 2671248 - DNA, 15 bp, Homo sapiens
gatgccattacattt

SEQ ID NO: 2671249 - DNA, 15 bp, Homo sapiens
ctctgtttatgcttt

SEQ ID NO: 2671250 - DNA, 14 bp, Homo sapiens
ctcttctcagccac

SEQ ID NO: 2671251 - DNA, 22 bp, Homo sapiens
ctcttcttttagcagtaaaata

SEQ ID NO: 2671252 - DNA, 17 bp, Homo sapiens
ctcttgtaaataaagcc

SEQ ID NO: 2671253 - DNA, 19 bp, Homo sapiens
ctcttgtaaataaagccct

SEQ ID NO: 2671254 - DNA, 12 bp, Homo sapiens
ctcttttctctg

SEQ ID NO: 2671255 - DNA, 17 bp, Homo sapiens
ctgaaaacctctcctca

SEQ ID NO: 2671256 - DNA, 19 bp, Homo sapiens
ctgaaagtgaaagtccaga

SEQ ID NO: 2671257 - DNA, 19 bp, Homo sapiens
ctgaaatatacacacagca

SEQ ID NO: 2671258 - DNA, 11 bp, Homo sapiens
ctgaacaccat

SEQ ID NO: 2671259 - DNA, 18 bp, Homo sapiens
ctgaacaccattgaaggc

SEQ ID NO: 2671260 - DNA, 19 bp, Homo sapiens
ctgaacaccattgaaggct

SEQ ID NO: 2671261 - DNA, 16 bp, Homo sapiens
ctgaacccctccctcc

SEQ ID NO: 2671262 - DNA, 19 bp, Homo sapiens
ctgaactgatgggtttctc

SEQ ID NO: 2671263 - DNA, 15 bp, Homo sapiens
ctgaagagtcctctg

SEQ ID NO: 2671264 - DNA, 16 bp, Homo sapiens
ctgaagagtcctctga

SEQ ID NO: 2671265 - DNA, 19 bp, Homo sapiens
ctgaagcctttcttttgga

SEQ ID NO: 2671266 - DNA, 14 bp, Homo sapiens
ctgacacctttcat

SEQ ID NO: 2671267 - DNA, 19 bp, Homo sapiens
ctgaccctgtatatagccc

SEQ ID NO: 2671268 - DNA, 16 bp, Homo sapiens
ctgacctggtccacag

SEQ ID NO: 2671269 - DNA, 20 bp, Homo sapiens
ctgacctggtccacagggca

SEQ ID NO: 2671270 - DNA, 17 bp, Homo sapiens
ctgaccttgatgagctg

SEQ ID NO: 2671271 - DNA, 22 bp, Homo sapiens
ctgactcacacctgaactgaac

SEQ ID NO: 2671272 - DNA, 20 bp, Homo sapiens
ctgagaatataatactgtat

SEQ ID NO: 2671273 - DNA, 16 bp, Homo sapiens
ctgagccagtgtcagg

SEQ ID NO: 2671274 - DNA, 22 bp, Homo sapiens
ctgagcgcctgggtccagggga

SEQ ID NO: 2671275 - DNA, 20 bp, Homo sapiens
ctgagggagctccaactcag

SEQ ID NO: 2671276 - DNA, 23 bp, Homo sapiens
ctgagtggcttcactcctgctgt

SEQ ID NO: 2671277 - DNA, 18 bp, Homo sapiens
ctgatcaggacctccaag

SEQ ID NO: 2671278 - DNA, 18 bp, Homo sapiens
ctgatgactcaagattcc

SEQ ID NO: 2671279 - DNA, 22 bp, Homo sapiens
ctgatgactcaagattcccagg

SEQ ID NO: 2671280 - DNA, 23 bp, Homo sapiens
ctgatgactcaagattcccagga

SEQ ID NO: 2671281 - DNA, 22 bp, Homo sapiens
ctgatgttcctttggaagaaaa

SEQ ID NO: 2671282 - DNA, 16 bp, Homo sapiens
ctgatttagatatgca

SEQ ID NO: 2671283 - DNA, 18 bp, Homo sapiens
ctgcaccatttaaaaaca

SEQ ID NO: 2671284 - DNA, 17 bp, Homo sapiens
ctgcaccgtactgtgga

SEQ ID NO: 2671285 - DNA, 20 bp, Homo sapiens
ctgcactctagcctgggtga

SEQ ID NO: 2671286 - DNA, 18 bp, Homo sapiens
ctgcagggccgccaggga

SEQ ID NO: 2671287 - DNA, 22 bp, Homo sapiens
ctgcccccgcatcccctgcctc

SEQ ID NO: 2671288 - DNA, 16 bp, Homo sapiens
ctgcctcaggcctctg

SEQ ID NO: 2671289 - DNA, 13 bp, Homo sapiens
ctgcctccatcct

SEQ ID NO: 2671290 - DNA, 14 bp, Homo sapiens
ctgcctccatccta

SEQ ID NO: 2671291 - DNA, 21 bp, Homo sapiens
ctgcctctcacagctgagttg

SEQ ID NO: 2671292 - DNA, 17 bp, Homo sapiens
ctgcggagcaagaggag

SEQ ID NO: 2671293 - DNA, 20 bp, Homo sapiens
ctgctactcaagtagcattt

SEQ ID NO: 2671294 - DNA, 22 bp, Homo sapiens
ctgctcagggaaaagcagctct

SEQ ID NO: 2671295 - DNA, 15 bp, Homo sapiens
ctgctggaaacagac

SEQ ID NO: 2671296 - DNA, 21 bp, Homo sapiens
ctgctggttttaacaactgtg

SEQ ID NO: 2671297 - DNA, 19 bp, Homo sapiens
ctgctgtaaatttggcttc

SEQ ID NO: 2671298 - DNA, 19 bp, Homo sapiens
ctggacctgcccccgcatc

SEQ ID NO: 2671299 - DNA, 21 bp, Homo sapiens
ctggactagagggacctctcc

SEQ ID NO: 2671300 - DNA, 15 bp, Homo sapiens
aagacgtgtttgtgt

SEQ ID NO: 2671301 - DNA, 16 bp, Homo sapiens
aagacgtgtttgtgtt

SEQ ID NO: 2671302 - DNA, 20 bp, Homo sapiens
aagactatccaacttaacat

SEQ ID NO: 2671303 - DNA, 18 bp, Homo sapiens
aagagaaaaagaaatgca

SEQ ID NO: 2671304 - DNA, 15 bp, Homo sapiens
aagagccacaggtct

SEQ ID NO: 2671305 - DNA, 22 bp, Homo sapiens
aagagccacaggtctttatgtt

SEQ ID NO: 2671306 - DNA, 11 bp, Homo sapiens
aagagctgagg

SEQ ID NO: 2671307 - DNA, 14 bp, Homo sapiens
aagaggatgctgtg

SEQ ID NO: 2671308 - DNA, 13 bp, Homo sapiens
aagattcccagga

SEQ ID NO: 2671309 - DNA, 15 bp, Homo sapiens
aagattcccaggagt

SEQ ID NO: 2671310 - DNA, 16 bp, Homo sapiens
aagattcccaggagtt

SEQ ID NO: 2671311 - DNA, 19 bp, Homo sapiens
aagattcttcccattctcc

SEQ ID NO: 2671312 - DNA, 20 bp, Homo sapiens
aagattcttcccattctcca

SEQ ID NO: 2671313 - DNA, 22 bp, Homo sapiens
aagattcttcccattctccatt

SEQ ID NO: 2671314 - DNA, 14 bp, Homo sapiens
aagcaaagggctcc

SEQ ID NO: 2671315 - DNA, 22 bp, Homo sapiens
aagcagcggtcagcagacaagg

SEQ ID NO: 2671316 - DNA, 13 bp, Homo sapiens
aagcagctctccc

SEQ ID NO: 2671317 - DNA, 16 bp, Homo sapiens
aagccttccacactca

SEQ ID NO: 2671318 - DNA, 17 bp, Homo sapiens
aagctcttgaagacact

SEQ ID NO: 2671319 - DNA, 19 bp, Homo sapiens
aagctcttgaagacactga

SEQ ID NO: 2671320 - DNA, 20 bp, Homo sapiens
aagctcttgaagacactgaa

SEQ ID NO: 2671321 - DNA, 16 bp, Homo sapiens
aagctggggttcatga

SEQ ID NO: 2671322 - DNA, 18 bp, Homo sapiens
aaggagcctaggccaggt

SEQ ID NO: 2671323 - DNA, 12 bp, Homo sapiens
aaggagggtgag

SEQ ID NO: 2671324 - DNA, 20 bp, Homo sapiens
aaggcagggagcgagggaga

SEQ ID NO: 2671325 - DNA, 15 bp, Homo sapiens
aaggcctcgcaggaa

SEQ ID NO: 2671326 - DNA, 17 bp, Homo sapiens
aaggcctcgcaggaaga

SEQ ID NO: 2671327 - DNA, 19 bp, Homo sapiens
aagggagtgtactcccagg

SEQ ID NO: 2671328 - DNA, 14 bp, Homo sapiens
aagggctgcatgat

SEQ ID NO: 2671329 - DNA, 20 bp, Homo sapiens
aaggggacccccgccccctg

SEQ ID NO: 2671330 - DNA, 13 bp, Homo sapiens
aaggttgtattgc

SEQ ID NO: 2671331 - DNA, 11 bp, Homo sapiens
aagtagcattt

SEQ ID NO: 2671332 - DNA, 12 bp, Homo sapiens
aagtgccagaaa

SEQ ID NO: 2671333 - DNA, 14 bp, Homo sapiens
aagtggcataaaaa

SEQ ID NO: 2671334 - DNA, 14 bp, Homo sapiens
aagttaaattttat

SEQ ID NO: 2671335 - DNA, 16 bp, Homo sapiens
aagttcagccaccctg

SEQ ID NO: 2671336 - DNA, 18 bp, Homo sapiens
aagtttccttccagccca

SEQ ID NO: 2671337 - DNA, 21 bp, Homo sapiens
aagttttcccttgaggaaaca

SEQ ID NO: 2671338 - DNA, 18 bp, Homo sapiens
aataaaaaaaagaaatga

SEQ ID NO: 2671339 - DNA, 17 bp, Homo sapiens
aataaaacattttcaca

SEQ ID NO: 2671340 - DNA, 19 bp, Homo sapiens
aataaaacattttcacaca

SEQ ID NO: 2671341 - DNA, 22 bp, Homo sapiens
aataagttaactattttatttt

SEQ ID NO: 2671342 - DNA, 14 bp, Homo sapiens
aatacaataagtta

SEQ ID NO: 2671343 - DNA, 21 bp, Homo sapiens
aatactatatttatactgtat

SEQ ID NO: 2671344 - DNA, 16 bp, Homo sapiens
aatagactaaatgaaa

SEQ ID NO: 2671345 - DNA, 18 bp, Homo sapiens
aatagatacagcagaggc

SEQ ID NO: 2671346 - DNA, 23 bp, Homo sapiens
aatagccactgcataccaacctg

SEQ ID NO: 2671347 - DNA, 19 bp, Homo sapiens
aatataaatgttaagaaaa

SEQ ID NO: 2671348 - DNA, 15 bp, Homo sapiens
aatattgactttgtc

SEQ ID NO: 2671349 - DNA, 16 bp, Homo sapiens
aatattgactttgtct

SEQ ID NO: 2671350 - DNA, 13 bp, Homo sapiens
aatattgtctttt

SEQ ID NO: 2671351 - DNA, 13 bp, Homo sapiens
aatattttgatct

SEQ ID NO: 2671352 - DNA, 23 bp, Homo sapiens
aatattttgatcttcaacaaatt

SEQ ID NO: 2671353 - DNA, 18 bp, Homo sapiens
aatcatcaagaagggctg

SEQ ID NO: 2671354 - DNA, 18 bp, Homo sapiens
aatctaggaaaatatttt

SEQ ID NO: 2671355 - DNA, 22 bp, Homo sapiens
aatctccaccagtcatttttca

SEQ ID NO: 2671356 - DNA, 18 bp, Homo sapiens
aatctcccttcacaagtt

SEQ ID NO: 2671357 - DNA, 17 bp, Homo sapiens
aatgactaattcttgca

SEQ ID NO: 2671358 - DNA, 17 bp, Homo sapiens
aatgagaggcatttccc

SEQ ID NO: 2671359 - DNA, 21 bp, Homo sapiens
aatgatggcccattctacttg

SEQ ID NO: 2671360 - DNA, 18 bp, Homo sapiens
aatgcaacaacatgtata

SEQ ID NO: 2671361 - DNA, 19 bp, Homo sapiens
aatgcagtctgtccaggct

SEQ ID NO: 2671362 - DNA, 15 bp, Homo sapiens
aatgctcagaccagc

SEQ ID NO: 2671363 - DNA, 18 bp, Homo sapiens
aatgctttagaaaggttt

SEQ ID NO: 2671364 - DNA, 14 bp, Homo sapiens
aatggaaccaggct

SEQ ID NO: 2671365 - DNA, 16 bp, Homo sapiens
aatggaaccaggcttg

SEQ ID NO: 2671366 - DNA, 17 bp, Homo sapiens
aatggaaccaggcttgg

SEQ ID NO: 2671367 - DNA, 13 bp, Homo sapiens
aatggctccttca

SEQ ID NO: 2671368 - DNA, 14 bp, Homo sapiens
aatggtttgaatat

SEQ ID NO: 2671369 - DNA, 17 bp, Homo sapiens
aatggtttgcaaggaag

SEQ ID NO: 2671370 - DNA, 20 bp, Homo sapiens
aatgtactaggatactgctg

SEQ ID NO: 2671371 - DNA, 23 bp, Homo sapiens
aatgtattttcttcacctctgct

SEQ ID NO: 2671372 - DNA, 17 bp, Homo sapiens
aatgtcttctagaatat

SEQ ID NO: 2671373 - DNA, 22 bp, Homo sapiens
aatgtgtctttctttttggaca

SEQ ID NO: 2671374 - DNA, 21 bp, Homo sapiens
aattagtaggctcatttactg

SEQ ID NO: 2671375 - DNA, 22 bp, Homo sapiens
aattagtaggctcatttactgt

SEQ ID NO: 2671376 - DNA, 14 bp, Homo sapiens
aattatctaattta

SEQ ID NO: 2671377 - DNA, 18 bp, Homo sapiens
aattcaacgttaataatt

SEQ ID NO: 2671378 - DNA, 21 bp, Homo sapiens
aattcaacgttaataattctg

SEQ ID NO: 2671379 - DNA, 13 bp, Homo sapiens
aattcttgcatat

SEQ ID NO: 2671380 - DNA, 18 bp, Homo sapiens
aattgagctgcagaaacg

SEQ ID NO: 2671381 - DNA, 20 bp, Homo sapiens
aattgtttgtaagtgaagtg

SEQ ID NO: 2671382 - DNA, 18 bp, Homo sapiens
aatttattttataagaaa

SEQ ID NO: 2671383 - DNA, 23 bp, Homo sapiens
aatttatttttaccttcactgtg

SEQ ID NO: 2671384 - DNA, 12 bp, Homo sapiens
aatttggcttct

SEQ ID NO: 2671385 - DNA, 16 bp, Homo sapiens
aattttgttctctggg

SEQ ID NO: 2671386 - DNA, 16 bp, Homo sapiens
acaaacaaacaaacaa

SEQ ID NO: 2671387 - DNA, 15 bp, Homo sapiens
acaaactctctgaac

SEQ ID NO: 2671388 - DNA, 21 bp, Homo sapiens
acaaagatgggtgaaggctgg

SEQ ID NO: 2671389 - DNA, 18 bp, Homo sapiens
acaaaggcaaagggtcca

SEQ ID NO: 2671390 - DNA, 13 bp, Homo sapiens
acaaatgtatgat

SEQ ID NO: 2671391 - DNA, 14 bp, Homo sapiens
acaacatgtataat

SEQ ID NO: 2671392 - DNA, 18 bp, Homo sapiens
acaaccacatacaacaca

SEQ ID NO: 2671393 - DNA, 19 bp, Homo sapiens
acaactacagaaaaaccag

SEQ ID NO: 2671394 - DNA, 15 bp, Homo sapiens
acaagcaaacccaga

SEQ ID NO: 2671395 - DNA, 19 bp, Homo sapiens
acaagcaaacccagacggc

SEQ ID NO: 2671396 - DNA, 17 bp, Homo sapiens
acaagcccccccttcca

SEQ ID NO: 2671397 - DNA, 21 bp, Homo sapiens
acaataagttaactattttat

SEQ ID NO: 2671398 - DNA, 17 bp, Homo sapiens
acaatctcccttcacaa

SEQ ID NO: 2671399 - DNA, 20 bp, Homo sapiens
acaatgatgctatttgcaat

SEQ ID NO: 2671400 - DNA, 23 bp, Homo sapiens
acaatgtgtctttctttttggac

SEQ ID NO: 2671401 - DNA, 12 bp, Homo sapiens
acacaatacaat

SEQ ID NO: 2671402 - DNA, 17 bp, Homo sapiens
acacaatgtgtctttct

SEQ ID NO: 2671403 - DNA, 16 bp, Homo sapiens
acacatcgcactgtgg

SEQ ID NO: 2671404 - DNA, 14 bp, Homo sapiens
acaccagacagaca

SEQ ID NO: 2671405 - DNA, 17 bp, Homo sapiens
acaccattgaaggctta

SEQ ID NO: 2671406 - DNA, 19 bp, Homo sapiens
acacctaaataaccaatct

SEQ ID NO: 2671407 - DNA, 15 bp, Homo sapiens
acaccttatatttac

SEQ ID NO: 2671408 - DNA, 14 bp, Homo sapiens
acacctttctcctt

SEQ ID NO: 2671409 - DNA, 13 bp, Homo sapiens
acacgcaggagca

SEQ ID NO: 2671410 - DNA, 20 bp, Homo sapiens
acactctgggctccagagtg

SEQ ID NO: 2671411 - DNA, 18 bp, Homo sapiens
acactgaaatatacacac

SEQ ID NO: 2671412 - DNA, 20 bp, Homo sapiens
acactgaaatatacacacag

SEQ ID NO: 2671413 - DNA, 21 bp, Homo sapiens
acactgatttccccttttgca

SEQ ID NO: 2671414 - DNA, 22 bp, Homo sapiens
acactgatttccccttttgcat

SEQ ID NO: 2671415 - DNA, 14 bp, Homo sapiens
acactgggaggcca

SEQ ID NO: 2671416 - DNA, 12 bp, Homo sapiens
acagaacactgt

SEQ ID NO: 2671417 - DNA, 23 bp, Homo sapiens
acagagtacttggctgttagccc

SEQ ID NO: 2671418 - DNA, 13 bp, Homo sapiens
cagggacaaagag

SEQ ID NO: 2671419 - DNA, 17 bp, Homo sapiens
cagggacaaagaggcct

SEQ ID NO: 2671420 - DNA, 18 bp, Homo sapiens
cagggacaaagaggcctt

SEQ ID NO: 2671421 - DNA, 23 bp, Homo sapiens
cagggacaaagaggcctttaacc

SEQ ID NO: 2671422 - DNA, 23 bp, Homo sapiens
cagggacgaagaagagccacagt

SEQ ID NO: 2671423 - DNA, 21 bp, Homo sapiens
cagggactgaaaacctctcct

SEQ ID NO: 2671424 - DNA, 20 bp, Homo sapiens
cagggagacctggacacagg

SEQ ID NO: 2671425 - DNA, 19 bp, Homo sapiens
cagggagcattttcctcca

SEQ ID NO: 2671426 - DNA, 20 bp, Homo sapiens
cagggagcattttcctccat

SEQ ID NO: 2671427 - DNA, 13 bp, Homo sapiens
cagggccaaccct

SEQ ID NO: 2671428 - DNA, 22 bp, Homo sapiens
cagggccgccagggagacctgg

SEQ ID NO: 2671429 - DNA, 18 bp, Homo sapiens
cagggcttacggccctgg

SEQ ID NO: 2671430 - DNA, 20 bp, Homo sapiens
cagggcttacggccctggcc

SEQ ID NO: 2671431 - DNA, 23 bp, Homo sapiens
cagggcttacggccctggccttg

SEQ ID NO: 2671432 - DNA, 20 bp, Homo sapiens
caggggatttcaccactcaa

SEQ ID NO: 2671433 - DNA, 14 bp, Homo sapiens
caggggccagaaga

SEQ ID NO: 2671434 - DNA, 10 bp, Homo sapiens
cagggtcaga

SEQ ID NO: 2671435 - DNA, 16 bp, Homo sapiens
cagggtcagaaacagg

SEQ ID NO: 2671436 - DNA, 18 bp, Homo sapiens
cagggtcagaaacaggac

SEQ ID NO: 2671437 - DNA, 19 bp, Homo sapiens
caggtagaacacaaggtca

SEQ ID NO: 2671438 - DNA, 23 bp, Homo sapiens
caggtagaattatctaatttata

SEQ ID NO: 2671439 - DNA, 20 bp, Homo sapiens
caggtatgaccttctaggaa

SEQ ID NO: 2671440 - DNA, 18 bp, Homo sapiens
caggtattttataattct

SEQ ID NO: 2671441 - DNA, 23 bp, Homo sapiens
caggtattttataattctgggaa

SEQ ID NO: 2671442 - DNA, 16 bp, Homo sapiens
caggtgaaacccagtc

SEQ ID NO: 2671443 - DNA, 24 bp, Homo sapiens
caggtgcaaccagggagctgcagg

SEQ ID NO: 2671444 - DNA, 15 bp, Homo sapiens
caggtgcagccagag

SEQ ID NO: 2671445 - DNA, 14 bp, Homo sapiens
cagtaaaatagctg

SEQ ID NO: 2671446 - DNA, 21 bp, Homo sapiens
cagtcatttttcagacctttt

SEQ ID NO: 2671447 - DNA, 15 bp, Homo sapiens
cagtccttccacctc

SEQ ID NO: 2671448 - DNA, 16 bp, Homo sapiens
cagtctatttgagact

SEQ ID NO: 2671449 - DNA, 22 bp, Homo sapiens
cagtctgatgagaactctgagc

SEQ ID NO: 2671450 - DNA, 23 bp, Homo sapiens
cagtcttatagcaagactgttag

SEQ ID NO: 2671451 - DNA, 15 bp, Homo sapiens
cagtgcaacactgaa

SEQ ID NO: 2671452 - DNA, 12 bp, Homo sapiens
cagtttaaagca

SEQ ID NO: 2671453 - DNA, 20 bp, Homo sapiens
cataaagcaaatagacacag

SEQ ID NO: 2671454 - DNA, 16 bp, Homo sapiens
cataaggtttttatgc

SEQ ID NO: 2671455 - DNA, 17 bp, Homo sapiens
cataaggtttttatgca

SEQ ID NO: 2671456 - DNA, 17 bp, Homo sapiens
cataataaatgcttcag

SEQ ID NO: 2671457 - DNA, 15 bp, Homo sapiens
catacaacacaaaga

SEQ ID NO: 2671458 - DNA, 16 bp, Homo sapiens
catacaacacaaagag

SEQ ID NO: 2671459 - DNA, 22 bp, Homo sapiens
catagttggggtcatagatgtt

SEQ ID NO: 2671460 - DNA, 19 bp, Homo sapiens
catattgtaaaacaggtag

SEQ ID NO: 2671461 - DNA, 12 bp, Homo sapiens
catatttcaatt

SEQ ID NO: 2671462 - DNA, 12 bp, Homo sapiens
catatttgcact

SEQ ID NO: 2671463 - DNA, 14 bp, Homo sapiens
catattttgtaact

SEQ ID NO: 2671464 - DNA, 22 bp, Homo sapiens
catcaagaagggctgcatgatg

SEQ ID NO: 2671465 - DNA, 20 bp, Homo sapiens
catcagctaaacaccacgtc

SEQ ID NO: 2671466 - DNA, 17 bp, Homo sapiens
catcatgaccagcaaat

SEQ ID NO: 2671467 - DNA, 14 bp, Homo sapiens
catcccctgcctcc

SEQ ID NO: 2671468 - DNA, 16 bp, Homo sapiens
catcccctgcctccat

SEQ ID NO: 2671469 - DNA, 22 bp, Homo sapiens
catcccctgcctccatcctagt

SEQ ID NO: 2671470 - DNA, 15 bp, Homo sapiens
catcccctgtgggaa

SEQ ID NO: 2671471 - DNA, 19 bp, Homo sapiens
catcctgtgcctccatcag

SEQ ID NO: 2671472 - DNA, 18 bp, Homo sapiens
catccttcctcacaccag

SEQ ID NO: 2671473 - DNA, 22 bp, Homo sapiens
catcgttttcttcactgtcctc

SEQ ID NO: 2671474 - DNA, 22 bp, Homo sapiens
catctcaggttaagtgtgagta

SEQ ID NO: 2671475 - DNA, 14 bp, Homo sapiens
catctttctttgga

SEQ ID NO: 2671476 - DNA, 13 bp, Homo sapiens
catctttgtgaag

SEQ ID NO: 2671477 - DNA, 18 bp, Homo sapiens
catgaagaggatgctgtg

SEQ ID NO: 2671478 - DNA, 15 bp, Homo sapiens
catgaaggtttctga

SEQ ID NO: 2671479 - DNA, 15 bp, Homo sapiens
catgaccagcaaata

SEQ ID NO: 2671480 - DNA, 20 bp, Homo sapiens
catgatccaagcaagactga

SEQ ID NO: 2671481 - DNA, 12 bp, Homo sapiens
catgatgtttgc

SEQ ID NO: 2671482 - DNA, 13 bp, Homo sapiens
catgatgtttgcc

SEQ ID NO: 2671483 - DNA, 16 bp, Homo sapiens
catgatttacagagaa

SEQ ID NO: 2671484 - DNA, 22 bp, Homo sapiens
catgcagcctaaggctgtatga

SEQ ID NO: 2671485 - DNA, 11 bp, Homo sapiens
catgcctcagc

SEQ ID NO: 2671486 - DNA, 14 bp, Homo sapiens
catgcctcagccct

SEQ ID NO: 2671487 - DNA, 22 bp, Homo sapiens
catgcgacactgggaggccagt

SEQ ID NO: 2671488 - DNA, 21 bp, Homo sapiens
catggacagaagaaggcagca

SEQ ID NO: 2671489 - DNA, 16 bp, Homo sapiens
catgggaaggtgggcg

SEQ ID NO: 2671490 - DNA, 20 bp, Homo sapiens
catgtaaagcagtattaaaa

SEQ ID NO: 2671491 - DNA, 14 bp, Homo sapiens
catgtagaaaacaa

SEQ ID NO: 2671492 - DNA, 22 bp, Homo sapiens
catgtgctacaggggccagaag

SEQ ID NO: 2671493 - DNA, 14 bp, Homo sapiens
catgttctgctttc

SEQ ID NO: 2671494 - DNA, 18 bp, Homo sapiens
catgttgctgtttccagt

SEQ ID NO: 2671495 - DNA, 18 bp, Homo sapiens
catgttgtgcctccctgg

SEQ ID NO: 2671496 - DNA, 19 bp, Homo sapiens
catgttgtgcctccctggt

SEQ ID NO: 2671497 - DNA, 20 bp, Homo sapiens
catgttgtgcctccctggtg

SEQ ID NO: 2671498 - DNA, 21 bp, Homo sapiens
catgttgtgcctccctggtga

SEQ ID NO: 2671499 - DNA, 16 bp, Homo sapiens
cattaagccttccaca

SEQ ID NO: 2671500 - DNA, 21 bp, Homo sapiens
cattacagggcacaggccatg

SEQ ID NO: 2671501 - DNA, 22 bp, Homo sapiens
cattacagggcacaggccatgg

SEQ ID NO: 2671502 - DNA, 18 bp, Homo sapiens
cattcagtatataaaata

SEQ ID NO: 2671503 - DNA, 13 bp, Homo sapiens
cattctaatgatg

SEQ ID NO: 2671504 - DNA, 19 bp, Homo sapiens
cattctaatgatggcccat

SEQ ID NO: 2671505 - DNA, 14 bp, Homo sapiens
cattctacttgctc

SEQ ID NO: 2671506 - DNA, 18 bp, Homo sapiens
cattctacttgctctgga

SEQ ID NO: 2671507 - DNA, 23 bp, Homo sapiens
cattctaggcctcctggcccagg

SEQ ID NO: 2671508 - DNA, 13 bp, Homo sapiens
cattctcattgaa

SEQ ID NO: 2671509 - DNA, 15 bp, Homo sapiens
cattcttttgtaatt

SEQ ID NO: 2671510 - DNA, 22 bp, Homo sapiens
cattgatatttgtgcattttct

SEQ ID NO: 2671511 - DNA, 23 bp, Homo sapiens
cattgatatttgtgcattttcta

SEQ ID NO: 2671512 - DNA, 20 bp, Homo sapiens
cattgggtgaggtaataaac

SEQ ID NO: 2671513 - DNA, 15 bp, Homo sapiens
cattgtattagatct

SEQ ID NO: 2671514 - DNA, 23 bp, Homo sapiens
catttacaacccggttcactctt

SEQ ID NO: 2671515 - DNA, 20 bp, Homo sapiens
catttcccccaccccatttc

SEQ ID NO: 2671516 - DNA, 10 bp, Homo sapiens
catttctctc

SEQ ID NO: 2671517 - DNA, 18 bp, Homo sapiens
catttgtttgttttcctt

SEQ ID NO: 2671518 - DNA, 20 bp, Homo sapiens
cattttacccacacacagat

SEQ ID NO: 2671519 - DNA, 14 bp, Homo sapiens
cattttcctctgct

SEQ ID NO: 2671520 - DNA, 17 bp, Homo sapiens
cattttcctctgctttg

SEQ ID NO: 2671521 - DNA, 20 bp, Homo sapiens
cattttcctctgctttgaaa

SEQ ID NO: 2671522 - DNA, 18 bp, Homo sapiens
cattttgtaacaaatgaa

SEQ ID NO: 2671523 - DNA, 22 bp, Homo sapiens
ccaaaaaagctgtattttgaaa

SEQ ID NO: 2671524 - DNA, 14 bp, Homo sapiens
ccaaaagctgctca

SEQ ID NO: 2671525 - DNA, 22 bp, Homo sapiens
ccaaaatttattttataagaaa

SEQ ID NO: 2671526 - DNA, 21 bp, Homo sapiens
ccaacccttctcctcttgtaa

SEQ ID NO: 2671527 - DNA, 21 bp, Homo sapiens
ccaacctattttgaagtacca

SEQ ID NO: 2671528 - DNA, 12 bp, Homo sapiens
ccaagagaccag

SEQ ID NO: 2671529 - DNA, 15 bp, Homo sapiens
ccaagcaagactgag

SEQ ID NO: 2671530 - DNA, 11 bp, Homo sapiens
ccaattcttac

SEQ ID NO: 2671531 - DNA, 19 bp, Homo sapiens
ccaattcttacaaacatgt

SEQ ID NO: 2671532 - DNA, 16 bp, Homo sapiens
ccaatttttttttcct

SEQ ID NO: 2671533 - DNA, 17 bp, Homo sapiens
ccaatttttttttcctt

SEQ ID NO: 2671534 - DNA, 16 bp, Homo sapiens
ccacaaaggcaaaggg

SEQ ID NO: 2671535 - DNA, 23 bp, Homo sapiens
cttgccgcgtcgccctcccaggc

SEQ ID NO: 2671536 - DNA, 13 bp, Homo sapiens
cttgcctgcaggc

SEQ ID NO: 2671537 - DNA, 17 bp, Homo sapiens
cttgctctggacctgcc

SEQ ID NO: 2671538 - DNA, 19 bp, Homo sapiens
cttgctttgtgttctttgt

SEQ ID NO: 2671539 - DNA, 12 bp, Homo sapiens
cttgtagccttt

SEQ ID NO: 2671540 - DNA, 16 bp, Homo sapiens
cttgtagccttttgac

SEQ ID NO: 2671541 - DNA, 15 bp, Homo sapiens
cttgtggctttgcaa

SEQ ID NO: 2671542 - DNA, 22 bp, Homo sapiens
cttgtgtttttaactcaatatt

SEQ ID NO: 2671543 - DNA, 21 bp, Homo sapiens
ctttaagggagtgtactccca

SEQ ID NO: 2671544 - DNA, 23 bp, Homo sapiens
ctttaagggagtgtactcccagg

SEQ ID NO: 2671545 - DNA, 21 bp, Homo sapiens
ctttattgaaaaaataaaaaa

SEQ ID NO: 2671546 - DNA, 12 bp, Homo sapiens
ctttatttccaa

SEQ ID NO: 2671547 - DNA, 22 bp, Homo sapiens
ctttcaatggtttgcaaggaag

SEQ ID NO: 2671548 - DNA, 14 bp, Homo sapiens
ctttcacaaaaaag

SEQ ID NO: 2671549 - DNA, 18 bp, Homo sapiens
ctttcactctttagaaat

SEQ ID NO: 2671550 - DNA, 17 bp, Homo sapiens
ctttcataatctttgct

SEQ ID NO: 2671551 - DNA, 22 bp, Homo sapiens
ctttccatttggtttagaacat

SEQ ID NO: 2671552 - DNA, 16 bp, Homo sapiens
ctttctttcacaaaaa

SEQ ID NO: 2671553 - DNA, 15 bp, Homo sapiens
ctttgaggttgcttt

SEQ ID NO: 2671554 - DNA, 14 bp, Homo sapiens
ctttgatgtatttt

SEQ ID NO: 2671555 - DNA, 17 bp, Homo sapiens
ctttgatgtattttccc

SEQ ID NO: 2671556 - DNA, 16 bp, Homo sapiens
ctttgccaagaccttt

SEQ ID NO: 2671557 - DNA, 20 bp, Homo sapiens
ctttgccaagacctttcaaa

SEQ ID NO: 2671558 - DNA, 20 bp, Homo sapiens
ctttgttctgctgttctcta

SEQ ID NO: 2671559 - DNA, 14 bp, Homo sapiens
ctttgtttttattt

SEQ ID NO: 2671560 - DNA, 21 bp, Homo sapiens
cttttaactcctcaattccaa

SEQ ID NO: 2671561 - DNA, 20 bp, Homo sapiens
cttttagggagctggtctga

SEQ ID NO: 2671562 - DNA, 17 bp, Homo sapiens
cttttcatatttgcact

SEQ ID NO: 2671563 - DNA, 13 bp, Homo sapiens
cttttgaacccag

SEQ ID NO: 2671564 - DNA, 14 bp, Homo sapiens
cttttgcattctcc

SEQ ID NO: 2671565 - DNA, 14 bp, Homo sapiens
cttttgttcccatc

SEQ ID NO: 2671566 - DNA, 13 bp, Homo sapiens
ctttttaaaaata

SEQ ID NO: 2671567 - DNA, 17 bp, Homo sapiens
ctttttattgaatctat

SEQ ID NO: 2671568 - DNA, 20 bp, Homo sapiens
cttttttgtgtttttaaaag

SEQ ID NO: 2671569 - DNA, 19 bp, Homo sapiens
gaaaaaaatcgtccaggga

SEQ ID NO: 2671570 - DNA, 18 bp, Homo sapiens
gaaaaaccagaggcagct

SEQ ID NO: 2671571 - DNA, 14 bp, Homo sapiens
gaaaaagaaatgca

SEQ ID NO: 2671572 - DNA, 22 bp, Homo sapiens
gaaaacgctctctactctgctt

SEQ ID NO: 2671573 - DNA, 12 bp, Homo sapiens
gaaaaggcaaaa

SEQ ID NO: 2671574 - DNA, 17 bp, Homo sapiens
gaaaatattttgatctt

SEQ ID NO: 2671575 - DNA, 23 bp, Homo sapiens
gaaaatattttgatcttcaacaa

SEQ ID NO: 2671576 - DNA, 23 bp, Homo sapiens
gaaaatcatcaagaagggctgca

SEQ ID NO: 2671577 - DNA, 16 bp, Homo sapiens
gaaaatgaatccctct

SEQ ID NO: 2671578 - DNA, 15 bp, Homo sapiens
gaaaatggaaccagg

SEQ ID NO: 2671579 - DNA, 15 bp, Homo sapiens
gaaaattaacactgc

SEQ ID NO: 2671580 - DNA, 21 bp, Homo sapiens
gaaacaacagctttaaaagaa

SEQ ID NO: 2671581 - DNA, 16 bp, Homo sapiens
gaaagacagagctggg

SEQ ID NO: 2671582 - DNA, 17 bp, Homo sapiens
gaaatgcaaaaatctct

SEQ ID NO: 2671583 - DNA, 19 bp, Homo sapiens
gaacaatattgactttgtc

SEQ ID NO: 2671584 - DNA, 19 bp, Homo sapiens
gaacaccattgaaggctta

SEQ ID NO: 2671585 - DNA, 15 bp, Homo sapiens
gaacataaagcaaat

SEQ ID NO: 2671586 - DNA, 22 bp, Homo sapiens
gaacataaagcaaatagacaca

SEQ ID NO: 2671587 - DNA, 15 bp, Homo sapiens
gaaccaggcttggaa

SEQ ID NO: 2671588 - DNA, 16 bp, Homo sapiens
gaaccatgtttgtggc

SEQ ID NO: 2671589 - DNA, 15 bp, Homo sapiens
gaaccgtaggaccca

SEQ ID NO: 2671590 - DNA, 21 bp, Homo sapiens
gaaccttctggcctcccacag

SEQ ID NO: 2671591 - DNA, 21 bp, Homo sapiens
gaactgaacaccattgaaggc

SEQ ID NO: 2671592 - DNA, 21 bp, Homo sapiens
gaactgcctttggcagagttc

SEQ ID NO: 2671593 - DNA, 15 bp, Homo sapiens
gaagaagagccacag

SEQ ID NO: 2671594 - DNA, 19 bp, Homo sapiens
gaagacccaacacatggga

SEQ ID NO: 2671595 - DNA, 21 bp, Homo sapiens
gaagagtgtggagtcattctc

SEQ ID NO: 2671596 - DNA, 22 bp, Homo sapiens
gaagattcttcccattctccat

SEQ ID NO: 2671597 - DNA, 13 bp, Homo sapiens
gaagcaaacacat

SEQ ID NO: 2671598 - DNA, 12 bp, Homo sapiens
gaagctttacca

SEQ ID NO: 2671599 - DNA, 18 bp, Homo sapiens
gaagctttaccagctgaa

SEQ ID NO: 2671600 - DNA, 15 bp, Homo sapiens
gaaggagacaggcag

SEQ ID NO: 2671601 - DNA, 17 bp, Homo sapiens
gaaggagatagggaaaa

SEQ ID NO: 2671602 - DNA, 18 bp, Homo sapiens
gaagggatatgtgaaaca

SEQ ID NO: 2671603 - DNA, 13 bp, Homo sapiens
gaagggctgcatg

SEQ ID NO: 2671604 - DNA, 18 bp, Homo sapiens
gaagggctgcatgatgtt

SEQ ID NO: 2671605 - DNA, 15 bp, Homo sapiens
gaaggttgctgtggg

SEQ ID NO: 2671606 - DNA, 16 bp, Homo sapiens
gaataataaatattta

SEQ ID NO: 2671607 - DNA, 23 bp, Homo sapiens
gaatagttgaacctatttctctt

SEQ ID NO: 2671608 - DNA, 21 bp, Homo sapiens
gaatataaacactatatggca

SEQ ID NO: 2671609 - DNA, 16 bp, Homo sapiens
gaatataatactgtat

SEQ ID NO: 2671610 - DNA, 15 bp, Homo sapiens
gaatctatttaagta

SEQ ID NO: 2671611 - DNA, 18 bp, Homo sapiens
gaatctatttatcttcat

SEQ ID NO: 2671612 - DNA, 19 bp, Homo sapiens
gaatctatttatcttcatt

SEQ ID NO: 2671613 - DNA, 20 bp, Homo sapiens
gaatctatttatcttcattt

SEQ ID NO: 2671614 - DNA, 22 bp, Homo sapiens
gaatggcacagcccaaagaagg

SEQ ID NO: 2671615 - DNA, 15 bp, Homo sapiens
gaattagctgcttct

SEQ ID NO: 2671616 - DNA, 16 bp, Homo sapiens
gaattataaaagccag

SEQ ID NO: 2671617 - DNA, 14 bp, Homo sapiens
gaattatctaattt

SEQ ID NO: 2671618 - DNA, 14 bp, Homo sapiens
gaattgagctgcag

SEQ ID NO: 2671619 - DNA, 23 bp, Homo sapiens
gaattttgttctctgggagaaaa

SEQ ID NO: 2671620 - DNA, 16 bp, Homo sapiens
gacaatggcagatgta

SEQ ID NO: 2671621 - DNA, 21 bp, Homo sapiens
gacatagcatcttgtggcttt

SEQ ID NO: 2671622 - DNA, 18 bp, Homo sapiens
gacatttacctttttgaa

SEQ ID NO: 2671623 - DNA, 13 bp, Homo sapiens
gaccagcaaatac

SEQ ID NO: 2671624 - DNA, 22 bp, Homo sapiens
gaccagcctggccaacatggta

SEQ ID NO: 2671625 - DNA, 15 bp, Homo sapiens
gacccccgccccctg

SEQ ID NO: 2671626 - DNA, 18 bp, Homo sapiens
gacccccgccccctgccc

SEQ ID NO: 2671627 - DNA, 19 bp, Homo sapiens
gacccccgccccctgccct

SEQ ID NO: 2671628 - DNA, 11 bp, Homo sapiens
gaccctgtata

SEQ ID NO: 2671629 - DNA, 12 bp, Homo sapiens
gacctctcccag

SEQ ID NO: 2671630 - DNA, 14 bp, Homo sapiens
gacctctcccaggg

SEQ ID NO: 2671631 - DNA, 17 bp, Homo sapiens
gacctgcagacgcccag

SEQ ID NO: 2671632 - DNA, 23 bp, Homo sapiens
gacctgcccccgcatcccctgcc

SEQ ID NO: 2671633 - DNA, 16 bp, Homo sapiens
gacctgtctcctggcg

SEQ ID NO: 2671634 - DNA, 18 bp, Homo sapiens
gacgaagaagagccacag

SEQ ID NO: 2671635 - DNA, 18 bp, Homo sapiens
gacggctccactaggact

SEQ ID NO: 2671636 - DNA, 22 bp, Homo sapiens
gacggctgggcacacgcctccc

SEQ ID NO: 2671637 - DNA, 18 bp, Homo sapiens
gacgtttacaagcccccc

SEQ ID NO: 2671638 - DNA, 12 bp, Homo sapiens
gactaaatgaaa

SEQ ID NO: 2671639 - DNA, 18 bp, Homo sapiens
gactaactatcaaataga

SEQ ID NO: 2671640 - DNA, 18 bp, Homo sapiens
gactaattcttgcatatt

SEQ ID NO: 2671641 - DNA, 15 bp, Homo sapiens
gactagagctttctt

SEQ ID NO: 2671642 - DNA, 17 bp, Homo sapiens
gactagagggacctctc

SEQ ID NO: 2671643 - DNA, 19 bp, Homo sapiens
gactagagggacctctccc

SEQ ID NO: 2671644 - DNA, 23 bp, Homo sapiens
gactagagggacctctcccaggg

SEQ ID NO: 2671645 - DNA, 18 bp, Homo sapiens
gactatattgtacacacc

SEQ ID NO: 2671646 - DNA, 20 bp, Homo sapiens
gactcaagattcccaggagt

SEQ ID NO: 2671647 - DNA, 15 bp, Homo sapiens
gactccggccctcct

SEQ ID NO: 2671648 - DNA, 19 bp, Homo sapiens
gactgacctggtccacagg

SEQ ID NO: 2671649 - DNA, 20 bp, Homo sapiens
gactgacctggtccacaggg

SEQ ID NO: 2671650 - DNA, 22 bp, Homo sapiens
gactgacctggtccacagggca

SEQ ID NO: 2671651 - DNA, 19 bp, Homo sapiens
gactgaccttgatgagctg

SEQ ID NO: 2671652 - DNA, 15 bp, Homo sapiens
gactttcattggaaa

SEQ ID NO: 2671653 - DNA, 16 bp, Homo sapiens
gttctcttaaaaggta

SEQ ID NO: 2671654 - DNA, 17 bp, Homo sapiens
gttcttgccactttttt

SEQ ID NO: 2671655 - DNA, 20 bp, Homo sapiens
gttgaattttgttctctggg

SEQ ID NO: 2671656 - DNA, 21 bp, Homo sapiens
gttgaattttgttctctggga

SEQ ID NO: 2671657 - DNA, 14 bp, Homo sapiens
gttgtacttcattt

SEQ ID NO: 2671658 - DNA, 14 bp, Homo sapiens
gttgtcaccttcac

SEQ ID NO: 2671659 - DNA, 12 bp, Homo sapiens
gttgtccctgca

SEQ ID NO: 2671660 - DNA, 16 bp, Homo sapiens
gttgtgcctccctggt

SEQ ID NO: 2671661 - DNA, 15 bp, Homo sapiens
gtttaatttaaagcc

SEQ ID NO: 2671662 - DNA, 19 bp, Homo sapiens
gtttaattttataaacaaa

SEQ ID NO: 2671663 - DNA, 22 bp, Homo sapiens
gtttacaagcccccccttccac

SEQ ID NO: 2671664 - DNA, 14 bp, Homo sapiens
gtttacagtctatt

SEQ ID NO: 2671665 - DNA, 16 bp, Homo sapiens
gtttacagtctatttg

SEQ ID NO: 2671666 - DNA, 14 bp, Homo sapiens
gtttcctgcaggcc

SEQ ID NO: 2671667 - DNA, 13 bp, Homo sapiens
gtttgaatataaa

SEQ ID NO: 2671668 - DNA, 17 bp, Homo sapiens
gtttgaatataaacact

SEQ ID NO: 2671669 - DNA, 21 bp, Homo sapiens
gtttgaatctatttatcttca

SEQ ID NO: 2671670 - DNA, 14 bp, Homo sapiens
gtttgcaaggaagc

SEQ ID NO: 2671671 - DNA, 17 bp, Homo sapiens
gtttgcaaggaagccac

SEQ ID NO: 2671672 - DNA, 19 bp, Homo sapiens
gtttgggatcctattgaac

SEQ ID NO: 2671673 - DNA, 15 bp, Homo sapiens
gtttgtggctattaa

SEQ ID NO: 2671674 - DNA, 18 bp, Homo sapiens
gtttgtggctattaaaac

SEQ ID NO: 2671675 - DNA, 13 bp, Homo sapiens
gtttgttttcctt

SEQ ID NO: 2671676 - DNA, 18 bp, Homo sapiens
gtttgttttccttttatt

SEQ ID NO: 2671677 - DNA, 21 bp, Homo sapiens
gttttaatttatactggcatg

SEQ ID NO: 2671678 - DNA, 13 bp, Homo sapiens
gttttgtaaagtc

SEQ ID NO: 2671679 - DNA, 15 bp, Homo sapiens
gtttttaactcaata

SEQ ID NO: 2671680 - DNA, 19 bp, Homo sapiens
gtttttaactcaatatttt

SEQ ID NO: 2671681 - DNA, 23 bp, Homo sapiens
gtttttttcattgccaaaaacta

SEQ ID NO: 2671682 - DNA, 18 bp, Homo sapiens
taaaacattttcacacaa

SEQ ID NO: 2671683 - DNA, 15 bp, Homo sapiens
taaaactacaaaaat

SEQ ID NO: 2671684 - DNA, 14 bp, Homo sapiens
taaaactcttttaa

SEQ ID NO: 2671685 - DNA, 13 bp, Homo sapiens
taaaactttttat

SEQ ID NO: 2671686 - DNA, 11 bp, Homo sapiens
taaaagcacac

SEQ ID NO: 2671687 - DNA, 18 bp, Homo sapiens
taaaataaatattgtctt

SEQ ID NO: 2671688 - DNA, 23 bp, Homo sapiens
taaaatctgatatgtattgtttg

SEQ ID NO: 2671689 - DNA, 16 bp, Homo sapiens
taaaatgtatcttcca

SEQ ID NO: 2671690 - DNA, 21 bp, Homo sapiens
taaaatttggccaaacaagtg

SEQ ID NO: 2671691 - DNA, 12 bp, Homo sapiens
taaacaaatgta

SEQ ID NO: 2671692 - DNA, 19 bp, Homo sapiens
taaacaaatgtatgattac

SEQ ID NO: 2671693 - DNA, 18 bp, Homo sapiens
taaacaatatcagacttt

SEQ ID NO: 2671694 - DNA, 13 bp, Homo sapiens
taaagttattctt

SEQ ID NO: 2671695 - DNA, 22 bp, Homo sapiens
taaatggaaactgaaactactg

SEQ ID NO: 2671696 - DNA, 22 bp, Homo sapiens
taaccatgtgaaaaggcaaaaa

SEQ ID NO: 2671697 - DNA, 18 bp, Homo sapiens
taaccccgtcaacaaatc

SEQ ID NO: 2671698 - DNA, 15 bp, Homo sapiens
taactagcttggaaa

SEQ ID NO: 2671699 - DNA, 19 bp, Homo sapiens
taactattttattttctaa

SEQ ID NO: 2671700 - DNA, 14 bp, Homo sapiens
taactcaatatttt

SEQ ID NO: 2671701 - DNA, 23 bp, Homo sapiens
taactgcccagcggacagtggca

SEQ ID NO: 2671702 - DNA, 13 bp, Homo sapiens
taagaaaaacttt

SEQ ID NO: 2671703 - DNA, 19 bp, Homo sapiens
taagtttccttccagccca

SEQ ID NO: 2671704 - DNA, 20 bp, Homo sapiens
taatacaatgatgctatttg

SEQ ID NO: 2671705 - DNA, 12 bp, Homo sapiens
taatactgtatt

SEQ ID NO: 2671706 - DNA, 14 bp, Homo sapiens
taatataaagttgg

SEQ ID NO: 2671707 - DNA, 19 bp, Homo sapiens
taatataaagttggatgcg

SEQ ID NO: 2671708 - DNA, 19 bp, Homo sapiens
taatatatttgtgtattta

SEQ ID NO: 2671709 - DNA, 20 bp, Homo sapiens
taatatatttgtgtatttaa

SEQ ID NO: 2671710 - DNA, 16 bp, Homo sapiens
taatatggggatgcag

SEQ ID NO: 2671711 - DNA, 15 bp, Homo sapiens
taatatttttaatta

SEQ ID NO: 2671712 - DNA, 18 bp, Homo sapiens
taatcttatcaagagttg

SEQ ID NO: 2671713 - DNA, 18 bp, Homo sapiens
taatgatggcccattcta

SEQ ID NO: 2671714 - DNA, 19 bp, Homo sapiens
taatttaaagccacaacca

SEQ ID NO: 2671715 - DNA, 14 bp, Homo sapiens
taatttatactggc

SEQ ID NO: 2671716 - DNA, 22 bp, Homo sapiens
taatttgatagtattgtgcata

SEQ ID NO: 2671717 - DNA, 23 bp, Homo sapiens
tacaacccggttcactcttctca

SEQ ID NO: 2671718 - DNA, 16 bp, Homo sapiens
tacacaatgtgtcttt

SEQ ID NO: 2671719 - DNA, 19 bp, Homo sapiens
tacacctttctcctttgta

SEQ ID NO: 2671720 - DNA, 20 bp, Homo sapiens
tacagggcacaggccatgga

SEQ ID NO: 2671721 - DNA, 17 bp, Homo sapiens
taccatgtgctacaggg

SEQ ID NO: 2671722 - DNA, 14 bp, Homo sapiens
tacccgcagagttc

SEQ ID NO: 2671723 - DNA, 21 bp, Homo sapiens
taccctgcgcccagtccttcc

SEQ ID NO: 2671724 - DNA, 16 bp, Homo sapiens
taccttcatatgcagt

SEQ ID NO: 2671725 - DNA, 22 bp, Homo sapiens
tacgtttgaagacattgcacca

SEQ ID NO: 2671726 - DNA, 23 bp, Homo sapiens
tactcccagggcttacggccctg

SEQ ID NO: 2671727 - DNA, 17 bp, Homo sapiens
tactgatgttcctttgg

SEQ ID NO: 2671728 - DNA, 18 bp, Homo sapiens
tactgatgttcctttgga

SEQ ID NO: 2671729 - DNA, 12 bp, Homo sapiens
tactgtatttga

SEQ ID NO: 2671730 - DNA, 12 bp, Homo sapiens
tacttgctctgg

SEQ ID NO: 2671731 - DNA, 17 bp, Homo sapiens
tacttgctctggacctg

SEQ ID NO: 2671732 - DNA, 16 bp, Homo sapiens
tagaataataaatatt

SEQ ID NO: 2671733 - DNA, 14 bp, Homo sapiens
tagactaaatgaaa

SEQ ID NO: 2671734 - DNA, 23 bp, Homo sapiens
tagagctttctttcacaaaaaag

SEQ ID NO: 2671735 - DNA, 15 bp, Homo sapiens
tagagggacctctcc

SEQ ID NO: 2671736 - DNA, 19 bp, Homo sapiens
tagagggacctctcccagg

SEQ ID NO: 2671737 - DNA, 20 bp, Homo sapiens
tagagggacctctcccaggg

SEQ ID NO: 2671738 - DNA, 13 bp, Homo sapiens
tagcagtaaaata

SEQ ID NO: 2671739 - DNA, 16 bp, Homo sapiens
tagccatttttactgt

SEQ ID NO: 2671740 - DNA, 20 bp, Homo sapiens
tagcctatgtggattttttc

SEQ ID NO: 2671741 - DNA, 16 bp, Homo sapiens
taggacccaagcagag

SEQ ID NO: 2671742 - DNA, 14 bp, Homo sapiens
taggatgtaaatct

SEQ ID NO: 2671743 - DNA, 17 bp, Homo sapiens
taggctcatttactgtt

SEQ ID NO: 2671744 - DNA, 15 bp, Homo sapiens
tagtaaaaatacaaa

SEQ ID NO: 2671745 - DNA, 17 bp, Homo sapiens
tagtaaggagttcattt

SEQ ID NO: 2671746 - DNA, 12 bp, Homo sapiens
tataagaaaaac

SEQ ID NO: 2671747 - DNA, 16 bp, Homo sapiens
tataatatatttgtgt

SEQ ID NO: 2671748 - DNA, 14 bp, Homo sapiens
tatatattttaatt

SEQ ID NO: 2671749 - DNA, 13 bp, Homo sapiens
tatctaatttata

SEQ ID NO: 2671750 - DNA, 19 bp, Homo sapiens
tatctgagctctttgcact

SEQ ID NO: 2671751 - DNA, 15 bp, Homo sapiens
tatgtgaaacaatgt

SEQ ID NO: 2671752 - DNA, 22 bp, Homo sapiens
tatgttttttttctgctggaaa

SEQ ID NO: 2671753 - DNA, 15 bp, Homo sapiens
tattaaaactctttt

SEQ ID NO: 2671754 - DNA, 17 bp, Homo sapiens
tattaaatggaaactga

SEQ ID NO: 2671755 - DNA, 19 bp, Homo sapiens
tattaaatggaaactgaaa

SEQ ID NO: 2671756 - DNA, 20 bp, Homo sapiens
tattaaatggaaactgaaac

SEQ ID NO: 2671757 - DNA, 23 bp, Homo sapiens
tattaatacaatgatgctatttg

SEQ ID NO: 2671758 - DNA, 14 bp, Homo sapiens
tattcgcttgagaa

SEQ ID NO: 2671759 - DNA, 17 bp, Homo sapiens
tattcttattcaaagaa

SEQ ID NO: 2671760 - DNA, 22 bp, Homo sapiens
tattctttcgaaagaagaaaat

SEQ ID NO: 2671761 - DNA, 17 bp, Homo sapiens
tattgggttccattctc

SEQ ID NO: 2671762 - DNA, 15 bp, Homo sapiens
tattgtaaaacaggt

SEQ ID NO: 2671763 - DNA, 14 bp, Homo sapiens
tattgtctttttgt

SEQ ID NO: 2671764 - DNA, 22 bp, Homo sapiens
tatttagctccaaaccttcaca

SEQ ID NO: 2671765 - DNA, 13 bp, Homo sapiens
tatttctctttct

SEQ ID NO: 2671766 - DNA, 14 bp, Homo sapiens
tatttgagaatata

SEQ ID NO: 2671767 - DNA, 17 bp, Homo sapiens
tatttgtgcattttcta

SEQ ID NO: 2671768 - DNA, 20 bp, Homo sapiens
tattttccatgaaaatgcaa

SEQ ID NO: 2671769 - DNA, 15 bp, Homo sapiens
tattttgatcttcaa

SEQ ID NO: 2671770 - DNA, 16 bp, Homo sapiens
tattttgatcttcaac

SEQ ID NO: 2671771 - DNA, 13 bp, Homo sapiens
tatttttatttgt

SEQ ID NO: 2671772 - DNA, 22 bp, Homo sapiens
ttcgcgatggacagactcacaa

SEQ ID NO: 2671773 - DNA, 14 bp, Homo sapiens
ttctaaacagagat

SEQ ID NO: 2671774 - DNA, 20 bp, Homo sapiens
ttctacttgctctggacctg

SEQ ID NO: 2671775 - DNA, 14 bp, Homo sapiens
ttctccagggtcag

SEQ ID NO: 2671776 - DNA, 14 bp, Homo sapiens
ttctcctcttgtaa

SEQ ID NO: 2671777 - DNA, 12 bp, Homo sapiens
ttctctgggaga

SEQ ID NO: 2671778 - DNA, 16 bp, Homo sapiens
ttctctgggagaaaat

SEQ ID NO: 2671779 - DNA, 18 bp, Homo sapiens
ttctgaagctttaccagc

SEQ ID NO: 2671780 - DNA, 21 bp, Homo sapiens
ttctgtatctactttaataaa

SEQ ID NO: 2671781 - DNA, 22 bp, Homo sapiens
ttcttcactgtcctccaagcca

SEQ ID NO: 2671782 - DNA, 13 bp, Homo sapiens
ttcttcccattct

SEQ ID NO: 2671783 - DNA, 14 bp, Homo sapiens
ttcttgcatatttt

SEQ ID NO: 2671784 - DNA, 19 bp, Homo sapiens
ttctttcacaaaaaagaag

SEQ ID NO: 2671785 - DNA, 13 bp, Homo sapiens
ttcttttgtaatt

SEQ ID NO: 2671786 - DNA, 15 bp, Homo sapiens
ttctttttattgaat

SEQ ID NO: 2671787 - DNA, 20 bp, Homo sapiens
ttgaactgtaccatgtgcta

SEQ ID NO: 2671788 - DNA, 13 bp, Homo sapiens
ttgaagacactga

SEQ ID NO: 2671789 - DNA, 15 bp, Homo sapiens
ttgaagacactgaaa

SEQ ID NO: 2671790 - DNA, 11 bp, Homo sapiens
ttgaaggctta

SEQ ID NO: 2671791 - DNA, 21 bp, Homo sapiens
ttgaatataatatatttgtgt

SEQ ID NO: 2671792 - DNA, 15 bp, Homo sapiens
ttgaatctatttaag

SEQ ID NO: 2671793 - DNA, 17 bp, Homo sapiens
ttgaatctatttaagta

SEQ ID NO: 2671794 - DNA, 20 bp, Homo sapiens
ttgaatctatttaagtaaaa

SEQ ID NO: 2671795 - DNA, 17 bp, Homo sapiens
ttgaatctatttatctt

SEQ ID NO: 2671796 - DNA, 20 bp, Homo sapiens
ttgaatctatttatcttcat

SEQ ID NO: 2671797 - DNA, 18 bp, Homo sapiens
ttgacactggaatgagtt

SEQ ID NO: 2671798 - DNA, 15 bp, Homo sapiens
ttgacagaacactgt

SEQ ID NO: 2671799 - DNA, 16 bp, Homo sapiens
ttgacagaacactgtc

SEQ ID NO: 2671800 - DNA, 17 bp, Homo sapiens
ttgacagaacactgtct

SEQ ID NO: 2671801 - DNA, 23 bp, Homo sapiens
ttgacgagtgtgaagcttccttg

SEQ ID NO: 2671802 - DNA, 19 bp, Homo sapiens
ttgacttgacagaacactg

SEQ ID NO: 2671803 - DNA, 20 bp, Homo sapiens
ttgacttgacagaacactgt

SEQ ID NO: 2671804 - DNA, 11 bp, Homo sapiens
ttgactttgtc

SEQ ID NO: 2671805 - DNA, 12 bp, Homo sapiens
ttgactttgtct

SEQ ID NO: 2671806 - DNA, 22 bp, Homo sapiens
ttgagactcctcagttcttgcc

SEQ ID NO: 2671807 - DNA, 18 bp, Homo sapiens
ttgaggaaacaacagctt

SEQ ID NO: 2671808 - DNA, 19 bp, Homo sapiens
ttgaggggagagggaacgg

SEQ ID NO: 2671809 - DNA, 14 bp, Homo sapiens
ttgagtaaaataaa

SEQ ID NO: 2671810 - DNA, 18 bp, Homo sapiens
ttgagtaaaataaatatt

SEQ ID NO: 2671811 - DNA, 21 bp, Homo sapiens
ttgatatttgtgcattttcta

SEQ ID NO: 2671812 - DNA, 13 bp, Homo sapiens
ttgatcttcaaca

SEQ ID NO: 2671813 - DNA, 15 bp, Homo sapiens
ttgatcttcaacaaa

SEQ ID NO: 2671814 - DNA, 16 bp, Homo sapiens
ttgatcttcaacaaat

SEQ ID NO: 2671815 - DNA, 17 bp, Homo sapiens
ttgatgctgacagtcat

SEQ ID NO: 2671816 - DNA, 16 bp, Homo sapiens
ttgcactaagatattt

SEQ ID NO: 2671817 - DNA, 18 bp, Homo sapiens
ttgcatattttgtaactt

SEQ ID NO: 2671818 - DNA, 15 bp, Homo sapiens
ttgccaagacctttc

SEQ ID NO: 2671819 - DNA, 17 bp, Homo sapiens
ttgccaagacctttcaa

SEQ ID NO: 2671820 - DNA, 22 bp, Homo sapiens
ttggatgggactagagctttct

SEQ ID NO: 2671821 - DNA, 21 bp, Homo sapiens
ttgggaaggggacccccgccc

SEQ ID NO: 2671822 - DNA, 19 bp, Homo sapiens
ttggttaagctttgacact

SEQ ID NO: 2671823 - DNA, 20 bp, Homo sapiens
ttggttaagctttgacactg

SEQ ID NO: 2671824 - DNA, 19 bp, Homo sapiens
ttgtagccttttgactttc

SEQ ID NO: 2671825 - DNA, 22 bp, Homo sapiens
ttgtgaaggcctcgcaggaaga

SEQ ID NO: 2671826 - DNA, 22 bp, Homo sapiens
ttgtggaggagctcaggacact

SEQ ID NO: 2671827 - DNA, 17 bp, Homo sapiens
ttgtggctattaaaact

SEQ ID NO: 2671828 - DNA, 13 bp, Homo sapiens
ttgtgtatttaac

SEQ ID NO: 2671829 - DNA, 12 bp, Homo sapiens
ttgttctctggg

SEQ ID NO: 2671830 - DNA, 13 bp, Homo sapiens
ttgttctctggga

SEQ ID NO: 2671831 - DNA, 19 bp, Homo sapiens
tttaagacgtgtttgtgtt

SEQ ID NO: 2671832 - DNA, 21 bp, Homo sapiens
tttacaccagttcctttcaat

SEQ ID NO: 2671833 - DNA, 13 bp, Homo sapiens
tttacggacaccc

SEQ ID NO: 2671834 - DNA, 14 bp, Homo sapiens
tttactgaagcctt

SEQ ID NO: 2671835 - DNA, 19 bp, Homo sapiens
tttagcagtaaaatagctg

SEQ ID NO: 2671836 - DNA, 13 bp, Homo sapiens
tttatttcttaaa

SEQ ID NO: 2671837 - DNA, 21 bp, Homo sapiens
tttcaatggtttgcaaggaag

SEQ ID NO: 2671838 - DNA, 14 bp, Homo sapiens
tttcaatttccaag

SEQ ID NO: 2671839 - DNA, 22 bp, Homo sapiens
tttcacaaacagaaaacatgta

SEQ ID NO: 2671840 - DNA, 14 bp, Homo sapiens
tttcataatctttg

SEQ ID NO: 2671841 - DNA, 20 bp, Homo sapiens
tttcatagttggggtcatag

SEQ ID NO: 2671842 - DNA, 18 bp, Homo sapiens
tttcattcagcctttaga

SEQ ID NO: 2671843 - DNA, 21 bp, Homo sapiens
tttcatttgtttgttttcctt

SEQ ID NO: 2671844 - DNA, 22 bp, Homo sapiens
tttcattttgtaacaaatgaac

SEQ ID NO: 2671845 - DNA, 13 bp, Homo sapiens
tttccaagagctg

SEQ ID NO: 2671846 - DNA, 14 bp, Homo sapiens
tttccaagagctga

SEQ ID NO: 2671847 - DNA, 16 bp, Homo sapiens
tttccaagagctgagg

SEQ ID NO: 2671848 - DNA, 17 bp, Homo sapiens
tttccatgaaaatgcaa

SEQ ID NO: 2671849 - DNA, 14 bp, Homo sapiens
tttccccttttgca

SEQ ID NO: 2671850 - DNA, 16 bp, Homo sapiens
tttccttccagcccag

SEQ ID NO: 2671851 - DNA, 13 bp, Homo sapiens
tttcgttcagtta

SEQ ID NO: 2671852 - DNA, 16 bp, Homo sapiens
tttctaaacagagatg

SEQ ID NO: 2671853 - DNA, 12 bp, Homo sapiens
tttctctttctt

SEQ ID NO: 2671854 - DNA, 20 bp, Homo sapiens
tttctgaaaattaacactgc

SEQ ID NO: 2671855 - DNA, 16 bp, Homo sapiens
tttcttaaacaaatgt

SEQ ID NO: 2671856 - DNA, 20 bp, Homo sapiens
tttgaaagccccagaaatca

SEQ ID NO: 2671857 - DNA, 19 bp, Homo sapiens
tttgaatataaacactata

SEQ ID NO: 2671858 - DNA, 21 bp, Homo sapiens
tttgcaaggaagccacagctg

SEQ ID NO: 2671859 - DNA, 21 bp, Homo sapiens
tttgcccaaaatttattttat

SEQ ID NO: 2671860 - DNA, 23 bp, Homo sapiens
tttggtagtggaaaaaaaaaaga

SEQ ID NO: 2671861 - DNA, 18 bp, Homo sapiens
tttgtaggggaactcatt

SEQ ID NO: 2671862 - DNA, 20 bp, Homo sapiens
tttgtaggggaactcatttg

SEQ ID NO: 2671863 - DNA, 12 bp, Homo sapiens
tttgtatgtttt

SEQ ID NO: 2671864 - DNA, 16 bp, Homo sapiens
tttgtgaatctttgtg

SEQ ID NO: 2671865 - DNA, 15 bp, Homo sapiens
tttgtgcattttcta

SEQ ID NO: 2671866 - DNA, 20 bp, Homo sapiens
tttgtgtatttaacagggag

SEQ ID NO: 2671867 - DNA, 21 bp, Homo sapiens
tttgttctctgggagaaaatc

SEQ ID NO: 2671868 - DNA, 21 bp, Homo sapiens
ttttaaagacctgacaccttt

SEQ ID NO: 2671869 - DNA, 16 bp, Homo sapiens
ttttaaccccgtcaac

SEQ ID NO: 2671870 - DNA, 20 bp, Homo sapiens
ttttaaccccgtcaacaaat

SEQ ID NO: 2671871 - DNA, 18 bp, Homo sapiens
ttttagatactttgctag

SEQ ID NO: 2671872 - DNA, 17 bp, Homo sapiens
ttttataagaaaaactt

SEQ ID NO: 2671873 - DNA, 13 bp, Homo sapiens
ttttcagcattga

SEQ ID NO: 2671874 - DNA, 18 bp, Homo sapiens
ttttccatgaaaatgcaa

SEQ ID NO: 2671875 - DNA, 19 bp, Homo sapiens
ttttccatgaaaatgcaac

SEQ ID NO: 2671876 - DNA, 14 bp, Homo sapiens
ttttgagcatgggt

SEQ ID NO: 2671877 - DNA, 19 bp, Homo sapiens
ttttgatcttcaacaaatt

SEQ ID NO: 2671878 - DNA, 15 bp, Homo sapiens
ttttgcataatttca

SEQ ID NO: 2671879 - DNA, 14 bp, Homo sapiens
ttttgttctctggg

SEQ ID NO: 2671880 - DNA, 11 bp, Homo sapiens
tttttaaaagt

SEQ ID NO: 2671881 - DNA, 15 bp, Homo sapiens
tttttaaagctacaa

SEQ ID NO: 2671882 - DNA, 22 bp, Homo sapiens
tttttaactcaatattttccat

SEQ ID NO: 2671883 - DNA, 13 bp, Homo sapiens
tttttaatctcca

SEQ ID NO: 2671884 - DNA, 19 bp, Homo sapiens
tttttatttgtttgtgcat

SEQ ID NO: 2671885 - DNA, 23 bp, Homo sapiens
tttttcccttcatctgggcactg

SEQ ID NO: 2671886 - DNA, 21 bp, Homo sapiens
tttttggttaaaaaaaagaat

SEQ ID NO: 2671887 - DNA, 12 bp, Homo sapiens
tttttgtatgtt

SEQ ID NO: 2671888 - DNA, 15 bp, Homo sapiens
tttttgtgtatttgt

SEQ ID NO: 2671889 - DNA, 14 bp, Homo sapiens
agattcccaggagt

SEQ ID NO: 2671890 - DNA, 17 bp, Homo sapiens
agattcccaggagttct

SEQ ID NO: 2671891 - DNA, 22 bp, Homo sapiens
agattcttcccattctccattt

SEQ ID NO: 2671892 - DNA, 13 bp, Homo sapiens
agcaacagaaaaa

SEQ ID NO: 2671893 - DNA, 20 bp, Homo sapiens
agcaagggttccctcaagag

SEQ ID NO: 2671894 - DNA, 23 bp, Homo sapiens
agcacaatgtctcacatgggaca

SEQ ID NO: 2671895 - DNA, 14 bp, Homo sapiens
agcacactcatccc

SEQ ID NO: 2671896 - DNA, 16 bp, Homo sapiens
agcacctgaacagttt

SEQ ID NO: 2671897 - DNA, 18 bp, Homo sapiens
agcagaaaggcacgtcca

SEQ ID NO: 2671898 - DNA, 13 bp, Homo sapiens
agcagtaaaatag

SEQ ID NO: 2671899 - DNA, 17 bp, Homo sapiens
agcatcacttgggatta

SEQ ID NO: 2671900 - DNA, 17 bp, Homo sapiens
agcatgatctgaaaaat

SEQ ID NO: 2671901 - DNA, 21 bp, Homo sapiens
agcattgatatttgtgcattt

SEQ ID NO: 2671902 - DNA, 21 bp, Homo sapiens
agcattgggtgaggtaataaa

SEQ ID NO: 2671903 - DNA, 17 bp, Homo sapiens
agcattttcctctgctt

SEQ ID NO: 2671904 - DNA, 13 bp, Homo sapiens
agcctaggccagg

SEQ ID NO: 2671905 - DNA, 22 bp, Homo sapiens
agcctatgtggattttttccta

SEQ ID NO: 2671906 - DNA, 21 bp, Homo sapiens
agcctggtttagcctggatgt

SEQ ID NO: 2671907 - DNA, 16 bp, Homo sapiens
agcggatcacaaggtc

SEQ ID NO: 2671908 - DNA, 22 bp, Homo sapiens
agctacacctttctcctttgta

SEQ ID NO: 2671909 - DNA, 14 bp, Homo sapiens
agctacctcaacca

SEQ ID NO: 2671910 - DNA, 23 bp, Homo sapiens
agctacctcaaccaatgccaaaa

SEQ ID NO: 2671911 - DNA, 20 bp, Homo sapiens
agctcccaggtgcagccaga

SEQ ID NO: 2671912 - DNA, 15 bp, Homo sapiens
agctctcccctcaga

SEQ ID NO: 2671913 - DNA, 14 bp, Homo sapiens
agctctttgcacta

SEQ ID NO: 2671914 - DNA, 18 bp, Homo sapiens
agctgaaatatgctggct

SEQ ID NO: 2671915 - DNA, 17 bp, Homo sapiens
agctgaggcaattctaa

SEQ ID NO: 2671916 - DNA, 15 bp, Homo sapiens
agctgatgactcaag

SEQ ID NO: 2671917 - DNA, 15 bp, Homo sapiens
agctggccccgccgc

SEQ ID NO: 2671918 - DNA, 18 bp, Homo sapiens
agctggccccgccgcctg

SEQ ID NO: 2671919 - DNA, 15 bp, Homo sapiens
agctgtattttgaaa

SEQ ID NO: 2671920 - DNA, 21 bp, Homo sapiens
agcttcaccccaatcccagct

SEQ ID NO: 2671921 - DNA, 22 bp, Homo sapiens
agcttccccaacacgcaggagc

SEQ ID NO: 2671922 - DNA, 15 bp, Homo sapiens
agcttccttggcttt

SEQ ID NO: 2671923 - DNA, 23 bp, Homo sapiens
agcttggaaactggatgaggtca

SEQ ID NO: 2671924 - DNA, 14 bp, Homo sapiens
agctttaccagctg

SEQ ID NO: 2671925 - DNA, 14 bp, Homo sapiens
agctttctttcaca

SEQ ID NO: 2671926 - DNA, 17 bp, Homo sapiens
agctttgacactggaat

SEQ ID NO: 2671927 - DNA, 20 bp, Homo sapiens
agctttgcttctctctctaa

SEQ ID NO: 2671928 - DNA, 13 bp, Homo sapiens
aggaaaatatttt

SEQ ID NO: 2671929 - DNA, 14 bp, Homo sapiens
aggaaacaacagct

SEQ ID NO: 2671930 - DNA, 15 bp, Homo sapiens
aggaaacaacagctt

SEQ ID NO: 2671931 - DNA, 15 bp, Homo sapiens
aggaaatagaattga

SEQ ID NO: 2671932 - DNA, 15 bp, Homo sapiens
aggaagccacagctg

SEQ ID NO: 2671933 - DNA, 16 bp, Homo sapiens
aggaagccacagctgg

SEQ ID NO: 2671934 - DNA, 23 bp, Homo sapiens
aggaattaagttagggaatggca

SEQ ID NO: 2671935 - DNA, 18 bp, Homo sapiens
aggacccaagcagagaag

SEQ ID NO: 2671936 - DNA, 21 bp, Homo sapiens
aggactgtgatgccctgccct

SEQ ID NO: 2671937 - DNA, 21 bp, Homo sapiens
aggagaactcatgttattttt

SEQ ID NO: 2671938 - DNA, 13 bp, Homo sapiens
aggagacaggcag

SEQ ID NO: 2671939 - DNA, 15 bp, Homo sapiens
aggagcacacccagc

SEQ ID NO: 2671940 - DNA, 15 bp, Homo sapiens
aggagcctaggccag

SEQ ID NO: 2671941 - DNA, 16 bp, Homo sapiens
aggagcctaggccagg

SEQ ID NO: 2671942 - DNA, 23 bp, Homo sapiens
aggagttcagggtcatagcatgc

SEQ ID NO: 2671943 - DNA, 14 bp, Homo sapiens
aggagttctgctca

SEQ ID NO: 2671944 - DNA, 22 bp, Homo sapiens
aggatggcaggacgtgggctgg

SEQ ID NO: 2671945 - DNA, 16 bp, Homo sapiens
aggattcctcttttct

SEQ ID NO: 2671946 - DNA, 20 bp, Homo sapiens
aggcaaagggtccagaagga

SEQ ID NO: 2671947 - DNA, 18 bp, Homo sapiens
aggcacctcaagaagaag

SEQ ID NO: 2671948 - DNA, 20 bp, Homo sapiens
aggcagctttttctctccca

SEQ ID NO: 2671949 - DNA, 18 bp, Homo sapiens
aggcaggtgaattgtttg

SEQ ID NO: 2671950 - DNA, 14 bp, Homo sapiens
aggccagacctgca

SEQ ID NO: 2671951 - DNA, 18 bp, Homo sapiens
aggccaggtgcaaccagg

SEQ ID NO: 2671952 - DNA, 23 bp, Homo sapiens
aggcccccgggtgtgaagcacag

SEQ ID NO: 2671953 - DNA, 17 bp, Homo sapiens
aggcctcgcaggaagac

SEQ ID NO: 2671954 - DNA, 19 bp, Homo sapiens
aggcctctggaaagcaaag

SEQ ID NO: 2671955 - DNA, 21 bp, Homo sapiens
aggcggtgggcacccaccctg

SEQ ID NO: 2671956 - DNA, 18 bp, Homo sapiens
aggctaaagcccagagac

SEQ ID NO: 2671957 - DNA, 21 bp, Homo sapiens
aggctattgtcccctaaacca

SEQ ID NO: 2671958 - DNA, 20 bp, Homo sapiens
aggctctcaacaggggagag

SEQ ID NO: 2671959 - DNA, 16 bp, Homo sapiens
aggctctgtttatgct

SEQ ID NO: 2671960 - DNA, 16 bp, Homo sapiens
agggaaaagcagctct

SEQ ID NO: 2671961 - DNA, 13 bp, Homo sapiens
agggaagttttgt

SEQ ID NO: 2671962 - DNA, 15 bp, Homo sapiens
agggaatggcacagc

SEQ ID NO: 2671963 - DNA, 16 bp, Homo sapiens
agggacctctcccagg

SEQ ID NO: 2671964 - DNA, 17 bp, Homo sapiens
agggacgaagaagagcc

SEQ ID NO: 2671965 - DNA, 16 bp, Homo sapiens
agggagacctggacac

SEQ ID NO: 2671966 - DNA, 15 bp, Homo sapiens
agggagcattttcct

SEQ ID NO: 2671967 - DNA, 23 bp, Homo sapiens
agggagctagccagaggactgtg

SEQ ID NO: 2671968 - DNA, 18 bp, Homo sapiens
agggatctatacttgctt

SEQ ID NO: 2671969 - DNA, 14 bp, Homo sapiens
agggcacaggccat

SEQ ID NO: 2671970 - DNA, 17 bp, Homo sapiens
agggcacaggccatgga

SEQ ID NO: 2671971 - DNA, 20 bp, Homo sapiens
agggcttacggccctggcct

SEQ ID NO: 2671972 - DNA, 13 bp, Homo sapiens
aggggcatgggaa

SEQ ID NO: 2671973 - DNA, 23 bp, Homo sapiens
aggggcgccgcaaaccacactgg

SEQ ID NO: 2671974 - DNA, 17 bp, Homo sapiens
agggtcagccagggcct

SEQ ID NO: 2671975 - DNA, 18 bp, Homo sapiens
agggtccagaaggagaca

SEQ ID NO: 2671976 - DNA, 21 bp, Homo sapiens
agggtccagaaggagacaggc

SEQ ID NO: 2671977 - DNA, 20 bp, Homo sapiens
aggtagacctgtctcctggc

SEQ ID NO: 2671978 - DNA, 22 bp, Homo sapiens
aggtatgaccttctaggaagct

SEQ ID NO: 2671979 - DNA, 11 bp, Homo sapiens
aggtctagcct

SEQ ID NO: 2671980 - DNA, 13 bp, Homo sapiens
aggtgcaaccagg

SEQ ID NO: 2671981 - DNA, 17 bp, Homo sapiens
aggtgcagccagaggca

SEQ ID NO: 2671982 - DNA, 13 bp, Homo sapiens
aggtgtctgtatc

SEQ ID NO: 2671983 - DNA, 12 bp, Homo sapiens
agtaaaaataca

SEQ ID NO: 2671984 - DNA, 19 bp, Homo sapiens
agtaaaataaatattgtct

SEQ ID NO: 2671985 - DNA, 20 bp, Homo sapiens
agtaaaataaatattgtctt

SEQ ID NO: 2671986 - DNA, 22 bp, Homo sapiens
agtaaaataaatattgtctttt

SEQ ID NO: 2671987 - DNA, 17 bp, Homo sapiens
agtaggctcatttactg

SEQ ID NO: 2671988 - DNA, 18 bp, Homo sapiens
agtagtgcctttacttca

SEQ ID NO: 2671989 - DNA, 24 bp, Homo sapiens
agtcactgtgagctcccaggtgca

SEQ ID NO: 2671990 - DNA, 15 bp, Homo sapiens
agtctgtccaggctc

SEQ ID NO: 2671991 - DNA, 15 bp, Homo sapiens
agtctgttttgtaaa

SEQ ID NO: 2671992 - DNA, 14 bp, Homo sapiens
agtcttgcagctga

SEQ ID NO: 2671993 - DNA, 18 bp, Homo sapiens
agtgaataactgcaaagt

SEQ ID NO: 2671994 - DNA, 23 bp, Homo sapiens
agtgagcggtgctgtcctcaggt

SEQ ID NO: 2671995 - DNA, 17 bp, Homo sapiens
agtgcaacactgaagct

SEQ ID NO: 2671996 - DNA, 15 bp, Homo sapiens
agtgcaagcccctgc

SEQ ID NO: 2671997 - DNA, 15 bp, Homo sapiens
agtgccaagtttgtt

SEQ ID NO: 2671998 - DNA, 15 bp, Homo sapiens
agtggatttcccatc

SEQ ID NO: 2671999 - DNA, 18 bp, Homo sapiens
agtggcttcactcctgct

SEQ ID NO: 2672000 - DNA, 21 bp, Homo sapiens
agtggcttcactcctgctgta

SEQ ID NO: 2672001 - DNA, 19 bp, Homo sapiens
agtgtagcatcctaaagat

SEQ ID NO: 2672002 - DNA, 14 bp, Homo sapiens
agtgtcaggaggaa

SEQ ID NO: 2672003 - DNA, 23 bp, Homo sapiens
agtgtggagtcattctcattgaa

SEQ ID NO: 2672004 - DNA, 23 bp, Homo sapiens
agtgtggtgtttcctgcaggcca

SEQ ID NO: 2672005 - DNA, 16 bp, Homo sapiens
agttaactattttatt

SEQ ID NO: 2672006 - DNA, 18 bp, Homo sapiens
agttagaataataaatat

SEQ ID NO: 2672007 - DNA, 15 bp, Homo sapiens
catgaaaatgcaaca

SEQ ID NO: 2672008 - DNA, 15 bp, Homo sapiens
catgatgtttgccca

SEQ ID NO: 2672009 - DNA, 20 bp, Homo sapiens
catgatttacagagaagtga

SEQ ID NO: 2672010 - DNA, 22 bp, Homo sapiens
catgcagtctgggagtggggaa

SEQ ID NO: 2672011 - DNA, 16 bp, Homo sapiens
catgcctcagccctga

SEQ ID NO: 2672012 - DNA, 20 bp, Homo sapiens
catgcctcagccctgaccct

SEQ ID NO: 2672013 - DNA, 19 bp, Homo sapiens
catgctgtgattgtgccta

SEQ ID NO: 2672014 - DNA, 18 bp, Homo sapiens
catgggacctataactgc

SEQ ID NO: 2672015 - DNA, 22 bp, Homo sapiens
catgggacctataactgcccag

SEQ ID NO: 2672016 - DNA, 16 bp, Homo sapiens
catggtgccctggctt

SEQ ID NO: 2672017 - DNA, 21 bp, Homo sapiens
catgtaaagcagtattaaaat

SEQ ID NO: 2672018 - DNA, 19 bp, Homo sapiens
catgtaccctaaggtcatt

SEQ ID NO: 2672019 - DNA, 15 bp, Homo sapiens
catgtataatatttt

SEQ ID NO: 2672020 - DNA, 22 bp, Homo sapiens
catgtgaaaaggcaaaaagcat

SEQ ID NO: 2672021 - DNA, 17 bp, Homo sapiens
catgtgctacaggggcc

SEQ ID NO: 2672022 - DNA, 22 bp, Homo sapiens
catgtggttaatgccatggaca

SEQ ID NO: 2672023 - DNA, 21 bp, Homo sapiens
cattatgatgtgggtcaagga

SEQ ID NO: 2672024 - DNA, 20 bp, Homo sapiens
cattcccttcgacagcattt

SEQ ID NO: 2672025 - DNA, 12 bp, Homo sapiens
cattctacttgc

SEQ ID NO: 2672026 - DNA, 15 bp, Homo sapiens
cattctacttgctct

SEQ ID NO: 2672027 - DNA, 22 bp, Homo sapiens
cattctacttgctctggacctg

SEQ ID NO: 2672028 - DNA, 12 bp, Homo sapiens
cattctccattt

SEQ ID NO: 2672029 - DNA, 17 bp, Homo sapiens
cattctccatttgttat

SEQ ID NO: 2672030 - DNA, 15 bp, Homo sapiens
cattgaacagcaaag

SEQ ID NO: 2672031 - DNA, 17 bp, Homo sapiens
cattgcactccagcctg

SEQ ID NO: 2672032 - DNA, 12 bp, Homo sapiens
cattggaaatta

SEQ ID NO: 2672033 - DNA, 17 bp, Homo sapiens
catttactgtgtctttg

SEQ ID NO: 2672034 - DNA, 23 bp, Homo sapiens
cattttaggaaaaaaaaaagcat

SEQ ID NO: 2672035 - DNA, 11 bp, Homo sapiens
cattttcatct

SEQ ID NO: 2672036 - DNA, 12 bp, Homo sapiens
catttttactgt

SEQ ID NO: 2672037 - DNA, 13 bp, Homo sapiens
ccaacccttctcc

SEQ ID NO: 2672038 - DNA, 14 bp, Homo sapiens
ccaacctattttga

SEQ ID NO: 2672039 - DNA, 22 bp, Homo sapiens
ccaagagctgaggcaattctaa

SEQ ID NO: 2672040 - DNA, 12 bp, Homo sapiens
ccaagccactga

SEQ ID NO: 2672041 - DNA, 13 bp, Homo sapiens
ccaaggctctgtt

SEQ ID NO: 2672042 - DNA, 18 bp, Homo sapiens
ccaatcccagctacctca

SEQ ID NO: 2672043 - DNA, 18 bp, Homo sapiens
ccaattcttacaaacatg

SEQ ID NO: 2672044 - DNA, 13 bp, Homo sapiens
ccacactggactc

SEQ ID NO: 2672045 - DNA, 21 bp, Homo sapiens
ccacactggactccggccctc

SEQ ID NO: 2672046 - DNA, 19 bp, Homo sapiens
ccacatacaacacaaagag

SEQ ID NO: 2672047 - DNA, 20 bp, Homo sapiens
ccacatacaacacaaagaga

SEQ ID NO: 2672048 - DNA, 16 bp, Homo sapiens
ccacctctccctgacc

SEQ ID NO: 2672049 - DNA, 18 bp, Homo sapiens
ccacctctccctgaccct

SEQ ID NO: 2672050 - DNA, 14 bp, Homo sapiens
ccactcaaaggcca

SEQ ID NO: 2672051 - DNA, 16 bp, Homo sapiens
ccactcaaaggccaga

SEQ ID NO: 2672052 - DNA, 18 bp, Homo sapiens
ccactgcataccaacctg

SEQ ID NO: 2672053 - DNA, 19 bp, Homo sapiens
ccactgcataccaacctgg

SEQ ID NO: 2672054 - DNA, 24 bp, Homo sapiens
ccagaaactgttcccacctgctgg

SEQ ID NO: 2672055 - DNA, 14 bp, Homo sapiens
ccagaaggagacag

SEQ ID NO: 2672056 - DNA, 17 bp, Homo sapiens
ccagaaggagacaggca

SEQ ID NO: 2672057 - DNA, 16 bp, Homo sapiens
ccagagaaagcgcaga

SEQ ID NO: 2672058 - DNA, 14 bp, Homo sapiens
ccagatttaaataa

SEQ ID NO: 2672059 - DNA, 15 bp, Homo sapiens
ccagcggacagtggc

SEQ ID NO: 2672060 - DNA, 16 bp, Homo sapiens
ccagcggacagtggca

SEQ ID NO: 2672061 - DNA, 17 bp, Homo sapiens
ccagcggacagtggcag

SEQ ID NO: 2672062 - DNA, 17 bp, Homo sapiens
ccagcgggaatggcagc

SEQ ID NO: 2672063 - DNA, 22 bp, Homo sapiens
ccagctattgatataaataaaa

SEQ ID NO: 2672064 - DNA, 17 bp, Homo sapiens
ccaggagttctgctcat

SEQ ID NO: 2672065 - DNA, 18 bp, Homo sapiens
ccaggattcctcttttct

SEQ ID NO: 2672066 - DNA, 17 bp, Homo sapiens
ccaggcttgcctgcagg

SEQ ID NO: 2672067 - DNA, 12 bp, Homo sapiens
ccaggcttggaa

SEQ ID NO: 2672068 - DNA, 18 bp, Homo sapiens
ccagggacgaagaagagc

SEQ ID NO: 2672069 - DNA, 19 bp, Homo sapiens
ccagggacgaagaagagcc

SEQ ID NO: 2672070 - DNA, 16 bp, Homo sapiens
ccagggagacctggac

SEQ ID NO: 2672071 - DNA, 21 bp, Homo sapiens
ccagggagacctggacacagg

SEQ ID NO: 2672072 - DNA, 22 bp, Homo sapiens
ccagggagacctggacacaggc

SEQ ID NO: 2672073 - DNA, 13 bp, Homo sapiens
ccagggcctgcga

SEQ ID NO: 2672074 - DNA, 14 bp, Homo sapiens
ccagggcctgcgag

SEQ ID NO: 2672075 - DNA, 21 bp, Homo sapiens
ccagggcttacggccctggcc

SEQ ID NO: 2672076 - DNA, 17 bp, Homo sapiens
ccagggtcagaaacagg

SEQ ID NO: 2672077 - DNA, 21 bp, Homo sapiens
ccaggtgagtcctagagctac

SEQ ID NO: 2672078 - DNA, 18 bp, Homo sapiens
ccaggtgcaaccagggag

SEQ ID NO: 2672079 - DNA, 15 bp, Homo sapiens
ccaggtgcagccaga

SEQ ID NO: 2672080 - DNA, 21 bp, Homo sapiens
ccagtcactgtgagctcccag

SEQ ID NO: 2672081 - DNA, 13 bp, Homo sapiens
ccagtccttccac

SEQ ID NO: 2672082 - DNA, 14 bp, Homo sapiens
ccatattgtaaaac

SEQ ID NO: 2672083 - DNA, 22 bp, Homo sapiens
ccatcgccagctgatgactcaa

SEQ ID NO: 2672084 - DNA, 23 bp, Homo sapiens
ccatcgccagctgatgactcaag

SEQ ID NO: 2672085 - DNA, 23 bp, Homo sapiens
ccatctggttaggatggcaggac

SEQ ID NO: 2672086 - DNA, 21 bp, Homo sapiens
ccatgaagaggatgctgtgaa

SEQ ID NO: 2672087 - DNA, 20 bp, Homo sapiens
ccatgagatagcattagctg

SEQ ID NO: 2672088 - DNA, 14 bp, Homo sapiens
ccatgcctcagccc

SEQ ID NO: 2672089 - DNA, 21 bp, Homo sapiens
ccatgcgacactgggaggcca

SEQ ID NO: 2672090 - DNA, 14 bp, Homo sapiens
ccatggtgcttgtt

SEQ ID NO: 2672091 - DNA, 18 bp, Homo sapiens
ccatgtgctacaggggcc

SEQ ID NO: 2672092 - DNA, 21 bp, Homo sapiens
ccatgtttgtggctattaaaa

SEQ ID NO: 2672093 - DNA, 15 bp, Homo sapiens
ccattatgtcctagt

SEQ ID NO: 2672094 - DNA, 13 bp, Homo sapiens
ccattctacttgc

SEQ ID NO: 2672095 - DNA, 18 bp, Homo sapiens
ccattctacttgctctgg

SEQ ID NO: 2672096 - DNA, 17 bp, Homo sapiens
ccattgaaggcttaaac

SEQ ID NO: 2672097 - DNA, 18 bp, Homo sapiens
cccaaaatttattttata

SEQ ID NO: 2672098 - DNA, 18 bp, Homo sapiens
cccaagacctcagggcac

SEQ ID NO: 2672099 - DNA, 14 bp, Homo sapiens
cccaagcagagaag

SEQ ID NO: 2672100 - DNA, 21 bp, Homo sapiens
cccactggggtccagggagca

SEQ ID NO: 2672101 - DNA, 17 bp, Homo sapiens
cccaggagttctgctca

SEQ ID NO: 2672102 - DNA, 23 bp, Homo sapiens
cccaggagttctgctcattctaa

SEQ ID NO: 2672103 - DNA, 21 bp, Homo sapiens
cccaggtgcagccagaggcac

SEQ ID NO: 2672104 - DNA, 14 bp, Homo sapiens
cccagtccttccac

SEQ ID NO: 2672105 - DNA, 13 bp, Homo sapiens
cccattctacttg

SEQ ID NO: 2672106 - DNA, 20 bp, Homo sapiens
cccattctacttgctctgga

SEQ ID NO: 2672107 - DNA, 22 bp, Homo sapiens
cccattctacttgctctggacc

SEQ ID NO: 2672108 - DNA, 24 bp, Homo sapiens
cccattctacttgctctggacctg

SEQ ID NO: 2672109 - DNA, 20 bp, Homo sapiens
cccattcttttgtaatttaa

SEQ ID NO: 2672110 - DNA, 21 bp, Homo sapiens
cccattcttttgtaatttaaa

SEQ ID NO: 2672111 - DNA, 13 bp, Homo sapiens
ccccaatcccagc

SEQ ID NO: 2672112 - DNA, 13 bp, Homo sapiens
ccccaccccattt

SEQ ID NO: 2672113 - DNA, 17 bp, Homo sapiens
ccccacctctccctgac

SEQ ID NO: 2672114 - DNA, 13 bp, Homo sapiens
cccccccttccac

SEQ ID NO: 2672115 - DNA, 13 bp, Homo sapiens
cccccgccccctg

SEQ ID NO: 2672116 - DNA, 13 bp, Homo sapiens
ccccctgccctcc

SEQ ID NO: 2672117 - DNA, 16 bp, Homo sapiens
ccccgcatcccctgcc

SEQ ID NO: 2672118 - DNA, 19 bp, Homo sapiens
ccccgcatcccctgcctcc

SEQ ID NO: 2672119 - DNA, 13 bp, Homo sapiens
ccccgccccctgc

SEQ ID NO: 2672120 - DNA, 15 bp, Homo sapiens
cccctgcctccatcc

SEQ ID NO: 2672121 - DNA, 16 bp, Homo sapiens
cccctgcctccatcct

SEQ ID NO: 2672122 - DNA, 12 bp, Homo sapiens
ccccttttgcat

SEQ ID NO: 2672123 - DNA, 15 bp, Homo sapiens
cccgcatcccctgcc

SEQ ID NO: 2672124 - DNA, 15 bp, Homo sapiens
cccgccaaaagctgc

SEQ ID NO: 2672125 - DNA, 17 bp, Homo sapiens
cccgccccctgccctcc

SEQ ID NO: 2672126 - DNA, 21 bp, Homo sapiens
cccgcggggacattgggaagg

SEQ ID NO: 2672127 - DNA, 18 bp, Homo sapiens
ccctctggtttgccggtg

SEQ ID NO: 2672128 - DNA, 16 bp, Homo sapiens
ccctgaccctgtatat

SEQ ID NO: 2672129 - DNA, 19 bp, Homo sapiens
ccctgaccctgtggaagca

SEQ ID NO: 2672130 - DNA, 19 bp, Homo sapiens
ccctgctccagaagatagc

SEQ ID NO: 2672131 - DNA, 11 bp, Homo sapiens
ccctggcctga

SEQ ID NO: 2672132 - DNA, 21 bp, Homo sapiens
ccctggccttgggccctctgg

SEQ ID NO: 2672133 - DNA, 24 bp, Homo sapiens
ccctgggaggcgggcgcactgcct

SEQ ID NO: 2672134 - DNA, 15 bp, Homo sapiens
ccctgtatatagccc

SEQ ID NO: 2672135 - DNA, 18 bp, Homo sapiens
ccctgtatatagcccagc

SEQ ID NO: 2672136 - DNA, 13 bp, Homo sapiens
cccttccaggggt

SEQ ID NO: 2672137 - DNA, 17 bp, Homo sapiens
cccttctcctcttgtaa

SEQ ID NO: 2672138 - DNA, 19 bp, Homo sapiens
ccgaggtgagcggatcaca

SEQ ID NO: 2672139 - DNA, 15 bp, Homo sapiens
ccgcaaaccacactg

SEQ ID NO: 2672140 - DNA, 13 bp, Homo sapiens
ccgcatcccctgc

SEQ ID NO: 2672141 - DNA, 14 bp, Homo sapiens
ccgcctggtactca

SEQ ID NO: 2672142 - DNA, 21 bp, Homo sapiens
ccggccctcctaccctgcgcc

SEQ ID NO: 2672143 - DNA, 22 bp, Homo sapiens
ccggttcactcttctcagccac

SEQ ID NO: 2672144 - DNA, 17 bp, Homo sapiens
ccgtaggacccaagcag

SEQ ID NO: 2672145 - DNA, 21 bp, Homo sapiens
cctaaaccaaaaactgaaagt

SEQ ID NO: 2672146 - DNA, 12 bp, Homo sapiens
cctaggccaggt

SEQ ID NO: 2672147 - DNA, 22 bp, Homo sapiens
cctcacacacagactcatatta

SEQ ID NO: 2672148 - DNA, 17 bp, Homo sapiens
cctcagccctgaccctg

SEQ ID NO: 2672149 - DNA, 19 bp, Homo sapiens
cctcaggcctctgtgccgc

SEQ ID NO: 2672150 - DNA, 12 bp, Homo sapiens
cctcaggtggcc

SEQ ID NO: 2672151 - DNA, 15 bp, Homo sapiens
cctcctggcccaggt

SEQ ID NO: 2672152 - DNA, 18 bp, Homo sapiens
cctcgaattttgttttct

SEQ ID NO: 2672153 - DNA, 15 bp, Homo sapiens
cctcgttctccctgg

SEQ ID NO: 2672154 - DNA, 11 bp, Homo sapiens
cctctcccagg

SEQ ID NO: 2672155 - DNA, 12 bp, Homo sapiens
cctctccctgac

SEQ ID NO: 2672156 - DNA, 15 bp, Homo sapiens
cctctccctgaccct

SEQ ID NO: 2672157 - DNA, 15 bp, Homo sapiens
cctcttcctgcctag

SEQ ID NO: 2672158 - DNA, 18 bp, Homo sapiens
cctcttgtaaataaagcc

SEQ ID NO: 2672159 - DNA, 14 bp, Homo sapiens
cctcttttctctgc

SEQ ID NO: 2672160 - DNA, 13 bp, Homo sapiens
cctgaacctagga

SEQ ID NO: 2672161 - DNA, 19 bp, Homo sapiens
cctgaccctgtatatagcc

SEQ ID NO: 2672162 - DNA, 19 bp, Homo sapiens
cctgcactctttaagggag

SEQ ID NO: 2672163 - DNA, 16 bp, Homo sapiens
cctgcccattggagag

SEQ ID NO: 2672164 - DNA, 13 bp, Homo sapiens
cctgcccttggca

SEQ ID NO: 2672165 - DNA, 13 bp, Homo sapiens
cctgcgagggcag

SEQ ID NO: 2672166 - DNA, 15 bp, Homo sapiens
cctgcttccatggcc

SEQ ID NO: 2672167 - DNA, 13 bp, Homo sapiens
cctggacacaggc

SEQ ID NO: 2672168 - DNA, 16 bp, Homo sapiens
cctggacacaggcctg

SEQ ID NO: 2672169 - DNA, 22 bp, Homo sapiens
cctggactagagggacctctcc

SEQ ID NO: 2672170 - DNA, 23 bp, Homo sapiens
cctgggaggcgggcgcactgcct

SEQ ID NO: 2672171 - DNA, 15 bp, Homo sapiens
cctggtactcaagcc

SEQ ID NO: 2672172 - DNA, 13 bp, Homo sapiens
cctgtctcctggc

SEQ ID NO: 2672173 - DNA, 14 bp, Homo sapiens
cctgttttttttct

SEQ ID NO: 2672174 - DNA, 18 bp, Homo sapiens
ccttccttgtagcctttt

SEQ ID NO: 2672175 - DNA, 14 bp, Homo sapiens
ccttctaggaagct

SEQ ID NO: 2672176 - DNA, 18 bp, Homo sapiens
ccttgaggaaacaacagc

SEQ ID NO: 2672177 - DNA, 21 bp, Homo sapiens
ccttggcttttactgaagcct

SEQ ID NO: 2672178 - DNA, 19 bp, Homo sapiens
cctttacggacaccccctc

SEQ ID NO: 2672179 - DNA, 16 bp, Homo sapiens
cctttcaaagccattt

SEQ ID NO: 2672180 - DNA, 14 bp, Homo sapiens
cctttctcctttgt

SEQ ID NO: 2672181 - DNA, 18 bp, Homo sapiens
ccttttatttcttcacca

SEQ ID NO: 2672182 - DNA, 13 bp, Homo sapiens
ccttttgcattct

SEQ ID NO: 2672183 - DNA, 20 bp, Homo sapiens
ccttttttaaaagtaaatgt

SEQ ID NO: 2672184 - DNA, 22 bp, Homo sapiens
cgaaaaccaggccttatctcca

SEQ ID NO: 2672185 - DNA, 20 bp, Homo sapiens
cgaagccatctttctttgga

SEQ ID NO: 2672186 - DNA, 14 bp, Homo sapiens
cgaatacaaaattg

SEQ ID NO: 2672187 - DNA, 22 bp, Homo sapiens
cgaatgacaaaatcatctttgt

SEQ ID NO: 2672188 - DNA, 17 bp, Homo sapiens
cgaggaggtaatgaatt

SEQ ID NO: 2672189 - DNA, 22 bp, Homo sapiens
cgagtgtgaagcttccttggct

SEQ ID NO: 2672190 - DNA, 19 bp, Homo sapiens
cgatcgcggcggagctggc

SEQ ID NO: 2672191 - DNA, 21 bp, Homo sapiens
cgatgggcccaattcttacaa

SEQ ID NO: 2672192 - DNA, 15 bp, Homo sapiens
cgattcatattgaat

SEQ ID NO: 2672193 - DNA, 21 bp, Homo sapiens
cgatttccctggttttagtct

SEQ ID NO: 2672194 - DNA, 13 bp, Homo sapiens
cgcatcccctgcc

SEQ ID NO: 2672195 - DNA, 14 bp, Homo sapiens
cgcatcccctgcct

SEQ ID NO: 2672196 - DNA, 16 bp, Homo sapiens
cgcatcccctgcctcc

SEQ ID NO: 2672197 - DNA, 16 bp, Homo sapiens
cgccagctgatgactc

SEQ ID NO: 2672198 - DNA, 17 bp, Homo sapiens
cgccagctgatgactca

SEQ ID NO: 2672199 - DNA, 15 bp, Homo sapiens
cgcccagtccttcca

SEQ ID NO: 2672200 - DNA, 14 bp, Homo sapiens
cgccccctgccctc

SEQ ID NO: 2672201 - DNA, 12 bp, Homo sapiens
cgccctcccagg

SEQ ID NO: 2672202 - DNA, 20 bp, Homo sapiens
cgccgcaaaccacactggac

SEQ ID NO: 2672203 - DNA, 21 bp, Homo sapiens
cgccgcaaaccacactggact

SEQ ID NO: 2672204 - DNA, 22 bp, Homo sapiens
cgccgcaaaccacactggactc

SEQ ID NO: 2672205 - DNA, 17 bp, Homo sapiens
cgcctgggtccagggga

SEQ ID NO: 2672206 - DNA, 21 bp, Homo sapiens
cgcggcggagctggccccgcc

SEQ ID NO: 2672207 - DNA, 23 bp, Homo sapiens
cgcggcggagctggccccgccgc

SEQ ID NO: 2672208 - DNA, 21 bp, Homo sapiens
cgcgtcgccctcccaggctct

SEQ ID NO: 2672209 - DNA, 13 bp, Homo sapiens
cggagctggcccc

SEQ ID NO: 2672210 - DNA, 16 bp, Homo sapiens
cggagctggccccgcc

SEQ ID NO: 2672211 - DNA, 22 bp, Homo sapiens
cggccctcctaccctgcgccca

SEQ ID NO: 2672212 - DNA, 16 bp, Homo sapiens
cggctgggcacacgcc

SEQ ID NO: 2672213 - DNA, 17 bp, Homo sapiens
cggctgggcacacgcct

SEQ ID NO: 2672214 - DNA, 20 bp, Homo sapiens
cggctgggcacacgcctccc

SEQ ID NO: 2672215 - DNA, 22 bp, Homo sapiens
cgggagcctccctgcctcaggc

SEQ ID NO: 2672216 - DNA, 17 bp, Homo sapiens
cgggcgcactgcctctc

SEQ ID NO: 2672217 - DNA, 16 bp, Homo sapiens
cggtggacccagacac

SEQ ID NO: 2672218 - DNA, 15 bp, Homo sapiens
cggtgggcacccacc

SEQ ID NO: 2672219 - DNA, 22 bp, Homo sapiens
cggttcactcttctcagccact

SEQ ID NO: 2672220 - DNA, 19 bp, Homo sapiens
cgtcattacagggcacagg

SEQ ID NO: 2672221 - DNA, 16 bp, Homo sapiens
cgtcgccctcccaggc

SEQ ID NO: 2672222 - DNA, 14 bp, Homo sapiens
cgtgatcaaagcca

SEQ ID NO: 2672223 - DNA, 18 bp, Homo sapiens
cgtgatcaaagccacact

SEQ ID NO: 2672224 - DNA, 21 bp, Homo sapiens
cgtgatcaaagccacactctg

SEQ ID NO: 2672225 - DNA, 17 bp, Homo sapiens
cgtgcagggacaaagag

SEQ ID NO: 2672226 - DNA, 13 bp, Homo sapiens
ctaatgatggccc

SEQ ID NO: 2672227 - DNA, 22 bp, Homo sapiens
ctaatgatggcccattctactt

SEQ ID NO: 2672228 - DNA, 17 bp, Homo sapiens
ctaattcttgcatattt

SEQ ID NO: 2672229 - DNA, 12 bp, Homo sapiens
ctaatttataaa

SEQ ID NO: 2672230 - DNA, 16 bp, Homo sapiens
ctacaatttaaagcaa

SEQ ID NO: 2672231 - DNA, 15 bp, Homo sapiens
ctacacctttctcct

SEQ ID NO: 2672232 - DNA, 20 bp, Homo sapiens
ctacacctttctcctttgta

SEQ ID NO: 2672233 - DNA, 13 bp, Homo sapiens
ctacagaaaaacc

SEQ ID NO: 2672234 - DNA, 14 bp, Homo sapiens
ctacaggggccaga

SEQ ID NO: 2672235 - DNA, 17 bp, Homo sapiens
ctacaggtttgggtaca

SEQ ID NO: 2672236 - DNA, 16 bp, Homo sapiens
ctactcgggaagctga

SEQ ID NO: 2672237 - DNA, 21 bp, Homo sapiens
ctactgtggtgttttgtttat

SEQ ID NO: 2672238 - DNA, 15 bp, Homo sapiens
ctacttgctctggac

SEQ ID NO: 2672239 - DNA, 18 bp, Homo sapiens
ctacttgctctggacctg

SEQ ID NO: 2672240 - DNA, 18 bp, Homo sapiens
ctagaaagaatatttggt

SEQ ID NO: 2672241 - DNA, 15 bp, Homo sapiens
ctagagggacctctc

SEQ ID NO: 2672242 - DNA, 16 bp, Homo sapiens
ctagagggacctctcc

SEQ ID NO: 2672243 - DNA, 17 bp, Homo sapiens
ctagagggacctctccc

SEQ ID NO: 2672244 - DNA, 22 bp, Homo sapiens
gcagatgtaaagttattcttga

SEQ ID NO: 2672245 - DNA, 12 bp, Homo sapiens
gcagctctcccc

SEQ ID NO: 2672246 - DNA, 18 bp, Homo sapiens
gcagctgaaatatgctgg

SEQ ID NO: 2672247 - DNA, 22 bp, Homo sapiens
gcagctgaaatatgctggctgg

SEQ ID NO: 2672248 - DNA, 13 bp, Homo sapiens
gcaggacaggaaa

SEQ ID NO: 2672249 - DNA, 20 bp, Homo sapiens
gcaggagcacacccagcccc

SEQ ID NO: 2672250 - DNA, 21 bp, Homo sapiens
gcagggacaaagaggccttta

SEQ ID NO: 2672251 - DNA, 15 bp, Homo sapiens
gcagggccgccaggg

SEQ ID NO: 2672252 - DNA, 23 bp, Homo sapiens
gcagggccgccagggagacctgg

SEQ ID NO: 2672253 - DNA, 20 bp, Homo sapiens
gcaggggagggtcagccagg

SEQ ID NO: 2672254 - DNA, 21 bp, Homo sapiens
gcaggggagggtcagccaggg

SEQ ID NO: 2672255 - DNA, 15 bp, Homo sapiens
gcagtgcctgataag

SEQ ID NO: 2672256 - DNA, 13 bp, Homo sapiens
gcagtttaaagca

SEQ ID NO: 2672257 - DNA, 20 bp, Homo sapiens
gcataataaatgcttcagtg

SEQ ID NO: 2672258 - DNA, 15 bp, Homo sapiens
gcatcccctgcctcc

SEQ ID NO: 2672259 - DNA, 20 bp, Homo sapiens
gcatcctaaagataaagcca

SEQ ID NO: 2672260 - DNA, 13 bp, Homo sapiens
gcatgaaggtttc

SEQ ID NO: 2672261 - DNA, 22 bp, Homo sapiens
gcatgatgtttgcccaaaattt

SEQ ID NO: 2672262 - DNA, 17 bp, Homo sapiens
gcatttactgtgtcttt

SEQ ID NO: 2672263 - DNA, 18 bp, Homo sapiens
gcatttactgtgtctttg

SEQ ID NO: 2672264 - DNA, 14 bp, Homo sapiens
gccaaaagctgctc

SEQ ID NO: 2672265 - DNA, 22 bp, Homo sapiens
gccaacccttctcctcttgtaa

SEQ ID NO: 2672266 - DNA, 15 bp, Homo sapiens
gccaacctattttga

SEQ ID NO: 2672267 - DNA, 21 bp, Homo sapiens
gccaaggagggtgagtgcaag

SEQ ID NO: 2672268 - DNA, 19 bp, Homo sapiens
gccagaagatgaacagact

SEQ ID NO: 2672269 - DNA, 13 bp, Homo sapiens
gccagacctgcag

SEQ ID NO: 2672270 - DNA, 21 bp, Homo sapiens
gccagacctgcagacgcccag

SEQ ID NO: 2672271 - DNA, 13 bp, Homo sapiens
gccagaggcacct

SEQ ID NO: 2672272 - DNA, 18 bp, Homo sapiens
gccagctgatgactcaag

SEQ ID NO: 2672273 - DNA, 12 bp, Homo sapiens
gccaggccagct

SEQ ID NO: 2672274 - DNA, 18 bp, Homo sapiens
gccagggagacctggaca

SEQ ID NO: 2672275 - DNA, 22 bp, Homo sapiens
gccagggagacctggacacagg

SEQ ID NO: 2672276 - DNA, 18 bp, Homo sapiens
gccaggtgcaaccaggga

SEQ ID NO: 2672277 - DNA, 20 bp, Homo sapiens
gccagtcttgacgagtgtga

SEQ ID NO: 2672278 - DNA, 15 bp, Homo sapiens
gccagtgagccactc

SEQ ID NO: 2672279 - DNA, 23 bp, Homo sapiens
gccatgaagaggatgctgtgaaa

SEQ ID NO: 2672280 - DNA, 14 bp, Homo sapiens
gccatgcctcagcc

SEQ ID NO: 2672281 - DNA, 19 bp, Homo sapiens
gccatgttgtgcctccctg

SEQ ID NO: 2672282 - DNA, 20 bp, Homo sapiens
gccattttgcattttcatct

SEQ ID NO: 2672283 - DNA, 15 bp, Homo sapiens
gcccaaaatttattt

SEQ ID NO: 2672284 - DNA, 21 bp, Homo sapiens
gcccaaaatttattttataag

SEQ ID NO: 2672285 - DNA, 19 bp, Homo sapiens
gcccagattatgagacaca

SEQ ID NO: 2672286 - DNA, 14 bp, Homo sapiens
gcccagccaggccc

SEQ ID NO: 2672287 - DNA, 19 bp, Homo sapiens
gcccagcggacagtggcag

SEQ ID NO: 2672288 - DNA, 21 bp, Homo sapiens
gcccagcggacagtggcagga

SEQ ID NO: 2672289 - DNA, 14 bp, Homo sapiens
gcccaggatgctgc

SEQ ID NO: 2672290 - DNA, 19 bp, Homo sapiens
gcccagtccttccacctcg

SEQ ID NO: 2672291 - DNA, 18 bp, Homo sapiens
gcccattctacttgctct

SEQ ID NO: 2672292 - DNA, 20 bp, Homo sapiens
gcccattctacttgctctgg

SEQ ID NO: 2672293 - DNA, 13 bp, Homo sapiens
gcccccccttcca

SEQ ID NO: 2672294 - DNA, 16 bp, Homo sapiens
gcccccgcatcccctg

SEQ ID NO: 2672295 - DNA, 18 bp, Homo sapiens
gcccccgcatcccctgcc

SEQ ID NO: 2672296 - DNA, 12 bp, Homo sapiens
gccccctgccct

SEQ ID NO: 2672297 - DNA, 14 bp, Homo sapiens
gccccctgccctcc

SEQ ID NO: 2672298 - DNA, 19 bp, Homo sapiens
gccccctgccctcccctct

SEQ ID NO: 2672299 - DNA, 13 bp, Homo sapiens
gccccgccgcctg

SEQ ID NO: 2672300 - DNA, 15 bp, Homo sapiens
gccctcccctctctg

SEQ ID NO: 2672301 - DNA, 18 bp, Homo sapiens
gccctcccctctctgcac

SEQ ID NO: 2672302 - DNA, 14 bp, Homo sapiens
gccctgaccctgtg

SEQ ID NO: 2672303 - DNA, 17 bp, Homo sapiens
gccctgaccctgtggaa

SEQ ID NO: 2672304 - DNA, 21 bp, Homo sapiens
gccgcaaaccacactggactc

SEQ ID NO: 2672305 - DNA, 15 bp, Homo sapiens
gccgcctggtactca

SEQ ID NO: 2672306 - DNA, 17 bp, Homo sapiens
gccgcgtcgccctccca

SEQ ID NO: 2672307 - DNA, 15 bp, Homo sapiens
gccggtggtgcaggt

SEQ ID NO: 2672308 - DNA, 19 bp, Homo sapiens
gccgttgattcacttcacg

SEQ ID NO: 2672309 - DNA, 13 bp, Homo sapiens
gcctaggccaggt

SEQ ID NO: 2672310 - DNA, 22 bp, Homo sapiens
gcctcagccctgaccctgtgga

SEQ ID NO: 2672311 - DNA, 15 bp, Homo sapiens
gcctccatcagctaa

SEQ ID NO: 2672312 - DNA, 14 bp, Homo sapiens
gcctcccactgggg

SEQ ID NO: 2672313 - DNA, 16 bp, Homo sapiens
gcctccctgcctcagg

SEQ ID NO: 2672314 - DNA, 17 bp, Homo sapiens
gcctccctgcctcaggc

SEQ ID NO: 2672315 - DNA, 14 bp, Homo sapiens
gcctcgcaggaaga

SEQ ID NO: 2672316 - DNA, 20 bp, Homo sapiens
gcctgataagcttcaaagct

SEQ ID NO: 2672317 - DNA, 20 bp, Homo sapiens
gcctgggtgacagagcaaga

SEQ ID NO: 2672318 - DNA, 22 bp, Homo sapiens
gcctgggtgacagagcaagact

SEQ ID NO: 2672319 - DNA, 14 bp, Homo sapiens
gcctggtttagcct

SEQ ID NO: 2672320 - DNA, 14 bp, Homo sapiens
gcggacagtggcag

SEQ ID NO: 2672321 - DNA, 17 bp, Homo sapiens
gcggagcaagaggaggc

SEQ ID NO: 2672322 - DNA, 20 bp, Homo sapiens
gcggcggagctggccccgcc

SEQ ID NO: 2672323 - DNA, 19 bp, Homo sapiens
gcgggaatggcagctgcca

SEQ ID NO: 2672324 - DNA, 17 bp, Homo sapiens
gcgggcgcactgcctct

SEQ ID NO: 2672325 - DNA, 23 bp, Homo sapiens
gcgggcgcactgcctctcacagc

SEQ ID NO: 2672326 - DNA, 16 bp, Homo sapiens
gcggtgctgtcctcag

SEQ ID NO: 2672327 - DNA, 16 bp, Homo sapiens
gcgtcattacagggca

SEQ ID NO: 2672328 - DNA, 22 bp, Homo sapiens
gcgtcattacagggcacaggcc

SEQ ID NO: 2672329 - DNA, 23 bp, Homo sapiens
gcgtcattacagggcacaggcca

SEQ ID NO: 2672330 - DNA, 16 bp, Homo sapiens
gcgtcgccctcccagg

SEQ ID NO: 2672331 - DNA, 17 bp, Homo sapiens
gcgtcgccctcccaggc

SEQ ID NO: 2672332 - DNA, 18 bp, Homo sapiens
gcgtgcagggacaaagag

SEQ ID NO: 2672333 - DNA, 19 bp, Homo sapiens
gcgtgcagggacaaagagg

SEQ ID NO: 2672334 - DNA, 15 bp, Homo sapiens
gctaaagcccagaga

SEQ ID NO: 2672335 - DNA, 16 bp, Homo sapiens
gctaacaccagacaga

SEQ ID NO: 2672336 - DNA, 15 bp, Homo sapiens
gctacaggggccaga

SEQ ID NO: 2672337 - DNA, 20 bp, Homo sapiens
gctacagttttgtgaatctt

SEQ ID NO: 2672338 - DNA, 12 bp, Homo sapiens
gctagccagagg

SEQ ID NO: 2672339 - DNA, 18 bp, Homo sapiens
gctagccagaggactgtg

SEQ ID NO: 2672340 - DNA, 18 bp, Homo sapiens
gctattaaaactctttta

SEQ ID NO: 2672341 - DNA, 19 bp, Homo sapiens
gctattaaaactcttttaa

SEQ ID NO: 2672342 - DNA, 17 bp, Homo sapiens
gctatttgcaattcctg

SEQ ID NO: 2672343 - DNA, 18 bp, Homo sapiens
gctcattctaatgatggc

SEQ ID NO: 2672344 - DNA, 12 bp, Homo sapiens
gctcatttactg

SEQ ID NO: 2672345 - DNA, 17 bp, Homo sapiens
gctcatttactgtttta

SEQ ID NO: 2672346 - DNA, 22 bp, Homo sapiens
gctctctttttctccagggtca

SEQ ID NO: 2672347 - DNA, 13 bp, Homo sapiens
gctctggacctgc

SEQ ID NO: 2672348 - DNA, 20 bp, Homo sapiens
gctcttccgaaaaccaggcc

SEQ ID NO: 2672349 - DNA, 14 bp, Homo sapiens
gctgaaaaaaaatt

SEQ ID NO: 2672350 - DNA, 23 bp, Homo sapiens
gctgatgactcaagattcccagg

SEQ ID NO: 2672351 - DNA, 12 bp, Homo sapiens
gctggagtgagg

SEQ ID NO: 2672352 - DNA, 13 bp, Homo sapiens
gctggccccgccg

SEQ ID NO: 2672353 - DNA, 23 bp, Homo sapiens
gctggccccgccgcctggtactc

SEQ ID NO: 2672354 - DNA, 22 bp, Homo sapiens
gctggtcaaacaaactctctga

SEQ ID NO: 2672355 - DNA, 18 bp, Homo sapiens
gctgtaaatttggcttct

SEQ ID NO: 2672356 - DNA, 19 bp, Homo sapiens
gctgtaaatttggcttctg

SEQ ID NO: 2672357 - DNA, 22 bp, Homo sapiens
gctgtaaatttggcttctgttg

SEQ ID NO: 2672358 - DNA, 18 bp, Homo sapiens
gctgtcctcaggtggcca

SEQ ID NO: 2672359 - DNA, 19 bp, Homo sapiens
gctgtgcacaaagtggcat

SEQ ID NO: 2672360 - DNA, 21 bp, Homo sapiens
gctgtgcacaaagtggcataa

SEQ ID NO: 2672361 - DNA, 12 bp, Homo sapiens
gcttaatgaaaa

SEQ ID NO: 2672362 - DNA, 18 bp, Homo sapiens
ttgaatataaacactata

SEQ ID NO: 2672363 - DNA, 20 bp, Homo sapiens
ttgaatataatatatttgtg

SEQ ID NO: 2672364 - DNA, 22 bp, Homo sapiens
ttgaatataatatatttgtgta

SEQ ID NO: 2672365 - DNA, 22 bp, Homo sapiens
ttgaattttgttctctgggaga

SEQ ID NO: 2672366 - DNA, 21 bp, Homo sapiens
ttgacttgacagaacactgtc

SEQ ID NO: 2672367 - DNA, 15 bp, Homo sapiens
ttgagtctgttttgt

SEQ ID NO: 2672368 - DNA, 18 bp, Homo sapiens
ttgagtctgttttgtaaa

SEQ ID NO: 2672369 - DNA, 18 bp, Homo sapiens
ttgatataaataaaacat

SEQ ID NO: 2672370 - DNA, 20 bp, Homo sapiens
ttgatatttgtgcattttct

SEQ ID NO: 2672371 - DNA, 17 bp, Homo sapiens
ttgatcttcaacaaatt

SEQ ID NO: 2672372 - DNA, 13 bp, Homo sapiens
ttgattcacttca

SEQ ID NO: 2672373 - DNA, 13 bp, Homo sapiens
ttgcataaggttt

SEQ ID NO: 2672374 - DNA, 12 bp, Homo sapiens
ttgcataataaa

SEQ ID NO: 2672375 - DNA, 14 bp, Homo sapiens
ttgccaagaccttt

SEQ ID NO: 2672376 - DNA, 21 bp, Homo sapiens
ttgccgcgtcgccctcccagg

SEQ ID NO: 2672377 - DNA, 21 bp, Homo sapiens
ttgcgtggaattgtgctgagt

SEQ ID NO: 2672378 - DNA, 23 bp, Homo sapiens
ttgctgaaggctaaattcacagc

SEQ ID NO: 2672379 - DNA, 15 bp, Homo sapiens
ttgctttgtgttctt

SEQ ID NO: 2672380 - DNA, 17 bp, Homo sapiens
ttggacggctgggcaca

SEQ ID NO: 2672381 - DNA, 15 bp, Homo sapiens
ttggccaaacaagtg

SEQ ID NO: 2672382 - DNA, 21 bp, Homo sapiens
ttggccccccgaccttgtaga

SEQ ID NO: 2672383 - DNA, 13 bp, Homo sapiens
ttgggattaatat

SEQ ID NO: 2672384 - DNA, 13 bp, Homo sapiens
ttggttttcctgt

SEQ ID NO: 2672385 - DNA, 15 bp, Homo sapiens
ttggttttcctgtat

SEQ ID NO: 2672386 - DNA, 14 bp, Homo sapiens
ttgtaaaacaggta

SEQ ID NO: 2672387 - DNA, 22 bp, Homo sapiens
ttgtaaagtccccagagaaagc

SEQ ID NO: 2672388 - DNA, 19 bp, Homo sapiens
ttgtcccggatttttgtta

SEQ ID NO: 2672389 - DNA, 22 bp, Homo sapiens
ttgtgccaacctattttgaagt

SEQ ID NO: 2672390 - DNA, 21 bp, Homo sapiens
ttgtgtatttaacagggaggg

SEQ ID NO: 2672391 - DNA, 19 bp, Homo sapiens
ttgtgtgtgctctgcttca

SEQ ID NO: 2672392 - DNA, 13 bp, Homo sapiens
ttgtgttctttgt

SEQ ID NO: 2672393 - DNA, 19 bp, Homo sapiens
ttgttaatggtttgaatat

SEQ ID NO: 2672394 - DNA, 13 bp, Homo sapiens
ttgttatctggga

SEQ ID NO: 2672395 - DNA, 21 bp, Homo sapiens
ttgttctctgggagaaaatca

SEQ ID NO: 2672396 - DNA, 13 bp, Homo sapiens
ttgttctttttat

SEQ ID NO: 2672397 - DNA, 19 bp, Homo sapiens
ttgtttattagttttgcat

SEQ ID NO: 2672398 - DNA, 21 bp, Homo sapiens
tttaaccccgtcaacaaatct

SEQ ID NO: 2672399 - DNA, 24 bp, Homo sapiens
tttaactcaatattttccatgaaa

SEQ ID NO: 2672400 - DNA, 18 bp, Homo sapiens
tttaactcctcaattcca

SEQ ID NO: 2672401 - DNA, 15 bp, Homo sapiens
tttaagtaactttaa

SEQ ID NO: 2672402 - DNA, 13 bp, Homo sapiens
tttaattaaataa

SEQ ID NO: 2672403 - DNA, 13 bp, Homo sapiens
tttaatttaaagc

SEQ ID NO: 2672404 - DNA, 15 bp, Homo sapiens
tttacaagccccccc

SEQ ID NO: 2672405 - DNA, 21 bp, Homo sapiens
tttacaagcccccccttccac

SEQ ID NO: 2672406 - DNA, 17 bp, Homo sapiens
tttacggacaccccctc

SEQ ID NO: 2672407 - DNA, 20 bp, Homo sapiens
tttatgccttttatttctta

SEQ ID NO: 2672408 - DNA, 14 bp, Homo sapiens
tttatgtacaggat

SEQ ID NO: 2672409 - DNA, 14 bp, Homo sapiens
tttcagcattgata

SEQ ID NO: 2672410 - DNA, 15 bp, Homo sapiens
tttcagcattgatat

SEQ ID NO: 2672411 - DNA, 17 bp, Homo sapiens
tttcagtgaaagcatca

SEQ ID NO: 2672412 - DNA, 12 bp, Homo sapiens
tttcataatctt

SEQ ID NO: 2672413 - DNA, 22 bp, Homo sapiens
tttcattggaaattaggatgta

SEQ ID NO: 2672414 - DNA, 22 bp, Homo sapiens
tttcccccaccccatttctctc

SEQ ID NO: 2672415 - DNA, 15 bp, Homo sapiens
tttcccttgaggaaa

SEQ ID NO: 2672416 - DNA, 17 bp, Homo sapiens
tttcctcttcctgccta

SEQ ID NO: 2672417 - DNA, 15 bp, Homo sapiens
tttctaaacagagat

SEQ ID NO: 2672418 - DNA, 23 bp, Homo sapiens
tttctccatattagatttaccca

SEQ ID NO: 2672419 - DNA, 23 bp, Homo sapiens
tttcttatcacaaaaaagaaaat

SEQ ID NO: 2672420 - DNA, 23 bp, Homo sapiens
tttcttcacctctgctactcaag

SEQ ID NO: 2672421 - DNA, 16 bp, Homo sapiens
tttctttcacaaaaaa

SEQ ID NO: 2672422 - DNA, 20 bp, Homo sapiens
tttgaaaaagaaaacactta

SEQ ID NO: 2672423 - DNA, 17 bp, Homo sapiens
tttgaatataaacacta

SEQ ID NO: 2672424 - DNA, 16 bp, Homo sapiens
tttgagcatgggttca

SEQ ID NO: 2672425 - DNA, 18 bp, Homo sapiens
tttgatagtattgtgcat

SEQ ID NO: 2672426 - DNA, 18 bp, Homo sapiens
tttgatcttcaacaaatt

SEQ ID NO: 2672427 - DNA, 12 bp, Homo sapiens
tttgcaaggaag

SEQ ID NO: 2672428 - DNA, 15 bp, Homo sapiens
tttgccaagaccttt

SEQ ID NO: 2672429 - DNA, 22 bp, Homo sapiens
tttgctaactagcttggaaact

SEQ ID NO: 2672430 - DNA, 16 bp, Homo sapiens
tttgcttctctctcta

SEQ ID NO: 2672431 - DNA, 16 bp, Homo sapiens
tttggactgttttgtt

SEQ ID NO: 2672432 - DNA, 13 bp, Homo sapiens
tttggcagagttc

SEQ ID NO: 2672433 - DNA, 18 bp, Homo sapiens
tttggttaaaaaaaagaa

SEQ ID NO: 2672434 - DNA, 13 bp, Homo sapiens
tttgtgcattttc

SEQ ID NO: 2672435 - DNA, 13 bp, Homo sapiens
tttgtgttctttg

SEQ ID NO: 2672436 - DNA, 13 bp, Homo sapiens
tttgttctctggg

SEQ ID NO: 2672437 - DNA, 13 bp, Homo sapiens
tttgtttgtgcat

SEQ ID NO: 2672438 - DNA, 15 bp, Homo sapiens
tttgtttgttttcct

SEQ ID NO: 2672439 - DNA, 22 bp, Homo sapiens
ttttaaaagttactccttttag

SEQ ID NO: 2672440 - DNA, 18 bp, Homo sapiens
ttttaaccccgtcaacaa

SEQ ID NO: 2672441 - DNA, 21 bp, Homo sapiens
ttttaaccccgtcaacaaatc

SEQ ID NO: 2672442 - DNA, 13 bp, Homo sapiens
ttttaactcaata

SEQ ID NO: 2672443 - DNA, 19 bp, Homo sapiens
ttttaagacgtgtttgtgt

SEQ ID NO: 2672444 - DNA, 14 bp, Homo sapiens
ttttaccttcactg

SEQ ID NO: 2672445 - DNA, 19 bp, Homo sapiens
ttttactgaagcctttctt

SEQ ID NO: 2672446 - DNA, 14 bp, Homo sapiens
ttttataagaaaaa

SEQ ID NO: 2672447 - DNA, 16 bp, Homo sapiens
ttttataagaaaaact

SEQ ID NO: 2672448 - DNA, 19 bp, Homo sapiens
ttttattgaatctatttaa

SEQ ID NO: 2672449 - DNA, 16 bp, Homo sapiens
ttttcatatttgcact

SEQ ID NO: 2672450 - DNA, 18 bp, Homo sapiens
ttttcattgaacagcaaa

SEQ ID NO: 2672451 - DNA, 18 bp, Homo sapiens
ttttcccagctacacctt

SEQ ID NO: 2672452 - DNA, 15 bp, Homo sapiens
ttttctactgtttta

SEQ ID NO: 2672453 - DNA, 15 bp, Homo sapiens
ttttcttcactgtcc

SEQ ID NO: 2672454 - DNA, 19 bp, Homo sapiens
ttttggttaagctttgaca

SEQ ID NO: 2672455 - DNA, 14 bp, Homo sapiens
ttttgtaatttaaa

SEQ ID NO: 2672456 - DNA, 17 bp, Homo sapiens
ttttgttctctgggaga

SEQ ID NO: 2672457 - DNA, 18 bp, Homo sapiens
tttttaaaaactaaaaaa

SEQ ID NO: 2672458 - DNA, 22 bp, Homo sapiens
tttttacgtttgaagacattgc

SEQ ID NO: 2672459 - DNA, 15 bp, Homo sapiens
tttttccttctctgg

SEQ ID NO: 2672460 - DNA, 12 bp, Homo sapiens
ttttttaaaaaa

SEQ ID NO: 2672461 - DNA, 19 bp, Homo sapiens
aaaaaagattgtattgctg

SEQ ID NO: 2672462 - DNA, 18 bp, Homo sapiens
aaaaagattgtattgctg

SEQ ID NO: 2672463 - DNA, 17 bp, Homo sapiens
aaaaatacaaaaatttg

SEQ ID NO: 2672464 - DNA, 17 bp, Homo sapiens
aaaaatagcaacttgtg

SEQ ID NO: 2672465 - DNA, 17 bp, Homo sapiens
aaaacaatattgtttct

SEQ ID NO: 2672466 - DNA, 21 bp, Homo sapiens
aaaacatccagatacacccaa

SEQ ID NO: 2672467 - DNA, 15 bp, Homo sapiens
aaaagattgtattgc

SEQ ID NO: 2672468 - DNA, 15 bp, Homo sapiens
aaaataaaaaatgtg

SEQ ID NO: 2672469 - DNA, 24 bp, Homo sapiens
aaaatacctcaggaaagaatagaa

SEQ ID NO: 2672470 - DNA, 12 bp, Homo sapiens
aaaatgcaatat

SEQ ID NO: 2672471 - DNA, 16 bp, Homo sapiens
aaaatggaggtggaaa

SEQ ID NO: 2672472 - DNA, 16 bp, Homo sapiens
aaaatgtgtgtattct

SEQ ID NO: 2672473 - DNA, 16 bp, Homo sapiens
gctctcctgactttta

SEQ ID NO: 2672474 - DNA, 17 bp, Homo sapiens
gctgatatatgtgtttt

SEQ ID NO: 2672475 - DNA, 18 bp, Homo sapiens
gctgtccttgaatgccat

SEQ ID NO: 2672476 - DNA, 21 bp, Homo sapiens
gctgtgcacccagaagaagat

SEQ ID NO: 2672477 - DNA, 17 bp, Homo sapiens
gcttcttttctttgtat

SEQ ID NO: 2672478 - DNA, 20 bp, Homo sapiens
ggaaataataaagatgctct

SEQ ID NO: 2672479 - DNA, 20 bp, Homo sapiens
ggagctgttctctgtcgtga

SEQ ID NO: 2672480 - DNA, 20 bp, Homo sapiens
ggaggcggagcttgcagtga

SEQ ID NO: 2672481 - DNA, 20 bp, Homo sapiens
ggaggtggaggctgcagtga

SEQ ID NO: 2672482 - DNA, 13 bp, Homo sapiens
ggataaagcagct

SEQ ID NO: 2672483 - DNA, 21 bp, Homo sapiens
ggatctggtagggggaaaatg

SEQ ID NO: 2672484 - DNA, 20 bp, Homo sapiens
ggatggccgcagggctgtgc

SEQ ID NO: 2672485 - DNA, 23 bp, Homo sapiens
ggcaagagaatcgcttgaaccca

SEQ ID NO: 2672486 - DNA, 16 bp, Homo sapiens
ggcaccaaagccacca

SEQ ID NO: 2672487 - DNA, 14 bp, Homo sapiens
ggccattaggaaac

SEQ ID NO: 2672488 - DNA, 20 bp, Homo sapiens
ggcgacagagcgagactccg

SEQ ID NO: 2672489 - DNA, 15 bp, Homo sapiens
ggctggacgtggtgg

SEQ ID NO: 2672490 - DNA, 18 bp, Homo sapiens
ggcttcttttctttgtat

SEQ ID NO: 2672491 - DNA, 13 bp, Homo sapiens
ggtaaatttctgt

SEQ ID NO: 2672492 - DNA, 18 bp, Homo sapiens
ggtatatatccgcctggc

SEQ ID NO: 2672493 - DNA, 21 bp, Homo sapiens
ggtcctttgggaaaggagaag

SEQ ID NO: 2672494 - DNA, 19 bp, Homo sapiens
ggtggcgggtgcctgtaat

SEQ ID NO: 2672495 - DNA, 19 bp, Homo sapiens
ggtggctcacacctgtaat

SEQ ID NO: 2672496 - DNA, 15 bp, Homo sapiens
ggttgcactttgtag

SEQ ID NO: 2672497 - DNA, 13 bp, Homo sapiens
ggtttaatattac

SEQ ID NO: 2672498 - DNA, 18 bp, Homo sapiens
gtaactgcattgagaact

SEQ ID NO: 2672499 - DNA, 12 bp, Homo sapiens
gtaatataaaag

SEQ ID NO: 2672500 - DNA, 17 bp, Homo sapiens
gtacaagtcagtttcta

SEQ ID NO: 2672501 - DNA, 12 bp, Homo sapiens
gtagtcccagct

SEQ ID NO: 2672502 - DNA, 13 bp, Homo sapiens
gtatagttgcttt

SEQ ID NO: 2672503 - DNA, 14 bp, Homo sapiens
gtcacatacaatta

SEQ ID NO: 2672504 - DNA, 13 bp, Homo sapiens
gtcactgtttctc

SEQ ID NO: 2672505 - DNA, 16 bp, Homo sapiens
gtcatatgttaagcag

SEQ ID NO: 2672506 - DNA, 13 bp, Homo sapiens
gtcctatgcaata

SEQ ID NO: 2672507 - DNA, 14 bp, Homo sapiens
gtcctatgcaataa

SEQ ID NO: 2672508 - DNA, 16 bp, Homo sapiens
gtcctatgcaataaaa

SEQ ID NO: 2672509 - DNA, 13 bp, Homo sapiens
gtctttaaatcat

SEQ ID NO: 2672510 - DNA, 22 bp, Homo sapiens
gtgctttccgtggcactgcata

SEQ ID NO: 2672511 - DNA, 18 bp, Homo sapiens
gtgtaactggcagttttc

SEQ ID NO: 2672512 - DNA, 22 bp, Homo sapiens
gtgtgtattcttaaaatgcaat

SEQ ID NO: 2672513 - DNA, 21 bp, Homo sapiens
gttacagcacaaaatgatggc

SEQ ID NO: 2672514 - DNA, 11 bp, Homo sapiens
gttactctgaa

SEQ ID NO: 2672515 - DNA, 22 bp, Homo sapiens
gttgatagcaagtgaatttttc

SEQ ID NO: 2672516 - DNA, 23 bp, Homo sapiens
gttgatagcaagtgaatttttct

SEQ ID NO: 2672517 - DNA, 18 bp, Homo sapiens
gttgccaaacagccacac

SEQ ID NO: 2672518 - DNA, 20 bp, Homo sapiens
gttgctggttataagcagca

SEQ ID NO: 2672519 - DNA, 11 bp, Homo sapiens
gttgctttgtt

SEQ ID NO: 2672520 - DNA, 18 bp, Homo sapiens
gttggttgcactttgtag

SEQ ID NO: 2672521 - DNA, 22 bp, Homo sapiens
gtttcggccttcataatggcct

SEQ ID NO: 2672522 - DNA, 15 bp, Homo sapiens
gtttctctgctgttg

SEQ ID NO: 2672523 - DNA, 22 bp, Homo sapiens
gtttgtcctgatgcttttgtct

SEQ ID NO: 2672524 - DNA, 22 bp, Homo sapiens
gttttcataataaaactttaaa

SEQ ID NO: 2672525 - DNA, 18 bp, Homo sapiens
taaaaaaaaaaagattgt

SEQ ID NO: 2672526 - DNA, 19 bp, Homo sapiens
taaaaaaaaaaagattgta

SEQ ID NO: 2672527 - DNA, 22 bp, Homo sapiens
taaaaacaaaaacatcccaaga

SEQ ID NO: 2672528 - DNA, 18 bp, Homo sapiens
taaaacaatattgtttct

SEQ ID NO: 2672529 - DNA, 19 bp, Homo sapiens
taaaagagacaaactgtaa

SEQ ID NO: 2672530 - DNA, 18 bp, Homo sapiens
taaaatggtttgtcctga

SEQ ID NO: 2672531 - DNA, 14 bp, Homo sapiens
taaaattatttgca

SEQ ID NO: 2672532 - DNA, 14 bp, Homo sapiens
taaagatttcttga

SEQ ID NO: 2672533 - DNA, 22 bp, Homo sapiens
taaagtgaattgttgacaaatg

SEQ ID NO: 2672534 - DNA, 17 bp, Homo sapiens
taaatcattttaggaaa

SEQ ID NO: 2672535 - DNA, 19 bp, Homo sapiens
taaatcattttaggaaagg

SEQ ID NO: 2672536 - DNA, 15 bp, Homo sapiens
taaattttaatttat

SEQ ID NO: 2672537 - DNA, 16 bp, Homo sapiens
taacctgcaaaatctg

SEQ ID NO: 2672538 - DNA, 20 bp, Homo sapiens
taactgagtagctctcctga

SEQ ID NO: 2672539 - DNA, 23 bp, Homo sapiens
taactgagtagctctcctgactt

SEQ ID NO: 2672540 - DNA, 23 bp, Homo sapiens
taagcaacatctagcaaatgtta

SEQ ID NO: 2672541 - DNA, 17 bp, Homo sapiens
taagcagctaaattttc

SEQ ID NO: 2672542 - DNA, 17 bp, Homo sapiens
taagtttcagttgattt

SEQ ID NO: 2672543 - DNA, 17 bp, Homo sapiens
taataaagatgctcttt

SEQ ID NO: 2672544 - DNA, 16 bp, Homo sapiens
taatataaaagatctt

SEQ ID NO: 2672545 - DNA, 20 bp, Homo sapiens
taatataaaagatcttgcag

SEQ ID NO: 2672546 - DNA, 15 bp, Homo sapiens
taatatcaatagaag

SEQ ID NO: 2672547 - DNA, 12 bp, Homo sapiens
taatatgagaat

SEQ ID NO: 2672548 - DNA, 22 bp, Homo sapiens
taatattacctaatgaaagtga

SEQ ID NO: 2672549 - DNA, 19 bp, Homo sapiens
taatgaaagtgatgacata

SEQ ID NO: 2672550 - DNA, 22 bp, Homo sapiens
taattgcagataactttgactt

SEQ ID NO: 2672551 - DNA, 23 bp, Homo sapiens
taattgcagataactttgacttt

SEQ ID NO: 2672552 - DNA, 18 bp, Homo sapiens
tacaagtcagtttctaca

SEQ ID NO: 2672553 - DNA, 13 bp, Homo sapiens
tacaataaaagta

SEQ ID NO: 2672554 - DNA, 18 bp, Homo sapiens
tacaattatttttacagt

SEQ ID NO: 2672555 - DNA, 13 bp, Homo sapiens
tacatactgctgt

SEQ ID NO: 2672556 - DNA, 12 bp, Homo sapiens
tacctcaggaaa

SEQ ID NO: 2672557 - DNA, 13 bp, Homo sapiens
tacctgtgaaata

SEQ ID NO: 2672558 - DNA, 19 bp, Homo sapiens
tactctgaagggcatcatg

SEQ ID NO: 2672559 - DNA, 17 bp, Homo sapiens
tactgaaggtaaaattg

SEQ ID NO: 2672560 - DNA, 22 bp, Homo sapiens
tacttgcagctcccattctatg

SEQ ID NO: 2672561 - DNA, 21 bp, Homo sapiens
tagaaggatgtacatttccaa

SEQ ID NO: 2672562 - DNA, 17 bp, Homo sapiens
tagaataatcttgctca

SEQ ID NO: 2672563 - DNA, 23 bp, Homo sapiens
tagatgtagataaactcagaaat

SEQ ID NO: 2672564 - DNA, 18 bp, Homo sapiens
tagattaagagatgggtt

SEQ ID NO: 2672565 - DNA, 16 bp, Homo sapiens
tataacttcaaatttt

SEQ ID NO: 2672566 - DNA, 14 bp, Homo sapiens
tatatagctggcaa

SEQ ID NO: 2672567 - DNA, 20 bp, Homo sapiens
tatatagctggcaagaatgg

SEQ ID NO: 2672568 - DNA, 14 bp, Homo sapiens
tatatctggaatga

SEQ ID NO: 2672569 - DNA, 17 bp, Homo sapiens
tatatgagaagaatagc

SEQ ID NO: 2672570 - DNA, 18 bp, Homo sapiens
tatcactgacacaaaaag

SEQ ID NO: 2672571 - DNA, 15 bp, Homo sapiens
tatcatgcaaatgct

SEQ ID NO: 2672572 - DNA, 13 bp, Homo sapiens
tatcattcatctt

SEQ ID NO: 2672573 - DNA, 14 bp, Homo sapiens
tatcttgtttttcc

SEQ ID NO: 2672574 - DNA, 18 bp, Homo sapiens
tatcttgtttttccacta

SEQ ID NO: 2672575 - DNA, 21 bp, Homo sapiens
tatgcaataaaattatttgca

SEQ ID NO: 2672576 - DNA, 14 bp, Homo sapiens
tatgtaactgcatt

SEQ ID NO: 2672577 - DNA, 24 bp, Homo sapiens
tatgtaactgcattgagaactgca

SEQ ID NO: 2672578 - DNA, 16 bp, Homo sapiens
tatgtgtttttcacat

SEQ ID NO: 2672579 - DNA, 14 bp, Homo sapiens
tattagctttactg

SEQ ID NO: 2672580 - DNA, 12 bp, Homo sapiens
tattagttgctt

SEQ ID NO: 2672581 - DNA, 22 bp, Homo sapiens
tattatcatgcaaatgctgtat

SEQ ID NO: 2672582 - DNA, 15 bp, Homo sapiens
tattcttaaaatgca

SEQ ID NO: 2672583 - DNA, 18 bp, Homo sapiens
tatttaaagacaaagaca

SEQ ID NO: 2672584 - DNA, 20 bp, Homo sapiens
tatttaagcaacatcttttt

SEQ ID NO: 2672585 - DNA, 21 bp, Homo sapiens
tatttaagcaacatcttttta

SEQ ID NO: 2672586 - DNA, 18 bp, Homo sapiens
tatttagggaactgcttg

SEQ ID NO: 2672587 - DNA, 22 bp, Homo sapiens
tatttgcaggtctttaaatcat

SEQ ID NO: 2672588 - DNA, 23 bp, Homo sapiens
tatttgtaaggcttgttccaatg

SEQ ID NO: 2672589 - DNA, 12 bp, Homo sapiens
tcaaaatgcttc

SEQ ID NO: 2672590 - DNA, 13 bp, Homo sapiens
tcaacaagcctga

SEQ ID NO: 2672591 - DNA, 20 bp, Homo sapiens
tcaatagtgtcctatgcaat

SEQ ID NO: 2672592 - DNA, 13 bp, Homo sapiens
tcacagtgtgttt

SEQ ID NO: 2672593 - DNA, 18 bp, Homo sapiens
tcacatcctgtgtttcta

SEQ ID NO: 2672594 - DNA, 19 bp, Homo sapiens
tcacatcctgtgtttctag

SEQ ID NO: 2672595 - DNA, 21 bp, Homo sapiens
tcacctgagcccggatgcttc

SEQ ID NO: 2672596 - DNA, 23 bp, Homo sapiens
tcacctgagcccggatgcttctc

SEQ ID NO: 2672597 - DNA, 14 bp, Homo sapiens
tcactccagcctgg

SEQ ID NO: 2672598 - DNA, 18 bp, Homo sapiens
tcactgtttctctgctgt

SEQ ID NO: 2672599 - DNA, 22 bp, Homo sapiens
tcacttaacattcctaaaatgc

SEQ ID NO: 2672600 - DNA, 22 bp, Homo sapiens
tcagaaacatcagttactctga

SEQ ID NO: 2672601 - DNA, 14 bp, Homo sapiens
tcagaaatttaatt

SEQ ID NO: 2672602 - DNA, 21 bp, Homo sapiens
tcagaaatttaattcatgttt

SEQ ID NO: 2672603 - DNA, 23 bp, Homo sapiens
tcaggaaagaatagaaagaaagt

SEQ ID NO: 2672604 - DNA, 19 bp, Homo sapiens
tcaggacgagaatgagggt

SEQ ID NO: 2672605 - DNA, 20 bp, Homo sapiens
tcagtggttatttagggaac

SEQ ID NO: 2672606 - DNA, 12 bp, Homo sapiens
tcagtttctaca

SEQ ID NO: 2672607 - DNA, 16 bp, Homo sapiens
tcatcttcttctttaa

SEQ ID NO: 2672608 - DNA, 22 bp, Homo sapiens
tcatgtaaacataccaacatgt

SEQ ID NO: 2672609 - DNA, 20 bp, Homo sapiens
tccttcacatcctgtgtttc

SEQ ID NO: 2672610 - DNA, 13 bp, Homo sapiens
tcctttttgttat

SEQ ID NO: 2672611 - DNA, 14 bp, Homo sapiens
tcgagactgcaatg

SEQ ID NO: 2672612 - DNA, 19 bp, Homo sapiens
tcgctgatatatgtgtttt

SEQ ID NO: 2672613 - DNA, 22 bp, Homo sapiens
tcgctgatatatgtgtttttca

SEQ ID NO: 2672614 - DNA, 17 bp, Homo sapiens
tcgtgaagtatactgta

SEQ ID NO: 2672615 - DNA, 21 bp, Homo sapiens
tctaatgacatgcctatatga

SEQ ID NO: 2672616 - DNA, 23 bp, Homo sapiens
tctactgtgtaatataaaagatc

SEQ ID NO: 2672617 - DNA, 13 bp, Homo sapiens
tctagggaaatga

SEQ ID NO: 2672618 - DNA, 17 bp, Homo sapiens
tctcctccatactcagg

SEQ ID NO: 2672619 - DNA, 22 bp, Homo sapiens
tctgaagagtgggtttcacaag

SEQ ID NO: 2672620 - DNA, 18 bp, Homo sapiens
tctggcgacagttttcct

SEQ ID NO: 2672621 - DNA, 14 bp, Homo sapiens
tcttaaaatgcaat

SEQ ID NO: 2672622 - DNA, 16 bp, Homo sapiens
tcttaaaatgcaatat

SEQ ID NO: 2672623 - DNA, 12 bp, Homo sapiens
tcttaagcttcc

SEQ ID NO: 2672624 - DNA, 19 bp, Homo sapiens
tcttcccttttacatactg

SEQ ID NO: 2672625 - DNA, 21 bp, Homo sapiens
tcttcccttttacatactgct

SEQ ID NO: 2672626 - DNA, 22 bp, Homo sapiens
tcttcccttttacatactgctg

SEQ ID NO: 2672627 - DNA, 16 bp, Homo sapiens
tcttctgaatatttta

SEQ ID NO: 2672628 - DNA, 21 bp, Homo sapiens
tcttgagttttgttttaaaat

SEQ ID NO: 2672629 - DNA, 17 bp, Homo sapiens
tctttgtatcattcatc

SEQ ID NO: 2672630 - DNA, 13 bp, Homo sapiens
tcttttctttgta

SEQ ID NO: 2672631 - DNA, 17 bp, Homo sapiens
tcttttctttgtatcat

SEQ ID NO: 2672632 - DNA, 18 bp, Homo sapiens
tgaaaaatcggcttacca

SEQ ID NO: 2672633 - DNA, 19 bp, Homo sapiens
tgaaaggcattctctgaag

SEQ ID NO: 2672634 - DNA, 15 bp, Homo sapiens
tgaaagtgatgacat

SEQ ID NO: 2672635 - DNA, 22 bp, Homo sapiens
tgaaattaaccatagatgtaga

SEQ ID NO: 2672636 - DNA, 20 bp, Homo sapiens
tgaactgaaggcagcatgta

SEQ ID NO: 2672637 - DNA, 16 bp, Homo sapiens
tgaatatatggcattt

SEQ ID NO: 2672638 - DNA, 23 bp, Homo sapiens
tgaatatatttaagcaacatctt

SEQ ID NO: 2672639 - DNA, 20 bp, Homo sapiens
tgaatattttatctttcctt

SEQ ID NO: 2672640 - DNA, 17 bp, Homo sapiens
tgacaaatgtaaacatt

SEQ ID NO: 2672641 - DNA, 23 bp, Homo sapiens
tgacaaatgtgtatcggatgctt

SEQ ID NO: 2672642 - DNA, 17 bp, Homo sapiens
tgagaactgcatatgtt

SEQ ID NO: 2672643 - DNA, 20 bp, Homo sapiens
tgagaactgcatatgtttcg

SEQ ID NO: 2672644 - DNA, 14 bp, Homo sapiens
tgagactttctttc

SEQ ID NO: 2672645 - DNA, 18 bp, Homo sapiens
tgagtggatgatgtttcg

SEQ ID NO: 2672646 - DNA, 20 bp, Homo sapiens
tgagttttgttttaaaatta

SEQ ID NO: 2672647 - DNA, 21 bp, Homo sapiens
tgatatatgtgtttttcacat

SEQ ID NO: 2672648 - DNA, 16 bp, Homo sapiens
tgatcaaaaataatgc

SEQ ID NO: 2672649 - DNA, 17 bp, Homo sapiens
tgattccctcctgctac

SEQ ID NO: 2672650 - DNA, 15 bp, Homo sapiens
tgcaaatgctgtatt

SEQ ID NO: 2672651 - DNA, 14 bp, Homo sapiens
tgcaacctgttgat

SEQ ID NO: 2672652 - DNA, 18 bp, Homo sapiens
tgcactttgtagtgtttg

SEQ ID NO: 2672653 - DNA, 20 bp, Homo sapiens
tgcagaagttcttagtgttg

SEQ ID NO: 2672654 - DNA, 17 bp, Homo sapiens
tgcataaagtcagtgcc

SEQ ID NO: 2672655 - DNA, 18 bp, Homo sapiens
tgcataagtgaaaatctt

SEQ ID NO: 2672656 - DNA, 22 bp, Homo sapiens
tgcatcttactgaaggtaaaat

SEQ ID NO: 2672657 - DNA, 20 bp, Homo sapiens
tgccacttcactccagcctg

SEQ ID NO: 2672658 - DNA, 16 bp, Homo sapiens
tgctactctgttcctt

SEQ ID NO: 2672659 - DNA, 18 bp, Homo sapiens
tgctcttgtcctagcttg

SEQ ID NO: 2672660 - DNA, 19 bp, Homo sapiens
tgctcttgtcctagcttgg

SEQ ID NO: 2672661 - DNA, 14 bp, Homo sapiens
tgctgatccttgca

SEQ ID NO: 2672662 - DNA, 14 bp, Homo sapiens
tggatgatgtttcg

SEQ ID NO: 2672663 - DNA, 19 bp, Homo sapiens
tggcactgcatacaatctg

SEQ ID NO: 2672664 - DNA, 17 bp, Homo sapiens
tggcatttgcagatttt

SEQ ID NO: 2672665 - DNA, 19 bp, Homo sapiens
tggcatttgcagattttta

SEQ ID NO: 2672666 - DNA, 21 bp, Homo sapiens
tgggagaattcttacatgttt

SEQ ID NO: 2672667 - DNA, 14 bp, Homo sapiens
tgggaggcttcccc

SEQ ID NO: 2672668 - DNA, 16 bp, Homo sapiens
tgggctactttgtcct

SEQ ID NO: 2672669 - DNA, 22 bp, Homo sapiens
tgggtttcacaagtgaaaaaca

SEQ ID NO: 2672670 - DNA, 18 bp, Homo sapiens
tggtgctcatttaaatat

SEQ ID NO: 2672671 - DNA, 15 bp, Homo sapiens
tgtactttttccaga

SEQ ID NO: 2672672 - DNA, 14 bp, Homo sapiens
tgtatagttgcttt

SEQ ID NO: 2672673 - DNA, 17 bp, Homo sapiens
tgtcactgtttctctgc

SEQ ID NO: 2672674 - DNA, 18 bp, Homo sapiens
tgtcactgtttctctgct

SEQ ID NO: 2672675 - DNA, 13 bp, Homo sapiens
tgtcatttgttaa

SEQ ID NO: 2672676 - DNA, 23 bp, Homo sapiens
tgtcccctatggggatggtccac

SEQ ID NO: 2672677 - DNA, 23 bp, Homo sapiens
tgtgtattcttaaaatgcaatat

SEQ ID NO: 2672678 - DNA, 20 bp, Homo sapiens
tgtgtcatcaatagtgtcct

SEQ ID NO: 2672679 - DNA, 17 bp, Homo sapiens
tgtgttttcataataaa

SEQ ID NO: 2672680 - DNA, 21 bp, Homo sapiens
tgttccaatgccacatacttg

SEQ ID NO: 2672681 - DNA, 18 bp, Homo sapiens
tgttccttcacatcctgt

SEQ ID NO: 2672682 - DNA, 20 bp, Homo sapiens
tgttggataaatcagtggtt

SEQ ID NO: 2672683 - DNA, 19 bp, Homo sapiens
tgtttcgtgaagtatactg

SEQ ID NO: 2672684 - DNA, 15 bp, Homo sapiens
tgtttctagggaaat

SEQ ID NO: 2672685 - DNA, 12 bp, Homo sapiens
ttaaaatgcaat

SEQ ID NO: 2672686 - DNA, 13 bp, Homo sapiens
ttaaaatgcaata

SEQ ID NO: 2672687 - DNA, 19 bp, Homo sapiens
ttaaagctaaagtatctgt

SEQ ID NO: 2672688 - DNA, 15 bp, Homo sapiens
ttaaatataatatgc

SEQ ID NO: 2672689 - DNA, 13 bp, Homo sapiens
ttaaatcatttta

SEQ ID NO: 2672690 - DNA, 23 bp, Homo sapiens
ttaaatgggctactttgtccttt

SEQ ID NO: 2672691 - DNA, 16 bp, Homo sapiens
ttaaattttaatttat

SEQ ID NO: 2672692 - DNA, 22 bp, Homo sapiens
ttaatgaatcgtaatgaagttg

SEQ ID NO: 2672693 - DNA, 13 bp, Homo sapiens
ttaattcatgttt

SEQ ID NO: 2672694 - DNA, 14 bp, Homo sapiens
ttacaattgaaatg

SEQ ID NO: 2672695 - DNA, 15 bp, Homo sapiens
ttacaattgaaatga

SEQ ID NO: 2672696 - DNA, 14 bp, Homo sapiens
ttacatactgctgt

SEQ ID NO: 2672697 - DNA, 13 bp, Homo sapiens
ttacctgtgaaat

SEQ ID NO: 2672698 - DNA, 22 bp, Homo sapiens
ttactacagtttttaactctac

SEQ ID NO: 2672699 - DNA, 18 bp, Homo sapiens
ttactgaaggtaaaattg

SEQ ID NO: 2672700 - DNA, 19 bp, Homo sapiens
ttactgaaggtaaaattga

SEQ ID NO: 2672701 - DNA, 20 bp, Homo sapiens
ttactgaaggtaaaattgaa

SEQ ID NO: 2672702 - DNA, 15 bp, Homo sapiens
ttaggctattcacaa

SEQ ID NO: 2672703 - DNA, 16 bp, Homo sapiens
ttaggctattcacaac

SEQ ID NO: 2672704 - DNA, 19 bp, Homo sapiens
ttagtttttgtaatttatt

SEQ ID NO: 2672705 - DNA, 20 bp, Homo sapiens
ttatattagttgctttgtta

SEQ ID NO: 2672706 - DNA, 11 bp, Homo sapiens
ttatcatgcaa

SEQ ID NO: 2672707 - DNA, 16 bp, Homo sapiens
ttatcatgcaaatgct

SEQ ID NO: 2672708 - DNA, 17 bp, Homo sapiens
ttatgaggagctgcaga

SEQ ID NO: 2672709 - DNA, 17 bp, Homo sapiens
ttatttagggaactgct

SEQ ID NO: 2672710 - DNA, 13 bp, Homo sapiens
ttcactccagcct

SEQ ID NO: 2672711 - DNA, 12 bp, Homo sapiens
ttcatgtttctt

SEQ ID NO: 2672712 - DNA, 13 bp, Homo sapiens
ttcatgtttctta

SEQ ID NO: 2672713 - DNA, 15 bp, Homo sapiens
ttccctcctgctact

SEQ ID NO: 2672714 - DNA, 17 bp, Homo sapiens
ttcccttttacatactg

SEQ ID NO: 2672715 - DNA, 18 bp, Homo sapiens
ttcccttttacatactgc

SEQ ID NO: 2672716 - DNA, 21 bp, Homo sapiens
ttcgtgaagtatactgtattt

SEQ ID NO: 2672717 - DNA, 23 bp, Homo sapiens
ttctacactgggtgctgatcctt

SEQ ID NO: 2672718 - DNA, 23 bp, Homo sapiens
ttctctgaagagtgggtttcaca

SEQ ID NO: 2672719 - DNA, 22 bp, Homo sapiens
ttctgaatattttatctttcct

SEQ ID NO: 2672720 - DNA, 15 bp, Homo sapiens
ttctgctttcatctt

SEQ ID NO: 2672721 - DNA, 21 bp, Homo sapiens
ttcttaaaatgcaatatttgt

SEQ ID NO: 2672722 - DNA, 22 bp, Homo sapiens
ttcttaaaatgcaatatttgta

SEQ ID NO: 2672723 - DNA, 23 bp, Homo sapiens
ttcttaaaatgcaatatttgtaa

SEQ ID NO: 2672724 - DNA, 13 bp, Homo sapiens
ttcttacatgttt

SEQ ID NO: 2672725 - DNA, 14 bp, Homo sapiens
ttcttacatgtttt

SEQ ID NO: 2672726 - DNA, 22 bp, Homo sapiens
ttcttagtgttggtttaatatt

SEQ ID NO: 2672727 - DNA, 12 bp, Homo sapiens
ttctttgtatca

SEQ ID NO: 2672728 - DNA, 14 bp, Homo sapiens
ttcttttctttgta

SEQ ID NO: 2672729 - DNA, 15 bp, Homo sapiens
ttcttttctttgtat

SEQ ID NO: 2672730 - DNA, 16 bp, Homo sapiens
ttgaaggaatacaata

SEQ ID NO: 2672731 - DNA, 13 bp, Homo sapiens
ttgattttacaat

SEQ ID NO: 2672732 - DNA, 20 bp, Homo sapiens
ttgcacgcgccctttctacc

SEQ ID NO: 2672733 - DNA, 17 bp, Homo sapiens
ttgcagctcccattcta

SEQ ID NO: 2672734 - DNA, 17 bp, Homo sapiens
ttgcgaatggttccatt

SEQ ID NO: 2672735 - DNA, 17 bp, Homo sapiens
ttgcttccccttttgcc

SEQ ID NO: 2672736 - DNA, 22 bp, Homo sapiens
tttgactttcttctgaatattt

SEQ ID NO: 2672737 - DNA, 20 bp, Homo sapiens
tttgagtggatgatgtttcg

SEQ ID NO: 2672738 - DNA, 15 bp, Homo sapiens
tttgattctgtgtgt

SEQ ID NO: 2672739 - DNA, 21 bp, Homo sapiens
ttttaatttatttatactatt

SEQ ID NO: 2672740 - DNA, 14 bp, Homo sapiens
ttttacaattgaaa

SEQ ID NO: 2672741 - DNA, 21 bp, Homo sapiens
ttttcatcttctctggcgaca

SEQ ID NO: 2672742 - DNA, 15 bp, Homo sapiens
ttttccactactgct

SEQ ID NO: 2672743 - DNA, 16 bp, Homo sapiens
ttttccattggtttac

SEQ ID NO: 2672744 - DNA, 18 bp, Homo sapiens
ttttctttgtatcattca

SEQ ID NO: 2672745 - DNA, 20 bp, Homo sapiens
ttttctttgtatcattcatc

SEQ ID NO: 2672746 - DNA, 15 bp, Homo sapiens
ttttgtctaattaaa

SEQ ID NO: 2672747 - DNA, 15 bp, Homo sapiens
tttttaaaagagaca

SEQ ID NO: 2672748 - DNA, 13 bp, Homo sapiens
tttttgtaattta

SEQ ID NO: 2672749 - DNA, 18 bp, Homo sapiens
agatcttgcagaagttct

SEQ ID NO: 2672750 - DNA, 15 bp, Homo sapiens
agcagtacaataaaa

SEQ ID NO: 2672751 - DNA, 20 bp, Homo sapiens
agcattttccagcactttgc

SEQ ID NO: 2672752 - DNA, 21 bp, Homo sapiens
agccacactgtgggactcttc

SEQ ID NO: 2672753 - DNA, 13 bp, Homo sapiens
agccatcatggat

SEQ ID NO: 2672754 - DNA, 20 bp, Homo sapiens
agcctggccaacatggcgaa

SEQ ID NO: 2672755 - DNA, 19 bp, Homo sapiens
agcctgggtgacaaagcga

SEQ ID NO: 2672756 - DNA, 22 bp, Homo sapiens
agcctgttgggatcgcattgca

SEQ ID NO: 2672757 - DNA, 23 bp, Homo sapiens
agccttgggaacatgcgtgtgac

SEQ ID NO: 2672758 - DNA, 15 bp, Homo sapiens
agcgaacaaccacag

SEQ ID NO: 2672759 - DNA, 13 bp, Homo sapiens
agcgggcgcctgt

SEQ ID NO: 2672760 - DNA, 13 bp, Homo sapiens
agctcccattcta

SEQ ID NO: 2672761 - DNA, 14 bp, Homo sapiens
aaaaatagcaactt

SEQ ID NO: 2672762 - DNA, 15 bp, Homo sapiens
aaaaatagcaacttg

SEQ ID NO: 2672763 - DNA, 22 bp, Homo sapiens
aaaaatgtgtgtattcttaaaa

SEQ ID NO: 2672764 - DNA, 15 bp, Homo sapiens
aaaacaatattgttt

SEQ ID NO: 2672765 - DNA, 18 bp, Homo sapiens
aaaacaatattgtttcta

SEQ ID NO: 2672766 - DNA, 17 bp, Homo sapiens
aaaagattgtattgctg

SEQ ID NO: 2672767 - DNA, 14 bp, Homo sapiens
aaaagttgaaatta

SEQ ID NO: 2672768 - DNA, 17 bp, Homo sapiens
aaaatacaaaaatttgc

SEQ ID NO: 2672769 - DNA, 20 bp, Homo sapiens
aaaatggaagccaacacatc

SEQ ID NO: 2672770 - DNA, 22 bp, Homo sapiens
aaacatcagttactctgaaggg

SEQ ID NO: 2672771 - DNA, 15 bp, Homo sapiens
aaaccacaaaaaaat

SEQ ID NO: 2672772 - DNA, 21 bp, Homo sapiens
aaactgtaaaaaatgtgtgta

SEQ ID NO: 2672773 - DNA, 19 bp, Homo sapiens
aaagaagacaacattaaaa

SEQ ID NO: 2672774 - DNA, 22 bp, Homo sapiens
aaagacaaattctgtttcttga

SEQ ID NO: 2672775 - DNA, 22 bp, Homo sapiens
aaagagacaaactgtaaaaaat

SEQ ID NO: 2672776 - DNA, 14 bp, Homo sapiens
aaagtaaaccacaa

SEQ ID NO: 2672777 - DNA, 15 bp, Homo sapiens
aaagtgatgacatat

SEQ ID NO: 2672778 - DNA, 21 bp, Homo sapiens
aaatacctcaggaaagaatag

SEQ ID NO: 2672779 - DNA, 10 bp, Homo sapiens
aaatatctga

SEQ ID NO: 2672780 - DNA, 19 bp, Homo sapiens
aaatatctgaacatttact

SEQ ID NO: 2672781 - DNA, 18 bp, Homo sapiens
aaatgcttcactgtacgt

SEQ ID NO: 2672782 - DNA, 19 bp, Homo sapiens
aaatgcttcactgtacgta

SEQ ID NO: 2672783 - DNA, 18 bp, Homo sapiens
aaatgtgtgtattcttaa

SEQ ID NO: 2672784 - DNA, 21 bp, Homo sapiens
cctcaggaaagaatagaaaga

SEQ ID NO: 2672785 - DNA, 15 bp, Homo sapiens
cctcctgctactctg

SEQ ID NO: 2672786 - DNA, 14 bp, Homo sapiens
cctctagaggcaag

SEQ ID NO: 2672787 - DNA, 12 bp, Homo sapiens
cctgtacttttt

SEQ ID NO: 2672788 - DNA, 17 bp, Homo sapiens
ccttttacatactgctg

SEQ ID NO: 2672789 - DNA, 12 bp, Homo sapiens
cgacctcggtgg

SEQ ID NO: 2672790 - DNA, 20 bp, Homo sapiens
cgcctgtaatcccagcactt

SEQ ID NO: 2672791 - DNA, 20 bp, Homo sapiens
cgcctgtagtcccagctact

SEQ ID NO: 2672792 - DNA, 13 bp, Homo sapiens
cgctgatatatgt

SEQ ID NO: 2672793 - DNA, 22 bp, Homo sapiens
cgggaggcggagcttgcagtga

SEQ ID NO: 2672794 - DNA, 17 bp, Homo sapiens
cgtctcaacccctcaca

SEQ ID NO: 2672795 - DNA, 19 bp, Homo sapiens
cgtgagtgtctcttgtcta

SEQ ID NO: 2672796 - DNA, 15 bp, Homo sapiens
ctaaattttctgaaa

SEQ ID NO: 2672797 - DNA, 13 bp, Homo sapiens
ctaagtttcagtt

SEQ ID NO: 2672798 - DNA, 20 bp, Homo sapiens
ctaatgaaagtgatgacata

SEQ ID NO: 2672799 - DNA, 14 bp, Homo sapiens
ctacagtttttcct

SEQ ID NO: 2672800 - DNA, 15 bp, Homo sapiens
ctactctgttccttc

SEQ ID NO: 2672801 - DNA, 19 bp, Homo sapiens
ctactctgttccttcacat

SEQ ID NO: 2672802 - DNA, 22 bp, Homo sapiens
ctactctgttccttcacatcct

SEQ ID NO: 2672803 - DNA, 17 bp, Homo sapiens
ctagaataatcttgctc

SEQ ID NO: 2672804 - DNA, 24 bp, Homo sapiens
ctagatatgaatatatggcatttg

SEQ ID NO: 2672805 - DNA, 22 bp, Homo sapiens
ctagcggagttccagcaaacaa

SEQ ID NO: 2672806 - DNA, 18 bp, Homo sapiens
ctatatgagaagaatagc

SEQ ID NO: 2672807 - DNA, 13 bp, Homo sapiens
ctatcctacccca

SEQ ID NO: 2672808 - DNA, 21 bp, Homo sapiens
ctatgtaactgcattgagaac

SEQ ID NO: 2672809 - DNA, 16 bp, Homo sapiens
ctattagccacaaaat

SEQ ID NO: 2672810 - DNA, 11 bp, Homo sapiens
ctattcacaac

SEQ ID NO: 2672811 - DNA, 20 bp, Homo sapiens
ctatttagtttttgtaattt

SEQ ID NO: 2672812 - DNA, 19 bp, Homo sapiens
ctcacaccgcgtctggtga

SEQ ID NO: 2672813 - DNA, 21 bp, Homo sapiens
ctcacaccgcgtctggtgaca

SEQ ID NO: 2672814 - DNA, 20 bp, Homo sapiens
ctcaggaaagaatagaaaga

SEQ ID NO: 2672815 - DNA, 12 bp, Homo sapiens
ctcatctgtgat

SEQ ID NO: 2672816 - DNA, 14 bp, Homo sapiens
ctcatttaaatatc

SEQ ID NO: 2672817 - DNA, 22 bp, Homo sapiens
ctctgaagggcatcatgcatct

SEQ ID NO: 2672818 - DNA, 22 bp, Homo sapiens
ctctgttccttcacatcctgtg

SEQ ID NO: 2672819 - DNA, 16 bp, Homo sapiens
ctgaatacattctgct

SEQ ID NO: 2672820 - DNA, 18 bp, Homo sapiens
ctgaatacattctgcttt

SEQ ID NO: 2672821 - DNA, 19 bp, Homo sapiens
ctgagactttctttctgta

SEQ ID NO: 2672822 - DNA, 21 bp, Homo sapiens
ctgatatatgtgtttttcaca

SEQ ID NO: 2672823 - DNA, 15 bp, Homo sapiens
ctgcaacctgttgat

SEQ ID NO: 2672824 - DNA, 18 bp, Homo sapiens
ctgcaatgtgatctatgt

SEQ ID NO: 2672825 - DNA, 18 bp, Homo sapiens
ctgctactctgttccttc

SEQ ID NO: 2672826 - DNA, 19 bp, Homo sapiens
ctggcgacagttttccttc

SEQ ID NO: 2672827 - DNA, 16 bp, Homo sapiens
ctggttataagcagca

SEQ ID NO: 2672828 - DNA, 13 bp, Homo sapiens
ctgtaatcccagc

SEQ ID NO: 2672829 - DNA, 22 bp, Homo sapiens
ctgtaatcccagctactcggga

SEQ ID NO: 2672830 - DNA, 19 bp, Homo sapiens
ctgtcactgtttctctgct

SEQ ID NO: 2672831 - DNA, 16 bp, Homo sapiens
ctgtcccttctcttaa

SEQ ID NO: 2672832 - DNA, 23 bp, Homo sapiens
ctgtgaccaggaaggaagtcagc

SEQ ID NO: 2672833 - DNA, 19 bp, Homo sapiens
ctgtgcacccagaagaaga

SEQ ID NO: 2672834 - DNA, 18 bp, Homo sapiens
ctgtgtgttttcataata

SEQ ID NO: 2672835 - DNA, 15 bp, Homo sapiens
ctgttctaacatgta

SEQ ID NO: 2672836 - DNA, 16 bp, Homo sapiens
ctgttctaacatgtaa

SEQ ID NO: 2672837 - DNA, 13 bp, Homo sapiens
ctgtttctctgct

SEQ ID NO: 2672838 - DNA, 20 bp, Homo sapiens
cttaaaatgcaatatttgta

SEQ ID NO: 2672839 - DNA, 22 bp, Homo sapiens
cttaaaatgcaatatttgtaag

SEQ ID NO: 2672840 - DNA, 16 bp, Homo sapiens
cttaaattttaattta

SEQ ID NO: 2672841 - DNA, 17 bp, Homo sapiens
cttaaattttaatttat

SEQ ID NO: 2672842 - DNA, 14 bp, Homo sapiens
cttacatgttttct

SEQ ID NO: 2672843 - DNA, 12 bp, Homo sapiens
cttactgaaggt

SEQ ID NO: 2672844 - DNA, 15 bp, Homo sapiens
cttatgaatatattt

SEQ ID NO: 2672845 - DNA, 21 bp, Homo sapiens
cttcaaattttttaaaagaga

SEQ ID NO: 2672846 - DNA, 21 bp, Homo sapiens
cttcacatcctgtgtttctag

SEQ ID NO: 2672847 - DNA, 20 bp, Homo sapiens
cttcactccagcctgggtga

SEQ ID NO: 2672848 - DNA, 23 bp, Homo sapiens
cttctatggactggttgttgcca

SEQ ID NO: 2672849 - DNA, 14 bp, Homo sapiens
cttctcttaattta

SEQ ID NO: 2672850 - DNA, 16 bp, Homo sapiens
cttctcttaatttaat

SEQ ID NO: 2672851 - DNA, 23 bp, Homo sapiens
cttgaatgccatagtcaaagaga

SEQ ID NO: 2672852 - DNA, 14 bp, Homo sapiens
cttggtcacataca

SEQ ID NO: 2672853 - DNA, 23 bp, Homo sapiens
cttgtttttataataaaaagctt

SEQ ID NO: 2672854 - DNA, 18 bp, Homo sapiens
cttgtttttccactactg

SEQ ID NO: 2672855 - DNA, 12 bp, Homo sapiens
ctttactgtttg

SEQ ID NO: 2672856 - DNA, 14 bp, Homo sapiens
ctttactgtttgtt

SEQ ID NO: 2672857 - DNA, 17 bp, Homo sapiens
ctttccgtggcactgca

SEQ ID NO: 2672858 - DNA, 22 bp, Homo sapiens
ctttgatacagtcaacaagcct

SEQ ID NO: 2672859 - DNA, 13 bp, Homo sapiens
cttttacatactg

SEQ ID NO: 2672860 - DNA, 17 bp, Homo sapiens
cttttacatactgctgt

SEQ ID NO: 2672861 - DNA, 14 bp, Homo sapiens
cttttctttgtatc

SEQ ID NO: 2672862 - DNA, 16 bp, Homo sapiens
ctttttaacctgcaaa

SEQ ID NO: 2672863 - DNA, 16 bp, Homo sapiens
gaaaaatagcaacttg

SEQ ID NO: 2672864 - DNA, 17 bp, Homo sapiens
gaaaaatagcaacttgt

SEQ ID NO: 2672865 - DNA, 19 bp, Homo sapiens
gaaacatcagttactctga

SEQ ID NO: 2672866 - DNA, 23 bp, Homo sapiens
gaaacatcagttactctgaaggg

SEQ ID NO: 2672867 - DNA, 21 bp, Homo sapiens
gaaactgtcggtttgctttga

SEQ ID NO: 2672868 - DNA, 22 bp, Homo sapiens
gaaagaactgtcatgtaaacat

SEQ ID NO: 2672869 - DNA, 19 bp, Homo sapiens
gaaagaatagaaagaaagt

SEQ ID NO: 2672870 - DNA, 18 bp, Homo sapiens
gaaatagttcaaagccaa

SEQ ID NO: 2672871 - DNA, 19 bp, Homo sapiens
gaaatgactaaaaaacaaa

SEQ ID NO: 2672872 - DNA, 20 bp, Homo sapiens
gaaatttaattcatgtttct

SEQ ID NO: 2672873 - DNA, 21 bp, Homo sapiens
gaaatttaattcatgtttctt

SEQ ID NO: 2672874 - DNA, 23 bp, Homo sapiens
gaacactgcactcttaagcttcc

SEQ ID NO: 2672875 - DNA, 18 bp, Homo sapiens
gaagaaggggacaatggc

SEQ ID NO: 2672876 - DNA, 20 bp, Homo sapiens
gaaggatgtacatttccaaa

SEQ ID NO: 2672877 - DNA, 12 bp, Homo sapiens
gaatagaaagaa

SEQ ID NO: 2672878 - DNA, 15 bp, Homo sapiens
gaatagaaagaaagt

SEQ ID NO: 2672879 - DNA, 12 bp, Homo sapiens
gaatattagctt

SEQ ID NO: 2672880 - DNA, 14 bp, Homo sapiens
gaatattttatctt

SEQ ID NO: 2672881 - DNA, 14 bp, Homo sapiens
gaatttttctctaa

SEQ ID NO: 2672882 - DNA, 16 bp, Homo sapiens
gaatttttttcatctt

SEQ ID NO: 2672883 - DNA, 20 bp, Homo sapiens
gaatttttttcatcttctct

SEQ ID NO: 2672884 - DNA, 12 bp, Homo sapiens
gacaaattctgt

SEQ ID NO: 2672885 - DNA, 16 bp, Homo sapiens
gacaaattctgtttct

SEQ ID NO: 2672886 - DNA, 19 bp, Homo sapiens
gagaactgcatatgtttcg

SEQ ID NO: 2672887 - DNA, 11 bp, Homo sapiens
gagaagaatag

SEQ ID NO: 2672888 - DNA, 14 bp, Homo sapiens
gagaagaatagcct

SEQ ID NO: 2672889 - DNA, 23 bp, Homo sapiens
gagaatattagctttactgtttg

SEQ ID NO: 2672890 - DNA, 18 bp, Homo sapiens
gagaattcttacatgttt

SEQ ID NO: 2672891 - DNA, 22 bp, Homo sapiens
gagaattcttacatgttttctt

SEQ ID NO: 2672892 - DNA, 21 bp, Homo sapiens
gagatcgtgccattgcactcc

SEQ ID NO: 2672893 - DNA, 18 bp, Homo sapiens
gagttaggctattcacaa

SEQ ID NO: 2672894 - DNA, 20 bp, Homo sapiens
gagtttgagaccagcctggc

SEQ ID NO: 2672895 - DNA, 19 bp, Homo sapiens
gagttttgttttaaaatta

SEQ ID NO: 2672896 - DNA, 17 bp, Homo sapiens
gataatatgagaatcag

SEQ ID NO: 2672897 - DNA, 21 bp, Homo sapiens
gatacacccaaagtatcagga

SEQ ID NO: 2672898 - DNA, 18 bp, Homo sapiens
gatacagtcaacaagcct

SEQ ID NO: 2672899 - DNA, 20 bp, Homo sapiens
gatatatgtgtttttcacat

SEQ ID NO: 2672900 - DNA, 22 bp, Homo sapiens
gatatatgtgtttttcacattt

SEQ ID NO: 2672901 - DNA, 14 bp, Homo sapiens
gatatgaatatatg

SEQ ID NO: 2672902 - DNA, 15 bp, Homo sapiens
gatctatgtttcatc

SEQ ID NO: 2672903 - DNA, 15 bp, Homo sapiens
gatcttgcagaagtt

SEQ ID NO: 2672904 - DNA, 16 bp, Homo sapiens
gatgcttttgtctaat

SEQ ID NO: 2672905 - DNA, 16 bp, Homo sapiens
gcaaatgtttaaacat

SEQ ID NO: 2672906 - DNA, 18 bp, Homo sapiens
gcaacatctagcaaatgt

SEQ ID NO: 2672907 - DNA, 14 bp, Homo sapiens
gcactccagcctgg

SEQ ID NO: 2672908 - DNA, 17 bp, Homo sapiens
gcactttgtagtgtttg

SEQ ID NO: 2672909 - DNA, 19 bp, Homo sapiens
gcagctcaggttgtagtgg

SEQ ID NO: 2672910 - DNA, 15 bp, Homo sapiens
gcagctcccattcta

SEQ ID NO: 2672911 - DNA, 16 bp, Homo sapiens
gcagtacaataaaagt

SEQ ID NO: 2672912 - DNA, 16 bp, Homo sapiens
gcatcttactgaaggt

SEQ ID NO: 2672913 - DNA, 16 bp, Homo sapiens
gcatgtatagttgctt

SEQ ID NO: 2672914 - DNA, 19 bp, Homo sapiens
gcattaaatataatatgca

SEQ ID NO: 2672915 - DNA, 12 bp, Homo sapiens
gcattgagaact

SEQ ID NO: 2672916 - DNA, 22 bp, Homo sapiens
gcattgagaactgcatatgttt

SEQ ID NO: 2672917 - DNA, 20 bp, Homo sapiens
gcatttcacaaaacagcctt

SEQ ID NO: 2672918 - DNA, 17 bp, Homo sapiens
gcatttgcagattttta

SEQ ID NO: 2672919 - DNA, 18 bp, Homo sapiens
gcattttccagcactttg

SEQ ID NO: 2672920 - DNA, 17 bp, Homo sapiens
gccatagtcaaagagag

SEQ ID NO: 2672921 - DNA, 23 bp, Homo sapiens
gccatagtcaaagagagttttta

SEQ ID NO: 2672922 - DNA, 11 bp, Homo sapiens
gccgtctcaac

SEQ ID NO: 2672923 - DNA, 23 bp, Homo sapiens
gcctcctctctcagtttttatat

SEQ ID NO: 2672924 - DNA, 13 bp, Homo sapiens
gcctttgggaaat

SEQ ID NO: 2672925 - DNA, 16 bp, Homo sapiens
gcggagcttgcagtga

SEQ ID NO: 2672926 - DNA, 16 bp, Homo sapiens
ttttgttttaaaatta

SEQ ID NO: 2672927 - DNA, 13 bp, Homo sapiens
tttttaatagaac

SEQ ID NO: 2672928 - DNA, 18 bp, Homo sapiens
tttttatattagttgctt

SEQ ID NO: 2672929 - DNA, 13 bp, Homo sapiens
aaaaagcttcccc

SEQ ID NO: 2672930 - DNA, 23 bp, Homo sapiens
aaaaatacctcaggaaagaatag

SEQ ID NO: 2672931 - DNA, 15 bp, Homo sapiens
cactccagcctgggt

SEQ ID NO: 2672932 - DNA, 16 bp, Homo sapiens
cactcttaagcttccg

SEQ ID NO: 2672933 - DNA, 16 bp, Homo sapiens
cactgtgggactcttc

SEQ ID NO: 2672934 - DNA, 18 bp, Homo sapiens
cacttgaggtcaggagtt

SEQ ID NO: 2672935 - DNA, 12 bp, Homo sapiens
cactttcaaaac

SEQ ID NO: 2672936 - DNA, 23 bp, Homo sapiens
cagaaacatcagttactctgaag

SEQ ID NO: 2672937 - DNA, 24 bp, Homo sapiens
cagaacaggtgttggtgacaattg

SEQ ID NO: 2672938 - DNA, 22 bp, Homo sapiens
cagatttttatattagttgctt

SEQ ID NO: 2672939 - DNA, 23 bp, Homo sapiens
cagatttttatattagttgcttt

SEQ ID NO: 2672940 - DNA, 12 bp, Homo sapiens
cagcacaaaatg

SEQ ID NO: 2672941 - DNA, 12 bp, Homo sapiens
cagccacactgt

SEQ ID NO: 2672942 - DNA, 17 bp, Homo sapiens
cagctggaattatgctg

SEQ ID NO: 2672943 - DNA, 23 bp, Homo sapiens
caggaaaattgtttgaacccagg

SEQ ID NO: 2672944 - DNA, 20 bp, Homo sapiens
caggaggcagaggttgcagt

SEQ ID NO: 2672945 - DNA, 21 bp, Homo sapiens
caggagtttgagaccagcctg

SEQ ID NO: 2672946 - DNA, 13 bp, Homo sapiens
cagtcctctttca

SEQ ID NO: 2672947 - DNA, 14 bp, Homo sapiens
cagtggttatttag

SEQ ID NO: 2672948 - DNA, 17 bp, Homo sapiens
cagtgtgtttgtgattg

SEQ ID NO: 2672949 - DNA, 15 bp, Homo sapiens
cagttactctgaagg

SEQ ID NO: 2672950 - DNA, 18 bp, Homo sapiens
cagttctgtcatatgtta

SEQ ID NO: 2672951 - DNA, 22 bp, Homo sapiens
cagttttccttctcatctgtga

SEQ ID NO: 2672952 - DNA, 22 bp, Homo sapiens
cagtttttaactctactgtgta

SEQ ID NO: 2672953 - DNA, 23 bp, Homo sapiens
catcaatagtgtcctatgcaata

SEQ ID NO: 2672954 - DNA, 15 bp, Homo sapiens
catcctgtgtttcta

SEQ ID NO: 2672955 - DNA, 14 bp, Homo sapiens
catctagcaaatgt

SEQ ID NO: 2672956 - DNA, 18 bp, Homo sapiens
catctagcaaatgttatg

SEQ ID NO: 2672957 - DNA, 20 bp, Homo sapiens
catctcctccatactcagga

SEQ ID NO: 2672958 - DNA, 15 bp, Homo sapiens
catctgtgattccct

SEQ ID NO: 2672959 - DNA, 12 bp, Homo sapiens
catctttcacat

SEQ ID NO: 2672960 - DNA, 21 bp, Homo sapiens
catctttttaacctgcaaaat

SEQ ID NO: 2672961 - DNA, 14 bp, Homo sapiens
catgagacacatct

SEQ ID NO: 2672962 - DNA, 16 bp, Homo sapiens
catgcaaatgctgtat

SEQ ID NO: 2672963 - DNA, 16 bp, Homo sapiens
catgcatcttactgaa

SEQ ID NO: 2672964 - DNA, 20 bp, Homo sapiens
catggcaccaaagccaccag

SEQ ID NO: 2672965 - DNA, 17 bp, Homo sapiens
catgtatagttgctttt

SEQ ID NO: 2672966 - DNA, 20 bp, Homo sapiens
catgttggttgcactttgta

SEQ ID NO: 2672967 - DNA, 22 bp, Homo sapiens
catgttggttgcactttgtagt

SEQ ID NO: 2672968 - DNA, 14 bp, Homo sapiens
catgtttaaacctg

SEQ ID NO: 2672969 - DNA, 10 bp, Homo sapiens
catgtttctt

SEQ ID NO: 2672970 - DNA, 23 bp, Homo sapiens
cattacaatcgagactgcaatgt

SEQ ID NO: 2672971 - DNA, 18 bp, Homo sapiens
cattcaaaagttgaaatt

SEQ ID NO: 2672972 - DNA, 12 bp, Homo sapiens
cattctctgaag

SEQ ID NO: 2672973 - DNA, 18 bp, Homo sapiens
cattgagaactgcatatg

SEQ ID NO: 2672974 - DNA, 19 bp, Homo sapiens
cattgagaactgcatatgt

SEQ ID NO: 2672975 - DNA, 23 bp, Homo sapiens
cattgagaactgcatatgtttcg

SEQ ID NO: 2672976 - DNA, 17 bp, Homo sapiens
catttccaaattcacaa

SEQ ID NO: 2672977 - DNA, 21 bp, Homo sapiens
catttgcgaatggttccattc

SEQ ID NO: 2672978 - DNA, 12 bp, Homo sapiens
catttttatcta

SEQ ID NO: 2672979 - DNA, 24 bp, Homo sapiens
ccaagggagttaggctattcacaa

SEQ ID NO: 2672980 - DNA, 19 bp, Homo sapiens
ccactgtcactgtttctct

SEQ ID NO: 2672981 - DNA, 24 bp, Homo sapiens
ccactgtcactgtttctctgctgt

SEQ ID NO: 2672982 - DNA, 21 bp, Homo sapiens
ccagcagtacaataaaagtaa

SEQ ID NO: 2672983 - DNA, 17 bp, Homo sapiens
ccagcctggccaacatg

SEQ ID NO: 2672984 - DNA, 12 bp, Homo sapiens
cccaactgttat

SEQ ID NO: 2672985 - DNA, 18 bp, Homo sapiens
ccctaaggcatgtgtgaa

SEQ ID NO: 2672986 - DNA, 20 bp, Homo sapiens
ccgagatcgtgccattgcac

SEQ ID NO: 2672987 - DNA, 12 bp, Homo sapiens
cctaatgaaagt

SEQ ID NO: 2672988 - DNA, 21 bp, Homo sapiens
cctagcttgggaggcttcccc

SEQ ID NO: 2672989 - DNA, 12 bp, Homo sapiens
cctatgcaataa

SEQ ID NO: 2672990 - DNA, 13 bp, Homo sapiens
cctcaggaaagaa

SEQ ID NO: 2672991 - DNA, 13 bp, Homo sapiens
cctgtgtttctag

SEQ ID NO: 2672992 - DNA, 14 bp, Homo sapiens
ccttctcttaattt

SEQ ID NO: 2672993 - DNA, 19 bp, Homo sapiens
ctaactcagaaacatcagt

SEQ ID NO: 2672994 - DNA, 20 bp, Homo sapiens
ctaaggcatgtgtgaaacat

SEQ ID NO: 2672995 - DNA, 13 bp, Homo sapiens
ctaatgaaagtga

SEQ ID NO: 2672996 - DNA, 16 bp, Homo sapiens
ctactctgttccttca

SEQ ID NO: 2672997 - DNA, 20 bp, Homo sapiens
ctactttgtcctttttgtta

SEQ ID NO: 2672998 - DNA, 14 bp, Homo sapiens
ctagatatgaatat

SEQ ID NO: 2672999 - DNA, 22 bp, Homo sapiens
ctagatatgaatatatggcatt

SEQ ID NO: 2673000 - DNA, 20 bp, Homo sapiens
ctagcttgggaggcttcccc

SEQ ID NO: 2673001 - DNA, 15 bp, Homo sapiens
ctatgtaactgcatt

SEQ ID NO: 2673002 - DNA, 20 bp, Homo sapiens
ctcaagtgttcacaacctgg

SEQ ID NO: 2673003 - DNA, 21 bp, Homo sapiens
ctcaggaaagaatagaaagaa

SEQ ID NO: 2673004 - DNA, 16 bp, Homo sapiens
ctcaggactcctctcc

SEQ ID NO: 2673005 - DNA, 21 bp, Homo sapiens
ctccatgagacacatctcctc

SEQ ID NO: 2673006 - DNA, 14 bp, Homo sapiens
ctctactgtgtaat

SEQ ID NO: 2673007 - DNA, 21 bp, Homo sapiens
ctctcctgacttttaatgtca

SEQ ID NO: 2673008 - DNA, 20 bp, Homo sapiens
ctctctcctgtactttttcc

SEQ ID NO: 2673009 - DNA, 13 bp, Homo sapiens
ctctgaagagtgg

SEQ ID NO: 2673010 - DNA, 23 bp, Homo sapiens
ctctgaagagtgggtttcacaag

SEQ ID NO: 2673011 - DNA, 15 bp, Homo sapiens
ctgaaggtaaaattg

SEQ ID NO: 2673012 - DNA, 17 bp, Homo sapiens
ctgaaggtaaaattgaa

SEQ ID NO: 2673013 - DNA, 13 bp, Homo sapiens
ctgacaacttgaa

SEQ ID NO: 2673014 - DNA, 18 bp, Homo sapiens
ctgacacaaaaagtagat

SEQ ID NO: 2673015 - DNA, 22 bp, Homo sapiens
ctgatatatgtgtttttcacat

SEQ ID NO: 2673016 - DNA, 19 bp, Homo sapiens
ctgcactcttaagcttccg

SEQ ID NO: 2673017 - DNA, 17 bp, Homo sapiens
ctgctactctgttcctt

SEQ ID NO: 2673018 - DNA, 22 bp, Homo sapiens
ctgctactctgttccttcacat

SEQ ID NO: 2673019 - DNA, 16 bp, Homo sapiens
ctgggtgctgatcctt

SEQ ID NO: 2673020 - DNA, 14 bp, Homo sapiens
ctgtaatcccagct

SEQ ID NO: 2673021 - DNA, 22 bp, Homo sapiens
ctgtagtcccagctactcggga

SEQ ID NO: 2673022 - DNA, 18 bp, Homo sapiens
ctgtatttttaaagcatg

SEQ ID NO: 2673023 - DNA, 14 bp, Homo sapiens
ctgtcactgtttct

SEQ ID NO: 2673024 - DNA, 12 bp, Homo sapiens
ctgtgaaatagt

SEQ ID NO: 2673025 - DNA, 15 bp, Homo sapiens
cttaaaatgcaatat

SEQ ID NO: 2673026 - DNA, 21 bp, Homo sapiens
cttaaaatgcaatatttgtaa

SEQ ID NO: 2673027 - DNA, 19 bp, Homo sapiens
cttaacattcctaaaatgc

SEQ ID NO: 2673028 - DNA, 12 bp, Homo sapiens
cttaagcttccg

SEQ ID NO: 2673029 - DNA, 21 bp, Homo sapiens
cttacatgttttctttgcttt

SEQ ID NO: 2673030 - DNA, 12 bp, Homo sapiens
cttcccctcact

SEQ ID NO: 2673031 - DNA, 14 bp, Homo sapiens
cttcccttttacat

SEQ ID NO: 2673032 - DNA, 12 bp, Homo sapiens
cttctcatctgt

SEQ ID NO: 2673033 - DNA, 12 bp, Homo sapiens
cttctcttaatt

SEQ ID NO: 2673034 - DNA, 15 bp, Homo sapiens
cttctcttaatttaa

SEQ ID NO: 2673035 - DNA, 15 bp, Homo sapiens
cttctgaatatttta

SEQ ID NO: 2673036 - DNA, 18 bp, Homo sapiens
cttctgaatattttatct

SEQ ID NO: 2673037 - DNA, 16 bp, Homo sapiens
cttcttttctttgtat

SEQ ID NO: 2673038 - DNA, 18 bp, Homo sapiens
cttgttccaatgccacat

SEQ ID NO: 2673039 - DNA, 20 bp, Homo sapiens
ctttgtagtgtttggtgctc

SEQ ID NO: 2673040 - DNA, 19 bp, Homo sapiens
ctttgtatcattcatcttc

SEQ ID NO: 2673041 - DNA, 17 bp, Homo sapiens
ctttgtcctttttgtta

SEQ ID NO: 2673042 - DNA, 14 bp, Homo sapiens
cttttacatactgc

SEQ ID NO: 2673043 - DNA, 16 bp, Homo sapiens
cttttgtctaattaaa

SEQ ID NO: 2673044 - DNA, 22 bp, Homo sapiens
cttttgttcagggctgtgatcg

SEQ ID NO: 2673045 - DNA, 18 bp, Homo sapiens
cttttttatgtgccgtgt

SEQ ID NO: 2673046 - DNA, 12 bp, Homo sapiens
gaaagcaacttt

SEQ ID NO: 2673047 - DNA, 16 bp, Homo sapiens
gaaaggagtagaaaaa

SEQ ID NO: 2673048 - DNA, 16 bp, Homo sapiens
gaaaggcattctctga

SEQ ID NO: 2673049 - DNA, 16 bp, Homo sapiens
gaaatttaattcatgt

SEQ ID NO: 2673050 - DNA, 23 bp, Homo sapiens
gaaatttaattcatgtttcttaa

SEQ ID NO: 2673051 - DNA, 17 bp, Homo sapiens
gaacggtaaatttctgt

SEQ ID NO: 2673052 - DNA, 15 bp, Homo sapiens
gaactgcatatgttt

SEQ ID NO: 2673053 - DNA, 21 bp, Homo sapiens
gaactgcatatgtttcgctga

SEQ ID NO: 2673054 - DNA, 17 bp, Homo sapiens
gaagagtgggtttcaca

SEQ ID NO: 2673055 - DNA, 16 bp, Homo sapiens
gaagatggctgttagc

SEQ ID NO: 2673056 - DNA, 16 bp, Homo sapiens
gaaggatgtacatttc

SEQ ID NO: 2673057 - DNA, 17 bp, Homo sapiens
gaaggatgtacatttcc

SEQ ID NO: 2673058 - DNA, 20 bp, Homo sapiens
gaaggtactgtcatgggcta

SEQ ID NO: 2673059 - DNA, 14 bp, Homo sapiens
gaatatatggcatt

SEQ ID NO: 2673060 - DNA, 16 bp, Homo sapiens
gaatatatttaagcaa

SEQ ID NO: 2673061 - DNA, 21 bp, Homo sapiens
gaatattagctttactgtttg

SEQ ID NO: 2673062 - DNA, 19 bp, Homo sapiens
gaatcagatcatttcaaaa

SEQ ID NO: 2673063 - DNA, 23 bp, Homo sapiens
gaatgccatagtcaaagagagtt

SEQ ID NO: 2673064 - DNA, 19 bp, Homo sapiens
gaattcttacatgttttct

SEQ ID NO: 2673065 - DNA, 14 bp, Homo sapiens
gacaaactgtaaaa

SEQ ID NO: 2673066 - DNA, 14 bp, Homo sapiens
gacaaagacaaatt

SEQ ID NO: 2673067 - DNA, 16 bp, Homo sapiens
gacaaatgtaaacatt

SEQ ID NO: 2673068 - DNA, 22 bp, Homo sapiens
gacaaatgtgtatcggatgctt

SEQ ID NO: 2673069 - DNA, 14 bp, Homo sapiens
gacaaattctgttt

SEQ ID NO: 2673070 - DNA, 20 bp, Homo sapiens
gacaaattctgtttcttgag

SEQ ID NO: 2673071 - DNA, 22 bp, Homo sapiens
gacagttttccttctcatctgt

SEQ ID NO: 2673072 - DNA, 21 bp, Homo sapiens
gacttttaatgtcatttgtta

SEQ ID NO: 2673073 - DNA, 15 bp, Homo sapiens
cagcagtacaataaa

SEQ ID NO: 2673074 - DNA, 14 bp, Homo sapiens
cagcctttgggaaa

SEQ ID NO: 2673075 - DNA, 18 bp, Homo sapiens
cagctaaattttctgaaa

SEQ ID NO: 2673076 - DNA, 12 bp, Homo sapiens
caggaaagaata

SEQ ID NO: 2673077 - DNA, 14 bp, Homo sapiens
caggaaggaagtca

SEQ ID NO: 2673078 - DNA, 16 bp, Homo sapiens
caggaagtcttcaggg

SEQ ID NO: 2673079 - DNA, 14 bp, Homo sapiens
caggctggacgtgg

SEQ ID NO: 2673080 - DNA, 24 bp, Homo sapiens
cagtcatggcaccaaagccaccag

SEQ ID NO: 2673081 - DNA, 13 bp, Homo sapiens
cagttttccttct

SEQ ID NO: 2673082 - DNA, 13 bp, Homo sapiens
catatgttaagca

SEQ ID NO: 2673083 - DNA, 22 bp, Homo sapiens
catatgtttcgctgatatatgt

SEQ ID NO: 2673084 - DNA, 22 bp, Homo sapiens
catcagttactctgaagggcat

SEQ ID NO: 2673085 - DNA, 16 bp, Homo sapiens
catcatgcatcttact

SEQ ID NO: 2673086 - DNA, 22 bp, Homo sapiens
catcctgtgtttctagggaaat

SEQ ID NO: 2673087 - DNA, 14 bp, Homo sapiens
catcttactgaagg

SEQ ID NO: 2673088 - DNA, 13 bp, Homo sapiens
catctttcacatt

SEQ ID NO: 2673089 - DNA, 22 bp, Homo sapiens
catgcaaatgctgtattcttct

SEQ ID NO: 2673090 - DNA, 21 bp, Homo sapiens
catgcctatatgagaagaata

SEQ ID NO: 2673091 - DNA, 18 bp, Homo sapiens
catgtttttaaagggcta

SEQ ID NO: 2673092 - DNA, 21 bp, Homo sapiens
cattaaaacaatattgtttct

SEQ ID NO: 2673093 - DNA, 14 bp, Homo sapiens
cattcctaaaatgc

SEQ ID NO: 2673094 - DNA, 16 bp, Homo sapiens
cattcctaaaatgctt

SEQ ID NO: 2673095 - DNA, 17 bp, Homo sapiens
cattgcactccagcctg

SEQ ID NO: 2673096 - DNA, 16 bp, Homo sapiens
catttaaatatctgaa

SEQ ID NO: 2673097 - DNA, 15 bp, Homo sapiens
catttcaaaatgctt

SEQ ID NO: 2673098 - DNA, 20 bp, Homo sapiens
catttcacaaaacagccttt

SEQ ID NO: 2673099 - DNA, 15 bp, Homo sapiens
catttgattctgtgt

SEQ ID NO: 2673100 - DNA, 22 bp, Homo sapiens
ccaaagccaccagactgacaaa

SEQ ID NO: 2673101 - DNA, 22 bp, Homo sapiens
ccactgtcactgtttctctgct

SEQ ID NO: 2673102 - DNA, 23 bp, Homo sapiens
ccactgtcactgtttctctgctg

SEQ ID NO: 2673103 - DNA, 17 bp, Homo sapiens
ccagaagaagatggctg

SEQ ID NO: 2673104 - DNA, 15 bp, Homo sapiens
ccagcaaacaaaatg

SEQ ID NO: 2673105 - DNA, 15 bp, Homo sapiens
ccagcagtacaataa

SEQ ID NO: 2673106 - DNA, 22 bp, Homo sapiens
ccatgttggttgcactttgtag

SEQ ID NO: 2673107 - DNA, 20 bp, Homo sapiens
ccattgcactccagcctggg

SEQ ID NO: 2673108 - DNA, 17 bp, Homo sapiens
ccgcgtctggtgacaac

SEQ ID NO: 2673109 - DNA, 15 bp, Homo sapiens
ccgtggcactgcata

SEQ ID NO: 2673110 - DNA, 22 bp, Homo sapiens
cctaaggcatgtgtgaaacata

SEQ ID NO: 2673111 - DNA, 20 bp, Homo sapiens
cctaagtttcagttgatttt

SEQ ID NO: 2673112 - DNA, 15 bp, Homo sapiens
cctagatatgaatat

SEQ ID NO: 2673113 - DNA, 22 bp, Homo sapiens
cctatatgagaagaatagccta

SEQ ID NO: 2673114 - DNA, 14 bp, Homo sapiens
cctatgcaataaaa

SEQ ID NO: 2673115 - DNA, 17 bp, Homo sapiens
cctatggggatggtcca

SEQ ID NO: 2673116 - DNA, 16 bp, Homo sapiens
cctcaggaaagaatag

SEQ ID NO: 2673117 - DNA, 18 bp, Homo sapiens
cctcaggaaagaatagaa

SEQ ID NO: 2673118 - DNA, 19 bp, Homo sapiens
cctgatgcttttgtctaat

SEQ ID NO: 2673119 - DNA, 13 bp, Homo sapiens
cctgctactctgt

SEQ ID NO: 2673120 - DNA, 16 bp, Homo sapiens
cctgctactctgttcc

SEQ ID NO: 2673121 - DNA, 13 bp, Homo sapiens
cctggcatttcac

SEQ ID NO: 2673122 - DNA, 14 bp, Homo sapiens
cctggccaacatgg

SEQ ID NO: 2673123 - DNA, 20 bp, Homo sapiens
ccttcacatcctgtgtttct

SEQ ID NO: 2673124 - DNA, 13 bp, Homo sapiens
cctttttccttcc

SEQ ID NO: 2673125 - DNA, 14 bp, Homo sapiens
cgagaccagcctgg

SEQ ID NO: 2673126 - DNA, 20 bp, Homo sapiens
cgcctgtaatcccagctact

SEQ ID NO: 2673127 - DNA, 19 bp, Homo sapiens
cgctgcaacctgttgatag

SEQ ID NO: 2673128 - DNA, 17 bp, Homo sapiens
cgtgaagtatactgtat

SEQ ID NO: 2673129 - DNA, 13 bp, Homo sapiens
ctaaattttctga

SEQ ID NO: 2673130 - DNA, 18 bp, Homo sapiens
ctaatgaaagtgatgaca

SEQ ID NO: 2673131 - DNA, 23 bp, Homo sapiens
ctaatgacatgcctatatgagaa

SEQ ID NO: 2673132 - DNA, 11 bp, Homo sapiens
ctactgtgtaa

SEQ ID NO: 2673133 - DNA, 20 bp, Homo sapiens
gaggcagaggttgcagtgag

SEQ ID NO: 2673134 - DNA, 20 bp, Homo sapiens
gaggcggagcttgcagtgag

SEQ ID NO: 2673135 - DNA, 18 bp, Homo sapiens
gagtggatgatgtttcgt

SEQ ID NO: 2673136 - DNA, 16 bp, Homo sapiens
gagtttttaatagaac

SEQ ID NO: 2673137 - DNA, 18 bp, Homo sapiens
gataaatcagtggttatt

SEQ ID NO: 2673138 - DNA, 19 bp, Homo sapiens
gatacagtcaacaagcctg

SEQ ID NO: 2673139 - DNA, 20 bp, Homo sapiens
gatagcaagtgaatttttct

SEQ ID NO: 2673140 - DNA, 18 bp, Homo sapiens
gatctagaataatcttgc

SEQ ID NO: 2673141 - DNA, 21 bp, Homo sapiens
gatggccgcagggctgtgcac

SEQ ID NO: 2673142 - DNA, 18 bp, Homo sapiens
gatgggtttgacaaggtt

SEQ ID NO: 2673143 - DNA, 22 bp, Homo sapiens
gattaagagatgggtttgacaa

SEQ ID NO: 2673144 - DNA, 21 bp, Homo sapiens
gattccctcctgctactctgt

SEQ ID NO: 2673145 - DNA, 23 bp, Homo sapiens
gattctaccacacagcagcagtt

SEQ ID NO: 2673146 - DNA, 19 bp, Homo sapiens
gattctgtgtgttttcata

SEQ ID NO: 2673147 - DNA, 22 bp, Homo sapiens
gattctgtgtgttttcataata

SEQ ID NO: 2673148 - DNA, 17 bp, Homo sapiens
gattgtttgctctgaga

SEQ ID NO: 2673149 - DNA, 20 bp, Homo sapiens
gcaagtgaatttttctctaa

SEQ ID NO: 2673150 - DNA, 20 bp, Homo sapiens
gcacaaaatgatggcagtgg

SEQ ID NO: 2673151 - DNA, 20 bp, Homo sapiens
gcacgcgccctttctaccat

SEQ ID NO: 2673152 - DNA, 16 bp, Homo sapiens
gcactcttaagcttcc

SEQ ID NO: 2673153 - DNA, 11 bp, Homo sapiens
gcactttgtag

SEQ ID NO: 2673154 - DNA, 14 bp, Homo sapiens
gcagggctgtgcac

SEQ ID NO: 2673155 - DNA, 21 bp, Homo sapiens
gcatatgtttcgctgatatat

SEQ ID NO: 2673156 - DNA, 14 bp, Homo sapiens
gcattctctgaaga

SEQ ID NO: 2673157 - DNA, 22 bp, Homo sapiens
gcatttcacaaaacagcctttg

SEQ ID NO: 2673158 - DNA, 16 bp, Homo sapiens
gccacatacttgcagc

SEQ ID NO: 2673159 - DNA, 20 bp, Homo sapiens
gcctgggtgacaaagcgaga

SEQ ID NO: 2673160 - DNA, 23 bp, Homo sapiens
gcctgggtgacaaagtgagactc

SEQ ID NO: 2673161 - DNA, 20 bp, Homo sapiens
gcgagaacctaagtttcagt

SEQ ID NO: 2673162 - DNA, 13 bp, Homo sapiens
gctaaattttctg

SEQ ID NO: 2673163 - DNA, 17 bp, Homo sapiens
gctactctgttccttca

SEQ ID NO: 2673164 - DNA, 18 bp, Homo sapiens
gctactctgttccttcac

SEQ ID NO: 2673165 - DNA, 14 bp, Homo sapiens
gctctcctgacttt

SEQ ID NO: 2673166 - DNA, 17 bp, Homo sapiens
gcttatgaatatattta

SEQ ID NO: 2673167 - DNA, 18 bp, Homo sapiens
gcttccccttttgccaat

SEQ ID NO: 2673168 - DNA, 13 bp, Homo sapiens
gcttgaacccagg

SEQ ID NO: 2673169 - DNA, 16 bp, Homo sapiens
gctttactgtttgtta

SEQ ID NO: 2673170 - DNA, 15 bp, Homo sapiens
ggaaatgaaagaaag

SEQ ID NO: 2673171 - DNA, 18 bp, Homo sapiens
ggaggaacactgcactct

SEQ ID NO: 2673172 - DNA, 20 bp, Homo sapiens
ggaggcagaggttgcagtga

SEQ ID NO: 2673173 - DNA, 16 bp, Homo sapiens
ggatgtacatttccaa

SEQ ID NO: 2673174 - DNA, 12 bp, Homo sapiens
ggcattctctga

SEQ ID NO: 2673175 - DNA, 17 bp, Homo sapiens
ggccattaggaaactgt

SEQ ID NO: 2673176 - DNA, 22 bp, Homo sapiens
ggcccacgcctgtaatcccagc

SEQ ID NO: 2673177 - DNA, 14 bp, Homo sapiens
ggccttcataatgg

SEQ ID NO: 2673178 - DNA, 18 bp, Homo sapiens
ggcgacagttttccttct

SEQ ID NO: 2673179 - DNA, 21 bp, Homo sapiens
ggcggagcttgcagtgagccg

SEQ ID NO: 2673180 - DNA, 14 bp, Homo sapiens
gggcccagattcta

SEQ ID NO: 2673181 - DNA, 16 bp, Homo sapiens
ggtagccatcatggat

SEQ ID NO: 2673182 - DNA, 19 bp, Homo sapiens
ggtggctcacgcctgtaat

SEQ ID NO: 2673183 - DNA, 12 bp, Homo sapiens
aaaacaaagaag

SEQ ID NO: 2673184 - DNA, 16 bp, Homo sapiens
aaaacatccagataca

SEQ ID NO: 2673185 - DNA, 12 bp, Homo sapiens
aaaagttgaaat

SEQ ID NO: 2673186 - DNA, 16 bp, Homo sapiens
aaaatacctcaggaaa

SEQ ID NO: 2673187 - DNA, 18 bp, Homo sapiens
aaaatacctcaggaaaga

SEQ ID NO: 2673188 - DNA, 20 bp, Homo sapiens
aaaatacctcaggaaagaat

SEQ ID NO: 2673189 - DNA, 17 bp, Homo sapiens
aaaatgcaatatttgta

SEQ ID NO: 2673190 - DNA, 14 bp, Homo sapiens
aaaatgcttcaaag

SEQ ID NO: 2673191 - DNA, 13 bp, Homo sapiens
aaaattatttgca

SEQ ID NO: 2673192 - DNA, 14 bp, Homo sapiens
aaacaatattgttt

SEQ ID NO: 2673193 - DNA, 15 bp, Homo sapiens
aaacaatattgtttc

SEQ ID NO: 2673194 - DNA, 19 bp, Homo sapiens
aaacatcagttactctgaa

SEQ ID NO: 2673195 - DNA, 12 bp, Homo sapiens
aaagaatagaaa

SEQ ID NO: 2673196 - DNA, 15 bp, Homo sapiens
agctttactgtttgt

SEQ ID NO: 2673197 - DNA, 16 bp, Homo sapiens
aggaacggtaaatttc

SEQ ID NO: 2673198 - DNA, 15 bp, Homo sapiens
aggaatacaatatat

SEQ ID NO: 2673199 - DNA, 19 bp, Homo sapiens
aggctaaggcaggaaaatt

SEQ ID NO: 2673200 - DNA, 21 bp, Homo sapiens
aggcttgttccaatgccacat

SEQ ID NO: 2673201 - DNA, 22 bp, Homo sapiens
aggtactgtcatgggctaggca

SEQ ID NO: 2673202 - DNA, 14 bp, Homo sapiens
agtaactgacaact

SEQ ID NO: 2673203 - DNA, 22 bp, Homo sapiens
agtcaaagagagtttttaatag

SEQ ID NO: 2673204 - DNA, 23 bp, Homo sapiens
agtcaaagagagtttttaataga

SEQ ID NO: 2673205 - DNA, 14 bp, Homo sapiens
agtcaacaagcctg

SEQ ID NO: 2673206 - DNA, 20 bp, Homo sapiens
agtcagtgcccaactgttat

SEQ ID NO: 2673207 - DNA, 11 bp, Homo sapiens
agtctatggcc

SEQ ID NO: 2673208 - DNA, 23 bp, Homo sapiens
agtctatggccaggtatgcatgg

SEQ ID NO: 2673209 - DNA, 17 bp, Homo sapiens
agtgaatttttctctaa

SEQ ID NO: 2673210 - DNA, 20 bp, Homo sapiens
agtgaatttttctctaactc

SEQ ID NO: 2673211 - DNA, 15 bp, Homo sapiens
agtgcccaactgtta

SEQ ID NO: 2673212 - DNA, 16 bp, Homo sapiens
agtggctgtcatcagc

SEQ ID NO: 2673213 - DNA, 17 bp, Homo sapiens
agtggctgtcatcagcc

SEQ ID NO: 2673214 - DNA, 15 bp, Homo sapiens
agtgggtttcacaag

SEQ ID NO: 2673215 - DNA, 21 bp, Homo sapiens
agtgggtttcacaagtgaaaa

SEQ ID NO: 2673216 - DNA, 16 bp, Homo sapiens
agtgtcctatgcaata

SEQ ID NO: 2673217 - DNA, 23 bp, Homo sapiens
agtgtcctatgcaataaaattat

SEQ ID NO: 2673218 - DNA, 23 bp, Homo sapiens
agtgttcacaacctggaagtgct

SEQ ID NO: 2673219 - DNA, 23 bp, Homo sapiens
agtgttggtttaatattacctaa

SEQ ID NO: 2673220 - DNA, 20 bp, Homo sapiens
agtgtttggtgctcatttaa

SEQ ID NO: 2673221 - DNA, 21 bp, Homo sapiens
agttcctgtcccttctcttaa

SEQ ID NO: 2673222 - DNA, 23 bp, Homo sapiens
agttcctgtcccttctcttaatt

SEQ ID NO: 2673223 - DNA, 17 bp, Homo sapiens
agttgaagactttgttt

SEQ ID NO: 2673224 - DNA, 21 bp, Homo sapiens
agttgattttacaattgaaat

SEQ ID NO: 2673225 - DNA, 23 bp, Homo sapiens
agttttccttctcatctgtgatt

SEQ ID NO: 2673226 - DNA, 16 bp, Homo sapiens
agtttttgtaatttat

SEQ ID NO: 2673227 - DNA, 16 bp, Homo sapiens
ataacttcaaattttt

SEQ ID NO: 2673228 - DNA, 14 bp, Homo sapiens
ataagtgaaaatct

SEQ ID NO: 2673229 - DNA, 14 bp, Homo sapiens
atacaatatatagc

SEQ ID NO: 2673230 - DNA, 23 bp, Homo sapiens
atacttgcagctcccattctatg

SEQ ID NO: 2673231 - DNA, 22 bp, Homo sapiens
atagatgtagataaactcagaa

SEQ ID NO: 2673232 - DNA, 19 bp, Homo sapiens
atagcaagtgaatttttct

SEQ ID NO: 2673233 - DNA, 17 bp, Homo sapiens
atagctggcaagaatgg

SEQ ID NO: 2673234 - DNA, 20 bp, Homo sapiens
atagttgcttttgaaggaat

SEQ ID NO: 2673235 - DNA, 21 bp, Homo sapiens
atagttgcttttgaaggaata

SEQ ID NO: 2673236 - DNA, 16 bp, Homo sapiens
atatagctggcaagaa

SEQ ID NO: 2673237 - DNA, 17 bp, Homo sapiens
atatatggcatttgcag

SEQ ID NO: 2673238 - DNA, 15 bp, Homo sapiens
atatatgtgtttttc

SEQ ID NO: 2673239 - DNA, 20 bp, Homo sapiens
atatatttaagcaacatctt

SEQ ID NO: 2673240 - DNA, 19 bp, Homo sapiens
atatgtgtttttcacattt

SEQ ID NO: 2673241 - DNA, 13 bp, Homo sapiens
atattagttgctt

SEQ ID NO: 2673242 - DNA, 19 bp, Homo sapiens
atattatcatgcaaatgct

SEQ ID NO: 2673243 - DNA, 18 bp, Homo sapiens
atatttaagcaacatctt

SEQ ID NO: 2673244 - DNA, 12 bp, Homo sapiens
atcaaaaataat

SEQ ID NO: 2673245 - DNA, 13 bp, Homo sapiens
atcaaaaataatg

SEQ ID NO: 2673246 - DNA, 18 bp, Homo sapiens
atcagatcatttcaaaac

SEQ ID NO: 2673247 - DNA, 18 bp, Homo sapiens
atcagttactctgaaggg

SEQ ID NO: 2673248 - DNA, 22 bp, Homo sapiens
atcatgcatcttactgaaggta

SEQ ID NO: 2673249 - DNA, 12 bp, Homo sapiens
atcattcatctt

SEQ ID NO: 2673250 - DNA, 21 bp, Homo sapiens
atcattcatcttcttctttaa

SEQ ID NO: 2673251 - DNA, 15 bp, Homo sapiens
atcattttaggaaag

SEQ ID NO: 2673252 - DNA, 18 bp, Homo sapiens
atctagcaaatgttatgc

SEQ ID NO: 2673253 - DNA, 21 bp, Homo sapiens
atcttacaacaggcttatgaa

SEQ ID NO: 2673254 - DNA, 14 bp, Homo sapiens
atcttactgaaggt

SEQ ID NO: 2673255 - DNA, 23 bp, Homo sapiens
atcttgtttttccactactgcta

SEQ ID NO: 2673256 - DNA, 14 bp, Homo sapiens
atgaaagaaaggcc

SEQ ID NO: 2673257 - DNA, 22 bp, Homo sapiens
atgaatttttttcatcttctct

SEQ ID NO: 2673258 - DNA, 13 bp, Homo sapiens
atgagaagaatag

SEQ ID NO: 2673259 - DNA, 15 bp, Homo sapiens
atgcaataaaattat

SEQ ID NO: 2673260 - DNA, 16 bp, Homo sapiens
atgcaataaaattatt

SEQ ID NO: 2673261 - DNA, 19 bp, Homo sapiens
atgcaataaaattatttgc

SEQ ID NO: 2673262 - DNA, 13 bp, Homo sapiens
atgcaatatttgt

SEQ ID NO: 2673263 - DNA, 21 bp, Homo sapiens
atgcacacagtgctttccgtg

SEQ ID NO: 2673264 - DNA, 20 bp, Homo sapiens
atgcttcaaagtccacatta

SEQ ID NO: 2673265 - DNA, 19 bp, Homo sapiens
atggcaccaaagccaccag

SEQ ID NO: 2673266 - DNA, 14 bp, Homo sapiens
atggcatttgcaga

SEQ ID NO: 2673267 - DNA, 17 bp, Homo sapiens
atggcatttgcagattt

SEQ ID NO: 2673268 - DNA, 20 bp, Homo sapiens
atgtacatttccaaattcac

SEQ ID NO: 2673269 - DNA, 18 bp, Homo sapiens
atgtagataaactcagaa

SEQ ID NO: 2673270 - DNA, 19 bp, Homo sapiens
atgtagataaactcagaaa

SEQ ID NO: 2673271 - DNA, 15 bp, Homo sapiens
atgtatagttgcttt

SEQ ID NO: 2673272 - DNA, 16 bp, Homo sapiens
atgtggttgaagagca

SEQ ID NO: 2673273 - DNA, 21 bp, Homo sapiens
atgttaagcagctaaattttc

SEQ ID NO: 2673274 - DNA, 17 bp, Homo sapiens
atgttatgcataaagtc

SEQ ID NO: 2673275 - DNA, 18 bp, Homo sapiens
atgttatgcataaagtca

SEQ ID NO: 2673276 - DNA, 18 bp, Homo sapiens
atgttggttgcactttgt

SEQ ID NO: 2673277 - DNA, 18 bp, Homo sapiens
atgtttcttaaatgggct

SEQ ID NO: 2673278 - DNA, 17 bp, Homo sapiens
attaaagctaaagtatc

SEQ ID NO: 2673279 - DNA, 15 bp, Homo sapiens
attaaatataatatg

SEQ ID NO: 2673280 - DNA, 16 bp, Homo sapiens
attacatctttcacat

SEQ ID NO: 2673281 - DNA, 20 bp, Homo sapiens
attagctttactgtttgtta

SEQ ID NO: 2673282 - DNA, 16 bp, Homo sapiens
attcaaaagttgaaat

SEQ ID NO: 2673283 - DNA, 17 bp, Homo sapiens
attcagctgaggttcat

SEQ ID NO: 2673284 - DNA, 21 bp, Homo sapiens
attcagctgaggttcattaca

SEQ ID NO: 2673285 - DNA, 21 bp, Homo sapiens
attccctcctgctactctgtt

SEQ ID NO: 2673286 - DNA, 15 bp, Homo sapiens
attctctctcctgta

SEQ ID NO: 2673287 - DNA, 13 bp, Homo sapiens
attcttaaaatgc

SEQ ID NO: 2673288 - DNA, 17 bp, Homo sapiens
attcttaaaatgcaata

SEQ ID NO: 2673289 - DNA, 22 bp, Homo sapiens
attgagaactgcatatgtttcg

SEQ ID NO: 2673290 - DNA, 20 bp, Homo sapiens
attgcactccagcctgggtg

SEQ ID NO: 2673291 - DNA, 22 bp, Homo sapiens
attgctgtccttgaatgccata

SEQ ID NO: 2673292 - DNA, 19 bp, Homo sapiens
attggctatttaaagacaa

SEQ ID NO: 2673293 - DNA, 16 bp, Homo sapiens
atttaaagacaaagac

SEQ ID NO: 2673294 - DNA, 23 bp, Homo sapiens
atttaaatatctgaacatttact

SEQ ID NO: 2673295 - DNA, 14 bp, Homo sapiens
atttactacagttt

SEQ ID NO: 2673296 - DNA, 19 bp, Homo sapiens
atttagtttttgtaattta

SEQ ID NO: 2673297 - DNA, 14 bp, Homo sapiens
atttcaaaatgctt

SEQ ID NO: 2673298 - DNA, 15 bp, Homo sapiens
atttccattatttat

SEQ ID NO: 2673299 - DNA, 23 bp, Homo sapiens
atttgattctgtgtgttttcata

SEQ ID NO: 2673300 - DNA, 21 bp, Homo sapiens
atttgcctgtttctgcttgct

SEQ ID NO: 2673301 - DNA, 16 bp, Homo sapiens
atttgtaaggcttgtt

SEQ ID NO: 2673302 - DNA, 14 bp, Homo sapiens
atttgttaaaatac

SEQ ID NO: 2673303 - DNA, 12 bp, Homo sapiens
attttaatttat

SEQ ID NO: 2673304 - DNA, 20 bp, Homo sapiens
atttttacctttttccttcc

SEQ ID NO: 2673305 - DNA, 20 bp, Homo sapiens
atttttatattagttgcttt

SEQ ID NO: 2673306 - DNA, 21 bp, Homo sapiens
attttttaaaagagacaaact

SEQ ID NO: 2673307 - DNA, 23 bp, Homo sapiens
aaaatgtgtgtattcttaaaatg

SEQ ID NO: 2673308 - DNA, 12 bp, Homo sapiens
aaacaaaaacat

SEQ ID NO: 2673309 - DNA, 16 bp, Homo sapiens
aaacaatattgtttct

SEQ ID NO: 2673310 - DNA, 14 bp, Homo sapiens
aaacactttcaaaa

SEQ ID NO: 2673311 - DNA, 16 bp, Homo sapiens
aaacatcagttactct

SEQ ID NO: 2673312 - DNA, 20 bp, Homo sapiens
aaacatcagttactctgaag

SEQ ID NO: 2673313 - DNA, 19 bp, Homo sapiens
aaacattttcagaaatatt

SEQ ID NO: 2673314 - DNA, 15 bp, Homo sapiens
aaactcatttcctat

SEQ ID NO: 2673315 - DNA, 22 bp, Homo sapiens
aaactcatttcctatgtaactg

SEQ ID NO: 2673316 - DNA, 14 bp, Homo sapiens
aaagaaagcaactt

SEQ ID NO: 2673317 - DNA, 14 bp, Homo sapiens
aaagaatagaaaga

SEQ ID NO: 2673318 - DNA, 16 bp, Homo sapiens
aaagacaaattctgtt

SEQ ID NO: 2673319 - DNA, 19 bp, Homo sapiens
aaagacaaattctgtttct

SEQ ID NO: 2673320 - DNA, 17 bp, Homo sapiens
aaagcagtaactgacaa

SEQ ID NO: 2673321 - DNA, 16 bp, Homo sapiens
aaaggcattctctgaa

SEQ ID NO: 2673322 - DNA, 18 bp, Homo sapiens
aaagtgaattgttgacaa

SEQ ID NO: 2673323 - DNA, 17 bp, Homo sapiens
aaagtgatgacatattt

SEQ ID NO: 2673324 - DNA, 14 bp, Homo sapiens
aaatacctcaggaa

SEQ ID NO: 2673325 - DNA, 15 bp, Homo sapiens
aaatacctcaggaaa

SEQ ID NO: 2673326 - DNA, 14 bp, Homo sapiens
agctctcctgactt

SEQ ID NO: 2673327 - DNA, 19 bp, Homo sapiens
agctctcttcaatgacata

SEQ ID NO: 2673328 - DNA, 15 bp, Homo sapiens
agctgaatacattct

SEQ ID NO: 2673329 - DNA, 12 bp, Homo sapiens
aggaaagaatag

SEQ ID NO: 2673330 - DNA, 20 bp, Homo sapiens
aggaacggtaaatttctgtg

SEQ ID NO: 2673331 - DNA, 20 bp, Homo sapiens
aggaggcagaggttgcagtg

SEQ ID NO: 2673332 - DNA, 13 bp, Homo sapiens
aggcattctctga

SEQ ID NO: 2673333 - DNA, 17 bp, Homo sapiens
agggcatcatgcatctt

SEQ ID NO: 2673334 - DNA, 19 bp, Homo sapiens
aggtaaaattgaaaggcat

SEQ ID NO: 2673335 - DNA, 15 bp, Homo sapiens
aggtgttggtgacaa

SEQ ID NO: 2673336 - DNA, 23 bp, Homo sapiens
aggttcttcccttttacatactg

SEQ ID NO: 2673337 - DNA, 15 bp, Homo sapiens
agtagctctcctgac

SEQ ID NO: 2673338 - DNA, 16 bp, Homo sapiens
agtcaaagagagtttt

SEQ ID NO: 2673339 - DNA, 14 bp, Homo sapiens
agtcagtttctaca

SEQ ID NO: 2673340 - DNA, 15 bp, Homo sapiens
agtcagtttctacac

SEQ ID NO: 2673341 - DNA, 16 bp, Homo sapiens
agtctctaggttctga

SEQ ID NO: 2673342 - DNA, 15 bp, Homo sapiens
agtgaatttttctct

SEQ ID NO: 2673343 - DNA, 14 bp, Homo sapiens
agtgcccaactgtt

SEQ ID NO: 2673344 - DNA, 13 bp, Homo sapiens
agtggatgatgtt

SEQ ID NO: 2673345 - DNA, 20 bp, Homo sapiens
agtggatgatgtttcgtgaa

SEQ ID NO: 2673346 - DNA, 19 bp, Homo sapiens
agtgtcctatgcaataaaa

SEQ ID NO: 2673347 - DNA, 20 bp, Homo sapiens
agttcctgtcccttctctta

SEQ ID NO: 2673348 - DNA, 12 bp, Homo sapiens
agttttccttct

SEQ ID NO: 2673349 - DNA, 14 bp, Homo sapiens
ataaagatgctctt

SEQ ID NO: 2673350 - DNA, 20 bp, Homo sapiens
ataatatgcacacagtgctt

SEQ ID NO: 2673351 - DNA, 20 bp, Homo sapiens
atactatttagtttttgtaa

SEQ ID NO: 2673352 - DNA, 23 bp, Homo sapiens
atactatttagtttttgtaattt

SEQ ID NO: 2673353 - DNA, 22 bp, Homo sapiens
atagcaagtgaatttttctcta

SEQ ID NO: 2673354 - DNA, 14 bp, Homo sapiens
atagtcaaagagag

SEQ ID NO: 2673355 - DNA, 16 bp, Homo sapiens
atagtgtcctatgcaa

SEQ ID NO: 2673356 - DNA, 20 bp, Homo sapiens
atagtgtcctatgcaataaa

SEQ ID NO: 2673357 - DNA, 15 bp, Homo sapiens
atagttcaaagccaa

SEQ ID NO: 2673358 - DNA, 19 bp, Homo sapiens
atataaaagatcttgcaga

SEQ ID NO: 2673359 - DNA, 23 bp, Homo sapiens
atataatatgcacacagtgcttt

SEQ ID NO: 2673360 - DNA, 20 bp, Homo sapiens
atatatagctggcaagaatg

SEQ ID NO: 2673361 - DNA, 21 bp, Homo sapiens
atatatgtgtttttcacattt

SEQ ID NO: 2673362 - DNA, 15 bp, Homo sapiens
atatgagaagaatag

SEQ ID NO: 2673363 - DNA, 17 bp, Homo sapiens
atatgtgtttttcacat

SEQ ID NO: 2673364 - DNA, 23 bp, Homo sapiens
atatgttaagcagctaaattttc

SEQ ID NO: 2673365 - DNA, 17 bp, Homo sapiens
atattacctaatgaaag

SEQ ID NO: 2673366 - DNA, 21 bp, Homo sapiens
atattagctttactgtttgtt

SEQ ID NO: 2673367 - DNA, 15 bp, Homo sapiens
atatttgtaaggctt

SEQ ID NO: 2673368 - DNA, 21 bp, Homo sapiens
atatttgtaaggcttgttcca

SEQ ID NO: 2673369 - DNA, 22 bp, Homo sapiens
atattttttatatctggaatga

SEQ ID NO: 2673370 - DNA, 22 bp, Homo sapiens
atcaatagtgtcctatgcaata

SEQ ID NO: 2673371 - DNA, 23 bp, Homo sapiens
atcaatagtgtcctatgcaataa

SEQ ID NO: 2673372 - DNA, 15 bp, Homo sapiens
atcacttaacattcc

SEQ ID NO: 2673373 - DNA, 23 bp, Homo sapiens
atcacttaacattcctaaaatgc

SEQ ID NO: 2673374 - DNA, 22 bp, Homo sapiens
atcagatcatttcaaaactcat

SEQ ID NO: 2673375 - DNA, 17 bp, Homo sapiens
atcagattttaacagct

SEQ ID NO: 2673376 - DNA, 21 bp, Homo sapiens
atcagtcctctttcaaaggta

SEQ ID NO: 2673377 - DNA, 18 bp, Homo sapiens
atccagcagtacaataaa

SEQ ID NO: 2673378 - DNA, 14 bp, Homo sapiens
atctagcaaatgtt

SEQ ID NO: 2673379 - DNA, 20 bp, Homo sapiens
atgaatatatggcatttgca

SEQ ID NO: 2673380 - DNA, 21 bp, Homo sapiens
atgaatttttttcatcttctc

SEQ ID NO: 2673381 - DNA, 23 bp, Homo sapiens
atgaatttttttcatcttctctg

SEQ ID NO: 2673382 - DNA, 15 bp, Homo sapiens
atgatcaaaaataat

SEQ ID NO: 2673383 - DNA, 22 bp, Homo sapiens
atgcaataaaattatttgcagg

SEQ ID NO: 2673384 - DNA, 19 bp, Homo sapiens
atggcctgagactttcttt

SEQ ID NO: 2673385 - DNA, 22 bp, Homo sapiens
atggtggcttcttttctttgta

SEQ ID NO: 2673386 - DNA, 23 bp, Homo sapiens
atggtggcttcttttctttgtat

SEQ ID NO: 2673387 - DNA, 18 bp, Homo sapiens
atgtaaacataccaacat

SEQ ID NO: 2673388 - DNA, 20 bp, Homo sapiens
atgtaaacataccaacatgt

SEQ ID NO: 2673389 - DNA, 20 bp, Homo sapiens
atgtaactgcattgagaact

SEQ ID NO: 2673390 - DNA, 23 bp, Homo sapiens
atgttaagcagctaaattttctg

SEQ ID NO: 2673391 - DNA, 20 bp, Homo sapiens
atgttggttgcactttgtag

SEQ ID NO: 2673392 - DNA, 23 bp, Homo sapiens
atgtttcgtgaagtatactgtat

SEQ ID NO: 2673393 - DNA, 18 bp, Homo sapiens
attaaaacaatattgttt

SEQ ID NO: 2673394 - DNA, 18 bp, Homo sapiens
attaaagctaaagtatct

SEQ ID NO: 2673395 - DNA, 14 bp, Homo sapiens
attacctaatgaaa

SEQ ID NO: 2673396 - DNA, 15 bp, Homo sapiens
attacctaatgaaag

SEQ ID NO: 2673397 - DNA, 15 bp, Homo sapiens
attagctttactgtt

SEQ ID NO: 2673398 - DNA, 15 bp, Homo sapiens
attatcatgcaaatg

SEQ ID NO: 2673399 - DNA, 17 bp, Homo sapiens
attatcatgcaaatgct

SEQ ID NO: 2673400 - DNA, 13 bp, Homo sapiens
attcatgtttctt

SEQ ID NO: 2673401 - DNA, 15 bp, Homo sapiens
attcatgtttcttaa

SEQ ID NO: 2673402 - DNA, 13 bp, Homo sapiens
attctatgtgtca

SEQ ID NO: 2673403 - DNA, 23 bp, Homo sapiens
attctatgtgtcatcaatagtgt

SEQ ID NO: 2673404 - DNA, 17 bp, Homo sapiens
attctgtgtgttttcat

SEQ ID NO: 2673405 - DNA, 21 bp, Homo sapiens
attctgtgtgttttcataata

SEQ ID NO: 2673406 - DNA, 17 bp, Homo sapiens
attcttacatgttttct

SEQ ID NO: 2673407 - DNA, 18 bp, Homo sapiens
attgaaaggcattctctg

SEQ ID NO: 2673408 - DNA, 16 bp, Homo sapiens
attggataaagcagct

SEQ ID NO: 2673409 - DNA, 23 bp, Homo sapiens
attgtattaggtgtcatttccat

SEQ ID NO: 2673410 - DNA, 18 bp, Homo sapiens
atttaatcttttttatgt

SEQ ID NO: 2673411 - DNA, 15 bp, Homo sapiens
atttaattcatgttt

SEQ ID NO: 2673412 - DNA, 16 bp, Homo sapiens
atttagggaactgctt

SEQ ID NO: 2673413 - DNA, 23 bp, Homo sapiens
atttcacagtgtgtttgtgattg

SEQ ID NO: 2673414 - DNA, 17 bp, Homo sapiens
attttacaattgaaatg

SEQ ID NO: 2673415 - DNA, 21 bp, Homo sapiens
attttacaattgaaatgacta

SEQ ID NO: 2673416 - DNA, 19 bp, Homo sapiens
atttttatattagttgctt

SEQ ID NO: 2673417 - DNA, 13 bp, Homo sapiens
attttttcatttc

SEQ ID NO: 2673418 - DNA, 14 bp, Homo sapiens
attttttcatttca

SEQ ID NO: 2673419 - DNA, 15 bp, Homo sapiens
caaaaaaaagtctat

SEQ ID NO: 2673420 - DNA, 16 bp, Homo sapiens
caaaaaattagccggg

SEQ ID NO: 2673421 - DNA, 18 bp, Homo sapiens
caaaaaattagccgggcg

SEQ ID NO: 2673422 - DNA, 13 bp, Homo sapiens
caaaaagcttccc

SEQ ID NO: 2673423 - DNA, 19 bp, Homo sapiens
caaaatcaagcaagcctct

SEQ ID NO: 2673424 - DNA, 12 bp, Homo sapiens
caaactgtaaaa

SEQ ID NO: 2673425 - DNA, 22 bp, Homo sapiens
caaagagagtttttaatagaac

SEQ ID NO: 2673426 - DNA, 15 bp, Homo sapiens
caaatgctgtattct

SEQ ID NO: 2673427 - DNA, 17 bp, Homo sapiens
caaattttttaaaagag

SEQ ID NO: 2673428 - DNA, 16 bp, Homo sapiens
caagtcagtttctaca

SEQ ID NO: 2673429 - DNA, 18 bp, Homo sapiens
caataaaattatttgcag

SEQ ID NO: 2673430 - DNA, 21 bp, Homo sapiens
caatagtgtcctatgcaataa

SEQ ID NO: 2673431 - DNA, 14 bp, Homo sapiens
caatattgtttcta

SEQ ID NO: 2673432 - DNA, 20 bp, Homo sapiens
caatggtgttatttgaaact

SEQ ID NO: 2673433 - DNA, 15 bp, Homo sapiens
caatgtgatctatgt

SEQ ID NO: 2673434 - DNA, 15 bp, Homo sapiens
cacagctacctcttc

SEQ ID NO: 2673435 - DNA, 16 bp, Homo sapiens
cacgcctgtaatccca

SEQ ID NO: 2673436 - DNA, 19 bp, Homo sapiens
cactgacacaaaaagtaga

SEQ ID NO: 2673437 - DNA, 19 bp, Homo sapiens
cactgtcactgtttctctg

SEQ ID NO: 2673438 - DNA, 12 bp, Homo sapiens
cactgtttctct

SEQ ID NO: 2673439 - DNA, 14 bp, Homo sapiens
cactgtttctctgc

SEQ ID NO: 2673440 - DNA, 21 bp, Homo sapiens
cacttttttgagtggatgatg

SEQ ID NO: 2673441 - DNA, 22 bp, Homo sapiens
cagaaatttaattcatgtttct

SEQ ID NO: 2673442 - DNA, 21 bp, Homo sapiens
cagacacttttttgagtggat

SEQ ID NO: 2673443 - DNA, 13 bp, Homo sapiens
caggaaagaatag

SEQ ID NO: 2673444 - DNA, 21 bp, Homo sapiens
caggcttatgaatatatttaa

SEQ ID NO: 2673445 - DNA, 13 bp, Homo sapiens
cagggctgtgcac

SEQ ID NO: 2673446 - DNA, 13 bp, Homo sapiens
cagttactctgaa

SEQ ID NO: 2673447 - DNA, 16 bp, Homo sapiens
cagttactctgaaggg

SEQ ID NO: 2673448 - DNA, 15 bp, Homo sapiens
cataaagtcagtgcc

SEQ ID NO: 2673449 - DNA, 22 bp, Homo sapiens
catcaatagtgtcctatgcaat

SEQ ID NO: 2673450 - DNA, 21 bp, Homo sapiens
catcctgtgtttctagggaaa

SEQ ID NO: 2673451 - DNA, 13 bp, Homo sapiens
catcttactgaag

SEQ ID NO: 2673452 - DNA, 15 bp, Homo sapiens
catcttactgaaggt

SEQ ID NO: 2673453 - DNA, 14 bp, Homo sapiens
catgcaaatgctgt

SEQ ID NO: 2673454 - DNA, 17 bp, Homo sapiens
catgcatcttactgaag

SEQ ID NO: 2673455 - DNA, 20 bp, Homo sapiens
catgtatagttgcttttgaa

SEQ ID NO: 2673456 - DNA, 16 bp, Homo sapiens
catgttggttgcactt

SEQ ID NO: 2673457 - DNA, 21 bp, Homo sapiens
catgttggttgcactttgtag

SEQ ID NO: 2673458 - DNA, 12 bp, Homo sapiens
cattaaaacaat

SEQ ID NO: 2673459 - DNA, 19 bp, Homo sapiens
cattagaaaaatagcaact

SEQ ID NO: 2673460 - DNA, 16 bp, Homo sapiens
cattcaaaagttgaaa

SEQ ID NO: 2673461 - DNA, 18 bp, Homo sapiens
gcgagactccgtctcaaa

SEQ ID NO: 2673462 - DNA, 13 bp, Homo sapiens
gctcacagctgtg

SEQ ID NO: 2673463 - DNA, 21 bp, Homo sapiens
tcaatagtgtcctatgcaata

SEQ ID NO: 2673464 - DNA, 20 bp, Homo sapiens
tcacaagttgtgtttgatat

SEQ ID NO: 2673465 - DNA, 22 bp, Homo sapiens
tcacctgagcccggatgcttct

SEQ ID NO: 2673466 - DNA, 17 bp, Homo sapiens
tcactgtttctctgctg

SEQ ID NO: 2673467 - DNA, 20 bp, Homo sapiens
tcacttaacattcctaaaat

SEQ ID NO: 2673468 - DNA, 23 bp, Homo sapiens
tcagaaatttaattcatgtttct

SEQ ID NO: 2673469 - DNA, 17 bp, Homo sapiens
tcagttactctgaaggg

SEQ ID NO: 2673470 - DNA, 13 bp, Homo sapiens
tcataatggcctg

SEQ ID NO: 2673471 - DNA, 14 bp, Homo sapiens
tcatgtaaacatac

SEQ ID NO: 2673472 - DNA, 15 bp, Homo sapiens
tcatgtttcttaaat

SEQ ID NO: 2673473 - DNA, 18 bp, Homo sapiens
tcattcaaaagttgaaat

SEQ ID NO: 2673474 - DNA, 13 bp, Homo sapiens
tccaaattcacaa

SEQ ID NO: 2673475 - DNA, 22 bp, Homo sapiens
tccaatgccacatacttgcagc

SEQ ID NO: 2673476 - DNA, 13 bp, Homo sapiens
tccatactcagga

SEQ ID NO: 2673477 - DNA, 12 bp, Homo sapiens
tccattatttat

SEQ ID NO: 2673478 - DNA, 14 bp, Homo sapiens
tccattatttatat

SEQ ID NO: 2673479 - DNA, 15 bp, Homo sapiens
tccattatttatatt

SEQ ID NO: 2673480 - DNA, 19 bp, Homo sapiens
tcccaagattttttcattt

SEQ ID NO: 2673481 - DNA, 13 bp, Homo sapiens
tcccattctatgt

SEQ ID NO: 2673482 - DNA, 22 bp, Homo sapiens
tccctaaggcatgtgtgaaaca

SEQ ID NO: 2673483 - DNA, 19 bp, Homo sapiens
tcccttttacatactgctg

SEQ ID NO: 2673484 - DNA, 22 bp, Homo sapiens
tcctagcttgggaggcttcccc

SEQ ID NO: 2673485 - DNA, 16 bp, Homo sapiens
tcctatgcaataaaat

SEQ ID NO: 2673486 - DNA, 21 bp, Homo sapiens
tccttatcactgacacaaaaa

SEQ ID NO: 2673487 - DNA, 23 bp, Homo sapiens
tccttgcacgcgccctttctacc

SEQ ID NO: 2673488 - DNA, 15 bp, Homo sapiens
tctaactcagaaaca

SEQ ID NO: 2673489 - DNA, 15 bp, Homo sapiens
tctagcaaatgttat

SEQ ID NO: 2673490 - DNA, 16 bp, Homo sapiens
tctagcaaatgttatg

SEQ ID NO: 2673491 - DNA, 12 bp, Homo sapiens
tctatctaatga

SEQ ID NO: 2673492 - DNA, 14 bp, Homo sapiens
tctatctaatgaca

SEQ ID NO: 2673493 - DNA, 16 bp, Homo sapiens
tctatctaatgacatg

SEQ ID NO: 2673494 - DNA, 14 bp, Homo sapiens
tctcctgactttta

SEQ ID NO: 2673495 - DNA, 18 bp, Homo sapiens
tctctaactcagaaacat

SEQ ID NO: 2673496 - DNA, 20 bp, Homo sapiens
tctctaactcagaaacatca

SEQ ID NO: 2673497 - DNA, 14 bp, Homo sapiens
tctctcctgtactt

SEQ ID NO: 2673498 - DNA, 22 bp, Homo sapiens
tctctctcctgtactttttcca

SEQ ID NO: 2673499 - DNA, 22 bp, Homo sapiens
tctctgaagagtgggtttcaca

SEQ ID NO: 2673500 - DNA, 23 bp, Homo sapiens
tctctgaagagtgggtttcacaa

SEQ ID NO: 2673501 - DNA, 14 bp, Homo sapiens
tctctttaaaatgc

SEQ ID NO: 2673502 - DNA, 22 bp, Homo sapiens
tctggcgacagttttccttctc

SEQ ID NO: 2673503 - DNA, 15 bp, Homo sapiens
tcttaaaatgcaata

SEQ ID NO: 2673504 - DNA, 21 bp, Homo sapiens
tcttaaaatgcaatatttgta

SEQ ID NO: 2673505 - DNA, 23 bp, Homo sapiens
tcttaatttaatcttttttatgt

SEQ ID NO: 2673506 - DNA, 14 bp, Homo sapiens
tcttacatgttttc

SEQ ID NO: 2673507 - DNA, 13 bp, Homo sapiens
tcttgtcctagct

SEQ ID NO: 2673508 - DNA, 13 bp, Homo sapiens
tcttgtttttcca

SEQ ID NO: 2673509 - DNA, 20 bp, Homo sapiens
tcttgtttttccactactgc

SEQ ID NO: 2673510 - DNA, 23 bp, Homo sapiens
tctttaaatcattttaggaaagg

SEQ ID NO: 2673511 - DNA, 20 bp, Homo sapiens
tctttcaaaggtagccatca

SEQ ID NO: 2673512 - DNA, 10 bp, Homo sapiens
tctttcacat

SEQ ID NO: 2673513 - DNA, 20 bp, Homo sapiens
tcttttctttgtatcattca

SEQ ID NO: 2673514 - DNA, 13 bp, Homo sapiens
tcttttttatgtg

SEQ ID NO: 2673515 - DNA, 16 bp, Homo sapiens
tgaaagtgatgacata

SEQ ID NO: 2673516 - DNA, 20 bp, Homo sapiens
tgaaagtgatgacatatttt

SEQ ID NO: 2673517 - DNA, 18 bp, Homo sapiens
tgaaattaaccatagatg

SEQ ID NO: 2673518 - DNA, 15 bp, Homo sapiens
tgaagtatactgtat

SEQ ID NO: 2673519 - DNA, 20 bp, Homo sapiens
tgaatatatggcatttgcag

SEQ ID NO: 2673520 - DNA, 22 bp, Homo sapiens
tgaatatatttaagcaacatct

SEQ ID NO: 2673521 - DNA, 21 bp, Homo sapiens
tgaatgccatagtcaaagaga

SEQ ID NO: 2673522 - DNA, 13 bp, Homo sapiens
tgaatttttctct

SEQ ID NO: 2673523 - DNA, 15 bp, Homo sapiens
tgaatttttctctaa

SEQ ID NO: 2673524 - DNA, 13 bp, Homo sapiens
tgacaattgtcac

SEQ ID NO: 2673525 - DNA, 23 bp, Homo sapiens
tgacatgcctatatgagaagaat

SEQ ID NO: 2673526 - DNA, 22 bp, Homo sapiens
tgactaaaaaacaaagaagaca

SEQ ID NO: 2673527 - DNA, 12 bp, Homo sapiens
tgagaagaatag

SEQ ID NO: 2673528 - DNA, 17 bp, Homo sapiens
tgagaatcagatcattt

SEQ ID NO: 2673529 - DNA, 17 bp, Homo sapiens
tgagcccggatgcttct

SEQ ID NO: 2673530 - DNA, 23 bp, Homo sapiens
tgatagcaagtgaatttttctct

SEQ ID NO: 2673531 - DNA, 13 bp, Homo sapiens
tgatatatgtgtt

SEQ ID NO: 2673532 - DNA, 18 bp, Homo sapiens
tgatcaaaaataatgcat

SEQ ID NO: 2673533 - DNA, 15 bp, Homo sapiens
tgattctgtgtgttt

SEQ ID NO: 2673534 - DNA, 16 bp, Homo sapiens
tgattgtttgctctga

SEQ ID NO: 2673535 - DNA, 20 bp, Homo sapiens
tgcaatatttgtaaggcttg

SEQ ID NO: 2673536 - DNA, 14 bp, Homo sapiens
tgcacacagtgctt

SEQ ID NO: 2673537 - DNA, 15 bp, Homo sapiens
tgcacccagaagaag

SEQ ID NO: 2673538 - DNA, 20 bp, Homo sapiens
tgcacgcgccctttctacca

SEQ ID NO: 2673539 - DNA, 13 bp, Homo sapiens
tgcactttgtagt

SEQ ID NO: 2673540 - DNA, 15 bp, Homo sapiens
tgcactttgtagtgt

SEQ ID NO: 2673541 - DNA, 17 bp, Homo sapiens
tgcagataactttgact

SEQ ID NO: 2673542 - DNA, 21 bp, Homo sapiens
tgcaggtctttaaatcatttt

SEQ ID NO: 2673543 - DNA, 22 bp, Homo sapiens
tgcaggtctttaaatcatttta

SEQ ID NO: 2673544 - DNA, 14 bp, Homo sapiens
tgcataagtgaaaa

SEQ ID NO: 2673545 - DNA, 21 bp, Homo sapiens
tgcatccagcagtacaataaa

SEQ ID NO: 2673546 - DNA, 14 bp, Homo sapiens
tgcatcttactgaa

SEQ ID NO: 2673547 - DNA, 18 bp, Homo sapiens
tgccatagtcaaagagag

SEQ ID NO: 2673548 - DNA, 24 bp, Homo sapiens
tgccatagtcaaagagagttttta

SEQ ID NO: 2673549 - DNA, 21 bp, Homo sapiens
tgcctatatgagaagaatagc

SEQ ID NO: 2673550 - DNA, 19 bp, Homo sapiens
tgctcatgggctgtgtgat

SEQ ID NO: 2673551 - DNA, 18 bp, Homo sapiens
tgcttccccttttgccaa

SEQ ID NO: 2673552 - DNA, 19 bp, Homo sapiens
tgctttcatcttggtcaca

SEQ ID NO: 2673553 - DNA, 20 bp, Homo sapiens
tgctttccgtggcactgcat

SEQ ID NO: 2673554 - DNA, 20 bp, Homo sapiens
tgcttttgaaggaatacaat

SEQ ID NO: 2673555 - DNA, 21 bp, Homo sapiens
tggaattatgctggcttctga

SEQ ID NO: 2673556 - DNA, 16 bp, Homo sapiens
tggctatttaaagaca

SEQ ID NO: 2673557 - DNA, 17 bp, Homo sapiens
tggctgtatcttgtttt

SEQ ID NO: 2673558 - DNA, 17 bp, Homo sapiens
tgggaaaggagtagaaa

SEQ ID NO: 2673559 - DNA, 22 bp, Homo sapiens
tgggagaattcttacatgtttt

SEQ ID NO: 2673560 - DNA, 19 bp, Homo sapiens
tggtagggggaaaatgtgt

SEQ ID NO: 2673561 - DNA, 22 bp, Homo sapiens
tggttatttagggaactgcttg

SEQ ID NO: 2673562 - DNA, 13 bp, Homo sapiens
tggtttgtcctga

SEQ ID NO: 2673563 - DNA, 19 bp, Homo sapiens
tgtaaacataccaacatgt

SEQ ID NO: 2673564 - DNA, 21 bp, Homo sapiens
tgtaactggcagttttccatt

SEQ ID NO: 2673565 - DNA, 18 bp, Homo sapiens
tgtacatttccaaattca

SEQ ID NO: 2673566 - DNA, 21 bp, Homo sapiens
tgtacatttccaaattcacaa

SEQ ID NO: 2673567 - DNA, 23 bp, Homo sapiens
tgtaggtggtctggagctgtccg

SEQ ID NO: 2673568 - DNA, 15 bp, Homo sapiens
tgtatagttgctttt

SEQ ID NO: 2673569 - DNA, 22 bp, Homo sapiens
tgtattcttaaaatgcaatatt

SEQ ID NO: 2673570 - DNA, 17 bp, Homo sapiens
tgtatttttaaagcatg

SEQ ID NO: 2673571 - DNA, 13 bp, Homo sapiens
tgtcactgtttct

SEQ ID NO: 2673572 - DNA, 16 bp, Homo sapiens
tgtcatttgttaaaat

SEQ ID NO: 2673573 - DNA, 12 bp, Homo sapiens
tgtcctatgcaa

SEQ ID NO: 2673574 - DNA, 15 bp, Homo sapiens
tgtcctatgcaataa

SEQ ID NO: 2673575 - DNA, 16 bp, Homo sapiens
tgtcctatgcaataaa

SEQ ID NO: 2673576 - DNA, 16 bp, Homo sapiens
tgtccttgaatgccat

SEQ ID NO: 2673577 - DNA, 17 bp, Homo sapiens
tgtccttgaatgccata

SEQ ID NO: 2673578 - DNA, 13 bp, Homo sapiens
tgtctaattaaaa

SEQ ID NO: 2673579 - DNA, 14 bp, Homo sapiens
tgtgtattcttaaa

SEQ ID NO: 2673580 - DNA, 18 bp, Homo sapiens
tgttaagcagctaaattt

SEQ ID NO: 2673581 - DNA, 18 bp, Homo sapiens
tgttataggttgttggat

SEQ ID NO: 2673582 - DNA, 18 bp, Homo sapiens
tgttatggcttaatgaca

SEQ ID NO: 2673583 - DNA, 16 bp, Homo sapiens
tgttctaacatgtaat

SEQ ID NO: 2673584 - DNA, 18 bp, Homo sapiens
tgttgggatcgcattgca

SEQ ID NO: 2673585 - DNA, 20 bp, Homo sapiens
tgtttattgttgctggttat

SEQ ID NO: 2673586 - DNA, 20 bp, Homo sapiens
tgtttcgtgaagtatactgt

SEQ ID NO: 2673587 - DNA, 15 bp, Homo sapiens
tgttttcataataaa

SEQ ID NO: 2673588 - DNA, 20 bp, Homo sapiens
ttaaaatgcaatatttgtaa

SEQ ID NO: 2673589 - DNA, 23 bp, Homo sapiens
ttaaaatgcaatatttgtaaggc

SEQ ID NO: 2673590 - DNA, 21 bp, Homo sapiens
ttaaaatggtttgtcctgatg

SEQ ID NO: 2673591 - DNA, 21 bp, Homo sapiens
ttaaagacaaagacaaattct

SEQ ID NO: 2673592 - DNA, 21 bp, Homo sapiens
ttaaatcattttaggaaagga

SEQ ID NO: 2673593 - DNA, 15 bp, Homo sapiens
ttaaattttaattta

SEQ ID NO: 2673594 - DNA, 19 bp, Homo sapiens
ttaagcaacatctttttaa

SEQ ID NO: 2673595 - DNA, 20 bp, Homo sapiens
ttaatcacttaacattccta

SEQ ID NO: 2673596 - DNA, 14 bp, Homo sapiens
ttaattcatgtttc

SEQ ID NO: 2673597 - DNA, 17 bp, Homo sapiens
ttacaattgaaatgact

SEQ ID NO: 2673598 - DNA, 15 bp, Homo sapiens
ttacatctttcacat

SEQ ID NO: 2673599 - DNA, 12 bp, Homo sapiens
ttacatgttttc

SEQ ID NO: 2673600 - DNA, 15 bp, Homo sapiens
ttactgtttgttatg

SEQ ID NO: 2673601 - DNA, 13 bp, Homo sapiens
ttagccacaaaat

SEQ ID NO: 2673602 - DNA, 16 bp, Homo sapiens
ttagctttactgtttg

SEQ ID NO: 2673603 - DNA, 17 bp, Homo sapiens
ttagctttactgtttgt

SEQ ID NO: 2673604 - DNA, 18 bp, Homo sapiens
gctgatatatgtgttttt

SEQ ID NO: 2673605 - DNA, 20 bp, Homo sapiens
gctgatatatgtgtttttca

SEQ ID NO: 2673606 - DNA, 14 bp, Homo sapiens
gctgtatcttgttt

SEQ ID NO: 2673607 - DNA, 13 bp, Homo sapiens
gctgtattcttct

SEQ ID NO: 2673608 - DNA, 19 bp, Homo sapiens
gcttcgaggcccagcgacc

SEQ ID NO: 2673609 - DNA, 20 bp, Homo sapiens
gcttcttttctttgtatcat

SEQ ID NO: 2673610 - DNA, 19 bp, Homo sapiens
gcttgcagtgagccgagat

SEQ ID NO: 2673611 - DNA, 18 bp, Homo sapiens
gcttgttccaatgccaca

SEQ ID NO: 2673612 - DNA, 19 bp, Homo sapiens
gcttgttccaatgccacat

SEQ ID NO: 2673613 - DNA, 15 bp, Homo sapiens
gctttgttaaaaaaa

SEQ ID NO: 2673614 - DNA, 23 bp, Homo sapiens
gctttgttaaaaaaaaaaagatt

SEQ ID NO: 2673615 - DNA, 20 bp, Homo sapiens
gcttttgtctaattaaaaca

SEQ ID NO: 2673616 - DNA, 21 bp, Homo sapiens
gcttttgtctaattaaaacac

SEQ ID NO: 2673617 - DNA, 21 bp, Homo sapiens
ggaaaggagtagaaaaagcag

SEQ ID NO: 2673618 - DNA, 21 bp, Homo sapiens
ggaaaggatgatcaaaaataa

SEQ ID NO: 2673619 - DNA, 20 bp, Homo sapiens
ggaacggtaaatttctgtgg

SEQ ID NO: 2673620 - DNA, 17 bp, Homo sapiens
ggagttccagcaaacaa

SEQ ID NO: 2673621 - DNA, 21 bp, Homo sapiens
ggcagaggttgcagtgagccg

SEQ ID NO: 2673622 - DNA, 23 bp, Homo sapiens
ggcatcatgcatcttactgaagg

SEQ ID NO: 2673623 - DNA, 13 bp, Homo sapiens
ggcatttcacaaa

SEQ ID NO: 2673624 - DNA, 17 bp, Homo sapiens
ggccaacatggcgaaac

SEQ ID NO: 2673625 - DNA, 16 bp, Homo sapiens
ggcccagcgacctcgg

SEQ ID NO: 2673626 - DNA, 12 bp, Homo sapiens
gggaaggtcacc

SEQ ID NO: 2673627 - DNA, 20 bp, Homo sapiens
gggaggcggagcttgcagtg

SEQ ID NO: 2673628 - DNA, 13 bp, Homo sapiens
gggaggcttcccc

SEQ ID NO: 2673629 - DNA, 19 bp, Homo sapiens
ggtggcccacgcctgtaat

SEQ ID NO: 2673630 - DNA, 21 bp, Homo sapiens
ggtggcttcttttctttgtat

SEQ ID NO: 2673631 - DNA, 16 bp, Homo sapiens
gtaaaattgaaaggca

SEQ ID NO: 2673632 - DNA, 11 bp, Homo sapiens
gtaatttattt

SEQ ID NO: 2673633 - DNA, 15 bp, Homo sapiens
gtattcttaaaatgc

SEQ ID NO: 2673634 - DNA, 20 bp, Homo sapiens
gtccactgtcactgtttctc

SEQ ID NO: 2673635 - DNA, 19 bp, Homo sapiens
gtcccttctcttaatttaa

SEQ ID NO: 2673636 - DNA, 15 bp, Homo sapiens
gtcctatgcaataaa

SEQ ID NO: 2673637 - DNA, 15 bp, Homo sapiens
gtcctctttcaaagg

SEQ ID NO: 2673638 - DNA, 16 bp, Homo sapiens
gtccttgaatgccata

SEQ ID NO: 2673639 - DNA, 22 bp, Homo sapiens
gtctaattaaaacactttcaaa

SEQ ID NO: 2673640 - DNA, 17 bp, Homo sapiens
gtgaagtatactgtatt

SEQ ID NO: 2673641 - DNA, 14 bp, Homo sapiens
gtgaatttttctct

SEQ ID NO: 2673642 - DNA, 16 bp, Homo sapiens
gtgaatttttctctaa

SEQ ID NO: 2673643 - DNA, 15 bp, Homo sapiens
gtgcacccagaagaa

SEQ ID NO: 2673644 - DNA, 21 bp, Homo sapiens
gtgtattcttaaaatgcaata

SEQ ID NO: 2673645 - DNA, 14 bp, Homo sapiens
gtgtgaaacatact

SEQ ID NO: 2673646 - DNA, 18 bp, Homo sapiens
gtgtgatctcttcagggt

SEQ ID NO: 2673647 - DNA, 14 bp, Homo sapiens
gtgtgtttgtgatt

SEQ ID NO: 2673648 - DNA, 17 bp, Homo sapiens
gtgtgttttcataataa

SEQ ID NO: 2673649 - DNA, 15 bp, Homo sapiens
gtgttttcataataa

SEQ ID NO: 2673650 - DNA, 16 bp, Homo sapiens
gtgttttcataataaa

SEQ ID NO: 2673651 - DNA, 15 bp, Homo sapiens
gttacagcacaaaat

SEQ ID NO: 2673652 - DNA, 17 bp, Homo sapiens
gttgccaaacagccaca

SEQ ID NO: 2673653 - DNA, 18 bp, Homo sapiens
gttgggatcgcattgcat

SEQ ID NO: 2673654 - DNA, 16 bp, Homo sapiens
gtttacctgtgaaata

SEQ ID NO: 2673655 - DNA, 15 bp, Homo sapiens
gtttctagggaaatg

SEQ ID NO: 2673656 - DNA, 18 bp, Homo sapiens
gtttctagggaaatgaaa

SEQ ID NO: 2673657 - DNA, 14 bp, Homo sapiens
gttttaaaattaaa

SEQ ID NO: 2673658 - DNA, 14 bp, Homo sapiens
gttttcataataaa

SEQ ID NO: 2673659 - DNA, 14 bp, Homo sapiens
gtttttaactctac

SEQ ID NO: 2673660 - DNA, 15 bp, Homo sapiens
gtttttccactactg

SEQ ID NO: 2673661 - DNA, 14 bp, Homo sapiens
taaaaaacaaagaa

SEQ ID NO: 2673662 - DNA, 15 bp, Homo sapiens
taaaaaatgtgtgta

SEQ ID NO: 2673663 - DNA, 23 bp, Homo sapiens
taaaaaatgtgtgtattcttaaa

SEQ ID NO: 2673664 - DNA, 23 bp, Homo sapiens
taaaaacaaaaacatcccaagat

SEQ ID NO: 2673665 - DNA, 12 bp, Homo sapiens
taaaatgcaata

SEQ ID NO: 2673666 - DNA, 11 bp, Homo sapiens
taaagacaaag

SEQ ID NO: 2673667 - DNA, 22 bp, Homo sapiens
taaagacaaagacaaattctgt

SEQ ID NO: 2673668 - DNA, 12 bp, Homo sapiens
taaatcatttta

SEQ ID NO: 2673669 - DNA, 17 bp, Homo sapiens
taacacatttgattctg

SEQ ID NO: 2673670 - DNA, 22 bp, Homo sapiens
taactcagaaacatcagttact

SEQ ID NO: 2673671 - DNA, 13 bp, Homo sapiens
taactgacaactt

SEQ ID NO: 2673672 - DNA, 17 bp, Homo sapiens
taactgcattgagaact

SEQ ID NO: 2673673 - DNA, 14 bp, Homo sapiens
taagcaacatcttt

SEQ ID NO: 2673674 - DNA, 22 bp, Homo sapiens
taagcagctaaattttctgaaa

SEQ ID NO: 2673675 - DNA, 16 bp, Homo sapiens
taataaagatgctctt

SEQ ID NO: 2673676 - DNA, 21 bp, Homo sapiens
taatcccagcattttgggaag

SEQ ID NO: 2673677 - DNA, 15 bp, Homo sapiens
taattaaaacacttt

SEQ ID NO: 2673678 - DNA, 15 bp, Homo sapiens
tacaattatatcagt

SEQ ID NO: 2673679 - DNA, 19 bp, Homo sapiens
tacaattatatcagtcctc

SEQ ID NO: 2673680 - DNA, 16 bp, Homo sapiens
tacaattgaaatgact

SEQ ID NO: 2673681 - DNA, 14 bp, Homo sapiens
tacatctttcacat

SEQ ID NO: 2673682 - DNA, 21 bp, Homo sapiens
tacatttccaaattcacaagt

SEQ ID NO: 2673683 - DNA, 14 bp, Homo sapiens
tacctcaggaaaga

SEQ ID NO: 2673684 - DNA, 16 bp, Homo sapiens
tacctcaggaaagaat

SEQ ID NO: 2673685 - DNA, 14 bp, Homo sapiens
tactacagttttta

SEQ ID NO: 2673686 - DNA, 22 bp, Homo sapiens
tactctgaagggcatcatgcat

SEQ ID NO: 2673687 - DNA, 20 bp, Homo sapiens
tactttgtcctttttgttat

SEQ ID NO: 2673688 - DNA, 23 bp, Homo sapiens
tagaaccatgttggttgcacttt

SEQ ID NO: 2673689 - DNA, 15 bp, Homo sapiens
tagataaactcagaa

SEQ ID NO: 2673690 - DNA, 18 bp, Homo sapiens
tagcaagtgaatttttct

SEQ ID NO: 2673691 - DNA, 20 bp, Homo sapiens
tagccacaaaattgggaaag

SEQ ID NO: 2673692 - DNA, 19 bp, Homo sapiens
tagcttgggaggcttcccc

SEQ ID NO: 2673693 - DNA, 20 bp, Homo sapiens
taggaacggtaaatttctgt

SEQ ID NO: 2673694 - DNA, 20 bp, Homo sapiens
taggcaaatgtttaaacatt

SEQ ID NO: 2673695 - DNA, 16 bp, Homo sapiens
taggtgtcatttccat

SEQ ID NO: 2673696 - DNA, 14 bp, Homo sapiens
tagtgtcctatgca

SEQ ID NO: 2673697 - DNA, 16 bp, Homo sapiens
tagtgtcctatgcaat

SEQ ID NO: 2673698 - DNA, 14 bp, Homo sapiens
tagttgctttgtta

SEQ ID NO: 2673699 - DNA, 18 bp, Homo sapiens
tagttgcttttgaaggaa

SEQ ID NO: 2673700 - DNA, 19 bp, Homo sapiens
tatatagctggcaagaatg

SEQ ID NO: 2673701 - DNA, 14 bp, Homo sapiens
tatatgagaagaat

SEQ ID NO: 2673702 - DNA, 16 bp, Homo sapiens
tatatgagaagaatag

SEQ ID NO: 2673703 - DNA, 20 bp, Homo sapiens
tatatgagaagaatagccta

SEQ ID NO: 2673704 - DNA, 18 bp, Homo sapiens
tatattagttgctttgtt

SEQ ID NO: 2673705 - DNA, 14 bp, Homo sapiens
tatctgaacattta

SEQ ID NO: 2673706 - DNA, 14 bp, Homo sapiens
tatgcataaagtca

SEQ ID NO: 2673707 - DNA, 19 bp, Homo sapiens
tatggcatttgcagatttt

SEQ ID NO: 2673708 - DNA, 17 bp, Homo sapiens
tatgtgtttttcacatt

SEQ ID NO: 2673709 - DNA, 15 bp, Homo sapiens
tattagccacaaaat

SEQ ID NO: 2673710 - DNA, 23 bp, Homo sapiens
tattagccacaaaattgggaaag

SEQ ID NO: 2673711 - DNA, 14 bp, Homo sapiens
tattagttgctttg

SEQ ID NO: 2673712 - DNA, 16 bp, Homo sapiens
tattatcatgcaaatg

SEQ ID NO: 2673713 - DNA, 18 bp, Homo sapiens
tattatcatgcaaatgct

SEQ ID NO: 2673714 - DNA, 20 bp, Homo sapiens
tattcatgaagcggtcacag

SEQ ID NO: 2673715 - DNA, 17 bp, Homo sapiens
tattcttaaaatgcaat

SEQ ID NO: 2673716 - DNA, 12 bp, Homo sapiens
tatttgaaactt

SEQ ID NO: 2673717 - DNA, 21 bp, Homo sapiens
tattttattacatctttcaca

SEQ ID NO: 2673718 - DNA, 13 bp, Homo sapiens
tattttgccattt

SEQ ID NO: 2673719 - DNA, 19 bp, Homo sapiens
tattttttatatctggaat

SEQ ID NO: 2673720 - DNA, 18 bp, Homo sapiens
tcaaaactcatttcctat

SEQ ID NO: 2673721 - DNA, 16 bp, Homo sapiens
tcaaaagttgaaatta

SEQ ID NO: 2673722 - DNA, 21 bp, Homo sapiens
tcaaattttttaaaagagaca

SEQ ID NO: 2673723 - DNA, 16 bp, Homo sapiens
tcacaaaacagccttt

SEQ ID NO: 2673724 - DNA, 19 bp, Homo sapiens
tcactgacacaaaaagtag

SEQ ID NO: 2673725 - DNA, 14 bp, Homo sapiens
tcactgtttctctg

SEQ ID NO: 2673726 - DNA, 20 bp, Homo sapiens
tcagagacaggaagtcttca

SEQ ID NO: 2673727 - DNA, 21 bp, Homo sapiens
tcagatcatttcaaaactcat

SEQ ID NO: 2673728 - DNA, 20 bp, Homo sapiens
tcaggaaagaatagaaagaa

SEQ ID NO: 2673729 - DNA, 14 bp, Homo sapiens
tcaggactcctctc

SEQ ID NO: 2673730 - DNA, 16 bp, Homo sapiens
tcagtgcccaactgtt

SEQ ID NO: 2673731 - DNA, 16 bp, Homo sapiens
tcagttactctgaagg

SEQ ID NO: 2673732 - DNA, 11 bp, Homo sapiens
tcatgtttctt

SEQ ID NO: 2673733 - DNA, 16 bp, Homo sapiens
tcatgtttcttaaatg

SEQ ID NO: 2673734 - DNA, 22 bp, Homo sapiens
tcattcaaaagttgaaattaac

SEQ ID NO: 2673735 - DNA, 22 bp, Homo sapiens
tcatttcctatgtaactgcatt

SEQ ID NO: 2673736 - DNA, 15 bp, Homo sapiens
tcattttaggaaagg

SEQ ID NO: 2673737 - DNA, 19 bp, Homo sapiens
tccactgtcactgtttctc

SEQ ID NO: 2673738 - DNA, 16 bp, Homo sapiens
tcccagctactcggga

SEQ ID NO: 2673739 - DNA, 15 bp, Homo sapiens
tcccattctatgtgt

SEQ ID NO: 2673740 - DNA, 20 bp, Homo sapiens
tcccttttacatactgctgt

SEQ ID NO: 2673741 - DNA, 21 bp, Homo sapiens
tcctagcttgggaggcttccc

SEQ ID NO: 2673742 - DNA, 12 bp, Homo sapiens
tcctatgcaata

SEQ ID NO: 2673743 - DNA, 20 bp, Homo sapiens
tcctctccgcagttcctgtc

SEQ ID NO: 2673744 - DNA, 14 bp, Homo sapiens
tcctgctactctgt

SEQ ID NO: 2673745 - DNA, 18 bp, Homo sapiens
tcctgctactctgttcct

SEQ ID NO: 2673746 - DNA, 17 bp, Homo sapiens
caaaaattagccgggcg

SEQ ID NO: 2673747 - DNA, 21 bp, Homo sapiens
caaaactcatttcctatgtaa

SEQ ID NO: 2673748 - DNA, 13 bp, Homo sapiens
caaaaggaagtct

SEQ ID NO: 2673749 - DNA, 16 bp, Homo sapiens
caaaatctgttctaac

SEQ ID NO: 2673750 - DNA, 17 bp, Homo sapiens
caaaatctgttctaaca

SEQ ID NO: 2673751 - DNA, 13 bp, Homo sapiens
caaacagccacac

SEQ ID NO: 2673752 - DNA, 21 bp, Homo sapiens
caaagacaaattctgtttctt

SEQ ID NO: 2673753 - DNA, 14 bp, Homo sapiens
caaagagagttttt

SEQ ID NO: 2673754 - DNA, 19 bp, Homo sapiens
caaagtatcaggacgagaa

SEQ ID NO: 2673755 - DNA, 14 bp, Homo sapiens
caaatgtaaacatt

SEQ ID NO: 2673756 - DNA, 20 bp, Homo sapiens
caaatgtgtatcggatgctt

SEQ ID NO: 2673757 - DNA, 21 bp, Homo sapiens
caaatgttatgcataaagtca

SEQ ID NO: 2673758 - DNA, 18 bp, Homo sapiens
caactatattatcatgca

SEQ ID NO: 2673759 - DNA, 13 bp, Homo sapiens
caagtcagtttct

SEQ ID NO: 2673760 - DNA, 19 bp, Homo sapiens
caagtgaatttttctctaa

SEQ ID NO: 2673761 - DNA, 16 bp, Homo sapiens
caagtgttcacaacct

SEQ ID NO: 2673762 - DNA, 17 bp, Homo sapiens
caagttgaagactttgt

SEQ ID NO: 2673763 - DNA, 23 bp, Homo sapiens
caatagaaggatgtacatttcca

SEQ ID NO: 2673764 - DNA, 20 bp, Homo sapiens
caatagtgtcctatgcaata

SEQ ID NO: 2673765 - DNA, 22 bp, Homo sapiens
caatagtgtcctatgcaataaa

SEQ ID NO: 2673766 - DNA, 23 bp, Homo sapiens
caattatatcagtcctctttcaa

SEQ ID NO: 2673767 - DNA, 13 bp, Homo sapiens
cacaaaacagcct

SEQ ID NO: 2673768 - DNA, 12 bp, Homo sapiens
cacaagtgaaaa

SEQ ID NO: 2673769 - DNA, 17 bp, Homo sapiens
cacatcctgtgtttcta

SEQ ID NO: 2673770 - DNA, 22 bp, Homo sapiens
cacatctcctccatactcagga

SEQ ID NO: 2673771 - DNA, 21 bp, Homo sapiens
caccaattggataaagcagct

SEQ ID NO: 2673772 - DNA, 16 bp, Homo sapiens
cacgttgcctctactt

SEQ ID NO: 2673773 - DNA, 21 bp, Homo sapiens
cactactgctaccacaactat

SEQ ID NO: 2673774 - DNA, 16 bp, Homo sapiens
cactccagcctgggtg

SEQ ID NO: 2673775 - DNA, 22 bp, Homo sapiens
cactgtcactgtttctctgctg

SEQ ID NO: 2673776 - DNA, 21 bp, Homo sapiens
cacttaacattcctaaaatgc

SEQ ID NO: 2673777 - DNA, 17 bp, Homo sapiens
cagaaacatcagttact

SEQ ID NO: 2673778 - DNA, 19 bp, Homo sapiens
cagaaacatcagttactct

SEQ ID NO: 2673779 - DNA, 22 bp, Homo sapiens
cagaaacatcagttactctgaa

SEQ ID NO: 2673780 - DNA, 20 bp, Homo sapiens
cagactgacaaatgtgtatc

SEQ ID NO: 2673781 - DNA, 14 bp, Homo sapiens
ctactttgtccttt

SEQ ID NO: 2673782 - DNA, 22 bp, Homo sapiens
ctactttgtcctttttgttatt

SEQ ID NO: 2673783 - DNA, 16 bp, Homo sapiens
ctatatgagaagaata

SEQ ID NO: 2673784 - DNA, 13 bp, Homo sapiens
ctatctaatgaca

SEQ ID NO: 2673785 - DNA, 15 bp, Homo sapiens
ctatctaatgacatg

SEQ ID NO: 2673786 - DNA, 16 bp, Homo sapiens
ctatgaactgaaggca

SEQ ID NO: 2673787 - DNA, 18 bp, Homo sapiens
ctatggggatggtccact

SEQ ID NO: 2673788 - DNA, 14 bp, Homo sapiens
ctatgtttcatctt

SEQ ID NO: 2673789 - DNA, 15 bp, Homo sapiens
ctatgtttcatcttg

SEQ ID NO: 2673790 - DNA, 17 bp, Homo sapiens
ctatttagtttttgtaa

SEQ ID NO: 2673791 - DNA, 22 bp, Homo sapiens
ctatttagtttttgtaatttat

SEQ ID NO: 2673792 - DNA, 17 bp, Homo sapiens
ctcactatcctacccca

SEQ ID NO: 2673793 - DNA, 11 bp, Homo sapiens
ctcaggaaaga

SEQ ID NO: 2673794 - DNA, 15 bp, Homo sapiens
ctcaggaaagaatag

SEQ ID NO: 2673795 - DNA, 15 bp, Homo sapiens
ctcaggactcctctc

SEQ ID NO: 2673796 - DNA, 15 bp, Homo sapiens
ctcattcaaaagttg

SEQ ID NO: 2673797 - DNA, 19 bp, Homo sapiens
ctcattcaaaagttgaaat

SEQ ID NO: 2673798 - DNA, 14 bp, Homo sapiens
ctccatactcagga

SEQ ID NO: 2673799 - DNA, 15 bp, Homo sapiens
ctccgcagttcctgt

SEQ ID NO: 2673800 - DNA, 18 bp, Homo sapiens
ctcctgctactctgttcc

SEQ ID NO: 2673801 - DNA, 22 bp, Homo sapiens
ctctgaagagtgggtttcacaa

SEQ ID NO: 2673802 - DNA, 17 bp, Homo sapiens
ctctgaagggcatcatg

SEQ ID NO: 2673803 - DNA, 16 bp, Homo sapiens
ctctggcgacagtttt

SEQ ID NO: 2673804 - DNA, 16 bp, Homo sapiens
ctctgttccttcacat

SEQ ID NO: 2673805 - DNA, 19 bp, Homo sapiens
ctcttcttaacttaaattt

SEQ ID NO: 2673806 - DNA, 21 bp, Homo sapiens
ctgaacatttactacagtttt

SEQ ID NO: 2673807 - DNA, 20 bp, Homo sapiens
ctgaagagtgggtttcacaa

SEQ ID NO: 2673808 - DNA, 18 bp, Homo sapiens
ctgaaggcagcatgtata

SEQ ID NO: 2673809 - DNA, 22 bp, Homo sapiens
ctgacaatggtgttatttgaaa

SEQ ID NO: 2673810 - DNA, 21 bp, Homo sapiens
ctgacttttaatgtcatttgt

SEQ ID NO: 2673811 - DNA, 19 bp, Homo sapiens
ctgagtagctctcctgact

SEQ ID NO: 2673812 - DNA, 15 bp, Homo sapiens
ctgatatatgtgttt

SEQ ID NO: 2673813 - DNA, 16 bp, Homo sapiens
ctgcactccagcctgg

SEQ ID NO: 2673814 - DNA, 16 bp, Homo sapiens
ctggcaaacatgaaaa

SEQ ID NO: 2673815 - DNA, 13 bp, Homo sapiens
ctggcaagaatgg

SEQ ID NO: 2673816 - DNA, 15 bp, Homo sapiens
ctggcagttttccat

SEQ ID NO: 2673817 - DNA, 20 bp, Homo sapiens
ctgtcactgtttctctgctg

SEQ ID NO: 2673818 - DNA, 16 bp, Homo sapiens
ctgtgtgttttcataa

SEQ ID NO: 2673819 - DNA, 19 bp, Homo sapiens
ctgtgtgttttcataataa

SEQ ID NO: 2673820 - DNA, 21 bp, Homo sapiens
ctgttccttcacatcctgtgt

SEQ ID NO: 2673821 - DNA, 14 bp, Homo sapiens
ctgtttctctgctg

SEQ ID NO: 2673822 - DNA, 17 bp, Homo sapiens
ctgtttctgcttgctct

SEQ ID NO: 2673823 - DNA, 12 bp, Homo sapiens
ctgtttgttatg

SEQ ID NO: 2673824 - DNA, 14 bp, Homo sapiens
cttaaaatgcaata

SEQ ID NO: 2673825 - DNA, 19 bp, Homo sapiens
cttaaaatgcaatatttgt

SEQ ID NO: 2673826 - DNA, 22 bp, Homo sapiens
cttaacttaaattttaatttat

SEQ ID NO: 2673827 - DNA, 18 bp, Homo sapiens
cttatcactgacacaaaa

SEQ ID NO: 2673828 - DNA, 20 bp, Homo sapiens
cttcacatcctgtgtttcta

SEQ ID NO: 2673829 - DNA, 15 bp, Homo sapiens
cttcataatggcctg

SEQ ID NO: 2673830 - DNA, 14 bp, Homo sapiens
cttctgaatatttt

SEQ ID NO: 2673831 - DNA, 15 bp, Homo sapiens
cttcttttctttgta

SEQ ID NO: 2673832 - DNA, 18 bp, Homo sapiens
cttgtcctagcttgggag

SEQ ID NO: 2673833 - DNA, 15 bp, Homo sapiens
ctttaaatcatttta

SEQ ID NO: 2673834 - DNA, 19 bp, Homo sapiens
ctttccgtggcactgcata

SEQ ID NO: 2673835 - DNA, 14 bp, Homo sapiens
ctttgactttcttc

SEQ ID NO: 2673836 - DNA, 15 bp, Homo sapiens
ctttgggaaaggaga

SEQ ID NO: 2673837 - DNA, 15 bp, Homo sapiens
cttttcccttgcttc

SEQ ID NO: 2673838 - DNA, 20 bp, Homo sapiens
gaaacatcagttactctgaa

SEQ ID NO: 2673839 - DNA, 13 bp, Homo sapiens
gaaagaatagaaa

SEQ ID NO: 2673840 - DNA, 15 bp, Homo sapiens
gaaagaatagaaaga

SEQ ID NO: 2673841 - DNA, 17 bp, Homo sapiens
gaaaggcattctctgaa

SEQ ID NO: 2673842 - DNA, 21 bp, Homo sapiens
gaaagtctatctaatgacatg

SEQ ID NO: 2673843 - DNA, 15 bp, Homo sapiens
gaaagtgatgacata

SEQ ID NO: 2673844 - DNA, 13 bp, Homo sapiens
gaaatgaaagaaa

SEQ ID NO: 2673845 - DNA, 13 bp, Homo sapiens
gaagatggctgtt

SEQ ID NO: 2673846 - DNA, 18 bp, Homo sapiens
gaagggcatcatgcatct

SEQ ID NO: 2673847 - DNA, 17 bp, Homo sapiens
gaaggtcacctgagccc

SEQ ID NO: 2673848 - DNA, 22 bp, Homo sapiens
gaatacaatatatagctggcaa

SEQ ID NO: 2673849 - DNA, 17 bp, Homo sapiens
gaatagcctagatatga

SEQ ID NO: 2673850 - DNA, 19 bp, Homo sapiens
gaatatatggcatttgcag

SEQ ID NO: 2673851 - DNA, 23 bp, Homo sapiens
gaatatatggcatttgcagattt

SEQ ID NO: 2673852 - DNA, 19 bp, Homo sapiens
gacaaactgtaaaaaatgt

SEQ ID NO: 2673853 - DNA, 15 bp, Homo sapiens
gacaaattctgtttc

SEQ ID NO: 2673854 - DNA, 17 bp, Homo sapiens
gacaaattctgtttctt

SEQ ID NO: 2673855 - DNA, 12 bp, Homo sapiens
gacaacattaaa

SEQ ID NO: 2673856 - DNA, 18 bp, Homo sapiens
gacatgcctatatgagaa

SEQ ID NO: 2673857 - DNA, 22 bp, Homo sapiens
gacatgcctatatgagaagaat

SEQ ID NO: 2673858 - DNA, 18 bp, Homo sapiens
gagaacctaagtttcagt

SEQ ID NO: 2673859 - DNA, 23 bp, Homo sapiens
gagaactgcatatgtttcgctga

SEQ ID NO: 2673860 - DNA, 13 bp, Homo sapiens
gagaatgagggtc

SEQ ID NO: 2673861 - DNA, 20 bp, Homo sapiens
gagaatggcgtgaacccggg

SEQ ID NO: 2673862 - DNA, 16 bp, Homo sapiens
gagaattcttacatgt

SEQ ID NO: 2673863 - DNA, 15 bp, Homo sapiens
gagataatatgagaa

SEQ ID NO: 2673864 - DNA, 20 bp, Homo sapiens
gagatcgcgccactgcactc

SEQ ID NO: 2673865 - DNA, 18 bp, Homo sapiens
gagatcgtgccattgcac

SEQ ID NO: 2673866 - DNA, 21 bp, Homo sapiens
gagattgtgccacttcactcc

SEQ ID NO: 2673867 - DNA, 17 bp, Homo sapiens
gagcccggatgcttctc

SEQ ID NO: 2673868 - DNA, 20 bp, Homo sapiens
gagccgagatcgcgccactg

SEQ ID NO: 2673869 - DNA, 20 bp, Homo sapiens
ggttatttagggaactgctt

SEQ ID NO: 2673870 - DNA, 13 bp, Homo sapiens
ggttcttcccttt

SEQ ID NO: 2673871 - DNA, 15 bp, Homo sapiens
gtaaaatggaggtgg

SEQ ID NO: 2673872 - DNA, 19 bp, Homo sapiens
gtaaacataccaacatgtt

SEQ ID NO: 2673873 - DNA, 16 bp, Homo sapiens
gtaaatatatgaacat

SEQ ID NO: 2673874 - DNA, 22 bp, Homo sapiens
gtaactgcattgagaactgcat

SEQ ID NO: 2673875 - DNA, 14 bp, Homo sapiens
gtaatataaaagat

SEQ ID NO: 2673876 - DNA, 15 bp, Homo sapiens
gtaatcccagcactt

SEQ ID NO: 2673877 - DNA, 18 bp, Homo sapiens
gtaggaacggtaaatttc

SEQ ID NO: 2673878 - DNA, 19 bp, Homo sapiens
gtattcttaaaatgcaata

SEQ ID NO: 2673879 - DNA, 20 bp, Homo sapiens
gtattcttaaaatgcaatat

SEQ ID NO: 2673880 - DNA, 23 bp, Homo sapiens
gtcatcaatagtgtcctatgcaa

SEQ ID NO: 2673881 - DNA, 12 bp, Homo sapiens
gtccactgtcac

SEQ ID NO: 2673882 - DNA, 20 bp, Homo sapiens
gtcctatgcaataaaattat

SEQ ID NO: 2673883 - DNA, 21 bp, Homo sapiens
gtcctatgcaataaaattatt

SEQ ID NO: 2673884 - DNA, 21 bp, Homo sapiens
gtgaaatagttcaaagccaag

SEQ ID NO: 2673885 - DNA, 15 bp, Homo sapiens
gtgaatttttctcta

SEQ ID NO: 2673886 - DNA, 16 bp, Homo sapiens
gtggaggctgcagtga

SEQ ID NO: 2673887 - DNA, 20 bp, Homo sapiens
gtggcttcttttctttgtat

SEQ ID NO: 2673888 - DNA, 18 bp, Homo sapiens
gtggtggcccacgcctgt

SEQ ID NO: 2673889 - DNA, 18 bp, Homo sapiens
gtggtggctcacgcctgt

SEQ ID NO: 2673890 - DNA, 14 bp, Homo sapiens
gtggttgaagagca

SEQ ID NO: 2673891 - DNA, 13 bp, Homo sapiens
gtgttttcataat

SEQ ID NO: 2673892 - DNA, 14 bp, Homo sapiens
gttactctgaaggg

SEQ ID NO: 2673893 - DNA, 22 bp, Homo sapiens
gttagcgtttcggccttcataa

SEQ ID NO: 2673894 - DNA, 16 bp, Homo sapiens
gttgaagactttgttt

SEQ ID NO: 2673895 - DNA, 14 bp, Homo sapiens
gttgcactttgtag

SEQ ID NO: 2673896 - DNA, 12 bp, Homo sapiens
gtttctctgctg

SEQ ID NO: 2673897 - DNA, 17 bp, Homo sapiens
gttttgttttaaaatta

SEQ ID NO: 2673898 - DNA, 13 bp, Homo sapiens
gtttttaatagaa

SEQ ID NO: 2673899 - DNA, 15 bp, Homo sapiens
gtttttataataaaa

SEQ ID NO: 2673900 - DNA, 17 bp, Homo sapiens
gtttttccactactgct

SEQ ID NO: 2673901 - DNA, 19 bp, Homo sapiens
taaaaaacaaagaagacaa

SEQ ID NO: 2673902 - DNA, 22 bp, Homo sapiens
taaaaaatgtgtgtattcttaa

SEQ ID NO: 2673903 - DNA, 20 bp, Homo sapiens
taaaaaggagaatttttcct

SEQ ID NO: 2673904 - DNA, 21 bp, Homo sapiens
taaaatgcttcactgtacgta

SEQ ID NO: 2673905 - DNA, 16 bp, Homo sapiens
taaaatggtttgtcct

SEQ ID NO: 2673906 - DNA, 16 bp, Homo sapiens
taaagaaagcaacttt

SEQ ID NO: 2673907 - DNA, 15 bp, Homo sapiens
taaagacaaagacaa

SEQ ID NO: 2673908 - DNA, 19 bp, Homo sapiens
taaagacaaagacaaattc

SEQ ID NO: 2673909 - DNA, 20 bp, Homo sapiens
taaagacaaagacaaattct

SEQ ID NO: 2673910 - DNA, 18 bp, Homo sapiens
taaaggggtctgaaattt

SEQ ID NO: 2673911 - DNA, 21 bp, Homo sapiens
taaatatctgaacatttacta

SEQ ID NO: 2673912 - DNA, 11 bp, Homo sapiens
taaatcagtgg

SEQ ID NO: 2673913 - DNA, 20 bp, Homo sapiens
taaatcattttaggaaagga

SEQ ID NO: 2673914 - DNA, 15 bp, Homo sapiens
taaattttctgaaac

SEQ ID NO: 2673915 - DNA, 16 bp, Homo sapiens
taacattcctaaaatg

SEQ ID NO: 2673916 - DNA, 23 bp, Homo sapiens
taactggcagttttccattggtt

SEQ ID NO: 2673917 - DNA, 15 bp, Homo sapiens
taagtgaaaatctta

SEQ ID NO: 2673918 - DNA, 14 bp, Homo sapiens
taataaagatgctc

SEQ ID NO: 2673919 - DNA, 19 bp, Homo sapiens
taatattacctaatgaaag

SEQ ID NO: 2673920 - DNA, 19 bp, Homo sapiens
taatcacttaacattccta

SEQ ID NO: 2673921 - DNA, 22 bp, Homo sapiens
taatgaaagtgatgacatattt

SEQ ID NO: 2673922 - DNA, 16 bp, Homo sapiens
taatgacatgcctata

SEQ ID NO: 2673923 - DNA, 22 bp, Homo sapiens
tacaaaaatttgccaggcgtgg

SEQ ID NO: 2673924 - DNA, 19 bp, Homo sapiens
tacaccagagataatatga

SEQ ID NO: 2673925 - DNA, 20 bp, Homo sapiens
tacaccagagataatatgag

SEQ ID NO: 2673926 - DNA, 12 bp, Homo sapiens
tacatactgctg

SEQ ID NO: 2673927 - DNA, 15 bp, Homo sapiens
tacatctttcacatt

SEQ ID NO: 2673928 - DNA, 14 bp, Homo sapiens
tactctgttccttc

SEQ ID NO: 2673929 - DNA, 19 bp, Homo sapiens
tactctgttccttcacatc

SEQ ID NO: 2673930 - DNA, 22 bp, Homo sapiens
tactgtatttttacctttttcc

SEQ ID NO: 2673931 - DNA, 16 bp, Homo sapiens
tactgtgtaatataaa

SEQ ID NO: 2673932 - DNA, 13 bp, Homo sapiens
tagaaaaagcagt

SEQ ID NO: 2673933 - DNA, 21 bp, Homo sapiens
tagaaccatgttggttgcact

SEQ ID NO: 2673934 - DNA, 22 bp, Homo sapiens
tagcaagtgaatttttctctaa

SEQ ID NO: 2673935 - DNA, 18 bp, Homo sapiens
tagcctagatatgaatat

SEQ ID NO: 2673936 - DNA, 22 bp, Homo sapiens
tagcctagatatgaatatatgg

SEQ ID NO: 2673937 - DNA, 16 bp, Homo sapiens
tagctggcaagaatgg

SEQ ID NO: 2673938 - DNA, 19 bp, Homo sapiens
tagctttactgtttgttat

SEQ ID NO: 2673939 - DNA, 14 bp, Homo sapiens
taggctattcacaa

SEQ ID NO: 2673940 - DNA, 13 bp, Homo sapiens
tagggaaatgaaa

SEQ ID NO: 2673941 - DNA, 14 bp, Homo sapiens
tagtctattagcca

SEQ ID NO: 2673942 - DNA, 17 bp, Homo sapiens
tagtgtcctatgcaata

SEQ ID NO: 2673943 - DNA, 17 bp, Homo sapiens
tagttgcttttgaagga

SEQ ID NO: 2673944 - DNA, 17 bp, Homo sapiens
tagtttttgtaatttat

SEQ ID NO: 2673945 - DNA, 18 bp, Homo sapiens
tatagctggcaagaatgg

SEQ ID NO: 2673946 - DNA, 15 bp, Homo sapiens
tatatgagaagaata

SEQ ID NO: 2673947 - DNA, 15 bp, Homo sapiens
tatatggcatttgca

SEQ ID NO: 2673948 - DNA, 18 bp, Homo sapiens
tatatgtgtttttcacat

SEQ ID NO: 2673949 - DNA, 14 bp, Homo sapiens
tatattatcatgca

SEQ ID NO: 2673950 - DNA, 22 bp, Homo sapiens
tatattatcatgcaaatgctgt

SEQ ID NO: 2673951 - DNA, 20 bp, Homo sapiens
tatatttaagcaacatcttt

SEQ ID NO: 2673952 - DNA, 17 bp, Homo sapiens
tatcatgcaaatgctgt

SEQ ID NO: 2673953 - DNA, 19 bp, Homo sapiens
tatcattcatcttcttctt

SEQ ID NO: 2673954 - DNA, 13 bp, Homo sapiens
tatctaatgacat

SEQ ID NO: 2673955 - DNA, 14 bp, Homo sapiens
tatctaatgacatg

SEQ ID NO: 2673956 - DNA, 15 bp, Homo sapiens
tatctgaacatttac

SEQ ID NO: 2673957 - DNA, 17 bp, Homo sapiens
tatctgaacatttacta

SEQ ID NO: 2673958 - DNA, 21 bp, Homo sapiens
tatgaatatatggcatttgca

SEQ ID NO: 2673959 - DNA, 14 bp, Homo sapiens
tatgagaagaatag

SEQ ID NO: 2673960 - DNA, 12 bp, Homo sapiens
tatgcaataaaa

SEQ ID NO: 2673961 - DNA, 13 bp, Homo sapiens
tatggcatttgca

SEQ ID NO: 2673962 - DNA, 15 bp, Homo sapiens
tatgtgtttttcaca

SEQ ID NO: 2673963 - DNA, 12 bp, Homo sapiens
tattacatcttt

SEQ ID NO: 2673964 - DNA, 17 bp, Homo sapiens
tattacatctttcacat

SEQ ID NO: 2673965 - DNA, 16 bp, Homo sapiens
tattagctttactgtt

SEQ ID NO: 2673966 - DNA, 13 bp, Homo sapiens
tattagttgcttt

SEQ ID NO: 2673967 - DNA, 19 bp, Homo sapiens
tattgctgtccttgaatgc

SEQ ID NO: 2673968 - DNA, 12 bp, Homo sapiens
tatttaaagaca

SEQ ID NO: 2673969 - DNA, 13 bp, Homo sapiens
tatttaaagacaa

SEQ ID NO: 2673970 - DNA, 18 bp, Homo sapiens
tatttaagcaacatcttt

SEQ ID NO: 2673971 - DNA, 14 bp, Homo sapiens
tcaaaagttgaaat

SEQ ID NO: 2673972 - DNA, 18 bp, Homo sapiens
tcaaagccaagtttatat

SEQ ID NO: 2673973 - DNA, 19 bp, Homo sapiens
tcaaaggtagccatcatgg

SEQ ID NO: 2673974 - DNA, 20 bp, Homo sapiens
tcaaattttttaaaagagac

SEQ ID NO: 2673975 - DNA, 19 bp, Homo sapiens
tcaatagtgtcctatgcaa

SEQ ID NO: 2673976 - DNA, 22 bp, Homo sapiens
tcacaaaacagcctttgggaaa

SEQ ID NO: 2673977 - DNA, 16 bp, Homo sapiens
tcacaagtgaaaaaca

SEQ ID NO: 2673978 - DNA, 22 bp, Homo sapiens
tcacaagtgaaaaacatccaga

SEQ ID NO: 2673979 - DNA, 18 bp, Homo sapiens
tcacatacaattattttt

SEQ ID NO: 2673980 - DNA, 17 bp, Homo sapiens
tcacatcctgtgtttct

SEQ ID NO: 2673981 - DNA, 20 bp, Homo sapiens
tcactgtttctctgctgttg

SEQ ID NO: 2673982 - DNA, 18 bp, Homo sapiens
tcagaaacatcagttact

SEQ ID NO: 2673983 - DNA, 23 bp, Homo sapiens
tcagagacaggaagtcttcaggg

SEQ ID NO: 2673984 - DNA, 12 bp, Homo sapiens
tcaggaaagaat

SEQ ID NO: 2673985 - DNA, 14 bp, Homo sapiens
tcaggaaagaatag

SEQ ID NO: 2673986 - DNA, 21 bp, Homo sapiens
tcatcaatagtgtcctatgca

SEQ ID NO: 2673987 - DNA, 13 bp, Homo sapiens
tcatcttctctgg

SEQ ID NO: 2673988 - DNA, 20 bp, Homo sapiens
tcatgcaaatgctgtattct

SEQ ID NO: 2673989 - DNA, 16 bp, Homo sapiens
tcattcaaaagttgaa

SEQ ID NO: 2673990 - DNA, 14 bp, Homo sapiens
tccacagctacctc

SEQ ID NO: 2673991 - DNA, 13 bp, Homo sapiens
tccactactgcta

SEQ ID NO: 2673992 - DNA, 22 bp, Homo sapiens
tccactgtcactgtttctctgc

SEQ ID NO: 2673993 - DNA, 11 bp, Homo sapiens
tccattattta

SEQ ID NO: 2673994 - DNA, 14 bp, Homo sapiens
tcccaagatttttt

SEQ ID NO: 2673995 - DNA, 14 bp, Homo sapiens
tccctcctgctact

SEQ ID NO: 2673996 - DNA, 16 bp, Homo sapiens
tcctccatactcagga

SEQ ID NO: 2673997 - DNA, 13 bp, Homo sapiens
tcctgacttttaa

SEQ ID NO: 2673998 - DNA, 18 bp, Homo sapiens
tcctgtcccttctcttaa

SEQ ID NO: 2673999 - DNA, 12 bp, Homo sapiens
tcctgtgtttct

SEQ ID NO: 2674000 - DNA, 14 bp, Homo sapiens
tccttcacatcctg

SEQ ID NO: 2674001 - DNA, 16 bp, Homo sapiens
tctaattaaaacactt

SEQ ID NO: 2674002 - DNA, 13 bp, Homo sapiens
tctcatctgtgat

SEQ ID NO: 2674003 - DNA, 17 bp, Homo sapiens
tctcatctgtgattccc

SEQ ID NO: 2674004 - DNA, 16 bp, Homo sapiens
tctctggcgacagttt

SEQ ID NO: 2674005 - DNA, 17 bp, Homo sapiens
tctctggcgacagtttt

SEQ ID NO: 2674006 - DNA, 22 bp, Homo sapiens
tctctggcgacagttttccttc

SEQ ID NO: 2674007 - DNA, 21 bp, Homo sapiens
tttgagtggatgatgtttcgt

SEQ ID NO: 2674008 - DNA, 22 bp, Homo sapiens
tttgatacagtcaacaagcctg

SEQ ID NO: 2674009 - DNA, 17 bp, Homo sapiens
tttgatatccaaagctg

SEQ ID NO: 2674010 - DNA, 19 bp, Homo sapiens
tttgtcctgatgcttttgt

SEQ ID NO: 2674011 - DNA, 24 bp, Homo sapiens
tttgttaaaatacagttctgtcat

SEQ ID NO: 2674012 - DNA, 15 bp, Homo sapiens
tttgttttaaaatta

SEQ ID NO: 2674013 - DNA, 23 bp, Homo sapiens
ttttaaaagagacaaactgtaaa

SEQ ID NO: 2674014 - DNA, 12 bp, Homo sapiens
ttttaatagaac

SEQ ID NO: 2674015 - DNA, 16 bp, Homo sapiens
ttttacaattgaaatg

SEQ ID NO: 2674016 - DNA, 15 bp, Homo sapiens
ttttacatactgctg

SEQ ID NO: 2674017 - DNA, 16 bp, Homo sapiens
ttttacatactgctgt

SEQ ID NO: 2674018 - DNA, 12 bp, Homo sapiens
ttttaggaaagg

SEQ ID NO: 2674019 - DNA, 12 bp, Homo sapiens
ttttcataataa

SEQ ID NO: 2674020 - DNA, 12 bp, Homo sapiens
ttttctttgtat

SEQ ID NO: 2674021 - DNA, 18 bp, Homo sapiens
ttttgagtggatgatgtt

SEQ ID NO: 2674022 - DNA, 20 bp, Homo sapiens
tttttaaaagagacaaactg

SEQ ID NO: 2674023 - DNA, 22 bp, Homo sapiens
tttttaactctactgtgtaata

SEQ ID NO: 2674024 - DNA, 12 bp, Homo sapiens
tttttaatagaa

SEQ ID NO: 2674025 - DNA, 17 bp, Homo sapiens
tttttatattagttgct

SEQ ID NO: 2674026 - DNA, 11 bp, Homo sapiens
tttttctctaa

SEQ ID NO: 2674027 - DNA, 18 bp, Homo sapiens
agacaaactgtaaaaaat

SEQ ID NO: 2674028 - DNA, 17 bp, Homo sapiens
agacaaattctgtttct

SEQ ID NO: 2674029 - DNA, 21 bp, Homo sapiens
agacaaattctgtttcttgag

SEQ ID NO: 2674030 - DNA, 22 bp, Homo sapiens
agaccagcctggccaacatggc

SEQ ID NO: 2674031 - DNA, 19 bp, Homo sapiens
agactttgtttttaaaatg

SEQ ID NO: 2674032 - DNA, 22 bp, Homo sapiens
agagaatattagctttactgtt

SEQ ID NO: 2674033 - DNA, 22 bp, Homo sapiens
agagacaaactgtaaaaaatgt

SEQ ID NO: 2674034 - DNA, 13 bp, Homo sapiens
agataaactcaga

SEQ ID NO: 2674035 - DNA, 19 bp, Homo sapiens
agataaactcagaaattta

SEQ ID NO: 2674036 - DNA, 19 bp, Homo sapiens
agataactttgactttctt

SEQ ID NO: 2674037 - DNA, 13 bp, Homo sapiens
agatgctctttta

SEQ ID NO: 2674038 - DNA, 14 bp, Homo sapiens
agattgtattgctg

SEQ ID NO: 2674039 - DNA, 19 bp, Homo sapiens
agatttcttgagttttgtt

SEQ ID NO: 2674040 - DNA, 21 bp, Homo sapiens
agcaacatctagcaaatgtta

SEQ ID NO: 2674041 - DNA, 14 bp, Homo sapiens
agcaagtgaatttt

SEQ ID NO: 2674042 - DNA, 17 bp, Homo sapiens
agcagctaaattttctg

SEQ ID NO: 2674043 - DNA, 17 bp, Homo sapiens
agcagtaactgacaact

SEQ ID NO: 2674044 - DNA, 21 bp, Homo sapiens
agcagttacaaaaaccttccc

SEQ ID NO: 2674045 - DNA, 20 bp, Homo sapiens
agcatgaatttttttcatct

SEQ ID NO: 2674046 - DNA, 17 bp, Homo sapiens
agcatgtatagttgctt

SEQ ID NO: 2674047 - DNA, 19 bp, Homo sapiens
agcctagatatgaatatat

SEQ ID NO: 2674048 - DNA, 17 bp, Homo sapiens
agcctttgggaaatgct

SEQ ID NO: 2674049 - DNA, 20 bp, Homo sapiens
agctcccattctatgtgtca

SEQ ID NO: 2674050 - DNA, 22 bp, Homo sapiens
aggaatgttttgtagctctagg

SEQ ID NO: 2674051 - DNA, 20 bp, Homo sapiens
aggagaatggcgtgaacccg

SEQ ID NO: 2674052 - DNA, 19 bp, Homo sapiens
aggcaaatgtttaaacatt

SEQ ID NO: 2674053 - DNA, 12 bp, Homo sapiens
aggcatggtggc

SEQ ID NO: 2674054 - DNA, 17 bp, Homo sapiens
aggcatgtgtgaaacat

SEQ ID NO: 2674055 - DNA, 19 bp, Homo sapiens
aggctgaggcaggagaatg

SEQ ID NO: 2674056 - DNA, 20 bp, Homo sapiens
aggtggaggctgcagtgagc

SEQ ID NO: 2674057 - DNA, 15 bp, Homo sapiens
aggtgtcatttccat

SEQ ID NO: 2674058 - DNA, 16 bp, Homo sapiens
aggtgttggtgacaat

SEQ ID NO: 2674059 - DNA, 21 bp, Homo sapiens
agtctgtatttttaaagcatg

SEQ ID NO: 2674060 - DNA, 15 bp, Homo sapiens
agtggatgatgtttc

SEQ ID NO: 2674061 - DNA, 15 bp, Homo sapiens
agttactctgaaggg

SEQ ID NO: 2674062 - DNA, 18 bp, Homo sapiens
agttaggctattcacaac

SEQ ID NO: 2674063 - DNA, 23 bp, Homo sapiens
agttgattttacaattgaaatga

SEQ ID NO: 2674064 - DNA, 14 bp, Homo sapiens
agttttccttctca

SEQ ID NO: 2674065 - DNA, 23 bp, Homo sapiens
agtttttaactctactgtgtaat

SEQ ID NO: 2674066 - DNA, 15 bp, Homo sapiens
ataaaattatttgca

SEQ ID NO: 2674067 - DNA, 16 bp, Homo sapiens
ataaaattatttgcag

SEQ ID NO: 2674068 - DNA, 13 bp, Homo sapiens
ataacttcaaatt

SEQ ID NO: 2674069 - DNA, 12 bp, Homo sapiens
ataatatgcaca

SEQ ID NO: 2674070 - DNA, 15 bp, Homo sapiens
atacaaaaatttgcc

SEQ ID NO: 2674071 - DNA, 16 bp, Homo sapiens
atacaatatatagctg

SEQ ID NO: 2674072 - DNA, 19 bp, Homo sapiens
atacaccagagataatatg

SEQ ID NO: 2674073 - DNA, 19 bp, Homo sapiens
atacctcaggaaagaatag

SEQ ID NO: 2674074 - DNA, 20 bp, Homo sapiens
ataccttcggggtacaagtc

SEQ ID NO: 2674075 - DNA, 13 bp, Homo sapiens
atagaaagaaagt

SEQ ID NO: 2674076 - DNA, 18 bp, Homo sapiens
atagtgtcctatgcaata

SEQ ID NO: 2674077 - DNA, 15 bp, Homo sapiens
atagttgcttttgaa

SEQ ID NO: 2674078 - DNA, 14 bp, Homo sapiens
atatacaattatat

SEQ ID NO: 2674079 - DNA, 16 bp, Homo sapiens
atatatggcatttgca

SEQ ID NO: 2674080 - DNA, 13 bp, Homo sapiens
atatatgtgtttt

SEQ ID NO: 2674081 - DNA, 13 bp, Homo sapiens
atatatttaagca

SEQ ID NO: 2674082 - DNA, 13 bp, Homo sapiens
atatgagaagaat

SEQ ID NO: 2674083 - DNA, 19 bp, Homo sapiens
atatgcacacagtgctttc

SEQ ID NO: 2674084 - DNA, 18 bp, Homo sapiens
atattagttgctttgtta

SEQ ID NO: 2674085 - DNA, 21 bp, Homo sapiens
atattatcatgcaaatgctgt

SEQ ID NO: 2674086 - DNA, 19 bp, Homo sapiens
atcagtggttatttaggga

SEQ ID NO: 2674087 - DNA, 19 bp, Homo sapiens
atcatgcaaatgctgtatt

SEQ ID NO: 2674088 - DNA, 16 bp, Homo sapiens
atcattttaggaaagg

SEQ ID NO: 2674089 - DNA, 20 bp, Homo sapiens
atccagatacacccaaagta

SEQ ID NO: 2674090 - DNA, 14 bp, Homo sapiens
atcgcattgcatac

SEQ ID NO: 2674091 - DNA, 20 bp, Homo sapiens
atctatgtttcatcttgttt

SEQ ID NO: 2674092 - DNA, 14 bp, Homo sapiens
atctgttctaacat

SEQ ID NO: 2674093 - DNA, 22 bp, Homo sapiens
atcttacaacaggcttatgaat

SEQ ID NO: 2674094 - DNA, 15 bp, Homo sapiens
atcttactgaaggta

SEQ ID NO: 2674095 - DNA, 14 bp, Homo sapiens
atcttctctggcga

SEQ ID NO: 2674096 - DNA, 22 bp, Homo sapiens
atcttgcagaagttcttagtgt

SEQ ID NO: 2674097 - DNA, 15 bp, Homo sapiens
atcttgtttttccac

SEQ ID NO: 2674098 - DNA, 22 bp, Homo sapiens
atgaatatatggcatttgcaga

SEQ ID NO: 2674099 - DNA, 21 bp, Homo sapiens
atgatgtttcgtgaagtatac

SEQ ID NO: 2674100 - DNA, 15 bp, Homo sapiens
atgcaatatttgtaa

SEQ ID NO: 2674101 - DNA, 15 bp, Homo sapiens
atgcataaagtcagt

SEQ ID NO: 2674102 - DNA, 16 bp, Homo sapiens
atgcatcttactgaag

SEQ ID NO: 2674103 - DNA, 18 bp, Homo sapiens
atgcatcttactgaaggt

SEQ ID NO: 2674104 - DNA, 19 bp, Homo sapiens
atgctgtattcttctttgg

SEQ ID NO: 2674105 - DNA, 14 bp, Homo sapiens
atggaagccaacac

SEQ ID NO: 2674106 - DNA, 13 bp, Homo sapiens
atggcatttgcag

SEQ ID NO: 2674107 - DNA, 23 bp, Homo sapiens
atgtaactgcattgagaactgca

SEQ ID NO: 2674108 - DNA, 21 bp, Homo sapiens
atgtgatctatgtttcatctt

SEQ ID NO: 2674109 - DNA, 21 bp, Homo sapiens
atgtgccgtgttattgtatta

SEQ ID NO: 2674110 - DNA, 18 bp, Homo sapiens
atgtgtatcggatgcttt

SEQ ID NO: 2674111 - DNA, 17 bp, Homo sapiens
atgtgtattttattaca

SEQ ID NO: 2674112 - DNA, 15 bp, Homo sapiens
atgttggttgcactt

SEQ ID NO: 2674113 - DNA, 14 bp, Homo sapiens
atgtttaaacattt

SEQ ID NO: 2674114 - DNA, 14 bp, Homo sapiens
attaaaacaatatt

SEQ ID NO: 2674115 - DNA, 21 bp, Homo sapiens
attaaaacaatattgtttcta

SEQ ID NO: 2674116 - DNA, 21 bp, Homo sapiens
attagaaaaatagcaacttgt

SEQ ID NO: 2674117 - DNA, 17 bp, Homo sapiens
attagccacaaaattgg

SEQ ID NO: 2674118 - DNA, 15 bp, Homo sapiens
attagttgctttgtt

SEQ ID NO: 2674119 - DNA, 16 bp, Homo sapiens
attcatcttcttcttt

SEQ ID NO: 2674120 - DNA, 12 bp, Homo sapiens
attcatgtttct

SEQ ID NO: 2674121 - DNA, 22 bp, Homo sapiens
attctgtgtgttttcataataa

SEQ ID NO: 2674122 - DNA, 23 bp, Homo sapiens
attctgtgtgttttcataataaa

SEQ ID NO: 2674123 - DNA, 18 bp, Homo sapiens
attcttaaaatgcaatat

SEQ ID NO: 2674124 - DNA, 22 bp, Homo sapiens
attcttaaaatgcaatatttgt

SEQ ID NO: 2674125 - DNA, 16 bp, Homo sapiens
attgaaatgactaaaa

SEQ ID NO: 2674126 - DNA, 17 bp, Homo sapiens
attgcactccagcctgg

SEQ ID NO: 2674127 - DNA, 23 bp, Homo sapiens
attgcattaaatataatatgcac

SEQ ID NO: 2674128 - DNA, 14 bp, Homo sapiens
attgtattgctgtc

SEQ ID NO: 2674129 - DNA, 17 bp, Homo sapiens
atttaattcatgtttct

SEQ ID NO: 2674130 - DNA, 18 bp, Homo sapiens
atttagggaactgcttga

SEQ ID NO: 2674131 - DNA, 20 bp, Homo sapiens
atttagtttttgtaatttat

SEQ ID NO: 2674132 - DNA, 14 bp, Homo sapiens
atttatactattta

SEQ ID NO: 2674133 - DNA, 17 bp, Homo sapiens
atttccaaattcacaag

SEQ ID NO: 2674134 - DNA, 17 bp, Homo sapiens
atttccattatttatat

SEQ ID NO: 2674135 - DNA, 20 bp, Homo sapiens
atttcctatgtaactgcatt

SEQ ID NO: 2674136 - DNA, 13 bp, Homo sapiens
atttctgtgggag

SEQ ID NO: 2674137 - DNA, 15 bp, Homo sapiens
atttgcgaatggttc

SEQ ID NO: 2674138 - DNA, 13 bp, Homo sapiens
attttacaattga

SEQ ID NO: 2674139 - DNA, 13 bp, Homo sapiens
attttaggaaagg

SEQ ID NO: 2674140 - DNA, 15 bp, Homo sapiens
attttaggaaaggat

SEQ ID NO: 2674141 - DNA, 14 bp, Homo sapiens
atttttaaagcatg

SEQ ID NO: 2674142 - DNA, 18 bp, Homo sapiens
atttttatattagttgct

SEQ ID NO: 2674143 - DNA, 14 bp, Homo sapiens
caaaaagcttcccc

SEQ ID NO: 2674144 - DNA, 20 bp, Homo sapiens
caaaaattagccgggcgtgg

SEQ ID NO: 2674145 - DNA, 23 bp, Homo sapiens
caaaattgggaaaggagtagaaa

SEQ ID NO: 2674146 - DNA, 21 bp, Homo sapiens
caaagagagtttttaatagaa

SEQ ID NO: 2674147 - DNA, 17 bp, Homo sapiens
caaatgtaaacattttc

SEQ ID NO: 2674148 - DNA, 16 bp, Homo sapiens
caaatgtttaaacatt

SEQ ID NO: 2674149 - DNA, 18 bp, Homo sapiens
caaatgtttaaacatttt

SEQ ID NO: 2674150 - DNA, 19 bp, Homo sapiens
caaattttttaaaagagac

SEQ ID NO: 2674151 - DNA, 16 bp, Homo sapiens
caacaaaaagcttccc

SEQ ID NO: 2674152 - DNA, 13 bp, Homo sapiens
caacatcttttta

SEQ ID NO: 2674153 - DNA, 20 bp, Homo sapiens
caacattaaaacaatattgt

SEQ ID NO: 2674154 - DNA, 17 bp, Homo sapiens
caataaaattatttgca

SEQ ID NO: 2674155 - DNA, 19 bp, Homo sapiens
caataaaattatttgcagg

SEQ ID NO: 2674156 - DNA, 22 bp, Homo sapiens
caataaaattatttgcaggtct

SEQ ID NO: 2674157 - DNA, 20 bp, Homo sapiens
caatatatagctggcaagaa

SEQ ID NO: 2674158 - DNA, 15 bp, Homo sapiens
caatgccacatactt

SEQ ID NO: 2674159 - DNA, 20 bp, Homo sapiens
caatgccacatacttgcagc

SEQ ID NO: 2674160 - DNA, 16 bp, Homo sapiens
caatgtgatctatgtt

SEQ ID NO: 2674161 - DNA, 22 bp, Homo sapiens
caatgtgatctatgtttcatct

SEQ ID NO: 2674162 - DNA, 20 bp, Homo sapiens
caatgtgtggctgaagactt

SEQ ID NO: 2674163 - DNA, 13 bp, Homo sapiens
caattatttttac

SEQ ID NO: 2674164 - DNA, 16 bp, Homo sapiens
cacaagtgaaaaacat

SEQ ID NO: 2674165 - DNA, 13 bp, Homo sapiens
cacagtgtgtttg

SEQ ID NO: 2674166 - DNA, 17 bp, Homo sapiens
cacatttgattctgtgt

SEQ ID NO: 2674167 - DNA, 21 bp, Homo sapiens
cacccagaagaagatggctgt

SEQ ID NO: 2674168 - DNA, 16 bp, Homo sapiens
cactccagcctgggcg

SEQ ID NO: 2674169 - DNA, 18 bp, Homo sapiens
gagaactgcatatgtttc

SEQ ID NO: 2674170 - DNA, 23 bp, Homo sapiens
gagaagaatagcctagatatgaa

SEQ ID NO: 2674171 - DNA, 20 bp, Homo sapiens
gagactttctttctgtaggt

SEQ ID NO: 2674172 - DNA, 17 bp, Homo sapiens
gagagtttttaatagaa

SEQ ID NO: 2674173 - DNA, 16 bp, Homo sapiens
gaggctgaggcaagag

SEQ ID NO: 2674174 - DNA, 13 bp, Homo sapiens
gagttttgtttta

SEQ ID NO: 2674175 - DNA, 16 bp, Homo sapiens
gataaagatttcttga

SEQ ID NO: 2674176 - DNA, 16 bp, Homo sapiens
gataaagcagctcagg

SEQ ID NO: 2674177 - DNA, 19 bp, Homo sapiens
gatacacccaaagtatcag

SEQ ID NO: 2674178 - DNA, 17 bp, Homo sapiens
gatacagtcaacaagcc

SEQ ID NO: 2674179 - DNA, 22 bp, Homo sapiens
gatgtacatttccaaattcaca

SEQ ID NO: 2674180 - DNA, 13 bp, Homo sapiens
gattgtattgctg

SEQ ID NO: 2674181 - DNA, 15 bp, Homo sapiens
gattgtattgctgtc

SEQ ID NO: 2674182 - DNA, 17 bp, Homo sapiens
gcaaatgtttaaacatt

SEQ ID NO: 2674183 - DNA, 13 bp, Homo sapiens
gcaacatcttttt

SEQ ID NO: 2674184 - DNA, 16 bp, Homo sapiens
gcaataaaattatttg

SEQ ID NO: 2674185 - DNA, 19 bp, Homo sapiens
gcaataaaattatttgcag

SEQ ID NO: 2674186 - DNA, 23 bp, Homo sapiens
gcagatttttatattagttgctt

SEQ ID NO: 2674187 - DNA, 13 bp, Homo sapiens
gcagcatgtatag

SEQ ID NO: 2674188 - DNA, 21 bp, Homo sapiens
gcaggtctttaaatcatttta

SEQ ID NO: 2674189 - DNA, 17 bp, Homo sapiens
gcagtacaataaaagta

SEQ ID NO: 2674190 - DNA, 13 bp, Homo sapiens
gcatacaatctga

SEQ ID NO: 2674191 - DNA, 18 bp, Homo sapiens
gcatgtatagttgctttt

SEQ ID NO: 2674192 - DNA, 21 bp, Homo sapiens
gcattgagaactgcatatgtt

SEQ ID NO: 2674193 - DNA, 19 bp, Homo sapiens
gcatttcacaaaacagcct

SEQ ID NO: 2674194 - DNA, 15 bp, Homo sapiens
gccaaacagccacac

SEQ ID NO: 2674195 - DNA, 20 bp, Homo sapiens
gccaagtttatatacaatta

SEQ ID NO: 2674196 - DNA, 17 bp, Homo sapiens
gccacatacttgcagct

SEQ ID NO: 2674197 - DNA, 19 bp, Homo sapiens
gcctatatgagaagaatag

SEQ ID NO: 2674198 - DNA, 20 bp, Homo sapiens
gcctggccaacatggcgaaa

SEQ ID NO: 2674199 - DNA, 23 bp, Homo sapiens
gcgtgaacccgggaggcggagct

SEQ ID NO: 2674200 - DNA, 20 bp, Homo sapiens
gctaatatcaatagaaggat

SEQ ID NO: 2674201 - DNA, 21 bp, Homo sapiens
gctcaagtgttcacaacctgg

SEQ ID NO: 2674202 - DNA, 16 bp, Homo sapiens
gctgtatcttgttttt

SEQ ID NO: 2674203 - DNA, 18 bp, Homo sapiens
gctgtatcttgtttttcc

SEQ ID NO: 2674204 - DNA, 18 bp, Homo sapiens
gcttaatgacactagcta

SEQ ID NO: 2674205 - DNA, 21 bp, Homo sapiens
gcttcgaggcccagcgacctc

SEQ ID NO: 2674206 - DNA, 20 bp, Homo sapiens
ggcggagcttgcagtgagcc

SEQ ID NO: 2674207 - DNA, 22 bp, Homo sapiens
ggcgggtgcctgtaatcccagc

SEQ ID NO: 2674208 - DNA, 13 bp, Homo sapiens
ggctattcacaac

SEQ ID NO: 2674209 - DNA, 13 bp, Homo sapiens
gggcatcatgcat

SEQ ID NO: 2674210 - DNA, 12 bp, Homo sapiens
gggctgtgatcg

SEQ ID NO: 2674211 - DNA, 22 bp, Homo sapiens
gggctgtgcacccagaagaaga

SEQ ID NO: 2674212 - DNA, 23 bp, Homo sapiens
ggtctttaaatcattttaggaaa

SEQ ID NO: 2674213 - DNA, 16 bp, Homo sapiens
gtaaacataccaacat

SEQ ID NO: 2674214 - DNA, 13 bp, Homo sapiens
gtaactgacaact

SEQ ID NO: 2674215 - DNA, 19 bp, Homo sapiens
gtaactgcattgagaactg

SEQ ID NO: 2674216 - DNA, 16 bp, Homo sapiens
gtacaataaaagtaaa

SEQ ID NO: 2674217 - DNA, 21 bp, Homo sapiens
gtaggaacggtaaatttctgt

SEQ ID NO: 2674218 - DNA, 17 bp, Homo sapiens
gtatcaggacgagaatg

SEQ ID NO: 2674219 - DNA, 23 bp, Homo sapiens
gtatcttgtttttccactactgc

SEQ ID NO: 2674220 - DNA, 20 bp, Homo sapiens
gtattgctgtccttgaatgc

SEQ ID NO: 2674221 - DNA, 15 bp, Homo sapiens
gtcactgtttctctg

SEQ ID NO: 2674222 - DNA, 16 bp, Homo sapiens
gtcactgtttctctgc

SEQ ID NO: 2674223 - DNA, 13 bp, Homo sapiens
gtcagtttctaca

SEQ ID NO: 2674224 - DNA, 16 bp, Homo sapiens
gtcatttgttaaaata

SEQ ID NO: 2674225 - DNA, 14 bp, Homo sapiens
gtcccagctactcg

SEQ ID NO: 2674226 - DNA, 23 bp, Homo sapiens
gtcctagcttgggaggcttcccc

SEQ ID NO: 2674227 - DNA, 17 bp, Homo sapiens
gtctatctaatgacatg

SEQ ID NO: 2674228 - DNA, 17 bp, Homo sapiens
gtgaaatagttcaaagc

SEQ ID NO: 2674229 - DNA, 19 bp, Homo sapiens
gtgaagtatactgtatttt

SEQ ID NO: 2674230 - DNA, 18 bp, Homo sapiens
gtgacctccacagctacc

SEQ ID NO: 2674231 - DNA, 13 bp, Homo sapiens
gtgatgacatatt

SEQ ID NO: 2674232 - DNA, 15 bp, Homo sapiens
gtgctgatccttgca

SEQ ID NO: 2674233 - DNA, 15 bp, Homo sapiens
gtggatgatgtttcg

SEQ ID NO: 2674234 - DNA, 14 bp, Homo sapiens
gtgtgtattcttaa

SEQ ID NO: 2674235 - DNA, 18 bp, Homo sapiens
gtgtgttttcataataaa

SEQ ID NO: 2674236 - DNA, 11 bp, Homo sapiens
gtgtttctagg

SEQ ID NO: 2674237 - DNA, 15 bp, Homo sapiens
gtgtttctagggaaa

SEQ ID NO: 2674238 - DNA, 14 bp, Homo sapiens
gtgttttcataata

SEQ ID NO: 2674239 - DNA, 22 bp, Homo sapiens
gttaaaatacagttctgtcata

SEQ ID NO: 2674240 - DNA, 21 bp, Homo sapiens
gttattagggtggtatttagt

SEQ ID NO: 2674241 - DNA, 21 bp, Homo sapiens
gttgcttttgaaggaatacaa

SEQ ID NO: 2674242 - DNA, 21 bp, Homo sapiens
gtttaatattacctaatgaaa

SEQ ID NO: 2674243 - DNA, 20 bp, Homo sapiens
gtttcgtgaagtatactgta

SEQ ID NO: 2674244 - DNA, 13 bp, Homo sapiens
gtttctctgctgt

SEQ ID NO: 2674245 - DNA, 12 bp, Homo sapiens
gttttaaaatta

SEQ ID NO: 2674246 - DNA, 12 bp, Homo sapiens
gttttgtacatg

SEQ ID NO: 2674247 - DNA, 21 bp, Homo sapiens
gtttttaactctactgtgtaa

SEQ ID NO: 2674248 - DNA, 16 bp, Homo sapiens
gtttttccactactgc

SEQ ID NO: 2674249 - DNA, 18 bp, Homo sapiens
gtttttccactactgcta

SEQ ID NO: 2674250 - DNA, 20 bp, Homo sapiens
taaaaaatgtgtgtattctt

SEQ ID NO: 2674251 - DNA, 14 bp, Homo sapiens
taaaacaatattgt

SEQ ID NO: 2674252 - DNA, 17 bp, Homo sapiens
taaaacactttcaaaac

SEQ ID NO: 2674253 - DNA, 16 bp, Homo sapiens
taaaagatcttgcaga

SEQ ID NO: 2674254 - DNA, 16 bp, Homo sapiens
taaaatgcaatatttg

SEQ ID NO: 2674255 - DNA, 18 bp, Homo sapiens
taaaatgcaatatttgta

SEQ ID NO: 2674256 - DNA, 14 bp, Homo sapiens
taaaattaaagcta

SEQ ID NO: 2674257 - DNA, 13 bp, Homo sapiens
taaaattgaaagg

SEQ ID NO: 2674258 - DNA, 14 bp, Homo sapiens
taaagtgaattgtt

SEQ ID NO: 2674259 - DNA, 21 bp, Homo sapiens
taaatcattttaggaaaggat

SEQ ID NO: 2674260 - DNA, 13 bp, Homo sapiens
taacattcctaaa

SEQ ID NO: 2674261 - DNA, 17 bp, Homo sapiens
taacattcctaaaatgc

SEQ ID NO: 2674262 - DNA, 20 bp, Homo sapiens
taacattcctaaaatgcttc

SEQ ID NO: 2674263 - DNA, 24 bp, Homo sapiens
taactggcagttttccattggttt

SEQ ID NO: 2674264 - DNA, 16 bp, Homo sapiens
taagcagctaaatttt

SEQ ID NO: 2674265 - DNA, 18 bp, Homo sapiens
taaggcatgtgtgaaaca

SEQ ID NO: 2674266 - DNA, 20 bp, Homo sapiens
taatgaatcgtaatgaagtt

SEQ ID NO: 2674267 - DNA, 14 bp, Homo sapiens
taattcatgtttct

SEQ ID NO: 2674268 - DNA, 15 bp, Homo sapiens
taattcatgtttctt

SEQ ID NO: 2674269 - DNA, 16 bp, Homo sapiens
tacaagtcagtttcta

SEQ ID NO: 2674270 - DNA, 23 bp, Homo sapiens
tacaatatatagctggcaagaat

SEQ ID NO: 2674271 - DNA, 22 bp, Homo sapiens
tacaatcgagactgcaatgtga

SEQ ID NO: 2674272 - DNA, 22 bp, Homo sapiens
tacaattatttttacagttctc

SEQ ID NO: 2674273 - DNA, 13 bp, Homo sapiens
tacaattgaaatg

SEQ ID NO: 2674274 - DNA, 14 bp, Homo sapiens
tacaattgaaatga

SEQ ID NO: 2674275 - DNA, 20 bp, Homo sapiens
tacatctttcacattggcta

SEQ ID NO: 2674276 - DNA, 18 bp, Homo sapiens
tacctcaggaaagaatag

SEQ ID NO: 2674277 - DNA, 12 bp, Homo sapiens
tactctgaaggg

SEQ ID NO: 2674278 - DNA, 20 bp, Homo sapiens
tacttgcagctcccattcta

SEQ ID NO: 2674279 - DNA, 18 bp, Homo sapiens
tagaaaaatagcaacttg

SEQ ID NO: 2674280 - DNA, 12 bp, Homo sapiens
tagaaagaaagt

SEQ ID NO: 2674281 - DNA, 17 bp, Homo sapiens
tagaaggatgtacattt

SEQ ID NO: 2674282 - DNA, 20 bp, Homo sapiens
tagatgtagataaactcaga

SEQ ID NO: 2674283 - DNA, 11 bp, Homo sapiens
taggaaaggat

SEQ ID NO: 2674284 - DNA, 15 bp, Homo sapiens
taggctattcacaac

SEQ ID NO: 2674285 - DNA, 16 bp, Homo sapiens
tagggaaatgaaagaa

SEQ ID NO: 2674286 - DNA, 21 bp, Homo sapiens
tagttgcttttgaaggaatac

SEQ ID NO: 2674287 - DNA, 13 bp, Homo sapiens
tatagttgctttt

SEQ ID NO: 2674288 - DNA, 18 bp, Homo sapiens
tatatagctggcaagaat

SEQ ID NO: 2674289 - DNA, 14 bp, Homo sapiens
tatattagttgctt

SEQ ID NO: 2674290 - DNA, 20 bp, Homo sapiens
tatattatcatgcaaatgct

SEQ ID NO: 2674291 - DNA, 16 bp, Homo sapiens
tatcatgcaaatgctg

SEQ ID NO: 2674292 - DNA, 19 bp, Homo sapiens
tatctgaacatttactaca

SEQ ID NO: 2674293 - DNA, 16 bp, Homo sapiens
tatctggaatgagcct

SEQ ID NO: 2674294 - DNA, 22 bp, Homo sapiens
tatcttgtttttccactactgc

SEQ ID NO: 2674295 - DNA, 15 bp, Homo sapiens
tatgcataaagtcag

SEQ ID NO: 2674296 - DNA, 22 bp, Homo sapiens
tatgttaagcagctaaattttc

SEQ ID NO: 2674297 - DNA, 17 bp, Homo sapiens
tattacctaatgaaagt

SEQ ID NO: 2674298 - DNA, 13 bp, Homo sapiens
tattcttaaaatg

SEQ ID NO: 2674299 - DNA, 18 bp, Homo sapiens
tattcttaaaatgcaata

SEQ ID NO: 2674300 - DNA, 19 bp, Homo sapiens
tattcttaaaatgcaatat

SEQ ID NO: 2674301 - DNA, 21 bp, Homo sapiens
tattcttaaaatgcaatattt

SEQ ID NO: 2674302 - DNA, 11 bp, Homo sapiens
tattgtttcta

SEQ ID NO: 2674303 - DNA, 17 bp, Homo sapiens
tatttaaagacaaagac

SEQ ID NO: 2674304 - DNA, 17 bp, Homo sapiens
tatttaagcaacatctt

SEQ ID NO: 2674305 - DNA, 17 bp, Homo sapiens
tatttagggaactgctt

SEQ ID NO: 2674306 - DNA, 22 bp, Homo sapiens
tattttaaaggggtctgaaatt

SEQ ID NO: 2674307 - DNA, 16 bp, Homo sapiens
tattttgccatttagc

SEQ ID NO: 2674308 - DNA, 15 bp, Homo sapiens
tcaaaagttgaaatt

SEQ ID NO: 2674309 - DNA, 16 bp, Homo sapiens
tcaaagagagttttta

SEQ ID NO: 2674310 - DNA, 13 bp, Homo sapiens
tcaatagtgtcct

SEQ ID NO: 2674311 - DNA, 17 bp, Homo sapiens
aaatgtttaaacatttt

SEQ ID NO: 2674312 - DNA, 13 bp, Homo sapiens
aaattctgtttct

SEQ ID NO: 2674313 - DNA, 15 bp, Homo sapiens
aaattctgtttcttg

SEQ ID NO: 2674314 - DNA, 23 bp, Homo sapiens
aaattgaaaggcattctctgaag

SEQ ID NO: 2674315 - DNA, 14 bp, Homo sapiens
aacaaaaagcttcc

SEQ ID NO: 2674316 - DNA, 21 bp, Homo sapiens
aacattaaaacaatattgttt

SEQ ID NO: 2674317 - DNA, 17 bp, Homo sapiens
aacattcctaaaatgct

SEQ ID NO: 2674318 - DNA, 18 bp, Homo sapiens
aacattcctaaaatgctt

SEQ ID NO: 2674319 - DNA, 13 bp, Homo sapiens
aacatttactaca

SEQ ID NO: 2674320 - DNA, 17 bp, Homo sapiens
aacggtaaatttctgtg

SEQ ID NO: 2674321 - DNA, 21 bp, Homo sapiens
aactcagaaacatcagttact

SEQ ID NO: 2674322 - DNA, 15 bp, Homo sapiens
aactctactgtgtaa

SEQ ID NO: 2674323 - DNA, 20 bp, Homo sapiens
aactgcattgagaactgcat

SEQ ID NO: 2674324 - DNA, 17 bp, Homo sapiens
aactggcagttttccat

SEQ ID NO: 2674325 - DNA, 16 bp, Homo sapiens
aacttaaattttaatt

SEQ ID NO: 2674326 - DNA, 19 bp, Homo sapiens
aacttaaattttaatttat

SEQ ID NO: 2674327 - DNA, 19 bp, Homo sapiens
aagaaagtctatctaatga

SEQ ID NO: 2674328 - DNA, 21 bp, Homo sapiens
aagaaggggacaatggcagaa

SEQ ID NO: 2674329 - DNA, 20 bp, Homo sapiens
aagaatagcctagatatgaa

SEQ ID NO: 2674330 - DNA, 16 bp, Homo sapiens
aagacaaattctgttt

SEQ ID NO: 2674331 - DNA, 15 bp, Homo sapiens
aagacaacattaaaa

SEQ ID NO: 2674332 - DNA, 20 bp, Homo sapiens
aagagaatattagctttact

SEQ ID NO: 2674333 - DNA, 11 bp, Homo sapiens
aagagagtttt

SEQ ID NO: 2674334 - DNA, 19 bp, Homo sapiens
aagatcttgcagaagttct

SEQ ID NO: 2674335 - DNA, 13 bp, Homo sapiens
aagcagtaactga

SEQ ID NO: 2674336 - DNA, 20 bp, Homo sapiens
aagcctagaagagcttctga

SEQ ID NO: 2674337 - DNA, 23 bp, Homo sapiens
aagctgaatacattctgctttca

SEQ ID NO: 2674338 - DNA, 22 bp, Homo sapiens
aagcttcgaggcccagcgacct

SEQ ID NO: 2674339 - DNA, 13 bp, Homo sapiens
aaggagtagaaaa

SEQ ID NO: 2674340 - DNA, 19 bp, Homo sapiens
aaggcatgtgtgaaacata

SEQ ID NO: 2674341 - DNA, 16 bp, Homo sapiens
aagggcccagattcta

SEQ ID NO: 2674342 - DNA, 12 bp, Homo sapiens
aaggtaaaattg

SEQ ID NO: 2674343 - DNA, 16 bp, Homo sapiens
aaggtaaaattgaaag

SEQ ID NO: 2674344 - DNA, 12 bp, Homo sapiens
aagtatactgta

SEQ ID NO: 2674345 - DNA, 18 bp, Homo sapiens
aagtatactgtattttta

SEQ ID NO: 2674346 - DNA, 19 bp, Homo sapiens
aataaaattatttgcaggt

SEQ ID NO: 2674347 - DNA, 21 bp, Homo sapiens
aatacaaaaaattagccgggc

SEQ ID NO: 2674348 - DNA, 15 bp, Homo sapiens
aatacattctgcttt

SEQ ID NO: 2674349 - DNA, 14 bp, Homo sapiens
aatagaaagaaagt

SEQ ID NO: 2674350 - DNA, 19 bp, Homo sapiens
aatagaaggatgtacattt

SEQ ID NO: 2674351 - DNA, 19 bp, Homo sapiens
aatagtgtcctatgcaata

SEQ ID NO: 2674352 - DNA, 20 bp, Homo sapiens
aatagtgtcctatgcaataa

SEQ ID NO: 2674353 - DNA, 13 bp, Homo sapiens
aatatatggcatt

SEQ ID NO: 2674354 - DNA, 14 bp, Homo sapiens
aatattacctaatg

SEQ ID NO: 2674355 - DNA, 19 bp, Homo sapiens
aatattacctaatgaaagt

SEQ ID NO: 2674356 - DNA, 19 bp, Homo sapiens
aatattagctttactgttt

SEQ ID NO: 2674357 - DNA, 20 bp, Homo sapiens
aatgaatcgtaatgaagttg

SEQ ID NO: 2674358 - DNA, 18 bp, Homo sapiens
aatgcttcactgtacgta

SEQ ID NO: 2674359 - DNA, 16 bp, Homo sapiens
aatggtttgtcctgat

SEQ ID NO: 2674360 - DNA, 19 bp, Homo sapiens
aatgtgatctatgtttcat

SEQ ID NO: 2674361 - DNA, 19 bp, Homo sapiens
aatgtgtatcggatgcttt

SEQ ID NO: 2674362 - DNA, 16 bp, Homo sapiens
aatgtttaaacatttt

SEQ ID NO: 2674363 - DNA, 13 bp, Homo sapiens
aattaaaacactt

SEQ ID NO: 2674364 - DNA, 22 bp, Homo sapiens
aattatatcagtcctctttcaa

SEQ ID NO: 2674365 - DNA, 16 bp, Homo sapiens
aattctgtttcttgag

SEQ ID NO: 2674366 - DNA, 15 bp, Homo sapiens
aattcttacatgttt

SEQ ID NO: 2674367 - DNA, 15 bp, Homo sapiens
aattttaatttattt

SEQ ID NO: 2674368 - DNA, 23 bp, Homo sapiens
acaaaaaaatacctcaggaaaga

SEQ ID NO: 2674369 - DNA, 18 bp, Homo sapiens
acaaagacaaattctgtt

SEQ ID NO: 2674370 - DNA, 22 bp, Homo sapiens
acaaggttcttcccttttacat

SEQ ID NO: 2674371 - DNA, 14 bp, Homo sapiens
acaatattgtttct

SEQ ID NO: 2674372 - DNA, 13 bp, Homo sapiens
acagttctgtcat

SEQ ID NO: 2674373 - DNA, 14 bp, Homo sapiens
acagttttccttct

SEQ ID NO: 2674374 - DNA, 22 bp, Homo sapiens
acagttttccttctcatctgtg

SEQ ID NO: 2674375 - DNA, 19 bp, Homo sapiens
acatattttttatatctgg

SEQ ID NO: 2674376 - DNA, 21 bp, Homo sapiens
acatattttttatatctggaa

SEQ ID NO: 2674377 - DNA, 20 bp, Homo sapiens
acatcagttactctgaaggg

SEQ ID NO: 2674378 - DNA, 14 bp, Homo sapiens
acatcctgtgtttc

SEQ ID NO: 2674379 - DNA, 16 bp, Homo sapiens
acatcctgtgtttcta

SEQ ID NO: 2674380 - DNA, 12 bp, Homo sapiens
acatctttcaca

SEQ ID NO: 2674381 - DNA, 20 bp, Homo sapiens
acattcagctgaggttcatt

SEQ ID NO: 2674382 - DNA, 21 bp, Homo sapiens
acattcagctgaggttcatta

SEQ ID NO: 2674383 - DNA, 21 bp, Homo sapiens
acatttactacagtttttaac

SEQ ID NO: 2674384 - DNA, 14 bp, Homo sapiens
accaaagccaccag

SEQ ID NO: 2674385 - DNA, 20 bp, Homo sapiens
acccctcacaggagcttact

SEQ ID NO: 2674386 - DNA, 20 bp, Homo sapiens
acctaagtttcagttgattt

SEQ ID NO: 2674387 - DNA, 21 bp, Homo sapiens
acctaatgaaagtgatgacat

SEQ ID NO: 2674388 - DNA, 12 bp, Homo sapiens
acctcaggaaag

SEQ ID NO: 2674389 - DNA, 20 bp, Homo sapiens
actatttagtttttgtaatt

SEQ ID NO: 2674390 - DNA, 21 bp, Homo sapiens
actatttagtttttgtaattt

SEQ ID NO: 2674391 - DNA, 13 bp, Homo sapiens
actcattcaaaag

SEQ ID NO: 2674392 - DNA, 19 bp, Homo sapiens
actcttcttaacttaaatt

SEQ ID NO: 2674393 - DNA, 20 bp, Homo sapiens
actcttcttaacttaaattt

SEQ ID NO: 2674394 - DNA, 23 bp, Homo sapiens
actgacacaaaaagtagattaag

SEQ ID NO: 2674395 - DNA, 16 bp, Homo sapiens
actggcagttttccat

SEQ ID NO: 2674396 - DNA, 15 bp, Homo sapiens
actgtcactgtttct

SEQ ID NO: 2674397 - DNA, 16 bp, Homo sapiens
actgtcactgtttctc

SEQ ID NO: 2674398 - DNA, 20 bp, Homo sapiens
actgtcactgtttctctgct

SEQ ID NO: 2674399 - DNA, 15 bp, Homo sapiens
acttaacattcctaa

SEQ ID NO: 2674400 - DNA, 19 bp, Homo sapiens
acttcaaattttttaaaag

SEQ ID NO: 2674401 - DNA, 15 bp, Homo sapiens
actttaaaataaaat

SEQ ID NO: 2674402 - DNA, 12 bp, Homo sapiens
actttgtagtgt

SEQ ID NO: 2674403 - DNA, 11 bp, Homo sapiens
actttttccag

SEQ ID NO: 2674404 - DNA, 14 bp, Homo sapiens
agaaacatcagtta

SEQ ID NO: 2674405 - DNA, 19 bp, Homo sapiens
agaactgcatatgtttcgc

SEQ ID NO: 2674406 - DNA, 20 bp, Homo sapiens
agaactgcatatgtttcgct

SEQ ID NO: 2674407 - DNA, 21 bp, Homo sapiens
agaactgcatatgtttcgctg

SEQ ID NO: 2674408 - DNA, 22 bp, Homo sapiens
agaagagaatattagctttact

SEQ ID NO: 2674409 - DNA, 17 bp, Homo sapiens
agaatcagatcatttca

SEQ ID NO: 2674410 - DNA, 17 bp, Homo sapiens
agaattcttacatgttt

SEQ ID NO: 2674411 - DNA, 18 bp, Homo sapiens
agacaaattctgtttctt

SEQ ID NO: 2674412 - DNA, 19 bp, Homo sapiens
agacaaattctgtttcttg

SEQ ID NO: 2674413 - DNA, 19 bp, Homo sapiens
agaccagcctggccaacat

SEQ ID NO: 2674414 - DNA, 18 bp, Homo sapiens
agactttgtttttaaaat

SEQ ID NO: 2674415 - DNA, 20 bp, Homo sapiens
agagacaaactgtaaaaaat

SEQ ID NO: 2674416 - DNA, 16 bp, Homo sapiens
agagtgggtttcacaa

SEQ ID NO: 2674417 - DNA, 19 bp, Homo sapiens
agatgtagataaactcaga

SEQ ID NO: 2674418 - DNA, 15 bp, Homo sapiens
agattgtattgctgt

SEQ ID NO: 2674419 - DNA, 22 bp, Homo sapiens
agatttttatattagttgcttt

SEQ ID NO: 2674420 - DNA, 15 bp, Homo sapiens
agcactttgcaagga

SEQ ID NO: 2674421 - DNA, 14 bp, Homo sapiens
agcagtacaataaa

SEQ ID NO: 2674422 - DNA, 14 bp, Homo sapiens
agcccggatgcttc

SEQ ID NO: 2674423 - DNA, 17 bp, Homo sapiens
agcctagaagagcttct

SEQ ID NO: 2674424 - DNA, 18 bp, Homo sapiens
agcctagatatgaatata

SEQ ID NO: 2674425 - DNA, 18 bp, Homo sapiens
agctgaatacattctgct

SEQ ID NO: 2674426 - DNA, 18 bp, Homo sapiens
agcttctgaggcgctgct

SEQ ID NO: 2674427 - DNA, 18 bp, Homo sapiens
agcttgggaggcttcccc

SEQ ID NO: 2674428 - DNA, 14 bp, Homo sapiens
aggaattttaaaaa

SEQ ID NO: 2674429 - DNA, 19 bp, Homo sapiens
aggagcaggagcctgagcc

SEQ ID NO: 2674430 - DNA, 20 bp, Homo sapiens
aggaggtggaggctgcagtg

SEQ ID NO: 2674431 - DNA, 16 bp, Homo sapiens
aggcagcatgtatagt

SEQ ID NO: 2674432 - DNA, 21 bp, Homo sapiens
aggcagcatgtatagttgctt

SEQ ID NO: 2674433 - DNA, 18 bp, Homo sapiens
aggcatgtgtgaaacata

SEQ ID NO: 2674434 - DNA, 14 bp, Homo sapiens
agggaaatgaaaga

SEQ ID NO: 2674435 - DNA, 17 bp, Homo sapiens
aggtgtcatttccatta

SEQ ID NO: 2674436 - DNA, 18 bp, Homo sapiens
aggtgttggtgacaattg

SEQ ID NO: 2674437 - DNA, 19 bp, Homo sapiens
aggttcttcccttttacat

SEQ ID NO: 2674438 - DNA, 14 bp, Homo sapiens
agtacaataaaagt

SEQ ID NO: 2674439 - DNA, 18 bp, Homo sapiens
agtctatctaatgacatg

SEQ ID NO: 2674440 - DNA, 14 bp, Homo sapiens
agtctattagccac

SEQ ID NO: 2674441 - DNA, 16 bp, Homo sapiens
agtgaatttttctcta

SEQ ID NO: 2674442 - DNA, 23 bp, Homo sapiens
agtgaatttttctctaactcaga

SEQ ID NO: 2674443 - DNA, 17 bp, Homo sapiens
agtgcccaactgttata

SEQ ID NO: 2674444 - DNA, 15 bp, Homo sapiens
agtgctatgaagaca

SEQ ID NO: 2674445 - DNA, 15 bp, Homo sapiens
agtgttcacaacctg

SEQ ID NO: 2674446 - DNA, 16 bp, Homo sapiens
agttactctgaagggc

SEQ ID NO: 2674447 - DNA, 18 bp, Homo sapiens
agttttccttctcatctg

SEQ ID NO: 2674448 - DNA, 22 bp, Homo sapiens
agttttccttctcatctgtgat

SEQ ID NO: 2674449 - DNA, 18 bp, Homo sapiens
agttttgttttaaaatta

SEQ ID NO: 2674450 - DNA, 15 bp, Homo sapiens
ataaagatgctcttt

SEQ ID NO: 2674451 - DNA, 20 bp, Homo sapiens
ataaagatttcttgagtttt

SEQ ID NO: 2674452 - DNA, 17 bp, Homo sapiens
ataactttgactttctt

SEQ ID NO: 2674453 - DNA, 21 bp, Homo sapiens
tcctgtcccttctcttaattt

SEQ ID NO: 2674454 - DNA, 13 bp, Homo sapiens
tcctttgggaaag

SEQ ID NO: 2674455 - DNA, 14 bp, Homo sapiens
tcctttttgttatt

SEQ ID NO: 2674456 - DNA, 18 bp, Homo sapiens
tcgaggcccagcgacctc

SEQ ID NO: 2674457 - DNA, 19 bp, Homo sapiens
tcgtgaagtatactgtatt

SEQ ID NO: 2674458 - DNA, 21 bp, Homo sapiens
tctacactgggtgctgatcct

SEQ ID NO: 2674459 - DNA, 17 bp, Homo sapiens
tctagggaaatgaaaga

SEQ ID NO: 2674460 - DNA, 18 bp, Homo sapiens
tctcctccatactcagga

SEQ ID NO: 2674461 - DNA, 21 bp, Homo sapiens
tctctaactcagaaacatcag

SEQ ID NO: 2674462 - DNA, 22 bp, Homo sapiens
tctctaactcagaaacatcagt

SEQ ID NO: 2674463 - DNA, 14 bp, Homo sapiens
tctctcctgcggga

SEQ ID NO: 2674464 - DNA, 14 bp, Homo sapiens
tctggaatgagcct

SEQ ID NO: 2674465 - DNA, 13 bp, Homo sapiens
tctgttccttcac

SEQ ID NO: 2674466 - DNA, 15 bp, Homo sapiens
tcttacatgttttct

SEQ ID NO: 2674467 - DNA, 21 bp, Homo sapiens
tcttgtttttccactactgct

SEQ ID NO: 2674468 - DNA, 23 bp, Homo sapiens
tctttaatcacttaacattccta

SEQ ID NO: 2674469 - DNA, 22 bp, Homo sapiens
tctttcaaaggtagccatcatg

SEQ ID NO: 2674470 - DNA, 17 bp, Homo sapiens
tgaaaggcattctctga

SEQ ID NO: 2674471 - DNA, 19 bp, Homo sapiens
tgaaatagttcaaagccaa

SEQ ID NO: 2674472 - DNA, 15 bp, Homo sapiens
tgaacatttactaca

SEQ ID NO: 2674473 - DNA, 19 bp, Homo sapiens
tgaagagtgggtttcacaa

SEQ ID NO: 2674474 - DNA, 16 bp, Homo sapiens
tgaaggaatacaatat

SEQ ID NO: 2674475 - DNA, 21 bp, Homo sapiens
tgaaggtaaaattgaaaggca

SEQ ID NO: 2674476 - DNA, 15 bp, Homo sapiens
tgaatatatggcatt

SEQ ID NO: 2674477 - DNA, 21 bp, Homo sapiens
tgaatatatggcatttgcaga

SEQ ID NO: 2674478 - DNA, 21 bp, Homo sapiens
tgaatttttttcatcttctct

SEQ ID NO: 2674479 - DNA, 17 bp, Homo sapiens
tgatcaaaaataatgca

SEQ ID NO: 2674480 - DNA, 20 bp, Homo sapiens
tgcaataaaattatttgcag

SEQ ID NO: 2674481 - DNA, 22 bp, Homo sapiens
tgcaataaaattatttgcaggt

SEQ ID NO: 2674482 - DNA, 14 bp, Homo sapiens
tgcaatatttgtaa

SEQ ID NO: 2674483 - DNA, 14 bp, Homo sapiens
tgcactccagcctg

SEQ ID NO: 2674484 - DNA, 13 bp, Homo sapiens
tgcatatgtttcg

SEQ ID NO: 2674485 - DNA, 17 bp, Homo sapiens
tgcatcttactgaaggt

SEQ ID NO: 2674486 - DNA, 18 bp, Homo sapiens
tgcatcttactgaaggta

SEQ ID NO: 2674487 - DNA, 17 bp, Homo sapiens
tgcattgagaactgcat

SEQ ID NO: 2674488 - DNA, 17 bp, Homo sapiens
tgccatagtcaaagaga

SEQ ID NO: 2674489 - DNA, 15 bp, Homo sapiens
tgccattgcactcca

SEQ ID NO: 2674490 - DNA, 14 bp, Homo sapiens
tgcccaactgttat

SEQ ID NO: 2674491 - DNA, 17 bp, Homo sapiens
tgctttccgtggcactg

SEQ ID NO: 2674492 - DNA, 22 bp, Homo sapiens
tgctttgttaaaaaaaaaaaga

SEQ ID NO: 2674493 - DNA, 17 bp, Homo sapiens
tggatgatgtttcgtga

SEQ ID NO: 2674494 - DNA, 20 bp, Homo sapiens
tggcccacgcctgtaatccc

SEQ ID NO: 2674495 - DNA, 19 bp, Homo sapiens
tggctcacgcctgtaatcc

SEQ ID NO: 2674496 - DNA, 20 bp, Homo sapiens
tggctgaagacttttgttat

SEQ ID NO: 2674497 - DNA, 16 bp, Homo sapiens
tgggaaaggagtagaa

SEQ ID NO: 2674498 - DNA, 19 bp, Homo sapiens
tggtgttatttgaaacttt

SEQ ID NO: 2674499 - DNA, 16 bp, Homo sapiens
tggttgcactttgtag

SEQ ID NO: 2674500 - DNA, 17 bp, Homo sapiens
tgtaaaaaatgtgtgta

SEQ ID NO: 2674501 - DNA, 23 bp, Homo sapiens
tgtaactgcattgagaactgcat

SEQ ID NO: 2674502 - DNA, 13 bp, Homo sapiens
tgtatagttgctt

SEQ ID NO: 2674503 - DNA, 21 bp, Homo sapiens
tgtattaggtgtcatttccat

SEQ ID NO: 2674504 - DNA, 15 bp, Homo sapiens
tgtcctgatgctttt

SEQ ID NO: 2674505 - DNA, 17 bp, Homo sapiens
tgtcctttttgttatta

SEQ ID NO: 2674506 - DNA, 23 bp, Homo sapiens
tgtcgtgagtgtctcttgtctaa

SEQ ID NO: 2674507 - DNA, 18 bp, Homo sapiens
tgtctaattaaaacactt

SEQ ID NO: 2674508 - DNA, 21 bp, Homo sapiens
tgtgaaatagttcaaagccaa

SEQ ID NO: 2674509 - DNA, 23 bp, Homo sapiens
tgttaagcagctaaattttctga

SEQ ID NO: 2674510 - DNA, 20 bp, Homo sapiens
tgttccaatgccacatactt

SEQ ID NO: 2674511 - DNA, 19 bp, Homo sapiens
tgttggttgcactttgtag

SEQ ID NO: 2674512 - DNA, 14 bp, Homo sapiens
tgttggtttaatat

SEQ ID NO: 2674513 - DNA, 15 bp, Homo sapiens
tgtttcgtgaagtat

SEQ ID NO: 2674514 - DNA, 15 bp, Homo sapiens
tgtttctctgctgtt

SEQ ID NO: 2674515 - DNA, 18 bp, Homo sapiens
tgtttggtgctcatttaa

SEQ ID NO: 2674516 - DNA, 13 bp, Homo sapiens
tgtttttcacatt

SEQ ID NO: 2674517 - DNA, 20 bp, Homo sapiens
ttaaaacaatattgtttcta

SEQ ID NO: 2674518 - DNA, 12 bp, Homo sapiens
ttaaaacacttt

SEQ ID NO: 2674519 - DNA, 18 bp, Homo sapiens
ttaaaatgcaaaataatg

SEQ ID NO: 2674520 - DNA, 19 bp, Homo sapiens
ttaaaatggtttgtcctga

SEQ ID NO: 2674521 - DNA, 17 bp, Homo sapiens
ttaaatatctgaacatt

SEQ ID NO: 2674522 - DNA, 21 bp, Homo sapiens
ttaaatatctgaacatttact

SEQ ID NO: 2674523 - DNA, 22 bp, Homo sapiens
ttaaatatctgaacatttacta

SEQ ID NO: 2674524 - DNA, 22 bp, Homo sapiens
ttaacattcctaaaatgcttca

SEQ ID NO: 2674525 - DNA, 13 bp, Homo sapiens
ttaactctactgt

SEQ ID NO: 2674526 - DNA, 17 bp, Homo sapiens
ttaactctactgtgtaa

SEQ ID NO: 2674527 - DNA, 22 bp, Homo sapiens
ttaacttaaattttaatttatt

SEQ ID NO: 2674528 - DNA, 14 bp, Homo sapiens
ttaagcaacatctt

SEQ ID NO: 2674529 - DNA, 16 bp, Homo sapiens
ttaatgtggttgaaga

SEQ ID NO: 2674530 - DNA, 15 bp, Homo sapiens
ttaattcatgtttct

SEQ ID NO: 2674531 - DNA, 13 bp, Homo sapiens
ttacaattgaaat

SEQ ID NO: 2674532 - DNA, 15 bp, Homo sapiens
ttactacagttttta

SEQ ID NO: 2674533 - DNA, 13 bp, Homo sapiens
ttactctgaaggg

SEQ ID NO: 2674534 - DNA, 15 bp, Homo sapiens
ttagctttactgttt

SEQ ID NO: 2674535 - DNA, 18 bp, Homo sapiens
ttaggaaaggatgatcaa

SEQ ID NO: 2674536 - DNA, 17 bp, Homo sapiens
ttcaaaagttgaaatta

SEQ ID NO: 2674537 - DNA, 23 bp, Homo sapiens
ttcaaagccaagtttatatacaa

SEQ ID NO: 2674538 - DNA, 21 bp, Homo sapiens
ttcaaattttttaaaagagac

SEQ ID NO: 2674539 - DNA, 12 bp, Homo sapiens
ttcacaacctgg

SEQ ID NO: 2674540 - DNA, 20 bp, Homo sapiens
ttcataatggcctgagactt

SEQ ID NO: 2674541 - DNA, 22 bp, Homo sapiens
ttcatcttggtcacatacaatt

SEQ ID NO: 2674542 - DNA, 15 bp, Homo sapiens
ttccactactgctac

SEQ ID NO: 2674543 - DNA, 16 bp, Homo sapiens
ttccccttttgccaat

SEQ ID NO: 2674544 - DNA, 14 bp, Homo sapiens
ttcgagaccagcct

SEQ ID NO: 2674545 - DNA, 12 bp, Homo sapiens
ttcgctgcaacc

SEQ ID NO: 2674546 - DNA, 17 bp, Homo sapiens
ttcgtgaagtatactgt

SEQ ID NO: 2674547 - DNA, 23 bp, Homo sapiens
ttctccatgagacacatctcctc

SEQ ID NO: 2674548 - DNA, 15 bp, Homo sapiens
ttctcttaatttaat

SEQ ID NO: 2674549 - DNA, 18 bp, Homo sapiens
ttcttaaaatgcaatatt

SEQ ID NO: 2674550 - DNA, 21 bp, Homo sapiens
ttcttaaatgggctactttgt

SEQ ID NO: 2674551 - DNA, 20 bp, Homo sapiens
ttcttcccttttacatactg

SEQ ID NO: 2674552 - DNA, 12 bp, Homo sapiens
ttcttctttaat

SEQ ID NO: 2674553 - DNA, 19 bp, Homo sapiens
ttgaaaggcattctctgaa

SEQ ID NO: 2674554 - DNA, 21 bp, Homo sapiens
ttgagaactgcatatgtttcg

SEQ ID NO: 2674555 - DNA, 21 bp, Homo sapiens
ttgagttttgttttaaaatta

SEQ ID NO: 2674556 - DNA, 13 bp, Homo sapiens
ttgccatttagcg

SEQ ID NO: 2674557 - DNA, 16 bp, Homo sapiens
ttgcttccccttttgc

SEQ ID NO: 2674558 - DNA, 20 bp, Homo sapiens
ttgcttccccttttgccaat

SEQ ID NO: 2674559 - DNA, 23 bp, Homo sapiens
ttgctttgttaaaaaaaaaaaga

SEQ ID NO: 2674560 - DNA, 18 bp, Homo sapiens
ttgcttttgaaggaatac

SEQ ID NO: 2674561 - DNA, 21 bp, Homo sapiens
ttgcttttgaaggaatacaat

SEQ ID NO: 2674562 - DNA, 16 bp, Homo sapiens
ttggtggagataaaga

SEQ ID NO: 2674563 - DNA, 16 bp, Homo sapiens
ttgtacagtttaaaat

SEQ ID NO: 2674564 - DNA, 15 bp, Homo sapiens
ttgtattgctgtcct

SEQ ID NO: 2674565 - DNA, 19 bp, Homo sapiens
ttgtcctgatgcttttgtc

SEQ ID NO: 2674566 - DNA, 14 bp, Homo sapiens
tttaaaagagacaa

SEQ ID NO: 2674567 - DNA, 20 bp, Homo sapiens
tttaactatgaactgaaggc

SEQ ID NO: 2674568 - DNA, 21 bp, Homo sapiens
tttaactctactgtgtaatat

SEQ ID NO: 2674569 - DNA, 17 bp, Homo sapiens
tttaattttttaaataa

SEQ ID NO: 2674570 - DNA, 15 bp, Homo sapiens
tttacaattgaaatg

SEQ ID NO: 2674571 - DNA, 15 bp, Homo sapiens
tttacatactgctgt

SEQ ID NO: 2674572 - DNA, 16 bp, Homo sapiens
tttacctgtgaaatag

SEQ ID NO: 2674573 - DNA, 16 bp, Homo sapiens
tttatatctggaatga

SEQ ID NO: 2674574 - DNA, 16 bp, Homo sapiens
tttatattagttgctt

SEQ ID NO: 2674575 - DNA, 21 bp, Homo sapiens
tttatattagttgctttgtta

SEQ ID NO: 2674576 - DNA, 16 bp, Homo sapiens
tttattacatctttca

SEQ ID NO: 2674577 - DNA, 15 bp, Homo sapiens
tttatttatactatt

SEQ ID NO: 2674578 - DNA, 15 bp, Homo sapiens
tttccaaattcacaa

SEQ ID NO: 2674579 - DNA, 23 bp, Homo sapiens
tttccaaattcacaagttgtgtt

SEQ ID NO: 2674580 - DNA, 13 bp, Homo sapiens
tttccactactgc

SEQ ID NO: 2674581 - DNA, 14 bp, Homo sapiens
tttccactactgct

SEQ ID NO: 2674582 - DNA, 13 bp, Homo sapiens
tttccattattta

SEQ ID NO: 2674583 - DNA, 21 bp, Homo sapiens
tttccattatttatattagtt

SEQ ID NO: 2674584 - DNA, 18 bp, Homo sapiens
tttgactttcttctgaat

SEQ ID NO: 2674585 - DNA, 16 bp, Homo sapiens
tttgagtggatgatgt

SEQ ID NO: 2674586 - DNA, 16 bp, Homo sapiens
tttgcaggtctttaaa

SEQ ID NO: 2674587 - DNA, 20 bp, Homo sapiens
tttggtgctcatttaaatat

SEQ ID NO: 2674588 - DNA, 15 bp, Homo sapiens
tttggtggagataaa

SEQ ID NO: 2674589 - DNA, 17 bp, Homo sapiens
tttgtaaggcttgttcc

SEQ ID NO: 2674590 - DNA, 20 bp, Homo sapiens
ttttaatgtcatttgttaaa

SEQ ID NO: 2674591 - DNA, 21 bp, Homo sapiens
ttttatatctggaatgagcct

SEQ ID NO: 2674592 - DNA, 13 bp, Homo sapiens
ttttccactactg

SEQ ID NO: 2674593 - DNA, 15 bp, Homo sapiens
ttttctttgtatcat

SEQ ID NO: 2674594 - DNA, 14 bp, Homo sapiens
ttttgaaggaatac

SEQ ID NO: 2674595 - DNA, 18 bp, Homo sapiens
aaatacctcaggaaagaa

SEQ ID NO: 2674596 - DNA, 15 bp, Homo sapiens
aaatatatgaacatt

SEQ ID NO: 2674597 - DNA, 12 bp, Homo sapiens
aaatgaaagaaa

SEQ ID NO: 2674598 - DNA, 22 bp, Homo sapiens
aaatgactaaaaaacaaagaag

SEQ ID NO: 2674599 - DNA, 11 bp, Homo sapiens
aaatgcaatat

SEQ ID NO: 2674600 - DNA, 15 bp, Homo sapiens
aaatgcaatatttgt

SEQ ID NO: 2674601 - DNA, 20 bp, Homo sapiens
aaatgtgtatcggatgcttt

SEQ ID NO: 2674602 - DNA, 20 bp, Homo sapiens
aaattaaccatagatgtaga

SEQ ID NO: 2674603 - DNA, 14 bp, Homo sapiens
aaattatttgcagg

SEQ ID NO: 2674604 - DNA, 15 bp, Homo sapiens
aaattgggaaaggag

SEQ ID NO: 2674605 - DNA, 17 bp, Homo sapiens
aaatttaattcatgttt

SEQ ID NO: 2674606 - DNA, 18 bp, Homo sapiens
aaattttttaaaagagac

SEQ ID NO: 2674607 - DNA, 14 bp, Homo sapiens
aacaagcccaaagc

SEQ ID NO: 2674608 - DNA, 16 bp, Homo sapiens
aacaatattgtttcta

SEQ ID NO: 2674609 - DNA, 18 bp, Homo sapiens
aacacatttgattctgtg

SEQ ID NO: 2674610 - DNA, 15 bp, Homo sapiens
aacataccaacatgt

SEQ ID NO: 2674611 - DNA, 18 bp, Homo sapiens
aacatcagttactctgaa

SEQ ID NO: 2674612 - DNA, 17 bp, Homo sapiens
aacatttactacagttt

SEQ ID NO: 2674613 - DNA, 14 bp, Homo sapiens
aactgcattgagaa

SEQ ID NO: 2674614 - DNA, 20 bp, Homo sapiens
aactgtaaaaaatgtgtgta

SEQ ID NO: 2674615 - DNA, 14 bp, Homo sapiens
aagaaagcaacttt

SEQ ID NO: 2674616 - DNA, 20 bp, Homo sapiens
aagaactgtcatgtaaacat

SEQ ID NO: 2674617 - DNA, 19 bp, Homo sapiens
aagaatggtggcttctttt

SEQ ID NO: 2674618 - DNA, 19 bp, Homo sapiens
aagagagtttttaatagaa

SEQ ID NO: 2674619 - DNA, 13 bp, Homo sapiens
aagatcttgcaga

SEQ ID NO: 2674620 - DNA, 19 bp, Homo sapiens
aagctcaagtgttcacaac

SEQ ID NO: 2674621 - DNA, 13 bp, Homo sapiens
aagctgaatacat

SEQ ID NO: 2674622 - DNA, 18 bp, Homo sapiens
aagctgagagtgctatga

SEQ ID NO: 2674623 - DNA, 15 bp, Homo sapiens
aaggatgtacatttc

SEQ ID NO: 2674624 - DNA, 12 bp, Homo sapiens
aaggcattctct

SEQ ID NO: 2674625 - DNA, 14 bp, Homo sapiens
aaggcattctctga

SEQ ID NO: 2674626 - DNA, 19 bp, Homo sapiens
aagtgaatttttctctaac

SEQ ID NO: 2674627 - DNA, 13 bp, Homo sapiens
aagtgatgacata

SEQ ID NO: 2674628 - DNA, 11 bp, Homo sapiens
aagtgtaactg

SEQ ID NO: 2674629 - DNA, 14 bp, Homo sapiens
aataaaattatttg

SEQ ID NO: 2674630 - DNA, 17 bp, Homo sapiens
aataaaattatttgcag

SEQ ID NO: 2674631 - DNA, 18 bp, Homo sapiens
aataataaagatgctctt

SEQ ID NO: 2674632 - DNA, 20 bp, Homo sapiens
aatacaaaaattagccgggc

SEQ ID NO: 2674633 - DNA, 14 bp, Homo sapiens
aatacaaaaatttg

SEQ ID NO: 2674634 - DNA, 20 bp, Homo sapiens
aatagaaggatgtacatttc

SEQ ID NO: 2674635 - DNA, 21 bp, Homo sapiens
aatagtgtcctatgcaataaa

SEQ ID NO: 2674636 - DNA, 22 bp, Homo sapiens
aatagtgtcctatgcaataaaa

SEQ ID NO: 2674637 - DNA, 16 bp, Homo sapiens
aatatatgaacattag

SEQ ID NO: 2674638 - DNA, 17 bp, Homo sapiens
aatatatggcatttgca

SEQ ID NO: 2674639 - DNA, 22 bp, Homo sapiens
aatatatggcatttgcagattt

SEQ ID NO: 2674640 - DNA, 15 bp, Homo sapiens
aatatctgaacattt

SEQ ID NO: 2674641 - DNA, 21 bp, Homo sapiens
aatatctgaacatttactaca

SEQ ID NO: 2674642 - DNA, 16 bp, Homo sapiens
aatatgagaatcagat

SEQ ID NO: 2674643 - DNA, 18 bp, Homo sapiens
aatatgcacacagtgctt

SEQ ID NO: 2674644 - DNA, 17 bp, Homo sapiens
aatattttatctttcct

SEQ ID NO: 2674645 - DNA, 19 bp, Homo sapiens
aatcacttaacattcctaa

SEQ ID NO: 2674646 - DNA, 17 bp, Homo sapiens
aatcgagactgcaatgt

SEQ ID NO: 2674647 - DNA, 17 bp, Homo sapiens
aatgaaagtgatgacat

SEQ ID NO: 2674648 - DNA, 15 bp, Homo sapiens
aatggtggcttcttt

SEQ ID NO: 2674649 - DNA, 22 bp, Homo sapiens
aatggtggcttcttttctttgt

SEQ ID NO: 2674650 - DNA, 14 bp, Homo sapiens
aatgtgatctatgt

SEQ ID NO: 2674651 - DNA, 22 bp, Homo sapiens
aatgtgatctatgtttcatctt

SEQ ID NO: 2674652 - DNA, 17 bp, Homo sapiens
aatgtgttttgtacatg

SEQ ID NO: 2674653 - DNA, 14 bp, Homo sapiens
aattagccgggcgt

SEQ ID NO: 2674654 - DNA, 17 bp, Homo sapiens
aattatttttacagttc

SEQ ID NO: 2674655 - DNA, 14 bp, Homo sapiens
aattcatgtttctt

SEQ ID NO: 2674656 - DNA, 18 bp, Homo sapiens
aattcgctgcaacctgtt

SEQ ID NO: 2674657 - DNA, 17 bp, Homo sapiens
aattgaaaggcattctc

SEQ ID NO: 2674658 - DNA, 22 bp, Homo sapiens
aattgaaaggcattctctgaag

SEQ ID NO: 2674659 - DNA, 14 bp, Homo sapiens
aattgttgacaaat

SEQ ID NO: 2674660 - DNA, 18 bp, Homo sapiens
aatttaattcatgtttct

SEQ ID NO: 2674661 - DNA, 23 bp, Homo sapiens
aatttaattcatgtttcttaaat

SEQ ID NO: 2674662 - DNA, 17 bp, Homo sapiens
aatttatttatactatt

SEQ ID NO: 2674663 - DNA, 21 bp, Homo sapiens
acaaaaaaatacctcaggaaa

SEQ ID NO: 2674664 - DNA, 14 bp, Homo sapiens
acaaaaagcttccc

SEQ ID NO: 2674665 - DNA, 15 bp, Homo sapiens
acaaaaagcttcccc

SEQ ID NO: 2674666 - DNA, 18 bp, Homo sapiens
acaaactgtaaaaaatgt

SEQ ID NO: 2674667 - DNA, 14 bp, Homo sapiens
acaaatgtaaacat

SEQ ID NO: 2674668 - DNA, 17 bp, Homo sapiens
acaaatgtaaacatttt

SEQ ID NO: 2674669 - DNA, 22 bp, Homo sapiens
acaaatgtgtatcggatgcttt

SEQ ID NO: 2674670 - DNA, 12 bp, Homo sapiens
acaaattctgtt

SEQ ID NO: 2674671 - DNA, 23 bp, Homo sapiens
acaatatatagctggcaagaatg

SEQ ID NO: 2674672 - DNA, 18 bp, Homo sapiens
acaatggcagaacaggtg

SEQ ID NO: 2674673 - DNA, 18 bp, Homo sapiens
acaattatatcagtcctc

SEQ ID NO: 2674674 - DNA, 14 bp, Homo sapiens
acacagcagcagtt

SEQ ID NO: 2674675 - DNA, 12 bp, Homo sapiens
acacatctcctc

SEQ ID NO: 2674676 - DNA, 22 bp, Homo sapiens
acactagctaatatcaatagaa

SEQ ID NO: 2674677 - DNA, 17 bp, Homo sapiens
acaggaagtcttcaggg

SEQ ID NO: 2674678 - DNA, 17 bp, Homo sapiens
acaggtgttggtgacaa

SEQ ID NO: 2674679 - DNA, 22 bp, Homo sapiens
acatattttttatatctggaat

SEQ ID NO: 2674680 - DNA, 15 bp, Homo sapiens
acatcagttactctg

SEQ ID NO: 2674681 - DNA, 22 bp, Homo sapiens
acattaaaacaatattgtttct

SEQ ID NO: 2674682 - DNA, 12 bp, Homo sapiens
acattctgcttt

SEQ ID NO: 2674683 - DNA, 18 bp, Homo sapiens
acattctgctttcatctt

SEQ ID NO: 2674684 - DNA, 22 bp, Homo sapiens
accacaggaattttaaaaacaa

SEQ ID NO: 2674685 - DNA, 17 bp, Homo sapiens
accagcctggccaacat

SEQ ID NO: 2674686 - DNA, 21 bp, Homo sapiens
acccgggaggcggagcttgca

SEQ ID NO: 2674687 - DNA, 23 bp, Homo sapiens
accctgtaaaatggaggtggaaa

SEQ ID NO: 2674688 - DNA, 13 bp, Homo sapiens
acctaatgaaagt

SEQ ID NO: 2674689 - DNA, 22 bp, Homo sapiens
acctaatgaaagtgatgacata

SEQ ID NO: 2674690 - DNA, 16 bp, Homo sapiens
acctcaggaaagaata

SEQ ID NO: 2674691 - DNA, 23 bp, Homo sapiens
acctcaggaaagaatagaaagaa

SEQ ID NO: 2674692 - DNA, 14 bp, Homo sapiens
acctttttccttcc

SEQ ID NO: 2674693 - DNA, 21 bp, Homo sapiens
acgcctgtaatcccagcactt

SEQ ID NO: 2674694 - DNA, 20 bp, Homo sapiens
actactgctaccacaactat

SEQ ID NO: 2674695 - DNA, 18 bp, Homo sapiens
actcatagatgttatgca

SEQ ID NO: 2674696 - DNA, 14 bp, Homo sapiens
actctactgtgtaa

SEQ ID NO: 2674697 - DNA, 21 bp, Homo sapiens
actctgaagggcatcatgcat

SEQ ID NO: 2674698 - DNA, 20 bp, Homo sapiens
actctgttccttcacatcct

SEQ ID NO: 2674699 - DNA, 15 bp, Homo sapiens
actgcaatgtgatct

SEQ ID NO: 2674700 - DNA, 20 bp, Homo sapiens
actggttgttgccaaacagc

SEQ ID NO: 2674701 - DNA, 15 bp, Homo sapiens
actgtgtaatataaa

SEQ ID NO: 2674702 - DNA, 14 bp, Homo sapiens
actgtttctctgct

SEQ ID NO: 2674703 - DNA, 12 bp, Homo sapiens
actgtttgttat

SEQ ID NO: 2674704 - DNA, 17 bp, Homo sapiens
acttaaattttaattta

SEQ ID NO: 2674705 - DNA, 21 bp, Homo sapiens
acttaacattcctaaaatgct

SEQ ID NO: 2674706 - DNA, 14 bp, Homo sapiens
actttcttctgaat

SEQ ID NO: 2674707 - DNA, 18 bp, Homo sapiens
actttcttctgaatattt

SEQ ID NO: 2674708 - DNA, 20 bp, Homo sapiens
actttcttctgaatatttta

SEQ ID NO: 2674709 - DNA, 15 bp, Homo sapiens
actttgtagtgtttg

SEQ ID NO: 2674710 - DNA, 20 bp, Homo sapiens
actttgtagtgtttggtgct

SEQ ID NO: 2674711 - DNA, 22 bp, Homo sapiens
acttttttgagtggatgatgtt

SEQ ID NO: 2674712 - DNA, 16 bp, Homo sapiens
agaaacatcagttact

SEQ ID NO: 2674713 - DNA, 21 bp, Homo sapiens
agaaatttaattcatgtttct

SEQ ID NO: 2674714 - DNA, 23 bp, Homo sapiens
agaacaggtgttggtgacaattg

SEQ ID NO: 2674715 - DNA, 15 bp, Homo sapiens
agaagttaagcaaca

SEQ ID NO: 2674716 - DNA, 20 bp, Homo sapiens
agaatagcctagatatgaat

SEQ ID NO: 2674717 - DNA, 17 bp, Homo sapiens
agaatggtggcttcttt

SEQ ID NO: 2674718 - DNA, 20 bp, Homo sapiens
agaattcttacatgttttct

SEQ ID NO: 2674719 - DNA, 21 bp, Homo sapiens
agacaaactgtaaaaaatgtg

SEQ ID NO: 2674720 - DNA, 21 bp, Homo sapiens
agactgcaatgtgatctatgt

SEQ ID NO: 2674721 - DNA, 18 bp, Homo sapiens
agagacaaactgtaaaaa

SEQ ID NO: 2674722 - DNA, 17 bp, Homo sapiens
agataaagatttcttga

SEQ ID NO: 2674723 - DNA, 15 bp, Homo sapiens
agataatatgagaat

SEQ ID NO: 2674724 - DNA, 23 bp, Homo sapiens
ttgcttttgaaggaatacaatat

SEQ ID NO: 2674725 - DNA, 19 bp, Homo sapiens
ttggtgctcatttaaatat

SEQ ID NO: 2674726 - DNA, 22 bp, Homo sapiens
ttgttaaaaaaaaaaagattgt

SEQ ID NO: 2674727 - DNA, 19 bp, Homo sapiens
ttgttatggcttaatgaca

SEQ ID NO: 2674728 - DNA, 16 bp, Homo sapiens
tttaactatgaactga

SEQ ID NO: 2674729 - DNA, 18 bp, Homo sapiens
tttaactctactgtgtaa

SEQ ID NO: 2674730 - DNA, 17 bp, Homo sapiens
tttaagcaacatctttt

SEQ ID NO: 2674731 - DNA, 14 bp, Homo sapiens
tttaagtgtaactg

SEQ ID NO: 2674732 - DNA, 17 bp, Homo sapiens
tttaatagaaccatgtt

SEQ ID NO: 2674733 - DNA, 16 bp, Homo sapiens
tttaattcatgtttct

SEQ ID NO: 2674734 - DNA, 23 bp, Homo sapiens
tttaattcatgtttcttaaatgg

SEQ ID NO: 2674735 - DNA, 20 bp, Homo sapiens
tttcaaaactcatttcctat

SEQ ID NO: 2674736 - DNA, 19 bp, Homo sapiens
tttcacagtgtgtttgtga

SEQ ID NO: 2674737 - DNA, 16 bp, Homo sapiens
tttccgtggcactgca

SEQ ID NO: 2674738 - DNA, 15 bp, Homo sapiens
tttccttctcatctg

SEQ ID NO: 2674739 - DNA, 18 bp, Homo sapiens
tttccttctcatctgtga

SEQ ID NO: 2674740 - DNA, 14 bp, Homo sapiens
tttctagggaaatg

SEQ ID NO: 2674741 - DNA, 15 bp, Homo sapiens
tttctagggaaatga

SEQ ID NO: 2674742 - DNA, 18 bp, Homo sapiens
tttctagggaaatgaaag

SEQ ID NO: 2674743 - DNA, 15 bp, Homo sapiens
tttgactttcttctg

SEQ ID NO: 2674744 - DNA, 16 bp, Homo sapiens
cattctctctcctgta

SEQ ID NO: 2674745 - DNA, 14 bp, Homo sapiens
catttcaaaatgct

SEQ ID NO: 2674746 - DNA, 17 bp, Homo sapiens
catttcctatgtaactg

SEQ ID NO: 2674747 - DNA, 19 bp, Homo sapiens
catttcctatgtaactgca

SEQ ID NO: 2674748 - DNA, 13 bp, Homo sapiens
catttgttaaaat

SEQ ID NO: 2674749 - DNA, 16 bp, Homo sapiens
ccaaacagccacactg

SEQ ID NO: 2674750 - DNA, 13 bp, Homo sapiens
ccaaagccaccag

SEQ ID NO: 2674751 - DNA, 14 bp, Homo sapiens
ccaagtttatatac

SEQ ID NO: 2674752 - DNA, 23 bp, Homo sapiens
ccaccagactgacaaatgtgtat

SEQ ID NO: 2674753 - DNA, 17 bp, Homo sapiens
ccagcagtacaataaaa

SEQ ID NO: 2674754 - DNA, 15 bp, Homo sapiens
ccattaaagttctca

SEQ ID NO: 2674755 - DNA, 12 bp, Homo sapiens
ccattctatgtg

SEQ ID NO: 2674756 - DNA, 19 bp, Homo sapiens
ccattgcactccagcctgg

SEQ ID NO: 2674757 - DNA, 16 bp, Homo sapiens
ccctatggggatggtc

SEQ ID NO: 2674758 - DNA, 18 bp, Homo sapiens
ccctatggggatggtcca

SEQ ID NO: 2674759 - DNA, 14 bp, Homo sapiens
ccctattttgccat

SEQ ID NO: 2674760 - DNA, 22 bp, Homo sapiens
cctaatgaaagtgatgacatat

SEQ ID NO: 2674761 - DNA, 14 bp, Homo sapiens
cctagatatgaata

SEQ ID NO: 2674762 - DNA, 16 bp, Homo sapiens
cctagatatgaatata

SEQ ID NO: 2674763 - DNA, 21 bp, Homo sapiens
cctagatatgaatatatggca

SEQ ID NO: 2674764 - DNA, 15 bp, Homo sapiens
cctatatgagaagaa

SEQ ID NO: 2674765 - DNA, 19 bp, Homo sapiens
cctcaggaaagaatagaaa

SEQ ID NO: 2674766 - DNA, 23 bp, Homo sapiens
cctgtcccttctcttaatttaat

SEQ ID NO: 2674767 - DNA, 19 bp, Homo sapiens
cctgtgaaatagttcaaag

SEQ ID NO: 2674768 - DNA, 18 bp, Homo sapiens
ccttttacatactgctgt

SEQ ID NO: 2674769 - DNA, 12 bp, Homo sapiens
ccttttgccaat

SEQ ID NO: 2674770 - DNA, 14 bp, Homo sapiens
cgagactgcaatgt

SEQ ID NO: 2674771 - DNA, 16 bp, Homo sapiens
ctaaattttctgaaac

SEQ ID NO: 2674772 - DNA, 19 bp, Homo sapiens
ctaagtttcagttgatttt

SEQ ID NO: 2674773 - DNA, 20 bp, Homo sapiens
ctaattaaaacactttcaaa

SEQ ID NO: 2674774 - DNA, 14 bp, Homo sapiens
ctacactgggtgct

SEQ ID NO: 2674775 - DNA, 16 bp, Homo sapiens
ctagaataatcttgct

SEQ ID NO: 2674776 - DNA, 17 bp, Homo sapiens
ctatatgagaagaatag

SEQ ID NO: 2674777 - DNA, 15 bp, Homo sapiens
ctatggggatggtcc

SEQ ID NO: 2674778 - DNA, 17 bp, Homo sapiens
ctatgtggctgtatctt

SEQ ID NO: 2674779 - DNA, 23 bp, Homo sapiens
ctatttagtttttgtaatttatt

SEQ ID NO: 2674780 - DNA, 18 bp, Homo sapiens
ctcacgcctgtaatccca

SEQ ID NO: 2674781 - DNA, 15 bp, Homo sapiens
ctccacagctacctc

SEQ ID NO: 2674782 - DNA, 21 bp, Homo sapiens
ctccctaaggcatgtgtgaaa

SEQ ID NO: 2674783 - DNA, 17 bp, Homo sapiens
ctcctgtactttttcca

SEQ ID NO: 2674784 - DNA, 13 bp, Homo sapiens
ctctactgtgtaa

SEQ ID NO: 2674785 - DNA, 12 bp, Homo sapiens
ctctcagttttt

SEQ ID NO: 2674786 - DNA, 18 bp, Homo sapiens
ctctcctgtactttttcc

SEQ ID NO: 2674787 - DNA, 15 bp, Homo sapiens
ctctctcctgtactt

SEQ ID NO: 2674788 - DNA, 21 bp, Homo sapiens
ctctgaagagtgggtttcaca

SEQ ID NO: 2674789 - DNA, 19 bp, Homo sapiens
ctctgaagggcatcatgca

SEQ ID NO: 2674790 - DNA, 23 bp, Homo sapiens
ctctgaagggcatcatgcatctt

SEQ ID NO: 2674791 - DNA, 22 bp, Homo sapiens
ctcttaagcttccgccgtctca

SEQ ID NO: 2674792 - DNA, 19 bp, Homo sapiens
ctgaaggtaaaattgaaag

SEQ ID NO: 2674793 - DNA, 17 bp, Homo sapiens
ctgagtagctctcctga

SEQ ID NO: 2674794 - DNA, 19 bp, Homo sapiens
ctgatgcttttgtctaatt

SEQ ID NO: 2674795 - DNA, 13 bp, Homo sapiens
ctgcaaaatctgt

SEQ ID NO: 2674796 - DNA, 20 bp, Homo sapiens
ctgcataagtgaaaatctta

SEQ ID NO: 2674797 - DNA, 14 bp, Homo sapiens
ctgcatacaatctg

SEQ ID NO: 2674798 - DNA, 17 bp, Homo sapiens
ctgcattgagaactgca

SEQ ID NO: 2674799 - DNA, 22 bp, Homo sapiens
ctggcaaacatgaaaaatcggc

SEQ ID NO: 2674800 - DNA, 18 bp, Homo sapiens
ctggccaacatggcgaaa

SEQ ID NO: 2674801 - DNA, 20 bp, Homo sapiens
ctggcgacagttttccttct

SEQ ID NO: 2674802 - DNA, 20 bp, Homo sapiens
ctgggtgctgatccttgcac

SEQ ID NO: 2674803 - DNA, 17 bp, Homo sapiens
ctgtaatcccagcactt

SEQ ID NO: 2674804 - DNA, 19 bp, Homo sapiens
ctgtaatcccagctactcg

SEQ ID NO: 2674805 - DNA, 18 bp, Homo sapiens
ctgtatcttgtttttcca

SEQ ID NO: 2674806 - DNA, 21 bp, Homo sapiens
ctgtatttttacctttttcct

SEQ ID NO: 2674807 - DNA, 21 bp, Homo sapiens
ctgtcccttctcttaatttaa

SEQ ID NO: 2674808 - DNA, 19 bp, Homo sapiens
ctgtccttgaatgccatag

SEQ ID NO: 2674809 - DNA, 18 bp, Homo sapiens
ctgtgaccaggaaggaag

SEQ ID NO: 2674810 - DNA, 15 bp, Homo sapiens
ctgttccttcacatc

SEQ ID NO: 2674811 - DNA, 18 bp, Homo sapiens
ctgttccttcacatcctg

SEQ ID NO: 2674812 - DNA, 13 bp, Homo sapiens
cttaaaatgcaat

SEQ ID NO: 2674813 - DNA, 18 bp, Homo sapiens
cttaaattttaatttatt

SEQ ID NO: 2674814 - DNA, 16 bp, Homo sapiens
cttaacattcctaaaa

SEQ ID NO: 2674815 - DNA, 13 bp, Homo sapiens
cttaccattaaag

SEQ ID NO: 2674816 - DNA, 15 bp, Homo sapiens
cttccctcacaccgc

SEQ ID NO: 2674817 - DNA, 20 bp, Homo sapiens
cttctttaatcacttaacat

SEQ ID NO: 2674818 - DNA, 21 bp, Homo sapiens
cttgcacgcgccctttctacc

SEQ ID NO: 2674819 - DNA, 22 bp, Homo sapiens
cttgcacgcgccctttctacca

SEQ ID NO: 2674820 - DNA, 15 bp, Homo sapiens
cttgggaggcttccc

SEQ ID NO: 2674821 - DNA, 16 bp, Homo sapiens
cttgggaggcttcccc

SEQ ID NO: 2674822 - DNA, 21 bp, Homo sapiens
cttgttccaatgccacatact

SEQ ID NO: 2674823 - DNA, 15 bp, Homo sapiens
cttgtttttataata

SEQ ID NO: 2674824 - DNA, 22 bp, Homo sapiens
ctttaatcacttaacattccta

SEQ ID NO: 2674825 - DNA, 15 bp, Homo sapiens
ctttactgtttgtta

SEQ ID NO: 2674826 - DNA, 22 bp, Homo sapiens
ctttgggaaaggagaagttaag

SEQ ID NO: 2674827 - DNA, 17 bp, Homo sapiens
ctttggtggagataaag

SEQ ID NO: 2674828 - DNA, 18 bp, Homo sapiens
ctttgtatcattcatctt

SEQ ID NO: 2674829 - DNA, 16 bp, Homo sapiens
ctttgtcaaaaggaag

SEQ ID NO: 2674830 - DNA, 14 bp, Homo sapiens
ctttgttaaaaaaa

SEQ ID NO: 2674831 - DNA, 12 bp, Homo sapiens
cttttctttgta

SEQ ID NO: 2674832 - DNA, 13 bp, Homo sapiens
cttttctttgtat

SEQ ID NO: 2674833 - DNA, 22 bp, Homo sapiens
ctttttccagacacttttttga

SEQ ID NO: 2674834 - DNA, 23 bp, Homo sapiens
cttttttatgtgccgtgttattg

SEQ ID NO: 2674835 - DNA, 22 bp, Homo sapiens
gaaaaagcagtaactgacaact

SEQ ID NO: 2674836 - DNA, 12 bp, Homo sapiens
gaaagaatagaa

SEQ ID NO: 2674837 - DNA, 14 bp, Homo sapiens
gaaagaatagaaag

SEQ ID NO: 2674838 - DNA, 15 bp, Homo sapiens
gaaaggagtagaaaa

SEQ ID NO: 2674839 - DNA, 14 bp, Homo sapiens
gaaagtgatgacat

SEQ ID NO: 2674840 - DNA, 21 bp, Homo sapiens
gaaccatgttggttgcacttt

SEQ ID NO: 2674841 - DNA, 15 bp, Homo sapiens
gaacggtaaatttct

SEQ ID NO: 2674842 - DNA, 18 bp, Homo sapiens
gaagagtgggtttcacaa

SEQ ID NO: 2674843 - DNA, 15 bp, Homo sapiens
gaaggatgtacattt

SEQ ID NO: 2674844 - DNA, 13 bp, Homo sapiens
gaaggtaaaattg

SEQ ID NO: 2674845 - DNA, 18 bp, Homo sapiens
gaagtctctaggttctga

SEQ ID NO: 2674846 - DNA, 13 bp, Homo sapiens
gaatagaaagaaa

SEQ ID NO: 2674847 - DNA, 16 bp, Homo sapiens
gaatagaaagaaagtc

SEQ ID NO: 2674848 - DNA, 22 bp, Homo sapiens
gaatagcctagatatgaatata

SEQ ID NO: 2674849 - DNA, 21 bp, Homo sapiens
gaatgccatagtcaaagagag

SEQ ID NO: 2674850 - DNA, 18 bp, Homo sapiens
gaattcttacatgttttc

SEQ ID NO: 2674851 - DNA, 22 bp, Homo sapiens
gaattcttacatgttttctttg

SEQ ID NO: 2674852 - DNA, 22 bp, Homo sapiens
gaattgttgacaaatgtaaaca

SEQ ID NO: 2674853 - DNA, 22 bp, Homo sapiens
gaatttttttcatcttctctgg

SEQ ID NO: 2674854 - DNA, 21 bp, Homo sapiens
gacaaagacaaattctgtttc

SEQ ID NO: 2674855 - DNA, 22 bp, Homo sapiens
gacaaggttcttcccttttaca

SEQ ID NO: 2674856 - DNA, 16 bp, Homo sapiens
gacacaaaaagtagat

SEQ ID NO: 2674857 - DNA, 19 bp, Homo sapiens
gacacttttttgagtggat

SEQ ID NO: 2674858 - DNA, 18 bp, Homo sapiens
gaccagcctggccaacat

SEQ ID NO: 2674859 - DNA, 20 bp, Homo sapiens
gacgtaggaacggtaaattt

SEQ ID NO: 2674860 - DNA, 17 bp, Homo sapiens
gactttgtttttaaaat

SEQ ID NO: 2674861 - DNA, 20 bp, Homo sapiens
gagaatcagatcatttcaaa

SEQ ID NO: 2674862 - DNA, 18 bp, Homo sapiens
gagagtttttaatagaac

SEQ ID NO: 2674863 - DNA, 18 bp, Homo sapiens
gagctgtccggctggtgg

SEQ ID NO: 2674864 - DNA, 19 bp, Homo sapiens
gaggtggaggctgcagtga

SEQ ID NO: 2674865 - DNA, 17 bp, Homo sapiens
gagttaggctattcaca

SEQ ID NO: 2674866 - DNA, 13 bp, Homo sapiens
gataaagatttct

SEQ ID NO: 2674867 - DNA, 23 bp, Homo sapiens
gatactccgctgtcggcacattc

SEQ ID NO: 2674868 - DNA, 17 bp, Homo sapiens
gatatgaatatatggca

SEQ ID NO: 2674869 - DNA, 23 bp, Homo sapiens
gatatgaatatatggcatttgca

SEQ ID NO: 2674870 - DNA, 15 bp, Homo sapiens
gatgtacatttccaa

SEQ ID NO: 2674871 - DNA, 18 bp, Homo sapiens
gattttacaattgaaatg

SEQ ID NO: 2674872 - DNA, 19 bp, Homo sapiens
gattttacaattgaaatga

SEQ ID NO: 2674873 - DNA, 20 bp, Homo sapiens
gatttttatattagttgctt

SEQ ID NO: 2674874 - DNA, 22 bp, Homo sapiens
gatttttatattagttgctttg

SEQ ID NO: 2674875 - DNA, 19 bp, Homo sapiens
gcaaaatcaagcaagcctc

SEQ ID NO: 2674876 - DNA, 20 bp, Homo sapiens
gcaagaatggtggcttcttt

SEQ ID NO: 2674877 - DNA, 21 bp, Homo sapiens
gcaagaatggtggcttctttt

SEQ ID NO: 2674878 - DNA, 18 bp, Homo sapiens
gcaataaaattatttgca

SEQ ID NO: 2674879 - DNA, 18 bp, Homo sapiens
gcacgcgccctttctacc

SEQ ID NO: 2674880 - DNA, 14 bp, Homo sapiens
gcaggagcctgagc

SEQ ID NO: 2674881 - DNA, 14 bp, Homo sapiens
gcaggtctttaaat

SEQ ID NO: 2674882 - DNA, 15 bp, Homo sapiens
gcatcttactgaagg

SEQ ID NO: 2674883 - DNA, 23 bp, Homo sapiens
gcatcttactgaaggtaaaattg

SEQ ID NO: 2674884 - DNA, 19 bp, Homo sapiens
gcatgtatagttgcttttg

SEQ ID NO: 2674885 - DNA, 15 bp, Homo sapiens
gccaagtttatatac

SEQ ID NO: 2674886 - DNA, 17 bp, Homo sapiens
gccaagtttatatacaa

SEQ ID NO: 2674887 - DNA, 14 bp, Homo sapiens
gcccggatgcttct

SEQ ID NO: 2674888 - DNA, 20 bp, Homo sapiens
gcctgggcgacagagcgaga

SEQ ID NO: 2674889 - DNA, 18 bp, Homo sapiens
tcatttcaaaatgcttca

SEQ ID NO: 2674890 - DNA, 20 bp, Homo sapiens
tccaatgccacatacttgca

SEQ ID NO: 2674891 - DNA, 13 bp, Homo sapiens
tccagacactttt

SEQ ID NO: 2674892 - DNA, 22 bp, Homo sapiens
tccattggtttacctgtgaaat

SEQ ID NO: 2674893 - DNA, 14 bp, Homo sapiens
tcccattctatgtg

SEQ ID NO: 2674894 - DNA, 18 bp, Homo sapiens
tcccattctatgtgtcat

SEQ ID NO: 2674895 - DNA, 19 bp, Homo sapiens
tcccctatggggatggtcc

SEQ ID NO: 2674896 - DNA, 13 bp, Homo sapiens
tcccttttacata

SEQ ID NO: 2674897 - DNA, 17 bp, Homo sapiens
tcccttttacatactgc

SEQ ID NO: 2674898 - DNA, 13 bp, Homo sapiens
tcctatgcaataa

SEQ ID NO: 2674899 - DNA, 19 bp, Homo sapiens
tcctgtgtttctagggaaa

SEQ ID NO: 2674900 - DNA, 18 bp, Homo sapiens
tctcttaatttaatcttt

SEQ ID NO: 2674901 - DNA, 23 bp, Homo sapiens
tctgaggcctcctctctcagttt

SEQ ID NO: 2674902 - DNA, 18 bp, Homo sapiens
tctgcttgctcttgtcct

SEQ ID NO: 2674903 - DNA, 14 bp, Homo sapiens
tctggagctgtccg

SEQ ID NO: 2674904 - DNA, 15 bp, Homo sapiens
tctgttccttcacat

SEQ ID NO: 2674905 - DNA, 15 bp, Homo sapiens
tctgttctaacatgt

SEQ ID NO: 2674906 - DNA, 13 bp, Homo sapiens
tcttactgaaggt

SEQ ID NO: 2674907 - DNA, 23 bp, Homo sapiens
tcttactgaaggtaaaattgaaa

SEQ ID NO: 2674908 - DNA, 21 bp, Homo sapiens
tcttctctggcgacagttttc

SEQ ID NO: 2674909 - DNA, 13 bp, Homo sapiens
tcttcttaactta

SEQ ID NO: 2674910 - DNA, 22 bp, Homo sapiens
tcttgtttttccactactgcta

SEQ ID NO: 2674911 - DNA, 16 bp, Homo sapiens
tctttaaatcatttta

SEQ ID NO: 2674912 - DNA, 14 bp, Homo sapiens
tctttaatcactta

SEQ ID NO: 2674913 - DNA, 18 bp, Homo sapiens
tctttaatcacttaacat

SEQ ID NO: 2674914 - DNA, 14 bp, Homo sapiens
tcttttctttgtat

SEQ ID NO: 2674915 - DNA, 20 bp, Homo sapiens
tgaacatttactacagtttt

SEQ ID NO: 2674916 - DNA, 22 bp, Homo sapiens
tgaacatttactacagttttta

SEQ ID NO: 2674917 - DNA, 22 bp, Homo sapiens
tgaatttttctctaactcagaa

SEQ ID NO: 2674918 - DNA, 23 bp, Homo sapiens
tgaatttttttcatcttctctgg

SEQ ID NO: 2674919 - DNA, 17 bp, Homo sapiens
tgacatgcctatatgag

SEQ ID NO: 2674920 - DNA, 15 bp, Homo sapiens
tgactaaaaaacaaa

SEQ ID NO: 2674921 - DNA, 20 bp, Homo sapiens
tgagaatcagatcatttcaa

SEQ ID NO: 2674922 - DNA, 13 bp, Homo sapiens
tgagaccagcctg

SEQ ID NO: 2674923 - DNA, 14 bp, Homo sapiens
tgagaccagcctgg

SEQ ID NO: 2674924 - DNA, 20 bp, Homo sapiens
tgatacagtcaacaagcctg

SEQ ID NO: 2674925 - DNA, 18 bp, Homo sapiens
tgattccctcctgctact

SEQ ID NO: 2674926 - DNA, 13 bp, Homo sapiens
tgattctgtgtgt

SEQ ID NO: 2674927 - DNA, 19 bp, Homo sapiens
tgattttacaattgaaatg

SEQ ID NO: 2674928 - DNA, 13 bp, Homo sapiens
tgcaatatttgta

SEQ ID NO: 2674929 - DNA, 18 bp, Homo sapiens
tgcaatgtgatctatgtt

SEQ ID NO: 2674930 - DNA, 19 bp, Homo sapiens
tgcacgcgccctttctacc

SEQ ID NO: 2674931 - DNA, 15 bp, Homo sapiens
tgcactccagcctgg

SEQ ID NO: 2674932 - DNA, 19 bp, Homo sapiens
tgcactccagcctgggcga

SEQ ID NO: 2674933 - DNA, 12 bp, Homo sapiens
tgcactttgtag

SEQ ID NO: 2674934 - DNA, 15 bp, Homo sapiens
tgcaggtctttaaat

SEQ ID NO: 2674935 - DNA, 22 bp, Homo sapiens
tgcataagtgaaaatcttacaa

SEQ ID NO: 2674936 - DNA, 15 bp, Homo sapiens
tgcattgagaactgc

SEQ ID NO: 2674937 - DNA, 16 bp, Homo sapiens
tgccaatctcaacacc

SEQ ID NO: 2674938 - DNA, 20 bp, Homo sapiens
tgcctatatgagaagaatag

SEQ ID NO: 2674939 - DNA, 22 bp, Homo sapiens
tgcgaatggttccattctctct

SEQ ID NO: 2674940 - DNA, 15 bp, Homo sapiens
tgctactctgttcct

SEQ ID NO: 2674941 - DNA, 14 bp, Homo sapiens
tgctgtccttgaat

SEQ ID NO: 2674942 - DNA, 14 bp, Homo sapiens
tgctgtctatgtgg

SEQ ID NO: 2674943 - DNA, 15 bp, Homo sapiens
tgcttccccttttgc

SEQ ID NO: 2674944 - DNA, 17 bp, Homo sapiens
tgcttctccatgagaca

SEQ ID NO: 2674945 - DNA, 21 bp, Homo sapiens
tgctttccgtggcactgcata

SEQ ID NO: 2674946 - DNA, 21 bp, Homo sapiens
tggaatcagattttaacagct

SEQ ID NO: 2674947 - DNA, 20 bp, Homo sapiens
tggagataaagatttcttga

SEQ ID NO: 2674948 - DNA, 12 bp, Homo sapiens
tggatgatgttt

SEQ ID NO: 2674949 - DNA, 19 bp, Homo sapiens
tggcttcttttctttgtat

SEQ ID NO: 2674950 - DNA, 22 bp, Homo sapiens
tggcttcttttctttgtatcat

SEQ ID NO: 2674951 - DNA, 18 bp, Homo sapiens
tgggtgctgatccttgca

SEQ ID NO: 2674952 - DNA, 21 bp, Homo sapiens
tgtaaggcttgttccaatgcc

SEQ ID NO: 2674953 - DNA, 20 bp, Homo sapiens
tgtaatcccagctactcggg

SEQ ID NO: 2674954 - DNA, 22 bp, Homo sapiens
tgtacatttccaaattcacaag

SEQ ID NO: 2674955 - DNA, 17 bp, Homo sapiens
tgtatagttgcttttga

SEQ ID NO: 2674956 - DNA, 15 bp, Homo sapiens
tgtatcggatgcttt

SEQ ID NO: 2674957 - DNA, 14 bp, Homo sapiens
tgtattcttaaaat

SEQ ID NO: 2674958 - DNA, 20 bp, Homo sapiens
tgtattcttaaaatgcaata

SEQ ID NO: 2674959 - DNA, 12 bp, Homo sapiens
tgtattgctgtc

SEQ ID NO: 2674960 - DNA, 14 bp, Homo sapiens
tgtattgctgtcct

SEQ ID NO: 2674961 - DNA, 23 bp, Homo sapiens
tgtcatcaatagtgtcctatgca

SEQ ID NO: 2674962 - DNA, 14 bp, Homo sapiens
tgtcctatgcaata

SEQ ID NO: 2674963 - DNA, 18 bp, Homo sapiens
tgtcctgatgcttttgtc

SEQ ID NO: 2674964 - DNA, 16 bp, Homo sapiens
tgtcctttttgttatt

SEQ ID NO: 2674965 - DNA, 14 bp, Homo sapiens
tgtcggcacattca

SEQ ID NO: 2674966 - DNA, 12 bp, Homo sapiens
tgtgtattctta

SEQ ID NO: 2674967 - DNA, 20 bp, Homo sapiens
tgtgtattcttaaaatgcaa

SEQ ID NO: 2674968 - DNA, 14 bp, Homo sapiens
tgttcacaacctgg

SEQ ID NO: 2674969 - DNA, 15 bp, Homo sapiens
tgttccaatgccaca

SEQ ID NO: 2674970 - DNA, 19 bp, Homo sapiens
tgttggataaatcagtggt

SEQ ID NO: 2674971 - DNA, 15 bp, Homo sapiens
tgttggttgcacttt

SEQ ID NO: 2674972 - DNA, 21 bp, Homo sapiens
tgtttcgctgatatatgtgtt

SEQ ID NO: 2674973 - DNA, 13 bp, Homo sapiens
tgtttctctgctg

SEQ ID NO: 2674974 - DNA, 14 bp, Homo sapiens
tgtttctctgctgt

SEQ ID NO: 2674975 - DNA, 12 bp, Homo sapiens
tgtttgttatgg

SEQ ID NO: 2674976 - DNA, 18 bp, Homo sapiens
ttaaaacactttcaaaac

SEQ ID NO: 2674977 - DNA, 13 bp, Homo sapiens
ttaaagtgaattg

SEQ ID NO: 2674978 - DNA, 18 bp, Homo sapiens
ttaaatcattttaggaaa

SEQ ID NO: 2674979 - DNA, 20 bp, Homo sapiens
ttaaatcattttaggaaagg

SEQ ID NO: 2674980 - DNA, 22 bp, Homo sapiens
ttaagcagctaaattttctgaa

SEQ ID NO: 2674981 - DNA, 21 bp, Homo sapiens
ttaatattacctaatgaaagt

SEQ ID NO: 2674982 - DNA, 15 bp, Homo sapiens
ttaatcacttaacat

SEQ ID NO: 2674983 - DNA, 15 bp, Homo sapiens
ttacagcacaaaatg

SEQ ID NO: 2674984 - DNA, 18 bp, Homo sapiens
ttacatgttttctttgct

SEQ ID NO: 2674985 - DNA, 22 bp, Homo sapiens
ttacatgttttctttgctttaa

SEQ ID NO: 2674986 - DNA, 14 bp, Homo sapiens
ttactacagttttt

SEQ ID NO: 2674987 - DNA, 22 bp, Homo sapiens
ttactctgaagggcatcatgca

SEQ ID NO: 2674988 - DNA, 13 bp, Homo sapiens
ttagccgggcgtg

SEQ ID NO: 2674989 - DNA, 18 bp, Homo sapiens
ttagtttttgtaatttat

SEQ ID NO: 2674990 - DNA, 19 bp, Homo sapiens
ttatatcagtcctctttca

SEQ ID NO: 2674991 - DNA, 12 bp, Homo sapiens
ttattacatctt

SEQ ID NO: 2674992 - DNA, 18 bp, Homo sapiens
ttattacatctttcacat

SEQ ID NO: 2674993 - DNA, 21 bp, Homo sapiens
ttatttagggaactgcttgac

SEQ ID NO: 2674994 - DNA, 16 bp, Homo sapiens
ttcaaaagttgaaatt

SEQ ID NO: 2674995 - DNA, 18 bp, Homo sapiens
ttcacatcctgtgtttct

SEQ ID NO: 2674996 - DNA, 21 bp, Homo sapiens
ttcacatcctgtgtttctagg

SEQ ID NO: 2674997 - DNA, 16 bp, Homo sapiens
ttcagttgattttaca

SEQ ID NO: 2674998 - DNA, 11 bp, Homo sapiens
ttcataatggc

SEQ ID NO: 2674999 - DNA, 23 bp, Homo sapiens
ttccaaattcacaagttgtgttt

SEQ ID NO: 2675000 - DNA, 19 bp, Homo sapiens
ttcccttttacatactgct

SEQ ID NO: 2675001 - DNA, 21 bp, Homo sapiens
ttcccttttacatactgctgt

SEQ ID NO: 2675002 - DNA, 17 bp, Homo sapiens
ttccttcacatcctgtg

SEQ ID NO: 2675003 - DNA, 14 bp, Homo sapiens
ttccttctcatctg

SEQ ID NO: 2675004 - DNA, 18 bp, Homo sapiens
ttcgtgaagtatactgta

SEQ ID NO: 2675005 - DNA, 21 bp, Homo sapiens
ttctaccacacagcagcagtt

SEQ ID NO: 2675006 - DNA, 15 bp, Homo sapiens
ttctagggaaatgaa

SEQ ID NO: 2675007 - DNA, 22 bp, Homo sapiens
ttctgtgggagaattcttacat

SEQ ID NO: 2675008 - DNA, 20 bp, Homo sapiens
ttctgtgtgttttcataata

SEQ ID NO: 2675009 - DNA, 16 bp, Homo sapiens
ttcttaaaatgcaata

SEQ ID NO: 2675010 - DNA, 22 bp, Homo sapiens
ttcttcccttttacatactgct

SEQ ID NO: 2675011 - DNA, 21 bp, Homo sapiens
ttgaaaggcattctctgaaga

SEQ ID NO: 2675012 - DNA, 23 bp, Homo sapiens
ttgaatgccatagtcaaagagag

SEQ ID NO: 2675013 - DNA, 17 bp, Homo sapiens
ttgagtggatgatgttt

SEQ ID NO: 2675014 - DNA, 19 bp, Homo sapiens
ttgagtggatgatgtttcg

SEQ ID NO: 2675015 - DNA, 12 bp, Homo sapiens
ttgagttttgtt

SEQ ID NO: 2675016 - DNA, 23 bp, Homo sapiens
ttgattttacaattgaaatgact

SEQ ID NO: 2675017 - DNA, 18 bp, Homo sapiens
ttgcacgcgccctttcta

SEQ ID NO: 2675018 - DNA, 12 bp, Homo sapiens
ttgcactttgta

SEQ ID NO: 2675019 - DNA, 22 bp, Homo sapiens
ttgcagctcccattctatgtgt

SEQ ID NO: 2675020 - DNA, 12 bp, Homo sapiens
ttgcctctactt

SEQ ID NO: 2675021 - DNA, 23 bp, Homo sapiens
ttgtcctgatgcttttgtctaat

SEQ ID NO: 2675022 - DNA, 14 bp, Homo sapiens
ttgttatggcttaa

SEQ ID NO: 2675023 - DNA, 16 bp, Homo sapiens
ttgttccaatgccaca

SEQ ID NO: 2675024 - DNA, 17 bp, Homo sapiens
tttaactctactgtgta

SEQ ID NO: 2675025 - DNA, 15 bp, Homo sapiens
tttaagcaacatctt

SEQ ID NO: 2675026 - DNA, 22 bp, Homo sapiens
tttaagtgtaactggcagtttt

SEQ ID NO: 2675027 - DNA, 24 bp, Homo sapiens
tttaatattacctaatgaaagtga

SEQ ID NO: 2675028 - DNA, 12 bp, Homo sapiens
tttaatcactta

SEQ ID NO: 2675029 - DNA, 21 bp, Homo sapiens
tttaatcacttaacattccta

SEQ ID NO: 2675030 - DNA, 16 bp, Homo sapiens
tttacaattgaaatga

SEQ ID NO: 2675031 - DNA, 14 bp, Homo sapiens
tttactgtttgtta

SEQ ID NO: 2675032 - DNA, 20 bp, Homo sapiens
tttatattagttgctttgtt

SEQ ID NO: 2675033 - DNA, 16 bp, Homo sapiens
tttcatttcaaaatgc

SEQ ID NO: 2675034 - DNA, 15 bp, Homo sapiens
tttccactactgcta

SEQ ID NO: 2675035 - DNA, 17 bp, Homo sapiens
tttctttgtatcattca

SEQ ID NO: 2675036 - DNA, 21 bp, Homo sapiens
tttgaaggaatacaatatata

SEQ ID NO: 2675037 - DNA, 16 bp, Homo sapiens
tttgagaccagcctgg

SEQ ID NO: 2675038 - DNA, 17 bp, Homo sapiens
aaagacaaattctgttt

SEQ ID NO: 2675039 - DNA, 23 bp, Homo sapiens
aaagagagtttttaatagaacca

SEQ ID NO: 2675040 - DNA, 20 bp, Homo sapiens
aaaggatgatcaaaaataat

SEQ ID NO: 2675041 - DNA, 18 bp, Homo sapiens
aaaggcattctctgaaga

SEQ ID NO: 2675042 - DNA, 14 bp, Homo sapiens
aaagtagattaaga

SEQ ID NO: 2675043 - DNA, 12 bp, Homo sapiens
aaagttgaaatt

SEQ ID NO: 2675044 - DNA, 17 bp, Homo sapiens
aaataataaagatgctc

SEQ ID NO: 2675045 - DNA, 18 bp, Homo sapiens
aaatcattttaggaaagg

SEQ ID NO: 2675046 - DNA, 15 bp, Homo sapiens
aaatctgttctaaca

SEQ ID NO: 2675047 - DNA, 19 bp, Homo sapiens
aaatgactaaaaaacaaag

SEQ ID NO: 2675048 - DNA, 13 bp, Homo sapiens
aaatgtgtatttt

SEQ ID NO: 2675049 - DNA, 15 bp, Homo sapiens
aaattagccgggcgt

SEQ ID NO: 2675050 - DNA, 21 bp, Homo sapiens
aaattcgctgcaacctgttga

SEQ ID NO: 2675051 - DNA, 14 bp, Homo sapiens
aaattctgtttctt

SEQ ID NO: 2675052 - DNA, 20 bp, Homo sapiens
aaattgaaaggcattctctg

SEQ ID NO: 2675053 - DNA, 20 bp, Homo sapiens
aaattgggaaaggagtagaa

SEQ ID NO: 2675054 - DNA, 16 bp, Homo sapiens
aacaaaaagcttcccc

SEQ ID NO: 2675055 - DNA, 17 bp, Homo sapiens
aacaaagaagacaacat

SEQ ID NO: 2675056 - DNA, 15 bp, Homo sapiens
aacaaccacaggaat

SEQ ID NO: 2675057 - DNA, 22 bp, Homo sapiens
aacaagcctgaccctgtaaaat

SEQ ID NO: 2675058 - DNA, 22 bp, Homo sapiens
aacagctctcttcaatgacata

SEQ ID NO: 2675059 - DNA, 23 bp, Homo sapiens
aacagctctcttcaatgacatag

SEQ ID NO: 2675060 - DNA, 19 bp, Homo sapiens
aacatcagttactctgaag

SEQ ID NO: 2675061 - DNA, 23 bp, Homo sapiens
aacattaaaacaatattgtttct

SEQ ID NO: 2675062 - DNA, 22 bp, Homo sapiens
aaccacaaaaaaatacctcagg

SEQ ID NO: 2675063 - DNA, 16 bp, Homo sapiens
aacctgcaaaatctgt

SEQ ID NO: 2675064 - DNA, 22 bp, Homo sapiens
aactcatttcctatgtaactgc

SEQ ID NO: 2675065 - DNA, 13 bp, Homo sapiens
aacttcaaatttt

SEQ ID NO: 2675066 - DNA, 12 bp, Homo sapiens
aagaaagcaact

SEQ ID NO: 2675067 - DNA, 22 bp, Homo sapiens
aagaaagtctatctaatgacat

SEQ ID NO: 2675068 - DNA, 19 bp, Homo sapiens
aagaactgtcatgtaaaca

SEQ ID NO: 2675069 - DNA, 19 bp, Homo sapiens
aagagcaatgtgtggctga

SEQ ID NO: 2675070 - DNA, 15 bp, Homo sapiens
aagatgctcttttaa

SEQ ID NO: 2675071 - DNA, 16 bp, Homo sapiens
aagattgtattgctgt

SEQ ID NO: 2675072 - DNA, 13 bp, Homo sapiens
aagatttcttgag

SEQ ID NO: 2675073 - DNA, 14 bp, Homo sapiens
aagattttttcatt

SEQ ID NO: 2675074 - DNA, 17 bp, Homo sapiens
aagattttttcatttca

SEQ ID NO: 2675075 - DNA, 16 bp, Homo sapiens
aagcagctaaattttc

SEQ ID NO: 2675076 - DNA, 16 bp, Homo sapiens
aaggcagcatgtatag

SEQ ID NO: 2675077 - DNA, 21 bp, Homo sapiens
aaggcagcatgtatagttgct

SEQ ID NO: 2675078 - DNA, 18 bp, Homo sapiens
aaggcatgtgtgaaacat

SEQ ID NO: 2675079 - DNA, 17 bp, Homo sapiens
aaggcattctctgaaga

SEQ ID NO: 2675080 - DNA, 21 bp, Homo sapiens
aaggttcttcccttttacata

SEQ ID NO: 2675081 - DNA, 21 bp, Homo sapiens
aagtcagtgcccaactgttat

SEQ ID NO: 2675082 - DNA, 15 bp, Homo sapiens
aagtcagtttctaca

SEQ ID NO: 2675083 - DNA, 22 bp, Homo sapiens
aagtctatctaatgacatgcct

SEQ ID NO: 2675084 - DNA, 17 bp, Homo sapiens
aagtctctaggttctga

SEQ ID NO: 2675085 - DNA, 12 bp, Homo sapiens
aagtcttcaggg

SEQ ID NO: 2675086 - DNA, 14 bp, Homo sapiens
aagtgatgacatat

SEQ ID NO: 2675087 - DNA, 17 bp, Homo sapiens
aagttgaaattaaccat

SEQ ID NO: 2675088 - DNA, 16 bp, Homo sapiens
aataaaattatttgca

SEQ ID NO: 2675089 - DNA, 23 bp, Homo sapiens
aataatgcatccagcagtacaat

SEQ ID NO: 2675090 - DNA, 17 bp, Homo sapiens
aatacagttctgtcata

SEQ ID NO: 2675091 - DNA, 22 bp, Homo sapiens
aatagttcaaagccaagtttat

SEQ ID NO: 2675092 - DNA, 14 bp, Homo sapiens
aatatatggcattt

SEQ ID NO: 2675093 - DNA, 16 bp, Homo sapiens
aatatatggcatttgc

SEQ ID NO: 2675094 - DNA, 18 bp, Homo sapiens
aatatatggcatttgcag

SEQ ID NO: 2675095 - DNA, 19 bp, Homo sapiens
aatatctgaacatttacta

SEQ ID NO: 2675096 - DNA, 18 bp, Homo sapiens
aatattacctaatgaaag

SEQ ID NO: 2675097 - DNA, 15 bp, Homo sapiens
aatattagctttact

SEQ ID NO: 2675098 - DNA, 18 bp, Homo sapiens
aatattagctttactgtt

SEQ ID NO: 2675099 - DNA, 13 bp, Homo sapiens
aatattgtttcta

SEQ ID NO: 2675100 - DNA, 16 bp, Homo sapiens
aatcaagcaagcctct

SEQ ID NO: 2675101 - DNA, 17 bp, Homo sapiens
aatcacttaacattcct

SEQ ID NO: 2675102 - DNA, 18 bp, Homo sapiens
aatcacttaacattccta

SEQ ID NO: 2675103 - DNA, 14 bp, Homo sapiens
aatcagatcatttc

SEQ ID NO: 2675104 - DNA, 15 bp, Homo sapiens
aatcagatcatttca

SEQ ID NO: 2675105 - DNA, 17 bp, Homo sapiens
aatcattttaggaaagg

SEQ ID NO: 2675106 - DNA, 14 bp, Homo sapiens
aatgaagttggggt

SEQ ID NO: 2675107 - DNA, 20 bp, Homo sapiens
aatgactaaaaaacaaagaa

SEQ ID NO: 2675108 - DNA, 21 bp, Homo sapiens
aatgatggcagtggtttgaaa

SEQ ID NO: 2675109 - DNA, 21 bp, Homo sapiens
aatgcatccagcagtacaata

SEQ ID NO: 2675110 - DNA, 19 bp, Homo sapiens
aatggcgtgaacccgggag

SEQ ID NO: 2675111 - DNA, 23 bp, Homo sapiens
aatggtggcttcttttctttgta

SEQ ID NO: 2675112 - DNA, 13 bp, Homo sapiens
aatgtaaacattt

SEQ ID NO: 2675113 - DNA, 14 bp, Homo sapiens
aatgtaaacatttt

SEQ ID NO: 2675114 - DNA, 15 bp, Homo sapiens
aatgtttaaacattt

SEQ ID NO: 2675115 - DNA, 14 bp, Homo sapiens
aattaaaacacttt

SEQ ID NO: 2675116 - DNA, 12 bp, Homo sapiens
aattctgtttct

SEQ ID NO: 2675117 - DNA, 13 bp, Homo sapiens
aattctgtttctt

SEQ ID NO: 2675118 - DNA, 22 bp, Homo sapiens
aatttttctctaactcagaaac

SEQ ID NO: 2675119 - DNA, 17 bp, Homo sapiens
aattttttaaaagagac

SEQ ID NO: 2675120 - DNA, 18 bp, Homo sapiens
acaaagaagacaacatta

SEQ ID NO: 2675121 - DNA, 18 bp, Homo sapiens
acaaatgtaaacattttc

SEQ ID NO: 2675122 - DNA, 17 bp, Homo sapiens
acaacaaaaagcttccc

SEQ ID NO: 2675123 - DNA, 16 bp, Homo sapiens
acaacattaaaacaat

SEQ ID NO: 2675124 - DNA, 13 bp, Homo sapiens
acaaggttcttcc

SEQ ID NO: 2675125 - DNA, 14 bp, Homo sapiens
acaagttgtgtttg

SEQ ID NO: 2675126 - DNA, 15 bp, Homo sapiens
acaagttgtgtttga

SEQ ID NO: 2675127 - DNA, 15 bp, Homo sapiens
acaatattgtttcta

SEQ ID NO: 2675128 - DNA, 22 bp, Homo sapiens
acaatggtgttatttgaaactt

SEQ ID NO: 2675129 - DNA, 18 bp, Homo sapiens
acaattatttttacagtt

SEQ ID NO: 2675130 - DNA, 21 bp, Homo sapiens
acaattatttttacagttctc

SEQ ID NO: 2675131 - DNA, 12 bp, Homo sapiens
acaattgaaatg

SEQ ID NO: 2675132 - DNA, 14 bp, Homo sapiens
acacatctcctcca

SEQ ID NO: 2675133 - DNA, 15 bp, Homo sapiens
acagtcaacaagcct

SEQ ID NO: 2675134 - DNA, 16 bp, Homo sapiens
acatacaattattttt

SEQ ID NO: 2675135 - DNA, 17 bp, Homo sapiens
acatagaaagttcatgg

SEQ ID NO: 2675136 - DNA, 15 bp, Homo sapiens
acatattttttatat

SEQ ID NO: 2675137 - DNA, 18 bp, Homo sapiens
acatcagttactctgaag

SEQ ID NO: 2675138 - DNA, 21 bp, Homo sapiens
acatctcctccatactcagga

SEQ ID NO: 2675139 - DNA, 15 bp, Homo sapiens
acattaaaacaatat

SEQ ID NO: 2675140 - DNA, 15 bp, Homo sapiens
acattcagctgaggt

SEQ ID NO: 2675141 - DNA, 22 bp, Homo sapiens
acattcagctgaggttcattac

SEQ ID NO: 2675142 - DNA, 14 bp, Homo sapiens
acattcctaaaatg

SEQ ID NO: 2675143 - DNA, 22 bp, Homo sapiens
acattttcagaaatattcatga

SEQ ID NO: 2675144 - DNA, 23 bp, Homo sapiens
accatgttggttgcactttgtag

SEQ ID NO: 2675145 - DNA, 23 bp, Homo sapiens
acccaggaggcagaggttgcagt

SEQ ID NO: 2675146 - DNA, 23 bp, Homo sapiens
acctgagcccggatgcttctcca

SEQ ID NO: 2675147 - DNA, 14 bp, Homo sapiens
actcagaaacatca

SEQ ID NO: 2675148 - DNA, 15 bp, Homo sapiens
actcagaaacatcag

SEQ ID NO: 2675149 - DNA, 20 bp, Homo sapiens
actctgaagggcatcatgca

SEQ ID NO: 2675150 - DNA, 14 bp, Homo sapiens
actctgttccttca

SEQ ID NO: 2675151 - DNA, 17 bp, Homo sapiens
actctgttccttcacat

SEQ ID NO: 2675152 - DNA, 22 bp, Homo sapiens
actctgttccttcacatcctgt

SEQ ID NO: 2675153 - DNA, 17 bp, Homo sapiens
actgaaggtaaaattga

SEQ ID NO: 2675154 - DNA, 21 bp, Homo sapiens
actgcactccagcctgggcga

SEQ ID NO: 2675155 - DNA, 15 bp, Homo sapiens
actgcattgagaact

SEQ ID NO: 2675156 - DNA, 20 bp, Homo sapiens
actgtatttttacctttttc

SEQ ID NO: 2675157 - DNA, 21 bp, Homo sapiens
actgtgtaatataaaagatct

SEQ ID NO: 2675158 - DNA, 22 bp, Homo sapiens
actgtgtaatataaaagatctt

SEQ ID NO: 2675159 - DNA, 13 bp, Homo sapiens
actgtttctctgc

SEQ ID NO: 2675160 - DNA, 14 bp, Homo sapiens
actttatcaattaa

SEQ ID NO: 2675161 - DNA, 21 bp, Homo sapiens
agaaacatcagttactctgaa

SEQ ID NO: 2675162 - DNA, 22 bp, Homo sapiens
agaaagtctatctaatgacatg

SEQ ID NO: 2675163 - DNA, 15 bp, Homo sapiens
agaactgcatatgtt

SEQ ID NO: 2675164 - DNA, 16 bp, Homo sapiens
agaaggatgtacattt

SEQ ID NO: 2675165 - DNA, 19 bp, Homo sapiens
agaagttaagcaacatcta

SEQ ID NO: 2675166 - DNA, 19 bp, Homo sapiens
agaatattagctttactgt

SEQ ID NO: 2675167 - DNA, 23 bp, Homo sapiens
agaatattagctttactgtttgt

SEQ ID NO: 2675168 - DNA, 21 bp, Homo sapiens
agactttctttctgtaggtgg

SEQ ID NO: 2675169 - DNA, 17 bp, Homo sapiens
agagtttttaatagaac

SEQ ID NO: 2675170 - DNA, 14 bp, Homo sapiens
agataaagatttct

SEQ ID NO: 2675171 - DNA, 18 bp, Homo sapiens
agataaagatttcttgag

SEQ ID NO: 2675172 - DNA, 17 bp, Homo sapiens
agataatatgagaatca

SEQ ID NO: 2675173 - DNA, 14 bp, Homo sapiens
agatatgaatatat

SEQ ID NO: 2675174 - DNA, 22 bp, Homo sapiens
agatgggtggatcacttgaggt

SEQ ID NO: 2675175 - DNA, 21 bp, Homo sapiens
agatttttatattagttgctt

SEQ ID NO: 2675176 - DNA, 20 bp, Homo sapiens
agcaaaatcaagcaagcctc

SEQ ID NO: 2675177 - DNA, 17 bp, Homo sapiens
agcaaatgttatgcata

SEQ ID NO: 2675178 - DNA, 19 bp, Homo sapiens
agcactttgcaaggaatgt

SEQ ID NO: 2675179 - DNA, 18 bp, Homo sapiens
agcagctaaattttctga

SEQ ID NO: 2675180 - DNA, 18 bp, Homo sapiens
agcatgtatagttgcttt

SEQ ID NO: 2675181 - DNA, 19 bp, Homo sapiens
agcctagaagagcttctga

SEQ ID NO: 2675182 - DNA, 14 bp, Homo sapiens
agcctgggtgacaa

SEQ ID NO: 2675183 - DNA, 17 bp, Homo sapiens
agctctcctgactttta

SEQ ID NO: 2675184 - DNA, 20 bp, Homo sapiens
agctgagtctccctaaggca

SEQ ID NO: 2675185 - DNA, 16 bp, Homo sapiens
aaaatacaaaaatttg

SEQ ID NO: 2675186 - DNA, 16 bp, Homo sapiens
aaaatacaaacacatg

SEQ ID NO: 2675187 - DNA, 11 bp, Homo sapiens
aaaatgcaata

SEQ ID NO: 2675188 - DNA, 15 bp, Homo sapiens
aaaatgcaatatttg

SEQ ID NO: 2675189 - DNA, 11 bp, Homo sapiens
aaaattaaagc

SEQ ID NO: 2675190 - DNA, 18 bp, Homo sapiens
aaaattagccgggcgtgg

SEQ ID NO: 2675191 - DNA, 14 bp, Homo sapiens
aaaattatttgcag

SEQ ID NO: 2675192 - DNA, 17 bp, Homo sapiens
aaacaatattgtttcta

SEQ ID NO: 2675193 - DNA, 13 bp, Homo sapiens
aaacactttcaaa

SEQ ID NO: 2675194 - DNA, 17 bp, Homo sapiens
aaacataccaacatgtt

SEQ ID NO: 2675195 - DNA, 23 bp, Homo sapiens
aaacatcagttactctgaagggc

SEQ ID NO: 2675196 - DNA, 23 bp, Homo sapiens
aaactgcataagtgaaaatctta

SEQ ID NO: 2675197 - DNA, 14 bp, Homo sapiens
aaactgtaaaaaat

SEQ ID NO: 2675198 - DNA, 15 bp, Homo sapiens
aaagattgtattgct

SEQ ID NO: 2675199 - DNA, 14 bp, Homo sapiens
aaagatttcttgag

SEQ ID NO: 2675200 - DNA, 23 bp, Homo sapiens
aaagccaagtttatatacaatta

SEQ ID NO: 2675201 - DNA, 18 bp, Homo sapiens
aaagctaaagtatctgta

SEQ ID NO: 2675202 - DNA, 14 bp, Homo sapiens
aaagcttcagggaa

SEQ ID NO: 2675203 - DNA, 11 bp, Homo sapiens
aaagcttcccc

SEQ ID NO: 2675204 - DNA, 21 bp, Homo sapiens
aaagtaaaccacaaaaaaata

SEQ ID NO: 2675205 - DNA, 16 bp, Homo sapiens
aaagtctatctaatga

SEQ ID NO: 2675206 - DNA, 16 bp, Homo sapiens
aaagtgatgacatatt

SEQ ID NO: 2675207 - DNA, 19 bp, Homo sapiens
aaataataaagatgctctt

SEQ ID NO: 2675208 - DNA, 17 bp, Homo sapiens
aaatacctcaggaaaga

SEQ ID NO: 2675209 - DNA, 16 bp, Homo sapiens
aaatatctgaacattt

SEQ ID NO: 2675210 - DNA, 17 bp, Homo sapiens
aaatatctgaacattta

SEQ ID NO: 2675211 - DNA, 17 bp, Homo sapiens
aaatcaagcaagcctct

SEQ ID NO: 2675212 - DNA, 16 bp, Homo sapiens
aaatcattttaggaaa

SEQ ID NO: 2675213 - DNA, 19 bp, Homo sapiens
aaatcattttaggaaagga

SEQ ID NO: 2675214 - DNA, 13 bp, Homo sapiens
aaatcttacaaca

SEQ ID NO: 2675215 - DNA, 15 bp, Homo sapiens
aaatgtaaacatttt

SEQ ID NO: 2675216 - DNA, 18 bp, Homo sapiens
aaattcacaagttgtgtt

SEQ ID NO: 2675217 - DNA, 19 bp, Homo sapiens
aaattcacaagttgtgttt

SEQ ID NO: 2675218 - DNA, 22 bp, Homo sapiens
aaattgaaaggcattctctgaa

SEQ ID NO: 2675219 - DNA, 18 bp, Homo sapiens
aaatttaattcatgtttc

SEQ ID NO: 2675220 - DNA, 14 bp, Homo sapiens
aaattttaatttat

SEQ ID NO: 2675221 - DNA, 16 bp, Homo sapiens
aaattttttaaaagag

SEQ ID NO: 2675222 - DNA, 20 bp, Homo sapiens
aacacatttgattctgtgtg

SEQ ID NO: 2675223 - DNA, 20 bp, Homo sapiens
aacagcctttgggaaatgct

SEQ ID NO: 2675224 - DNA, 18 bp, Homo sapiens
aacaggtgttggtgacaa

SEQ ID NO: 2675225 - DNA, 21 bp, Homo sapiens
aacatcagttactctgaaggg

SEQ ID NO: 2675226 - DNA, 15 bp, Homo sapiens
aacatcccaagattt

SEQ ID NO: 2675227 - DNA, 22 bp, Homo sapiens
aacatcccaagattttttcatt

SEQ ID NO: 2675228 - DNA, 17 bp, Homo sapiens
aacatctagcaaatgtt

SEQ ID NO: 2675229 - DNA, 21 bp, Homo sapiens
aacatctttttaacctgcaaa

SEQ ID NO: 2675230 - DNA, 19 bp, Homo sapiens
aacatttactacagttttt

SEQ ID NO: 2675231 - DNA, 21 bp, Homo sapiens
aacctgttgatagcaagtgaa

SEQ ID NO: 2675232 - DNA, 23 bp, Homo sapiens
aagaaagtctatctaatgacatg

SEQ ID NO: 2675233 - DNA, 22 bp, Homo sapiens
aagaactgtcatgtaaacatac

SEQ ID NO: 2675234 - DNA, 18 bp, Homo sapiens
aagacaaattctgtttct

SEQ ID NO: 2675235 - DNA, 12 bp, Homo sapiens
aagacaacatta

SEQ ID NO: 2675236 - DNA, 21 bp, Homo sapiens
aagacaacattaaaacaatat

SEQ ID NO: 2675237 - DNA, 13 bp, Homo sapiens
aagagacaaactg

SEQ ID NO: 2675238 - DNA, 14 bp, Homo sapiens
aagattgtattgct

SEQ ID NO: 2675239 - DNA, 17 bp, Homo sapiens
aagctaagatgggtgga

SEQ ID NO: 2675240 - DNA, 20 bp, Homo sapiens
aaggaatacaatatatagct

SEQ ID NO: 2675241 - DNA, 16 bp, Homo sapiens
aaggatgtacatttcc

SEQ ID NO: 2675242 - DNA, 15 bp, Homo sapiens
aaggcatgtgtgaaa

SEQ ID NO: 2675243 - DNA, 16 bp, Homo sapiens
aagggctatgtaaata

SEQ ID NO: 2675244 - DNA, 16 bp, Homo sapiens
aaggggtctgaaattt

SEQ ID NO: 2675245 - DNA, 20 bp, Homo sapiens
aagtcagtgcccaactgtta

SEQ ID NO: 2675246 - DNA, 13 bp, Homo sapiens
aagtgaaaatctt

SEQ ID NO: 2675247 - DNA, 14 bp, Homo sapiens
aagtgaaaatctta

SEQ ID NO: 2675248 - DNA, 14 bp, Homo sapiens
aagtgaatttttct

SEQ ID NO: 2675249 - DNA, 17 bp, Homo sapiens
aagtgaatttttctcta

SEQ ID NO: 2675250 - DNA, 12 bp, Homo sapiens
aagtgtaactgg

SEQ ID NO: 2675251 - DNA, 16 bp, Homo sapiens
aagtttcagttgattt

SEQ ID NO: 2675252 - DNA, 19 bp, Homo sapiens
aataataaagatgctcttt

SEQ ID NO: 2675253 - DNA, 16 bp, Homo sapiens
aatacctcaggaaaga

SEQ ID NO: 2675254 - DNA, 20 bp, Homo sapiens
aatagaaccatgttggttgc

SEQ ID NO: 2675255 - DNA, 22 bp, Homo sapiens
aatagaaggatgtacatttcca

SEQ ID NO: 2675256 - DNA, 14 bp, Homo sapiens
aatagtgtcctatg

SEQ ID NO: 2675257 - DNA, 23 bp, Homo sapiens
aatagtgtcctatgcaataaaat

SEQ ID NO: 2675258 - DNA, 20 bp, Homo sapiens
aatatatagctggcaagaat

SEQ ID NO: 2675259 - DNA, 21 bp, Homo sapiens
aatattagctttactgtttgt

SEQ ID NO: 2675260 - DNA, 19 bp, Homo sapiens
aatcattttaggaaaggat

SEQ ID NO: 2675261 - DNA, 17 bp, Homo sapiens
aatctgaggcctcctct

SEQ ID NO: 2675262 - DNA, 17 bp, Homo sapiens
aatgactaaaaaacaaa

SEQ ID NO: 2675263 - DNA, 14 bp, Homo sapiens
aatgcaatatttgt

SEQ ID NO: 2675264 - DNA, 23 bp, Homo sapiens
aatgccatagtcaaagagagttt

SEQ ID NO: 2675265 - DNA, 17 bp, Homo sapiens
aatggtgttatttgaaa

SEQ ID NO: 2675266 - DNA, 23 bp, Homo sapiens
aatgtgtgtattcttaaaatgca

SEQ ID NO: 2675267 - DNA, 19 bp, Homo sapiens
aattatttgcaggtcttta

SEQ ID NO: 2675268 - DNA, 13 bp, Homo sapiens
aattcttacatgt

SEQ ID NO: 2675269 - DNA, 21 bp, Homo sapiens
aattgaaaggcattctctgaa

SEQ ID NO: 2675270 - DNA, 20 bp, Homo sapiens
aattgcagataactttgact

SEQ ID NO: 2675271 - DNA, 19 bp, Homo sapiens
aatttaattcatgtttctt

SEQ ID NO: 2675272 - DNA, 20 bp, Homo sapiens
aatttatttatactatttag

SEQ ID NO: 2675273 - DNA, 13 bp, Homo sapiens
aattttaatttat

SEQ ID NO: 2675274 - DNA, 20 bp, Homo sapiens
aatttttctctaactcagaa

SEQ ID NO: 2675275 - DNA, 21 bp, Homo sapiens
aatttttttcatcttctctgg

SEQ ID NO: 2675276 - DNA, 19 bp, Homo sapiens
acaaagacaaattctgttt

SEQ ID NO: 2675277 - DNA, 22 bp, Homo sapiens
acaaagacaaattctgtttctt

SEQ ID NO: 2675278 - DNA, 15 bp, Homo sapiens
acaaattctgtttct

SEQ ID NO: 2675279 - DNA, 16 bp, Homo sapiens
acaaattctgtttctt

SEQ ID NO: 2675280 - DNA, 17 bp, Homo sapiens
acaaccactcattcaaa

SEQ ID NO: 2675281 - DNA, 18 bp, Homo sapiens
acaagtgaaaaacatcca

SEQ ID NO: 2675282 - DNA, 22 bp, Homo sapiens
acactgcactcttaagcttccg

SEQ ID NO: 2675283 - DNA, 15 bp, Homo sapiens
acaggaattttaaaa

SEQ ID NO: 2675284 - DNA, 19 bp, Homo sapiens
acagtttttaactctactg

SEQ ID NO: 2675285 - DNA, 22 bp, Homo sapiens
acatacaattatttttacagtt

SEQ ID NO: 2675286 - DNA, 12 bp, Homo sapiens
acatactgctgt

SEQ ID NO: 2675287 - DNA, 23 bp, Homo sapiens
acatcctgtgtttctagggaaat

SEQ ID NO: 2675288 - DNA, 13 bp, Homo sapiens
acatctttcacat

SEQ ID NO: 2675289 - DNA, 15 bp, Homo sapiens
acatctttcacattg

SEQ ID NO: 2675290 - DNA, 22 bp, Homo sapiens
acatgcctatatgagaagaata

SEQ ID NO: 2675291 - DNA, 18 bp, Homo sapiens
accacaaaaaaatacctc

SEQ ID NO: 2675292 - DNA, 20 bp, Homo sapiens
accagagataatatgagaat

SEQ ID NO: 2675293 - DNA, 15 bp, Homo sapiens
accgcgtctggtgac

SEQ ID NO: 2675294 - DNA, 17 bp, Homo sapiens
acctcaggaaagaatag

SEQ ID NO: 2675295 - DNA, 21 bp, Homo sapiens
acctgagcccggatgcttctc

SEQ ID NO: 2675296 - DNA, 15 bp, Homo sapiens
acctttttccttcct

SEQ ID NO: 2675297 - DNA, 18 bp, Homo sapiens
actatattatcatgcaaa

SEQ ID NO: 2675298 - DNA, 22 bp, Homo sapiens
actatgaactgaaggcagcatg

SEQ ID NO: 2675299 - DNA, 23 bp, Homo sapiens
actatttagtttttgtaatttat

SEQ ID NO: 2675300 - DNA, 21 bp, Homo sapiens
actcagaaatttaattcatgt

SEQ ID NO: 2675301 - DNA, 21 bp, Homo sapiens
actcattcaaaagttgaaatt

SEQ ID NO: 2675302 - DNA, 16 bp, Homo sapiens
actcatttcctatgta

SEQ ID NO: 2675303 - DNA, 15 bp, Homo sapiens
actctactgtgtaat

SEQ ID NO: 2675304 - DNA, 23 bp, Homo sapiens
actgaaggcagcatgtatagttg

SEQ ID NO: 2675305 - DNA, 20 bp, Homo sapiens
actgagtagctctcctgact

SEQ ID NO: 2675306 - DNA, 14 bp, Homo sapiens
actgcatacaatct

SEQ ID NO: 2675307 - DNA, 22 bp, Homo sapiens
actggcagttttccattggttt

SEQ ID NO: 2675308 - DNA, 18 bp, Homo sapiens
actgtaaaaaatgtgtgt

SEQ ID NO: 2675309 - DNA, 21 bp, Homo sapiens
actgtcactgtttctctgctg

SEQ ID NO: 2675310 - DNA, 12 bp, Homo sapiens
actgtttctctg

SEQ ID NO: 2675311 - DNA, 15 bp, Homo sapiens
actgtttctctgctg

SEQ ID NO: 2675312 - DNA, 17 bp, Homo sapiens
actttctttctgtaggt

SEQ ID NO: 2675313 - DNA, 23 bp, Homo sapiens
agaaacatcagttactctgaagg

SEQ ID NO: 2675314 - DNA, 17 bp, Homo sapiens
agaaatttaattcatgt

SEQ ID NO: 2675315 - DNA, 22 bp, Homo sapiens
agaaatttaattcatgtttctt

SEQ ID NO: 2675316 - DNA, 22 bp, Homo sapiens
agaactgtcatgtaaacatacc

SEQ ID NO: 2675317 - DNA, 17 bp, Homo sapiens
agaaggatgtacatttc

SEQ ID NO: 2675318 - DNA, 13 bp, Homo sapiens
agaatagaaagaa

SEQ ID NO: 2675319 - DNA, 14 bp, Homo sapiens
agaatagaaagaaa

SEQ ID NO: 2675320 - DNA, 20 bp, Homo sapiens
agaatattagctttactgtt

SEQ ID NO: 2675321 - DNA, 21 bp, Homo sapiens
agaatattagctttactgttt

SEQ ID NO: 2675322 - DNA, 13 bp, Homo sapiens
agaatggtggctt

SEQ ID NO: 2675323 - DNA, 16 bp, Homo sapiens
agaattcttacatgtt

SEQ ID NO: 2675324 - DNA, 19 bp, Homo sapiens
agaattcttacatgttttc

SEQ ID NO: 2675325 - DNA, 23 bp, Homo sapiens
agaattcttacatgttttctttg

SEQ ID NO: 2675326 - DNA, 17 bp, Homo sapiens
ttagtttttgtaattta

SEQ ID NO: 2675327 - DNA, 18 bp, Homo sapiens
ttatcactgacacaaaaa

SEQ ID NO: 2675328 - DNA, 18 bp, Homo sapiens
ttatgtgccgtgttattg

SEQ ID NO: 2675329 - DNA, 18 bp, Homo sapiens
ttatttagggaactgctt

SEQ ID NO: 2675330 - DNA, 19 bp, Homo sapiens
ttcacatcctgtgtttcta

SEQ ID NO: 2675331 - DNA, 12 bp, Homo sapiens
ttcactgtacgt

SEQ ID NO: 2675332 - DNA, 15 bp, Homo sapiens
ttccaaattcacaag

SEQ ID NO: 2675333 - DNA, 13 bp, Homo sapiens
ttcctaaaatgct

SEQ ID NO: 2675334 - DNA, 14 bp, Homo sapiens
ttcctatgtaactg

SEQ ID NO: 2675335 - DNA, 16 bp, Homo sapiens
ttccttctcatctgtg

SEQ ID NO: 2675336 - DNA, 11 bp, Homo sapiens
ttctgtttctt

SEQ ID NO: 2675337 - DNA, 21 bp, Homo sapiens
ttcttcccttttacatactgc

SEQ ID NO: 2675338 - DNA, 22 bp, Homo sapiens
ttctttggtggagataaagatt

SEQ ID NO: 2675339 - DNA, 20 bp, Homo sapiens
ttgaaaggcattctctgaag

SEQ ID NO: 2675340 - DNA, 18 bp, Homo sapiens
ttgaaggaatacaatata

SEQ ID NO: 2675341 - DNA, 23 bp, Homo sapiens
ttgaaggaatacaatatatagct

SEQ ID NO: 2675342 - DNA, 19 bp, Homo sapiens
ttgagaactgcatatgttt

SEQ ID NO: 2675343 - DNA, 16 bp, Homo sapiens
ttgcactccagcctgg

SEQ ID NO: 2675344 - DNA, 13 bp, Homo sapiens
ttgcactttgtag

SEQ ID NO: 2675345 - DNA, 14 bp, Homo sapiens
ttgcactttgtagt

SEQ ID NO: 2675346 - DNA, 13 bp, Homo sapiens
ttgcagaagttct

SEQ ID NO: 2675347 - DNA, 19 bp, Homo sapiens
ttgcagaagttcttagtgt

SEQ ID NO: 2675348 - DNA, 23 bp, Homo sapiens
ttgcagctcccattctatgtgtc

SEQ ID NO: 2675349 - DNA, 22 bp, Homo sapiens
ttgggatcgcattgcatacctt

SEQ ID NO: 2675350 - DNA, 12 bp, Homo sapiens
ttggtttaatat

SEQ ID NO: 2675351 - DNA, 23 bp, Homo sapiens
ttgttaaaaaaaaaaagattgta

SEQ ID NO: 2675352 - DNA, 18 bp, Homo sapiens
ttgttttaaaattaaagc

SEQ ID NO: 2675353 - DNA, 20 bp, Homo sapiens
ttgttttaaaattaaagcta

SEQ ID NO: 2675354 - DNA, 16 bp, Homo sapiens
tttaaaagagacaaac

SEQ ID NO: 2675355 - DNA, 20 bp, Homo sapiens
tttaaaatggtttgtcctga

SEQ ID NO: 2675356 - DNA, 23 bp, Homo sapiens
tttaaatatctgaacatttacta

SEQ ID NO: 2675357 - DNA, 15 bp, Homo sapiens
tttaatattacctaa

SEQ ID NO: 2675358 - DNA, 14 bp, Homo sapiens
tttaattcatgttt

SEQ ID NO: 2675359 - DNA, 15 bp, Homo sapiens
tttacctgtgaaata

SEQ ID NO: 2675360 - DNA, 13 bp, Homo sapiens
tttactacagttt

SEQ ID NO: 2675361 - DNA, 14 bp, Homo sapiens
tttatatctggaat

SEQ ID NO: 2675362 - DNA, 23 bp, Homo sapiens
tttatatctggaatgagcctgtt

SEQ ID NO: 2675363 - DNA, 19 bp, Homo sapiens
tttatattagttgctttgt

SEQ ID NO: 2675364 - DNA, 21 bp, Homo sapiens
tttccattggtttacctgtga

SEQ ID NO: 2675365 - DNA, 17 bp, Homo sapiens
tttcccttgcttcccct

SEQ ID NO: 2675366 - DNA, 15 bp, Homo sapiens
tttcttaaatgggct

SEQ ID NO: 2675367 - DNA, 17 bp, Homo sapiens
tttgactttcttctgaa

SEQ ID NO: 2675368 - DNA, 23 bp, Homo sapiens
tttgatatccaaagctgaataca

SEQ ID NO: 2675369 - DNA, 22 bp, Homo sapiens
tttgcaggtctttaaatcattt

SEQ ID NO: 2675370 - DNA, 14 bp, Homo sapiens
ttttaaaagagaca

SEQ ID NO: 2675371 - DNA, 22 bp, Homo sapiens
ttttaaaagagacaaactgtaa

SEQ ID NO: 2675372 - DNA, 17 bp, Homo sapiens
ttttctctaactcagaa

SEQ ID NO: 2675373 - DNA, 23 bp, Homo sapiens
tttttatatctggaatgagcctg

SEQ ID NO: 2675374 - DNA, 12 bp, Homo sapiens
ttttttcatctt

SEQ ID NO: 2675375 - DNA, 16 bp, Homo sapiens
ataagtgaaaatctta

SEQ ID NO: 2675376 - DNA, 12 bp, Homo sapiens
ataatatgagaa

SEQ ID NO: 2675377 - DNA, 15 bp, Homo sapiens
ataatatgagaatca

SEQ ID NO: 2675378 - DNA, 18 bp, Homo sapiens
ataatgcatccagcagta

SEQ ID NO: 2675379 - DNA, 15 bp, Homo sapiens
atacagtcaacaagc

SEQ ID NO: 2675380 - DNA, 14 bp, Homo sapiens
atacatggataaca

SEQ ID NO: 2675381 - DNA, 15 bp, Homo sapiens
atacctcaggaaaga

SEQ ID NO: 2675382 - DNA, 17 bp, Homo sapiens
atacctcaggaaagaat

SEQ ID NO: 2675383 - DNA, 18 bp, Homo sapiens
atacctcaggaaagaata

SEQ ID NO: 2675384 - DNA, 21 bp, Homo sapiens
atacctcaggaaagaatagaa

SEQ ID NO: 2675385 - DNA, 19 bp, Homo sapiens
atagaaggatgtacatttc

SEQ ID NO: 2675386 - DNA, 13 bp, Homo sapiens
atagcaagtgaat

SEQ ID NO: 2675387 - DNA, 16 bp, Homo sapiens
atagctggcaagaatg

SEQ ID NO: 2675388 - DNA, 20 bp, Homo sapiens
atagtcaaagagagttttta

SEQ ID NO: 2675389 - DNA, 12 bp, Homo sapiens
atagttgctttt

SEQ ID NO: 2675390 - DNA, 13 bp, Homo sapiens
atatagctggcaa

SEQ ID NO: 2675391 - DNA, 19 bp, Homo sapiens
atatagctggcaagaatgg

SEQ ID NO: 2675392 - DNA, 15 bp, Homo sapiens
atatatggcatttgc

SEQ ID NO: 2675393 - DNA, 23 bp, Homo sapiens
atatatgtgtttttcacatttgc

SEQ ID NO: 2675394 - DNA, 18 bp, Homo sapiens
atatctgaacatttacta

SEQ ID NO: 2675395 - DNA, 16 bp, Homo sapiens
atatggcatttgcaga

SEQ ID NO: 2675396 - DNA, 22 bp, Homo sapiens
atatgtgtttttcacatttgcg

SEQ ID NO: 2675397 - DNA, 21 bp, Homo sapiens
atattacctaatgaaagtgat

SEQ ID NO: 2675398 - DNA, 20 bp, Homo sapiens
atattagctttactgtttgt

SEQ ID NO: 2675399 - DNA, 12 bp, Homo sapiens
atattgtttcta

SEQ ID NO: 2675400 - DNA, 20 bp, Homo sapiens
atcaattaactgagtagctc

SEQ ID NO: 2675401 - DNA, 14 bp, Homo sapiens
atcctgtgtttcta

SEQ ID NO: 2675402 - DNA, 18 bp, Homo sapiens
atcctgtgtttctaggga

SEQ ID NO: 2675403 - DNA, 16 bp, Homo sapiens
atctatgtttcatctt

SEQ ID NO: 2675404 - DNA, 20 bp, Homo sapiens
atctggtagggggaaaatgt

SEQ ID NO: 2675405 - DNA, 16 bp, Homo sapiens
atctgttctaacatgt

SEQ ID NO: 2675406 - DNA, 20 bp, Homo sapiens
atgaaagtgatgacatattt

SEQ ID NO: 2675407 - DNA, 20 bp, Homo sapiens
atgaacattagaaaaatagc

SEQ ID NO: 2675408 - DNA, 13 bp, Homo sapiens
atgaatatatggc

SEQ ID NO: 2675409 - DNA, 23 bp, Homo sapiens
atgaatatatttaagcaacatct

SEQ ID NO: 2675410 - DNA, 13 bp, Homo sapiens
atgacatattttt

SEQ ID NO: 2675411 - DNA, 13 bp, Homo sapiens
atgatcaaaaata

SEQ ID NO: 2675412 - DNA, 18 bp, Homo sapiens
atgcaataaaattatttg

SEQ ID NO: 2675413 - DNA, 20 bp, Homo sapiens
atgcaataaaattatttgca

SEQ ID NO: 2675414 - DNA, 21 bp, Homo sapiens
atgcaataaaattatttgcag

SEQ ID NO: 2675415 - DNA, 14 bp, Homo sapiens
atgcaatatttgta

SEQ ID NO: 2675416 - DNA, 14 bp, Homo sapiens
atgcatcttactga

SEQ ID NO: 2675417 - DNA, 13 bp, Homo sapiens
atgcttttgtcta

SEQ ID NO: 2675418 - DNA, 20 bp, Homo sapiens
atggccgcagggctgtgcac

SEQ ID NO: 2675419 - DNA, 15 bp, Homo sapiens
atggtttgtcctgat

SEQ ID NO: 2675420 - DNA, 12 bp, Homo sapiens
atgtaaacattt

SEQ ID NO: 2675421 - DNA, 22 bp, Homo sapiens
atgtggctgtatcttgtttttc

SEQ ID NO: 2675422 - DNA, 20 bp, Homo sapiens
atgtgggaattaagcaaaat

SEQ ID NO: 2675423 - DNA, 16 bp, Homo sapiens
atgttggttgcacttt

SEQ ID NO: 2675424 - DNA, 19 bp, Homo sapiens
atgttggttgcactttgta

SEQ ID NO: 2675425 - DNA, 22 bp, Homo sapiens
atgtttcgctgatatatgtgtt

SEQ ID NO: 2675426 - DNA, 20 bp, Homo sapiens
atgtttcgtgaagtatactg

SEQ ID NO: 2675427 - DNA, 18 bp, Homo sapiens
atgttttctttgctttaa

SEQ ID NO: 2675428 - DNA, 20 bp, Homo sapiens
attaaaacaatattgtttct

SEQ ID NO: 2675429 - DNA, 15 bp, Homo sapiens
attaaccatagatgt

SEQ ID NO: 2675430 - DNA, 22 bp, Homo sapiens
attaactgagtagctctcctga

SEQ ID NO: 2675431 - DNA, 15 bp, Homo sapiens
attacatctttcaca

SEQ ID NO: 2675432 - DNA, 18 bp, Homo sapiens
attacatctttcacattg

SEQ ID NO: 2675433 - DNA, 22 bp, Homo sapiens
attacatctttcacattggcta

SEQ ID NO: 2675434 - DNA, 13 bp, Homo sapiens
attagttgctttg

SEQ ID NO: 2675435 - DNA, 14 bp, Homo sapiens
attagttgctttgt

SEQ ID NO: 2675436 - DNA, 14 bp, Homo sapiens
attccctcctgcta

SEQ ID NO: 2675437 - DNA, 14 bp, Homo sapiens
attctatgtgtcat

SEQ ID NO: 2675438 - DNA, 12 bp, Homo sapiens
attctgtttctt

SEQ ID NO: 2675439 - DNA, 20 bp, Homo sapiens
attcttaaaatgcaatattt

SEQ ID NO: 2675440 - DNA, 15 bp, Homo sapiens
attcttacatgtttt

SEQ ID NO: 2675441 - DNA, 14 bp, Homo sapiens
attgagaactgcat

SEQ ID NO: 2675442 - DNA, 18 bp, Homo sapiens
attgagaactgcatatgt

SEQ ID NO: 2675443 - DNA, 20 bp, Homo sapiens
attgcagataactttgactt

SEQ ID NO: 2675444 - DNA, 12 bp, Homo sapiens
attgtattgctg

SEQ ID NO: 2675445 - DNA, 20 bp, Homo sapiens
atttaaatatctgaacattt

SEQ ID NO: 2675446 - DNA, 16 bp, Homo sapiens
atttaagcaacatctt

SEQ ID NO: 2675447 - DNA, 14 bp, Homo sapiens
atttcaaaactcat

SEQ ID NO: 2675448 - DNA, 16 bp, Homo sapiens
atttctgtgggagaat

SEQ ID NO: 2675449 - DNA, 21 bp, Homo sapiens
atttcttgagttttgttttaa

SEQ ID NO: 2675450 - DNA, 22 bp, Homo sapiens
atttgttaaaatacagttctgt

SEQ ID NO: 2675451 - DNA, 20 bp, Homo sapiens
attttattacatctttcaca

SEQ ID NO: 2675452 - DNA, 16 bp, Homo sapiens
attttgccatttagcg

SEQ ID NO: 2675453 - DNA, 15 bp, Homo sapiens
atttttaaagcatgg

SEQ ID NO: 2675454 - DNA, 15 bp, Homo sapiens
attttttaaaagaga

SEQ ID NO: 2675455 - DNA, 21 bp, Homo sapiens
attttttcatttcaaaatgct

SEQ ID NO: 2675456 - DNA, 15 bp, Homo sapiens
caaaaattagccggg

SEQ ID NO: 2675457 - DNA, 17 bp, Homo sapiens
caaaatcaagcaagcct

SEQ ID NO: 2675458 - DNA, 21 bp, Homo sapiens
caaactgtaaaaaatgtgtgt

SEQ ID NO: 2675459 - DNA, 14 bp, Homo sapiens
caaagaagacaaca

SEQ ID NO: 2675460 - DNA, 20 bp, Homo sapiens
caaagacaaattctgtttct

SEQ ID NO: 2675461 - DNA, 13 bp, Homo sapiens
caaatgttatgca

SEQ ID NO: 2675462 - DNA, 14 bp, Homo sapiens
caaattctgtttct

SEQ ID NO: 2675463 - DNA, 15 bp, Homo sapiens
caaattctgtttctt

SEQ ID NO: 2675464 - DNA, 17 bp, Homo sapiens
caacaaaaagcttcccc

SEQ ID NO: 2675465 - DNA, 20 bp, Homo sapiens
caacaggcttatgaatatat

SEQ ID NO: 2675466 - DNA, 13 bp, Homo sapiens
caacatctagcaa

SEQ ID NO: 2675467 - DNA, 19 bp, Homo sapiens
caactatattatcatgcaa

SEQ ID NO: 2675468 - DNA, 15 bp, Homo sapiens
caagaatggtggctt

SEQ ID NO: 2675469 - DNA, 20 bp, Homo sapiens
caagaatggtggcttctttt

SEQ ID NO: 2675470 - DNA, 19 bp, Homo sapiens
caagttgaagactttgttt

SEQ ID NO: 2675471 - DNA, 21 bp, Homo sapiens
caatggtgttatttgaaactt

SEQ ID NO: 2675472 - DNA, 19 bp, Homo sapiens
caatgtgtggctgaagact

SEQ ID NO: 2675473 - DNA, 16 bp, Homo sapiens
cacaaaattgggaaag

SEQ ID NO: 2675474 - DNA, 14 bp, Homo sapiens
cacaagttgtgttt

SEQ ID NO: 2675475 - DNA, 15 bp, Homo sapiens
cacacagcagcagtt

SEQ ID NO: 2675476 - DNA, 22 bp, Homo sapiens
cacagtgctttccgtggcactg

SEQ ID NO: 2675477 - DNA, 16 bp, Homo sapiens
cacagtgtgtttgtga

SEQ ID NO: 2675478 - DNA, 21 bp, Homo sapiens
cacctgagcccggatgcttct

SEQ ID NO: 2675479 - DNA, 23 bp, Homo sapiens
cacctgagcccggatgcttctcc

SEQ ID NO: 2675480 - DNA, 17 bp, Homo sapiens
cacgcgccctttctacc

SEQ ID NO: 2675481 - DNA, 18 bp, Homo sapiens
cactgtcactgtttctct

SEQ ID NO: 2675482 - DNA, 18 bp, Homo sapiens
cactgtttctctgctgtt

SEQ ID NO: 2675483 - DNA, 18 bp, Homo sapiens
cacttcactccagcctgg

SEQ ID NO: 2675484 - DNA, 23 bp, Homo sapiens
cagaaatttaattcatgtttctt

SEQ ID NO: 2675485 - DNA, 20 bp, Homo sapiens
cagaacaggtgttggtgaca

SEQ ID NO: 2675486 - DNA, 22 bp, Homo sapiens
cagagacaggaagtcttcaggg

SEQ ID NO: 2675487 - DNA, 14 bp, Homo sapiens
cagatcacagtgtc

SEQ ID NO: 2675488 - DNA, 18 bp, Homo sapiens
cagcatgtatagttgctt

SEQ ID NO: 2675489 - DNA, 19 bp, Homo sapiens
cagcatgtatagttgcttt

SEQ ID NO: 2675490 - DNA, 20 bp, Homo sapiens
caggaggtggaggctgcagt

SEQ ID NO: 2675491 - DNA, 15 bp, Homo sapiens
cagtcaacaagcctg

SEQ ID NO: 2675492 - DNA, 13 bp, Homo sapiens
cagttttccattg

SEQ ID NO: 2675493 - DNA, 19 bp, Homo sapiens
cagtttttaactctactgt

SEQ ID NO: 2675494 - DNA, 11 bp, Homo sapiens
catactgctgt

SEQ ID NO: 2675495 - DNA, 18 bp, Homo sapiens
catatgttaagcagctaa

SEQ ID NO: 2675496 - DNA, 19 bp, Homo sapiens
catattttttatatctgga

SEQ ID NO: 2675497 - DNA, 21 bp, Homo sapiens
catgaatttttttcatcttct

SEQ ID NO: 2675498 - DNA, 19 bp, Homo sapiens
catgagacacatctcctcc

SEQ ID NO: 2675499 - DNA, 14 bp, Homo sapiens
catgcatcttactg

SEQ ID NO: 2675500 - DNA, 19 bp, Homo sapiens
catggcaccaaagccacca

SEQ ID NO: 2675501 - DNA, 15 bp, Homo sapiens
catgtatagttgctt

SEQ ID NO: 2675502 - DNA, 22 bp, Homo sapiens
cattaaaacaatattgtttcta

SEQ ID NO: 2675503 - DNA, 17 bp, Homo sapiens
cattcaaaagttgaaat

SEQ ID NO: 2675504 - DNA, 21 bp, Homo sapiens
cattcagctgaggttcattac

SEQ ID NO: 2675505 - DNA, 13 bp, Homo sapiens
cattctctgaaga

SEQ ID NO: 2675506 - DNA, 20 bp, Homo sapiens
cattctgctttcatcttggt

SEQ ID NO: 2675507 - DNA, 14 bp, Homo sapiens
cattttaggaaagg

SEQ ID NO: 2675508 - DNA, 21 bp, Homo sapiens
ccaatgccacatacttgcagc

SEQ ID NO: 2675509 - DNA, 17 bp, Homo sapiens
ccacgcctgtaatccca

SEQ ID NO: 2675510 - DNA, 21 bp, Homo sapiens
ccagatacacccaaagtatca

SEQ ID NO: 2675511 - DNA, 16 bp, Homo sapiens
ccatagtcaaagagag

SEQ ID NO: 2675512 - DNA, 14 bp, Homo sapiens
ccattctctctcct

SEQ ID NO: 2675513 - DNA, 20 bp, Homo sapiens
ccctaaggcatgtgtgaaac

SEQ ID NO: 2675514 - DNA, 21 bp, Homo sapiens
cctaatgaaagtgatgacata

SEQ ID NO: 2675515 - DNA, 20 bp, Homo sapiens
cctagcttgggaggcttccc

SEQ ID NO: 2675516 - DNA, 12 bp, Homo sapiens
cctcaggaaaga

SEQ ID NO: 2675517 - DNA, 13 bp, Homo sapiens
actgagcctgttc

SEQ ID NO: 2675518 - DNA, 19 bp, Homo sapiens
actgagcctgttcattctg

SEQ ID NO: 2675519 - DNA, 17 bp, Homo sapiens
actgatcctgctccagc

SEQ ID NO: 2675520 - DNA, 15 bp, Homo sapiens
actgcactccagcct

SEQ ID NO: 2675521 - DNA, 20 bp, Homo sapiens
aactagagatgactgagtcc

SEQ ID NO: 2675522 - DNA, 18 bp, Homo sapiens
aactcacacctccttttc

SEQ ID NO: 2675523 - DNA, 17 bp, Homo sapiens
aactcctgattttgtag

SEQ ID NO: 2675524 - DNA, 11 bp, Homo sapiens
aactctttaac

SEQ ID NO: 2675525 - DNA, 16 bp, Homo sapiens
aactgatcctgctcca

SEQ ID NO: 2675526 - DNA, 17 bp, Homo sapiens
aactgatcctgctccag

SEQ ID NO: 2675527 - DNA, 18 bp, Homo sapiens
aactgatcctgctccagc

SEQ ID NO: 2675528 - DNA, 19 bp, Homo sapiens
aactgatcctgctccagca

SEQ ID NO: 2675529 - DNA, 13 bp, Homo sapiens
aactgcagtttga

SEQ ID NO: 2675530 - DNA, 20 bp, Homo sapiens
aactgctgttaattgattaa

SEQ ID NO: 2675531 - DNA, 15 bp, Homo sapiens
aactggctgctccct

SEQ ID NO: 2675532 - DNA, 17 bp, Homo sapiens
aactggctgctccctgc

SEQ ID NO: 2675533 - DNA, 18 bp, Homo sapiens
aactggctgctccctgct

SEQ ID NO: 2675534 - DNA, 13 bp, Homo sapiens
aacttcaagaagt

SEQ ID NO: 2675535 - DNA, 12 bp, Homo sapiens
aacttgaggaca

SEQ ID NO: 2675536 - DNA, 17 bp, Homo sapiens
aacttgaggacacatgt

SEQ ID NO: 2675537 - DNA, 17 bp, Homo sapiens
aagaaattcctgtagca

SEQ ID NO: 2675538 - DNA, 16 bp, Homo sapiens
aagaactccttatttt

SEQ ID NO: 2675539 - DNA, 17 bp, Homo sapiens
aattcctgtagcatctt

SEQ ID NO: 2675540 - DNA, 22 bp, Homo sapiens
aattctcaacctaccacccctt

SEQ ID NO: 2675541 - DNA, 19 bp, Homo sapiens
aattgcttaaaagacattt

SEQ ID NO: 2675542 - DNA, 17 bp, Homo sapiens
aattgcttttgttgtga

SEQ ID NO: 2675543 - DNA, 17 bp, Homo sapiens
aattgtaattaataata

SEQ ID NO: 2675544 - DNA, 17 bp, Homo sapiens
aatttcccctaatcttt

SEQ ID NO: 2675545 - DNA, 12 bp, Homo sapiens
aatttccctggg

SEQ ID NO: 2675546 - DNA, 20 bp, Homo sapiens
aatttccctgggggcatcct

SEQ ID NO: 2675547 - DNA, 19 bp, Homo sapiens
aattttactgacagaaatg

SEQ ID NO: 2675548 - DNA, 17 bp, Homo sapiens
aattttttttaatgtac

SEQ ID NO: 2675549 - DNA, 15 bp, Homo sapiens
acaaacaaataaata

SEQ ID NO: 2675550 - DNA, 13 bp, Homo sapiens
acaaaccatctgg

SEQ ID NO: 2675551 - DNA, 15 bp, Homo sapiens
acaaaccatctggtg

SEQ ID NO: 2675552 - DNA, 18 bp, Homo sapiens
ctgaggccattatttcaa

SEQ ID NO: 2675553 - DNA, 14 bp, Homo sapiens
ctgaggcttccaga

SEQ ID NO: 2675554 - DNA, 13 bp, Homo sapiens
ctgaggtgcctcc

SEQ ID NO: 2675555 - DNA, 15 bp, Homo sapiens
ctgaggtgcctccca

SEQ ID NO: 2675556 - DNA, 20 bp, Homo sapiens
ctgaggtgcctcccagtggc

SEQ ID NO: 2675557 - DNA, 20 bp, Homo sapiens
ctgagtcacccatgaagaca

SEQ ID NO: 2675558 - DNA, 12 bp, Homo sapiens
ctgataaaatac

SEQ ID NO: 2675559 - DNA, 16 bp, Homo sapiens
ctgatcctgctccagc

SEQ ID NO: 2675560 - DNA, 17 bp, Homo sapiens
ctgatcctgctccagca

SEQ ID NO: 2675561 - DNA, 18 bp, Homo sapiens
ctgatgccaaagctgctt

SEQ ID NO: 2675562 - DNA, 20 bp, Homo sapiens
ctgatgccaaagctgctttc

SEQ ID NO: 2675563 - DNA, 21 bp, Homo sapiens
ctgatgccaaagctgctttct

SEQ ID NO: 2675564 - DNA, 13 bp, Homo sapiens
ctgatggcccctc

SEQ ID NO: 2675565 - DNA, 20 bp, Homo sapiens
ctgatggcccctccagcaca

SEQ ID NO: 2675566 - DNA, 12 bp, Homo sapiens
ctgatggccctc

SEQ ID NO: 2675567 - DNA, 20 bp, Homo sapiens
ctgatgtccatttgtcccaa

SEQ ID NO: 2675568 - DNA, 22 bp, Homo sapiens
ctgatgtccatttgtcccaata

SEQ ID NO: 2675569 - DNA, 13 bp, Homo sapiens
ctgcacctgccag

SEQ ID NO: 2675570 - DNA, 20 bp, Homo sapiens
ctgcacctgccagcctggct

SEQ ID NO: 2675571 - DNA, 17 bp, Homo sapiens
ctgcactccagcctggg

SEQ ID NO: 2675572 - DNA, 20 bp, Homo sapiens
ctgcactccagcctgggcga

SEQ ID NO: 2675573 - DNA, 13 bp, Homo sapiens
ctgcagaaggcca

SEQ ID NO: 2675574 - DNA, 14 bp, Homo sapiens
ctgcagaaggccaa

SEQ ID NO: 2675575 - DNA, 22 bp, Homo sapiens
ctgcagacaagtcttgctgtgc

SEQ ID NO: 2675576 - DNA, 21 bp, Homo sapiens
ctgcagaggggaaaccagtgt

SEQ ID NO: 2675577 - DNA, 23 bp, Homo sapiens
ctgcagaggggaaaccagtgtag

SEQ ID NO: 2675578 - DNA, 19 bp, Homo sapiens
ctgcagaggggctttctgg

SEQ ID NO: 2675579 - DNA, 13 bp, Homo sapiens
ctgcagccagtca

SEQ ID NO: 2675580 - DNA, 19 bp, Homo sapiens
ctgcagccagtcaggcagg

SEQ ID NO: 2675581 - DNA, 13 bp, Homo sapiens
ctgcagcctccct

SEQ ID NO: 2675582 - DNA, 16 bp, Homo sapiens
ctgcaggcatggaact

SEQ ID NO: 2675583 - DNA, 19 bp, Homo sapiens
ctgcaggccaagagcagag

SEQ ID NO: 2675584 - DNA, 21 bp, Homo sapiens
ctgcaggccaagagcagaggc

SEQ ID NO: 2675585 - DNA, 18 bp, Homo sapiens
ctgcaggctccatgcacc

SEQ ID NO: 2675586 - DNA, 15 bp, Homo sapiens
ctgcagtagtctctg

SEQ ID NO: 2675587 - DNA, 20 bp, Homo sapiens
ctgcattgttattgtggaag

SEQ ID NO: 2675588 - DNA, 12 bp, Homo sapiens
ctgccaaaacaa

SEQ ID NO: 2675589 - DNA, 16 bp, Homo sapiens
ctgccacctctcccag

SEQ ID NO: 2675590 - DNA, 17 bp, Homo sapiens
ctgccacctctcccagc

SEQ ID NO: 2675591 - DNA, 18 bp, Homo sapiens
ctgccacctctcccagcc

SEQ ID NO: 2675592 - DNA, 11 bp, Homo sapiens
ctgccacctgt

SEQ ID NO: 2675593 - DNA, 13 bp, Homo sapiens
ctgccacctgtct

SEQ ID NO: 2675594 - DNA, 12 bp, Homo sapiens
ctgccagcctgg

SEQ ID NO: 2675595 - DNA, 20 bp, Homo sapiens
ctgccagcctggcttctgga

SEQ ID NO: 2675596 - DNA, 22 bp, Homo sapiens
ctgccagcctggcttctggagc

SEQ ID NO: 2675597 - DNA, 13 bp, Homo sapiens
ctgccagctgctc

SEQ ID NO: 2675598 - DNA, 22 bp, Homo sapiens
ctgccatggcgtgtccctctcg

SEQ ID NO: 2675599 - DNA, 21 bp, Homo sapiens
ctgccatttgcaccctccgcc

SEQ ID NO: 2675600 - DNA, 13 bp, Homo sapiens
ctgccccagctct

SEQ ID NO: 2675601 - DNA, 16 bp, Homo sapiens
ctgccccagctctggc

SEQ ID NO: 2675602 - DNA, 13 bp, Homo sapiens
ctgccccctggtg

SEQ ID NO: 2675603 - DNA, 24 bp, Homo sapiens
ctgcccctacgggcgctgcagcct

SEQ ID NO: 2675604 - DNA, 12 bp, Homo sapiens
ctgccctcccct

SEQ ID NO: 2675605 - DNA, 13 bp, Homo sapiens
ctgccctcccctg

SEQ ID NO: 2675606 - DNA, 15 bp, Homo sapiens
ctgccctcccctgct

SEQ ID NO: 2675607 - DNA, 19 bp, Homo sapiens
ctgccctcccctgctccca

SEQ ID NO: 2675608 - DNA, 17 bp, Homo sapiens
ctgccctccccttcccc

SEQ ID NO: 2675609 - DNA, 11 bp, Homo sapiens
ctgccctgcca

SEQ ID NO: 2675610 - DNA, 14 bp, Homo sapiens
ctgccctgccacct

SEQ ID NO: 2675611 - DNA, 16 bp, Homo sapiens
ctgccctgccactttg

SEQ ID NO: 2675612 - DNA, 11 bp, Homo sapiens
ctgccctgccc

SEQ ID NO: 2675613 - DNA, 15 bp, Homo sapiens
ctgccctgccctgcc

SEQ ID NO: 2675614 - DNA, 13 bp, Homo sapiens
ctgccctggctgt

SEQ ID NO: 2675615 - DNA, 20 bp, Homo sapiens
ctgccctgtgagagccacgc

SEQ ID NO: 2675616 - DNA, 14 bp, Homo sapiens
ctgcccttcctcca

SEQ ID NO: 2675617 - DNA, 17 bp, Homo sapiens
ctgcccttcctccagga

SEQ ID NO: 2675618 - DNA, 18 bp, Homo sapiens
ctgcctcctcctcacgca

SEQ ID NO: 2675619 - DNA, 13 bp, Homo sapiens
ctgcctggtcctc

SEQ ID NO: 2675620 - DNA, 16 bp, Homo sapiens
ctgcctggtcctccct

SEQ ID NO: 2675621 - DNA, 17 bp, Homo sapiens
ctgcctggtcctccctc

SEQ ID NO: 2675622 - DNA, 20 bp, Homo sapiens
ctgcctggtcctccctccca

SEQ ID NO: 2675623 - DNA, 22 bp, Homo sapiens
ctgcctggtcctccctcccaag

SEQ ID NO: 2675624 - DNA, 17 bp, Homo sapiens
ctgccttctcccctcca

SEQ ID NO: 2675625 - DNA, 20 bp, Homo sapiens
ctgccttgaagccactgaag

SEQ ID NO: 2675626 - DNA, 19 bp, Homo sapiens
ctgcgaaggggccctggtc

SEQ ID NO: 2675627 - DNA, 19 bp, Homo sapiens
ctgcgggatggtcctgggg

SEQ ID NO: 2675628 - DNA, 19 bp, Homo sapiens
cgaaacctgtccataaagt

SEQ ID NO: 2675629 - DNA, 16 bp, Homo sapiens
cgagatcacgccactg

SEQ ID NO: 2675630 - DNA, 20 bp, Homo sapiens
cgagatcacgccactgcact

SEQ ID NO: 2675631 - DNA, 16 bp, Homo sapiens
cgagattgcgccactg

SEQ ID NO: 2675632 - DNA, 17 bp, Homo sapiens
cgaggggatggggatgc

SEQ ID NO: 2675633 - DNA, 20 bp, Homo sapiens
cgatcttggctcactgcaac

SEQ ID NO: 2675634 - DNA, 23 bp, Homo sapiens
cgatgaatgtgttgatttgagaa

SEQ ID NO: 2675635 - DNA, 23 bp, Homo sapiens
cgatgaatttggagactctgtgg

SEQ ID NO: 2675636 - DNA, 13 bp, Homo sapiens
cgcaaggctgtgc

SEQ ID NO: 2675637 - DNA, 16 bp, Homo sapiens
cgcacctgccccctgg

SEQ ID NO: 2675638 - DNA, 16 bp, Homo sapiens
cgcagagccctccagg

SEQ ID NO: 2675639 - DNA, 16 bp, Homo sapiens
cgcagcctccctctga

SEQ ID NO: 2675640 - DNA, 21 bp, Homo sapiens
cgcaggctatttgttcagaga

SEQ ID NO: 2675641 - DNA, 13 bp, Homo sapiens
cgcagtctggcct

SEQ ID NO: 2675642 - DNA, 15 bp, Homo sapiens
cgcagtctggcctgg

SEQ ID NO: 2675643 - DNA, 21 bp, Homo sapiens
cgccactacactccagcctga

SEQ ID NO: 2675644 - DNA, 15 bp, Homo sapiens
cgcccagctgcacct

SEQ ID NO: 2675645 - DNA, 20 bp, Homo sapiens
cgcccagctgcacctgccag

SEQ ID NO: 2675646 - DNA, 22 bp, Homo sapiens
cgccgtgttactgttgcactga

SEQ ID NO: 2675647 - DNA, 21 bp, Homo sapiens
cgcctgagcccaggaggtgga

SEQ ID NO: 2675648 - DNA, 18 bp, Homo sapiens
cgcctgtaatcccagcac

SEQ ID NO: 2675649 - DNA, 18 bp, Homo sapiens
cgcctgtgctgaggactc

SEQ ID NO: 2675650 - DNA, 18 bp, Homo sapiens
cgcctttccggggctgct

SEQ ID NO: 2675651 - DNA, 13 bp, Homo sapiens
cgctcacctcaga

SEQ ID NO: 2675652 - DNA, 17 bp, Homo sapiens
cgctcacctcagagcag

SEQ ID NO: 2675653 - DNA, 15 bp, Homo sapiens
cgctccccacctacc

SEQ ID NO: 2675654 - DNA, 17 bp, Homo sapiens
cgctccccacctaccca

SEQ ID NO: 2675655 - DNA, 20 bp, Homo sapiens
cgctccccacctacccagct

SEQ ID NO: 2675656 - DNA, 12 bp, Homo sapiens
cgctgcagcctc

SEQ ID NO: 2675657 - DNA, 19 bp, Homo sapiens
cgctgcagcctcccttcca

SEQ ID NO: 2675658 - DNA, 19 bp, Homo sapiens
cgctggtccctgccctccc

SEQ ID NO: 2675659 - DNA, 12 bp, Homo sapiens
cgcttgctctcc

SEQ ID NO: 2675660 - DNA, 14 bp, Homo sapiens
cgcttgctctcctg

SEQ ID NO: 2675661 - DNA, 15 bp, Homo sapiens
cgcttgctctcctgg

SEQ ID NO: 2675662 - DNA, 16 bp, Homo sapiens
cgcttgctctcctgga

SEQ ID NO: 2675663 - DNA, 17 bp, Homo sapiens
cgcttgctctcctggag

SEQ ID NO: 2675664 - DNA, 16 bp, Homo sapiens
cggacagtgcccatgc

SEQ ID NO: 2675665 - DNA, 23 bp, Homo sapiens
cggagatgcttctaaggcatggt

SEQ ID NO: 2675666 - DNA, 13 bp, Homo sapiens
cggcacccaggcc

SEQ ID NO: 2675667 - DNA, 20 bp, Homo sapiens
cggcatcctgaaagccagca

SEQ ID NO: 2675668 - DNA, 11 bp, Homo sapiens
cggccacatgc

SEQ ID NO: 2675669 - DNA, 21 bp, Homo sapiens
cggccacatgccgcgtccctg

SEQ ID NO: 2675670 - DNA, 13 bp, Homo sapiens
cggcgcagagccc

SEQ ID NO: 2675671 - DNA, 20 bp, Homo sapiens
cggcggcacccaggcctccc

SEQ ID NO: 2675672 - DNA, 15 bp, Homo sapiens
cggcgtgggcgaggc

SEQ ID NO: 2675673 - DNA, 16 bp, Homo sapiens
cggcgtgggcgaggcc

SEQ ID NO: 2675674 - DNA, 18 bp, Homo sapiens
cggctcccgcttgctctc

SEQ ID NO: 2675675 - DNA, 19 bp, Homo sapiens
cgggaccccctggccctgc

SEQ ID NO: 2675676 - DNA, 16 bp, Homo sapiens
cgggataaactgagcc

SEQ ID NO: 2675677 - DNA, 16 bp, Homo sapiens
cgggatggtcctgggg

SEQ ID NO: 2675678 - DNA, 14 bp, Homo sapiens
cgggcacctgtagt

SEQ ID NO: 2675679 - DNA, 16 bp, Homo sapiens
cgggcgctgcagcctc

SEQ ID NO: 2675680 - DNA, 14 bp, Homo sapiens
cgggctgccctgcc

SEQ ID NO: 2675681 - DNA, 17 bp, Homo sapiens
cggggctgctggcctgg

SEQ ID NO: 2675682 - DNA, 13 bp, Homo sapiens
cgggtgctgccag

SEQ ID NO: 2675683 - DNA, 18 bp, Homo sapiens
cgggtggatcacctgagg

SEQ ID NO: 2675684 - DNA, 17 bp, Homo sapiens
ctagagctcctgtccct

SEQ ID NO: 2675685 - DNA, 17 bp, Homo sapiens
ctaggaatatagattaa

SEQ ID NO: 2675686 - DNA, 15 bp, Homo sapiens
ctaggactctgaggc

SEQ ID NO: 2675687 - DNA, 22 bp, Homo sapiens
ctaggactctgaggctctttct

SEQ ID NO: 2675688 - DNA, 15 bp, Homo sapiens
ctaggagccccagct

SEQ ID NO: 2675689 - DNA, 21 bp, Homo sapiens
ctagggaaaacacggccctcc

SEQ ID NO: 2675690 - DNA, 15 bp, Homo sapiens
ctagtcccttctctc

SEQ ID NO: 2675691 - DNA, 22 bp, Homo sapiens
ctagtttcagtaaataatgaaa

SEQ ID NO: 2675692 - DNA, 16 bp, Homo sapiens
ctagttttttttgtaa

SEQ ID NO: 2675693 - DNA, 19 bp, Homo sapiens
ctagttttttttgtaaact

SEQ ID NO: 2675694 - DNA, 14 bp, Homo sapiens
ctataaacactgtt

SEQ ID NO: 2675695 - DNA, 13 bp, Homo sapiens
ctataaattatat

SEQ ID NO: 2675696 - DNA, 18 bp, Homo sapiens
ctatatctataaacactg

SEQ ID NO: 2675697 - DNA, 15 bp, Homo sapiens
ctatatctctaaact

SEQ ID NO: 2675698 - DNA, 19 bp, Homo sapiens
ctatgaagggacagctgct

SEQ ID NO: 2675699 - DNA, 21 bp, Homo sapiens
ctatgatcccagcactttggg

SEQ ID NO: 2675700 - DNA, 14 bp, Homo sapiens
ctatgccaggctgt

SEQ ID NO: 2675701 - DNA, 13 bp, Homo sapiens
ctattttctctga

SEQ ID NO: 2675702 - DNA, 19 bp, Homo sapiens
ctcaatattcaataaagct

SEQ ID NO: 2675703 - DNA, 22 bp, Homo sapiens
ctcaatgcattgtcttgtggag

SEQ ID NO: 2675704 - DNA, 14 bp, Homo sapiens
ctcacctcagagca

SEQ ID NO: 2675705 - DNA, 16 bp, Homo sapiens
ctcacctcagagcagg

SEQ ID NO: 2675706 - DNA, 19 bp, Homo sapiens
ctcactctgggtgcctcct

SEQ ID NO: 2675707 - DNA, 15 bp, Homo sapiens
ctcacttctgtctcc

SEQ ID NO: 2675708 - DNA, 21 bp, Homo sapiens
ctcacttctgtctcctgtctt

SEQ ID NO: 2675709 - DNA, 17 bp, Homo sapiens
ctcagaagccagtctgc

SEQ ID NO: 2675710 - DNA, 19 bp, Homo sapiens
ctcagaagccagtctgcgt

SEQ ID NO: 2675711 - DNA, 20 bp, Homo sapiens
ctcagaagccagtctgcgtc

SEQ ID NO: 2675712 - DNA, 14 bp, Homo sapiens
ctcagaagcctgag

SEQ ID NO: 2675713 - DNA, 15 bp, Homo sapiens
ctcagagcagggcca

SEQ ID NO: 2675714 - DNA, 12 bp, Homo sapiens
ctcagatctgaa

SEQ ID NO: 2675715 - DNA, 13 bp, Homo sapiens
ctcagcccagctg

SEQ ID NO: 2675716 - DNA, 22 bp, Homo sapiens
ctcagcccagctggccacctag

SEQ ID NO: 2675717 - DNA, 20 bp, Homo sapiens
ctcagccctccatggcctgg

SEQ ID NO: 2675718 - DNA, 14 bp, Homo sapiens
ctcaggaggctgag

SEQ ID NO: 2675719 - DNA, 17 bp, Homo sapiens
ctcaggcttccttggca

SEQ ID NO: 2675720 - DNA, 17 bp, Homo sapiens
ctcagggcccagcaggc

SEQ ID NO: 2675721 - DNA, 13 bp, Homo sapiens
ctcagtctcagga

SEQ ID NO: 2675722 - DNA, 18 bp, Homo sapiens
ctccaatggggccagcac

SEQ ID NO: 2675723 - DNA, 13 bp, Homo sapiens
ctccagcagcaca

SEQ ID NO: 2675724 - DNA, 14 bp, Homo sapiens
ctccagcagcacac

SEQ ID NO: 2675725 - DNA, 15 bp, Homo sapiens
ctccagcagcacacc

SEQ ID NO: 2675726 - DNA, 20 bp, Homo sapiens
ctccagcagcacacctcagc

SEQ ID NO: 2675727 - DNA, 22 bp, Homo sapiens
ctccagcagcacacctcagccc

SEQ ID NO: 2675728 - DNA, 16 bp, Homo sapiens
ctccagcatcttttcc

SEQ ID NO: 2675729 - DNA, 23 bp, Homo sapiens
ctccagcatcttttccatcctga

SEQ ID NO: 2675730 - DNA, 13 bp, Homo sapiens
ctccagcctgagc

SEQ ID NO: 2675731 - DNA, 13 bp, Homo sapiens
ctccagcctgggc

SEQ ID NO: 2675732 - DNA, 20 bp, Homo sapiens
ctccagctaactgtggagaa

SEQ ID NO: 2675733 - DNA, 13 bp, Homo sapiens
ctccaggcctgca

SEQ ID NO: 2675734 - DNA, 15 bp, Homo sapiens
ctccaggcctgcagg

SEQ ID NO: 2675735 - DNA, 15 bp, Homo sapiens
ctccagtggttgctg

SEQ ID NO: 2675736 - DNA, 16 bp, Homo sapiens
ctccagtggttgctgt

SEQ ID NO: 2675737 - DNA, 15 bp, Homo sapiens
ctccatgcacctccc

SEQ ID NO: 2675738 - DNA, 13 bp, Homo sapiens
ctccatgtggccc

SEQ ID NO: 2675739 - DNA, 21 bp, Homo sapiens
ctccatgtggccccaggtgcc

SEQ ID NO: 2675740 - DNA, 16 bp, Homo sapiens
ctcccagccctcagca

SEQ ID NO: 2675741 - DNA, 15 bp, Homo sapiens
ctcccaggaaccaaa

SEQ ID NO: 2675742 - DNA, 17 bp, Homo sapiens
ctcccagggactgacac

SEQ ID NO: 2675743 - DNA, 19 bp, Homo sapiens
ctcccagggccagggccct

SEQ ID NO: 2675744 - DNA, 12 bp, Homo sapiens
ctccccctgggc

SEQ ID NO: 2675745 - DNA, 16 bp, Homo sapiens
ccctcgtggacacctg

SEQ ID NO: 2675746 - DNA, 17 bp, Homo sapiens
ccctcgtggacacctgc

SEQ ID NO: 2675747 - DNA, 13 bp, Homo sapiens
ccctgcacagcct

SEQ ID NO: 2675748 - DNA, 21 bp, Homo sapiens
ccctgccctcccctgctccca

SEQ ID NO: 2675749 - DNA, 15 bp, Homo sapiens
ccctgccctgccacc

SEQ ID NO: 2675750 - DNA, 11 bp, Homo sapiens
ccctgcctgcc

SEQ ID NO: 2675751 - DNA, 12 bp, Homo sapiens
ccctgctcccag

SEQ ID NO: 2675752 - DNA, 16 bp, Homo sapiens
ccctgctcccagggac

SEQ ID NO: 2675753 - DNA, 14 bp, Homo sapiens
ccctgctcccaggt

SEQ ID NO: 2675754 - DNA, 15 bp, Homo sapiens
ccctgctctgtagcc

SEQ ID NO: 2675755 - DNA, 14 bp, Homo sapiens
ccctggaccccagg

SEQ ID NO: 2675756 - DNA, 13 bp, Homo sapiens
ccctggccctgcc

SEQ ID NO: 2675757 - DNA, 12 bp, Homo sapiens
ccctggctgtgg

SEQ ID NO: 2675758 - DNA, 15 bp, Homo sapiens
ccctgggctctgccc

SEQ ID NO: 2675759 - DNA, 16 bp, Homo sapiens
ccctgggggcatcctg

SEQ ID NO: 2675760 - DNA, 19 bp, Homo sapiens
ccctgggggcatcctgctt

SEQ ID NO: 2675761 - DNA, 21 bp, Homo sapiens
ccctgggggcatcctgcttcc

SEQ ID NO: 2675762 - DNA, 23 bp, Homo sapiens
ccctgggggcatcctgcttcctg

SEQ ID NO: 2675763 - DNA, 17 bp, Homo sapiens
ccctggtccttccaggc

SEQ ID NO: 2675764 - DNA, 17 bp, Homo sapiens
ccctggtggacagtcct

SEQ ID NO: 2675765 - DNA, 18 bp, Homo sapiens
ccctggtggacagtcctg

SEQ ID NO: 2675766 - DNA, 19 bp, Homo sapiens
ccctggtggacagtcctgg

SEQ ID NO: 2675767 - DNA, 19 bp, Homo sapiens
ccctgtcagaatcatgctg

SEQ ID NO: 2675768 - DNA, 22 bp, Homo sapiens
ccctgtcagaatcatgctgttc

SEQ ID NO: 2675769 - DNA, 16 bp, Homo sapiens
ccctgtgagagccacg

SEQ ID NO: 2675770 - DNA, 15 bp, Homo sapiens
cccttccatgcccca

SEQ ID NO: 2675771 - DNA, 19 bp, Homo sapiens
cccttccatgccccaggat

SEQ ID NO: 2675772 - DNA, 21 bp, Homo sapiens
cccttccatgccccaggatca

SEQ ID NO: 2675773 - DNA, 22 bp, Homo sapiens
cccttcccctttactcagccca

SEQ ID NO: 2675774 - DNA, 18 bp, Homo sapiens
cccttctcccttgccctc

SEQ ID NO: 2675775 - DNA, 18 bp, Homo sapiens
cccttctctctttctaag

SEQ ID NO: 2675776 - DNA, 12 bp, Homo sapiens
cccttgtgtgtg

SEQ ID NO: 2675777 - DNA, 18 bp, Homo sapiens
ccctttactcagcccagc

SEQ ID NO: 2675778 - DNA, 20 bp, Homo sapiens
ccctttactcagcccagctg

SEQ ID NO: 2675779 - DNA, 16 bp, Homo sapiens
ccgagattgcgccact

SEQ ID NO: 2675780 - DNA, 14 bp, Homo sapiens
ccgagcctaatgaa

SEQ ID NO: 2675781 - DNA, 15 bp, Homo sapiens
ccgatgctgaggcca

SEQ ID NO: 2675782 - DNA, 20 bp, Homo sapiens
ccgcagaaggggaatgtgtc

SEQ ID NO: 2675783 - DNA, 21 bp, Homo sapiens
cctgaggcaggtgagaaccca

SEQ ID NO: 2675784 - DNA, 23 bp, Homo sapiens
cctgaggcaggtgagaacccaga

SEQ ID NO: 2675785 - DNA, 13 bp, Homo sapiens
cctgagggctcct

SEQ ID NO: 2675786 - DNA, 18 bp, Homo sapiens
cctgagggctcctccatg

SEQ ID NO: 2675787 - DNA, 19 bp, Homo sapiens
cctgagggctcctccatgg

SEQ ID NO: 2675788 - DNA, 14 bp, Homo sapiens
cctgaggtgcctcc

SEQ ID NO: 2675789 - DNA, 16 bp, Homo sapiens
cctgaggtgcctccca

SEQ ID NO: 2675790 - DNA, 18 bp, Homo sapiens
cctgaggtgcctcccagt

SEQ ID NO: 2675791 - DNA, 13 bp, Homo sapiens
cctgcacagcctc

SEQ ID NO: 2675792 - DNA, 15 bp, Homo sapiens
cctgcacagcctcta

SEQ ID NO: 2675793 - DNA, 19 bp, Homo sapiens
cctgcagaggggaaaccag

SEQ ID NO: 2675794 - DNA, 22 bp, Homo sapiens
cctgcaggccaagagcagaggc

SEQ ID NO: 2675795 - DNA, 23 bp, Homo sapiens
cctgcaggctccatgcacctccc

SEQ ID NO: 2675796 - DNA, 20 bp, Homo sapiens
cctgcaggcttaggtcctca

SEQ ID NO: 2675797 - DNA, 22 bp, Homo sapiens
cctgcaggcttaggtcctcact

SEQ ID NO: 2675798 - DNA, 22 bp, Homo sapiens
cctgcaggggcaaggggctggc

SEQ ID NO: 2675799 - DNA, 16 bp, Homo sapiens
cctgcaggtcctggtg

SEQ ID NO: 2675800 - DNA, 20 bp, Homo sapiens
cctgcaggtgagcaggcagg

SEQ ID NO: 2675801 - DNA, 19 bp, Homo sapiens
cctgccaagctcacacagc

SEQ ID NO: 2675802 - DNA, 16 bp, Homo sapiens
cctgccacctctccca

SEQ ID NO: 2675803 - DNA, 17 bp, Homo sapiens
cctgccacctgtctgtc

SEQ ID NO: 2675804 - DNA, 23 bp, Homo sapiens
cctgccactttggtacatggcca

SEQ ID NO: 2675805 - DNA, 18 bp, Homo sapiens
cctgccagagctttgttt

SEQ ID NO: 2675806 - DNA, 17 bp, Homo sapiens
cctgccagcctggcttc

SEQ ID NO: 2675807 - DNA, 21 bp, Homo sapiens
cctgccagcctggcttctgga

SEQ ID NO: 2675808 - DNA, 17 bp, Homo sapiens
cctgccatttgcaccct

SEQ ID NO: 2675809 - DNA, 12 bp, Homo sapiens
cctgccccctgg

SEQ ID NO: 2675810 - DNA, 15 bp, Homo sapiens
cctgccccctggtgg

SEQ ID NO: 2675811 - DNA, 13 bp, Homo sapiens
cctgccctcccct

SEQ ID NO: 2675812 - DNA, 14 bp, Homo sapiens
cctgccctcccctg

SEQ ID NO: 2675813 - DNA, 18 bp, Homo sapiens
cctgccctcccctgctcc

SEQ ID NO: 2675814 - DNA, 11 bp, Homo sapiens
cctgccctgcc

SEQ ID NO: 2675815 - DNA, 17 bp, Homo sapiens
cctgccctgccacctgt

SEQ ID NO: 2675816 - DNA, 16 bp, Homo sapiens
cctgccctgccctgcc

SEQ ID NO: 2675817 - DNA, 20 bp, Homo sapiens
cctgcctgccttctcccctc

SEQ ID NO: 2675818 - DNA, 12 bp, Homo sapiens
cctgcctggtcc

SEQ ID NO: 2675819 - DNA, 19 bp, Homo sapiens
cctgcctggtcctccctcc

SEQ ID NO: 2675820 - DNA, 14 bp, Homo sapiens
cctgccttctcccc

SEQ ID NO: 2675821 - DNA, 16 bp, Homo sapiens
cctgccttgaagccac

SEQ ID NO: 2675822 - DNA, 22 bp, Homo sapiens
cctgccttgaagccactgaagc

SEQ ID NO: 2675823 - DNA, 13 bp, Homo sapiens
cctgctagctgtc

SEQ ID NO: 2675824 - DNA, 15 bp, Homo sapiens
cctgctagctgtctc

SEQ ID NO: 2675825 - DNA, 15 bp, Homo sapiens
cctgctccagcagca

SEQ ID NO: 2675826 - DNA, 16 bp, Homo sapiens
cctgctccagcagcac

SEQ ID NO: 2675827 - DNA, 22 bp, Homo sapiens
cctgctccagcagcacacctca

SEQ ID NO: 2675828 - DNA, 15 bp, Homo sapiens
cctgctcccagggac

SEQ ID NO: 2675829 - DNA, 20 bp, Homo sapiens
cctgctctgcttcctcaggg

SEQ ID NO: 2675830 - DNA, 21 bp, Homo sapiens
cctgctctgcttcctcagggc

SEQ ID NO: 2675831 - DNA, 22 bp, Homo sapiens
cctgctctgcttcctcagggcc

SEQ ID NO: 2675832 - DNA, 15 bp, Homo sapiens
cctgctctgtagcca

SEQ ID NO: 2675833 - DNA, 19 bp, Homo sapiens
cctgctctgtagccacctc

SEQ ID NO: 2675834 - DNA, 17 bp, Homo sapiens
cctgctctttctctgag

SEQ ID NO: 2675835 - DNA, 20 bp, Homo sapiens
cctgctgcgggggagccagt

SEQ ID NO: 2675836 - DNA, 22 bp, Homo sapiens
cctgctgcgggggagccagttc

SEQ ID NO: 2675837 - DNA, 13 bp, Homo sapiens
cctgcttcctgaa

SEQ ID NO: 2675838 - DNA, 14 bp, Homo sapiens
cctgcttcctgaaa

SEQ ID NO: 2675839 - DNA, 23 bp, Homo sapiens
cctgcttcctgaaagctgttgga

SEQ ID NO: 2675840 - DNA, 21 bp, Homo sapiens
cctggaaaggctcagtctcag

SEQ ID NO: 2675841 - DNA, 22 bp, Homo sapiens
cctggaaaggctcagtctcagg

SEQ ID NO: 2675842 - DNA, 20 bp, Homo sapiens
cctggaactcactcactctg

SEQ ID NO: 2675843 - DNA, 14 bp, Homo sapiens
cctggaccccaggc

SEQ ID NO: 2675844 - DNA, 18 bp, Homo sapiens
cctggactgactgcagcc

SEQ ID NO: 2675845 - DNA, 15 bp, Homo sapiens
cctggcacgagggga

SEQ ID NO: 2675846 - DNA, 22 bp, Homo sapiens
cctggcccttgagtggggcagc

SEQ ID NO: 2675847 - DNA, 15 bp, Homo sapiens
cctggcttctggagc

SEQ ID NO: 2675848 - DNA, 17 bp, Homo sapiens
cctggcttctggagccc

SEQ ID NO: 2675849 - DNA, 21 bp, Homo sapiens
cctggcttctggagcccttgg

SEQ ID NO: 2675850 - DNA, 15 bp, Homo sapiens
cctgggaacctcctt

SEQ ID NO: 2675851 - DNA, 23 bp, Homo sapiens
cctgggaacctccttacctggag

SEQ ID NO: 2675852 - DNA, 14 bp, Homo sapiens
cctgggatgatgtg

SEQ ID NO: 2675853 - DNA, 21 bp, Homo sapiens
cctgggatgatgtgtgaaacc

SEQ ID NO: 2675854 - DNA, 13 bp, Homo sapiens
cctgggccagaga

SEQ ID NO: 2675855 - DNA, 20 bp, Homo sapiens
cctgggctctgccccagctc

SEQ ID NO: 2675856 - DNA, 24 bp, Homo sapiens
cctgggctctgccccagctctggc

SEQ ID NO: 2675857 - DNA, 15 bp, Homo sapiens
cctggggctctgtgc

SEQ ID NO: 2675858 - DNA, 17 bp, Homo sapiens
cctgggggcatcctgct

SEQ ID NO: 2675859 - DNA, 19 bp, Homo sapiens
cctgggggcatcctgcttc

SEQ ID NO: 2675860 - DNA, 21 bp, Homo sapiens
cctgggggcatcctgcttcct

SEQ ID NO: 2675861 - DNA, 17 bp, Homo sapiens
agctcttctcagtgtct

SEQ ID NO: 2675862 - DNA, 19 bp, Homo sapiens
agctcttgttccgtgccag

SEQ ID NO: 2675863 - DNA, 19 bp, Homo sapiens
agctgcagccagtcaggca

SEQ ID NO: 2675864 - DNA, 19 bp, Homo sapiens
agctgctgggacccacctc

SEQ ID NO: 2675865 - DNA, 21 bp, Homo sapiens
agctgctgggacccacctccc

SEQ ID NO: 2675866 - DNA, 13 bp, Homo sapiens
agctgctttcttc

SEQ ID NO: 2675867 - DNA, 14 bp, Homo sapiens
agctgctttcttct

SEQ ID NO: 2675868 - DNA, 18 bp, Homo sapiens
agctgctttcttctctgc

SEQ ID NO: 2675869 - DNA, 22 bp, Homo sapiens
agctgctttcttctctgcctcc

SEQ ID NO: 2675870 - DNA, 11 bp, Homo sapiens
agctggcctct

SEQ ID NO: 2675871 - DNA, 23 bp, Homo sapiens
agctgggtacggtggcacgtgcc

SEQ ID NO: 2675872 - DNA, 13 bp, Homo sapiens
agctttcagagcc

SEQ ID NO: 2675873 - DNA, 15 bp, Homo sapiens
agctttcagagccag

SEQ ID NO: 2675874 - DNA, 16 bp, Homo sapiens
agctttcagagccagt

SEQ ID NO: 2675875 - DNA, 19 bp, Homo sapiens
agctttcagagccagtgaa

SEQ ID NO: 2675876 - DNA, 16 bp, Homo sapiens
agctttccttctgccc

SEQ ID NO: 2675877 - DNA, 18 bp, Homo sapiens
agctttccttctgccctt

SEQ ID NO: 2675878 - DNA, 22 bp, Homo sapiens
agctttccttctgcccttcctc

SEQ ID NO: 2675879 - DNA, 14 bp, Homo sapiens
agctttgttgtcct

SEQ ID NO: 2675880 - DNA, 18 bp, Homo sapiens
agctttgttgtcctccca

SEQ ID NO: 2675881 - DNA, 20 bp, Homo sapiens
agctttgttgtcctcccagg

SEQ ID NO: 2675882 - DNA, 22 bp, Homo sapiens
agctttgttgtcctcccaggaa

SEQ ID NO: 2675883 - DNA, 16 bp, Homo sapiens
agcttttcatggaagt

SEQ ID NO: 2675884 - DNA, 18 bp, Homo sapiens
aggaaaacaaatcactgt

SEQ ID NO: 2675885 - DNA, 11 bp, Homo sapiens
aggaaccaaaa

SEQ ID NO: 2675886 - DNA, 23 bp, Homo sapiens
aggaaccaaaaaaccccagctat

SEQ ID NO: 2675887 - DNA, 20 bp, Homo sapiens
aggaagttttgagtttctct

SEQ ID NO: 2675888 - DNA, 12 bp, Homo sapiens
aggacacatgtc

SEQ ID NO: 2675889 - DNA, 15 bp, Homo sapiens
aggacacgtggcctg

SEQ ID NO: 2675890 - DNA, 16 bp, Homo sapiens
aggacacgtggcctgc

SEQ ID NO: 2675891 - DNA, 15 bp, Homo sapiens
aggacagtgcttcag

SEQ ID NO: 2675892 - DNA, 22 bp, Homo sapiens
aggacagtgggcaggaggcccc

SEQ ID NO: 2675893 - DNA, 21 bp, Homo sapiens
aggacatgatggagcgcacct

SEQ ID NO: 2675894 - DNA, 19 bp, Homo sapiens
aggacccaaatttccctgg

SEQ ID NO: 2675895 - DNA, 21 bp, Homo sapiens
aggacccaaatttccctgggg

SEQ ID NO: 2675896 - DNA, 23 bp, Homo sapiens
aggacctctgcttttgcacacct

SEQ ID NO: 2675897 - DNA, 20 bp, Homo sapiens
aggactaacataaaatctgt

SEQ ID NO: 2675898 - DNA, 22 bp, Homo sapiens
aggactaacataaaatctgtga

SEQ ID NO: 2675899 - DNA, 13 bp, Homo sapiens
aggactccctcca

SEQ ID NO: 2675900 - DNA, 17 bp, Homo sapiens
aggactccctccatgtg

SEQ ID NO: 2675901 - DNA, 17 bp, Homo sapiens
aggactgtgaccaaagc

SEQ ID NO: 2675902 - DNA, 14 bp, Homo sapiens
aggagaaaatgcat

SEQ ID NO: 2675903 - DNA, 17 bp, Homo sapiens
aggagcaaatgtttctg

SEQ ID NO: 2675904 - DNA, 19 bp, Homo sapiens
aggagcaaatgtttctgca

SEQ ID NO: 2675905 - DNA, 13 bp, Homo sapiens
aggagccccagct

SEQ ID NO: 2675906 - DNA, 17 bp, Homo sapiens
aggagcctcgtgtcctg

SEQ ID NO: 2675907 - DNA, 18 bp, Homo sapiens
aggagcctcgtgtcctgc

SEQ ID NO: 2675908 - DNA, 13 bp, Homo sapiens
aggaggctgaggg

SEQ ID NO: 2675909 - DNA, 19 bp, Homo sapiens
aggagggatgctgcctgag

SEQ ID NO: 2675910 - DNA, 14 bp, Homo sapiens
aggaggggcctctg

SEQ ID NO: 2675911 - DNA, 14 bp, Homo sapiens
aggaggtggcagcc

SEQ ID NO: 2675912 - DNA, 20 bp, Homo sapiens
aggaggtggcagccctgtag

SEQ ID NO: 2675913 - DNA, 22 bp, Homo sapiens
aggagttggagaccaggcctga

SEQ ID NO: 2675914 - DNA, 19 bp, Homo sapiens
aggagtttgaggctgcagc

SEQ ID NO: 2675915 - DNA, 22 bp, Homo sapiens
aggataacttccttgcccctgc

SEQ ID NO: 2675916 - DNA, 16 bp, Homo sapiens
aggatacagctcttct

SEQ ID NO: 2675917 - DNA, 14 bp, Homo sapiens
aggcacgtctcctg

SEQ ID NO: 2675918 - DNA, 16 bp, Homo sapiens
aggcagggctgggcca

SEQ ID NO: 2675919 - DNA, 19 bp, Homo sapiens
aggcagggctgggccaggt

SEQ ID NO: 2675920 - DNA, 20 bp, Homo sapiens
aggcagggctgggccaggtc

SEQ ID NO: 2675921 - DNA, 21 bp, Homo sapiens
aggcagggctgggccaggtct

SEQ ID NO: 2675922 - DNA, 23 bp, Homo sapiens
aggcagggctgggccaggtctcc

SEQ ID NO: 2675923 - DNA, 18 bp, Homo sapiens
aggcaggggtcctgcagg

SEQ ID NO: 2675924 - DNA, 19 bp, Homo sapiens
aggcaggggtcctgcaggt

SEQ ID NO: 2675925 - DNA, 20 bp, Homo sapiens
aggcaggtgagaacccagag

SEQ ID NO: 2675926 - DNA, 14 bp, Homo sapiens
aggccaagaatcaa

SEQ ID NO: 2675927 - DNA, 14 bp, Homo sapiens
aggccaagagcaga

SEQ ID NO: 2675928 - DNA, 17 bp, Homo sapiens
aggccaagagcagaggc

SEQ ID NO: 2675929 - DNA, 18 bp, Homo sapiens
aggccaagagcagaggca

SEQ ID NO: 2675930 - DNA, 20 bp, Homo sapiens
aggccaagagcagaggcagc

SEQ ID NO: 2675931 - DNA, 22 bp, Homo sapiens
aggccaccatattcagtgctgt

SEQ ID NO: 2675932 - DNA, 16 bp, Homo sapiens
aggccacccactgacc

SEQ ID NO: 2675933 - DNA, 14 bp, Homo sapiens
aggccagccttggc

SEQ ID NO: 2675934 - DNA, 15 bp, Homo sapiens
aggcctccctgcaga

SEQ ID NO: 2675935 - DNA, 18 bp, Homo sapiens
aggcctccctgcagactc

SEQ ID NO: 2675936 - DNA, 18 bp, Homo sapiens
aggcctcttggacctctg

SEQ ID NO: 2675937 - DNA, 21 bp, Homo sapiens
aggcctcttggacctctgctc

SEQ ID NO: 2675938 - DNA, 19 bp, Homo sapiens
aggcctgacacaggccagc

SEQ ID NO: 2675939 - DNA, 20 bp, Homo sapiens
aggcgggggtttgagccctg

SEQ ID NO: 2675940 - DNA, 21 bp, Homo sapiens
aggcgggggtttgagccctgg

SEQ ID NO: 2675941 - DNA, 15 bp, Homo sapiens
aggctaagcatggcc

SEQ ID NO: 2675942 - DNA, 23 bp, Homo sapiens
aggctcagtctcaggagcatggg

SEQ ID NO: 2675943 - DNA, 13 bp, Homo sapiens
aggctccatgcac

SEQ ID NO: 2675944 - DNA, 15 bp, Homo sapiens
aggctccatgcacct

SEQ ID NO: 2675945 - DNA, 20 bp, Homo sapiens
aggctctttctgggccaagt

SEQ ID NO: 2675946 - DNA, 17 bp, Homo sapiens
aggctgagactgcggga

SEQ ID NO: 2675947 - DNA, 14 bp, Homo sapiens
aggctgagagccag

SEQ ID NO: 2675948 - DNA, 14 bp, Homo sapiens
aggctgaggcagga

SEQ ID NO: 2675949 - DNA, 11 bp, Homo sapiens
aggctgaggcg

SEQ ID NO: 2675950 - DNA, 21 bp, Homo sapiens
aggctgaggcgggtggatcac

SEQ ID NO: 2675951 - DNA, 17 bp, Homo sapiens
aggctgcagaaggccaa

SEQ ID NO: 2675952 - DNA, 12 bp, Homo sapiens
aggctggagaca

SEQ ID NO: 2675953 - DNA, 10 bp, Homo sapiens
cacataaagg

SEQ ID NO: 2675954 - DNA, 20 bp, Homo sapiens
cacatataaaagttaaacta

SEQ ID NO: 2675955 - DNA, 12 bp, Homo sapiens
cacatatatgta

SEQ ID NO: 2675956 - DNA, 19 bp, Homo sapiens
cacattttgtacaaagata

SEQ ID NO: 2675957 - DNA, 12 bp, Homo sapiens
caccaataaaaa

SEQ ID NO: 2675958 - DNA, 20 bp, Homo sapiens
caccactaggactctgaggc

SEQ ID NO: 2675959 - DNA, 20 bp, Homo sapiens
caccagaggctgcagaaggc

SEQ ID NO: 2675960 - DNA, 16 bp, Homo sapiens
caccatattcagtgct

SEQ ID NO: 2675961 - DNA, 21 bp, Homo sapiens
caccatattcagtgctgtggc

SEQ ID NO: 2675962 - DNA, 11 bp, Homo sapiens
cacccacatga

SEQ ID NO: 2675963 - DNA, 13 bp, Homo sapiens
cacccactgaccc

SEQ ID NO: 2675964 - DNA, 11 bp, Homo sapiens
cacccactggc

SEQ ID NO: 2675965 - DNA, 14 bp, Homo sapiens
cacccaggcctccc

SEQ ID NO: 2675966 - DNA, 23 bp, Homo sapiens
cacccaggcctccctgcagactc

SEQ ID NO: 2675967 - DNA, 12 bp, Homo sapiens
caccccttcctg

SEQ ID NO: 2675968 - DNA, 21 bp, Homo sapiens
caccctcgtggacacctgccc

SEQ ID NO: 2675969 - DNA, 11 bp, Homo sapiens
caccctggaat

SEQ ID NO: 2675970 - DNA, 17 bp, Homo sapiens
caccgctggtccctgcc

SEQ ID NO: 2675971 - DNA, 16 bp, Homo sapiens
caccgtggaccttcct

SEQ ID NO: 2675972 - DNA, 23 bp, Homo sapiens
caccgtggaccttcctgccacca

SEQ ID NO: 2675973 - DNA, 18 bp, Homo sapiens
cacctagaagtctccctg

SEQ ID NO: 2675974 - DNA, 13 bp, Homo sapiens
cacctcagagcag

SEQ ID NO: 2675975 - DNA, 16 bp, Homo sapiens
cacctcagagcagggc

SEQ ID NO: 2675976 - DNA, 16 bp, Homo sapiens
cacctcagccccactg

SEQ ID NO: 2675977 - DNA, 15 bp, Homo sapiens
cacctcaggccaggt

SEQ ID NO: 2675978 - DNA, 14 bp, Homo sapiens
cacctccccctccc

SEQ ID NO: 2675979 - DNA, 19 bp, Homo sapiens
cacctccccctccccggcc

SEQ ID NO: 2675980 - DNA, 21 bp, Homo sapiens
cacctccccctccccggccac

SEQ ID NO: 2675981 - DNA, 22 bp, Homo sapiens
cacctccccctccccggccaca

SEQ ID NO: 2675982 - DNA, 17 bp, Homo sapiens
cacctcccttccctccc

SEQ ID NO: 2675983 - DNA, 13 bp, Homo sapiens
cacctctcaatat

SEQ ID NO: 2675984 - DNA, 16 bp, Homo sapiens
cacctctcccagccct

SEQ ID NO: 2675985 - DNA, 18 bp, Homo sapiens
cacctcttctcttcctgt

SEQ ID NO: 2675986 - DNA, 15 bp, Homo sapiens
cacctgccagcctgg

SEQ ID NO: 2675987 - DNA, 16 bp, Homo sapiens
cacctgccagcctggc

SEQ ID NO: 2675988 - DNA, 22 bp, Homo sapiens
cacctgccagcctggcttctgg

SEQ ID NO: 2675989 - DNA, 17 bp, Homo sapiens
cacctgccatttgcacc

SEQ ID NO: 2675990 - DNA, 22 bp, Homo sapiens
cacctgccatttgcaccctccg

SEQ ID NO: 2675991 - DNA, 14 bp, Homo sapiens
cacctgccccctgg

SEQ ID NO: 2675992 - DNA, 13 bp, Homo sapiens
cacctgccctgcc

SEQ ID NO: 2675993 - DNA, 17 bp, Homo sapiens
cacctgccctgccctgc

SEQ ID NO: 2675994 - DNA, 18 bp, Homo sapiens
cacctgccctgccctgcc

SEQ ID NO: 2675995 - DNA, 21 bp, Homo sapiens
cacctgccctgccctgccacc

SEQ ID NO: 2675996 - DNA, 13 bp, Homo sapiens
cacctgctcccag

SEQ ID NO: 2675997 - DNA, 18 bp, Homo sapiens
cagactcctcagatctga

SEQ ID NO: 2675998 - DNA, 16 bp, Homo sapiens
cagactggctggctgc

SEQ ID NO: 2675999 - DNA, 15 bp, Homo sapiens
cagagaagataatgt

SEQ ID NO: 2676000 - DNA, 19 bp, Homo sapiens
cagagaagataatgttctt

SEQ ID NO: 2676001 - DNA, 17 bp, Homo sapiens
cagagagtcctctggat

SEQ ID NO: 2676002 - DNA, 24 bp, Homo sapiens
cagagcaaaagacttgagccatcc

SEQ ID NO: 2676003 - DNA, 16 bp, Homo sapiens
cagagcacagaggtag

SEQ ID NO: 2676004 - DNA, 12 bp, Homo sapiens
cagagcagggcc

SEQ ID NO: 2676005 - DNA, 13 bp, Homo sapiens
cagagccagtgaa

SEQ ID NO: 2676006 - DNA, 14 bp, Homo sapiens
cagagccagtgaag

SEQ ID NO: 2676007 - DNA, 12 bp, Homo sapiens
cagagccctcca

SEQ ID NO: 2676008 - DNA, 13 bp, Homo sapiens
cagagccctccag

SEQ ID NO: 2676009 - DNA, 14 bp, Homo sapiens
cagagccctccagg

SEQ ID NO: 2676010 - DNA, 17 bp, Homo sapiens
cagagccctccaggcct

SEQ ID NO: 2676011 - DNA, 18 bp, Homo sapiens
cagagccctccaggcctg

SEQ ID NO: 2676012 - DNA, 15 bp, Homo sapiens
cagagctgcagccag

SEQ ID NO: 2676013 - DNA, 17 bp, Homo sapiens
cagagctgcagccagtc

SEQ ID NO: 2676014 - DNA, 15 bp, Homo sapiens
cagagggcccaggca

SEQ ID NO: 2676015 - DNA, 23 bp, Homo sapiens
cagaggggaaaccagtgtagcct

SEQ ID NO: 2676016 - DNA, 18 bp, Homo sapiens
cagaggggctttctggag

SEQ ID NO: 2676017 - DNA, 23 bp, Homo sapiens
cagaggggtgggttcctcttccc

SEQ ID NO: 2676018 - DNA, 15 bp, Homo sapiens
cagagtgagaccctg

SEQ ID NO: 2676019 - DNA, 20 bp, Homo sapiens
cagagtgagaccctgtctct

SEQ ID NO: 2676020 - DNA, 22 bp, Homo sapiens
cagagttattgaatcttaattt

SEQ ID NO: 2676021 - DNA, 15 bp, Homo sapiens
cagatctttttgtga

SEQ ID NO: 2676022 - DNA, 16 bp, Homo sapiens
cagatctttttgtgaa

SEQ ID NO: 2676023 - DNA, 19 bp, Homo sapiens
cagatgaggaaacaggcct

SEQ ID NO: 2676024 - DNA, 22 bp, Homo sapiens
cagatgaggaaacaggcctcaa

SEQ ID NO: 2676025 - DNA, 19 bp, Homo sapiens
cagatgcccagagggccca

SEQ ID NO: 2676026 - DNA, 16 bp, Homo sapiens
cagatttctctttgaa

SEQ ID NO: 2676027 - DNA, 20 bp, Homo sapiens
cagcaaagcctccagcatct

SEQ ID NO: 2676028 - DNA, 15 bp, Homo sapiens
cagcaatctgtcttt

SEQ ID NO: 2676029 - DNA, 14 bp, Homo sapiens
cagcacacctcagc

SEQ ID NO: 2676030 - DNA, 18 bp, Homo sapiens
cagcacacctcagcccca

SEQ ID NO: 2676031 - DNA, 21 bp, Homo sapiens
cagcacacctcagccccactg

SEQ ID NO: 2676032 - DNA, 14 bp, Homo sapiens
cagcacctgctccc

SEQ ID NO: 2676033 - DNA, 15 bp, Homo sapiens
cagcacctgctccca

SEQ ID NO: 2676034 - DNA, 16 bp, Homo sapiens
cagcacctgctcccag

SEQ ID NO: 2676035 - DNA, 20 bp, Homo sapiens
cagcactttgggaggctgag

SEQ ID NO: 2676036 - DNA, 23 bp, Homo sapiens
cagcactttgggaggctgaggcg

SEQ ID NO: 2676037 - DNA, 13 bp, Homo sapiens
cagcagcacacct

SEQ ID NO: 2676038 - DNA, 19 bp, Homo sapiens
cagcagcacacctcagccc

SEQ ID NO: 2676039 - DNA, 21 bp, Homo sapiens
cagcagcacacctcagcccca

SEQ ID NO: 2676040 - DNA, 19 bp, Homo sapiens
cagcagcccatggcctctg

SEQ ID NO: 2676041 - DNA, 23 bp, Homo sapiens
cagcagcccatggcctctggcca

SEQ ID NO: 2676042 - DNA, 24 bp, Homo sapiens
cagcaggcgggggtttgagccctg

SEQ ID NO: 2676043 - DNA, 18 bp, Homo sapiens
cagcaggtgtgaccctga

SEQ ID NO: 2676044 - DNA, 23 bp, Homo sapiens
cagcatccttttctgcagagggg

SEQ ID NO: 2676045 - DNA, 21 bp, Homo sapiens
catcctgcttcctgaaagctg

SEQ ID NO: 2676046 - DNA, 19 bp, Homo sapiens
catctagccagaggctgga

SEQ ID NO: 2676047 - DNA, 23 bp, Homo sapiens
catctagccagaggctggagaca

SEQ ID NO: 2676048 - DNA, 19 bp, Homo sapiens
catctctaattggaagaaa

SEQ ID NO: 2676049 - DNA, 21 bp, Homo sapiens
catctctctactcctacctca

SEQ ID NO: 2676050 - DNA, 14 bp, Homo sapiens
catctggtgccttt

SEQ ID NO: 2676051 - DNA, 21 bp, Homo sapiens
catctggtgcctttccacaca

SEQ ID NO: 2676052 - DNA, 14 bp, Homo sapiens
catgaagacaggac

SEQ ID NO: 2676053 - DNA, 23 bp, Homo sapiens
catgacttttccattgaccagct

SEQ ID NO: 2676054 - DNA, 20 bp, Homo sapiens
catgatcgagccactgcact

SEQ ID NO: 2676055 - DNA, 17 bp, Homo sapiens
catgcacctcccttccc

SEQ ID NO: 2676056 - DNA, 13 bp, Homo sapiens
catgctgtgctct

SEQ ID NO: 2676057 - DNA, 15 bp, Homo sapiens
catgctgtgctcttt

SEQ ID NO: 2676058 - DNA, 19 bp, Homo sapiens
catgctgtgctctttgaag

SEQ ID NO: 2676059 - DNA, 22 bp, Homo sapiens
catgctgtgctctttgaagaga

SEQ ID NO: 2676060 - DNA, 20 bp, Homo sapiens
catgctgttctctttgctga

SEQ ID NO: 2676061 - DNA, 19 bp, Homo sapiens
catggcctggactgactgc

SEQ ID NO: 2676062 - DNA, 18 bp, Homo sapiens
catggctacttgctttga

SEQ ID NO: 2676063 - DNA, 16 bp, Homo sapiens
catggtgatcagtgca

SEQ ID NO: 2676064 - DNA, 12 bp, Homo sapiens
catggtgctgca

SEQ ID NO: 2676065 - DNA, 23 bp, Homo sapiens
catggtgtgaaagtcagatgccc

SEQ ID NO: 2676066 - DNA, 20 bp, Homo sapiens
catgtcaccgtggaccttcc

SEQ ID NO: 2676067 - DNA, 13 bp, Homo sapiens
catgtgcagtgct

SEQ ID NO: 2676068 - DNA, 17 bp, Homo sapiens
catgtggccccaggtgc

SEQ ID NO: 2676069 - DNA, 18 bp, Homo sapiens
catgtggccccaggtgcc

SEQ ID NO: 2676070 - DNA, 19 bp, Homo sapiens
catgtggccccaggtgcca

SEQ ID NO: 2676071 - DNA, 13 bp, Homo sapiens
catgtttgtaaat

SEQ ID NO: 2676072 - DNA, 22 bp, Homo sapiens
cattcaccaaatgatgccactt

SEQ ID NO: 2676073 - DNA, 23 bp, Homo sapiens
cattcccgtggtctccttgcact

SEQ ID NO: 2676074 - DNA, 18 bp, Homo sapiens
cattccgagggtgaaaca

SEQ ID NO: 2676075 - DNA, 15 bp, Homo sapiens
cattgaccagctctc

SEQ ID NO: 2676076 - DNA, 13 bp, Homo sapiens
cattgcacctgca

SEQ ID NO: 2676077 - DNA, 17 bp, Homo sapiens
cattgcacctgcaggct

SEQ ID NO: 2676078 - DNA, 23 bp, Homo sapiens
cattgcccctccgatgctgaggc

SEQ ID NO: 2676079 - DNA, 14 bp, Homo sapiens
cattgtagaaacac

SEQ ID NO: 2676080 - DNA, 20 bp, Homo sapiens
cattgtcttccaaccccagc

SEQ ID NO: 2676081 - DNA, 21 bp, Homo sapiens
cattgtcttccaaccccagct

SEQ ID NO: 2676082 - DNA, 22 bp, Homo sapiens
cattgtcttccaaccccagctg

SEQ ID NO: 2676083 - DNA, 16 bp, Homo sapiens
cattgttattgtggaa

SEQ ID NO: 2676084 - DNA, 17 bp, Homo sapiens
catttctagtcccttct

SEQ ID NO: 2676085 - DNA, 20 bp, Homo sapiens
catttggtgctggtctattt

SEQ ID NO: 2676086 - DNA, 15 bp, Homo sapiens
cattttagtgactgt

SEQ ID NO: 2676087 - DNA, 15 bp, Homo sapiens
cattttgttatagaa

SEQ ID NO: 2676088 - DNA, 17 bp, Homo sapiens
cattttgttatagaata

SEQ ID NO: 2676089 - DNA, 20 bp, Homo sapiens
ccaaaaaaccccagctattt

SEQ ID NO: 2676090 - DNA, 14 bp, Homo sapiens
ccaaaagatgcctt

SEQ ID NO: 2676091 - DNA, 13 bp, Homo sapiens
ccaaactacagaa

SEQ ID NO: 2676092 - DNA, 20 bp, Homo sapiens
ccaaagagactggagcatct

SEQ ID NO: 2676093 - DNA, 15 bp, Homo sapiens
ccaaagcatttctag

SEQ ID NO: 2676094 - DNA, 12 bp, Homo sapiens
ccaaagccacct

SEQ ID NO: 2676095 - DNA, 14 bp, Homo sapiens
ccaaagctgctttc

SEQ ID NO: 2676096 - DNA, 14 bp, Homo sapiens
ccaaaggtggcctg

SEQ ID NO: 2676097 - DNA, 15 bp, Homo sapiens
ccaaatttccctggg

SEQ ID NO: 2676098 - DNA, 17 bp, Homo sapiens
ccaaccccagctggcct

SEQ ID NO: 2676099 - DNA, 18 bp, Homo sapiens
ccaaccccagctggcctc

SEQ ID NO: 2676100 - DNA, 18 bp, Homo sapiens
ccaaccctgtttcctgag

SEQ ID NO: 2676101 - DNA, 17 bp, Homo sapiens
ccaaggtgggctgagcc

SEQ ID NO: 2676102 - DNA, 16 bp, Homo sapiens
ccaatggggccagcac

SEQ ID NO: 2676103 - DNA, 23 bp, Homo sapiens
ccagcagcatagaacaggacctc

SEQ ID NO: 2676104 - DNA, 19 bp, Homo sapiens
ccagcatccttttctgcag

SEQ ID NO: 2676105 - DNA, 19 bp, Homo sapiens
ccagccattaccatggaga

SEQ ID NO: 2676106 - DNA, 19 bp, Homo sapiens
ccagcctggcttctggagc

SEQ ID NO: 2676107 - DNA, 19 bp, Homo sapiens
ccagcctgggcgacagagc

SEQ ID NO: 2676108 - DNA, 15 bp, Homo sapiens
ccagcgcctgtgctg

SEQ ID NO: 2676109 - DNA, 20 bp, Homo sapiens
ccagcgcctgtgctgaggac

SEQ ID NO: 2676110 - DNA, 22 bp, Homo sapiens
ccagcgcctgtgctgaggactc

SEQ ID NO: 2676111 - DNA, 21 bp, Homo sapiens
ccagctactcagaagcctgag

SEQ ID NO: 2676112 - DNA, 20 bp, Homo sapiens
ccagctactcgggaggctga

SEQ ID NO: 2676113 - DNA, 14 bp, Homo sapiens
ccagctctcttcct

SEQ ID NO: 2676114 - DNA, 14 bp, Homo sapiens
ccagctctggcttc

SEQ ID NO: 2676115 - DNA, 22 bp, Homo sapiens
ccagctgcacctgccagcctgg

SEQ ID NO: 2676116 - DNA, 13 bp, Homo sapiens
ccagctggcctct

SEQ ID NO: 2676117 - DNA, 22 bp, Homo sapiens
ccaggaaccaaaaaaccccagc

SEQ ID NO: 2676118 - DNA, 23 bp, Homo sapiens
ccaggaaccaaaaaaccccagct

SEQ ID NO: 2676119 - DNA, 15 bp, Homo sapiens
ccaggaggggcctct

SEQ ID NO: 2676120 - DNA, 18 bp, Homo sapiens
ccaggaggggcctctgaa

SEQ ID NO: 2676121 - DNA, 20 bp, Homo sapiens
ccaggagtttgaggctgcag

SEQ ID NO: 2676122 - DNA, 22 bp, Homo sapiens
ccaggagtttgaggctgcagcg

SEQ ID NO: 2676123 - DNA, 16 bp, Homo sapiens
ccaggatcactctctg

SEQ ID NO: 2676124 - DNA, 18 bp, Homo sapiens
ccaggatcactctctgct

SEQ ID NO: 2676125 - DNA, 22 bp, Homo sapiens
ccaggccggtgtgggctgtgtc

SEQ ID NO: 2676126 - DNA, 11 bp, Homo sapiens
ccaggcctccc

SEQ ID NO: 2676127 - DNA, 12 bp, Homo sapiens
ccaggcctccct

SEQ ID NO: 2676128 - DNA, 19 bp, Homo sapiens
ccaggcctccctgcagact

SEQ ID NO: 2676129 - DNA, 22 bp, Homo sapiens
ccaggcctgattcactggcctg

SEQ ID NO: 2676130 - DNA, 17 bp, Homo sapiens
ccaggcttcctgggtcc

SEQ ID NO: 2676131 - DNA, 21 bp, Homo sapiens
ccaggcttcctgggtcctgcc

SEQ ID NO: 2676132 - DNA, 16 bp, Homo sapiens
ccagggaaggctaagc

SEQ ID NO: 2676133 - DNA, 14 bp, Homo sapiens
ccagggccagggcc

SEQ ID NO: 2676134 - DNA, 17 bp, Homo sapiens
ccagggccagggccctg

SEQ ID NO: 2676135 - DNA, 14 bp, Homo sapiens
ccagggccctgcag

SEQ ID NO: 2676136 - DNA, 14 bp, Homo sapiens
ccaggggttctgag

SEQ ID NO: 2676137 - DNA, 15 bp, Homo sapiens
ccaggggttctgaga

SEQ ID NO: 2676138 - DNA, 22 bp, Homo sapiens
ccaggggttctgagaagcgctg

SEQ ID NO: 2676139 - DNA, 14 bp, Homo sapiens
ccaggtctgatgcc

SEQ ID NO: 2676140 - DNA, 20 bp, Homo sapiens
ccaggtctgatgccaaagct

SEQ ID NO: 2676141 - DNA, 16 bp, Homo sapiens
ccaggtgccaccaata

SEQ ID NO: 2676142 - DNA, 17 bp, Homo sapiens
ccaggtggaggtgccag

SEQ ID NO: 2676143 - DNA, 18 bp, Homo sapiens
ccaggtggaggtgccagg

SEQ ID NO: 2676144 - DNA, 21 bp, Homo sapiens
ccaggttagcctttgccctgt

SEQ ID NO: 2676145 - DNA, 22 bp, Homo sapiens
ccagtcccacaccgctggtccc

SEQ ID NO: 2676146 - DNA, 16 bp, Homo sapiens
ccagtcctagagctcc

SEQ ID NO: 2676147 - DNA, 19 bp, Homo sapiens
ccagtcctagagctcctgt

SEQ ID NO: 2676148 - DNA, 20 bp, Homo sapiens
ccagtcctagagctcctgtc

SEQ ID NO: 2676149 - DNA, 23 bp, Homo sapiens
ccagtcctagagctcctgtccct

SEQ ID NO: 2676150 - DNA, 12 bp, Homo sapiens
ccagtcttgtgt

SEQ ID NO: 2676151 - DNA, 12 bp, Homo sapiens
ccagtgactttt

SEQ ID NO: 2676152 - DNA, 17 bp, Homo sapiens
ccagtgtaactggctgc

SEQ ID NO: 2676153 - DNA, 19 bp, Homo sapiens
ccagtgtaactggctgctc

SEQ ID NO: 2676154 - DNA, 20 bp, Homo sapiens
ccagtgtaactggctgctcc

SEQ ID NO: 2676155 - DNA, 22 bp, Homo sapiens
ccagtgtaactggctgctccct

SEQ ID NO: 2676156 - DNA, 23 bp, Homo sapiens
ccagtgtaactggctgctccctg

SEQ ID NO: 2676157 - DNA, 12 bp, Homo sapiens
ccagttctgggg

SEQ ID NO: 2676158 - DNA, 18 bp, Homo sapiens
ccatcattgcacctgcag

SEQ ID NO: 2676159 - DNA, 16 bp, Homo sapiens
ccatcccaggatgggt

SEQ ID NO: 2676160 - DNA, 20 bp, Homo sapiens
ccatcctgaggtgcctccca

SEQ ID NO: 2676161 - DNA, 22 bp, Homo sapiens
ccatcctgaggtgcctcccagt

SEQ ID NO: 2676162 - DNA, 20 bp, Homo sapiens
ccatctctctactcctacct

SEQ ID NO: 2676163 - DNA, 13 bp, Homo sapiens
ccatctctggttg

SEQ ID NO: 2676164 - DNA, 17 bp, Homo sapiens
ccatgaagacaggacag

SEQ ID NO: 2676165 - DNA, 19 bp, Homo sapiens
ccatgaagacaggacagtg

SEQ ID NO: 2676166 - DNA, 13 bp, Homo sapiens
tgttgctcttgga

SEQ ID NO: 2676167 - DNA, 18 bp, Homo sapiens
tgttggacccgctctgga

SEQ ID NO: 2676168 - DNA, 19 bp, Homo sapiens
tgttggacccgctctggac

SEQ ID NO: 2676169 - DNA, 13 bp, Homo sapiens
tgttgtcctccca

SEQ ID NO: 2676170 - DNA, 14 bp, Homo sapiens
tgttgtcctcccag

SEQ ID NO: 2676171 - DNA, 23 bp, Homo sapiens
tgtttaaaggtttctattttctc

SEQ ID NO: 2676172 - DNA, 16 bp, Homo sapiens
tgtttaaatataaatg

SEQ ID NO: 2676173 - DNA, 16 bp, Homo sapiens
tgtttctccccctggg

SEQ ID NO: 2676174 - DNA, 12 bp, Homo sapiens
tgtttctgcagt

SEQ ID NO: 2676175 - DNA, 22 bp, Homo sapiens
tgtttctgcagtagtctctgtg

SEQ ID NO: 2676176 - DNA, 15 bp, Homo sapiens
tgtttgaagtctgct

SEQ ID NO: 2676177 - DNA, 13 bp, Homo sapiens
tgtttgtaaatta

SEQ ID NO: 2676178 - DNA, 15 bp, Homo sapiens
tgtttgtaaattaat

SEQ ID NO: 2676179 - DNA, 17 bp, Homo sapiens
tgtttgtacaagattgt

SEQ ID NO: 2676180 - DNA, 12 bp, Homo sapiens
tgttttcttcaa

SEQ ID NO: 2676181 - DNA, 13 bp, Homo sapiens
tgttttgtacaat

SEQ ID NO: 2676182 - DNA, 15 bp, Homo sapiens
tgttttgtacaatta

SEQ ID NO: 2676183 - DNA, 22 bp, Homo sapiens
ttaaaaaactttctactcattt

SEQ ID NO: 2676184 - DNA, 19 bp, Homo sapiens
ttaaatataaatgtttgtc

SEQ ID NO: 2676185 - DNA, 19 bp, Homo sapiens
ttaagccctgctctttctc

SEQ ID NO: 2676186 - DNA, 14 bp, Homo sapiens
ttaaggcagtgact

SEQ ID NO: 2676187 - DNA, 15 bp, Homo sapiens
tgctccctgctccca

SEQ ID NO: 2676188 - DNA, 18 bp, Homo sapiens
tgctccctgctcccaggg

SEQ ID NO: 2676189 - DNA, 21 bp, Homo sapiens
tgctctcctggagcaagctct

SEQ ID NO: 2676190 - DNA, 13 bp, Homo sapiens
tgctctctgagag

SEQ ID NO: 2676191 - DNA, 17 bp, Homo sapiens
tgctctctgagagcaca

SEQ ID NO: 2676192 - DNA, 13 bp, Homo sapiens
tgctctgcttcct

SEQ ID NO: 2676193 - DNA, 18 bp, Homo sapiens
tgctctgtagccacctcc

SEQ ID NO: 2676194 - DNA, 22 bp, Homo sapiens
tgctctgtagccacctccttgg

SEQ ID NO: 2676195 - DNA, 14 bp, Homo sapiens
tgctcttcctctgg

SEQ ID NO: 2676196 - DNA, 17 bp, Homo sapiens
tgctgaggactccctcc

SEQ ID NO: 2676197 - DNA, 15 bp, Homo sapiens
tgctgaggccaccca

SEQ ID NO: 2676198 - DNA, 21 bp, Homo sapiens
tgctgatggcccctccagcac

SEQ ID NO: 2676199 - DNA, 15 bp, Homo sapiens
tgctgccagctgctc

SEQ ID NO: 2676200 - DNA, 14 bp, Homo sapiens
taatatggtgactt

SEQ ID NO: 2676201 - DNA, 16 bp, Homo sapiens
taatgaaaaggaagtt

SEQ ID NO: 2676202 - DNA, 14 bp, Homo sapiens
taatgttttgtaca

SEQ ID NO: 2676203 - DNA, 16 bp, Homo sapiens
taatgttttgtacaat

SEQ ID NO: 2676204 - DNA, 18 bp, Homo sapiens
taattcctgttgctctgt

SEQ ID NO: 2676205 - DNA, 21 bp, Homo sapiens
taattggaagaaattcctgta

SEQ ID NO: 2676206 - DNA, 21 bp, Homo sapiens
tacaaaaaccaaaaagttaaa

SEQ ID NO: 2676207 - DNA, 18 bp, Homo sapiens
tacaagacaacattgtaa

SEQ ID NO: 2676208 - DNA, 13 bp, Homo sapiens
tacaataaatgct

SEQ ID NO: 2676209 - DNA, 16 bp, Homo sapiens
tacaataaatgctgaa

SEQ ID NO: 2676210 - DNA, 17 bp, Homo sapiens
tacagaaattagccggg

SEQ ID NO: 2676211 - DNA, 14 bp, Homo sapiens
taccactcaggcca

SEQ ID NO: 2676212 - DNA, 18 bp, Homo sapiens
tacccactctttgctaca

SEQ ID NO: 2676213 - DNA, 16 bp, Homo sapiens
taccctatatctataa

SEQ ID NO: 2676214 - DNA, 23 bp, Homo sapiens
taccctatatctataaacactgt

SEQ ID NO: 2676215 - DNA, 14 bp, Homo sapiens
tacctcagcctaga

SEQ ID NO: 2676216 - DNA, 16 bp, Homo sapiens
tacctcagcctagacc

SEQ ID NO: 2676217 - DNA, 19 bp, Homo sapiens
tacctctttattttttgat

SEQ ID NO: 2676218 - DNA, 14 bp, Homo sapiens
tacctgcaggctcc

SEQ ID NO: 2676219 - DNA, 19 bp, Homo sapiens
tacctgcaggctccatgca

SEQ ID NO: 2676220 - DNA, 20 bp, Homo sapiens
taccttagattagctctgga

SEQ ID NO: 2676221 - DNA, 21 bp, Homo sapiens
taccttagattagctctggac

SEQ ID NO: 2676222 - DNA, 18 bp, Homo sapiens
taccttccttaagccagg

SEQ ID NO: 2676223 - DNA, 18 bp, Homo sapiens
tacgggcgctgcagcctc

SEQ ID NO: 2676224 - DNA, 18 bp, Homo sapiens
tactaaagatatcagagc

SEQ ID NO: 2676225 - DNA, 21 bp, Homo sapiens
tactataacatagaattgcaa

SEQ ID NO: 2676226 - DNA, 16 bp, Homo sapiens
tactcagaagcctgag

SEQ ID NO: 2676227 - DNA, 13 bp, Homo sapiens
tactcagcccagc

SEQ ID NO: 2676228 - DNA, 14 bp, Homo sapiens
tactcagcccagct

SEQ ID NO: 2676229 - DNA, 14 bp, Homo sapiens
tactgacagaaatg

SEQ ID NO: 2676230 - DNA, 13 bp, Homo sapiens
tactgcacatttt

SEQ ID NO: 2676231 - DNA, 15 bp, Homo sapiens
tactgcacattttgt

SEQ ID NO: 2676232 - DNA, 23 bp, Homo sapiens
tacttcctgggatgatgtgtgaa

SEQ ID NO: 2676233 - DNA, 22 bp, Homo sapiens
tacttgggaggctgaggcagga

SEQ ID NO: 2676234 - DNA, 19 bp, Homo sapiens
tacttttttctagtttcag

SEQ ID NO: 2676235 - DNA, 15 bp, Homo sapiens
tagaacacccactgg

SEQ ID NO: 2676236 - DNA, 17 bp, Homo sapiens
tagaacacccactggcc

SEQ ID NO: 2676237 - DNA, 18 bp, Homo sapiens
tagaacacccactggcca

SEQ ID NO: 2676238 - DNA, 21 bp, Homo sapiens
tagaacccaggtctgatgcca

SEQ ID NO: 2676239 - DNA, 22 bp, Homo sapiens
tagaagtctccctgcacagcct

SEQ ID NO: 2676240 - DNA, 21 bp, Homo sapiens
tagaatacttttttctagttt

SEQ ID NO: 2676241 - DNA, 17 bp, Homo sapiens
tagaattgcaatctata

SEQ ID NO: 2676242 - DNA, 19 bp, Homo sapiens
tagagctcctgtccctacc

SEQ ID NO: 2676243 - DNA, 16 bp, Homo sapiens
tagatgagggtgactg

SEQ ID NO: 2676244 - DNA, 18 bp, Homo sapiens
tagattagctctggacca

SEQ ID NO: 2676245 - DNA, 22 bp, Homo sapiens
tagcaacacccaaaggtggcct

SEQ ID NO: 2676246 - DNA, 23 bp, Homo sapiens
tagccaaggtgggctgagccctg

SEQ ID NO: 2676247 - DNA, 15 bp, Homo sapiens
tagccacctccttgg

SEQ ID NO: 2676248 - DNA, 16 bp, Homo sapiens
tagccacctccttggc

SEQ ID NO: 2676249 - DNA, 23 bp, Homo sapiens
tagccacctccttggcaccggcc

SEQ ID NO: 2676250 - DNA, 13 bp, Homo sapiens
tagccagaggctg

SEQ ID NO: 2676251 - DNA, 14 bp, Homo sapiens
tagccagaggctgg

SEQ ID NO: 2676252 - DNA, 14 bp, Homo sapiens
tagcctgggccaga

SEQ ID NO: 2676253 - DNA, 16 bp, Homo sapiens
tagctgtctctcttgt

SEQ ID NO: 2676254 - DNA, 20 bp, Homo sapiens
tagctttgttgtcctcccag

SEQ ID NO: 2676255 - DNA, 21 bp, Homo sapiens
tagctttgttgtcctcccagg

SEQ ID NO: 2676256 - DNA, 18 bp, Homo sapiens
taggactctgaggctctt

SEQ ID NO: 2676257 - DNA, 14 bp, Homo sapiens
taggagccccagct

SEQ ID NO: 2676258 - DNA, 21 bp, Homo sapiens
taggagttcgagaccagcctg

SEQ ID NO: 2676259 - DNA, 18 bp, Homo sapiens
taggcttttaagaaacac

SEQ ID NO: 2676260 - DNA, 14 bp, Homo sapiens
taggggctgcaggg

SEQ ID NO: 2676261 - DNA, 21 bp, Homo sapiens
taggtcctcacttctgtctcc

SEQ ID NO: 2676262 - DNA, 17 bp, Homo sapiens
taggtttctctcttccc

SEQ ID NO: 2676263 - DNA, 13 bp, Homo sapiens
tagtagtgtcttc

SEQ ID NO: 2676264 - DNA, 19 bp, Homo sapiens
tagtcccttctctctttct

SEQ ID NO: 2676265 - DNA, 23 bp, Homo sapiens
tagtgccctccacagccgcagcc

SEQ ID NO: 2676266 - DNA, 15 bp, Homo sapiens
tagtttattggaagt

SEQ ID NO: 2676267 - DNA, 20 bp, Homo sapiens
tagtttgatttaatatctga

SEQ ID NO: 2676268 - DNA, 19 bp, Homo sapiens
tagttttaccctatatcta

SEQ ID NO: 2676269 - DNA, 21 bp, Homo sapiens
tagttttttttgtaaactgta

SEQ ID NO: 2676270 - DNA, 12 bp, Homo sapiens
tataaacactgt

SEQ ID NO: 2676271 - DNA, 13 bp, Homo sapiens
tataaacactgtt

SEQ ID NO: 2676272 - DNA, 13 bp, Homo sapiens
tataaataataaa

SEQ ID NO: 2676273 - DNA, 19 bp, Homo sapiens
tataaataataaagaactc

SEQ ID NO: 2676274 - DNA, 21 bp, Homo sapiens
tataaatagtgtacacagact

SEQ ID NO: 2676275 - DNA, 12 bp, Homo sapiens
tataaatgttta

SEQ ID NO: 2676276 - DNA, 22 bp, Homo sapiens
tatagaaagcaagatgtactat

SEQ ID NO: 2676277 - DNA, 15 bp, Homo sapiens
tatataccgtggggg

SEQ ID NO: 2676278 - DNA, 22 bp, Homo sapiens
tatatattctacacatatatgt

SEQ ID NO: 2676279 - DNA, 17 bp, Homo sapiens
tatatctatatctctaa

SEQ ID NO: 2676280 - DNA, 17 bp, Homo sapiens
tatatctcaaattgtaa

SEQ ID NO: 2676281 - DNA, 14 bp, Homo sapiens
tatatgtatatcta

SEQ ID NO: 2676282 - DNA, 15 bp, Homo sapiens
tatatgttgtaataa

SEQ ID NO: 2676283 - DNA, 19 bp, Homo sapiens
tatattcctcttgcatttc

SEQ ID NO: 2676284 - DNA, 16 bp, Homo sapiens
tatcaaatctgtatat

SEQ ID NO: 2676285 - DNA, 19 bp, Homo sapiens
tatcaggactgtgaccaaa

SEQ ID NO: 2676286 - DNA, 23 bp, Homo sapiens
tatcaggactgtgaccaaagcat

SEQ ID NO: 2676287 - DNA, 23 bp, Homo sapiens
tggtaaaaagattatatatcata

SEQ ID NO: 2676288 - DNA, 22 bp, Homo sapiens
tggtatgaacttgaggacacat

SEQ ID NO: 2676289 - DNA, 13 bp, Homo sapiens
tggtcacaggctg

SEQ ID NO: 2676290 - DNA, 16 bp, Homo sapiens
tggtcacccttaatat

SEQ ID NO: 2676291 - DNA, 16 bp, Homo sapiens
tggtccctgccctccc

SEQ ID NO: 2676292 - DNA, 22 bp, Homo sapiens
tggtccctgccctcccctgctc

SEQ ID NO: 2676293 - DNA, 11 bp, Homo sapiens
tggtcctgggg

SEQ ID NO: 2676294 - DNA, 14 bp, Homo sapiens
tggtcctggggctc

SEQ ID NO: 2676295 - DNA, 16 bp, Homo sapiens
tggtcctggggctctg

SEQ ID NO: 2676296 - DNA, 17 bp, Homo sapiens
tggtctattttgatttt

SEQ ID NO: 2676297 - DNA, 15 bp, Homo sapiens
tggtctccacctgtg

SEQ ID NO: 2676298 - DNA, 21 bp, Homo sapiens
tggtctccttgcactttctca

SEQ ID NO: 2676299 - DNA, 18 bp, Homo sapiens
tggtgcatgcactgtctc

SEQ ID NO: 2676300 - DNA, 20 bp, Homo sapiens
tggtgctgcattgagtccag

SEQ ID NO: 2676301 - DNA, 18 bp, Homo sapiens
tgtaaaggtcacttttca

SEQ ID NO: 2676302 - DNA, 21 bp, Homo sapiens
tgtaaaggtcacttttcacat

SEQ ID NO: 2676303 - DNA, 20 bp, Homo sapiens
tgtaacacaagccacagaag

SEQ ID NO: 2676304 - DNA, 16 bp, Homo sapiens
tccacacagaactggc

SEQ ID NO: 2676305 - DNA, 16 bp, Homo sapiens
tccacagccgcagcct

SEQ ID NO: 2676306 - DNA, 18 bp, Homo sapiens
tccacagccgcagcctcc

SEQ ID NO: 2676307 - DNA, 18 bp, Homo sapiens
tccacgcaaggctgtgct

SEQ ID NO: 2676308 - DNA, 18 bp, Homo sapiens
tccactgccaaaacaatg

SEQ ID NO: 2676309 - DNA, 19 bp, Homo sapiens
tccagaccattgtcttcca

SEQ ID NO: 2676310 - DNA, 15 bp, Homo sapiens
tccagagagtcctct

SEQ ID NO: 2676311 - DNA, 12 bp, Homo sapiens
tccagcagcaca

SEQ ID NO: 2676312 - DNA, 11 bp, Homo sapiens
tccagcctggg

SEQ ID NO: 2676313 - DNA, 18 bp, Homo sapiens
tccagctttccttctgcc

SEQ ID NO: 2676314 - DNA, 20 bp, Homo sapiens
tccagctttccttctgccct

SEQ ID NO: 2676315 - DNA, 13 bp, Homo sapiens
tccaggcctgcag

SEQ ID NO: 2676316 - DNA, 18 bp, Homo sapiens
tccaggcctgcaggggca

SEQ ID NO: 2676317 - DNA, 12 bp, Homo sapiens
tccagtgacttt

SEQ ID NO: 2676318 - DNA, 15 bp, Homo sapiens
tccagtggttgctgt

SEQ ID NO: 2676319 - DNA, 14 bp, Homo sapiens
tccagtttccaaag

SEQ ID NO: 2676320 - DNA, 16 bp, Homo sapiens
tccttccaggccccca

SEQ ID NO: 2676321 - DNA, 14 bp, Homo sapiens
tccttcctcccctt

SEQ ID NO: 2676322 - DNA, 19 bp, Homo sapiens
tccttccttgctgtcctag

SEQ ID NO: 2676323 - DNA, 22 bp, Homo sapiens
tccttctgcccttcctccagga

SEQ ID NO: 2676324 - DNA, 23 bp, Homo sapiens
tcctttctgtaggtttctctctt

SEQ ID NO: 2676325 - DNA, 19 bp, Homo sapiens
tccttttgcaacaagacaa

SEQ ID NO: 2676326 - DNA, 13 bp, Homo sapiens
tcgagctgtgctc

SEQ ID NO: 2676327 - DNA, 20 bp, Homo sapiens
tcgatgaatgtgttgatttg

SEQ ID NO: 2676328 - DNA, 22 bp, Homo sapiens
tcgccgtgttactgttgcactg

SEQ ID NO: 2676329 - DNA, 15 bp, Homo sapiens
tcgcctgagcccagg

SEQ ID NO: 2676330 - DNA, 19 bp, Homo sapiens
tcgggaggctgaggcagga

SEQ ID NO: 2676331 - DNA, 18 bp, Homo sapiens
tcgggcccctgcctgcct

SEQ ID NO: 2676332 - DNA, 19 bp, Homo sapiens
tcgggcccctgcctgcctt

SEQ ID NO: 2676333 - DNA, 14 bp, Homo sapiens
tcgtggacacctgc

SEQ ID NO: 2676334 - DNA, 16 bp, Homo sapiens
tcgtggacacctgccc

SEQ ID NO: 2676335 - DNA, 17 bp, Homo sapiens
tcgtggacacctgccct

SEQ ID NO: 2676336 - DNA, 15 bp, Homo sapiens
tcgtgggtgtgtgta

SEQ ID NO: 2676337 - DNA, 20 bp, Homo sapiens
tcgtgtcctgctagctgtct

SEQ ID NO: 2676338 - DNA, 20 bp, Homo sapiens
tctaagttcatgtttgtaaa

SEQ ID NO: 2676339 - DNA, 19 bp, Homo sapiens
tctaagttgagtatattat

SEQ ID NO: 2676340 - DNA, 17 bp, Homo sapiens
tctactcctacctcagc

SEQ ID NO: 2676341 - DNA, 22 bp, Homo sapiens
tctactcctacctcagcctaga

SEQ ID NO: 2676342 - DNA, 14 bp, Homo sapiens
tctagaacacccac

SEQ ID NO: 2676343 - DNA, 17 bp, Homo sapiens
tctagaacacccactgg

SEQ ID NO: 2676344 - DNA, 20 bp, Homo sapiens
tctagaacacccactggcca

SEQ ID NO: 2676345 - DNA, 22 bp, Homo sapiens
tctagaacacccactggccagt

SEQ ID NO: 2676346 - DNA, 19 bp, Homo sapiens
tctagctttgttgtcctcc

SEQ ID NO: 2676347 - DNA, 18 bp, Homo sapiens
tctagtcccttctctctt

SEQ ID NO: 2676348 - DNA, 13 bp, Homo sapiens
tctataaacactg

SEQ ID NO: 2676349 - DNA, 17 bp, Homo sapiens
tctataaacactgtttg

SEQ ID NO: 2676350 - DNA, 21 bp, Homo sapiens
tctcaacctaccaccccttcc

SEQ ID NO: 2676351 - DNA, 22 bp, Homo sapiens
tctcaacctaccaccccttcct

SEQ ID NO: 2676352 - DNA, 23 bp, Homo sapiens
tctcaacctaccaccccttcctg

SEQ ID NO: 2676353 - DNA, 20 bp, Homo sapiens
tctcaatattcaataaagct

SEQ ID NO: 2676354 - DNA, 11 bp, Homo sapiens
tctcagagcac

SEQ ID NO: 2676355 - DNA, 22 bp, Homo sapiens
tctcagccctccatggcctggc

SEQ ID NO: 2676356 - DNA, 15 bp, Homo sapiens
tctcaggagcatggg

SEQ ID NO: 2676357 - DNA, 11 bp, Homo sapiens
tctccaccccc

SEQ ID NO: 2676358 - DNA, 23 bp, Homo sapiens
tctccaccccccacgtctgtcct

SEQ ID NO: 2676359 - DNA, 16 bp, Homo sapiens
tctccacctgtgcttg

SEQ ID NO: 2676360 - DNA, 18 bp, Homo sapiens
tctccagtggttgctgtt

SEQ ID NO: 2676361 - DNA, 20 bp, Homo sapiens
tctccagtggttgctgttga

SEQ ID NO: 2676362 - DNA, 15 bp, Homo sapiens
tctccctgcacagcc

SEQ ID NO: 2676363 - DNA, 12 bp, Homo sapiens
tctcctgctgcg

SEQ ID NO: 2676364 - DNA, 17 bp, Homo sapiens
tctcggaaggctggctg

SEQ ID NO: 2676365 - DNA, 20 bp, Homo sapiens
tctctaaactgctgttaatt

SEQ ID NO: 2676366 - DNA, 21 bp, Homo sapiens
tctctactcctacctcagcct

SEQ ID NO: 2676367 - DNA, 22 bp, Homo sapiens
tctctccaccccccacgtctgt

SEQ ID NO: 2676368 - DNA, 19 bp, Homo sapiens
tctctctactcctacctca

SEQ ID NO: 2676369 - DNA, 20 bp, Homo sapiens
tctctctactcctacctcag

SEQ ID NO: 2676370 - DNA, 22 bp, Homo sapiens
tctctctactcctacctcagcc

SEQ ID NO: 2676371 - DNA, 17 bp, Homo sapiens
tctctgagaaccaaaag

SEQ ID NO: 2676372 - DNA, 12 bp, Homo sapiens
tctctgcctcct

SEQ ID NO: 2676373 - DNA, 14 bp, Homo sapiens
tctctgcctcctcc

SEQ ID NO: 2676374 - DNA, 23 bp, Homo sapiens
tctctgctggcaggattcttccc

SEQ ID NO: 2676375 - DNA, 18 bp, Homo sapiens
tctctgtgacctgccccg

SEQ ID NO: 2676376 - DNA, 16 bp, Homo sapiens
tctctgtgctttgact

SEQ ID NO: 2676377 - DNA, 21 bp, Homo sapiens
tctctgtgctttgactcacct

SEQ ID NO: 2676378 - DNA, 22 bp, Homo sapiens
tctgaacacagtttagtgcttt

SEQ ID NO: 2676379 - DNA, 18 bp, Homo sapiens
tctgaaggcaaatataag

SEQ ID NO: 2676380 - DNA, 11 bp, Homo sapiens
tctgaccaaaa

SEQ ID NO: 2676381 - DNA, 16 bp, Homo sapiens
tctgacctgcaggcca

SEQ ID NO: 2676382 - DNA, 13 bp, Homo sapiens
tctgagagcacag

SEQ ID NO: 2676383 - DNA, 16 bp, Homo sapiens
tctgagagcacagcgt

SEQ ID NO: 2676384 - DNA, 20 bp, Homo sapiens
tctgagcttttcatggaagt

SEQ ID NO: 2676385 - DNA, 21 bp, Homo sapiens
tctgagcttttcatggaagtg

SEQ ID NO: 2676386 - DNA, 21 bp, Homo sapiens
tctgaggctctttctgggcca

SEQ ID NO: 2676387 - DNA, 14 bp, Homo sapiens
tctgatatgtttgt

SEQ ID NO: 2676388 - DNA, 15 bp, Homo sapiens
tctgatgccaaagct

SEQ ID NO: 2676389 - DNA, 20 bp, Homo sapiens
tctgcagacaagtcttgctg

SEQ ID NO: 2676390 - DNA, 16 bp, Homo sapiens
tctgccccagctctgg

SEQ ID NO: 2676391 - DNA, 20 bp, Homo sapiens
tctgccccagctctggcttc

SEQ ID NO: 2676392 - DNA, 15 bp, Homo sapiens
tctgcccttcctcca

SEQ ID NO: 2676393 - DNA, 17 bp, Homo sapiens
tctgcccttcctccagg

SEQ ID NO: 2676394 - DNA, 18 bp, Homo sapiens
tctgcccttcctccagga

SEQ ID NO: 2676395 - DNA, 19 bp, Homo sapiens
tctgcgccccgcctcccca

SEQ ID NO: 2676396 - DNA, 15 bp, Homo sapiens
tctgcgtctgtgttg

SEQ ID NO: 2676397 - DNA, 13 bp, Homo sapiens
tctggagcccttg

SEQ ID NO: 2676398 - DNA, 16 bp, Homo sapiens
tctggagcccttgggt

SEQ ID NO: 2676399 - DNA, 18 bp, Homo sapiens
tctggcaaagttatattt

SEQ ID NO: 2676400 - DNA, 23 bp, Homo sapiens
tctggcttccagaaaaccccagc

SEQ ID NO: 2676401 - DNA, 20 bp, Homo sapiens
tctgggaggcagaacaggct

SEQ ID NO: 2676402 - DNA, 15 bp, Homo sapiens
tctgggatgtagaac

SEQ ID NO: 2676403 - DNA, 12 bp, Homo sapiens
tctgggccaagt

SEQ ID NO: 2676404 - DNA, 19 bp, Homo sapiens
tctgggccaagttcctcta

SEQ ID NO: 2676405 - DNA, 23 bp, Homo sapiens
tctgggccaagttcctctagtgc

SEQ ID NO: 2676406 - DNA, 18 bp, Homo sapiens
tctgggtggaagtgccca

SEQ ID NO: 2676407 - DNA, 20 bp, Homo sapiens
tctgggtggaagtgcccagc

SEQ ID NO: 2676408 - DNA, 20 bp, Homo sapiens
tctgtagccacctccttggc

SEQ ID NO: 2676409 - DNA, 11 bp, Homo sapiens
tctgtcctcct

SEQ ID NO: 2676410 - DNA, 15 bp, Homo sapiens
tctgtctgtcccaaa

SEQ ID NO: 2676411 - DNA, 22 bp, Homo sapiens
tctgtgaattaaaaaagctcaa

SEQ ID NO: 2676412 - DNA, 16 bp, Homo sapiens
tctgtgaccgccctcc

SEQ ID NO: 2676413 - DNA, 11 bp, Homo sapiens
tcttagtttac

SEQ ID NO: 2676414 - DNA, 19 bp, Homo sapiens
tcttagtttacttatacct

SEQ ID NO: 2676415 - DNA, 24 bp, Homo sapiens
tcttcagagcaaaagacttgagcc

SEQ ID NO: 2676416 - DNA, 12 bp, Homo sapiens
tcttccaacccc

SEQ ID NO: 2676417 - DNA, 17 bp, Homo sapiens
tcttccaaccccagctg

SEQ ID NO: 2676418 - DNA, 18 bp, Homo sapiens
tcttccaaccccagctgg

SEQ ID NO: 2676419 - DNA, 20 bp, Homo sapiens
tcttccaaccccagctggcc

SEQ ID NO: 2676420 - DNA, 19 bp, Homo sapiens
tcttccccactccccacct

SEQ ID NO: 2676421 - DNA, 13 bp, Homo sapiens
tcttcccttctcc

SEQ ID NO: 2676422 - DNA, 14 bp, Homo sapiens
tcttcccttctccc

SEQ ID NO: 2676423 - DNA, 15 bp, Homo sapiens
tcttctctgcctcct

SEQ ID NO: 2676424 - DNA, 13 bp, Homo sapiens
tcttctcttcctg

SEQ ID NO: 2676425 - DNA, 14 bp, Homo sapiens
tcttgcatttcact

SEQ ID NO: 2676426 - DNA, 18 bp, Homo sapiens
tcttggacctctgctctg

SEQ ID NO: 2676427 - DNA, 21 bp, Homo sapiens
tcttggacctctgctctgagg

SEQ ID NO: 2676428 - DNA, 16 bp, Homo sapiens
tctttaacttgtaata

SEQ ID NO: 2676429 - DNA, 20 bp, Homo sapiens
tctttaatgttgtccaggaa

SEQ ID NO: 2676430 - DNA, 19 bp, Homo sapiens
tctttgaaacatgcttgtg

SEQ ID NO: 2676431 - DNA, 21 bp, Homo sapiens
tctttgctacaataaatgctg

SEQ ID NO: 2676432 - DNA, 16 bp, Homo sapiens
tcttttaagccctgct

SEQ ID NO: 2676433 - DNA, 19 bp, Homo sapiens
tcttttaagccctgctctt

SEQ ID NO: 2676434 - DNA, 12 bp, Homo sapiens
tgaaacatgctt

SEQ ID NO: 2676435 - DNA, 18 bp, Homo sapiens
tgaaaccaaatgtaacta

SEQ ID NO: 2676436 - DNA, 19 bp, Homo sapiens
tgaaactcctgattttgta

SEQ ID NO: 2676437 - DNA, 20 bp, Homo sapiens
tgaaaggtgctgatggccct

SEQ ID NO: 2676438 - DNA, 17 bp, Homo sapiens
tgaaagtttgcactgta

SEQ ID NO: 2676439 - DNA, 17 bp, Homo sapiens
tgaaatcagtaaacact

SEQ ID NO: 2676440 - DNA, 19 bp, Homo sapiens
tgaaatcagtaaacactgt

SEQ ID NO: 2676441 - DNA, 20 bp, Homo sapiens
tgaaatcagtaaacactgtg

SEQ ID NO: 2676442 - DNA, 22 bp, Homo sapiens
tgaaatcagtaaacactgtgta

SEQ ID NO: 2676443 - DNA, 21 bp, Homo sapiens
tgaaattcaacctgtgtctta

SEQ ID NO: 2676444 - DNA, 16 bp, Homo sapiens
tgaaattcttgaagtt

SEQ ID NO: 2676445 - DNA, 12 bp, Homo sapiens
tgaacaaaagct

SEQ ID NO: 2676446 - DNA, 18 bp, Homo sapiens
tgaacttgaggacacatg

SEQ ID NO: 2676447 - DNA, 22 bp, Homo sapiens
tgaacttgaggacacatgtcca

SEQ ID NO: 2676448 - DNA, 14 bp, Homo sapiens
tgaagacaggacag

SEQ ID NO: 2676449 - DNA, 15 bp, Homo sapiens
tgaagatcagagctg

SEQ ID NO: 2676450 - DNA, 17 bp, Homo sapiens
tgaagatcagagctgca

SEQ ID NO: 2676451 - DNA, 19 bp, Homo sapiens
tgaagccactgaagctggg

SEQ ID NO: 2676452 - DNA, 13 bp, Homo sapiens
tgaaggagaaaat

SEQ ID NO: 2676453 - DNA, 14 bp, Homo sapiens
tgaagtctgctcat

SEQ ID NO: 2676454 - DNA, 19 bp, Homo sapiens
tgaagttcatggtgatcag

SEQ ID NO: 2676455 - DNA, 12 bp, Homo sapiens
tgaataagcact

SEQ ID NO: 2676456 - DNA, 15 bp, Homo sapiens
tgaataagcactttt

SEQ ID NO: 2676457 - DNA, 16 bp, Homo sapiens
tgaatagatgtgatca

SEQ ID NO: 2676458 - DNA, 13 bp, Homo sapiens
tgaatcaaagaca

SEQ ID NO: 2676459 - DNA, 17 bp, Homo sapiens
tgaatgccggggacaga

SEQ ID NO: 2676460 - DNA, 18 bp, Homo sapiens
tgaatggccctagaactg

SEQ ID NO: 2676461 - DNA, 12 bp, Homo sapiens
tgaatggcctgc

SEQ ID NO: 2676462 - DNA, 21 bp, Homo sapiens
tgaatggcctgccttgaagcc

SEQ ID NO: 2676463 - DNA, 16 bp, Homo sapiens
tgacacctccatttct

SEQ ID NO: 2676464 - DNA, 22 bp, Homo sapiens
tgacacctccatttctctccag

SEQ ID NO: 2676465 - DNA, 21 bp, Homo sapiens
tgacacggggatcatctctgt

SEQ ID NO: 2676466 - DNA, 18 bp, Homo sapiens
tgacactgtgaccctggg

SEQ ID NO: 2676467 - DNA, 17 bp, Homo sapiens
tgacatgtgcagtgctg

SEQ ID NO: 2676468 - DNA, 19 bp, Homo sapiens
tgaccaaaatgtgtttcat

SEQ ID NO: 2676469 - DNA, 17 bp, Homo sapiens
tgaccagctctcttcct

SEQ ID NO: 2676470 - DNA, 19 bp, Homo sapiens
tgaccagctctcttcctgt

SEQ ID NO: 2676471 - DNA, 18 bp, Homo sapiens
tgaccctgagggctcctc

SEQ ID NO: 2676472 - DNA, 20 bp, Homo sapiens
tgaccctgagggctcctcca

SEQ ID NO: 2676473 - DNA, 11 bp, Homo sapiens
tgacctgcagg

SEQ ID NO: 2676474 - DNA, 13 bp, Homo sapiens
tgacctgccccgc

SEQ ID NO: 2676475 - DNA, 13 bp, Homo sapiens
tgactgcagcccc

SEQ ID NO: 2676476 - DNA, 14 bp, Homo sapiens
tgactgtaattaat

SEQ ID NO: 2676477 - DNA, 15 bp, Homo sapiens
tgactttcaggaatt

SEQ ID NO: 2676478 - DNA, 21 bp, Homo sapiens
tgactttcaggaattgcccat

SEQ ID NO: 2676479 - DNA, 12 bp, Homo sapiens
tgagaaccaaaa

SEQ ID NO: 2676480 - DNA, 16 bp, Homo sapiens
tgagaagcgctgccct

SEQ ID NO: 2676481 - DNA, 17 bp, Homo sapiens
tgagaagcgctgccctg

SEQ ID NO: 2676482 - DNA, 20 bp, Homo sapiens
tgagaagcgctgccctgtga

SEQ ID NO: 2676483 - DNA, 19 bp, Homo sapiens
tgagaccacctctcaatat

SEQ ID NO: 2676484 - DNA, 20 bp, Homo sapiens
tgagacctcgccggccttgt

SEQ ID NO: 2676485 - DNA, 23 bp, Homo sapiens
tgagactgcgggatggtcctggg

SEQ ID NO: 2676486 - DNA, 21 bp, Homo sapiens
tgagagccagatgcctcccca

SEQ ID NO: 2676487 - DNA, 16 bp, Homo sapiens
tgagcaggcagggctg

SEQ ID NO: 2676488 - DNA, 21 bp, Homo sapiens
tgagcaggcagggctgggcca

SEQ ID NO: 2676489 - DNA, 16 bp, Homo sapiens
tgagccatccaaagaa

SEQ ID NO: 2676490 - DNA, 21 bp, Homo sapiens
tgagccatgatcgagccactg

SEQ ID NO: 2676491 - DNA, 18 bp, Homo sapiens
tgagccctggaccccagg

SEQ ID NO: 2676492 - DNA, 12 bp, Homo sapiens
tgagctcaggca

SEQ ID NO: 2676493 - DNA, 13 bp, Homo sapiens
tgagctcaggcat

SEQ ID NO: 2676494 - DNA, 22 bp, Homo sapiens
tgagctcttgttccgtgccagg

SEQ ID NO: 2676495 - DNA, 14 bp, Homo sapiens
tgaggacacatgtc

SEQ ID NO: 2676496 - DNA, 16 bp, Homo sapiens
tgaggacacatgtcca

SEQ ID NO: 2676497 - DNA, 20 bp, Homo sapiens
tgaggatacagctcttctca

SEQ ID NO: 2676498 - DNA, 13 bp, Homo sapiens
tgaggccacccac

SEQ ID NO: 2676499 - DNA, 15 bp, Homo sapiens
tgaggccattatttc

SEQ ID NO: 2676500 - DNA, 14 bp, Homo sapiens
tgaggcctcttgga

SEQ ID NO: 2676501 - DNA, 18 bp, Homo sapiens
tgaggctctttctgggcc

SEQ ID NO: 2676502 - DNA, 13 bp, Homo sapiens
tgaggctgcagcg

SEQ ID NO: 2676503 - DNA, 12 bp, Homo sapiens
tgaggctgggaa

SEQ ID NO: 2676504 - DNA, 22 bp, Homo sapiens
tgaggggaggatcactggagcc

SEQ ID NO: 2676505 - DNA, 15 bp, Homo sapiens
tgaggggctcctgga

SEQ ID NO: 2676506 - DNA, 13 bp, Homo sapiens
tgaggtgcctccc

SEQ ID NO: 2676507 - DNA, 14 bp, Homo sapiens
tgaggtgcctccca

SEQ ID NO: 2676508 - DNA, 14 bp, Homo sapiens
tgagtatattataa

SEQ ID NO: 2676509 - DNA, 15 bp, Homo sapiens
tgagtatattataat

SEQ ID NO: 2676510 - DNA, 17 bp, Homo sapiens
tgagtccagctttcctt

SEQ ID NO: 2676511 - DNA, 20 bp, Homo sapiens
tgagtccagctttccttctg

SEQ ID NO: 2676512 - DNA, 18 bp, Homo sapiens
tgagtgtctgcgccccgc

SEQ ID NO: 2676513 - DNA, 21 bp, Homo sapiens
tgataggacttccttaagcat

SEQ ID NO: 2676514 - DNA, 21 bp, Homo sapiens
tgatatatctcaaattgtaat

SEQ ID NO: 2676515 - DNA, 14 bp, Homo sapiens
tgatattttacttg

SEQ ID NO: 2676516 - DNA, 15 bp, Homo sapiens
tgatcctgctccagc

SEQ ID NO: 2676517 - DNA, 20 bp, Homo sapiens
tgatcctgctccagcagcac

SEQ ID NO: 2676518 - DNA, 14 bp, Homo sapiens
tgatgatgtctctt

SEQ ID NO: 2676519 - DNA, 18 bp, Homo sapiens
tgatgccaaagctgcttt

SEQ ID NO: 2676520 - DNA, 21 bp, Homo sapiens
tgatgccaaagctgctttctt

SEQ ID NO: 2676521 - DNA, 15 bp, Homo sapiens
tgatggaccaaagcc

SEQ ID NO: 2676522 - DNA, 18 bp, Homo sapiens
tgatggaccaaagccacc

SEQ ID NO: 2676523 - DNA, 22 bp, Homo sapiens
tgatggaccaaagccacctgct

SEQ ID NO: 2676524 - DNA, 16 bp, Homo sapiens
tgatggcccctccagc

SEQ ID NO: 2676525 - DNA, 17 bp, Homo sapiens
tgatggcccctccagca

SEQ ID NO: 2676526 - DNA, 20 bp, Homo sapiens
tgatggcccctccagcacac

SEQ ID NO: 2676527 - DNA, 20 bp, Homo sapiens
tgatggccctcatctccagc

SEQ ID NO: 2676528 - DNA, 17 bp, Homo sapiens
gtaacacaagccacaga

SEQ ID NO: 2676529 - DNA, 17 bp, Homo sapiens
gtaacagtgaggctggg

SEQ ID NO: 2676530 - DNA, 14 bp, Homo sapiens
gtaactggctgctc

SEQ ID NO: 2676531 - DNA, 17 bp, Homo sapiens
gtaactggctgctccct

SEQ ID NO: 2676532 - DNA, 18 bp, Homo sapiens
gtaactggctgctccctg

SEQ ID NO: 2676533 - DNA, 24 bp, Homo sapiens
gtaactggctgctccctgctccca

SEQ ID NO: 2676534 - DNA, 16 bp, Homo sapiens
gtaagaccccatctct

SEQ ID NO: 2676535 - DNA, 19 bp, Homo sapiens
gtaagatggcttatttgta

SEQ ID NO: 2676536 - DNA, 23 bp, Homo sapiens
gtaagttgaatggcctgccttga

SEQ ID NO: 2676537 - DNA, 22 bp, Homo sapiens
gtaatcggctcccgcttgctct

SEQ ID NO: 2676538 - DNA, 22 bp, Homo sapiens
gtacttgctctctgagagcaca

SEQ ID NO: 2676539 - DNA, 11 bp, Homo sapiens
gtagccacctc

SEQ ID NO: 2676540 - DNA, 16 bp, Homo sapiens
gtagccacctccttgg

SEQ ID NO: 2676541 - DNA, 21 bp, Homo sapiens
gtagccacctccttggcaccg

SEQ ID NO: 2676542 - DNA, 18 bp, Homo sapiens
gtaggtttctctcttccc

SEQ ID NO: 2676543 - DNA, 17 bp, Homo sapiens
gtagtcgtcaagttgca

SEQ ID NO: 2676544 - DNA, 14 bp, Homo sapiens
gtatatattctaca

SEQ ID NO: 2676545 - DNA, 16 bp, Homo sapiens
gtatatctatatctct

SEQ ID NO: 2676546 - DNA, 16 bp, Homo sapiens
gtatatgtatatctat

SEQ ID NO: 2676547 - DNA, 18 bp, Homo sapiens
gtatatgtatatctatat

SEQ ID NO: 2676548 - DNA, 13 bp, Homo sapiens
gtatatgttgtaa

SEQ ID NO: 2676549 - DNA, 13 bp, Homo sapiens
gtatcaaatctgt

SEQ ID NO: 2676550 - DNA, 18 bp, Homo sapiens
gtatcaggactgtgacca

SEQ ID NO: 2676551 - DNA, 20 bp, Homo sapiens
gtatcaggactgtgaccaaa

SEQ ID NO: 2676552 - DNA, 23 bp, Homo sapiens
gtatcaggactgtgaccaaagca

SEQ ID NO: 2676553 - DNA, 15 bp, Homo sapiens
gtatccagaatggaa

SEQ ID NO: 2676554 - DNA, 19 bp, Homo sapiens
gtatcgctgccttgccatg

SEQ ID NO: 2676555 - DNA, 15 bp, Homo sapiens
gtatgaacttgagga

SEQ ID NO: 2676556 - DNA, 22 bp, Homo sapiens
gtatgttaaagcatcagagatg

SEQ ID NO: 2676557 - DNA, 18 bp, Homo sapiens
gtattacatctaatgctt

SEQ ID NO: 2676558 - DNA, 12 bp, Homo sapiens
gtatttaagatt

SEQ ID NO: 2676559 - DNA, 12 bp, Homo sapiens
gtcacaggctgt

SEQ ID NO: 2676560 - DNA, 20 bp, Homo sapiens
gtcaccgtggaccttcctgc

SEQ ID NO: 2676561 - DNA, 15 bp, Homo sapiens
gtcagaatcatgctg

SEQ ID NO: 2676562 - DNA, 14 bp, Homo sapiens
gtcagactgctggg

SEQ ID NO: 2676563 - DNA, 16 bp, Homo sapiens
gtcagactgctgggac

SEQ ID NO: 2676564 - DNA, 20 bp, Homo sapiens
gtcagactgctgggactggc

SEQ ID NO: 2676565 - DNA, 17 bp, Homo sapiens
gtcagcccagcacctgc

SEQ ID NO: 2676566 - DNA, 20 bp, Homo sapiens
gtcagcctgaagatcagagc

SEQ ID NO: 2676567 - DNA, 19 bp, Homo sapiens
gtcaggcacgtctcctgct

SEQ ID NO: 2676568 - DNA, 22 bp, Homo sapiens
gtcaggcacgtctcctgctgcg

SEQ ID NO: 2676569 - DNA, 18 bp, Homo sapiens
gtccagaccattgtcttc

SEQ ID NO: 2676570 - DNA, 19 bp, Homo sapiens
gtccagaccattgtcttcc

SEQ ID NO: 2676571 - DNA, 20 bp, Homo sapiens
gtccagaccattgtcttcca

SEQ ID NO: 2676572 - DNA, 13 bp, Homo sapiens
gtccagctttcct

SEQ ID NO: 2676573 - DNA, 17 bp, Homo sapiens
gtccagctttccttctg

SEQ ID NO: 2676574 - DNA, 18 bp, Homo sapiens
gtccagctttccttctgc

SEQ ID NO: 2676575 - DNA, 19 bp, Homo sapiens
gtccagctttccttctgcc

SEQ ID NO: 2676576 - DNA, 12 bp, Homo sapiens
gtccataaagta

SEQ ID NO: 2676577 - DNA, 20 bp, Homo sapiens
gtcccaatagctctactgcc

SEQ ID NO: 2676578 - DNA, 23 bp, Homo sapiens
gtcccacaccgctggtccctgcc

SEQ ID NO: 2676579 - DNA, 13 bp, Homo sapiens
gtcccacctcttc

SEQ ID NO: 2676580 - DNA, 19 bp, Homo sapiens
gtcccacctcttctcttcc

SEQ ID NO: 2676581 - DNA, 15 bp, Homo sapiens
gtcccccccagtgca

SEQ ID NO: 2676582 - DNA, 16 bp, Homo sapiens
gtccctgccctcccct

SEQ ID NO: 2676583 - DNA, 17 bp, Homo sapiens
gtccctgccctcccctg

SEQ ID NO: 2676584 - DNA, 21 bp, Homo sapiens
gtccctgccctcccctgctcc

SEQ ID NO: 2676585 - DNA, 16 bp, Homo sapiens
gtccgtgtgcctcctg

SEQ ID NO: 2676586 - DNA, 21 bp, Homo sapiens
gtccgtttgagtgtctgcgcc

SEQ ID NO: 2676587 - DNA, 18 bp, Homo sapiens
gtcctcacttctgtctcc

SEQ ID NO: 2676588 - DNA, 19 bp, Homo sapiens
gtcctcacttctgtctcct

SEQ ID NO: 2676589 - DNA, 12 bp, Homo sapiens
gtcctcccagga

SEQ ID NO: 2676590 - DNA, 13 bp, Homo sapiens
gtcctcccaggaa

SEQ ID NO: 2676591 - DNA, 19 bp, Homo sapiens
gtcctcccaggaaccaaaa

SEQ ID NO: 2676592 - DNA, 13 bp, Homo sapiens
gtcctccctccca

SEQ ID NO: 2676593 - DNA, 14 bp, Homo sapiens
gtcctccctcccaa

SEQ ID NO: 2676594 - DNA, 15 bp, Homo sapiens
gtcctcctgctctgc

SEQ ID NO: 2676595 - DNA, 18 bp, Homo sapiens
gtcctcctgctctgcttc

SEQ ID NO: 2676596 - DNA, 12 bp, Homo sapiens
gtcctcctttct

SEQ ID NO: 2676597 - DNA, 23 bp, Homo sapiens
gtcctgcctggtcctccctccca

SEQ ID NO: 2676598 - DNA, 16 bp, Homo sapiens
gtcctgctagctgtct

SEQ ID NO: 2676599 - DNA, 20 bp, Homo sapiens
gtcctggtgggtcagcccag

SEQ ID NO: 2676600 - DNA, 22 bp, Homo sapiens
gtccttttgtaccatggtgtga

SEQ ID NO: 2676601 - DNA, 23 bp, Homo sapiens
gtcgagctgtgctcgggtgctgc

SEQ ID NO: 2676602 - DNA, 18 bp, Homo sapiens
gtcgggcccctgcctgcc

SEQ ID NO: 2676603 - DNA, 20 bp, Homo sapiens
gtcgggcccctgcctgcctt

SEQ ID NO: 2676604 - DNA, 12 bp, Homo sapiens
gtctccacctgt

SEQ ID NO: 2676605 - DNA, 18 bp, Homo sapiens
gtctccacctgtgcttgg

SEQ ID NO: 2676606 - DNA, 19 bp, Homo sapiens
gtctccagtggttgctgtt

SEQ ID NO: 2676607 - DNA, 13 bp, Homo sapiens
gtctccatctctg

SEQ ID NO: 2676608 - DNA, 15 bp, Homo sapiens
gtctccctgcacagc

SEQ ID NO: 2676609 - DNA, 17 bp, Homo sapiens
gtctccctgcacagcct

SEQ ID NO: 2676610 - DNA, 18 bp, Homo sapiens
gtctgatgccaaagctgc

SEQ ID NO: 2676611 - DNA, 22 bp, Homo sapiens
gtctgcagacaagtcttgctgt

SEQ ID NO: 2676612 - DNA, 22 bp, Homo sapiens
gtctgcattgttattgtggaag

SEQ ID NO: 2676613 - DNA, 19 bp, Homo sapiens
gtctgggatgtagaacttc

SEQ ID NO: 2676614 - DNA, 14 bp, Homo sapiens
gtctgtcctctctg

SEQ ID NO: 2676615 - DNA, 14 bp, Homo sapiens
gtcttccaacccca

SEQ ID NO: 2676616 - DNA, 15 bp, Homo sapiens
gtcttccaaccccag

SEQ ID NO: 2676617 - DNA, 17 bp, Homo sapiens
gtcttccaaccccagct

SEQ ID NO: 2676618 - DNA, 23 bp, Homo sapiens
gtcttccaaccccagctggcctc

SEQ ID NO: 2676619 - DNA, 16 bp, Homo sapiens
gtcttgctgtgcttta

SEQ ID NO: 2676620 - DNA, 20 bp, Homo sapiens
gtctttagaatcgctttcct

SEQ ID NO: 2676621 - DNA, 17 bp, Homo sapiens
gtctttgttgtctccct

SEQ ID NO: 2676622 - DNA, 21 bp, Homo sapiens
gtgaaagtcagatgcccagag

SEQ ID NO: 2676623 - DNA, 19 bp, Homo sapiens
gtgaatggccctagaactg

SEQ ID NO: 2676624 - DNA, 12 bp, Homo sapiens
gtgaattaaaaa

SEQ ID NO: 2676625 - DNA, 12 bp, Homo sapiens
gtgaccaaagca

SEQ ID NO: 2676626 - DNA, 23 bp, Homo sapiens
gtgaccaaagcatttctagtccc

SEQ ID NO: 2676627 - DNA, 23 bp, Homo sapiens
gtgacctgccccgcccagctgca

SEQ ID NO: 2676628 - DNA, 14 bp, Homo sapiens
gtgagaacccagag

SEQ ID NO: 2676629 - DNA, 21 bp, Homo sapiens
gtgagcaggcagggctgggcc

SEQ ID NO: 2676630 - DNA, 12 bp, Homo sapiens
gtgaggctggga

SEQ ID NO: 2676631 - DNA, 15 bp, Homo sapiens
gtgatattttacttg

SEQ ID NO: 2676632 - DNA, 16 bp, Homo sapiens
gtgcactggccccacc

SEQ ID NO: 2676633 - DNA, 17 bp, Homo sapiens
gtgcatgcactgtctca

SEQ ID NO: 2676634 - DNA, 15 bp, Homo sapiens
gtgccaccaataaaa

SEQ ID NO: 2676635 - DNA, 21 bp, Homo sapiens
gtgccaccaataaaaatccta

SEQ ID NO: 2676636 - DNA, 18 bp, Homo sapiens
gtgccagtcttgtgtctg

SEQ ID NO: 2676637 - DNA, 20 bp, Homo sapiens
gtgcccagcccctgccccta

SEQ ID NO: 2676638 - DNA, 16 bp, Homo sapiens
gtgcctcccagtggcc

SEQ ID NO: 2676639 - DNA, 17 bp, Homo sapiens
gaagtgcccagcccctg

SEQ ID NO: 2676640 - DNA, 20 bp, Homo sapiens
gaagtgcccagcccctgccc

SEQ ID NO: 2676641 - DNA, 21 bp, Homo sapiens
gaagtgcccagcccctgcccc

SEQ ID NO: 2676642 - DNA, 13 bp, Homo sapiens
gaagtgtatatag

SEQ ID NO: 2676643 - DNA, 18 bp, Homo sapiens
gaagtgttcaagaaataa

SEQ ID NO: 2676644 - DNA, 16 bp, Homo sapiens
gaataagcacttttta

SEQ ID NO: 2676645 - DNA, 15 bp, Homo sapiens
gaatagatgtgatca

SEQ ID NO: 2676646 - DNA, 19 bp, Homo sapiens
gaatagggctaggaatata

SEQ ID NO: 2676647 - DNA, 22 bp, Homo sapiens
gaatatttattcagtgacttct

SEQ ID NO: 2676648 - DNA, 16 bp, Homo sapiens
gaatcaaagacatgga

SEQ ID NO: 2676649 - DNA, 20 bp, Homo sapiens
gaatcaagatgtcagactgg

SEQ ID NO: 2676650 - DNA, 22 bp, Homo sapiens
gaatcatgctgttctctttgct

SEQ ID NO: 2676651 - DNA, 17 bp, Homo sapiens
gaatcgctttccttcct

SEQ ID NO: 2676652 - DNA, 17 bp, Homo sapiens
gaatgtgtcctcctgct

SEQ ID NO: 2676653 - DNA, 14 bp, Homo sapiens
gaattaatatttat

SEQ ID NO: 2676654 - DNA, 16 bp, Homo sapiens
gaattaatatttatgt

SEQ ID NO: 2676655 - DNA, 19 bp, Homo sapiens
gaattgaaggagaaaatgc

SEQ ID NO: 2676656 - DNA, 19 bp, Homo sapiens
gaatttggagactctgtgg

SEQ ID NO: 2676657 - DNA, 20 bp, Homo sapiens
gacaaagccaaactctgcca

SEQ ID NO: 2676658 - DNA, 14 bp, Homo sapiens
gacaacattgtaag

SEQ ID NO: 2676659 - DNA, 17 bp, Homo sapiens
gacaagtcttgctgtgc

SEQ ID NO: 2676660 - DNA, 15 bp, Homo sapiens
gacacaagcggccct

SEQ ID NO: 2676661 - DNA, 14 bp, Homo sapiens
gacacaggccagcc

SEQ ID NO: 2676662 - DNA, 20 bp, Homo sapiens
gacacaggccagccttggca

SEQ ID NO: 2676663 - DNA, 22 bp, Homo sapiens
gacacaggccagccttggcacg

SEQ ID NO: 2676664 - DNA, 10 bp, Homo sapiens
gacacctgcc

SEQ ID NO: 2676665 - DNA, 12 bp, Homo sapiens
gacacctgccct

SEQ ID NO: 2676666 - DNA, 13 bp, Homo sapiens
gacacctgccctg

SEQ ID NO: 2676667 - DNA, 15 bp, Homo sapiens
gacacctgccctgcc

SEQ ID NO: 2676668 - DNA, 22 bp, Homo sapiens
gacacctgccctgccctgccac

SEQ ID NO: 2676669 - DNA, 18 bp, Homo sapiens
gacacggggatcatctct

SEQ ID NO: 2676670 - DNA, 20 bp, Homo sapiens
gacacggggatcatctctgt

SEQ ID NO: 2676671 - DNA, 22 bp, Homo sapiens
gacacggggatcatctctgtga

SEQ ID NO: 2676672 - DNA, 17 bp, Homo sapiens
gacacgtgatggaccaa

SEQ ID NO: 2676673 - DNA, 21 bp, Homo sapiens
gacacgtgatggaccaaagcc

SEQ ID NO: 2676674 - DNA, 19 bp, Homo sapiens
gacactgtgaccctgggtc

SEQ ID NO: 2676675 - DNA, 13 bp, Homo sapiens
gtgggagcttccc

SEQ ID NO: 2676676 - DNA, 13 bp, Homo sapiens
gtgggcgaggcct

SEQ ID NO: 2676677 - DNA, 20 bp, Homo sapiens
gtgggcgaggcctgacacag

SEQ ID NO: 2676678 - DNA, 13 bp, Homo sapiens
gtgggctgagccc

SEQ ID NO: 2676679 - DNA, 18 bp, Homo sapiens
gtgggctgagccctggca

SEQ ID NO: 2676680 - DNA, 22 bp, Homo sapiens
gtggggctcccggcatcctgaa

SEQ ID NO: 2676681 - DNA, 15 bp, Homo sapiens
gtgggtcagcccagc

SEQ ID NO: 2676682 - DNA, 23 bp, Homo sapiens
gtggtctccttgcactttctcag

SEQ ID NO: 2676683 - DNA, 16 bp, Homo sapiens
gtgtagccttgcccgg

SEQ ID NO: 2676684 - DNA, 15 bp, Homo sapiens
gtgtcctcctgctct

SEQ ID NO: 2676685 - DNA, 16 bp, Homo sapiens
gtgtcctcctgctctg

SEQ ID NO: 2676686 - DNA, 19 bp, Homo sapiens
gtgtctgaacaatctccaa

SEQ ID NO: 2676687 - DNA, 20 bp, Homo sapiens
gtgtctgcattgttattgtg

SEQ ID NO: 2676688 - DNA, 22 bp, Homo sapiens
gtgtctgcgccccgcctcccca

SEQ ID NO: 2676689 - DNA, 15 bp, Homo sapiens
gtgtgaaacctgaca

SEQ ID NO: 2676690 - DNA, 12 bp, Homo sapiens
gtgtgaccctga

SEQ ID NO: 2676691 - DNA, 14 bp, Homo sapiens
gtgtgggctgtgtc

SEQ ID NO: 2676692 - DNA, 14 bp, Homo sapiens
gtgttcaagaaata

SEQ ID NO: 2676693 - DNA, 15 bp, Homo sapiens
gtgttgatcccaaga

SEQ ID NO: 2676694 - DNA, 20 bp, Homo sapiens
gttagctcaggaggcttgga

SEQ ID NO: 2676695 - DNA, 13 bp, Homo sapiens
gttcaagaaataa

SEQ ID NO: 2676696 - DNA, 15 bp, Homo sapiens
gttcaagcccaggct

SEQ ID NO: 2676697 - DNA, 18 bp, Homo sapiens
gttcactaaactctgaat

SEQ ID NO: 2676698 - DNA, 20 bp, Homo sapiens
gttcactaaactctgaataa

SEQ ID NO: 2676699 - DNA, 15 bp, Homo sapiens
gttcatgtttgtaaa

SEQ ID NO: 2676700 - DNA, 18 bp, Homo sapiens
gttcatgtttgtaaatta

SEQ ID NO: 2676701 - DNA, 12 bp, Homo sapiens
gttcattctgat

SEQ ID NO: 2676702 - DNA, 17 bp, Homo sapiens
gttcattttagtgactg

SEQ ID NO: 2676703 - DNA, 16 bp, Homo sapiens
gttcgagaccagcctg

SEQ ID NO: 2676704 - DNA, 18 bp, Homo sapiens
gttctctttgctgacact

SEQ ID NO: 2676705 - DNA, 16 bp, Homo sapiens
gttctgagaagcgctg

SEQ ID NO: 2676706 - DNA, 22 bp, Homo sapiens
gttctgagaagcgctgccctgt

SEQ ID NO: 2676707 - DNA, 22 bp, Homo sapiens
gttctggggcccgcctgccacc

SEQ ID NO: 2676708 - DNA, 20 bp, Homo sapiens
gttgaaaaatctagtttttt

SEQ ID NO: 2676709 - DNA, 18 bp, Homo sapiens
gttgacgggctgtccgtg

SEQ ID NO: 2676710 - DNA, 17 bp, Homo sapiens
gttgaggggctcctgga

SEQ ID NO: 2676711 - DNA, 18 bp, Homo sapiens
gttgataaattccactgg

SEQ ID NO: 2676712 - DNA, 22 bp, Homo sapiens
gttgcagatctttttgtgaaat

SEQ ID NO: 2676713 - DNA, 19 bp, Homo sapiens
gttgcctttttacagccaa

SEQ ID NO: 2676714 - DNA, 22 bp, Homo sapiens
gttgcttagatgagggtgactg

SEQ ID NO: 2676715 - DNA, 16 bp, Homo sapiens
gttggacccgctctgg

SEQ ID NO: 2676716 - DNA, 13 bp, Homo sapiens
gttgtcctcccag

SEQ ID NO: 2676717 - DNA, 16 bp, Homo sapiens
gttgtcctcccaggaa

SEQ ID NO: 2676718 - DNA, 14 bp, Homo sapiens
gtttaaaaaaagta

SEQ ID NO: 2676719 - DNA, 19 bp, Homo sapiens
gtttaaaaaaagtatatat

SEQ ID NO: 2676720 - DNA, 22 bp, Homo sapiens
gtttaaaaaaagtatatattct

SEQ ID NO: 2676721 - DNA, 18 bp, Homo sapiens
gtttatagttaatctata

SEQ ID NO: 2676722 - DNA, 14 bp, Homo sapiens
gtttctccccctgg

SEQ ID NO: 2676723 - DNA, 23 bp, Homo sapiens
gtttctccccctgggctctgccc

SEQ ID NO: 2676724 - DNA, 14 bp, Homo sapiens
gtttctctcttccc

SEQ ID NO: 2676725 - DNA, 20 bp, Homo sapiens
gtttctgcagtagtctctgt

SEQ ID NO: 2676726 - DNA, 22 bp, Homo sapiens
gtttctgcagtagtctctgtgc

SEQ ID NO: 2676727 - DNA, 21 bp, Homo sapiens
gtttctgcccacattggaccc

SEQ ID NO: 2676728 - DNA, 15 bp, Homo sapiens
gtttgagccctggac

SEQ ID NO: 2676729 - DNA, 19 bp, Homo sapiens
gtttgcactgtatgctgga

SEQ ID NO: 2676730 - DNA, 22 bp, Homo sapiens
gtttgcactgtatgctggacgg

SEQ ID NO: 2676731 - DNA, 21 bp, Homo sapiens
gtttgtttctccccctgggct

SEQ ID NO: 2676732 - DNA, 16 bp, Homo sapiens
gttttaccctatatct

SEQ ID NO: 2676733 - DNA, 15 bp, Homo sapiens
gttttatatccattt

SEQ ID NO: 2676734 - DNA, 21 bp, Homo sapiens
gttttatcgtccagtgacttt

SEQ ID NO: 2676735 - DNA, 14 bp, Homo sapiens
gttttccaccctgg

SEQ ID NO: 2676736 - DNA, 23 bp, Homo sapiens
gttttcttcaagggaagaaacac

SEQ ID NO: 2676737 - DNA, 18 bp, Homo sapiens
gttttgaaagaaaaatac

SEQ ID NO: 2676738 - DNA, 21 bp, Homo sapiens
gttttgtataaataataaaga

SEQ ID NO: 2676739 - DNA, 14 bp, Homo sapiens
taaaaaaagtatat

SEQ ID NO: 2676740 - DNA, 12 bp, Homo sapiens
taaaaagattat

SEQ ID NO: 2676741 - DNA, 19 bp, Homo sapiens
taaaaagattatatatcat

SEQ ID NO: 2676742 - DNA, 22 bp, Homo sapiens
taaaagttaaactacttgtaaa

SEQ ID NO: 2676743 - DNA, 23 bp, Homo sapiens
taaacacccatgaatcaaagaca

SEQ ID NO: 2676744 - DNA, 14 bp, Homo sapiens
taaacactgtgtat

SEQ ID NO: 2676745 - DNA, 13 bp, Homo sapiens
taaactctgaata

SEQ ID NO: 2676746 - DNA, 14 bp, Homo sapiens
taaactctgaataa

SEQ ID NO: 2676747 - DNA, 22 bp, Homo sapiens
taaactctgaataagcactttt

SEQ ID NO: 2676748 - DNA, 13 bp, Homo sapiens
taaataatgaaaa

SEQ ID NO: 2676749 - DNA, 22 bp, Homo sapiens
taaatcatactcctatgcttta

SEQ ID NO: 2676750 - DNA, 12 bp, Homo sapiens
taaatgtttaaa

SEQ ID NO: 2676751 - DNA, 18 bp, Homo sapiens
taaatgtttaaatataaa

SEQ ID NO: 2676752 - DNA, 15 bp, Homo sapiens
taacaaaccatctgg

SEQ ID NO: 2676753 - DNA, 21 bp, Homo sapiens
taacaaaccatctggtgcctt

SEQ ID NO: 2676754 - DNA, 16 bp, Homo sapiens
taacacaagccacaga

SEQ ID NO: 2676755 - DNA, 15 bp, Homo sapiens
taacagtgaggctgg

SEQ ID NO: 2676756 - DNA, 20 bp, Homo sapiens
taacataaaatctgtgaatt

SEQ ID NO: 2676757 - DNA, 23 bp, Homo sapiens
taacatagaattgcaatctataa

SEQ ID NO: 2676758 - DNA, 14 bp, Homo sapiens
ggctcctccatggt

SEQ ID NO: 2676759 - DNA, 19 bp, Homo sapiens
ggctcctccatggtgctgc

SEQ ID NO: 2676760 - DNA, 15 bp, Homo sapiens
ggctctgaagccaag

SEQ ID NO: 2676761 - DNA, 20 bp, Homo sapiens
ggctctgccccagctctggc

SEQ ID NO: 2676762 - DNA, 15 bp, Homo sapiens
ggctctttcagagag

SEQ ID NO: 2676763 - DNA, 21 bp, Homo sapiens
ggctgagactgcgggatggtc

SEQ ID NO: 2676764 - DNA, 16 bp, Homo sapiens
ggctgagccctggcag

SEQ ID NO: 2676765 - DNA, 16 bp, Homo sapiens
ggctgctccctgctcc

SEQ ID NO: 2676766 - DNA, 19 bp, Homo sapiens
ggctgctccctgctcccag

SEQ ID NO: 2676767 - DNA, 19 bp, Homo sapiens
ggctgctggcctggccctt

SEQ ID NO: 2676768 - DNA, 13 bp, Homo sapiens
ggctggagacagg

SEQ ID NO: 2676769 - DNA, 23 bp, Homo sapiens
ggctggctggagtctcagagcac

SEQ ID NO: 2676770 - DNA, 14 bp, Homo sapiens
ggctgggccaggtc

SEQ ID NO: 2676771 - DNA, 11 bp, Homo sapiens
ggctgggctcc

SEQ ID NO: 2676772 - DNA, 19 bp, Homo sapiens
ggctgtccgtgtgcctcct

SEQ ID NO: 2676773 - DNA, 13 bp, Homo sapiens
ggcttccagagag

SEQ ID NO: 2676774 - DNA, 21 bp, Homo sapiens
gggaaaacacggccctcctgg

SEQ ID NO: 2676775 - DNA, 22 bp, Homo sapiens
gggaaaacacggccctcctggg

SEQ ID NO: 2676776 - DNA, 23 bp, Homo sapiens
gggaaagtcagctttcagagcca

SEQ ID NO: 2676777 - DNA, 21 bp, Homo sapiens
gggaacctccttacctggagt

SEQ ID NO: 2676778 - DNA, 21 bp, Homo sapiens
gggaatgtgtcctcctgctct

SEQ ID NO: 2676779 - DNA, 16 bp, Homo sapiens
gggacagaccagcagc

SEQ ID NO: 2676780 - DNA, 20 bp, Homo sapiens
gggacagctgctgggaccca

SEQ ID NO: 2676781 - DNA, 17 bp, Homo sapiens
gggacccacctccccct

SEQ ID NO: 2676782 - DNA, 22 bp, Homo sapiens
gggaccttgtgggaccagtccc

SEQ ID NO: 2676783 - DNA, 12 bp, Homo sapiens
gggagagcccag

SEQ ID NO: 2676784 - DNA, 13 bp, Homo sapiens
gggagccagttct

SEQ ID NO: 2676785 - DNA, 14 bp, Homo sapiens
gggagccagttctg

SEQ ID NO: 2676786 - DNA, 14 bp, Homo sapiens
gggaggctgaggcg

SEQ ID NO: 2676787 - DNA, 16 bp, Homo sapiens
gggataaactgagcct

SEQ ID NO: 2676788 - DNA, 16 bp, Homo sapiens
gggatggggatgcttc

SEQ ID NO: 2676789 - DNA, 13 bp, Homo sapiens
gggcagagccggg

SEQ ID NO: 2676790 - DNA, 17 bp, Homo sapiens
gggcagagccgggaagc

SEQ ID NO: 2676791 - DNA, 15 bp, Homo sapiens
gggcatcctgcttcc

SEQ ID NO: 2676792 - DNA, 17 bp, Homo sapiens
gggcatcctgcttcctg

SEQ ID NO: 2676793 - DNA, 14 bp, Homo sapiens
gggcatgctggggc

SEQ ID NO: 2676794 - DNA, 17 bp, Homo sapiens
gggcatgctggggcaag

SEQ ID NO: 2676795 - DNA, 16 bp, Homo sapiens
gggccaaagcacagct

SEQ ID NO: 2676796 - DNA, 19 bp, Homo sapiens
gggccaaagcacagctggg

SEQ ID NO: 2676797 - DNA, 13 bp, Homo sapiens
gggccagggccct

SEQ ID NO: 2676798 - DNA, 18 bp, Homo sapiens
gggccagggccctgcaga

SEQ ID NO: 2676799 - DNA, 13 bp, Homo sapiens
gggcccaggcagg

SEQ ID NO: 2676800 - DNA, 16 bp, Homo sapiens
gggcccctgcctgcct

SEQ ID NO: 2676801 - DNA, 14 bp, Homo sapiens
gggcccgcctgcca

SEQ ID NO: 2676802 - DNA, 18 bp, Homo sapiens
gggcccgcctgccacctc

SEQ ID NO: 2676803 - DNA, 15 bp, Homo sapiens
gggcgctgcagcctc

SEQ ID NO: 2676804 - DNA, 13 bp, Homo sapiens
gggcgtgcctgcc

SEQ ID NO: 2676805 - DNA, 17 bp, Homo sapiens
gggctcccggcatcctg

SEQ ID NO: 2676806 - DNA, 18 bp, Homo sapiens
gggctcccggcatcctga

SEQ ID NO: 2676807 - DNA, 20 bp, Homo sapiens
gggctcctggaaaggctcag

SEQ ID NO: 2676808 - DNA, 14 bp, Homo sapiens
gggctgctggcctg

SEQ ID NO: 2676809 - DNA, 20 bp, Homo sapiens
gggctgctggcctggccctt

SEQ ID NO: 2676810 - DNA, 22 bp, Homo sapiens
gggctggctggagtctcagagc

SEQ ID NO: 2676811 - DNA, 21 bp, Homo sapiens
gggctgtccgtgtgcctcctg

SEQ ID NO: 2676812 - DNA, 15 bp, Homo sapiens
gggctttctggagag

SEQ ID NO: 2676813 - DNA, 22 bp, Homo sapiens
ggggaatgtgtcctcctgctct

SEQ ID NO: 2676814 - DNA, 19 bp, Homo sapiens
ggggaggatcactggagcc

SEQ ID NO: 2676815 - DNA, 20 bp, Homo sapiens
ggggagggtcaagggctggg

SEQ ID NO: 2676816 - DNA, 12 bp, Homo sapiens
ggggcagctcct

SEQ ID NO: 2676817 - DNA, 14 bp, Homo sapiens
ggggcagctcctga

SEQ ID NO: 2676818 - DNA, 18 bp, Homo sapiens
ggggcagctcctgaccaa

SEQ ID NO: 2676819 - DNA, 18 bp, Homo sapiens
ggggcatcctgcttcctg

SEQ ID NO: 2676820 - DNA, 16 bp, Homo sapiens
ggggcatgctggggca

SEQ ID NO: 2676821 - DNA, 12 bp, Homo sapiens
ggggccagcact

SEQ ID NO: 2676822 - DNA, 14 bp, Homo sapiens
ggggcccgcctgcc

SEQ ID NO: 2676823 - DNA, 13 bp, Homo sapiens
ggggctcctggaa

SEQ ID NO: 2676824 - DNA, 21 bp, Homo sapiens
gggggcgtgcctgccaagctc

SEQ ID NO: 2676825 - DNA, 12 bp, Homo sapiens
ggggttcaagcc

SEQ ID NO: 2676826 - DNA, 18 bp, Homo sapiens
gggtaacagtgaggctgg

SEQ ID NO: 2676827 - DNA, 20 bp, Homo sapiens
gggtaacagtgaggctggga

SEQ ID NO: 2676828 - DNA, 23 bp, Homo sapiens
gggtatcaggactgtgaccaaag

SEQ ID NO: 2676829 - DNA, 16 bp, Homo sapiens
gggtcaagggctgggg

SEQ ID NO: 2676830 - DNA, 12 bp, Homo sapiens
gggtcagcccag

SEQ ID NO: 2676831 - DNA, 23 bp, Homo sapiens
gggtgacatcccaggaggggcct

SEQ ID NO: 2676832 - DNA, 18 bp, Homo sapiens
gggtggaagtgcccagcc

SEQ ID NO: 2676833 - DNA, 23 bp, Homo sapiens
gggttctgagaagcgctgccctg

SEQ ID NO: 2676834 - DNA, 12 bp, Homo sapiens
gggttttgtatt

SEQ ID NO: 2676835 - DNA, 23 bp, Homo sapiens
ggtaaaaagattatatatcataa

SEQ ID NO: 2676836 - DNA, 15 bp, Homo sapiens
ggtaacagtgaggct

SEQ ID NO: 2676837 - DNA, 17 bp, Homo sapiens
ggtaacagtgaggctgg

SEQ ID NO: 2676838 - DNA, 16 bp, Homo sapiens
ggtatgaacttgagga

SEQ ID NO: 2676839 - DNA, 21 bp, Homo sapiens
ggtatgaacttgaggacacat

SEQ ID NO: 2676840 - DNA, 23 bp, Homo sapiens
ggtatgaacttgaggacacatgt

SEQ ID NO: 2676841 - DNA, 12 bp, Homo sapiens
ggtcacaggctg

SEQ ID NO: 2676842 - DNA, 13 bp, Homo sapiens
ggtcacaggctgt

SEQ ID NO: 2676843 - DNA, 15 bp, Homo sapiens
ggtcacaggctgtgc

SEQ ID NO: 2676844 - DNA, 13 bp, Homo sapiens
ggtcagcccagca

SEQ ID NO: 2676845 - DNA, 19 bp, Homo sapiens
ggtcagcccagcacctgct

SEQ ID NO: 2676846 - DNA, 15 bp, Homo sapiens
ggtccctgccctccc

SEQ ID NO: 2676847 - DNA, 18 bp, Homo sapiens
ggtccctgccctcccctg

SEQ ID NO: 2676848 - DNA, 19 bp, Homo sapiens
ggtcctcacttctgtctcc

SEQ ID NO: 2676849 - DNA, 23 bp, Homo sapiens
ggtcctggggctctgtgcaggga

SEQ ID NO: 2676850 - DNA, 15 bp, Homo sapiens
ggtcgagctgtgctc

SEQ ID NO: 2676851 - DNA, 16 bp, Homo sapiens
ggtctccacctgtgct

SEQ ID NO: 2676852 - DNA, 24 bp, Homo sapiens
ggtctgatgccaaagctgctttct

SEQ ID NO: 2676853 - DNA, 15 bp, Homo sapiens
ggtctggtgctgagg

SEQ ID NO: 2676854 - DNA, 14 bp, Homo sapiens
ggtgagaccacctc

SEQ ID NO: 2676855 - DNA, 16 bp, Homo sapiens
ggtgccaccaataaaa

SEQ ID NO: 2676856 - DNA, 15 bp, Homo sapiens
ggtgctgatggccct

SEQ ID NO: 2676857 - DNA, 16 bp, Homo sapiens
ggtgctgatggccctc

SEQ ID NO: 2676858 - DNA, 15 bp, Homo sapiens
ggtggaagtgcccag

SEQ ID NO: 2676859 - DNA, 17 bp, Homo sapiens
ggtggaagtgcccagcc

SEQ ID NO: 2676860 - DNA, 20 bp, Homo sapiens
ggtggaggttgcagtgagcc

SEQ ID NO: 2676861 - DNA, 21 bp, Homo sapiens
ggtggaggttgcagtgagcca

SEQ ID NO: 2676862 - DNA, 20 bp, Homo sapiens
ggtgtgaaagtcagatgccc

SEQ ID NO: 2676863 - DNA, 22 bp, Homo sapiens
ggttctgagaagcgctgccctg

SEQ ID NO: 2676864 - DNA, 23 bp, Homo sapiens
ggttctgagaagcgctgccctgt

SEQ ID NO: 2676865 - DNA, 15 bp, Homo sapiens
ggtttttggctcttt

SEQ ID NO: 2676866 - DNA, 21 bp, Homo sapiens
gtaaaaagattatatatcata

SEQ ID NO: 2676867 - DNA, 11 bp, Homo sapiens
gtaaacactgt

SEQ ID NO: 2676868 - DNA, 21 bp, Homo sapiens
gtaaactgtatcaaatctgta

SEQ ID NO: 2676869 - DNA, 19 bp, Homo sapiens
ggactaacataaaatctgt

SEQ ID NO: 2676870 - DNA, 19 bp, Homo sapiens
ggactccctccatgtggcc

SEQ ID NO: 2676871 - DNA, 21 bp, Homo sapiens
ggactctgaggctctttctgg

SEQ ID NO: 2676872 - DNA, 14 bp, Homo sapiens
ggactgtgaccaaa

SEQ ID NO: 2676873 - DNA, 17 bp, Homo sapiens
ggacttccttaagcatg

SEQ ID NO: 2676874 - DNA, 15 bp, Homo sapiens
ggagaacctcaggct

SEQ ID NO: 2676875 - DNA, 12 bp, Homo sapiens
ggagagcccagc

SEQ ID NO: 2676876 - DNA, 15 bp, Homo sapiens
ggagcaaatgtttct

SEQ ID NO: 2676877 - DNA, 15 bp, Homo sapiens
ggagcaagctctgcc

SEQ ID NO: 2676878 - DNA, 22 bp, Homo sapiens
ggagcaagctctgccctggctg

SEQ ID NO: 2676879 - DNA, 21 bp, Homo sapiens
ggagccgagatcacgccactg

SEQ ID NO: 2676880 - DNA, 15 bp, Homo sapiens
ggagcgcacctgccc

SEQ ID NO: 2676881 - DNA, 21 bp, Homo sapiens
ggagcgcacctgccccctggt

SEQ ID NO: 2676882 - DNA, 13 bp, Homo sapiens
ggagcttgcagtg

SEQ ID NO: 2676883 - DNA, 19 bp, Homo sapiens
ggaggaagcaggttgaggg

SEQ ID NO: 2676884 - DNA, 17 bp, Homo sapiens
ggaggatcactggagcc

SEQ ID NO: 2676885 - DNA, 19 bp, Homo sapiens
ggaggatcactggagccca

SEQ ID NO: 2676886 - DNA, 21 bp, Homo sapiens
ggaggatcactggagcccagg

SEQ ID NO: 2676887 - DNA, 22 bp, Homo sapiens
ggaggatcactggagcccagga

SEQ ID NO: 2676888 - DNA, 15 bp, Homo sapiens
ggaggccccaggctg

SEQ ID NO: 2676889 - DNA, 16 bp, Homo sapiens
ggaggctgaggcagga

SEQ ID NO: 2676890 - DNA, 21 bp, Homo sapiens
ggagggatgctgcctgagtca

SEQ ID NO: 2676891 - DNA, 13 bp, Homo sapiens
ggaggggcccacc

SEQ ID NO: 2676892 - DNA, 16 bp, Homo sapiens
ggaggggcccacccac

SEQ ID NO: 2676893 - DNA, 15 bp, Homo sapiens
ggaggggcctctgaa

SEQ ID NO: 2676894 - DNA, 19 bp, Homo sapiens
ggagggtcaagggctgggg

SEQ ID NO: 2676895 - DNA, 15 bp, Homo sapiens
ggaggtggcagccct

SEQ ID NO: 2676896 - DNA, 16 bp, Homo sapiens
ggaggttggtgactga

SEQ ID NO: 2676897 - DNA, 21 bp, Homo sapiens
ggagtctccagtggttgctgt

SEQ ID NO: 2676898 - DNA, 20 bp, Homo sapiens
ggataacttccttgcccctg

SEQ ID NO: 2676899 - DNA, 21 bp, Homo sapiens
ggataacttccttgcccctgc

SEQ ID NO: 2676900 - DNA, 22 bp, Homo sapiens
ggataacttccttgcccctgct

SEQ ID NO: 2676901 - DNA, 23 bp, Homo sapiens
ggataacttccttgcccctgctc

SEQ ID NO: 2676902 - DNA, 16 bp, Homo sapiens
ggatcactctctgctg

SEQ ID NO: 2676903 - DNA, 17 bp, Homo sapiens
ggatcactctctgctgg

SEQ ID NO: 2676904 - DNA, 14 bp, Homo sapiens
ggatcactggagcc

SEQ ID NO: 2676905 - DNA, 17 bp, Homo sapiens
ggatcactggagcccag

SEQ ID NO: 2676906 - DNA, 22 bp, Homo sapiens
ggatgatgtgtgaaacctgaca

SEQ ID NO: 2676907 - DNA, 19 bp, Homo sapiens
ggatgggatcccaggccag

SEQ ID NO: 2676908 - DNA, 20 bp, Homo sapiens
ggatggtcctggggctctgt

SEQ ID NO: 2676909 - DNA, 22 bp, Homo sapiens
ggatggtcctggggctctgtgc

SEQ ID NO: 2676910 - DNA, 18 bp, Homo sapiens
ggatggtctccacctgtg

SEQ ID NO: 2676911 - DNA, 19 bp, Homo sapiens
ggatggtctccacctgtgc

SEQ ID NO: 2676912 - DNA, 20 bp, Homo sapiens
ggatggtctccacctgtgct

SEQ ID NO: 2676913 - DNA, 13 bp, Homo sapiens
ggattctgggagg

SEQ ID NO: 2676914 - DNA, 19 bp, Homo sapiens
ggattctgggaggaagcag

SEQ ID NO: 2676915 - DNA, 22 bp, Homo sapiens
ggcaccagaggctgcagaaggc

SEQ ID NO: 2676916 - DNA, 13 bp, Homo sapiens
ggcacccaggcct

SEQ ID NO: 2676917 - DNA, 18 bp, Homo sapiens
ggcacccaggcctccctg

SEQ ID NO: 2676918 - DNA, 14 bp, Homo sapiens
ggcaccggcctcta

SEQ ID NO: 2676919 - DNA, 18 bp, Homo sapiens
ggcacctatagtcccagc

SEQ ID NO: 2676920 - DNA, 16 bp, Homo sapiens
ggcacgtctcctgctg

SEQ ID NO: 2676921 - DNA, 17 bp, Homo sapiens
ggcacgtctcctgctgc

SEQ ID NO: 2676922 - DNA, 18 bp, Homo sapiens
ggcacgtctcctgctgcg

SEQ ID NO: 2676923 - DNA, 21 bp, Homo sapiens
ggcacgtctcctgctgcgtga

SEQ ID NO: 2676924 - DNA, 21 bp, Homo sapiens
ggcagaacgatgcctgcaggc

SEQ ID NO: 2676925 - DNA, 22 bp, Homo sapiens
ggcagaatgacttttattgagc

SEQ ID NO: 2676926 - DNA, 15 bp, Homo sapiens
ggcagccctgtaggg

SEQ ID NO: 2676927 - DNA, 22 bp, Homo sapiens
ggcagcctccttgcctggaact

SEQ ID NO: 2676928 - DNA, 18 bp, Homo sapiens
ggcagctcctgaccaaag

SEQ ID NO: 2676929 - DNA, 15 bp, Homo sapiens
ggcaggatgaccctg

SEQ ID NO: 2676930 - DNA, 20 bp, Homo sapiens
ggcaggattcttcccatgga

SEQ ID NO: 2676931 - DNA, 20 bp, Homo sapiens
ggcaggattcttcccgctcc

SEQ ID NO: 2676932 - DNA, 18 bp, Homo sapiens
ggcaggtgagaacccaga

SEQ ID NO: 2676933 - DNA, 16 bp, Homo sapiens
ggcatcacagggcaga

SEQ ID NO: 2676934 - DNA, 17 bp, Homo sapiens
ggcatcacagggcagag

SEQ ID NO: 2676935 - DNA, 13 bp, Homo sapiens
ggcatcctgcttc

SEQ ID NO: 2676936 - DNA, 16 bp, Homo sapiens
ggcatcctgcttcctg

SEQ ID NO: 2676937 - DNA, 20 bp, Homo sapiens
ggcatctagccagaggctgg

SEQ ID NO: 2676938 - DNA, 15 bp, Homo sapiens
ggcatctctaattgg

SEQ ID NO: 2676939 - DNA, 13 bp, Homo sapiens
ggcattcctgctt

SEQ ID NO: 2676940 - DNA, 13 bp, Homo sapiens
ggccaaagcacag

SEQ ID NO: 2676941 - DNA, 19 bp, Homo sapiens
ggccaaagcacagctgggc

SEQ ID NO: 2676942 - DNA, 19 bp, Homo sapiens
ggccacctagaagtctccc

SEQ ID NO: 2676943 - DNA, 22 bp, Homo sapiens
ggccacctagaagtctccctgc

SEQ ID NO: 2676944 - DNA, 18 bp, Homo sapiens
ggccagggaaagcccgtg

SEQ ID NO: 2676945 - DNA, 23 bp, Homo sapiens
ggccaggggttctgagaagcgct

SEQ ID NO: 2676946 - DNA, 20 bp, Homo sapiens
ggccagtcctagagctcctg

SEQ ID NO: 2676947 - DNA, 13 bp, Homo sapiens
ggcccacccacat

SEQ ID NO: 2676948 - DNA, 13 bp, Homo sapiens
ggcccctccagca

SEQ ID NO: 2676949 - DNA, 17 bp, Homo sapiens
ggcccgcctgccacctc

SEQ ID NO: 2676950 - DNA, 18 bp, Homo sapiens
ggcccgcctgccacctct

SEQ ID NO: 2676951 - DNA, 14 bp, Homo sapiens
ggccctcctgggaa

SEQ ID NO: 2676952 - DNA, 12 bp, Homo sapiens
ggccctggtcct

SEQ ID NO: 2676953 - DNA, 17 bp, Homo sapiens
ggccctggtccttccag

SEQ ID NO: 2676954 - DNA, 15 bp, Homo sapiens
ggccgtgaggacacg

SEQ ID NO: 2676955 - DNA, 23 bp, Homo sapiens
ggcctctagaacacccactggcc

SEQ ID NO: 2676956 - DNA, 17 bp, Homo sapiens
ggcctctgaaatttccc

SEQ ID NO: 2676957 - DNA, 17 bp, Homo sapiens
ggcctgattcactggcc

SEQ ID NO: 2676958 - DNA, 19 bp, Homo sapiens
ggcctgattcactggcctg

SEQ ID NO: 2676959 - DNA, 15 bp, Homo sapiens
ggcctgccctctgcc

SEQ ID NO: 2676960 - DNA, 16 bp, Homo sapiens
ggcctgccctctgccc

SEQ ID NO: 2676961 - DNA, 18 bp, Homo sapiens
ggcctgccctctgcccca

SEQ ID NO: 2676962 - DNA, 19 bp, Homo sapiens
ggcctggactgactgcagc

SEQ ID NO: 2676963 - DNA, 21 bp, Homo sapiens
ggcctggactgactgcagccc

SEQ ID NO: 2676964 - DNA, 23 bp, Homo sapiens
ggcgaggcctgacacaggccagc

SEQ ID NO: 2676965 - DNA, 14 bp, Homo sapiens
ggcgctgcagcctc

SEQ ID NO: 2676966 - DNA, 15 bp, Homo sapiens
ggcgctgcagcctcc

SEQ ID NO: 2676967 - DNA, 16 bp, Homo sapiens
ggcgctgcagcctccc

SEQ ID NO: 2676968 - DNA, 21 bp, Homo sapiens
ggcgctgcagcctcccttcca

SEQ ID NO: 2676969 - DNA, 20 bp, Homo sapiens
ggcgtgggcgaggcctgaca

SEQ ID NO: 2676970 - DNA, 16 bp, Homo sapiens
ggcgtggtggcgggca

SEQ ID NO: 2676971 - DNA, 20 bp, Homo sapiens
ggctcacgcctatgatccca

SEQ ID NO: 2676972 - DNA, 15 bp, Homo sapiens
ggctcagtctcagga

SEQ ID NO: 2676973 - DNA, 17 bp, Homo sapiens
ggctcagtctcaggagc

SEQ ID NO: 2676974 - DNA, 13 bp, Homo sapiens
ggctccatgcacc

SEQ ID NO: 2676975 - DNA, 17 bp, Homo sapiens
ggctccatgcacctccc

SEQ ID NO: 2676976 - DNA, 22 bp, Homo sapiens
ggctccatgcacctcccttccc

SEQ ID NO: 2676977 - DNA, 19 bp, Homo sapiens
ggctcccgcttgctctcct

SEQ ID NO: 2676978 - DNA, 21 bp, Homo sapiens
ggctcccgcttgctctcctgg

SEQ ID NO: 2676979 - DNA, 17 bp, Homo sapiens
ggctcccggcatcctga

SEQ ID NO: 2676980 - DNA, 17 bp, Homo sapiens
ctccccttttgcccccg

SEQ ID NO: 2676981 - DNA, 18 bp, Homo sapiens
ctccccttttgcccccgt

SEQ ID NO: 2676982 - DNA, 12 bp, Homo sapiens
ctcccgcttgct

SEQ ID NO: 2676983 - DNA, 18 bp, Homo sapiens
ctcccggcatcctgaaag

SEQ ID NO: 2676984 - DNA, 16 bp, Homo sapiens
ctccctccatgtggcc

SEQ ID NO: 2676985 - DNA, 14 bp, Homo sapiens
ctccctctgacctg

SEQ ID NO: 2676986 - DNA, 17 bp, Homo sapiens
ctccctctgacctgcag

SEQ ID NO: 2676987 - DNA, 18 bp, Homo sapiens
ctccctctgacctgcagg

SEQ ID NO: 2676988 - DNA, 21 bp, Homo sapiens
ctccctctttctcagttcctc

SEQ ID NO: 2676989 - DNA, 11 bp, Homo sapiens
ctccctgcaca

SEQ ID NO: 2676990 - DNA, 17 bp, Homo sapiens
ctccctgcacagcctct

SEQ ID NO: 2676991 - DNA, 16 bp, Homo sapiens
ctccctgcagactcca

SEQ ID NO: 2676992 - DNA, 13 bp, Homo sapiens
ctccctgctccca

SEQ ID NO: 2676993 - DNA, 14 bp, Homo sapiens
ctccctgctcccag

SEQ ID NO: 2676994 - DNA, 15 bp, Homo sapiens
ctccctgctcccagg

SEQ ID NO: 2676995 - DNA, 16 bp, Homo sapiens
ctccctgctcccaggg

SEQ ID NO: 2676996 - DNA, 19 bp, Homo sapiens
ctcccttccatgccccagg

SEQ ID NO: 2676997 - DNA, 16 bp, Homo sapiens
ctcccttccctccctg

SEQ ID NO: 2676998 - DNA, 13 bp, Homo sapiens
ctcccttgccctc

SEQ ID NO: 2676999 - DNA, 14 bp, Homo sapiens
ctcccttgccctcc

SEQ ID NO: 2677000 - DNA, 15 bp, Homo sapiens
ctcccttgccctccc

SEQ ID NO: 2677001 - DNA, 15 bp, Homo sapiens
ctccctttctctctc

SEQ ID NO: 2677002 - DNA, 17 bp, Homo sapiens
ctccgatgctgaggcca

SEQ ID NO: 2677003 - DNA, 20 bp, Homo sapiens
ctccgatgctgaggccaccc

SEQ ID NO: 2677004 - DNA, 22 bp, Homo sapiens
ctccgtcgggcccctgcctgcc

SEQ ID NO: 2677005 - DNA, 12 bp, Homo sapiens
ctcctacctcag

SEQ ID NO: 2677006 - DNA, 13 bp, Homo sapiens
ctcctacctcagc

SEQ ID NO: 2677007 - DNA, 18 bp, Homo sapiens
ctcctatgctttagctta

SEQ ID NO: 2677008 - DNA, 13 bp, Homo sapiens
ctcctgaccaaag

SEQ ID NO: 2677009 - DNA, 19 bp, Homo sapiens
ctcctgctctgcttcctca

SEQ ID NO: 2677010 - DNA, 20 bp, Homo sapiens
ctcctgctctgcttcctcag

SEQ ID NO: 2677011 - DNA, 21 bp, Homo sapiens
ctcctgctctgcttcctcagg

SEQ ID NO: 2677012 - DNA, 18 bp, Homo sapiens
ctcctggaaaggctcagt

SEQ ID NO: 2677013 - DNA, 15 bp, Homo sapiens
ctcctggagcaagct

SEQ ID NO: 2677014 - DNA, 19 bp, Homo sapiens
ctcctggagcaagctctgc

SEQ ID NO: 2677015 - DNA, 21 bp, Homo sapiens
ctcctggagcaagctctgccc

SEQ ID NO: 2677016 - DNA, 18 bp, Homo sapiens
ctcctgggaacctcctta

SEQ ID NO: 2677017 - DNA, 14 bp, Homo sapiens
ctcctgtccctacc

SEQ ID NO: 2677018 - DNA, 15 bp, Homo sapiens
ctcctgtccctaccc

SEQ ID NO: 2677019 - DNA, 17 bp, Homo sapiens
ctcctgtccctacccac

SEQ ID NO: 2677020 - DNA, 18 bp, Homo sapiens
ctcctgtccctacccact

SEQ ID NO: 2677021 - DNA, 19 bp, Homo sapiens
ctcctgtccctacccactc

SEQ ID NO: 2677022 - DNA, 20 bp, Homo sapiens
ctcctgtccctacccactct

SEQ ID NO: 2677023 - DNA, 18 bp, Homo sapiens
ctcctgtcttcagagcaa

SEQ ID NO: 2677024 - DNA, 23 bp, Homo sapiens
ctcctgtgtgtctgcagacaagt

SEQ ID NO: 2677025 - DNA, 13 bp, Homo sapiens
ctccttgcctgga

SEQ ID NO: 2677026 - DNA, 20 bp, Homo sapiens
ctcctttcttattctgtgag

SEQ ID NO: 2677027 - DNA, 18 bp, Homo sapiens
gctggattaatgttttgt

SEQ ID NO: 2677028 - DNA, 18 bp, Homo sapiens
gctggcaggattcttccc

SEQ ID NO: 2677029 - DNA, 14 bp, Homo sapiens
gctggcctggccct

SEQ ID NO: 2677030 - DNA, 18 bp, Homo sapiens
gctggctggagtctcaga

SEQ ID NO: 2677031 - DNA, 20 bp, Homo sapiens
gctggctggagtctcagagc

SEQ ID NO: 2677032 - DNA, 17 bp, Homo sapiens
gctggggcaagtccctg

SEQ ID NO: 2677033 - DNA, 21 bp, Homo sapiens
gctggtccctgccctcccctg

SEQ ID NO: 2677034 - DNA, 22 bp, Homo sapiens
gctgtccgtgtgcctcctgtgt

SEQ ID NO: 2677035 - DNA, 16 bp, Homo sapiens
gctgtcctaggccaca

SEQ ID NO: 2677036 - DNA, 21 bp, Homo sapiens
gctgtgctcttcctctggttt

SEQ ID NO: 2677037 - DNA, 22 bp, Homo sapiens
gcttaaattgcttttgttgtga

SEQ ID NO: 2677038 - DNA, 20 bp, Homo sapiens
gcttagatgagggtgactgt

SEQ ID NO: 2677039 - DNA, 15 bp, Homo sapiens
gcttagctttctgga

SEQ ID NO: 2677040 - DNA, 17 bp, Homo sapiens
gcttatgctcagaagcc

SEQ ID NO: 2677041 - DNA, 14 bp, Homo sapiens
gcttcctcagggcc

SEQ ID NO: 2677042 - DNA, 15 bp, Homo sapiens
gcttcctgaaagctg

SEQ ID NO: 2677043 - DNA, 16 bp, Homo sapiens
gcttcctgaaagctgt

SEQ ID NO: 2677044 - DNA, 14 bp, Homo sapiens
gcttcctgggtcct

SEQ ID NO: 2677045 - DNA, 18 bp, Homo sapiens
gcttcctgggtcctgcct

SEQ ID NO: 2677046 - DNA, 16 bp, Homo sapiens
gcttcctttcaggcca

SEQ ID NO: 2677047 - DNA, 12 bp, Homo sapiens
gcttcggacagt

SEQ ID NO: 2677048 - DNA, 14 bp, Homo sapiens
gcttctggagccct

SEQ ID NO: 2677049 - DNA, 13 bp, Homo sapiens
gcttgctctcctg

SEQ ID NO: 2677050 - DNA, 15 bp, Homo sapiens
gcttgctctcctgga

SEQ ID NO: 2677051 - DNA, 21 bp, Homo sapiens
gcttggaaagcatcacctcag

SEQ ID NO: 2677052 - DNA, 18 bp, Homo sapiens
gctttcttctctgcctcc

SEQ ID NO: 2677053 - DNA, 20 bp, Homo sapiens
gctttcttctctgcctcctc

SEQ ID NO: 2677054 - DNA, 14 bp, Homo sapiens
gctttgactcacct

SEQ ID NO: 2677055 - DNA, 19 bp, Homo sapiens
gctttgttgtcctcccagg

SEQ ID NO: 2677056 - DNA, 14 bp, Homo sapiens
gctttgttttatat

SEQ ID NO: 2677057 - DNA, 15 bp, Homo sapiens
gcttttaagaaacac

SEQ ID NO: 2677058 - DNA, 19 bp, Homo sapiens
gcttttaagaaacacaggg

SEQ ID NO: 2677059 - DNA, 18 bp, Homo sapiens
ggaaaacacggccctcct

SEQ ID NO: 2677060 - DNA, 13 bp, Homo sapiens
ggaaagcctctgc

SEQ ID NO: 2677061 - DNA, 15 bp, Homo sapiens
ggaaatattctatga

SEQ ID NO: 2677062 - DNA, 13 bp, Homo sapiens
ggaaccagagggg

SEQ ID NO: 2677063 - DNA, 22 bp, Homo sapiens
ggaaccagtgtaactggctgct

SEQ ID NO: 2677064 - DNA, 13 bp, Homo sapiens
ggaacctccttac

SEQ ID NO: 2677065 - DNA, 18 bp, Homo sapiens
ggaagaaacactcttatt

SEQ ID NO: 2677066 - DNA, 23 bp, Homo sapiens
ggaagaaattcctgtagcatctt

SEQ ID NO: 2677067 - DNA, 12 bp, Homo sapiens
ggaagtgttcaa

SEQ ID NO: 2677068 - DNA, 18 bp, Homo sapiens
ggaatgtgtcctcctgct

SEQ ID NO: 2677069 - DNA, 19 bp, Homo sapiens
ggaatgtgtcctcctgctc

SEQ ID NO: 2677070 - DNA, 13 bp, Homo sapiens
ggacacaagcggc

SEQ ID NO: 2677071 - DNA, 12 bp, Homo sapiens
ggacacctgccc

SEQ ID NO: 2677072 - DNA, 23 bp, Homo sapiens
ggacaccttagacggaggtgcct

SEQ ID NO: 2677073 - DNA, 15 bp, Homo sapiens
ggacagaccagcagc

SEQ ID NO: 2677074 - DNA, 13 bp, Homo sapiens
ggacagtcctggg

SEQ ID NO: 2677075 - DNA, 16 bp, Homo sapiens
ggacagtcctgggaga

SEQ ID NO: 2677076 - DNA, 21 bp, Homo sapiens
ggacagtgcttcagcctgagg

SEQ ID NO: 2677077 - DNA, 12 bp, Homo sapiens
ggaccaaagcca

SEQ ID NO: 2677078 - DNA, 14 bp, Homo sapiens
ggaccaaagccacc

SEQ ID NO: 2677079 - DNA, 22 bp, Homo sapiens
ggaccaaccctgtttcctgagt

SEQ ID NO: 2677080 - DNA, 15 bp, Homo sapiens
ggacccgctctggac

SEQ ID NO: 2677081 - DNA, 13 bp, Homo sapiens
ggacctctgctct

SEQ ID NO: 2677082 - DNA, 16 bp, Homo sapiens
ggacctctgctctgag

SEQ ID NO: 2677083 - DNA, 18 bp, Homo sapiens
ggactaacataaaatctg

SEQ ID NO: 2677084 - DNA, 18 bp, Homo sapiens
agcacacctcagccccac

SEQ ID NO: 2677085 - DNA, 20 bp, Homo sapiens
agcacacctcagccccactg

SEQ ID NO: 2677086 - DNA, 16 bp, Homo sapiens
agcacagcgtttacat

SEQ ID NO: 2677087 - DNA, 17 bp, Homo sapiens
agcacagctgggcatgc

SEQ ID NO: 2677088 - DNA, 19 bp, Homo sapiens
agcactggaggggcccacc

SEQ ID NO: 2677089 - DNA, 21 bp, Homo sapiens
agcactttgggaggccgaggc

SEQ ID NO: 2677090 - DNA, 15 bp, Homo sapiens
agcagcatagaacag

SEQ ID NO: 2677091 - DNA, 14 bp, Homo sapiens
agcaggcagggctg

SEQ ID NO: 2677092 - DNA, 18 bp, Homo sapiens
agcaggcagggctgggcc

SEQ ID NO: 2677093 - DNA, 20 bp, Homo sapiens
agcagggccaaagcacagct

SEQ ID NO: 2677094 - DNA, 16 bp, Homo sapiens
agcaggtggcatctct

SEQ ID NO: 2677095 - DNA, 18 bp, Homo sapiens
agcaggtgtgaccctgag

SEQ ID NO: 2677096 - DNA, 15 bp, Homo sapiens
agcatcacctcaggc

SEQ ID NO: 2677097 - DNA, 19 bp, Homo sapiens
agcatccttttctgcagag

SEQ ID NO: 2677098 - DNA, 15 bp, Homo sapiens
agcatcttctggagt

SEQ ID NO: 2677099 - DNA, 21 bp, Homo sapiens
agcatcttttccatcctgagg

SEQ ID NO: 2677100 - DNA, 23 bp, Homo sapiens
agcatcttttccatcctgaggtg

SEQ ID NO: 2677101 - DNA, 13 bp, Homo sapiens
agcatggcctgga

SEQ ID NO: 2677102 - DNA, 22 bp, Homo sapiens
agcattagctacttttcagaat

SEQ ID NO: 2677103 - DNA, 19 bp, Homo sapiens
agcattgtcagcctgaaga

SEQ ID NO: 2677104 - DNA, 10 bp, Homo sapiens
agccacagaa

SEQ ID NO: 2677105 - DNA, 23 bp, Homo sapiens
agccacagaagccaggagcaaat

SEQ ID NO: 2677106 - DNA, 13 bp, Homo sapiens
agccacctccttg

SEQ ID NO: 2677107 - DNA, 14 bp, Homo sapiens
agccacctgctgcg

SEQ ID NO: 2677108 - DNA, 17 bp, Homo sapiens
agccacgctggccttcg

SEQ ID NO: 2677109 - DNA, 16 bp, Homo sapiens
agccactgaagctggg

SEQ ID NO: 2677110 - DNA, 16 bp, Homo sapiens
agccagaaacgcagat

SEQ ID NO: 2677111 - DNA, 14 bp, Homo sapiens
agccagaggctgga

SEQ ID NO: 2677112 - DNA, 18 bp, Homo sapiens
agccagaggctggagaca

SEQ ID NO: 2677113 - DNA, 17 bp, Homo sapiens
agccagatgcctcccca

SEQ ID NO: 2677114 - DNA, 14 bp, Homo sapiens
agccagcaaagcct

SEQ ID NO: 2677115 - DNA, 17 bp, Homo sapiens
agccagcaaagcctcca

SEQ ID NO: 2677116 - DNA, 19 bp, Homo sapiens
agccagcaaagcctccagc

SEQ ID NO: 2677117 - DNA, 22 bp, Homo sapiens
agccagcaaagcctccagcatc

SEQ ID NO: 2677118 - DNA, 12 bp, Homo sapiens
agccagtgactt

SEQ ID NO: 2677119 - DNA, 22 bp, Homo sapiens
agccagttctggggcccgcctg

SEQ ID NO: 2677120 - DNA, 16 bp, Homo sapiens
agccatcacctaggac

SEQ ID NO: 2677121 - DNA, 19 bp, Homo sapiens
agccatcacctaggactga

SEQ ID NO: 2677122 - DNA, 18 bp, Homo sapiens
agccatccaaagaaacac

SEQ ID NO: 2677123 - DNA, 18 bp, Homo sapiens
agccattaccatggagac

SEQ ID NO: 2677124 - DNA, 22 bp, Homo sapiens
agccattctgtgtgtgactctg

SEQ ID NO: 2677125 - DNA, 17 bp, Homo sapiens
agcccagcacctgctcc

SEQ ID NO: 2677126 - DNA, 18 bp, Homo sapiens
agcccagcacctgctccc

SEQ ID NO: 2677127 - DNA, 23 bp, Homo sapiens
agcccagccattaccatggagac

SEQ ID NO: 2677128 - DNA, 14 bp, Homo sapiens
agcccagctggcca

SEQ ID NO: 2677129 - DNA, 15 bp, Homo sapiens
agcccagctggccac

SEQ ID NO: 2677130 - DNA, 15 bp, Homo sapiens
agcccaggcttcctg

SEQ ID NO: 2677131 - DNA, 16 bp, Homo sapiens
agcccatggcctctgg

SEQ ID NO: 2677132 - DNA, 22 bp, Homo sapiens
agcccatggcctctggccaggc

SEQ ID NO: 2677133 - DNA, 12 bp, Homo sapiens
agccctccaggc

SEQ ID NO: 2677134 - DNA, 15 bp, Homo sapiens
agccctccaggcctg

SEQ ID NO: 2677135 - DNA, 10 bp, Homo sapiens
agccctgctc

SEQ ID NO: 2677136 - DNA, 13 bp, Homo sapiens
agccctgctcttt

SEQ ID NO: 2677137 - DNA, 15 bp, Homo sapiens
agccctggaccccag

SEQ ID NO: 2677138 - DNA, 17 bp, Homo sapiens
agccctggaccccaggc

SEQ ID NO: 2677139 - DNA, 12 bp, Homo sapiens
agccctggcagg

SEQ ID NO: 2677140 - DNA, 13 bp, Homo sapiens
agccctggcagga

SEQ ID NO: 2677141 - DNA, 18 bp, Homo sapiens
agccgagatcacgccact

SEQ ID NO: 2677142 - DNA, 19 bp, Homo sapiens
agccgagattgcgccactg

SEQ ID NO: 2677143 - DNA, 15 bp, Homo sapiens
agcctagaccctcct

SEQ ID NO: 2677144 - DNA, 14 bp, Homo sapiens
agcctccagcatct

SEQ ID NO: 2677145 - DNA, 13 bp, Homo sapiens
agcctccctctga

SEQ ID NO: 2677146 - DNA, 14 bp, Homo sapiens
agcctccctctgac

SEQ ID NO: 2677147 - DNA, 15 bp, Homo sapiens
agcctccctctgacc

SEQ ID NO: 2677148 - DNA, 20 bp, Homo sapiens
agcctcccttccatgcccca

SEQ ID NO: 2677149 - DNA, 22 bp, Homo sapiens
agcctcccttccatgccccagg

SEQ ID NO: 2677150 - DNA, 14 bp, Homo sapiens
agcctcgtgtcctg

SEQ ID NO: 2677151 - DNA, 16 bp, Homo sapiens
agcctcgtgtcctgct

SEQ ID NO: 2677152 - DNA, 17 bp, Homo sapiens
agcctcgtgtcctgcta

SEQ ID NO: 2677153 - DNA, 20 bp, Homo sapiens
actcattgcatcatttacaa

SEQ ID NO: 2677154 - DNA, 19 bp, Homo sapiens
actccagcctgagcaacag

SEQ ID NO: 2677155 - DNA, 13 bp, Homo sapiens
actccagcctggg

SEQ ID NO: 2677156 - DNA, 15 bp, Homo sapiens
actccggtgtgcctg

SEQ ID NO: 2677157 - DNA, 16 bp, Homo sapiens
actccggtgtgcctgc

SEQ ID NO: 2677158 - DNA, 20 bp, Homo sapiens
actccggtgtgcctgcagcc

SEQ ID NO: 2677159 - DNA, 21 bp, Homo sapiens
actccggtgtgcctgcagccc

SEQ ID NO: 2677160 - DNA, 15 bp, Homo sapiens
actcctacctcagcc

SEQ ID NO: 2677161 - DNA, 18 bp, Homo sapiens
actcctcagatctgaaca

SEQ ID NO: 2677162 - DNA, 15 bp, Homo sapiens
actcctgattttgta

SEQ ID NO: 2677163 - DNA, 15 bp, Homo sapiens
actctgaaaaacatt

SEQ ID NO: 2677164 - DNA, 23 bp, Homo sapiens
actctgaataagcactttttaaa

SEQ ID NO: 2677165 - DNA, 23 bp, Homo sapiens
actctgaggctctttctgggcca

SEQ ID NO: 2677166 - DNA, 17 bp, Homo sapiens
actctgtggggccttgg

SEQ ID NO: 2677167 - DNA, 19 bp, Homo sapiens
actctttaacttgtaataa

SEQ ID NO: 2677168 - DNA, 16 bp, Homo sapiens
actgactgcagccccc

SEQ ID NO: 2677169 - DNA, 14 bp, Homo sapiens
actgagcctgttca

SEQ ID NO: 2677170 - DNA, 22 bp, Homo sapiens
actgatcctgctccagcagcac

SEQ ID NO: 2677171 - DNA, 17 bp, Homo sapiens
actgcactccagcctgg

SEQ ID NO: 2677172 - DNA, 19 bp, Homo sapiens
actgcactccagcctgggc

SEQ ID NO: 2677173 - DNA, 22 bp, Homo sapiens
actgcagtccgcagtctggcct

SEQ ID NO: 2677174 - DNA, 15 bp, Homo sapiens
actgccaaaacaatg

SEQ ID NO: 2677175 - DNA, 16 bp, Homo sapiens
actgccaaaacaatgc

SEQ ID NO: 2677176 - DNA, 13 bp, Homo sapiens
actgccctcccct

SEQ ID NO: 2677177 - DNA, 18 bp, Homo sapiens
actgccctccccttcccc

SEQ ID NO: 2677178 - DNA, 21 bp, Homo sapiens
actgcgggatggtcctggggc

SEQ ID NO: 2677179 - DNA, 22 bp, Homo sapiens
actggacttgagcttggcagct

SEQ ID NO: 2677180 - DNA, 17 bp, Homo sapiens
actggagcatctgactc

SEQ ID NO: 2677181 - DNA, 13 bp, Homo sapiens
actggagcccagg

SEQ ID NO: 2677182 - DNA, 15 bp, Homo sapiens
actggaggggcccac

SEQ ID NO: 2677183 - DNA, 20 bp, Homo sapiens
actggcaggagcctcgtgtc

SEQ ID NO: 2677184 - DNA, 13 bp, Homo sapiens
actggccagtcct

SEQ ID NO: 2677185 - DNA, 19 bp, Homo sapiens
actggccagtcctagagct

SEQ ID NO: 2677186 - DNA, 20 bp, Homo sapiens
accagtctttcaactcattg

SEQ ID NO: 2677187 - DNA, 17 bp, Homo sapiens
accagtgaaccaaagag

SEQ ID NO: 2677188 - DNA, 18 bp, Homo sapiens
accagtgaaccaaagaga

SEQ ID NO: 2677189 - DNA, 13 bp, Homo sapiens
accatctggtgcc

SEQ ID NO: 2677190 - DNA, 17 bp, Homo sapiens
accatctggtgcctttc

SEQ ID NO: 2677191 - DNA, 16 bp, Homo sapiens
accattgtcttccaac

SEQ ID NO: 2677192 - DNA, 23 bp, Homo sapiens
accattgtcttccaaccccagct

SEQ ID NO: 2677193 - DNA, 15 bp, Homo sapiens
acccaaatttccctg

SEQ ID NO: 2677194 - DNA, 22 bp, Homo sapiens
acccaactgatcctgctccagc

SEQ ID NO: 2677195 - DNA, 21 bp, Homo sapiens
acccacctccccctccccggc

SEQ ID NO: 2677196 - DNA, 13 bp, Homo sapiens
acccactctttgc

SEQ ID NO: 2677197 - DNA, 17 bp, Homo sapiens
acccactctttgctaca

SEQ ID NO: 2677198 - DNA, 13 bp, Homo sapiens
acccactggccag

SEQ ID NO: 2677199 - DNA, 14 bp, Homo sapiens
acccactggccagt

SEQ ID NO: 2677200 - DNA, 21 bp, Homo sapiens
acccagagagaggggcctgca

SEQ ID NO: 2677201 - DNA, 15 bp, Homo sapiens
acccagctgatgggg

SEQ ID NO: 2677202 - DNA, 24 bp, Homo sapiens
acccaggcctccctgcagactcca

SEQ ID NO: 2677203 - DNA, 16 bp, Homo sapiens
acccaggcctgattca

SEQ ID NO: 2677204 - DNA, 15 bp, Homo sapiens
acccagtgtccttcc

SEQ ID NO: 2677205 - DNA, 17 bp, Homo sapiens
acccatgaatcaaagac

SEQ ID NO: 2677206 - DNA, 18 bp, Homo sapiens
accccagctattttctga

SEQ ID NO: 2677207 - DNA, 20 bp, Homo sapiens
accccagctattttctgacc

SEQ ID NO: 2677208 - DNA, 23 bp, Homo sapiens
accccagctattttctgaccaaa

SEQ ID NO: 2677209 - DNA, 16 bp, Homo sapiens
accccagctggcctct

SEQ ID NO: 2677210 - DNA, 15 bp, Homo sapiens
accccctggccctgc

SEQ ID NO: 2677211 - DNA, 16 bp, Homo sapiens
accccctggccctgcc

SEQ ID NO: 2677212 - DNA, 17 bp, Homo sapiens
accccctggccctgcct

SEQ ID NO: 2677213 - DNA, 14 bp, Homo sapiens
accccttcctgtcc

SEQ ID NO: 2677214 - DNA, 12 bp, Homo sapiens
acccggctgggc

SEQ ID NO: 2677215 - DNA, 21 bp, Homo sapiens
aatatctgagaagtgtatata

SEQ ID NO: 2677216 - DNA, 21 bp, Homo sapiens
aatatcttgctggattaatgt

SEQ ID NO: 2677217 - DNA, 16 bp, Homo sapiens
aatattcaataaagct

SEQ ID NO: 2677218 - DNA, 16 bp, Homo sapiens
aatcaaagacatggaa

SEQ ID NO: 2677219 - DNA, 19 bp, Homo sapiens
aatcactttacctgcaggc

SEQ ID NO: 2677220 - DNA, 22 bp, Homo sapiens
aatcactttacctgcaggctcc

SEQ ID NO: 2677221 - DNA, 14 bp, Homo sapiens
aatcagtaaacact

SEQ ID NO: 2677222 - DNA, 20 bp, Homo sapiens
aatcatactcctatgcttta

SEQ ID NO: 2677223 - DNA, 20 bp, Homo sapiens
aatcatgctgttctctttgc

SEQ ID NO: 2677224 - DNA, 14 bp, Homo sapiens
aatcattgtagaaa

SEQ ID NO: 2677225 - DNA, 17 bp, Homo sapiens
aatcggctcccgcttgc

SEQ ID NO: 2677226 - DNA, 23 bp, Homo sapiens
aatctgtgaattaaaaaagctca

SEQ ID NO: 2677227 - DNA, 15 bp, Homo sapiens
aatgaaaaggaagtt

SEQ ID NO: 2677228 - DNA, 14 bp, Homo sapiens
aatgagcattagct

SEQ ID NO: 2677229 - DNA, 13 bp, Homo sapiens
aatgattgtttaa

SEQ ID NO: 2677230 - DNA, 16 bp, Homo sapiens
aatgtacaagttttgt

SEQ ID NO: 2677231 - DNA, 20 bp, Homo sapiens
aatgtacaagttttgtataa

SEQ ID NO: 2677232 - DNA, 23 bp, Homo sapiens
aatgtgtcctcctgctctgcttc

SEQ ID NO: 2677233 - DNA, 12 bp, Homo sapiens
aatgttgtccag

SEQ ID NO: 2677234 - DNA, 16 bp, Homo sapiens
aatgtttaaatataaa

SEQ ID NO: 2677235 - DNA, 15 bp, Homo sapiens
aatgtttctgcagta

SEQ ID NO: 2677236 - DNA, 18 bp, Homo sapiens
aatgttttgtacaattac

SEQ ID NO: 2677237 - DNA, 17 bp, Homo sapiens
aattctcaacctaccac

SEQ ID NO: 2677238 - DNA, 20 bp, Homo sapiens
aattgaaggagaaaatgcat

SEQ ID NO: 2677239 - DNA, 15 bp, Homo sapiens
aattgcaatctataa

SEQ ID NO: 2677240 - DNA, 21 bp, Homo sapiens
tggtccctgccctcccctgct

SEQ ID NO: 2677241 - DNA, 16 bp, Homo sapiens
tggtcctccctcccaa

SEQ ID NO: 2677242 - DNA, 21 bp, Homo sapiens
tggtgctgcattgagtccagc

SEQ ID NO: 2677243 - DNA, 16 bp, Homo sapiens
tggtggacagtcctgg

SEQ ID NO: 2677244 - DNA, 17 bp, Homo sapiens
tggtggcgggcacctgt

SEQ ID NO: 2677245 - DNA, 21 bp, Homo sapiens
tggtgggtcagcccagcacct

SEQ ID NO: 2677246 - DNA, 18 bp, Homo sapiens
tggtggtcacaggctgtg

SEQ ID NO: 2677247 - DNA, 19 bp, Homo sapiens
tggtggtcacaggctgtgc

SEQ ID NO: 2677248 - DNA, 15 bp, Homo sapiens
tggtgtgaaagtcag

SEQ ID NO: 2677249 - DNA, 23 bp, Homo sapiens
tggttccgacttgtccctctctc

SEQ ID NO: 2677250 - DNA, 15 bp, Homo sapiens
tggtttgccaggcca

SEQ ID NO: 2677251 - DNA, 19 bp, Homo sapiens
tggtttttggctctttcag

SEQ ID NO: 2677252 - DNA, 21 bp, Homo sapiens
tgtaacacaagccacagaagc

SEQ ID NO: 2677253 - DNA, 17 bp, Homo sapiens
tgtaactatgttttatc

SEQ ID NO: 2677254 - DNA, 13 bp, Homo sapiens
tgtaactggctgc

SEQ ID NO: 2677255 - DNA, 21 bp, Homo sapiens
tgtaataaaacttatgctagt

SEQ ID NO: 2677256 - DNA, 23 bp, Homo sapiens
tgtaataaacccttaactggcat

SEQ ID NO: 2677257 - DNA, 16 bp, Homo sapiens
tgtaattaatatcttg

SEQ ID NO: 2677258 - DNA, 19 bp, Homo sapiens
tgtacaagttttgtataaa

SEQ ID NO: 2677259 - DNA, 18 bp, Homo sapiens
tgtactcaggaggctgag

SEQ ID NO: 2677260 - DNA, 13 bp, Homo sapiens
tgtagaagatgga

SEQ ID NO: 2677261 - DNA, 17 bp, Homo sapiens
tgtagccacctccttgg

SEQ ID NO: 2677262 - DNA, 18 bp, Homo sapiens
tgtagccacctccttggc

SEQ ID NO: 2677263 - DNA, 16 bp, Homo sapiens
tgtagccttgcccgga

SEQ ID NO: 2677264 - DNA, 17 bp, Homo sapiens
tgtagccttgcccggat

SEQ ID NO: 2677265 - DNA, 14 bp, Homo sapiens
tgtagctgatgaaa

SEQ ID NO: 2677266 - DNA, 21 bp, Homo sapiens
tgtagctgatgaaactcctga

SEQ ID NO: 2677267 - DNA, 19 bp, Homo sapiens
tgtaggtttctctcttccc

SEQ ID NO: 2677268 - DNA, 17 bp, Homo sapiens
tgtatacattttgttat

SEQ ID NO: 2677269 - DNA, 12 bp, Homo sapiens
tgtatatagttt

SEQ ID NO: 2677270 - DNA, 13 bp, Homo sapiens
tgtatatagtttg

SEQ ID NO: 2677271 - DNA, 19 bp, Homo sapiens
tgtatatctatatctctaa

SEQ ID NO: 2677272 - DNA, 16 bp, Homo sapiens
tgtatatgtatatcta

SEQ ID NO: 2677273 - DNA, 16 bp, Homo sapiens
tgtatatgttgtaata

SEQ ID NO: 2677274 - DNA, 17 bp, Homo sapiens
tgtatcaaatctgtata

SEQ ID NO: 2677275 - DNA, 21 bp, Homo sapiens
tgtatttaagatttttgtaaa

SEQ ID NO: 2677276 - DNA, 15 bp, Homo sapiens
tgtcaagtacaagca

SEQ ID NO: 2677277 - DNA, 22 bp, Homo sapiens
tgtcaccgtggaccttcctgcc

SEQ ID NO: 2677278 - DNA, 23 bp, Homo sapiens
tgtcagcctgaagatcagagctg

SEQ ID NO: 2677279 - DNA, 24 bp, Homo sapiens
tgtcattagtgagacatatttaca

SEQ ID NO: 2677280 - DNA, 14 bp, Homo sapiens
tgtcattgcccctc

SEQ ID NO: 2677281 - DNA, 13 bp, Homo sapiens
tgtccataaagta

SEQ ID NO: 2677282 - DNA, 14 bp, Homo sapiens
tgtccatttgtccc

SEQ ID NO: 2677283 - DNA, 21 bp, Homo sapiens
tgtcccacctcttctcttcct

SEQ ID NO: 2677284 - DNA, 14 bp, Homo sapiens
tgtccctacccact

SEQ ID NO: 2677285 - DNA, 18 bp, Homo sapiens
tgtccctacccactcttt

SEQ ID NO: 2677286 - DNA, 20 bp, Homo sapiens
tgtccctctctcagccctcc

SEQ ID NO: 2677287 - DNA, 17 bp, Homo sapiens
tgtccgtgtgcctcctg

SEQ ID NO: 2677288 - DNA, 18 bp, Homo sapiens
tgtccgtgtgcctcctgt

SEQ ID NO: 2677289 - DNA, 17 bp, Homo sapiens
tgtcctcccaggaacca

SEQ ID NO: 2677290 - DNA, 16 bp, Homo sapiens
tgtcctcctgctctgc

SEQ ID NO: 2677291 - DNA, 18 bp, Homo sapiens
tgtcctcctgctctgctt

SEQ ID NO: 2677292 - DNA, 19 bp, Homo sapiens
tgtcctcctgctctgcttc

SEQ ID NO: 2677293 - DNA, 14 bp, Homo sapiens
tgtcctgctagctg

SEQ ID NO: 2677294 - DNA, 17 bp, Homo sapiens
tgtcctgctagctgtct

SEQ ID NO: 2677295 - DNA, 23 bp, Homo sapiens
tgtcgtagccaaggtgggctgag

SEQ ID NO: 2677296 - DNA, 18 bp, Homo sapiens
tgtctcttgtagaagatg

SEQ ID NO: 2677297 - DNA, 19 bp, Homo sapiens
tgtctgaacaatctccaaa

SEQ ID NO: 2677298 - DNA, 23 bp, Homo sapiens
tgtctgcagacaagtcttgctgt

SEQ ID NO: 2677299 - DNA, 15 bp, Homo sapiens
tgtctgcattgttat

SEQ ID NO: 2677300 - DNA, 19 bp, Homo sapiens
tgtcttataggtttccact

SEQ ID NO: 2677301 - DNA, 14 bp, Homo sapiens
tgtcttccaacccc

SEQ ID NO: 2677302 - DNA, 16 bp, Homo sapiens
tgtcttccaaccccag

SEQ ID NO: 2677303 - DNA, 18 bp, Homo sapiens
tgtcttccaaccccagct

SEQ ID NO: 2677304 - DNA, 21 bp, Homo sapiens
tgtcttccaaccccagctggc

SEQ ID NO: 2677305 - DNA, 20 bp, Homo sapiens
tgtcttcctagtatattagt

SEQ ID NO: 2677306 - DNA, 19 bp, Homo sapiens
tgtctttcagcattaggct

SEQ ID NO: 2677307 - DNA, 23 bp, Homo sapiens
tgtgaaaggtgctgatggccctc

SEQ ID NO: 2677308 - DNA, 23 bp, Homo sapiens
tgtgaaattcaacctgtgtctta

SEQ ID NO: 2677309 - DNA, 12 bp, Homo sapiens
tgtgaccaaagc

SEQ ID NO: 2677310 - DNA, 21 bp, Homo sapiens
tgtgaccctgagggctcctcc

SEQ ID NO: 2677311 - DNA, 23 bp, Homo sapiens
tgtgaccctgagggctcctccat

SEQ ID NO: 2677312 - DNA, 20 bp, Homo sapiens
tgtgactttgaaaatatata

SEQ ID NO: 2677313 - DNA, 20 bp, Homo sapiens
tgtgagagccacgctggcct

SEQ ID NO: 2677314 - DNA, 13 bp, Homo sapiens
tgtgcctgcagcc

SEQ ID NO: 2677315 - DNA, 15 bp, Homo sapiens
tgtgctcttcctctg

SEQ ID NO: 2677316 - DNA, 18 bp, Homo sapiens
tgtgctcttcctctggtt

SEQ ID NO: 2677317 - DNA, 20 bp, Homo sapiens
tgtgctcttcctctggtttc

SEQ ID NO: 2677318 - DNA, 15 bp, Homo sapiens
tgtgctctttgaaga

SEQ ID NO: 2677319 - DNA, 20 bp, Homo sapiens
tgtgctttgactcacctgtt

SEQ ID NO: 2677320 - DNA, 20 bp, Homo sapiens
tgtggaaagcctctgctgcc

SEQ ID NO: 2677321 - DNA, 15 bp, Homo sapiens
tgtggagaagcccct

SEQ ID NO: 2677322 - DNA, 18 bp, Homo sapiens
tgtggccccaggtgccac

SEQ ID NO: 2677323 - DNA, 15 bp, Homo sapiens
tgtgggaccagtccc

SEQ ID NO: 2677324 - DNA, 11 bp, Homo sapiens
tgtgtcctcct

SEQ ID NO: 2677325 - DNA, 16 bp, Homo sapiens
tgtgtcctcctgctct

SEQ ID NO: 2677326 - DNA, 19 bp, Homo sapiens
tgtgtctgcgtctgtgttg

SEQ ID NO: 2677327 - DNA, 14 bp, Homo sapiens
tgttaattgattaa

SEQ ID NO: 2677328 - DNA, 18 bp, Homo sapiens
tgttaattgattaaaatc

SEQ ID NO: 2677329 - DNA, 13 bp, Homo sapiens
tgttactaaagtc

SEQ ID NO: 2677330 - DNA, 15 bp, Homo sapiens
tgttattgtggaaga

SEQ ID NO: 2677331 - DNA, 18 bp, Homo sapiens
tgttcaagaaataaaaat

SEQ ID NO: 2677332 - DNA, 17 bp, Homo sapiens
tgttcactaaactctga

SEQ ID NO: 2677333 - DNA, 17 bp, Homo sapiens
tgttctctttgctgaca

SEQ ID NO: 2677334 - DNA, 13 bp, Homo sapiens
tgttgagtgttca

SEQ ID NO: 2677335 - DNA, 19 bp, Homo sapiens
tgttgataaattccactgg

SEQ ID NO: 2677336 - DNA, 15 bp, Homo sapiens
tgttgctcttggaaa

SEQ ID NO: 2677337 - DNA, 18 bp, Homo sapiens
tgttgcttagatgagggt

SEQ ID NO: 2677338 - DNA, 18 bp, Homo sapiens
tgttgtaataaaacttat

SEQ ID NO: 2677339 - DNA, 21 bp, Homo sapiens
tgtttctgcagtagtctctgt

SEQ ID NO: 2677340 - DNA, 16 bp, Homo sapiens
tgtttgtaaattaata

SEQ ID NO: 2677341 - DNA, 18 bp, Homo sapiens
tgtttgtacaagattgtc

SEQ ID NO: 2677342 - DNA, 22 bp, Homo sapiens
tgtttgtttctccccctgggct

SEQ ID NO: 2677343 - DNA, 18 bp, Homo sapiens
ttaaaaaaagtatatatt

SEQ ID NO: 2677344 - DNA, 14 bp, Homo sapiens
ttaaaagacatttt

SEQ ID NO: 2677345 - DNA, 22 bp, Homo sapiens
ttaaacatgctaaatagttcta

SEQ ID NO: 2677346 - DNA, 18 bp, Homo sapiens
ttaaattatactgtagct

SEQ ID NO: 2677347 - DNA, 16 bp, Homo sapiens
ttaaattgcttttgtt

SEQ ID NO: 2677348 - DNA, 16 bp, Homo sapiens
ttaacctgaattattc

SEQ ID NO: 2677349 - DNA, 13 bp, Homo sapiens
ttaagccctgctc

SEQ ID NO: 2677350 - DNA, 22 bp, Homo sapiens
ttaagccctgctctttctctga

SEQ ID NO: 2677351 - DNA, 22 bp, Homo sapiens
tgacacgtgatggaccaaagcc

SEQ ID NO: 2677352 - DNA, 19 bp, Homo sapiens
tgacactgtgaccctgggt

SEQ ID NO: 2677353 - DNA, 14 bp, Homo sapiens
tgacagaaatgcaa

SEQ ID NO: 2677354 - DNA, 12 bp, Homo sapiens
tgacatcccagg

SEQ ID NO: 2677355 - DNA, 13 bp, Homo sapiens
tgacatcccagga

SEQ ID NO: 2677356 - DNA, 14 bp, Homo sapiens
tgacatcccaggag

SEQ ID NO: 2677357 - DNA, 20 bp, Homo sapiens
tgacatcccaggaggggcct

SEQ ID NO: 2677358 - DNA, 18 bp, Homo sapiens
tgaccaaaatgtgtttca

SEQ ID NO: 2677359 - DNA, 13 bp, Homo sapiens
tgaccaaagcatt

SEQ ID NO: 2677360 - DNA, 20 bp, Homo sapiens
tgacccaactgatcctgctc

SEQ ID NO: 2677361 - DNA, 21 bp, Homo sapiens
tgacccaactgatcctgctcc

SEQ ID NO: 2677362 - DNA, 13 bp, Homo sapiens
tgaccctgagggc

SEQ ID NO: 2677363 - DNA, 21 bp, Homo sapiens
tgaccctgagggctcctccat

SEQ ID NO: 2677364 - DNA, 22 bp, Homo sapiens
tgaccctgagggctcctccatg

SEQ ID NO: 2677365 - DNA, 23 bp, Homo sapiens
tgaccctgcgaaggggccctggt

SEQ ID NO: 2677366 - DNA, 13 bp, Homo sapiens
tgaccgccctccg

SEQ ID NO: 2677367 - DNA, 20 bp, Homo sapiens
tgacctgccccgcccagctg

SEQ ID NO: 2677368 - DNA, 15 bp, Homo sapiens
tgacgggctgtccgt

SEQ ID NO: 2677369 - DNA, 19 bp, Homo sapiens
tgacgtgcacctgtactca

SEQ ID NO: 2677370 - DNA, 17 bp, Homo sapiens
tgactaggaagaaaaca

SEQ ID NO: 2677371 - DNA, 19 bp, Homo sapiens
tgactcacaagaagaccag

SEQ ID NO: 2677372 - DNA, 13 bp, Homo sapiens
tgactctctgtga

SEQ ID NO: 2677373 - DNA, 23 bp, Homo sapiens
tgactctgggtggaagtgcccag

SEQ ID NO: 2677374 - DNA, 14 bp, Homo sapiens
tgactgcagccccc

SEQ ID NO: 2677375 - DNA, 18 bp, Homo sapiens
tgacttctggcttatgct

SEQ ID NO: 2677376 - DNA, 14 bp, Homo sapiens
tgactttgaaaata

SEQ ID NO: 2677377 - DNA, 18 bp, Homo sapiens
tgactttttagccagtga

SEQ ID NO: 2677378 - DNA, 21 bp, Homo sapiens
tgagaagcgctgccctgtgag

SEQ ID NO: 2677379 - DNA, 18 bp, Homo sapiens
tgagacagccacttggtt

SEQ ID NO: 2677380 - DNA, 12 bp, Homo sapiens
tgagaccacctc

SEQ ID NO: 2677381 - DNA, 15 bp, Homo sapiens
tgagaccacctctca

SEQ ID NO: 2677382 - DNA, 22 bp, Homo sapiens
tgagactgcgggatggtcctgg

SEQ ID NO: 2677383 - DNA, 14 bp, Homo sapiens
tgagagcacagcgt

SEQ ID NO: 2677384 - DNA, 20 bp, Homo sapiens
tgagagcacagcgtttacat

SEQ ID NO: 2677385 - DNA, 14 bp, Homo sapiens
tgagagccacgctg

SEQ ID NO: 2677386 - DNA, 18 bp, Homo sapiens
tgagagccacgctggcct

SEQ ID NO: 2677387 - DNA, 18 bp, Homo sapiens
tgagccacctttactctg

SEQ ID NO: 2677388 - DNA, 21 bp, Homo sapiens
tgagccacctttactctgctc

SEQ ID NO: 2677389 - DNA, 23 bp, Homo sapiens
tgagccatgatcgagccactgca

SEQ ID NO: 2677390 - DNA, 16 bp, Homo sapiens
tgagcggcgcagagcc

SEQ ID NO: 2677391 - DNA, 17 bp, Homo sapiens
tgagcggcgcagagccc

SEQ ID NO: 2677392 - DNA, 23 bp, Homo sapiens
tgagctcttgttccgtgccaggc

SEQ ID NO: 2677393 - DNA, 19 bp, Homo sapiens
tgagcttggcagctgaact

SEQ ID NO: 2677394 - DNA, 15 bp, Homo sapiens
tgaggaaacaggcct

SEQ ID NO: 2677395 - DNA, 17 bp, Homo sapiens
tgaggataacttccttg

SEQ ID NO: 2677396 - DNA, 16 bp, Homo sapiens
tgaggccattatttca

SEQ ID NO: 2677397 - DNA, 15 bp, Homo sapiens
tgaggcctcttggac

SEQ ID NO: 2677398 - DNA, 23 bp, Homo sapiens
tgaggcgggtggatcacctgagg

SEQ ID NO: 2677399 - DNA, 12 bp, Homo sapiens
tgagggctcctc

SEQ ID NO: 2677400 - DNA, 15 bp, Homo sapiens
tgaggtgcctcccag

SEQ ID NO: 2677401 - DNA, 16 bp, Homo sapiens
tgaggtgcctcccagt

SEQ ID NO: 2677402 - DNA, 16 bp, Homo sapiens
tgagtatattataata

SEQ ID NO: 2677403 - DNA, 16 bp, Homo sapiens
tgagtcacccatgaag

SEQ ID NO: 2677404 - DNA, 21 bp, Homo sapiens
tgagtccagctttccttctgc

SEQ ID NO: 2677405 - DNA, 23 bp, Homo sapiens
tgagtccagctttccttctgccc

SEQ ID NO: 2677406 - DNA, 14 bp, Homo sapiens
tgagtgtctgcgcc

SEQ ID NO: 2677407 - DNA, 15 bp, Homo sapiens
tgagtgtctgcgccc

SEQ ID NO: 2677408 - DNA, 23 bp, Homo sapiens
tgagtgttcattttagtgactgt

SEQ ID NO: 2677409 - DNA, 16 bp, Homo sapiens
tgatacttttttgaaa

SEQ ID NO: 2677410 - DNA, 12 bp, Homo sapiens
tgatcccagcac

SEQ ID NO: 2677411 - DNA, 13 bp, Homo sapiens
tgatcccagcact

SEQ ID NO: 2677412 - DNA, 15 bp, Homo sapiens
tgatgatgtctcttg

SEQ ID NO: 2677413 - DNA, 16 bp, Homo sapiens
tgatgccaaagctgct

SEQ ID NO: 2677414 - DNA, 19 bp, Homo sapiens
tgatgccaaagctgctttc

SEQ ID NO: 2677415 - DNA, 13 bp, Homo sapiens
tgatggaccaaag

SEQ ID NO: 2677416 - DNA, 19 bp, Homo sapiens
tgatggaccaaagccacct

SEQ ID NO: 2677417 - DNA, 15 bp, Homo sapiens
tgatgtccatttgtc

SEQ ID NO: 2677418 - DNA, 13 bp, Homo sapiens
tgatttaatatct

SEQ ID NO: 2677419 - DNA, 18 bp, Homo sapiens
tgcacaccttttccccag

SEQ ID NO: 2677420 - DNA, 16 bp, Homo sapiens
tgcacccatgccatag

SEQ ID NO: 2677421 - DNA, 16 bp, Homo sapiens
tgcacctcccttccct

SEQ ID NO: 2677422 - DNA, 18 bp, Homo sapiens
tgcacctcccttccctcc

SEQ ID NO: 2677423 - DNA, 15 bp, Homo sapiens
tgcacctgcaggctt

SEQ ID NO: 2677424 - DNA, 15 bp, Homo sapiens
tgcacctgccagcct

SEQ ID NO: 2677425 - DNA, 18 bp, Homo sapiens
tgcacctgccagcctggc

SEQ ID NO: 2677426 - DNA, 20 bp, Homo sapiens
tgcacctgccagcctggctt

SEQ ID NO: 2677427 - DNA, 22 bp, Homo sapiens
tgcacctgccagcctggcttct

SEQ ID NO: 2677428 - DNA, 12 bp, Homo sapiens
tgcactccagcc

SEQ ID NO: 2677429 - DNA, 14 bp, Homo sapiens
tgcactccagcctg

SEQ ID NO: 2677430 - DNA, 16 bp, Homo sapiens
tgcactccagcctggg

SEQ ID NO: 2677431 - DNA, 18 bp, Homo sapiens
tgcactccagcctgggcg

SEQ ID NO: 2677432 - DNA, 19 bp, Homo sapiens
tgcactccagcctgggcga

SEQ ID NO: 2677433 - DNA, 15 bp, Homo sapiens
tgcactggccccacc

SEQ ID NO: 2677434 - DNA, 16 bp, Homo sapiens
tgcactggccccaccc

SEQ ID NO: 2677435 - DNA, 13 bp, Homo sapiens
tgcagaaggccaa

SEQ ID NO: 2677436 - DNA, 23 bp, Homo sapiens
tgcagacaagtcttgctgtgctt

SEQ ID NO: 2677437 - DNA, 20 bp, Homo sapiens
tgcagactccaatggggcca

SEQ ID NO: 2677438 - DNA, 21 bp, Homo sapiens
tgcagactccaatggggccag

SEQ ID NO: 2677439 - DNA, 22 bp, Homo sapiens
tgcagactccaatggggccagc

SEQ ID NO: 2677440 - DNA, 20 bp, Homo sapiens
tgcagaggggctttctggag

SEQ ID NO: 2677441 - DNA, 22 bp, Homo sapiens
tgcagaggggctttctggagag

SEQ ID NO: 2677442 - DNA, 15 bp, Homo sapiens
tgcagccagtcaggc

SEQ ID NO: 2677443 - DNA, 21 bp, Homo sapiens
tgcaggccaagagcagaggca

SEQ ID NO: 2677444 - DNA, 24 bp, Homo sapiens
tgcagggaggaggtggcagccctg

SEQ ID NO: 2677445 - DNA, 23 bp, Homo sapiens
tgcaggggcaaggggctggctgg

SEQ ID NO: 2677446 - DNA, 17 bp, Homo sapiens
tgcaggtgagcaggcag

SEQ ID NO: 2677447 - DNA, 22 bp, Homo sapiens
tgcagtgacgtgcacctgtact

SEQ ID NO: 2677448 - DNA, 22 bp, Homo sapiens
tgcagtgctgtaatcggctccc

SEQ ID NO: 2677449 - DNA, 17 bp, Homo sapiens
tgcagtggctcacgcct

SEQ ID NO: 2677450 - DNA, 16 bp, Homo sapiens
tgcatgcactgtctca

SEQ ID NO: 2677451 - DNA, 13 bp, Homo sapiens
tgcatgtaatcaa

SEQ ID NO: 2677452 - DNA, 21 bp, Homo sapiens
tgcatgtaatcaacatggcta

SEQ ID NO: 2677453 - DNA, 17 bp, Homo sapiens
tgcattgtcttgtggag

SEQ ID NO: 2677454 - DNA, 16 bp, Homo sapiens
tgccaaagctgctttc

SEQ ID NO: 2677455 - DNA, 14 bp, Homo sapiens
acaccgctggtccc

SEQ ID NO: 2677456 - DNA, 19 bp, Homo sapiens
acaccgctggtccctgccc

SEQ ID NO: 2677457 - DNA, 15 bp, Homo sapiens
acacctccttttctt

SEQ ID NO: 2677458 - DNA, 17 bp, Homo sapiens
acacctgccctgccctg

SEQ ID NO: 2677459 - DNA, 22 bp, Homo sapiens
acacctgccctgccctgccacc

SEQ ID NO: 2677460 - DNA, 19 bp, Homo sapiens
acaccttttccccaggagc

SEQ ID NO: 2677461 - DNA, 14 bp, Homo sapiens
acacggccctcctg

SEQ ID NO: 2677462 - DNA, 20 bp, Homo sapiens
acacggggatcatctctgtg

SEQ ID NO: 2677463 - DNA, 18 bp, Homo sapiens
acacgtgatggaccaaag

SEQ ID NO: 2677464 - DNA, 20 bp, Homo sapiens
acacgtgatggaccaaagcc

SEQ ID NO: 2677465 - DNA, 17 bp, Homo sapiens
acactaagctctctggg

SEQ ID NO: 2677466 - DNA, 12 bp, Homo sapiens
acactccagcct

SEQ ID NO: 2677467 - DNA, 14 bp, Homo sapiens
acactccagcctga

SEQ ID NO: 2677468 - DNA, 17 bp, Homo sapiens
acactccagcctgagca

SEQ ID NO: 2677469 - DNA, 18 bp, Homo sapiens
acactggtttgccaggcc

SEQ ID NO: 2677470 - DNA, 19 bp, Homo sapiens
acactggtttgccaggcca

SEQ ID NO: 2677471 - DNA, 19 bp, Homo sapiens
acagaactggcaggagcct

SEQ ID NO: 2677472 - DNA, 13 bp, Homo sapiens
acagaccagcagc

SEQ ID NO: 2677473 - DNA, 23 bp, Homo sapiens
acagaccagcagcaatctgtctt

SEQ ID NO: 2677474 - DNA, 20 bp, Homo sapiens
acagcaggaactgagccaga

SEQ ID NO: 2677475 - DNA, 14 bp, Homo sapiens
acagctcttctcag

SEQ ID NO: 2677476 - DNA, 19 bp, Homo sapiens
acagctcttctcagtgtct

SEQ ID NO: 2677477 - DNA, 12 bp, Homo sapiens
acagctgctggg

SEQ ID NO: 2677478 - DNA, 13 bp, Homo sapiens
acagcttggcact

SEQ ID NO: 2677479 - DNA, 15 bp, Homo sapiens
acaggctgtgccttg

SEQ ID NO: 2677480 - DNA, 16 bp, Homo sapiens
acagggcagagccggg

SEQ ID NO: 2677481 - DNA, 12 bp, Homo sapiens
acagggctcttt

SEQ ID NO: 2677482 - DNA, 22 bp, Homo sapiens
acagggctctttgatggaccca

SEQ ID NO: 2677483 - DNA, 14 bp, Homo sapiens
acagggttttgtat

SEQ ID NO: 2677484 - DNA, 14 bp, Homo sapiens
acaggtcgagctgt

SEQ ID NO: 2677485 - DNA, 19 bp, Homo sapiens
acaggtcgagctgtgctcg

SEQ ID NO: 2677486 - DNA, 16 bp, Homo sapiens
acaggtgcgcccctgg

SEQ ID NO: 2677487 - DNA, 14 bp, Homo sapiens
acagtgaggctggg

SEQ ID NO: 2677488 - DNA, 17 bp, Homo sapiens
acagtgcttcagcctga

SEQ ID NO: 2677489 - DNA, 21 bp, Homo sapiens
acagtgggcaggaggccccag

SEQ ID NO: 2677490 - DNA, 16 bp, Homo sapiens
acagttatagaaagca

SEQ ID NO: 2677491 - DNA, 15 bp, Homo sapiens
acagttttgaaagaa

SEQ ID NO: 2677492 - DNA, 14 bp, Homo sapiens
acatataaaagtta

SEQ ID NO: 2677493 - DNA, 20 bp, Homo sapiens
acatgccgcgtccctgcccc

SEQ ID NO: 2677494 - DNA, 16 bp, Homo sapiens
acatgctgtgctcttt

SEQ ID NO: 2677495 - DNA, 17 bp, Homo sapiens
acatgctgtgctctttg

SEQ ID NO: 2677496 - DNA, 13 bp, Homo sapiens
acatgtgcagtgc

SEQ ID NO: 2677497 - DNA, 20 bp, Homo sapiens
acattcacacagggctcttt

SEQ ID NO: 2677498 - DNA, 21 bp, Homo sapiens
acattttgttatagaatactt

SEQ ID NO: 2677499 - DNA, 18 bp, Homo sapiens
accaaaatgtgtttcata

SEQ ID NO: 2677500 - DNA, 18 bp, Homo sapiens
accaaagagactggagca

SEQ ID NO: 2677501 - DNA, 21 bp, Homo sapiens
accaaagagactggagcatct

SEQ ID NO: 2677502 - DNA, 22 bp, Homo sapiens
accaaagagactggagcatctg

SEQ ID NO: 2677503 - DNA, 18 bp, Homo sapiens
accaaatgtaactatgtt

SEQ ID NO: 2677504 - DNA, 16 bp, Homo sapiens
accaaccctgtttcct

SEQ ID NO: 2677505 - DNA, 18 bp, Homo sapiens
accaagaaaggaacctgt

SEQ ID NO: 2677506 - DNA, 18 bp, Homo sapiens
accagactgtggagaaat

SEQ ID NO: 2677507 - DNA, 14 bp, Homo sapiens
accagaggctgcag

SEQ ID NO: 2677508 - DNA, 15 bp, Homo sapiens
accagaggctgcaga

SEQ ID NO: 2677509 - DNA, 19 bp, Homo sapiens
accagaggctgcagaaggc

SEQ ID NO: 2677510 - DNA, 21 bp, Homo sapiens
accagaggctgcagaaggcca

SEQ ID NO: 2677511 - DNA, 22 bp, Homo sapiens
accagaggctgcagaaggccaa

SEQ ID NO: 2677512 - DNA, 20 bp, Homo sapiens
accagctctcttcctgtctt

SEQ ID NO: 2677513 - DNA, 21 bp, Homo sapiens
accagtgtaactggctgctcc

SEQ ID NO: 2677514 - DNA, 23 bp, Homo sapiens
accagtgtaactggctgctccct

SEQ ID NO: 2677515 - DNA, 21 bp, Homo sapiens
accagtgtagccttgcccgga

SEQ ID NO: 2677516 - DNA, 15 bp, Homo sapiens
accatctggtgcctt

SEQ ID NO: 2677517 - DNA, 16 bp, Homo sapiens
accatggagacaagaa

SEQ ID NO: 2677518 - DNA, 23 bp, Homo sapiens
accattcaaacaggtcgagctgt

SEQ ID NO: 2677519 - DNA, 13 bp, Homo sapiens
accattgtcttcc

SEQ ID NO: 2677520 - DNA, 18 bp, Homo sapiens
accattgtcttccaaccc

SEQ ID NO: 2677521 - DNA, 20 bp, Homo sapiens
accattgtcttccaacccca

SEQ ID NO: 2677522 - DNA, 21 bp, Homo sapiens
accattgtcttccaaccccag

SEQ ID NO: 2677523 - DNA, 18 bp, Homo sapiens
acccaaagaccaatattc

SEQ ID NO: 2677524 - DNA, 19 bp, Homo sapiens
acccaactgatcctgctcc

SEQ ID NO: 2677525 - DNA, 23 bp, Homo sapiens
acccaactgatcctgctccagca

SEQ ID NO: 2677526 - DNA, 22 bp, Homo sapiens
acccacagcgtcattttgaatc

SEQ ID NO: 2677527 - DNA, 16 bp, Homo sapiens
acccacctccccctcc

SEQ ID NO: 2677528 - DNA, 18 bp, Homo sapiens
acccacgaacgctcttag

SEQ ID NO: 2677529 - DNA, 14 bp, Homo sapiens
acccactctttgct

SEQ ID NO: 2677530 - DNA, 23 bp, Homo sapiens
acccactctttgctacaataaat

SEQ ID NO: 2677531 - DNA, 12 bp, Homo sapiens
acccactggcca

SEQ ID NO: 2677532 - DNA, 23 bp, Homo sapiens
acccactggccagtcctagagct

SEQ ID NO: 2677533 - DNA, 23 bp, Homo sapiens
acccagagagaggggcctgcagg

SEQ ID NO: 2677534 - DNA, 14 bp, Homo sapiens
acccaggtctgatg

SEQ ID NO: 2677535 - DNA, 20 bp, Homo sapiens
acccaggtctgatgccaaag

SEQ ID NO: 2677536 - DNA, 13 bp, Homo sapiens
acccatgccatag

SEQ ID NO: 2677537 - DNA, 22 bp, Homo sapiens
accccagctattttctgaccaa

SEQ ID NO: 2677538 - DNA, 11 bp, Homo sapiens
accccagctgg

SEQ ID NO: 2677539 - DNA, 15 bp, Homo sapiens
accccagctggcctc

SEQ ID NO: 2677540 - DNA, 12 bp, Homo sapiens
accccccagcac

SEQ ID NO: 2677541 - DNA, 13 bp, Homo sapiens
acccggctgggct

SEQ ID NO: 2677542 - DNA, 15 bp, Homo sapiens
accctgagggctcct

SEQ ID NO: 2677543 - DNA, 16 bp, Homo sapiens
accctgagggctcctc

SEQ ID NO: 2677544 - DNA, 23 bp, Homo sapiens
accctgtcagaatcatgctgttc

SEQ ID NO: 2677545 - DNA, 15 bp, Homo sapiens
accgctggtccctgc

SEQ ID NO: 2677546 - DNA, 19 bp, Homo sapiens
acctaccaccccttcctgt

SEQ ID NO: 2677547 - DNA, 15 bp, Homo sapiens
acctagaagtctccc

SEQ ID NO: 2677548 - DNA, 22 bp, Homo sapiens
acctaggactgactcggcagtg

SEQ ID NO: 2677549 - DNA, 10 bp, Homo sapiens
acctcagcct

SEQ ID NO: 2677550 - DNA, 15 bp, Homo sapiens
acctcagcctagacc

SEQ ID NO: 2677551 - DNA, 13 bp, Homo sapiens
acctcaggccagg

SEQ ID NO: 2677552 - DNA, 20 bp, Homo sapiens
acctcaggccaggtgcagtg

SEQ ID NO: 2677553 - DNA, 19 bp, Homo sapiens
acctccccctccccggcca

SEQ ID NO: 2677554 - DNA, 22 bp, Homo sapiens
acctccccctccccggccacat

SEQ ID NO: 2677555 - DNA, 13 bp, Homo sapiens
acctcccttccct

SEQ ID NO: 2677556 - DNA, 15 bp, Homo sapiens
acctccttacctgga

SEQ ID NO: 2677557 - DNA, 14 bp, Homo sapiens
acctccttggcacc

SEQ ID NO: 2677558 - DNA, 13 bp, Homo sapiens
acctccttttctt

SEQ ID NO: 2677559 - DNA, 14 bp, Homo sapiens
acctccttttcttc

SEQ ID NO: 2677560 - DNA, 19 bp, Homo sapiens
acctctgaaggcaaatata

SEQ ID NO: 2677561 - DNA, 23 bp, Homo sapiens
acctctgctctgaggcttccaga

SEQ ID NO: 2677562 - DNA, 19 bp, Homo sapiens
acctctgcttttgcacacc

SEQ ID NO: 2677563 - DNA, 20 bp, Homo sapiens
acctctgcttttgcacacct

SEQ ID NO: 2677564 - DNA, 14 bp, Homo sapiens
acctcttctatgca

SEQ ID NO: 2677565 - DNA, 15 bp, Homo sapiens
agccacctccttggc

SEQ ID NO: 2677566 - DNA, 13 bp, Homo sapiens
agccacctgctgc

SEQ ID NO: 2677567 - DNA, 15 bp, Homo sapiens
agccacgtgaatggc

SEQ ID NO: 2677568 - DNA, 13 bp, Homo sapiens
agccagaggctgg

SEQ ID NO: 2677569 - DNA, 20 bp, Homo sapiens
agccagaggctggagacagg

SEQ ID NO: 2677570 - DNA, 20 bp, Homo sapiens
agccagcaaagcctccagca

SEQ ID NO: 2677571 - DNA, 23 bp, Homo sapiens
agccagcaaagcctccagcatct

SEQ ID NO: 2677572 - DNA, 23 bp, Homo sapiens
agccaggttagcctttgccctgt

SEQ ID NO: 2677573 - DNA, 16 bp, Homo sapiens
agccagtcaggcaggg

SEQ ID NO: 2677574 - DNA, 13 bp, Homo sapiens
agccagtctgcgt

SEQ ID NO: 2677575 - DNA, 20 bp, Homo sapiens
agccagtctgcgtcaggcac

SEQ ID NO: 2677576 - DNA, 13 bp, Homo sapiens
agccagtgaagga

SEQ ID NO: 2677577 - DNA, 23 bp, Homo sapiens
agccagttctggggcccgcctgc

SEQ ID NO: 2677578 - DNA, 20 bp, Homo sapiens
agccattaccatggagacaa

SEQ ID NO: 2677579 - DNA, 12 bp, Homo sapiens
agcccagcacct

SEQ ID NO: 2677580 - DNA, 21 bp, Homo sapiens
agcccagccattaccatggag

SEQ ID NO: 2677581 - DNA, 12 bp, Homo sapiens
agcccagctggc

SEQ ID NO: 2677582 - DNA, 18 bp, Homo sapiens
agccccgcgcctccttcc

SEQ ID NO: 2677583 - DNA, 21 bp, Homo sapiens
agcccctgggggctccctgat

SEQ ID NO: 2677584 - DNA, 16 bp, Homo sapiens
agccctccatggcctg

SEQ ID NO: 2677585 - DNA, 19 bp, Homo sapiens
agccctccatggcctggca

SEQ ID NO: 2677586 - DNA, 11 bp, Homo sapiens
agccctgctct

SEQ ID NO: 2677587 - DNA, 16 bp, Homo sapiens
agccctgctctttctc

SEQ ID NO: 2677588 - DNA, 12 bp, Homo sapiens
agcccttgggtt

SEQ ID NO: 2677589 - DNA, 21 bp, Homo sapiens
agccgagattgcgccactgca

SEQ ID NO: 2677590 - DNA, 14 bp, Homo sapiens
agccgcagcctccc

SEQ ID NO: 2677591 - DNA, 23 bp, Homo sapiens
agccggacacaagcggccctgac

SEQ ID NO: 2677592 - DNA, 22 bp, Homo sapiens
agccgggcgtggtggcgggcac

SEQ ID NO: 2677593 - DNA, 14 bp, Homo sapiens
agcctaatgaaagg

SEQ ID NO: 2677594 - DNA, 18 bp, Homo sapiens
agcctagaccctcctcct

SEQ ID NO: 2677595 - DNA, 22 bp, Homo sapiens
agcctccctctgacctgcaggc

SEQ ID NO: 2677596 - DNA, 21 bp, Homo sapiens
agcctcccttccatgccccag

SEQ ID NO: 2677597 - DNA, 15 bp, Homo sapiens
agcctcgtgtcctgc

SEQ ID NO: 2677598 - DNA, 23 bp, Homo sapiens
agcctcgtgtcctgctagctgtc

SEQ ID NO: 2677599 - DNA, 13 bp, Homo sapiens
agcctctgctgcc

SEQ ID NO: 2677600 - DNA, 22 bp, Homo sapiens
agcctcttagtgattgtgtctg

SEQ ID NO: 2677601 - DNA, 20 bp, Homo sapiens
agcctgaagatcagagctgc

SEQ ID NO: 2677602 - DNA, 11 bp, Homo sapiens
agcctgaggct

SEQ ID NO: 2677603 - DNA, 14 bp, Homo sapiens
agcctggccaacat

SEQ ID NO: 2677604 - DNA, 14 bp, Homo sapiens
agcctggcttctgg

SEQ ID NO: 2677605 - DNA, 18 bp, Homo sapiens
agcctggcttctggagcc

SEQ ID NO: 2677606 - DNA, 15 bp, Homo sapiens
agcctgggccagaga

SEQ ID NO: 2677607 - DNA, 16 bp, Homo sapiens
agcctgggccagagaa

SEQ ID NO: 2677608 - DNA, 19 bp, Homo sapiens
agcctgttcattctgatgt

SEQ ID NO: 2677609 - DNA, 22 bp, Homo sapiens
agcctgttggacccgctctgga

SEQ ID NO: 2677610 - DNA, 19 bp, Homo sapiens
agccttccccctcccaggg

SEQ ID NO: 2677611 - DNA, 13 bp, Homo sapiens
agcctttgccctg

SEQ ID NO: 2677612 - DNA, 16 bp, Homo sapiens
agcgagagtctgtctc

SEQ ID NO: 2677613 - DNA, 18 bp, Homo sapiens
agcgatgaatttggagac

SEQ ID NO: 2677614 - DNA, 17 bp, Homo sapiens
agcgcacctgccccctg

SEQ ID NO: 2677615 - DNA, 18 bp, Homo sapiens
agcgcacctgccccctgg

SEQ ID NO: 2677616 - DNA, 21 bp, Homo sapiens
agcgcacctgccccctggtgg

SEQ ID NO: 2677617 - DNA, 20 bp, Homo sapiens
agcgcctgtgctgaggactc

SEQ ID NO: 2677618 - DNA, 13 bp, Homo sapiens
agcgctgccctgt

SEQ ID NO: 2677619 - DNA, 14 bp, Homo sapiens
agcgctgccctgtg

SEQ ID NO: 2677620 - DNA, 12 bp, Homo sapiens
agcggcgcagag

SEQ ID NO: 2677621 - DNA, 14 bp, Homo sapiens
agctagaaggccac

SEQ ID NO: 2677622 - DNA, 18 bp, Homo sapiens
agctatgattatgccact

SEQ ID NO: 2677623 - DNA, 15 bp, Homo sapiens
agctattagcaactg

SEQ ID NO: 2677624 - DNA, 14 bp, Homo sapiens
agctattttctgac

SEQ ID NO: 2677625 - DNA, 17 bp, Homo sapiens
agctattttctgaccaa

SEQ ID NO: 2677626 - DNA, 18 bp, Homo sapiens
agctattttctgaccaaa

SEQ ID NO: 2677627 - DNA, 16 bp, Homo sapiens
agctcacacagcagga

SEQ ID NO: 2677628 - DNA, 15 bp, Homo sapiens
agctcacctctgaag

SEQ ID NO: 2677629 - DNA, 17 bp, Homo sapiens
agctcaggaggcttgga

SEQ ID NO: 2677630 - DNA, 21 bp, Homo sapiens
agctcaggcatttgaggctgt

SEQ ID NO: 2677631 - DNA, 14 bp, Homo sapiens
agctcctgaccaaa

SEQ ID NO: 2677632 - DNA, 19 bp, Homo sapiens
agctcctgtccctacccac

SEQ ID NO: 2677633 - DNA, 12 bp, Homo sapiens
agctctgccctg

SEQ ID NO: 2677634 - DNA, 18 bp, Homo sapiens
agctctgccctggctgtg

SEQ ID NO: 2677635 - DNA, 12 bp, Homo sapiens
agctctggacca

SEQ ID NO: 2677636 - DNA, 14 bp, Homo sapiens
agctcttctcagtg

SEQ ID NO: 2677637 - DNA, 22 bp, Homo sapiens
agctcttgttccgtgccaggca

SEQ ID NO: 2677638 - DNA, 16 bp, Homo sapiens
agctgaacaatgaatg

SEQ ID NO: 2677639 - DNA, 20 bp, Homo sapiens
agctgatgatgtctcttgta

SEQ ID NO: 2677640 - DNA, 21 bp, Homo sapiens
agctgatgatgtctcttgtag

SEQ ID NO: 2677641 - DNA, 21 bp, Homo sapiens
agctgcacctgccagcctggc

SEQ ID NO: 2677642 - DNA, 18 bp, Homo sapiens
agctgcagccagtcaggc

SEQ ID NO: 2677643 - DNA, 15 bp, Homo sapiens
agctgctttcttctc

SEQ ID NO: 2677644 - DNA, 17 bp, Homo sapiens
agctgctttcttctctg

SEQ ID NO: 2677645 - DNA, 19 bp, Homo sapiens
agctgctttcttctctgcc

SEQ ID NO: 2677646 - DNA, 20 bp, Homo sapiens
agctgctttcttctctgcct

SEQ ID NO: 2677647 - DNA, 21 bp, Homo sapiens
agctgctttcttctctgcctc

SEQ ID NO: 2677648 - DNA, 23 bp, Homo sapiens
agctgctttcttctctgcctcct

SEQ ID NO: 2677649 - DNA, 18 bp, Homo sapiens
agctggcctctagaacac

SEQ ID NO: 2677650 - DNA, 13 bp, Homo sapiens
agctgtctctctt

SEQ ID NO: 2677651 - DNA, 15 bp, Homo sapiens
agctgtctctcttgt

SEQ ID NO: 2677652 - DNA, 16 bp, Homo sapiens
agctgtctctcttgtt

SEQ ID NO: 2677653 - DNA, 23 bp, Homo sapiens
agctgtgctcgggtgctgccagc

SEQ ID NO: 2677654 - DNA, 24 bp, Homo sapiens
agcttaaattgcttttgttgtgac

SEQ ID NO: 2677655 - DNA, 17 bp, Homo sapiens
agctttcagagccagtg

SEQ ID NO: 2677656 - DNA, 15 bp, Homo sapiens
agctttccttctgcc

SEQ ID NO: 2677657 - DNA, 17 bp, Homo sapiens
agctttccttctgccct

SEQ ID NO: 2677658 - DNA, 13 bp, Homo sapiens
agctttgttgtcc

SEQ ID NO: 2677659 - DNA, 18 bp, Homo sapiens
aggaaggttttctccact

SEQ ID NO: 2677660 - DNA, 19 bp, Homo sapiens
aggaatatagattaaatca

SEQ ID NO: 2677661 - DNA, 11 bp, Homo sapiens
aggacacatgt

SEQ ID NO: 2677662 - DNA, 13 bp, Homo sapiens
aggacacatgtcc

SEQ ID NO: 2677663 - DNA, 19 bp, Homo sapiens
aggacagtgcttcagcctg

SEQ ID NO: 2677664 - DNA, 22 bp, Homo sapiens
aggacattgatttgatttttat

SEQ ID NO: 2677665 - DNA, 13 bp, Homo sapiens
aggacctctgctt

SEQ ID NO: 2677666 - DNA, 20 bp, Homo sapiens
aggactccctccatgtggcc

SEQ ID NO: 2677667 - DNA, 14 bp, Homo sapiens
aggactgtgaccaa

SEQ ID NO: 2677668 - DNA, 15 bp, Homo sapiens
aggactgtgaccaaa

SEQ ID NO: 2677669 - DNA, 16 bp, Homo sapiens
aggactgtgaccaaag

SEQ ID NO: 2677670 - DNA, 13 bp, Homo sapiens
aggagcctcgtgt

SEQ ID NO: 2677671 - DNA, 22 bp, Homo sapiens
aggagcctcgtgtcctgctagc

SEQ ID NO: 2677672 - DNA, 14 bp, Homo sapiens
aggaggccccaggc

SEQ ID NO: 2677673 - DNA, 18 bp, Homo sapiens
aggaggtggcagccctgt

SEQ ID NO: 2677674 - DNA, 21 bp, Homo sapiens
aggaggtggcagccctgtagg

SEQ ID NO: 2677675 - DNA, 17 bp, Homo sapiens
caccagtcactgtccct

SEQ ID NO: 2677676 - DNA, 15 bp, Homo sapiens
caccattcaaacagg

SEQ ID NO: 2677677 - DNA, 17 bp, Homo sapiens
cacccaaaggtggcctg

SEQ ID NO: 2677678 - DNA, 12 bp, Homo sapiens
cacccactggcc

SEQ ID NO: 2677679 - DNA, 13 bp, Homo sapiens
cacccactggcca

SEQ ID NO: 2677680 - DNA, 15 bp, Homo sapiens
cacccactggccagt

SEQ ID NO: 2677681 - DNA, 17 bp, Homo sapiens
cacccactggccagtcc

SEQ ID NO: 2677682 - DNA, 11 bp, Homo sapiens
cacccaggcct

SEQ ID NO: 2677683 - DNA, 18 bp, Homo sapiens
cacccagtgtccttccat

SEQ ID NO: 2677684 - DNA, 19 bp, Homo sapiens
cacccatgaatcaaagaca

SEQ ID NO: 2677685 - DNA, 22 bp, Homo sapiens
caccccccacgtctgtcctcct

SEQ ID NO: 2677686 - DNA, 13 bp, Homo sapiens
caccccccagcac

SEQ ID NO: 2677687 - DNA, 22 bp, Homo sapiens
caccccttcctgtcccacctct

SEQ ID NO: 2677688 - DNA, 19 bp, Homo sapiens
caccctcgtggacacctgc

SEQ ID NO: 2677689 - DNA, 12 bp, Homo sapiens
caccgctggtcc

SEQ ID NO: 2677690 - DNA, 23 bp, Homo sapiens
caccgctggtccctgccctcccc

SEQ ID NO: 2677691 - DNA, 17 bp, Homo sapiens
caccgtggaccttcctg

SEQ ID NO: 2677692 - DNA, 12 bp, Homo sapiens
cacctacccagc

SEQ ID NO: 2677693 - DNA, 14 bp, Homo sapiens
cacctacccagctg

SEQ ID NO: 2677694 - DNA, 16 bp, Homo sapiens
cacctagaagtctccc

SEQ ID NO: 2677695 - DNA, 20 bp, Homo sapiens
cacctagaagtctccctgca

SEQ ID NO: 2677696 - DNA, 17 bp, Homo sapiens
cacctagtgcttccact

SEQ ID NO: 2677697 - DNA, 23 bp, Homo sapiens
cacctcagagcagggccaaagca

SEQ ID NO: 2677698 - DNA, 21 bp, Homo sapiens
cacctcagccccactgacacc

SEQ ID NO: 2677699 - DNA, 15 bp, Homo sapiens
cacctccccctcccc

SEQ ID NO: 2677700 - DNA, 18 bp, Homo sapiens
cacctccccctccccggc

SEQ ID NO: 2677701 - DNA, 14 bp, Homo sapiens
cacctcccttccct

SEQ ID NO: 2677702 - DNA, 22 bp, Homo sapiens
cacctcccttccctccctgagg

SEQ ID NO: 2677703 - DNA, 23 bp, Homo sapiens
cacctccttttcttctagctttg

SEQ ID NO: 2677704 - DNA, 13 bp, Homo sapiens
cacctctcccagc

SEQ ID NO: 2677705 - DNA, 15 bp, Homo sapiens
cacctctcccagccc

SEQ ID NO: 2677706 - DNA, 18 bp, Homo sapiens
cacctgaggttaggagtt

SEQ ID NO: 2677707 - DNA, 17 bp, Homo sapiens
cacctgccagcctggct

SEQ ID NO: 2677708 - DNA, 20 bp, Homo sapiens
cacctgccagcctggcttct

SEQ ID NO: 2677709 - DNA, 21 bp, Homo sapiens
cacctgccccctggtggacag

SEQ ID NO: 2677710 - DNA, 14 bp, Homo sapiens
cacctgccctgccc

SEQ ID NO: 2677711 - DNA, 19 bp, Homo sapiens
cacctgccctgccctgcca

SEQ ID NO: 2677712 - DNA, 12 bp, Homo sapiens
cacctgctccca

SEQ ID NO: 2677713 - DNA, 11 bp, Homo sapiens
cacctgctgcg

SEQ ID NO: 2677714 - DNA, 11 bp, Homo sapiens
cacctgtctgt

SEQ ID NO: 2677715 - DNA, 12 bp, Homo sapiens
cacctgtctgtc

SEQ ID NO: 2677716 - DNA, 22 bp, Homo sapiens
cacctgtctgtctgtctgtccc

SEQ ID NO: 2677717 - DNA, 21 bp, Homo sapiens
caccttagacggaggtgcctg

SEQ ID NO: 2677718 - DNA, 22 bp, Homo sapiens
caccttagacggaggtgcctga

SEQ ID NO: 2677719 - DNA, 23 bp, Homo sapiens
caccttagacggaggtgcctgag

SEQ ID NO: 2677720 - DNA, 19 bp, Homo sapiens
caccttcaattcctgggcc

SEQ ID NO: 2677721 - DNA, 16 bp, Homo sapiens
caccttttccccagga

SEQ ID NO: 2677722 - DNA, 18 bp, Homo sapiens
cacgcaactcacacctcc

SEQ ID NO: 2677723 - DNA, 22 bp, Homo sapiens
cacgccactgcactccagcctg

SEQ ID NO: 2677724 - DNA, 18 bp, Homo sapiens
cacgcctatgatcccagc

SEQ ID NO: 2677725 - DNA, 20 bp, Homo sapiens
cacgcctgtaatcccagcac

SEQ ID NO: 2677726 - DNA, 21 bp, Homo sapiens
cacgcctgtaatcccagcact

SEQ ID NO: 2677727 - DNA, 15 bp, Homo sapiens
cacggccctcctggg

SEQ ID NO: 2677728 - DNA, 16 bp, Homo sapiens
cacggccctcctggga

SEQ ID NO: 2677729 - DNA, 19 bp, Homo sapiens
cacggggatcatctctgtg

SEQ ID NO: 2677730 - DNA, 20 bp, Homo sapiens
cacggggatcatctctgtga

SEQ ID NO: 2677731 - DNA, 14 bp, Homo sapiens
cacgtctgtcctcc

SEQ ID NO: 2677732 - DNA, 12 bp, Homo sapiens
cacgtgaatggc

SEQ ID NO: 2677733 - DNA, 18 bp, Homo sapiens
cacgtgatggaccaaagc

SEQ ID NO: 2677734 - DNA, 16 bp, Homo sapiens
cactaaactctgaata

SEQ ID NO: 2677735 - DNA, 22 bp, Homo sapiens
cactaaactctgaataagcact

SEQ ID NO: 2677736 - DNA, 16 bp, Homo sapiens
cactacactccagcct

SEQ ID NO: 2677737 - DNA, 19 bp, Homo sapiens
cactcaggccaacaagcca

SEQ ID NO: 2677738 - DNA, 13 bp, Homo sapiens
cactccagcctgg

SEQ ID NO: 2677739 - DNA, 21 bp, Homo sapiens
cactccagcctgggcgacaga

SEQ ID NO: 2677740 - DNA, 23 bp, Homo sapiens
cactccagcctgggcgacagagc

SEQ ID NO: 2677741 - DNA, 22 bp, Homo sapiens
cactccggtgtgcctgcagccc

SEQ ID NO: 2677742 - DNA, 12 bp, Homo sapiens
cactctctgctg

SEQ ID NO: 2677743 - DNA, 15 bp, Homo sapiens
cactctctgctggca

SEQ ID NO: 2677744 - DNA, 14 bp, Homo sapiens
cactctttgctaca

SEQ ID NO: 2677745 - DNA, 16 bp, Homo sapiens
cactctttgctacaat

SEQ ID NO: 2677746 - DNA, 20 bp, Homo sapiens
cactctttgctacaataaat

SEQ ID NO: 2677747 - DNA, 23 bp, Homo sapiens
cactgacccaactgatcctgctc

SEQ ID NO: 2677748 - DNA, 17 bp, Homo sapiens
cactgcactccagcctg

SEQ ID NO: 2677749 - DNA, 12 bp, Homo sapiens
cactggagccca

SEQ ID NO: 2677750 - DNA, 18 bp, Homo sapiens
cactggaggggcccaccc

SEQ ID NO: 2677751 - DNA, 14 bp, Homo sapiens
cactggccagtcct

SEQ ID NO: 2677752 - DNA, 18 bp, Homo sapiens
cactggccagtcctagag

SEQ ID NO: 2677753 - DNA, 21 bp, Homo sapiens
cactggccagtcctagagctc

SEQ ID NO: 2677754 - DNA, 19 bp, Homo sapiens
cactggtttgccaggccaa

SEQ ID NO: 2677755 - DNA, 16 bp, Homo sapiens
cactgtatgctggacg

SEQ ID NO: 2677756 - DNA, 23 bp, Homo sapiens
cactgtccctcaaatgacccaaa

SEQ ID NO: 2677757 - DNA, 16 bp, Homo sapiens
cactgtgaccctgggt

SEQ ID NO: 2677758 - DNA, 19 bp, Homo sapiens
cactgtttaactgggagtg

SEQ ID NO: 2677759 - DNA, 13 bp, Homo sapiens
cacttctgtctcc

SEQ ID NO: 2677760 - DNA, 17 bp, Homo sapiens
cacttctgtctcctgtc

SEQ ID NO: 2677761 - DNA, 21 bp, Homo sapiens
cacttctgtctcctgtcttca

SEQ ID NO: 2677762 - DNA, 24 bp, Homo sapiens
cacttctgtctcctgtcttcagag

SEQ ID NO: 2677763 - DNA, 18 bp, Homo sapiens
cacttggtttttggctct

SEQ ID NO: 2677764 - DNA, 14 bp, Homo sapiens
cactttaaagcatt

SEQ ID NO: 2677765 - DNA, 14 bp, Homo sapiens
cagaaaaccccagc

SEQ ID NO: 2677766 - DNA, 22 bp, Homo sapiens
cagaaacgcagattgggctggc

SEQ ID NO: 2677767 - DNA, 20 bp, Homo sapiens
cagaaactcgatgaatgtgt

SEQ ID NO: 2677768 - DNA, 18 bp, Homo sapiens
cagaactggcaggagcct

SEQ ID NO: 2677769 - DNA, 21 bp, Homo sapiens
cagaagagagtggggcctgcc

SEQ ID NO: 2677770 - DNA, 17 bp, Homo sapiens
cagaagccaggagcaaa

SEQ ID NO: 2677771 - DNA, 21 bp, Homo sapiens
cagaatcatgctgttctcttt

SEQ ID NO: 2677772 - DNA, 18 bp, Homo sapiens
cagaatctgtatgattct

SEQ ID NO: 2677773 - DNA, 11 bp, Homo sapiens
cagaatgaatc

SEQ ID NO: 2677774 - DNA, 16 bp, Homo sapiens
cagaattgaaggagaa

SEQ ID NO: 2677775 - DNA, 23 bp, Homo sapiens
cagacatttatcttttgggtctg

SEQ ID NO: 2677776 - DNA, 12 bp, Homo sapiens
cagaccagcagc

SEQ ID NO: 2677777 - DNA, 18 bp, Homo sapiens
cagaccattgtcttccaa

SEQ ID NO: 2677778 - DNA, 13 bp, Homo sapiens
cagactccaatgg

SEQ ID NO: 2677779 - DNA, 18 bp, Homo sapiens
cagactccaatggggcca

SEQ ID NO: 2677780 - DNA, 19 bp, Homo sapiens
cagactccaatggggccag

SEQ ID NO: 2677781 - DNA, 15 bp, Homo sapiens
cagactgctgggact

SEQ ID NO: 2677782 - DNA, 19 bp, Homo sapiens
cagagagaggggcctgcag

SEQ ID NO: 2677783 - DNA, 13 bp, Homo sapiens
cagagaggccttt

SEQ ID NO: 2677784 - DNA, 14 bp, Homo sapiens
cagagagtcctctg

SEQ ID NO: 2677785 - DNA, 14 bp, Homo sapiens
ccatgccccaggat

SEQ ID NO: 2677786 - DNA, 21 bp, Homo sapiens
ccatggcgtgtccctctcgga

SEQ ID NO: 2677787 - DNA, 23 bp, Homo sapiens
ccatgtctgagcggcgcagagcc

SEQ ID NO: 2677788 - DNA, 15 bp, Homo sapiens
ccatgtggccccagg

SEQ ID NO: 2677789 - DNA, 16 bp, Homo sapiens
ccatgtggccccaggt

SEQ ID NO: 2677790 - DNA, 20 bp, Homo sapiens
ccatgtggccccaggtgcca

SEQ ID NO: 2677791 - DNA, 22 bp, Homo sapiens
ccatgtggccccaggtgccacc

SEQ ID NO: 2677792 - DNA, 17 bp, Homo sapiens
ccattgaccagctctct

SEQ ID NO: 2677793 - DNA, 13 bp, Homo sapiens
ccattgtcttcca

SEQ ID NO: 2677794 - DNA, 16 bp, Homo sapiens
ccattgtcttccaacc

SEQ ID NO: 2677795 - DNA, 23 bp, Homo sapiens
ccattgtcttccaaccccagctg

SEQ ID NO: 2677796 - DNA, 15 bp, Homo sapiens
cccaaaggtggcctg

SEQ ID NO: 2677797 - DNA, 19 bp, Homo sapiens
cccaagactgtcattgccc

SEQ ID NO: 2677798 - DNA, 23 bp, Homo sapiens
cccaagactgtcattgcccctcc

SEQ ID NO: 2677799 - DNA, 19 bp, Homo sapiens
cccaagtagtagtgtcttc

SEQ ID NO: 2677800 - DNA, 22 bp, Homo sapiens
cccaagtagtagtgtcttccta

SEQ ID NO: 2677801 - DNA, 15 bp, Homo sapiens
cccaagtgccagtct

SEQ ID NO: 2677802 - DNA, 15 bp, Homo sapiens
cccaatagctctact

SEQ ID NO: 2677803 - DNA, 16 bp, Homo sapiens
cccaatagctctactg

SEQ ID NO: 2677804 - DNA, 23 bp, Homo sapiens
cccaccctcgtggacacctgccc

SEQ ID NO: 2677805 - DNA, 14 bp, Homo sapiens
cccacctccccctc

SEQ ID NO: 2677806 - DNA, 22 bp, Homo sapiens
cccaccttcaattcctgggccc

SEQ ID NO: 2677807 - DNA, 15 bp, Homo sapiens
cccacgtctgtcctc

SEQ ID NO: 2677808 - DNA, 17 bp, Homo sapiens
cccactccccaccttca

SEQ ID NO: 2677809 - DNA, 22 bp, Homo sapiens
cccactctttgctacaataaat

SEQ ID NO: 2677810 - DNA, 14 bp, Homo sapiens
cccactgacaccca

SEQ ID NO: 2677811 - DNA, 16 bp, Homo sapiens
cccactggccagtcct

SEQ ID NO: 2677812 - DNA, 21 bp, Homo sapiens
cccactggccagtcctagagc

SEQ ID NO: 2677813 - DNA, 22 bp, Homo sapiens
cccagaacccttcctgagacct

SEQ ID NO: 2677814 - DNA, 18 bp, Homo sapiens
cccagccattaccatgga

SEQ ID NO: 2677815 - DNA, 15 bp, Homo sapiens
cccagcccctgcccc

SEQ ID NO: 2677816 - DNA, 16 bp, Homo sapiens
cccagcccctgcccct

SEQ ID NO: 2677817 - DNA, 21 bp, Homo sapiens
cccagctactcagaagcctga

SEQ ID NO: 2677818 - DNA, 23 bp, Homo sapiens
cccagctactcagaagcctgagg

SEQ ID NO: 2677819 - DNA, 19 bp, Homo sapiens
cccagctattttctgacca

SEQ ID NO: 2677820 - DNA, 18 bp, Homo sapiens
cccagctgcacctgccag

SEQ ID NO: 2677821 - DNA, 22 bp, Homo sapiens
cccagctgcacctgccagcctg

SEQ ID NO: 2677822 - DNA, 23 bp, Homo sapiens
cccagctgcacctgccagcctgg

SEQ ID NO: 2677823 - DNA, 16 bp, Homo sapiens
cccagctggcctctag

SEQ ID NO: 2677824 - DNA, 13 bp, Homo sapiens
cccagcttcctgt

SEQ ID NO: 2677825 - DNA, 18 bp, Homo sapiens
cccaggaggggcctctga

SEQ ID NO: 2677826 - DNA, 21 bp, Homo sapiens
cccaggatcactctctgctgg

SEQ ID NO: 2677827 - DNA, 22 bp, Homo sapiens
cccaggatcactctctgctggc

SEQ ID NO: 2677828 - DNA, 14 bp, Homo sapiens
cccaggcaggccac

SEQ ID NO: 2677829 - DNA, 16 bp, Homo sapiens
cccaggctgagagcca

SEQ ID NO: 2677830 - DNA, 23 bp, Homo sapiens
cccagggacaaaacactgtgtcc

SEQ ID NO: 2677831 - DNA, 20 bp, Homo sapiens
cccagggccagggccctgca

SEQ ID NO: 2677832 - DNA, 16 bp, Homo sapiens
cccaggtctgatgcca

SEQ ID NO: 2677833 - DNA, 17 bp, Homo sapiens
cccaggtgccaccaata

SEQ ID NO: 2677834 - DNA, 18 bp, Homo sapiens
cccaggtgccaccaataa

SEQ ID NO: 2677835 - DNA, 20 bp, Homo sapiens
cccaggtgccaccaataaaa

SEQ ID NO: 2677836 - DNA, 21 bp, Homo sapiens
cccaggtgccaccaataaaaa

SEQ ID NO: 2677837 - DNA, 17 bp, Homo sapiens
cccagtgggagcttccc

SEQ ID NO: 2677838 - DNA, 18 bp, Homo sapiens
cccagtgggagcttcccg

SEQ ID NO: 2677839 - DNA, 23 bp, Homo sapiens
cccagtgtccttccatcttcaca

SEQ ID NO: 2677840 - DNA, 20 bp, Homo sapiens
cccatcattgcacctgcagg

SEQ ID NO: 2677841 - DNA, 22 bp, Homo sapiens
cccatgaagacaggacagtgct

SEQ ID NO: 2677842 - DNA, 17 bp, Homo sapiens
ccccacctacccagctg

SEQ ID NO: 2677843 - DNA, 22 bp, Homo sapiens
ccccacctacccagctgatggg

SEQ ID NO: 2677844 - DNA, 23 bp, Homo sapiens
ccccacctacccagctgatgggg

SEQ ID NO: 2677845 - DNA, 12 bp, Homo sapiens
ccccacctgcca

SEQ ID NO: 2677846 - DNA, 16 bp, Homo sapiens
ccccacgtctgtcctc

SEQ ID NO: 2677847 - DNA, 14 bp, Homo sapiens
ccccactccccacc

SEQ ID NO: 2677848 - DNA, 23 bp, Homo sapiens
ccccagctattttctgaccaaaa

SEQ ID NO: 2677849 - DNA, 17 bp, Homo sapiens
ccccagctctggcttcc

SEQ ID NO: 2677850 - DNA, 18 bp, Homo sapiens
ccccaggtgccaccaata

SEQ ID NO: 2677851 - DNA, 21 bp, Homo sapiens
ccccaggtgccaccaataaaa

SEQ ID NO: 2677852 - DNA, 15 bp, Homo sapiens
ccccatacttcctgg

SEQ ID NO: 2677853 - DNA, 16 bp, Homo sapiens
ccccatacttcctggg

SEQ ID NO: 2677854 - DNA, 19 bp, Homo sapiens
ccccatcattgcacctgca

SEQ ID NO: 2677855 - DNA, 18 bp, Homo sapiens
ccccatcccaggatgggt

SEQ ID NO: 2677856 - DNA, 11 bp, Homo sapiens
ccccccagcac

SEQ ID NO: 2677857 - DNA, 18 bp, Homo sapiens
ccccgtggatggtctcca

SEQ ID NO: 2677858 - DNA, 23 bp, Homo sapiens
cccctacgggcgctgcagcctcc

SEQ ID NO: 2677859 - DNA, 11 bp, Homo sapiens
cccctccagca

SEQ ID NO: 2677860 - DNA, 12 bp, Homo sapiens
cccctccagcac

SEQ ID NO: 2677861 - DNA, 15 bp, Homo sapiens
cccctccagcacaca

SEQ ID NO: 2677862 - DNA, 14 bp, Homo sapiens
cccctcccagggcc

SEQ ID NO: 2677863 - DNA, 12 bp, Homo sapiens
cccctgcctgcc

SEQ ID NO: 2677864 - DNA, 13 bp, Homo sapiens
cccctgcctgcct

SEQ ID NO: 2677865 - DNA, 12 bp, Homo sapiens
cccctgctccca

SEQ ID NO: 2677866 - DNA, 20 bp, Homo sapiens
cccctggtggacagtcctgg

SEQ ID NO: 2677867 - DNA, 17 bp, Homo sapiens
cccctttactcagccca

SEQ ID NO: 2677868 - DNA, 16 bp, Homo sapiens
cccgaaagggacacaa

SEQ ID NO: 2677869 - DNA, 22 bp, Homo sapiens
cccgcctgccacctctcccagc

SEQ ID NO: 2677870 - DNA, 12 bp, Homo sapiens
cccgctccccac

SEQ ID NO: 2677871 - DNA, 16 bp, Homo sapiens
cccgcttgctctcctg

SEQ ID NO: 2677872 - DNA, 18 bp, Homo sapiens
cccgcttgctctcctgga

SEQ ID NO: 2677873 - DNA, 14 bp, Homo sapiens
cccggattctggga

SEQ ID NO: 2677874 - DNA, 16 bp, Homo sapiens
cccggattctgggagg

SEQ ID NO: 2677875 - DNA, 14 bp, Homo sapiens
cccggccacatgcc

SEQ ID NO: 2677876 - DNA, 11 bp, Homo sapiens
cccggctgggc

SEQ ID NO: 2677877 - DNA, 11 bp, Homo sapiens
cccgtccctgc

SEQ ID NO: 2677878 - DNA, 12 bp, Homo sapiens
cccgtccctgcc

SEQ ID NO: 2677879 - DNA, 19 bp, Homo sapiens
ccctatatctataaacact

SEQ ID NO: 2677880 - DNA, 18 bp, Homo sapiens
ccctcaaatgacccaaag

SEQ ID NO: 2677881 - DNA, 16 bp, Homo sapiens
ccctccacgcaaggct

SEQ ID NO: 2677882 - DNA, 13 bp, Homo sapiens
ccctccagcacac

SEQ ID NO: 2677883 - DNA, 23 bp, Homo sapiens
ccctccatgtggccccaggtgcc

SEQ ID NO: 2677884 - DNA, 22 bp, Homo sapiens
ccctcccagggccagggccctg

SEQ ID NO: 2677885 - DNA, 15 bp, Homo sapiens
ccctcccctgctccc

SEQ ID NO: 2677886 - DNA, 13 bp, Homo sapiens
ccctccccttccc

SEQ ID NO: 2677887 - DNA, 17 bp, Homo sapiens
ccctccgatgctgaggc

SEQ ID NO: 2677888 - DNA, 19 bp, Homo sapiens
ccctccgatgctgaggcca

SEQ ID NO: 2677889 - DNA, 21 bp, Homo sapiens
ccctccgccttcactccggtg

SEQ ID NO: 2677890 - DNA, 22 bp, Homo sapiens
ccctccgccttcactccggtgt

SEQ ID NO: 2677891 - DNA, 19 bp, Homo sapiens
ccctccgtcgggcccctgc

SEQ ID NO: 2677892 - DNA, 20 bp, Homo sapiens
ccctccgtcgggcccctgcc

SEQ ID NO: 2677893 - DNA, 11 bp, Homo sapiens
ccctcctggga

SEQ ID NO: 2677894 - DNA, 14 bp, Homo sapiens
cgtggacacctgcc

SEQ ID NO: 2677895 - DNA, 17 bp, Homo sapiens
cgtggaccttcctgcca

SEQ ID NO: 2677896 - DNA, 14 bp, Homo sapiens
cgtggggctcccgg

SEQ ID NO: 2677897 - DNA, 22 bp, Homo sapiens
cgtggggctcccggcatcctga

SEQ ID NO: 2677898 - DNA, 17 bp, Homo sapiens
cgtggtctccttgcact

SEQ ID NO: 2677899 - DNA, 13 bp, Homo sapiens
cgtgtgcctcctg

SEQ ID NO: 2677900 - DNA, 14 bp, Homo sapiens
cgtgtgcctcctgt

SEQ ID NO: 2677901 - DNA, 22 bp, Homo sapiens
cgttatcacccaggcctgattc

SEQ ID NO: 2677902 - DNA, 13 bp, Homo sapiens
cgtttacatattt

SEQ ID NO: 2677903 - DNA, 21 bp, Homo sapiens
ctaaagctctgaacaaaagct

SEQ ID NO: 2677904 - DNA, 22 bp, Homo sapiens
ctaaatgtggacatcatgaagc

SEQ ID NO: 2677905 - DNA, 14 bp, Homo sapiens
ctaaattgtataca

SEQ ID NO: 2677906 - DNA, 21 bp, Homo sapiens
ctaaattgtatacattttgtt

SEQ ID NO: 2677907 - DNA, 16 bp, Homo sapiens
ctaagcatggcctgga

SEQ ID NO: 2677908 - DNA, 18 bp, Homo sapiens
ctaaggggcagctcctga

SEQ ID NO: 2677909 - DNA, 20 bp, Homo sapiens
ctaaggggcagctcctgacc

SEQ ID NO: 2677910 - DNA, 21 bp, Homo sapiens
ctaagttgagtatattataat

SEQ ID NO: 2677911 - DNA, 11 bp, Homo sapiens
ctacaataaat

SEQ ID NO: 2677912 - DNA, 12 bp, Homo sapiens
ctacaataaatg

SEQ ID NO: 2677913 - DNA, 14 bp, Homo sapiens
ctacaataaatgct

SEQ ID NO: 2677914 - DNA, 17 bp, Homo sapiens
ctacaataaatgctgaa

SEQ ID NO: 2677915 - DNA, 18 bp, Homo sapiens
ctacaataaatgctgaat

SEQ ID NO: 2677916 - DNA, 19 bp, Homo sapiens
ctacaataaatgctgaatg

SEQ ID NO: 2677917 - DNA, 19 bp, Homo sapiens
ctacacatatatgtatatg

SEQ ID NO: 2677918 - DNA, 18 bp, Homo sapiens
ctacactccagcctgagc

SEQ ID NO: 2677919 - DNA, 19 bp, Homo sapiens
ctacagctcacctctgaag

SEQ ID NO: 2677920 - DNA, 22 bp, Homo sapiens
ctacatggggtctgggtggggg

SEQ ID NO: 2677921 - DNA, 14 bp, Homo sapiens
ctaccaccccttcc

SEQ ID NO: 2677922 - DNA, 18 bp, Homo sapiens
ctaccaccccttcctgtc

SEQ ID NO: 2677923 - DNA, 21 bp, Homo sapiens
ctacccactctttgctacaat

SEQ ID NO: 2677924 - DNA, 17 bp, Homo sapiens
ctacccagctgatgggg

SEQ ID NO: 2677925 - DNA, 15 bp, Homo sapiens
ctacctcagcctaga

SEQ ID NO: 2677926 - DNA, 17 bp, Homo sapiens
ctactcagaagcctgag

SEQ ID NO: 2677927 - DNA, 21 bp, Homo sapiens
ctactcagaagcctgaggctg

SEQ ID NO: 2677928 - DNA, 16 bp, Homo sapiens
ctactcattttaatga

SEQ ID NO: 2677929 - DNA, 15 bp, Homo sapiens
ctactcctacctcag

SEQ ID NO: 2677930 - DNA, 17 bp, Homo sapiens
ctactcctacctcagcc

SEQ ID NO: 2677931 - DNA, 21 bp, Homo sapiens
ctactcctacctcagcctaga

SEQ ID NO: 2677932 - DNA, 23 bp, Homo sapiens
ctactcgggaggctgaggcagga

SEQ ID NO: 2677933 - DNA, 23 bp, Homo sapiens
ctacttgggaggctgaggcagga

SEQ ID NO: 2677934 - DNA, 14 bp, Homo sapiens
ctagaacacccact

SEQ ID NO: 2677935 - DNA, 17 bp, Homo sapiens
ctagaacacccactggc

SEQ ID NO: 2677936 - DNA, 13 bp, Homo sapiens
ctagaaggccaca

SEQ ID NO: 2677937 - DNA, 22 bp, Homo sapiens
ctagaagtctccctgcacagcc

SEQ ID NO: 2677938 - DNA, 13 bp, Homo sapiens
ctagagctcctgt

SEQ ID NO: 2677939 - DNA, 16 bp, Homo sapiens
ctagagctcctgtccc

SEQ ID NO: 2677940 - DNA, 21 bp, Homo sapiens
ctagagctcctgtccctaccc

SEQ ID NO: 2677941 - DNA, 24 bp, Homo sapiens
ctagagctcctgtccctacccact

SEQ ID NO: 2677942 - DNA, 15 bp, Homo sapiens
ctagccagaggctgg

SEQ ID NO: 2677943 - DNA, 16 bp, Homo sapiens
ctagccagaggctgga

SEQ ID NO: 2677944 - DNA, 17 bp, Homo sapiens
ctagcctgggccagaga

SEQ ID NO: 2677945 - DNA, 14 bp, Homo sapiens
ctagctttgttgtc

SEQ ID NO: 2677946 - DNA, 17 bp, Homo sapiens
ctagctttgttgtcctc

SEQ ID NO: 2677947 - DNA, 18 bp, Homo sapiens
ctagctttgttgtcctcc

SEQ ID NO: 2677948 - DNA, 14 bp, Homo sapiens
ctaggactctgagg

SEQ ID NO: 2677949 - DNA, 14 bp, Homo sapiens
ctaggagccccagc

SEQ ID NO: 2677950 - DNA, 16 bp, Homo sapiens
ctaggagccccagctt

SEQ ID NO: 2677951 - DNA, 19 bp, Homo sapiens
ctaggccacaccatctcct

SEQ ID NO: 2677952 - DNA, 11 bp, Homo sapiens
ctagtatatta

SEQ ID NO: 2677953 - DNA, 21 bp, Homo sapiens
ctagtatattagtttgattta

SEQ ID NO: 2677954 - DNA, 19 bp, Homo sapiens
ctagtgccctccacagccg

SEQ ID NO: 2677955 - DNA, 23 bp, Homo sapiens
ctagtgccctccacagccgcagc

SEQ ID NO: 2677956 - DNA, 15 bp, Homo sapiens
ctagttttttttgta

SEQ ID NO: 2677957 - DNA, 18 bp, Homo sapiens
ctagttttttttgtaaac

SEQ ID NO: 2677958 - DNA, 21 bp, Homo sapiens
ctataaacactgtttgttcca

SEQ ID NO: 2677959 - DNA, 19 bp, Homo sapiens
ctataacatagaattgcaa

SEQ ID NO: 2677960 - DNA, 22 bp, Homo sapiens
ctatgaagggacagctgctggg

SEQ ID NO: 2677961 - DNA, 22 bp, Homo sapiens
ctatgatcccagcactttggga

SEQ ID NO: 2677962 - DNA, 17 bp, Homo sapiens
ctatgcaaatgcctcca

SEQ ID NO: 2677963 - DNA, 15 bp, Homo sapiens
ctatgccaggctgtg

SEQ ID NO: 2677964 - DNA, 16 bp, Homo sapiens
ctatgccaggctgtgc

SEQ ID NO: 2677965 - DNA, 18 bp, Homo sapiens
ctatgccaggctgtgcta

SEQ ID NO: 2677966 - DNA, 14 bp, Homo sapiens
ctattagcaactgt

SEQ ID NO: 2677967 - DNA, 15 bp, Homo sapiens
ctatttgttcagaga

SEQ ID NO: 2677968 - DNA, 16 bp, Homo sapiens
ctattttctctgatac

SEQ ID NO: 2677969 - DNA, 17 bp, Homo sapiens
ctattttctctgatact

SEQ ID NO: 2677970 - DNA, 16 bp, Homo sapiens
ctattttctgaccaaa

SEQ ID NO: 2677971 - DNA, 16 bp, Homo sapiens
ctcaatattcaataaa

SEQ ID NO: 2677972 - DNA, 21 bp, Homo sapiens
ctcaatgcattgtcttgtgga

SEQ ID NO: 2677973 - DNA, 16 bp, Homo sapiens
ctcacacctccttttc

SEQ ID NO: 2677974 - DNA, 13 bp, Homo sapiens
ctcacctcagagc

SEQ ID NO: 2677975 - DNA, 11 bp, Homo sapiens
ctcactcctgc

SEQ ID NO: 2677976 - DNA, 16 bp, Homo sapiens
ctcagaagccagtctg

SEQ ID NO: 2677977 - DNA, 11 bp, Homo sapiens
ctcagaagcct

SEQ ID NO: 2677978 - DNA, 13 bp, Homo sapiens
ctcagaagcctga

SEQ ID NO: 2677979 - DNA, 16 bp, Homo sapiens
ctcagaagcctgaggc

SEQ ID NO: 2677980 - DNA, 18 bp, Homo sapiens
ctcagaagcctgaggctg

SEQ ID NO: 2677981 - DNA, 21 bp, Homo sapiens
ctcagcattgtcagcctgaag

SEQ ID NO: 2677982 - DNA, 15 bp, Homo sapiens
ctcagcccagctggc

SEQ ID NO: 2677983 - DNA, 14 bp, Homo sapiens
ctcagtctcaggag

SEQ ID NO: 2677984 - DNA, 15 bp, Homo sapiens
ctcattgtttttccc

SEQ ID NO: 2677985 - DNA, 21 bp, Homo sapiens
ctcattttaatgattgtttaa

SEQ ID NO: 2677986 - DNA, 16 bp, Homo sapiens
ctccaatggggccagc

SEQ ID NO: 2677987 - DNA, 19 bp, Homo sapiens
ctccaatggggccagcact

SEQ ID NO: 2677988 - DNA, 20 bp, Homo sapiens
ctccaatggggccagcactg

SEQ ID NO: 2677989 - DNA, 14 bp, Homo sapiens
ctccacagccgcag

SEQ ID NO: 2677990 - DNA, 15 bp, Homo sapiens
ctccacgcaaggctg

SEQ ID NO: 2677991 - DNA, 21 bp, Homo sapiens
ctccagcatcttttccatcct

SEQ ID NO: 2677992 - DNA, 12 bp, Homo sapiens
ctccagcctggg

SEQ ID NO: 2677993 - DNA, 12 bp, Homo sapiens
ctccatctctgg

SEQ ID NO: 2677994 - DNA, 15 bp, Homo sapiens
ctccatggtgctgca

SEQ ID NO: 2677995 - DNA, 22 bp, Homo sapiens
ctccatgtggccccaggtgcca

SEQ ID NO: 2677996 - DNA, 14 bp, Homo sapiens
ctcccaaggagcca

SEQ ID NO: 2677997 - DNA, 14 bp, Homo sapiens
ctcccagccctcag

SEQ ID NO: 2677998 - DNA, 16 bp, Homo sapiens
ctcccagggccagggc

SEQ ID NO: 2677999 - DNA, 15 bp, Homo sapiens
ctcccagtggcctgg

SEQ ID NO: 2678000 - DNA, 19 bp, Homo sapiens
ctcccagtgggagcttccc

SEQ ID NO: 2678001 - DNA, 13 bp, Homo sapiens
ctccccaagactg

SEQ ID NO: 2678002 - DNA, 23 bp, Homo sapiens
ctccccaggtggaggtgccagga

SEQ ID NO: 2678003 - DNA, 18 bp, Homo sapiens
ctccccatacttcctggg

SEQ ID NO: 2678004 - DNA, 23 bp, Homo sapiens
cttagaaatcattgtagaaacac

SEQ ID NO: 2678005 - DNA, 17 bp, Homo sapiens
cttagacggaggtgcct

SEQ ID NO: 2678006 - DNA, 19 bp, Homo sapiens
cttagagactaaggggcag

SEQ ID NO: 2678007 - DNA, 17 bp, Homo sapiens
cttagattagctctgga

SEQ ID NO: 2678008 - DNA, 19 bp, Homo sapiens
cttagctgaacaatgaatg

SEQ ID NO: 2678009 - DNA, 16 bp, Homo sapiens
cttagctttctcaggg

SEQ ID NO: 2678010 - DNA, 13 bp, Homo sapiens
cttagctttctgg

SEQ ID NO: 2678011 - DNA, 23 bp, Homo sapiens
cttaggtcctcacttctgtctcc

SEQ ID NO: 2678012 - DNA, 20 bp, Homo sapiens
cttagtggggttttatatcc

SEQ ID NO: 2678013 - DNA, 15 bp, Homo sapiens
cttatacctctctca

SEQ ID NO: 2678014 - DNA, 14 bp, Homo sapiens
cttataggtttcca

SEQ ID NO: 2678015 - DNA, 20 bp, Homo sapiens
cttattcccaaactacagaa

SEQ ID NO: 2678016 - DNA, 14 bp, Homo sapiens
cttatttgtataat

SEQ ID NO: 2678017 - DNA, 15 bp, Homo sapiens
cttattttgtattac

SEQ ID NO: 2678018 - DNA, 19 bp, Homo sapiens
cttcaagttagctcaggag

SEQ ID NO: 2678019 - DNA, 15 bp, Homo sapiens
cttcaattcctgggc

SEQ ID NO: 2678020 - DNA, 22 bp, Homo sapiens
cttcactccggtgtgcctgcag

SEQ ID NO: 2678021 - DNA, 23 bp, Homo sapiens
cttcactccggtgtgcctgcagc

SEQ ID NO: 2678022 - DNA, 14 bp, Homo sapiens
cttccaaccccagc

SEQ ID NO: 2678023 - DNA, 18 bp, Homo sapiens
cttccagagagtcctctg

SEQ ID NO: 2678024 - DNA, 17 bp, Homo sapiens
cttcccagaggcagagc

SEQ ID NO: 2678025 - DNA, 18 bp, Homo sapiens
cttcccctttactcagcc

SEQ ID NO: 2678026 - DNA, 12 bp, Homo sapiens
cttcccttctcc

SEQ ID NO: 2678027 - DNA, 20 bp, Homo sapiens
cttcctcagggcccagcagg

SEQ ID NO: 2678028 - DNA, 13 bp, Homo sapiens
cttcctccaggag

SEQ ID NO: 2678029 - DNA, 17 bp, Homo sapiens
cttcctccaggagaagg

SEQ ID NO: 2678030 - DNA, 13 bp, Homo sapiens
cttcctgccacca

SEQ ID NO: 2678031 - DNA, 15 bp, Homo sapiens
cttcctgccaccagt

SEQ ID NO: 2678032 - DNA, 21 bp, Homo sapiens
cttcctgccaccagtcactgt

SEQ ID NO: 2678033 - DNA, 22 bp, Homo sapiens
cttcctgggtcctgcctggtcc

SEQ ID NO: 2678034 - DNA, 21 bp, Homo sapiens
cttcctgtcccacctcttctc

SEQ ID NO: 2678035 - DNA, 16 bp, Homo sapiens
cttccttgcccctgct

SEQ ID NO: 2678036 - DNA, 20 bp, Homo sapiens
cttccttgcccctgctctgt

SEQ ID NO: 2678037 - DNA, 22 bp, Homo sapiens
cttccttgcccctgctctgtag

SEQ ID NO: 2678038 - DNA, 17 bp, Homo sapiens
cttccttgctgtcctag

SEQ ID NO: 2678039 - DNA, 19 bp, Homo sapiens
cttcctttcaggccaaggc

SEQ ID NO: 2678040 - DNA, 19 bp, Homo sapiens
cttcgtctccatctctggt

SEQ ID NO: 2678041 - DNA, 14 bp, Homo sapiens
cttctcccctccac

SEQ ID NO: 2678042 - DNA, 13 bp, Homo sapiens
cttctctgcctcc

SEQ ID NO: 2678043 - DNA, 14 bp, Homo sapiens
cttctctgcctcct

SEQ ID NO: 2678044 - DNA, 14 bp, Homo sapiens
cttctcttcctgta

SEQ ID NO: 2678045 - DNA, 14 bp, Homo sapiens
cttctgcccttcct

SEQ ID NO: 2678046 - DNA, 21 bp, Homo sapiens
cttctgcccttcctccaggag

SEQ ID NO: 2678047 - DNA, 14 bp, Homo sapiens
cttctggagccctt

SEQ ID NO: 2678048 - DNA, 20 bp, Homo sapiens
cttctggagtctccagtggt

SEQ ID NO: 2678049 - DNA, 15 bp, Homo sapiens
cttctgtctcctgtc

SEQ ID NO: 2678050 - DNA, 17 bp, Homo sapiens
cttgaaataccagtgaa

SEQ ID NO: 2678051 - DNA, 17 bp, Homo sapiens
cttgaagccactgaagc

SEQ ID NO: 2678052 - DNA, 19 bp, Homo sapiens
cttgaagccactgaagctg

SEQ ID NO: 2678053 - DNA, 20 bp, Homo sapiens
cttgagcttggcagctgaac

SEQ ID NO: 2678054 - DNA, 12 bp, Homo sapiens
cttgaggacaca

SEQ ID NO: 2678055 - DNA, 14 bp, Homo sapiens
cttgcccctgctct

SEQ ID NO: 2678056 - DNA, 17 bp, Homo sapiens
cttgcccctgctctgta

SEQ ID NO: 2678057 - DNA, 20 bp, Homo sapiens
cttgcccctgctctgtagcc

SEQ ID NO: 2678058 - DNA, 22 bp, Homo sapiens
cttgcccctgctctgtagccac

SEQ ID NO: 2678059 - DNA, 19 bp, Homo sapiens
cttgccctccctttctctc

SEQ ID NO: 2678060 - DNA, 14 bp, Homo sapiens
cttgctctcctgga

SEQ ID NO: 2678061 - DNA, 17 bp, Homo sapiens
cttgctctcctggagca

SEQ ID NO: 2678062 - DNA, 21 bp, Homo sapiens
cttgctctcctggagcaagct

SEQ ID NO: 2678063 - DNA, 22 bp, Homo sapiens
cttgctctctgagagcacagcg

SEQ ID NO: 2678064 - DNA, 20 bp, Homo sapiens
cttgctgtcctaggccacac

SEQ ID NO: 2678065 - DNA, 21 bp, Homo sapiens
cttggaaagcatcacctcagg

SEQ ID NO: 2678066 - DNA, 22 bp, Homo sapiens
cttggcatcacagggcagagcc

SEQ ID NO: 2678067 - DNA, 20 bp, Homo sapiens
cttgggaggctgaggcagga

SEQ ID NO: 2678068 - DNA, 16 bp, Homo sapiens
cttggtttttggctct

SEQ ID NO: 2678069 - DNA, 18 bp, Homo sapiens
cttgtgggaccagtccca

SEQ ID NO: 2678070 - DNA, 16 bp, Homo sapiens
cttgttccgtgccagg

SEQ ID NO: 2678071 - DNA, 19 bp, Homo sapiens
ctttaaaaaagctataaat

SEQ ID NO: 2678072 - DNA, 15 bp, Homo sapiens
ctttaaaataaaata

SEQ ID NO: 2678073 - DNA, 20 bp, Homo sapiens
ctttacatgctgtgctcttt

SEQ ID NO: 2678074 - DNA, 15 bp, Homo sapiens
ctttactcagcccag

SEQ ID NO: 2678075 - DNA, 22 bp, Homo sapiens
ctttactcagcccagctggcca

SEQ ID NO: 2678076 - DNA, 21 bp, Homo sapiens
ctttaggcatatgcttcttta

SEQ ID NO: 2678077 - DNA, 20 bp, Homo sapiens
ctttcagagccagtgaagga

SEQ ID NO: 2678078 - DNA, 16 bp, Homo sapiens
ctttccggggctgctg

SEQ ID NO: 2678079 - DNA, 18 bp, Homo sapiens
ctttccggggctgctggc

SEQ ID NO: 2678080 - DNA, 13 bp, Homo sapiens
ctttccttcctcc

SEQ ID NO: 2678081 - DNA, 14 bp, Homo sapiens
ctttccttctgccc

SEQ ID NO: 2678082 - DNA, 20 bp, Homo sapiens
ctttctctgagaaccaaaag

SEQ ID NO: 2678083 - DNA, 20 bp, Homo sapiens
ctttctgtaggtttctctct

SEQ ID NO: 2678084 - DNA, 22 bp, Homo sapiens
ctttgctacaataaatgctgaa

SEQ ID NO: 2678085 - DNA, 17 bp, Homo sapiens
ctttgggaggctgaggc

SEQ ID NO: 2678086 - DNA, 22 bp, Homo sapiens
ctttggtacatggccagtgtga

SEQ ID NO: 2678087 - DNA, 17 bp, Homo sapiens
ctttgttgtcctcccag

SEQ ID NO: 2678088 - DNA, 18 bp, Homo sapiens
ctttgttgtcctcccagg

SEQ ID NO: 2678089 - DNA, 13 bp, Homo sapiens
cttttaagaaaca

SEQ ID NO: 2678090 - DNA, 14 bp, Homo sapiens
cttttaagaaacac

SEQ ID NO: 2678091 - DNA, 15 bp, Homo sapiens
cttttaagccctgct

SEQ ID NO: 2678092 - DNA, 17 bp, Homo sapiens
cttttaagccctgctct

SEQ ID NO: 2678093 - DNA, 21 bp, Homo sapiens
cttttaagccctgctctttct

SEQ ID NO: 2678094 - DNA, 16 bp, Homo sapiens
cttttattgagctctt

SEQ ID NO: 2678095 - DNA, 14 bp, Homo sapiens
cttttccatcctga

SEQ ID NO: 2678096 - DNA, 20 bp, Homo sapiens
cttttccattgaccagctct

SEQ ID NO: 2678097 - DNA, 15 bp, Homo sapiens
cttttccccaggagc

SEQ ID NO: 2678098 - DNA, 14 bp, Homo sapiens
cttttctgttgtac

SEQ ID NO: 2678099 - DNA, 13 bp, Homo sapiens
cttttgtaacttg

SEQ ID NO: 2678100 - DNA, 13 bp, Homo sapiens
cttttgttgtgac

SEQ ID NO: 2678101 - DNA, 21 bp, Homo sapiens
ctttttagatgtgctgctttg

SEQ ID NO: 2678102 - DNA, 22 bp, Homo sapiens
ctttttgtgaaattcaacctgt

SEQ ID NO: 2678103 - DNA, 19 bp, Homo sapiens
gaaaacacggccctcctgg

SEQ ID NO: 2678104 - DNA, 22 bp, Homo sapiens
gaaaacacggccctcctgggaa

SEQ ID NO: 2678105 - DNA, 14 bp, Homo sapiens
gaaaaccccagcat

SEQ ID NO: 2678106 - DNA, 14 bp, Homo sapiens
gaaacacagggttt

SEQ ID NO: 2678107 - DNA, 18 bp, Homo sapiens
gaaacctgtccataaagt

SEQ ID NO: 2678108 - DNA, 19 bp, Homo sapiens
gaaagcatcacctcaggcc

SEQ ID NO: 2678109 - DNA, 18 bp, Homo sapiens
gaaaggctcagtctcagg

SEQ ID NO: 2678110 - DNA, 22 bp, Homo sapiens
gaaaggctcagtctcaggagca

SEQ ID NO: 2678111 - DNA, 12 bp, Homo sapiens
gaaaggtgctga

SEQ ID NO: 2678112 - DNA, 19 bp, Homo sapiens
gaaaggtgctgatggccct

SEQ ID NO: 2678113 - DNA, 16 bp, Homo sapiens
gaaatcattgtagaaa

SEQ ID NO: 2678114 - DNA, 19 bp, Homo sapiens
gagagcacccacagccgca

SEQ ID NO: 2678115 - DNA, 21 bp, Homo sapiens
gagagccagatgcctccccaa

SEQ ID NO: 2678116 - DNA, 13 bp, Homo sapiens
gagagcccagcca

SEQ ID NO: 2678117 - DNA, 18 bp, Homo sapiens
gagaggccttttgtttaa

SEQ ID NO: 2678118 - DNA, 15 bp, Homo sapiens
gagagtcctctggat

SEQ ID NO: 2678119 - DNA, 13 bp, Homo sapiens
gagatgactgagt

SEQ ID NO: 2678120 - DNA, 17 bp, Homo sapiens
gagattgcgccactgca

SEQ ID NO: 2678121 - DNA, 19 bp, Homo sapiens
gagcaaaagacttgagcca

SEQ ID NO: 2678122 - DNA, 15 bp, Homo sapiens
gagcaaatgtttctg

SEQ ID NO: 2678123 - DNA, 17 bp, Homo sapiens
gagcaagctctgccctg

SEQ ID NO: 2678124 - DNA, 21 bp, Homo sapiens
gagcaagctctgccctggctg

SEQ ID NO: 2678125 - DNA, 22 bp, Homo sapiens
gagcaagctctgccctggctgt

SEQ ID NO: 2678126 - DNA, 18 bp, Homo sapiens
gagcaagtttcatcagcc

SEQ ID NO: 2678127 - DNA, 16 bp, Homo sapiens
gagcaggcagggctgg

SEQ ID NO: 2678128 - DNA, 20 bp, Homo sapiens
gagcaggcagggctgggcca

SEQ ID NO: 2678129 - DNA, 13 bp, Homo sapiens
gagcatctgactc

SEQ ID NO: 2678130 - DNA, 21 bp, Homo sapiens
gagcatggggataaaggagaa

SEQ ID NO: 2678131 - DNA, 22 bp, Homo sapiens
gagcatggggataaaggagaag

SEQ ID NO: 2678132 - DNA, 16 bp, Homo sapiens
gagccagatgcctccc

SEQ ID NO: 2678133 - DNA, 22 bp, Homo sapiens
gagccatcacctaggactgact

SEQ ID NO: 2678134 - DNA, 12 bp, Homo sapiens
gagcccaggagt

SEQ ID NO: 2678135 - DNA, 17 bp, Homo sapiens
gagccccagcttcctgt

SEQ ID NO: 2678136 - DNA, 13 bp, Homo sapiens
gagccctccaggc

SEQ ID NO: 2678137 - DNA, 16 bp, Homo sapiens
gagccctccaggcctg

SEQ ID NO: 2678138 - DNA, 13 bp, Homo sapiens
gagccctggaccc

SEQ ID NO: 2678139 - DNA, 15 bp, Homo sapiens
gagccctggacccca

SEQ ID NO: 2678140 - DNA, 20 bp, Homo sapiens
gagccgagatcacgccactg

SEQ ID NO: 2678141 - DNA, 18 bp, Homo sapiens
gagcctcgtgtcctgcta

SEQ ID NO: 2678142 - DNA, 12 bp, Homo sapiens
gagcctcttagt

SEQ ID NO: 2678143 - DNA, 20 bp, Homo sapiens
gagcgcacctgccccctggt

SEQ ID NO: 2678144 - DNA, 21 bp, Homo sapiens
gagcggcgcagagccctccag

SEQ ID NO: 2678145 - DNA, 16 bp, Homo sapiens
gagctattttaaacca

SEQ ID NO: 2678146 - DNA, 16 bp, Homo sapiens
gagctcctgtccctac

SEQ ID NO: 2678147 - DNA, 20 bp, Homo sapiens
gagctcctgtccctacccac

SEQ ID NO: 2678148 - DNA, 21 bp, Homo sapiens
gagctcctgtccctacccact

SEQ ID NO: 2678149 - DNA, 23 bp, Homo sapiens
gagctcctgtccctacccactct

SEQ ID NO: 2678150 - DNA, 22 bp, Homo sapiens
gagctcttgttccgtgccaggc

SEQ ID NO: 2678151 - DNA, 22 bp, Homo sapiens
gagctgtgctcgggtgctgcca

SEQ ID NO: 2678152 - DNA, 13 bp, Homo sapiens
gaggacacatgtc

SEQ ID NO: 2678153 - DNA, 20 bp, Homo sapiens
gaggaggtggcagccctgta

SEQ ID NO: 2678154 - DNA, 23 bp, Homo sapiens
gaggataacttccttgcccctgc

SEQ ID NO: 2678155 - DNA, 17 bp, Homo sapiens
gaggatcactggagccc

SEQ ID NO: 2678156 - DNA, 20 bp, Homo sapiens
gaggatcactggagcccagg

SEQ ID NO: 2678157 - DNA, 18 bp, Homo sapiens
gaggatgaatagatgtga

SEQ ID NO: 2678158 - DNA, 18 bp, Homo sapiens
gaggcctcttggacctct

SEQ ID NO: 2678159 - DNA, 19 bp, Homo sapiens
gaggcctcttggacctctg

SEQ ID NO: 2678160 - DNA, 24 bp, Homo sapiens
gaggcctcttggacctctgctctg

SEQ ID NO: 2678161 - DNA, 21 bp, Homo sapiens
gaggcctgacacaggccagcc

SEQ ID NO: 2678162 - DNA, 15 bp, Homo sapiens
gaggcttggaaagca

SEQ ID NO: 2678163 - DNA, 15 bp, Homo sapiens
gagggctcctccatg

SEQ ID NO: 2678164 - DNA, 16 bp, Homo sapiens
gagggtcaagggctgg

SEQ ID NO: 2678165 - DNA, 11 bp, Homo sapiens
gagggtgactg

SEQ ID NO: 2678166 - DNA, 15 bp, Homo sapiens
gaggtgagaccacct

SEQ ID NO: 2678167 - DNA, 16 bp, Homo sapiens
gaggtgagaccacctc

SEQ ID NO: 2678168 - DNA, 12 bp, Homo sapiens
gaggtgccagga

SEQ ID NO: 2678169 - DNA, 14 bp, Homo sapiens
gaggtgcctcccag

SEQ ID NO: 2678170 - DNA, 22 bp, Homo sapiens
gaggtgcctcccagtggcctgg

SEQ ID NO: 2678171 - DNA, 22 bp, Homo sapiens
gaggtgcgctcacctcagagca

SEQ ID NO: 2678172 - DNA, 14 bp, Homo sapiens
gaggttggtgactg

SEQ ID NO: 2678173 - DNA, 20 bp, Homo sapiens
gagtctccagtggttgctgt

SEQ ID NO: 2678174 - DNA, 15 bp, Homo sapiens
gagtggggcagcctc

SEQ ID NO: 2678175 - DNA, 22 bp, Homo sapiens
gagtggggcctgccctctgccc

SEQ ID NO: 2678176 - DNA, 21 bp, Homo sapiens
gagtgttcattttagtgactg

SEQ ID NO: 2678177 - DNA, 19 bp, Homo sapiens
gagttcgagaccagcctgg

SEQ ID NO: 2678178 - DNA, 23 bp, Homo sapiens
gataacttccttgcccctgctct

SEQ ID NO: 2678179 - DNA, 18 bp, Homo sapiens
gatatcagagctcttaat

SEQ ID NO: 2678180 - DNA, 13 bp, Homo sapiens
gatcactggagcc

SEQ ID NO: 2678181 - DNA, 17 bp, Homo sapiens
gatcactggagcccagg

SEQ ID NO: 2678182 - DNA, 18 bp, Homo sapiens
gatcactggagcccagga

SEQ ID NO: 2678183 - DNA, 14 bp, Homo sapiens
gatcagagctgcag

SEQ ID NO: 2678184 - DNA, 17 bp, Homo sapiens
gatcagagctgcagcca

SEQ ID NO: 2678185 - DNA, 12 bp, Homo sapiens
gatcccatctct

SEQ ID NO: 2678186 - DNA, 16 bp, Homo sapiens
gatcctgctccagcag

SEQ ID NO: 2678187 - DNA, 15 bp, Homo sapiens
gatcgagccactgca

SEQ ID NO: 2678188 - DNA, 15 bp, Homo sapiens
gatgaatagatgtga

SEQ ID NO: 2678189 - DNA, 20 bp, Homo sapiens
gatgacacctccatttctct

SEQ ID NO: 2678190 - DNA, 23 bp, Homo sapiens
gatgaccctgcgaaggggccctg

SEQ ID NO: 2678191 - DNA, 17 bp, Homo sapiens
gatgactgagtcctcgt

SEQ ID NO: 2678192 - DNA, 21 bp, Homo sapiens
gatgaggaaacaggcctcaag

SEQ ID NO: 2678193 - DNA, 14 bp, Homo sapiens
gatgaggcctcttg

SEQ ID NO: 2678194 - DNA, 16 bp, Homo sapiens
gatgatgtctcttgta

SEQ ID NO: 2678195 - DNA, 20 bp, Homo sapiens
gatgatgtctcttgtagaag

SEQ ID NO: 2678196 - DNA, 16 bp, Homo sapiens
gatgccaaagctgctt

SEQ ID NO: 2678197 - DNA, 18 bp, Homo sapiens
gatgcccagagggcccag

SEQ ID NO: 2678198 - DNA, 13 bp, Homo sapiens
gatgcctccccaa

SEQ ID NO: 2678199 - DNA, 16 bp, Homo sapiens
gatgctgcctgagtca

SEQ ID NO: 2678200 - DNA, 14 bp, Homo sapiens
gatggactctgaaa

SEQ ID NO: 2678201 - DNA, 18 bp, Homo sapiens
gatggcaccaacgggacc

SEQ ID NO: 2678202 - DNA, 13 bp, Homo sapiens
gatggccctcatc

SEQ ID NO: 2678203 - DNA, 18 bp, Homo sapiens
gatggccctcatctccag

SEQ ID NO: 2678204 - DNA, 13 bp, Homo sapiens
gatggtcctgggg

SEQ ID NO: 2678205 - DNA, 21 bp, Homo sapiens
gatggtcctggggctctgtgc

SEQ ID NO: 2678206 - DNA, 18 bp, Homo sapiens
gatggtctccacctgtgc

SEQ ID NO: 2678207 - DNA, 13 bp, Homo sapiens
gatgtctcttgta

SEQ ID NO: 2678208 - DNA, 17 bp, Homo sapiens
gatgtctcttgtagaag

SEQ ID NO: 2678209 - DNA, 15 bp, Homo sapiens
gattaatgttttgta

SEQ ID NO: 2678210 - DNA, 16 bp, Homo sapiens
gattagctctggacca

SEQ ID NO: 2678211 - DNA, 18 bp, Homo sapiens
gattatatatcataaagt

SEQ ID NO: 2678212 - DNA, 19 bp, Homo sapiens
gattatatatcataaagta

SEQ ID NO: 2678213 - DNA, 20 bp, Homo sapiens
gattatatatcataaagtat

SEQ ID NO: 2678214 - DNA, 22 bp, Homo sapiens
gattatatatcataaagtatgc

SEQ ID NO: 2678215 - DNA, 14 bp, Homo sapiens
gattcagatttctc

SEQ ID NO: 2678216 - DNA, 21 bp, Homo sapiens
gattcttcccgctccccacct

SEQ ID NO: 2678217 - DNA, 14 bp, Homo sapiens
gatttcctcttgaa

SEQ ID NO: 2678218 - DNA, 21 bp, Homo sapiens
gatttcctcttgaaccagaac

SEQ ID NO: 2678219 - DNA, 14 bp, Homo sapiens
gcaaagcctccagc

SEQ ID NO: 2678220 - DNA, 13 bp, Homo sapiens
gcaaagttatatt

SEQ ID NO: 2678221 - DNA, 17 bp, Homo sapiens
gcaaatataagctggga

SEQ ID NO: 2678222 - DNA, 14 bp, Homo sapiens
gcaacagagtgaga

SEQ ID NO: 2678223 - DNA, 13 bp, Homo sapiens
gcaaggctgtgct

SEQ ID NO: 2678224 - DNA, 21 bp, Homo sapiens
gctgctccctgctcccaggga

SEQ ID NO: 2678225 - DNA, 21 bp, Homo sapiens
gctgctttcttctctgcctcc

SEQ ID NO: 2678226 - DNA, 15 bp, Homo sapiens
gctggagtctcagag

SEQ ID NO: 2678227 - DNA, 16 bp, Homo sapiens
gctggagtctcagagc

SEQ ID NO: 2678228 - DNA, 20 bp, Homo sapiens
gctggcaggattcttcccgc

SEQ ID NO: 2678229 - DNA, 24 bp, Homo sapiens
gctgggaaggggaacacagaccag

SEQ ID NO: 2678230 - DNA, 16 bp, Homo sapiens
gctgggactggccagg

SEQ ID NO: 2678231 - DNA, 21 bp, Homo sapiens
gctgggcatgccatgtctgag

SEQ ID NO: 2678232 - DNA, 14 bp, Homo sapiens
gctggtccctgccc

SEQ ID NO: 2678233 - DNA, 20 bp, Homo sapiens
gctggtctattttgattttg

SEQ ID NO: 2678234 - DNA, 19 bp, Homo sapiens
gctgtccgtgtgcctcctg

SEQ ID NO: 2678235 - DNA, 23 bp, Homo sapiens
gctgtccgtgtgcctcctgtgtg

SEQ ID NO: 2678236 - DNA, 16 bp, Homo sapiens
gctgtctctcttgttg

SEQ ID NO: 2678237 - DNA, 20 bp, Homo sapiens
gctgtgccttggtttcctga

SEQ ID NO: 2678238 - DNA, 14 bp, Homo sapiens
gctgtgctcttcct

SEQ ID NO: 2678239 - DNA, 15 bp, Homo sapiens
gctgtgctcttcctc

SEQ ID NO: 2678240 - DNA, 22 bp, Homo sapiens
gctgtgctcttcctctggtttc

SEQ ID NO: 2678241 - DNA, 19 bp, Homo sapiens
gctgtgctttatttgtgaa

SEQ ID NO: 2678242 - DNA, 23 bp, Homo sapiens
gctgtgctttatttgtgaaactt

SEQ ID NO: 2678243 - DNA, 21 bp, Homo sapiens
gctgttgatgaggcctcttgg

SEQ ID NO: 2678244 - DNA, 17 bp, Homo sapiens
gcttaaaaaaaactctt

SEQ ID NO: 2678245 - DNA, 13 bp, Homo sapiens
gcttaaaagacat

SEQ ID NO: 2678246 - DNA, 19 bp, Homo sapiens
gcttcaagtgttgctcttg

SEQ ID NO: 2678247 - DNA, 21 bp, Homo sapiens
gcttcaagtgttgctcttgga

SEQ ID NO: 2678248 - DNA, 12 bp, Homo sapiens
gcttcagcctga

SEQ ID NO: 2678249 - DNA, 13 bp, Homo sapiens
gcttccagagagt

SEQ ID NO: 2678250 - DNA, 19 bp, Homo sapiens
gcttccagagagtcctctg

SEQ ID NO: 2678251 - DNA, 20 bp, Homo sapiens
gcttccagagagtcctctgg

SEQ ID NO: 2678252 - DNA, 22 bp, Homo sapiens
gcttccagagagtcctctggat

SEQ ID NO: 2678253 - DNA, 22 bp, Homo sapiens
gcttcccgggataaactgagcc

SEQ ID NO: 2678254 - DNA, 23 bp, Homo sapiens
gcttcccgggataaactgagcct

SEQ ID NO: 2678255 - DNA, 20 bp, Homo sapiens
gcttcctcagggcccagcag

SEQ ID NO: 2678256 - DNA, 17 bp, Homo sapiens
gcttcctgaaagctgtt

SEQ ID NO: 2678257 - DNA, 18 bp, Homo sapiens
gcttcctgaaagctgttg

SEQ ID NO: 2678258 - DNA, 13 bp, Homo sapiens
gcttcctgggtcc

SEQ ID NO: 2678259 - DNA, 19 bp, Homo sapiens
gcttcctgggtcctgcctg

SEQ ID NO: 2678260 - DNA, 22 bp, Homo sapiens
gcttcctgggtcctgcctggtc

SEQ ID NO: 2678261 - DNA, 22 bp, Homo sapiens
gcttccttggcatcacagggca

SEQ ID NO: 2678262 - DNA, 17 bp, Homo sapiens
gcttcctttcaggccaa

SEQ ID NO: 2678263 - DNA, 12 bp, Homo sapiens
gcttctggagcc

SEQ ID NO: 2678264 - DNA, 13 bp, Homo sapiens
gcttctggagccc

SEQ ID NO: 2678265 - DNA, 18 bp, Homo sapiens
gcttctggagcccttggg

SEQ ID NO: 2678266 - DNA, 20 bp, Homo sapiens
gcttctttaaaaaagctata

SEQ ID NO: 2678267 - DNA, 16 bp, Homo sapiens
gcttgctctcctggag

SEQ ID NO: 2678268 - DNA, 20 bp, Homo sapiens
gcttgctctcctggagcaag

SEQ ID NO: 2678269 - DNA, 17 bp, Homo sapiens
gcttgcttgccgagcct

SEQ ID NO: 2678270 - DNA, 20 bp, Homo sapiens
gctttacatgctgtgctctt

SEQ ID NO: 2678271 - DNA, 12 bp, Homo sapiens
gctttagcttat

SEQ ID NO: 2678272 - DNA, 13 bp, Homo sapiens
gctttcagagcca

SEQ ID NO: 2678273 - DNA, 13 bp, Homo sapiens
gctttccttcctc

SEQ ID NO: 2678274 - DNA, 20 bp, Homo sapiens
gctttccttcctcccctttt

SEQ ID NO: 2678275 - DNA, 21 bp, Homo sapiens
gctttccttctgcccttcctc

SEQ ID NO: 2678276 - DNA, 12 bp, Homo sapiens
gctttctcaggg

SEQ ID NO: 2678277 - DNA, 13 bp, Homo sapiens
gctttcttctctg

SEQ ID NO: 2678278 - DNA, 14 bp, Homo sapiens
gctttcttctctgc

SEQ ID NO: 2678279 - DNA, 14 bp, Homo sapiens
gctttgttgtcctc

SEQ ID NO: 2678280 - DNA, 16 bp, Homo sapiens
gcttttcatggaagtg

SEQ ID NO: 2678281 - DNA, 21 bp, Homo sapiens
gcttttgcacaccttttcccc

SEQ ID NO: 2678282 - DNA, 20 bp, Homo sapiens
gcttttgttgtgacttttta

SEQ ID NO: 2678283 - DNA, 15 bp, Homo sapiens
ggaaaaaagttttga

SEQ ID NO: 2678284 - DNA, 16 bp, Homo sapiens
ggaaagcctctgctgc

SEQ ID NO: 2678285 - DNA, 20 bp, Homo sapiens
ggaaagctgatgatgtctct

SEQ ID NO: 2678286 - DNA, 20 bp, Homo sapiens
ggaaaggctcagtctcagga

SEQ ID NO: 2678287 - DNA, 23 bp, Homo sapiens
ggaaaggctcagtctcaggagca

SEQ ID NO: 2678288 - DNA, 18 bp, Homo sapiens
ggaaatggtatccagaat

SEQ ID NO: 2678289 - DNA, 19 bp, Homo sapiens
ggaacacagaccaggaagc

SEQ ID NO: 2678290 - DNA, 21 bp, Homo sapiens
ggaaccaaaaaaccccagcta

SEQ ID NO: 2678291 - DNA, 18 bp, Homo sapiens
ggaaccagtgtaactggc

SEQ ID NO: 2678292 - DNA, 23 bp, Homo sapiens
ggaactgagccagaaacgcagat

SEQ ID NO: 2678293 - DNA, 18 bp, Homo sapiens
ggaagaaattcctgtagc

SEQ ID NO: 2678294 - DNA, 17 bp, Homo sapiens
ggaaggctggctgggca

SEQ ID NO: 2678295 - DNA, 15 bp, Homo sapiens
ggaagtgcccagccc

SEQ ID NO: 2678296 - DNA, 22 bp, Homo sapiens
ggaagtgttcaagaaataaaaa

SEQ ID NO: 2678297 - DNA, 14 bp, Homo sapiens
ggacacaagcggcc

SEQ ID NO: 2678298 - DNA, 18 bp, Homo sapiens
ggacacaagcggccctga

SEQ ID NO: 2678299 - DNA, 21 bp, Homo sapiens
ggacacaagcggccctgacac

SEQ ID NO: 2678300 - DNA, 12 bp, Homo sapiens
ggacacatgtcc

SEQ ID NO: 2678301 - DNA, 13 bp, Homo sapiens
ggacacatgtcca

SEQ ID NO: 2678302 - DNA, 14 bp, Homo sapiens
ggacacctgccctg

SEQ ID NO: 2678303 - DNA, 17 bp, Homo sapiens
ggacacctgccctgccc

SEQ ID NO: 2678304 - DNA, 22 bp, Homo sapiens
ggacagctgctgggacccacct

SEQ ID NO: 2678305 - DNA, 14 bp, Homo sapiens
ggacagtgcttcag

SEQ ID NO: 2678306 - DNA, 17 bp, Homo sapiens
ggacagtgcttcagcct

SEQ ID NO: 2678307 - DNA, 22 bp, Homo sapiens
ggacagtgcttcagcctgaggc

SEQ ID NO: 2678308 - DNA, 23 bp, Homo sapiens
ggacagtgcttcagcctgaggct

SEQ ID NO: 2678309 - DNA, 18 bp, Homo sapiens
ggaccaaagccacctgct

SEQ ID NO: 2678310 - DNA, 21 bp, Homo sapiens
ggaccaaagccacctgctgcg

SEQ ID NO: 2678311 - DNA, 20 bp, Homo sapiens
ggaccaaccctgtttcctga

SEQ ID NO: 2678312 - DNA, 15 bp, Homo sapiens
ggaccagtcccacac

SEQ ID NO: 2678313 - DNA, 18 bp, Homo sapiens
ggacccaaatttccctgg

SEQ ID NO: 2678314 - DNA, 15 bp, Homo sapiens
ggacccacctccccc

SEQ ID NO: 2678315 - DNA, 19 bp, Homo sapiens
ggacccacctccccctccc

SEQ ID NO: 2678316 - DNA, 12 bp, Homo sapiens
ggacctctgctc

SEQ ID NO: 2678317 - DNA, 14 bp, Homo sapiens
ggacctctgctctg

SEQ ID NO: 2678318 - DNA, 12 bp, Homo sapiens
ggaccttcctgc

SEQ ID NO: 2678319 - DNA, 22 bp, Homo sapiens
ggaccttgtgggaccagtccca

SEQ ID NO: 2678320 - DNA, 16 bp, Homo sapiens
ggactgtgaccaaagc

SEQ ID NO: 2678321 - DNA, 19 bp, Homo sapiens
ggactgtgaccaaagcatt

SEQ ID NO: 2678322 - DNA, 16 bp, Homo sapiens
ggagaagcccctgggg

SEQ ID NO: 2678323 - DNA, 11 bp, Homo sapiens
ggagagcccag

SEQ ID NO: 2678324 - DNA, 18 bp, Homo sapiens
ggagcaagctctgccctg

SEQ ID NO: 2678325 - DNA, 20 bp, Homo sapiens
ggagcaagctctgccctggc

SEQ ID NO: 2678326 - DNA, 15 bp, Homo sapiens
ggagccagttctggg

SEQ ID NO: 2678327 - DNA, 21 bp, Homo sapiens
ggagccatcacctaggactga

SEQ ID NO: 2678328 - DNA, 19 bp, Homo sapiens
ggagcctcgtgtcctgcta

SEQ ID NO: 2678329 - DNA, 20 bp, Homo sapiens
ggaggatcactggagcccag

SEQ ID NO: 2678330 - DNA, 22 bp, Homo sapiens
ggaggccccaggctgagagcca

SEQ ID NO: 2678331 - DNA, 20 bp, Homo sapiens
ggaggtggaggttgcagtga

SEQ ID NO: 2678332 - DNA, 14 bp, Homo sapiens
ggaggttgcaggga

SEQ ID NO: 2678333 - DNA, 16 bp, Homo sapiens
gtggaagtgcccagcc

SEQ ID NO: 2678334 - DNA, 12 bp, Homo sapiens
gtggacacctgc

SEQ ID NO: 2678335 - DNA, 16 bp, Homo sapiens
gtggacacctgccctg

SEQ ID NO: 2678336 - DNA, 14 bp, Homo sapiens
gtggaccttcctgc

SEQ ID NO: 2678337 - DNA, 23 bp, Homo sapiens
gtggagaaataaaaatacctctt

SEQ ID NO: 2678338 - DNA, 14 bp, Homo sapiens
gtggaggtgccagg

SEQ ID NO: 2678339 - DNA, 15 bp, Homo sapiens
gtggatcacctgagg

SEQ ID NO: 2678340 - DNA, 19 bp, Homo sapiens
gtggatcatgaggtcagga

SEQ ID NO: 2678341 - DNA, 18 bp, Homo sapiens
gtggatggtctccacctg

SEQ ID NO: 2678342 - DNA, 17 bp, Homo sapiens
gtggccccaggtgccac

SEQ ID NO: 2678343 - DNA, 12 bp, Homo sapiens
gtggcctggctt

SEQ ID NO: 2678344 - DNA, 11 bp, Homo sapiens
gtgggaccagt

SEQ ID NO: 2678345 - DNA, 13 bp, Homo sapiens
gtggggccttggt

SEQ ID NO: 2678346 - DNA, 13 bp, Homo sapiens
gtggggctcccgg

SEQ ID NO: 2678347 - DNA, 15 bp, Homo sapiens
gtgggtatcaggact

SEQ ID NO: 2678348 - DNA, 22 bp, Homo sapiens
gtgggtcagcccagcacctgct

SEQ ID NO: 2678349 - DNA, 14 bp, Homo sapiens
gtggtcacaggctg

SEQ ID NO: 2678350 - DNA, 17 bp, Homo sapiens
gtggtcacaggctgtgc

SEQ ID NO: 2678351 - DNA, 17 bp, Homo sapiens
gtgtaactggctgctcc

SEQ ID NO: 2678352 - DNA, 21 bp, Homo sapiens
gtgtaactggctgctccctgc

SEQ ID NO: 2678353 - DNA, 13 bp, Homo sapiens
gtgtactgataaa

SEQ ID NO: 2678354 - DNA, 14 bp, Homo sapiens
gtgtagccaaggtc

SEQ ID NO: 2678355 - DNA, 17 bp, Homo sapiens
gtgtagccttgcccgga

SEQ ID NO: 2678356 - DNA, 23 bp, Homo sapiens
gtgtccagaccattgtcttccaa

SEQ ID NO: 2678357 - DNA, 21 bp, Homo sapiens
gtgtcctcctgctctgcttcc

SEQ ID NO: 2678358 - DNA, 22 bp, Homo sapiens
gtgtcctgctagctgtctctct

SEQ ID NO: 2678359 - DNA, 13 bp, Homo sapiens
gtgtgaccctgag

SEQ ID NO: 2678360 - DNA, 21 bp, Homo sapiens
gtgtgaccctgagggctcctc

SEQ ID NO: 2678361 - DNA, 19 bp, Homo sapiens
gtgtgatcccaagtgccag

SEQ ID NO: 2678362 - DNA, 12 bp, Homo sapiens
gtgtgcctcctg

SEQ ID NO: 2678363 - DNA, 13 bp, Homo sapiens
gtgtgcctcctgt

SEQ ID NO: 2678364 - DNA, 15 bp, Homo sapiens
gtgttcaagaaataa

SEQ ID NO: 2678365 - DNA, 20 bp, Homo sapiens
gttaaaggaagtttgttcac

SEQ ID NO: 2678366 - DNA, 19 bp, Homo sapiens
gttaattgattaaaatctg

SEQ ID NO: 2678367 - DNA, 17 bp, Homo sapiens
gttagccaacttcaaga

SEQ ID NO: 2678368 - DNA, 23 bp, Homo sapiens
gttatagaatacttttttctagt

SEQ ID NO: 2678369 - DNA, 17 bp, Homo sapiens
gttatcacccaggcctg

SEQ ID NO: 2678370 - DNA, 12 bp, Homo sapiens
gttattgtggaa

SEQ ID NO: 2678371 - DNA, 14 bp, Homo sapiens
gttcaagcccaggc

SEQ ID NO: 2678372 - DNA, 16 bp, Homo sapiens
gttcatggtgatcagt

SEQ ID NO: 2678373 - DNA, 16 bp, Homo sapiens
gttcattctgatgtcc

SEQ ID NO: 2678374 - DNA, 14 bp, Homo sapiens
gttccgtgccaggc

SEQ ID NO: 2678375 - DNA, 18 bp, Homo sapiens
gttcgagaccagcctggc

SEQ ID NO: 2678376 - DNA, 19 bp, Homo sapiens
gttcgagaccagcctggcc

SEQ ID NO: 2678377 - DNA, 15 bp, Homo sapiens
gttctctttgctgac

SEQ ID NO: 2678378 - DNA, 21 bp, Homo sapiens
gttctgagaagcgctgccctg

SEQ ID NO: 2678379 - DNA, 18 bp, Homo sapiens
gttctggggcccgcctgc

SEQ ID NO: 2678380 - DNA, 22 bp, Homo sapiens
gttcttagctgaacaatgaatg

SEQ ID NO: 2678381 - DNA, 13 bp, Homo sapiens
gttgaaaaatcta

SEQ ID NO: 2678382 - DNA, 16 bp, Homo sapiens
gttgaaaaatctagtt

SEQ ID NO: 2678383 - DNA, 21 bp, Homo sapiens
gttgataaattccactggact

SEQ ID NO: 2678384 - DNA, 22 bp, Homo sapiens
gttgctgatggcccctccagca

SEQ ID NO: 2678385 - DNA, 15 bp, Homo sapiens
gttggggggtgagtg

SEQ ID NO: 2678386 - DNA, 11 bp, Homo sapiens
gttggtgactg

SEQ ID NO: 2678387 - DNA, 19 bp, Homo sapiens
gttgtcctcccaggaacca

SEQ ID NO: 2678388 - DNA, 22 bp, Homo sapiens
gttgtcctcccaggaaccaaaa

SEQ ID NO: 2678389 - DNA, 23 bp, Homo sapiens
gttgtgactttttagccagtgac

SEQ ID NO: 2678390 - DNA, 23 bp, Homo sapiens
gtttaaaaaaagtatatattcta

SEQ ID NO: 2678391 - DNA, 14 bp, Homo sapiens
gtttattggaagtg

SEQ ID NO: 2678392 - DNA, 20 bp, Homo sapiens
gtttattggaagtgttcaag

SEQ ID NO: 2678393 - DNA, 14 bp, Homo sapiens
gtttcagtaaataa

SEQ ID NO: 2678394 - DNA, 21 bp, Homo sapiens
gtttccaaagggcagtaaagt

SEQ ID NO: 2678395 - DNA, 22 bp, Homo sapiens
gtttcctaaaatatctgggtgg

SEQ ID NO: 2678396 - DNA, 14 bp, Homo sapiens
gtttctgcagtagt

SEQ ID NO: 2678397 - DNA, 12 bp, Homo sapiens
gtttgagccctg

SEQ ID NO: 2678398 - DNA, 14 bp, Homo sapiens
gtttgttccagaat

SEQ ID NO: 2678399 - DNA, 21 bp, Homo sapiens
gttttgatgaaattcttgaag

SEQ ID NO: 2678400 - DNA, 18 bp, Homo sapiens
gttttgcttttgtaactt

SEQ ID NO: 2678401 - DNA, 13 bp, Homo sapiens
gtttttggctctt

SEQ ID NO: 2678402 - DNA, 13 bp, Homo sapiens
taaaacatgcacg

SEQ ID NO: 2678403 - DNA, 19 bp, Homo sapiens
taaaatctggcaaagttat

SEQ ID NO: 2678404 - DNA, 13 bp, Homo sapiens
taaaatctgtgaa

SEQ ID NO: 2678405 - DNA, 17 bp, Homo sapiens
taaaattcttgggagtg

SEQ ID NO: 2678406 - DNA, 22 bp, Homo sapiens
taaactgtatcaaatctgtata

SEQ ID NO: 2678407 - DNA, 17 bp, Homo sapiens
taaagaactccttattt

SEQ ID NO: 2678408 - DNA, 19 bp, Homo sapiens
taaagaactccttattttg

SEQ ID NO: 2678409 - DNA, 20 bp, Homo sapiens
taaagatatcagagctctta

SEQ ID NO: 2678410 - DNA, 13 bp, Homo sapiens
taaagcttaaatt

SEQ ID NO: 2678411 - DNA, 22 bp, Homo sapiens
taaaggtatttagaatatatta

SEQ ID NO: 2678412 - DNA, 17 bp, Homo sapiens
taaatataaatgtttaa

SEQ ID NO: 2678413 - DNA, 14 bp, Homo sapiens
taaatgctgaatga

SEQ ID NO: 2678414 - DNA, 19 bp, Homo sapiens
taaatgttctcgttttgaa

SEQ ID NO: 2678415 - DNA, 13 bp, Homo sapiens
taaattccactgg

SEQ ID NO: 2678416 - DNA, 16 bp, Homo sapiens
taaattccactggact

SEQ ID NO: 2678417 - DNA, 20 bp, Homo sapiens
taacagcaggtgtgaccctg

SEQ ID NO: 2678418 - DNA, 21 bp, Homo sapiens
taacagcaggtgtgaccctga

SEQ ID NO: 2678419 - DNA, 16 bp, Homo sapiens
taacataaaatctgtg

SEQ ID NO: 2678420 - DNA, 21 bp, Homo sapiens
taacataaaatctgtgaatta

SEQ ID NO: 2678421 - DNA, 17 bp, Homo sapiens
taacatagaattgcaat

SEQ ID NO: 2678422 - DNA, 16 bp, Homo sapiens
taactggctgctccct

SEQ ID NO: 2678423 - DNA, 17 bp, Homo sapiens
taactggtgatatatct

SEQ ID NO: 2678424 - DNA, 18 bp, Homo sapiens
taactggtgatatatctc

SEQ ID NO: 2678425 - DNA, 23 bp, Homo sapiens
taagaaacacagggttttgtatt

SEQ ID NO: 2678426 - DNA, 15 bp, Homo sapiens
taagagaaacaggcc

SEQ ID NO: 2678427 - DNA, 12 bp, Homo sapiens
taagccctgctc

SEQ ID NO: 2678428 - DNA, 17 bp, Homo sapiens
taagccctgctctttct

SEQ ID NO: 2678429 - DNA, 22 bp, Homo sapiens
taagccctgctctttctctgag

SEQ ID NO: 2678430 - DNA, 14 bp, Homo sapiens
taagctctctgggc

SEQ ID NO: 2678431 - DNA, 21 bp, Homo sapiens
taagctctctgggcctgggtt

SEQ ID NO: 2678432 - DNA, 22 bp, Homo sapiens
taaggggcagctcctgaccaaa

SEQ ID NO: 2678433 - DNA, 18 bp, Homo sapiens
taagtaccactcaggcca

SEQ ID NO: 2678434 - DNA, 17 bp, Homo sapiens
taagtacttgctctctg

SEQ ID NO: 2678435 - DNA, 19 bp, Homo sapiens
taagtctgggatgtagaac

SEQ ID NO: 2678436 - DNA, 12 bp, Homo sapiens
taagttgagtat

SEQ ID NO: 2678437 - DNA, 19 bp, Homo sapiens
taatacttcatttggtgct

SEQ ID NO: 2678438 - DNA, 22 bp, Homo sapiens
taatatctgagaagtgtatata

SEQ ID NO: 2678439 - DNA, 21 bp, Homo sapiens
taatatttatgtctctgttat

SEQ ID NO: 2678440 - DNA, 23 bp, Homo sapiens
taatcaacatggctacttgcttt

SEQ ID NO: 2678441 - DNA, 18 bp, Homo sapiens
taatcagcattattcttc

SEQ ID NO: 2678442 - DNA, 11 bp, Homo sapiens
taatgctttgg

SEQ ID NO: 2678443 - DNA, 16 bp, Homo sapiens
tccttgcccctgctct

SEQ ID NO: 2678444 - DNA, 18 bp, Homo sapiens
tcctttcaggccaaggct

SEQ ID NO: 2678445 - DNA, 19 bp, Homo sapiens
tcctttctgtaggtttctc

SEQ ID NO: 2678446 - DNA, 15 bp, Homo sapiens
tcgagaccagcctgg

SEQ ID NO: 2678447 - DNA, 16 bp, Homo sapiens
tcgagaccagcctggc

SEQ ID NO: 2678448 - DNA, 17 bp, Homo sapiens
tcgagaccagcctggcc

SEQ ID NO: 2678449 - DNA, 15 bp, Homo sapiens
tcgagccactgcact

SEQ ID NO: 2678450 - DNA, 18 bp, Homo sapiens
tcggacagtgcccatgca

SEQ ID NO: 2678451 - DNA, 17 bp, Homo sapiens
tcggctcccgcttgctc

SEQ ID NO: 2678452 - DNA, 19 bp, Homo sapiens
tcgggacagaccagcagca

SEQ ID NO: 2678453 - DNA, 12 bp, Homo sapiens
tcgggcccctgc

SEQ ID NO: 2678454 - DNA, 15 bp, Homo sapiens
tcgggcccctgcctg

SEQ ID NO: 2678455 - DNA, 17 bp, Homo sapiens
tcgggcccctgcctgcc

SEQ ID NO: 2678456 - DNA, 23 bp, Homo sapiens
tcgggcccctgcctgccttctcc

SEQ ID NO: 2678457 - DNA, 17 bp, Homo sapiens
tcggggcatgctggggc

SEQ ID NO: 2678458 - DNA, 15 bp, Homo sapiens
tcggggccctgtgta

SEQ ID NO: 2678459 - DNA, 12 bp, Homo sapiens
tcgtggacacct

SEQ ID NO: 2678460 - DNA, 13 bp, Homo sapiens
tcgtggacacctg

SEQ ID NO: 2678461 - DNA, 20 bp, Homo sapiens
tcgtggacacctgccctgcc

SEQ ID NO: 2678462 - DNA, 12 bp, Homo sapiens
tcgtgtcctgct

SEQ ID NO: 2678463 - DNA, 19 bp, Homo sapiens
tcgtgtcctgctagctgtc

SEQ ID NO: 2678464 - DNA, 15 bp, Homo sapiens
tctaattcctgttgc

SEQ ID NO: 2678465 - DNA, 21 bp, Homo sapiens
tctacacatatatgtatatgt

SEQ ID NO: 2678466 - DNA, 15 bp, Homo sapiens
tctactcattttaat

SEQ ID NO: 2678467 - DNA, 14 bp, Homo sapiens
tctactgccctccc

SEQ ID NO: 2678468 - DNA, 15 bp, Homo sapiens
tctactgccctcccc

SEQ ID NO: 2678469 - DNA, 17 bp, Homo sapiens
tctactgccctcccctt

SEQ ID NO: 2678470 - DNA, 21 bp, Homo sapiens
tctactgccctccccttcccc

SEQ ID NO: 2678471 - DNA, 17 bp, Homo sapiens
tctagcctgggccagag

SEQ ID NO: 2678472 - DNA, 16 bp, Homo sapiens
tctagtcccttctctc

SEQ ID NO: 2678473 - DNA, 22 bp, Homo sapiens
tctagtcccttctctctttcta

SEQ ID NO: 2678474 - DNA, 23 bp, Homo sapiens
tctagtttcagtaaataatgaaa

SEQ ID NO: 2678475 - DNA, 17 bp, Homo sapiens
tctagttttttttgtaa

SEQ ID NO: 2678476 - DNA, 15 bp, Homo sapiens
tctataaacactgtt

SEQ ID NO: 2678477 - DNA, 12 bp, Homo sapiens
tctatgccaggc

SEQ ID NO: 2678478 - DNA, 20 bp, Homo sapiens
tctcagccaacccgctccac

SEQ ID NO: 2678479 - DNA, 20 bp, Homo sapiens
tctcagccctccatggcctg

SEQ ID NO: 2678480 - DNA, 21 bp, Homo sapiens
tctcagccctccatggcctgg

SEQ ID NO: 2678481 - DNA, 20 bp, Homo sapiens
tctcagggggtcagcagagt

SEQ ID NO: 2678482 - DNA, 13 bp, Homo sapiens
tctccacctgtgc

SEQ ID NO: 2678483 - DNA, 15 bp, Homo sapiens
tctccacctgtgctt

SEQ ID NO: 2678484 - DNA, 20 bp, Homo sapiens
tctccagctaactgtggaga

SEQ ID NO: 2678485 - DNA, 12 bp, Homo sapiens
tctccccctggg

SEQ ID NO: 2678486 - DNA, 13 bp, Homo sapiens
tctccccctgggc

SEQ ID NO: 2678487 - DNA, 15 bp, Homo sapiens
tctcctgctgcgtga

SEQ ID NO: 2678488 - DNA, 14 bp, Homo sapiens
tctcctggagcaag

SEQ ID NO: 2678489 - DNA, 14 bp, Homo sapiens
tctcctttcaggga

SEQ ID NO: 2678490 - DNA, 20 bp, Homo sapiens
tctctactcctacctcagcc

SEQ ID NO: 2678491 - DNA, 23 bp, Homo sapiens
tctctccaccccccacgtctgtc

SEQ ID NO: 2678492 - DNA, 17 bp, Homo sapiens
tctctcttcccttctcc

SEQ ID NO: 2678493 - DNA, 16 bp, Homo sapiens
tctctgagaaccaaaa

SEQ ID NO: 2678494 - DNA, 23 bp, Homo sapiens
tctctgagaaccaaaagatgcct

SEQ ID NO: 2678495 - DNA, 14 bp, Homo sapiens
tctctgctggcagg

SEQ ID NO: 2678496 - DNA, 11 bp, Homo sapiens
tctctgggcct

SEQ ID NO: 2678497 - DNA, 18 bp, Homo sapiens
tctctgtgaccgccctcc

SEQ ID NO: 2678498 - DNA, 22 bp, Homo sapiens
tctctgtgctttgactcacctg

SEQ ID NO: 2678499 - DNA, 15 bp, Homo sapiens
tctcttcccttctcc

SEQ ID NO: 2678500 - DNA, 11 bp, Homo sapiens
tctcttcctgt

SEQ ID NO: 2678501 - DNA, 20 bp, Homo sapiens
tctcttgttgatttccgtga

SEQ ID NO: 2678502 - DNA, 12 bp, Homo sapiens
tctctttgaaac

SEQ ID NO: 2678503 - DNA, 16 bp, Homo sapiens
tctgaaaaacattcca

SEQ ID NO: 2678504 - DNA, 18 bp, Homo sapiens
tctgaaatcgccgtgtta

SEQ ID NO: 2678505 - DNA, 16 bp, Homo sapiens
tctgaaatttcccaca

SEQ ID NO: 2678506 - DNA, 15 bp, Homo sapiens
tctgaacaaaagctt

SEQ ID NO: 2678507 - DNA, 17 bp, Homo sapiens
tctgaaggcaaatataa

SEQ ID NO: 2678508 - DNA, 12 bp, Homo sapiens
tctgacctgcag

SEQ ID NO: 2678509 - DNA, 21 bp, Homo sapiens
tctgacctgcaggccaagagc

SEQ ID NO: 2678510 - DNA, 16 bp, Homo sapiens
tctgactcacaagaag

SEQ ID NO: 2678511 - DNA, 22 bp, Homo sapiens
tctgagaaccaaaagatgcctt

SEQ ID NO: 2678512 - DNA, 15 bp, Homo sapiens
tctgagaagcgctgc

SEQ ID NO: 2678513 - DNA, 17 bp, Homo sapiens
tctgagaagcgctgccc

SEQ ID NO: 2678514 - DNA, 18 bp, Homo sapiens
tctgagaagcgctgccct

SEQ ID NO: 2678515 - DNA, 20 bp, Homo sapiens
tctgagaagcgctgccctgt

SEQ ID NO: 2678516 - DNA, 16 bp, Homo sapiens
tctgagaagtgtatat

SEQ ID NO: 2678517 - DNA, 18 bp, Homo sapiens
tctgagcggcgcagagcc

SEQ ID NO: 2678518 - DNA, 22 bp, Homo sapiens
tctgagcggcgcagagccctcc

SEQ ID NO: 2678519 - DNA, 18 bp, Homo sapiens
tctgagcttttcatggaa

SEQ ID NO: 2678520 - DNA, 22 bp, Homo sapiens
tctgagcttttcatggaagtgg

SEQ ID NO: 2678521 - DNA, 15 bp, Homo sapiens
tctgaggcttccaga

SEQ ID NO: 2678522 - DNA, 19 bp, Homo sapiens
tctgaggcttccagagagt

SEQ ID NO: 2678523 - DNA, 22 bp, Homo sapiens
tctgatgtccatttgtcccaat

SEQ ID NO: 2678524 - DNA, 23 bp, Homo sapiens
tctgcagacaagtcttgctgtgc

SEQ ID NO: 2678525 - DNA, 19 bp, Homo sapiens
tctgcagtagtctctgtgc

SEQ ID NO: 2678526 - DNA, 20 bp, Homo sapiens
tctgcagtagtctctgtgct

SEQ ID NO: 2678527 - DNA, 20 bp, Homo sapiens
tctgcattgttattgtggaa

SEQ ID NO: 2678528 - DNA, 21 bp, Homo sapiens
tctgcattgttattgtggaag

SEQ ID NO: 2678529 - DNA, 22 bp, Homo sapiens
tctgcattgttattgtggaaga

SEQ ID NO: 2678530 - DNA, 23 bp, Homo sapiens
tctgcattgttattgtggaagat

SEQ ID NO: 2678531 - DNA, 18 bp, Homo sapiens
tctgcccacattggaccc

SEQ ID NO: 2678532 - DNA, 14 bp, Homo sapiens
tctgccccagctct

SEQ ID NO: 2678533 - DNA, 13 bp, Homo sapiens
tctgccctggctg

SEQ ID NO: 2678534 - DNA, 16 bp, Homo sapiens
tctgccctggctgtgg

SEQ ID NO: 2678535 - DNA, 22 bp, Homo sapiens
tctgccctggctgtgggtatca

SEQ ID NO: 2678536 - DNA, 19 bp, Homo sapiens
tctgcccttcctccaggag

SEQ ID NO: 2678537 - DNA, 15 bp, Homo sapiens
tctgcctcctcctca

SEQ ID NO: 2678538 - DNA, 16 bp, Homo sapiens
tctgcgccccgcctcc

SEQ ID NO: 2678539 - DNA, 20 bp, Homo sapiens
tctgctctgaggcttccaga

SEQ ID NO: 2678540 - DNA, 22 bp, Homo sapiens
tctgctggcaggattcttcccg

SEQ ID NO: 2678541 - DNA, 13 bp, Homo sapiens
tctgcttcctcag

SEQ ID NO: 2678542 - DNA, 17 bp, Homo sapiens
tctgcttcctcagggcc

SEQ ID NO: 2678543 - DNA, 23 bp, Homo sapiens
tctggaccaaccctgtttcctga

SEQ ID NO: 2678544 - DNA, 12 bp, Homo sapiens
tctggagccctt

SEQ ID NO: 2678545 - DNA, 18 bp, Homo sapiens
tctggatggcaccagagg

SEQ ID NO: 2678546 - DNA, 19 bp, Homo sapiens
tctggatggcaccagaggc

SEQ ID NO: 2678547 - DNA, 23 bp, Homo sapiens
tctggcttatgctcagaagccag

SEQ ID NO: 2678548 - DNA, 23 bp, Homo sapiens
tctgggatgtagaacttcaagaa

SEQ ID NO: 2678549 - DNA, 19 bp, Homo sapiens
tctggggcccgcctgccac

SEQ ID NO: 2678550 - DNA, 21 bp, Homo sapiens
tctgggtggaagtgcccagcc

SEQ ID NO: 2678551 - DNA, 22 bp, Homo sapiens
tctgggtggaagtgcccagccc

SEQ ID NO: 2678552 - DNA, 23 bp, Homo sapiens
tctggtatgaacttgaggacaca

SEQ ID NO: 2678553 - DNA, 17 bp, Homo sapiens
tgggctggctctgaagc

SEQ ID NO: 2678554 - DNA, 21 bp, Homo sapiens
tgggctggctctgaagccaag

SEQ ID NO: 2678555 - DNA, 17 bp, Homo sapiens
tggggagggtcaagggc

SEQ ID NO: 2678556 - DNA, 18 bp, Homo sapiens
tggggattcagatttctc

SEQ ID NO: 2678557 - DNA, 20 bp, Homo sapiens
tggggattcagatttctctt

SEQ ID NO: 2678558 - DNA, 16 bp, Homo sapiens
tggggcccgcctgcca

SEQ ID NO: 2678559 - DNA, 11 bp, Homo sapiens
tggggcctgcc

SEQ ID NO: 2678560 - DNA, 22 bp, Homo sapiens
tggggctcccggcatcctgaaa

SEQ ID NO: 2678561 - DNA, 13 bp, Homo sapiens
tgggggcatcctg

SEQ ID NO: 2678562 - DNA, 19 bp, Homo sapiens
tgggggcatcctgcttcct

SEQ ID NO: 2678563 - DNA, 22 bp, Homo sapiens
tgggggcatcctgcttcctgaa

SEQ ID NO: 2678564 - DNA, 13 bp, Homo sapiens
tggggtgcttcct

SEQ ID NO: 2678565 - DNA, 22 bp, Homo sapiens
tggggtgcttcctttcaggcca

SEQ ID NO: 2678566 - DNA, 17 bp, Homo sapiens
tggggttcaagcccagg

SEQ ID NO: 2678567 - DNA, 18 bp, Homo sapiens
tggggttcaagcccaggc

SEQ ID NO: 2678568 - DNA, 20 bp, Homo sapiens
tgggtcagcccagcacctgc

SEQ ID NO: 2678569 - DNA, 15 bp, Homo sapiens
tgggtctgtcctctc

SEQ ID NO: 2678570 - DNA, 18 bp, Homo sapiens
tgggtggaagtgcccagc

SEQ ID NO: 2678571 - DNA, 19 bp, Homo sapiens
tgggtggaagtgcccagcc

SEQ ID NO: 2678572 - DNA, 20 bp, Homo sapiens
tgggtggaagtgcccagccc

SEQ ID NO: 2678573 - DNA, 13 bp, Homo sapiens
tgggttcctcttc

SEQ ID NO: 2678574 - DNA, 16 bp, Homo sapiens
tggtacatggccagtg

SEQ ID NO: 2678575 - DNA, 23 bp, Homo sapiens
tggtatgaacttgaggacacatg

SEQ ID NO: 2678576 - DNA, 23 bp, Homo sapiens
tggtccttccaggcccccaccac

SEQ ID NO: 2678577 - DNA, 17 bp, Homo sapiens
tggtcgggggagagggc

SEQ ID NO: 2678578 - DNA, 17 bp, Homo sapiens
tggtctccacctgtgct

SEQ ID NO: 2678579 - DNA, 14 bp, Homo sapiens
tggtgactttttaa

SEQ ID NO: 2678580 - DNA, 15 bp, Homo sapiens
tggtgcatgcactgt

SEQ ID NO: 2678581 - DNA, 18 bp, Homo sapiens
tggtggacagtcctggga

SEQ ID NO: 2678582 - DNA, 20 bp, Homo sapiens
tggtgggtcagcccagcacc

SEQ ID NO: 2678583 - DNA, 16 bp, Homo sapiens
tggtggtcacaggctg

SEQ ID NO: 2678584 - DNA, 16 bp, Homo sapiens
tggtgttactaaagtc

SEQ ID NO: 2678585 - DNA, 14 bp, Homo sapiens
tggtttctgtgtgt

SEQ ID NO: 2678586 - DNA, 20 bp, Homo sapiens
tgtaaactgtatcaaatctg

SEQ ID NO: 2678587 - DNA, 16 bp, Homo sapiens
tgtaaaggtcactttt

SEQ ID NO: 2678588 - DNA, 15 bp, Homo sapiens
tgtaacacaagccac

SEQ ID NO: 2678589 - DNA, 16 bp, Homo sapiens
tgtaacacaagccaca

SEQ ID NO: 2678590 - DNA, 14 bp, Homo sapiens
tgtaatcaacatgg

SEQ ID NO: 2678591 - DNA, 17 bp, Homo sapiens
tgtaatcggctcccgct

SEQ ID NO: 2678592 - DNA, 18 bp, Homo sapiens
tgtacaaagatatgctaa

SEQ ID NO: 2678593 - DNA, 17 bp, Homo sapiens
tgtacaagttttgtata

SEQ ID NO: 2678594 - DNA, 23 bp, Homo sapiens
tgtacaagttttgtataaataat

SEQ ID NO: 2678595 - DNA, 21 bp, Homo sapiens
tgtaccttccttaagccagga

SEQ ID NO: 2678596 - DNA, 21 bp, Homo sapiens
tgtagaaacacagttttgaaa

SEQ ID NO: 2678597 - DNA, 21 bp, Homo sapiens
tgtagaagatggactctgaaa

SEQ ID NO: 2678598 - DNA, 20 bp, Homo sapiens
tgtataaataataaagaact

SEQ ID NO: 2678599 - DNA, 18 bp, Homo sapiens
tgtatacattttgttata

SEQ ID NO: 2678600 - DNA, 19 bp, Homo sapiens
tgtatacattttgttatag

SEQ ID NO: 2678601 - DNA, 21 bp, Homo sapiens
tgtatcaaatctgtatatgtt

SEQ ID NO: 2678602 - DNA, 21 bp, Homo sapiens
tgtattatttcaccagcagca

SEQ ID NO: 2678603 - DNA, 19 bp, Homo sapiens
tgtcaccgtggaccttcct

SEQ ID NO: 2678604 - DNA, 20 bp, Homo sapiens
tgtcaccgtggaccttcctg

SEQ ID NO: 2678605 - DNA, 22 bp, Homo sapiens
tgtcactttttaaaccactgta

SEQ ID NO: 2678606 - DNA, 21 bp, Homo sapiens
tgtcataaggcggcgtgggcg

SEQ ID NO: 2678607 - DNA, 22 bp, Homo sapiens
tgtccagaccattgtcttccaa

SEQ ID NO: 2678608 - DNA, 21 bp, Homo sapiens
tgtccaggaaaccctggcttg

SEQ ID NO: 2678609 - DNA, 14 bp, Homo sapiens
tgtccagtttccaa

SEQ ID NO: 2678610 - DNA, 14 bp, Homo sapiens
tgtcccccccagtg

SEQ ID NO: 2678611 - DNA, 14 bp, Homo sapiens
tgtccgtgtgcctc

SEQ ID NO: 2678612 - DNA, 16 bp, Homo sapiens
tgtccgtgtgcctcct

SEQ ID NO: 2678613 - DNA, 12 bp, Homo sapiens
tgtcctcccagg

SEQ ID NO: 2678614 - DNA, 12 bp, Homo sapiens
tgtcctcctgct

SEQ ID NO: 2678615 - DNA, 22 bp, Homo sapiens
tgtcctcctgctctgcttcctc

SEQ ID NO: 2678616 - DNA, 23 bp, Homo sapiens
tgtcctgttattttttatttcca

SEQ ID NO: 2678617 - DNA, 12 bp, Homo sapiens
tgtctctcttgt

SEQ ID NO: 2678618 - DNA, 15 bp, Homo sapiens
tgtctcttgtagaag

SEQ ID NO: 2678619 - DNA, 18 bp, Homo sapiens
tgtctgaacaatctccaa

SEQ ID NO: 2678620 - DNA, 19 bp, Homo sapiens
tgtctgcgccccgcctccc

SEQ ID NO: 2678621 - DNA, 14 bp, Homo sapiens
tgtctgtctgtccc

SEQ ID NO: 2678622 - DNA, 15 bp, Homo sapiens
tgtctgtctgtctgt

SEQ ID NO: 2678623 - DNA, 16 bp, Homo sapiens
tgtctgtctgtctgtc

SEQ ID NO: 2678624 - DNA, 13 bp, Homo sapiens
tgtcttcagagca

SEQ ID NO: 2678625 - DNA, 19 bp, Homo sapiens
tgtcttccaaccccagctg

SEQ ID NO: 2678626 - DNA, 21 bp, Homo sapiens
tgtgaaaggtgctgatggccc

SEQ ID NO: 2678627 - DNA, 22 bp, Homo sapiens
tgtgaaaggtgctgatggccct

SEQ ID NO: 2678628 - DNA, 22 bp, Homo sapiens
tgtgaccctgagggctcctcca

SEQ ID NO: 2678629 - DNA, 12 bp, Homo sapiens
tgtgaccctggg

SEQ ID NO: 2678630 - DNA, 16 bp, Homo sapiens
tgtgacgctttcaaca

SEQ ID NO: 2678631 - DNA, 16 bp, Homo sapiens
tgtgatattttacttg

SEQ ID NO: 2678632 - DNA, 11 bp, Homo sapiens
tgtgcctcctg

SEQ ID NO: 2678633 - DNA, 15 bp, Homo sapiens
tgtgcctcctgtgtg

SEQ ID NO: 2678634 - DNA, 16 bp, Homo sapiens
tgtgcctcctgtgtgt

SEQ ID NO: 2678635 - DNA, 16 bp, Homo sapiens
tgtgctcttcctctgg

SEQ ID NO: 2678636 - DNA, 17 bp, Homo sapiens
tgtgctcttcctctggt

SEQ ID NO: 2678637 - DNA, 21 bp, Homo sapiens
tgtgctcttcctctggtttct

SEQ ID NO: 2678638 - DNA, 20 bp, Homo sapiens
tgtgctgaggactccctcca

SEQ ID NO: 2678639 - DNA, 18 bp, Homo sapiens
tgtgctgctttgatatat

SEQ ID NO: 2678640 - DNA, 15 bp, Homo sapiens
tgtgcttggaaccag

SEQ ID NO: 2678641 - DNA, 17 bp, Homo sapiens
tgtgctttatttgtgaa

SEQ ID NO: 2678642 - DNA, 19 bp, Homo sapiens
tgtgctttatttgtgaaac

SEQ ID NO: 2678643 - DNA, 12 bp, Homo sapiens
tgtggaaagcct

SEQ ID NO: 2678644 - DNA, 23 bp, Homo sapiens
tgtggagaaataaaaatacctct

SEQ ID NO: 2678645 - DNA, 16 bp, Homo sapiens
tgtggccccaggtgcc

SEQ ID NO: 2678646 - DNA, 17 bp, Homo sapiens
tgtggccccaggtgcca

SEQ ID NO: 2678647 - DNA, 21 bp, Homo sapiens
tgtggccccaggtgccaccaa

SEQ ID NO: 2678648 - DNA, 16 bp, Homo sapiens
tgtggtacaatctcaa

SEQ ID NO: 2678649 - DNA, 19 bp, Homo sapiens
tgtgtcctcctgctctgct

SEQ ID NO: 2678650 - DNA, 20 bp, Homo sapiens
tgtgtcctcctgctctgctt

SEQ ID NO: 2678651 - DNA, 22 bp, Homo sapiens
tgtgtcctcctgctctgcttcc

SEQ ID NO: 2678652 - DNA, 22 bp, Homo sapiens
tgtgtgttgatcccaagacaat

SEQ ID NO: 2678653 - DNA, 19 bp, Homo sapiens
tgtgttcactaaactctga

SEQ ID NO: 2678654 - DNA, 18 bp, Homo sapiens
tgttagccaacttcaaga

SEQ ID NO: 2678655 - DNA, 19 bp, Homo sapiens
tgttattattttgcactgt

SEQ ID NO: 2678656 - DNA, 20 bp, Homo sapiens
tgttattttttatttccaca

SEQ ID NO: 2678657 - DNA, 16 bp, Homo sapiens
tgttccgtgccaggca

SEQ ID NO: 2678658 - DNA, 18 bp, Homo sapiens
tgttctcgttttgaaact

SEQ ID NO: 2678659 - DNA, 14 bp, Homo sapiens
tgttctctttgctg

SEQ ID NO: 2678660 - DNA, 14 bp, Homo sapiens
tgttgagtgttcat

SEQ ID NO: 2678661 - DNA, 18 bp, Homo sapiens
tgttgagtgttcatttta

SEQ ID NO: 2678662 - DNA, 12 bp, Homo sapiens
aaaaaaactctt

SEQ ID NO: 2678663 - DNA, 22 bp, Homo sapiens
aaaaaccccagctattttctga

SEQ ID NO: 2678664 - DNA, 13 bp, Homo sapiens
aaaaagattatat

SEQ ID NO: 2678665 - DNA, 17 bp, Homo sapiens
aaaaagtatatattcta

SEQ ID NO: 2678666 - DNA, 20 bp, Homo sapiens
aaaaagtcagactgctggga

SEQ ID NO: 2678667 - DNA, 13 bp, Homo sapiens
aaaaagttttgat

SEQ ID NO: 2678668 - DNA, 13 bp, Homo sapiens
aaaaatctagttt

SEQ ID NO: 2678669 - DNA, 20 bp, Homo sapiens
aaaacaaataataaatgttc

SEQ ID NO: 2678670 - DNA, 15 bp, Homo sapiens
aaaacaaatcactgt

SEQ ID NO: 2678671 - DNA, 20 bp, Homo sapiens
aaaacacggccctcctggga

SEQ ID NO: 2678672 - DNA, 12 bp, Homo sapiens
aaaactctttaa

SEQ ID NO: 2678673 - DNA, 20 bp, Homo sapiens
aaaacttatgctagtttatt

SEQ ID NO: 2678674 - DNA, 13 bp, Homo sapiens
aaaagacattttt

SEQ ID NO: 2678675 - DNA, 22 bp, Homo sapiens
aaaagtaagtaccactcaggcc

SEQ ID NO: 2678676 - DNA, 23 bp, Homo sapiens
aaaagtaagtaccactcaggcca

SEQ ID NO: 2678677 - DNA, 11 bp, Homo sapiens
aaaagtatata

SEQ ID NO: 2678678 - DNA, 15 bp, Homo sapiens
aaaatactctagcct

SEQ ID NO: 2678679 - DNA, 12 bp, Homo sapiens
aaaatctagttt

SEQ ID NO: 2678680 - DNA, 16 bp, Homo sapiens
aaacacggccctcctg

SEQ ID NO: 2678681 - DNA, 18 bp, Homo sapiens
aaacacggccctcctggg

SEQ ID NO: 2678682 - DNA, 19 bp, Homo sapiens
aaaccagtgtagccttgcc

SEQ ID NO: 2678683 - DNA, 16 bp, Homo sapiens
aaaccatctggtgcct

SEQ ID NO: 2678684 - DNA, 13 bp, Homo sapiens
aaaccccagctat

SEQ ID NO: 2678685 - DNA, 18 bp, Homo sapiens
aaaccccagctattttct

SEQ ID NO: 2678686 - DNA, 13 bp, Homo sapiens
aaaccccgtctct

SEQ ID NO: 2678687 - DNA, 23 bp, Homo sapiens
aaacgcagattgggctggctctg

SEQ ID NO: 2678688 - DNA, 17 bp, Homo sapiens
aaactcctgattttgta

SEQ ID NO: 2678689 - DNA, 14 bp, Homo sapiens
aaactctgccagcc

SEQ ID NO: 2678690 - DNA, 19 bp, Homo sapiens
aaactgaggccattatttc

SEQ ID NO: 2678691 - DNA, 16 bp, Homo sapiens
aaagaactccttattt

SEQ ID NO: 2678692 - DNA, 17 bp, Homo sapiens
aaagattatatatcata

SEQ ID NO: 2678693 - DNA, 21 bp, Homo sapiens
aaagattatatatcataaagt

SEQ ID NO: 2678694 - DNA, 17 bp, Homo sapiens
aaagcaggtggcatctc

SEQ ID NO: 2678695 - DNA, 16 bp, Homo sapiens
aaagcatcacctcagg

SEQ ID NO: 2678696 - DNA, 13 bp, Homo sapiens
aaagccacatttt

SEQ ID NO: 2678697 - DNA, 16 bp, Homo sapiens
aaagccacctgctgcg

SEQ ID NO: 2678698 - DNA, 13 bp, Homo sapiens
aaagccagcaaag

SEQ ID NO: 2678699 - DNA, 15 bp, Homo sapiens
aaagcctccagcatc

SEQ ID NO: 2678700 - DNA, 23 bp, Homo sapiens
aaagctgctgagaatctagcctc

SEQ ID NO: 2678701 - DNA, 20 bp, Homo sapiens
aaagctgctttcttctctgc

SEQ ID NO: 2678702 - DNA, 19 bp, Homo sapiens
aaagctgttggatttcagt

SEQ ID NO: 2678703 - DNA, 21 bp, Homo sapiens
aaaggctcagtctcaggagca

SEQ ID NO: 2678704 - DNA, 15 bp, Homo sapiens
aaagggcagtaaagt

SEQ ID NO: 2678705 - DNA, 13 bp, Homo sapiens
aaaggtatttaga

SEQ ID NO: 2678706 - DNA, 19 bp, Homo sapiens
aaatcaacttgtgtactga

SEQ ID NO: 2678707 - DNA, 22 bp, Homo sapiens
aaatcactttacctgcaggctc

SEQ ID NO: 2678708 - DNA, 22 bp, Homo sapiens
aaatcatactcctatgctttag

SEQ ID NO: 2678709 - DNA, 16 bp, Homo sapiens
aaatctgtatatgttg

SEQ ID NO: 2678710 - DNA, 19 bp, Homo sapiens
aaatctgtatatgttgtaa

SEQ ID NO: 2678711 - DNA, 14 bp, Homo sapiens
aaatgacccaaaga

SEQ ID NO: 2678712 - DNA, 15 bp, Homo sapiens
aaatgagcattagct

SEQ ID NO: 2678713 - DNA, 22 bp, Homo sapiens
aaatgagcattagctacttttc

SEQ ID NO: 2678714 - DNA, 19 bp, Homo sapiens
aaatgcaagtgtttgaagt

SEQ ID NO: 2678715 - DNA, 15 bp, Homo sapiens
aaatgcgtccctgta

SEQ ID NO: 2678716 - DNA, 18 bp, Homo sapiens
aaatggtatccagaatgg

SEQ ID NO: 2678717 - DNA, 18 bp, Homo sapiens
aaatgttctcgttttgaa

SEQ ID NO: 2678718 - DNA, 17 bp, Homo sapiens
aaattcttgaagttcat

SEQ ID NO: 2678719 - DNA, 18 bp, Homo sapiens
aaattgcttttgttgtga

SEQ ID NO: 2678720 - DNA, 19 bp, Homo sapiens
aaattgcttttgttgtgac

SEQ ID NO: 2678721 - DNA, 19 bp, Homo sapiens
aaattgtatacattttgtt

SEQ ID NO: 2678722 - DNA, 14 bp, Homo sapiens
aaatttccctgggg

SEQ ID NO: 2678723 - DNA, 22 bp, Homo sapiens
aacaaaatccaaccctgtcaga

SEQ ID NO: 2678724 - DNA, 14 bp, Homo sapiens
aacaaaccatctgg

SEQ ID NO: 2678725 - DNA, 20 bp, Homo sapiens
aacaaaccatctggtgcctt

SEQ ID NO: 2678726 - DNA, 18 bp, Homo sapiens
aacaagaatattgtatgt

SEQ ID NO: 2678727 - DNA, 11 bp, Homo sapiens
aacaatgaatg

SEQ ID NO: 2678728 - DNA, 14 bp, Homo sapiens
aacaatgtcagaaa

SEQ ID NO: 2678729 - DNA, 16 bp, Homo sapiens
aacacaagccacagaa

SEQ ID NO: 2678730 - DNA, 12 bp, Homo sapiens
aacacacaacag

SEQ ID NO: 2678731 - DNA, 13 bp, Homo sapiens
aacacagtttagt

SEQ ID NO: 2678732 - DNA, 19 bp, Homo sapiens
aacacagtttagtgcttta

SEQ ID NO: 2678733 - DNA, 14 bp, Homo sapiens
aacacagttttgaa

SEQ ID NO: 2678734 - DNA, 20 bp, Homo sapiens
actccagcctgagcaacaga

SEQ ID NO: 2678735 - DNA, 18 bp, Homo sapiens
actccagcctgggcaaca

SEQ ID NO: 2678736 - DNA, 16 bp, Homo sapiens
actccctccatgtggc

SEQ ID NO: 2678737 - DNA, 23 bp, Homo sapiens
actccctccatgtggccccaggt

SEQ ID NO: 2678738 - DNA, 19 bp, Homo sapiens
actccggtgtgcctgcagc

SEQ ID NO: 2678739 - DNA, 17 bp, Homo sapiens
actcctacctcagccta

SEQ ID NO: 2678740 - DNA, 19 bp, Homo sapiens
actcctcagatctgaacac

SEQ ID NO: 2678741 - DNA, 10 bp, Homo sapiens
actctgaaaa

SEQ ID NO: 2678742 - DNA, 13 bp, Homo sapiens
actctgaaaaaca

SEQ ID NO: 2678743 - DNA, 21 bp, Homo sapiens
actctgctctatgccaggctg

SEQ ID NO: 2678744 - DNA, 23 bp, Homo sapiens
actctgctctatgccaggctgtg

SEQ ID NO: 2678745 - DNA, 16 bp, Homo sapiens
actctgggtgcctcct

SEQ ID NO: 2678746 - DNA, 15 bp, Homo sapiens
actctttaacttgta

SEQ ID NO: 2678747 - DNA, 16 bp, Homo sapiens
actctttgctacaata

SEQ ID NO: 2678748 - DNA, 18 bp, Homo sapiens
actctttgctacaataaa

SEQ ID NO: 2678749 - DNA, 21 bp, Homo sapiens
actctttgctacaataaatgc

SEQ ID NO: 2678750 - DNA, 15 bp, Homo sapiens
actgaggccattatt

SEQ ID NO: 2678751 - DNA, 19 bp, Homo sapiens
actgatcctgctccagcag

SEQ ID NO: 2678752 - DNA, 21 bp, Homo sapiens
actgcactccagcctgggcga

SEQ ID NO: 2678753 - DNA, 14 bp, Homo sapiens
actgccctcccctt

SEQ ID NO: 2678754 - DNA, 19 bp, Homo sapiens
actgcgggatggtcctggg

SEQ ID NO: 2678755 - DNA, 20 bp, Homo sapiens
actgcgggatggtcctgggg

SEQ ID NO: 2678756 - DNA, 22 bp, Homo sapiens
actgcgggatggtcctggggct

SEQ ID NO: 2678757 - DNA, 15 bp, Homo sapiens
actgctttccagcct

SEQ ID NO: 2678758 - DNA, 14 bp, Homo sapiens
actggagcatctga

SEQ ID NO: 2678759 - DNA, 13 bp, Homo sapiens
actggccccaccc

SEQ ID NO: 2678760 - DNA, 14 bp, Homo sapiens
actggctgctccct

SEQ ID NO: 2678761 - DNA, 15 bp, Homo sapiens
actggctgctccctg

SEQ ID NO: 2678762 - DNA, 23 bp, Homo sapiens
actggctgctccctgctcccagg

SEQ ID NO: 2678763 - DNA, 21 bp, Homo sapiens
actggggttcaagcccaggct

SEQ ID NO: 2678764 - DNA, 22 bp, Homo sapiens
actgtatcaaatctgtatatgt

SEQ ID NO: 2678765 - DNA, 14 bp, Homo sapiens
actgtgaccctggg

SEQ ID NO: 2678766 - DNA, 15 bp, Homo sapiens
actgtgaccctgggt

SEQ ID NO: 2678767 - DNA, 19 bp, Homo sapiens
actgtggagaagcccctgg

SEQ ID NO: 2678768 - DNA, 18 bp, Homo sapiens
acttcacccggctgggct

SEQ ID NO: 2678769 - DNA, 20 bp, Homo sapiens
acttcacccggctgggctcc

SEQ ID NO: 2678770 - DNA, 9 bp, Homo sapiens
acttcctgg

SEQ ID NO: 2678771 - DNA, 15 bp, Homo sapiens
acttccttgcccctg

SEQ ID NO: 2678772 - DNA, 18 bp, Homo sapiens
acttccttgcccctgctc

SEQ ID NO: 2678773 - DNA, 16 bp, Homo sapiens
acttgaggacacatgt

SEQ ID NO: 2678774 - DNA, 18 bp, Homo sapiens
acttgaggacacatgtcc

SEQ ID NO: 2678775 - DNA, 19 bp, Homo sapiens
acttgaggacacatgtcca

SEQ ID NO: 2678776 - DNA, 23 bp, Homo sapiens
acttgtccttttgtaccatggtg

SEQ ID NO: 2678777 - DNA, 20 bp, Homo sapiens
acttgtgtactgataaaata

SEQ ID NO: 2678778 - DNA, 21 bp, Homo sapiens
acttgtgtactgataaaatac

SEQ ID NO: 2678779 - DNA, 19 bp, Homo sapiens
actttacctgcaggctcca

SEQ ID NO: 2678780 - DNA, 19 bp, Homo sapiens
actttctactcattttaat

SEQ ID NO: 2678781 - DNA, 19 bp, Homo sapiens
actttggtacatggccagt

SEQ ID NO: 2678782 - DNA, 22 bp, Homo sapiens
acttttctaaagctctgaacaa

SEQ ID NO: 2678783 - DNA, 16 bp, Homo sapiens
acttttttgaaatcag

SEQ ID NO: 2678784 - DNA, 22 bp, Homo sapiens
agaaacacagggttttgtattc

SEQ ID NO: 2678785 - DNA, 19 bp, Homo sapiens
agaaactcgatgaatgtgt

SEQ ID NO: 2678786 - DNA, 12 bp, Homo sapiens
agaaataaaaat

SEQ ID NO: 2678787 - DNA, 16 bp, Homo sapiens
agaaatcattgtagaa

SEQ ID NO: 2678788 - DNA, 15 bp, Homo sapiens
agaaattagccgggc

SEQ ID NO: 2678789 - DNA, 23 bp, Homo sapiens
agaaattcctgtagcatcttctg

SEQ ID NO: 2678790 - DNA, 22 bp, Homo sapiens
agaaattttactgacagaaatg

SEQ ID NO: 2678791 - DNA, 13 bp, Homo sapiens
agaacacccactg

SEQ ID NO: 2678792 - DNA, 22 bp, Homo sapiens
agaacatgaggataacttcctt

SEQ ID NO: 2678793 - DNA, 19 bp, Homo sapiens
agaaccagtctttcaactc

SEQ ID NO: 2678794 - DNA, 22 bp, Homo sapiens
agaaccagtctttcaactcatt

SEQ ID NO: 2678795 - DNA, 14 bp, Homo sapiens
agaacccaggtctg

SEQ ID NO: 2678796 - DNA, 18 bp, Homo sapiens
agaacgatgcctgcaggc

SEQ ID NO: 2678797 - DNA, 13 bp, Homo sapiens
agaactgccattg

SEQ ID NO: 2678798 - DNA, 15 bp, Homo sapiens
agaactggcaggagc

SEQ ID NO: 2678799 - DNA, 17 bp, Homo sapiens
agaactggcaggagcct

SEQ ID NO: 2678800 - DNA, 22 bp, Homo sapiens
agaactggggttcaagcccagg

SEQ ID NO: 2678801 - DNA, 12 bp, Homo sapiens
agaagccaggag

SEQ ID NO: 2678802 - DNA, 14 bp, Homo sapiens
agaagccaggagca

SEQ ID NO: 2678803 - DNA, 12 bp, Homo sapiens
agaagccagtct

SEQ ID NO: 2678804 - DNA, 14 bp, Homo sapiens
agaagccagtctgc

SEQ ID NO: 2678805 - DNA, 17 bp, Homo sapiens
agaagccagtctgcgtc

SEQ ID NO: 2678806 - DNA, 12 bp, Homo sapiens
agaagcctgagg

SEQ ID NO: 2678807 - DNA, 15 bp, Homo sapiens
agaagcgctgccctg

SEQ ID NO: 2678808 - DNA, 22 bp, Homo sapiens
agaaggggaatgtgtcctcctg

SEQ ID NO: 2678809 - DNA, 16 bp, Homo sapiens
agaagtctccctgcac

SEQ ID NO: 2678810 - DNA, 13 bp, Homo sapiens
agaagtgtatata

SEQ ID NO: 2678811 - DNA, 12 bp, Homo sapiens
agaatacttttt

SEQ ID NO: 2678812 - DNA, 15 bp, Homo sapiens
agaatcgctttcctt

SEQ ID NO: 2678813 - DNA, 19 bp, Homo sapiens
agaatcgctttccttcctc

SEQ ID NO: 2678814 - DNA, 23 bp, Homo sapiens
agacacaggtgcctcacgcctgt

SEQ ID NO: 2678815 - DNA, 21 bp, Homo sapiens
agacaggacagtgcttcagcc

SEQ ID NO: 2678816 - DNA, 17 bp, Homo sapiens
agaccacctctcaatat

SEQ ID NO: 2678817 - DNA, 17 bp, Homo sapiens
agaccagactgtggaga

SEQ ID NO: 2678818 - DNA, 18 bp, Homo sapiens
agaccagactgtggagaa

SEQ ID NO: 2678819 - DNA, 12 bp, Homo sapiens
agaccagcagca

SEQ ID NO: 2678820 - DNA, 12 bp, Homo sapiens
agaccagcctgg

SEQ ID NO: 2678821 - DNA, 17 bp, Homo sapiens
agaccattgtcttccaa

SEQ ID NO: 2678822 - DNA, 20 bp, Homo sapiens
agactaaggggcagctcctg

SEQ ID NO: 2678823 - DNA, 18 bp, Homo sapiens
agactccaatggggccag

SEQ ID NO: 2678824 - DNA, 16 bp, Homo sapiens
agactctgtggggcct

SEQ ID NO: 2678825 - DNA, 20 bp, Homo sapiens
agactgcgggatggtcctgg

SEQ ID NO: 2678826 - DNA, 15 bp, Homo sapiens
agactgctgggactg

SEQ ID NO: 2678827 - DNA, 14 bp, Homo sapiens
agactggctggctg

SEQ ID NO: 2678828 - DNA, 17 bp, Homo sapiens
agactgtcattgcccct

SEQ ID NO: 2678829 - DNA, 18 bp, Homo sapiens
agactgtcattgcccctc

SEQ ID NO: 2678830 - DNA, 20 bp, Homo sapiens
agactgtcattgcccctccg

SEQ ID NO: 2678831 - DNA, 20 bp, Homo sapiens
agagaagataatgttcttta

SEQ ID NO: 2678832 - DNA, 22 bp, Homo sapiens
agagactaaggggcagctcctg

SEQ ID NO: 2678833 - DNA, 14 bp, Homo sapiens
agagactggagcat

SEQ ID NO: 2678834 - DNA, 16 bp, Homo sapiens
agagagaggggcctgc

SEQ ID NO: 2678835 - DNA, 15 bp, Homo sapiens
agagagtcctctgga

SEQ ID NO: 2678836 - DNA, 16 bp, Homo sapiens
agagagtcctctggat

SEQ ID NO: 2678837 - DNA, 16 bp, Homo sapiens
agagagtggggcctgc

SEQ ID NO: 2678838 - DNA, 19 bp, Homo sapiens
agagagtggggcctgccct

SEQ ID NO: 2678839 - DNA, 17 bp, Homo sapiens
agagatgactgagtcct

SEQ ID NO: 2678840 - DNA, 23 bp, Homo sapiens
agagcacagcgtttacatattta

SEQ ID NO: 2678841 - DNA, 19 bp, Homo sapiens
agagccctccaggcctgca

SEQ ID NO: 2678842 - DNA, 14 bp, Homo sapiens
agagctcctgtccc

SEQ ID NO: 2678843 - DNA, 17 bp, Homo sapiens
agagctcctgtccctac

SEQ ID NO: 2678844 - DNA, 18 bp, Homo sapiens
caagcccaggcttcctgg

SEQ ID NO: 2678845 - DNA, 17 bp, Homo sapiens
caagctcacacagcagg

SEQ ID NO: 2678846 - DNA, 13 bp, Homo sapiens
caagctctgccct

SEQ ID NO: 2678847 - DNA, 14 bp, Homo sapiens
caagctctgccctg

SEQ ID NO: 2678848 - DNA, 15 bp, Homo sapiens
caagctctgccctgg

SEQ ID NO: 2678849 - DNA, 17 bp, Homo sapiens
caagctctgccctggct

SEQ ID NO: 2678850 - DNA, 15 bp, Homo sapiens
caaggctgtgctctt

SEQ ID NO: 2678851 - DNA, 12 bp, Homo sapiens
caaggtgggctg

SEQ ID NO: 2678852 - DNA, 18 bp, Homo sapiens
caaggtgggctgagccct

SEQ ID NO: 2678853 - DNA, 14 bp, Homo sapiens
caagttagctcagg

SEQ ID NO: 2678854 - DNA, 16 bp, Homo sapiens
caagttagctcaggag

SEQ ID NO: 2678855 - DNA, 21 bp, Homo sapiens
caagttcctctagtgccctcc

SEQ ID NO: 2678856 - DNA, 13 bp, Homo sapiens
caagttttgtata

SEQ ID NO: 2678857 - DNA, 22 bp, Homo sapiens
caataaagctgctgagaatcta

SEQ ID NO: 2678858 - DNA, 14 bp, Homo sapiens
caataaatgctgaa

SEQ ID NO: 2678859 - DNA, 15 bp, Homo sapiens
caatattcaaatgcg

SEQ ID NO: 2678860 - DNA, 17 bp, Homo sapiens
caatattcaataaagct

SEQ ID NO: 2678861 - DNA, 20 bp, Homo sapiens
caatctcaaattctcaacct

SEQ ID NO: 2678862 - DNA, 16 bp, Homo sapiens
caatggggccagcact

SEQ ID NO: 2678863 - DNA, 17 bp, Homo sapiens
caatggggccagcactg

SEQ ID NO: 2678864 - DNA, 21 bp, Homo sapiens
caatgtatatgaagctcttga

SEQ ID NO: 2678865 - DNA, 15 bp, Homo sapiens
caattacatgtttgg

SEQ ID NO: 2678866 - DNA, 12 bp, Homo sapiens
cacaagccacag

SEQ ID NO: 2678867 - DNA, 16 bp, Homo sapiens
cacacctcagccccac

SEQ ID NO: 2678868 - DNA, 15 bp, Homo sapiens
cacacctccttttct

SEQ ID NO: 2678869 - DNA, 14 bp, Homo sapiens
cacaccttttcccc

SEQ ID NO: 2678870 - DNA, 16 bp, Homo sapiens
cacaccttttccccag

SEQ ID NO: 2678871 - DNA, 21 bp, Homo sapiens
cacactggtttgccaggccaa

SEQ ID NO: 2678872 - DNA, 14 bp, Homo sapiens
cacagaagccagga

SEQ ID NO: 2678873 - DNA, 12 bp, Homo sapiens
cacagctgggca

SEQ ID NO: 2678874 - DNA, 13 bp, Homo sapiens
cacagctgggcat

SEQ ID NO: 2678875 - DNA, 13 bp, Homo sapiens
cacaggccagcct

SEQ ID NO: 2678876 - DNA, 17 bp, Homo sapiens
cacaggctgtgccttgg

SEQ ID NO: 2678877 - DNA, 13 bp, Homo sapiens
cacagggcagagc

SEQ ID NO: 2678878 - DNA, 17 bp, Homo sapiens
cacagggcagagccggg

SEQ ID NO: 2678879 - DNA, 23 bp, Homo sapiens
cacagggctctttgatggaccca

SEQ ID NO: 2678880 - DNA, 15 bp, Homo sapiens
cacagttttgaaaga

SEQ ID NO: 2678881 - DNA, 17 bp, Homo sapiens
cacagttttgaaagaaa

SEQ ID NO: 2678882 - DNA, 20 bp, Homo sapiens
cacataaaggtatttagaat

SEQ ID NO: 2678883 - DNA, 15 bp, Homo sapiens
cacatatatgtatat

SEQ ID NO: 2678884 - DNA, 21 bp, Homo sapiens
cacatccttgactttttagat

SEQ ID NO: 2678885 - DNA, 12 bp, Homo sapiens
cacatgtcaccg

SEQ ID NO: 2678886 - DNA, 23 bp, Homo sapiens
cacatgtcaccgtggaccttcct

SEQ ID NO: 2678887 - DNA, 16 bp, Homo sapiens
caccagaggctgcaga

SEQ ID NO: 2678888 - DNA, 21 bp, Homo sapiens
caccagaggctgcagaaggcc

SEQ ID NO: 2678889 - DNA, 10 bp, Homo sapiens
caccagcagc

SEQ ID NO: 2678890 - DNA, 21 bp, Homo sapiens
cacccaaaggtggcctgcggg

SEQ ID NO: 2678891 - DNA, 18 bp, Homo sapiens
cacccactggccagtcct

SEQ ID NO: 2678892 - DNA, 15 bp, Homo sapiens
cacccaggcctccct

SEQ ID NO: 2678893 - DNA, 18 bp, Homo sapiens
cacccaggcctccctgca

SEQ ID NO: 2678894 - DNA, 21 bp, Homo sapiens
cacccaggcctccctgcagac

SEQ ID NO: 2678895 - DNA, 14 bp, Homo sapiens
cacccatgaagaca

SEQ ID NO: 2678896 - DNA, 15 bp, Homo sapiens
cacccatgaagacag

SEQ ID NO: 2678897 - DNA, 15 bp, Homo sapiens
cacccatgaatcaaa

SEQ ID NO: 2678898 - DNA, 12 bp, Homo sapiens
caccccagcgcc

SEQ ID NO: 2678899 - DNA, 13 bp, Homo sapiens
caccccttcctgt

SEQ ID NO: 2678900 - DNA, 14 bp, Homo sapiens
caccccttcctgtc

SEQ ID NO: 2678901 - DNA, 17 bp, Homo sapiens
caccctcgtggacacct

SEQ ID NO: 2678902 - DNA, 18 bp, Homo sapiens
caccctcgtggacacctg

SEQ ID NO: 2678903 - DNA, 20 bp, Homo sapiens
caccctcgtggacacctgcc

SEQ ID NO: 2678904 - DNA, 23 bp, Homo sapiens
caccctcgtggacacctgccctg

SEQ ID NO: 2678905 - DNA, 15 bp, Homo sapiens
caccgtggaccttcc

SEQ ID NO: 2678906 - DNA, 18 bp, Homo sapiens
caccgtggaccttcctgc

SEQ ID NO: 2678907 - DNA, 19 bp, Homo sapiens
caccgtggaccttcctgcc

SEQ ID NO: 2678908 - DNA, 20 bp, Homo sapiens
caccgtggaccttcctgcca

SEQ ID NO: 2678909 - DNA, 13 bp, Homo sapiens
cacctacccagct

SEQ ID NO: 2678910 - DNA, 15 bp, Homo sapiens
cacctacccagctga

SEQ ID NO: 2678911 - DNA, 19 bp, Homo sapiens
cacctacccagctgatggg

SEQ ID NO: 2678912 - DNA, 16 bp, Homo sapiens
cacctatagtcccagc

SEQ ID NO: 2678913 - DNA, 11 bp, Homo sapiens
cacctcagagc

SEQ ID NO: 2678914 - DNA, 18 bp, Homo sapiens
cacctcagagcagggcca

SEQ ID NO: 2678915 - DNA, 19 bp, Homo sapiens
cacctcagagcagggccaa

SEQ ID NO: 2678916 - DNA, 23 bp, Homo sapiens
cacctcaggccaggtgcagtggc

SEQ ID NO: 2678917 - DNA, 16 bp, Homo sapiens
cacctccccctccccg

SEQ ID NO: 2678918 - DNA, 23 bp, Homo sapiens
cacctccccctccccggccacat

SEQ ID NO: 2678919 - DNA, 20 bp, Homo sapiens
cacctcccttccctccctga

SEQ ID NO: 2678920 - DNA, 17 bp, Homo sapiens
cacctccttttcttcta

SEQ ID NO: 2678921 - DNA, 21 bp, Homo sapiens
cacctctcaatattcaataaa

SEQ ID NO: 2678922 - DNA, 17 bp, Homo sapiens
cacctcttctcttcctg

SEQ ID NO: 2678923 - DNA, 22 bp, Homo sapiens
cacctcttctcttcctgtaaca

SEQ ID NO: 2678924 - DNA, 14 bp, Homo sapiens
cacctgcaggctta

SEQ ID NO: 2678925 - DNA, 14 bp, Homo sapiens
cacctgccagcctg

SEQ ID NO: 2678926 - DNA, 15 bp, Homo sapiens
cacctgccccctggt

SEQ ID NO: 2678927 - DNA, 12 bp, Homo sapiens
cacctgccctgc

SEQ ID NO: 2678928 - DNA, 16 bp, Homo sapiens
cacctgccctgccctg

SEQ ID NO: 2678929 - DNA, 21 bp, Homo sapiens
cacctgctgcgggggagccag

SEQ ID NO: 2678930 - DNA, 16 bp, Homo sapiens
cacctgtactcaggag

SEQ ID NO: 2678931 - DNA, 16 bp, Homo sapiens
cacctgtagtcccagc

SEQ ID NO: 2678932 - DNA, 13 bp, Homo sapiens
cacctgtctgtct

SEQ ID NO: 2678933 - DNA, 16 bp, Homo sapiens
cacctgtctgtctgtc

SEQ ID NO: 2678934 - DNA, 19 bp, Homo sapiens
caccttagacggaggtgcc

SEQ ID NO: 2678935 - DNA, 17 bp, Homo sapiens
caccttcaattcctggg

SEQ ID NO: 2678936 - DNA, 15 bp, Homo sapiens
caccttttccccagg

SEQ ID NO: 2678937 - DNA, 16 bp, Homo sapiens
cacgaggggggccagg

SEQ ID NO: 2678938 - DNA, 21 bp, Homo sapiens
cacgcaactcacacctccttt

SEQ ID NO: 2678939 - DNA, 17 bp, Homo sapiens
cacgcaaggctgtgctc

SEQ ID NO: 2678940 - DNA, 21 bp, Homo sapiens
cacgcctatgatcccagcact

SEQ ID NO: 2678941 - DNA, 19 bp, Homo sapiens
cacgcctgtaatcccagca

SEQ ID NO: 2678942 - DNA, 20 bp, Homo sapiens
cacgctggccttcgtctcca

SEQ ID NO: 2678943 - DNA, 13 bp, Homo sapiens
cacgtctcctgct

SEQ ID NO: 2678944 - DNA, 14 bp, Homo sapiens
cacgtctcctgctg

SEQ ID NO: 2678945 - DNA, 15 bp, Homo sapiens
cacgtctcctgctgc

SEQ ID NO: 2678946 - DNA, 12 bp, Homo sapiens
cacgtctgtcct

SEQ ID NO: 2678947 - DNA, 13 bp, Homo sapiens
cacgtctgtcctc

SEQ ID NO: 2678948 - DNA, 17 bp, Homo sapiens
cacgtgatggaccaaag

SEQ ID NO: 2678949 - DNA, 19 bp, Homo sapiens
cacgtgatggaccaaagcc

SEQ ID NO: 2678950 - DNA, 12 bp, Homo sapiens
cactaaactctg

SEQ ID NO: 2678951 - DNA, 14 bp, Homo sapiens
cactaagctctctg

SEQ ID NO: 2678952 - DNA, 18 bp, Homo sapiens
cactacactccagcctga

SEQ ID NO: 2678953 - DNA, 20 bp, Homo sapiens
cactacactccagcctgagc

SEQ ID NO: 2678954 - DNA, 21 bp, Homo sapiens
cactacactccagcctgagca

SEQ ID NO: 2678955 - DNA, 21 bp, Homo sapiens
caggaaccaaaaaaccccagc

SEQ ID NO: 2678956 - DNA, 16 bp, Homo sapiens
caggaactgagccaga

SEQ ID NO: 2678957 - DNA, 17 bp, Homo sapiens
caggaactgagccagaa

SEQ ID NO: 2678958 - DNA, 22 bp, Homo sapiens
caggaagctccctccctcactg

SEQ ID NO: 2678959 - DNA, 20 bp, Homo sapiens
caggacagtgcttcagcctg

SEQ ID NO: 2678960 - DNA, 21 bp, Homo sapiens
caggacagtgcttcagcctga

SEQ ID NO: 2678961 - DNA, 22 bp, Homo sapiens
caggacagtgcttcagcctgag

SEQ ID NO: 2678962 - DNA, 14 bp, Homo sapiens
caggacctctgctt

SEQ ID NO: 2678963 - DNA, 13 bp, Homo sapiens
caggactgtgacc

SEQ ID NO: 2678964 - DNA, 18 bp, Homo sapiens
caggactgtgaccaaagc

SEQ ID NO: 2678965 - DNA, 19 bp, Homo sapiens
caggactgtgaccaaagca

SEQ ID NO: 2678966 - DNA, 15 bp, Homo sapiens
caggagaaggggccc

SEQ ID NO: 2678967 - DNA, 19 bp, Homo sapiens
caggagagcacccacagcc

SEQ ID NO: 2678968 - DNA, 22 bp, Homo sapiens
caggagagcacccacagccgca

SEQ ID NO: 2678969 - DNA, 17 bp, Homo sapiens
caggagatcgagaccat

SEQ ID NO: 2678970 - DNA, 13 bp, Homo sapiens
caggagcagaaga

SEQ ID NO: 2678971 - DNA, 11 bp, Homo sapiens
caggaggcccc

SEQ ID NO: 2678972 - DNA, 17 bp, Homo sapiens
caggaggccccaggctg

SEQ ID NO: 2678973 - DNA, 23 bp, Homo sapiens
caggaggccccaggctgagagcc

SEQ ID NO: 2678974 - DNA, 15 bp, Homo sapiens
caggaggctgagggg

SEQ ID NO: 2678975 - DNA, 15 bp, Homo sapiens
caggaggggcctctg

SEQ ID NO: 2678976 - DNA, 20 bp, Homo sapiens
caggagtttgaggctgcagc

SEQ ID NO: 2678977 - DNA, 19 bp, Homo sapiens
caggatcactctctgctgg

SEQ ID NO: 2678978 - DNA, 22 bp, Homo sapiens
caggatcactctctgctggcag

SEQ ID NO: 2678979 - DNA, 21 bp, Homo sapiens
caggatgacacctccatttct

SEQ ID NO: 2678980 - DNA, 17 bp, Homo sapiens
caggattcttcccgctc

SEQ ID NO: 2678981 - DNA, 17 bp, Homo sapiens
caggcacgtctcctgct

SEQ ID NO: 2678982 - DNA, 15 bp, Homo sapiens
caggcagggctgggc

SEQ ID NO: 2678983 - DNA, 18 bp, Homo sapiens
caggccaagagcagaggc

SEQ ID NO: 2678984 - DNA, 23 bp, Homo sapiens
caggccaatgttgctgatggccc

SEQ ID NO: 2678985 - DNA, 13 bp, Homo sapiens
caggccagccttg

SEQ ID NO: 2678986 - DNA, 15 bp, Homo sapiens
caggccagccttggc

SEQ ID NO: 2678987 - DNA, 22 bp, Homo sapiens
caggccggtgtgggctgtgtcg

SEQ ID NO: 2678988 - DNA, 17 bp, Homo sapiens
caggcctccctgcagac

SEQ ID NO: 2678989 - DNA, 19 bp, Homo sapiens
caggcctccctgcagactc

SEQ ID NO: 2678990 - DNA, 19 bp, Homo sapiens
caggcctgattcactggcc

SEQ ID NO: 2678991 - DNA, 20 bp, Homo sapiens
caggcctgattcactggcct

SEQ ID NO: 2678992 - DNA, 21 bp, Homo sapiens
caggcctgattcactggcctg

SEQ ID NO: 2678993 - DNA, 22 bp, Homo sapiens
caggcctgattcactggcctgg

SEQ ID NO: 2678994 - DNA, 23 bp, Homo sapiens
caggcctgattcactggcctggc

SEQ ID NO: 2678995 - DNA, 18 bp, Homo sapiens
caggcctgcaggggcaag

SEQ ID NO: 2678996 - DNA, 19 bp, Homo sapiens
caggctatttgttcagaga

SEQ ID NO: 2678997 - DNA, 20 bp, Homo sapiens
caggctatttgttcagagag

SEQ ID NO: 2678998 - DNA, 13 bp, Homo sapiens
caggctccatgca

SEQ ID NO: 2678999 - DNA, 14 bp, Homo sapiens
caggctgagagcca

SEQ ID NO: 2679000 - DNA, 14 bp, Homo sapiens
caggcttccttggc

SEQ ID NO: 2679001 - DNA, 23 bp, Homo sapiens
cagggaatttcaggaactagaga

SEQ ID NO: 2679002 - DNA, 13 bp, Homo sapiens
cagggccctgcag

SEQ ID NO: 2679003 - DNA, 14 bp, Homo sapiens
cagggccctgcaga

SEQ ID NO: 2679004 - DNA, 18 bp, Homo sapiens
cagggctctttgatggac

SEQ ID NO: 2679005 - DNA, 14 bp, Homo sapiens
cagggctgggccag

SEQ ID NO: 2679006 - DNA, 19 bp, Homo sapiens
cagggctgggccaggtctc

SEQ ID NO: 2679007 - DNA, 20 bp, Homo sapiens
caggggcaaggggctggctg

SEQ ID NO: 2679008 - DNA, 19 bp, Homo sapiens
caggggtcctgcaggtcct

SEQ ID NO: 2679009 - DNA, 23 bp, Homo sapiens
caggggttctgagaagcgctgcc

SEQ ID NO: 2679010 - DNA, 18 bp, Homo sapiens
caggtcctggtgggtcag

SEQ ID NO: 2679011 - DNA, 13 bp, Homo sapiens
caggtctccacca

SEQ ID NO: 2679012 - DNA, 17 bp, Homo sapiens
caggtctccaccaagga

SEQ ID NO: 2679013 - DNA, 23 bp, Homo sapiens
caggtctccaccaaggaggcagg

SEQ ID NO: 2679014 - DNA, 19 bp, Homo sapiens
caggtgagaacccagagag

SEQ ID NO: 2679015 - DNA, 16 bp, Homo sapiens
caggtgagcaggcagg

SEQ ID NO: 2679016 - DNA, 20 bp, Homo sapiens
caggtgagcaggcagggctg

SEQ ID NO: 2679017 - DNA, 13 bp, Homo sapiens
caggtgcagtggc

SEQ ID NO: 2679018 - DNA, 16 bp, Homo sapiens
caggtgccaccaataa

SEQ ID NO: 2679019 - DNA, 17 bp, Homo sapiens
caggtgccaccaataaa

SEQ ID NO: 2679020 - DNA, 20 bp, Homo sapiens
caggtgccaccaataaaaat

SEQ ID NO: 2679021 - DNA, 18 bp, Homo sapiens
caggtggaggtgccagga

SEQ ID NO: 2679022 - DNA, 22 bp, Homo sapiens
caggtggaggtgccaggaagct

SEQ ID NO: 2679023 - DNA, 21 bp, Homo sapiens
caggttgaggggctcctggaa

SEQ ID NO: 2679024 - DNA, 22 bp, Homo sapiens
caggttgaggggctcctggaaa

SEQ ID NO: 2679025 - DNA, 16 bp, Homo sapiens
cagtagtcgtcaagtt

SEQ ID NO: 2679026 - DNA, 16 bp, Homo sapiens
cagtagtctctgtgct

SEQ ID NO: 2679027 - DNA, 23 bp, Homo sapiens
cagtagtctctgtgctttgactc

SEQ ID NO: 2679028 - DNA, 14 bp, Homo sapiens
cagtcaattacatg

SEQ ID NO: 2679029 - DNA, 21 bp, Homo sapiens
cagtcactgtccctcaaatga

SEQ ID NO: 2679030 - DNA, 22 bp, Homo sapiens
cagtcccacaccgctggtccct

SEQ ID NO: 2679031 - DNA, 19 bp, Homo sapiens
cagtcctagagctcctgtc

SEQ ID NO: 2679032 - DNA, 23 bp, Homo sapiens
cagtcctagagctcctgtcccta

SEQ ID NO: 2679033 - DNA, 12 bp, Homo sapiens
cagtcctgggag

SEQ ID NO: 2679034 - DNA, 21 bp, Homo sapiens
cagtcctgggagaacctcagg

SEQ ID NO: 2679035 - DNA, 15 bp, Homo sapiens
cagtctgcgtcaggc

SEQ ID NO: 2679036 - DNA, 20 bp, Homo sapiens
cagtctttcaactcattgca

SEQ ID NO: 2679037 - DNA, 23 bp, Homo sapiens
cagtgaaccaaagagactggagc

SEQ ID NO: 2679038 - DNA, 17 bp, Homo sapiens
cagtgacgtgcacctgt

SEQ ID NO: 2679039 - DNA, 15 bp, Homo sapiens
cagtgacttctggct

SEQ ID NO: 2679040 - DNA, 17 bp, Homo sapiens
cagtgacttctggctta

SEQ ID NO: 2679041 - DNA, 19 bp, Homo sapiens
cagtgactttttctgagct

SEQ ID NO: 2679042 - DNA, 22 bp, Homo sapiens
cagtgatttttccccccacccc

SEQ ID NO: 2679043 - DNA, 14 bp, Homo sapiens
cagtgcccatgcaa

SEQ ID NO: 2679044 - DNA, 20 bp, Homo sapiens
cagtgctgtaatcggctccc

SEQ ID NO: 2679045 - DNA, 22 bp, Homo sapiens
cagtgctgtaatcggctcccgc

SEQ ID NO: 2679046 - DNA, 17 bp, Homo sapiens
cagtgctgtggcctggg

SEQ ID NO: 2679047 - DNA, 20 bp, Homo sapiens
cagtgctgtggcctgggcaa

SEQ ID NO: 2679048 - DNA, 16 bp, Homo sapiens
cagtgcttcagcctga

SEQ ID NO: 2679049 - DNA, 13 bp, Homo sapiens
cagtggcctggct

SEQ ID NO: 2679050 - DNA, 20 bp, Homo sapiens
cagtggctcacgcctatgat

SEQ ID NO: 2679051 - DNA, 21 bp, Homo sapiens
cagtgggaggtgagaccacct

SEQ ID NO: 2679052 - DNA, 22 bp, Homo sapiens
cagtgggaggtgagaccacctc

SEQ ID NO: 2679053 - DNA, 20 bp, Homo sapiens
cagtgggcaggaggccccag

SEQ ID NO: 2679054 - DNA, 13 bp, Homo sapiens
cagtggttgctgt

SEQ ID NO: 2679055 - DNA, 21 bp, Homo sapiens
cagtgtaactggctgctccct

SEQ ID NO: 2679056 - DNA, 23 bp, Homo sapiens
cagtgtaactggctgctccctgc

SEQ ID NO: 2679057 - DNA, 20 bp, Homo sapiens
cagttctggggcccgcctgc

SEQ ID NO: 2679058 - DNA, 22 bp, Homo sapiens
cagttctggggcccgcctgcca

SEQ ID NO: 2679059 - DNA, 18 bp, Homo sapiens
cagttgaaaatggatttt

SEQ ID NO: 2679060 - DNA, 14 bp, Homo sapiens
cataaaatctgtga

SEQ ID NO: 2679061 - DNA, 16 bp, Homo sapiens
cataaaggtatttaga

SEQ ID NO: 2679062 - DNA, 23 bp, Homo sapiens
cataaaggtatttagaatatatt

SEQ ID NO: 2679063 - DNA, 22 bp, Homo sapiens
cctagaagtctccctgcacagc

SEQ ID NO: 2679064 - DNA, 13 bp, Homo sapiens
cctagagctcctg

SEQ ID NO: 2679065 - DNA, 16 bp, Homo sapiens
cctagagctcctgtcc

SEQ ID NO: 2679066 - DNA, 13 bp, Homo sapiens
cctaggactgact

SEQ ID NO: 2679067 - DNA, 15 bp, Homo sapiens
cctagtgcttccact

SEQ ID NO: 2679068 - DNA, 23 bp, Homo sapiens
cctagtgcttccacttctatgca

SEQ ID NO: 2679069 - DNA, 17 bp, Homo sapiens
cctagttcctgtggcca

SEQ ID NO: 2679070 - DNA, 16 bp, Homo sapiens
cctcaaacatggaaga

SEQ ID NO: 2679071 - DNA, 16 bp, Homo sapiens
cctcaaatgacccaaa

SEQ ID NO: 2679072 - DNA, 22 bp, Homo sapiens
cctcacttctgtctcctgtctt

SEQ ID NO: 2679073 - DNA, 14 bp, Homo sapiens
cctcagcctagacc

SEQ ID NO: 2679074 - DNA, 17 bp, Homo sapiens
cctcaggcttccttggc

SEQ ID NO: 2679075 - DNA, 12 bp, Homo sapiens
cctcagggccca

SEQ ID NO: 2679076 - DNA, 17 bp, Homo sapiens
cctccaagccattcact

SEQ ID NO: 2679077 - DNA, 15 bp, Homo sapiens
cctccacagccgcag

SEQ ID NO: 2679078 - DNA, 20 bp, Homo sapiens
cctccacgcaaggctgtgct

SEQ ID NO: 2679079 - DNA, 21 bp, Homo sapiens
cctccacgcaaggctgtgctc

SEQ ID NO: 2679080 - DNA, 23 bp, Homo sapiens
cctccaggagaaggggcccaagg

SEQ ID NO: 2679081 - DNA, 15 bp, Homo sapiens
cctccatggtgctgc

SEQ ID NO: 2679082 - DNA, 15 bp, Homo sapiens
cctccatgtggcccc

SEQ ID NO: 2679083 - DNA, 19 bp, Homo sapiens
cctccccatacttcctggg

SEQ ID NO: 2679084 - DNA, 13 bp, Homo sapiens
cctccccggccac

SEQ ID NO: 2679085 - DNA, 14 bp, Homo sapiens
cctccccttcccct

SEQ ID NO: 2679086 - DNA, 18 bp, Homo sapiens
cctccctctgacctgcag

SEQ ID NO: 2679087 - DNA, 15 bp, Homo sapiens
cctccctgcagactc

SEQ ID NO: 2679088 - DNA, 19 bp, Homo sapiens
cctccctttctctctccac

SEQ ID NO: 2679089 - DNA, 17 bp, Homo sapiens
cctccgtcgggcccctg

SEQ ID NO: 2679090 - DNA, 20 bp, Homo sapiens
cctccgtcgggcccctgcct

SEQ ID NO: 2679091 - DNA, 21 bp, Homo sapiens
cctccgtcgggcccctgcctg

SEQ ID NO: 2679092 - DNA, 12 bp, Homo sapiens
cctcctcctcac

SEQ ID NO: 2679093 - DNA, 15 bp, Homo sapiens
cctcctgctctgctt

SEQ ID NO: 2679094 - DNA, 18 bp, Homo sapiens
cctcctgctctgcttcct

SEQ ID NO: 2679095 - DNA, 20 bp, Homo sapiens
cctcctgtgtgtctgcagac

SEQ ID NO: 2679096 - DNA, 12 bp, Homo sapiens
cctccttttctt

SEQ ID NO: 2679097 - DNA, 20 bp, Homo sapiens
cctcgtggacacctgccctg

SEQ ID NO: 2679098 - DNA, 16 bp, Homo sapiens
cctctagaacacccac

SEQ ID NO: 2679099 - DNA, 22 bp, Homo sapiens
cctctagaacacccactggcca

SEQ ID NO: 2679100 - DNA, 14 bp, Homo sapiens
cctctagtgccctc

SEQ ID NO: 2679101 - DNA, 18 bp, Homo sapiens
cctctcccagccctcagc

SEQ ID NO: 2679102 - DNA, 19 bp, Homo sapiens
cctctgacctgcaggccaa

SEQ ID NO: 2679103 - DNA, 14 bp, Homo sapiens
cctctgctctgagg

SEQ ID NO: 2679104 - DNA, 18 bp, Homo sapiens
cctctgcttttgcacacc

SEQ ID NO: 2679105 - DNA, 17 bp, Homo sapiens
cctcttctcttcctgta

SEQ ID NO: 2679106 - DNA, 14 bp, Homo sapiens
cctctttctcagtt

SEQ ID NO: 2679107 - DNA, 18 bp, Homo sapiens
cctgaaagccagcaaagc

SEQ ID NO: 2679108 - DNA, 19 bp, Homo sapiens
cctgaaagccagcaaagcc

SEQ ID NO: 2679109 - DNA, 15 bp, Homo sapiens
cctgaagatcagagc

SEQ ID NO: 2679110 - DNA, 17 bp, Homo sapiens
cctgaagatcagagctg

SEQ ID NO: 2679111 - DNA, 18 bp, Homo sapiens
cctgaagggtgacatccc

SEQ ID NO: 2679112 - DNA, 20 bp, Homo sapiens
cctgaagggtgacatcccag

SEQ ID NO: 2679113 - DNA, 22 bp, Homo sapiens
cctgaagggtgacatcccagga

SEQ ID NO: 2679114 - DNA, 15 bp, Homo sapiens
cctgaattattccaa

SEQ ID NO: 2679115 - DNA, 13 bp, Homo sapiens
cctgacacaggcc

SEQ ID NO: 2679116 - DNA, 13 bp, Homo sapiens
cctgactctctgt

SEQ ID NO: 2679117 - DNA, 21 bp, Homo sapiens
cctgaggctgagactgcggga

SEQ ID NO: 2679118 - DNA, 21 bp, Homo sapiens
cctgagggctcctccatggtg

SEQ ID NO: 2679119 - DNA, 23 bp, Homo sapiens
cctgagggctcctccatggtgct

SEQ ID NO: 2679120 - DNA, 13 bp, Homo sapiens
cctgaggtgcctc

SEQ ID NO: 2679121 - DNA, 15 bp, Homo sapiens
cctgagtcacccatg

SEQ ID NO: 2679122 - DNA, 18 bp, Homo sapiens
cctgagtcacccatgaag

SEQ ID NO: 2679123 - DNA, 14 bp, Homo sapiens
cctgagtcactggt

SEQ ID NO: 2679124 - DNA, 17 bp, Homo sapiens
cctgattcactggcctg

SEQ ID NO: 2679125 - DNA, 14 bp, Homo sapiens
cctgcacagcctct

SEQ ID NO: 2679126 - DNA, 16 bp, Homo sapiens
cctgcacagcctctag

SEQ ID NO: 2679127 - DNA, 12 bp, Homo sapiens
cctgcagactcc

SEQ ID NO: 2679128 - DNA, 16 bp, Homo sapiens
cctgcaggccaagagc

SEQ ID NO: 2679129 - DNA, 21 bp, Homo sapiens
cctgcaggccaagagcagagg

SEQ ID NO: 2679130 - DNA, 12 bp, Homo sapiens
cctgcaggctcc

SEQ ID NO: 2679131 - DNA, 21 bp, Homo sapiens
cctgcaggctccatgcacctc

SEQ ID NO: 2679132 - DNA, 19 bp, Homo sapiens
cctgcaggtgagcaggcag

SEQ ID NO: 2679133 - DNA, 21 bp, Homo sapiens
cctgccaagctcacacagcag

SEQ ID NO: 2679134 - DNA, 12 bp, Homo sapiens
cctgccacctct

SEQ ID NO: 2679135 - DNA, 17 bp, Homo sapiens
cctgccacctctcccag

SEQ ID NO: 2679136 - DNA, 18 bp, Homo sapiens
cctgccacctctcccagc

SEQ ID NO: 2679137 - DNA, 13 bp, Homo sapiens
cctgccagcctgg

SEQ ID NO: 2679138 - DNA, 15 bp, Homo sapiens
cctgccagcctggct

SEQ ID NO: 2679139 - DNA, 23 bp, Homo sapiens
cctgccatttgcaccctccgcct

SEQ ID NO: 2679140 - DNA, 21 bp, Homo sapiens
cctgccctcccctgctcccag

SEQ ID NO: 2679141 - DNA, 12 bp, Homo sapiens
cctgccctgcca

SEQ ID NO: 2679142 - DNA, 14 bp, Homo sapiens
cctgccctgccacc

SEQ ID NO: 2679143 - DNA, 18 bp, Homo sapiens
cctgccctgccacctgtc

SEQ ID NO: 2679144 - DNA, 21 bp, Homo sapiens
cctgccctgccacctgtctgt

SEQ ID NO: 2679145 - DNA, 15 bp, Homo sapiens
cctgccctgccctgc

SEQ ID NO: 2679146 - DNA, 12 bp, Homo sapiens
cctgcctgcctt

SEQ ID NO: 2679147 - DNA, 16 bp, Homo sapiens
cctgcctggtcctccc

SEQ ID NO: 2679148 - DNA, 19 bp, Homo sapiens
cctgccttgaagccactga

SEQ ID NO: 2679149 - DNA, 23 bp, Homo sapiens
cctgccttgaagccactgaagct

SEQ ID NO: 2679150 - DNA, 20 bp, Homo sapiens
cctgcgaaggggccctggtc

SEQ ID NO: 2679151 - DNA, 21 bp, Homo sapiens
cctgctagctgtctctcttgt

SEQ ID NO: 2679152 - DNA, 12 bp, Homo sapiens
cctgctccagca

SEQ ID NO: 2679153 - DNA, 14 bp, Homo sapiens
cctgctccagcagc

SEQ ID NO: 2679154 - DNA, 19 bp, Homo sapiens
cctgctccagcagcacacc

SEQ ID NO: 2679155 - DNA, 23 bp, Homo sapiens
cctgctccagcagcacacctcag

SEQ ID NO: 2679156 - DNA, 13 bp, Homo sapiens
cctgctcccaggg

SEQ ID NO: 2679157 - DNA, 12 bp, Homo sapiens
cctgctctgctt

SEQ ID NO: 2679158 - DNA, 14 bp, Homo sapiens
cctgctctgcttcc

SEQ ID NO: 2679159 - DNA, 15 bp, Homo sapiens
cctgctctgcttcct

SEQ ID NO: 2679160 - DNA, 19 bp, Homo sapiens
cctgctctgcttcctcagg

SEQ ID NO: 2679161 - DNA, 13 bp, Homo sapiens
cctgctctgtagc

SEQ ID NO: 2679162 - DNA, 15 bp, Homo sapiens
cctgctctttctctg

SEQ ID NO: 2679163 - DNA, 16 bp, Homo sapiens
cctgctctttctctga

SEQ ID NO: 2679164 - DNA, 22 bp, Homo sapiens
cctgctgcaaaggacagtgggc

SEQ ID NO: 2679165 - DNA, 18 bp, Homo sapiens
cctgctgcgggggagcca

SEQ ID NO: 2679166 - DNA, 16 bp, Homo sapiens
cctgcttcctgaaagc

SEQ ID NO: 2679167 - DNA, 13 bp, Homo sapiens
cctggaactcact

SEQ ID NO: 2679168 - DNA, 14 bp, Homo sapiens
cctggactgactgc

SEQ ID NO: 2679169 - DNA, 15 bp, Homo sapiens
cctggagcaagctct

SEQ ID NO: 2679170 - DNA, 16 bp, Homo sapiens
cctggagcaagctctg

SEQ ID NO: 2679171 - DNA, 18 bp, Homo sapiens
cctggagcaagctctgcc

SEQ ID NO: 2679172 - DNA, 21 bp, Homo sapiens
cctggctgtgggtatcaggac

SEQ ID NO: 2679173 - DNA, 13 bp, Homo sapiens
cctggcttctgga

SEQ ID NO: 2679174 - DNA, 12 bp, Homo sapiens
ctctgccccagc

SEQ ID NO: 2679175 - DNA, 17 bp, Homo sapiens
ctctgccccagctctgg

SEQ ID NO: 2679176 - DNA, 23 bp, Homo sapiens
ctctgccccatcattgcacctgc

SEQ ID NO: 2679177 - DNA, 21 bp, Homo sapiens
ctctgctctatgccaggctgt

SEQ ID NO: 2679178 - DNA, 15 bp, Homo sapiens
ctctgctgccatggc

SEQ ID NO: 2679179 - DNA, 14 bp, Homo sapiens
ctctgcttcctcag

SEQ ID NO: 2679180 - DNA, 18 bp, Homo sapiens
ctctgcttcctcagggcc

SEQ ID NO: 2679181 - DNA, 16 bp, Homo sapiens
ctctggaccaaccctg

SEQ ID NO: 2679182 - DNA, 22 bp, Homo sapiens
ctctggaccaaccctgtttcct

SEQ ID NO: 2679183 - DNA, 15 bp, Homo sapiens
ctctggatggcacca

SEQ ID NO: 2679184 - DNA, 16 bp, Homo sapiens
ctctggccaggcatgg

SEQ ID NO: 2679185 - DNA, 19 bp, Homo sapiens
ctctgggtggaagtgccca

SEQ ID NO: 2679186 - DNA, 17 bp, Homo sapiens
ctctggtttctgtgtgt

SEQ ID NO: 2679187 - DNA, 15 bp, Homo sapiens
ctctgtagccacctc

SEQ ID NO: 2679188 - DNA, 18 bp, Homo sapiens
ctctgtagccacctcctt

SEQ ID NO: 2679189 - DNA, 20 bp, Homo sapiens
ctctgtagccacctccttgg

SEQ ID NO: 2679190 - DNA, 17 bp, Homo sapiens
ctctgtgaccgccctcc

SEQ ID NO: 2679191 - DNA, 23 bp, Homo sapiens
ctctgtgacctgccccgcccagc

SEQ ID NO: 2679192 - DNA, 22 bp, Homo sapiens
ctctgttgcccaggctggagtg

SEQ ID NO: 2679193 - DNA, 14 bp, Homo sapiens
ctcttcccttctcc

SEQ ID NO: 2679194 - DNA, 18 bp, Homo sapiens
ctcttggacctctgctct

SEQ ID NO: 2679195 - DNA, 19 bp, Homo sapiens
ctcttgttccgtgccaggc

SEQ ID NO: 2679196 - DNA, 19 bp, Homo sapiens
ctcttgttgatttccgtga

SEQ ID NO: 2679197 - DNA, 19 bp, Homo sapiens
ctctttaacttgtaataaa

SEQ ID NO: 2679198 - DNA, 11 bp, Homo sapiens
ctctttgaaac

SEQ ID NO: 2679199 - DNA, 21 bp, Homo sapiens
ctctttgctacaataaatgct

SEQ ID NO: 2679200 - DNA, 20 bp, Homo sapiens
ctgaaacattcacacagggc

SEQ ID NO: 2679201 - DNA, 13 bp, Homo sapiens
ctgaaagccagca

SEQ ID NO: 2679202 - DNA, 12 bp, Homo sapiens
ctgaaatttccc

SEQ ID NO: 2679203 - DNA, 18 bp, Homo sapiens
ctgaagatcagagctgca

SEQ ID NO: 2679204 - DNA, 22 bp, Homo sapiens
ctgaagatcagagctgcagcca

SEQ ID NO: 2679205 - DNA, 15 bp, Homo sapiens
ctgaagggtgacatc

SEQ ID NO: 2679206 - DNA, 20 bp, Homo sapiens
ctgaagggtgacatcccagg

SEQ ID NO: 2679207 - DNA, 19 bp, Homo sapiens
ctgaataagcactttttaa

SEQ ID NO: 2679208 - DNA, 15 bp, Homo sapiens
ctgacacaggccagc

SEQ ID NO: 2679209 - DNA, 16 bp, Homo sapiens
ctgacacaggccagcc

SEQ ID NO: 2679210 - DNA, 21 bp, Homo sapiens
ctgacacaggccagccttggc

SEQ ID NO: 2679211 - DNA, 22 bp, Homo sapiens
ctgacacccagtgtccttccat

SEQ ID NO: 2679212 - DNA, 22 bp, Homo sapiens
ctgacacggggatcatctctgt

SEQ ID NO: 2679213 - DNA, 21 bp, Homo sapiens
ctgacacgtgatggaccaaag

SEQ ID NO: 2679214 - DNA, 14 bp, Homo sapiens
ctgacactgtgacc

SEQ ID NO: 2679215 - DNA, 18 bp, Homo sapiens
ctgacactgtgaccctgg

SEQ ID NO: 2679216 - DNA, 19 bp, Homo sapiens
ctgacactgtgaccctggg

SEQ ID NO: 2679217 - DNA, 13 bp, Homo sapiens
ctgacagaaatgc

SEQ ID NO: 2679218 - DNA, 15 bp, Homo sapiens
ctgaccaaaatgtgt

SEQ ID NO: 2679219 - DNA, 23 bp, Homo sapiens
ctgacccaactgatcctgctcca

SEQ ID NO: 2679220 - DNA, 13 bp, Homo sapiens
ctgacctgcaggc

SEQ ID NO: 2679221 - DNA, 17 bp, Homo sapiens
ctgactcacaagaagac

SEQ ID NO: 2679222 - DNA, 22 bp, Homo sapiens
ctgactcggcagtgtgcagtgg

SEQ ID NO: 2679223 - DNA, 15 bp, Homo sapiens
ctgactgcagccccc

SEQ ID NO: 2679224 - DNA, 18 bp, Homo sapiens
ctgagaaccaaaagatgc

SEQ ID NO: 2679225 - DNA, 14 bp, Homo sapiens
ctgagaagcgctgc

SEQ ID NO: 2679226 - DNA, 16 bp, Homo sapiens
ctgagaagcgctgccc

SEQ ID NO: 2679227 - DNA, 17 bp, Homo sapiens
ctgagaagcgctgccct

SEQ ID NO: 2679228 - DNA, 18 bp, Homo sapiens
ctgagaagcgctgccctg

SEQ ID NO: 2679229 - DNA, 24 bp, Homo sapiens
ctgagcaacagagtgagaccctgt

SEQ ID NO: 2679230 - DNA, 14 bp, Homo sapiens
ctgagccctggcag

SEQ ID NO: 2679231 - DNA, 17 bp, Homo sapiens
ctgagcggcgcagagcc

SEQ ID NO: 2679232 - DNA, 18 bp, Homo sapiens
ctgagcttttcatggaag

SEQ ID NO: 2679233 - DNA, 20 bp, Homo sapiens
ctgagcttttcatggaagtg

SEQ ID NO: 2679234 - DNA, 13 bp, Homo sapiens
ctgaggactccct

SEQ ID NO: 2679235 - DNA, 16 bp, Homo sapiens
ctgaggatacagctct

SEQ ID NO: 2679236 - DNA, 22 bp, Homo sapiens
ctgaggcaggtgagaacccaga

SEQ ID NO: 2679237 - DNA, 19 bp, Homo sapiens
ctgaggccacccactgacc

SEQ ID NO: 2679238 - DNA, 18 bp, Homo sapiens
ctgaggcgggtggatcac

SEQ ID NO: 2679239 - DNA, 20 bp, Homo sapiens
ctgaggctctttctgggcca

SEQ ID NO: 2679240 - DNA, 16 bp, Homo sapiens
ctgagggctcctccat

SEQ ID NO: 2679241 - DNA, 21 bp, Homo sapiens
ctgaggggaggatcactggag

SEQ ID NO: 2679242 - DNA, 23 bp, Homo sapiens
ctgaggggaggatcactggagcc

SEQ ID NO: 2679243 - DNA, 11 bp, Homo sapiens
ctgaggtgcct

SEQ ID NO: 2679244 - DNA, 12 bp, Homo sapiens
ctgaggtgcctc

SEQ ID NO: 2679245 - DNA, 16 bp, Homo sapiens
ctgaggtgcctcccag

SEQ ID NO: 2679246 - DNA, 17 bp, Homo sapiens
ctgaggtgcctcccagt

SEQ ID NO: 2679247 - DNA, 15 bp, Homo sapiens
ctgatacttttttga

SEQ ID NO: 2679248 - DNA, 13 bp, Homo sapiens
ctgatcctgctcc

SEQ ID NO: 2679249 - DNA, 21 bp, Homo sapiens
ctgatgatgtctcttgtagaa

SEQ ID NO: 2679250 - DNA, 13 bp, Homo sapiens
ctgatgccaaagc

SEQ ID NO: 2679251 - DNA, 14 bp, Homo sapiens
ctgatgccaaagct

SEQ ID NO: 2679252 - DNA, 19 bp, Homo sapiens
ctgatgccaaagctgcttt

SEQ ID NO: 2679253 - DNA, 16 bp, Homo sapiens
ctgatggcccctccag

SEQ ID NO: 2679254 - DNA, 14 bp, Homo sapiens
ctgatggccctcat

SEQ ID NO: 2679255 - DNA, 23 bp, Homo sapiens
ctgattaatggaggcttagcttt

SEQ ID NO: 2679256 - DNA, 15 bp, Homo sapiens
ctgattcactggcct

SEQ ID NO: 2679257 - DNA, 20 bp, Homo sapiens
ctgattcactggcctggcgg

SEQ ID NO: 2679258 - DNA, 13 bp, Homo sapiens
ctgcacagcctct

SEQ ID NO: 2679259 - DNA, 16 bp, Homo sapiens
ctgcacctgccagcct

SEQ ID NO: 2679260 - DNA, 19 bp, Homo sapiens
ctgcagaaggccaagaatc

SEQ ID NO: 2679261 - DNA, 23 bp, Homo sapiens
ctgcagactccaatggggccagc

SEQ ID NO: 2679262 - DNA, 23 bp, Homo sapiens
ctgcagaggggctttctggagag

SEQ ID NO: 2679263 - DNA, 15 bp, Homo sapiens
ctgcagccagtcagg

SEQ ID NO: 2679264 - DNA, 18 bp, Homo sapiens
ctgcagccagtcaggcag

SEQ ID NO: 2679265 - DNA, 12 bp, Homo sapiens
ctgcagccccct

SEQ ID NO: 2679266 - DNA, 11 bp, Homo sapiens
ctgcagcctcc

SEQ ID NO: 2679267 - DNA, 24 bp, Homo sapiens
ctgcaggccaagagcagaggcagc

SEQ ID NO: 2679268 - DNA, 12 bp, Homo sapiens
ctgcaggctcca

SEQ ID NO: 2679269 - DNA, 19 bp, Homo sapiens
ctgcaggctccatgcacct

SEQ ID NO: 2679270 - DNA, 20 bp, Homo sapiens
ctgcaggctccatgcacctc

SEQ ID NO: 2679271 - DNA, 22 bp, Homo sapiens
ctgcaggctccatgcacctccc

SEQ ID NO: 2679272 - DNA, 17 bp, Homo sapiens
ctgcaggtgagcaggca

SEQ ID NO: 2679273 - DNA, 20 bp, Homo sapiens
ctgcagtagtctctgtgctt

SEQ ID NO: 2679274 - DNA, 23 bp, Homo sapiens
ctgcagtagtctctgtgctttga

SEQ ID NO: 2679275 - DNA, 17 bp, Homo sapiens
ctgcattgagtccagct

SEQ ID NO: 2679276 - DNA, 15 bp, Homo sapiens
ctgcattgttattgt

SEQ ID NO: 2679277 - DNA, 14 bp, Homo sapiens
ctgccaccagtcac

SEQ ID NO: 2679278 - DNA, 23 bp, Homo sapiens
ctgccacctctcccagccctcag

SEQ ID NO: 2679279 - DNA, 12 bp, Homo sapiens
ctgccacctgtc

SEQ ID NO: 2679280 - DNA, 14 bp, Homo sapiens
ctgccacctgtctg

SEQ ID NO: 2679281 - DNA, 15 bp, Homo sapiens
ctgccacctgtctgt

SEQ ID NO: 2679282 - DNA, 16 bp, Homo sapiens
ctgccacctgtctgtc

SEQ ID NO: 2679283 - DNA, 14 bp, Homo sapiens
ctgccagcctggct

SEQ ID NO: 2679284 - DNA, 22 bp, Homo sapiens
cttctggcttatgctcagaagc

SEQ ID NO: 2679285 - DNA, 22 bp, Homo sapiens
cttgaaaacctcatttaccata

SEQ ID NO: 2679286 - DNA, 16 bp, Homo sapiens
cttgaagccactgaag

SEQ ID NO: 2679287 - DNA, 18 bp, Homo sapiens
cttgaagccactgaagct

SEQ ID NO: 2679288 - DNA, 21 bp, Homo sapiens
cttgaagccactgaagctggg

SEQ ID NO: 2679289 - DNA, 14 bp, Homo sapiens
cttgagccatccaa

SEQ ID NO: 2679290 - DNA, 22 bp, Homo sapiens
cttgagccatccaaagaaacac

SEQ ID NO: 2679291 - DNA, 12 bp, Homo sapiens
cttgagcttggc

SEQ ID NO: 2679292 - DNA, 21 bp, Homo sapiens
cttgagcttggcagctgaact

SEQ ID NO: 2679293 - DNA, 14 bp, Homo sapiens
cttgaggacacatg

SEQ ID NO: 2679294 - DNA, 16 bp, Homo sapiens
cttgcccctgctctgt

SEQ ID NO: 2679295 - DNA, 19 bp, Homo sapiens
cttgcccctgctctgtagc

SEQ ID NO: 2679296 - DNA, 21 bp, Homo sapiens
cttgcccctgctctgtagcca

SEQ ID NO: 2679297 - DNA, 20 bp, Homo sapiens
cttgcccggattctgggagg

SEQ ID NO: 2679298 - DNA, 13 bp, Homo sapiens
cttgctctcctgg

SEQ ID NO: 2679299 - DNA, 15 bp, Homo sapiens
cttgctctcctggag

SEQ ID NO: 2679300 - DNA, 16 bp, Homo sapiens
cttgctctcctggagc

SEQ ID NO: 2679301 - DNA, 12 bp, Homo sapiens
cttgctctctga

SEQ ID NO: 2679302 - DNA, 16 bp, Homo sapiens
cttgctggattaatgt

SEQ ID NO: 2679303 - DNA, 15 bp, Homo sapiens
cttgctgtcctaggc

SEQ ID NO: 2679304 - DNA, 12 bp, Homo sapiens
cttgctgtgctt

SEQ ID NO: 2679305 - DNA, 13 bp, Homo sapiens
cttgctgtgcttt

SEQ ID NO: 2679306 - DNA, 19 bp, Homo sapiens
cttgcttgccgagcctaat

SEQ ID NO: 2679307 - DNA, 20 bp, Homo sapiens
cttggaaagcatcacctcag

SEQ ID NO: 2679308 - DNA, 12 bp, Homo sapiens
cttggacctctg

SEQ ID NO: 2679309 - DNA, 13 bp, Homo sapiens
cttggacctctgc

SEQ ID NO: 2679310 - DNA, 14 bp, Homo sapiens
cttggacctctgct

SEQ ID NO: 2679311 - DNA, 15 bp, Homo sapiens
cttggacctctgctc

SEQ ID NO: 2679312 - DNA, 16 bp, Homo sapiens
cttggacctctgctct

SEQ ID NO: 2679313 - DNA, 19 bp, Homo sapiens
cttggacctctgctctgag

SEQ ID NO: 2679314 - DNA, 15 bp, Homo sapiens
cttggcagctgaact

SEQ ID NO: 2679315 - DNA, 19 bp, Homo sapiens
cttggcatcacagggcaga

SEQ ID NO: 2679316 - DNA, 17 bp, Homo sapiens
cttgtccctctctcagc

SEQ ID NO: 2679317 - DNA, 20 bp, Homo sapiens
cttgtgggaccagtcccaca

SEQ ID NO: 2679318 - DNA, 13 bp, Homo sapiens
cttgtgtctgcgt

SEQ ID NO: 2679319 - DNA, 19 bp, Homo sapiens
cttgttagccaacttcaag

SEQ ID NO: 2679320 - DNA, 13 bp, Homo sapiens
cttgttgtggagg

SEQ ID NO: 2679321 - DNA, 16 bp, Homo sapiens
ctttacatgctgtgct

SEQ ID NO: 2679322 - DNA, 16 bp, Homo sapiens
ctttacctgcaggctc

SEQ ID NO: 2679323 - DNA, 21 bp, Homo sapiens
ctttactcagcccagctggcc

SEQ ID NO: 2679324 - DNA, 23 bp, Homo sapiens
ctttactcagcccagctggccac

SEQ ID NO: 2679325 - DNA, 22 bp, Homo sapiens
ctttactctgctctatgccagg

SEQ ID NO: 2679326 - DNA, 23 bp, Homo sapiens
ctttactctgctctatgccaggc

SEQ ID NO: 2679327 - DNA, 22 bp, Homo sapiens
ctttagaatcgctttccttcct

SEQ ID NO: 2679328 - DNA, 15 bp, Homo sapiens
ctttcagagccagtg

SEQ ID NO: 2679329 - DNA, 18 bp, Homo sapiens
ctttcagagccagtgaag

SEQ ID NO: 2679330 - DNA, 16 bp, Homo sapiens
ctttccagcctgggca

SEQ ID NO: 2679331 - DNA, 20 bp, Homo sapiens
ctttccggggctgctggcct

SEQ ID NO: 2679332 - DNA, 16 bp, Homo sapiens
ctttcctcgtgaagga

SEQ ID NO: 2679333 - DNA, 15 bp, Homo sapiens
ctttccttctgccct

SEQ ID NO: 2679334 - DNA, 17 bp, Homo sapiens
ctttctaaggacccaaa

SEQ ID NO: 2679335 - DNA, 14 bp, Homo sapiens
ctttctctctccac

SEQ ID NO: 2679336 - DNA, 15 bp, Homo sapiens
ctttcttctctgcct

SEQ ID NO: 2679337 - DNA, 23 bp, Homo sapiens
ctttcttctctgcctcctcctca

SEQ ID NO: 2679338 - DNA, 14 bp, Homo sapiens
ctttgactcacctg

SEQ ID NO: 2679339 - DNA, 15 bp, Homo sapiens
ctttgctacaataaa

SEQ ID NO: 2679340 - DNA, 19 bp, Homo sapiens
ctttgctacaataaatgct

SEQ ID NO: 2679341 - DNA, 18 bp, Homo sapiens
ctttgggaggctgaggcg

SEQ ID NO: 2679342 - DNA, 16 bp, Homo sapiens
cttttaagccctgctc

SEQ ID NO: 2679343 - DNA, 15 bp, Homo sapiens
cttttcatggaagtg

SEQ ID NO: 2679344 - DNA, 21 bp, Homo sapiens
cttttccattgaccagctctc

SEQ ID NO: 2679345 - DNA, 12 bp, Homo sapiens
cttttccccagg

SEQ ID NO: 2679346 - DNA, 13 bp, Homo sapiens
cttttccccagga

SEQ ID NO: 2679347 - DNA, 14 bp, Homo sapiens
cttttgttgtgact

SEQ ID NO: 2679348 - DNA, 14 bp, Homo sapiens
ctttttagccagtg

SEQ ID NO: 2679349 - DNA, 15 bp, Homo sapiens
cttttttgaaatcag

SEQ ID NO: 2679350 - DNA, 15 bp, Homo sapiens
gaaaatgcattatgt

SEQ ID NO: 2679351 - DNA, 17 bp, Homo sapiens
gaaacaaatttttttct

SEQ ID NO: 2679352 - DNA, 22 bp, Homo sapiens
gaaacattcacacagggctctt

SEQ ID NO: 2679353 - DNA, 19 bp, Homo sapiens
gaaaccagtgtagccttgc

SEQ ID NO: 2679354 - DNA, 19 bp, Homo sapiens
gaaacctgtccataaagta

SEQ ID NO: 2679355 - DNA, 20 bp, Homo sapiens
gaaacctgtccataaagtaa

SEQ ID NO: 2679356 - DNA, 23 bp, Homo sapiens
gaaacgcagattgggctggctct

SEQ ID NO: 2679357 - DNA, 22 bp, Homo sapiens
gaaactcctgattttgtagtta

SEQ ID NO: 2679358 - DNA, 16 bp, Homo sapiens
gaaagcatcacctcag

SEQ ID NO: 2679359 - DNA, 17 bp, Homo sapiens
gaaagcatcacctcagg

SEQ ID NO: 2679360 - DNA, 15 bp, Homo sapiens
gaaagcctctgctgc

SEQ ID NO: 2679361 - DNA, 16 bp, Homo sapiens
gaaagcctctgctgcc

SEQ ID NO: 2679362 - DNA, 20 bp, Homo sapiens
gaaagtcagatgcccagagg

SEQ ID NO: 2679363 - DNA, 13 bp, Homo sapiens
gaaattagccggg

SEQ ID NO: 2679364 - DNA, 20 bp, Homo sapiens
gaaattcaacctgtgtctta

SEQ ID NO: 2679365 - DNA, 19 bp, Homo sapiens
gaaatttcccacaccccag

SEQ ID NO: 2679366 - DNA, 17 bp, Homo sapiens
gaacacagaccaggaag

SEQ ID NO: 2679367 - DNA, 18 bp, Homo sapiens
gaacacagaccaggaagc

SEQ ID NO: 2679368 - DNA, 15 bp, Homo sapiens
gaacacccactggcc

SEQ ID NO: 2679369 - DNA, 18 bp, Homo sapiens
gaacacccactggccagt

SEQ ID NO: 2679370 - DNA, 19 bp, Homo sapiens
gaaccaaaaaaccccagct

SEQ ID NO: 2679371 - DNA, 19 bp, Homo sapiens
gaaccaaaagatgccttga

SEQ ID NO: 2679372 - DNA, 20 bp, Homo sapiens
gaaccaaagagactggagca

SEQ ID NO: 2679373 - DNA, 22 bp, Homo sapiens
gaaccagagggggcgtgcctgc

SEQ ID NO: 2679374 - DNA, 21 bp, Homo sapiens
gaacccaggtctgatgccaaa

SEQ ID NO: 2679375 - DNA, 13 bp, Homo sapiens
gaacgctcttagc

SEQ ID NO: 2679376 - DNA, 16 bp, Homo sapiens
gaacggggtccttcaa

SEQ ID NO: 2679377 - DNA, 20 bp, Homo sapiens
gaactccttattttgtatta

SEQ ID NO: 2679378 - DNA, 20 bp, Homo sapiens
gaactggggttcaagcccag

SEQ ID NO: 2679379 - DNA, 23 bp, Homo sapiens
gaactggggttcaagcccaggct

SEQ ID NO: 2679380 - DNA, 16 bp, Homo sapiens
gaacttgaggacacat

SEQ ID NO: 2679381 - DNA, 18 bp, Homo sapiens
gaagaccagactgtggag

SEQ ID NO: 2679382 - DNA, 21 bp, Homo sapiens
gaagagagtggggcctgccct

SEQ ID NO: 2679383 - DNA, 21 bp, Homo sapiens
gaagatcagagctgcagccag

SEQ ID NO: 2679384 - DNA, 15 bp, Homo sapiens
gaagccaggagcaaa

SEQ ID NO: 2679385 - DNA, 19 bp, Homo sapiens
gaagcggagcttgcagtga

SEQ ID NO: 2679386 - DNA, 16 bp, Homo sapiens
gaagctcggtgagtga

SEQ ID NO: 2679387 - DNA, 21 bp, Homo sapiens
gaaggataagagaaacaggcc

SEQ ID NO: 2679388 - DNA, 15 bp, Homo sapiens
gaaggcaaatataag

SEQ ID NO: 2679389 - DNA, 13 bp, Homo sapiens
gaaggccacatgt

SEQ ID NO: 2679390 - DNA, 18 bp, Homo sapiens
gaagggacagctgctggg

SEQ ID NO: 2679391 - DNA, 21 bp, Homo sapiens
gaagggacagctgctgggacc

SEQ ID NO: 2679392 - DNA, 15 bp, Homo sapiens
gaagggtgacatccc

SEQ ID NO: 2679393 - DNA, 17 bp, Homo sapiens
gaagggtgacatcccag

SEQ ID NO: 2679394 - DNA, 13 bp, Homo sapiens
gccctccaggcct

SEQ ID NO: 2679395 - DNA, 14 bp, Homo sapiens
gccctccaggcctg

SEQ ID NO: 2679396 - DNA, 19 bp, Homo sapiens
gccctccaggcctgcaggg

SEQ ID NO: 2679397 - DNA, 15 bp, Homo sapiens
gccctccatggcctg

SEQ ID NO: 2679398 - DNA, 17 bp, Homo sapiens
gccctcccctgctccca

SEQ ID NO: 2679399 - DNA, 23 bp, Homo sapiens
gccctccctttctctctccaccc

SEQ ID NO: 2679400 - DNA, 16 bp, Homo sapiens
gccctctgccccatca

SEQ ID NO: 2679401 - DNA, 21 bp, Homo sapiens
gccctgcagaggggaaaccag

SEQ ID NO: 2679402 - DNA, 15 bp, Homo sapiens
gccctgccacctgtc

SEQ ID NO: 2679403 - DNA, 17 bp, Homo sapiens
gccctgccacctgtctg

SEQ ID NO: 2679404 - DNA, 20 bp, Homo sapiens
gccctgccacctgtctgtct

SEQ ID NO: 2679405 - DNA, 16 bp, Homo sapiens
gccctgctctttctct

SEQ ID NO: 2679406 - DNA, 11 bp, Homo sapiens
gccctggaccc

SEQ ID NO: 2679407 - DNA, 14 bp, Homo sapiens
gccctggaccccag

SEQ ID NO: 2679408 - DNA, 15 bp, Homo sapiens
gccctggtccttcca

SEQ ID NO: 2679409 - DNA, 20 bp, Homo sapiens
gccctgtgagagccacgctg

SEQ ID NO: 2679410 - DNA, 12 bp, Homo sapiens
gcccttcctcca

SEQ ID NO: 2679411 - DNA, 15 bp, Homo sapiens
gcccttcctccagga

SEQ ID NO: 2679412 - DNA, 18 bp, Homo sapiens
gccgagattgcgccactg

SEQ ID NO: 2679413 - DNA, 20 bp, Homo sapiens
gccgagattgcgccactgca

SEQ ID NO: 2679414 - DNA, 22 bp, Homo sapiens
gccgcagaaggggaatgtgtcc

SEQ ID NO: 2679415 - DNA, 13 bp, Homo sapiens
gccgcgtccctgc

SEQ ID NO: 2679416 - DNA, 13 bp, Homo sapiens
gcctcccagtggc

SEQ ID NO: 2679417 - DNA, 16 bp, Homo sapiens
gcctccccatacttcc

SEQ ID NO: 2679418 - DNA, 24 bp, Homo sapiens
gcctccccatacttcctgggatga

SEQ ID NO: 2679419 - DNA, 14 bp, Homo sapiens
gcctccctgcagac

SEQ ID NO: 2679420 - DNA, 23 bp, Homo sapiens
gcctcccttccatgccccaggat

SEQ ID NO: 2679421 - DNA, 11 bp, Homo sapiens
gcctcctcctc

SEQ ID NO: 2679422 - DNA, 13 bp, Homo sapiens
gcctcctgtgtgt

SEQ ID NO: 2679423 - DNA, 14 bp, Homo sapiens
gcctcgtgtcctgc

SEQ ID NO: 2679424 - DNA, 21 bp, Homo sapiens
gcctctagaacacccactggc

SEQ ID NO: 2679425 - DNA, 16 bp, Homo sapiens
gcctctgaaatttccc

SEQ ID NO: 2679426 - DNA, 19 bp, Homo sapiens
gcctctgaaatttcccaca

SEQ ID NO: 2679427 - DNA, 12 bp, Homo sapiens
gcctctggccag

SEQ ID NO: 2679428 - DNA, 19 bp, Homo sapiens
gcctctggccaggcatggc

SEQ ID NO: 2679429 - DNA, 20 bp, Homo sapiens
gcctcttagtgattgtgtct

SEQ ID NO: 2679430 - DNA, 21 bp, Homo sapiens
gcctcttggacctctgctctg

SEQ ID NO: 2679431 - DNA, 17 bp, Homo sapiens
gcctgaagatcagagct

SEQ ID NO: 2679432 - DNA, 18 bp, Homo sapiens
gcctgaagatcagagctg

SEQ ID NO: 2679433 - DNA, 19 bp, Homo sapiens
gcctgaagatcagagctgc

SEQ ID NO: 2679434 - DNA, 21 bp, Homo sapiens
gcctgaagatcagagctgcag

SEQ ID NO: 2679435 - DNA, 13 bp, Homo sapiens
gcctgaggctgag

SEQ ID NO: 2679436 - DNA, 17 bp, Homo sapiens
gcctgaggctgagactg

SEQ ID NO: 2679437 - DNA, 17 bp, Homo sapiens
gcctgattcactggcct

SEQ ID NO: 2679438 - DNA, 11 bp, Homo sapiens
gcctgcagccc

SEQ ID NO: 2679439 - DNA, 15 bp, Homo sapiens
gcctgccctctgccc

SEQ ID NO: 2679440 - DNA, 18 bp, Homo sapiens
gcctgccctctgccccat

SEQ ID NO: 2679441 - DNA, 21 bp, Homo sapiens
gcctgccttctcccctccacg

SEQ ID NO: 2679442 - DNA, 16 bp, Homo sapiens
gcctggcccttgagtg

SEQ ID NO: 2679443 - DNA, 16 bp, Homo sapiens
gcctggcttctggagc

SEQ ID NO: 2679444 - DNA, 22 bp, Homo sapiens
gcctggcttctggagcccttgg

SEQ ID NO: 2679445 - DNA, 23 bp, Homo sapiens
gcctggcttctggagcccttggg

SEQ ID NO: 2679446 - DNA, 14 bp, Homo sapiens
gcctgggccagaga

SEQ ID NO: 2679447 - DNA, 16 bp, Homo sapiens
gcctgggccagagaag

SEQ ID NO: 2679448 - DNA, 20 bp, Homo sapiens
gcctgggcgacagagcgaga

SEQ ID NO: 2679449 - DNA, 18 bp, Homo sapiens
gcctggtcctccctccca

SEQ ID NO: 2679450 - DNA, 19 bp, Homo sapiens
gcctggtcctccctcccaa

SEQ ID NO: 2679451 - DNA, 19 bp, Homo sapiens
gcctgttggacccgctctg

SEQ ID NO: 2679452 - DNA, 21 bp, Homo sapiens
gccttaaggtagaaggcacat

SEQ ID NO: 2679453 - DNA, 20 bp, Homo sapiens
gccttcactccggtgtgcct

SEQ ID NO: 2679454 - DNA, 22 bp, Homo sapiens
gccttgcccggattctgggagg

SEQ ID NO: 2679455 - DNA, 18 bp, Homo sapiens
gccttggttcccttgtgt

SEQ ID NO: 2679456 - DNA, 12 bp, Homo sapiens
gcctttgccctg

SEQ ID NO: 2679457 - DNA, 14 bp, Homo sapiens
gccttttgtttaaa

SEQ ID NO: 2679458 - DNA, 17 bp, Homo sapiens
gcctttttacagccaac

SEQ ID NO: 2679459 - DNA, 14 bp, Homo sapiens
gcgaaggggccctg

SEQ ID NO: 2679460 - DNA, 16 bp, Homo sapiens
gcgagagtctgtctca

SEQ ID NO: 2679461 - DNA, 21 bp, Homo sapiens
gcgagctatgatcgcgccact

SEQ ID NO: 2679462 - DNA, 18 bp, Homo sapiens
gcgcacctgccccctggt

SEQ ID NO: 2679463 - DNA, 17 bp, Homo sapiens
gcgcagagccctccagg

SEQ ID NO: 2679464 - DNA, 18 bp, Homo sapiens
gcgcagagccctccaggc

SEQ ID NO: 2679465 - DNA, 20 bp, Homo sapiens
gcgcagagccctccaggcct

SEQ ID NO: 2679466 - DNA, 22 bp, Homo sapiens
gcgccactacactccagcctga

SEQ ID NO: 2679467 - DNA, 15 bp, Homo sapiens
gcgcctccttccttg

SEQ ID NO: 2679468 - DNA, 14 bp, Homo sapiens
gcgctgcagcctcc

SEQ ID NO: 2679469 - DNA, 16 bp, Homo sapiens
gcgctgccctgtgaga

SEQ ID NO: 2679470 - DNA, 16 bp, Homo sapiens
gcggagcttgcagtga

SEQ ID NO: 2679471 - DNA, 20 bp, Homo sapiens
gcggagcttgcagtgagccg

SEQ ID NO: 2679472 - DNA, 15 bp, Homo sapiens
gcggaggttgcaggg

SEQ ID NO: 2679473 - DNA, 19 bp, Homo sapiens
gcggcacccaggcctccct

SEQ ID NO: 2679474 - DNA, 13 bp, Homo sapiens
gcggcgcagagcc

SEQ ID NO: 2679475 - DNA, 15 bp, Homo sapiens
gcggcgcagagccct

SEQ ID NO: 2679476 - DNA, 21 bp, Homo sapiens
gcggcgtgggcgaggcctgac

SEQ ID NO: 2679477 - DNA, 17 bp, Homo sapiens
gcggtaggggctgcagg

SEQ ID NO: 2679478 - DNA, 18 bp, Homo sapiens
gcggtaggggctgcaggg

SEQ ID NO: 2679479 - DNA, 22 bp, Homo sapiens
gcgtcaggcacgtctcctgctg

SEQ ID NO: 2679480 - DNA, 23 bp, Homo sapiens
gcgtcaggcacgtctcctgctgc

SEQ ID NO: 2679481 - DNA, 21 bp, Homo sapiens
gcgtgacatgtgcagtgctgt

SEQ ID NO: 2679482 - DNA, 23 bp, Homo sapiens
gctaactgtggagaagcccctgg

SEQ ID NO: 2679483 - DNA, 22 bp, Homo sapiens
gctaagttctaagttcatgttt

SEQ ID NO: 2679484 - DNA, 18 bp, Homo sapiens
gctacaataaatgctgaa

SEQ ID NO: 2679485 - DNA, 21 bp, Homo sapiens
gctactcagaagcctgaggct

SEQ ID NO: 2679486 - DNA, 18 bp, Homo sapiens
gctaggagccccagcttc

SEQ ID NO: 2679487 - DNA, 17 bp, Homo sapiens
gctatttgttcagagag

SEQ ID NO: 2679488 - DNA, 21 bp, Homo sapiens
gctattttaaaccaattgcag

SEQ ID NO: 2679489 - DNA, 13 bp, Homo sapiens
gctattttctgac

SEQ ID NO: 2679490 - DNA, 23 bp, Homo sapiens
gctattttctgaccaaaatgtgt

SEQ ID NO: 2679491 - DNA, 13 bp, Homo sapiens
gctcacctcagag

SEQ ID NO: 2679492 - DNA, 14 bp, Homo sapiens
gctcacctctgaag

SEQ ID NO: 2679493 - DNA, 19 bp, Homo sapiens
gctcagaagccagtctgcg

SEQ ID NO: 2679494 - DNA, 14 bp, Homo sapiens
gctcagtctcagga

SEQ ID NO: 2679495 - DNA, 21 bp, Homo sapiens
gctcagtctcaggagcatggg

SEQ ID NO: 2679496 - DNA, 19 bp, Homo sapiens
gctccactacccggcaggg

SEQ ID NO: 2679497 - DNA, 22 bp, Homo sapiens
gctccatgcacctcccttccct

SEQ ID NO: 2679498 - DNA, 21 bp, Homo sapiens
gctcccagtgggagcttcccg

SEQ ID NO: 2679499 - DNA, 15 bp, Homo sapiens
gctccccacctaccc

SEQ ID NO: 2679500 - DNA, 19 bp, Homo sapiens
gctccccacctacccagct

SEQ ID NO: 2679501 - DNA, 19 bp, Homo sapiens
gctcccgcttgctctcctg

SEQ ID NO: 2679502 - DNA, 13 bp, Homo sapiens
gctcccggcatcc

SEQ ID NO: 2679503 - DNA, 12 bp, Homo sapiens
gctccctgctcc

SEQ ID NO: 2679504 - DNA, 17 bp, Homo sapiens
gggtcattatcagaaca

SEQ ID NO: 2679505 - DNA, 17 bp, Homo sapiens
gggtggaagtgcccagc

SEQ ID NO: 2679506 - DNA, 17 bp, Homo sapiens
gggtgttaaggcagtga

SEQ ID NO: 2679507 - DNA, 17 bp, Homo sapiens
gggttttccaccctgga

SEQ ID NO: 2679508 - DNA, 13 bp, Homo sapiens
ggtagaaggcaca

SEQ ID NO: 2679509 - DNA, 15 bp, Homo sapiens
ggtaggggctgcagg

SEQ ID NO: 2679510 - DNA, 23 bp, Homo sapiens
ggtatcaggactgtgaccaaagc

SEQ ID NO: 2679511 - DNA, 20 bp, Homo sapiens
ggtatgaacttgaggacaca

SEQ ID NO: 2679512 - DNA, 22 bp, Homo sapiens
ggtatgaacttgaggacacatg

SEQ ID NO: 2679513 - DNA, 18 bp, Homo sapiens
ggtcacaggctgtgcctt

SEQ ID NO: 2679514 - DNA, 12 bp, Homo sapiens
ggtcagcccagc

SEQ ID NO: 2679515 - DNA, 15 bp, Homo sapiens
ggtcagcccagcacc

SEQ ID NO: 2679516 - DNA, 16 bp, Homo sapiens
ggtcagcccagcacct

SEQ ID NO: 2679517 - DNA, 21 bp, Homo sapiens
ggtcagcccagcacctgctcc

SEQ ID NO: 2679518 - DNA, 13 bp, Homo sapiens
ggtcctccctccc

SEQ ID NO: 2679519 - DNA, 14 bp, Homo sapiens
ggtcctgcaggtcc

SEQ ID NO: 2679520 - DNA, 15 bp, Homo sapiens
ggtcctgcctggtcc

SEQ ID NO: 2679521 - DNA, 15 bp, Homo sapiens
ggtcctggggctctg

SEQ ID NO: 2679522 - DNA, 23 bp, Homo sapiens
ggtcctggtgggtcagcccagca

SEQ ID NO: 2679523 - DNA, 15 bp, Homo sapiens
ggtccttccaggccc

SEQ ID NO: 2679524 - DNA, 17 bp, Homo sapiens
ggtctccacctgtgctt

SEQ ID NO: 2679525 - DNA, 20 bp, Homo sapiens
ggtctgatgccaaagctgct

SEQ ID NO: 2679526 - DNA, 13 bp, Homo sapiens
ggtgacatcccag

SEQ ID NO: 2679527 - DNA, 13 bp, Homo sapiens
ggtgagaacccag

SEQ ID NO: 2679528 - DNA, 15 bp, Homo sapiens
ggtgagaccacctct

SEQ ID NO: 2679529 - DNA, 12 bp, Homo sapiens
ggtgatcagtgc

SEQ ID NO: 2679530 - DNA, 17 bp, Homo sapiens
ggtgcactggccccacc

SEQ ID NO: 2679531 - DNA, 12 bp, Homo sapiens
ggtgccaccaat

SEQ ID NO: 2679532 - DNA, 14 bp, Homo sapiens
ggtgccaccaataa

SEQ ID NO: 2679533 - DNA, 17 bp, Homo sapiens
ggtgccaccaataaaaa

SEQ ID NO: 2679534 - DNA, 20 bp, Homo sapiens
ggtgctgaggatacagctct

SEQ ID NO: 2679535 - DNA, 17 bp, Homo sapiens
ggtgctgatggccctca

SEQ ID NO: 2679536 - DNA, 18 bp, Homo sapiens
ggtggaagtgcccagccc

SEQ ID NO: 2679537 - DNA, 17 bp, Homo sapiens
ggtggacagtcctggga

SEQ ID NO: 2679538 - DNA, 15 bp, Homo sapiens
ggtggcagccctgta

SEQ ID NO: 2679539 - DNA, 18 bp, Homo sapiens
ggtggcagccctgtaggg

SEQ ID NO: 2679540 - DNA, 13 bp, Homo sapiens
ggtggcctgcggg

SEQ ID NO: 2679541 - DNA, 19 bp, Homo sapiens
ggtggcgggcacctatagt

SEQ ID NO: 2679542 - DNA, 16 bp, Homo sapiens
ggtgggagagcccagc

SEQ ID NO: 2679543 - DNA, 15 bp, Homo sapiens
ggtgggctgagccct

SEQ ID NO: 2679544 - DNA, 17 bp, Homo sapiens
ggtgggctgagccctgg

SEQ ID NO: 2679545 - DNA, 15 bp, Homo sapiens
ggtgggtcagcccag

SEQ ID NO: 2679546 - DNA, 17 bp, Homo sapiens
ggtgggtcagcccagca

SEQ ID NO: 2679547 - DNA, 15 bp, Homo sapiens
ggtggtcacaggctg

SEQ ID NO: 2679548 - DNA, 22 bp, Homo sapiens
ggttcaagcccaggcttcctgg

SEQ ID NO: 2679549 - DNA, 18 bp, Homo sapiens
ggttctgagaagcgctgc

SEQ ID NO: 2679550 - DNA, 22 bp, Homo sapiens
ggttgctgttgatgaggcctct

SEQ ID NO: 2679551 - DNA, 14 bp, Homo sapiens
ggtttctctcttcc

SEQ ID NO: 2679552 - DNA, 15 bp, Homo sapiens
ggtttgccaggccaa

SEQ ID NO: 2679553 - DNA, 15 bp, Homo sapiens
ggttttgtattcttt

SEQ ID NO: 2679554 - DNA, 20 bp, Homo sapiens
gtaacacaagccacagaagc

SEQ ID NO: 2679555 - DNA, 18 bp, Homo sapiens
gtaacagtgaggctggga

SEQ ID NO: 2679556 - DNA, 18 bp, Homo sapiens
gtaaccggacaccttaga

SEQ ID NO: 2679557 - DNA, 19 bp, Homo sapiens
gtaactggctgctccctgc

SEQ ID NO: 2679558 - DNA, 18 bp, Homo sapiens
gtaagtaccactcaggcc

SEQ ID NO: 2679559 - DNA, 22 bp, Homo sapiens
gtaatcagcattattcttcaga

SEQ ID NO: 2679560 - DNA, 19 bp, Homo sapiens
gtaattaaaagaattttcc

SEQ ID NO: 2679561 - DNA, 14 bp, Homo sapiens
gtaccactcaggcc

SEQ ID NO: 2679562 - DNA, 14 bp, Homo sapiens
gtactgataaaata

SEQ ID NO: 2679563 - DNA, 12 bp, Homo sapiens
gtacttgctctc

SEQ ID NO: 2679564 - DNA, 12 bp, Homo sapiens
gtagaaggcaca

SEQ ID NO: 2679565 - DNA, 16 bp, Homo sapiens
gtagcatcttctggag

SEQ ID NO: 2679566 - DNA, 18 bp, Homo sapiens
gtagccaaggtgggctga

SEQ ID NO: 2679567 - DNA, 19 bp, Homo sapiens
gtagccaaggtgggctgag

SEQ ID NO: 2679568 - DNA, 15 bp, Homo sapiens
gtagccttgcccgga

SEQ ID NO: 2679569 - DNA, 21 bp, Homo sapiens
gtatatattctacacatatat

SEQ ID NO: 2679570 - DNA, 18 bp, Homo sapiens
gtatatctatatctctaa

SEQ ID NO: 2679571 - DNA, 17 bp, Homo sapiens
gtatatgttgtaataaa

SEQ ID NO: 2679572 - DNA, 19 bp, Homo sapiens
gtatgaacttgaggacaca

SEQ ID NO: 2679573 - DNA, 20 bp, Homo sapiens
gtatgaacttgaggacacat

SEQ ID NO: 2679574 - DNA, 22 bp, Homo sapiens
gtatgaacttgaggacacatgt

SEQ ID NO: 2679575 - DNA, 14 bp, Homo sapiens
gtcaagggctgggg

SEQ ID NO: 2679576 - DNA, 15 bp, Homo sapiens
gtcacaggctgtgcc

SEQ ID NO: 2679577 - DNA, 16 bp, Homo sapiens
gtcacaggctgtgcct

SEQ ID NO: 2679578 - DNA, 19 bp, Homo sapiens
gtcaccgtggaccttcctg

SEQ ID NO: 2679579 - DNA, 19 bp, Homo sapiens
gtcagaatcatgctgttct

SEQ ID NO: 2679580 - DNA, 14 bp, Homo sapiens
gtcagactggctgg

SEQ ID NO: 2679581 - DNA, 12 bp, Homo sapiens
gtcagcccagca

SEQ ID NO: 2679582 - DNA, 13 bp, Homo sapiens
gtcagcccagcac

SEQ ID NO: 2679583 - DNA, 13 bp, Homo sapiens
gtcagctttcaga

SEQ ID NO: 2679584 - DNA, 21 bp, Homo sapiens
gtcagctttcagagccagtga

SEQ ID NO: 2679585 - DNA, 12 bp, Homo sapiens
gtcattgcccct

SEQ ID NO: 2679586 - DNA, 13 bp, Homo sapiens
gtcattgcccctc

SEQ ID NO: 2679587 - DNA, 24 bp, Homo sapiens
gtccagtgggaggtgagaccacct

SEQ ID NO: 2679588 - DNA, 18 bp, Homo sapiens
gtcccacaccgctggtcc

SEQ ID NO: 2679589 - DNA, 12 bp, Homo sapiens
gtcccacctctt

SEQ ID NO: 2679590 - DNA, 21 bp, Homo sapiens
gtcccacctcttctcttcctg

SEQ ID NO: 2679591 - DNA, 22 bp, Homo sapiens
gtcccagctactcagaagcctg

SEQ ID NO: 2679592 - DNA, 22 bp, Homo sapiens
gtccccgtggatggtctccacc

SEQ ID NO: 2679593 - DNA, 14 bp, Homo sapiens
gtccctacccactc

SEQ ID NO: 2679594 - DNA, 20 bp, Homo sapiens
gtccctacccactctttgct

SEQ ID NO: 2679595 - DNA, 23 bp, Homo sapiens
gtccctacccactctttgctaca

SEQ ID NO: 2679596 - DNA, 20 bp, Homo sapiens
gtccctcaaatgacccaaag

SEQ ID NO: 2679597 - DNA, 23 bp, Homo sapiens
gtccctcaaatgacccaaagacc

SEQ ID NO: 2679598 - DNA, 17 bp, Homo sapiens
gtccctgactctctgtg

SEQ ID NO: 2679599 - DNA, 19 bp, Homo sapiens
gtccctgccctcccctgct

SEQ ID NO: 2679600 - DNA, 15 bp, Homo sapiens
gtccgtgtgcctcct

SEQ ID NO: 2679601 - DNA, 18 bp, Homo sapiens
gtccgtgtgcctcctgtg

SEQ ID NO: 2679602 - DNA, 22 bp, Homo sapiens
gtcctagagctcctgtccctac

SEQ ID NO: 2679603 - DNA, 16 bp, Homo sapiens
gtcctcacttctgtct

SEQ ID NO: 2679604 - DNA, 21 bp, Homo sapiens
gtcctcacttctgtctcctgt

SEQ ID NO: 2679605 - DNA, 14 bp, Homo sapiens
gtcctcctgctctg

SEQ ID NO: 2679606 - DNA, 21 bp, Homo sapiens
gtcctcctgctctgcttcctc

SEQ ID NO: 2679607 - DNA, 11 bp, Homo sapiens
gtcctctggat

SEQ ID NO: 2679608 - DNA, 18 bp, Homo sapiens
gtcctctggatggcacca

SEQ ID NO: 2679609 - DNA, 10 bp, Homo sapiens
gtcctgcagg

SEQ ID NO: 2679610 - DNA, 17 bp, Homo sapiens
gtcctggggctctgtgc

SEQ ID NO: 2679611 - DNA, 14 bp, Homo sapiens
gtccttccaggccc

SEQ ID NO: 2679612 - DNA, 22 bp, Homo sapiens
gtccttccaggcccccaccact

SEQ ID NO: 2679613 - DNA, 17 bp, Homo sapiens
gtccttttgtaccatgg

SEQ ID NO: 2679614 - DNA, 19 bp, Homo sapiens
tcagtgctgtggcctgggc

SEQ ID NO: 2679615 - DNA, 16 bp, Homo sapiens
tcatgctgttctcttt

SEQ ID NO: 2679616 - DNA, 22 bp, Homo sapiens
tcatttaccataaaaatccttc

SEQ ID NO: 2679617 - DNA, 13 bp, Homo sapiens
tcatttggtgctg

SEQ ID NO: 2679618 - DNA, 12 bp, Homo sapiens
tccaaccccagc

SEQ ID NO: 2679619 - DNA, 13 bp, Homo sapiens
tccaaccccagct

SEQ ID NO: 2679620 - DNA, 18 bp, Homo sapiens
tccaaccccagctggcct

SEQ ID NO: 2679621 - DNA, 20 bp, Homo sapiens
tccaaccccagctggcctct

SEQ ID NO: 2679622 - DNA, 14 bp, Homo sapiens
tccacacagaactg

SEQ ID NO: 2679623 - DNA, 17 bp, Homo sapiens
tccacagccgcagcctc

SEQ ID NO: 2679624 - DNA, 14 bp, Homo sapiens
tccacataaaggta

SEQ ID NO: 2679625 - DNA, 17 bp, Homo sapiens
tccaccccccacgtctg

SEQ ID NO: 2679626 - DNA, 20 bp, Homo sapiens
tccaccccccacgtctgtcc

SEQ ID NO: 2679627 - DNA, 22 bp, Homo sapiens
tccaccccccacgtctgtcctc

SEQ ID NO: 2679628 - DNA, 21 bp, Homo sapiens
tccacctgtgcttggaaccag

SEQ ID NO: 2679629 - DNA, 20 bp, Homo sapiens
tccacgcaaggctgtgctct

SEQ ID NO: 2679630 - DNA, 17 bp, Homo sapiens
tccactacccggcaggg

SEQ ID NO: 2679631 - DNA, 10 bp, Homo sapiens
tccactggac

SEQ ID NO: 2679632 - DNA, 17 bp, Homo sapiens
tccactggacttgagct

SEQ ID NO: 2679633 - DNA, 18 bp, Homo sapiens
tccagaaaaccccagcat

SEQ ID NO: 2679634 - DNA, 22 bp, Homo sapiens
tccagaccattgtcttccaacc

SEQ ID NO: 2679635 - DNA, 18 bp, Homo sapiens
tccagagagtcctctgga

SEQ ID NO: 2679636 - DNA, 19 bp, Homo sapiens
tccagagagtcctctggat

SEQ ID NO: 2679637 - DNA, 14 bp, Homo sapiens
tccagcatcttttc

SEQ ID NO: 2679638 - DNA, 22 bp, Homo sapiens
tccagcatcttttccatcctga

SEQ ID NO: 2679639 - DNA, 17 bp, Homo sapiens
tccagcctgggcgacag

SEQ ID NO: 2679640 - DNA, 13 bp, Homo sapiens
tccagctttcctt

SEQ ID NO: 2679641 - DNA, 23 bp, Homo sapiens
tccagttcacaggccagaaaaca

SEQ ID NO: 2679642 - DNA, 12 bp, Homo sapiens
tccatcctgagg

SEQ ID NO: 2679643 - DNA, 19 bp, Homo sapiens
tccatcctgaggtgcctcc

SEQ ID NO: 2679644 - DNA, 22 bp, Homo sapiens
tccatcctgaggtgcctcccag

SEQ ID NO: 2679645 - DNA, 16 bp, Homo sapiens
tccatggtgctgcatt

SEQ ID NO: 2679646 - DNA, 22 bp, Homo sapiens
tccatgtggccccaggtgccac

SEQ ID NO: 2679647 - DNA, 20 bp, Homo sapiens
tccatttctctccaggaagt

SEQ ID NO: 2679648 - DNA, 16 bp, Homo sapiens
tcccaaggagccattc

SEQ ID NO: 2679649 - DNA, 20 bp, Homo sapiens
tcccaagtagtagtgtcttc

SEQ ID NO: 2679650 - DNA, 17 bp, Homo sapiens
tcccaatagctctactg

SEQ ID NO: 2679651 - DNA, 14 bp, Homo sapiens
tcccacaccgctgg

SEQ ID NO: 2679652 - DNA, 22 bp, Homo sapiens
tcccacctcttctcttcctgta

SEQ ID NO: 2679653 - DNA, 13 bp, Homo sapiens
tcccagaggcaga

SEQ ID NO: 2679654 - DNA, 16 bp, Homo sapiens
tcccagctactcagaa

SEQ ID NO: 2679655 - DNA, 21 bp, Homo sapiens
tcccaggaggggcctctgaaa

SEQ ID NO: 2679656 - DNA, 12 bp, Homo sapiens
tcccaggccagg

SEQ ID NO: 2679657 - DNA, 17 bp, Homo sapiens
tcccagggccagggccc

SEQ ID NO: 2679658 - DNA, 20 bp, Homo sapiens
tcccagggccagggccctgc

SEQ ID NO: 2679659 - DNA, 15 bp, Homo sapiens
tccccaagactgtca

SEQ ID NO: 2679660 - DNA, 17 bp, Homo sapiens
tccccacctacccagct

SEQ ID NO: 2679661 - DNA, 12 bp, Homo sapiens
tccccaggagca

SEQ ID NO: 2679662 - DNA, 21 bp, Homo sapiens
tccccaggtggaggtgccagg

SEQ ID NO: 2679663 - DNA, 18 bp, Homo sapiens
tccccatacttcctggga

SEQ ID NO: 2679664 - DNA, 16 bp, Homo sapiens
tccccccaccccccag

SEQ ID NO: 2679665 - DNA, 17 bp, Homo sapiens
tccccctcccagggcca

SEQ ID NO: 2679666 - DNA, 19 bp, Homo sapiens
tccccctcccagggccagg

SEQ ID NO: 2679667 - DNA, 12 bp, Homo sapiens
tccccctgggct

SEQ ID NO: 2679668 - DNA, 21 bp, Homo sapiens
tcccctttactcagcccagct

SEQ ID NO: 2679669 - DNA, 13 bp, Homo sapiens
tcccgctccccac

SEQ ID NO: 2679670 - DNA, 13 bp, Homo sapiens
tcccggcatcctg

SEQ ID NO: 2679671 - DNA, 18 bp, Homo sapiens
tccctacccactctttgc

SEQ ID NO: 2679672 - DNA, 18 bp, Homo sapiens
tccctagcctgcttttgt

SEQ ID NO: 2679673 - DNA, 20 bp, Homo sapiens
tccctcaaatgacccaaaga

SEQ ID NO: 2679674 - DNA, 22 bp, Homo sapiens
tccctcccaaggagccattctg

SEQ ID NO: 2679675 - DNA, 21 bp, Homo sapiens
tccctccttgagcaccagccc

SEQ ID NO: 2679676 - DNA, 13 bp, Homo sapiens
tccctgcacagcc

SEQ ID NO: 2679677 - DNA, 22 bp, Homo sapiens
tccctgccccgacccgggtctg

SEQ ID NO: 2679678 - DNA, 13 bp, Homo sapiens
tccctgccctccc

SEQ ID NO: 2679679 - DNA, 21 bp, Homo sapiens
tccctgccctcccctgctccc

SEQ ID NO: 2679680 - DNA, 23 bp, Homo sapiens
tccctgggggcatcctgcttcct

SEQ ID NO: 2679681 - DNA, 17 bp, Homo sapiens
tcccttctcccttgccc

SEQ ID NO: 2679682 - DNA, 13 bp, Homo sapiens
tcccttgccctcc

SEQ ID NO: 2679683 - DNA, 14 bp, Homo sapiens
tcccttgccctccc

SEQ ID NO: 2679684 - DNA, 20 bp, Homo sapiens
tcccttgccctccctttctc

SEQ ID NO: 2679685 - DNA, 15 bp, Homo sapiens
tcccttgtgtgtgtg

SEQ ID NO: 2679686 - DNA, 14 bp, Homo sapiens
tccctttctctctc

SEQ ID NO: 2679687 - DNA, 21 bp, Homo sapiens
tccgtcgggcccctgcctgcc

SEQ ID NO: 2679688 - DNA, 22 bp, Homo sapiens
tccgtcgggcccctgcctgcct

SEQ ID NO: 2679689 - DNA, 12 bp, Homo sapiens
tccgtgtgcctc

SEQ ID NO: 2679690 - DNA, 17 bp, Homo sapiens
tccgtgtgcctcctgtg

SEQ ID NO: 2679691 - DNA, 19 bp, Homo sapiens
tccgtgtgcctcctgtgtg

SEQ ID NO: 2679692 - DNA, 20 bp, Homo sapiens
tccgtttgagtgtctgcgcc

SEQ ID NO: 2679693 - DNA, 13 bp, Homo sapiens
tcctacctcagcc

SEQ ID NO: 2679694 - DNA, 16 bp, Homo sapiens
tcctacctcagcctag

SEQ ID NO: 2679695 - DNA, 17 bp, Homo sapiens
tcctacctcagcctaga

SEQ ID NO: 2679696 - DNA, 14 bp, Homo sapiens
tcctagagctcctg

SEQ ID NO: 2679697 - DNA, 18 bp, Homo sapiens
tcctagagctcctgtccc

SEQ ID NO: 2679698 - DNA, 21 bp, Homo sapiens
tcctagagctcctgtccctac

SEQ ID NO: 2679699 - DNA, 13 bp, Homo sapiens
tcctaggccacac

SEQ ID NO: 2679700 - DNA, 12 bp, Homo sapiens
tcctcacttctg

SEQ ID NO: 2679701 - DNA, 16 bp, Homo sapiens
tcctcagggcccagca

SEQ ID NO: 2679702 - DNA, 18 bp, Homo sapiens
tcctcagggcccagcagg

SEQ ID NO: 2679703 - DNA, 18 bp, Homo sapiens
tcctccccttttgccccc

SEQ ID NO: 2679704 - DNA, 14 bp, Homo sapiens
tcctccctcccaag

SEQ ID NO: 2679705 - DNA, 15 bp, Homo sapiens
tcctcctcccccaga

SEQ ID NO: 2679706 - DNA, 11 bp, Homo sapiens
tcctcctgctc

SEQ ID NO: 2679707 - DNA, 17 bp, Homo sapiens
tcctcctgctctgcttc

SEQ ID NO: 2679708 - DNA, 22 bp, Homo sapiens
tcctcctgctctgcttcctcag

SEQ ID NO: 2679709 - DNA, 17 bp, Homo sapiens
tcctctggatggcacca

SEQ ID NO: 2679710 - DNA, 21 bp, Homo sapiens
tcctctggtttctgtgtgtcc

SEQ ID NO: 2679711 - DNA, 17 bp, Homo sapiens
tcctcttgcatttcact

SEQ ID NO: 2679712 - DNA, 13 bp, Homo sapiens
tcctgaaagccag

SEQ ID NO: 2679713 - DNA, 12 bp, Homo sapiens
tcctgaaagctg

SEQ ID NO: 2679714 - DNA, 11 bp, Homo sapiens
tcctgaccaaa

SEQ ID NO: 2679715 - DNA, 12 bp, Homo sapiens
tcctgaccaaag

SEQ ID NO: 2679716 - DNA, 19 bp, Homo sapiens
tcctgaggtgcctcccagt

SEQ ID NO: 2679717 - DNA, 19 bp, Homo sapiens
tcctgcaggtcctggtggg

SEQ ID NO: 2679718 - DNA, 20 bp, Homo sapiens
tcctgctagctgtctctctt

SEQ ID NO: 2679719 - DNA, 13 bp, Homo sapiens
tcctgctccagca

SEQ ID NO: 2679720 - DNA, 16 bp, Homo sapiens
tcctgctccagcagca

SEQ ID NO: 2679721 - DNA, 15 bp, Homo sapiens
tcctgctctgcttcc

SEQ ID NO: 2679722 - DNA, 20 bp, Homo sapiens
tcctgctctgcttcctcagg

SEQ ID NO: 2679723 - DNA, 19 bp, Homo sapiens
tcctggaaaggctcagtct

SEQ ID NO: 2679724 - DNA, 13 bp, Homo sapiens
tgaggctgagact

SEQ ID NO: 2679725 - DNA, 18 bp, Homo sapiens
tgaggctgagactgcggg

SEQ ID NO: 2679726 - DNA, 11 bp, Homo sapiens
tgaggctggga

SEQ ID NO: 2679727 - DNA, 21 bp, Homo sapiens
tgaggggaggatcactggagc

SEQ ID NO: 2679728 - DNA, 12 bp, Homo sapiens
tgagggtgactg

SEQ ID NO: 2679729 - DNA, 13 bp, Homo sapiens
tgagggtgactgt

SEQ ID NO: 2679730 - DNA, 22 bp, Homo sapiens
tgaggtgcctcccagtggcctg

SEQ ID NO: 2679731 - DNA, 22 bp, Homo sapiens
tgagtccagctttccttctgcc

SEQ ID NO: 2679732 - DNA, 19 bp, Homo sapiens
tgataaattccactggact

SEQ ID NO: 2679733 - DNA, 22 bp, Homo sapiens
tgataggacttccttaagcatg

SEQ ID NO: 2679734 - DNA, 19 bp, Homo sapiens
tgatcccaagtgccagtct

SEQ ID NO: 2679735 - DNA, 16 bp, Homo sapiens
tgatcctgctccagca

SEQ ID NO: 2679736 - DNA, 19 bp, Homo sapiens
tgatcctgctccagcagca

SEQ ID NO: 2679737 - DNA, 15 bp, Homo sapiens
tgatcgagccactgc

SEQ ID NO: 2679738 - DNA, 16 bp, Homo sapiens
tgatcgagccactgca

SEQ ID NO: 2679739 - DNA, 18 bp, Homo sapiens
tgatcgagccactgcact

SEQ ID NO: 2679740 - DNA, 22 bp, Homo sapiens
tgatgaaactcctgattttgta

SEQ ID NO: 2679741 - DNA, 16 bp, Homo sapiens
tgatgaaattcttgaa

SEQ ID NO: 2679742 - DNA, 17 bp, Homo sapiens
tgatgaggcctcttgga

SEQ ID NO: 2679743 - DNA, 18 bp, Homo sapiens
tgatgaggcctcttggac

SEQ ID NO: 2679744 - DNA, 14 bp, Homo sapiens
tgatgccaaagctg

SEQ ID NO: 2679745 - DNA, 15 bp, Homo sapiens
tgatgccaaagctgc

SEQ ID NO: 2679746 - DNA, 17 bp, Homo sapiens
tgatgccaaagctgctt

SEQ ID NO: 2679747 - DNA, 20 bp, Homo sapiens
tgatgccaaagctgctttct

SEQ ID NO: 2679748 - DNA, 20 bp, Homo sapiens
tgatgccacttcccagaggc

SEQ ID NO: 2679749 - DNA, 23 bp, Homo sapiens
tgatggaccaaagccacctgctg

SEQ ID NO: 2679750 - DNA, 14 bp, Homo sapiens
tgatggccctcatc

SEQ ID NO: 2679751 - DNA, 16 bp, Homo sapiens
tgatgtctcttgtaga

SEQ ID NO: 2679752 - DNA, 18 bp, Homo sapiens
tgatgtctcttgtagaag

SEQ ID NO: 2679753 - DNA, 14 bp, Homo sapiens
tgatgtgtgaaacc

SEQ ID NO: 2679754 - DNA, 17 bp, Homo sapiens
tgattcactggcctggc

SEQ ID NO: 2679755 - DNA, 14 bp, Homo sapiens
tgcaaatgcctcca

SEQ ID NO: 2679756 - DNA, 22 bp, Homo sapiens
tgcaacaagacaaagcaaagcc

SEQ ID NO: 2679757 - DNA, 20 bp, Homo sapiens
tgcaacgctttttgggagaa

SEQ ID NO: 2679758 - DNA, 22 bp, Homo sapiens
tgcacaccttttccccaggagc

SEQ ID NO: 2679759 - DNA, 16 bp, Homo sapiens
tgcacctgcaggctta

SEQ ID NO: 2679760 - DNA, 19 bp, Homo sapiens
tgcacctgccagcctggct

SEQ ID NO: 2679761 - DNA, 17 bp, Homo sapiens
tgcacgaactggactgt

SEQ ID NO: 2679762 - DNA, 20 bp, Homo sapiens
tgcacgaactggactgtgtg

SEQ ID NO: 2679763 - DNA, 13 bp, Homo sapiens
tgcactccagcct

SEQ ID NO: 2679764 - DNA, 17 bp, Homo sapiens
tgcactggccccaccct

SEQ ID NO: 2679765 - DNA, 17 bp, Homo sapiens
tgcactgtctcagccaa

SEQ ID NO: 2679766 - DNA, 15 bp, Homo sapiens
tgcagaaggccaaga

SEQ ID NO: 2679767 - DNA, 22 bp, Homo sapiens
tgcagacaagtcttgctgtgct

SEQ ID NO: 2679768 - DNA, 23 bp, Homo sapiens
tgcagactccaatggggccagca

SEQ ID NO: 2679769 - DNA, 20 bp, Homo sapiens
tgcagactcctcagatctga

SEQ ID NO: 2679770 - DNA, 21 bp, Homo sapiens
tgcagccccgcgcctccttcc

SEQ ID NO: 2679771 - DNA, 15 bp, Homo sapiens
tgcaggctccatgca

SEQ ID NO: 2679772 - DNA, 16 bp, Homo sapiens
tgcaggctccatgcac

SEQ ID NO: 2679773 - DNA, 13 bp, Homo sapiens
tgcaggtcctggt

SEQ ID NO: 2679774 - DNA, 21 bp, Homo sapiens
tgcagtagtctctgtgctttg

SEQ ID NO: 2679775 - DNA, 18 bp, Homo sapiens
tgcagtgacgtgcacctg

SEQ ID NO: 2679776 - DNA, 18 bp, Homo sapiens
tgcatgcactgtctcagc

SEQ ID NO: 2679777 - DNA, 16 bp, Homo sapiens
tgcattagacagatga

SEQ ID NO: 2679778 - DNA, 22 bp, Homo sapiens
tgcattgagtccagctttcctt

SEQ ID NO: 2679779 - DNA, 14 bp, Homo sapiens
tgccaaagctgctt

SEQ ID NO: 2679780 - DNA, 23 bp, Homo sapiens
tgccaaagctgctttcttctctg

SEQ ID NO: 2679781 - DNA, 14 bp, Homo sapiens
tgccaccaataaaa

SEQ ID NO: 2679782 - DNA, 19 bp, Homo sapiens
tgccaccaataaaaatcct

SEQ ID NO: 2679783 - DNA, 13 bp, Homo sapiens
tgccacctgtctg

SEQ ID NO: 2679784 - DNA, 16 bp, Homo sapiens
tgccacctgtctgtct

SEQ ID NO: 2679785 - DNA, 23 bp, Homo sapiens
tgccagagctttgttttatatat

SEQ ID NO: 2679786 - DNA, 11 bp, Homo sapiens
tgccagccaca

SEQ ID NO: 2679787 - DNA, 15 bp, Homo sapiens
tgccagcctggcttc

SEQ ID NO: 2679788 - DNA, 21 bp, Homo sapiens
tgccaggcattcaatcctcag

SEQ ID NO: 2679789 - DNA, 22 bp, Homo sapiens
tgccatgtcttgttcagaagac

SEQ ID NO: 2679790 - DNA, 19 bp, Homo sapiens
tgcccagagggcccaggca

SEQ ID NO: 2679791 - DNA, 12 bp, Homo sapiens
tgcccagcccct

SEQ ID NO: 2679792 - DNA, 14 bp, Homo sapiens
tgcccagcccctgc

SEQ ID NO: 2679793 - DNA, 14 bp, Homo sapiens
tgccccagctctgg

SEQ ID NO: 2679794 - DNA, 19 bp, Homo sapiens
tgccccagctctggcttcc

SEQ ID NO: 2679795 - DNA, 22 bp, Homo sapiens
tgcccctacgggcgctgcagcc

SEQ ID NO: 2679796 - DNA, 22 bp, Homo sapiens
tgcccctccgatgctgaggcca

SEQ ID NO: 2679797 - DNA, 13 bp, Homo sapiens
tgcccctgctctg

SEQ ID NO: 2679798 - DNA, 20 bp, Homo sapiens
tgcccctgctctgtagccac

SEQ ID NO: 2679799 - DNA, 18 bp, Homo sapiens
tgcccggattctgggagg

SEQ ID NO: 2679800 - DNA, 18 bp, Homo sapiens
tgccctccccttcccctt

SEQ ID NO: 2679801 - DNA, 20 bp, Homo sapiens
tgccctccctttctctctcc

SEQ ID NO: 2679802 - DNA, 15 bp, Homo sapiens
tgccctgccctgcca

SEQ ID NO: 2679803 - DNA, 15 bp, Homo sapiens
tgcccttcctccagg

SEQ ID NO: 2679804 - DNA, 16 bp, Homo sapiens
tgcccttcctccagga

SEQ ID NO: 2679805 - DNA, 17 bp, Homo sapiens
tgcctcccagtggcctg

SEQ ID NO: 2679806 - DNA, 21 bp, Homo sapiens
tgcctcccagtggcctggctt

SEQ ID NO: 2679807 - DNA, 12 bp, Homo sapiens
tgcctcctcctc

SEQ ID NO: 2679808 - DNA, 14 bp, Homo sapiens
tgcctcctgtgtgt

SEQ ID NO: 2679809 - DNA, 20 bp, Homo sapiens
tgcctcctgtgtgtctgcag

SEQ ID NO: 2679810 - DNA, 22 bp, Homo sapiens
tgcctgcagccccgcgcctcct

SEQ ID NO: 2679811 - DNA, 12 bp, Homo sapiens
tgcctgccttct

SEQ ID NO: 2679812 - DNA, 19 bp, Homo sapiens
tgcctggagtcccgtccct

SEQ ID NO: 2679813 - DNA, 21 bp, Homo sapiens
tgcgaaggggccctggtcctt

SEQ ID NO: 2679814 - DNA, 17 bp, Homo sapiens
tgcgctcacctcagagc

SEQ ID NO: 2679815 - DNA, 18 bp, Homo sapiens
tgcgctcacctcagagca

SEQ ID NO: 2679816 - DNA, 18 bp, Homo sapiens
tgcgggggagccagttct

SEQ ID NO: 2679817 - DNA, 12 bp, Homo sapiens
tgctacaataaa

SEQ ID NO: 2679818 - DNA, 14 bp, Homo sapiens
tgctaggagcccca

SEQ ID NO: 2679819 - DNA, 15 bp, Homo sapiens
tgctaggagccccag

SEQ ID NO: 2679820 - DNA, 17 bp, Homo sapiens
tgctaggagccccagct

SEQ ID NO: 2679821 - DNA, 21 bp, Homo sapiens
tgctaggagccccagcttcct

SEQ ID NO: 2679822 - DNA, 15 bp, Homo sapiens
tgctcagaagccagt

SEQ ID NO: 2679823 - DNA, 17 bp, Homo sapiens
tgctcagaagccagtct

SEQ ID NO: 2679824 - DNA, 18 bp, Homo sapiens
tgctcagaagccagtctg

SEQ ID NO: 2679825 - DNA, 19 bp, Homo sapiens
tgctccagcagcacacctc

SEQ ID NO: 2679826 - DNA, 21 bp, Homo sapiens
tgctccagcagcacacctcag

SEQ ID NO: 2679827 - DNA, 16 bp, Homo sapiens
tgctccctgctcccag

SEQ ID NO: 2679828 - DNA, 20 bp, Homo sapiens
tgctcgggtgctgccagctg

SEQ ID NO: 2679829 - DNA, 22 bp, Homo sapiens
tgctctatgccaggctgtgcta

SEQ ID NO: 2679830 - DNA, 12 bp, Homo sapiens
tgctctcctgga

SEQ ID NO: 2679831 - DNA, 14 bp, Homo sapiens
tgctctcctggagc

SEQ ID NO: 2679832 - DNA, 15 bp, Homo sapiens
tgctctcctggagca

SEQ ID NO: 2679833 - DNA, 12 bp, Homo sapiens
tgctctctgaga

SEQ ID NO: 2679834 - DNA, 16 bp, Homo sapiens
tgttgtcctcccagga

SEQ ID NO: 2679835 - DNA, 17 bp, Homo sapiens
tgttgtcctcccaggaa

SEQ ID NO: 2679836 - DNA, 22 bp, Homo sapiens
tgttgtcctcccaggaaccaaa

SEQ ID NO: 2679837 - DNA, 23 bp, Homo sapiens
tgttgtcctcccaggaaccaaaa

SEQ ID NO: 2679838 - DNA, 20 bp, Homo sapiens
tgtttaaaaaaagtatatat

SEQ ID NO: 2679839 - DNA, 22 bp, Homo sapiens
tgtttcataacaaaccatctgg

SEQ ID NO: 2679840 - DNA, 11 bp, Homo sapiens
tgtttcctgag

SEQ ID NO: 2679841 - DNA, 17 bp, Homo sapiens
tgtttctccccctgggc

SEQ ID NO: 2679842 - DNA, 16 bp, Homo sapiens
tgtttgaagtctgctc

SEQ ID NO: 2679843 - DNA, 18 bp, Homo sapiens
tgtttgaagtctgctcat

SEQ ID NO: 2679844 - DNA, 19 bp, Homo sapiens
tgtttgtaaattaatactt

SEQ ID NO: 2679845 - DNA, 20 bp, Homo sapiens
tgtttgtacaagattgtcat

SEQ ID NO: 2679846 - DNA, 15 bp, Homo sapiens
tgtttgtctggattg

SEQ ID NO: 2679847 - DNA, 22 bp, Homo sapiens
ttaaaaaaagtatatattctac

SEQ ID NO: 2679848 - DNA, 14 bp, Homo sapiens
ttaaaacatgcacg

SEQ ID NO: 2679849 - DNA, 16 bp, Homo sapiens
ttaaaataaaataatt

SEQ ID NO: 2679850 - DNA, 22 bp, Homo sapiens
ttaaatcatactcctatgcttt

SEQ ID NO: 2679851 - DNA, 22 bp, Homo sapiens
ttaacagcaggtgtgaccctga

SEQ ID NO: 2679852 - DNA, 18 bp, Homo sapiens
ttaacctgaattattcca

SEQ ID NO: 2679853 - DNA, 14 bp, Homo sapiens
ttaagccctgctct

SEQ ID NO: 2679854 - DNA, 15 bp, Homo sapiens
ttaagtgcctgagac

SEQ ID NO: 2679855 - DNA, 14 bp, Homo sapiens
ttaatatctgagaa

SEQ ID NO: 2679856 - DNA, 17 bp, Homo sapiens
ttaatatctgagaagtg

SEQ ID NO: 2679857 - DNA, 16 bp, Homo sapiens
ttaatatggtgacttt

SEQ ID NO: 2679858 - DNA, 15 bp, Homo sapiens
ttacctgcaggctcc

SEQ ID NO: 2679859 - DNA, 23 bp, Homo sapiens
ttacctgcaggctccatgcacct

SEQ ID NO: 2679860 - DNA, 21 bp, Homo sapiens
ttaccttagattagctctgga

SEQ ID NO: 2679861 - DNA, 22 bp, Homo sapiens
ttaccttagattagctctggac

SEQ ID NO: 2679862 - DNA, 18 bp, Homo sapiens
ttaccttttctgttgtac

SEQ ID NO: 2679863 - DNA, 15 bp, Homo sapiens
ttactgacagaaatg

SEQ ID NO: 2679864 - DNA, 15 bp, Homo sapiens
ttactgttgcactga

SEQ ID NO: 2679865 - DNA, 19 bp, Homo sapiens
ttacttcacccggctgggc

SEQ ID NO: 2679866 - DNA, 12 bp, Homo sapiens
ttagccagtgac

SEQ ID NO: 2679867 - DNA, 18 bp, Homo sapiens
ttaggcttttaagaaaca

SEQ ID NO: 2679868 - DNA, 11 bp, Homo sapiens
ttagtgactgt

SEQ ID NO: 2679869 - DNA, 16 bp, Homo sapiens
ttagtgagacatattt

SEQ ID NO: 2679870 - DNA, 16 bp, Homo sapiens
ttagtgctttacatgc

SEQ ID NO: 2679871 - DNA, 19 bp, Homo sapiens
ttagttgaaaaatctagtt

SEQ ID NO: 2679872 - DNA, 15 bp, Homo sapiens
ttatagaatactttt

SEQ ID NO: 2679873 - DNA, 13 bp, Homo sapiens
ttatagttaatct

SEQ ID NO: 2679874 - DNA, 14 bp, Homo sapiens
ttatagttaatcta

SEQ ID NO: 2679875 - DNA, 13 bp, Homo sapiens
ttatgccactgct

SEQ ID NO: 2679876 - DNA, 20 bp, Homo sapiens
ttattaatatggtgactttt

SEQ ID NO: 2679877 - DNA, 14 bp, Homo sapiens
ttattctctaagag

SEQ ID NO: 2679878 - DNA, 22 bp, Homo sapiens
ttattggaagtgttcaagaaat

SEQ ID NO: 2679879 - DNA, 20 bp, Homo sapiens
ttatttagttgaaaaatcta

SEQ ID NO: 2679880 - DNA, 16 bp, Homo sapiens
ttatttcaccagcagc

SEQ ID NO: 2679881 - DNA, 16 bp, Homo sapiens
ttcaacctgtgtctta

SEQ ID NO: 2679882 - DNA, 12 bp, Homo sapiens
ttcaagaaataa

SEQ ID NO: 2679883 - DNA, 15 bp, Homo sapiens
ttcaagcccaggctt

SEQ ID NO: 2679884 - DNA, 19 bp, Homo sapiens
ttcaagcccaggcttcctg

SEQ ID NO: 2679885 - DNA, 16 bp, Homo sapiens
ttcaagggaagaaaca

SEQ ID NO: 2679886 - DNA, 17 bp, Homo sapiens
ttcaagttagctcagga

SEQ ID NO: 2679887 - DNA, 13 bp, Homo sapiens
ttcaattcctggg

SEQ ID NO: 2679888 - DNA, 16 bp, Homo sapiens
ttcaattcctgggccc

SEQ ID NO: 2679889 - DNA, 13 bp, Homo sapiens
ttcaccagcagca

SEQ ID NO: 2679890 - DNA, 22 bp, Homo sapiens
ttcagaagacacaggggagcag

SEQ ID NO: 2679891 - DNA, 18 bp, Homo sapiens
ttcagcattaggctttta

SEQ ID NO: 2679892 - DNA, 18 bp, Homo sapiens
ttcagtgacttctggctt

SEQ ID NO: 2679893 - DNA, 22 bp, Homo sapiens
ttcataacaaaccatctggtgc

SEQ ID NO: 2679894 - DNA, 17 bp, Homo sapiens
ttcatctgggaggcaga

SEQ ID NO: 2679895 - DNA, 17 bp, Homo sapiens
ttcatgtttgtaaatta

SEQ ID NO: 2679896 - DNA, 14 bp, Homo sapiens
ttccaaccccagct

SEQ ID NO: 2679897 - DNA, 20 bp, Homo sapiens
ttccaaccccagctggcctc

SEQ ID NO: 2679898 - DNA, 15 bp, Homo sapiens
ttccataaacaccca

SEQ ID NO: 2679899 - DNA, 14 bp, Homo sapiens
ttccattgaccagc

SEQ ID NO: 2679900 - DNA, 23 bp, Homo sapiens
ttccattgaccagctctcttcct

SEQ ID NO: 2679901 - DNA, 17 bp, Homo sapiens
ttcccctttactcagcc

SEQ ID NO: 2679902 - DNA, 14 bp, Homo sapiens
ttcccgctccccac

SEQ ID NO: 2679903 - DNA, 15 bp, Homo sapiens
ttcccgctccccacc

SEQ ID NO: 2679904 - DNA, 20 bp, Homo sapiens
ttcccgggataaactgagcc

SEQ ID NO: 2679905 - DNA, 22 bp, Homo sapiens
ttcccttctcccttgccctccc

SEQ ID NO: 2679906 - DNA, 14 bp, Homo sapiens
ttcctagtatatta

SEQ ID NO: 2679907 - DNA, 22 bp, Homo sapiens
ttcctccaggagaaggggccca

SEQ ID NO: 2679908 - DNA, 12 bp, Homo sapiens
ttcctgaaagct

SEQ ID NO: 2679909 - DNA, 15 bp, Homo sapiens
ttcctgccaccagtc

SEQ ID NO: 2679910 - DNA, 15 bp, Homo sapiens
ttcctgggtcctgcc

SEQ ID NO: 2679911 - DNA, 16 bp, Homo sapiens
ttcctgggtcctgcct

SEQ ID NO: 2679912 - DNA, 11 bp, Homo sapiens
ttcctgtaaca

SEQ ID NO: 2679913 - DNA, 19 bp, Homo sapiens
ttcctgtaacacaagccac

SEQ ID NO: 2679914 - DNA, 21 bp, Homo sapiens
ttcctgtaacacaagccacag

SEQ ID NO: 2679915 - DNA, 22 bp, Homo sapiens
ttcctgtaacacaagccacaga

SEQ ID NO: 2679916 - DNA, 23 bp, Homo sapiens
ttcctgtaacacaagccacagaa

SEQ ID NO: 2679917 - DNA, 18 bp, Homo sapiens
ttcctgtagcatcttctg

SEQ ID NO: 2679918 - DNA, 21 bp, Homo sapiens
ttcctgtctttgttgtctccc

SEQ ID NO: 2679919 - DNA, 15 bp, Homo sapiens
ttcctgttgctctgt

SEQ ID NO: 2679920 - DNA, 15 bp, Homo sapiens
ttccttaagccagga

SEQ ID NO: 2679921 - DNA, 20 bp, Homo sapiens
ttccttctgcccttcctcca

SEQ ID NO: 2679922 - DNA, 18 bp, Homo sapiens
ttccttgctgtcctaggc

SEQ ID NO: 2679923 - DNA, 16 bp, Homo sapiens
ttcgagaccagcctgg

SEQ ID NO: 2679924 - DNA, 16 bp, Homo sapiens
ttcgtctccatctctg

SEQ ID NO: 2679925 - DNA, 21 bp, Homo sapiens
ttctaagttcatgtttgtaaa

SEQ ID NO: 2679926 - DNA, 17 bp, Homo sapiens
ttctagctttgttgtcc

SEQ ID NO: 2679927 - DNA, 18 bp, Homo sapiens
ttctagctttgttgtcct

SEQ ID NO: 2679928 - DNA, 22 bp, Homo sapiens
ttctagctttgttgtcctccca

SEQ ID NO: 2679929 - DNA, 17 bp, Homo sapiens
ttctatcaggaaaacaa

SEQ ID NO: 2679930 - DNA, 22 bp, Homo sapiens
ttctattttctctgatactttt

SEQ ID NO: 2679931 - DNA, 14 bp, Homo sapiens
ttctcaacctacca

SEQ ID NO: 2679932 - DNA, 18 bp, Homo sapiens
ttctccccctgggctctg

SEQ ID NO: 2679933 - DNA, 16 bp, Homo sapiens
ttctcccttgccctcc

SEQ ID NO: 2679934 - DNA, 12 bp, Homo sapiens
ttctctcttccc

SEQ ID NO: 2679935 - DNA, 13 bp, Homo sapiens
ttctctcttccct

SEQ ID NO: 2679936 - DNA, 12 bp, Homo sapiens
ttctcttcctgt

SEQ ID NO: 2679937 - DNA, 14 bp, Homo sapiens
ttctgaccaaaatg

SEQ ID NO: 2679938 - DNA, 21 bp, Homo sapiens
ttctgaccaaaatgtgtttca

SEQ ID NO: 2679939 - DNA, 22 bp, Homo sapiens
ttctgaccaaaatgtgtttcat

SEQ ID NO: 2679940 - DNA, 21 bp, Homo sapiens
ttctgcagtagtctctgtgct

SEQ ID NO: 2679941 - DNA, 16 bp, Homo sapiens
ttctgggaggaagcag

SEQ ID NO: 2679942 - DNA, 20 bp, Homo sapiens
ttctggggcccgcctgccac

SEQ ID NO: 2679943 - DNA, 18 bp, Homo sapiens
ttctgtaggtttctctct

SEQ ID NO: 2679944 - DNA, 18 bp, Homo sapiens
aaaaactttctactcatt

SEQ ID NO: 2679945 - DNA, 13 bp, Homo sapiens
aaaaagtatatat

SEQ ID NO: 2679946 - DNA, 16 bp, Homo sapiens
aaaaatctagtttttt

SEQ ID NO: 2679947 - DNA, 21 bp, Homo sapiens
aaaaccccagctattttctga

SEQ ID NO: 2679948 - DNA, 21 bp, Homo sapiens
aaaactctttaacttgtaata

SEQ ID NO: 2679949 - DNA, 15 bp, Homo sapiens
aaaagattatatatc

SEQ ID NO: 2679950 - DNA, 22 bp, Homo sapiens
aaaagattatatatcataaagt

SEQ ID NO: 2679951 - DNA, 23 bp, Homo sapiens
aaaagattatatatcataaagta

SEQ ID NO: 2679952 - DNA, 21 bp, Homo sapiens
aaaagctacaaaaaactgcag

SEQ ID NO: 2679953 - DNA, 14 bp, Homo sapiens
aaaatctagttttt

SEQ ID NO: 2679954 - DNA, 16 bp, Homo sapiens
aaaatgcatgtaatca

SEQ ID NO: 2679955 - DNA, 17 bp, Homo sapiens
aaacacggccctcctgg

SEQ ID NO: 2679956 - DNA, 19 bp, Homo sapiens
aaacacggccctcctggga

SEQ ID NO: 2679957 - DNA, 17 bp, Homo sapiens
aaacactaagctctctg

SEQ ID NO: 2679958 - DNA, 24 bp, Homo sapiens
aaacatgctaaatagttctatcag

SEQ ID NO: 2679959 - DNA, 21 bp, Homo sapiens
aaaccatctggtgcctttcca

SEQ ID NO: 2679960 - DNA, 16 bp, Homo sapiens
aaaccccagctatttt

SEQ ID NO: 2679961 - DNA, 17 bp, Homo sapiens
aaaccctggcttgcttg

SEQ ID NO: 2679962 - DNA, 14 bp, Homo sapiens
aaactgctgttaat

SEQ ID NO: 2679963 - DNA, 23 bp, Homo sapiens
aaacttatgctagtttattggaa

SEQ ID NO: 2679964 - DNA, 21 bp, Homo sapiens
aaactttctactcattttaat

SEQ ID NO: 2679965 - DNA, 20 bp, Homo sapiens
aaagaactccttattttgta

SEQ ID NO: 2679966 - DNA, 21 bp, Homo sapiens
aaagaactccttattttgtat

SEQ ID NO: 2679967 - DNA, 22 bp, Homo sapiens
aaagacttgttagccaacttca

SEQ ID NO: 2679968 - DNA, 15 bp, Homo sapiens
aaagagactggagca

SEQ ID NO: 2679969 - DNA, 12 bp, Homo sapiens
aaagattatata

SEQ ID NO: 2679970 - DNA, 15 bp, Homo sapiens
aaagattatatatca

SEQ ID NO: 2679971 - DNA, 17 bp, Homo sapiens
aaagccaaactctgcca

SEQ ID NO: 2679972 - DNA, 15 bp, Homo sapiens
aaagccacctgctgc

SEQ ID NO: 2679973 - DNA, 16 bp, Homo sapiens
aaagctgttggatttc

SEQ ID NO: 2679974 - DNA, 19 bp, Homo sapiens
aaaggctcagtctcaggag

SEQ ID NO: 2679975 - DNA, 19 bp, Homo sapiens
aaagtaagtaccactcagg

SEQ ID NO: 2679976 - DNA, 14 bp, Homo sapiens
aaagtatatattct

SEQ ID NO: 2679977 - DNA, 20 bp, Homo sapiens
aaagtcagctttcagagcca

SEQ ID NO: 2679978 - DNA, 18 bp, Homo sapiens
aaataccagtgaaccaaa

SEQ ID NO: 2679979 - DNA, 19 bp, Homo sapiens
aaatattctatgaccactt

SEQ ID NO: 2679980 - DNA, 15 bp, Homo sapiens
aaatcactgtattta

SEQ ID NO: 2679981 - DNA, 14 bp, Homo sapiens
aaatcagtcttgga

SEQ ID NO: 2679982 - DNA, 20 bp, Homo sapiens
aaatccaaccctgtcagaat

SEQ ID NO: 2679983 - DNA, 20 bp, Homo sapiens
aaatctagttttttttgtaa

SEQ ID NO: 2679984 - DNA, 22 bp, Homo sapiens
aaatctggcaaagttatattta

SEQ ID NO: 2679985 - DNA, 22 bp, Homo sapiens
aaatctgtatatgttgtaataa

SEQ ID NO: 2679986 - DNA, 20 bp, Homo sapiens
aaatctgtgaattaaaaaag

SEQ ID NO: 2679987 - DNA, 17 bp, Homo sapiens
aaatgacccaaagacca

SEQ ID NO: 2679988 - DNA, 13 bp, Homo sapiens
aaatgcattatgt

SEQ ID NO: 2679989 - DNA, 16 bp, Homo sapiens
aaattaatacttcatt

SEQ ID NO: 2679990 - DNA, 12 bp, Homo sapiens
aaattatattcc

SEQ ID NO: 2679991 - DNA, 19 bp, Homo sapiens
aaattcaacctgtgtctta

SEQ ID NO: 2679992 - DNA, 13 bp, Homo sapiens
aaattccactgga

SEQ ID NO: 2679993 - DNA, 14 bp, Homo sapiens
aaattcctgtagca

SEQ ID NO: 2679994 - DNA, 20 bp, Homo sapiens
aaattgtatacattttgtta

SEQ ID NO: 2679995 - DNA, 20 bp, Homo sapiens
aacaaaaaaaaaccatgcat

SEQ ID NO: 2679996 - DNA, 13 bp, Homo sapiens
aacaaaccatctg

SEQ ID NO: 2679997 - DNA, 21 bp, Homo sapiens
aacaacgttcttagtttactt

SEQ ID NO: 2679998 - DNA, 14 bp, Homo sapiens
aacacaagccacag

SEQ ID NO: 2679999 - DNA, 15 bp, Homo sapiens
aacacagggttttgt

SEQ ID NO: 2680000 - DNA, 17 bp, Homo sapiens
aacacagggttttgtat

SEQ ID NO: 2680001 - DNA, 12 bp, Homo sapiens
aacacccactgg

SEQ ID NO: 2680002 - DNA, 13 bp, Homo sapiens
aacacccactggc

SEQ ID NO: 2680003 - DNA, 18 bp, Homo sapiens
aacacggccctcctggga

SEQ ID NO: 2680004 - DNA, 15 bp, Homo sapiens
aacactaagctctct

SEQ ID NO: 2680005 - DNA, 19 bp, Homo sapiens
aacagagtgagaccctgtc

SEQ ID NO: 2680006 - DNA, 14 bp, Homo sapiens
aacataaaatctgt

SEQ ID NO: 2680007 - DNA, 15 bp, Homo sapiens
aacatgggcattggg

SEQ ID NO: 2680008 - DNA, 22 bp, Homo sapiens
aacattcacacagggctctttg

SEQ ID NO: 2680009 - DNA, 15 bp, Homo sapiens
aaccaaaagatgcct

SEQ ID NO: 2680010 - DNA, 16 bp, Homo sapiens
aaccaaagagactgga

SEQ ID NO: 2680011 - DNA, 17 bp, Homo sapiens
aaccatctggtgccttt

SEQ ID NO: 2680012 - DNA, 13 bp, Homo sapiens
aaccccagctggc

SEQ ID NO: 2680013 - DNA, 23 bp, Homo sapiens
aaccccagctggcctctagaaca

SEQ ID NO: 2680014 - DNA, 19 bp, Homo sapiens
aacctaccaccccttcctg

SEQ ID NO: 2680015 - DNA, 15 bp, Homo sapiens
aacctccttacctgg

SEQ ID NO: 2680016 - DNA, 13 bp, Homo sapiens
aacctgtgtctta

SEQ ID NO: 2680017 - DNA, 17 bp, Homo sapiens
aacgggctgccctgcca

SEQ ID NO: 2680018 - DNA, 16 bp, Homo sapiens
acaaaccatctggtgc

SEQ ID NO: 2680019 - DNA, 17 bp, Homo sapiens
acaaaccatctggtgcc

SEQ ID NO: 2680020 - DNA, 22 bp, Homo sapiens
acaaaccatctggtgcctttcc

SEQ ID NO: 2680021 - DNA, 13 bp, Homo sapiens
acaagaagaccag

SEQ ID NO: 2680022 - DNA, 15 bp, Homo sapiens
acaagacaacattgt

SEQ ID NO: 2680023 - DNA, 17 bp, Homo sapiens
acaagacaacattgtaa

SEQ ID NO: 2680024 - DNA, 13 bp, Homo sapiens
acaagttttgtat

SEQ ID NO: 2680025 - DNA, 11 bp, Homo sapiens
acaataaatgc

SEQ ID NO: 2680026 - DNA, 12 bp, Homo sapiens
acaatctcaaat

SEQ ID NO: 2680027 - DNA, 14 bp, Homo sapiens
acaattactaaatt

SEQ ID NO: 2680028 - DNA, 17 bp, Homo sapiens
acaattactaaattgta

SEQ ID NO: 2680029 - DNA, 22 bp, Homo sapiens
acaatttttgatcaatgtatat

SEQ ID NO: 2680030 - DNA, 13 bp, Homo sapiens
acacaagccacag

SEQ ID NO: 2680031 - DNA, 14 bp, Homo sapiens
acacaagcggccct

SEQ ID NO: 2680032 - DNA, 18 bp, Homo sapiens
acacagactgacgaaact

SEQ ID NO: 2680033 - DNA, 14 bp, Homo sapiens
acacagggctcttt

SEQ ID NO: 2680034 - DNA, 16 bp, Homo sapiens
acacagggctctttga

SEQ ID NO: 2680035 - DNA, 19 bp, Homo sapiens
acacagggctctttgatgg

SEQ ID NO: 2680036 - DNA, 15 bp, Homo sapiens
acacagggttttgta

SEQ ID NO: 2680037 - DNA, 15 bp, Homo sapiens
acacccactggccag

SEQ ID NO: 2680038 - DNA, 13 bp, Homo sapiens
acaccgctggtcc

SEQ ID NO: 2680039 - DNA, 18 bp, Homo sapiens
acacctccttttcttcta

SEQ ID NO: 2680040 - DNA, 14 bp, Homo sapiens
acacctgccctgcc

SEQ ID NO: 2680041 - DNA, 23 bp, Homo sapiens
acacctgccctgccctgccacct

SEQ ID NO: 2680042 - DNA, 15 bp, Homo sapiens
acacggccctcctgg

SEQ ID NO: 2680043 - DNA, 17 bp, Homo sapiens
acacggccctcctggga

SEQ ID NO: 2680044 - DNA, 22 bp, Homo sapiens
acacggggatcatctctgtgac

SEQ ID NO: 2680045 - DNA, 23 bp, Homo sapiens
acacggggatcatctctgtgacc

SEQ ID NO: 2680046 - DNA, 16 bp, Homo sapiens
acacgtgatggaccaa

SEQ ID NO: 2680047 - DNA, 14 bp, Homo sapiens
acacgtggcctgca

SEQ ID NO: 2680048 - DNA, 16 bp, Homo sapiens
acacgtggcctgcacc

SEQ ID NO: 2680049 - DNA, 15 bp, Homo sapiens
acactccagcctgag

SEQ ID NO: 2680050 - DNA, 11 bp, Homo sapiens
acactgtgacc

SEQ ID NO: 2680051 - DNA, 13 bp, Homo sapiens
acagaagccagga

SEQ ID NO: 2680052 - DNA, 15 bp, Homo sapiens
acagaagccaggagc

SEQ ID NO: 2680053 - DNA, 21 bp, Homo sapiens
acagagcgagagtctgtctca

SEQ ID NO: 2680054 - DNA, 17 bp, Homo sapiens
acagcaggtgtgaccct

SEQ ID NO: 2680055 - DNA, 17 bp, Homo sapiens
acagctcacctctgaag

SEQ ID NO: 2680056 - DNA, 17 bp, Homo sapiens
acagctgctgggaccca

SEQ ID NO: 2680057 - DNA, 20 bp, Homo sapiens
acaggacagtgcttcagcct

SEQ ID NO: 2680058 - DNA, 16 bp, Homo sapiens
acaggccagccttggc

SEQ ID NO: 2680059 - DNA, 19 bp, Homo sapiens
acaggccagccttggcacg

SEQ ID NO: 2680060 - DNA, 17 bp, Homo sapiens
acaggcctcaagcgtgg

SEQ ID NO: 2680061 - DNA, 13 bp, Homo sapiens
acagggttttgta

SEQ ID NO: 2680062 - DNA, 18 bp, Homo sapiens
acaggtcgagctgtgctc

SEQ ID NO: 2680063 - DNA, 12 bp, Homo sapiens
acagtcctggga

SEQ ID NO: 2680064 - DNA, 22 bp, Homo sapiens
acagtcctgggagaacctcagg

SEQ ID NO: 2680065 - DNA, 14 bp, Homo sapiens
acagtgcttcagcc

SEQ ID NO: 2680066 - DNA, 18 bp, Homo sapiens
acagtgcttcagcctgag

SEQ ID NO: 2680067 - DNA, 17 bp, Homo sapiens
acagtgggcaggaggcc

SEQ ID NO: 2680068 - DNA, 22 bp, Homo sapiens
acagtgggcaggaggccccagg

SEQ ID NO: 2680069 - DNA, 12 bp, Homo sapiens
acatataaaagt

SEQ ID NO: 2680070 - DNA, 11 bp, Homo sapiens
acatatatata

SEQ ID NO: 2680071 - DNA, 14 bp, Homo sapiens
acatatatgtatat

SEQ ID NO: 2680072 - DNA, 17 bp, Homo sapiens
acatatatgtatatgta

SEQ ID NO: 2680073 - DNA, 23 bp, Homo sapiens
acatatatgtatatgtatatcta

SEQ ID NO: 2680074 - DNA, 15 bp, Homo sapiens
acatcccaggagggg

SEQ ID NO: 2680075 - DNA, 19 bp, Homo sapiens
acatgccgcgtccctgccc

SEQ ID NO: 2680076 - DNA, 17 bp, Homo sapiens
acatgctaaatagttct

SEQ ID NO: 2680077 - DNA, 20 bp, Homo sapiens
acatgcttgtgtttcttagt

SEQ ID NO: 2680078 - DNA, 14 bp, Homo sapiens
acatggccagtgtg

SEQ ID NO: 2680079 - DNA, 15 bp, Homo sapiens
acatggccagtgtga

SEQ ID NO: 2680080 - DNA, 15 bp, Homo sapiens
acattcctctgcagc

SEQ ID NO: 2680081 - DNA, 20 bp, Homo sapiens
acattttgtacaaagatatg

SEQ ID NO: 2680082 - DNA, 16 bp, Homo sapiens
accaaaatgtgtttca

SEQ ID NO: 2680083 - DNA, 14 bp, Homo sapiens
accaaagccacctg

SEQ ID NO: 2680084 - DNA, 15 bp, Homo sapiens
accaaagccacctgc

SEQ ID NO: 2680085 - DNA, 15 bp, Homo sapiens
accaaatgatgccac

SEQ ID NO: 2680086 - DNA, 14 bp, Homo sapiens
accaaccctgtttc

SEQ ID NO: 2680087 - DNA, 19 bp, Homo sapiens
accaaccctgtttcctgag

SEQ ID NO: 2680088 - DNA, 14 bp, Homo sapiens
accaccccttcctg

SEQ ID NO: 2680089 - DNA, 19 bp, Homo sapiens
accagcagcaatctgtctt

SEQ ID NO: 2680090 - DNA, 12 bp, Homo sapiens
accagctctctt

SEQ ID NO: 2680091 - DNA, 16 bp, Homo sapiens
accagctctcttcctg

SEQ ID NO: 2680092 - DNA, 20 bp, Homo sapiens
accaggaagctcggtgagtg

SEQ ID NO: 2680093 - DNA, 18 bp, Homo sapiens
accagtgtaactggctgc

SEQ ID NO: 2680094 - DNA, 13 bp, Homo sapiens
accagtgtagcct

SEQ ID NO: 2680095 - DNA, 16 bp, Homo sapiens
accagtgtagccttgc

SEQ ID NO: 2680096 - DNA, 14 bp, Homo sapiens
accatctggtgcct

SEQ ID NO: 2680097 - DNA, 12 bp, Homo sapiens
accattgtcttc

SEQ ID NO: 2680098 - DNA, 14 bp, Homo sapiens
accattgtcttcca

SEQ ID NO: 2680099 - DNA, 22 bp, Homo sapiens
accattgtcttccaaccccagc

SEQ ID NO: 2680100 - DNA, 18 bp, Homo sapiens
acccaactgatcctgctc

SEQ ID NO: 2680101 - DNA, 12 bp, Homo sapiens
acccactgaccc

SEQ ID NO: 2680102 - DNA, 17 bp, Homo sapiens
acccactggccagtcct

SEQ ID NO: 2680103 - DNA, 20 bp, Homo sapiens
acccagagagaggggcctgc

SEQ ID NO: 2680104 - DNA, 18 bp, Homo sapiens
acccaggcctccctgcag

SEQ ID NO: 2680105 - DNA, 19 bp, Homo sapiens
acccaggcctccctgcaga

SEQ ID NO: 2680106 - DNA, 16 bp, Homo sapiens
acccaggtctgatgcc

SEQ ID NO: 2680107 - DNA, 17 bp, Homo sapiens
acccaggtctgatgcca

SEQ ID NO: 2680108 - DNA, 22 bp, Homo sapiens
acccaggtctgatgccaaagct

SEQ ID NO: 2680109 - DNA, 19 bp, Homo sapiens
acccatgaagacaggacag

SEQ ID NO: 2680110 - DNA, 20 bp, Homo sapiens
acccatgaagacaggacagt

SEQ ID NO: 2680111 - DNA, 14 bp, Homo sapiens
acccatgaatcaaa

SEQ ID NO: 2680112 - DNA, 13 bp, Homo sapiens
accccagctggcc

SEQ ID NO: 2680113 - DNA, 14 bp, Homo sapiens
accccagctggcct

SEQ ID NO: 2680114 - DNA, 13 bp, Homo sapiens
accccccacctgc

SEQ ID NO: 2680115 - DNA, 19 bp, Homo sapiens
acccctacttcacagagga

SEQ ID NO: 2680116 - DNA, 13 bp, Homo sapiens
acccgctctggac

SEQ ID NO: 2680117 - DNA, 15 bp, Homo sapiens
acccgctctggacca

SEQ ID NO: 2680118 - DNA, 16 bp, Homo sapiens
aagacttgagccatcc

SEQ ID NO: 2680119 - DNA, 16 bp, Homo sapiens
aagataatgttcttta

SEQ ID NO: 2680120 - DNA, 17 bp, Homo sapiens
aagatatcagagctctt

SEQ ID NO: 2680121 - DNA, 18 bp, Homo sapiens
aagatcagagctgcagcc

SEQ ID NO: 2680122 - DNA, 16 bp, Homo sapiens
aagatggactctgaaa

SEQ ID NO: 2680123 - DNA, 17 bp, Homo sapiens
aagatgtactataacat

SEQ ID NO: 2680124 - DNA, 21 bp, Homo sapiens
aagattatatatcataaagta

SEQ ID NO: 2680125 - DNA, 23 bp, Homo sapiens
aagattatatatcataaagtatg

SEQ ID NO: 2680126 - DNA, 17 bp, Homo sapiens
aagcaaagccacatttt

SEQ ID NO: 2680127 - DNA, 22 bp, Homo sapiens
aagcactgtttaactgggagtg

SEQ ID NO: 2680128 - DNA, 18 bp, Homo sapiens
aagcatcacctcaggcca

SEQ ID NO: 2680129 - DNA, 22 bp, Homo sapiens
aagcatcagagatggtaatcta

SEQ ID NO: 2680130 - DNA, 22 bp, Homo sapiens
aagcatggcctggactgactgc

SEQ ID NO: 2680131 - DNA, 11 bp, Homo sapiens
aagccacagaa

SEQ ID NO: 2680132 - DNA, 15 bp, Homo sapiens
aagccacctgctgcg

SEQ ID NO: 2680133 - DNA, 20 bp, Homo sapiens
aagccagcaaagcctccagc

SEQ ID NO: 2680134 - DNA, 21 bp, Homo sapiens
aagccaggagcaaatgtttct

SEQ ID NO: 2680135 - DNA, 23 bp, Homo sapiens
aagccattcacttccccaatctt

SEQ ID NO: 2680136 - DNA, 11 bp, Homo sapiens
aagcccaggct

SEQ ID NO: 2680137 - DNA, 10 bp, Homo sapiens
aagccctgct

SEQ ID NO: 2680138 - DNA, 13 bp, Homo sapiens
aagccctgctctt

SEQ ID NO: 2680139 - DNA, 20 bp, Homo sapiens
aagccctgctctttctctga

SEQ ID NO: 2680140 - DNA, 16 bp, Homo sapiens
aagcctccagcatctt

SEQ ID NO: 2680141 - DNA, 21 bp, Homo sapiens
aagcgatgaatttggagactc

SEQ ID NO: 2680142 - DNA, 19 bp, Homo sapiens
aagctctgaacaaaagctt

SEQ ID NO: 2680143 - DNA, 17 bp, Homo sapiens
aagctgctttcttctct

SEQ ID NO: 2680144 - DNA, 20 bp, Homo sapiens
aaggacccaaatttccctgg

SEQ ID NO: 2680145 - DNA, 17 bp, Homo sapiens
aaggactaacataaaat

SEQ ID NO: 2680146 - DNA, 20 bp, Homo sapiens
aaggagaaaatgcattatgt

SEQ ID NO: 2680147 - DNA, 17 bp, Homo sapiens
aaggagaacccaatttt

SEQ ID NO: 2680148 - DNA, 20 bp, Homo sapiens
aaggctaagcatggcctgga

SEQ ID NO: 2680149 - DNA, 15 bp, Homo sapiens
aaggctgtgctcttc

SEQ ID NO: 2680150 - DNA, 21 bp, Homo sapiens
aaggctgtgctcttcctctgg

SEQ ID NO: 2680151 - DNA, 12 bp, Homo sapiens
aagggacacaat

SEQ ID NO: 2680152 - DNA, 11 bp, Homo sapiens
aagggctgggg

SEQ ID NO: 2680153 - DNA, 22 bp, Homo sapiens
aaggggaatgtgtcctcctgct

SEQ ID NO: 2680154 - DNA, 15 bp, Homo sapiens
aaggggcagctcctg

SEQ ID NO: 2680155 - DNA, 14 bp, Homo sapiens
aagggtgacatccc

SEQ ID NO: 2680156 - DNA, 16 bp, Homo sapiens
aagggtgacatcccag

SEQ ID NO: 2680157 - DNA, 23 bp, Homo sapiens
aaggtggcctgcggggagccatc

SEQ ID NO: 2680158 - DNA, 18 bp, Homo sapiens
aagtaagtaccactcagg

SEQ ID NO: 2680159 - DNA, 19 bp, Homo sapiens
aagtacttgctctctgaga

SEQ ID NO: 2680160 - DNA, 20 bp, Homo sapiens
aagtcagactgctgggactg

SEQ ID NO: 2680161 - DNA, 18 bp, Homo sapiens
aagtctccctgcacagcc

SEQ ID NO: 2680162 - DNA, 17 bp, Homo sapiens
aagtctgggatgtagaa

SEQ ID NO: 2680163 - DNA, 20 bp, Homo sapiens
aagtctgggatgtagaactt

SEQ ID NO: 2680164 - DNA, 11 bp, Homo sapiens
aagtcttgctg

SEQ ID NO: 2680165 - DNA, 15 bp, Homo sapiens
aagtcttgctgtgct

SEQ ID NO: 2680166 - DNA, 18 bp, Homo sapiens
aagtgttcaagaaataaa

SEQ ID NO: 2680167 - DNA, 14 bp, Homo sapiens
aagttcctctagtg

SEQ ID NO: 2680168 - DNA, 15 bp, Homo sapiens
aagttctaagttcat

SEQ ID NO: 2680169 - DNA, 16 bp, Homo sapiens
aagttctaagttcatg

SEQ ID NO: 2680170 - DNA, 21 bp, Homo sapiens
aagtttgcactgtatgctgga

SEQ ID NO: 2680171 - DNA, 21 bp, Homo sapiens
aataaaaatcaacttgtgtac

SEQ ID NO: 2680172 - DNA, 22 bp, Homo sapiens
aataaaacttatgctagtttat

SEQ ID NO: 2680173 - DNA, 18 bp, Homo sapiens
aataatgtgttaaacatg

SEQ ID NO: 2680174 - DNA, 19 bp, Homo sapiens
aatacagaaattagccggg

SEQ ID NO: 2680175 - DNA, 15 bp, Homo sapiens
aatacttttttctag

SEQ ID NO: 2680176 - DNA, 20 bp, Homo sapiens
aatagctctactgccctccc

SEQ ID NO: 2680177 - DNA, 17 bp, Homo sapiens
aatatagattaaatcat

SEQ ID NO: 2680178 - DNA, 19 bp, Homo sapiens
aatatagattaaatcatac

SEQ ID NO: 2680179 - DNA, 18 bp, Homo sapiens
aatatcttgctggattaa

SEQ ID NO: 2680180 - DNA, 22 bp, Homo sapiens
aatatgttgagtgttcatttta

SEQ ID NO: 2680181 - DNA, 14 bp, Homo sapiens
aatattcaataaag

SEQ ID NO: 2680182 - DNA, 21 bp, Homo sapiens
aatcactttacctgcaggctc

SEQ ID NO: 2680183 - DNA, 23 bp, Homo sapiens
aatcatgctgttctctttgctga

SEQ ID NO: 2680184 - DNA, 13 bp, Homo sapiens
aatcattgtagaa

SEQ ID NO: 2680185 - DNA, 16 bp, Homo sapiens
aatctggcaaagttat

SEQ ID NO: 2680186 - DNA, 23 bp, Homo sapiens
aatctgtatatgttgtaataaaa

SEQ ID NO: 2680187 - DNA, 22 bp, Homo sapiens
aatctgtctttagaatcgcttt

SEQ ID NO: 2680188 - DNA, 16 bp, Homo sapiens
aatctgtgaattaaaa

SEQ ID NO: 2680189 - DNA, 22 bp, Homo sapiens
aatcttttctgaatcttctgaa

SEQ ID NO: 2680190 - DNA, 15 bp, Homo sapiens
aatgaaagtttgcac

SEQ ID NO: 2680191 - DNA, 22 bp, Homo sapiens
aatgcaagtgtttgaagtctgc

SEQ ID NO: 2680192 - DNA, 14 bp, Homo sapiens
aatgcgtaattaaa

SEQ ID NO: 2680193 - DNA, 19 bp, Homo sapiens
aatggtgttactaaagtca

SEQ ID NO: 2680194 - DNA, 18 bp, Homo sapiens
aatgtacaagttttgtat

SEQ ID NO: 2680195 - DNA, 15 bp, Homo sapiens
aatgtgtcctcctgc

SEQ ID NO: 2680196 - DNA, 17 bp, Homo sapiens
aatgtgtcctcctgctc

SEQ ID NO: 2680197 - DNA, 20 bp, Homo sapiens
aatgtgtcctcctgctctgc

SEQ ID NO: 2680198 - DNA, 22 bp, Homo sapiens
aatgtgttgatttgagaaattt

SEQ ID NO: 2680199 - DNA, 19 bp, Homo sapiens
aatgtgtttcataacaaac

SEQ ID NO: 2680200 - DNA, 21 bp, Homo sapiens
aattaccttagattagctctg

SEQ ID NO: 2680201 - DNA, 23 bp, Homo sapiens
aattaccttagattagctctgga

SEQ ID NO: 2680202 - DNA, 16 bp, Homo sapiens
aattactaaattgtat

SEQ ID NO: 2680203 - DNA, 24 bp, Homo sapiens
aattactaaattgtatacattttg

SEQ ID NO: 2680204 - DNA, 14 bp, Homo sapiens
aattagccgggcgt

SEQ ID NO: 2680205 - DNA, 11 bp, Homo sapiens
aattatattcc

SEQ ID NO: 2680206 - DNA, 23 bp, Homo sapiens
aattatattcctcttgcatttca

SEQ ID NO: 2680207 - DNA, 15 bp, Homo sapiens
aattatttttaagtg

SEQ ID NO: 2680208 - DNA, 17 bp, Homo sapiens
aattcaacctgtgtctt

SEQ ID NO: 2680209 - DNA, 18 bp, Homo sapiens
aattcaacctgtgtctta

SEQ ID NO: 2680210 - DNA, 21 bp, Homo sapiens
aattccactggacttgagctt

SEQ ID NO: 2680211 - DNA, 22 bp, Homo sapiens
accctccgccttcactccggtg

SEQ ID NO: 2680212 - DNA, 15 bp, Homo sapiens
accctcgtggacacc

SEQ ID NO: 2680213 - DNA, 17 bp, Homo sapiens
accctcgtggacacctg

SEQ ID NO: 2680214 - DNA, 22 bp, Homo sapiens
accctcgtggacacctgccctg

SEQ ID NO: 2680215 - DNA, 22 bp, Homo sapiens
accctgcgaaggggccctggtc

SEQ ID NO: 2680216 - DNA, 16 bp, Homo sapiens
accctgggtcgggaca

SEQ ID NO: 2680217 - DNA, 20 bp, Homo sapiens
accctgtcagaatcatgctg

SEQ ID NO: 2680218 - DNA, 21 bp, Homo sapiens
accctgtctcttaaagaaaaa

SEQ ID NO: 2680219 - DNA, 15 bp, Homo sapiens
accgagaccaaactc

SEQ ID NO: 2680220 - DNA, 20 bp, Homo sapiens
accgctggtccctgccctcc

SEQ ID NO: 2680221 - DNA, 17 bp, Homo sapiens
accgtggaccttcctgc

SEQ ID NO: 2680222 - DNA, 21 bp, Homo sapiens
acctaccaccccttcctgtcc

SEQ ID NO: 2680223 - DNA, 16 bp, Homo sapiens
acctagaagtctccct

SEQ ID NO: 2680224 - DNA, 18 bp, Homo sapiens
acctagaagtctccctgc

SEQ ID NO: 2680225 - DNA, 19 bp, Homo sapiens
acctagaagtctccctgca

SEQ ID NO: 2680226 - DNA, 16 bp, Homo sapiens
acctatagtcccagct

SEQ ID NO: 2680227 - DNA, 12 bp, Homo sapiens
acctcagagcag

SEQ ID NO: 2680228 - DNA, 16 bp, Homo sapiens
acctcagagcagggcc

SEQ ID NO: 2680229 - DNA, 18 bp, Homo sapiens
acctcaggcttccttggc

SEQ ID NO: 2680230 - DNA, 19 bp, Homo sapiens
acctcaggcttccttggca

SEQ ID NO: 2680231 - DNA, 12 bp, Homo sapiens
acctccccctcc

SEQ ID NO: 2680232 - DNA, 20 bp, Homo sapiens
acctcccttccctccctgag

SEQ ID NO: 2680233 - DNA, 13 bp, Homo sapiens
acctccttacctg

SEQ ID NO: 2680234 - DNA, 17 bp, Homo sapiens
acctccttacctggagt

SEQ ID NO: 2680235 - DNA, 21 bp, Homo sapiens
acctccttttcttctagcttt

SEQ ID NO: 2680236 - DNA, 12 bp, Homo sapiens
acctctcaatat

SEQ ID NO: 2680237 - DNA, 15 bp, Homo sapiens
acctctcccagccct

SEQ ID NO: 2680238 - DNA, 14 bp, Homo sapiens
acctctgctctgag

SEQ ID NO: 2680239 - DNA, 22 bp, Homo sapiens
acctctgctctgaggcttccag

SEQ ID NO: 2680240 - DNA, 22 bp, Homo sapiens
acctcttctatgcaagccttgc

SEQ ID NO: 2680241 - DNA, 19 bp, Homo sapiens
acctctttattttttgatt

SEQ ID NO: 2680242 - DNA, 20 bp, Homo sapiens
acctgaagggtgacatccca

SEQ ID NO: 2680243 - DNA, 23 bp, Homo sapiens
acctgaagggtgacatcccagga

SEQ ID NO: 2680244 - DNA, 19 bp, Homo sapiens
acctgcaggccaagagcag

SEQ ID NO: 2680245 - DNA, 12 bp, Homo sapiens
acctgcaggctt

SEQ ID NO: 2680246 - DNA, 15 bp, Homo sapiens
acctgccagcctggc

SEQ ID NO: 2680247 - DNA, 19 bp, Homo sapiens
acctgccatttgcaccctc

SEQ ID NO: 2680248 - DNA, 23 bp, Homo sapiens
acctgccccgcccagctgcacct

SEQ ID NO: 2680249 - DNA, 17 bp, Homo sapiens
acctgccctgccctgcc

SEQ ID NO: 2680250 - DNA, 21 bp, Homo sapiens
acctgccctgccctgccacct

SEQ ID NO: 2680251 - DNA, 12 bp, Homo sapiens
acctgctcccag

SEQ ID NO: 2680252 - DNA, 13 bp, Homo sapiens
acctgctcccagt

SEQ ID NO: 2680253 - DNA, 15 bp, Homo sapiens
acctgctgcggggga

SEQ ID NO: 2680254 - DNA, 12 bp, Homo sapiens
acctgtactcag

SEQ ID NO: 2680255 - DNA, 19 bp, Homo sapiens
acctgtagtcccagctact

SEQ ID NO: 2680256 - DNA, 11 bp, Homo sapiens
acctgtctgtc

SEQ ID NO: 2680257 - DNA, 18 bp, Homo sapiens
acctgtgcttggaaccag

SEQ ID NO: 2680258 - DNA, 19 bp, Homo sapiens
acctgttttgcttttgtaa

SEQ ID NO: 2680259 - DNA, 22 bp, Homo sapiens
accttagaaatcattgtagaaa

SEQ ID NO: 2680260 - DNA, 18 bp, Homo sapiens
accttagacggaggtgcc

SEQ ID NO: 2680261 - DNA, 17 bp, Homo sapiens
accttagattagctctg

SEQ ID NO: 2680262 - DNA, 18 bp, Homo sapiens
accttcctgccaccagtc

SEQ ID NO: 2680263 - DNA, 15 bp, Homo sapiens
acgatgcctgcaggc

SEQ ID NO: 2680264 - DNA, 18 bp, Homo sapiens
acgcaactcacacctcct

SEQ ID NO: 2680265 - DNA, 17 bp, Homo sapiens
acgcaaggctgtgctct

SEQ ID NO: 2680266 - DNA, 12 bp, Homo sapiens
acgctcttagct

SEQ ID NO: 2680267 - DNA, 14 bp, Homo sapiens
acggccctcctggg

SEQ ID NO: 2680268 - DNA, 16 bp, Homo sapiens
acgggcgctgcagcct

SEQ ID NO: 2680269 - DNA, 14 bp, Homo sapiens
acgggctgccctgc

SEQ ID NO: 2680270 - DNA, 22 bp, Homo sapiens
acgggctgtccgtgtgcctcct

SEQ ID NO: 2680271 - DNA, 23 bp, Homo sapiens
acgggctgtccgtgtgcctcctg

SEQ ID NO: 2680272 - DNA, 12 bp, Homo sapiens
acgtctcctgct

SEQ ID NO: 2680273 - DNA, 13 bp, Homo sapiens
acgtctcctgctg

SEQ ID NO: 2680274 - DNA, 15 bp, Homo sapiens
acgtctcctgctgcg

SEQ ID NO: 2680275 - DNA, 18 bp, Homo sapiens
acgtctcctgctgcgtga

SEQ ID NO: 2680276 - DNA, 23 bp, Homo sapiens
acgtgcacctgtactcaggaggc

SEQ ID NO: 2680277 - DNA, 14 bp, Homo sapiens
acgttcggggcatg

SEQ ID NO: 2680278 - DNA, 21 bp, Homo sapiens
actaaagatatcagagctctt

SEQ ID NO: 2680279 - DNA, 18 bp, Homo sapiens
actaaattgtatacattt

SEQ ID NO: 2680280 - DNA, 21 bp, Homo sapiens
actaaattgtatacattttgt

SEQ ID NO: 2680281 - DNA, 17 bp, Homo sapiens
actaacataaaatctgt

SEQ ID NO: 2680282 - DNA, 20 bp, Homo sapiens
actaagctctctgggcctgg

SEQ ID NO: 2680283 - DNA, 18 bp, Homo sapiens
actaaggggcagctcctg

SEQ ID NO: 2680284 - DNA, 23 bp, Homo sapiens
actaaggggcagctcctgaccaa

SEQ ID NO: 2680285 - DNA, 17 bp, Homo sapiens
actacactccagcctga

SEQ ID NO: 2680286 - DNA, 20 bp, Homo sapiens
actacactccagcctgagca

SEQ ID NO: 2680287 - DNA, 15 bp, Homo sapiens
actacagaataatgt

SEQ ID NO: 2680288 - DNA, 16 bp, Homo sapiens
actacatattgaatag

SEQ ID NO: 2680289 - DNA, 14 bp, Homo sapiens
actcacacctcctt

SEQ ID NO: 2680290 - DNA, 16 bp, Homo sapiens
actcacacctcctttt

SEQ ID NO: 2680291 - DNA, 21 bp, Homo sapiens
actcacacctccttttcttct

SEQ ID NO: 2680292 - DNA, 20 bp, Homo sapiens
actcactctgggtgcctcct

SEQ ID NO: 2680293 - DNA, 13 bp, Homo sapiens
actcagaagcctg

SEQ ID NO: 2680294 - DNA, 18 bp, Homo sapiens
actcagaagcctgaggct

SEQ ID NO: 2680295 - DNA, 14 bp, Homo sapiens
actcagcccagctg

SEQ ID NO: 2680296 - DNA, 16 bp, Homo sapiens
actcagcccagctggc

SEQ ID NO: 2680297 - DNA, 16 bp, Homo sapiens
actcaggaggctgagg

SEQ ID NO: 2680298 - DNA, 17 bp, Homo sapiens
actcaggaggctgaggg

SEQ ID NO: 2680299 - DNA, 19 bp, Homo sapiens
actcattttaatgattgtt

SEQ ID NO: 2680300 - DNA, 18 bp, Homo sapiens
actccaatggggccagca

SEQ ID NO: 2680301 - DNA, 15 bp, Homo sapiens
actccagcctgagca

SEQ ID NO: 2680302 - DNA, 15 bp, Homo sapiens
actccagcctgggcg

SEQ ID NO: 2680303 - DNA, 16 bp, Homo sapiens
actcctacctcagcct

SEQ ID NO: 2680304 - DNA, 20 bp, Homo sapiens
actcctgattttgtagttaa

SEQ ID NO: 2680305 - DNA, 21 bp, Homo sapiens
actcctgattttgtagttaat

SEQ ID NO: 2680306 - DNA, 18 bp, Homo sapiens
actcctgccagttgaaaa

SEQ ID NO: 2680307 - DNA, 18 bp, Homo sapiens
actccttattttgtatta

SEQ ID NO: 2680308 - DNA, 15 bp, Homo sapiens
actcgatgaatgtgt

SEQ ID NO: 2680309 - DNA, 21 bp, Homo sapiens
actcgggaggctgaggcagga

SEQ ID NO: 2680310 - DNA, 17 bp, Homo sapiens
actctagcctgggccag

SEQ ID NO: 2680311 - DNA, 13 bp, Homo sapiens
actctctgctggc

SEQ ID NO: 2680312 - DNA, 21 bp, Homo sapiens
actctgaggctctttctgggc

SEQ ID NO: 2680313 - DNA, 22 bp, Homo sapiens
actctgctctatgccaggctgt

SEQ ID NO: 2680314 - DNA, 16 bp, Homo sapiens
actctgtggggccttg

SEQ ID NO: 2680315 - DNA, 19 bp, Homo sapiens
actctttgctacaataaat

SEQ ID NO: 2680316 - DNA, 20 bp, Homo sapiens
actctttgctacaataaatg

SEQ ID NO: 2680317 - DNA, 24 bp, Homo sapiens
actctttgctacaataaatgctga

SEQ ID NO: 2680318 - DNA, 21 bp, Homo sapiens
actgaaccgacttttctaaag

SEQ ID NO: 2680319 - DNA, 23 bp, Homo sapiens
actgactcggcagtgtgcagtgg

SEQ ID NO: 2680320 - DNA, 13 bp, Homo sapiens
actgactgcagcc

SEQ ID NO: 2680321 - DNA, 22 bp, Homo sapiens
actgagacagccacttggtttt

SEQ ID NO: 2680322 - DNA, 17 bp, Homo sapiens
aggctgtgctcttcctc

SEQ ID NO: 2680323 - DNA, 23 bp, Homo sapiens
agggaaaacacggccctcctggg

SEQ ID NO: 2680324 - DNA, 19 bp, Homo sapiens
agggacagctgctgggacc

SEQ ID NO: 2680325 - DNA, 16 bp, Homo sapiens
agggatgctgcctgag

SEQ ID NO: 2680326 - DNA, 19 bp, Homo sapiens
agggatgctgcctgagtca

SEQ ID NO: 2680327 - DNA, 16 bp, Homo sapiens
agggccaaagcacagc

SEQ ID NO: 2680328 - DNA, 17 bp, Homo sapiens
agggccaaagcacagct

SEQ ID NO: 2680329 - DNA, 18 bp, Homo sapiens
agggccaaagcacagctg

SEQ ID NO: 2680330 - DNA, 12 bp, Homo sapiens
agggccagggcc

SEQ ID NO: 2680331 - DNA, 14 bp, Homo sapiens
agggccagggccct

SEQ ID NO: 2680332 - DNA, 15 bp, Homo sapiens
agggcccagcaggcg

SEQ ID NO: 2680333 - DNA, 17 bp, Homo sapiens
agggcccaggcaggcca

SEQ ID NO: 2680334 - DNA, 15 bp, Homo sapiens
agggctaggaatata

SEQ ID NO: 2680335 - DNA, 15 bp, Homo sapiens
agggctcctccatgg

SEQ ID NO: 2680336 - DNA, 17 bp, Homo sapiens
agggctgggccaggtct

SEQ ID NO: 2680337 - DNA, 20 bp, Homo sapiens
aggggaaaccagtgtagcct

SEQ ID NO: 2680338 - DNA, 15 bp, Homo sapiens
aggggaatgtgtcct

SEQ ID NO: 2680339 - DNA, 19 bp, Homo sapiens
aggggcaaggggctggctg

SEQ ID NO: 2680340 - DNA, 21 bp, Homo sapiens
aggggcagctcctgaccaaag

SEQ ID NO: 2680341 - DNA, 13 bp, Homo sapiens
agaggggcctgca

SEQ ID NO: 2680342 - DNA, 15 bp, Homo sapiens
agaggggcctgcagg

SEQ ID NO: 2680343 - DNA, 18 bp, Homo sapiens
agaggggcctgcaggtga

SEQ ID NO: 2680344 - DNA, 19 bp, Homo sapiens
agaggtggaggttgcagtg

SEQ ID NO: 2680345 - DNA, 14 bp, Homo sapiens
agagtcctctggat

SEQ ID NO: 2680346 - DNA, 12 bp, Homo sapiens
agagtctgtctc

SEQ ID NO: 2680347 - DNA, 15 bp, Homo sapiens
agagttattgaatct

SEQ ID NO: 2680348 - DNA, 19 bp, Homo sapiens
agagttattgaatcttaat

SEQ ID NO: 2680349 - DNA, 20 bp, Homo sapiens
agataatgttctttaatgtt

SEQ ID NO: 2680350 - DNA, 18 bp, Homo sapiens
agatatcagagctcttaa

SEQ ID NO: 2680351 - DNA, 19 bp, Homo sapiens
agatctgaacacagtttag

SEQ ID NO: 2680352 - DNA, 15 bp, Homo sapiens
agatctttttgtgaa

SEQ ID NO: 2680353 - DNA, 20 bp, Homo sapiens
agatggcttatttgtataat

SEQ ID NO: 2680354 - DNA, 15 bp, Homo sapiens
agatgtcagactggc

SEQ ID NO: 2680355 - DNA, 18 bp, Homo sapiens
agatgtcagactggctgg

SEQ ID NO: 2680356 - DNA, 16 bp, Homo sapiens
agattgcgccactgca

SEQ ID NO: 2680357 - DNA, 17 bp, Homo sapiens
agattgggctggctctg

SEQ ID NO: 2680358 - DNA, 14 bp, Homo sapiens
agattgtgaataat

SEQ ID NO: 2680359 - DNA, 18 bp, Homo sapiens
agattgtgaataatgatt

SEQ ID NO: 2680360 - DNA, 22 bp, Homo sapiens
agatttaccttttctgttgtac

SEQ ID NO: 2680361 - DNA, 15 bp, Homo sapiens
agatttctctttgaa

SEQ ID NO: 2680362 - DNA, 15 bp, Homo sapiens
agcaagatgtactat

SEQ ID NO: 2680363 - DNA, 12 bp, Homo sapiens
agcacagctggg

SEQ ID NO: 2680364 - DNA, 14 bp, Homo sapiens
agcacagctgggca

SEQ ID NO: 2680365 - DNA, 13 bp, Homo sapiens
agcacctgctccc

SEQ ID NO: 2680366 - DNA, 15 bp, Homo sapiens
agcacctgctcccag

SEQ ID NO: 2680367 - DNA, 21 bp, Homo sapiens
agcacgtaaatgcgtccctgt

SEQ ID NO: 2680368 - DNA, 17 bp, Homo sapiens
agcacttctaagttgag

SEQ ID NO: 2680369 - DNA, 20 bp, Homo sapiens
agcacttctaagttgagtat

SEQ ID NO: 2680370 - DNA, 12 bp, Homo sapiens
agcactttggga

SEQ ID NO: 2680371 - DNA, 13 bp, Homo sapiens
agcagaggcagcg

SEQ ID NO: 2680372 - DNA, 19 bp, Homo sapiens
agcagagttattgaatctt

SEQ ID NO: 2680373 - DNA, 20 bp, Homo sapiens
agcagcacacctcagcccca

SEQ ID NO: 2680374 - DNA, 17 bp, Homo sapiens
agcagcccatggcctct

SEQ ID NO: 2680375 - DNA, 19 bp, Homo sapiens
agcagggccaaagcacagc

SEQ ID NO: 2680376 - DNA, 21 bp, Homo sapiens
agcaggtgtgaccctgagggc

SEQ ID NO: 2680377 - DNA, 22 bp, Homo sapiens
agcaggttgaggggctcctgga

SEQ ID NO: 2680378 - DNA, 14 bp, Homo sapiens
agcatcacctcagg

SEQ ID NO: 2680379 - DNA, 20 bp, Homo sapiens
agcatcacctcaggccaggt

SEQ ID NO: 2680380 - DNA, 12 bp, Homo sapiens
agcatcagagat

SEQ ID NO: 2680381 - DNA, 17 bp, Homo sapiens
agcattattcttcagaa

SEQ ID NO: 2680382 - DNA, 14 bp, Homo sapiens
agccaaactctgcc

SEQ ID NO: 2680383 - DNA, 15 bp, Homo sapiens
agccaaactctgcca

SEQ ID NO: 2680384 - DNA, 21 bp, Homo sapiens
agccaacgacaaagccaaact

SEQ ID NO: 2680385 - DNA, 12 bp, Homo sapiens
agccaacttcaa

SEQ ID NO: 2680386 - DNA, 19 bp, Homo sapiens
agccaaggtgggctgagcc

SEQ ID NO: 2680387 - DNA, 23 bp, Homo sapiens
agccaaggtgggctgagccctgg

SEQ ID NO: 2680388 - DNA, 19 bp, Homo sapiens
agccacagaagccaggagc

SEQ ID NO: 2680389 - DNA, 22 bp, Homo sapiens
agccacagaagccaggagcaaa

SEQ ID NO: 2680390 - DNA, 23 bp, Homo sapiens
agccacctgctgcgggggagcca

SEQ ID NO: 2680391 - DNA, 15 bp, Homo sapiens
agccacgctggcctt

SEQ ID NO: 2680392 - DNA, 20 bp, Homo sapiens
agccacgctggccttcgtct

SEQ ID NO: 2680393 - DNA, 12 bp, Homo sapiens
agccactgaagc

SEQ ID NO: 2680394 - DNA, 18 bp, Homo sapiens
agccagtgaaggagccac

SEQ ID NO: 2680395 - DNA, 13 bp, Homo sapiens
agccagtgacttt

SEQ ID NO: 2680396 - DNA, 14 bp, Homo sapiens
agccagtgactttt

SEQ ID NO: 2680397 - DNA, 15 bp, Homo sapiens
agccagtgacttttt

SEQ ID NO: 2680398 - DNA, 11 bp, Homo sapiens
agccagttctg

SEQ ID NO: 2680399 - DNA, 22 bp, Homo sapiens
agccatctctctactcctacct

SEQ ID NO: 2680400 - DNA, 22 bp, Homo sapiens
agccatgatcgagccactgcac

SEQ ID NO: 2680401 - DNA, 13 bp, Homo sapiens
agccattctgtgt

SEQ ID NO: 2680402 - DNA, 16 bp, Homo sapiens
agcccagcacctgctc

SEQ ID NO: 2680403 - DNA, 17 bp, Homo sapiens
agcccagctggccacct

SEQ ID NO: 2680404 - DNA, 13 bp, Homo sapiens
agcccaggcttcc

SEQ ID NO: 2680405 - DNA, 13 bp, Homo sapiens
agcccctgcccct

SEQ ID NO: 2680406 - DNA, 14 bp, Homo sapiens
agccctccaggcct

SEQ ID NO: 2680407 - DNA, 16 bp, Homo sapiens
agccctccaggcctgc

SEQ ID NO: 2680408 - DNA, 17 bp, Homo sapiens
agccctccaggcctgca

SEQ ID NO: 2680409 - DNA, 18 bp, Homo sapiens
agccctccaggcctgcag

SEQ ID NO: 2680410 - DNA, 20 bp, Homo sapiens
agccctccaggcctgcaggg

SEQ ID NO: 2680411 - DNA, 15 bp, Homo sapiens
agccctgctctttct

SEQ ID NO: 2680412 - DNA, 18 bp, Homo sapiens
agccctgctctttctctg

SEQ ID NO: 2680413 - DNA, 18 bp, Homo sapiens
agccctggaccccaggct

SEQ ID NO: 2680414 - DNA, 20 bp, Homo sapiens
agccctggaccccaggctct

SEQ ID NO: 2680415 - DNA, 21 bp, Homo sapiens
agccctggcaggatgaccctg

SEQ ID NO: 2680416 - DNA, 18 bp, Homo sapiens
agccgagattgcgccact

SEQ ID NO: 2680417 - DNA, 17 bp, Homo sapiens
agccggacacaagcggc

SEQ ID NO: 2680418 - DNA, 21 bp, Homo sapiens
agccggacacaagcggccctg

SEQ ID NO: 2680419 - DNA, 21 bp, Homo sapiens
agcctccctctgacctgcagg

SEQ ID NO: 2680420 - DNA, 23 bp, Homo sapiens
agcctcccttccatgccccagga

SEQ ID NO: 2680421 - DNA, 16 bp, Homo sapiens
agcctccttgcctgga

SEQ ID NO: 2680422 - DNA, 19 bp, Homo sapiens
agcctcgtgtcctgctagc

SEQ ID NO: 2680423 - DNA, 18 bp, Homo sapiens
agcctgaagatcagagct

SEQ ID NO: 2680424 - DNA, 19 bp, Homo sapiens
agcctggcttctggagccc

SEQ ID NO: 2680425 - DNA, 20 bp, Homo sapiens
agcctggcttctggagccct

SEQ ID NO: 2680426 - DNA, 13 bp, Homo sapiens
agcctgggcaaca

SEQ ID NO: 2680427 - DNA, 17 bp, Homo sapiens
agcctggtgcccatcct

SEQ ID NO: 2680428 - DNA, 20 bp, Homo sapiens
agccttgctagacagccagg

SEQ ID NO: 2680429 - DNA, 23 bp, Homo sapiens
agccttggcacgaggggggccag

SEQ ID NO: 2680430 - DNA, 16 bp, Homo sapiens
agcctttgccctgtca

SEQ ID NO: 2680431 - DNA, 14 bp, Homo sapiens
agcgagttgtggaa

SEQ ID NO: 2680432 - DNA, 11 bp, Homo sapiens
agcgctgccct

SEQ ID NO: 2680433 - DNA, 17 bp, Homo sapiens
agcgctgccctgtgaga

SEQ ID NO: 2680434 - DNA, 20 bp, Homo sapiens
agcgctgccctgtgagagcc

SEQ ID NO: 2680435 - DNA, 19 bp, Homo sapiens
agcggcgcagagccctcca

SEQ ID NO: 2680436 - DNA, 20 bp, Homo sapiens
agcggcgcagagccctccag

SEQ ID NO: 2680437 - DNA, 16 bp, Homo sapiens
agctaactgtggagaa

SEQ ID NO: 2680438 - DNA, 18 bp, Homo sapiens
agctacaaaaaactgcag

SEQ ID NO: 2680439 - DNA, 14 bp, Homo sapiens
agctactcagaagc

SEQ ID NO: 2680440 - DNA, 18 bp, Homo sapiens
agctactcagaagcctga

SEQ ID NO: 2680441 - DNA, 20 bp, Homo sapiens
agctattagcaactgtgcta

SEQ ID NO: 2680442 - DNA, 19 bp, Homo sapiens
agctattttctgaccaaaa

SEQ ID NO: 2680443 - DNA, 13 bp, Homo sapiens
agctcctgaccaa

SEQ ID NO: 2680444 - DNA, 16 bp, Homo sapiens
agctcctgtccctacc

SEQ ID NO: 2680445 - DNA, 22 bp, Homo sapiens
aggggcagctcctgaccaaaga

SEQ ID NO: 2680446 - DNA, 14 bp, Homo sapiens
aggggcccacccac

SEQ ID NO: 2680447 - DNA, 23 bp, Homo sapiens
aggggcctctgaaatttcccaca

SEQ ID NO: 2680448 - DNA, 17 bp, Homo sapiens
aggggctggctggagtc

SEQ ID NO: 2680449 - DNA, 17 bp, Homo sapiens
aggggctttctggagag

SEQ ID NO: 2680450 - DNA, 23 bp, Homo sapiens
agggggcggtaggggctgcaggg

SEQ ID NO: 2680451 - DNA, 23 bp, Homo sapiens
agggtgacatcccaggaggggcc

SEQ ID NO: 2680452 - DNA, 13 bp, Homo sapiens
agggttttgtatt

SEQ ID NO: 2680453 - DNA, 20 bp, Homo sapiens
aggtcctcacttctgtctcc

SEQ ID NO: 2680454 - DNA, 14 bp, Homo sapiens
aggtcgagctgtgc

SEQ ID NO: 2680455 - DNA, 19 bp, Homo sapiens
aggtctgatgccaaagctg

SEQ ID NO: 2680456 - DNA, 20 bp, Homo sapiens
aggtctgatgccaaagctgc

SEQ ID NO: 2680457 - DNA, 22 bp, Homo sapiens
aggtgccaccaataaaaatcct

SEQ ID NO: 2680458 - DNA, 18 bp, Homo sapiens
aggtgcctcacgcctgta

SEQ ID NO: 2680459 - DNA, 17 bp, Homo sapiens
aggtgcctcccagtggc

SEQ ID NO: 2680460 - DNA, 22 bp, Homo sapiens
aggtgcctcccagtggcctggc

SEQ ID NO: 2680461 - DNA, 15 bp, Homo sapiens
aggtggcagccctgt

SEQ ID NO: 2680462 - DNA, 17 bp, Homo sapiens
aggtgggctgagccctg

SEQ ID NO: 2680463 - DNA, 18 bp, Homo sapiens
aggtgggctgagccctgg

SEQ ID NO: 2680464 - DNA, 20 bp, Homo sapiens
aggtgggctgagccctggca

SEQ ID NO: 2680465 - DNA, 14 bp, Homo sapiens
aggtgtgaccctga

SEQ ID NO: 2680466 - DNA, 20 bp, Homo sapiens
aggttgaggggctcctggaa

SEQ ID NO: 2680467 - DNA, 14 bp, Homo sapiens
aggtttctattttc

SEQ ID NO: 2680468 - DNA, 13 bp, Homo sapiens
aggtttctctctt

SEQ ID NO: 2680469 - DNA, 13 bp, Homo sapiens
aggttttctccac

SEQ ID NO: 2680470 - DNA, 12 bp, Homo sapiens
agtaaacactgt

SEQ ID NO: 2680471 - DNA, 13 bp, Homo sapiens
agtaaacactgtg

SEQ ID NO: 2680472 - DNA, 14 bp, Homo sapiens
agtaaataatgaaa

SEQ ID NO: 2680473 - DNA, 18 bp, Homo sapiens
agtaactggtgatatatc

SEQ ID NO: 2680474 - DNA, 19 bp, Homo sapiens
agtaagagctaagttctaa

SEQ ID NO: 2680475 - DNA, 17 bp, Homo sapiens
agtaagtaccactcagg

SEQ ID NO: 2680476 - DNA, 18 bp, Homo sapiens
agtacaatgtgactttga

SEQ ID NO: 2680477 - DNA, 22 bp, Homo sapiens
agtagaacccaggtctgatgcc

SEQ ID NO: 2680478 - DNA, 13 bp, Homo sapiens
agtatatattcta

SEQ ID NO: 2680479 - DNA, 19 bp, Homo sapiens
agtatattagtttgattta

SEQ ID NO: 2680480 - DNA, 10 bp, Homo sapiens
agtcactgtc

SEQ ID NO: 2680481 - DNA, 19 bp, Homo sapiens
agtcatggggtccctgctg

SEQ ID NO: 2680482 - DNA, 21 bp, Homo sapiens
agtcatggggtccctgctgca

SEQ ID NO: 2680483 - DNA, 23 bp, Homo sapiens
agtccagctttccttctgccctt

SEQ ID NO: 2680484 - DNA, 19 bp, Homo sapiens
agtcccacaccgctggtcc

SEQ ID NO: 2680485 - DNA, 21 bp, Homo sapiens
agtccctgactctctgtgacc

SEQ ID NO: 2680486 - DNA, 14 bp, Homo sapiens
agtcccttctctct

SEQ ID NO: 2680487 - DNA, 15 bp, Homo sapiens
agtcccttctctctt

SEQ ID NO: 2680488 - DNA, 16 bp, Homo sapiens
agtcccttctctcttt

SEQ ID NO: 2680489 - DNA, 18 bp, Homo sapiens
agtcccttctctctttct

SEQ ID NO: 2680490 - DNA, 22 bp, Homo sapiens
agtcccttctctctttctaagg

SEQ ID NO: 2680491 - DNA, 15 bp, Homo sapiens
agtcctagagctcct

SEQ ID NO: 2680492 - DNA, 18 bp, Homo sapiens
agtcctagagctcctgtc

SEQ ID NO: 2680493 - DNA, 22 bp, Homo sapiens
agtcctagagctcctgtcccta

SEQ ID NO: 2680494 - DNA, 15 bp, Homo sapiens
agtcctcgtagccat

SEQ ID NO: 2680495 - DNA, 21 bp, Homo sapiens
agtcctgggagaacctcaggc

SEQ ID NO: 2680496 - DNA, 13 bp, Homo sapiens
agtcgtcaagttg

SEQ ID NO: 2680497 - DNA, 20 bp, Homo sapiens
agtctccctgcacagcctct

SEQ ID NO: 2680498 - DNA, 17 bp, Homo sapiens
agtctgtctcaaaagaa

SEQ ID NO: 2680499 - DNA, 15 bp, Homo sapiens
agtcttgctgtgctt

SEQ ID NO: 2680500 - DNA, 17 bp, Homo sapiens
agtgaaaaatatgttga

SEQ ID NO: 2680501 - DNA, 14 bp, Homo sapiens
agtgacttctggct

SEQ ID NO: 2680502 - DNA, 16 bp, Homo sapiens
agtgagaccctgtctc

SEQ ID NO: 2680503 - DNA, 24 bp, Homo sapiens
agtgattgtgtctgcattgttatt

SEQ ID NO: 2680504 - DNA, 11 bp, Homo sapiens
agtgcccagcc

SEQ ID NO: 2680505 - DNA, 23 bp, Homo sapiens
agtgcccagcccctgcccctacg

SEQ ID NO: 2680506 - DNA, 17 bp, Homo sapiens
agtgccctccacagccg

SEQ ID NO: 2680507 - DNA, 20 bp, Homo sapiens
agtgctgtggcctgggcaag

SEQ ID NO: 2680508 - DNA, 16 bp, Homo sapiens
agtgcttcagcctgag

SEQ ID NO: 2680509 - DNA, 17 bp, Homo sapiens
agtggaggtttatagtt

SEQ ID NO: 2680510 - DNA, 13 bp, Homo sapiens
agtggcctggctt

SEQ ID NO: 2680511 - DNA, 14 bp, Homo sapiens
agtggctcacgcct

SEQ ID NO: 2680512 - DNA, 20 bp, Homo sapiens
agtgtaactggctgctccct

SEQ ID NO: 2680513 - DNA, 22 bp, Homo sapiens
agttagctcaggaggcttggaa

SEQ ID NO: 2680514 - DNA, 19 bp, Homo sapiens
agttatatttactttaaaa

SEQ ID NO: 2680515 - DNA, 15 bp, Homo sapiens
agttattctctaaga

SEQ ID NO: 2680516 - DNA, 17 bp, Homo sapiens
agttcatggtgatcagt

SEQ ID NO: 2680517 - DNA, 18 bp, Homo sapiens
agttcgagaccagcctgg

SEQ ID NO: 2680518 - DNA, 19 bp, Homo sapiens
agttctgaactggaacatg

SEQ ID NO: 2680519 - DNA, 20 bp, Homo sapiens
agttctggggcccgcctgcc

SEQ ID NO: 2680520 - DNA, 21 bp, Homo sapiens
agttctggggcccgcctgcca

SEQ ID NO: 2680521 - DNA, 20 bp, Homo sapiens
agttgaaaatggatttttaa

SEQ ID NO: 2680522 - DNA, 19 bp, Homo sapiens
agttgagtatattataata

SEQ ID NO: 2680523 - DNA, 15 bp, Homo sapiens
agttggagaccaggc

SEQ ID NO: 2680524 - DNA, 19 bp, Homo sapiens
agttgtggaaagcctctgc

SEQ ID NO: 2680525 - DNA, 15 bp, Homo sapiens
agtttattggaagtg

SEQ ID NO: 2680526 - DNA, 18 bp, Homo sapiens
agtttattggaagtgttc

SEQ ID NO: 2680527 - DNA, 15 bp, Homo sapiens
ctgaacaatctccaa

SEQ ID NO: 2680528 - DNA, 14 bp, Homo sapiens
ctgaacaatgaatg

SEQ ID NO: 2680529 - DNA, 15 bp, Homo sapiens
ctgaagatcagagct

SEQ ID NO: 2680530 - DNA, 16 bp, Homo sapiens
ctgaagatcagagctg

SEQ ID NO: 2680531 - DNA, 17 bp, Homo sapiens
ctgaagatcagagctgc

SEQ ID NO: 2680532 - DNA, 21 bp, Homo sapiens
ctgaagatcagagctgcagcc

SEQ ID NO: 2680533 - DNA, 17 bp, Homo sapiens
ctgaagggtgacatccc

SEQ ID NO: 2680534 - DNA, 19 bp, Homo sapiens
ctgaagggtgacatcccag

SEQ ID NO: 2680535 - DNA, 21 bp, Homo sapiens
ctgaagggtgacatcccagga

SEQ ID NO: 2680536 - DNA, 16 bp, Homo sapiens
ctgaataagcactttt

SEQ ID NO: 2680537 - DNA, 18 bp, Homo sapiens
ctgaataagcacttttta

SEQ ID NO: 2680538 - DNA, 13 bp, Homo sapiens
ctgaatccgtggt

SEQ ID NO: 2680539 - DNA, 15 bp, Homo sapiens
ctgaatcttctgaaa

SEQ ID NO: 2680540 - DNA, 17 bp, Homo sapiens
ctgacacaggccagcct

SEQ ID NO: 2680541 - DNA, 21 bp, Homo sapiens
ctgacacggggatcatctctg

SEQ ID NO: 2680542 - DNA, 22 bp, Homo sapiens
ctgacacgtgatggaccaaagc

SEQ ID NO: 2680543 - DNA, 13 bp, Homo sapiens
ctgacactgtgac

SEQ ID NO: 2680544 - DNA, 15 bp, Homo sapiens
ctgacactgtgaccc

SEQ ID NO: 2680545 - DNA, 17 bp, Homo sapiens
ctgacactgtgaccctg

SEQ ID NO: 2680546 - DNA, 20 bp, Homo sapiens
ctgacactgtgaccctgggt

SEQ ID NO: 2680547 - DNA, 14 bp, Homo sapiens
ctgaccaaaatgtg

SEQ ID NO: 2680548 - DNA, 22 bp, Homo sapiens
ctgacccaactgatcctgctcc

SEQ ID NO: 2680549 - DNA, 14 bp, Homo sapiens
ctgactgcagcccc

SEQ ID NO: 2680550 - DNA, 19 bp, Homo sapiens
ctgagaagcgctgccctgt

SEQ ID NO: 2680551 - DNA, 21 bp, Homo sapiens
ctgagaagcgctgccctgtga

SEQ ID NO: 2680552 - DNA, 20 bp, Homo sapiens
ctgagagccagatgcctccc

SEQ ID NO: 2680553 - DNA, 23 bp, Homo sapiens
ctgagcaacagagtgagaccctg

SEQ ID NO: 2680554 - DNA, 22 bp, Homo sapiens
ctgagccagaaacgcagattgg

SEQ ID NO: 2680555 - DNA, 15 bp, Homo sapiens
ctgagccctggcagg

SEQ ID NO: 2680556 - DNA, 19 bp, Homo sapiens
ctgagcggcgcagagccct

SEQ ID NO: 2680557 - DNA, 14 bp, Homo sapiens
ctgagcttttcatg

SEQ ID NO: 2680558 - DNA, 15 bp, Homo sapiens
ctgaggactccctcc

SEQ ID NO: 2680559 - DNA, 16 bp, Homo sapiens
ctgaggactccctcca

SEQ ID NO: 2680560 - DNA, 20 bp, Homo sapiens
ctgaggcaggtgagaaccca

SEQ ID NO: 2680561 - DNA, 14 bp, Homo sapiens
ctgaggccacccac

SEQ ID NO: 2680562 - DNA, 20 bp, Homo sapiens
ctgaggccacccactgaccc

SEQ ID NO: 2680563 - DNA, 17 bp, Homo sapiens
cggtaggggctgcaggg

SEQ ID NO: 2680564 - DNA, 14 bp, Homo sapiens
cggtgaggccgggc

SEQ ID NO: 2680565 - DNA, 16 bp, Homo sapiens
cggtgtgggctgtgtc

SEQ ID NO: 2680566 - DNA, 19 bp, Homo sapiens
cgtaagatggcttatttgt

SEQ ID NO: 2680567 - DNA, 17 bp, Homo sapiens
cgtcaggcacgtctcct

SEQ ID NO: 2680568 - DNA, 14 bp, Homo sapiens
cgtccctgcccaga

SEQ ID NO: 2680569 - DNA, 14 bp, Homo sapiens
cgtcgggcccctgc

SEQ ID NO: 2680570 - DNA, 16 bp, Homo sapiens
cgtcgggcccctgcct

SEQ ID NO: 2680571 - DNA, 21 bp, Homo sapiens
cgtcgggcccctgcctgcctt

SEQ ID NO: 2680572 - DNA, 18 bp, Homo sapiens
cgtgacatgtgcagtgct

SEQ ID NO: 2680573 - DNA, 15 bp, Homo sapiens
cgtgatggaccaaag

SEQ ID NO: 2680574 - DNA, 15 bp, Homo sapiens
cgtggacacctgccc

SEQ ID NO: 2680575 - DNA, 15 bp, Homo sapiens
cgtggatggtctcca

SEQ ID NO: 2680576 - DNA, 22 bp, Homo sapiens
cgtgtcaatgaatgccggggac

SEQ ID NO: 2680577 - DNA, 16 bp, Homo sapiens
cgtgtcctgctagctg

SEQ ID NO: 2680578 - DNA, 16 bp, Homo sapiens
ctaaagtcacatataa

SEQ ID NO: 2680579 - DNA, 15 bp, Homo sapiens
ctaaatagttctatc

SEQ ID NO: 2680580 - DNA, 17 bp, Homo sapiens
ctaaattgtatacattt

SEQ ID NO: 2680581 - DNA, 15 bp, Homo sapiens
ctaagcatggcctgg

SEQ ID NO: 2680582 - DNA, 13 bp, Homo sapiens
ctaagctctctgg

SEQ ID NO: 2680583 - DNA, 15 bp, Homo sapiens
ctaagctctctgggc

SEQ ID NO: 2680584 - DNA, 16 bp, Homo sapiens
ctaaggggcagctcct

SEQ ID NO: 2680585 - DNA, 17 bp, Homo sapiens
ctaaggggcagctcctg

SEQ ID NO: 2680586 - DNA, 21 bp, Homo sapiens
ctaaggggcagctcctgacca

SEQ ID NO: 2680587 - DNA, 20 bp, Homo sapiens
ctaagttcatgtttgtaaat

SEQ ID NO: 2680588 - DNA, 17 bp, Homo sapiens
ctaagttctaagttcat

SEQ ID NO: 2680589 - DNA, 19 bp, Homo sapiens
ctaagttgagtatattata

SEQ ID NO: 2680590 - DNA, 22 bp, Homo sapiens
ctaagttgagtatattataata

SEQ ID NO: 2680591 - DNA, 13 bp, Homo sapiens
ctacaataaatgc

SEQ ID NO: 2680592 - DNA, 14 bp, Homo sapiens
ctacacatatatgt

SEQ ID NO: 2680593 - DNA, 12 bp, Homo sapiens
ctacatattgaa

SEQ ID NO: 2680594 - DNA, 14 bp, Homo sapiens
ctacatattgaata

SEQ ID NO: 2680595 - DNA, 12 bp, Homo sapiens
ctacccactctt

SEQ ID NO: 2680596 - DNA, 14 bp, Homo sapiens
ctacccactctttg

SEQ ID NO: 2680597 - DNA, 16 bp, Homo sapiens
ctacccactctttgct

SEQ ID NO: 2680598 - DNA, 17 bp, Homo sapiens
ctacgggcgctgcagcc

SEQ ID NO: 2680599 - DNA, 22 bp, Homo sapiens
ctacgggcgctgcagcctccct

SEQ ID NO: 2680600 - DNA, 13 bp, Homo sapiens
ctactcagaagcc

SEQ ID NO: 2680601 - DNA, 12 bp, Homo sapiens
ctactcatttta

SEQ ID NO: 2680602 - DNA, 14 bp, Homo sapiens
ctacttcacagagg

SEQ ID NO: 2680603 - DNA, 13 bp, Homo sapiens
ctacttttcagaa

SEQ ID NO: 2680604 - DNA, 15 bp, Homo sapiens
ctagaacacccactg

SEQ ID NO: 2680605 - DNA, 16 bp, Homo sapiens
ctagaacacccactgg

SEQ ID NO: 2680606 - DNA, 20 bp, Homo sapiens
ctagaacacccactggccag

SEQ ID NO: 2680607 - DNA, 22 bp, Homo sapiens
ctagaacacccactggccagtc

SEQ ID NO: 2680608 - DNA, 14 bp, Homo sapiens
ctagaaggccacat

SEQ ID NO: 2680609 - DNA, 19 bp, Homo sapiens
ctagaaggccacatgtcac

SEQ ID NO: 2680610 - DNA, 22 bp, Homo sapiens
ctagaagtaactggtgatatat

SEQ ID NO: 2680611 - DNA, 17 bp, Homo sapiens
ctagaagtctccctgca

SEQ ID NO: 2680612 - DNA, 23 bp, Homo sapiens
ctagaagtctccctgcacagcct

SEQ ID NO: 2680613 - DNA, 14 bp, Homo sapiens
ctagagctcctgtc

SEQ ID NO: 2680614 - DNA, 14 bp, Homo sapiens
ctccttttcttcta

SEQ ID NO: 2680615 - DNA, 16 bp, Homo sapiens
ctcggaaggctggctg

SEQ ID NO: 2680616 - DNA, 20 bp, Homo sapiens
ctcggaaggctggctgggca

SEQ ID NO: 2680617 - DNA, 18 bp, Homo sapiens
ctcgggtgctgccagctg

SEQ ID NO: 2680618 - DNA, 14 bp, Homo sapiens
ctcgtagccatctc

SEQ ID NO: 2680619 - DNA, 19 bp, Homo sapiens
ctcgtggacacctgccctg

SEQ ID NO: 2680620 - DNA, 12 bp, Homo sapiens
ctcgtgtcctgc

SEQ ID NO: 2680621 - DNA, 21 bp, Homo sapiens
ctcgtgtcctgctagctgtct

SEQ ID NO: 2680622 - DNA, 18 bp, Homo sapiens
ctctaaactgctgttaat

SEQ ID NO: 2680623 - DNA, 19 bp, Homo sapiens
ctctactaaaaatacagaa

SEQ ID NO: 2680624 - DNA, 19 bp, Homo sapiens
ctctagaacacccactggc

SEQ ID NO: 2680625 - DNA, 20 bp, Homo sapiens
ctctagaacacccactggcc

SEQ ID NO: 2680626 - DNA, 18 bp, Homo sapiens
ctctagtgccctccacag

SEQ ID NO: 2680627 - DNA, 13 bp, Homo sapiens
ctctatgccaggc

SEQ ID NO: 2680628 - DNA, 14 bp, Homo sapiens
ctctccacccccca

SEQ ID NO: 2680629 - DNA, 16 bp, Homo sapiens
ctctccaccccccacg

SEQ ID NO: 2680630 - DNA, 12 bp, Homo sapiens
ctctcctggagc

SEQ ID NO: 2680631 - DNA, 16 bp, Homo sapiens
ctctcggaaggctggc

SEQ ID NO: 2680632 - DNA, 16 bp, Homo sapiens
ctctctcctttttgct

SEQ ID NO: 2680633 - DNA, 21 bp, Homo sapiens
ctctctgagagcacagcgttt

SEQ ID NO: 2680634 - DNA, 14 bp, Homo sapiens
ctctctgctggcag

SEQ ID NO: 2680635 - DNA, 11 bp, Homo sapiens
ctctcttccct

SEQ ID NO: 2680636 - DNA, 18 bp, Homo sapiens
ctctcttcccttctccct

SEQ ID NO: 2680637 - DNA, 12 bp, Homo sapiens
ctctcttcctgt

SEQ ID NO: 2680638 - DNA, 13 bp, Homo sapiens
ctctcttcctgtc

SEQ ID NO: 2680639 - DNA, 11 bp, Homo sapiens
ctctctttcta

SEQ ID NO: 2680640 - DNA, 17 bp, Homo sapiens
ctctgaaatttcccaca

SEQ ID NO: 2680641 - DNA, 20 bp, Homo sapiens
ctctgaaatttcccacaccc

SEQ ID NO: 2680642 - DNA, 14 bp, Homo sapiens
ctctgagagcacag

SEQ ID NO: 2680643 - DNA, 15 bp, Homo sapiens
ctctgaggcttccag

SEQ ID NO: 2680644 - DNA, 21 bp, Homo sapiens
ctctgaggcttccagagagtc

SEQ ID NO: 2680645 - DNA, 17 bp, Homo sapiens
ctctgatacttttttga

SEQ ID NO: 2680646 - DNA, 20 bp, Homo sapiens
ctctgatacttttttgaaat

SEQ ID NO: 2680647 - DNA, 22 bp, Homo sapiens
ctctgatacttttttgaaatca

SEQ ID NO: 2680648 - DNA, 13 bp, Homo sapiens
ctctgccccagct

SEQ ID NO: 2680649 - DNA, 18 bp, Homo sapiens
ctctgccccagctctggc

SEQ ID NO: 2680650 - DNA, 18 bp, Homo sapiens
ctctgcctcctcctcacg

SEQ ID NO: 2680651 - DNA, 15 bp, Homo sapiens
ctctgctctatgcca

SEQ ID NO: 2680652 - DNA, 19 bp, Homo sapiens
ctctgctctatgccaggct

SEQ ID NO: 2680653 - DNA, 13 bp, Homo sapiens
ctctgctgccatg

SEQ ID NO: 2680654 - DNA, 13 bp, Homo sapiens
ctctgctggcagg

SEQ ID NO: 2680655 - DNA, 10 bp, Homo sapiens
ctctgcttcc

SEQ ID NO: 2680656 - DNA, 12 bp, Homo sapiens
ctctgcttcctc

SEQ ID NO: 2680657 - DNA, 16 bp, Homo sapiens
ctctggatggcaccag

SEQ ID NO: 2680658 - DNA, 14 bp, Homo sapiens
ctctggccaggcat

SEQ ID NO: 2680659 - DNA, 21 bp, Homo sapiens
ctctgggtggaagtgcccagc

SEQ ID NO: 2680660 - DNA, 20 bp, Homo sapiens
ctctggttgacgggctgtcc

SEQ ID NO: 2680661 - DNA, 15 bp, Homo sapiens
ctctggtttctgtgt

SEQ ID NO: 2680662 - DNA, 18 bp, Homo sapiens
ctctggtttctgtgtgtc

SEQ ID NO: 2680663 - DNA, 18 bp, Homo sapiens
ctctgtgctttgactcac

SEQ ID NO: 2680664 - DNA, 15 bp, Homo sapiens
ctctgtttcttcctt

SEQ ID NO: 2680665 - DNA, 20 bp, Homo sapiens
ctcttagtgattgtgtctgc

SEQ ID NO: 2680666 - DNA, 21 bp, Homo sapiens
ctcttctatgcaagccttgct

SEQ ID NO: 2680667 - DNA, 14 bp, Homo sapiens
ctcttctcttcctg

SEQ ID NO: 2680668 - DNA, 15 bp, Homo sapiens
ctcttctcttcctgt

SEQ ID NO: 2680669 - DNA, 17 bp, Homo sapiens
ctcttggacctctgctc

SEQ ID NO: 2680670 - DNA, 19 bp, Homo sapiens
ctcttggacctctgctctg

SEQ ID NO: 2680671 - DNA, 22 bp, Homo sapiens
ctctttcagagaggtctcaggt

SEQ ID NO: 2680672 - DNA, 12 bp, Homo sapiens
ctctttctctga

SEQ ID NO: 2680673 - DNA, 14 bp, Homo sapiens
ctctttgctacaat

SEQ ID NO: 2680674 - DNA, 15 bp, Homo sapiens
ctctttgctacaata

SEQ ID NO: 2680675 - DNA, 16 bp, Homo sapiens
ctctttgctacaataa

SEQ ID NO: 2680676 - DNA, 17 bp, Homo sapiens
ctctttgctacaataaa

SEQ ID NO: 2680677 - DNA, 20 bp, Homo sapiens
ctctttgctacaataaatgc

SEQ ID NO: 2680678 - DNA, 23 bp, Homo sapiens
ctctttgctacaataaatgctga

SEQ ID NO: 2680679 - DNA, 17 bp, Homo sapiens
ccaatggggccagcact

SEQ ID NO: 2680680 - DNA, 23 bp, Homo sapiens
ccacaccgctggtccctgccctc

SEQ ID NO: 2680681 - DNA, 12 bp, Homo sapiens
ccacagccgcag

SEQ ID NO: 2680682 - DNA, 14 bp, Homo sapiens
ccacatgtcaccgt

SEQ ID NO: 2680683 - DNA, 14 bp, Homo sapiens
ccaccagtcactgt

SEQ ID NO: 2680684 - DNA, 18 bp, Homo sapiens
ccaccctcgtggacacct

SEQ ID NO: 2680685 - DNA, 20 bp, Homo sapiens
ccacctagaagtctccctgc

SEQ ID NO: 2680686 - DNA, 14 bp, Homo sapiens
ccacctctcaatat

SEQ ID NO: 2680687 - DNA, 16 bp, Homo sapiens
ccacctcttctcttcc

SEQ ID NO: 2680688 - DNA, 18 bp, Homo sapiens
ccacctcttctcttcctg

SEQ ID NO: 2680689 - DNA, 12 bp, Homo sapiens
ccacctgctgcg

SEQ ID NO: 2680690 - DNA, 11 bp, Homo sapiens
ccacctgtctg

SEQ ID NO: 2680691 - DNA, 17 bp, Homo sapiens
ccaccttcaattcctgg

SEQ ID NO: 2680692 - DNA, 18 bp, Homo sapiens
ccaccttcaattcctggg

SEQ ID NO: 2680693 - DNA, 19 bp, Homo sapiens
ccaccttcaattcctgggc

SEQ ID NO: 2680694 - DNA, 15 bp, Homo sapiens
ccacgtctgtcctcc

SEQ ID NO: 2680695 - DNA, 19 bp, Homo sapiens
ccactacactccagcctga

SEQ ID NO: 2680696 - DNA, 21 bp, Homo sapiens
ccactacactccagcctgagc

SEQ ID NO: 2680697 - DNA, 18 bp, Homo sapiens
ccactaggactctgaggc

SEQ ID NO: 2680698 - DNA, 20 bp, Homo sapiens
ccactaggactctgaggctc

SEQ ID NO: 2680699 - DNA, 20 bp, Homo sapiens
ccactcaggccaacaagcca

SEQ ID NO: 2680700 - DNA, 16 bp, Homo sapiens
ccactccccaccttca

SEQ ID NO: 2680701 - DNA, 22 bp, Homo sapiens
ccactggacttgagcttggcag

SEQ ID NO: 2680702 - DNA, 19 bp, Homo sapiens
ccactggccagtcctagag

SEQ ID NO: 2680703 - DNA, 21 bp, Homo sapiens
ccactttggtacatggccagt

SEQ ID NO: 2680704 - DNA, 15 bp, Homo sapiens
ccagaaaaccccagc

SEQ ID NO: 2680705 - DNA, 14 bp, Homo sapiens
ccagaattattttt

SEQ ID NO: 2680706 - DNA, 14 bp, Homo sapiens
ccagaccattgtct

SEQ ID NO: 2680707 - DNA, 15 bp, Homo sapiens
ccagaccattgtctt

SEQ ID NO: 2680708 - DNA, 18 bp, Homo sapiens
ccagaccattgtcttcca

SEQ ID NO: 2680709 - DNA, 16 bp, Homo sapiens
ccagactgtggagaaa

SEQ ID NO: 2680710 - DNA, 21 bp, Homo sapiens
ccagagagaggggcctgcagg

SEQ ID NO: 2680711 - DNA, 15 bp, Homo sapiens
ccagagagtcctctg

SEQ ID NO: 2680712 - DNA, 16 bp, Homo sapiens
ccagaggcagagcctg

SEQ ID NO: 2680713 - DNA, 18 bp, Homo sapiens
ccagagggcccaggcagg

SEQ ID NO: 2680714 - DNA, 15 bp, Homo sapiens
ccagcaaagcctcca

SEQ ID NO: 2680715 - DNA, 17 bp, Homo sapiens
ccagcaaagcctccagc

SEQ ID NO: 2680716 - DNA, 18 bp, Homo sapiens
ccagcaaagcctccagca

SEQ ID NO: 2680717 - DNA, 21 bp, Homo sapiens
ccagcaaagcctccagcatct

SEQ ID NO: 2680718 - DNA, 14 bp, Homo sapiens
ccagcacacacaca

SEQ ID NO: 2680719 - DNA, 14 bp, Homo sapiens
ccagcacctgctcc

SEQ ID NO: 2680720 - DNA, 19 bp, Homo sapiens
ccagcactggaggggccca

SEQ ID NO: 2680721 - DNA, 21 bp, Homo sapiens
ccagcactggaggggcccacc

SEQ ID NO: 2680722 - DNA, 14 bp, Homo sapiens
ccagcactttggga

SEQ ID NO: 2680723 - DNA, 20 bp, Homo sapiens
ccagcactttgggaggctga

SEQ ID NO: 2680724 - DNA, 15 bp, Homo sapiens
ccagcagcacacctc

SEQ ID NO: 2680725 - DNA, 16 bp, Homo sapiens
ccagcagcacacctca

SEQ ID NO: 2680726 - DNA, 17 bp, Homo sapiens
ccagcagcacacctcag

SEQ ID NO: 2680727 - DNA, 14 bp, Homo sapiens
atatatcataaagt

SEQ ID NO: 2680728 - DNA, 15 bp, Homo sapiens
atatatcataaagta

SEQ ID NO: 2680729 - DNA, 14 bp, Homo sapiens
atatatgtatatgt

SEQ ID NO: 2680730 - DNA, 15 bp, Homo sapiens
atatatgtatatgta

SEQ ID NO: 2680731 - DNA, 23 bp, Homo sapiens
atatattctacacatatatgtat

SEQ ID NO: 2680732 - DNA, 21 bp, Homo sapiens
atatcagagctcttaatgttg

SEQ ID NO: 2680733 - DNA, 15 bp, Homo sapiens
atatcataaagtatg

SEQ ID NO: 2680734 - DNA, 17 bp, Homo sapiens
atatctataaacactgt

SEQ ID NO: 2680735 - DNA, 19 bp, Homo sapiens
atatctgagaagtgtatat

SEQ ID NO: 2680736 - DNA, 15 bp, Homo sapiens
atatgaagctcttga

SEQ ID NO: 2680737 - DNA, 13 bp, Homo sapiens
atatgtatatcta

SEQ ID NO: 2680738 - DNA, 22 bp, Homo sapiens
atattagtttgatttaatatct

SEQ ID NO: 2680739 - DNA, 15 bp, Homo sapiens
atattcaataaagct

SEQ ID NO: 2680740 - DNA, 22 bp, Homo sapiens
atattcagtgctgtggcctggg

SEQ ID NO: 2680741 - DNA, 19 bp, Homo sapiens
atatttttgctaggagccc

SEQ ID NO: 2680742 - DNA, 22 bp, Homo sapiens
atcaaatctgtatatgttgtaa

SEQ ID NO: 2680743 - DNA, 17 bp, Homo sapiens
atcaagctagaaggcca

SEQ ID NO: 2680744 - DNA, 12 bp, Homo sapiens
atcacagggcag

SEQ ID NO: 2680745 - DNA, 20 bp, Homo sapiens
atcacagggcagagccggga

SEQ ID NO: 2680746 - DNA, 14 bp, Homo sapiens
atcacgccactgca

SEQ ID NO: 2680747 - DNA, 14 bp, Homo sapiens
atcactctctgctg

SEQ ID NO: 2680748 - DNA, 13 bp, Homo sapiens
atcactggagccc

SEQ ID NO: 2680749 - DNA, 14 bp, Homo sapiens
atcagagctgcagc

SEQ ID NO: 2680750 - DNA, 18 bp, Homo sapiens
atcagagctgcagccagt

SEQ ID NO: 2680751 - DNA, 13 bp, Homo sapiens
atcagtaaacact

SEQ ID NO: 2680752 - DNA, 15 bp, Homo sapiens
atcagtaaacactgt

SEQ ID NO: 2680753 - DNA, 17 bp, Homo sapiens
atcatactcctatgctt

SEQ ID NO: 2680754 - DNA, 18 bp, Homo sapiens
atcatactcctatgcttt

SEQ ID NO: 2680755 - DNA, 19 bp, Homo sapiens
atcatactcctatgcttta

SEQ ID NO: 2680756 - DNA, 17 bp, Homo sapiens
atcatgctgttctcttt

SEQ ID NO: 2680757 - DNA, 18 bp, Homo sapiens
atccaaccccccacctgc

SEQ ID NO: 2680758 - DNA, 23 bp, Homo sapiens
atcccaggaggggcctctgaaat

SEQ ID NO: 2680759 - DNA, 22 bp, Homo sapiens
atcccaggatgggtgtctgggg

SEQ ID NO: 2680760 - DNA, 18 bp, Homo sapiens
atcctcaaacatggaaga

SEQ ID NO: 2680761 - DNA, 16 bp, Homo sapiens
atcctgaaagccagca

SEQ ID NO: 2680762 - DNA, 22 bp, Homo sapiens
atcctgaaagccagcaaagcct

SEQ ID NO: 2680763 - DNA, 13 bp, Homo sapiens
atcctgaggtgcc

SEQ ID NO: 2680764 - DNA, 14 bp, Homo sapiens
atcctgaggtgcct

SEQ ID NO: 2680765 - DNA, 16 bp, Homo sapiens
atcctgaggtgcctcc

SEQ ID NO: 2680766 - DNA, 17 bp, Homo sapiens
atcctgaggtgcctccc

SEQ ID NO: 2680767 - DNA, 13 bp, Homo sapiens
atcctgctccagc

SEQ ID NO: 2680768 - DNA, 13 bp, Homo sapiens
atcctgcttcctg

SEQ ID NO: 2680769 - DNA, 14 bp, Homo sapiens
atcctgcttcctga

SEQ ID NO: 2680770 - DNA, 15 bp, Homo sapiens
atcctgcttcctgaa

SEQ ID NO: 2680771 - DNA, 16 bp, Homo sapiens
atcctgcttcctgaaa

SEQ ID NO: 2680772 - DNA, 17 bp, Homo sapiens
atcgagaactgccattg

SEQ ID NO: 2680773 - DNA, 21 bp, Homo sapiens
atcgctttccttcctcccctt

SEQ ID NO: 2680774 - DNA, 18 bp, Homo sapiens
atctagttttttttgtaa

SEQ ID NO: 2680775 - DNA, 13 bp, Homo sapiens
atctataaacact

SEQ ID NO: 2680776 - DNA, 15 bp, Homo sapiens
atctataaacactgt

SEQ ID NO: 2680777 - DNA, 17 bp, Homo sapiens
atctataactacatatt

SEQ ID NO: 2680778 - DNA, 15 bp, Homo sapiens
atctcctttcaggga

SEQ ID NO: 2680779 - DNA, 23 bp, Homo sapiens
atctctctactcctacctcagcc

SEQ ID NO: 2680780 - DNA, 18 bp, Homo sapiens
atctgaacacagtttagt

SEQ ID NO: 2680781 - DNA, 17 bp, Homo sapiens
atctgagaagtgtatat

SEQ ID NO: 2680782 - DNA, 18 bp, Homo sapiens
atctgagaagtgtatata

SEQ ID NO: 2680783 - DNA, 13 bp, Homo sapiens
atctggtgccttt

SEQ ID NO: 2680784 - DNA, 20 bp, Homo sapiens
atctgtatatgttgtaataa

SEQ ID NO: 2680785 - DNA, 14 bp, Homo sapiens
atctgtatgattct

SEQ ID NO: 2680786 - DNA, 19 bp, Homo sapiens
atctgtatgattctatgga

SEQ ID NO: 2680787 - DNA, 21 bp, Homo sapiens
atctgtctttagaatcgcttt

SEQ ID NO: 2680788 - DNA, 13 bp, Homo sapiens
atctgtgaattaa

SEQ ID NO: 2680789 - DNA, 19 bp, Homo sapiens
atcttaattttttttaatg

SEQ ID NO: 2680790 - DNA, 20 bp, Homo sapiens
atcttctggagtctccagtg

SEQ ID NO: 2680791 - DNA, 21 bp, Homo sapiens
atgaaagggaaagtcagcttt

SEQ ID NO: 2680792 - DNA, 18 bp, Homo sapiens
atgaaattcttgaagttc

SEQ ID NO: 2680793 - DNA, 15 bp, Homo sapiens
atgaacttgaggaca

SEQ ID NO: 2680794 - DNA, 20 bp, Homo sapiens
atgaagggacagctgctggg

SEQ ID NO: 2680795 - DNA, 15 bp, Homo sapiens
atgaatttggagact

SEQ ID NO: 2680796 - DNA, 13 bp, Homo sapiens
atgacccaaagac

SEQ ID NO: 2680797 - DNA, 22 bp, Homo sapiens
atgactggatacagaatgaatc

SEQ ID NO: 2680798 - DNA, 20 bp, Homo sapiens
atgaggaaacaggcctcaag

SEQ ID NO: 2680799 - DNA, 19 bp, Homo sapiens
atgaggataacttccttgc

SEQ ID NO: 2680800 - DNA, 23 bp, Homo sapiens
atgaggcctcttggacctctgct

SEQ ID NO: 2680801 - DNA, 17 bp, Homo sapiens
atgattatgccactgct

SEQ ID NO: 2680802 - DNA, 23 bp, Homo sapiens
atgcacctcccttccctccctga

SEQ ID NO: 2680803 - DNA, 21 bp, Homo sapiens
atgcagactcctcagatctga

SEQ ID NO: 2680804 - DNA, 19 bp, Homo sapiens
atgcatgtaatcaacatgg

SEQ ID NO: 2680805 - DNA, 21 bp, Homo sapiens
caggagcctcgtgtcctgcta

SEQ ID NO: 2680806 - DNA, 22 bp, Homo sapiens
caggagcctcgtgtcctgctag

SEQ ID NO: 2680807 - DNA, 24 bp, Homo sapiens
caggagcctcgtgtcctgctagct

SEQ ID NO: 2680808 - DNA, 16 bp, Homo sapiens
caggaggccccaggct

SEQ ID NO: 2680809 - DNA, 19 bp, Homo sapiens
caggaggccccaggctgag

SEQ ID NO: 2680810 - DNA, 13 bp, Homo sapiens
caggaggctgagg

SEQ ID NO: 2680811 - DNA, 18 bp, Homo sapiens
caggaggttggtgactga

SEQ ID NO: 2680812 - DNA, 17 bp, Homo sapiens
caggagttggagaccag

SEQ ID NO: 2680813 - DNA, 21 bp, Homo sapiens
caggagtttgaggctgcagcg

SEQ ID NO: 2680814 - DNA, 22 bp, Homo sapiens
caggagtttgaggctgcagcga

SEQ ID NO: 2680815 - DNA, 13 bp, Homo sapiens
caggatcactctc

SEQ ID NO: 2680816 - DNA, 19 bp, Homo sapiens
caggatgggtgtctgggga

SEQ ID NO: 2680817 - DNA, 14 bp, Homo sapiens
caggattcttcccg

SEQ ID NO: 2680818 - DNA, 19 bp, Homo sapiens
caggattcttcccgctccc

SEQ ID NO: 2680819 - DNA, 16 bp, Homo sapiens
caggcacgtctcctgc

SEQ ID NO: 2680820 - DNA, 18 bp, Homo sapiens
caggcacgtctcctgctg

SEQ ID NO: 2680821 - DNA, 19 bp, Homo sapiens
caggcacgtctcctgctgc

SEQ ID NO: 2680822 - DNA, 19 bp, Homo sapiens
caggcagggctgggccagg

SEQ ID NO: 2680823 - DNA, 22 bp, Homo sapiens
caggcagggctgggccaggtct

SEQ ID NO: 2680824 - DNA, 23 bp, Homo sapiens
caggcagggctgggccaggtctc

SEQ ID NO: 2680825 - DNA, 21 bp, Homo sapiens
caggccaagagcagaggcagc

SEQ ID NO: 2680826 - DNA, 23 bp, Homo sapiens
caggccaagagcagaggcagcga

SEQ ID NO: 2680827 - DNA, 12 bp, Homo sapiens
caggccaaggct

SEQ ID NO: 2680828 - DNA, 17 bp, Homo sapiens
caggccaatgttgctga

SEQ ID NO: 2680829 - DNA, 18 bp, Homo sapiens
caggccaatgttgctgat

SEQ ID NO: 2680830 - DNA, 15 bp, Homo sapiens
caggcccagagaagc

SEQ ID NO: 2680831 - DNA, 15 bp, Homo sapiens
caggcccccaccact

SEQ ID NO: 2680832 - DNA, 23 bp, Homo sapiens
caggcccggggggaccaggatga

SEQ ID NO: 2680833 - DNA, 13 bp, Homo sapiens
caggcctcaagcg

SEQ ID NO: 2680834 - DNA, 15 bp, Homo sapiens
caggctatttgttca

SEQ ID NO: 2680835 - DNA, 14 bp, Homo sapiens
caggctccatgcac

SEQ ID NO: 2680836 - DNA, 16 bp, Homo sapiens
caggctccatgcacct

SEQ ID NO: 2680837 - DNA, 17 bp, Homo sapiens
caggctccatgcacctc

SEQ ID NO: 2680838 - DNA, 19 bp, Homo sapiens
caggctgagagccagatgc

SEQ ID NO: 2680839 - DNA, 23 bp, Homo sapiens
caggcttcctgggtcctgcctgg

SEQ ID NO: 2680840 - DNA, 15 bp, Homo sapiens
cagggaaggctaagc

SEQ ID NO: 2680841 - DNA, 21 bp, Homo sapiens
cagggaaggctaagcatggcc

SEQ ID NO: 2680842 - DNA, 21 bp, Homo sapiens
cagggacaaaacactgtgtcc

SEQ ID NO: 2680843 - DNA, 21 bp, Homo sapiens
cagggaggaggtggcagccct

SEQ ID NO: 2680844 - DNA, 16 bp, Homo sapiens
cagggccaaagcacag

SEQ ID NO: 2680845 - DNA, 18 bp, Homo sapiens
cagggccaaagcacagct

SEQ ID NO: 2680846 - DNA, 23 bp, Homo sapiens
cagggccaaagcacagctgggca

SEQ ID NO: 2680847 - DNA, 12 bp, Homo sapiens
cagggccagggc

SEQ ID NO: 2680848 - DNA, 13 bp, Homo sapiens
cagggccagggcc

SEQ ID NO: 2680849 - DNA, 14 bp, Homo sapiens
cagggcccagcagg

SEQ ID NO: 2680850 - DNA, 18 bp, Homo sapiens
cagggccctgcagagggg

SEQ ID NO: 2680851 - DNA, 12 bp, Homo sapiens
cagggctgggcc

SEQ ID NO: 2680852 - DNA, 21 bp, Homo sapiens
caggggcaaggggctggctgg

SEQ ID NO: 2680853 - DNA, 18 bp, Homo sapiens
caggggtcctgcaggtcc

SEQ ID NO: 2680854 - DNA, 15 bp, Homo sapiens
cagggttttgtattc

SEQ ID NO: 2680855 - DNA, 17 bp, Homo sapiens
caggtcctggtgggtca

SEQ ID NO: 2680856 - DNA, 20 bp, Homo sapiens
caggtcctggtgggtcagcc

SEQ ID NO: 2680857 - DNA, 22 bp, Homo sapiens
caggtcctggtgggtcagccca

SEQ ID NO: 2680858 - DNA, 16 bp, Homo sapiens
ccatgaatcaaagaca

SEQ ID NO: 2680859 - DNA, 21 bp, Homo sapiens
ccatgatcgagccactgcact

SEQ ID NO: 2680860 - DNA, 15 bp, Homo sapiens
ccatgcacctccctt

SEQ ID NO: 2680861 - DNA, 17 bp, Homo sapiens
ccatggagacaagaagg

SEQ ID NO: 2680862 - DNA, 17 bp, Homo sapiens
ccatggcctctggccag

SEQ ID NO: 2680863 - DNA, 17 bp, Homo sapiens
ccatgtggccccaggtg

SEQ ID NO: 2680864 - DNA, 16 bp, Homo sapiens
ccattagagtcagcct

SEQ ID NO: 2680865 - DNA, 14 bp, Homo sapiens
ccattcacttcccc

SEQ ID NO: 2680866 - DNA, 14 bp, Homo sapiens
ccattgaccagctc

SEQ ID NO: 2680867 - DNA, 16 bp, Homo sapiens
ccattgaccagctctc

SEQ ID NO: 2680868 - DNA, 18 bp, Homo sapiens
ccattgaccagctctctt

SEQ ID NO: 2680869 - DNA, 23 bp, Homo sapiens
ccattgaccagctctcttcctgt

SEQ ID NO: 2680870 - DNA, 21 bp, Homo sapiens
ccattgtcttccaaccccagc

SEQ ID NO: 2680871 - DNA, 16 bp, Homo sapiens
cccaaatttccctggg

SEQ ID NO: 2680872 - DNA, 16 bp, Homo sapiens
cccaactgatcctgct

SEQ ID NO: 2680873 - DNA, 17 bp, Homo sapiens
cccaactgatcctgctc

SEQ ID NO: 2680874 - DNA, 22 bp, Homo sapiens
cccaactgatcctgctccagca

SEQ ID NO: 2680875 - DNA, 22 bp, Homo sapiens
cccaagactgtcattgcccctc

SEQ ID NO: 2680876 - DNA, 20 bp, Homo sapiens
cccaaggagccattctgtgt

SEQ ID NO: 2680877 - DNA, 15 bp, Homo sapiens
cccaaggtccccgtg

SEQ ID NO: 2680878 - DNA, 13 bp, Homo sapiens
cccacaccgctgg

SEQ ID NO: 2680879 - DNA, 15 bp, Homo sapiens
cccacaccgctggtc

SEQ ID NO: 2680880 - DNA, 18 bp, Homo sapiens
cccacatgaggacatgat

SEQ ID NO: 2680881 - DNA, 22 bp, Homo sapiens
cccaccctcgtggacacctgcc

SEQ ID NO: 2680882 - DNA, 15 bp, Homo sapiens
cccacctccccctcc

SEQ ID NO: 2680883 - DNA, 17 bp, Homo sapiens
cccacgaacgctcttag

SEQ ID NO: 2680884 - DNA, 13 bp, Homo sapiens
cccacgtctgtcc

SEQ ID NO: 2680885 - DNA, 21 bp, Homo sapiens
cccacgtctgtcctcctttct

SEQ ID NO: 2680886 - DNA, 12 bp, Homo sapiens
cccactgaccca

SEQ ID NO: 2680887 - DNA, 21 bp, Homo sapiens
cccagagagaggggcctgcag

SEQ ID NO: 2680888 - DNA, 13 bp, Homo sapiens
cccagagggccca

SEQ ID NO: 2680889 - DNA, 14 bp, Homo sapiens
cccagagggcccag

SEQ ID NO: 2680890 - DNA, 23 bp, Homo sapiens
cccagagggcccaggcaggccac

SEQ ID NO: 2680891 - DNA, 13 bp, Homo sapiens
cccagcacctgct

SEQ ID NO: 2680892 - DNA, 15 bp, Homo sapiens
cccagcacctgctcc

SEQ ID NO: 2680893 - DNA, 21 bp, Homo sapiens
cccagcatccttttctgcaga

SEQ ID NO: 2680894 - DNA, 19 bp, Homo sapiens
cccagccattaccatggag

SEQ ID NO: 2680895 - DNA, 22 bp, Homo sapiens
cccagccattaccatggagaca

SEQ ID NO: 2680896 - DNA, 21 bp, Homo sapiens
cccagcgcctgtgctgaggac

SEQ ID NO: 2680897 - DNA, 22 bp, Homo sapiens
cccagctactcagaagcctgag

SEQ ID NO: 2680898 - DNA, 16 bp, Homo sapiens
cccagctattttctga

SEQ ID NO: 2680899 - DNA, 22 bp, Homo sapiens
cccagctattttctgaccaaaa

SEQ ID NO: 2680900 - DNA, 21 bp, Homo sapiens
ccgccctccgtcgggcccctg

SEQ ID NO: 2680901 - DNA, 22 bp, Homo sapiens
ccgcctccccatacttcctggg

SEQ ID NO: 2680902 - DNA, 23 bp, Homo sapiens
ccgcctccccatacttcctggga

SEQ ID NO: 2680903 - DNA, 14 bp, Homo sapiens
ccgcgtccctgccc

SEQ ID NO: 2680904 - DNA, 16 bp, Homo sapiens
ccgcgtccctgccccg

SEQ ID NO: 2680905 - DNA, 14 bp, Homo sapiens
ccgctctggaccaa

SEQ ID NO: 2680906 - DNA, 22 bp, Homo sapiens
ccgcttgctctcctggagcaag

SEQ ID NO: 2680907 - DNA, 20 bp, Homo sapiens
ccggggaccttgtgggacca

SEQ ID NO: 2680908 - DNA, 17 bp, Homo sapiens
ccggggctgctggcctg

SEQ ID NO: 2680909 - DNA, 20 bp, Homo sapiens
ccgggtctggtgctgaggat

SEQ ID NO: 2680910 - DNA, 23 bp, Homo sapiens
ccgtcgggcccctgcctgccttc

SEQ ID NO: 2680911 - DNA, 18 bp, Homo sapiens
ccgtggatggtctccacc

SEQ ID NO: 2680912 - DNA, 17 bp, Homo sapiens
ccgtgggcagaatgact

SEQ ID NO: 2680913 - DNA, 21 bp, Homo sapiens
ccgtgggcagaatgactttta

SEQ ID NO: 2680914 - DNA, 21 bp, Homo sapiens
ccgtggggctcccggcatcct

SEQ ID NO: 2680915 - DNA, 21 bp, Homo sapiens
ccgtggtggcaccgagaccaa

SEQ ID NO: 2680916 - DNA, 13 bp, Homo sapiens
ccgtgtgcctcct

SEQ ID NO: 2680917 - DNA, 18 bp, Homo sapiens
ccgtgtgcctcctgtgtg

SEQ ID NO: 2680918 - DNA, 13 bp, Homo sapiens
cctacccactctt

SEQ ID NO: 2680919 - DNA, 16 bp, Homo sapiens
cctacccactctttgc

SEQ ID NO: 2680920 - DNA, 17 bp, Homo sapiens
cctacccagctgatggg

SEQ ID NO: 2680921 - DNA, 12 bp, Homo sapiens
cctacctcagcc

SEQ ID NO: 2680922 - DNA, 21 bp, Homo sapiens
cctacctcagcctagaccctc

SEQ ID NO: 2680923 - DNA, 18 bp, Homo sapiens
cctacgggcgctgcagcc

SEQ ID NO: 2680924 - DNA, 19 bp, Homo sapiens
cctacgggcgctgcagcct

SEQ ID NO: 2680925 - DNA, 20 bp, Homo sapiens
cctacgggcgctgcagcctc

SEQ ID NO: 2680926 - DNA, 21 bp, Homo sapiens
cctacgggcgctgcagcctcc

SEQ ID NO: 2680927 - DNA, 19 bp, Homo sapiens
cctagaagtctccctgcac

SEQ ID NO: 2680928 - DNA, 17 bp, Homo sapiens
cctagagctcctgtccc

SEQ ID NO: 2680929 - DNA, 13 bp, Homo sapiens
cctatagtcccag

SEQ ID NO: 2680930 - DNA, 15 bp, Homo sapiens
cctatgatcccagca

SEQ ID NO: 2680931 - DNA, 19 bp, Homo sapiens
cctcaaatgacccaaagac

SEQ ID NO: 2680932 - DNA, 23 bp, Homo sapiens
cctcacgcaactcacacctcctt

SEQ ID NO: 2680933 - DNA, 14 bp, Homo sapiens
cctcacttctgtct

SEQ ID NO: 2680934 - DNA, 15 bp, Homo sapiens
cctcacttctgtctc

SEQ ID NO: 2680935 - DNA, 16 bp, Homo sapiens
cctcacttctgtctcc

SEQ ID NO: 2680936 - DNA, 18 bp, Homo sapiens
cctcacttctgtctcctg

SEQ ID NO: 2680937 - DNA, 19 bp, Homo sapiens
cctcacttctgtctcctgt

SEQ ID NO: 2680938 - DNA, 16 bp, Homo sapiens
cctcagagcagggcca

SEQ ID NO: 2680939 - DNA, 18 bp, Homo sapiens
cctcagcattgtcagcct

SEQ ID NO: 2680940 - DNA, 19 bp, Homo sapiens
cctcagcattgtcagcctg

SEQ ID NO: 2680941 - DNA, 23 bp, Homo sapiens
cctcagccccactgacacccagt

SEQ ID NO: 2680942 - DNA, 16 bp, Homo sapiens
cctcagcctagaccct

SEQ ID NO: 2680943 - DNA, 19 bp, Homo sapiens
cctcagcctagaccctcct

SEQ ID NO: 2680944 - DNA, 21 bp, Homo sapiens
cctcaggccaggtgcagtggc

SEQ ID NO: 2680945 - DNA, 13 bp, Homo sapiens
cctcagggcccag

SEQ ID NO: 2680946 - DNA, 16 bp, Homo sapiens
cctccacagccgcagc

SEQ ID NO: 2680947 - DNA, 17 bp, Homo sapiens
cctccacagccgcagcc

SEQ ID NO: 2680948 - DNA, 19 bp, Homo sapiens
cctccacgcaaggctgtgc

SEQ ID NO: 2680949 - DNA, 22 bp, Homo sapiens
cctccaggagaaggggcccaag

SEQ ID NO: 2680950 - DNA, 11 bp, Homo sapiens
cctccaggcct

SEQ ID NO: 2680951 - DNA, 15 bp, Homo sapiens
cctccaggcctgcag

SEQ ID NO: 2680952 - DNA, 16 bp, Homo sapiens
cctccaggcctgcagg

SEQ ID NO: 2680953 - DNA, 13 bp, Homo sapiens
cctccatggcctg

SEQ ID NO: 2680954 - DNA, 14 bp, Homo sapiens
cctccatgtggccc

SEQ ID NO: 2680955 - DNA, 22 bp, Homo sapiens
cctccatttctctccaggaagt

SEQ ID NO: 2680956 - DNA, 15 bp, Homo sapiens
cctcccaaggagcca

SEQ ID NO: 2680957 - DNA, 19 bp, Homo sapiens
cctcccaaggagccattct

SEQ ID NO: 2680958 - DNA, 13 bp, Homo sapiens
cctcccaggaacc

SEQ ID NO: 2680959 - DNA, 13 bp, Homo sapiens
cctcccagtggcc

SEQ ID NO: 2680960 - DNA, 20 bp, Homo sapiens
cctccccattagagtcagcc

SEQ ID NO: 2680961 - DNA, 15 bp, Homo sapiens
cctccccggccacat

SEQ ID NO: 2680962 - DNA, 14 bp, Homo sapiens
cctcccctgctccc

SEQ ID NO: 2680963 - DNA, 17 bp, Homo sapiens
cctccccttttgccccc

SEQ ID NO: 2680964 - DNA, 14 bp, Homo sapiens
cctccctctgacct

SEQ ID NO: 2680965 - DNA, 14 bp, Homo sapiens
cctccctgcagact

SEQ ID NO: 2680966 - DNA, 16 bp, Homo sapiens
cctccctttctctctc

SEQ ID NO: 2680967 - DNA, 16 bp, Homo sapiens
cctccgatgctgaggc

SEQ ID NO: 2680968 - DNA, 23 bp, Homo sapiens
cctccgatgctgaggccacccac

SEQ ID NO: 2680969 - DNA, 19 bp, Homo sapiens
cctccgccttcactccggt

SEQ ID NO: 2680970 - DNA, 15 bp, Homo sapiens
cctccgtcgggcccc

SEQ ID NO: 2680971 - DNA, 22 bp, Homo sapiens
cctcctgctctgcttcctcagg

SEQ ID NO: 2680972 - DNA, 20 bp, Homo sapiens
cctccttccttgctgtccta

SEQ ID NO: 2680973 - DNA, 17 bp, Homo sapiens
tgtaactggctgctccc

SEQ ID NO: 2680974 - DNA, 18 bp, Homo sapiens
tgtaactggctgctccct

SEQ ID NO: 2680975 - DNA, 22 bp, Homo sapiens
tgtaactggctgctccctgctc

SEQ ID NO: 2680976 - DNA, 23 bp, Homo sapiens
tgtaagagagatgagcacttcta

SEQ ID NO: 2680977 - DNA, 22 bp, Homo sapiens
tgtaataaacccttaactggca

SEQ ID NO: 2680978 - DNA, 19 bp, Homo sapiens
tgtacaattactaaattgt

SEQ ID NO: 2680979 - DNA, 22 bp, Homo sapiens
tgtacaattactaaattgtata

SEQ ID NO: 2680980 - DNA, 12 bp, Homo sapiens
tgtacacagact

SEQ ID NO: 2680981 - DNA, 19 bp, Homo sapiens
tgtactataacatagaatt

SEQ ID NO: 2680982 - DNA, 12 bp, Homo sapiens
tgtactgataaa

SEQ ID NO: 2680983 - DNA, 23 bp, Homo sapiens
tgtagaaacacagttttgaaaga

SEQ ID NO: 2680984 - DNA, 16 bp, Homo sapiens
tgtagcatcttctgga

SEQ ID NO: 2680985 - DNA, 13 bp, Homo sapiens
tgtagctgatgaa

SEQ ID NO: 2680986 - DNA, 21 bp, Homo sapiens
tgtataaataataaagaactc

SEQ ID NO: 2680987 - DNA, 21 bp, Homo sapiens
tgtatacattttgttatagaa

SEQ ID NO: 2680988 - DNA, 22 bp, Homo sapiens
tgtatacattttgttatagaat

SEQ ID NO: 2680989 - DNA, 17 bp, Homo sapiens
tgtatatgtatatctat

SEQ ID NO: 2680990 - DNA, 14 bp, Homo sapiens
tgtatgttaaagca

SEQ ID NO: 2680991 - DNA, 18 bp, Homo sapiens
tgtattatttcaccagca

SEQ ID NO: 2680992 - DNA, 18 bp, Homo sapiens
tgtattgttgtaaaatgt

SEQ ID NO: 2680993 - DNA, 19 bp, Homo sapiens
tgtcaagtacaagcaagac

SEQ ID NO: 2680994 - DNA, 21 bp, Homo sapiens
tgtcagcctgaagatcagagc

SEQ ID NO: 2680995 - DNA, 19 bp, Homo sapiens
tgtcagggcagtacaatgt

SEQ ID NO: 2680996 - DNA, 15 bp, Homo sapiens
tgtcataaggcggcg

SEQ ID NO: 2680997 - DNA, 18 bp, Homo sapiens
tgtccagaccattgtctt

SEQ ID NO: 2680998 - DNA, 21 bp, Homo sapiens
tgtccagaccattgtcttcca

SEQ ID NO: 2680999 - DNA, 13 bp, Homo sapiens
tgtccagtttcca

SEQ ID NO: 2681000 - DNA, 22 bp, Homo sapiens
tgtcccacctcttctcttcctg

SEQ ID NO: 2681001 - DNA, 23 bp, Homo sapiens
tgtcccacctcttctcttcctgt

SEQ ID NO: 2681002 - DNA, 12 bp, Homo sapiens
tgtccctaccca

SEQ ID NO: 2681003 - DNA, 15 bp, Homo sapiens
tgtccctacccactc

SEQ ID NO: 2681004 - DNA, 15 bp, Homo sapiens
tgtccctccttgagc

SEQ ID NO: 2681005 - DNA, 22 bp, Homo sapiens
tgtccgtttgagtgtctgcgcc

SEQ ID NO: 2681006 - DNA, 13 bp, Homo sapiens
tgtcctcccagga

SEQ ID NO: 2681007 - DNA, 14 bp, Homo sapiens
tgtcctcccaggaa

SEQ ID NO: 2681008 - DNA, 11 bp, Homo sapiens
tgtcctcctgc

SEQ ID NO: 2681009 - DNA, 13 bp, Homo sapiens
tgtcctcctgctc

SEQ ID NO: 2681010 - DNA, 21 bp, Homo sapiens
tgtcctcctgctctgcttcct

SEQ ID NO: 2681011 - DNA, 16 bp, Homo sapiens
tgtcctgctagctgtc

SEQ ID NO: 2681012 - DNA, 23 bp, Homo sapiens
tgtcggagcaagtttcatcagcc

SEQ ID NO: 2681013 - DNA, 21 bp, Homo sapiens
tgtctccccgaaagggacaca

SEQ ID NO: 2681014 - DNA, 17 bp, Homo sapiens
tgtctccctctttctca

SEQ ID NO: 2681015 - DNA, 14 bp, Homo sapiens
tgtctctcttgttg

SEQ ID NO: 2681016 - DNA, 14 bp, Homo sapiens
tgtctcttgtagaa

SEQ ID NO: 2681017 - DNA, 20 bp, Homo sapiens
tgtctgaacaatctccaaaa

SEQ ID NO: 2681018 - DNA, 22 bp, Homo sapiens
tgtctggggagggtcaagggct

SEQ ID NO: 2681019 - DNA, 22 bp, Homo sapiens
tgtcttcctagtatattagttt

SEQ ID NO: 2681020 - DNA, 19 bp, Homo sapiens
tgtctttgttgtctccctc

SEQ ID NO: 2681021 - DNA, 21 bp, Homo sapiens
tgtgaaagtcagatgcccaga

SEQ ID NO: 2681022 - DNA, 22 bp, Homo sapiens
tgtgaaagtcagatgcccagag

SEQ ID NO: 2681023 - DNA, 19 bp, Homo sapiens
tgtgaaattcaacctgtgt

SEQ ID NO: 2681024 - DNA, 19 bp, Homo sapiens
tgtgaccctgagggctcct

SEQ ID NO: 2681025 - DNA, 20 bp, Homo sapiens
tgtgaccctgagggctcctc

SEQ ID NO: 2681026 - DNA, 13 bp, Homo sapiens
tgtgactttgaaa

SEQ ID NO: 2681027 - DNA, 21 bp, Homo sapiens
tgtgagagccacgctggcctt

SEQ ID NO: 2681028 - DNA, 18 bp, Homo sapiens
tgtgatcccaagtgccag

SEQ ID NO: 2681029 - DNA, 23 bp, Homo sapiens
tgtgatcccaagtgccagtcttg

SEQ ID NO: 2681030 - DNA, 12 bp, Homo sapiens
tgtgcagtgctg

SEQ ID NO: 2681031 - DNA, 12 bp, Homo sapiens
tgtgcctcctgt

SEQ ID NO: 2681032 - DNA, 13 bp, Homo sapiens
tgtgcctcctgtg

SEQ ID NO: 2681033 - DNA, 22 bp, Homo sapiens
tgtgcctcctgtgtgtctgcag

SEQ ID NO: 2681034 - DNA, 16 bp, Homo sapiens
tgtgctctttgaagag

SEQ ID NO: 2681035 - DNA, 14 bp, Homo sapiens
tgtgcttggaacca

SEQ ID NO: 2681036 - DNA, 16 bp, Homo sapiens
tgtgcttggaaccagt

SEQ ID NO: 2681037 - DNA, 15 bp, Homo sapiens
tgtggccccaggtgc

SEQ ID NO: 2681038 - DNA, 12 bp, Homo sapiens
tgtggggccttg

SEQ ID NO: 2681039 - DNA, 16 bp, Homo sapiens
tgtgtactgataaaat

SEQ ID NO: 2681040 - DNA, 17 bp, Homo sapiens
tgtgtactgataaaata

SEQ ID NO: 2681041 - DNA, 20 bp, Homo sapiens
tgtgtagggcttttttttga

SEQ ID NO: 2681042 - DNA, 13 bp, Homo sapiens
tgtgtcctcctgc

SEQ ID NO: 2681043 - DNA, 15 bp, Homo sapiens
tgtgtcctcctgctc

SEQ ID NO: 2681044 - DNA, 17 bp, Homo sapiens
tgtgtcctcctgctctg

SEQ ID NO: 2681045 - DNA, 21 bp, Homo sapiens
tgtgtcctcctgctctgcttc

SEQ ID NO: 2681046 - DNA, 20 bp, Homo sapiens
tgtgtctgcattgttattgt

SEQ ID NO: 2681047 - DNA, 14 bp, Homo sapiens
tgtgtgaaacctga

SEQ ID NO: 2681048 - DNA, 21 bp, Homo sapiens
tgtgtgtccgtttgagtgtct

SEQ ID NO: 2681049 - DNA, 16 bp, Homo sapiens
tgtgttaaacatgcta

SEQ ID NO: 2681050 - DNA, 17 bp, Homo sapiens
tgtgttaaacatgctaa

SEQ ID NO: 2681051 - DNA, 20 bp, Homo sapiens
tgtgttaaacatgctaaata

SEQ ID NO: 2681052 - DNA, 20 bp, Homo sapiens
tgtgttcactaaactctgaa

SEQ ID NO: 2681053 - DNA, 22 bp, Homo sapiens
tgtgtttcataacaaaccatct

SEQ ID NO: 2681054 - DNA, 22 bp, Homo sapiens
tgttactaaagtcacatataaa

SEQ ID NO: 2681055 - DNA, 13 bp, Homo sapiens
tgttattgtggaa

SEQ ID NO: 2681056 - DNA, 14 bp, Homo sapiens
tgttattgtggaag

SEQ ID NO: 2681057 - DNA, 21 bp, Homo sapiens
tgttattttttatttccacat

SEQ ID NO: 2681058 - DNA, 15 bp, Homo sapiens
tgttcactaaactct

SEQ ID NO: 2681059 - DNA, 18 bp, Homo sapiens
tgttcattttagtgactg

SEQ ID NO: 2681060 - DNA, 15 bp, Homo sapiens
tgttccgtgccaggc

SEQ ID NO: 2681061 - DNA, 15 bp, Homo sapiens
tgttctcgttttgaa

SEQ ID NO: 2681062 - DNA, 18 bp, Homo sapiens
tgttctctttgctgacac

SEQ ID NO: 2681063 - DNA, 19 bp, Homo sapiens
ttgcctttttacagccaac

SEQ ID NO: 2681064 - DNA, 13 bp, Homo sapiens
ttgctacaataaa

SEQ ID NO: 2681065 - DNA, 14 bp, Homo sapiens
ttgctacaataaat

SEQ ID NO: 2681066 - DNA, 15 bp, Homo sapiens
ttgctacaataaatg

SEQ ID NO: 2681067 - DNA, 16 bp, Homo sapiens
ttgctagacagccagg

SEQ ID NO: 2681068 - DNA, 17 bp, Homo sapiens
ttgctaggagccccagc

SEQ ID NO: 2681069 - DNA, 22 bp, Homo sapiens
ttgctctcctggagcaagctct

SEQ ID NO: 2681070 - DNA, 12 bp, Homo sapiens
ttgctctctgag

SEQ ID NO: 2681071 - DNA, 16 bp, Homo sapiens
ttgctcttggaaagct

SEQ ID NO: 2681072 - DNA, 21 bp, Homo sapiens
ttgctgatggcccctccagca

SEQ ID NO: 2681073 - DNA, 22 bp, Homo sapiens
ttgctgatggcccctccagcac

SEQ ID NO: 2681074 - DNA, 11 bp, Homo sapiens
ttgctgtccta

SEQ ID NO: 2681075 - DNA, 21 bp, Homo sapiens
ttgctgttgatgaggcctctt

SEQ ID NO: 2681076 - DNA, 14 bp, Homo sapiens
ttgcttaaaagaca

SEQ ID NO: 2681077 - DNA, 16 bp, Homo sapiens
ttggaaagctgatgat

SEQ ID NO: 2681078 - DNA, 17 bp, Homo sapiens
ttggacctctgctctga

SEQ ID NO: 2681079 - DNA, 18 bp, Homo sapiens
ttggacctctgctctgag

SEQ ID NO: 2681080 - DNA, 13 bp, Homo sapiens
ttggagactctgt

SEQ ID NO: 2681081 - DNA, 14 bp, Homo sapiens
ttggctctttcaga

SEQ ID NO: 2681082 - DNA, 19 bp, Homo sapiens
ttgggaggctgaggcagga

SEQ ID NO: 2681083 - DNA, 15 bp, Homo sapiens
ttggggtgcttcctt

SEQ ID NO: 2681084 - DNA, 21 bp, Homo sapiens
ttgtaattaataatagattgt

SEQ ID NO: 2681085 - DNA, 16 bp, Homo sapiens
ttgtacaaagatatgc

SEQ ID NO: 2681086 - DNA, 12 bp, Homo sapiens
ttgtatgttaaa

SEQ ID NO: 2681087 - DNA, 19 bp, Homo sapiens
ttgtattatttcaccagca

SEQ ID NO: 2681088 - DNA, 14 bp, Homo sapiens
ttgtcctcccagga

SEQ ID NO: 2681089 - DNA, 19 bp, Homo sapiens
ttgtcttccaaccccagct

SEQ ID NO: 2681090 - DNA, 14 bp, Homo sapiens
ttgtggtaaaaaga

SEQ ID NO: 2681091 - DNA, 22 bp, Homo sapiens
ttgtgtgttcactaaactctga

SEQ ID NO: 2681092 - DNA, 14 bp, Homo sapiens
ttgttagttttaag

SEQ ID NO: 2681093 - DNA, 16 bp, Homo sapiens
ttgtttctccccctgg

SEQ ID NO: 2681094 - DNA, 21 bp, Homo sapiens
ttgtttgtttctccccctggg

SEQ ID NO: 2681095 - DNA, 13 bp, Homo sapiens
ttgtttttctgat

SEQ ID NO: 2681096 - DNA, 18 bp, Homo sapiens
tttaaaaaaagtatatat

SEQ ID NO: 2681097 - DNA, 16 bp, Homo sapiens
tttaaaaaactttcta

SEQ ID NO: 2681098 - DNA, 19 bp, Homo sapiens
tttaaaaaactttctactc

SEQ ID NO: 2681099 - DNA, 21 bp, Homo sapiens
tttaaaggtttctattttctc

SEQ ID NO: 2681100 - DNA, 17 bp, Homo sapiens
tttaaatataaatgttt

SEQ ID NO: 2681101 - DNA, 23 bp, Homo sapiens
tttaagccctgctctttctctga

SEQ ID NO: 2681102 - DNA, 21 bp, Homo sapiens
tttaatatctgagaagtgtat

SEQ ID NO: 2681103 - DNA, 20 bp, Homo sapiens
tttacaagacaacattgtaa

SEQ ID NO: 2681104 - DNA, 16 bp, Homo sapiens
tttacatatttacctg

SEQ ID NO: 2681105 - DNA, 22 bp, Homo sapiens
tttactctgctctatgccaggc

SEQ ID NO: 2681106 - DNA, 14 bp, Homo sapiens
tttactgacagaaa

SEQ ID NO: 2681107 - DNA, 15 bp, Homo sapiens
tttactgacagaaat

SEQ ID NO: 2681108 - DNA, 11 bp, Homo sapiens
tttagccagtg

SEQ ID NO: 2681109 - DNA, 13 bp, Homo sapiens
tttagccagtgac

SEQ ID NO: 2681110 - DNA, 18 bp, Homo sapiens
tttatttccacataaagg

SEQ ID NO: 2681111 - DNA, 15 bp, Homo sapiens
tttatttgtgaaact

SEQ ID NO: 2681112 - DNA, 23 bp, Homo sapiens
tttcaacaagaatattgtatgtt

SEQ ID NO: 2681113 - DNA, 16 bp, Homo sapiens
tttcaactcattgcat

SEQ ID NO: 2681114 - DNA, 13 bp, Homo sapiens
tttcaccagcagc

SEQ ID NO: 2681115 - DNA, 23 bp, Homo sapiens
tttcagctattagcaactgtgct

SEQ ID NO: 2681116 - DNA, 14 bp, Homo sapiens
tttcatcagcccta

SEQ ID NO: 2681117 - DNA, 19 bp, Homo sapiens
tttccattgaccagctctc

SEQ ID NO: 2681118 - DNA, 21 bp, Homo sapiens
tttctagtttcagtaaataat

SEQ ID NO: 2681119 - DNA, 14 bp, Homo sapiens
tttcttctagcttt

SEQ ID NO: 2681120 - DNA, 12 bp, Homo sapiens
tttcttctctgc

SEQ ID NO: 2681121 - DNA, 13 bp, Homo sapiens
tttcttctctgcc

SEQ ID NO: 2681122 - DNA, 17 bp, Homo sapiens
tttcttctctgcctcct

SEQ ID NO: 2681123 - DNA, 21 bp, Homo sapiens
tttgaaacatgcttgtgtttc

SEQ ID NO: 2681124 - DNA, 21 bp, Homo sapiens
tttgaaatcagtaaacactgt

SEQ ID NO: 2681125 - DNA, 14 bp, Homo sapiens
tttgagccctggac

SEQ ID NO: 2681126 - DNA, 13 bp, Homo sapiens
tttgcactgtttt

SEQ ID NO: 2681127 - DNA, 16 bp, Homo sapiens
tttgcattagacagat

SEQ ID NO: 2681128 - DNA, 18 bp, Homo sapiens
tttgctaggagccccagc

SEQ ID NO: 2681129 - DNA, 15 bp, Homo sapiens
tttggctctttcaga

SEQ ID NO: 2681130 - DNA, 19 bp, Homo sapiens
tttggggattcagatttct

SEQ ID NO: 2681131 - DNA, 17 bp, Homo sapiens
tttgtacaagattgtca

SEQ ID NO: 2681132 - DNA, 21 bp, Homo sapiens
tttgtattctttactaaagat

SEQ ID NO: 2681133 - DNA, 19 bp, Homo sapiens
tttgtggtaaaaagattat

SEQ ID NO: 2681134 - DNA, 16 bp, Homo sapiens
tttgttgtcctcccag

SEQ ID NO: 2681135 - DNA, 14 bp, Homo sapiens
ttttaatgtacaag

SEQ ID NO: 2681136 - DNA, 14 bp, Homo sapiens
ttttactgacagaa

SEQ ID NO: 2681137 - DNA, 15 bp, Homo sapiens
ttttcacatccttga

SEQ ID NO: 2681138 - DNA, 20 bp, Homo sapiens
ttttcagctattagcaactg

SEQ ID NO: 2681139 - DNA, 15 bp, Homo sapiens
ttttccaccctggaa

SEQ ID NO: 2681140 - DNA, 19 bp, Homo sapiens
ttttccattgaccagctct

SEQ ID NO: 2681141 - DNA, 20 bp, Homo sapiens
ttttctagtttcagtaaata

SEQ ID NO: 2681142 - DNA, 16 bp, Homo sapiens
ttttctgaatcttctg

SEQ ID NO: 2681143 - DNA, 12 bp, Homo sapiens
ttttctgaccaa

SEQ ID NO: 2681144 - DNA, 15 bp, Homo sapiens
ttttgaaagaaaaat

SEQ ID NO: 2681145 - DNA, 22 bp, Homo sapiens
ttttgaaatcagtaaacactgt

SEQ ID NO: 2681146 - DNA, 18 bp, Homo sapiens
ttttggggggtaatcagc

SEQ ID NO: 2681147 - DNA, 12 bp, Homo sapiens
ttttgtaaaaag

SEQ ID NO: 2681148 - DNA, 21 bp, Homo sapiens
ttttgtattacatctaatgct

SEQ ID NO: 2681149 - DNA, 20 bp, Homo sapiens
ttttgtattatttcaccagc

SEQ ID NO: 2681150 - DNA, 20 bp, Homo sapiens
tttttccccccaccccccag

SEQ ID NO: 2681151 - DNA, 13 bp, Homo sapiens
tttttgtaaactg

SEQ ID NO: 2681152 - DNA, 14 bp, Homo sapiens
tttttgtaaactgt

SEQ ID NO: 2681153 - DNA, 13 bp, Homo sapiens
ttttttatttcca

SEQ ID NO: 2681154 - DNA, 20 bp, Homo sapiens
ctgcgtcaggcacgtctcct

SEQ ID NO: 2681155 - DNA, 14 bp, Homo sapiens
ctgctcattccgag

SEQ ID NO: 2681156 - DNA, 18 bp, Homo sapiens
ctgctccagcagcacacc

SEQ ID NO: 2681157 - DNA, 14 bp, Homo sapiens
ctgctccctgctcc

SEQ ID NO: 2681158 - DNA, 16 bp, Homo sapiens
ctgctccctgctccca

SEQ ID NO: 2681159 - DNA, 18 bp, Homo sapiens
ctgctccctgctcccagg

SEQ ID NO: 2681160 - DNA, 14 bp, Homo sapiens
ctgctcgaagaaca

SEQ ID NO: 2681161 - DNA, 16 bp, Homo sapiens
ctgctcgaagaacaat

SEQ ID NO: 2681162 - DNA, 17 bp, Homo sapiens
ctgctctatgccaggct

SEQ ID NO: 2681163 - DNA, 19 bp, Homo sapiens
ctgctctgaggcttccaga

SEQ ID NO: 2681164 - DNA, 22 bp, Homo sapiens
ctgctctgtagccacctccttg

SEQ ID NO: 2681165 - DNA, 24 bp, Homo sapiens
ctgctctgtagccacctccttggc

SEQ ID NO: 2681166 - DNA, 22 bp, Homo sapiens
ctgctgccatggcgtgtccctc

SEQ ID NO: 2681167 - DNA, 18 bp, Homo sapiens
ctgctgcgggggagccag

SEQ ID NO: 2681168 - DNA, 23 bp, Homo sapiens
ctgctgcgggggagccagttctg

SEQ ID NO: 2681169 - DNA, 22 bp, Homo sapiens
ctgctggcaggattcttcccgc

SEQ ID NO: 2681170 - DNA, 12 bp, Homo sapiens
ctgctggcctgg

SEQ ID NO: 2681171 - DNA, 16 bp, Homo sapiens
ctgctggcctggccct

SEQ ID NO: 2681172 - DNA, 17 bp, Homo sapiens
ctgctggcctggccctt

SEQ ID NO: 2681173 - DNA, 23 bp, Homo sapiens
ctgctgttaattgattaaaatct

SEQ ID NO: 2681174 - DNA, 13 bp, Homo sapiens
ctgcttcctcagg

SEQ ID NO: 2681175 - DNA, 10 bp, Homo sapiens
ctgcttcctg

SEQ ID NO: 2681176 - DNA, 11 bp, Homo sapiens
ctgcttcctga

SEQ ID NO: 2681177 - DNA, 17 bp, Homo sapiens
ctgcttcctgaaagctg

SEQ ID NO: 2681178 - DNA, 18 bp, Homo sapiens
ctgcttcctgaaagctgt

SEQ ID NO: 2681179 - DNA, 20 bp, Homo sapiens
ctgctttcttctctgcctcc

SEQ ID NO: 2681180 - DNA, 16 bp, Homo sapiens
ctgcttttgcacacct

SEQ ID NO: 2681181 - DNA, 14 bp, Homo sapiens
ctggaaaggctcag

SEQ ID NO: 2681182 - DNA, 15 bp, Homo sapiens
ctggaaaggctcagt

SEQ ID NO: 2681183 - DNA, 23 bp, Homo sapiens
ctggaacatgggcattgggttct

SEQ ID NO: 2681184 - DNA, 13 bp, Homo sapiens
ctggaaccagagg

SEQ ID NO: 2681185 - DNA, 14 bp, Homo sapiens
ctggaaccagaggg

SEQ ID NO: 2681186 - DNA, 12 bp, Homo sapiens
ctggaccccagg

SEQ ID NO: 2681187 - DNA, 15 bp, Homo sapiens
ctggaccccaggctc

SEQ ID NO: 2681188 - DNA, 16 bp, Homo sapiens
ctggaccccaggctct

SEQ ID NO: 2681189 - DNA, 15 bp, Homo sapiens
ctggacggcattcct

SEQ ID NO: 2681190 - DNA, 17 bp, Homo sapiens
ctggacggcattcctgc

SEQ ID NO: 2681191 - DNA, 13 bp, Homo sapiens
ctggactgactgc

SEQ ID NO: 2681192 - DNA, 20 bp, Homo sapiens
ctggacttgagcttggcagc

SEQ ID NO: 2681193 - DNA, 16 bp, Homo sapiens
ctggagcaagctctgc

SEQ ID NO: 2681194 - DNA, 17 bp, Homo sapiens
ctggagcaagctctgcc

SEQ ID NO: 2681195 - DNA, 12 bp, Homo sapiens
ctggagcatctg

SEQ ID NO: 2681196 - DNA, 23 bp, Homo sapiens
ctggagcatctgactcacaagaa

SEQ ID NO: 2681197 - DNA, 15 bp, Homo sapiens
ctggagcccaggagt

SEQ ID NO: 2681198 - DNA, 18 bp, Homo sapiens
ctggaggggcccacccac

SEQ ID NO: 2681199 - DNA, 19 bp, Homo sapiens
ctggaggggcccacccaca

SEQ ID NO: 2681200 - DNA, 16 bp, Homo sapiens
ctggagtctcagagca

SEQ ID NO: 2681201 - DNA, 14 bp, Homo sapiens
ctggagtgcagtgg

SEQ ID NO: 2681202 - DNA, 20 bp, Homo sapiens
ctggatggcatctagccaga

SEQ ID NO: 2681203 - DNA, 22 bp, Homo sapiens
ctggatggcatctagccagagg

SEQ ID NO: 2681204 - DNA, 19 bp, Homo sapiens
ctggattaatgttttgtac

SEQ ID NO: 2681205 - DNA, 19 bp, Homo sapiens
ctggcaaagttatatttac

SEQ ID NO: 2681206 - DNA, 17 bp, Homo sapiens
ctggcaggagcctcgtg

SEQ ID NO: 2681207 - DNA, 21 bp, Homo sapiens
ctggcaggagcctcgtgtcct

SEQ ID NO: 2681208 - DNA, 24 bp, Homo sapiens
ctggcaggagcctcgtgtcctgct

SEQ ID NO: 2681209 - DNA, 17 bp, Homo sapiens
ctggcaggattcttccc

SEQ ID NO: 2681210 - DNA, 18 bp, Homo sapiens
ctggcaggattcttcccg

SEQ ID NO: 2681211 - DNA, 18 bp, Homo sapiens
ctggccagtcctagagct

SEQ ID NO: 2681212 - DNA, 19 bp, Homo sapiens
ctggccagtcctagagctc

SEQ ID NO: 2681213 - DNA, 12 bp, Homo sapiens
ctggccccaccc

SEQ ID NO: 2681214 - DNA, 15 bp, Homo sapiens
ctggcctctagaaca

SEQ ID NO: 2681215 - DNA, 15 bp, Homo sapiens
ctggctgctccctgc

SEQ ID NO: 2681216 - DNA, 16 bp, Homo sapiens
ctggctgctccctgct

SEQ ID NO: 2681217 - DNA, 17 bp, Homo sapiens
ctggctgctccctgctc

SEQ ID NO: 2681218 - DNA, 22 bp, Homo sapiens
ctggctgctccctgctcccagg

SEQ ID NO: 2681219 - DNA, 19 bp, Homo sapiens
ctggctggagtctcagagc

SEQ ID NO: 2681220 - DNA, 22 bp, Homo sapiens
ctggcttatgctcagaagccag

SEQ ID NO: 2681221 - DNA, 20 bp, Homo sapiens
ctggcttctggagcccttgg

SEQ ID NO: 2681222 - DNA, 16 bp, Homo sapiens
ctggcttgtcggagca

SEQ ID NO: 2681223 - DNA, 23 bp, Homo sapiens
ctgggaaaaaagttttgatgaaa

SEQ ID NO: 2681224 - DNA, 13 bp, Homo sapiens
ctgggaacctcct

SEQ ID NO: 2681225 - DNA, 15 bp, Homo sapiens
ctgggacccacctcc

SEQ ID NO: 2681226 - DNA, 19 bp, Homo sapiens
ctgggacccacctccccct

SEQ ID NO: 2681227 - DNA, 13 bp, Homo sapiens
ctgggactggcca

SEQ ID NO: 2681228 - DNA, 14 bp, Homo sapiens
ctgggagaacctca

SEQ ID NO: 2681229 - DNA, 22 bp, Homo sapiens
ctgggatgatgtgtgaaacctg

SEQ ID NO: 2681230 - DNA, 17 bp, Homo sapiens
ctgggatgtagaacttc

SEQ ID NO: 2681231 - DNA, 21 bp, Homo sapiens
ctgggcatgccatgtctgagc

SEQ ID NO: 2681232 - DNA, 14 bp, Homo sapiens
ctgggccaggtctc

SEQ ID NO: 2681233 - DNA, 23 bp, Homo sapiens
ctgggctctgccccagctctggc

SEQ ID NO: 2681234 - DNA, 19 bp, Homo sapiens
ctggggctctgtgcaggga

SEQ ID NO: 2681235 - DNA, 13 bp, Homo sapiens
ctgggggcatcct

SEQ ID NO: 2681236 - DNA, 17 bp, Homo sapiens
ctgggggcatcctgctt

SEQ ID NO: 2681237 - DNA, 20 bp, Homo sapiens
ctgggggcatcctgcttcct

SEQ ID NO: 2681238 - DNA, 22 bp, Homo sapiens
ctgggggcatcctgcttcctga

SEQ ID NO: 2681239 - DNA, 18 bp, Homo sapiens
ctggtatgaacttgagga

SEQ ID NO: 2681240 - DNA, 22 bp, Homo sapiens
ctggtatgaacttgaggacaca

SEQ ID NO: 2681241 - DNA, 15 bp, Homo sapiens
ctggtccctgccctc

SEQ ID NO: 2681242 - DNA, 17 bp, Homo sapiens
ctggtcctccctcccaa

SEQ ID NO: 2681243 - DNA, 19 bp, Homo sapiens
ctggtcctccctcccaagg

SEQ ID NO: 2681244 - DNA, 16 bp, Homo sapiens
ctggtccttccaggcc

SEQ ID NO: 2681245 - DNA, 17 bp, Homo sapiens
ctggtccttccaggccc

SEQ ID NO: 2681246 - DNA, 19 bp, Homo sapiens
ctggtccttccaggccccc

SEQ ID NO: 2681247 - DNA, 19 bp, Homo sapiens
ctggtgcactggccccacc

SEQ ID NO: 2681248 - DNA, 22 bp, Homo sapiens
ctggtgctgaggatacagctct

SEQ ID NO: 2681249 - DNA, 12 bp, Homo sapiens
ctggtggacagt

SEQ ID NO: 2681250 - DNA, 18 bp, Homo sapiens
ctggtggacagtcctggg

SEQ ID NO: 2681251 - DNA, 19 bp, Homo sapiens
ctggtggacagtcctggga

SEQ ID NO: 2681252 - DNA, 21 bp, Homo sapiens
ctggtggacagtcctgggaga

SEQ ID NO: 2681253 - DNA, 16 bp, Homo sapiens
ctggtgggtcagccca

SEQ ID NO: 2681254 - DNA, 19 bp, Homo sapiens
ctggtgggtcagcccagca

SEQ ID NO: 2681255 - DNA, 20 bp, Homo sapiens
ctggtgggtcagcccagcac

SEQ ID NO: 2681256 - DNA, 20 bp, Homo sapiens
ctggtggtcacaggctgtgc

SEQ ID NO: 2681257 - DNA, 19 bp, Homo sapiens
ctgtaacacaagccacaga

SEQ ID NO: 2681258 - DNA, 23 bp, Homo sapiens
ctgtaatcggctcccgcttgctc

SEQ ID NO: 2681259 - DNA, 20 bp, Homo sapiens
ctgtactcaggaggctgagg

SEQ ID NO: 2681260 - DNA, 12 bp, Homo sapiens
ctgtagcatctt

SEQ ID NO: 2681261 - DNA, 18 bp, Homo sapiens
ctgtagcatcttctggag

SEQ ID NO: 2681262 - DNA, 16 bp, Homo sapiens
ctgtagccacctcctt

SEQ ID NO: 2681263 - DNA, 19 bp, Homo sapiens
ctgtagccacctccttggc

SEQ ID NO: 2681264 - DNA, 21 bp, Homo sapiens
ctgtagccacctccttggcac

SEQ ID NO: 2681265 - DNA, 14 bp, Homo sapiens
cctgggtcctgcct

SEQ ID NO: 2681266 - DNA, 16 bp, Homo sapiens
cctggtcctccctccc

SEQ ID NO: 2681267 - DNA, 19 bp, Homo sapiens
cctggtccttccaggcccc

SEQ ID NO: 2681268 - DNA, 14 bp, Homo sapiens
cctggtggacagtc

SEQ ID NO: 2681269 - DNA, 21 bp, Homo sapiens
cctggtgggtcagcccagcac

SEQ ID NO: 2681270 - DNA, 15 bp, Homo sapiens
cctggtggtcacagg

SEQ ID NO: 2681271 - DNA, 18 bp, Homo sapiens
cctgtaacacaagccaca

SEQ ID NO: 2681272 - DNA, 19 bp, Homo sapiens
cctgtaacacaagccacag

SEQ ID NO: 2681273 - DNA, 22 bp, Homo sapiens
cctgtaacacaagccacagaag

SEQ ID NO: 2681274 - DNA, 13 bp, Homo sapiens
cctgtactcagga

SEQ ID NO: 2681275 - DNA, 13 bp, Homo sapiens
cctgtagcatctt

SEQ ID NO: 2681276 - DNA, 21 bp, Homo sapiens
cctgtcagaatcatgctgttc

SEQ ID NO: 2681277 - DNA, 22 bp, Homo sapiens
cctgtcagaatcatgctgttct

SEQ ID NO: 2681278 - DNA, 23 bp, Homo sapiens
cctgtcagaatcatgctgttctc

SEQ ID NO: 2681279 - DNA, 14 bp, Homo sapiens
cctgtcccacctct

SEQ ID NO: 2681280 - DNA, 16 bp, Homo sapiens
cctgtccctacccact

SEQ ID NO: 2681281 - DNA, 19 bp, Homo sapiens
cctgtccctacccactctt

SEQ ID NO: 2681282 - DNA, 20 bp, Homo sapiens
cctgtctgtctgtctgtccc

SEQ ID NO: 2681283 - DNA, 12 bp, Homo sapiens
cctgtcttcaga

SEQ ID NO: 2681284 - DNA, 20 bp, Homo sapiens
cctgtctttgttgtctccct

SEQ ID NO: 2681285 - DNA, 14 bp, Homo sapiens
cctgtgagagccac

SEQ ID NO: 2681286 - DNA, 14 bp, Homo sapiens
cctgtgctgaggac

SEQ ID NO: 2681287 - DNA, 17 bp, Homo sapiens
cctgtgctgaggactcc

SEQ ID NO: 2681288 - DNA, 16 bp, Homo sapiens
cctgtggccaggaggt

SEQ ID NO: 2681289 - DNA, 14 bp, Homo sapiens
cctgttgctctgtt

SEQ ID NO: 2681290 - DNA, 19 bp, Homo sapiens
cctgttggacccgctctgg

SEQ ID NO: 2681291 - DNA, 16 bp, Homo sapiens
cctgttttgcttttgt

SEQ ID NO: 2681292 - DNA, 16 bp, Homo sapiens
ccttagattagctctg

SEQ ID NO: 2681293 - DNA, 15 bp, Homo sapiens
ccttattttgtatta

SEQ ID NO: 2681294 - DNA, 19 bp, Homo sapiens
ccttcaagttagctcagga

SEQ ID NO: 2681295 - DNA, 15 bp, Homo sapiens
ccttcaattcctggg

SEQ ID NO: 2681296 - DNA, 20 bp, Homo sapiens
ccttcaattcctgggcccca

SEQ ID NO: 2681297 - DNA, 23 bp, Homo sapiens
ccttcactccggtgtgcctgcag

SEQ ID NO: 2681298 - DNA, 13 bp, Homo sapiens
ccttccaggcccc

SEQ ID NO: 2681299 - DNA, 12 bp, Homo sapiens
ccttccatgccc

SEQ ID NO: 2681300 - DNA, 16 bp, Homo sapiens
ccttccccctcccagg

SEQ ID NO: 2681301 - DNA, 15 bp, Homo sapiens
ccttccctccctgag

SEQ ID NO: 2681302 - DNA, 19 bp, Homo sapiens
ccttcctccccttttgccc

SEQ ID NO: 2681303 - DNA, 17 bp, Homo sapiens
ccttcctgagacctcgc

SEQ ID NO: 2681304 - DNA, 14 bp, Homo sapiens
ccttcctgccacca

SEQ ID NO: 2681305 - DNA, 17 bp, Homo sapiens
ccttcctgccaccagtc

SEQ ID NO: 2681306 - DNA, 20 bp, Homo sapiens
ccttctcccttgccctccct

SEQ ID NO: 2681307 - DNA, 13 bp, Homo sapiens
ccttctctctttc

SEQ ID NO: 2681308 - DNA, 20 bp, Homo sapiens
ccttctgcccttcctccagg

SEQ ID NO: 2681309 - DNA, 21 bp, Homo sapiens
ccttctgcccttcctccagga

SEQ ID NO: 2681310 - DNA, 22 bp, Homo sapiens
ccttgaagccactgaagctggg

SEQ ID NO: 2681311 - DNA, 22 bp, Homo sapiens
ccttgccctccctttctctctc

SEQ ID NO: 2681312 - DNA, 21 bp, Homo sapiens
ccttggcacgaggggggccag

SEQ ID NO: 2681313 - DNA, 22 bp, Homo sapiens
ccttggcacgaggggggccagg

SEQ ID NO: 2681314 - DNA, 21 bp, Homo sapiens
ccttgtgggaccagtcccaca

SEQ ID NO: 2681315 - DNA, 13 bp, Homo sapiens
cctttactcagcc

SEQ ID NO: 2681316 - DNA, 21 bp, Homo sapiens
cctttactcagcccagctggc

SEQ ID NO: 2681317 - DNA, 22 bp, Homo sapiens
cctttccggggctgctggcctg

SEQ ID NO: 2681318 - DNA, 13 bp, Homo sapiens
ccttttgcccccg

SEQ ID NO: 2681319 - DNA, 16 bp, Homo sapiens
cctttttacagccaac

SEQ ID NO: 2681320 - DNA, 17 bp, Homo sapiens
tgatgtctcttgtagaa

SEQ ID NO: 2681321 - DNA, 17 bp, Homo sapiens
tgatgtgtgaaacctga

SEQ ID NO: 2681322 - DNA, 20 bp, Homo sapiens
tgatgtgtgaaacctgacac

SEQ ID NO: 2681323 - DNA, 22 bp, Homo sapiens
tgatttggggattcagatttct

SEQ ID NO: 2681324 - DNA, 18 bp, Homo sapiens
tgcaatctataatatttg

SEQ ID NO: 2681325 - DNA, 17 bp, Homo sapiens
tgcacaccttttcccca

SEQ ID NO: 2681326 - DNA, 21 bp, Homo sapiens
tgcacaccttttccccaggag

SEQ ID NO: 2681327 - DNA, 19 bp, Homo sapiens
tgcacattttgtacaaaga

SEQ ID NO: 2681328 - DNA, 16 bp, Homo sapiens
tgcaccctccgccttc

SEQ ID NO: 2681329 - DNA, 16 bp, Homo sapiens
tgcacctgccagcctg

SEQ ID NO: 2681330 - DNA, 17 bp, Homo sapiens
tgcacctgccagcctgg

SEQ ID NO: 2681331 - DNA, 16 bp, Homo sapiens
tgcacctgtactcagg

SEQ ID NO: 2681332 - DNA, 17 bp, Homo sapiens
tgcacctgtactcagga

SEQ ID NO: 2681333 - DNA, 20 bp, Homo sapiens
tgcacctgtactcaggaggc

SEQ ID NO: 2681334 - DNA, 17 bp, Homo sapiens
tgcactccagcctgggc

SEQ ID NO: 2681335 - DNA, 18 bp, Homo sapiens
tgcactccagcctgggca

SEQ ID NO: 2681336 - DNA, 12 bp, Homo sapiens
tgcactgtctca

SEQ ID NO: 2681337 - DNA, 18 bp, Homo sapiens
tgcagacaagtcttgctg

SEQ ID NO: 2681338 - DNA, 14 bp, Homo sapiens
tgcagactcctcag

SEQ ID NO: 2681339 - DNA, 13 bp, Homo sapiens
tgcagaggggaaa

SEQ ID NO: 2681340 - DNA, 12 bp, Homo sapiens
tgcagcctccct

SEQ ID NO: 2681341 - DNA, 20 bp, Homo sapiens
tgcaggccaagagcagaggc

SEQ ID NO: 2681342 - DNA, 20 bp, Homo sapiens
tgcaggcttaggtcctcact

SEQ ID NO: 2681343 - DNA, 14 bp, Homo sapiens
tgcagggagccgag

SEQ ID NO: 2681344 - DNA, 17 bp, Homo sapiens
tgcaggtcctggtgggt

SEQ ID NO: 2681345 - DNA, 20 bp, Homo sapiens
tgcaggtcctggtgggtcag

SEQ ID NO: 2681346 - DNA, 18 bp, Homo sapiens
tgcagtagtctctgtgct

SEQ ID NO: 2681347 - DNA, 21 bp, Homo sapiens
tgcagtccgcagtctggcctg

SEQ ID NO: 2681348 - DNA, 19 bp, Homo sapiens
tgcagtgacgtgcacctgt

SEQ ID NO: 2681349 - DNA, 14 bp, Homo sapiens
tgcagtgagccatg

SEQ ID NO: 2681350 - DNA, 12 bp, Homo sapiens
tgcatgcactgt

SEQ ID NO: 2681351 - DNA, 12 bp, Homo sapiens
tgcatgtaatca

SEQ ID NO: 2681352 - DNA, 17 bp, Homo sapiens
tgcattgttattgtgga

SEQ ID NO: 2681353 - DNA, 18 bp, Homo sapiens
tgcattgttattgtggaa

SEQ ID NO: 2681354 - DNA, 12 bp, Homo sapiens
tgccaaagctgc

SEQ ID NO: 2681355 - DNA, 13 bp, Homo sapiens
tgccaaagctgct

SEQ ID NO: 2681356 - DNA, 17 bp, Homo sapiens
tgccaaagctgctttct

SEQ ID NO: 2681357 - DNA, 20 bp, Homo sapiens
tgccaaagctgctttcttct

SEQ ID NO: 2681358 - DNA, 19 bp, Homo sapiens
tgccaagctcacacagcag

SEQ ID NO: 2681359 - DNA, 12 bp, Homo sapiens
tgccaccaataa

SEQ ID NO: 2681360 - DNA, 13 bp, Homo sapiens
tgccaccaataaa

SEQ ID NO: 2681361 - DNA, 16 bp, Homo sapiens
tgccaccaataaaaat

SEQ ID NO: 2681362 - DNA, 17 bp, Homo sapiens
tgccaccaataaaaatc

SEQ ID NO: 2681363 - DNA, 15 bp, Homo sapiens
tgccacctctcccag

SEQ ID NO: 2681364 - DNA, 12 bp, Homo sapiens
tgccacctgtct

SEQ ID NO: 2681365 - DNA, 17 bp, Homo sapiens
tgccagcctggcttctg

SEQ ID NO: 2681366 - DNA, 18 bp, Homo sapiens
tgccagcctggcttctgg

SEQ ID NO: 2681367 - DNA, 20 bp, Homo sapiens
tgccagcctggcttctggag

SEQ ID NO: 2681368 - DNA, 22 bp, Homo sapiens
tgccagcctggcttctggagcc

SEQ ID NO: 2681369 - DNA, 13 bp, Homo sapiens
tgccaggctgtgc

SEQ ID NO: 2681370 - DNA, 16 bp, Homo sapiens
tgccatttgcaccctc

SEQ ID NO: 2681371 - DNA, 20 bp, Homo sapiens
tgcccagagggcccaggcag

SEQ ID NO: 2681372 - DNA, 15 bp, Homo sapiens
tgcccagcccctgcc

SEQ ID NO: 2681373 - DNA, 16 bp, Homo sapiens
tgcccagcccctgccc

SEQ ID NO: 2681374 - DNA, 19 bp, Homo sapiens
tgcccagcccctgccccta

SEQ ID NO: 2681375 - DNA, 20 bp, Homo sapiens
tgcccaggctggagtgcagt

SEQ ID NO: 2681376 - DNA, 13 bp, Homo sapiens
tgccccagctctg

SEQ ID NO: 2681377 - DNA, 18 bp, Homo sapiens
tgccccagctctggcttc

SEQ ID NO: 2681378 - DNA, 22 bp, Homo sapiens
tgccccaggatcactctctgct

SEQ ID NO: 2681379 - DNA, 21 bp, Homo sapiens
tgccccatcattgcacctgca

SEQ ID NO: 2681380 - DNA, 12 bp, Homo sapiens
tgccccctggtg

SEQ ID NO: 2681381 - DNA, 16 bp, Homo sapiens
tgccccgacccgggtc

SEQ ID NO: 2681382 - DNA, 19 bp, Homo sapiens
tgcccctccgatgctgagg

SEQ ID NO: 2681383 - DNA, 21 bp, Homo sapiens
tgcccctccgatgctgaggcc

SEQ ID NO: 2681384 - DNA, 16 bp, Homo sapiens
tgcccctgctctgtag

SEQ ID NO: 2681385 - DNA, 16 bp, Homo sapiens
tgcccggattctggga

SEQ ID NO: 2681386 - DNA, 17 bp, Homo sapiens
tgcccggattctgggag

SEQ ID NO: 2681387 - DNA, 14 bp, Homo sapiens
tgccctgccacctg

SEQ ID NO: 2681388 - DNA, 19 bp, Homo sapiens
tgccctgccacctgtctgt

SEQ ID NO: 2681389 - DNA, 14 bp, Homo sapiens
tgccctgccctgcc

SEQ ID NO: 2681390 - DNA, 22 bp, Homo sapiens
tgccctgtgagagccacgctgg

SEQ ID NO: 2681391 - DNA, 14 bp, Homo sapiens
tgcccttcctccag

SEQ ID NO: 2681392 - DNA, 17 bp, Homo sapiens
tgccgagcctaatgaaa

SEQ ID NO: 2681393 - DNA, 17 bp, Homo sapiens
tgccgcgtccctgcccc

SEQ ID NO: 2681394 - DNA, 20 bp, Homo sapiens
tgcctcccagtggcctggct

SEQ ID NO: 2681395 - DNA, 13 bp, Homo sapiens
tgcctcctcctca

SEQ ID NO: 2681396 - DNA, 19 bp, Homo sapiens
tgcctcctgtgtgtctgca

SEQ ID NO: 2681397 - DNA, 11 bp, Homo sapiens
tgcctgcaggc

SEQ ID NO: 2681398 - DNA, 14 bp, Homo sapiens
tgcctgccttctcc

SEQ ID NO: 2681399 - DNA, 20 bp, Homo sapiens
tgcctggtcctccctcccaa

SEQ ID NO: 2681400 - DNA, 18 bp, Homo sapiens
tgccttctcccctccacg

SEQ ID NO: 2681401 - DNA, 16 bp, Homo sapiens
tgcgccccgcctcccc

SEQ ID NO: 2681402 - DNA, 15 bp, Homo sapiens
tgcgctcacctcaga

SEQ ID NO: 2681403 - DNA, 19 bp, Homo sapiens
tgcgggatggtcctggggc

SEQ ID NO: 2681404 - DNA, 22 bp, Homo sapiens
tgcgggggagccagttctgggg

SEQ ID NO: 2681405 - DNA, 13 bp, Homo sapiens
tgcgtccctgtac

SEQ ID NO: 2681406 - DNA, 12 bp, Homo sapiens
tgctaaatagtt

SEQ ID NO: 2681407 - DNA, 13 bp, Homo sapiens
tgctacaataaat

SEQ ID NO: 2681408 - DNA, 15 bp, Homo sapiens
tgctacaataaatgc

SEQ ID NO: 2681409 - DNA, 18 bp, Homo sapiens
tgctagctgtctctcttg

SEQ ID NO: 2681410 - DNA, 16 bp, Homo sapiens
tgctaggagccccagc

SEQ ID NO: 2681411 - DNA, 18 bp, Homo sapiens
tgctaggagccccagctt

SEQ ID NO: 2681412 - DNA, 22 bp, Homo sapiens
tgctaggagccccagcttcctg

SEQ ID NO: 2681413 - DNA, 18 bp, Homo sapiens
tgctagtttattggaagt

SEQ ID NO: 2681414 - DNA, 14 bp, Homo sapiens
tgctcagaagccag

SEQ ID NO: 2681415 - DNA, 21 bp, Homo sapiens
tgctcagaagccagtctgcgt

SEQ ID NO: 2681416 - DNA, 22 bp, Homo sapiens
tgctcattccgagggtgaaaca

SEQ ID NO: 2681417 - DNA, 16 bp, Homo sapiens
tgctccagcagcacac

SEQ ID NO: 2681418 - DNA, 23 bp, Homo sapiens
tgctccagcagcacacctcagcc

SEQ ID NO: 2681419 - DNA, 22 bp, Homo sapiens
ttaatatctgagaagtgtatat

SEQ ID NO: 2681420 - DNA, 19 bp, Homo sapiens
ttaatgtacaagttttgta

SEQ ID NO: 2681421 - DNA, 13 bp, Homo sapiens
ttaatgttttgta

SEQ ID NO: 2681422 - DNA, 19 bp, Homo sapiens
ttacatgctgtgctctttg

SEQ ID NO: 2681423 - DNA, 19 bp, Homo sapiens
ttaccttggccgtgaggac

SEQ ID NO: 2681424 - DNA, 22 bp, Homo sapiens
ttacgggtaacagtgaggctgg

SEQ ID NO: 2681425 - DNA, 19 bp, Homo sapiens
ttactaaattgtatacatt

SEQ ID NO: 2681426 - DNA, 18 bp, Homo sapiens
ttacttatacctctctca

SEQ ID NO: 2681427 - DNA, 19 bp, Homo sapiens
ttagaaatcattgtagaaa

SEQ ID NO: 2681428 - DNA, 17 bp, Homo sapiens
ttagatgagggtgactg

SEQ ID NO: 2681429 - DNA, 20 bp, Homo sapiens
ttagatgtgctgctttgata

SEQ ID NO: 2681430 - DNA, 16 bp, Homo sapiens
ttagattagctctgga

SEQ ID NO: 2681431 - DNA, 16 bp, Homo sapiens
ttagcctttgccctgt

SEQ ID NO: 2681432 - DNA, 18 bp, Homo sapiens
ttagcctttgccctgtca

SEQ ID NO: 2681433 - DNA, 21 bp, Homo sapiens
ttaggagttcgagaccagcct

SEQ ID NO: 2681434 - DNA, 13 bp, Homo sapiens
ttagttgaaaaat

SEQ ID NO: 2681435 - DNA, 20 bp, Homo sapiens
ttatatatcataaagtatgc

SEQ ID NO: 2681436 - DNA, 24 bp, Homo sapiens
ttattaagtctgggatgtagaact

SEQ ID NO: 2681437 - DNA, 16 bp, Homo sapiens
ttattgaatcttaatt

SEQ ID NO: 2681438 - DNA, 17 bp, Homo sapiens
ttatttccacataaagg

SEQ ID NO: 2681439 - DNA, 21 bp, Homo sapiens
ttatttggaaatattctatga

SEQ ID NO: 2681440 - DNA, 22 bp, Homo sapiens
ttattttgtattacatctaatg

SEQ ID NO: 2681441 - DNA, 20 bp, Homo sapiens
ttcaacaacgttcttagttt

SEQ ID NO: 2681442 - DNA, 14 bp, Homo sapiens
ttcaagcccaggct

SEQ ID NO: 2681443 - DNA, 20 bp, Homo sapiens
ttcaagcccaggcttcctgg

SEQ ID NO: 2681444 - DNA, 21 bp, Homo sapiens
ttcaagggaagaaacactctt

SEQ ID NO: 2681445 - DNA, 21 bp, Homo sapiens
ttcaagtgttgctcttggaaa

SEQ ID NO: 2681446 - DNA, 14 bp, Homo sapiens
ttcaattcctgggc

SEQ ID NO: 2681447 - DNA, 12 bp, Homo sapiens
ttcaccagcagc

SEQ ID NO: 2681448 - DNA, 17 bp, Homo sapiens
ttcaccattcaaacagg

SEQ ID NO: 2681449 - DNA, 15 bp, Homo sapiens
ttcacccggctgggc

SEQ ID NO: 2681450 - DNA, 22 bp, Homo sapiens
ttcagaattgaaggagaaaatg

SEQ ID NO: 2681451 - DNA, 16 bp, Homo sapiens
ttcagcattaggcttt

SEQ ID NO: 2681452 - DNA, 17 bp, Homo sapiens
ttcataacaaaccatct

SEQ ID NO: 2681453 - DNA, 15 bp, Homo sapiens
ttcatttggtgctgg

SEQ ID NO: 2681454 - DNA, 13 bp, Homo sapiens
ttccaaccccagc

SEQ ID NO: 2681455 - DNA, 15 bp, Homo sapiens
ttccaaccccagctg

SEQ ID NO: 2681456 - DNA, 18 bp, Homo sapiens
ttccaaccccagctggcc

SEQ ID NO: 2681457 - DNA, 13 bp, Homo sapiens
ttccaccctggaa

SEQ ID NO: 2681458 - DNA, 18 bp, Homo sapiens
ttccagaaaaccccagca

SEQ ID NO: 2681459 - DNA, 13 bp, Homo sapiens
ttccatcctgagg

SEQ ID NO: 2681460 - DNA, 15 bp, Homo sapiens
ttccattgaccagct

SEQ ID NO: 2681461 - DNA, 18 bp, Homo sapiens
ttcccaaactacagaata

SEQ ID NO: 2681462 - DNA, 20 bp, Homo sapiens
ttcccaaactacagaataat

SEQ ID NO: 2681463 - DNA, 18 bp, Homo sapiens
ttccccccaccccccagc

SEQ ID NO: 2681464 - DNA, 20 bp, Homo sapiens
ttccccccaccccccagcac

SEQ ID NO: 2681465 - DNA, 22 bp, Homo sapiens
ttcccctttactcagcccagct

SEQ ID NO: 2681466 - DNA, 21 bp, Homo sapiens
ttcccgggataaactgagcct

SEQ ID NO: 2681467 - DNA, 16 bp, Homo sapiens
ttcccttctcccttgc

SEQ ID NO: 2681468 - DNA, 19 bp, Homo sapiens
ttccgacttgtccctctct

SEQ ID NO: 2681469 - DNA, 13 bp, Homo sapiens
ttccgtgccaggc

SEQ ID NO: 2681470 - DNA, 19 bp, Homo sapiens
ttcctcagggcccagcagg

SEQ ID NO: 2681471 - DNA, 19 bp, Homo sapiens
ttcctctagtgccctccac

SEQ ID NO: 2681472 - DNA, 14 bp, Homo sapiens
ttcctgaaagctgt

SEQ ID NO: 2681473 - DNA, 12 bp, Homo sapiens
ttcctgccacca

SEQ ID NO: 2681474 - DNA, 17 bp, Homo sapiens
ttcctgccaccagtcac

SEQ ID NO: 2681475 - DNA, 17 bp, Homo sapiens
ttcctgggtcctgcctg

SEQ ID NO: 2681476 - DNA, 15 bp, Homo sapiens
ttcctgtcccacctc

SEQ ID NO: 2681477 - DNA, 22 bp, Homo sapiens
ttcctgtctttgttgtctccct

SEQ ID NO: 2681478 - DNA, 14 bp, Homo sapiens
ttccttgcccctgc

SEQ ID NO: 2681479 - DNA, 17 bp, Homo sapiens
ttcgtctccatctctgg

SEQ ID NO: 2681480 - DNA, 19 bp, Homo sapiens
ttctacacatatatgtata

SEQ ID NO: 2681481 - DNA, 20 bp, Homo sapiens
ttctagctttgttgtcctcc

SEQ ID NO: 2681482 - DNA, 23 bp, Homo sapiens
ttctagctttgttgtcctcccag

SEQ ID NO: 2681483 - DNA, 18 bp, Homo sapiens
ttctatgcaagccttgct

SEQ ID NO: 2681484 - DNA, 15 bp, Homo sapiens
ttctcaacctaccac

SEQ ID NO: 2681485 - DNA, 14 bp, Homo sapiens
ttctccccctgggc

SEQ ID NO: 2681486 - DNA, 15 bp, Homo sapiens
ttctcccttgccctc

SEQ ID NO: 2681487 - DNA, 17 bp, Homo sapiens
ttctcccttgccctccc

SEQ ID NO: 2681488 - DNA, 16 bp, Homo sapiens
ttctcgttttgaaact

SEQ ID NO: 2681489 - DNA, 15 bp, Homo sapiens
ttctctctccacccc

SEQ ID NO: 2681490 - DNA, 19 bp, Homo sapiens
ttctctgcctcctcctcac

SEQ ID NO: 2681491 - DNA, 16 bp, Homo sapiens
ttctgaatcttctgaa

SEQ ID NO: 2681492 - DNA, 12 bp, Homo sapiens
ttctgaccaaaa

SEQ ID NO: 2681493 - DNA, 19 bp, Homo sapiens
ttctgaccaaaatgtgttt

SEQ ID NO: 2681494 - DNA, 20 bp, Homo sapiens
ttctgaccaaaatgtgtttc

SEQ ID NO: 2681495 - DNA, 19 bp, Homo sapiens
ttctgagaagcgctgccct

SEQ ID NO: 2681496 - DNA, 20 bp, Homo sapiens
ttctgagaagcgctgccctg

SEQ ID NO: 2681497 - DNA, 19 bp, Homo sapiens
ttctgcccacattggaccc

SEQ ID NO: 2681498 - DNA, 10 bp, Homo sapiens
ttctggagcc

SEQ ID NO: 2681499 - DNA, 21 bp, Homo sapiens
ttctggatggcatctagccag

SEQ ID NO: 2681500 - DNA, 18 bp, Homo sapiens
ttctggggcccgcctgcc

SEQ ID NO: 2681501 - DNA, 22 bp, Homo sapiens
ttctggggcccgcctgccacct

SEQ ID NO: 2681502 - DNA, 22 bp, Homo sapiens
ttctggtatgaacttgaggaca

SEQ ID NO: 2681503 - DNA, 18 bp, Homo sapiens
ttctgtccagtttccaaa

SEQ ID NO: 2681504 - DNA, 16 bp, Homo sapiens
ttctgtctcctgtctt

SEQ ID NO: 2681505 - DNA, 14 bp, Homo sapiens
ttctgtgtgtccgt

SEQ ID NO: 2681506 - DNA, 13 bp, Homo sapiens
ttcttctctgcct

SEQ ID NO: 2681507 - DNA, 17 bp, Homo sapiens
ttcttgaagttcatggt

SEQ ID NO: 2681508 - DNA, 16 bp, Homo sapiens
ttctttactaaagata

SEQ ID NO: 2681509 - DNA, 23 bp, Homo sapiens
ttgaaatcagtaaacactgtgta

SEQ ID NO: 2681510 - DNA, 21 bp, Homo sapiens
ttgaagccactgaagctggga

SEQ ID NO: 2681511 - DNA, 12 bp, Homo sapiens
ttgaccagctct

SEQ ID NO: 2681512 - DNA, 15 bp, Homo sapiens
ttgacgggctgtccg

SEQ ID NO: 2681513 - DNA, 22 bp, Homo sapiens
ttgacgggctgtccgtgtgcct

SEQ ID NO: 2681514 - DNA, 20 bp, Homo sapiens
ttgagccctggaccccaggc

SEQ ID NO: 2681515 - DNA, 14 bp, Homo sapiens
ttgaggctgcagcg

SEQ ID NO: 2681516 - DNA, 18 bp, Homo sapiens
ttgagtatattataatag

SEQ ID NO: 2681517 - DNA, 21 bp, Homo sapiens
ttgagtccagctttccttctg

SEQ ID NO: 2681518 - DNA, 12 bp, Homo sapiens
ttgagtgtctgc

SEQ ID NO: 2681519 - DNA, 15 bp, Homo sapiens
ttgagtgtctgcgcc

SEQ ID NO: 2681520 - DNA, 21 bp, Homo sapiens
ttgataaattccactggactt

SEQ ID NO: 2681521 - DNA, 14 bp, Homo sapiens
ttgatgaggcctct

SEQ ID NO: 2681522 - DNA, 15 bp, Homo sapiens
ttgatttgagaaatt

SEQ ID NO: 2681523 - DNA, 13 bp, Homo sapiens
ttgatttgatttt

SEQ ID NO: 2681524 - DNA, 16 bp, Homo sapiens
ttgcaatctataatat

SEQ ID NO: 2681525 - DNA, 21 bp, Homo sapiens
ttgcacaccttttccccagga

SEQ ID NO: 2681526 - DNA, 22 bp, Homo sapiens
ttgcccctgctctgtagccacc

SEQ ID NO: 2681527 - DNA, 17 bp, Homo sapiens
ttgcccggattctggga

SEQ ID NO: 2681528 - DNA, 22 bp, Homo sapiens
ttgccctccctttctctctcca

SEQ ID NO: 2681529 - DNA, 18 bp, Homo sapiens
ttgccgagcctaatgaaa

SEQ ID NO: 2681530 - DNA, 14 bp, Homo sapiens
gaggccccaggctg

SEQ ID NO: 2681531 - DNA, 22 bp, Homo sapiens
gaggcctcttggacctctgctc

SEQ ID NO: 2681532 - DNA, 14 bp, Homo sapiens
gaggcctgacacag

SEQ ID NO: 2681533 - DNA, 20 bp, Homo sapiens
gaggcctgacacaggccagc

SEQ ID NO: 2681534 - DNA, 22 bp, Homo sapiens
gaggcctgacacaggccagcct

SEQ ID NO: 2681535 - DNA, 16 bp, Homo sapiens
gaggctctttctgggc

SEQ ID NO: 2681536 - DNA, 12 bp, Homo sapiens
gaggctgaggcg

SEQ ID NO: 2681537 - DNA, 16 bp, Homo sapiens
gaggctgcagcgagct

SEQ ID NO: 2681538 - DNA, 20 bp, Homo sapiens
gaggcttccagagagtcctc

SEQ ID NO: 2681539 - DNA, 15 bp, Homo sapiens
gagggatgctgcctg

SEQ ID NO: 2681540 - DNA, 20 bp, Homo sapiens
gagggccaacaactgtccct

SEQ ID NO: 2681541 - DNA, 14 bp, Homo sapiens
gaggggcctctgaa

SEQ ID NO: 2681542 - DNA, 14 bp, Homo sapiens
gaggggctcctgga

SEQ ID NO: 2681543 - DNA, 15 bp, Homo sapiens
gaggggctcctggaa

SEQ ID NO: 2681544 - DNA, 17 bp, Homo sapiens
gagggtcaagggctggg

SEQ ID NO: 2681545 - DNA, 20 bp, Homo sapiens
gagggtcaagggctggggct

SEQ ID NO: 2681546 - DNA, 19 bp, Homo sapiens
gagggtgggagagcccagc

SEQ ID NO: 2681547 - DNA, 21 bp, Homo sapiens
gaggtctcaggttctttccat

SEQ ID NO: 2681548 - DNA, 12 bp, Homo sapiens
gaggtgcctccc

SEQ ID NO: 2681549 - DNA, 13 bp, Homo sapiens
gaggtgcctccca

SEQ ID NO: 2681550 - DNA, 19 bp, Homo sapiens
gaggtggaggttgcagtga

SEQ ID NO: 2681551 - DNA, 18 bp, Homo sapiens
gaggtggcagccctgtag

SEQ ID NO: 2681552 - DNA, 19 bp, Homo sapiens
gaggttgcagggagccgag

SEQ ID NO: 2681553 - DNA, 11 bp, Homo sapiens
gagtcagcctt

SEQ ID NO: 2681554 - DNA, 16 bp, Homo sapiens
gagtccagctttcctt

SEQ ID NO: 2681555 - DNA, 23 bp, Homo sapiens
gagtccagctttccttctgccct

SEQ ID NO: 2681556 - DNA, 12 bp, Homo sapiens
gagtcctctgga

SEQ ID NO: 2681557 - DNA, 16 bp, Homo sapiens
gagtctcagagcacag

SEQ ID NO: 2681558 - DNA, 12 bp, Homo sapiens
gagtctgtctca

SEQ ID NO: 2681559 - DNA, 20 bp, Homo sapiens
gagtggaggtttatagttaa

SEQ ID NO: 2681560 - DNA, 13 bp, Homo sapiens
gagtggggcctgc

SEQ ID NO: 2681561 - DNA, 17 bp, Homo sapiens
gagtgtctgcgccccgc

SEQ ID NO: 2681562 - DNA, 17 bp, Homo sapiens
gagttcgagaccagcct

SEQ ID NO: 2681563 - DNA, 16 bp, Homo sapiens
gagttgtggaaagcct

SEQ ID NO: 2681564 - DNA, 20 bp, Homo sapiens
gagttgtggaaagcctctgc

SEQ ID NO: 2681565 - DNA, 16 bp, Homo sapiens
gataaattccactgga

SEQ ID NO: 2681566 - DNA, 21 bp, Homo sapiens
gataacttccttgcccctgct

SEQ ID NO: 2681567 - DNA, 15 bp, Homo sapiens
gatacagctcttctc

SEQ ID NO: 2681568 - DNA, 16 bp, Homo sapiens
gatacagctcttctca

SEQ ID NO: 2681569 - DNA, 23 bp, Homo sapiens
gatcacgccactgcactccagcc

SEQ ID NO: 2681570 - DNA, 19 bp, Homo sapiens
gatcacttgagttcaggag

SEQ ID NO: 2681571 - DNA, 13 bp, Homo sapiens
gatcagagctgca

SEQ ID NO: 2681572 - DNA, 15 bp, Homo sapiens
gatcagagctgcagc

SEQ ID NO: 2681573 - DNA, 19 bp, Homo sapiens
gatcagagctgcagccagt

SEQ ID NO: 2681574 - DNA, 13 bp, Homo sapiens
gatcatctctgtg

SEQ ID NO: 2681575 - DNA, 14 bp, Homo sapiens
gatcatctctgtga

SEQ ID NO: 2681576 - DNA, 23 bp, Homo sapiens
gatcgcgccactacactccagcc

SEQ ID NO: 2681577 - DNA, 14 bp, Homo sapiens
gatgactgagtcct

SEQ ID NO: 2681578 - DNA, 17 bp, Homo sapiens
gatgccaaagctgcttt

SEQ ID NO: 2681579 - DNA, 20 bp, Homo sapiens
gatgccaaagctgctttctt

SEQ ID NO: 2681580 - DNA, 19 bp, Homo sapiens
gatgcccagagggcccagg

SEQ ID NO: 2681581 - DNA, 20 bp, Homo sapiens
gatgcccagagggcccaggc

SEQ ID NO: 2681582 - DNA, 12 bp, Homo sapiens
gatgcctcccca

SEQ ID NO: 2681583 - DNA, 14 bp, Homo sapiens
gatgctgaggccac

SEQ ID NO: 2681584 - DNA, 15 bp, Homo sapiens
gatgctgaggccacc

SEQ ID NO: 2681585 - DNA, 17 bp, Homo sapiens
gatgctgaggccaccca

SEQ ID NO: 2681586 - DNA, 12 bp, Homo sapiens
gatgctgcctga

SEQ ID NO: 2681587 - DNA, 14 bp, Homo sapiens
gatgctgcctgagt

SEQ ID NO: 2681588 - DNA, 19 bp, Homo sapiens
gatggaccaaagccacctg

SEQ ID NO: 2681589 - DNA, 14 bp, Homo sapiens
gatggcaccagagg

SEQ ID NO: 2681590 - DNA, 15 bp, Homo sapiens
gatggcaccagaggc

SEQ ID NO: 2681591 - DNA, 14 bp, Homo sapiens
gatggcccctccag

SEQ ID NO: 2681592 - DNA, 16 bp, Homo sapiens
gatggcccctccagca

SEQ ID NO: 2681593 - DNA, 19 bp, Homo sapiens
gatggggatgcttccgcct

SEQ ID NO: 2681594 - DNA, 15 bp, Homo sapiens
gatggtcctggggct

SEQ ID NO: 2681595 - DNA, 15 bp, Homo sapiens
gatggtctccacctg

SEQ ID NO: 2681596 - DNA, 19 bp, Homo sapiens
gatggtctccacctgtgct

SEQ ID NO: 2681597 - DNA, 21 bp, Homo sapiens
gatggtctccacctgtgcttg

SEQ ID NO: 2681598 - DNA, 16 bp, Homo sapiens
gatgtctcttgtagaa

SEQ ID NO: 2681599 - DNA, 19 bp, Homo sapiens
aagcatcacctcaggccag

SEQ ID NO: 2681600 - DNA, 16 bp, Homo sapiens
aagcatggcctggact

SEQ ID NO: 2681601 - DNA, 16 bp, Homo sapiens
aagccaaactctgcca

SEQ ID NO: 2681602 - DNA, 16 bp, Homo sapiens
aagccaacgacaaagc

SEQ ID NO: 2681603 - DNA, 12 bp, Homo sapiens
aagccacctgct

SEQ ID NO: 2681604 - DNA, 14 bp, Homo sapiens
aagccacctgctgc

SEQ ID NO: 2681605 - DNA, 13 bp, Homo sapiens
aagccactgaagc

SEQ ID NO: 2681606 - DNA, 18 bp, Homo sapiens
aagccaggagcaaatgtt

SEQ ID NO: 2681607 - DNA, 16 bp, Homo sapiens
aagccctgctctttct

SEQ ID NO: 2681608 - DNA, 18 bp, Homo sapiens
aagccctgctctttctct

SEQ ID NO: 2681609 - DNA, 14 bp, Homo sapiens
aagcctctgctgcc

SEQ ID NO: 2681610 - DNA, 20 bp, Homo sapiens
aagcgatgaatttggagact

SEQ ID NO: 2681611 - DNA, 12 bp, Homo sapiens
aagcgctgccct

SEQ ID NO: 2681612 - DNA, 13 bp, Homo sapiens
aagcgctgccctg

SEQ ID NO: 2681613 - DNA, 14 bp, Homo sapiens
aagcgctgccctgt

SEQ ID NO: 2681614 - DNA, 15 bp, Homo sapiens
aagcgctgccctgtg

SEQ ID NO: 2681615 - DNA, 22 bp, Homo sapiens
aagcgctgccctgtgagagcca

SEQ ID NO: 2681616 - DNA, 21 bp, Homo sapiens
aagcggaggttgcagggagcc

SEQ ID NO: 2681617 - DNA, 17 bp, Homo sapiens
aagctagaaggccacat

SEQ ID NO: 2681618 - DNA, 19 bp, Homo sapiens
aagctagaaggccacatgt

SEQ ID NO: 2681619 - DNA, 17 bp, Homo sapiens
aagctcacacagcagga

SEQ ID NO: 2681620 - DNA, 18 bp, Homo sapiens
aagctctgaacaaaagct

SEQ ID NO: 2681621 - DNA, 21 bp, Homo sapiens
aagctgctgagaatctagcct

SEQ ID NO: 2681622 - DNA, 22 bp, Homo sapiens
aagctgctttcttctctgcctc

SEQ ID NO: 2681623 - DNA, 24 bp, Homo sapiens
aagctgctttcttctctgcctcct

SEQ ID NO: 2681624 - DNA, 22 bp, Homo sapiens
aagctgggaaaaaagttttgat

SEQ ID NO: 2681625 - DNA, 20 bp, Homo sapiens
aagctgttggatttcagtga

SEQ ID NO: 2681626 - DNA, 17 bp, Homo sapiens
aaggaaggttttctcca

SEQ ID NO: 2681627 - DNA, 18 bp, Homo sapiens
aaggacccaaatttccct

SEQ ID NO: 2681628 - DNA, 21 bp, Homo sapiens
aaggactaacataaaatctgt

SEQ ID NO: 2681629 - DNA, 14 bp, Homo sapiens
aaggcatggtcggg

SEQ ID NO: 2681630 - DNA, 17 bp, Homo sapiens
aaggctaagcatggcct

SEQ ID NO: 2681631 - DNA, 16 bp, Homo sapiens
aaggctcagtctcagg

SEQ ID NO: 2681632 - DNA, 16 bp, Homo sapiens
aagggacagctgctgg

SEQ ID NO: 2681633 - DNA, 21 bp, Homo sapiens
aaggggaatgtgtcctcctgc

SEQ ID NO: 2681634 - DNA, 22 bp, Homo sapiens
aaggggcagctcctgaccaaag

SEQ ID NO: 2681635 - DNA, 23 bp, Homo sapiens
aaggggcagctcctgaccaaaga

SEQ ID NO: 2681636 - DNA, 13 bp, Homo sapiens
aaggggccctggt

SEQ ID NO: 2681637 - DNA, 14 bp, Homo sapiens
aaggggccctggtc

SEQ ID NO: 2681638 - DNA, 21 bp, Homo sapiens
aagggttttccaccctggaat

SEQ ID NO: 2681639 - DNA, 15 bp, Homo sapiens
aaggtagaaggcaca

SEQ ID NO: 2681640 - DNA, 20 bp, Homo sapiens
aaggtatttagaatatatta

SEQ ID NO: 2681641 - DNA, 18 bp, Homo sapiens
aaggtgctgatggccctc

SEQ ID NO: 2681642 - DNA, 14 bp, Homo sapiens
aaggttttctccac

SEQ ID NO: 2681643 - DNA, 12 bp, Homo sapiens
aagtaagacaca

SEQ ID NO: 2681644 - DNA, 21 bp, Homo sapiens
aagtaagtaccactcaggcca

SEQ ID NO: 2681645 - DNA, 18 bp, Homo sapiens
aagtacttgctctctgag

SEQ ID NO: 2681646 - DNA, 16 bp, Homo sapiens
aagtcagactgctggg

SEQ ID NO: 2681647 - DNA, 19 bp, Homo sapiens
aagtccctgactctctgtg

SEQ ID NO: 2681648 - DNA, 12 bp, Homo sapiens
aagtctccctgc

SEQ ID NO: 2681649 - DNA, 13 bp, Homo sapiens
aagtcttgctgtg

SEQ ID NO: 2681650 - DNA, 14 bp, Homo sapiens
aagtcttgctgtgc

SEQ ID NO: 2681651 - DNA, 17 bp, Homo sapiens
aagtcttgctgtgcttt

SEQ ID NO: 2681652 - DNA, 21 bp, Homo sapiens
aagtgccagtcttgtgtctgc

SEQ ID NO: 2681653 - DNA, 17 bp, Homo sapiens
aagtgcccagcccctgc

SEQ ID NO: 2681654 - DNA, 13 bp, Homo sapiens
aagtgttcaagaa

SEQ ID NO: 2681655 - DNA, 13 bp, Homo sapiens
aagttagctcagg

SEQ ID NO: 2681656 - DNA, 20 bp, Homo sapiens
aagttcatgtttgtaaatta

SEQ ID NO: 2681657 - DNA, 16 bp, Homo sapiens
aagttgagtatattat

SEQ ID NO: 2681658 - DNA, 18 bp, Homo sapiens
aagttgagtatattataa

SEQ ID NO: 2681659 - DNA, 14 bp, Homo sapiens
aagtttgcactgta

SEQ ID NO: 2681660 - DNA, 15 bp, Homo sapiens
aagttttgagtttct

SEQ ID NO: 2681661 - DNA, 20 bp, Homo sapiens
aataaagaactccttatttt

SEQ ID NO: 2681662 - DNA, 21 bp, Homo sapiens
aataaagaactccttattttg

SEQ ID NO: 2681663 - DNA, 21 bp, Homo sapiens
aatacaaaaaattagccgggc

SEQ ID NO: 2681664 - DNA, 20 bp, Homo sapiens
aatactctagcctgggccag

SEQ ID NO: 2681665 - DNA, 23 bp, Homo sapiens
aatatctgagaagtgtatatagt

SEQ ID NO: 2681666 - DNA, 18 bp, Homo sapiens
aatatgttgagtgttcat

SEQ ID NO: 2681667 - DNA, 15 bp, Homo sapiens
aatattcaataaagc

SEQ ID NO: 2681668 - DNA, 16 bp, Homo sapiens
aatcaacttgtgtact

SEQ ID NO: 2681669 - DNA, 18 bp, Homo sapiens
aatcactttacctgcagg

SEQ ID NO: 2681670 - DNA, 16 bp, Homo sapiens
aatcagtaaacactgt

SEQ ID NO: 2681671 - DNA, 16 bp, Homo sapiens
aatcatgctgttctct

SEQ ID NO: 2681672 - DNA, 19 bp, Homo sapiens
aatcggctcccgcttgctc

SEQ ID NO: 2681673 - DNA, 21 bp, Homo sapiens
aatctagttttttttgtaaac

SEQ ID NO: 2681674 - DNA, 22 bp, Homo sapiens
aatctgtatatgttgtaataaa

SEQ ID NO: 2681675 - DNA, 14 bp, Homo sapiens
aatgattgtttaaa

SEQ ID NO: 2681676 - DNA, 14 bp, Homo sapiens
aatggcctgccttg

SEQ ID NO: 2681677 - DNA, 22 bp, Homo sapiens
aatggcctgccttgaagccact

SEQ ID NO: 2681678 - DNA, 17 bp, Homo sapiens
aatggtgttactaaagt

SEQ ID NO: 2681679 - DNA, 18 bp, Homo sapiens
aatggtgttactaaagtc

SEQ ID NO: 2681680 - DNA, 19 bp, Homo sapiens
aatgtaaaggtcacttttc

SEQ ID NO: 2681681 - DNA, 17 bp, Homo sapiens
aatgtacaagttttgta

SEQ ID NO: 2681682 - DNA, 14 bp, Homo sapiens
aatgtcagaaactc

SEQ ID NO: 2681683 - DNA, 14 bp, Homo sapiens
aatgtgactttgaa

SEQ ID NO: 2681684 - DNA, 16 bp, Homo sapiens
aatgtgtcctcctgct

SEQ ID NO: 2681685 - DNA, 19 bp, Homo sapiens
aatgtgtcctcctgctctg

SEQ ID NO: 2681686 - DNA, 21 bp, Homo sapiens
aatgtgtcctcctgctctgct

SEQ ID NO: 2681687 - DNA, 15 bp, Homo sapiens
aatgttctttaatgt

SEQ ID NO: 2681688 - DNA, 14 bp, Homo sapiens
aatgtttaaatata

SEQ ID NO: 2681689 - DNA, 17 bp, Homo sapiens
aatgttttgtacaatta

SEQ ID NO: 2681690 - DNA, 14 bp, Homo sapiens
aattccactggact

SEQ ID NO: 2681691 - DNA, 11 bp, Homo sapiens
aattcctgggc

SEQ ID NO: 2681692 - DNA, 21 bp, Homo sapiens
aattcctgtagcatcttctgg

SEQ ID NO: 2681693 - DNA, 13 bp, Homo sapiens
aattcttgaagtt

SEQ ID NO: 2681694 - DNA, 17 bp, Homo sapiens
aattgaaggagaaaatg

SEQ ID NO: 2681695 - DNA, 20 bp, Homo sapiens
aattgtatacattttgttat

SEQ ID NO: 2681696 - DNA, 22 bp, Homo sapiens
aattgtatacattttgttatag

SEQ ID NO: 2681697 - DNA, 22 bp, Homo sapiens
aatttcccacaccccagcgcct

SEQ ID NO: 2681698 - DNA, 21 bp, Homo sapiens
aattttactgacagaaatgca

SEQ ID NO: 2681699 - DNA, 15 bp, Homo sapiens
aattttttttaatgt

SEQ ID NO: 2681700 - DNA, 20 bp, Homo sapiens
aattttttttaatgtacaag

SEQ ID NO: 2681701 - DNA, 14 bp, Homo sapiens
acaacagcagatgg

SEQ ID NO: 2681702 - DNA, 18 bp, Homo sapiens
acaagccacagaagccag

SEQ ID NO: 2681703 - DNA, 16 bp, Homo sapiens
acaagtcttgctgtgc

SEQ ID NO: 2681704 - DNA, 21 bp, Homo sapiens
acaataaatgctgaatgaatc

SEQ ID NO: 2681705 - DNA, 18 bp, Homo sapiens
acaattactaaattgtat

SEQ ID NO: 2681706 - DNA, 14 bp, Homo sapiens
acaatttttgatca

SEQ ID NO: 2681707 - DNA, 16 bp, Homo sapiens
acacatatatgtatat

SEQ ID NO: 2681708 - DNA, 13 bp, Homo sapiens
acaccccagcgcc

SEQ ID NO: 2681709 - DNA, 14 bp, Homo sapiens
acttgaggacacat

SEQ ID NO: 2681710 - DNA, 17 bp, Homo sapiens
acttgaggacacatgtc

SEQ ID NO: 2681711 - DNA, 19 bp, Homo sapiens
acttggtttttggctcttt

SEQ ID NO: 2681712 - DNA, 20 bp, Homo sapiens
acttggtttttggctctttc

SEQ ID NO: 2681713 - DNA, 15 bp, Homo sapiens
actttaaaataaaat

SEQ ID NO: 2681714 - DNA, 20 bp, Homo sapiens
actttaattgcttaaaagac

SEQ ID NO: 2681715 - DNA, 16 bp, Homo sapiens
acttttattgagctct

SEQ ID NO: 2681716 - DNA, 17 bp, Homo sapiens
actttttctgagctttt

SEQ ID NO: 2681717 - DNA, 19 bp, Homo sapiens
agaaacacagggttttgta

SEQ ID NO: 2681718 - DNA, 23 bp, Homo sapiens
agaaacactaagctctctgggcc

SEQ ID NO: 2681719 - DNA, 15 bp, Homo sapiens
agaaagcaagatgta

SEQ ID NO: 2681720 - DNA, 22 bp, Homo sapiens
agaaataaaaatcaacttgtgt

SEQ ID NO: 2681721 - DNA, 14 bp, Homo sapiens
agaaattagccggg

SEQ ID NO: 2681722 - DNA, 13 bp, Homo sapiens
agaaattcctgta

SEQ ID NO: 2681723 - DNA, 20 bp, Homo sapiens
agaaattttactgacagaaa

SEQ ID NO: 2681724 - DNA, 14 bp, Homo sapiens
agaacacccactgg

SEQ ID NO: 2681725 - DNA, 18 bp, Homo sapiens
agaacaggacctctgctt

SEQ ID NO: 2681726 - DNA, 12 bp, Homo sapiens
agaacctcaggc

SEQ ID NO: 2681727 - DNA, 23 bp, Homo sapiens
agaacgatgcctgcaggcatgga

SEQ ID NO: 2681728 - DNA, 17 bp, Homo sapiens
agaactccttattttgt

SEQ ID NO: 2681729 - DNA, 23 bp, Homo sapiens
agaactggggttcaagcccaggc

SEQ ID NO: 2681730 - DNA, 23 bp, Homo sapiens
agaagagagtggggcctgccctc

SEQ ID NO: 2681731 - DNA, 20 bp, Homo sapiens
agaagccaggagcaaatgtt

SEQ ID NO: 2681732 - DNA, 17 bp, Homo sapiens
agaagcctgaggctggg

SEQ ID NO: 2681733 - DNA, 16 bp, Homo sapiens
agaaggagcaagagaa

SEQ ID NO: 2681734 - DNA, 13 bp, Homo sapiens
agaaggccaagaa

SEQ ID NO: 2681735 - DNA, 20 bp, Homo sapiens
agaagggttttccaccctgg

SEQ ID NO: 2681736 - DNA, 21 bp, Homo sapiens
agaagggttttccaccctgga

SEQ ID NO: 2681737 - DNA, 15 bp, Homo sapiens
agaagtctccctgca

SEQ ID NO: 2681738 - DNA, 16 bp, Homo sapiens
agaatcatgctgttct

SEQ ID NO: 2681739 - DNA, 20 bp, Homo sapiens
agaatcatgctgttctcttt

SEQ ID NO: 2681740 - DNA, 20 bp, Homo sapiens
agaatcgctttccttcctcc

SEQ ID NO: 2681741 - DNA, 15 bp, Homo sapiens
agaattaatatttat

SEQ ID NO: 2681742 - DNA, 16 bp, Homo sapiens
agacaagtcttgctgt

SEQ ID NO: 2681743 - DNA, 19 bp, Homo sapiens
agaccagcagcaatctgtc

SEQ ID NO: 2681744 - DNA, 14 bp, Homo sapiens
agaccagcctggcc

SEQ ID NO: 2681745 - DNA, 22 bp, Homo sapiens
agaccattgtcttccaacccca

SEQ ID NO: 2681746 - DNA, 21 bp, Homo sapiens
agactaaggggcagctcctga

SEQ ID NO: 2681747 - DNA, 19 bp, Homo sapiens
agactccaatggggccagc

SEQ ID NO: 2681748 - DNA, 22 bp, Homo sapiens
agactccaatggggccagcact

SEQ ID NO: 2681749 - DNA, 15 bp, Homo sapiens
agactggagcatctg

SEQ ID NO: 2681750 - DNA, 18 bp, Homo sapiens
agactggagcatctgact

SEQ ID NO: 2681751 - DNA, 19 bp, Homo sapiens
agactgtcattgcccctcc

SEQ ID NO: 2681752 - DNA, 15 bp, Homo sapiens
agacttgagccatcc

SEQ ID NO: 2681753 - DNA, 18 bp, Homo sapiens
agagactaaggggcagct

SEQ ID NO: 2681754 - DNA, 14 bp, Homo sapiens
agagcacccacagc

SEQ ID NO: 2681755 - DNA, 18 bp, Homo sapiens
agagcacccacagccgca

SEQ ID NO: 2681756 - DNA, 23 bp, Homo sapiens
agagccagatgcctccccaagac

SEQ ID NO: 2681757 - DNA, 14 bp, Homo sapiens
agagcccagccatt

SEQ ID NO: 2681758 - DNA, 16 bp, Homo sapiens
agagccctccaggcct

SEQ ID NO: 2681759 - DNA, 16 bp, Homo sapiens
agagccgggaagcgat

SEQ ID NO: 2681760 - DNA, 15 bp, Homo sapiens
agagctcctgtccct

SEQ ID NO: 2681761 - DNA, 18 bp, Homo sapiens
agagctcctgtccctacc

SEQ ID NO: 2681762 - DNA, 10 bp, Homo sapiens
agaggaagaa

SEQ ID NO: 2681763 - DNA, 21 bp, Homo sapiens
agagggccaacaactgtccct

SEQ ID NO: 2681764 - DNA, 22 bp, Homo sapiens
agagggccaacaactgtccctc

SEQ ID NO: 2681765 - DNA, 16 bp, Homo sapiens
agagggcccaggcagg

SEQ ID NO: 2681766 - DNA, 20 bp, Homo sapiens
agagtgaagagtagaaccca

SEQ ID NO: 2681767 - DNA, 15 bp, Homo sapiens
agagtgagaccctgt

SEQ ID NO: 2681768 - DNA, 19 bp, Homo sapiens
agatatcagagctcttaat

SEQ ID NO: 2681769 - DNA, 17 bp, Homo sapiens
agatcagagctgcagcc

SEQ ID NO: 2681770 - DNA, 13 bp, Homo sapiens
agatcccatctct

SEQ ID NO: 2681771 - DNA, 20 bp, Homo sapiens
agatctttttgtgaaattca

SEQ ID NO: 2681772 - DNA, 15 bp, Homo sapiens
agatgactgagtcct

SEQ ID NO: 2681773 - DNA, 21 bp, Homo sapiens
agatgcccagagggcccaggc

SEQ ID NO: 2681774 - DNA, 15 bp, Homo sapiens
agatggactctgaaa

SEQ ID NO: 2681775 - DNA, 20 bp, Homo sapiens
agatggtaatctacagctca

SEQ ID NO: 2681776 - DNA, 15 bp, Homo sapiens
agattagctctggac

SEQ ID NO: 2681777 - DNA, 19 bp, Homo sapiens
agattatatatcataaagt

SEQ ID NO: 2681778 - DNA, 16 bp, Homo sapiens
agattgggctggctct

SEQ ID NO: 2681779 - DNA, 22 bp, Homo sapiens
agattgggctggctctgaagcc

SEQ ID NO: 2681780 - DNA, 20 bp, Homo sapiens
agatttttgtaaaaagctac

SEQ ID NO: 2681781 - DNA, 15 bp, Homo sapiens
agcaaaatgcatgta

SEQ ID NO: 2681782 - DNA, 19 bp, Homo sapiens
agcaaagccacattttgca

SEQ ID NO: 2681783 - DNA, 14 bp, Homo sapiens
agcaaagcctccag

SEQ ID NO: 2681784 - DNA, 16 bp, Homo sapiens
agcaaatgtttctgca

SEQ ID NO: 2681785 - DNA, 18 bp, Homo sapiens
agcaaatgtttctgcagt

SEQ ID NO: 2681786 - DNA, 22 bp, Homo sapiens
agcaacagagtgagaccctgtc

SEQ ID NO: 2681787 - DNA, 12 bp, Homo sapiens
agcaagctctgc

SEQ ID NO: 2681788 - DNA, 13 bp, Homo sapiens
agcaagctctgcc

SEQ ID NO: 2681789 - DNA, 16 bp, Homo sapiens
agcaagctctgccctg

SEQ ID NO: 2681790 - DNA, 19 bp, Homo sapiens
agcaagctctgccctggct

SEQ ID NO: 2681791 - DNA, 23 bp, Homo sapiens
agcaagctctgccctggctgtgg

SEQ ID NO: 2681792 - DNA, 13 bp, Homo sapiens
agcaatctgtctt

SEQ ID NO: 2681793 - DNA, 14 bp, Homo sapiens
agcaatctgtcttt

SEQ ID NO: 2681794 - DNA, 21 bp, Homo sapiens
agcacacacacataagcactg

SEQ ID NO: 2681795 - DNA, 20 bp, Homo sapiens
agcacagcgtttacatattt

SEQ ID NO: 2681796 - DNA, 16 bp, Homo sapiens
agcacccacagccgca

SEQ ID NO: 2681797 - DNA, 17 bp, Homo sapiens
agcactggaggggccca

SEQ ID NO: 2681798 - DNA, 23 bp, Homo sapiens
agcactggaggggcccacccaca

SEQ ID NO: 2681799 - DNA, 14 bp, Homo sapiens
agcactttttaaaa

SEQ ID NO: 2681800 - DNA, 15 bp, Homo sapiens
agcagagcaggggca

SEQ ID NO: 2681801 - DNA, 17 bp, Homo sapiens
agcagcaatctgtcttt

SEQ ID NO: 2681802 - DNA, 15 bp, Homo sapiens
agcagcacacctcag

SEQ ID NO: 2681803 - DNA, 18 bp, Homo sapiens
agcagcccatggcctctg

SEQ ID NO: 2681804 - DNA, 19 bp, Homo sapiens
agcaggtggcatctctaat

SEQ ID NO: 2681805 - DNA, 20 bp, Homo sapiens
agcaggttgaggggctcctg

SEQ ID NO: 2681806 - DNA, 13 bp, Homo sapiens
agcatcacctcag

SEQ ID NO: 2681807 - DNA, 16 bp, Homo sapiens
agcatcacctcaggcc

SEQ ID NO: 2681808 - DNA, 12 bp, Homo sapiens
agcatcttctgg

SEQ ID NO: 2681809 - DNA, 19 bp, Homo sapiens
agcatcttttccatcctga

SEQ ID NO: 2681810 - DNA, 15 bp, Homo sapiens
agcatggagagcctc

SEQ ID NO: 2681811 - DNA, 20 bp, Homo sapiens
agcatggagagcctcttagt

SEQ ID NO: 2681812 - DNA, 14 bp, Homo sapiens
agcattaggctttt

SEQ ID NO: 2681813 - DNA, 21 bp, Homo sapiens
agcattaggcttttaagaaac

SEQ ID NO: 2681814 - DNA, 15 bp, Homo sapiens
agcattattcttcag

SEQ ID NO: 2681815 - DNA, 20 bp, Homo sapiens
agccaaggtgggctgagccc

SEQ ID NO: 2681816 - DNA, 22 bp, Homo sapiens
agccaaggtgggctgagccctg

SEQ ID NO: 2681817 - DNA, 12 bp, Homo sapiens
agccacagaagc

SEQ ID NO: 2681818 - DNA, 14 bp, Homo sapiens
agccacctccttgg

SEQ ID NO: 2681819 - DNA, 19 bp, Homo sapiens
agtgctttacatgctgtgc

SEQ ID NO: 2681820 - DNA, 17 bp, Homo sapiens
agtggctcacgcctgta

SEQ ID NO: 2681821 - DNA, 22 bp, Homo sapiens
agtgggcaggaggccccaggct

SEQ ID NO: 2681822 - DNA, 14 bp, Homo sapiens
agtggggcctgccc

SEQ ID NO: 2681823 - DNA, 16 bp, Homo sapiens
agtggttttaataaaa

SEQ ID NO: 2681824 - DNA, 15 bp, Homo sapiens
agtgtaactggctgc

SEQ ID NO: 2681825 - DNA, 23 bp, Homo sapiens
agtgtaactggctgctccctgct

SEQ ID NO: 2681826 - DNA, 13 bp, Homo sapiens
agtgtagccttgc

SEQ ID NO: 2681827 - DNA, 17 bp, Homo sapiens
agtgtagccttgcccgg

SEQ ID NO: 2681828 - DNA, 18 bp, Homo sapiens
agtgtccccaaagactac

SEQ ID NO: 2681829 - DNA, 19 bp, Homo sapiens
agtgtcttcctagtatatt

SEQ ID NO: 2681830 - DNA, 16 bp, Homo sapiens
agtgtgcagtggtgca

SEQ ID NO: 2681831 - DNA, 18 bp, Homo sapiens
agtgttcattttagtgac

SEQ ID NO: 2681832 - DNA, 21 bp, Homo sapiens
agtgttcattttagtgactgt

SEQ ID NO: 2681833 - DNA, 14 bp, Homo sapiens
agttagctcaggag

SEQ ID NO: 2681834 - DNA, 16 bp, Homo sapiens
agttagctcaggaggc

SEQ ID NO: 2681835 - DNA, 15 bp, Homo sapiens
agttatagaaagcaa

SEQ ID NO: 2681836 - DNA, 17 bp, Homo sapiens
agttattgaatcttaat

SEQ ID NO: 2681837 - DNA, 19 bp, Homo sapiens
agttattgaatcttaattt

SEQ ID NO: 2681838 - DNA, 18 bp, Homo sapiens
agttcctctagtgccctc

SEQ ID NO: 2681839 - DNA, 19 bp, Homo sapiens
agttctggggcccgcctgc

SEQ ID NO: 2681840 - DNA, 18 bp, Homo sapiens
agttgtggaaagcctctg

SEQ ID NO: 2681841 - DNA, 20 bp, Homo sapiens
agttgtggaaagcctctgct

SEQ ID NO: 2681842 - DNA, 19 bp, Homo sapiens
agtttcagtaaataatgaa

SEQ ID NO: 2681843 - DNA, 21 bp, Homo sapiens
agtttcagtaaataatgaaaa

SEQ ID NO: 2681844 - DNA, 15 bp, Homo sapiens
agtttcatcagccct

SEQ ID NO: 2681845 - DNA, 17 bp, Homo sapiens
agtttgtggtaaaaaga

SEQ ID NO: 2681846 - DNA, 19 bp, Homo sapiens
agtttgtggtaaaaagatt

SEQ ID NO: 2681847 - DNA, 17 bp, Homo sapiens
agttttgaaagaaaaat

SEQ ID NO: 2681848 - DNA, 21 bp, Homo sapiens
agttttgatgaaattcttgaa

SEQ ID NO: 2681849 - DNA, 11 bp, Homo sapiens
agttttgtata

SEQ ID NO: 2681850 - DNA, 17 bp, Homo sapiens
agttttgtataaataat

SEQ ID NO: 2681851 - DNA, 18 bp, Homo sapiens
agttttgtataaataata

SEQ ID NO: 2681852 - DNA, 20 bp, Homo sapiens
agttttgtataaataataaa

SEQ ID NO: 2681853 - DNA, 16 bp, Homo sapiens
agttttttttgtaaac

SEQ ID NO: 2681854 - DNA, 17 bp, Homo sapiens
ataaaatactctagcct

SEQ ID NO: 2681855 - DNA, 21 bp, Homo sapiens
ataaagaactccttattttgt

SEQ ID NO: 2681856 - DNA, 22 bp, Homo sapiens
ataaagaactccttattttgta

SEQ ID NO: 2681857 - DNA, 21 bp, Homo sapiens
ataaaggtatttagaatatat

SEQ ID NO: 2681858 - DNA, 20 bp, Homo sapiens
ataaatgtttaaatataaat

SEQ ID NO: 2681859 - DNA, 14 bp, Homo sapiens
ataaatgtttgtct

SEQ ID NO: 2681860 - DNA, 17 bp, Homo sapiens
ataactacatattgaat

SEQ ID NO: 2681861 - DNA, 21 bp, Homo sapiens
ataaggcggcgtgggcgaggc

SEQ ID NO: 2681862 - DNA, 18 bp, Homo sapiens
ataatagattgtgaataa

SEQ ID NO: 2681863 - DNA, 19 bp, Homo sapiens
ataatggtgttactaaagt

SEQ ID NO: 2681864 - DNA, 21 bp, Homo sapiens
ataatggtgttactaaagtca

SEQ ID NO: 2681865 - DNA, 21 bp, Homo sapiens
ataatgttctttaatgttgtc

SEQ ID NO: 2681866 - DNA, 14 bp, Homo sapiens
atacagaatgaatc

SEQ ID NO: 2681867 - DNA, 18 bp, Homo sapiens
atacattttgttatagaa

SEQ ID NO: 2681868 - DNA, 17 bp, Homo sapiens
ataccagtgaaccaaag

SEQ ID NO: 2681869 - DNA, 15 bp, Homo sapiens
ataccatgtctctaa

SEQ ID NO: 2681870 - DNA, 17 bp, Homo sapiens
atactcctatgctttag

SEQ ID NO: 2681871 - DNA, 11 bp, Homo sapiens
atacttcctgg

SEQ ID NO: 2681872 - DNA, 23 bp, Homo sapiens
atacttcctgggatgatgtgtga

SEQ ID NO: 2681873 - DNA, 22 bp, Homo sapiens
atagaatacttttttctagttt

SEQ ID NO: 2681874 - DNA, 19 bp, Homo sapiens
atagattgtgaataatgat

SEQ ID NO: 2681875 - DNA, 21 bp, Homo sapiens
ataggaaatggtatccagaat

SEQ ID NO: 2681876 - DNA, 21 bp, Homo sapiens
atagtcatggggtccctgctg

SEQ ID NO: 2681877 - DNA, 13 bp, Homo sapiens
atatatcataaag

SEQ ID NO: 2681878 - DNA, 16 bp, Homo sapiens
atatatcataaagtat

SEQ ID NO: 2681879 - DNA, 16 bp, Homo sapiens
atatatctcaaattgt

SEQ ID NO: 2681880 - DNA, 12 bp, Homo sapiens
atatatgtatat

SEQ ID NO: 2681881 - DNA, 23 bp, Homo sapiens
atatatgtatatgtatatctata

SEQ ID NO: 2681882 - DNA, 12 bp, Homo sapiens
atatcataaagt

SEQ ID NO: 2681883 - DNA, 18 bp, Homo sapiens
atatctatatctctaaac

SEQ ID NO: 2681884 - DNA, 13 bp, Homo sapiens
atatgcttcttta

SEQ ID NO: 2681885 - DNA, 15 bp, Homo sapiens
atatgcttctttaaa

SEQ ID NO: 2681886 - DNA, 16 bp, Homo sapiens
atatgtatatgtatat

SEQ ID NO: 2681887 - DNA, 13 bp, Homo sapiens
atattcaataaag

SEQ ID NO: 2681888 - DNA, 23 bp, Homo sapiens
atattcagtgctgtggcctgggc

SEQ ID NO: 2681889 - DNA, 21 bp, Homo sapiens
atattctacacatatatgtat

SEQ ID NO: 2681890 - DNA, 15 bp, Homo sapiens
atattctatgaccac

SEQ ID NO: 2681891 - DNA, 13 bp, Homo sapiens
atatttactttaa

SEQ ID NO: 2681892 - DNA, 17 bp, Homo sapiens
atatttgtgtgttcact

SEQ ID NO: 2681893 - DNA, 16 bp, Homo sapiens
atcaagctagaaggcc

SEQ ID NO: 2681894 - DNA, 14 bp, Homo sapiens
atcacccaggcctg

SEQ ID NO: 2681895 - DNA, 23 bp, Homo sapiens
atcacccaggcctgattcactgg

SEQ ID NO: 2681896 - DNA, 12 bp, Homo sapiens
atcacctcaggc

SEQ ID NO: 2681897 - DNA, 14 bp, Homo sapiens
atcacctcaggcca

SEQ ID NO: 2681898 - DNA, 15 bp, Homo sapiens
atcacctcaggccag

SEQ ID NO: 2681899 - DNA, 12 bp, Homo sapiens
atcacctgaggt

SEQ ID NO: 2681900 - DNA, 23 bp, Homo sapiens
atcacgccactgcactccagcct

SEQ ID NO: 2681901 - DNA, 15 bp, Homo sapiens
atcactctctgctgg

SEQ ID NO: 2681902 - DNA, 10 bp, Homo sapiens
atcactggag

SEQ ID NO: 2681903 - DNA, 20 bp, Homo sapiens
atcactttacctgcaggctc

SEQ ID NO: 2681904 - DNA, 21 bp, Homo sapiens
atcactttacctgcaggctcc

SEQ ID NO: 2681905 - DNA, 14 bp, Homo sapiens
atcagagctcttaa

SEQ ID NO: 2681906 - DNA, 21 bp, Homo sapiens
atcagagctcttaatgttgct

SEQ ID NO: 2681907 - DNA, 15 bp, Homo sapiens
atcagagctgcagcc

SEQ ID NO: 2681908 - DNA, 15 bp, Homo sapiens
atcaggactgtgacc

SEQ ID NO: 2681909 - DNA, 19 bp, Homo sapiens
atcaggactgtgaccaaag

SEQ ID NO: 2681910 - DNA, 19 bp, Homo sapiens
atcaggatttcctcttgaa

SEQ ID NO: 2681911 - DNA, 14 bp, Homo sapiens
atcagtaaacactg

SEQ ID NO: 2681912 - DNA, 12 bp, Homo sapiens
atcatctctgtg

SEQ ID NO: 2681913 - DNA, 13 bp, Homo sapiens
atcatctctgtga

SEQ ID NO: 2681914 - DNA, 22 bp, Homo sapiens
atcatgctgttctctttgctga

SEQ ID NO: 2681915 - DNA, 20 bp, Homo sapiens
atccaaccccccacctgcca

SEQ ID NO: 2681916 - DNA, 15 bp, Homo sapiens
atcccaagtgccagt

SEQ ID NO: 2681917 - DNA, 13 bp, Homo sapiens
atcccaggagggg

SEQ ID NO: 2681918 - DNA, 13 bp, Homo sapiens
atcccaggccagg

SEQ ID NO: 2681919 - DNA, 20 bp, Homo sapiens
atcctgaggtgcctcccagt

SEQ ID NO: 2681920 - DNA, 16 bp, Homo sapiens
atcctgctccagcagc

SEQ ID NO: 2681921 - DNA, 19 bp, Homo sapiens
atcctgctccagcagcaca

SEQ ID NO: 2681922 - DNA, 21 bp, Homo sapiens
atcctgcttcctgaaagctgt

SEQ ID NO: 2681923 - DNA, 23 bp, Homo sapiens
atcgcgccactacactccagcct

SEQ ID NO: 2681924 - DNA, 17 bp, Homo sapiens
atcgctttccttcctcc

SEQ ID NO: 2681925 - DNA, 18 bp, Homo sapiens
atctagccagaggctgga

SEQ ID NO: 2681926 - DNA, 17 bp, Homo sapiens
atctagttttttttgta

SEQ ID NO: 2681927 - DNA, 14 bp, Homo sapiens
atctataaacactg

SEQ ID NO: 2681928 - DNA, 19 bp, Homo sapiens
atctataactacatattga

SEQ ID NO: 2681929 - DNA, 14 bp, Homo sapiens
caggtcgagctgtg

SEQ ID NO: 2681930 - DNA, 16 bp, Homo sapiens
caggtcgagctgtgct

SEQ ID NO: 2681931 - DNA, 19 bp, Homo sapiens
caggtctgatgccaaagct

SEQ ID NO: 2681932 - DNA, 19 bp, Homo sapiens
caggtgagcaggcagggct

SEQ ID NO: 2681933 - DNA, 15 bp, Homo sapiens
caggtgcagtggctc

SEQ ID NO: 2681934 - DNA, 15 bp, Homo sapiens
caggttgaccgggac

SEQ ID NO: 2681935 - DNA, 22 bp, Homo sapiens
caggttgaggtgcgctcacctc

SEQ ID NO: 2681936 - DNA, 21 bp, Homo sapiens
cagtaaacactgtgtattgtt

SEQ ID NO: 2681937 - DNA, 18 bp, Homo sapiens
cagtccgcagtctggcct

SEQ ID NO: 2681938 - DNA, 13 bp, Homo sapiens
cagtcctagagct

SEQ ID NO: 2681939 - DNA, 22 bp, Homo sapiens
cagtcctagagctcctgtccct

SEQ ID NO: 2681940 - DNA, 13 bp, Homo sapiens
cagtctcaggagc

SEQ ID NO: 2681941 - DNA, 17 bp, Homo sapiens
cagtctgcgtcaggcac

SEQ ID NO: 2681942 - DNA, 15 bp, Homo sapiens
cagtctggcctgggc

SEQ ID NO: 2681943 - DNA, 20 bp, Homo sapiens
cagtgaaccaaagagactgg

SEQ ID NO: 2681944 - DNA, 22 bp, Homo sapiens
cagtgacgtgcacctgtactca

SEQ ID NO: 2681945 - DNA, 13 bp, Homo sapiens
cagtgacttctgg

SEQ ID NO: 2681946 - DNA, 16 bp, Homo sapiens
cagtgacttctggctt

SEQ ID NO: 2681947 - DNA, 13 bp, Homo sapiens
cagtgaggctggg

SEQ ID NO: 2681948 - DNA, 13 bp, Homo sapiens
cagtgctgtggcc

SEQ ID NO: 2681949 - DNA, 15 bp, Homo sapiens
cagtgctgtggcctg

SEQ ID NO: 2681950 - DNA, 18 bp, Homo sapiens
cagtgctgtggcctgggc

SEQ ID NO: 2681951 - DNA, 15 bp, Homo sapiens
cagtgcttcagcctg

SEQ ID NO: 2681952 - DNA, 17 bp, Homo sapiens
cagtgcttcagcctgag

SEQ ID NO: 2681953 - DNA, 15 bp, Homo sapiens
cagtgggcaggaggc

SEQ ID NO: 2681954 - DNA, 22 bp, Homo sapiens
cagtgggcaggaggccccaggc

SEQ ID NO: 2681955 - DNA, 16 bp, Homo sapiens
cagtgtaactggctgc

SEQ ID NO: 2681956 - DNA, 20 bp, Homo sapiens
cagtgtaactggctgctccc

SEQ ID NO: 2681957 - DNA, 19 bp, Homo sapiens
cagtgtagccttgcccgga

SEQ ID NO: 2681958 - DNA, 18 bp, Homo sapiens
cagtgtgatcccaagtgc

SEQ ID NO: 2681959 - DNA, 21 bp, Homo sapiens
cagttcagagttgtacactgt

SEQ ID NO: 2681960 - DNA, 18 bp, Homo sapiens
cagttctggggcccgcct

SEQ ID NO: 2681961 - DNA, 12 bp, Homo sapiens
cataaaatctgt

SEQ ID NO: 2681962 - DNA, 17 bp, Homo sapiens
cataaaatctgtgaatt

SEQ ID NO: 2681963 - DNA, 15 bp, Homo sapiens
cataacaaaccatct

SEQ ID NO: 2681964 - DNA, 14 bp, Homo sapiens
catacttcctggga

SEQ ID NO: 2681965 - DNA, 16 bp, Homo sapiens
catacttcctgggatg

SEQ ID NO: 2681966 - DNA, 15 bp, Homo sapiens
catcacagggcagag

SEQ ID NO: 2681967 - DNA, 22 bp, Homo sapiens
catcagcagcccatggcctctg

SEQ ID NO: 2681968 - DNA, 16 bp, Homo sapiens
catcagccctagggaa

SEQ ID NO: 2681969 - DNA, 15 bp, Homo sapiens
catcattgcacctgc

SEQ ID NO: 2681970 - DNA, 16 bp, Homo sapiens
catcattgcacctgca

SEQ ID NO: 2681971 - DNA, 18 bp, Homo sapiens
catcattgcacctgcagg

SEQ ID NO: 2681972 - DNA, 16 bp, Homo sapiens
catccaaccccccacc

SEQ ID NO: 2681973 - DNA, 21 bp, Homo sapiens
catccaaccccccacctgcca

SEQ ID NO: 2681974 - DNA, 20 bp, Homo sapiens
catcctgaaagccagcaaag

SEQ ID NO: 2681975 - DNA, 22 bp, Homo sapiens
catcctgaaagccagcaaagcc

SEQ ID NO: 2681976 - DNA, 15 bp, Homo sapiens
catcctgaggtgcct

SEQ ID NO: 2681977 - DNA, 20 bp, Homo sapiens
catcctgaggtgcctcccag

SEQ ID NO: 2681978 - DNA, 21 bp, Homo sapiens
catcctgaggtgcctcccagt

SEQ ID NO: 2681979 - DNA, 15 bp, Homo sapiens
catcctgcttcctga

SEQ ID NO: 2681980 - DNA, 22 bp, Homo sapiens
catcctgcttcctgaaagctgt

SEQ ID NO: 2681981 - DNA, 23 bp, Homo sapiens
catcctgcttcctgaaagctgtt

SEQ ID NO: 2681982 - DNA, 17 bp, Homo sapiens
catccttttctgcagag

SEQ ID NO: 2681983 - DNA, 13 bp, Homo sapiens
catctagccagag

SEQ ID NO: 2681984 - DNA, 23 bp, Homo sapiens
catctctctactcctacctcagc

SEQ ID NO: 2681985 - DNA, 20 bp, Homo sapiens
catctctggttgacgggctg

SEQ ID NO: 2681986 - DNA, 16 bp, Homo sapiens
catgaagacaggacag

SEQ ID NO: 2681987 - DNA, 21 bp, Homo sapiens
catgaggacatgatggagcgc

SEQ ID NO: 2681988 - DNA, 22 bp, Homo sapiens
catgaggacatgatggagcgca

SEQ ID NO: 2681989 - DNA, 21 bp, Homo sapiens
catgaggataacttccttgcc

SEQ ID NO: 2681990 - DNA, 19 bp, Homo sapiens
catgcagactcctcagatc

SEQ ID NO: 2681991 - DNA, 18 bp, Homo sapiens
catgccgcgtccctgccc

SEQ ID NO: 2681992 - DNA, 20 bp, Homo sapiens
catgctggggcaagtccctg

SEQ ID NO: 2681993 - DNA, 13 bp, Homo sapiens
catgctgttctct

SEQ ID NO: 2681994 - DNA, 16 bp, Homo sapiens
catgctgttctctttg

SEQ ID NO: 2681995 - DNA, 19 bp, Homo sapiens
catgctgttctctttgctg

SEQ ID NO: 2681996 - DNA, 22 bp, Homo sapiens
catgctgttctctttgctgaca

SEQ ID NO: 2681997 - DNA, 18 bp, Homo sapiens
catgcttgtgtttcttag

SEQ ID NO: 2681998 - DNA, 19 bp, Homo sapiens
catgcttgtgtttcttagt

SEQ ID NO: 2681999 - DNA, 13 bp, Homo sapiens
catggcgaggctg

SEQ ID NO: 2682000 - DNA, 14 bp, Homo sapiens
catggcgtgtccct

SEQ ID NO: 2682001 - DNA, 16 bp, Homo sapiens
catggtgctgcattga

SEQ ID NO: 2682002 - DNA, 23 bp, Homo sapiens
cattatttcaaccgcttgccata

SEQ ID NO: 2682003 - DNA, 17 bp, Homo sapiens
cattcacacagggctct

SEQ ID NO: 2682004 - DNA, 22 bp, Homo sapiens
cattgaccagctctcttcctgt

SEQ ID NO: 2682005 - DNA, 14 bp, Homo sapiens
cattgagtccagct

SEQ ID NO: 2682006 - DNA, 16 bp, Homo sapiens
cattgatttgattttt

SEQ ID NO: 2682007 - DNA, 21 bp, Homo sapiens
cattgcccctccgatgctgag

SEQ ID NO: 2682008 - DNA, 21 bp, Homo sapiens
cattgtagaaacacagttttg

SEQ ID NO: 2682009 - DNA, 12 bp, Homo sapiens
cattgtcttcca

SEQ ID NO: 2682010 - DNA, 15 bp, Homo sapiens
cattgtcttccaacc

SEQ ID NO: 2682011 - DNA, 19 bp, Homo sapiens
cattgttattgtggaagat

SEQ ID NO: 2682012 - DNA, 17 bp, Homo sapiens
cattgtttttctgatat

SEQ ID NO: 2682013 - DNA, 15 bp, Homo sapiens
catttgcaccctccg

SEQ ID NO: 2682014 - DNA, 22 bp, Homo sapiens
catttttatcaggatttcctct

SEQ ID NO: 2682015 - DNA, 23 bp, Homo sapiens
catttttattaatatggtgactt

SEQ ID NO: 2682016 - DNA, 16 bp, Homo sapiens
ccaaaagatgccttga

SEQ ID NO: 2682017 - DNA, 16 bp, Homo sapiens
ccaaaagtacttaccc

SEQ ID NO: 2682018 - DNA, 17 bp, Homo sapiens
ccaaagagactggagca

SEQ ID NO: 2682019 - DNA, 19 bp, Homo sapiens
ccaaagcattgcctgccag

SEQ ID NO: 2682020 - DNA, 16 bp, Homo sapiens
ccaaagccacctgctg

SEQ ID NO: 2682021 - DNA, 13 bp, Homo sapiens
ccaaagctgcttt

SEQ ID NO: 2682022 - DNA, 15 bp, Homo sapiens
ccaaccccagctggc

SEQ ID NO: 2682023 - DNA, 19 bp, Homo sapiens
ccaaccccagctggcctct

SEQ ID NO: 2682024 - DNA, 16 bp, Homo sapiens
ccaactgatcctgctc

SEQ ID NO: 2682025 - DNA, 17 bp, Homo sapiens
ccaactgatcctgctcc

SEQ ID NO: 2682026 - DNA, 20 bp, Homo sapiens
ccaactgatcctgctccagc

SEQ ID NO: 2682027 - DNA, 21 bp, Homo sapiens
ccaactgatcctgctccagca

SEQ ID NO: 2682028 - DNA, 18 bp, Homo sapiens
ccaaggtgggctgagccc

SEQ ID NO: 2682029 - DNA, 15 bp, Homo sapiens
ccaatagctctactg

SEQ ID NO: 2682030 - DNA, 18 bp, Homo sapiens
ccaatggggccagcactg

SEQ ID NO: 2682031 - DNA, 23 bp, Homo sapiens
ccacacagaactggcaggagcct

SEQ ID NO: 2682032 - DNA, 17 bp, Homo sapiens
ccacagaagccaggagc

SEQ ID NO: 2682033 - DNA, 21 bp, Homo sapiens
ccacatgccgcgtccctgccc

SEQ ID NO: 2682034 - DNA, 21 bp, Homo sapiens
ccaccccccacgtctgtcctc

SEQ ID NO: 2682035 - DNA, 13 bp, Homo sapiens
ccaccccttcctg

SEQ ID NO: 2682036 - DNA, 17 bp, Homo sapiens
ccaccctcgtggacacc

SEQ ID NO: 2682037 - DNA, 19 bp, Homo sapiens
ccaccctcgtggacacctg

SEQ ID NO: 2682038 - DNA, 18 bp, Homo sapiens
cctcgtggacacctgccc

SEQ ID NO: 2682039 - DNA, 22 bp, Homo sapiens
cctcgtggacacctgccctgcc

SEQ ID NO: 2682040 - DNA, 12 bp, Homo sapiens
cctctagaacac

SEQ ID NO: 2682041 - DNA, 17 bp, Homo sapiens
cctctagaacacccact

SEQ ID NO: 2682042 - DNA, 19 bp, Homo sapiens
cctctagaacacccactgg

SEQ ID NO: 2682043 - DNA, 20 bp, Homo sapiens
cctctagaacacccactggc

SEQ ID NO: 2682044 - DNA, 18 bp, Homo sapiens
cctctcaatattcaataa

SEQ ID NO: 2682045 - DNA, 11 bp, Homo sapiens
cctctcccagc

SEQ ID NO: 2682046 - DNA, 17 bp, Homo sapiens
cctctcccagccctcag

SEQ ID NO: 2682047 - DNA, 16 bp, Homo sapiens
cctctgacctgcaggc

SEQ ID NO: 2682048 - DNA, 20 bp, Homo sapiens
cctctgacctgcaggccaag

SEQ ID NO: 2682049 - DNA, 15 bp, Homo sapiens
cctctgctgccatgg

SEQ ID NO: 2682050 - DNA, 16 bp, Homo sapiens
cctctggatggcacca

SEQ ID NO: 2682051 - DNA, 15 bp, Homo sapiens
cctctggtttctgtg

SEQ ID NO: 2682052 - DNA, 18 bp, Homo sapiens
cctctggtttctgtgtgt

SEQ ID NO: 2682053 - DNA, 17 bp, Homo sapiens
cctcttggacctctgct

SEQ ID NO: 2682054 - DNA, 21 bp, Homo sapiens
cctcttggacctctgctctga

SEQ ID NO: 2682055 - DNA, 14 bp, Homo sapiens
cctgaaagccagca

SEQ ID NO: 2682056 - DNA, 22 bp, Homo sapiens
cctgaaagccagcaaagcctcc

SEQ ID NO: 2682057 - DNA, 23 bp, Homo sapiens
cctgaagatcagagctgcagcca

SEQ ID NO: 2682058 - DNA, 16 bp, Homo sapiens
cctgacacaggccagc

SEQ ID NO: 2682059 - DNA, 17 bp, Homo sapiens
cctgacacaggccagcc

SEQ ID NO: 2682060 - DNA, 21 bp, Homo sapiens
cctgacacgtgatggaccaaa

SEQ ID NO: 2682061 - DNA, 22 bp, Homo sapiens
cctgacacgtgatggaccaaag

SEQ ID NO: 2682062 - DNA, 16 bp, Homo sapiens
cctgactctctgtgac

SEQ ID NO: 2682063 - DNA, 17 bp, Homo sapiens
cctgactctctgtgacc

SEQ ID NO: 2682064 - DNA, 18 bp, Homo sapiens
cctgactctctgtgacct

SEQ ID NO: 2682065 - DNA, 21 bp, Homo sapiens
cctgagcaacagagtgagacc

SEQ ID NO: 2682066 - DNA, 20 bp, Homo sapiens
cctgagccacctttactctg

SEQ ID NO: 2682067 - DNA, 14 bp, Homo sapiens
cctgagggctcctc

SEQ ID NO: 2682068 - DNA, 16 bp, Homo sapiens
cctgagggctcctcca

SEQ ID NO: 2682069 - DNA, 15 bp, Homo sapiens
cctgattttgtagtt

SEQ ID NO: 2682070 - DNA, 22 bp, Homo sapiens
cctgcagccccgcgcctccttc

SEQ ID NO: 2682071 - DNA, 15 bp, Homo sapiens
cctgcaggctccatg

SEQ ID NO: 2682072 - DNA, 17 bp, Homo sapiens
cctgcaggctccatgca

SEQ ID NO: 2682073 - DNA, 18 bp, Homo sapiens
cctgcaggctccatgcac

SEQ ID NO: 2682074 - DNA, 14 bp, Homo sapiens
cctgccaccagtca

SEQ ID NO: 2682075 - DNA, 12 bp, Homo sapiens
cctgccacctgt

SEQ ID NO: 2682076 - DNA, 13 bp, Homo sapiens
cctgccacctgtc

SEQ ID NO: 2682077 - DNA, 15 bp, Homo sapiens
cctgccacctgtctg

SEQ ID NO: 2682078 - DNA, 16 bp, Homo sapiens
cctgccagcctggctt

SEQ ID NO: 2682079 - DNA, 13 bp, Homo sapiens
cctgccccctggt

SEQ ID NO: 2682080 - DNA, 17 bp, Homo sapiens
cctgccctcccctgctc

SEQ ID NO: 2682081 - DNA, 22 bp, Homo sapiens
cctgccctcccctgctcccagg

SEQ ID NO: 2682082 - DNA, 12 bp, Homo sapiens
cctgccctctgc

SEQ ID NO: 2682083 - DNA, 13 bp, Homo sapiens
cctgccctctgcc

SEQ ID NO: 2682084 - DNA, 15 bp, Homo sapiens
cctgccctgccacct

SEQ ID NO: 2682085 - DNA, 16 bp, Homo sapiens
cctgcctcatccacca

SEQ ID NO: 2682086 - DNA, 15 bp, Homo sapiens
cctgcctgccttctc

SEQ ID NO: 2682087 - DNA, 17 bp, Homo sapiens
cctgccttctcccctcc

SEQ ID NO: 2682088 - DNA, 21 bp, Homo sapiens
cctgccttgaagccactgaag

SEQ ID NO: 2682089 - DNA, 15 bp, Homo sapiens
cctgcgaaggggccc

SEQ ID NO: 2682090 - DNA, 17 bp, Homo sapiens
cctgcgaaggggccctg

SEQ ID NO: 2682091 - DNA, 19 bp, Homo sapiens
cctgcgaaggggccctggt

SEQ ID NO: 2682092 - DNA, 16 bp, Homo sapiens
cctgctagctgtctct

SEQ ID NO: 2682093 - DNA, 17 bp, Homo sapiens
cctgctagctgtctctc

SEQ ID NO: 2682094 - DNA, 20 bp, Homo sapiens
cctgctagctgtctctcttg

SEQ ID NO: 2682095 - DNA, 18 bp, Homo sapiens
cctgctccagcagcacac

SEQ ID NO: 2682096 - DNA, 20 bp, Homo sapiens
cctgctccagcagcacacct

SEQ ID NO: 2682097 - DNA, 12 bp, Homo sapiens
cctgctcccagg

SEQ ID NO: 2682098 - DNA, 16 bp, Homo sapiens
cctgctctgcttcctc

SEQ ID NO: 2682099 - DNA, 18 bp, Homo sapiens
cctgctctgtagccacct

SEQ ID NO: 2682100 - DNA, 13 bp, Homo sapiens
cctgctctttctc

SEQ ID NO: 2682101 - DNA, 14 bp, Homo sapiens
cctgctctttctct

SEQ ID NO: 2682102 - DNA, 19 bp, Homo sapiens
cctgctctttctctgagaa

SEQ ID NO: 2682103 - DNA, 12 bp, Homo sapiens
cctgcttcctga

SEQ ID NO: 2682104 - DNA, 15 bp, Homo sapiens
cctggaaaggctcag

SEQ ID NO: 2682105 - DNA, 17 bp, Homo sapiens
cctggaaaggctcagtc

SEQ ID NO: 2682106 - DNA, 20 bp, Homo sapiens
cctggaaaggctcagtctca

SEQ ID NO: 2682107 - DNA, 22 bp, Homo sapiens
cctggactgactgcagccccct

SEQ ID NO: 2682108 - DNA, 21 bp, Homo sapiens
cctggagcaagctctgccctg

SEQ ID NO: 2682109 - DNA, 23 bp, Homo sapiens
cctggagtcccgtccctgcccag

SEQ ID NO: 2682110 - DNA, 22 bp, Homo sapiens
cctggcaggatgaccctgcgaa

SEQ ID NO: 2682111 - DNA, 13 bp, Homo sapiens
cctggccctgcct

SEQ ID NO: 2682112 - DNA, 10 bp, Homo sapiens
cctggccctt

SEQ ID NO: 2682113 - DNA, 14 bp, Homo sapiens
cctggcttctggag

SEQ ID NO: 2682114 - DNA, 16 bp, Homo sapiens
cctggcttctggagcc

SEQ ID NO: 2682115 - DNA, 16 bp, Homo sapiens
cctggcttgcttgccg

SEQ ID NO: 2682116 - DNA, 21 bp, Homo sapiens
cctggcttgcttgccgagcct

SEQ ID NO: 2682117 - DNA, 14 bp, Homo sapiens
cctgggctctgccc

SEQ ID NO: 2682118 - DNA, 16 bp, Homo sapiens
cctgggtcctgcctgg

SEQ ID NO: 2682119 - DNA, 23 bp, Homo sapiens
cctgggtcctgcctggtcctccc

SEQ ID NO: 2682120 - DNA, 18 bp, Homo sapiens
cctggtactgcacatttt

SEQ ID NO: 2682121 - DNA, 20 bp, Homo sapiens
cctggtcctccctcccaagg

SEQ ID NO: 2682122 - DNA, 15 bp, Homo sapiens
cctggtccttccagg

SEQ ID NO: 2682123 - DNA, 17 bp, Homo sapiens
cctggtgcactggcccc

SEQ ID NO: 2682124 - DNA, 22 bp, Homo sapiens
cctggtgggtcagcccagcacc

SEQ ID NO: 2682125 - DNA, 19 bp, Homo sapiens
cctggtggtcacaggctgt

SEQ ID NO: 2682126 - DNA, 22 bp, Homo sapiens
cctggtggtcacaggctgtgcc

SEQ ID NO: 2682127 - DNA, 24 bp, Homo sapiens
cctggtggtcacaggctgtgcctt

SEQ ID NO: 2682128 - DNA, 14 bp, Homo sapiens
cctgtactcaggag

SEQ ID NO: 2682129 - DNA, 15 bp, Homo sapiens
cctgtactcaggagg

SEQ ID NO: 2682130 - DNA, 22 bp, Homo sapiens
cctgtactcaggaggctgaggg

SEQ ID NO: 2682131 - DNA, 18 bp, Homo sapiens
cctgtagcatcttctgga

SEQ ID NO: 2682132 - DNA, 21 bp, Homo sapiens
cctgtagcatcttctggagtc

SEQ ID NO: 2682133 - DNA, 18 bp, Homo sapiens
cctgtcagaatcatgctg

SEQ ID NO: 2682134 - DNA, 20 bp, Homo sapiens
cctgtcagaatcatgctgtt

SEQ ID NO: 2682135 - DNA, 16 bp, Homo sapiens
cctgtcccacctcttc

SEQ ID NO: 2682136 - DNA, 17 bp, Homo sapiens
cctgtccctacccactc

SEQ ID NO: 2682137 - DNA, 18 bp, Homo sapiens
cctgtccctacccactct

SEQ ID NO: 2682138 - DNA, 16 bp, Homo sapiens
cctgtcttcagagcaa

SEQ ID NO: 2682139 - DNA, 21 bp, Homo sapiens
cctgtctttgttgtctccctc

SEQ ID NO: 2682140 - DNA, 15 bp, Homo sapiens
cctgtgctgaggact

SEQ ID NO: 2682141 - DNA, 16 bp, Homo sapiens
cctgtgctgaggactc

SEQ ID NO: 2682142 - DNA, 19 bp, Homo sapiens
cctgtgctgaggactccct

SEQ ID NO: 2682143 - DNA, 17 bp, Homo sapiens
cctgtgcttggaaccag

SEQ ID NO: 2682144 - DNA, 14 bp, Homo sapiens
cctgtggccaggag

SEQ ID NO: 2682145 - DNA, 11 bp, Homo sapiens
cctgtgtctta

SEQ ID NO: 2682146 - DNA, 22 bp, Homo sapiens
cctgttacttgaaataccagtg

SEQ ID NO: 2682147 - DNA, 14 bp, Homo sapiens
cctgttcattctga

SEQ ID NO: 2682148 - DNA, 13 bp, Homo sapiens
ctgactctctgtg

SEQ ID NO: 2682149 - DNA, 14 bp, Homo sapiens
ctgactctctgtga

SEQ ID NO: 2682150 - DNA, 13 bp, Homo sapiens
ctgagaaccaaaa

SEQ ID NO: 2682151 - DNA, 14 bp, Homo sapiens
ctgagaaccaaaag

SEQ ID NO: 2682152 - DNA, 13 bp, Homo sapiens
ctgagaagcgctg

SEQ ID NO: 2682153 - DNA, 17 bp, Homo sapiens
ctgagaagtgtatatag

SEQ ID NO: 2682154 - DNA, 12 bp, Homo sapiens
ctgagagccaga

SEQ ID NO: 2682155 - DNA, 16 bp, Homo sapiens
ctgagcaacagagtga

SEQ ID NO: 2682156 - DNA, 11 bp, Homo sapiens
ctgagccctgg

SEQ ID NO: 2682157 - DNA, 13 bp, Homo sapiens
ctgagccctggca

SEQ ID NO: 2682158 - DNA, 13 bp, Homo sapiens
ctgagcctgttca

SEQ ID NO: 2682159 - DNA, 21 bp, Homo sapiens
ctgagcggcgcagagccctcc

SEQ ID NO: 2682160 - DNA, 19 bp, Homo sapiens
ctgaggatacagctcttct

SEQ ID NO: 2682161 - DNA, 11 bp, Homo sapiens
ctgaggcagga

SEQ ID NO: 2682162 - DNA, 14 bp, Homo sapiens
ctgaggcaggtgag

SEQ ID NO: 2682163 - DNA, 18 bp, Homo sapiens
ctgaggctctttctgggc

SEQ ID NO: 2682164 - DNA, 14 bp, Homo sapiens
ctgagggctcctcc

SEQ ID NO: 2682165 - DNA, 23 bp, Homo sapiens
ctgagggctcctccatggtgctg

SEQ ID NO: 2682166 - DNA, 22 bp, Homo sapiens
ctgaggggaggatcactggagc

SEQ ID NO: 2682167 - DNA, 21 bp, Homo sapiens
ctgaggtgcctcccagtggcc

SEQ ID NO: 2682168 - DNA, 22 bp, Homo sapiens
ctgaggtgcctcccagtggcct

SEQ ID NO: 2682169 - DNA, 16 bp, Homo sapiens
ctgatacttttttgaa

SEQ ID NO: 2682170 - DNA, 15 bp, Homo sapiens
ctgatcctgctccag

SEQ ID NO: 2682171 - DNA, 19 bp, Homo sapiens
ctgatcctgctccagcagc

SEQ ID NO: 2682172 - DNA, 21 bp, Homo sapiens
ctgatcctgctccagcagcac

SEQ ID NO: 2682173 - DNA, 13 bp, Homo sapiens
ctgatgatgtctc

SEQ ID NO: 2682174 - DNA, 16 bp, Homo sapiens
ctgatgccaaagctgc

SEQ ID NO: 2682175 - DNA, 17 bp, Homo sapiens
ctgatgccaaagctgct

SEQ ID NO: 2682176 - DNA, 15 bp, Homo sapiens
ctgatggccctcatc

SEQ ID NO: 2682177 - DNA, 18 bp, Homo sapiens
ctgattttgtagttaatt

SEQ ID NO: 2682178 - DNA, 19 bp, Homo sapiens
ctgcacctgccagcctggc

SEQ ID NO: 2682179 - DNA, 16 bp, Homo sapiens
ctgcactccagcctgg

SEQ ID NO: 2682180 - DNA, 20 bp, Homo sapiens
ctgcagacaagtcttgctgt

SEQ ID NO: 2682181 - DNA, 21 bp, Homo sapiens
ctgcagacaagtcttgctgtg

SEQ ID NO: 2682182 - DNA, 20 bp, Homo sapiens
ctgcagaggggctttctgga

SEQ ID NO: 2682183 - DNA, 22 bp, Homo sapiens
ctgcagaggggctttctggaga

SEQ ID NO: 2682184 - DNA, 21 bp, Homo sapiens
ctgcaggcttaggtcctcact

SEQ ID NO: 2682185 - DNA, 16 bp, Homo sapiens
ctgcagtagtctctgt

SEQ ID NO: 2682186 - DNA, 14 bp, Homo sapiens
ctgcagtccgcagt

SEQ ID NO: 2682187 - DNA, 21 bp, Homo sapiens
ctgcagtccgcagtctggcct

SEQ ID NO: 2682188 - DNA, 23 bp, Homo sapiens
ctgcattgagtccagctttcctt

SEQ ID NO: 2682189 - DNA, 22 bp, Homo sapiens
ctgcattgttattgtggaagat

SEQ ID NO: 2682190 - DNA, 20 bp, Homo sapiens
ctgccaagctcacacagcag

SEQ ID NO: 2682191 - DNA, 18 bp, Homo sapiens
ctgccacctgtctgtctg

SEQ ID NO: 2682192 - DNA, 19 bp, Homo sapiens
ctgccactttggtacatgg

SEQ ID NO: 2682193 - DNA, 13 bp, Homo sapiens
ctgccagcctggc

SEQ ID NO: 2682194 - DNA, 15 bp, Homo sapiens
ctgccagcctggctt

SEQ ID NO: 2682195 - DNA, 23 bp, Homo sapiens
ctgccagcctggcttctggagcc

SEQ ID NO: 2682196 - DNA, 14 bp, Homo sapiens
ctgccatggcgtgt

SEQ ID NO: 2682197 - DNA, 23 bp, Homo sapiens
ctgcccagaacccttcctgagac

SEQ ID NO: 2682198 - DNA, 18 bp, Homo sapiens
ctgccccagctctggctt

SEQ ID NO: 2682199 - DNA, 21 bp, Homo sapiens
ctgccccatcattgcacctgc

SEQ ID NO: 2682200 - DNA, 22 bp, Homo sapiens
ctgccccctggtggacagtcct

SEQ ID NO: 2682201 - DNA, 20 bp, Homo sapiens
ctgccctcccctgctcccag

SEQ ID NO: 2682202 - DNA, 15 bp, Homo sapiens
ctgccctctgcccca

SEQ ID NO: 2682203 - DNA, 16 bp, Homo sapiens
ctgccctctgccccat

SEQ ID NO: 2682204 - DNA, 20 bp, Homo sapiens
ctgccctgccacctgtctgt

SEQ ID NO: 2682205 - DNA, 15 bp, Homo sapiens
ctgccctggctgtgg

SEQ ID NO: 2682206 - DNA, 16 bp, Homo sapiens
ctgccctgtgagagcc

SEQ ID NO: 2682207 - DNA, 21 bp, Homo sapiens
ctgccctgtgagagccacgct

SEQ ID NO: 2682208 - DNA, 15 bp, Homo sapiens
ctgcccttcctccag

SEQ ID NO: 2682209 - DNA, 18 bp, Homo sapiens
ctgcctgccttctcccct

SEQ ID NO: 2682210 - DNA, 21 bp, Homo sapiens
ctgcctggtcctccctcccaa

SEQ ID NO: 2682211 - DNA, 16 bp, Homo sapiens
ctgccttgaagccact

SEQ ID NO: 2682212 - DNA, 22 bp, Homo sapiens
ctgccttgaagccactgaagct

SEQ ID NO: 2682213 - DNA, 13 bp, Homo sapiens
ctgccttgccatg

SEQ ID NO: 2682214 - DNA, 17 bp, Homo sapiens
ctgcgggatggtcctgg

SEQ ID NO: 2682215 - DNA, 16 bp, Homo sapiens
ctgcgggggagccagt

SEQ ID NO: 2682216 - DNA, 19 bp, Homo sapiens
ctgcgtgacatgtgcagtg

SEQ ID NO: 2682217 - DNA, 20 bp, Homo sapiens
ctgcgtgacatgtgcagtgc

SEQ ID NO: 2682218 - DNA, 13 bp, Homo sapiens
ctgctagctgtct

SEQ ID NO: 2682219 - DNA, 15 bp, Homo sapiens
ctgctagctgtctct

SEQ ID NO: 2682220 - DNA, 14 bp, Homo sapiens
ctgctccagcagca

SEQ ID NO: 2682221 - DNA, 16 bp, Homo sapiens
ctgctcccaatgtgcc

SEQ ID NO: 2682222 - DNA, 20 bp, Homo sapiens
ctgctcccagggactgacac

SEQ ID NO: 2682223 - DNA, 14 bp, Homo sapiens
ctgctcccagtggg

SEQ ID NO: 2682224 - DNA, 22 bp, Homo sapiens
ctgctcccagtgggagcttccc

SEQ ID NO: 2682225 - DNA, 13 bp, Homo sapiens
ctgctccctgctc

SEQ ID NO: 2682226 - DNA, 20 bp, Homo sapiens
ctgctctgaggcttccagag

SEQ ID NO: 2682227 - DNA, 21 bp, Homo sapiens
ctgctctgaggcttccagaga

SEQ ID NO: 2682228 - DNA, 13 bp, Homo sapiens
ctgctctgcttcc

SEQ ID NO: 2682229 - DNA, 17 bp, Homo sapiens
ctgctctgcttcctcag

SEQ ID NO: 2682230 - DNA, 14 bp, Homo sapiens
ctgctctgtagcca

SEQ ID NO: 2682231 - DNA, 18 bp, Homo sapiens
ctgctctgtagccacctc

SEQ ID NO: 2682232 - DNA, 14 bp, Homo sapiens
ctgctctttctctg

SEQ ID NO: 2682233 - DNA, 15 bp, Homo sapiens
ctgctctttctctga

SEQ ID NO: 2682234 - DNA, 17 bp, Homo sapiens
ctgctctttctctgaga

SEQ ID NO: 2682235 - DNA, 21 bp, Homo sapiens
ctgctgcaaaggacagtgggc

SEQ ID NO: 2682236 - DNA, 14 bp, Homo sapiens
ctgctggcctggcc

SEQ ID NO: 2682237 - DNA, 18 bp, Homo sapiens
ctgctgggacccacctcc

SEQ ID NO: 2682238 - DNA, 19 bp, Homo sapiens
ctgctgggacccacctccc

SEQ ID NO: 2682239 - DNA, 23 bp, Homo sapiens
ctgctgggacccacctccccctc

SEQ ID NO: 2682240 - DNA, 19 bp, Homo sapiens
ctgctgggactggccaggt

SEQ ID NO: 2682241 - DNA, 12 bp, Homo sapiens
ctgcttcctgaa

SEQ ID NO: 2682242 - DNA, 16 bp, Homo sapiens
ctgctttcttctctgc

SEQ ID NO: 2682243 - DNA, 18 bp, Homo sapiens
ctgctttcttctctgcct

SEQ ID NO: 2682244 - DNA, 13 bp, Homo sapiens
ctggaaaggctca

SEQ ID NO: 2682245 - DNA, 23 bp, Homo sapiens
ctggaatcaagatgtcagactgg

SEQ ID NO: 2682246 - DNA, 14 bp, Homo sapiens
ctggaccccaggct

SEQ ID NO: 2682247 - DNA, 17 bp, Homo sapiens
ctggaccccaggctctt

SEQ ID NO: 2682248 - DNA, 19 bp, Homo sapiens
ctggacggcattcctgctt

SEQ ID NO: 2682249 - DNA, 16 bp, Homo sapiens
ctggactgactgcagc

SEQ ID NO: 2682250 - DNA, 19 bp, Homo sapiens
ctggagcaagctctgccct

SEQ ID NO: 2682251 - DNA, 20 bp, Homo sapiens
ctggagcaagctctgccctg

SEQ ID NO: 2682252 - DNA, 17 bp, Homo sapiens
ctggagcatctgactca

SEQ ID NO: 2682253 - DNA, 22 bp, Homo sapiens
ctggagcatctgactcacaaga

SEQ ID NO: 2682254 - DNA, 18 bp, Homo sapiens
ctggagtctcagagcaca

SEQ ID NO: 2682255 - DNA, 19 bp, Homo sapiens
ctggagtctcagagcacag

SEQ ID NO: 2682256 - DNA, 14 bp, Homo sapiens
ctggagtctccagt

SEQ ID NO: 2682257 - DNA, 18 bp, Homo sapiens
ctggatacagaatgaatc

SEQ ID NO: 2682258 - DNA, 17 bp, Homo sapiens
gaaatggtatccagaat

SEQ ID NO: 2682259 - DNA, 12 bp, Homo sapiens
gaaattcctgta

SEQ ID NO: 2682260 - DNA, 15 bp, Homo sapiens
gaaattcctgtagca

SEQ ID NO: 2682261 - DNA, 19 bp, Homo sapiens
gaaattcctgtagcatctt

SEQ ID NO: 2682262 - DNA, 20 bp, Homo sapiens
gaaattgtctagcagagcag

SEQ ID NO: 2682263 - DNA, 21 bp, Homo sapiens
gaaattgtctagcagagcagg

SEQ ID NO: 2682264 - DNA, 19 bp, Homo sapiens
gaaattttactgacagaaa

SEQ ID NO: 2682265 - DNA, 12 bp, Homo sapiens
gaacacccactg

SEQ ID NO: 2682266 - DNA, 13 bp, Homo sapiens
gaacacccactgg

SEQ ID NO: 2682267 - DNA, 16 bp, Homo sapiens
gaacacccactggcca

SEQ ID NO: 2682268 - DNA, 17 bp, Homo sapiens
gaacacccactggccag

SEQ ID NO: 2682269 - DNA, 21 bp, Homo sapiens
gaaccaaagagactggagcat

SEQ ID NO: 2682270 - DNA, 14 bp, Homo sapiens
gaacctcaggcttc

SEQ ID NO: 2682271 - DNA, 21 bp, Homo sapiens
gaacgctcttagctttctcag

SEQ ID NO: 2682272 - DNA, 15 bp, Homo sapiens
gaactattggagggt

SEQ ID NO: 2682273 - DNA, 16 bp, Homo sapiens
gaactcactcactctg

SEQ ID NO: 2682274 - DNA, 13 bp, Homo sapiens
gaactgagccaga

SEQ ID NO: 2682275 - DNA, 14 bp, Homo sapiens
gaactgagccagaa

SEQ ID NO: 2682276 - DNA, 15 bp, Homo sapiens
gaactggcaggagcc

SEQ ID NO: 2682277 - DNA, 16 bp, Homo sapiens
gaactggcaggagcct

SEQ ID NO: 2682278 - DNA, 21 bp, Homo sapiens
gaactggggttcaagcccagg

SEQ ID NO: 2682279 - DNA, 14 bp, Homo sapiens
gaactgtgcctagt

SEQ ID NO: 2682280 - DNA, 19 bp, Homo sapiens
gaacttgaggacacatgtc

SEQ ID NO: 2682281 - DNA, 22 bp, Homo sapiens
gaagaaacctggaaccagaggg

SEQ ID NO: 2682282 - DNA, 15 bp, Homo sapiens
gaagaaattcctgta

SEQ ID NO: 2682283 - DNA, 12 bp, Homo sapiens
gaagatttacct

SEQ ID NO: 2682284 - DNA, 18 bp, Homo sapiens
gaagcaggttgaggggct

SEQ ID NO: 2682285 - DNA, 23 bp, Homo sapiens
gaagcaggttgaggggctcctgg

SEQ ID NO: 2682286 - DNA, 18 bp, Homo sapiens
gaagccactgaagctggg

SEQ ID NO: 2682287 - DNA, 14 bp, Homo sapiens
gaagccaggagcaa

SEQ ID NO: 2682288 - DNA, 22 bp, Homo sapiens
gaagccaggagcaaatgtttct

SEQ ID NO: 2682289 - DNA, 17 bp, Homo sapiens
gaagcggagcttgcagt

SEQ ID NO: 2682290 - DNA, 16 bp, Homo sapiens
gaaggggaatgtgtcc

SEQ ID NO: 2682291 - DNA, 23 bp, Homo sapiens
gaaggggccctggtccttccagg

SEQ ID NO: 2682292 - DNA, 20 bp, Homo sapiens
gaagggttttccaccctgga

SEQ ID NO: 2682293 - DNA, 18 bp, Homo sapiens
gaagtaactggtgatata

SEQ ID NO: 2682294 - DNA, 13 bp, Homo sapiens
gaagtgcccagcc

SEQ ID NO: 2682295 - DNA, 14 bp, Homo sapiens
gaagtgcccagccc

SEQ ID NO: 2682296 - DNA, 10 bp, Homo sapiens
gaagtgttca

SEQ ID NO: 2682297 - DNA, 17 bp, Homo sapiens
gaataagcactttttaa

SEQ ID NO: 2682298 - DNA, 13 bp, Homo sapiens
gaataatgtgtta

SEQ ID NO: 2682299 - DNA, 17 bp, Homo sapiens
gaatatagattaaatca

SEQ ID NO: 2682300 - DNA, 19 bp, Homo sapiens
gaatatttattcagtgact

SEQ ID NO: 2682301 - DNA, 21 bp, Homo sapiens
gaatcaagatgtcagactggc

SEQ ID NO: 2682302 - DNA, 20 bp, Homo sapiens
gaatcaagctagaaggccac

SEQ ID NO: 2682303 - DNA, 15 bp, Homo sapiens
gaatcatgctgttct

SEQ ID NO: 2682304 - DNA, 16 bp, Homo sapiens
gaatctgtatgattct

SEQ ID NO: 2682305 - DNA, 15 bp, Homo sapiens
gaatgtgtcctcctg

SEQ ID NO: 2682306 - DNA, 21 bp, Homo sapiens
gaattgcccattgtttttctg

SEQ ID NO: 2682307 - DNA, 14 bp, Homo sapiens
gacaagtcttgctg

SEQ ID NO: 2682308 - DNA, 18 bp, Homo sapiens
gacacccagtgtccttcc

SEQ ID NO: 2682309 - DNA, 14 bp, Homo sapiens
gacacctgccctgc

SEQ ID NO: 2682310 - DNA, 16 bp, Homo sapiens
gacacctgccctgccc

SEQ ID NO: 2682311 - DNA, 20 bp, Homo sapiens
gacacgtgatggaccaaagc

SEQ ID NO: 2682312 - DNA, 23 bp, Homo sapiens
gacacgtgatggaccaaagccac

SEQ ID NO: 2682313 - DNA, 14 bp, Homo sapiens
gacacgtggcctgc

SEQ ID NO: 2682314 - DNA, 16 bp, Homo sapiens
gacacgtggcctgcac

SEQ ID NO: 2682315 - DNA, 15 bp, Homo sapiens
gacagaccagcagca

SEQ ID NO: 2682316 - DNA, 13 bp, Homo sapiens
gacagtcctggga

SEQ ID NO: 2682317 - DNA, 18 bp, Homo sapiens
gacagtgcttcagcctga

SEQ ID NO: 2682318 - DNA, 20 bp, Homo sapiens
gacagtgcttcagcctgagg

SEQ ID NO: 2682319 - DNA, 23 bp, Homo sapiens
gacatcccaggaggggcctctga

SEQ ID NO: 2682320 - DNA, 15 bp, Homo sapiens
gacatgtgcagtgct

SEQ ID NO: 2682321 - DNA, 14 bp, Homo sapiens
gaccaaagccacct

SEQ ID NO: 2682322 - DNA, 13 bp, Homo sapiens
gaccagctctctt

SEQ ID NO: 2682323 - DNA, 15 bp, Homo sapiens
gaccagctctcttcc

SEQ ID NO: 2682324 - DNA, 18 bp, Homo sapiens
gaccagtcccacaccgct

SEQ ID NO: 2682325 - DNA, 16 bp, Homo sapiens
gaccattgtcttccaa

SEQ ID NO: 2682326 - DNA, 19 bp, Homo sapiens
gaccattgtcttccaaccc

SEQ ID NO: 2682327 - DNA, 11 bp, Homo sapiens
gacccaaagac

SEQ ID NO: 2682328 - DNA, 18 bp, Homo sapiens
gacccaaatttccctggg

SEQ ID NO: 2682329 - DNA, 19 bp, Homo sapiens
gacccaactgatcctgctc

SEQ ID NO: 2682330 - DNA, 20 bp, Homo sapiens
gacccaactgatcctgctcc

SEQ ID NO: 2682331 - DNA, 14 bp, Homo sapiens
gacccacctccccc

SEQ ID NO: 2682332 - DNA, 16 bp, Homo sapiens
gaccctgagggctcct

SEQ ID NO: 2682333 - DNA, 12 bp, Homo sapiens
gaccgccctccg

SEQ ID NO: 2682334 - DNA, 16 bp, Homo sapiens
gacctctgctctgagg

SEQ ID NO: 2682335 - DNA, 11 bp, Homo sapiens
gacctctgctt

SEQ ID NO: 2682336 - DNA, 20 bp, Homo sapiens
gacctctgcttttgcacacc

SEQ ID NO: 2682337 - DNA, 21 bp, Homo sapiens
gacctgaagggtgacatccca

SEQ ID NO: 2682338 - DNA, 23 bp, Homo sapiens
gacctgaagggtgacatcccagg

SEQ ID NO: 2682339 - DNA, 13 bp, Homo sapiens
gacctgcaggcca

SEQ ID NO: 2682340 - DNA, 16 bp, Homo sapiens
gaccttcctgccacca

SEQ ID NO: 2682341 - DNA, 19 bp, Homo sapiens
gaccttcctgccaccagtc

SEQ ID NO: 2682342 - DNA, 23 bp, Homo sapiens
gaccttcctgccaccagtcactg

SEQ ID NO: 2682343 - DNA, 17 bp, Homo sapiens
gacgatacagcttggca

SEQ ID NO: 2682344 - DNA, 14 bp, Homo sapiens
gacggaggtgcctg

SEQ ID NO: 2682345 - DNA, 20 bp, Homo sapiens
gacgggctgtccgtgtgcct

SEQ ID NO: 2682346 - DNA, 23 bp, Homo sapiens
gacgggctgtccgtgtgcctcct

SEQ ID NO: 2682347 - DNA, 22 bp, Homo sapiens
gactaagtacttgctctctgag

SEQ ID NO: 2682348 - DNA, 17 bp, Homo sapiens
gactcacaagaagacca

SEQ ID NO: 2682349 - DNA, 15 bp, Homo sapiens
gactctctgtgacct

SEQ ID NO: 2682350 - DNA, 19 bp, Homo sapiens
gactctctgtgacctgccc

SEQ ID NO: 2682351 - DNA, 15 bp, Homo sapiens
gactctgaaaaacat

SEQ ID NO: 2682352 - DNA, 20 bp, Homo sapiens
gactctgaaaaacattccag

SEQ ID NO: 2682353 - DNA, 14 bp, Homo sapiens
gactgactgcagcc

SEQ ID NO: 2682354 - DNA, 15 bp, Homo sapiens
gactgcagcccccta

SEQ ID NO: 2682355 - DNA, 16 bp, Homo sapiens
gactggctggctgcag

SEQ ID NO: 2682356 - DNA, 17 bp, Homo sapiens
gactggctggctgcagt

SEQ ID NO: 2682357 - DNA, 13 bp, Homo sapiens
gactgtgaccaaa

SEQ ID NO: 2682358 - DNA, 15 bp, Homo sapiens
gactgtgaccaaagc

SEQ ID NO: 2682359 - DNA, 21 bp, Homo sapiens
gactgtgaccaaagcatttct

SEQ ID NO: 2682360 - DNA, 19 bp, Homo sapiens
gacttttccattgaccagc

SEQ ID NO: 2682361 - DNA, 14 bp, Homo sapiens
gagaacctcaggct

SEQ ID NO: 2682362 - DNA, 20 bp, Homo sapiens
gagaatggtgtgaacccggg

SEQ ID NO: 2682363 - DNA, 18 bp, Homo sapiens
gagacagccacttggttt

SEQ ID NO: 2682364 - DNA, 22 bp, Homo sapiens
gagactaaggggcagctcctga

SEQ ID NO: 2682365 - DNA, 23 bp, Homo sapiens
gagactgcgggatggtcctgggg

SEQ ID NO: 2682366 - DNA, 12 bp, Homo sapiens
gagactggagca

SEQ ID NO: 2682367 - DNA, 15 bp, Homo sapiens
gagagaggggcctgc

SEQ ID NO: 2682368 - DNA, 15 bp, Homo sapiens
gcctggtcctccctc

SEQ ID NO: 2682369 - DNA, 21 bp, Homo sapiens
gcctggtcctccctcccaagg

SEQ ID NO: 2682370 - DNA, 19 bp, Homo sapiens
gcctgtgctgaggactccc

SEQ ID NO: 2682371 - DNA, 23 bp, Homo sapiens
gccttccccctcccagggccagg

SEQ ID NO: 2682372 - DNA, 15 bp, Homo sapiens
gccttcgtctccatc

SEQ ID NO: 2682373 - DNA, 20 bp, Homo sapiens
gccttcgtctccatctctgg

SEQ ID NO: 2682374 - DNA, 16 bp, Homo sapiens
gccttctcccctccac

SEQ ID NO: 2682375 - DNA, 22 bp, Homo sapiens
gcctttccggggctgctggcct

SEQ ID NO: 2682376 - DNA, 23 bp, Homo sapiens
gcctttccggggctgctggcctg

SEQ ID NO: 2682377 - DNA, 19 bp, Homo sapiens
gcgacagagcgagagtctg

SEQ ID NO: 2682378 - DNA, 13 bp, Homo sapiens
gcgaggcctgaca

SEQ ID NO: 2682379 - DNA, 20 bp, Homo sapiens
gcgaggcctgacacaggcca

SEQ ID NO: 2682380 - DNA, 17 bp, Homo sapiens
gcgcacctgccccctgg

SEQ ID NO: 2682381 - DNA, 22 bp, Homo sapiens
gcgcagagccctccaggcctgc

SEQ ID NO: 2682382 - DNA, 14 bp, Homo sapiens
gcgccccgcctccc

SEQ ID NO: 2682383 - DNA, 22 bp, Homo sapiens
gcgcctccttccttgctgtcct

SEQ ID NO: 2682384 - DNA, 22 bp, Homo sapiens
gcgcctgtgctgaggactccct

SEQ ID NO: 2682385 - DNA, 16 bp, Homo sapiens
gcgctcacctcagagc

SEQ ID NO: 2682386 - DNA, 13 bp, Homo sapiens
gcgctgcagcctc

SEQ ID NO: 2682387 - DNA, 16 bp, Homo sapiens
gcgctgcagcctccct

SEQ ID NO: 2682388 - DNA, 17 bp, Homo sapiens
gcggcacccaggcctcc

SEQ ID NO: 2682389 - DNA, 12 bp, Homo sapiens
gcggccctgaca

SEQ ID NO: 2682390 - DNA, 14 bp, Homo sapiens
gcggcgcagagccc

SEQ ID NO: 2682391 - DNA, 16 bp, Homo sapiens
gcgggatggtcctggg

SEQ ID NO: 2682392 - DNA, 17 bp, Homo sapiens
gcgggatggtcctgggg

SEQ ID NO: 2682393 - DNA, 19 bp, Homo sapiens
gcgggtggatcacctgagg

SEQ ID NO: 2682394 - DNA, 21 bp, Homo sapiens
gcgtcaggcacgtctcctgct

SEQ ID NO: 2682395 - DNA, 13 bp, Homo sapiens
gcgtgcctgccaa

SEQ ID NO: 2682396 - DNA, 19 bp, Homo sapiens
gcgtgtcgtgggtgtgtgt

SEQ ID NO: 2682397 - DNA, 12 bp, Homo sapiens
gctacaataaat

SEQ ID NO: 2682398 - DNA, 13 bp, Homo sapiens
gctacaataaatg

SEQ ID NO: 2682399 - DNA, 15 bp, Homo sapiens
gctactcagaagcct

SEQ ID NO: 2682400 - DNA, 15 bp, Homo sapiens
gctagaaggccacat

SEQ ID NO: 2682401 - DNA, 14 bp, Homo sapiens
gctagctgtctctc

SEQ ID NO: 2682402 - DNA, 18 bp, Homo sapiens
gctaggaatatagattaa

SEQ ID NO: 2682403 - DNA, 17 bp, Homo sapiens
gctataaattatattcc

SEQ ID NO: 2682404 - DNA, 17 bp, Homo sapiens
gctatgatcgcgccact

SEQ ID NO: 2682405 - DNA, 16 bp, Homo sapiens
gctattttctgaccaa

SEQ ID NO: 2682406 - DNA, 18 bp, Homo sapiens
gctattttctgaccaaaa

SEQ ID NO: 2682407 - DNA, 23 bp, Homo sapiens
gctcaatgcattgtcttgtggag

SEQ ID NO: 2682408 - DNA, 15 bp, Homo sapiens
gctcacctcagagca

SEQ ID NO: 2682409 - DNA, 16 bp, Homo sapiens
gctcacctcagagcag

SEQ ID NO: 2682410 - DNA, 21 bp, Homo sapiens
gctcacgcctatgatcccagc

SEQ ID NO: 2682411 - DNA, 22 bp, Homo sapiens
gctcacgcctatgatcccagca

SEQ ID NO: 2682412 - DNA, 13 bp, Homo sapiens
gctcaggaggctt

SEQ ID NO: 2682413 - DNA, 16 bp, Homo sapiens
gctcaggaggcttgga

SEQ ID NO: 2682414 - DNA, 17 bp, Homo sapiens
gctcagtctcaggagca

SEQ ID NO: 2682415 - DNA, 20 bp, Homo sapiens
gctcagtctcaggagcatgg

SEQ ID NO: 2682416 - DNA, 12 bp, Homo sapiens
gctccagcagca

SEQ ID NO: 2682417 - DNA, 12 bp, Homo sapiens
gctccccaccta

SEQ ID NO: 2682418 - DNA, 13 bp, Homo sapiens
gctcccgcttgct

SEQ ID NO: 2682419 - DNA, 14 bp, Homo sapiens
gctcccgcttgctc

SEQ ID NO: 2682420 - DNA, 15 bp, Homo sapiens
gctcccggcatcctg

SEQ ID NO: 2682421 - DNA, 16 bp, Homo sapiens
gctcccggcatcctga

SEQ ID NO: 2682422 - DNA, 21 bp, Homo sapiens
gctcccggcatcctgaaagcc

SEQ ID NO: 2682423 - DNA, 14 bp, Homo sapiens
gctcctgaccaaag

SEQ ID NO: 2682424 - DNA, 18 bp, Homo sapiens
gctcctggaaaggctcag

SEQ ID NO: 2682425 - DNA, 21 bp, Homo sapiens
gctcctggaaaggctcagtct

SEQ ID NO: 2682426 - DNA, 12 bp, Homo sapiens
gctcctgtccct

SEQ ID NO: 2682427 - DNA, 16 bp, Homo sapiens
gctcctgtccctaccc

SEQ ID NO: 2682428 - DNA, 17 bp, Homo sapiens
gctcctgtccctaccca

SEQ ID NO: 2682429 - DNA, 23 bp, Homo sapiens
gctcctgtccctacccactcttt

SEQ ID NO: 2682430 - DNA, 14 bp, Homo sapiens
gctcgggtgctgcc

SEQ ID NO: 2682431 - DNA, 16 bp, Homo sapiens
gctcgggtgctgccag

SEQ ID NO: 2682432 - DNA, 17 bp, Homo sapiens
gctctactgccctcccc

SEQ ID NO: 2682433 - DNA, 19 bp, Homo sapiens
gctctactgccctcccctt

SEQ ID NO: 2682434 - DNA, 16 bp, Homo sapiens
gctctatgccaggctg

SEQ ID NO: 2682435 - DNA, 11 bp, Homo sapiens
gctctcctgga

SEQ ID NO: 2682436 - DNA, 13 bp, Homo sapiens
gctctcctggagc

SEQ ID NO: 2682437 - DNA, 13 bp, Homo sapiens
gctctcttcctgt

SEQ ID NO: 2682438 - DNA, 18 bp, Homo sapiens
gctctgaagccaagcctc

SEQ ID NO: 2682439 - DNA, 13 bp, Homo sapiens
gctctgccccagc

SEQ ID NO: 2682440 - DNA, 15 bp, Homo sapiens
gctctgccccagctc

SEQ ID NO: 2682441 - DNA, 13 bp, Homo sapiens
gctctgccctggc

SEQ ID NO: 2682442 - DNA, 14 bp, Homo sapiens
gctctgccctggct

SEQ ID NO: 2682443 - DNA, 15 bp, Homo sapiens
gctctgccctggctg

SEQ ID NO: 2682444 - DNA, 18 bp, Homo sapiens
gctctgccctggctgtgg

SEQ ID NO: 2682445 - DNA, 16 bp, Homo sapiens
gctctgcttcctcagg

SEQ ID NO: 2682446 - DNA, 17 bp, Homo sapiens
gctctggaccagcctgt

SEQ ID NO: 2682447 - DNA, 16 bp, Homo sapiens
gctctgtagccacctc

SEQ ID NO: 2682448 - DNA, 14 bp, Homo sapiens
gctctgtgcaggga

SEQ ID NO: 2682449 - DNA, 19 bp, Homo sapiens
gctctgtttcttcctttct

SEQ ID NO: 2682450 - DNA, 19 bp, Homo sapiens
gctcttagctttctcaggg

SEQ ID NO: 2682451 - DNA, 20 bp, Homo sapiens
gctcttcctctggtttctgt

SEQ ID NO: 2682452 - DNA, 13 bp, Homo sapiens
gctcttctcagtg

SEQ ID NO: 2682453 - DNA, 22 bp, Homo sapiens
gctcttggaaagctgatgatgt

SEQ ID NO: 2682454 - DNA, 20 bp, Homo sapiens
gctcttgttccgtgccaggc

SEQ ID NO: 2682455 - DNA, 14 bp, Homo sapiens
gctctttcagagag

SEQ ID NO: 2682456 - DNA, 13 bp, Homo sapiens
gctctttctctga

SEQ ID NO: 2682457 - DNA, 14 bp, Homo sapiens
gctctttctctgag

SEQ ID NO: 2682458 - DNA, 18 bp, Homo sapiens
gctctttctgggccaagt

SEQ ID NO: 2682459 - DNA, 14 bp, Homo sapiens
gctgagagccagat

SEQ ID NO: 2682460 - DNA, 20 bp, Homo sapiens
gctgagagccagatgcctcc

SEQ ID NO: 2682461 - DNA, 13 bp, Homo sapiens
gctgagccctggc

SEQ ID NO: 2682462 - DNA, 11 bp, Homo sapiens
gctgagctgga

SEQ ID NO: 2682463 - DNA, 13 bp, Homo sapiens
gctgaggactccc

SEQ ID NO: 2682464 - DNA, 21 bp, Homo sapiens
gctgaggactccctccatgtg

SEQ ID NO: 2682465 - DNA, 12 bp, Homo sapiens
gctgaggcagga

SEQ ID NO: 2682466 - DNA, 16 bp, Homo sapiens
gctgatggcccctcca

SEQ ID NO: 2682467 - DNA, 19 bp, Homo sapiens
gctgatggcccctccagca

SEQ ID NO: 2682468 - DNA, 21 bp, Homo sapiens
gctgatggcccctccagcaca

SEQ ID NO: 2682469 - DNA, 20 bp, Homo sapiens
gctgcacctgccagcctggc

SEQ ID NO: 2682470 - DNA, 16 bp, Homo sapiens
gctgcagaaggccaag

SEQ ID NO: 2682471 - DNA, 17 bp, Homo sapiens
gctgcagaaggccaaga

SEQ ID NO: 2682472 - DNA, 19 bp, Homo sapiens
gctgcagaaggccaagaat

SEQ ID NO: 2682473 - DNA, 12 bp, Homo sapiens
gctgcagcctcc

SEQ ID NO: 2682474 - DNA, 23 bp, Homo sapiens
gctgccatggcgtgtccctctcg

SEQ ID NO: 2682475 - DNA, 20 bp, Homo sapiens
gctgcccctggtgcactggc

SEQ ID NO: 2682476 - DNA, 12 bp, Homo sapiens
gctgccctgtga

SEQ ID NO: 2682477 - DNA, 23 bp, Homo sapiens
gctgccctgtgagagccacgctg

SEQ ID NO: 2682478 - DNA, 21 bp, Homo sapiens
gctgcgtgacatgtgcagtgc

SEQ ID NO: 2682479 - DNA, 11 bp, Homo sapiens
gtagtgtcttc

SEQ ID NO: 2682480 - DNA, 19 bp, Homo sapiens
gtataaataataaagaact

SEQ ID NO: 2682481 - DNA, 15 bp, Homo sapiens
gtatatgtatatcta

SEQ ID NO: 2682482 - DNA, 15 bp, Homo sapiens
gtatatgttgtaata

SEQ ID NO: 2682483 - DNA, 18 bp, Homo sapiens
gtatatgttgtaataaaa

SEQ ID NO: 2682484 - DNA, 14 bp, Homo sapiens
gtatattataatag

SEQ ID NO: 2682485 - DNA, 16 bp, Homo sapiens
gtatcaggactgtgac

SEQ ID NO: 2682486 - DNA, 22 bp, Homo sapiens
gtatcaggactgtgaccaaagc

SEQ ID NO: 2682487 - DNA, 16 bp, Homo sapiens
gtatgaacttgaggac

SEQ ID NO: 2682488 - DNA, 23 bp, Homo sapiens
gtatgaacttgaggacacatgtc

SEQ ID NO: 2682489 - DNA, 18 bp, Homo sapiens
gtatgccttcctgtttaa

SEQ ID NO: 2682490 - DNA, 16 bp, Homo sapiens
gtattatttcaccagc

SEQ ID NO: 2682491 - DNA, 19 bp, Homo sapiens
gtattatttcaccagcagc

SEQ ID NO: 2682492 - DNA, 20 bp, Homo sapiens
gtattatttcaccagcagca

SEQ ID NO: 2682493 - DNA, 15 bp, Homo sapiens
gtcagactgctggga

SEQ ID NO: 2682494 - DNA, 22 bp, Homo sapiens
gtcagactggctggctgcagtg

SEQ ID NO: 2682495 - DNA, 14 bp, Homo sapiens
gtcagcccagcacc

SEQ ID NO: 2682496 - DNA, 15 bp, Homo sapiens
gtcagcccagcacct

SEQ ID NO: 2682497 - DNA, 16 bp, Homo sapiens
gtcagcccagcacctg

SEQ ID NO: 2682498 - DNA, 22 bp, Homo sapiens
gtcagccttccccctcccaggg

SEQ ID NO: 2682499 - DNA, 19 bp, Homo sapiens
gtcagctttcagagccagt

SEQ ID NO: 2682500 - DNA, 18 bp, Homo sapiens
gtcaggcacgtctcctgc

SEQ ID NO: 2682501 - DNA, 20 bp, Homo sapiens
gtcaggcacgtctcctgctg

SEQ ID NO: 2682502 - DNA, 21 bp, Homo sapiens
gtcaggcacgtctcctgctgc

SEQ ID NO: 2682503 - DNA, 21 bp, Homo sapiens
gtccagaccattgtcttccaa

SEQ ID NO: 2682504 - DNA, 20 bp, Homo sapiens
gtccagctttccttctgccc

SEQ ID NO: 2682505 - DNA, 22 bp, Homo sapiens
gtccagctttccttctgccctt

SEQ ID NO: 2682506 - DNA, 11 bp, Homo sapiens
gtccataaagt

SEQ ID NO: 2682507 - DNA, 21 bp, Homo sapiens
gtcccaagtagtagtgtcttc

SEQ ID NO: 2682508 - DNA, 23 bp, Homo sapiens
gtcccaatagctctactgccctc

SEQ ID NO: 2682509 - DNA, 23 bp, Homo sapiens
gtcccacctcttctcttcctgta

SEQ ID NO: 2682510 - DNA, 18 bp, Homo sapiens
gtccctgactctctgtga

SEQ ID NO: 2682511 - DNA, 20 bp, Homo sapiens
gtccctgactctctgtgacc

SEQ ID NO: 2682512 - DNA, 18 bp, Homo sapiens
gtccctgccctcccctgc

SEQ ID NO: 2682513 - DNA, 22 bp, Homo sapiens
gtccctgccctcccctgctccc

SEQ ID NO: 2682514 - DNA, 14 bp, Homo sapiens
gtccgtgtgcctcc

SEQ ID NO: 2682515 - DNA, 19 bp, Homo sapiens
gtccgtttgagtgtctgcg

SEQ ID NO: 2682516 - DNA, 14 bp, Homo sapiens
gtcctagagctcct

SEQ ID NO: 2682517 - DNA, 15 bp, Homo sapiens
gtcctagagctcctg

SEQ ID NO: 2682518 - DNA, 17 bp, Homo sapiens
gtcctcacttctgtctc

SEQ ID NO: 2682519 - DNA, 15 bp, Homo sapiens
gtcctccctcccaag

SEQ ID NO: 2682520 - DNA, 20 bp, Homo sapiens
gtcctccctcccaaggagcc

SEQ ID NO: 2682521 - DNA, 12 bp, Homo sapiens
gtcctcctgctc

SEQ ID NO: 2682522 - DNA, 19 bp, Homo sapiens
gtcctcctgctctgcttcc

SEQ ID NO: 2682523 - DNA, 20 bp, Homo sapiens
gtcctcctgctctgcttcct

SEQ ID NO: 2682524 - DNA, 22 bp, Homo sapiens
gtcctcctgctctgcttcctca

SEQ ID NO: 2682525 - DNA, 22 bp, Homo sapiens
gtcctcctttcttattctgtga

SEQ ID NO: 2682526 - DNA, 21 bp, Homo sapiens
gtcctctggatggcaccagag

SEQ ID NO: 2682527 - DNA, 15 bp, Homo sapiens
gtcctgctagctgtc

SEQ ID NO: 2682528 - DNA, 17 bp, Homo sapiens
gtcctgctagctgtctc

SEQ ID NO: 2682529 - DNA, 18 bp, Homo sapiens
gtcctgctagctgtctct

SEQ ID NO: 2682530 - DNA, 20 bp, Homo sapiens
gtcctgctagctgtctctct

SEQ ID NO: 2682531 - DNA, 22 bp, Homo sapiens
gtcctgctagctgtctctcttg

SEQ ID NO: 2682532 - DNA, 19 bp, Homo sapiens
gtcctgggagaacctcagg

SEQ ID NO: 2682533 - DNA, 22 bp, Homo sapiens
gtcctggtgggtcagcccagca

SEQ ID NO: 2682534 - DNA, 23 bp, Homo sapiens
gtcctggtgggtcagcccagcac

SEQ ID NO: 2682535 - DNA, 14 bp, Homo sapiens
gtcgagctgtgctc

SEQ ID NO: 2682536 - DNA, 22 bp, Homo sapiens
gtcggagcaagtttcatcagcc

SEQ ID NO: 2682537 - DNA, 20 bp, Homo sapiens
gtcgggacagaccagcagca

SEQ ID NO: 2682538 - DNA, 12 bp, Homo sapiens
gtcgggcccctg

SEQ ID NO: 2682539 - DNA, 16 bp, Homo sapiens
gtcgggcccctgcctg

SEQ ID NO: 2682540 - DNA, 20 bp, Homo sapiens
gtctccagtggttgctgttg

SEQ ID NO: 2682541 - DNA, 12 bp, Homo sapiens
gtctcctgctgc

SEQ ID NO: 2682542 - DNA, 14 bp, Homo sapiens
gtctcctgctgcgt

SEQ ID NO: 2682543 - DNA, 22 bp, Homo sapiens
gtctctaagccaactttaattg

SEQ ID NO: 2682544 - DNA, 14 bp, Homo sapiens
gtctctgtgctttg

SEQ ID NO: 2682545 - DNA, 22 bp, Homo sapiens
gtctctgttattgttagtttta

SEQ ID NO: 2682546 - DNA, 19 bp, Homo sapiens
gtctgagcggcgcagagcc

SEQ ID NO: 2682547 - DNA, 20 bp, Homo sapiens
gtctgagcggcgcagagccc

SEQ ID NO: 2682548 - DNA, 19 bp, Homo sapiens
gtctgatgccaaagctgct

SEQ ID NO: 2682549 - DNA, 20 bp, Homo sapiens
gtctgatgccaaagctgctt

SEQ ID NO: 2682550 - DNA, 18 bp, Homo sapiens
gtctgcattgttattgtg

SEQ ID NO: 2682551 - DNA, 23 bp, Homo sapiens
gtctgcgtcaggcacgtctcctg

SEQ ID NO: 2682552 - DNA, 17 bp, Homo sapiens
gtctgggatgtagaact

SEQ ID NO: 2682553 - DNA, 13 bp, Homo sapiens
gtctgtcctctct

SEQ ID NO: 2682554 - DNA, 14 bp, Homo sapiens
gtctgtctgtctgt

SEQ ID NO: 2682555 - DNA, 16 bp, Homo sapiens
gtcttccaaccccagc

SEQ ID NO: 2682556 - DNA, 19 bp, Homo sapiens
gtcttccaaccccagctgg

SEQ ID NO: 2682557 - DNA, 20 bp, Homo sapiens
gtcttccaaccccagctggc

SEQ ID NO: 2682558 - DNA, 12 bp, Homo sapiens
gtcttgctgtgc

SEQ ID NO: 2682559 - DNA, 14 bp, Homo sapiens
gtgaataatgattt

SEQ ID NO: 2682560 - DNA, 20 bp, Homo sapiens
gtgacatgtgcagtgctgta

SEQ ID NO: 2682561 - DNA, 21 bp, Homo sapiens
gtgaccctgagggctcctcca

SEQ ID NO: 2682562 - DNA, 13 bp, Homo sapiens
gtgacttctggct

SEQ ID NO: 2682563 - DNA, 12 bp, Homo sapiens
gtgactttgaaa

SEQ ID NO: 2682564 - DNA, 15 bp, Homo sapiens
gtgactttttagcca

SEQ ID NO: 2682565 - DNA, 20 bp, Homo sapiens
gtgactttttagccagtgac

SEQ ID NO: 2682566 - DNA, 16 bp, Homo sapiens
gtgagaccctgtctct

SEQ ID NO: 2682567 - DNA, 24 bp, Homo sapiens
gtgagccatgatcgagccactgca

SEQ ID NO: 2682568 - DNA, 16 bp, Homo sapiens
gtgagtgatggcagaa

SEQ ID NO: 2682569 - DNA, 23 bp, Homo sapiens
gtgatggaccaaagccacctgct

SEQ ID NO: 2682570 - DNA, 22 bp, Homo sapiens
gtgatggcagaacgatgcctgc

SEQ ID NO: 2682571 - DNA, 13 bp, Homo sapiens
gtgattgtgtctg

SEQ ID NO: 2682572 - DNA, 15 bp, Homo sapiens
gtgcatgcactgtct

SEQ ID NO: 2682573 - DNA, 14 bp, Homo sapiens
gtgccaccaataaa

SEQ ID NO: 2682574 - DNA, 17 bp, Homo sapiens
gtgccaccaataaaaat

SEQ ID NO: 2682575 - DNA, 13 bp, Homo sapiens
gtgcccagcccct

SEQ ID NO: 2682576 - DNA, 17 bp, Homo sapiens
gtgcccagcccctgccc

SEQ ID NO: 2682577 - DNA, 12 bp, Homo sapiens
gtgcctcccagt

SEQ ID NO: 2682578 - DNA, 15 bp, Homo sapiens
gtgcctcctccccag

SEQ ID NO: 2682579 - DNA, 13 bp, Homo sapiens
gtgcctcctgtgt

SEQ ID NO: 2682580 - DNA, 11 bp, Homo sapiens
gtgcctgcagc

SEQ ID NO: 2682581 - DNA, 18 bp, Homo sapiens
gtgctcgggtgctgccag

SEQ ID NO: 2682582 - DNA, 19 bp, Homo sapiens
gtgctgaggatacagctct

SEQ ID NO: 2682583 - DNA, 21 bp, Homo sapiens
gtgctgcattgagtccagctt

SEQ ID NO: 2682584 - DNA, 12 bp, Homo sapiens
gtgctgctttga

SEQ ID NO: 2682585 - DNA, 21 bp, Homo sapiens
gtgctggtctattttgatttt

SEQ ID NO: 2682586 - DNA, 18 bp, Homo sapiens
gtgctgtaatcggctccc

SEQ ID NO: 2682587 - DNA, 20 bp, Homo sapiens
gtgctgtaatcggctcccgc

SEQ ID NO: 2682588 - DNA, 23 bp, Homo sapiens
tccagcagcacacctcagcccca

SEQ ID NO: 2682589 - DNA, 13 bp, Homo sapiens
tccagcctgagca

SEQ ID NO: 2682590 - DNA, 20 bp, Homo sapiens
tccagcctgggcgacagagc

SEQ ID NO: 2682591 - DNA, 15 bp, Homo sapiens
tccagctttccttct

SEQ ID NO: 2682592 - DNA, 19 bp, Homo sapiens
tccagctttccttctgccc

SEQ ID NO: 2682593 - DNA, 22 bp, Homo sapiens
tccagctttccttctgcccttc

SEQ ID NO: 2682594 - DNA, 19 bp, Homo sapiens
tccagtggttgctgttgat

SEQ ID NO: 2682595 - DNA, 20 bp, Homo sapiens
tccatcctgaggtgcctccc

SEQ ID NO: 2682596 - DNA, 15 bp, Homo sapiens
tccatcttcacactg

SEQ ID NO: 2682597 - DNA, 19 bp, Homo sapiens
tccatgcacctcccttccc

SEQ ID NO: 2682598 - DNA, 21 bp, Homo sapiens
tccatgcagactcctcagatc

SEQ ID NO: 2682599 - DNA, 14 bp, Homo sapiens
tccatgccccagga

SEQ ID NO: 2682600 - DNA, 21 bp, Homo sapiens
tccatgtggccccaggtgcca

SEQ ID NO: 2682601 - DNA, 16 bp, Homo sapiens
tccattgaccagctct

SEQ ID NO: 2682602 - DNA, 21 bp, Homo sapiens
tcccaaagaagttctggtatg

SEQ ID NO: 2682603 - DNA, 17 bp, Homo sapiens
tcccaagtgccagtctt

SEQ ID NO: 2682604 - DNA, 22 bp, Homo sapiens
tcccagggccagggccctgcag

SEQ ID NO: 2682605 - DNA, 23 bp, Homo sapiens
tcccaggttgaggtgcgctcacc

SEQ ID NO: 2682606 - DNA, 20 bp, Homo sapiens
tcccagtggcctggcttgtc

SEQ ID NO: 2682607 - DNA, 18 bp, Homo sapiens
tccccacctacccagctg

SEQ ID NO: 2682608 - DNA, 23 bp, Homo sapiens
tccccacctacccagctgatggg

SEQ ID NO: 2682609 - DNA, 18 bp, Homo sapiens
tccccaccttcaattcct

SEQ ID NO: 2682610 - DNA, 23 bp, Homo sapiens
tccccaccttcaattcctgggcc

SEQ ID NO: 2682611 - DNA, 16 bp, Homo sapiens
tccccatacttcctgg

SEQ ID NO: 2682612 - DNA, 17 bp, Homo sapiens
tccccatacttcctggg

SEQ ID NO: 2682613 - DNA, 19 bp, Homo sapiens
tccccatacttcctgggat

SEQ ID NO: 2682614 - DNA, 18 bp, Homo sapiens
tccccccaccccccagca

SEQ ID NO: 2682615 - DNA, 14 bp, Homo sapiens
tccccctgggctct

SEQ ID NO: 2682616 - DNA, 15 bp, Homo sapiens
tccccctgggctctg

SEQ ID NO: 2682617 - DNA, 22 bp, Homo sapiens
tccccctgggctctgccccagc

SEQ ID NO: 2682618 - DNA, 23 bp, Homo sapiens
tccccctgggctctgccccagct

SEQ ID NO: 2682619 - DNA, 21 bp, Homo sapiens
tccccgaaagggacacaatgt

SEQ ID NO: 2682620 - DNA, 16 bp, Homo sapiens
tccccggccacatgcc

SEQ ID NO: 2682621 - DNA, 16 bp, Homo sapiens
tcccctaatcttttct

SEQ ID NO: 2682622 - DNA, 20 bp, Homo sapiens
tcccctccacgcaaggctgt

SEQ ID NO: 2682623 - DNA, 17 bp, Homo sapiens
tcccctttactcagccc

SEQ ID NO: 2682624 - DNA, 14 bp, Homo sapiens
tcccgctccccacc

SEQ ID NO: 2682625 - DNA, 14 bp, Homo sapiens
tcccgcttgctctc

SEQ ID NO: 2682626 - DNA, 17 bp, Homo sapiens
tcccgcttgctctcctg

SEQ ID NO: 2682627 - DNA, 15 bp, Homo sapiens
tcccggcatcctgaa

SEQ ID NO: 2682628 - DNA, 12 bp, Homo sapiens
tccctcccaagg

SEQ ID NO: 2682629 - DNA, 19 bp, Homo sapiens
tccctccttgagcaccagc

SEQ ID NO: 2682630 - DNA, 22 bp, Homo sapiens
tccctctcggaaggctggctgg

SEQ ID NO: 2682631 - DNA, 15 bp, Homo sapiens
tccctgcacagcctc

SEQ ID NO: 2682632 - DNA, 16 bp, Homo sapiens
tccctgcacagcctct

SEQ ID NO: 2682633 - DNA, 14 bp, Homo sapiens
tccctgctcccagg

SEQ ID NO: 2682634 - DNA, 20 bp, Homo sapiens
tccctgggggcatcctgctt

SEQ ID NO: 2682635 - DNA, 24 bp, Homo sapiens
tccctgggggcatcctgcttcctg

SEQ ID NO: 2682636 - DNA, 14 bp, Homo sapiens
tcccttccatgccc

SEQ ID NO: 2682637 - DNA, 18 bp, Homo sapiens
tcccttccatgccccagg

SEQ ID NO: 2682638 - DNA, 16 bp, Homo sapiens
tcccttccctccctga

SEQ ID NO: 2682639 - DNA, 17 bp, Homo sapiens
tcccttctctctttcta

SEQ ID NO: 2682640 - DNA, 19 bp, Homo sapiens
tcccttctctctttctaag

SEQ ID NO: 2682641 - DNA, 23 bp, Homo sapiens
tcccttgccctccctttctctct

SEQ ID NO: 2682642 - DNA, 15 bp, Homo sapiens
tccgacttgtccctc

SEQ ID NO: 2682643 - DNA, 16 bp, Homo sapiens
tccgatgctgaggcca

SEQ ID NO: 2682644 - DNA, 19 bp, Homo sapiens
tccgcaggctatttgttca

SEQ ID NO: 2682645 - DNA, 17 bp, Homo sapiens
tccggggctgctggcct

SEQ ID NO: 2682646 - DNA, 12 bp, Homo sapiens
tccggtgtgcct

SEQ ID NO: 2682647 - DNA, 15 bp, Homo sapiens
tccggtgtgcctgca

SEQ ID NO: 2682648 - DNA, 18 bp, Homo sapiens
tccggtgtgcctgcagcc

SEQ ID NO: 2682649 - DNA, 19 bp, Homo sapiens
tccgtcgggcccctgcctg

SEQ ID NO: 2682650 - DNA, 14 bp, Homo sapiens
tccgtgtgcctcct

SEQ ID NO: 2682651 - DNA, 16 bp, Homo sapiens
tccgtgtgcctcctgt

SEQ ID NO: 2682652 - DNA, 23 bp, Homo sapiens
tcctcacgcaactcacacctcct

SEQ ID NO: 2682653 - DNA, 18 bp, Homo sapiens
tcctcacttctgtctcct

SEQ ID NO: 2682654 - DNA, 17 bp, Homo sapiens
tcctcagggcccagcag

SEQ ID NO: 2682655 - DNA, 19 bp, Homo sapiens
tcctcagggcccagcaggc

SEQ ID NO: 2682656 - DNA, 10 bp, Homo sapiens
tcctccagtc

SEQ ID NO: 2682657 - DNA, 18 bp, Homo sapiens
tcctccatggtgctgcat

SEQ ID NO: 2682658 - DNA, 12 bp, Homo sapiens
tcctcccaggaa

SEQ ID NO: 2682659 - DNA, 13 bp, Homo sapiens
tcctccctcccaa

SEQ ID NO: 2682660 - DNA, 10 bp, Homo sapiens
tcctcctgct

SEQ ID NO: 2682661 - DNA, 18 bp, Homo sapiens
tcctcctgctctgcttcc

SEQ ID NO: 2682662 - DNA, 19 bp, Homo sapiens
tcctcctgctctgcttcct

SEQ ID NO: 2682663 - DNA, 19 bp, Homo sapiens
tcctctggatggcaccaga

SEQ ID NO: 2682664 - DNA, 15 bp, Homo sapiens
tcctgaaagctgttg

SEQ ID NO: 2682665 - DNA, 14 bp, Homo sapiens
tcctgaggtgcctc

SEQ ID NO: 2682666 - DNA, 16 bp, Homo sapiens
tcctgaggtgcctccc

SEQ ID NO: 2682667 - DNA, 17 bp, Homo sapiens
tcctgccaccagtcact

SEQ ID NO: 2682668 - DNA, 21 bp, Homo sapiens
tcctgcctggtcctccctccc

SEQ ID NO: 2682669 - DNA, 16 bp, Homo sapiens
tcctgctagctgtctc

SEQ ID NO: 2682670 - DNA, 16 bp, Homo sapiens
tcctgctctgcttcct

SEQ ID NO: 2682671 - DNA, 19 bp, Homo sapiens
tcctgctctgcttcctcag

SEQ ID NO: 2682672 - DNA, 13 bp, Homo sapiens
tcctgctgcgtga

SEQ ID NO: 2682673 - DNA, 13 bp, Homo sapiens
tcctgcttcctga

SEQ ID NO: 2682674 - DNA, 14 bp, Homo sapiens
tcctgcttcctgaa

SEQ ID NO: 2682675 - DNA, 15 bp, Homo sapiens
tcctgcttcctgaaa

SEQ ID NO: 2682676 - DNA, 20 bp, Homo sapiens
tcctgcttcctgaaagctgt

SEQ ID NO: 2682677 - DNA, 19 bp, Homo sapiens
tcctggagcaagctctgcc

SEQ ID NO: 2682678 - DNA, 20 bp, Homo sapiens
tcctggagcaagctctgccc

SEQ ID NO: 2682679 - DNA, 21 bp, Homo sapiens
tcctggagcaagctctgccct

SEQ ID NO: 2682680 - DNA, 22 bp, Homo sapiens
tcctggagcaagctctgccctg

SEQ ID NO: 2682681 - DNA, 17 bp, Homo sapiens
tcctgggagaacctcag

SEQ ID NO: 2682682 - DNA, 17 bp, Homo sapiens
tcctgggatgatgtgtg

SEQ ID NO: 2682683 - DNA, 16 bp, Homo sapiens
tcctggggctctgtgc

SEQ ID NO: 2682684 - DNA, 23 bp, Homo sapiens
tcctggtgggtcagcccagcacc

SEQ ID NO: 2682685 - DNA, 23 bp, Homo sapiens
tcctgtaacacaagccacagaag

SEQ ID NO: 2682686 - DNA, 17 bp, Homo sapiens
tcctgtagcatcttctg

SEQ ID NO: 2682687 - DNA, 21 bp, Homo sapiens
tcctgtagcatcttctggagt

SEQ ID NO: 2682688 - DNA, 15 bp, Homo sapiens
tcctgtccctaccca

SEQ ID NO: 2682689 - DNA, 18 bp, Homo sapiens
tcctgtccctacccactc

SEQ ID NO: 2682690 - DNA, 21 bp, Homo sapiens
tcctgtccctacccactcttt

SEQ ID NO: 2682691 - DNA, 13 bp, Homo sapiens
tcctgtggccagg

SEQ ID NO: 2682692 - DNA, 10 bp, Homo sapiens
tcctgtgtgt

SEQ ID NO: 2682693 - DNA, 14 bp, Homo sapiens
tcctgtgtgtctgc

SEQ ID NO: 2682694 - DNA, 14 bp, Homo sapiens
tccttaagccagga

SEQ ID NO: 2682695 - DNA, 14 bp, Homo sapiens
tccttacctggagt

SEQ ID NO: 2682696 - DNA, 23 bp, Homo sapiens
tccttcaagttagctcaggaggc

SEQ ID NO: 2682697 - DNA, 13 bp, Homo sapiens
tccttctgccctt

SEQ ID NO: 2682698 - DNA, 22 bp, Homo sapiens
tgatgaggcctcttggacctct

SEQ ID NO: 2682699 - DNA, 19 bp, Homo sapiens
tgatgatgtctcttgtaga

SEQ ID NO: 2682700 - DNA, 21 bp, Homo sapiens
tgatgatgtctcttgtagaag

SEQ ID NO: 2682701 - DNA, 13 bp, Homo sapiens
tgatgccaaagct

SEQ ID NO: 2682702 - DNA, 12 bp, Homo sapiens
tgatggaccaaa

SEQ ID NO: 2682703 - DNA, 14 bp, Homo sapiens
tgatggaccaaagc

SEQ ID NO: 2682704 - DNA, 16 bp, Homo sapiens
tgatggaccaaagcca

SEQ ID NO: 2682705 - DNA, 20 bp, Homo sapiens
tgatggaccaaagccacctg

SEQ ID NO: 2682706 - DNA, 21 bp, Homo sapiens
tgatggcagaacgatgcctgc

SEQ ID NO: 2682707 - DNA, 22 bp, Homo sapiens
tgattcactggcctggcggaga

SEQ ID NO: 2682708 - DNA, 18 bp, Homo sapiens
tgatttggggattcagat

SEQ ID NO: 2682709 - DNA, 21 bp, Homo sapiens
tgatttggggattcagatttc

SEQ ID NO: 2682710 - DNA, 20 bp, Homo sapiens
tgattttgtagttaatttat

SEQ ID NO: 2682711 - DNA, 21 bp, Homo sapiens
tgcaagtgtttgaagtctgct

SEQ ID NO: 2682712 - DNA, 19 bp, Homo sapiens
tgcacaccttttccccagg

SEQ ID NO: 2682713 - DNA, 20 bp, Homo sapiens
tgcacaccttttccccagga

SEQ ID NO: 2682714 - DNA, 23 bp, Homo sapiens
tgcacaccttttccccaggagca

SEQ ID NO: 2682715 - DNA, 12 bp, Homo sapiens
tgcacagcctct

SEQ ID NO: 2682716 - DNA, 23 bp, Homo sapiens
tgcacattttgtacaaagatatg

SEQ ID NO: 2682717 - DNA, 14 bp, Homo sapiens
tgcaccctccgcct

SEQ ID NO: 2682718 - DNA, 21 bp, Homo sapiens
tgcacctcccttccctccctg

SEQ ID NO: 2682719 - DNA, 13 bp, Homo sapiens
tgcacctgcaggc

SEQ ID NO: 2682720 - DNA, 15 bp, Homo sapiens
tgcactccagcctgg

SEQ ID NO: 2682721 - DNA, 19 bp, Homo sapiens
tgcactggtcccaagtagt

SEQ ID NO: 2682722 - DNA, 15 bp, Homo sapiens
tgcactgtatgctgg

SEQ ID NO: 2682723 - DNA, 16 bp, Homo sapiens
tgcactgtatgctgga

SEQ ID NO: 2682724 - DNA, 21 bp, Homo sapiens
tgcagaggggctttctggaga

SEQ ID NO: 2682725 - DNA, 21 bp, Homo sapiens
tgcagatctttttgtgaaatt

SEQ ID NO: 2682726 - DNA, 15 bp, Homo sapiens
tgcagtagtctctgt

SEQ ID NO: 2682727 - DNA, 20 bp, Homo sapiens
tgcagtccgcagtctggcct

SEQ ID NO: 2682728 - DNA, 23 bp, Homo sapiens
tgcagtgctgtaatcggctcccg

SEQ ID NO: 2682729 - DNA, 13 bp, Homo sapiens
tgcagtttgatca

SEQ ID NO: 2682730 - DNA, 15 bp, Homo sapiens
tgcagtttgatcaaa

SEQ ID NO: 2682731 - DNA, 16 bp, Homo sapiens
tgcattgtcttgtgga

SEQ ID NO: 2682732 - DNA, 15 bp, Homo sapiens
tgccaaagctgcttt

SEQ ID NO: 2682733 - DNA, 11 bp, Homo sapiens
tgccaccaata

SEQ ID NO: 2682734 - DNA, 15 bp, Homo sapiens
tgccaccaataaaaa

SEQ ID NO: 2682735 - DNA, 21 bp, Homo sapiens
tgccaccaataaaaatcctac

SEQ ID NO: 2682736 - DNA, 16 bp, Homo sapiens
tgccaccagtcactgt

SEQ ID NO: 2682737 - DNA, 10 bp, Homo sapiens
tgccacctgt

SEQ ID NO: 2682738 - DNA, 12 bp, Homo sapiens
tgccacttccca

SEQ ID NO: 2682739 - DNA, 20 bp, Homo sapiens
tgccagagctttgttttata

SEQ ID NO: 2682740 - DNA, 16 bp, Homo sapiens
tgccagcctggcttct

SEQ ID NO: 2682741 - DNA, 23 bp, Homo sapiens
tgccagcctggcttctggagccc

SEQ ID NO: 2682742 - DNA, 22 bp, Homo sapiens
tgccagttgaaaatggattttt

SEQ ID NO: 2682743 - DNA, 17 bp, Homo sapiens
tgccatggcgtgtccct

SEQ ID NO: 2682744 - DNA, 21 bp, Homo sapiens
tgccatttgcaccctccgcct

SEQ ID NO: 2682745 - DNA, 22 bp, Homo sapiens
tgccatttgcaccctccgcctt

SEQ ID NO: 2682746 - DNA, 13 bp, Homo sapiens
tgcccagcccctg

SEQ ID NO: 2682747 - DNA, 17 bp, Homo sapiens
tgcccagcccctgcccc

SEQ ID NO: 2682748 - DNA, 19 bp, Homo sapiens
tgcccattgtttttctgat

SEQ ID NO: 2682749 - DNA, 13 bp, Homo sapiens
tgcccccgtgggg

SEQ ID NO: 2682750 - DNA, 13 bp, Homo sapiens
tgccccctggtgg

SEQ ID NO: 2682751 - DNA, 22 bp, Homo sapiens
tgccccctggtggacagtcctg

SEQ ID NO: 2682752 - DNA, 13 bp, Homo sapiens
tgccccgcccagc

SEQ ID NO: 2682753 - DNA, 20 bp, Homo sapiens
tgcccctccgatgctgaggc

SEQ ID NO: 2682754 - DNA, 14 bp, Homo sapiens
tgcccctgctctgt

SEQ ID NO: 2682755 - DNA, 15 bp, Homo sapiens
tgcccggattctggg

SEQ ID NO: 2682756 - DNA, 22 bp, Homo sapiens
tgcccggattctgggaggaagc

SEQ ID NO: 2682757 - DNA, 21 bp, Homo sapiens
tgccctccacagccgcagcct

SEQ ID NO: 2682758 - DNA, 16 bp, Homo sapiens
tgccctcccctgctcc

SEQ ID NO: 2682759 - DNA, 17 bp, Homo sapiens
tgccctcccctgctccc

SEQ ID NO: 2682760 - DNA, 13 bp, Homo sapiens
tgccctctgcccc

SEQ ID NO: 2682761 - DNA, 15 bp, Homo sapiens
tgccctgccacctgt

SEQ ID NO: 2682762 - DNA, 16 bp, Homo sapiens
tgccctgccacctgtc

SEQ ID NO: 2682763 - DNA, 17 bp, Homo sapiens
tgccctgccacctgtct

SEQ ID NO: 2682764 - DNA, 21 bp, Homo sapiens
tgccctgccacctgtctgtct

SEQ ID NO: 2682765 - DNA, 22 bp, Homo sapiens
tgccctgccacctgtctgtctg

SEQ ID NO: 2682766 - DNA, 16 bp, Homo sapiens
tgccctggctgtgggt

SEQ ID NO: 2682767 - DNA, 17 bp, Homo sapiens
tgccctgtgagagccac

SEQ ID NO: 2682768 - DNA, 21 bp, Homo sapiens
tgccctgtgagagccacgctg

SEQ ID NO: 2682769 - DNA, 21 bp, Homo sapiens
tgcctcctccccaggtggagg

SEQ ID NO: 2682770 - DNA, 11 bp, Homo sapiens
tgcctcctcct

SEQ ID NO: 2682771 - DNA, 22 bp, Homo sapiens
tgcctcctgtgtgtctgcagac

SEQ ID NO: 2682772 - DNA, 14 bp, Homo sapiens
tgccttgaagccac

SEQ ID NO: 2682773 - DNA, 15 bp, Homo sapiens
tgccttgaagccact

SEQ ID NO: 2682774 - DNA, 16 bp, Homo sapiens
tgcctttttacagcca

SEQ ID NO: 2682775 - DNA, 16 bp, Homo sapiens
tgcgaaggggccctgg

SEQ ID NO: 2682776 - DNA, 18 bp, Homo sapiens
tgcgccccgcctccccat

SEQ ID NO: 2682777 - DNA, 14 bp, Homo sapiens
tgcgctcacctcag

SEQ ID NO: 2682778 - DNA, 17 bp, Homo sapiens
tgcgggatggtcctggg

SEQ ID NO: 2682779 - DNA, 14 bp, Homo sapiens
tgcgggggagccag

SEQ ID NO: 2682780 - DNA, 22 bp, Homo sapiens
tgcgtcaggcacgtctcctgct

SEQ ID NO: 2682781 - DNA, 16 bp, Homo sapiens
tgctacaataaatgct

SEQ ID NO: 2682782 - DNA, 19 bp, Homo sapiens
tgctacaataaatgctgaa

SEQ ID NO: 2682783 - DNA, 12 bp, Homo sapiens
tgctagctgtct

SEQ ID NO: 2682784 - DNA, 19 bp, Homo sapiens
tgctaggagccccagcttc

SEQ ID NO: 2682785 - DNA, 20 bp, Homo sapiens
tgctaggagccccagcttcc

SEQ ID NO: 2682786 - DNA, 23 bp, Homo sapiens
tgctaggagccccagcttcctgt

SEQ ID NO: 2682787 - DNA, 22 bp, Homo sapiens
tgctcagaagccagtctgcgtc

SEQ ID NO: 2682788 - DNA, 23 bp, Homo sapiens
tgctcagaagccagtctgcgtca

SEQ ID NO: 2682789 - DNA, 14 bp, Homo sapiens
tgctcattccgagg

SEQ ID NO: 2682790 - DNA, 18 bp, Homo sapiens
tgctccagcagcacacct

SEQ ID NO: 2682791 - DNA, 21 bp, Homo sapiens
tgctcccagtgggagcttccc

SEQ ID NO: 2682792 - DNA, 22 bp, Homo sapiens
tgctcccagtgggagcttcccg

SEQ ID NO: 2682793 - DNA, 23 bp, Homo sapiens
tgctcccagtgggagcttcccgg

SEQ ID NO: 2682794 - DNA, 14 bp, Homo sapiens
tgctcgaagaacaa

SEQ ID NO: 2682795 - DNA, 15 bp, Homo sapiens
tgctcgggtgctgcc

SEQ ID NO: 2682796 - DNA, 21 bp, Homo sapiens
tgctcgggtgctgccagctgc

SEQ ID NO: 2682797 - DNA, 23 bp, Homo sapiens
tgctcgggtgctgccagctgctc

SEQ ID NO: 2682798 - DNA, 14 bp, Homo sapiens
tgctctatgccagg

SEQ ID NO: 2682799 - DNA, 17 bp, Homo sapiens
tgctctatgccaggctg

SEQ ID NO: 2682800 - DNA, 13 bp, Homo sapiens
tgctctcctggag

SEQ ID NO: 2682801 - DNA, 16 bp, Homo sapiens
tgctctgaggcttcca

SEQ ID NO: 2682802 - DNA, 14 bp, Homo sapiens
tgctctgcttcctc

SEQ ID NO: 2682803 - DNA, 15 bp, Homo sapiens
tgctctgcttcctca

SEQ ID NO: 2682804 - DNA, 16 bp, Homo sapiens
tgctctgtagccacct

SEQ ID NO: 2682805 - DNA, 17 bp, Homo sapiens
tgctctgtagccacctc

SEQ ID NO: 2682806 - DNA, 15 bp, Homo sapiens
tgctctgtttcttcc

SEQ ID NO: 2682807 - DNA, 13 bp, Homo sapiens
tgctcttcctctg

SEQ ID NO: 2682808 - DNA, 17 bp, Homo sapiens
ttcgagaccagcctggc

SEQ ID NO: 2682809 - DNA, 18 bp, Homo sapiens
ttcgtctccatctctggt

SEQ ID NO: 2682810 - DNA, 17 bp, Homo sapiens
ttctacacatatatgta

SEQ ID NO: 2682811 - DNA, 18 bp, Homo sapiens
ttctacacatatatgtat

SEQ ID NO: 2682812 - DNA, 15 bp, Homo sapiens
ttctagctttgttgt

SEQ ID NO: 2682813 - DNA, 23 bp, Homo sapiens
ttctatcaggaaaacaaatcact

SEQ ID NO: 2682814 - DNA, 16 bp, Homo sapiens
ttctattttctctgat

SEQ ID NO: 2682815 - DNA, 17 bp, Homo sapiens
ttctccccctgggctct

SEQ ID NO: 2682816 - DNA, 12 bp, Homo sapiens
ttctctctccac

SEQ ID NO: 2682817 - DNA, 16 bp, Homo sapiens
ttctctctttctaagg

SEQ ID NO: 2682818 - DNA, 14 bp, Homo sapiens
ttctctgagaacca

SEQ ID NO: 2682819 - DNA, 20 bp, Homo sapiens
ttctctgagaaccaaaagat

SEQ ID NO: 2682820 - DNA, 22 bp, Homo sapiens
ttctctgagaaccaaaagatgc

SEQ ID NO: 2682821 - DNA, 14 bp, Homo sapiens
ttctctgcctcctc

SEQ ID NO: 2682822 - DNA, 13 bp, Homo sapiens
ttctcttcctgta

SEQ ID NO: 2682823 - DNA, 12 bp, Homo sapiens
ttctctttgaaa

SEQ ID NO: 2682824 - DNA, 14 bp, Homo sapiens
ttctctttgctgac

SEQ ID NO: 2682825 - DNA, 11 bp, Homo sapiens
ttctgaccaaa

SEQ ID NO: 2682826 - DNA, 13 bp, Homo sapiens
ttctgaccaaaat

SEQ ID NO: 2682827 - DNA, 20 bp, Homo sapiens
ttctgagcttttcatggaag

SEQ ID NO: 2682828 - DNA, 19 bp, Homo sapiens
ttctgcagtagtctctgtg

SEQ ID NO: 2682829 - DNA, 20 bp, Homo sapiens
ttctgcagtagtctctgtgc

SEQ ID NO: 2682830 - DNA, 13 bp, Homo sapiens
ttctggagccctt

SEQ ID NO: 2682831 - DNA, 19 bp, Homo sapiens
ttctggggcccgcctgcca

SEQ ID NO: 2682832 - DNA, 21 bp, Homo sapiens
ttctggggcccgcctgccacc

SEQ ID NO: 2682833 - DNA, 23 bp, Homo sapiens
ttctggggcccgcctgccacctc

SEQ ID NO: 2682834 - DNA, 23 bp, Homo sapiens
ttctgtaggtttctctcttccct

SEQ ID NO: 2682835 - DNA, 16 bp, Homo sapiens
ttctgtccagtttcca

SEQ ID NO: 2682836 - DNA, 19 bp, Homo sapiens
ttcttcaagggaagaaaca

SEQ ID NO: 2682837 - DNA, 22 bp, Homo sapiens
ttcttctagctttgttgtcctc

SEQ ID NO: 2682838 - DNA, 17 bp, Homo sapiens
ttcttctctgcctcctc

SEQ ID NO: 2682839 - DNA, 17 bp, Homo sapiens
ttctttccatgcagact

SEQ ID NO: 2682840 - DNA, 21 bp, Homo sapiens
ttgaaatcagtaaacactgtg

SEQ ID NO: 2682841 - DNA, 13 bp, Homo sapiens
ttgaagccactga

SEQ ID NO: 2682842 - DNA, 17 bp, Homo sapiens
ttgaagccactgaagct

SEQ ID NO: 2682843 - DNA, 18 bp, Homo sapiens
ttgaaggagaaaatgcat

SEQ ID NO: 2682844 - DNA, 15 bp, Homo sapiens
ttgaagtctgctcat

SEQ ID NO: 2682845 - DNA, 21 bp, Homo sapiens
ttgaatatttattcagtgact

SEQ ID NO: 2682846 - DNA, 23 bp, Homo sapiens
ttgaccttctccctcactcctgc

SEQ ID NO: 2682847 - DNA, 16 bp, Homo sapiens
ttgactttttagatgt

SEQ ID NO: 2682848 - DNA, 13 bp, Homo sapiens
ttgaggacacatg

SEQ ID NO: 2682849 - DNA, 14 bp, Homo sapiens
ttgaggacacatgt

SEQ ID NO: 2682850 - DNA, 16 bp, Homo sapiens
ttgaggggctcctgga

SEQ ID NO: 2682851 - DNA, 22 bp, Homo sapiens
ttgaggtgcgctcacctcagag

SEQ ID NO: 2682852 - DNA, 13 bp, Homo sapiens
ttgagtccagctt

SEQ ID NO: 2682853 - DNA, 17 bp, Homo sapiens
ttgagtccagctttcct

SEQ ID NO: 2682854 - DNA, 18 bp, Homo sapiens
ttgataaattccactgga

SEQ ID NO: 2682855 - DNA, 21 bp, Homo sapiens
ttgcactgatgtccggagaga

SEQ ID NO: 2682856 - DNA, 13 bp, Homo sapiens
ttgcccctgctct

SEQ ID NO: 2682857 - DNA, 18 bp, Homo sapiens
ttgcctttttacagccaa

SEQ ID NO: 2682858 - DNA, 16 bp, Homo sapiens
ttgctacaataaatgc

SEQ ID NO: 2682859 - DNA, 17 bp, Homo sapiens
ttgctacaataaatgct

SEQ ID NO: 2682860 - DNA, 19 bp, Homo sapiens
ttgctaggagccccagctt

SEQ ID NO: 2682861 - DNA, 13 bp, Homo sapiens
ttgctctcctgga

SEQ ID NO: 2682862 - DNA, 13 bp, Homo sapiens
ttgctcttggaaa

SEQ ID NO: 2682863 - DNA, 17 bp, Homo sapiens
ttggacccgctctggac

SEQ ID NO: 2682864 - DNA, 21 bp, Homo sapiens
ttggacctctgctctgaggct

SEQ ID NO: 2682865 - DNA, 23 bp, Homo sapiens
ttggagggtgggagagcccagcc

SEQ ID NO: 2682866 - DNA, 15 bp, Homo sapiens
ttggcatttgtgtta

SEQ ID NO: 2682867 - DNA, 11 bp, Homo sapiens
ttggctctttc

SEQ ID NO: 2682868 - DNA, 13 bp, Homo sapiens
ttgggctggctct

SEQ ID NO: 2682869 - DNA, 23 bp, Homo sapiens
ttgtaataaacccttaactggca

SEQ ID NO: 2682870 - DNA, 19 bp, Homo sapiens
ttgtacaattactaaattg

SEQ ID NO: 2682871 - DNA, 17 bp, Homo sapiens
ttgtacgtaaagcttaa

SEQ ID NO: 2682872 - DNA, 21 bp, Homo sapiens
ttgtacgtaaagcttaaattg

SEQ ID NO: 2682873 - DNA, 19 bp, Homo sapiens
ttgtactcttgctttttca

SEQ ID NO: 2682874 - DNA, 14 bp, Homo sapiens
ttgtattacatcta

SEQ ID NO: 2682875 - DNA, 16 bp, Homo sapiens
ttgtattacatctaat

SEQ ID NO: 2682876 - DNA, 18 bp, Homo sapiens
ttgtcttccaaccccagc

SEQ ID NO: 2682877 - DNA, 22 bp, Homo sapiens
ttgtcttccaaccccagctggc

SEQ ID NO: 2682878 - DNA, 13 bp, Homo sapiens
ttgtcttgtggag

SEQ ID NO: 2682879 - DNA, 18 bp, Homo sapiens
ttgtggaaagcctctgct

SEQ ID NO: 2682880 - DNA, 21 bp, Homo sapiens
ttgttgataaattccactgga

SEQ ID NO: 2682881 - DNA, 12 bp, Homo sapiens
ttgttgtgactt

SEQ ID NO: 2682882 - DNA, 22 bp, Homo sapiens
tttaaaaaaagtatatattcta

SEQ ID NO: 2682883 - DNA, 19 bp, Homo sapiens
tttaaattatactgtagct

SEQ ID NO: 2682884 - DNA, 14 bp, Homo sapiens
tttaagccctgctc

SEQ ID NO: 2682885 - DNA, 15 bp, Homo sapiens
tttaagccctgctct

SEQ ID NO: 2682886 - DNA, 16 bp, Homo sapiens
tttaatgattgtttaa

SEQ ID NO: 2682887 - DNA, 16 bp, Homo sapiens
tttacaacctagaagt

SEQ ID NO: 2682888 - DNA, 15 bp, Homo sapiens
tttacagttatagaa

SEQ ID NO: 2682889 - DNA, 18 bp, Homo sapiens
tttaccctatatctataa

SEQ ID NO: 2682890 - DNA, 19 bp, Homo sapiens
tttacctgtatttaagatt

SEQ ID NO: 2682891 - DNA, 17 bp, Homo sapiens
tttaccttttctgttgt

SEQ ID NO: 2682892 - DNA, 20 bp, Homo sapiens
tttactaaagatatcagagc

SEQ ID NO: 2682893 - DNA, 18 bp, Homo sapiens
tttagaatcgctttcctt

SEQ ID NO: 2682894 - DNA, 21 bp, Homo sapiens
tttaggcatatgcttctttaa

SEQ ID NO: 2682895 - DNA, 17 bp, Homo sapiens
tttagtgactgtaatta

SEQ ID NO: 2682896 - DNA, 14 bp, Homo sapiens
tttagttgaaaaat

SEQ ID NO: 2682897 - DNA, 17 bp, Homo sapiens
tttatagttaatctata

SEQ ID NO: 2682898 - DNA, 14 bp, Homo sapiens
tttattaagtctgg

SEQ ID NO: 2682899 - DNA, 18 bp, Homo sapiens
tttattggaagtgttcaa

SEQ ID NO: 2682900 - DNA, 12 bp, Homo sapiens
tttcaacaattt

SEQ ID NO: 2682901 - DNA, 18 bp, Homo sapiens
tttcaaccgcttgccata

SEQ ID NO: 2682902 - DNA, 18 bp, Homo sapiens
tttcaactcattgcatca

SEQ ID NO: 2682903 - DNA, 23 bp, Homo sapiens
tttcagaattgaaggagaaaatg

SEQ ID NO: 2682904 - DNA, 13 bp, Homo sapiens
tttcagagccagt

SEQ ID NO: 2682905 - DNA, 21 bp, Homo sapiens
tttcagctattagcaactgtg

SEQ ID NO: 2682906 - DNA, 15 bp, Homo sapiens
tttcataacaaacca

SEQ ID NO: 2682907 - DNA, 14 bp, Homo sapiens
tttccatcctgagg

SEQ ID NO: 2682908 - DNA, 15 bp, Homo sapiens
tttccggggctgctg

SEQ ID NO: 2682909 - DNA, 12 bp, Homo sapiens
tttcctcttgaa

SEQ ID NO: 2682910 - DNA, 13 bp, Homo sapiens
tttccttctgccc

SEQ ID NO: 2682911 - DNA, 18 bp, Homo sapiens
tttccttctgcccttcct

SEQ ID NO: 2682912 - DNA, 22 bp, Homo sapiens
tttctaattcctgttgctctgt

SEQ ID NO: 2682913 - DNA, 13 bp, Homo sapiens
tttctactcattt

SEQ ID NO: 2682914 - DNA, 14 bp, Homo sapiens
tttctagtttcagt

SEQ ID NO: 2682915 - DNA, 15 bp, Homo sapiens
tttctctttgaaaca

SEQ ID NO: 2682916 - DNA, 12 bp, Homo sapiens
tttctgaccaaa

SEQ ID NO: 2682917 - DNA, 21 bp, Homo sapiens
tttctgaccaaaatgtgtttc

SEQ ID NO: 2682918 - DNA, 20 bp, Homo sapiens
aatatctgagaagtgtatat

SEQ ID NO: 2682919 - DNA, 16 bp, Homo sapiens
aatattctatgaccac

SEQ ID NO: 2682920 - DNA, 21 bp, Homo sapiens
aatcaacatggctacttgctt

SEQ ID NO: 2682921 - DNA, 19 bp, Homo sapiens
aatcatactcctatgcttt

SEQ ID NO: 2682922 - DNA, 22 bp, Homo sapiens
aatcatgctgttctctttgctg

SEQ ID NO: 2682923 - DNA, 22 bp, Homo sapiens
aatcgctttccttcctcccctt

SEQ ID NO: 2682924 - DNA, 19 bp, Homo sapiens
aatctagttttttttgtaa

SEQ ID NO: 2682925 - DNA, 23 bp, Homo sapiens
aatctagttttttttgtaaactg

SEQ ID NO: 2682926 - DNA, 20 bp, Homo sapiens
aatctcaaattctcaaccta

SEQ ID NO: 2682927 - DNA, 18 bp, Homo sapiens
aatctggcaaagttatat

SEQ ID NO: 2682928 - DNA, 19 bp, Homo sapiens
aatctggcaaagttatatt

SEQ ID NO: 2682929 - DNA, 16 bp, Homo sapiens
aatctgtatatgttgt

SEQ ID NO: 2682930 - DNA, 18 bp, Homo sapiens
aatctgtatatgttgtaa

SEQ ID NO: 2682931 - DNA, 14 bp, Homo sapiens
aatcttttctgaat

SEQ ID NO: 2682932 - DNA, 21 bp, Homo sapiens
aatgaaagggaaagtcagctt

SEQ ID NO: 2682933 - DNA, 16 bp, Homo sapiens
aatgacccaaagacca

SEQ ID NO: 2682934 - DNA, 18 bp, Homo sapiens
aatgattgtttaaaggtt

SEQ ID NO: 2682935 - DNA, 17 bp, Homo sapiens
aatgcattgtcttgtgg

SEQ ID NO: 2682936 - DNA, 23 bp, Homo sapiens
aatgccaacttgtccttttgtac

SEQ ID NO: 2682937 - DNA, 20 bp, Homo sapiens
aatgcttcaagtgttgctct

SEQ ID NO: 2682938 - DNA, 19 bp, Homo sapiens
aatggatttttaaattata

SEQ ID NO: 2682939 - DNA, 21 bp, Homo sapiens
aatggccctagaactgtgcct

SEQ ID NO: 2682940 - DNA, 20 bp, Homo sapiens
aatggcctgccttgaagcca

SEQ ID NO: 2682941 - DNA, 19 bp, Homo sapiens
aatgtacaagttttgtata

SEQ ID NO: 2682942 - DNA, 23 bp, Homo sapiens
aatgtcagaaactcgatgaatgt

SEQ ID NO: 2682943 - DNA, 18 bp, Homo sapiens
aatgtgtcctcctgctct

SEQ ID NO: 2682944 - DNA, 22 bp, Homo sapiens
aatgtgtcctcctgctctgctt

SEQ ID NO: 2682945 - DNA, 17 bp, Homo sapiens
aatgtgttgatttgaga

SEQ ID NO: 2682946 - DNA, 12 bp, Homo sapiens
aatgttttgtac

SEQ ID NO: 2682947 - DNA, 13 bp, Homo sapiens
aatgttttgtaca

SEQ ID NO: 2682948 - DNA, 14 bp, Homo sapiens
aatgttttgtacaa

SEQ ID NO: 2682949 - DNA, 15 bp, Homo sapiens
aattaatatttatgt

SEQ ID NO: 2682950 - DNA, 13 bp, Homo sapiens
aattccactggac

SEQ ID NO: 2682951 - DNA, 20 bp, Homo sapiens
aattgcttttgttgtgactt

SEQ ID NO: 2682952 - DNA, 21 bp, Homo sapiens
aatttcccacaccccagcgcc

SEQ ID NO: 2682953 - DNA, 21 bp, Homo sapiens
acaaaccatctggtgcctttc

SEQ ID NO: 2682954 - DNA, 19 bp, Homo sapiens
acaaagccaaactctgcca

SEQ ID NO: 2682955 - DNA, 20 bp, Homo sapiens
acaaagcgagatcccatctc

SEQ ID NO: 2682956 - DNA, 23 bp, Homo sapiens
acaagaagggttttccaccctgg

SEQ ID NO: 2682957 - DNA, 12 bp, Homo sapiens
acaagccacaga

SEQ ID NO: 2682958 - DNA, 13 bp, Homo sapiens
acaagccacagaa

SEQ ID NO: 2682959 - DNA, 13 bp, Homo sapiens
acaagtcttgctg

SEQ ID NO: 2682960 - DNA, 18 bp, Homo sapiens
acaagtcttgctgtgctt

SEQ ID NO: 2682961 - DNA, 20 bp, Homo sapiens
acaagtcttgctgtgcttta

SEQ ID NO: 2682962 - DNA, 21 bp, Homo sapiens
acaagttttgtataaataata

SEQ ID NO: 2682963 - DNA, 12 bp, Homo sapiens
acaataaatgct

SEQ ID NO: 2682964 - DNA, 20 bp, Homo sapiens
acaatttttgatcaatgtat

SEQ ID NO: 2682965 - DNA, 14 bp, Homo sapiens
acacaagccacaga

SEQ ID NO: 2682966 - DNA, 16 bp, Homo sapiens
acacaagccacagaag

SEQ ID NO: 2682967 - DNA, 19 bp, Homo sapiens
acacaagccacagaagcca

SEQ ID NO: 2682968 - DNA, 20 bp, Homo sapiens
acacagaactggcaggagcc

SEQ ID NO: 2682969 - DNA, 14 bp, Homo sapiens
acacccactggcca

SEQ ID NO: 2682970 - DNA, 20 bp, Homo sapiens
acaccgctggtccctgccct

SEQ ID NO: 2682971 - DNA, 22 bp, Homo sapiens
acaccgctggtccctgccctcc

SEQ ID NO: 2682972 - DNA, 16 bp, Homo sapiens
acacctcagccccact

SEQ ID NO: 2682973 - DNA, 12 bp, Homo sapiens
acacctgccctg

SEQ ID NO: 2682974 - DNA, 18 bp, Homo sapiens
acacctgccctgccctgc

SEQ ID NO: 2682975 - DNA, 21 bp, Homo sapiens
acaccttagacggaggtgcct

SEQ ID NO: 2682976 - DNA, 22 bp, Homo sapiens
acaccttagacggaggtgcctg

SEQ ID NO: 2682977 - DNA, 18 bp, Homo sapiens
acaccttttccccaggag

SEQ ID NO: 2682978 - DNA, 20 bp, Homo sapiens
acactggtttgccaggccaa

SEQ ID NO: 2682979 - DNA, 16 bp, Homo sapiens
acactgtgaccctggg

SEQ ID NO: 2682980 - DNA, 22 bp, Homo sapiens
acactgtgtcccccccagtgca

SEQ ID NO: 2682981 - DNA, 19 bp, Homo sapiens
acactgtttgttccagaat

SEQ ID NO: 2682982 - DNA, 16 bp, Homo sapiens
acagaagccaggagca

SEQ ID NO: 2682983 - DNA, 21 bp, Homo sapiens
acagcaggaactgagccagaa

SEQ ID NO: 2682984 - DNA, 20 bp, Homo sapiens
acagccgcagcctccctctg

SEQ ID NO: 2682985 - DNA, 22 bp, Homo sapiens
acagccgcagcctccctctgac

SEQ ID NO: 2682986 - DNA, 23 bp, Homo sapiens
acagccgcagcctccctctgacc

SEQ ID NO: 2682987 - DNA, 17 bp, Homo sapiens
acagcgtttacatattt

SEQ ID NO: 2682988 - DNA, 19 bp, Homo sapiens
acagcgtttacatatttac

SEQ ID NO: 2682989 - DNA, 15 bp, Homo sapiens
acagctcacctctga

SEQ ID NO: 2682990 - DNA, 22 bp, Homo sapiens
acagctcttctcagtgtctgaa

SEQ ID NO: 2682991 - DNA, 13 bp, Homo sapiens
acagctgctggga

SEQ ID NO: 2682992 - DNA, 18 bp, Homo sapiens
acagctgggcatgccatg

SEQ ID NO: 2682993 - DNA, 22 bp, Homo sapiens
acaggacagtgcttcagcctga

SEQ ID NO: 2682994 - DNA, 15 bp, Homo sapiens
acaggacctctgctt

SEQ ID NO: 2682995 - DNA, 12 bp, Homo sapiens
acaggtgcgccc

SEQ ID NO: 2682996 - DNA, 15 bp, Homo sapiens
acagtgcttcagcct

SEQ ID NO: 2682997 - DNA, 21 bp, Homo sapiens
acagtgcttcagcctgaggct

SEQ ID NO: 2682998 - DNA, 24 bp, Homo sapiens
acagtgggcaggaggccccaggct

SEQ ID NO: 2682999 - DNA, 21 bp, Homo sapiens
acatagtaagaccccatctct

SEQ ID NO: 2683000 - DNA, 22 bp, Homo sapiens
acatatttacctgtatttaaga

SEQ ID NO: 2683001 - DNA, 18 bp, Homo sapiens
acatcccaggaggggcct

SEQ ID NO: 2683002 - DNA, 21 bp, Homo sapiens
acatgaggacatgatggagcg

SEQ ID NO: 2683003 - DNA, 20 bp, Homo sapiens
acatgctgtgctctttgaag

SEQ ID NO: 2683004 - DNA, 21 bp, Homo sapiens
acatgctgtgctctttgaaga

SEQ ID NO: 2683005 - DNA, 21 bp, Homo sapiens
acatgtccagtgggaggtgag

SEQ ID NO: 2683006 - DNA, 16 bp, Homo sapiens
acattgatttgatttt

SEQ ID NO: 2683007 - DNA, 23 bp, Homo sapiens
acattgtaagagagatgagcact

SEQ ID NO: 2683008 - DNA, 19 bp, Homo sapiens
accaaaaaaccccagctat

SEQ ID NO: 2683009 - DNA, 17 bp, Homo sapiens
accaaagagactggagc

SEQ ID NO: 2683010 - DNA, 18 bp, Homo sapiens
accaaagccacctgctgc

SEQ ID NO: 2683011 - DNA, 23 bp, Homo sapiens
accaacgggaccccctggccctg

SEQ ID NO: 2683012 - DNA, 15 bp, Homo sapiens
accaccccttcctgt

SEQ ID NO: 2683013 - DNA, 15 bp, Homo sapiens
accacctctcaatat

SEQ ID NO: 2683014 - DNA, 20 bp, Homo sapiens
accagactgtggagaaataa

SEQ ID NO: 2683015 - DNA, 21 bp, Homo sapiens
accagactgtggagaaataaa

SEQ ID NO: 2683016 - DNA, 23 bp, Homo sapiens
accagcagcatagaacaggacct

SEQ ID NO: 2683017 - DNA, 23 bp, Homo sapiens
accagcctgttggacccgctctg

SEQ ID NO: 2683018 - DNA, 15 bp, Homo sapiens
accagctctcttcct

SEQ ID NO: 2683019 - DNA, 14 bp, Homo sapiens
accagtgaaccaaa

SEQ ID NO: 2683020 - DNA, 16 bp, Homo sapiens
accagtgaaccaaaga

SEQ ID NO: 2683021 - DNA, 19 bp, Homo sapiens
accagtgtaactggctgct

SEQ ID NO: 2683022 - DNA, 20 bp, Homo sapiens
accagtgtaactggctgctc

SEQ ID NO: 2683023 - DNA, 19 bp, Homo sapiens
accatattcagtgctgtgg

SEQ ID NO: 2683024 - DNA, 19 bp, Homo sapiens
accatgtctctaagccaac

SEQ ID NO: 2683025 - DNA, 15 bp, Homo sapiens
accattgtcttccaa

SEQ ID NO: 2683026 - DNA, 16 bp, Homo sapiens
agcgtttacatattta

SEQ ID NO: 2683027 - DNA, 15 bp, Homo sapiens
agctactcagaagcc

SEQ ID NO: 2683028 - DNA, 19 bp, Homo sapiens
agctactcagaagcctgag

SEQ ID NO: 2683029 - DNA, 21 bp, Homo sapiens
agctactcagaagcctgaggc

SEQ ID NO: 2683030 - DNA, 19 bp, Homo sapiens
agctatgattatgccactg

SEQ ID NO: 2683031 - DNA, 18 bp, Homo sapiens
agctattagcaactgtgc

SEQ ID NO: 2683032 - DNA, 16 bp, Homo sapiens
agctattttctgacca

SEQ ID NO: 2683033 - DNA, 13 bp, Homo sapiens
agctcctgtccct

SEQ ID NO: 2683034 - DNA, 21 bp, Homo sapiens
agctcctgtccctacccactc

SEQ ID NO: 2683035 - DNA, 19 bp, Homo sapiens
agctctactgccctcccct

SEQ ID NO: 2683036 - DNA, 20 bp, Homo sapiens
agctctactgccctcccctt

SEQ ID NO: 2683037 - DNA, 15 bp, Homo sapiens
agctctctgggcctg

SEQ ID NO: 2683038 - DNA, 17 bp, Homo sapiens
agctctctgggcctggg

SEQ ID NO: 2683039 - DNA, 14 bp, Homo sapiens
agctctgccctggc

SEQ ID NO: 2683040 - DNA, 15 bp, Homo sapiens
agctctgccctggct

SEQ ID NO: 2683041 - DNA, 12 bp, Homo sapiens
agctctggcttc

SEQ ID NO: 2683042 - DNA, 18 bp, Homo sapiens
agctcttctcagtgtctg

SEQ ID NO: 2683043 - DNA, 20 bp, Homo sapiens
agctcttgttccgtgccagg

SEQ ID NO: 2683044 - DNA, 22 bp, Homo sapiens
agctgatgaaactcctgatttt

SEQ ID NO: 2683045 - DNA, 15 bp, Homo sapiens
agctgatgatgtctc

SEQ ID NO: 2683046 - DNA, 18 bp, Homo sapiens
agctgcacctgccagcct

SEQ ID NO: 2683047 - DNA, 22 bp, Homo sapiens
agctgcacctgccagcctggct

SEQ ID NO: 2683048 - DNA, 17 bp, Homo sapiens
agctgctgggacccacc

SEQ ID NO: 2683049 - DNA, 23 bp, Homo sapiens
agctggccacctagaagtctccc

SEQ ID NO: 2683050 - DNA, 22 bp, Homo sapiens
agctgggaaaaaagttttgatg

SEQ ID NO: 2683051 - DNA, 20 bp, Homo sapiens
agctgggcatgccatgtctg

SEQ ID NO: 2683052 - DNA, 22 bp, Homo sapiens
agctgtgctcgggtgctgccag

SEQ ID NO: 2683053 - DNA, 23 bp, Homo sapiens
agcttaaattgcttttgttgtga

SEQ ID NO: 2683054 - DNA, 14 bp, Homo sapiens
agcttatttttaca

SEQ ID NO: 2683055 - DNA, 20 bp, Homo sapiens
agctttccttctgcccttcc

SEQ ID NO: 2683056 - DNA, 15 bp, Homo sapiens
agctttgttgtcctc

SEQ ID NO: 2683057 - DNA, 16 bp, Homo sapiens
agctttgttgtcctcc

SEQ ID NO: 2683058 - DNA, 19 bp, Homo sapiens
agctttgttgtcctcccag

SEQ ID NO: 2683059 - DNA, 21 bp, Homo sapiens
agctttgttgtcctcccagga

SEQ ID NO: 2683060 - DNA, 18 bp, Homo sapiens
agctttgttttatatatt

SEQ ID NO: 2683061 - DNA, 20 bp, Homo sapiens
aggaaccaaaaaaccccagc

SEQ ID NO: 2683062 - DNA, 21 bp, Homo sapiens
aggaaccaaaaaaccccagct

SEQ ID NO: 2683063 - DNA, 22 bp, Homo sapiens
aggaaccaaaaaaccccagcta

SEQ ID NO: 2683064 - DNA, 14 bp, Homo sapiens
aggaaggttttctc

SEQ ID NO: 2683065 - DNA, 16 bp, Homo sapiens
aggacagtgcttcagc

SEQ ID NO: 2683066 - DNA, 17 bp, Homo sapiens
aggacagtgcttcagcc

SEQ ID NO: 2683067 - DNA, 18 bp, Homo sapiens
aggacagtgcttcagcct

SEQ ID NO: 2683068 - DNA, 20 bp, Homo sapiens
aggacagtgcttcagcctga

SEQ ID NO: 2683069 - DNA, 21 bp, Homo sapiens
aggacagtgcttcagcctgag

SEQ ID NO: 2683070 - DNA, 22 bp, Homo sapiens
aggacagtgcttcagcctgagg

SEQ ID NO: 2683071 - DNA, 23 bp, Homo sapiens
aggacccaaatttccctgggggc

SEQ ID NO: 2683072 - DNA, 13 bp, Homo sapiens
aggactctgaggc

SEQ ID NO: 2683073 - DNA, 17 bp, Homo sapiens
aggactctgaggctctt

SEQ ID NO: 2683074 - DNA, 18 bp, Homo sapiens
aggactgtgaccaaagca

SEQ ID NO: 2683075 - DNA, 19 bp, Homo sapiens
aggactgtgaccaaagcat

SEQ ID NO: 2683076 - DNA, 22 bp, Homo sapiens
aggagcaaatgtttctgcagta

SEQ ID NO: 2683077 - DNA, 19 bp, Homo sapiens
aggagcctcgtgtcctgct

SEQ ID NO: 2683078 - DNA, 20 bp, Homo sapiens
aggagcctcgtgtcctgcta

SEQ ID NO: 2683079 - DNA, 16 bp, Homo sapiens
aggaggttggtgactg

SEQ ID NO: 2683080 - DNA, 17 bp, Homo sapiens
aggaggttggtgactga

SEQ ID NO: 2683081 - DNA, 19 bp, Homo sapiens
aggaggttggtgactgaaa

SEQ ID NO: 2683082 - DNA, 18 bp, Homo sapiens
aggataacttccttgccc

SEQ ID NO: 2683083 - DNA, 12 bp, Homo sapiens
aggatacagctc

SEQ ID NO: 2683084 - DNA, 14 bp, Homo sapiens
aggatacagctctt

SEQ ID NO: 2683085 - DNA, 20 bp, Homo sapiens
aggatcactctctgctggca

SEQ ID NO: 2683086 - DNA, 22 bp, Homo sapiens
aggatcactctctgctggcagg

SEQ ID NO: 2683087 - DNA, 15 bp, Homo sapiens
aggatcactggagcc

SEQ ID NO: 2683088 - DNA, 20 bp, Homo sapiens
aggatcactggagcccagga

SEQ ID NO: 2683089 - DNA, 22 bp, Homo sapiens
aggatcactggagcccaggagt

SEQ ID NO: 2683090 - DNA, 23 bp, Homo sapiens
aggattcttcccgctccccacct

SEQ ID NO: 2683091 - DNA, 17 bp, Homo sapiens
aggcacgtctcctgctg

SEQ ID NO: 2683092 - DNA, 18 bp, Homo sapiens
aggcacgtctcctgctgc

SEQ ID NO: 2683093 - DNA, 19 bp, Homo sapiens
aggcacgtctcctgctgcg

SEQ ID NO: 2683094 - DNA, 17 bp, Homo sapiens
aggcagggctgggccag

SEQ ID NO: 2683095 - DNA, 17 bp, Homo sapiens
aggcaggtgagaaccca

SEQ ID NO: 2683096 - DNA, 19 bp, Homo sapiens
aggcaggtgagaacccaga

SEQ ID NO: 2683097 - DNA, 18 bp, Homo sapiens
aggcatatgcttctttaa

SEQ ID NO: 2683098 - DNA, 19 bp, Homo sapiens
aggcatatgcttctttaaa

SEQ ID NO: 2683099 - DNA, 15 bp, Homo sapiens
aggccacatgtcacc

SEQ ID NO: 2683100 - DNA, 21 bp, Homo sapiens
aggccacatgtcaccgtggac

SEQ ID NO: 2683101 - DNA, 13 bp, Homo sapiens
aggccacccactg

SEQ ID NO: 2683102 - DNA, 13 bp, Homo sapiens
aggccagccttgg

SEQ ID NO: 2683103 - DNA, 15 bp, Homo sapiens
aggccagccttggca

SEQ ID NO: 2683104 - DNA, 23 bp, Homo sapiens
aggcctccctgcagactccaatg

SEQ ID NO: 2683105 - DNA, 23 bp, Homo sapiens
aggcctcttggacctctgctctg

SEQ ID NO: 2683106 - DNA, 24 bp, Homo sapiens
aggcctcttggacctctgctctga

SEQ ID NO: 2683107 - DNA, 20 bp, Homo sapiens
aggcctgattcactggcctg

SEQ ID NO: 2683108 - DNA, 23 bp, Homo sapiens
aggcctgattcactggcctggcg

SEQ ID NO: 2683109 - DNA, 17 bp, Homo sapiens
aggcctgcaggggcaag

SEQ ID NO: 2683110 - DNA, 19 bp, Homo sapiens
aggctaagcatggcctgga

SEQ ID NO: 2683111 - DNA, 21 bp, Homo sapiens
aggctatgaagggacagctgc

SEQ ID NO: 2683112 - DNA, 14 bp, Homo sapiens
aggctatttgttca

SEQ ID NO: 2683113 - DNA, 19 bp, Homo sapiens
aggctcagtctcaggagca

SEQ ID NO: 2683114 - DNA, 22 bp, Homo sapiens
aggctccatgcacctcccttcc

SEQ ID NO: 2683115 - DNA, 15 bp, Homo sapiens
aggctctttctgggc

SEQ ID NO: 2683116 - DNA, 23 bp, Homo sapiens
aggctgagagccagatgcctccc

SEQ ID NO: 2683117 - DNA, 22 bp, Homo sapiens
aggctgaggggaggatcactgg

SEQ ID NO: 2683118 - DNA, 20 bp, Homo sapiens
aggctgcagaaggccaagaa

SEQ ID NO: 2683119 - DNA, 14 bp, Homo sapiens
aggctggagacagg

SEQ ID NO: 2683120 - DNA, 17 bp, Homo sapiens
aggctggagacaggtgc

SEQ ID NO: 2683121 - DNA, 18 bp, Homo sapiens
aggctgtgctcttcctct

SEQ ID NO: 2683122 - DNA, 19 bp, Homo sapiens
aggctgtgctcttcctctg

SEQ ID NO: 2683123 - DNA, 14 bp, Homo sapiens
aggcttccagagag

SEQ ID NO: 2683124 - DNA, 16 bp, Homo sapiens
aggcttcctgggtcct

SEQ ID NO: 2683125 - DNA, 22 bp, Homo sapiens
agggaaaacacggccctcctgg

SEQ ID NO: 2683126 - DNA, 15 bp, Homo sapiens
agggaatttcaggaa

SEQ ID NO: 2683127 - DNA, 19 bp, Homo sapiens
agggccaaagcacagctgg

SEQ ID NO: 2683128 - DNA, 15 bp, Homo sapiens
agggccagggccctg

SEQ ID NO: 2683129 - DNA, 22 bp, Homo sapiens
agggccagggccctgcagaggg

SEQ ID NO: 2683130 - DNA, 14 bp, Homo sapiens
agggcccagcaggc

SEQ ID NO: 2683131 - DNA, 14 bp, Homo sapiens
agggcccaggcagg

SEQ ID NO: 2683132 - DNA, 12 bp, Homo sapiens
agggccctgcag

SEQ ID NO: 2683133 - DNA, 13 bp, Homo sapiens
agggccctgcaga

SEQ ID NO: 2683134 - DNA, 21 bp, Homo sapiens
agggctaggaatatagattaa

SEQ ID NO: 2683135 - DNA, 23 bp, Homo sapiens
atgtttctgcagtagtctctgtg

SEQ ID NO: 2683136 - DNA, 18 bp, Homo sapiens
atgtttgtacaagattgt

SEQ ID NO: 2683137 - DNA, 22 bp, Homo sapiens
atgttttatcgtccagtgactt

SEQ ID NO: 2683138 - DNA, 12 bp, Homo sapiens
atgttttgtaca

SEQ ID NO: 2683139 - DNA, 14 bp, Homo sapiens
attaaaagaatttt

SEQ ID NO: 2683140 - DNA, 21 bp, Homo sapiens
attaaaatctggcaaagttat

SEQ ID NO: 2683141 - DNA, 12 bp, Homo sapiens
attaatgctttg

SEQ ID NO: 2683142 - DNA, 14 bp, Homo sapiens
attacatctaatgc

SEQ ID NO: 2683143 - DNA, 21 bp, Homo sapiens
attaccttagattagctctgg

SEQ ID NO: 2683144 - DNA, 13 bp, Homo sapiens
attactaaattgt

SEQ ID NO: 2683145 - DNA, 12 bp, Homo sapiens
attagctctgga

SEQ ID NO: 2683146 - DNA, 20 bp, Homo sapiens
attatactgtagctgatgaa

SEQ ID NO: 2683147 - DNA, 12 bp, Homo sapiens
attatatatcat

SEQ ID NO: 2683148 - DNA, 18 bp, Homo sapiens
attatatatcataaagta

SEQ ID NO: 2683149 - DNA, 15 bp, Homo sapiens
attatttcaccagca

SEQ ID NO: 2683150 - DNA, 16 bp, Homo sapiens
attatttcaccagcag

SEQ ID NO: 2683151 - DNA, 18 bp, Homo sapiens
attatttcaccagcagca

SEQ ID NO: 2683152 - DNA, 18 bp, Homo sapiens
attcacacagggctcttt

SEQ ID NO: 2683153 - DNA, 19 bp, Homo sapiens
attcagatttctctttgaa

SEQ ID NO: 2683154 - DNA, 19 bp, Homo sapiens
attcagtgacttctggctt

SEQ ID NO: 2683155 - DNA, 19 bp, Homo sapiens
attcatctgggaggcagaa

SEQ ID NO: 2683156 - DNA, 17 bp, Homo sapiens
attccgagggtgaaaca

SEQ ID NO: 2683157 - DNA, 18 bp, Homo sapiens
attcctgtagcatcttct

SEQ ID NO: 2683158 - DNA, 16 bp, Homo sapiens
attctcggggccctgt

SEQ ID NO: 2683159 - DNA, 17 bp, Homo sapiens
attctgggttttgtagc

SEQ ID NO: 2683160 - DNA, 20 bp, Homo sapiens
attctgtgtgtgactctggg

SEQ ID NO: 2683161 - DNA, 19 bp, Homo sapiens
attcttcccgctccccacc

SEQ ID NO: 2683162 - DNA, 20 bp, Homo sapiens
attgaccttctccctcactc

SEQ ID NO: 2683163 - DNA, 15 bp, Homo sapiens
attgatttgattttt

SEQ ID NO: 2683164 - DNA, 19 bp, Homo sapiens
attgcaatctataatattt

SEQ ID NO: 2683165 - DNA, 19 bp, Homo sapiens
attgcttttgttgtgactt

SEQ ID NO: 2683166 - DNA, 20 bp, Homo sapiens
attgcttttgttgtgacttt

SEQ ID NO: 2683167 - DNA, 18 bp, Homo sapiens
attggaagaaattcctgt

SEQ ID NO: 2683168 - DNA, 19 bp, Homo sapiens
attggaagaaattcctgta

SEQ ID NO: 2683169 - DNA, 15 bp, Homo sapiens
attggctataacatg

SEQ ID NO: 2683170 - DNA, 12 bp, Homo sapiens
attgggctggct

SEQ ID NO: 2683171 - DNA, 11 bp, Homo sapiens
attgtcttcca

SEQ ID NO: 2683172 - DNA, 17 bp, Homo sapiens
attgtcttccaacccca

SEQ ID NO: 2683173 - DNA, 19 bp, Homo sapiens
attgtcttccaaccccagc

SEQ ID NO: 2683174 - DNA, 18 bp, Homo sapiens
attgtggtacaatctcaa

SEQ ID NO: 2683175 - DNA, 20 bp, Homo sapiens
attgtttttctgatatgttt

SEQ ID NO: 2683176 - DNA, 13 bp, Homo sapiens
atttaatatctga

SEQ ID NO: 2683177 - DNA, 16 bp, Homo sapiens
atttaatatctgagaa

SEQ ID NO: 2683178 - DNA, 18 bp, Homo sapiens
atttacctgtatttaaga

SEQ ID NO: 2683179 - DNA, 14 bp, Homo sapiens
atttagaatatatt

SEQ ID NO: 2683180 - DNA, 18 bp, Homo sapiens
atttagttgaaaaatcta

SEQ ID NO: 2683181 - DNA, 15 bp, Homo sapiens
atttattaagtctgg

SEQ ID NO: 2683182 - DNA, 18 bp, Homo sapiens
atttcaaccgcttgccat

SEQ ID NO: 2683183 - DNA, 14 bp, Homo sapiens
atttcaccagcagc

SEQ ID NO: 2683184 - DNA, 15 bp, Homo sapiens
atttcacttgagtgg

SEQ ID NO: 2683185 - DNA, 15 bp, Homo sapiens
atttccacataaagg

SEQ ID NO: 2683186 - DNA, 17 bp, Homo sapiens
atttccacataaaggta

SEQ ID NO: 2683187 - DNA, 21 bp, Homo sapiens
atttccacataaaggtattta

SEQ ID NO: 2683188 - DNA, 16 bp, Homo sapiens
atttcccctaatcttt

SEQ ID NO: 2683189 - DNA, 22 bp, Homo sapiens
atttctagtcccttctctcttt

SEQ ID NO: 2683190 - DNA, 19 bp, Homo sapiens
atttgatttttattattaa

SEQ ID NO: 2683191 - DNA, 17 bp, Homo sapiens
atttggagactctgtgg

SEQ ID NO: 2683192 - DNA, 22 bp, Homo sapiens
atttgtgtgttcactaaactct

SEQ ID NO: 2683193 - DNA, 15 bp, Homo sapiens
attttactgacagaa

SEQ ID NO: 2683194 - DNA, 17 bp, Homo sapiens
attttgtacaaagatat

SEQ ID NO: 2683195 - DNA, 14 bp, Homo sapiens
atttttaaattata

SEQ ID NO: 2683196 - DNA, 23 bp, Homo sapiens
atttttccccccaccccccagca

SEQ ID NO: 2683197 - DNA, 23 bp, Homo sapiens
atttttcttttaagccctgctct

SEQ ID NO: 2683198 - DNA, 20 bp, Homo sapiens
atttttgatcaatgtatatg

SEQ ID NO: 2683199 - DNA, 22 bp, Homo sapiens
atttttgctaggagccccagct

SEQ ID NO: 2683200 - DNA, 11 bp, Homo sapiens
caaaacaatgc

SEQ ID NO: 2683201 - DNA, 21 bp, Homo sapiens
caaaagaaaaaaaaaagcacc

SEQ ID NO: 2683202 - DNA, 15 bp, Homo sapiens
caaaagacttgagcc

SEQ ID NO: 2683203 - DNA, 18 bp, Homo sapiens
caaaagacttgagccatc

SEQ ID NO: 2683204 - DNA, 21 bp, Homo sapiens
caaacaggtcgagctgtgctc

SEQ ID NO: 2683205 - DNA, 16 bp, Homo sapiens
caaaccatctggtgcc

SEQ ID NO: 2683206 - DNA, 18 bp, Homo sapiens
caaaccatctggtgcctt

SEQ ID NO: 2683207 - DNA, 17 bp, Homo sapiens
caaactacagaataatg

SEQ ID NO: 2683208 - DNA, 22 bp, Homo sapiens
caaagaaacactaagctctctg

SEQ ID NO: 2683209 - DNA, 18 bp, Homo sapiens
caaagccaaactctgcca

SEQ ID NO: 2683210 - DNA, 14 bp, Homo sapiens
caaagccacatttt

SEQ ID NO: 2683211 - DNA, 15 bp, Homo sapiens
caaagccacctgctg

SEQ ID NO: 2683212 - DNA, 17 bp, Homo sapiens
caaagcctccagcatct

SEQ ID NO: 2683213 - DNA, 21 bp, Homo sapiens
caaagcctccagcatcttttc

SEQ ID NO: 2683214 - DNA, 19 bp, Homo sapiens
caaagcgagatcccatctc

SEQ ID NO: 2683215 - DNA, 21 bp, Homo sapiens
caaagctgctttcttctctgc

SEQ ID NO: 2683216 - DNA, 22 bp, Homo sapiens
caaagctgctttcttctctgcc

SEQ ID NO: 2683217 - DNA, 23 bp, Homo sapiens
caaagctgctttcttctctgcct

SEQ ID NO: 2683218 - DNA, 21 bp, Homo sapiens
caaattctcaacctaccaccc

SEQ ID NO: 2683219 - DNA, 16 bp, Homo sapiens
caaattgtaattaata

SEQ ID NO: 2683220 - DNA, 18 bp, Homo sapiens
caaattgtaattaataat

SEQ ID NO: 2683221 - DNA, 14 bp, Homo sapiens
caaatttccctggg

SEQ ID NO: 2683222 - DNA, 23 bp, Homo sapiens
caacaactgtccctccttgagca

SEQ ID NO: 2683223 - DNA, 19 bp, Homo sapiens
caacacccaaaggtggcct

SEQ ID NO: 2683224 - DNA, 20 bp, Homo sapiens
caacacccaaaggtggcctg

SEQ ID NO: 2683225 - DNA, 19 bp, Homo sapiens
caacagagtgagaccctgt

SEQ ID NO: 2683226 - DNA, 17 bp, Homo sapiens
caaccccccacctgcca

SEQ ID NO: 2683227 - DNA, 22 bp, Homo sapiens
caaccctgtcagaatcatgctg

SEQ ID NO: 2683228 - DNA, 21 bp, Homo sapiens
caacctaccaccccttcctgt

SEQ ID NO: 2683229 - DNA, 22 bp, Homo sapiens
caacctaccaccccttcctgtc

SEQ ID NO: 2683230 - DNA, 15 bp, Homo sapiens
caactcacacctcct

SEQ ID NO: 2683231 - DNA, 22 bp, Homo sapiens
caactcacacctccttttcttc

SEQ ID NO: 2683232 - DNA, 14 bp, Homo sapiens
caactcattgcatc

SEQ ID NO: 2683233 - DNA, 13 bp, Homo sapiens
caactgatcctgc

SEQ ID NO: 2683234 - DNA, 20 bp, Homo sapiens
caactgatcctgctccagca

SEQ ID NO: 2683235 - DNA, 22 bp, Homo sapiens
caactgatcctgctccagcagc

SEQ ID NO: 2683236 - DNA, 23 bp, Homo sapiens
caactgatcctgctccagcagca

SEQ ID NO: 2683237 - DNA, 13 bp, Homo sapiens
caagaagaccaga

SEQ ID NO: 2683238 - DNA, 23 bp, Homo sapiens
caagaagggttttccaccctgga

SEQ ID NO: 2683239 - DNA, 14 bp, Homo sapiens
caagacaaagcaaa

SEQ ID NO: 2683240 - DNA, 21 bp, Homo sapiens
caagactgtcattgcccctcc

SEQ ID NO: 2683241 - DNA, 14 bp, Homo sapiens
caagccacagaagc

SEQ ID NO: 2683242 - DNA, 22 bp, Homo sapiens
caagccacagaagccaggagca

SEQ ID NO: 2683243 - DNA, 14 bp, Homo sapiens
caagcccaggcttc

SEQ ID NO: 2683244 - DNA, 16 bp, Homo sapiens
cataaagtatgccttc

SEQ ID NO: 2683245 - DNA, 18 bp, Homo sapiens
catactcctatgctttag

SEQ ID NO: 2683246 - DNA, 12 bp, Homo sapiens
catacttcctgg

SEQ ID NO: 2683247 - DNA, 15 bp, Homo sapiens
catacttcctgggat

SEQ ID NO: 2683248 - DNA, 22 bp, Homo sapiens
catacttcctgggatgatgtgt

SEQ ID NO: 2683249 - DNA, 22 bp, Homo sapiens
catagaattgcaatctataata

SEQ ID NO: 2683250 - DNA, 14 bp, Homo sapiens
catatatgtatatg

SEQ ID NO: 2683251 - DNA, 20 bp, Homo sapiens
catatatgtatatgtatatc

SEQ ID NO: 2683252 - DNA, 15 bp, Homo sapiens
catatgcttctttaa

SEQ ID NO: 2683253 - DNA, 13 bp, Homo sapiens
catcacagggcag

SEQ ID NO: 2683254 - DNA, 21 bp, Homo sapiens
catcattgcacctgcaggctt

SEQ ID NO: 2683255 - DNA, 15 bp, Homo sapiens
catccaaccccccac

SEQ ID NO: 2683256 - DNA, 16 bp, Homo sapiens
catcctgaaagccagc

SEQ ID NO: 2683257 - DNA, 23 bp, Homo sapiens
catcctgaaagccagcaaagcct

SEQ ID NO: 2683258 - DNA, 18 bp, Homo sapiens
catcctgaggtgcctccc

SEQ ID NO: 2683259 - DNA, 19 bp, Homo sapiens
catcctgaggtgcctccca

SEQ ID NO: 2683260 - DNA, 12 bp, Homo sapiens
catcctgcttcc

SEQ ID NO: 2683261 - DNA, 13 bp, Homo sapiens
catcctgcttcct

SEQ ID NO: 2683262 - DNA, 17 bp, Homo sapiens
catcctgcttcctgaaa

SEQ ID NO: 2683263 - DNA, 19 bp, Homo sapiens
catccttttctgcagaggg

SEQ ID NO: 2683264 - DNA, 11 bp, Homo sapiens
catctctgtga

SEQ ID NO: 2683265 - DNA, 12 bp, Homo sapiens
catctgactcac

SEQ ID NO: 2683266 - DNA, 19 bp, Homo sapiens
catcttctggagtctccag

SEQ ID NO: 2683267 - DNA, 24 bp, Homo sapiens
catgaaattgtctagcagagcagg

SEQ ID NO: 2683268 - DNA, 17 bp, Homo sapiens
catgcagactcctcaga

SEQ ID NO: 2683269 - DNA, 18 bp, Homo sapiens
catgcagactcctcagat

SEQ ID NO: 2683270 - DNA, 13 bp, Homo sapiens
catgccccaggat

SEQ ID NO: 2683271 - DNA, 20 bp, Homo sapiens
catgccgcgtccctgccccg

SEQ ID NO: 2683272 - DNA, 17 bp, Homo sapiens
catgctgttctctttgc

SEQ ID NO: 2683273 - DNA, 21 bp, Homo sapiens
catgctgttctctttgctgac

SEQ ID NO: 2683274 - DNA, 19 bp, Homo sapiens
catggacgttcggggcatg

SEQ ID NO: 2683275 - DNA, 16 bp, Homo sapiens
catggagagcctctta

SEQ ID NO: 2683276 - DNA, 18 bp, Homo sapiens
catggcctctggccaggc

SEQ ID NO: 2683277 - DNA, 24 bp, Homo sapiens
catggcctggactgactgcagccc

SEQ ID NO: 2683278 - DNA, 14 bp, Homo sapiens
catggtgctgcatt

SEQ ID NO: 2683279 - DNA, 23 bp, Homo sapiens
catgtcaccgtggaccttcctgc

SEQ ID NO: 2683280 - DNA, 22 bp, Homo sapiens
catgtctgagcggcgcagagcc

SEQ ID NO: 2683281 - DNA, 19 bp, Homo sapiens
cattagctacttttcagaa

SEQ ID NO: 2683282 - DNA, 23 bp, Homo sapiens
cattctgatgtccatttgtccca

SEQ ID NO: 2683283 - DNA, 14 bp, Homo sapiens
cattgaccagctct

SEQ ID NO: 2683284 - DNA, 20 bp, Homo sapiens
cattgaccagctctcttcct

SEQ ID NO: 2683285 - DNA, 18 bp, Homo sapiens
cattgcacctgcaggctt

SEQ ID NO: 2683286 - DNA, 18 bp, Homo sapiens
cattggacccacatgagg

SEQ ID NO: 2683287 - DNA, 17 bp, Homo sapiens
cattgtcttccaacccc

SEQ ID NO: 2683288 - DNA, 18 bp, Homo sapiens
cattgtcttccaacccca

SEQ ID NO: 2683289 - DNA, 19 bp, Homo sapiens
cattgtcttccaaccccag

SEQ ID NO: 2683290 - DNA, 13 bp, Homo sapiens
catttgagtgtct

SEQ ID NO: 2683291 - DNA, 14 bp, Homo sapiens
cattttagtgactg

SEQ ID NO: 2683292 - DNA, 16 bp, Homo sapiens
cattttagtgactgta

SEQ ID NO: 2683293 - DNA, 19 bp, Homo sapiens
cattttgcattagacagat

SEQ ID NO: 2683294 - DNA, 17 bp, Homo sapiens
ccaaaaaaccccagcta

SEQ ID NO: 2683295 - DNA, 15 bp, Homo sapiens
ccaaaagatgccttg

SEQ ID NO: 2683296 - DNA, 13 bp, Homo sapiens
ccaaactctgcca

SEQ ID NO: 2683297 - DNA, 22 bp, Homo sapiens
ccaaagaaacactaagctctct

SEQ ID NO: 2683298 - DNA, 21 bp, Homo sapiens
ccaaagagactggagcatctg

SEQ ID NO: 2683299 - DNA, 16 bp, Homo sapiens
ccaaagcacagctggg

SEQ ID NO: 2683300 - DNA, 17 bp, Homo sapiens
ccaaagccacctgctgc

SEQ ID NO: 2683301 - DNA, 17 bp, Homo sapiens
ccaaagctgctttcttc

SEQ ID NO: 2683302 - DNA, 18 bp, Homo sapiens
ccaaagctgctttcttct

SEQ ID NO: 2683303 - DNA, 19 bp, Homo sapiens
ccaaatgatgccacttccc

SEQ ID NO: 2683304 - DNA, 12 bp, Homo sapiens
ccaaccccagct

SEQ ID NO: 2683305 - DNA, 18 bp, Homo sapiens
ccaaccccccacctgcca

SEQ ID NO: 2683306 - DNA, 23 bp, Homo sapiens
ccaaccctgtcagaatcatgctg

SEQ ID NO: 2683307 - DNA, 16 bp, Homo sapiens
ccaaccctgtttcctg

SEQ ID NO: 2683308 - DNA, 22 bp, Homo sapiens
ccaactgatcctgctccagcag

SEQ ID NO: 2683309 - DNA, 23 bp, Homo sapiens
ccaagactgtcattgcccctccg

SEQ ID NO: 2683310 - DNA, 19 bp, Homo sapiens
ccaagagcagaggcagcga

SEQ ID NO: 2683311 - DNA, 13 bp, Homo sapiens
ccaaggagccatt

SEQ ID NO: 2683312 - DNA, 16 bp, Homo sapiens
ccaagtgccagtcttg

SEQ ID NO: 2683313 - DNA, 22 bp, Homo sapiens
ccaatggggccagcactggagg

SEQ ID NO: 2683314 - DNA, 22 bp, Homo sapiens
ccacacagaactggcaggagcc

SEQ ID NO: 2683315 - DNA, 18 bp, Homo sapiens
ccacaccgctggtccctg

SEQ ID NO: 2683316 - DNA, 21 bp, Homo sapiens
ccacagaagccaggagcaaat

SEQ ID NO: 2683317 - DNA, 22 bp, Homo sapiens
ccacagaagccaggagcaaatg

SEQ ID NO: 2683318 - DNA, 18 bp, Homo sapiens
ccacagccgcagcctccc

SEQ ID NO: 2683319 - DNA, 20 bp, Homo sapiens
ccacatgccgcgtccctgcc

SEQ ID NO: 2683320 - DNA, 17 bp, Homo sapiens
ccaccaaggaggcagga

SEQ ID NO: 2683321 - DNA, 20 bp, Homo sapiens
ccaccactaggactctgagg

SEQ ID NO: 2683322 - DNA, 23 bp, Homo sapiens
ccaccatattcagtgctgtggcc

SEQ ID NO: 2683323 - DNA, 12 bp, Homo sapiens
ccacccacatga

SEQ ID NO: 2683324 - DNA, 13 bp, Homo sapiens
ccacccactgacc

SEQ ID NO: 2683325 - DNA, 17 bp, Homo sapiens
ccaccccccacgtctgt

SEQ ID NO: 2683326 - DNA, 19 bp, Homo sapiens
ccaccccccagcacaggag

SEQ ID NO: 2683327 - DNA, 15 bp, Homo sapiens
ccaccccttcctgtc

SEQ ID NO: 2683328 - DNA, 13 bp, Homo sapiens
ccacctacccagc

SEQ ID NO: 2683329 - DNA, 23 bp, Homo sapiens
ccacctagaagtctccctgcaca

SEQ ID NO: 2683330 - DNA, 13 bp, Homo sapiens
ccacctccccctc

SEQ ID NO: 2683331 - DNA, 13 bp, Homo sapiens
ccacctctcaata

SEQ ID NO: 2683332 - DNA, 20 bp, Homo sapiens
ccacctcttctcttcctgta

SEQ ID NO: 2683333 - DNA, 21 bp, Homo sapiens
ccacctgctgcgggggagcca

SEQ ID NO: 2683334 - DNA, 12 bp, Homo sapiens
ccacctgtctgt

SEQ ID NO: 2683335 - DNA, 22 bp, Homo sapiens
ccacctgtctgtctgtctgtcc

SEQ ID NO: 2683336 - DNA, 20 bp, Homo sapiens
ccacctgtgcttggaaccag

SEQ ID NO: 2683337 - DNA, 20 bp, Homo sapiens
ccaccttcaattcctgggcc

SEQ ID NO: 2683338 - DNA, 15 bp, Homo sapiens
ccacgcaaggctgtg

SEQ ID NO: 2683339 - DNA, 17 bp, Homo sapiens
ccacgcaaggctgtgct

SEQ ID NO: 2683340 - DNA, 14 bp, Homo sapiens
ccactacactccag

SEQ ID NO: 2683341 - DNA, 16 bp, Homo sapiens
ccactaggactctgag

SEQ ID NO: 2683342 - DNA, 13 bp, Homo sapiens
ccactcaggccaa

SEQ ID NO: 2683343 - DNA, 21 bp, Homo sapiens
ccactctttgctacaataaat

SEQ ID NO: 2683344 - DNA, 14 bp, Homo sapiens
ccactgaagctggg

SEQ ID NO: 2683345 - DNA, 15 bp, Homo sapiens
ccactgaagctggga

SEQ ID NO: 2683346 - DNA, 21 bp, Homo sapiens
ccactgacacccagtgtcctt

SEQ ID NO: 2683347 - DNA, 15 bp, Homo sapiens
ccactgacccaactg

SEQ ID NO: 2683348 - DNA, 18 bp, Homo sapiens
ccactgcactccagcctg

SEQ ID NO: 2683349 - DNA, 18 bp, Homo sapiens
ccactgctttccagcctg

SEQ ID NO: 2683350 - DNA, 21 bp, Homo sapiens
ccactggacttgagcttggca

SEQ ID NO: 2683351 - DNA, 20 bp, Homo sapiens
ccactggccagtcctagagc

SEQ ID NO: 2683352 - DNA, 14 bp, Homo sapiens
ccactttgttggaa

SEQ ID NO: 2683353 - DNA, 15 bp, Homo sapiens
cggggatcatctctg

SEQ ID NO: 2683354 - DNA, 19 bp, Homo sapiens
cggggcatgctggggcaag

SEQ ID NO: 2683355 - DNA, 12 bp, Homo sapiens
cgggggagccag

SEQ ID NO: 2683356 - DNA, 21 bp, Homo sapiens
cgggggtttgagccctggacc

SEQ ID NO: 2683357 - DNA, 20 bp, Homo sapiens
cgggtaacagtgaggctggg

SEQ ID NO: 2683358 - DNA, 23 bp, Homo sapiens
cggttttcagctattagcaactg

SEQ ID NO: 2683359 - DNA, 23 bp, Homo sapiens
cgtcaagttgcagatctttttgt

SEQ ID NO: 2683360 - DNA, 20 bp, Homo sapiens
cgtcaggcacgtctcctgct

SEQ ID NO: 2683361 - DNA, 21 bp, Homo sapiens
cgtcaggcacgtctcctgctg

SEQ ID NO: 2683362 - DNA, 23 bp, Homo sapiens
cgtcaggcacgtctcctgctgcg

SEQ ID NO: 2683363 - DNA, 14 bp, Homo sapiens
cgtctccatctctg

SEQ ID NO: 2683364 - DNA, 12 bp, Homo sapiens
cgtctcctgctg

SEQ ID NO: 2683365 - DNA, 22 bp, Homo sapiens
cgtgaatatcgagaactgccat

SEQ ID NO: 2683366 - DNA, 22 bp, Homo sapiens
cgtgagctatgattatgccact

SEQ ID NO: 2683367 - DNA, 22 bp, Homo sapiens
cgtgatggaccaaagccacctg

SEQ ID NO: 2683368 - DNA, 15 bp, Homo sapiens
cgtgcacctgtactc

SEQ ID NO: 2683369 - DNA, 17 bp, Homo sapiens
cgtggacacctgccctg

SEQ ID NO: 2683370 - DNA, 18 bp, Homo sapiens
cgtggacacctgccctgc

SEQ ID NO: 2683371 - DNA, 14 bp, Homo sapiens
cgtggaccttcctg

SEQ ID NO: 2683372 - DNA, 15 bp, Homo sapiens
cgtggaccttcctgc

SEQ ID NO: 2683373 - DNA, 13 bp, Homo sapiens
cgtggcctgcacc

SEQ ID NO: 2683374 - DNA, 23 bp, Homo sapiens
cgtgggtgtgtgtagccaaggtc

SEQ ID NO: 2683375 - DNA, 20 bp, Homo sapiens
cgtgtcctgctagctgtctc

SEQ ID NO: 2683376 - DNA, 21 bp, Homo sapiens
cgtgtcctgctagctgtctct

SEQ ID NO: 2683377 - DNA, 15 bp, Homo sapiens
cgtgtcgtgggtgtg

SEQ ID NO: 2683378 - DNA, 15 bp, Homo sapiens
cgtgtgcctcctgtg

SEQ ID NO: 2683379 - DNA, 16 bp, Homo sapiens
cgtgtgcctcctgtgt

SEQ ID NO: 2683380 - DNA, 18 bp, Homo sapiens
cgtgtgcctcctgtgtgt

SEQ ID NO: 2683381 - DNA, 17 bp, Homo sapiens
cgttagaggagcaacag

SEQ ID NO: 2683382 - DNA, 18 bp, Homo sapiens
cgtttgagtgtctgcgcc

SEQ ID NO: 2683383 - DNA, 19 bp, Homo sapiens
ctaaagatatcagagctct

SEQ ID NO: 2683384 - DNA, 22 bp, Homo sapiens
ctaaagatatcagagctcttaa

SEQ ID NO: 2683385 - DNA, 16 bp, Homo sapiens
ctaacataaaatctgt

SEQ ID NO: 2683386 - DNA, 17 bp, Homo sapiens
ctaacataaaatctgtg

SEQ ID NO: 2683387 - DNA, 18 bp, Homo sapiens
ctaacataaaatctgtga

SEQ ID NO: 2683388 - DNA, 14 bp, Homo sapiens
ctaactgtggagaa

SEQ ID NO: 2683389 - DNA, 20 bp, Homo sapiens
ctaagctctctgggcctggg

SEQ ID NO: 2683390 - DNA, 19 bp, Homo sapiens
ctaagtacttgctctctga

SEQ ID NO: 2683391 - DNA, 22 bp, Homo sapiens
ctaagttcatgtttgtaaatta

SEQ ID NO: 2683392 - DNA, 23 bp, Homo sapiens
ctaattcctgttgctctgtttct

SEQ ID NO: 2683393 - DNA, 19 bp, Homo sapiens
ctaattggaagaaattcct

SEQ ID NO: 2683394 - DNA, 15 bp, Homo sapiens
ctacaataaatgctg

SEQ ID NO: 2683395 - DNA, 16 bp, Homo sapiens
ctacaataaatgctga

SEQ ID NO: 2683396 - DNA, 22 bp, Homo sapiens
ctacaataaatgctgaatgaat

SEQ ID NO: 2683397 - DNA, 18 bp, Homo sapiens
ctacacatatatgtatat

SEQ ID NO: 2683398 - DNA, 14 bp, Homo sapiens
ctacactccagcct

SEQ ID NO: 2683399 - DNA, 16 bp, Homo sapiens
ctacactccagcctga

SEQ ID NO: 2683400 - DNA, 17 bp, Homo sapiens
ctacactccagcctgag

SEQ ID NO: 2683401 - DNA, 14 bp, Homo sapiens
ctacagaataatgt

SEQ ID NO: 2683402 - DNA, 16 bp, Homo sapiens
ctaccaccccttcctg

SEQ ID NO: 2683403 - DNA, 22 bp, Homo sapiens
ctaccaccccttcctgtcccac

SEQ ID NO: 2683404 - DNA, 12 bp, Homo sapiens
ctacccagctga

SEQ ID NO: 2683405 - DNA, 16 bp, Homo sapiens
ctacccagctgatggg

SEQ ID NO: 2683406 - DNA, 14 bp, Homo sapiens
ctacctcagcctag

SEQ ID NO: 2683407 - DNA, 19 bp, Homo sapiens
ctactcagaagcctgaggc

SEQ ID NO: 2683408 - DNA, 16 bp, Homo sapiens
ctactcctacctcagc

SEQ ID NO: 2683409 - DNA, 13 bp, Homo sapiens
ctactgccctccc

SEQ ID NO: 2683410 - DNA, 16 bp, Homo sapiens
ctactgccctcccctt

SEQ ID NO: 2683411 - DNA, 18 bp, Homo sapiens
ctagaacacccactggcc

SEQ ID NO: 2683412 - DNA, 19 bp, Homo sapiens
ctagaacacccactggcca

SEQ ID NO: 2683413 - DNA, 18 bp, Homo sapiens
ctagaagtctccctgcac

SEQ ID NO: 2683414 - DNA, 19 bp, Homo sapiens
ctagaagtctccctgcaca

SEQ ID NO: 2683415 - DNA, 19 bp, Homo sapiens
ctagagctcctgtccctac

SEQ ID NO: 2683416 - DNA, 21 bp, Homo sapiens
ctagcaacacccaaaggtggc

SEQ ID NO: 2683417 - DNA, 19 bp, Homo sapiens
ctagcagagcaggggcagg

SEQ ID NO: 2683418 - DNA, 16 bp, Homo sapiens
ctagctgtctctcttg

SEQ ID NO: 2683419 - DNA, 15 bp, Homo sapiens
ctagctttgttgtcc

SEQ ID NO: 2683420 - DNA, 21 bp, Homo sapiens
ctagctttgttgtcctcccag

SEQ ID NO: 2683421 - DNA, 23 bp, Homo sapiens
ctagctttgttgtcctcccagga

SEQ ID NO: 2683422 - DNA, 14 bp, Homo sapiens
ctaggaatatagat

SEQ ID NO: 2683423 - DNA, 19 bp, Homo sapiens
ctaggagccccagcttcct

SEQ ID NO: 2683424 - DNA, 18 bp, Homo sapiens
ctagtgccctccacagcc

SEQ ID NO: 2683425 - DNA, 14 bp, Homo sapiens
ctagtgtttgttaa

SEQ ID NO: 2683426 - DNA, 16 bp, Homo sapiens
ctagtttcagtaaata

SEQ ID NO: 2683427 - DNA, 14 bp, Homo sapiens
ctataacatgtctt

SEQ ID NO: 2683428 - DNA, 22 bp, Homo sapiens
ctatttatttttgcaaaccctg

SEQ ID NO: 2683429 - DNA, 20 bp, Homo sapiens
ctatttgttcagagaggcct

SEQ ID NO: 2683430 - DNA, 22 bp, Homo sapiens
ctattttctctgatactttttt

SEQ ID NO: 2683431 - DNA, 14 bp, Homo sapiens
ctattttctgacca

SEQ ID NO: 2683432 - DNA, 18 bp, Homo sapiens
ctattttctgaccaaaat

SEQ ID NO: 2683433 - DNA, 19 bp, Homo sapiens
ctcaaacatggaagatgaa

SEQ ID NO: 2683434 - DNA, 20 bp, Homo sapiens
ctcaacctaccaccccttcc

SEQ ID NO: 2683435 - DNA, 23 bp, Homo sapiens
ctcaacctaccaccccttcctgt

SEQ ID NO: 2683436 - DNA, 20 bp, Homo sapiens
ctcaatgcattgtcttgtgg

SEQ ID NO: 2683437 - DNA, 19 bp, Homo sapiens
ctcacaagaagaccagact

SEQ ID NO: 2683438 - DNA, 15 bp, Homo sapiens
ctcacctcagagcag

SEQ ID NO: 2683439 - DNA, 19 bp, Homo sapiens
ctcacctcagagcagggcc

SEQ ID NO: 2683440 - DNA, 20 bp, Homo sapiens
ctcacctcagagcagggcca

SEQ ID NO: 2683441 - DNA, 20 bp, Homo sapiens
ctcacgcctatgatcccagc

SEQ ID NO: 2683442 - DNA, 15 bp, Homo sapiens
ctcactcactctggg

SEQ ID NO: 2683443 - DNA, 18 bp, Homo sapiens
ctcacttctgtctcctgt

SEQ ID NO: 2683444 - DNA, 13 bp, Homo sapiens
ctcagaagccagt

SEQ ID NO: 2683445 - DNA, 21 bp, Homo sapiens
ctcagaagccagtctgcgtca

SEQ ID NO: 2683446 - DNA, 15 bp, Homo sapiens
ctcagaagcctgagg

SEQ ID NO: 2683447 - DNA, 17 bp, Homo sapiens
ctcagaagcctgaggct

SEQ ID NO: 2683448 - DNA, 14 bp, Homo sapiens
ctcagagcacagag

SEQ ID NO: 2683449 - DNA, 15 bp, Homo sapiens
ctcagagcacagagg

SEQ ID NO: 2683450 - DNA, 16 bp, Homo sapiens
ctcagagcagggccaa

SEQ ID NO: 2683451 - DNA, 23 bp, Homo sapiens
ctcagagcagggccaaagcacag

SEQ ID NO: 2683452 - DNA, 18 bp, Homo sapiens
ctcagcattgtcagcctg

SEQ ID NO: 2683453 - DNA, 19 bp, Homo sapiens
ctcagcattgtcagcctga

SEQ ID NO: 2683454 - DNA, 12 bp, Homo sapiens
ctcagcccagct

SEQ ID NO: 2683455 - DNA, 14 bp, Homo sapiens
ctcagcccagctgg

SEQ ID NO: 2683456 - DNA, 17 bp, Homo sapiens
ctcagcccagctggcca

SEQ ID NO: 2683457 - DNA, 20 bp, Homo sapiens
ctcagcccagctggccacct

SEQ ID NO: 2683458 - DNA, 16 bp, Homo sapiens
ctcagccccactgaca

SEQ ID NO: 2683459 - DNA, 19 bp, Homo sapiens
ctcagccctccatggcctg

SEQ ID NO: 2683460 - DNA, 15 bp, Homo sapiens
ctcaggaggctgagg

SEQ ID NO: 2683461 - DNA, 15 bp, Homo sapiens
ctcaggccaggtgca

SEQ ID NO: 2683462 - DNA, 19 bp, Homo sapiens
gaagtgttcaagaaataaa

SEQ ID NO: 2683463 - DNA, 17 bp, Homo sapiens
gaatcaaagacatggaa

SEQ ID NO: 2683464 - DNA, 22 bp, Homo sapiens
gaatcaagctagaaggccacat

SEQ ID NO: 2683465 - DNA, 18 bp, Homo sapiens
gaatcatgctgttctctt

SEQ ID NO: 2683466 - DNA, 20 bp, Homo sapiens
gaatcatgctgttctctttg

SEQ ID NO: 2683467 - DNA, 18 bp, Homo sapiens
gaatctgtatgattctat

SEQ ID NO: 2683468 - DNA, 18 bp, Homo sapiens
gaatggccctagaactgt

SEQ ID NO: 2683469 - DNA, 24 bp, Homo sapiens
gaatggccctagaactgtgcctag

SEQ ID NO: 2683470 - DNA, 17 bp, Homo sapiens
gaatggcctgccttgaa

SEQ ID NO: 2683471 - DNA, 22 bp, Homo sapiens
gaatgtgtcctcctgctctgct

SEQ ID NO: 2683472 - DNA, 20 bp, Homo sapiens
gaattgaaggagaaaatgca

SEQ ID NO: 2683473 - DNA, 15 bp, Homo sapiens
gacaagtcttgctgt

SEQ ID NO: 2683474 - DNA, 20 bp, Homo sapiens
gacaagtcttgctgtgcttt

SEQ ID NO: 2683475 - DNA, 15 bp, Homo sapiens
gacacaggccagcct

SEQ ID NO: 2683476 - DNA, 22 bp, Homo sapiens
gacaccttagacggaggtgcct

SEQ ID NO: 2683477 - DNA, 22 bp, Homo sapiens
gacacgtgatggaccaaagcca

SEQ ID NO: 2683478 - DNA, 18 bp, Homo sapiens
gacagaaatgcaatctcc

SEQ ID NO: 2683479 - DNA, 11 bp, Homo sapiens
gacagccaggt

SEQ ID NO: 2683480 - DNA, 13 bp, Homo sapiens
gacagctgctggg

SEQ ID NO: 2683481 - DNA, 19 bp, Homo sapiens
gacagctgctgggacccac

SEQ ID NO: 2683482 - DNA, 22 bp, Homo sapiens
gacagctgctgggacccacctc

SEQ ID NO: 2683483 - DNA, 14 bp, Homo sapiens
gacagtcctgggag

SEQ ID NO: 2683484 - DNA, 18 bp, Homo sapiens
gacagtcctgggagaacc

SEQ ID NO: 2683485 - DNA, 12 bp, Homo sapiens
gacagtgggcag

SEQ ID NO: 2683486 - DNA, 22 bp, Homo sapiens
gacagtgggcaggaggccccag

SEQ ID NO: 2683487 - DNA, 14 bp, Homo sapiens
gacatgtgcagtgc

SEQ ID NO: 2683488 - DNA, 18 bp, Homo sapiens
gacattgatttgattttt

SEQ ID NO: 2683489 - DNA, 16 bp, Homo sapiens
gaccaaagccacctgc

SEQ ID NO: 2683490 - DNA, 17 bp, Homo sapiens
gaccaaagccacctgct

SEQ ID NO: 2683491 - DNA, 18 bp, Homo sapiens
gaccaaagccacctgctg

SEQ ID NO: 2683492 - DNA, 23 bp, Homo sapiens
gaccagcctgttggacccgctct

SEQ ID NO: 2683493 - DNA, 14 bp, Homo sapiens
gaccagctctcttc

SEQ ID NO: 2683494 - DNA, 23 bp, Homo sapiens
gaccagctctcttcctgtctttg

SEQ ID NO: 2683495 - DNA, 18 bp, Homo sapiens
gaccattgtcttccaacc

SEQ ID NO: 2683496 - DNA, 20 bp, Homo sapiens
gaccattgtcttccaacccc

SEQ ID NO: 2683497 - DNA, 12 bp, Homo sapiens
gacccaaagacc

SEQ ID NO: 2683498 - DNA, 13 bp, Homo sapiens
gacccaaagacca

SEQ ID NO: 2683499 - DNA, 16 bp, Homo sapiens
gacccacctccccctc

SEQ ID NO: 2683500 - DNA, 19 bp, Homo sapiens
gaccctgagggctcctcca

SEQ ID NO: 2683501 - DNA, 22 bp, Homo sapiens
gaccctgcgaaggggccctggt

SEQ ID NO: 2683502 - DNA, 21 bp, Homo sapiens
gacctgccccgcccagctgca

SEQ ID NO: 2683503 - DNA, 22 bp, Homo sapiens
gacctgttttgcttttgtaact

SEQ ID NO: 2683504 - DNA, 19 bp, Homo sapiens
gaccttagaaatcattgta

SEQ ID NO: 2683505 - DNA, 21 bp, Homo sapiens
gaccttagaaatcattgtaga

SEQ ID NO: 2683506 - DNA, 23 bp, Homo sapiens
gaccttagaaatcattgtagaaa

SEQ ID NO: 2683507 - DNA, 13 bp, Homo sapiens
gacgggctgtccg

SEQ ID NO: 2683508 - DNA, 15 bp, Homo sapiens
gactaaggggcagct

SEQ ID NO: 2683509 - DNA, 15 bp, Homo sapiens
gactcacaagaagac

SEQ ID NO: 2683510 - DNA, 19 bp, Homo sapiens
gactccctccatgtggccc

SEQ ID NO: 2683511 - DNA, 13 bp, Homo sapiens
gactctctgtgac

SEQ ID NO: 2683512 - DNA, 14 bp, Homo sapiens
gactctctgtgacc

SEQ ID NO: 2683513 - DNA, 22 bp, Homo sapiens
gactctgaggctctttctgggc

SEQ ID NO: 2683514 - DNA, 17 bp, Homo sapiens
gactctgtggggccttg

SEQ ID NO: 2683515 - DNA, 22 bp, Homo sapiens
gactgagtcctcgtagccatct

SEQ ID NO: 2683516 - DNA, 22 bp, Homo sapiens
gactgcgggatggtcctggggc

SEQ ID NO: 2683517 - DNA, 14 bp, Homo sapiens
gactggagcatctg

SEQ ID NO: 2683518 - DNA, 22 bp, Homo sapiens
gactgtcaagtacaagcaagac

SEQ ID NO: 2683519 - DNA, 22 bp, Homo sapiens
gacttttccattgaccagctct

SEQ ID NO: 2683520 - DNA, 16 bp, Homo sapiens
gagaaccaaaagatgc

SEQ ID NO: 2683521 - DNA, 22 bp, Homo sapiens
gagaactggggttcaagcccag

SEQ ID NO: 2683522 - DNA, 17 bp, Homo sapiens
gagaagcgctgccctgt

SEQ ID NO: 2683523 - DNA, 19 bp, Homo sapiens
gagaagcgctgccctgtga

SEQ ID NO: 2683524 - DNA, 20 bp, Homo sapiens
gagaagcgctgccctgtgag

SEQ ID NO: 2683525 - DNA, 21 bp, Homo sapiens
gagaagcgctgccctgtgaga

SEQ ID NO: 2683526 - DNA, 21 bp, Homo sapiens
gagactaaggggcagctcctg

SEQ ID NO: 2683527 - DNA, 23 bp, Homo sapiens
gagactctgtggggccttggttc

SEQ ID NO: 2683528 - DNA, 22 bp, Homo sapiens
gagactgcgggatggtcctggg

SEQ ID NO: 2683529 - DNA, 13 bp, Homo sapiens
gagagcacagcgt

SEQ ID NO: 2683530 - DNA, 18 bp, Homo sapiens
gagagccacgctggcctt

SEQ ID NO: 2683531 - DNA, 19 bp, Homo sapiens
gagagccagatgcctcccc

SEQ ID NO: 2683532 - DNA, 11 bp, Homo sapiens
gagagcccagc

SEQ ID NO: 2683533 - DNA, 14 bp, Homo sapiens
gagagcctcttagt

SEQ ID NO: 2683534 - DNA, 19 bp, Homo sapiens
gagagcctcttagtgattg

SEQ ID NO: 2683535 - DNA, 13 bp, Homo sapiens
gagaggggcctgc

SEQ ID NO: 2683536 - DNA, 14 bp, Homo sapiens
gagaggggcctgca

SEQ ID NO: 2683537 - DNA, 15 bp, Homo sapiens
gagaggtctcaggtt

SEQ ID NO: 2683538 - DNA, 19 bp, Homo sapiens
gagagtggggcctgccctc

SEQ ID NO: 2683539 - DNA, 14 bp, Homo sapiens
gagcaaatgtttct

SEQ ID NO: 2683540 - DNA, 20 bp, Homo sapiens
gagcaacagagtgagaccct

SEQ ID NO: 2683541 - DNA, 21 bp, Homo sapiens
gagcagggccaaagcacagct

SEQ ID NO: 2683542 - DNA, 13 bp, Homo sapiens
gagcaggggcagg

SEQ ID NO: 2683543 - DNA, 16 bp, Homo sapiens
gagcaggggcagggtg

SEQ ID NO: 2683544 - DNA, 16 bp, Homo sapiens
gagccactgcactcca

SEQ ID NO: 2683545 - DNA, 17 bp, Homo sapiens
gagccagatgcctcccc

SEQ ID NO: 2683546 - DNA, 22 bp, Homo sapiens
gagccatgatcgagccactgca

SEQ ID NO: 2683547 - DNA, 11 bp, Homo sapiens
gagccccagct

SEQ ID NO: 2683548 - DNA, 16 bp, Homo sapiens
gagccccagcttcctg

SEQ ID NO: 2683549 - DNA, 20 bp, Homo sapiens
gagccctccaggcctgcagg

SEQ ID NO: 2683550 - DNA, 21 bp, Homo sapiens
gagccctggaccccaggctct

SEQ ID NO: 2683551 - DNA, 19 bp, Homo sapiens
gagccgagatcacgccact

SEQ ID NO: 2683552 - DNA, 22 bp, Homo sapiens
gagccgagattgcgccactgca

SEQ ID NO: 2683553 - DNA, 16 bp, Homo sapiens
gagcctaatgaaaggg

SEQ ID NO: 2683554 - DNA, 17 bp, Homo sapiens
gagcctcgtgtcctgct

SEQ ID NO: 2683555 - DNA, 16 bp, Homo sapiens
gagcggcgcagagccc

SEQ ID NO: 2683556 - DNA, 15 bp, Homo sapiens
gagctaagttctaag

SEQ ID NO: 2683557 - DNA, 20 bp, Homo sapiens
gagctatgattatgccactg

SEQ ID NO: 2683558 - DNA, 15 bp, Homo sapiens
gagctcctgtcccta

SEQ ID NO: 2683559 - DNA, 17 bp, Homo sapiens
gagctcctgtccctacc

SEQ ID NO: 2683560 - DNA, 22 bp, Homo sapiens
gagctttgttttatatatttat

SEQ ID NO: 2683561 - DNA, 11 bp, Homo sapiens
gaggacacatg

SEQ ID NO: 2683562 - DNA, 12 bp, Homo sapiens
gaggacacatgt

SEQ ID NO: 2683563 - DNA, 17 bp, Homo sapiens
gaggacacgtggcctgc

SEQ ID NO: 2683564 - DNA, 19 bp, Homo sapiens
gaggagggatgctgcctga

SEQ ID NO: 2683565 - DNA, 15 bp, Homo sapiens
gaggaggtggcagcc

SEQ ID NO: 2683566 - DNA, 19 bp, Homo sapiens
gaggatcactggagcccag

SEQ ID NO: 2683567 - DNA, 22 bp, Homo sapiens
gaggatgaatagatgtgatcac

SEQ ID NO: 2683568 - DNA, 17 bp, Homo sapiens
gaggcaggggtcctgca

SEQ ID NO: 2683569 - DNA, 10 bp, Homo sapiens
gaggcaggtg

SEQ ID NO: 2683570 - DNA, 18 bp, Homo sapiens
gaggccacccactgaccc

SEQ ID NO: 2683571 - DNA, 16 bp, Homo sapiens
gctccctgctcccagg

SEQ ID NO: 2683572 - DNA, 18 bp, Homo sapiens
gctcctccatggtgctgc

SEQ ID NO: 2683573 - DNA, 19 bp, Homo sapiens
gctcctccatggtgctgca

SEQ ID NO: 2683574 - DNA, 20 bp, Homo sapiens
gctcctccatggtgctgcat

SEQ ID NO: 2683575 - DNA, 13 bp, Homo sapiens
gctcggtgagtga

SEQ ID NO: 2683576 - DNA, 11 bp, Homo sapiens
gctctatgcca

SEQ ID NO: 2683577 - DNA, 21 bp, Homo sapiens
gctctatgccaggctgtgcta

SEQ ID NO: 2683578 - DNA, 14 bp, Homo sapiens
gctctcctggagca

SEQ ID NO: 2683579 - DNA, 17 bp, Homo sapiens
gctctcctggagcaagc

SEQ ID NO: 2683580 - DNA, 19 bp, Homo sapiens
gctctcctggagcaagctc

SEQ ID NO: 2683581 - DNA, 21 bp, Homo sapiens
gctctcctggagcaagctctg

SEQ ID NO: 2683582 - DNA, 16 bp, Homo sapiens
gctctctgggcctggg

SEQ ID NO: 2683583 - DNA, 16 bp, Homo sapiens
gctctcttcctgtctt

SEQ ID NO: 2683584 - DNA, 13 bp, Homo sapiens
gctctgcttcctc

SEQ ID NO: 2683585 - DNA, 15 bp, Homo sapiens
gctctgcttcctcag

SEQ ID NO: 2683586 - DNA, 19 bp, Homo sapiens
gctctgcttcctcagggcc

SEQ ID NO: 2683587 - DNA, 22 bp, Homo sapiens
gctctggaccaaccctgtttcc

SEQ ID NO: 2683588 - DNA, 15 bp, Homo sapiens
gctctgtagccacct

SEQ ID NO: 2683589 - DNA, 17 bp, Homo sapiens
gctctgtagccacctcc

SEQ ID NO: 2683590 - DNA, 22 bp, Homo sapiens
gctctgtagccacctccttggc

SEQ ID NO: 2683591 - DNA, 15 bp, Homo sapiens
gctctgtttcttcct

SEQ ID NO: 2683592 - DNA, 20 bp, Homo sapiens
gctctgtttcttcctttctg

SEQ ID NO: 2683593 - DNA, 12 bp, Homo sapiens
gctcttaatgtt

SEQ ID NO: 2683594 - DNA, 14 bp, Homo sapiens
gctcttcctctggt

SEQ ID NO: 2683595 - DNA, 22 bp, Homo sapiens
gctcttcctctggtttctgtgt

SEQ ID NO: 2683596 - DNA, 12 bp, Homo sapiens
gctctttctctg

SEQ ID NO: 2683597 - DNA, 13 bp, Homo sapiens
gctctttctgggc

SEQ ID NO: 2683598 - DNA, 20 bp, Homo sapiens
gctgacactgtgaccctggg

SEQ ID NO: 2683599 - DNA, 14 bp, Homo sapiens
gctgagactgcggg

SEQ ID NO: 2683600 - DNA, 13 bp, Homo sapiens
gctgagagccaga

SEQ ID NO: 2683601 - DNA, 16 bp, Homo sapiens
gctgagagccagatgc

SEQ ID NO: 2683602 - DNA, 12 bp, Homo sapiens
gctgagccctgg

SEQ ID NO: 2683603 - DNA, 15 bp, Homo sapiens
gctgagccctggcag

SEQ ID NO: 2683604 - DNA, 16 bp, Homo sapiens
gctgagccctggcagg

SEQ ID NO: 2683605 - DNA, 21 bp, Homo sapiens
gctgaggatacagctcttctc

SEQ ID NO: 2683606 - DNA, 19 bp, Homo sapiens
gctgaggccacccactgac

SEQ ID NO: 2683607 - DNA, 20 bp, Homo sapiens
gctgaggccacccactgacc

SEQ ID NO: 2683608 - DNA, 23 bp, Homo sapiens
gctgatgaaactcctgattttgt

SEQ ID NO: 2683609 - DNA, 13 bp, Homo sapiens
gctgatggccctc

SEQ ID NO: 2683610 - DNA, 18 bp, Homo sapiens
gctgcacctgccagcctg

SEQ ID NO: 2683611 - DNA, 19 bp, Homo sapiens
gctgcacctgccagcctgg

SEQ ID NO: 2683612 - DNA, 22 bp, Homo sapiens
gctgcacctgccagcctggctt

SEQ ID NO: 2683613 - DNA, 13 bp, Homo sapiens
gctgcagcctccc

SEQ ID NO: 2683614 - DNA, 12 bp, Homo sapiens
gctgccagctgc

SEQ ID NO: 2683615 - DNA, 14 bp, Homo sapiens
gctgccctgtgaga

SEQ ID NO: 2683616 - DNA, 17 bp, Homo sapiens
gctgcgggggagccagt

SEQ ID NO: 2683617 - DNA, 14 bp, Homo sapiens
gctgctccctgctc

SEQ ID NO: 2683618 - DNA, 20 bp, Homo sapiens
gctgctccctgctcccaggg

SEQ ID NO: 2683619 - DNA, 15 bp, Homo sapiens
gctgctttcttctct

SEQ ID NO: 2683620 - DNA, 22 bp, Homo sapiens
gctgctttcttctctgcctcct

SEQ ID NO: 2683621 - DNA, 16 bp, Homo sapiens
gctggacggcattcct

SEQ ID NO: 2683622 - DNA, 18 bp, Homo sapiens
gctggagtctcagagcac

SEQ ID NO: 2683623 - DNA, 15 bp, Homo sapiens
gctggagtgcagtgg

SEQ ID NO: 2683624 - DNA, 20 bp, Homo sapiens
gctggagtgcagtggtgcga

SEQ ID NO: 2683625 - DNA, 15 bp, Homo sapiens
gctggcctggccctt

SEQ ID NO: 2683626 - DNA, 13 bp, Homo sapiens
gctggctgcagtg

SEQ ID NO: 2683627 - DNA, 14 bp, Homo sapiens
gctggctgcagtga

SEQ ID NO: 2683628 - DNA, 15 bp, Homo sapiens
gctggctgggcatgg

SEQ ID NO: 2683629 - DNA, 16 bp, Homo sapiens
gctggctgggcatgga

SEQ ID NO: 2683630 - DNA, 19 bp, Homo sapiens
gctgggaaggggaacacag

SEQ ID NO: 2683631 - DNA, 14 bp, Homo sapiens
gctgggacccacct

SEQ ID NO: 2683632 - DNA, 16 bp, Homo sapiens
gctgggacccacctcc

SEQ ID NO: 2683633 - DNA, 18 bp, Homo sapiens
gctgggacccacctcccc

SEQ ID NO: 2683634 - DNA, 14 bp, Homo sapiens
gctgggactggcca

SEQ ID NO: 2683635 - DNA, 15 bp, Homo sapiens
gctgggactggccag

SEQ ID NO: 2683636 - DNA, 17 bp, Homo sapiens
gctggtccctgccctcc

SEQ ID NO: 2683637 - DNA, 19 bp, Homo sapiens
gctggtccctgccctcccc

SEQ ID NO: 2683638 - DNA, 20 bp, Homo sapiens
gctggtccctgccctcccct

SEQ ID NO: 2683639 - DNA, 18 bp, Homo sapiens
gctgtatttgttcagtga

SEQ ID NO: 2683640 - DNA, 18 bp, Homo sapiens
gctgtccgtgtgcctcct

SEQ ID NO: 2683641 - DNA, 21 bp, Homo sapiens
gctgtccgtgtgcctcctgtg

SEQ ID NO: 2683642 - DNA, 14 bp, Homo sapiens
gctgtcctaggcca

SEQ ID NO: 2683643 - DNA, 14 bp, Homo sapiens
gctgtctctcttgt

SEQ ID NO: 2683644 - DNA, 18 bp, Homo sapiens
gctgtgctcgggtgctgc

SEQ ID NO: 2683645 - DNA, 15 bp, Homo sapiens
gctgtggcctgggca

SEQ ID NO: 2683646 - DNA, 17 bp, Homo sapiens
gctgttctctttgctga

SEQ ID NO: 2683647 - DNA, 22 bp, Homo sapiens
gctgttctctttgctgacactg

SEQ ID NO: 2683648 - DNA, 17 bp, Homo sapiens
gcttaaattgcttttgt

SEQ ID NO: 2683649 - DNA, 23 bp, Homo sapiens
gcttaggtcctcacttctgtctc

SEQ ID NO: 2683650 - DNA, 24 bp, Homo sapiens
gcttaggtcctcacttctgtctcc

SEQ ID NO: 2683651 - DNA, 17 bp, Homo sapiens
gcttatcaataaacctg

SEQ ID NO: 2683652 - DNA, 14 bp, Homo sapiens
gcttcagcctgagg

SEQ ID NO: 2683653 - DNA, 15 bp, Homo sapiens
gcttcagcctgaggc

SEQ ID NO: 2683654 - DNA, 20 bp, Homo sapiens
gcttcagcctgaggctgaga

SEQ ID NO: 2683655 - DNA, 19 bp, Homo sapiens
gcttccagaaaaccccagc

SEQ ID NO: 2683656 - DNA, 21 bp, Homo sapiens
gcttccagagagtcctctgga

SEQ ID NO: 2683657 - DNA, 15 bp, Homo sapiens
gcttcctcagggccc

SEQ ID NO: 2683658 - DNA, 17 bp, Homo sapiens
gcttctggagcccttgg

SEQ ID NO: 2683659 - DNA, 12 bp, Homo sapiens
gcttgcttgccg

SEQ ID NO: 2683660 - DNA, 19 bp, Homo sapiens
gcttggaaagcatcacctc

SEQ ID NO: 2683661 - DNA, 15 bp, Homo sapiens
gcttggaaccagtgt

SEQ ID NO: 2683662 - DNA, 15 bp, Homo sapiens
gcttgtcggagcaag

SEQ ID NO: 2683663 - DNA, 17 bp, Homo sapiens
gctttacatgctgtgct

SEQ ID NO: 2683664 - DNA, 17 bp, Homo sapiens
gctttcagagccagtga

SEQ ID NO: 2683665 - DNA, 16 bp, Homo sapiens
gctttccttcctcccc

SEQ ID NO: 2683666 - DNA, 13 bp, Homo sapiens
gctttccttctgc

SEQ ID NO: 2683667 - DNA, 20 bp, Homo sapiens
gctttccttctgcccttcct

SEQ ID NO: 2683668 - DNA, 17 bp, Homo sapiens
gctttcttctctgcctc

SEQ ID NO: 2683669 - DNA, 20 bp, Homo sapiens
gctttgactcacctgttact

SEQ ID NO: 2683670 - DNA, 12 bp, Homo sapiens
gctttgatatat

SEQ ID NO: 2683671 - DNA, 17 bp, Homo sapiens
gctttgttgtcctccca

SEQ ID NO: 2683672 - DNA, 20 bp, Homo sapiens
gctttgttgtcctcccagga

SEQ ID NO: 2683673 - DNA, 15 bp, Homo sapiens
gctttgttttatata

SEQ ID NO: 2683674 - DNA, 12 bp, Homo sapiens
gcttttaagaaa

SEQ ID NO: 2683675 - DNA, 15 bp, Homo sapiens
gcttttgttgtgact

SEQ ID NO: 2683676 - DNA, 20 bp, Homo sapiens
ggaaaacaaatcactgtatt

SEQ ID NO: 2683677 - DNA, 21 bp, Homo sapiens
ggaaaacacggccctcctggg

SEQ ID NO: 2683678 - DNA, 22 bp, Homo sapiens
ggaaaacacggccctcctggga

SEQ ID NO: 2683679 - DNA, 19 bp, Homo sapiens
ggaaagcaggtggcatctc

SEQ ID NO: 2683680 - DNA, 21 bp, Homo sapiens
ggaaagcaggtggcatctcta

SEQ ID NO: 2683681 - DNA, 14 bp, Homo sapiens
ggaaagcctctgct

SEQ ID NO: 2683682 - DNA, 23 bp, Homo sapiens
ggaaccagtgtaactggctgctc

SEQ ID NO: 2683683 - DNA, 17 bp, Homo sapiens
ggaagaaacctggaacc

SEQ ID NO: 2683684 - DNA, 16 bp, Homo sapiens
ggaagaaattcctgta

SEQ ID NO: 2683685 - DNA, 20 bp, Homo sapiens
ggaagcggaggttgcaggga

SEQ ID NO: 2683686 - DNA, 22 bp, Homo sapiens
ggaagcggaggttgcagggagc

SEQ ID NO: 2683687 - DNA, 21 bp, Homo sapiens
ggaaggctaagcatggcctgg

SEQ ID NO: 2683688 - DNA, 14 bp, Homo sapiens
ggaaggctggctgg

SEQ ID NO: 2683689 - DNA, 12 bp, Homo sapiens
ggaagtgcccag

SEQ ID NO: 2683690 - DNA, 13 bp, Homo sapiens
ggaagtgcccagc

SEQ ID NO: 2683691 - DNA, 14 bp, Homo sapiens
ggaagtgcccagcc

SEQ ID NO: 2683692 - DNA, 16 bp, Homo sapiens
ggaagtgcccagcccc

SEQ ID NO: 2683693 - DNA, 22 bp, Homo sapiens
ggaatcaagatgtcagactggc

SEQ ID NO: 2683694 - DNA, 16 bp, Homo sapiens
ggaatgtgtcctcctg

SEQ ID NO: 2683695 - DNA, 17 bp, Homo sapiens
ggaatgtgtcctcctgc

SEQ ID NO: 2683696 - DNA, 19 bp, Homo sapiens
ggacacatgtccagtggga

SEQ ID NO: 2683697 - DNA, 13 bp, Homo sapiens
ggacacctgccct

SEQ ID NO: 2683698 - DNA, 16 bp, Homo sapiens
ggacacctgccctgcc

SEQ ID NO: 2683699 - DNA, 15 bp, Homo sapiens
ggacagctgctggga

SEQ ID NO: 2683700 - DNA, 14 bp, Homo sapiens
ggacagtcctggga

SEQ ID NO: 2683701 - DNA, 15 bp, Homo sapiens
ggacagtcctgggag

SEQ ID NO: 2683702 - DNA, 20 bp, Homo sapiens
ggaccaaagccacctgctgc

SEQ ID NO: 2683703 - DNA, 17 bp, Homo sapiens
ggaccagcctgttggac

SEQ ID NO: 2683704 - DNA, 14 bp, Homo sapiens
ggacccgctctgga

SEQ ID NO: 2683705 - DNA, 17 bp, Homo sapiens
ggacctctgctctgagg

SEQ ID NO: 2683706 - DNA, 23 bp, Homo sapiens
ggacctgaagggtgacatcccag

SEQ ID NO: 2683707 - DNA, 16 bp, Homo sapiens
ggacctgttttcttca

SEQ ID NO: 2683708 - DNA, 13 bp, Homo sapiens
ggaccttcctgcc

SEQ ID NO: 2683709 - DNA, 18 bp, Homo sapiens
ggacggcattcctgctta

SEQ ID NO: 2683710 - DNA, 21 bp, Homo sapiens
ggactaacataaaatctgtga

SEQ ID NO: 2683711 - DNA, 13 bp, Homo sapiens
ggactccagttca

SEQ ID NO: 2683712 - DNA, 16 bp, Homo sapiens
ggactgactgcagccc

SEQ ID NO: 2683713 - DNA, 15 bp, Homo sapiens
ggactgtgaccaaag

SEQ ID NO: 2683714 - DNA, 17 bp, Homo sapiens
ggactgtgaccaaagca

SEQ ID NO: 2683715 - DNA, 13 bp, Homo sapiens
ggagactctgtgg

SEQ ID NO: 2683716 - DNA, 20 bp, Homo sapiens
ggagactctgtggggccttg

SEQ ID NO: 2683717 - DNA, 16 bp, Homo sapiens
ggagcaaatgtttctg

SEQ ID NO: 2683718 - DNA, 18 bp, Homo sapiens
ggagcaaatgtttctgca

SEQ ID NO: 2683719 - DNA, 20 bp, Homo sapiens
ggagcaaatgtttctgcagt

SEQ ID NO: 2683720 - DNA, 18 bp, Homo sapiens
ggagcaagtttcatcagc

SEQ ID NO: 2683721 - DNA, 22 bp, Homo sapiens
ggagcaagtttcatcagcccta

SEQ ID NO: 2683722 - DNA, 16 bp, Homo sapiens
ggagcatctgactcac

SEQ ID NO: 2683723 - DNA, 12 bp, Homo sapiens
ggagccccagct

SEQ ID NO: 2683724 - DNA, 23 bp, Homo sapiens
ggagcgcacctgccccctggtgg

SEQ ID NO: 2683725 - DNA, 14 bp, Homo sapiens
ggagcttgcagtga

SEQ ID NO: 2683726 - DNA, 20 bp, Homo sapiens
ggaggaggtggcagccctgt

SEQ ID NO: 2683727 - DNA, 12 bp, Homo sapiens
ggaggctgaggc

SEQ ID NO: 2683728 - DNA, 17 bp, Homo sapiens
ggaggctgaggcaggag

SEQ ID NO: 2683729 - DNA, 19 bp, Homo sapiens
ggagggtgggagagcccag

SEQ ID NO: 2683730 - DNA, 17 bp, Homo sapiens
ggaggtgagaccacctc

SEQ ID NO: 2683731 - DNA, 17 bp, Homo sapiens
ggaggtggcagccctgt

SEQ ID NO: 2683732 - DNA, 12 bp, Homo sapiens
ggaggttgcagg

SEQ ID NO: 2683733 - DNA, 20 bp, Homo sapiens
ggagttcgagaccagcctgg

SEQ ID NO: 2683734 - DNA, 17 bp, Homo sapiens
ggataacttccttgccc

SEQ ID NO: 2683735 - DNA, 20 bp, Homo sapiens
ggatcactctctgctggcag

SEQ ID NO: 2683736 - DNA, 19 bp, Homo sapiens
ggatcactggagcccagga

SEQ ID NO: 2683737 - DNA, 14 bp, Homo sapiens
ggatcatctctgtg

SEQ ID NO: 2683738 - DNA, 14 bp, Homo sapiens
ggatgctgcctgag

SEQ ID NO: 2683739 - DNA, 20 bp, Homo sapiens
ggatggcatctagccagagg

SEQ ID NO: 2683740 - DNA, 21 bp, Homo sapiens
ggatggcatctagccagaggc

SEQ ID NO: 2683741 - DNA, 14 bp, Homo sapiens
ggatggtcctgggg

SEQ ID NO: 2683742 - DNA, 11 bp, Homo sapiens
ggatgtagaac

SEQ ID NO: 2683743 - DNA, 13 bp, Homo sapiens
ggatgtagaactt

SEQ ID NO: 2683744 - DNA, 13 bp, Homo sapiens
ggcaacagatgaa

SEQ ID NO: 2683745 - DNA, 16 bp, Homo sapiens
ggcaaggggctggctg

SEQ ID NO: 2683746 - DNA, 22 bp, Homo sapiens
ggcaagtccctgactctctgtg

SEQ ID NO: 2683747 - DNA, 19 bp, Homo sapiens
ggcaccagaggctgcagaa

SEQ ID NO: 2683748 - DNA, 19 bp, Homo sapiens
ggcacccaggcctccctgc

SEQ ID NO: 2683749 - DNA, 19 bp, Homo sapiens
ggcacctatagtcccagct

SEQ ID NO: 2683750 - DNA, 15 bp, Homo sapiens
ggcacgtctcctgct

SEQ ID NO: 2683751 - DNA, 16 bp, Homo sapiens
ggcagagccgggaagc

SEQ ID NO: 2683752 - DNA, 17 bp, Homo sapiens
ggcagcatggagagcct

SEQ ID NO: 2683753 - DNA, 13 bp, Homo sapiens
ggcagccctgtag

SEQ ID NO: 2683754 - DNA, 13 bp, Homo sapiens
ggcagctcctgac

SEQ ID NO: 2683755 - DNA, 14 bp, Homo sapiens
ggcagctcctgacc

SEQ ID NO: 2683756 - DNA, 15 bp, Homo sapiens
ggcagctcctgacca

SEQ ID NO: 2683757 - DNA, 22 bp, Homo sapiens
ggcaggagcctcgtgtcctgct

SEQ ID NO: 2683758 - DNA, 14 bp, Homo sapiens
ggcagggctgggcc

SEQ ID NO: 2683759 - DNA, 16 bp, Homo sapiens
ggcagggctgggccag

SEQ ID NO: 2683760 - DNA, 16 bp, Homo sapiens
ggcaggggtcctgcag

SEQ ID NO: 2683761 - DNA, 17 bp, Homo sapiens
ggcaggggtcctgcagg

SEQ ID NO: 2683762 - DNA, 22 bp, Homo sapiens
ggcaggggtcctgcaggtcctg

SEQ ID NO: 2683763 - DNA, 13 bp, Homo sapiens
ggcatcacagggc

SEQ ID NO: 2683764 - DNA, 23 bp, Homo sapiens
ggcatcacagggcagagccggga

SEQ ID NO: 2683765 - DNA, 18 bp, Homo sapiens
ggcatcctgaaagccagc

SEQ ID NO: 2683766 - DNA, 15 bp, Homo sapiens
ggcatcctgcttcct

SEQ ID NO: 2683767 - DNA, 17 bp, Homo sapiens
ggcatcctgcttcctga

SEQ ID NO: 2683768 - DNA, 15 bp, Homo sapiens
ggcatctagccagag

SEQ ID NO: 2683769 - DNA, 15 bp, Homo sapiens
ggcattcctgcttat

SEQ ID NO: 2683770 - DNA, 13 bp, Homo sapiens
ggcattgggttct

SEQ ID NO: 2683771 - DNA, 15 bp, Homo sapiens
ggccaaagcacagct

SEQ ID NO: 2683772 - DNA, 22 bp, Homo sapiens
ggccaaggctatgaagggacag

SEQ ID NO: 2683773 - DNA, 15 bp, Homo sapiens
ggccaatgttgctga

SEQ ID NO: 2683774 - DNA, 23 bp, Homo sapiens
ggccaatgttgctgatggcccct

SEQ ID NO: 2683775 - DNA, 21 bp, Homo sapiens
ggccagcactggaggggccca

SEQ ID NO: 2683776 - DNA, 16 bp, Homo sapiens
ggccagggccctgcag

SEQ ID NO: 2683777 - DNA, 14 bp, Homo sapiens
ggccaggtgcagtg

SEQ ID NO: 2683778 - DNA, 17 bp, Homo sapiens
ggccaggtttctgccca

SEQ ID NO: 2683779 - DNA, 24 bp, Homo sapiens
ggccagtcctagagctcctgtccc

SEQ ID NO: 2683780 - DNA, 13 bp, Homo sapiens
ggcccagcaggcg

SEQ ID NO: 2683781 - DNA, 15 bp, Homo sapiens
ggcccaggcaggcca

SEQ ID NO: 2683782 - DNA, 14 bp, Homo sapiens
ggcccgcctgccac

SEQ ID NO: 2683783 - DNA, 13 bp, Homo sapiens
ggccctcctggga

SEQ ID NO: 2683784 - DNA, 13 bp, Homo sapiens
ggcctccctgcag

SEQ ID NO: 2683785 - DNA, 18 bp, Homo sapiens
ggcctccctgcagactcc

SEQ ID NO: 2683786 - DNA, 13 bp, Homo sapiens
ggcctctagaaca

SEQ ID NO: 2683787 - DNA, 20 bp, Homo sapiens
ggcctctagaacacccactg

SEQ ID NO: 2683788 - DNA, 21 bp, Homo sapiens
ggcctctagaacacccactgg

SEQ ID NO: 2683789 - DNA, 20 bp, Homo sapiens
ggcctgacacaggccagcct

SEQ ID NO: 2683790 - DNA, 20 bp, Homo sapiens
ggcctgattcactggcctgg

SEQ ID NO: 2683791 - DNA, 14 bp, Homo sapiens
ggcctgccctctgc

SEQ ID NO: 2683792 - DNA, 12 bp, Homo sapiens
gttgtctccctc

SEQ ID NO: 2683793 - DNA, 19 bp, Homo sapiens
gttgtggaaagcctctgct

SEQ ID NO: 2683794 - DNA, 20 bp, Homo sapiens
gtttacttatacctctctca

SEQ ID NO: 2683795 - DNA, 17 bp, Homo sapiens
gtttatagttaatctat

SEQ ID NO: 2683796 - DNA, 20 bp, Homo sapiens
gtttcaacaatttttgatca

SEQ ID NO: 2683797 - DNA, 13 bp, Homo sapiens
gtttctattttct

SEQ ID NO: 2683798 - DNA, 23 bp, Homo sapiens
gtttctattttctctgatacttt

SEQ ID NO: 2683799 - DNA, 15 bp, Homo sapiens
gtttctccccctggg

SEQ ID NO: 2683800 - DNA, 13 bp, Homo sapiens
gtttctgtgtgtc

SEQ ID NO: 2683801 - DNA, 18 bp, Homo sapiens
gtttgtttctccccctgg

SEQ ID NO: 2683802 - DNA, 20 bp, Homo sapiens
gtttgtttctccccctgggc

SEQ ID NO: 2683803 - DNA, 16 bp, Homo sapiens
gttttccaccctggaa

SEQ ID NO: 2683804 - DNA, 22 bp, Homo sapiens
gttttcttcaagggaagaaaca

SEQ ID NO: 2683805 - DNA, 13 bp, Homo sapiens
gttttgtagcatt

SEQ ID NO: 2683806 - DNA, 19 bp, Homo sapiens
gttttgtataaataataaa

SEQ ID NO: 2683807 - DNA, 20 bp, Homo sapiens
taaaaaaaactctttaactt

SEQ ID NO: 2683808 - DNA, 18 bp, Homo sapiens
taaaaaaagtatatattc

SEQ ID NO: 2683809 - DNA, 14 bp, Homo sapiens
taaaaagattatat

SEQ ID NO: 2683810 - DNA, 22 bp, Homo sapiens
taaaatactctagcctgggcca

SEQ ID NO: 2683811 - DNA, 21 bp, Homo sapiens
taaaatttcccctaatctttt

SEQ ID NO: 2683812 - DNA, 22 bp, Homo sapiens
taaacacccatgaatcaaagac

SEQ ID NO: 2683813 - DNA, 17 bp, Homo sapiens
taaagatatcagagctc

SEQ ID NO: 2683814 - DNA, 14 bp, Homo sapiens
taaagcatcagaga

SEQ ID NO: 2683815 - DNA, 17 bp, Homo sapiens
taaaggagaaggcatga

SEQ ID NO: 2683816 - DNA, 22 bp, Homo sapiens
taaaggagaaggcatgaaattg

SEQ ID NO: 2683817 - DNA, 23 bp, Homo sapiens
taaaggtcacttttcacatcctt

SEQ ID NO: 2683818 - DNA, 21 bp, Homo sapiens
taaaggtttctattttctctg

SEQ ID NO: 2683819 - DNA, 15 bp, Homo sapiens
taaagtaattttgtg

SEQ ID NO: 2683820 - DNA, 14 bp, Homo sapiens
taaatgttctcgtt

SEQ ID NO: 2683821 - DNA, 22 bp, Homo sapiens
taaatgttctcgttttgaaact

SEQ ID NO: 2683822 - DNA, 19 bp, Homo sapiens
taaattaatacttcatttg

SEQ ID NO: 2683823 - DNA, 14 bp, Homo sapiens
taaattccactgga

SEQ ID NO: 2683824 - DNA, 18 bp, Homo sapiens
taacaaaccatctggtgc

SEQ ID NO: 2683825 - DNA, 16 bp, Homo sapiens
taacagtgaggctggg

SEQ ID NO: 2683826 - DNA, 17 bp, Homo sapiens
taacagtgaggctggga

SEQ ID NO: 2683827 - DNA, 18 bp, Homo sapiens
taactacatattgaatag

SEQ ID NO: 2683828 - DNA, 20 bp, Homo sapiens
taactggctgctccctgctc

SEQ ID NO: 2683829 - DNA, 23 bp, Homo sapiens
taactggctgctccctgctccca

SEQ ID NO: 2683830 - DNA, 22 bp, Homo sapiens
taagaaacacagggttttgtat

SEQ ID NO: 2683831 - DNA, 22 bp, Homo sapiens
taagatggcttatttgtataat

SEQ ID NO: 2683832 - DNA, 15 bp, Homo sapiens
taagatttttgtaaa

SEQ ID NO: 2683833 - DNA, 16 bp, Homo sapiens
taagcactttttaaaa

SEQ ID NO: 2683834 - DNA, 14 bp, Homo sapiens
taagccctgctctt

SEQ ID NO: 2683835 - DNA, 20 bp, Homo sapiens
taaggacccaaatttccctg

SEQ ID NO: 2683836 - DNA, 18 bp, Homo sapiens
taaggggcagctcctgac

SEQ ID NO: 2683837 - DNA, 23 bp, Homo sapiens
taaggggcagctcctgaccaaag

SEQ ID NO: 2683838 - DNA, 21 bp, Homo sapiens
taagtacttgctctctgagag

SEQ ID NO: 2683839 - DNA, 17 bp, Homo sapiens
taatacttcatttggtg

SEQ ID NO: 2683840 - DNA, 17 bp, Homo sapiens
taatatctgagaagtgt

SEQ ID NO: 2683841 - DNA, 21 bp, Homo sapiens
taatatctgagaagtgtatat

SEQ ID NO: 2683842 - DNA, 21 bp, Homo sapiens
taatgaaaaggaagttaatac

SEQ ID NO: 2683843 - DNA, 12 bp, Homo sapiens
taatgattgttt

SEQ ID NO: 2683844 - DNA, 16 bp, Homo sapiens
taatgcttcaagtgtt

SEQ ID NO: 2683845 - DNA, 23 bp, Homo sapiens
taatgcttcaagtgttgctcttg

SEQ ID NO: 2683846 - DNA, 19 bp, Homo sapiens
taatgtacaagttttgtat

SEQ ID NO: 2683847 - DNA, 20 bp, Homo sapiens
taattggaagaaattcctgt

SEQ ID NO: 2683848 - DNA, 16 bp, Homo sapiens
taattttttttaatgt

SEQ ID NO: 2683849 - DNA, 18 bp, Homo sapiens
tacaaaaaactgcagttt

SEQ ID NO: 2683850 - DNA, 13 bp, Homo sapiens
tacaagttttgta

SEQ ID NO: 2683851 - DNA, 14 bp, Homo sapiens
tacaagttttgtat

SEQ ID NO: 2683852 - DNA, 10 bp, Homo sapiens
tacaataaat

SEQ ID NO: 2683853 - DNA, 17 bp, Homo sapiens
tacaataaatgctgaat

SEQ ID NO: 2683854 - DNA, 13 bp, Homo sapiens
tacaatgtgactt

SEQ ID NO: 2683855 - DNA, 17 bp, Homo sapiens
tacaatgtgactttgaa

SEQ ID NO: 2683856 - DNA, 17 bp, Homo sapiens
tacactccagcctgagc

SEQ ID NO: 2683857 - DNA, 18 bp, Homo sapiens
tacactccagcctgagca

SEQ ID NO: 2683858 - DNA, 13 bp, Homo sapiens
tacagaatgaatc

SEQ ID NO: 2683859 - DNA, 18 bp, Homo sapiens
tacatatttacctgtatt

SEQ ID NO: 2683860 - DNA, 17 bp, Homo sapiens
tacatgctgtgctcttt

SEQ ID NO: 2683861 - DNA, 17 bp, Homo sapiens
taccaccccttcctgtc

SEQ ID NO: 2683862 - DNA, 16 bp, Homo sapiens
taccagtgaaccaaag

SEQ ID NO: 2683863 - DNA, 13 bp, Homo sapiens
tacccactctttg

SEQ ID NO: 2683864 - DNA, 14 bp, Homo sapiens
tacccactctttgc

SEQ ID NO: 2683865 - DNA, 22 bp, Homo sapiens
tacccactctttgctacaataa

SEQ ID NO: 2683866 - DNA, 16 bp, Homo sapiens
tacccagctgatgggg

SEQ ID NO: 2683867 - DNA, 11 bp, Homo sapiens
tacctcagcct

SEQ ID NO: 2683868 - DNA, 13 bp, Homo sapiens
tacctgcaggctc

SEQ ID NO: 2683869 - DNA, 20 bp, Homo sapiens
tacctgcaggctccatgcac

SEQ ID NO: 2683870 - DNA, 19 bp, Homo sapiens
tacctgtatttaagatttt

SEQ ID NO: 2683871 - DNA, 18 bp, Homo sapiens
tactctagcctgggccag

SEQ ID NO: 2683872 - DNA, 17 bp, Homo sapiens
tactgtagctgatgaaa

SEQ ID NO: 2683873 - DNA, 22 bp, Homo sapiens
tacttcacccggctgggctcct

SEQ ID NO: 2683874 - DNA, 12 bp, Homo sapiens
tacttcctggga

SEQ ID NO: 2683875 - DNA, 14 bp, Homo sapiens
tacttgctctctga

SEQ ID NO: 2683876 - DNA, 15 bp, Homo sapiens
tacttgctctctgag

SEQ ID NO: 2683877 - DNA, 14 bp, Homo sapiens
tagaacacccactg

SEQ ID NO: 2683878 - DNA, 16 bp, Homo sapiens
tagaacacccactggc

SEQ ID NO: 2683879 - DNA, 19 bp, Homo sapiens
tagaacaggacctctgctt

SEQ ID NO: 2683880 - DNA, 11 bp, Homo sapiens
tagaaggccac

SEQ ID NO: 2683881 - DNA, 15 bp, Homo sapiens
tagaatcgctttcct

SEQ ID NO: 2683882 - DNA, 21 bp, Homo sapiens
tagaatcgctttccttcctcc

SEQ ID NO: 2683883 - DNA, 18 bp, Homo sapiens
tagaattgcaatctataa

SEQ ID NO: 2683884 - DNA, 22 bp, Homo sapiens
tagagactaaggggcagctcct

SEQ ID NO: 2683885 - DNA, 17 bp, Homo sapiens
tagagatgactgagtcc

SEQ ID NO: 2683886 - DNA, 14 bp, Homo sapiens
tagagctcctgtcc

SEQ ID NO: 2683887 - DNA, 14 bp, Homo sapiens
tagattagctctgg

SEQ ID NO: 2683888 - DNA, 16 bp, Homo sapiens
tagattagctctggac

SEQ ID NO: 2683889 - DNA, 13 bp, Homo sapiens
tagcatcttctgg

SEQ ID NO: 2683890 - DNA, 16 bp, Homo sapiens
tagcatcttctggagt

SEQ ID NO: 2683891 - DNA, 21 bp, Homo sapiens
tagccaaggtgggctgagccc

SEQ ID NO: 2683892 - DNA, 14 bp, Homo sapiens
tagccagtgacttt

SEQ ID NO: 2683893 - DNA, 23 bp, Homo sapiens
tagcccgacagttctgaactgga

SEQ ID NO: 2683894 - DNA, 13 bp, Homo sapiens
tagcctgggccag

SEQ ID NO: 2683895 - DNA, 15 bp, Homo sapiens
tagctacttttcaga

SEQ ID NO: 2683896 - DNA, 17 bp, Homo sapiens
tagctgaacaatgaatg

SEQ ID NO: 2683897 - DNA, 13 bp, Homo sapiens
tagctttctcagg

SEQ ID NO: 2683898 - DNA, 15 bp, Homo sapiens
tagctttgttgtcct

SEQ ID NO: 2683899 - DNA, 15 bp, Homo sapiens
taggactctgaggct

SEQ ID NO: 2683900 - DNA, 16 bp, Homo sapiens
taggactctgaggctc

SEQ ID NO: 2683901 - DNA, 23 bp, Homo sapiens
taggagttcgagaccagcctggc

SEQ ID NO: 2683902 - DNA, 17 bp, Homo sapiens
tgctctgaggcttccag

SEQ ID NO: 2683903 - DNA, 20 bp, Homo sapiens
tgctctgcttcctcagggcc

SEQ ID NO: 2683904 - DNA, 17 bp, Homo sapiens
tgctcttggaaagctga

SEQ ID NO: 2683905 - DNA, 18 bp, Homo sapiens
tgctcttggaaagctgat

SEQ ID NO: 2683906 - DNA, 13 bp, Homo sapiens
tgctctttctctg

SEQ ID NO: 2683907 - DNA, 13 bp, Homo sapiens
tgctgaatgaatc

SEQ ID NO: 2683908 - DNA, 15 bp, Homo sapiens
tgctgaggactccct

SEQ ID NO: 2683909 - DNA, 19 bp, Homo sapiens
tgctgatggcccctccagc

SEQ ID NO: 2683910 - DNA, 20 bp, Homo sapiens
tgctgatggcccctccagca

SEQ ID NO: 2683911 - DNA, 22 bp, Homo sapiens
tgctgatggcccctccagcaca

SEQ ID NO: 2683912 - DNA, 22 bp, Homo sapiens
tgctgatggccctcatctccag

SEQ ID NO: 2683913 - DNA, 12 bp, Homo sapiens
tgctgccagctg

SEQ ID NO: 2683914 - DNA, 13 bp, Homo sapiens
tgctgccagctgc

SEQ ID NO: 2683915 - DNA, 14 bp, Homo sapiens
tgctgcctgagtca

SEQ ID NO: 2683916 - DNA, 18 bp, Homo sapiens
tgctgcgggggagccagt

SEQ ID NO: 2683917 - DNA, 21 bp, Homo sapiens
tgctgcgggggagccagttct

SEQ ID NO: 2683918 - DNA, 19 bp, Homo sapiens
tgctggacggcattcctgc

SEQ ID NO: 2683919 - DNA, 20 bp, Homo sapiens
tgctggacggcattcctgct

SEQ ID NO: 2683920 - DNA, 19 bp, Homo sapiens
tgctggcaggattcttccc

SEQ ID NO: 2683921 - DNA, 10 bp, Homo sapiens
tgctggcctg

SEQ ID NO: 2683922 - DNA, 14 bp, Homo sapiens
tgctggcctggccc

SEQ ID NO: 2683923 - DNA, 16 bp, Homo sapiens
tgctggcctggccctt

SEQ ID NO: 2683924 - DNA, 17 bp, Homo sapiens
tgctggcctggcccttg

SEQ ID NO: 2683925 - DNA, 16 bp, Homo sapiens
tgctgggacccacctc

SEQ ID NO: 2683926 - DNA, 21 bp, Homo sapiens
tgctgggacccacctccccct

SEQ ID NO: 2683927 - DNA, 18 bp, Homo sapiens
tgctgtgctctttgaaga

SEQ ID NO: 2683928 - DNA, 12 bp, Homo sapiens
tgcttaaaagac

SEQ ID NO: 2683929 - DNA, 16 bp, Homo sapiens
tgcttcaagtgttgct

SEQ ID NO: 2683930 - DNA, 23 bp, Homo sapiens
tgcttcagcctgaggctgagact

SEQ ID NO: 2683931 - DNA, 21 bp, Homo sapiens
tgcttccgcctttccggggct

SEQ ID NO: 2683932 - DNA, 12 bp, Homo sapiens
tgcttcctgaaa

SEQ ID NO: 2683933 - DNA, 17 bp, Homo sapiens
tgcttcctgaaagctgt

SEQ ID NO: 2683934 - DNA, 21 bp, Homo sapiens
tgcttcctgaaagctgttgga

SEQ ID NO: 2683935 - DNA, 15 bp, Homo sapiens
tgctttatttgtgaa

SEQ ID NO: 2683936 - DNA, 14 bp, Homo sapiens
tgctttcttctctg

SEQ ID NO: 2683937 - DNA, 15 bp, Homo sapiens
tgctttcttctctgc

SEQ ID NO: 2683938 - DNA, 17 bp, Homo sapiens
tgctttcttctctgcct

SEQ ID NO: 2683939 - DNA, 12 bp, Homo sapiens
tgctttgatata

SEQ ID NO: 2683940 - DNA, 13 bp, Homo sapiens
tgcttttgtaact

SEQ ID NO: 2683941 - DNA, 19 bp, Homo sapiens
tgcttttgttgtgactttt

SEQ ID NO: 2683942 - DNA, 16 bp, Homo sapiens
tggaaagcctctgctg

SEQ ID NO: 2683943 - DNA, 20 bp, Homo sapiens
tggaaaggctcagtctcagg

SEQ ID NO: 2683944 - DNA, 23 bp, Homo sapiens
tggaaaggctcagtctcaggagc

SEQ ID NO: 2683945 - DNA, 14 bp, Homo sapiens
tggacacctgccct

SEQ ID NO: 2683946 - DNA, 23 bp, Homo sapiens
tggacacctgccctgccctgcca

SEQ ID NO: 2683947 - DNA, 16 bp, Homo sapiens
tggacagtcctgggag

SEQ ID NO: 2683948 - DNA, 14 bp, Homo sapiens
tggaccaaagccac

SEQ ID NO: 2683949 - DNA, 15 bp, Homo sapiens
tggaccaaagccacc

SEQ ID NO: 2683950 - DNA, 17 bp, Homo sapiens
tggacctctgctctgag

SEQ ID NO: 2683951 - DNA, 12 bp, Homo sapiens
tggaccttcctg

SEQ ID NO: 2683952 - DNA, 13 bp, Homo sapiens
tggaccttcctgc

SEQ ID NO: 2683953 - DNA, 19 bp, Homo sapiens
tggactgactgcagccccc

SEQ ID NO: 2683954 - DNA, 23 bp, Homo sapiens
tggagaaataaaaatacctcttt

SEQ ID NO: 2683955 - DNA, 14 bp, Homo sapiens
tggagactctgtgg

SEQ ID NO: 2683956 - DNA, 19 bp, Homo sapiens
tggagactctgtggggcct

SEQ ID NO: 2683957 - DNA, 11 bp, Homo sapiens
tggagcatctg

SEQ ID NO: 2683958 - DNA, 15 bp, Homo sapiens
tggagcccttgggtt

SEQ ID NO: 2683959 - DNA, 21 bp, Homo sapiens
tggagcgcacctgccccctgg

SEQ ID NO: 2683960 - DNA, 14 bp, Homo sapiens
tggaggtgccagga

SEQ ID NO: 2683961 - DNA, 20 bp, Homo sapiens
tggatcatgaggtcaggaga

SEQ ID NO: 2683962 - DNA, 22 bp, Homo sapiens
tggatggcatctagccagaggc

SEQ ID NO: 2683963 - DNA, 17 bp, Homo sapiens
tggatggtctccacctg

SEQ ID NO: 2683964 - DNA, 20 bp, Homo sapiens
tggatggtctccacctgtgc

SEQ ID NO: 2683965 - DNA, 21 bp, Homo sapiens
tggatggtctccacctgtgct

SEQ ID NO: 2683966 - DNA, 15 bp, Homo sapiens
tggatttttaaatta

SEQ ID NO: 2683967 - DNA, 16 bp, Homo sapiens
tggcaattgtccccag

SEQ ID NO: 2683968 - DNA, 22 bp, Homo sapiens
tggcagaacgatgcctgcaggc

SEQ ID NO: 2683969 - DNA, 11 bp, Homo sapiens
tggcagccctg

SEQ ID NO: 2683970 - DNA, 12 bp, Homo sapiens
tggcagccctgt

SEQ ID NO: 2683971 - DNA, 14 bp, Homo sapiens
tggcagccctgtag

SEQ ID NO: 2683972 - DNA, 17 bp, Homo sapiens
tggcagccctgtaggga

SEQ ID NO: 2683973 - DNA, 16 bp, Homo sapiens
tggcaggagcctcgtg

SEQ ID NO: 2683974 - DNA, 20 bp, Homo sapiens
tggcaggattcttcccgctc

SEQ ID NO: 2683975 - DNA, 15 bp, Homo sapiens
tggcatcacagggca

SEQ ID NO: 2683976 - DNA, 18 bp, Homo sapiens
tggcatcacagggcagag

SEQ ID NO: 2683977 - DNA, 21 bp, Homo sapiens
tggccaggaggttggtgactg

SEQ ID NO: 2683978 - DNA, 20 bp, Homo sapiens
tggccagtcctagagctcct

SEQ ID NO: 2683979 - DNA, 16 bp, Homo sapiens
tggccagtgtgatccc

SEQ ID NO: 2683980 - DNA, 14 bp, Homo sapiens
tggccccaggtgcc

SEQ ID NO: 2683981 - DNA, 18 bp, Homo sapiens
tggccccaggtgccacca

SEQ ID NO: 2683982 - DNA, 23 bp, Homo sapiens
tggccccaggtgccaccaataaa

SEQ ID NO: 2683983 - DNA, 13 bp, Homo sapiens
tggccctcatctc

SEQ ID NO: 2683984 - DNA, 22 bp, Homo sapiens
tggcctctagaacacccactgg

SEQ ID NO: 2683985 - DNA, 16 bp, Homo sapiens
tggcctctggccaggc

SEQ ID NO: 2683986 - DNA, 13 bp, Homo sapiens
tggcctgcgggga

SEQ ID NO: 2683987 - DNA, 11 bp, Homo sapiens
tggcctgggca

SEQ ID NO: 2683988 - DNA, 23 bp, Homo sapiens
tggccttcgtctccatctctggt

SEQ ID NO: 2683989 - DNA, 18 bp, Homo sapiens
tggcgtgtccctctcgga

SEQ ID NO: 2683990 - DNA, 18 bp, Homo sapiens
tggctgctccctgctccc

SEQ ID NO: 2683991 - DNA, 20 bp, Homo sapiens
tggctgctccctgctcccag

SEQ ID NO: 2683992 - DNA, 18 bp, Homo sapiens
tggctggagtctcagagc

SEQ ID NO: 2683993 - DNA, 21 bp, Homo sapiens
tggcttatgctcagaagccag

SEQ ID NO: 2683994 - DNA, 22 bp, Homo sapiens
tggcttccagaaaaccccagca

SEQ ID NO: 2683995 - DNA, 23 bp, Homo sapiens
tggcttccagaaaaccccagcat

SEQ ID NO: 2683996 - DNA, 14 bp, Homo sapiens
tggcttctgggaga

SEQ ID NO: 2683997 - DNA, 17 bp, Homo sapiens
tggcttgtcggagcaag

SEQ ID NO: 2683998 - DNA, 17 bp, Homo sapiens
tgggacccacctccccc

SEQ ID NO: 2683999 - DNA, 23 bp, Homo sapiens
tgggactggccaggtttctgccc

SEQ ID NO: 2684000 - DNA, 18 bp, Homo sapiens
tgggaggctgaggcagga

SEQ ID NO: 2684001 - DNA, 15 bp, Homo sapiens
tgggaggctgaggcg

SEQ ID NO: 2684002 - DNA, 13 bp, Homo sapiens
tgggccagagaag

SEQ ID NO: 2684003 - DNA, 12 bp, Homo sapiens
tgggctctgccc

SEQ ID NO: 2684004 - DNA, 15 bp, Homo sapiens
tgggctctgccccag

SEQ ID NO: 2684005 - DNA, 17 bp, Homo sapiens
tggggataaaggagaag

SEQ ID NO: 2684006 - DNA, 16 bp, Homo sapiens
tggggattcagatttc

SEQ ID NO: 2684007 - DNA, 14 bp, Homo sapiens
tggggcccgcctgc

SEQ ID NO: 2684008 - DNA, 18 bp, Homo sapiens
tggggcccgcctgccacc

SEQ ID NO: 2684009 - DNA, 13 bp, Homo sapiens
tggggcctgccct

SEQ ID NO: 2684010 - DNA, 13 bp, Homo sapiens
tggggctcccggc

SEQ ID NO: 2684011 - DNA, 21 bp, Homo sapiens
tggggctcccggcatcctgaa

SEQ ID NO: 2684012 - DNA, 21 bp, Homo sapiens
ttttctgttgtacgtaaagct

SEQ ID NO: 2684013 - DNA, 20 bp, Homo sapiens
ttttcttttaagccctgctc

SEQ ID NO: 2684014 - DNA, 12 bp, Homo sapiens
ttttgattgaag

SEQ ID NO: 2684015 - DNA, 22 bp, Homo sapiens
ttttgcacaccttttccccagg

SEQ ID NO: 2684016 - DNA, 14 bp, Homo sapiens
ttttgtacaattac

SEQ ID NO: 2684017 - DNA, 18 bp, Homo sapiens
ttttgtattctttactaa

SEQ ID NO: 2684018 - DNA, 15 bp, Homo sapiens
ttttgtcctgttatt

SEQ ID NO: 2684019 - DNA, 14 bp, Homo sapiens
ttttgttatagaat

SEQ ID NO: 2684020 - DNA, 16 bp, Homo sapiens
ttttgttatagaatac

SEQ ID NO: 2684021 - DNA, 14 bp, Homo sapiens
tttttaaaaaactt

SEQ ID NO: 2684022 - DNA, 17 bp, Homo sapiens
aattgcttaaaagacat

SEQ ID NO: 2684023 - DNA, 16 bp, Homo sapiens
aattgcttttgttgtg

SEQ ID NO: 2684024 - DNA, 22 bp, Homo sapiens
aattgcttttgttgtgactttt

SEQ ID NO: 2684025 - DNA, 13 bp, Homo sapiens
aattgtatacatt

SEQ ID NO: 2684026 - DNA, 14 bp, Homo sapiens
aattgtatacattt

SEQ ID NO: 2684027 - DNA, 21 bp, Homo sapiens
aattgtatacattttgttata

SEQ ID NO: 2684028 - DNA, 16 bp, Homo sapiens
aatttattaagtctgg

SEQ ID NO: 2684029 - DNA, 18 bp, Homo sapiens
aatttcccctaatctttt

SEQ ID NO: 2684030 - DNA, 18 bp, Homo sapiens
aattttactgacagaaat

SEQ ID NO: 2684031 - DNA, 19 bp, Homo sapiens
aattttttttaatgtacaa

SEQ ID NO: 2684032 - DNA, 20 bp, Homo sapiens
acaaaccatctggtgccttt

SEQ ID NO: 2684033 - DNA, 19 bp, Homo sapiens
acaagattgtcattagtga

SEQ ID NO: 2684034 - DNA, 13 bp, Homo sapiens
acaagcggccctg

SEQ ID NO: 2684035 - DNA, 17 bp, Homo sapiens
acaagtcttgctgtgct

SEQ ID NO: 2684036 - DNA, 12 bp, Homo sapiens
acaagttttgta

SEQ ID NO: 2684037 - DNA, 17 bp, Homo sapiens
acaatgtgactttgaaa

SEQ ID NO: 2684038 - DNA, 20 bp, Homo sapiens
acaatgtgactttgaaaata

SEQ ID NO: 2684039 - DNA, 15 bp, Homo sapiens
acacaagccacagaa

SEQ ID NO: 2684040 - DNA, 12 bp, Homo sapiens
acacaagcggcc

SEQ ID NO: 2684041 - DNA, 14 bp, Homo sapiens
acacagttttgaaa

SEQ ID NO: 2684042 - DNA, 11 bp, Homo sapiens
acacccactgg

SEQ ID NO: 2684043 - DNA, 12 bp, Homo sapiens
acacccactggc

SEQ ID NO: 2684044 - DNA, 13 bp, Homo sapiens
acacccactggcc

SEQ ID NO: 2684045 - DNA, 13 bp, Homo sapiens
acacctgccctgc

SEQ ID NO: 2684046 - DNA, 15 bp, Homo sapiens
acacctgccctgccc

SEQ ID NO: 2684047 - DNA, 20 bp, Homo sapiens
acacctgccctgccctgcca

SEQ ID NO: 2684048 - DNA, 15 bp, Homo sapiens
acaccttttccccag

SEQ ID NO: 2684049 - DNA, 16 bp, Homo sapiens
acacggccctcctggg

SEQ ID NO: 2684050 - DNA, 18 bp, Homo sapiens
acacggccctcctgggaa

SEQ ID NO: 2684051 - DNA, 18 bp, Homo sapiens
acactaagctctctgggc

SEQ ID NO: 2684052 - DNA, 21 bp, Homo sapiens
acactaagctctctgggcctg

SEQ ID NO: 2684053 - DNA, 16 bp, Homo sapiens
acactccagcctgagc

SEQ ID NO: 2684054 - DNA, 17 bp, Homo sapiens
acactggtttgccaggc

SEQ ID NO: 2684055 - DNA, 13 bp, Homo sapiens
acactgtgaccct

SEQ ID NO: 2684056 - DNA, 17 bp, Homo sapiens
acactgtgaccctgggt

SEQ ID NO: 2684057 - DNA, 17 bp, Homo sapiens
acagaaattagccgggc

SEQ ID NO: 2684058 - DNA, 18 bp, Homo sapiens
acagaactggcaggagcc

SEQ ID NO: 2684059 - DNA, 18 bp, Homo sapiens
acagaagccaggagcaaa

SEQ ID NO: 2684060 - DNA, 21 bp, Homo sapiens
acagaagccaggagcaaatgt

SEQ ID NO: 2684061 - DNA, 14 bp, Homo sapiens
acagaccagcagca

SEQ ID NO: 2684062 - DNA, 17 bp, Homo sapiens
acagccgcagaagggga

SEQ ID NO: 2684063 - DNA, 13 bp, Homo sapiens
acagccgcagcct

SEQ ID NO: 2684064 - DNA, 20 bp, Homo sapiens
acagctcacctctgaaggca

SEQ ID NO: 2684065 - DNA, 17 bp, Homo sapiens
acaggacagtgcttcag

SEQ ID NO: 2684066 - DNA, 14 bp, Homo sapiens
acaggacctctgct

SEQ ID NO: 2684067 - DNA, 22 bp, Homo sapiens
acaggctgtgccttggtttcct

SEQ ID NO: 2684068 - DNA, 17 bp, Homo sapiens
acaggtcgagctgtgct

SEQ ID NO: 2684069 - DNA, 20 bp, Homo sapiens
acaggtcgagctgtgctcgg

SEQ ID NO: 2684070 - DNA, 21 bp, Homo sapiens
acagtcctgggagaacctcag

SEQ ID NO: 2684071 - DNA, 23 bp, Homo sapiens
acagtcctgggagaacctcaggc

SEQ ID NO: 2684072 - DNA, 15 bp, Homo sapiens
acagtgaggctggga

SEQ ID NO: 2684073 - DNA, 20 bp, Homo sapiens
acagtgcttcagcctgaggc

SEQ ID NO: 2684074 - DNA, 22 bp, Homo sapiens
acagtgcttcagcctgaggctg

SEQ ID NO: 2684075 - DNA, 14 bp, Homo sapiens
acataaaatctgtg

SEQ ID NO: 2684076 - DNA, 17 bp, Homo sapiens
acataaaatctgtgaat

SEQ ID NO: 2684077 - DNA, 12 bp, Homo sapiens
acataaaggtat

SEQ ID NO: 2684078 - DNA, 22 bp, Homo sapiens
acatataaaagttaaactactt

SEQ ID NO: 2684079 - DNA, 13 bp, Homo sapiens
acatatatgtata

SEQ ID NO: 2684080 - DNA, 16 bp, Homo sapiens
acatatttacctgtat

SEQ ID NO: 2684081 - DNA, 23 bp, Homo sapiens
acatcccaggaggggcctctgaa

SEQ ID NO: 2684082 - DNA, 18 bp, Homo sapiens
acatgctgtgctctttga

SEQ ID NO: 2684083 - DNA, 23 bp, Homo sapiens
acatgctgtgctctttgaagaga

SEQ ID NO: 2684084 - DNA, 23 bp, Homo sapiens
acatgtcaccgtggaccttcctg

SEQ ID NO: 2684085 - DNA, 19 bp, Homo sapiens
acattttgttatagaatac

SEQ ID NO: 2684086 - DNA, 21 bp, Homo sapiens
acatttttatttagttgaaaa

SEQ ID NO: 2684087 - DNA, 15 bp, Homo sapiens
accaaaagatgcctt

SEQ ID NO: 2684088 - DNA, 22 bp, Homo sapiens
accaaagacgatacagcttggc

SEQ ID NO: 2684089 - DNA, 16 bp, Homo sapiens
accaaagccacctgct

SEQ ID NO: 2684090 - DNA, 19 bp, Homo sapiens
accaaagccacctgctgcg

SEQ ID NO: 2684091 - DNA, 21 bp, Homo sapiens
accaaatgagcattagctact

SEQ ID NO: 2684092 - DNA, 17 bp, Homo sapiens
accaaccctgtttcctg

SEQ ID NO: 2684093 - DNA, 12 bp, Homo sapiens
accaataaaaat

SEQ ID NO: 2684094 - DNA, 15 bp, Homo sapiens
accaatctctaagcc

SEQ ID NO: 2684095 - DNA, 23 bp, Homo sapiens
accacctctcaatattcaataaa

SEQ ID NO: 2684096 - DNA, 17 bp, Homo sapiens
accactaggactctgag

SEQ ID NO: 2684097 - DNA, 19 bp, Homo sapiens
accagaaccagtctttcaa

SEQ ID NO: 2684098 - DNA, 13 bp, Homo sapiens
accagactgtgga

SEQ ID NO: 2684099 - DNA, 11 bp, Homo sapiens
accagcctggc

SEQ ID NO: 2684100 - DNA, 20 bp, Homo sapiens
accagcctggccaacatggt

SEQ ID NO: 2684101 - DNA, 20 bp, Homo sapiens
accagcctggtgcccatcct

SEQ ID NO: 2684102 - DNA, 14 bp, Homo sapiens
accagcctgttgga

SEQ ID NO: 2684103 - DNA, 17 bp, Homo sapiens
accagctctcttcctgt

SEQ ID NO: 2684104 - DNA, 21 bp, Homo sapiens
aactcctgattttgtagttaa

SEQ ID NO: 2684105 - DNA, 17 bp, Homo sapiens
aactccttattttgtat

SEQ ID NO: 2684106 - DNA, 15 bp, Homo sapiens
aactgatcctgctcc

SEQ ID NO: 2684107 - DNA, 22 bp, Homo sapiens
aactggctgctccctgctccca

SEQ ID NO: 2684108 - DNA, 20 bp, Homo sapiens
aactggggttcaagcccagg

SEQ ID NO: 2684109 - DNA, 21 bp, Homo sapiens
aactggggttcaagcccaggc

SEQ ID NO: 2684110 - DNA, 14 bp, Homo sapiens
aactggtgatatat

SEQ ID NO: 2684111 - DNA, 21 bp, Homo sapiens
aactgttatcacttatatata

SEQ ID NO: 2684112 - DNA, 17 bp, Homo sapiens
aacttccttgcccctgc

SEQ ID NO: 2684113 - DNA, 18 bp, Homo sapiens
aacttccttgcccctgct

SEQ ID NO: 2684114 - DNA, 20 bp, Homo sapiens
aacttccttgcccctgctct

SEQ ID NO: 2684115 - DNA, 14 bp, Homo sapiens
aacttgaggacaca

SEQ ID NO: 2684116 - DNA, 15 bp, Homo sapiens
aacttgaggacacat

SEQ ID NO: 2684117 - DNA, 16 bp, Homo sapiens
aacttgaggacacatg

SEQ ID NO: 2684118 - DNA, 20 bp, Homo sapiens
aacttgtgtactgataaaat

SEQ ID NO: 2684119 - DNA, 15 bp, Homo sapiens
aagaaacctggaacc

SEQ ID NO: 2684120 - DNA, 13 bp, Homo sapiens
aagaaataaaaat

SEQ ID NO: 2684121 - DNA, 17 bp, Homo sapiens
aagaactccttattttg

SEQ ID NO: 2684122 - DNA, 20 bp, Homo sapiens
aagaactccttattttgtat

SEQ ID NO: 2684123 - DNA, 19 bp, Homo sapiens
aagaagaccagactgtgga

SEQ ID NO: 2684124 - DNA, 13 bp, Homo sapiens
aagaccccatctc

SEQ ID NO: 2684125 - DNA, 17 bp, Homo sapiens
aagacgatacagcttgg

SEQ ID NO: 2684126 - DNA, 13 bp, Homo sapiens
aagacttttaaaa

SEQ ID NO: 2684127 - DNA, 14 bp, Homo sapiens
aagagactggagca

SEQ ID NO: 2684128 - DNA, 18 bp, Homo sapiens
aagagactggagcatctg

SEQ ID NO: 2684129 - DNA, 17 bp, Homo sapiens
aagagagtggggcctgc

SEQ ID NO: 2684130 - DNA, 17 bp, Homo sapiens
aagagtagaacccaggt

SEQ ID NO: 2684131 - DNA, 20 bp, Homo sapiens
aagatatcagagctcttaat

SEQ ID NO: 2684132 - DNA, 22 bp, Homo sapiens
aagatggactctgaaaaacatt

SEQ ID NO: 2684133 - DNA, 16 bp, Homo sapiens
aagatgtcagactggc

SEQ ID NO: 2684134 - DNA, 14 bp, Homo sapiens
aagattatatatca

SEQ ID NO: 2684135 - DNA, 15 bp, Homo sapiens
aagattatatatcat

SEQ ID NO: 2684136 - DNA, 13 bp, Homo sapiens
aagcacagctggg

SEQ ID NO: 2684137 - DNA, 22 bp, Homo sapiens
aagcaggttgaggggctcctgg

SEQ ID NO: 2684138 - DNA, 23 bp, Homo sapiens
aagcatcacctcaggccaggtgc

SEQ ID NO: 2684139 - DNA, 14 bp, Homo sapiens
aagccaaactctgc

SEQ ID NO: 2684140 - DNA, 17 bp, Homo sapiens
aagccactgaagctggg

SEQ ID NO: 2684141 - DNA, 11 bp, Homo sapiens
aagccctgctc

SEQ ID NO: 2684142 - DNA, 17 bp, Homo sapiens
aagccctgctctttctc

SEQ ID NO: 2684143 - DNA, 19 bp, Homo sapiens
aagccctgctctttctctg

SEQ ID NO: 2684144 - DNA, 11 bp, Homo sapiens
aagcctctgct

SEQ ID NO: 2684145 - DNA, 15 bp, Homo sapiens
aagcctgaggctggg

SEQ ID NO: 2684146 - DNA, 18 bp, Homo sapiens
aagcgagatcccatctct

SEQ ID NO: 2684147 - DNA, 14 bp, Homo sapiens
aagctataaattat

SEQ ID NO: 2684148 - DNA, 16 bp, Homo sapiens
aagctctctgggcctg

SEQ ID NO: 2684149 - DNA, 17 bp, Homo sapiens
aagctctgccctggctg

SEQ ID NO: 2684150 - DNA, 21 bp, Homo sapiens
aagctgatgatgtctcttgta

SEQ ID NO: 2684151 - DNA, 14 bp, Homo sapiens
aagctgctttcttc

SEQ ID NO: 2684152 - DNA, 16 bp, Homo sapiens
aaggaaggttttctcc

SEQ ID NO: 2684153 - DNA, 21 bp, Homo sapiens
aaggctatgaagggacagctg

SEQ ID NO: 2684154 - DNA, 17 bp, Homo sapiens
aaggctcagtctcagga

SEQ ID NO: 2684155 - DNA, 21 bp, Homo sapiens
aaggggccctggtccttccag

SEQ ID NO: 2684156 - DNA, 18 bp, Homo sapiens
aaggtgggctgagccctg

SEQ ID NO: 2684157 - DNA, 21 bp, Homo sapiens
aaggtgggctgagccctggca

SEQ ID NO: 2684158 - DNA, 18 bp, Homo sapiens
aagtaactggtgatatat

SEQ ID NO: 2684159 - DNA, 17 bp, Homo sapiens
aagtaccactcaggcca

SEQ ID NO: 2684160 - DNA, 17 bp, Homo sapiens
aagtacttgctctctga

SEQ ID NO: 2684161 - DNA, 14 bp, Homo sapiens
aagtagtagtgtct

SEQ ID NO: 2684162 - DNA, 17 bp, Homo sapiens
aagtcagactgctggga

SEQ ID NO: 2684163 - DNA, 20 bp, Homo sapiens
aagtcagctttcagagccag

SEQ ID NO: 2684164 - DNA, 15 bp, Homo sapiens
aagtctccctgcaca

SEQ ID NO: 2684165 - DNA, 15 bp, Homo sapiens
aagtctgctcattcc

SEQ ID NO: 2684166 - DNA, 18 bp, Homo sapiens
aagtctgggatgtagaac

SEQ ID NO: 2684167 - DNA, 12 bp, Homo sapiens
aagtcttgctgt

SEQ ID NO: 2684168 - DNA, 16 bp, Homo sapiens
aagtcttgctgtgctt

SEQ ID NO: 2684169 - DNA, 14 bp, Homo sapiens
aagtggttttaata

SEQ ID NO: 2684170 - DNA, 19 bp, Homo sapiens
aagtgttcaagaaataaaa

SEQ ID NO: 2684171 - DNA, 21 bp, Homo sapiens
aagtgttcaagaaataaaaat

SEQ ID NO: 2684172 - DNA, 14 bp, Homo sapiens
aagttagctcagga

SEQ ID NO: 2684173 - DNA, 15 bp, Homo sapiens
aagttagctcaggag

SEQ ID NO: 2684174 - DNA, 12 bp, Homo sapiens
aagttatattta

SEQ ID NO: 2684175 - DNA, 17 bp, Homo sapiens
aagttcatgtttgtaaa

SEQ ID NO: 2684176 - DNA, 21 bp, Homo sapiens
aagttgaatggcctgccttga

SEQ ID NO: 2684177 - DNA, 13 bp, Homo sapiens
aagttttgatgaa

SEQ ID NO: 2684178 - DNA, 22 bp, Homo sapiens
aagttttgtataaataataaag

SEQ ID NO: 2684179 - DNA, 22 bp, Homo sapiens
aataaagaactccttattttgt

SEQ ID NO: 2684180 - DNA, 12 bp, Homo sapiens
aataaatgctga

SEQ ID NO: 2684181 - DNA, 18 bp, Homo sapiens
aataaatgttctcgtttt

SEQ ID NO: 2684182 - DNA, 17 bp, Homo sapiens
aataagcactttttaaa

SEQ ID NO: 2684183 - DNA, 18 bp, Homo sapiens
aataatagattgtgaata

SEQ ID NO: 2684184 - DNA, 20 bp, Homo sapiens
aataccagtgaaccaaagag

SEQ ID NO: 2684185 - DNA, 17 bp, Homo sapiens
aatacttttttctagtt

SEQ ID NO: 2684186 - DNA, 16 bp, Homo sapiens
aatagatgtgatcact

SEQ ID NO: 2684187 - DNA, 13 bp, Homo sapiens
aatagctctactg

SEQ ID NO: 2684188 - DNA, 18 bp, Homo sapiens
aatagggctaggaatata

SEQ ID NO: 2684189 - DNA, 15 bp, Homo sapiens
aatatagattaaatc

SEQ ID NO: 2684190 - DNA, 18 bp, Homo sapiens
aatatctgagaagtgtat

SEQ ID NO: 2684191 - DNA, 21 bp, Homo sapiens
agcctcgtgtcctgctagctg

SEQ ID NO: 2684192 - DNA, 14 bp, Homo sapiens
agcctctgctgcca

SEQ ID NO: 2684193 - DNA, 19 bp, Homo sapiens
agcctgaagatcagagctg

SEQ ID NO: 2684194 - DNA, 22 bp, Homo sapiens
agcctgaagatcagagctgcag

SEQ ID NO: 2684195 - DNA, 17 bp, Homo sapiens
agcctgaggctgagact

SEQ ID NO: 2684196 - DNA, 15 bp, Homo sapiens
agcctggcttctgga

SEQ ID NO: 2684197 - DNA, 23 bp, Homo sapiens
agcctggcttctggagcccttgg

SEQ ID NO: 2684198 - DNA, 13 bp, Homo sapiens
agcctgggccaga

SEQ ID NO: 2684199 - DNA, 14 bp, Homo sapiens
agcctgttggaccc

SEQ ID NO: 2684200 - DNA, 21 bp, Homo sapiens
agccttaaggtagaaggcaca

SEQ ID NO: 2684201 - DNA, 21 bp, Homo sapiens
agccttgcccggattctggga

SEQ ID NO: 2684202 - DNA, 21 bp, Homo sapiens
agcgagttgtggaaagcctct

SEQ ID NO: 2684203 - DNA, 12 bp, Homo sapiens
agcgcacctgcc

SEQ ID NO: 2684204 - DNA, 21 bp, Homo sapiens
agcgctgccctgtgagagcca

SEQ ID NO: 2684205 - DNA, 23 bp, Homo sapiens
agcggaggttgcagggagccgag

SEQ ID NO: 2684206 - DNA, 13 bp, Homo sapiens
agcggccctgaca

SEQ ID NO: 2684207 - DNA, 14 bp, Homo sapiens
agcggcgcagagcc

SEQ ID NO: 2684208 - DNA, 16 bp, Homo sapiens
agcggcgcagagccct

SEQ ID NO: 2684209 - DNA, 18 bp, Homo sapiens
agcggcgcagagccctcc

SEQ ID NO: 2684210 - DNA, 20 bp, Homo sapiens
agctactcagaagcctgagg

SEQ ID NO: 2684211 - DNA, 15 bp, Homo sapiens
agctagaaggccaca

SEQ ID NO: 2684212 - DNA, 16 bp, Homo sapiens
agctagaaggccacat

SEQ ID NO: 2684213 - DNA, 16 bp, Homo sapiens
agctataaattatatt

SEQ ID NO: 2684214 - DNA, 20 bp, Homo sapiens
agctattttctgaccaaaat

SEQ ID NO: 2684215 - DNA, 14 bp, Homo sapiens
agctcacacagcag

SEQ ID NO: 2684216 - DNA, 12 bp, Homo sapiens
agctcctgacca

SEQ ID NO: 2684217 - DNA, 15 bp, Homo sapiens
agctcctgaccaaag

SEQ ID NO: 2684218 - DNA, 15 bp, Homo sapiens
agctcctgtccctac

SEQ ID NO: 2684219 - DNA, 17 bp, Homo sapiens
agctcctgtccctaccc

SEQ ID NO: 2684220 - DNA, 18 bp, Homo sapiens
agctcctgtccctaccca

SEQ ID NO: 2684221 - DNA, 16 bp, Homo sapiens
agctctactgccctcc

SEQ ID NO: 2684222 - DNA, 17 bp, Homo sapiens
agctctactgccctccc

SEQ ID NO: 2684223 - DNA, 18 bp, Homo sapiens
agctctactgccctcccc

SEQ ID NO: 2684224 - DNA, 13 bp, Homo sapiens
agctctctgggcc

SEQ ID NO: 2684225 - DNA, 14 bp, Homo sapiens
agctctcttcctgt

SEQ ID NO: 2684226 - DNA, 15 bp, Homo sapiens
agctctggaccagcc

SEQ ID NO: 2684227 - DNA, 20 bp, Homo sapiens
agctctggcttccagaaaac

SEQ ID NO: 2684228 - DNA, 21 bp, Homo sapiens
agctcttgttccgtgccaggc

SEQ ID NO: 2684229 - DNA, 23 bp, Homo sapiens
agctgatgatgtctcttgtagaa

SEQ ID NO: 2684230 - DNA, 16 bp, Homo sapiens
agctgcacctgccagc

SEQ ID NO: 2684231 - DNA, 14 bp, Homo sapiens
agctgcagccagtc

SEQ ID NO: 2684232 - DNA, 16 bp, Homo sapiens
agctgcagccagtcag

SEQ ID NO: 2684233 - DNA, 16 bp, Homo sapiens
agctgctttcttctct

SEQ ID NO: 2684234 - DNA, 20 bp, Homo sapiens
actggccagtcctagagctc

SEQ ID NO: 2684235 - DNA, 23 bp, Homo sapiens
actggccagtcctagagctcctg

SEQ ID NO: 2684236 - DNA, 20 bp, Homo sapiens
actggctgctccctgctccc

SEQ ID NO: 2684237 - DNA, 15 bp, Homo sapiens
actggtgatatatct

SEQ ID NO: 2684238 - DNA, 17 bp, Homo sapiens
actgtcattgcccctcc

SEQ ID NO: 2684239 - DNA, 14 bp, Homo sapiens
actgtccctcaaat

SEQ ID NO: 2684240 - DNA, 23 bp, Homo sapiens
actgtccctcaaatgacccaaag

SEQ ID NO: 2684241 - DNA, 15 bp, Homo sapiens
actgtctcagccaac

SEQ ID NO: 2684242 - DNA, 14 bp, Homo sapiens
actgtgaccaaagc

SEQ ID NO: 2684243 - DNA, 16 bp, Homo sapiens
acttccttgcccctgc

SEQ ID NO: 2684244 - DNA, 16 bp, Homo sapiens
acttctggcttatgct

SEQ ID NO: 2684245 - DNA, 18 bp, Homo sapiens
acttgaaataccagtgaa

SEQ ID NO: 2684246 - DNA, 22 bp, Homo sapiens
acttgagccatccaaagaaaca

SEQ ID NO: 2684247 - DNA, 11 bp, Homo sapiens
acttgaggaca

SEQ ID NO: 2684248 - DNA, 12 bp, Homo sapiens
acttgaggacac

SEQ ID NO: 2684249 - DNA, 15 bp, Homo sapiens
acttgctctctgaga

SEQ ID NO: 2684250 - DNA, 19 bp, Homo sapiens
actttgggaggctgaggcg

SEQ ID NO: 2684251 - DNA, 18 bp, Homo sapiens
actttttaaaaaactttc

SEQ ID NO: 2684252 - DNA, 18 bp, Homo sapiens
acttttttgaaatcagta

SEQ ID NO: 2684253 - DNA, 15 bp, Homo sapiens
agaaacacagttttg

SEQ ID NO: 2684254 - DNA, 16 bp, Homo sapiens
agaaacacagttttga

SEQ ID NO: 2684255 - DNA, 20 bp, Homo sapiens
agaaacactaagctctctgg

SEQ ID NO: 2684256 - DNA, 16 bp, Homo sapiens
agaaattcctgtagca

SEQ ID NO: 2684257 - DNA, 20 bp, Homo sapiens
agaaattcctgtagcatctt

SEQ ID NO: 2684258 - DNA, 15 bp, Homo sapiens
agaacacccactggc

SEQ ID NO: 2684259 - DNA, 16 bp, Homo sapiens
agaacacccactggcc

SEQ ID NO: 2684260 - DNA, 17 bp, Homo sapiens
agaacacccactggcca

SEQ ID NO: 2684261 - DNA, 23 bp, Homo sapiens
agaacatgaggataacttccttg

SEQ ID NO: 2684262 - DNA, 15 bp, Homo sapiens
agaaccaaaagatgc

SEQ ID NO: 2684263 - DNA, 17 bp, Homo sapiens
agaaccaaaagatgcct

SEQ ID NO: 2684264 - DNA, 19 bp, Homo sapiens
agaacccaattttgtttca

SEQ ID NO: 2684265 - DNA, 13 bp, Homo sapiens
agaacccaggtct

SEQ ID NO: 2684266 - DNA, 19 bp, Homo sapiens
agaacccaggtctgatgcc

SEQ ID NO: 2684267 - DNA, 22 bp, Homo sapiens
agaacccaggtctgatgccaaa

SEQ ID NO: 2684268 - DNA, 23 bp, Homo sapiens
agaacccaggtctgatgccaaag

SEQ ID NO: 2684269 - DNA, 21 bp, Homo sapiens
agaacctcaggcttccttggc

SEQ ID NO: 2684270 - DNA, 18 bp, Homo sapiens
agaactccttattttgta

SEQ ID NO: 2684271 - DNA, 21 bp, Homo sapiens
agaactccttattttgtatta

SEQ ID NO: 2684272 - DNA, 15 bp, Homo sapiens
agaagataatgttct

SEQ ID NO: 2684273 - DNA, 16 bp, Homo sapiens
agaagatggactctga

SEQ ID NO: 2684274 - DNA, 19 bp, Homo sapiens
agaagatggactctgaaaa

SEQ ID NO: 2684275 - DNA, 14 bp, Homo sapiens
agaagcctgaggct

SEQ ID NO: 2684276 - DNA, 14 bp, Homo sapiens
agaagcgctgccct

SEQ ID NO: 2684277 - DNA, 18 bp, Homo sapiens
agaagcgctgccctgtga

SEQ ID NO: 2684278 - DNA, 14 bp, Homo sapiens
agaaggccacatgt

SEQ ID NO: 2684279 - DNA, 23 bp, Homo sapiens
agaagtctccctgcacagcctct

SEQ ID NO: 2684280 - DNA, 12 bp, Homo sapiens
agaagtgtatat

SEQ ID NO: 2684281 - DNA, 17 bp, Homo sapiens
agaataatgtgttaaac

SEQ ID NO: 2684282 - DNA, 14 bp, Homo sapiens
agaatcgctttcct

SEQ ID NO: 2684283 - DNA, 15 bp, Homo sapiens
agaattgcaatctat

SEQ ID NO: 2684284 - DNA, 20 bp, Homo sapiens
agaattgcaatctataatat

SEQ ID NO: 2684285 - DNA, 12 bp, Homo sapiens
agacaaagcaaa

SEQ ID NO: 2684286 - DNA, 22 bp, Homo sapiens
agacaagtcttgctgtgcttta

SEQ ID NO: 2684287 - DNA, 12 bp, Homo sapiens
agaccacctctc

SEQ ID NO: 2684288 - DNA, 14 bp, Homo sapiens
agaccagactgtgg

SEQ ID NO: 2684289 - DNA, 22 bp, Homo sapiens
agaccagactgtggagaaataa

SEQ ID NO: 2684290 - DNA, 18 bp, Homo sapiens
agaccattgtcttccaac

SEQ ID NO: 2684291 - DNA, 23 bp, Homo sapiens
agaccattgtcttccaaccccag

SEQ ID NO: 2684292 - DNA, 13 bp, Homo sapiens
agaccccatctct

SEQ ID NO: 2684293 - DNA, 13 bp, Homo sapiens
agaccctgtctct

SEQ ID NO: 2684294 - DNA, 19 bp, Homo sapiens
agactaaggggcagctcct

SEQ ID NO: 2684295 - DNA, 20 bp, Homo sapiens
agactccaatggggccagca

SEQ ID NO: 2684296 - DNA, 22 bp, Homo sapiens
agactgcgggatggtcctgggg

SEQ ID NO: 2684297 - DNA, 19 bp, Homo sapiens
agactgctgggactggcca

SEQ ID NO: 2684298 - DNA, 20 bp, Homo sapiens
agactgctgggactggccag

SEQ ID NO: 2684299 - DNA, 22 bp, Homo sapiens
agactgctgggactggccaggt

SEQ ID NO: 2684300 - DNA, 14 bp, Homo sapiens
agactggagcatct

SEQ ID NO: 2684301 - DNA, 20 bp, Homo sapiens
agactgggaccttagaaatc

SEQ ID NO: 2684302 - DNA, 16 bp, Homo sapiens
agacttgagccatcca

SEQ ID NO: 2684303 - DNA, 23 bp, Homo sapiens
agagactaaggggcagctcctga

SEQ ID NO: 2684304 - DNA, 13 bp, Homo sapiens
agagactggagca

SEQ ID NO: 2684305 - DNA, 17 bp, Homo sapiens
agagactggagcatctg

SEQ ID NO: 2684306 - DNA, 21 bp, Homo sapiens
agagactggagcatctgactc

SEQ ID NO: 2684307 - DNA, 22 bp, Homo sapiens
agagagtcctctggatggcacc

SEQ ID NO: 2684308 - DNA, 14 bp, Homo sapiens
agagccacgctggc

SEQ ID NO: 2684309 - DNA, 18 bp, Homo sapiens
agagccacgctggccttc

SEQ ID NO: 2684310 - DNA, 16 bp, Homo sapiens
agagccagatgcctcc

SEQ ID NO: 2684311 - DNA, 18 bp, Homo sapiens
agagccctccaggcctgc

SEQ ID NO: 2684312 - DNA, 13 bp, Homo sapiens
agagccgggaagc

SEQ ID NO: 2684313 - DNA, 13 bp, Homo sapiens
agagcctcttagt

SEQ ID NO: 2684314 - DNA, 16 bp, Homo sapiens
agagctcctgtcccta

SEQ ID NO: 2684315 - DNA, 20 bp, Homo sapiens
agagctcctgtccctaccca

SEQ ID NO: 2684316 - DNA, 21 bp, Homo sapiens
agagctcctgtccctacccac

SEQ ID NO: 2684317 - DNA, 15 bp, Homo sapiens
agagctcttaatgtt

SEQ ID NO: 2684318 - DNA, 13 bp, Homo sapiens
agaggctgcagaa

SEQ ID NO: 2684319 - DNA, 17 bp, Homo sapiens
agagggcccaggcaggc

SEQ ID NO: 2684320 - DNA, 21 bp, Homo sapiens
agagggcccaggcaggccacc

SEQ ID NO: 2684321 - DNA, 22 bp, Homo sapiens
agaggggaaaccagtgtagcct

SEQ ID NO: 2684322 - DNA, 19 bp, Homo sapiens
agatatgctaagcagtagt

SEQ ID NO: 2684323 - DNA, 22 bp, Homo sapiens
agatcacgccactgcactccag

SEQ ID NO: 2684324 - DNA, 18 bp, Homo sapiens
agatcagagctgcagcca

SEQ ID NO: 2684325 - DNA, 14 bp, Homo sapiens
agatgactgagtcc

SEQ ID NO: 2684326 - DNA, 19 bp, Homo sapiens
agatgagcacttctaagtt

SEQ ID NO: 2684327 - DNA, 17 bp, Homo sapiens
agatgaggaaacaggcc

SEQ ID NO: 2684328 - DNA, 19 bp, Homo sapiens
agatgaggaaacaggcctc

SEQ ID NO: 2684329 - DNA, 16 bp, Homo sapiens
agatgagggtgactgt

SEQ ID NO: 2684330 - DNA, 17 bp, Homo sapiens
agatgagggtgactgtc

SEQ ID NO: 2684331 - DNA, 15 bp, Homo sapiens
agatgtactataaca

SEQ ID NO: 2684332 - DNA, 22 bp, Homo sapiens
agatgtactataacatagaatt

SEQ ID NO: 2684333 - DNA, 14 bp, Homo sapiens
agatgtgctgcttt

SEQ ID NO: 2684334 - DNA, 16 bp, Homo sapiens
agatgtgctgctttga

SEQ ID NO: 2684335 - DNA, 14 bp, Homo sapiens
agattagctctgga

SEQ ID NO: 2684336 - DNA, 17 bp, Homo sapiens
agattagctctggacca

SEQ ID NO: 2684337 - DNA, 15 bp, Homo sapiens
agattatatatcata

SEQ ID NO: 2684338 - DNA, 16 bp, Homo sapiens
agattatatatcataa

SEQ ID NO: 2684339 - DNA, 22 bp, Homo sapiens
agattatatatcataaagtatg

SEQ ID NO: 2684340 - DNA, 23 bp, Homo sapiens
agatttttcttttaagccctgct

SEQ ID NO: 2684341 - DNA, 15 bp, Homo sapiens
agcaaagcctccagc

SEQ ID NO: 2684342 - DNA, 18 bp, Homo sapiens
agcaaagcctccagcatc

SEQ ID NO: 2684343 - DNA, 13 bp, Homo sapiens
agcaaatgtttct

SEQ ID NO: 2684344 - DNA, 21 bp, Homo sapiens
agcaagctctgccctggctgt

SEQ ID NO: 2684345 - DNA, 20 bp, Homo sapiens
agctggcctctagaacaccc

SEQ ID NO: 2684346 - DNA, 23 bp, Homo sapiens
agctggcctctagaacacccact

SEQ ID NO: 2684347 - DNA, 20 bp, Homo sapiens
agctgggaaaaaagttttga

SEQ ID NO: 2684348 - DNA, 17 bp, Homo sapiens
agctgtctctcttgttg

SEQ ID NO: 2684349 - DNA, 22 bp, Homo sapiens
agcttatttttacagttataga

SEQ ID NO: 2684350 - DNA, 12 bp, Homo sapiens
agctttcagagc

SEQ ID NO: 2684351 - DNA, 16 bp, Homo sapiens
agctttctcagggggt

SEQ ID NO: 2684352 - DNA, 23 bp, Homo sapiens
agctttctcagggggtcagcaga

SEQ ID NO: 2684353 - DNA, 17 bp, Homo sapiens
agcttttcatggaagtg

SEQ ID NO: 2684354 - DNA, 23 bp, Homo sapiens
agcttttcatggaagtggcagtg

SEQ ID NO: 2684355 - DNA, 12 bp, Homo sapiens
aggaaccaaaaa

SEQ ID NO: 2684356 - DNA, 14 bp, Homo sapiens
aggactctgaggct

SEQ ID NO: 2684357 - DNA, 16 bp, Homo sapiens
aggagaacccaatttt

SEQ ID NO: 2684358 - DNA, 20 bp, Homo sapiens
aggagaatggtgtgaacccg

SEQ ID NO: 2684359 - DNA, 18 bp, Homo sapiens
aggagcaaatgtttctgc

SEQ ID NO: 2684360 - DNA, 14 bp, Homo sapiens
aggagccccagctt

SEQ ID NO: 2684361 - DNA, 21 bp, Homo sapiens
aggagcctcgtgtcctgctag

SEQ ID NO: 2684362 - DNA, 23 bp, Homo sapiens
aggagcctcgtgtcctgctagct

SEQ ID NO: 2684363 - DNA, 15 bp, Homo sapiens
aggaggccccaggct

SEQ ID NO: 2684364 - DNA, 21 bp, Homo sapiens
aggaggccccaggctgagagc

SEQ ID NO: 2684365 - DNA, 20 bp, Homo sapiens
aggaggcttggaaagcatca

SEQ ID NO: 2684366 - DNA, 12 bp, Homo sapiens
aggaggggcctc

SEQ ID NO: 2684367 - DNA, 20 bp, Homo sapiens
aggaggtggaggttgcagtg

SEQ ID NO: 2684368 - DNA, 17 bp, Homo sapiens
aggaggtggcagccctg

SEQ ID NO: 2684369 - DNA, 23 bp, Homo sapiens
aggaggtggcagccctgtaggga

SEQ ID NO: 2684370 - DNA, 22 bp, Homo sapiens
aggagttcgagaccagcctggc

SEQ ID NO: 2684371 - DNA, 20 bp, Homo sapiens
aggagtttgaggctgcagcg

SEQ ID NO: 2684372 - DNA, 17 bp, Homo sapiens
aggatcactctctgctg

SEQ ID NO: 2684373 - DNA, 14 bp, Homo sapiens
aggatcactggagc

SEQ ID NO: 2684374 - DNA, 13 bp, Homo sapiens
aggattcttcccg

SEQ ID NO: 2684375 - DNA, 16 bp, Homo sapiens
aggattcttcccgctc

SEQ ID NO: 2684376 - DNA, 15 bp, Homo sapiens
aggcacgtctcctgc

SEQ ID NO: 2684377 - DNA, 17 bp, Homo sapiens
aggcaggggtcctgcag

SEQ ID NO: 2684378 - DNA, 17 bp, Homo sapiens
aggcatatgcttcttta

SEQ ID NO: 2684379 - DNA, 22 bp, Homo sapiens
aggcatggtcgggggagagggc

SEQ ID NO: 2684380 - DNA, 22 bp, Homo sapiens
aggccacaccatctcctttcag

SEQ ID NO: 2684381 - DNA, 12 bp, Homo sapiens
aggccacccact

SEQ ID NO: 2684382 - DNA, 15 bp, Homo sapiens
aggccacccactgac

SEQ ID NO: 2684383 - DNA, 14 bp, Homo sapiens
aggccagggaaagc

SEQ ID NO: 2684384 - DNA, 14 bp, Homo sapiens
aggccaggtgcagt

SEQ ID NO: 2684385 - DNA, 12 bp, Homo sapiens
aggccccaggct

SEQ ID NO: 2684386 - DNA, 15 bp, Homo sapiens
aggccccaggctgag

SEQ ID NO: 2684387 - DNA, 18 bp, Homo sapiens
aggccccaggctgagagc

SEQ ID NO: 2684388 - DNA, 19 bp, Homo sapiens
aggcctgattcactggcct

SEQ ID NO: 2684389 - DNA, 22 bp, Homo sapiens
aggcctgattcactggcctggc

SEQ ID NO: 2684390 - DNA, 18 bp, Homo sapiens
aggcggcgtgggcgaggc

SEQ ID NO: 2684391 - DNA, 22 bp, Homo sapiens
aggcgggggtttgagccctgga

SEQ ID NO: 2684392 - DNA, 17 bp, Homo sapiens
aggctatgaagggacag

SEQ ID NO: 2684393 - DNA, 19 bp, Homo sapiens
aggctatttgttcagagag

SEQ ID NO: 2684394 - DNA, 17 bp, Homo sapiens
aggctcagtctcaggag

SEQ ID NO: 2684395 - DNA, 18 bp, Homo sapiens
aggctcagtctcaggagc

SEQ ID NO: 2684396 - DNA, 16 bp, Homo sapiens
aggctccatgcacctc

SEQ ID NO: 2684397 - DNA, 18 bp, Homo sapiens
aggctctttctgggccaa

SEQ ID NO: 2684398 - DNA, 18 bp, Homo sapiens
aggctgcagaaggccaag

SEQ ID NO: 2684399 - DNA, 21 bp, Homo sapiens
aggctgcagaaggccaagaat

SEQ ID NO: 2684400 - DNA, 15 bp, Homo sapiens
aggctgcagcgagct

SEQ ID NO: 2684401 - DNA, 16 bp, Homo sapiens
aggctgtgctcttcct

SEQ ID NO: 2684402 - DNA, 20 bp, Homo sapiens
aggctgtgctcttcctctgg

SEQ ID NO: 2684403 - DNA, 21 bp, Homo sapiens
aggctgtgctcttcctctggt

SEQ ID NO: 2684404 - DNA, 13 bp, Homo sapiens
aggcttccagaga

SEQ ID NO: 2684405 - DNA, 18 bp, Homo sapiens
aggcttcctgggtcctgc

SEQ ID NO: 2684406 - DNA, 13 bp, Homo sapiens
aggcttccttggc

SEQ ID NO: 2684407 - DNA, 20 bp, Homo sapiens
agggaaaacacggccctcct

SEQ ID NO: 2684408 - DNA, 14 bp, Homo sapiens
agggaaggctaagc

SEQ ID NO: 2684409 - DNA, 17 bp, Homo sapiens
agggatgctgcctgagt

SEQ ID NO: 2684410 - DNA, 18 bp, Homo sapiens
agggatgctgcctgagtc

SEQ ID NO: 2684411 - DNA, 22 bp, Homo sapiens
agggccaaagcacagctgggca

SEQ ID NO: 2684412 - DNA, 19 bp, Homo sapiens
agggccagggccctgcaga

SEQ ID NO: 2684413 - DNA, 13 bp, Homo sapiens
agggcccagcagg

SEQ ID NO: 2684414 - DNA, 16 bp, Homo sapiens
agggctaggaatatag

SEQ ID NO: 2684415 - DNA, 13 bp, Homo sapiens
agggctcctccat

SEQ ID NO: 2684416 - DNA, 23 bp, Homo sapiens
agggctcctccatggtgctgcat

SEQ ID NO: 2684417 - DNA, 14 bp, Homo sapiens
agggctgggccagg

SEQ ID NO: 2684418 - DNA, 13 bp, Homo sapiens
agggctggggctg

SEQ ID NO: 2684419 - DNA, 21 bp, Homo sapiens
agggcttttttttgagaatac

SEQ ID NO: 2684420 - DNA, 21 bp, Homo sapiens
aggggaaaccagtgtagcctt

SEQ ID NO: 2684421 - DNA, 16 bp, Homo sapiens
aggggaatgtgtcctc

SEQ ID NO: 2684422 - DNA, 19 bp, Homo sapiens
aggggaggatcactggagc

SEQ ID NO: 2684423 - DNA, 14 bp, Homo sapiens
aggggcagctcctg

SEQ ID NO: 2684424 - DNA, 16 bp, Homo sapiens
aggggcccacccacat

SEQ ID NO: 2684425 - DNA, 20 bp, Homo sapiens
aggggcctctgaaatttccc

SEQ ID NO: 2684426 - DNA, 20 bp, Homo sapiens
aggggctttctggagaggag

SEQ ID NO: 2684427 - DNA, 21 bp, Homo sapiens
agggggcggtaggggctgcag

SEQ ID NO: 2684428 - DNA, 18 bp, Homo sapiens
aggggtcctgcaggtcct

SEQ ID NO: 2684429 - DNA, 22 bp, Homo sapiens
aggggttctgagaagcgctgcc

SEQ ID NO: 2684430 - DNA, 23 bp, Homo sapiens
aggggttctgagaagcgctgccc

SEQ ID NO: 2684431 - DNA, 16 bp, Homo sapiens
agggtcaagggctggg

SEQ ID NO: 2684432 - DNA, 18 bp, Homo sapiens
agggtcattatcagaaca

SEQ ID NO: 2684433 - DNA, 18 bp, Homo sapiens
agggtgacatcccaggag

SEQ ID NO: 2684434 - DNA, 18 bp, Homo sapiens
agggtgggagagcccagc

SEQ ID NO: 2684435 - DNA, 19 bp, Homo sapiens
agggttttccaccctggaa

SEQ ID NO: 2684436 - DNA, 22 bp, Homo sapiens
aggtcctcacttctgtctcctg

SEQ ID NO: 2684437 - DNA, 21 bp, Homo sapiens
aggtcctggtgggtcagccca

SEQ ID NO: 2684438 - DNA, 22 bp, Homo sapiens
aggtcctggtgggtcagcccag

SEQ ID NO: 2684439 - DNA, 16 bp, Homo sapiens
aggtgagaccacctct

SEQ ID NO: 2684440 - DNA, 15 bp, Homo sapiens
aggtgagcaggcagg

SEQ ID NO: 2684441 - DNA, 22 bp, Homo sapiens
aggtgagcaggcagggctgggc

SEQ ID NO: 2684442 - DNA, 16 bp, Homo sapiens
aggtgcagtggctcac

SEQ ID NO: 2684443 - DNA, 15 bp, Homo sapiens
aggtgccaccaataa

SEQ ID NO: 2684444 - DNA, 17 bp, Homo sapiens
aggtgccaccaataaaa

SEQ ID NO: 2684445 - DNA, 19 bp, Homo sapiens
aggtgccaccaataaaaat

SEQ ID NO: 2684446 - DNA, 20 bp, Homo sapiens
aggtgccaccaataaaaatc

SEQ ID NO: 2684447 - DNA, 17 bp, Homo sapiens
aggtgcctcacgcctgt

SEQ ID NO: 2684448 - DNA, 13 bp, Homo sapiens
aggtgcctcccag

SEQ ID NO: 2684449 - DNA, 14 bp, Homo sapiens
aggtgcctcccagt

SEQ ID NO: 2684450 - DNA, 20 bp, Homo sapiens
aggtgcctcccagtggcctg

SEQ ID NO: 2684451 - DNA, 22 bp, Homo sapiens
aggtgcgctcacctcagagcag

SEQ ID NO: 2684452 - DNA, 15 bp, Homo sapiens
aggtggaggtgccag

SEQ ID NO: 2684453 - DNA, 16 bp, Homo sapiens
aggtggaggtgccagg

SEQ ID NO: 2684454 - DNA, 15 bp, Homo sapiens
aggtgggctgagccc

SEQ ID NO: 2684455 - DNA, 20 bp, Homo sapiens
acccgggtctggtgctgagg

SEQ ID NO: 2684456 - DNA, 15 bp, Homo sapiens
accctccgccttcac

SEQ ID NO: 2684457 - DNA, 18 bp, Homo sapiens
accctcgtggacacctgc

SEQ ID NO: 2684458 - DNA, 19 bp, Homo sapiens
accctcgtggacacctgcc

SEQ ID NO: 2684459 - DNA, 20 bp, Homo sapiens
accctcgtggacacctgccc

SEQ ID NO: 2684460 - DNA, 18 bp, Homo sapiens
accctgagggctcctcca

SEQ ID NO: 2684461 - DNA, 18 bp, Homo sapiens
accctgcgaaggggccct

SEQ ID NO: 2684462 - DNA, 19 bp, Homo sapiens
accctgcgaaggggccctg

SEQ ID NO: 2684463 - DNA, 20 bp, Homo sapiens
accctgcgaaggggccctgg

SEQ ID NO: 2684464 - DNA, 21 bp, Homo sapiens
accctggcttgcttgccgagc

SEQ ID NO: 2684465 - DNA, 21 bp, Homo sapiens
accctgtcagaatcatgctgt

SEQ ID NO: 2684466 - DNA, 14 bp, Homo sapiens
accctgtttcctga

SEQ ID NO: 2684467 - DNA, 21 bp, Homo sapiens
accgccctccgtcgggcccct

SEQ ID NO: 2684468 - DNA, 17 bp, Homo sapiens
accgctggtccctgccc

SEQ ID NO: 2684469 - DNA, 13 bp, Homo sapiens
acctacccagctg

SEQ ID NO: 2684470 - DNA, 20 bp, Homo sapiens
acctagaagtctccctgcac

SEQ ID NO: 2684471 - DNA, 15 bp, Homo sapiens
acctatagtcccagc

SEQ ID NO: 2684472 - DNA, 11 bp, Homo sapiens
acctcagagca

SEQ ID NO: 2684473 - DNA, 20 bp, Homo sapiens
acctcagagcagggccaaag

SEQ ID NO: 2684474 - DNA, 17 bp, Homo sapiens
acctcagccccactgac

SEQ ID NO: 2684475 - DNA, 13 bp, Homo sapiens
acctcagcctaga

SEQ ID NO: 2684476 - DNA, 15 bp, Homo sapiens
acctccccctccccg

SEQ ID NO: 2684477 - DNA, 18 bp, Homo sapiens
acctcccttccctccctg

SEQ ID NO: 2684478 - DNA, 21 bp, Homo sapiens
acctctcaatattcaataaag

SEQ ID NO: 2684479 - DNA, 23 bp, Homo sapiens
acctctcaatattcaataaagct

SEQ ID NO: 2684480 - DNA, 12 bp, Homo sapiens
acctctcccagc

SEQ ID NO: 2684481 - DNA, 20 bp, Homo sapiens
acctctcccagccctcagca

SEQ ID NO: 2684482 - DNA, 13 bp, Homo sapiens
acctctgaaggca

SEQ ID NO: 2684483 - DNA, 12 bp, Homo sapiens
acctctgctctg

SEQ ID NO: 2684484 - DNA, 16 bp, Homo sapiens
acctcttctcttcctg

SEQ ID NO: 2684485 - DNA, 17 bp, Homo sapiens
acctcttctcttcctgt

SEQ ID NO: 2684486 - DNA, 21 bp, Homo sapiens
acctcttctcttcctgtaaca

SEQ ID NO: 2684487 - DNA, 15 bp, Homo sapiens
acctgcaggccaaga

SEQ ID NO: 2684488 - DNA, 13 bp, Homo sapiens
acctgcaggctcc

SEQ ID NO: 2684489 - DNA, 17 bp, Homo sapiens
acctgcaggctccatgc

SEQ ID NO: 2684490 - DNA, 21 bp, Homo sapiens
acctgcaggcttaggtcctca

SEQ ID NO: 2684491 - DNA, 15 bp, Homo sapiens
acctgccatttgcac

SEQ ID NO: 2684492 - DNA, 18 bp, Homo sapiens
acctgccatttgcaccct

SEQ ID NO: 2684493 - DNA, 15 bp, Homo sapiens
acctgccccctggtg

SEQ ID NO: 2684494 - DNA, 16 bp, Homo sapiens
acctgccccgcccagc

SEQ ID NO: 2684495 - DNA, 17 bp, Homo sapiens
acctgccccgcccagct

SEQ ID NO: 2684496 - DNA, 13 bp, Homo sapiens
acctgccctgccc

SEQ ID NO: 2684497 - DNA, 16 bp, Homo sapiens
acctgccctgccctgc

SEQ ID NO: 2684498 - DNA, 22 bp, Homo sapiens
acctgccctgccctgccacctg

SEQ ID NO: 2684499 - DNA, 20 bp, Homo sapiens
acctgctgcgggggagccag

SEQ ID NO: 2684500 - DNA, 14 bp, Homo sapiens
acctgtctgtctgt

SEQ ID NO: 2684501 - DNA, 14 bp, Homo sapiens
acctgttttcttca

SEQ ID NO: 2684502 - DNA, 18 bp, Homo sapiens
accttagaaatcattgta

SEQ ID NO: 2684503 - DNA, 18 bp, Homo sapiens
accttagattagctctgg

SEQ ID NO: 2684504 - DNA, 19 bp, Homo sapiens
accttagattagctctgga

SEQ ID NO: 2684505 - DNA, 16 bp, Homo sapiens
accttcaattcctggg

SEQ ID NO: 2684506 - DNA, 17 bp, Homo sapiens
accttcaattcctgggc

SEQ ID NO: 2684507 - DNA, 16 bp, Homo sapiens
acctttactctgctct

SEQ ID NO: 2684508 - DNA, 22 bp, Homo sapiens
acgacaaagccaaactctgcca

SEQ ID NO: 2684509 - DNA, 14 bp, Homo sapiens
acgaggggggccag

SEQ ID NO: 2684510 - DNA, 16 bp, Homo sapiens
acgaggggggccaggg

SEQ ID NO: 2684511 - DNA, 19 bp, Homo sapiens
acgatgcctgcaggcatgg

SEQ ID NO: 2684512 - DNA, 20 bp, Homo sapiens
acgcaaggctgtgctcttcc

SEQ ID NO: 2684513 - DNA, 20 bp, Homo sapiens
acgcagattgggctggctct

SEQ ID NO: 2684514 - DNA, 22 bp, Homo sapiens
acgccactgcactccagcctgg

SEQ ID NO: 2684515 - DNA, 23 bp, Homo sapiens
acgccactgcactccagcctggg

SEQ ID NO: 2684516 - DNA, 11 bp, Homo sapiens
acgctggcctt

SEQ ID NO: 2684517 - DNA, 15 bp, Homo sapiens
acgggcgctgcagcc

SEQ ID NO: 2684518 - DNA, 18 bp, Homo sapiens
acgggcgctgcagcctcc

SEQ ID NO: 2684519 - DNA, 20 bp, Homo sapiens
acgggcgctgcagcctccct

SEQ ID NO: 2684520 - DNA, 14 bp, Homo sapiens
acggggtccttcaa

SEQ ID NO: 2684521 - DNA, 20 bp, Homo sapiens
acgggtaacagtgaggctgg

SEQ ID NO: 2684522 - DNA, 16 bp, Homo sapiens
acgtgatggaccaaag

SEQ ID NO: 2684523 - DNA, 20 bp, Homo sapiens
acgtgatggaccaaagccac

SEQ ID NO: 2684524 - DNA, 18 bp, Homo sapiens
actaacataaaatctgtg

SEQ ID NO: 2684525 - DNA, 18 bp, Homo sapiens
actacactccagcctgag

SEQ ID NO: 2684526 - DNA, 17 bp, Homo sapiens
actaggactctgaggct

SEQ ID NO: 2684527 - DNA, 22 bp, Homo sapiens
actatgttttatcgtccagtga

SEQ ID NO: 2684528 - DNA, 22 bp, Homo sapiens
actattctcggggccctgtgta

SEQ ID NO: 2684529 - DNA, 21 bp, Homo sapiens
actcacaagaagaccagactg

SEQ ID NO: 2684530 - DNA, 13 bp, Homo sapiens
actcagcccagct

SEQ ID NO: 2684531 - DNA, 17 bp, Homo sapiens
actcagcccagctggcc

SEQ ID NO: 2684532 - DNA, 18 bp, Homo sapiens
actcaggaggctgagggg

SEQ ID NO: 2684533 - DNA, 21 bp, Homo sapiens
caacttcaagaattaatattt

SEQ ID NO: 2684534 - DNA, 12 bp, Homo sapiens
caacttgtgtac

SEQ ID NO: 2684535 - DNA, 21 bp, Homo sapiens
caagaagaccagactgtggag

SEQ ID NO: 2684536 - DNA, 22 bp, Homo sapiens
caagaagggttttccaccctgg

SEQ ID NO: 2684537 - DNA, 17 bp, Homo sapiens
caagacaaagcaaagcc

SEQ ID NO: 2684538 - DNA, 18 bp, Homo sapiens
caagacttttaaaagact

SEQ ID NO: 2684539 - DNA, 15 bp, Homo sapiens
caagatgtcagactg

SEQ ID NO: 2684540 - DNA, 19 bp, Homo sapiens
caagccaacgacaaagcca

SEQ ID NO: 2684541 - DNA, 11 bp, Homo sapiens
caagccacaga

SEQ ID NO: 2684542 - DNA, 19 bp, Homo sapiens
caagccattcacttcccca

SEQ ID NO: 2684543 - DNA, 13 bp, Homo sapiens
caagcccaggctt

SEQ ID NO: 2684544 - DNA, 22 bp, Homo sapiens
caagcccaggcttcctgggtcc

SEQ ID NO: 2684545 - DNA, 23 bp, Homo sapiens
caagcccaggcttcctgggtcct

SEQ ID NO: 2684546 - DNA, 16 bp, Homo sapiens
caagcggccctgacac

SEQ ID NO: 2684547 - DNA, 13 bp, Homo sapiens
caaggaggcagga

SEQ ID NO: 2684548 - DNA, 16 bp, Homo sapiens
caaggaggcaggattc

SEQ ID NO: 2684549 - DNA, 20 bp, Homo sapiens
caaggctgtgctcttcctct

SEQ ID NO: 2684550 - DNA, 20 bp, Homo sapiens
caagggaagaaacactctta

SEQ ID NO: 2684551 - DNA, 16 bp, Homo sapiens
caaggtgggctgagcc

SEQ ID NO: 2684552 - DNA, 17 bp, Homo sapiens
caaggtgggctgagccc

SEQ ID NO: 2684553 - DNA, 20 bp, Homo sapiens
caaggtgggctgagccctgg

SEQ ID NO: 2684554 - DNA, 23 bp, Homo sapiens
caagtccctgactctctgtgacc

SEQ ID NO: 2684555 - DNA, 13 bp, Homo sapiens
caagtcttgctgt

SEQ ID NO: 2684556 - DNA, 16 bp, Homo sapiens
caagtcttgctgtgct

SEQ ID NO: 2684557 - DNA, 18 bp, Homo sapiens
caagtcttgctgtgcttt

SEQ ID NO: 2684558 - DNA, 19 bp, Homo sapiens
caagtgtttgaagtctgct

SEQ ID NO: 2684559 - DNA, 23 bp, Homo sapiens
caagtgtttgaagtctgctcatt

SEQ ID NO: 2684560 - DNA, 13 bp, Homo sapiens
caagttagctcag

SEQ ID NO: 2684561 - DNA, 17 bp, Homo sapiens
caagttagctcaggagg

SEQ ID NO: 2684562 - DNA, 19 bp, Homo sapiens
caagttagctcaggaggct

SEQ ID NO: 2684563 - DNA, 12 bp, Homo sapiens
caagttttgtat

SEQ ID NO: 2684564 - DNA, 14 bp, Homo sapiens
caagttttgtataa

SEQ ID NO: 2684565 - DNA, 17 bp, Homo sapiens
caagttttgtataaata

SEQ ID NO: 2684566 - DNA, 23 bp, Homo sapiens
caataaagctgctgagaatctag

SEQ ID NO: 2684567 - DNA, 11 bp, Homo sapiens
caataaatgct

SEQ ID NO: 2684568 - DNA, 13 bp, Homo sapiens
caataaatgctga

SEQ ID NO: 2684569 - DNA, 17 bp, Homo sapiens
caataaatgctgaatga

SEQ ID NO: 2684570 - DNA, 20 bp, Homo sapiens
caatgcattgtcttgtggag

SEQ ID NO: 2684571 - DNA, 14 bp, Homo sapiens
caatggggccagca

SEQ ID NO: 2684572 - DNA, 14 bp, Homo sapiens
caatgtcagaaact

SEQ ID NO: 2684573 - DNA, 13 bp, Homo sapiens
caattcctgggcc

SEQ ID NO: 2684574 - DNA, 19 bp, Homo sapiens
cacaagaagaccagactgt

SEQ ID NO: 2684575 - DNA, 15 bp, Homo sapiens
cacaagccacagaag

SEQ ID NO: 2684576 - DNA, 15 bp, Homo sapiens
cacaagcggccctga

SEQ ID NO: 2684577 - DNA, 17 bp, Homo sapiens
cacaagcggccctgaca

SEQ ID NO: 2684578 - DNA, 18 bp, Homo sapiens
cacaagcggccctgacac

SEQ ID NO: 2684579 - DNA, 22 bp, Homo sapiens
cacacagaactggcaggagcct

SEQ ID NO: 2684580 - DNA, 23 bp, Homo sapiens
cacacagcaggaactgagccaga

SEQ ID NO: 2684581 - DNA, 13 bp, Homo sapiens
cacacatatatat

SEQ ID NO: 2684582 - DNA, 13 bp, Homo sapiens
cacaccccagcgc

SEQ ID NO: 2684583 - DNA, 18 bp, Homo sapiens
cacaccttttccccagga

SEQ ID NO: 2684584 - DNA, 20 bp, Homo sapiens
cacactggtttgccaggcca

SEQ ID NO: 2684585 - DNA, 19 bp, Homo sapiens
cacagaactggcaggagcc

SEQ ID NO: 2684586 - DNA, 16 bp, Homo sapiens
cacagaagccaggagc

SEQ ID NO: 2684587 - DNA, 19 bp, Homo sapiens
cacagctgggcatgccatg

SEQ ID NO: 2684588 - DNA, 23 bp, Homo sapiens
cacagctgggcatgccatgtctg

SEQ ID NO: 2684589 - DNA, 19 bp, Homo sapiens
cacaggagagcacccacag

SEQ ID NO: 2684590 - DNA, 20 bp, Homo sapiens
cacaggagagcacccacagc

SEQ ID NO: 2684591 - DNA, 21 bp, Homo sapiens
cacaggagagcacccacagcc

SEQ ID NO: 2684592 - DNA, 22 bp, Homo sapiens
cacaggagagcacccacagccg

SEQ ID NO: 2684593 - DNA, 14 bp, Homo sapiens
cacagggcagagcc

SEQ ID NO: 2684594 - DNA, 21 bp, Homo sapiens
cacagttttgaaagaaaaata

SEQ ID NO: 2684595 - DNA, 22 bp, Homo sapiens
cacagttttgaaagaaaaatac

SEQ ID NO: 2684596 - DNA, 13 bp, Homo sapiens
cacataaaggtat

SEQ ID NO: 2684597 - DNA, 20 bp, Homo sapiens
cacatgtcaccgtggacctt

SEQ ID NO: 2684598 - DNA, 12 bp, Homo sapiens
cacatgtccagt

SEQ ID NO: 2684599 - DNA, 23 bp, Homo sapiens
caccagcctggtgcccatcctcc

SEQ ID NO: 2684600 - DNA, 15 bp, Homo sapiens
caccagtcactgtcc

SEQ ID NO: 2684601 - DNA, 13 bp, Homo sapiens
cacccacatgact

SEQ ID NO: 2684602 - DNA, 14 bp, Homo sapiens
cacccactggccag

SEQ ID NO: 2684603 - DNA, 16 bp, Homo sapiens
cacccactggccagtc

SEQ ID NO: 2684604 - DNA, 23 bp, Homo sapiens
cacccactggccagtcctagagc

SEQ ID NO: 2684605 - DNA, 16 bp, Homo sapiens
cacccaggcctccctg

SEQ ID NO: 2684606 - DNA, 19 bp, Homo sapiens
cacccaggcctccctgcag

SEQ ID NO: 2684607 - DNA, 22 bp, Homo sapiens
cacccaggcctccctgcagact

SEQ ID NO: 2684608 - DNA, 22 bp, Homo sapiens
cacccatgaagacaggacagtg

SEQ ID NO: 2684609 - DNA, 14 bp, Homo sapiens
cacccatgccatag

SEQ ID NO: 2684610 - DNA, 21 bp, Homo sapiens
caccccccacgtctgtcctcc

SEQ ID NO: 2684611 - DNA, 15 bp, Homo sapiens
caccccccagcacag

SEQ ID NO: 2684612 - DNA, 16 bp, Homo sapiens
caccccttcctgtccc

SEQ ID NO: 2684613 - DNA, 13 bp, Homo sapiens
cacccggctgggc

SEQ ID NO: 2684614 - DNA, 21 bp, Homo sapiens
cacccggttaccttggccgtg

SEQ ID NO: 2684615 - DNA, 21 bp, Homo sapiens
caccgctggtccctgccctcc

SEQ ID NO: 2684616 - DNA, 22 bp, Homo sapiens
caccgctggtccctgccctccc

SEQ ID NO: 2684617 - DNA, 17 bp, Homo sapiens
cacctagaagtctccct

SEQ ID NO: 2684618 - DNA, 21 bp, Homo sapiens
cacctagaagtctccctgcac

SEQ ID NO: 2684619 - DNA, 22 bp, Homo sapiens
cacctagaagtctccctgcaca

SEQ ID NO: 2684620 - DNA, 17 bp, Homo sapiens
cacctcagagcagggcc

SEQ ID NO: 2684621 - DNA, 13 bp, Homo sapiens
cacctcagcccca

SEQ ID NO: 2684622 - DNA, 15 bp, Homo sapiens
cacctcccttccctc

SEQ ID NO: 2684623 - DNA, 14 bp, Homo sapiens
cacctccttttctt

SEQ ID NO: 2684624 - DNA, 22 bp, Homo sapiens
cacctctcaatattcaataaag

SEQ ID NO: 2684625 - DNA, 23 bp, Homo sapiens
cacctctcaatattcaataaagc

SEQ ID NO: 2684626 - DNA, 14 bp, Homo sapiens
cacctctcccagcc

SEQ ID NO: 2684627 - DNA, 13 bp, Homo sapiens
cacctgccagcct

SEQ ID NO: 2684628 - DNA, 22 bp, Homo sapiens
cacctgccctgccctgccacct

SEQ ID NO: 2684629 - DNA, 23 bp, Homo sapiens
cacctgccctgccctgccacctg

SEQ ID NO: 2684630 - DNA, 14 bp, Homo sapiens
cacctgctcccagt

SEQ ID NO: 2684631 - DNA, 20 bp, Homo sapiens
cacctggtactgcacatttt

SEQ ID NO: 2684632 - DNA, 15 bp, Homo sapiens
cacctgtactcagga

SEQ ID NO: 2684633 - DNA, 23 bp, Homo sapiens
cacctgtactcaggaggctgagg

SEQ ID NO: 2684634 - DNA, 14 bp, Homo sapiens
cacctgtctgtctg

SEQ ID NO: 2684635 - DNA, 19 bp, Homo sapiens
cacctgtgcttggaaccag

SEQ ID NO: 2684636 - DNA, 20 bp, Homo sapiens
caccttagacggaggtgcct

SEQ ID NO: 2684637 - DNA, 18 bp, Homo sapiens
caccttcaattcctgggc

SEQ ID NO: 2684638 - DNA, 19 bp, Homo sapiens
caccttttccccaggagca

SEQ ID NO: 2684639 - DNA, 16 bp, Homo sapiens
cacgcaaggctgtgct

SEQ ID NO: 2684640 - DNA, 21 bp, Homo sapiens
cacgcaaggctgtgctcttcc

SEQ ID NO: 2684641 - DNA, 14 bp, Homo sapiens
cacggccctcctgg

SEQ ID NO: 2684642 - DNA, 21 bp, Homo sapiens
cacggggatcatctctgtgac

SEQ ID NO: 2684643 - DNA, 17 bp, Homo sapiens
cactaagctctctgggc

SEQ ID NO: 2684644 - DNA, 20 bp, Homo sapiens
atgtgctgctttgatatata

SEQ ID NO: 2684645 - DNA, 18 bp, Homo sapiens
atgtggccccaggtgcca

SEQ ID NO: 2684646 - DNA, 15 bp, Homo sapiens
atgtgtcctcctgct

SEQ ID NO: 2684647 - DNA, 16 bp, Homo sapiens
atgtgtcctcctgctc

SEQ ID NO: 2684648 - DNA, 18 bp, Homo sapiens
atgtgtgaaacctgacac

SEQ ID NO: 2684649 - DNA, 20 bp, Homo sapiens
atgtgtttaaaacatgcacg

SEQ ID NO: 2684650 - DNA, 20 bp, Homo sapiens
atgtgtttcataacaaacca

SEQ ID NO: 2684651 - DNA, 18 bp, Homo sapiens
atgttgctgatggcccct

SEQ ID NO: 2684652 - DNA, 23 bp, Homo sapiens
atgttgtaataaaacttatgcta

SEQ ID NO: 2684653 - DNA, 17 bp, Homo sapiens
atgttttgtacaattac

SEQ ID NO: 2684654 - DNA, 23 bp, Homo sapiens
atgttttgtattatttcaccagc

SEQ ID NO: 2684655 - DNA, 21 bp, Homo sapiens
attaaataacagtgtgtgacc

SEQ ID NO: 2684656 - DNA, 15 bp, Homo sapiens
attaaatcatactcc

SEQ ID NO: 2684657 - DNA, 21 bp, Homo sapiens
attaagtctgggatgtagaac

SEQ ID NO: 2684658 - DNA, 14 bp, Homo sapiens
attaatgttttgta

SEQ ID NO: 2684659 - DNA, 15 bp, Homo sapiens
attaatgttttgtac

SEQ ID NO: 2684660 - DNA, 16 bp, Homo sapiens
attaatgttttgtaca

SEQ ID NO: 2684661 - DNA, 15 bp, Homo sapiens
attaccatggagaca

SEQ ID NO: 2684662 - DNA, 17 bp, Homo sapiens
attagcaactgtgctac

SEQ ID NO: 2684663 - DNA, 17 bp, Homo sapiens
attagtactggattatt

SEQ ID NO: 2684664 - DNA, 23 bp, Homo sapiens
attatactgtagctgatgaaact

SEQ ID NO: 2684665 - DNA, 19 bp, Homo sapiens
attatatatcataaagtat

SEQ ID NO: 2684666 - DNA, 20 bp, Homo sapiens
attatattcctcttgcattt

SEQ ID NO: 2684667 - DNA, 16 bp, Homo sapiens
attattaatgctttgg

SEQ ID NO: 2684668 - DNA, 17 bp, Homo sapiens
attatttcaccagcagc

SEQ ID NO: 2684669 - DNA, 18 bp, Homo sapiens
attcaacctgtgtcttat

SEQ ID NO: 2684670 - DNA, 12 bp, Homo sapiens
attcaataaagc

SEQ ID NO: 2684671 - DNA, 13 bp, Homo sapiens
attcaataaagct

SEQ ID NO: 2684672 - DNA, 14 bp, Homo sapiens
attcactggcctgg

SEQ ID NO: 2684673 - DNA, 15 bp, Homo sapiens
attcactggcctggc

SEQ ID NO: 2684674 - DNA, 20 bp, Homo sapiens
attcagatttctctttgaaa

SEQ ID NO: 2684675 - DNA, 17 bp, Homo sapiens
attcagtgacttctggc

SEQ ID NO: 2684676 - DNA, 20 bp, Homo sapiens
attcagtgctgtggcctggg

SEQ ID NO: 2684677 - DNA, 10 bp, Homo sapiens
attcctgggc

SEQ ID NO: 2684678 - DNA, 19 bp, Homo sapiens
attctacacatatatgtat

SEQ ID NO: 2684679 - DNA, 17 bp, Homo sapiens
attctatggagctattt

SEQ ID NO: 2684680 - DNA, 19 bp, Homo sapiens
attgaaggagaaaatgcat

SEQ ID NO: 2684681 - DNA, 15 bp, Homo sapiens
attgaccagctctct

SEQ ID NO: 2684682 - DNA, 16 bp, Homo sapiens
attgagtccagctttc

SEQ ID NO: 2684683 - DNA, 19 bp, Homo sapiens
attgagtccagctttcctt

SEQ ID NO: 2684684 - DNA, 14 bp, Homo sapiens
attgattaaaatct

SEQ ID NO: 2684685 - DNA, 15 bp, Homo sapiens
attgcacctgcaggc

SEQ ID NO: 2684686 - DNA, 20 bp, Homo sapiens
attgcttaaaagacattttt

SEQ ID NO: 2684687 - DNA, 21 bp, Homo sapiens
attgcttttgttgtgactttt

SEQ ID NO: 2684688 - DNA, 23 bp, Homo sapiens
attggagggtgggagagcccagc

SEQ ID NO: 2684689 - DNA, 16 bp, Homo sapiens
attgtcttccaacccc

SEQ ID NO: 2684690 - DNA, 20 bp, Homo sapiens
attgtcttccaaccccagct

SEQ ID NO: 2684691 - DNA, 21 bp, Homo sapiens
attgtcttccaaccccagctg

SEQ ID NO: 2684692 - DNA, 22 bp, Homo sapiens
attgtcttccaaccccagctgg

SEQ ID NO: 2684693 - DNA, 23 bp, Homo sapiens
attgtcttccaaccccagctggc

SEQ ID NO: 2684694 - DNA, 17 bp, Homo sapiens
attgtgaataatgattt

SEQ ID NO: 2684695 - DNA, 19 bp, Homo sapiens
attgtggtacaatctcaaa

SEQ ID NO: 2684696 - DNA, 22 bp, Homo sapiens
attgttattgtggaagatttac

SEQ ID NO: 2684697 - DNA, 19 bp, Homo sapiens
atttacaagacaacattgt

SEQ ID NO: 2684698 - DNA, 19 bp, Homo sapiens
atttacctgtatttaagat

SEQ ID NO: 2684699 - DNA, 16 bp, Homo sapiens
atttattaagtctggg

SEQ ID NO: 2684700 - DNA, 23 bp, Homo sapiens
atttatttggaaatattctatga

SEQ ID NO: 2684701 - DNA, 12 bp, Homo sapiens
atttcaccagca

SEQ ID NO: 2684702 - DNA, 13 bp, Homo sapiens
atttcccacaccc

SEQ ID NO: 2684703 - DNA, 23 bp, Homo sapiens
atttccctgggggcatcctgctt

SEQ ID NO: 2684704 - DNA, 18 bp, Homo sapiens
attttactgacagaaatg

SEQ ID NO: 2684705 - DNA, 15 bp, Homo sapiens
attttagtgactgta

SEQ ID NO: 2684706 - DNA, 18 bp, Homo sapiens
attttagtgactgtaatt

SEQ ID NO: 2684707 - DNA, 17 bp, Homo sapiens
attttctctgatacttt

SEQ ID NO: 2684708 - DNA, 19 bp, Homo sapiens
attttctctgatacttttt

SEQ ID NO: 2684709 - DNA, 22 bp, Homo sapiens
attttctgaccaaaatgtgttt

SEQ ID NO: 2684710 - DNA, 12 bp, Homo sapiens
attttggtttct

SEQ ID NO: 2684711 - DNA, 21 bp, Homo sapiens
attttgtacaaagatatgcta

SEQ ID NO: 2684712 - DNA, 19 bp, Homo sapiens
attttgtattacatctaat

SEQ ID NO: 2684713 - DNA, 22 bp, Homo sapiens
attttgttatagaatacttttt

SEQ ID NO: 2684714 - DNA, 15 bp, Homo sapiens
atttttatcaggatt

SEQ ID NO: 2684715 - DNA, 13 bp, Homo sapiens
atttttattatta

SEQ ID NO: 2684716 - DNA, 16 bp, Homo sapiens
attttttatttccaca

SEQ ID NO: 2684717 - DNA, 15 bp, Homo sapiens
attttttttaatgta

SEQ ID NO: 2684718 - DNA, 18 bp, Homo sapiens
caaaaaaaaaccatgcat

SEQ ID NO: 2684719 - DNA, 19 bp, Homo sapiens
caaaaccacacaaggagaa

SEQ ID NO: 2684720 - DNA, 17 bp, Homo sapiens
caaaccatctggtgcct

SEQ ID NO: 2684721 - DNA, 16 bp, Homo sapiens
caaactctgccagcca

SEQ ID NO: 2684722 - DNA, 14 bp, Homo sapiens
caaagagactggag

SEQ ID NO: 2684723 - DNA, 18 bp, Homo sapiens
caaagagactggagcatc

SEQ ID NO: 2684724 - DNA, 12 bp, Homo sapiens
caaagcacagct

SEQ ID NO: 2684725 - DNA, 14 bp, Homo sapiens
caaagcacagctgg

SEQ ID NO: 2684726 - DNA, 14 bp, Homo sapiens
caaagcatttctag

SEQ ID NO: 2684727 - DNA, 13 bp, Homo sapiens
caaagcctccagc

SEQ ID NO: 2684728 - DNA, 16 bp, Homo sapiens
caaagcctccagcatc

SEQ ID NO: 2684729 - DNA, 13 bp, Homo sapiens
caaagctgctttc

SEQ ID NO: 2684730 - DNA, 16 bp, Homo sapiens
caaagggcagtaaagt

SEQ ID NO: 2684731 - DNA, 13 bp, Homo sapiens
caaaggtggcctg

SEQ ID NO: 2684732 - DNA, 14 bp, Homo sapiens
caaagttatattta

SEQ ID NO: 2684733 - DNA, 17 bp, Homo sapiens
caaagttatatttactt

SEQ ID NO: 2684734 - DNA, 12 bp, Homo sapiens
caaatctgtata

SEQ ID NO: 2684735 - DNA, 23 bp, Homo sapiens
caaatctgtatatgttgtaataa

SEQ ID NO: 2684736 - DNA, 11 bp, Homo sapiens
caaatgtttct

SEQ ID NO: 2684737 - DNA, 22 bp, Homo sapiens
caaattctcaacctaccacccc

SEQ ID NO: 2684738 - DNA, 15 bp, Homo sapiens
caaattgtaattaat

SEQ ID NO: 2684739 - DNA, 13 bp, Homo sapiens
caaatttccctgg

SEQ ID NO: 2684740 - DNA, 23 bp, Homo sapiens
caaatttccctgggggcatcctg

SEQ ID NO: 2684741 - DNA, 15 bp, Homo sapiens
caacaactgtccctc

SEQ ID NO: 2684742 - DNA, 18 bp, Homo sapiens
caacagcagatggcacca

SEQ ID NO: 2684743 - DNA, 23 bp, Homo sapiens
caacatagtaagaccccatctct

SEQ ID NO: 2684744 - DNA, 12 bp, Homo sapiens
caaccccagctg

SEQ ID NO: 2684745 - DNA, 13 bp, Homo sapiens
caaccccagctgg

SEQ ID NO: 2684746 - DNA, 18 bp, Homo sapiens
caaccccagctggcctct

SEQ ID NO: 2684747 - DNA, 22 bp, Homo sapiens
caaccccagctggcctctagaa

SEQ ID NO: 2684748 - DNA, 13 bp, Homo sapiens
caaccctgtttcc

SEQ ID NO: 2684749 - DNA, 15 bp, Homo sapiens
caaccctgtttcctg

SEQ ID NO: 2684750 - DNA, 16 bp, Homo sapiens
caaccctgtttcctga

SEQ ID NO: 2684751 - DNA, 18 bp, Homo sapiens
caacctaccaccccttcc

SEQ ID NO: 2684752 - DNA, 20 bp, Homo sapiens
caactcacacctccttttct

SEQ ID NO: 2684753 - DNA, 19 bp, Homo sapiens
caactgatcctgctccagc

SEQ ID NO: 2684754 - DNA, 24 bp, Homo sapiens
caactgatcctgctccagcagcac

SEQ ID NO: 2684755 - DNA, 16 bp, Homo sapiens
aggtgggctgagccct

SEQ ID NO: 2684756 - DNA, 23 bp, Homo sapiens
aggtgtgaccctgagggctcctc

SEQ ID NO: 2684757 - DNA, 12 bp, Homo sapiens
aggttgcaggga

SEQ ID NO: 2684758 - DNA, 20 bp, Homo sapiens
aggttggtgactgaaacatt

SEQ ID NO: 2684759 - DNA, 14 bp, Homo sapiens
aggttttctccact

SEQ ID NO: 2684760 - DNA, 14 bp, Homo sapiens
agtacttgctctct

SEQ ID NO: 2684761 - DNA, 15 bp, Homo sapiens
agtagaacccaggtc

SEQ ID NO: 2684762 - DNA, 22 bp, Homo sapiens
agtagtgtcttcctagtatatt

SEQ ID NO: 2684763 - DNA, 22 bp, Homo sapiens
agtcagccttccccctcccagg

SEQ ID NO: 2684764 - DNA, 23 bp, Homo sapiens
agtcagccttccccctcccaggg

SEQ ID NO: 2684765 - DNA, 13 bp, Homo sapiens
agtccagctttcc

SEQ ID NO: 2684766 - DNA, 18 bp, Homo sapiens
agtccagctttccttctg

SEQ ID NO: 2684767 - DNA, 22 bp, Homo sapiens
agtccagctttccttctgccct

SEQ ID NO: 2684768 - DNA, 20 bp, Homo sapiens
agtcccttctctctttctaa

SEQ ID NO: 2684769 - DNA, 17 bp, Homo sapiens
agtccgcagtctggcct

SEQ ID NO: 2684770 - DNA, 13 bp, Homo sapiens
agtcctagagctc

SEQ ID NO: 2684771 - DNA, 22 bp, Homo sapiens
agtcctctggatggcaccagag

SEQ ID NO: 2684772 - DNA, 15 bp, Homo sapiens
agtctcagagcacag

SEQ ID NO: 2684773 - DNA, 17 bp, Homo sapiens
agtctcagagcacagag

SEQ ID NO: 2684774 - DNA, 13 bp, Homo sapiens
agtctcaggagca

SEQ ID NO: 2684775 - DNA, 22 bp, Homo sapiens
agtctccagtggttgctgttga

SEQ ID NO: 2684776 - DNA, 17 bp, Homo sapiens
agtctgggatgtagaac

SEQ ID NO: 2684777 - DNA, 14 bp, Homo sapiens
agtcttgctgtgct

SEQ ID NO: 2684778 - DNA, 16 bp, Homo sapiens
agtcttgctgtgcttt

SEQ ID NO: 2684779 - DNA, 16 bp, Homo sapiens
agtcttggaatacttg

SEQ ID NO: 2684780 - DNA, 13 bp, Homo sapiens
agtgaaccaaaga

SEQ ID NO: 2684781 - DNA, 15 bp, Homo sapiens
agtgaaccaaagaga

SEQ ID NO: 2684782 - DNA, 22 bp, Homo sapiens
agtgaaccaaagagactggagc

SEQ ID NO: 2684783 - DNA, 21 bp, Homo sapiens
agtgaagagtagaacccaggt

SEQ ID NO: 2684784 - DNA, 16 bp, Homo sapiens
agtgactgtaattaat

SEQ ID NO: 2684785 - DNA, 12 bp, Homo sapiens
agtgaggctggg

SEQ ID NO: 2684786 - DNA, 19 bp, Homo sapiens
agtgcccagcccctgcccc

SEQ ID NO: 2684787 - DNA, 22 bp, Homo sapiens
agtgcccagcccctgcccctac

SEQ ID NO: 2684788 - DNA, 16 bp, Homo sapiens
agtgccctccacagcc

SEQ ID NO: 2684789 - DNA, 16 bp, Homo sapiens
agtgctgtggcctggg

SEQ ID NO: 2684790 - DNA, 17 bp, Homo sapiens
agtgctgtggcctgggc

SEQ ID NO: 2684791 - DNA, 14 bp, Homo sapiens
agtgcttcagcctg

SEQ ID NO: 2684792 - DNA, 15 bp, Homo sapiens
agtgcttcagcctga

SEQ ID NO: 2684793 - DNA, 18 bp, Homo sapiens
agtgcttcagcctgaggc

SEQ ID NO: 2684794 - DNA, 20 bp, Homo sapiens
agtgcttcagcctgaggctg

SEQ ID NO: 2684795 - DNA, 23 bp, Homo sapiens
agtgctttacatgctgtgctctt

SEQ ID NO: 2684796 - DNA, 20 bp, Homo sapiens
agtggcagtgaaaaatatgt

SEQ ID NO: 2684797 - DNA, 16 bp, Homo sapiens
agtgggagcttcccgg

SEQ ID NO: 2684798 - DNA, 23 bp, Homo sapiens
agtgggcaggaggccccaggctg

SEQ ID NO: 2684799 - DNA, 17 bp, Homo sapiens
agtggggcctgccctct

SEQ ID NO: 2684800 - DNA, 15 bp, Homo sapiens
agtgtagccttgccc

SEQ ID NO: 2684801 - DNA, 18 bp, Homo sapiens
agtgtagccttgcccgga

SEQ ID NO: 2684802 - DNA, 21 bp, Homo sapiens
agtgtccagaccattgtcttc

SEQ ID NO: 2684803 - DNA, 23 bp, Homo sapiens
agtgtccagaccattgtcttcca

SEQ ID NO: 2684804 - DNA, 17 bp, Homo sapiens
agtgtctgcgccccgcc

SEQ ID NO: 2684805 - DNA, 20 bp, Homo sapiens
agtgtctgcgccccgcctcc

SEQ ID NO: 2684806 - DNA, 17 bp, Homo sapiens
agtgtgaaaggtgctga

SEQ ID NO: 2684807 - DNA, 17 bp, Homo sapiens
agtgttcaagaaataaa

SEQ ID NO: 2684808 - DNA, 22 bp, Homo sapiens
agtgttcattttagtgactgta

SEQ ID NO: 2684809 - DNA, 14 bp, Homo sapiens
agtgttgctcttgg

SEQ ID NO: 2684810 - DNA, 18 bp, Homo sapiens
agtgttgctcttggaaag

SEQ ID NO: 2684811 - DNA, 14 bp, Homo sapiens
agttattctctaag

SEQ ID NO: 2684812 - DNA, 21 bp, Homo sapiens
agttattgaatcttaattttt

SEQ ID NO: 2684813 - DNA, 14 bp, Homo sapiens
agttcgagaccagc

SEQ ID NO: 2684814 - DNA, 19 bp, Homo sapiens
agttcgagaccagcctggc

SEQ ID NO: 2684815 - DNA, 21 bp, Homo sapiens
agttcgagaccagcctggcca

SEQ ID NO: 2684816 - DNA, 22 bp, Homo sapiens
agttctaagttcatgtttgtaa

SEQ ID NO: 2684817 - DNA, 20 bp, Homo sapiens
agttgaatggcctgccttga

SEQ ID NO: 2684818 - DNA, 23 bp, Homo sapiens
agttgagtatattataatagatt

SEQ ID NO: 2684819 - DNA, 21 bp, Homo sapiens
agttgtggaaagcctctgctg

SEQ ID NO: 2684820 - DNA, 17 bp, Homo sapiens
agtttgaggctgcagcg

SEQ ID NO: 2684821 - DNA, 15 bp, Homo sapiens
agttttgaaagaaaa

SEQ ID NO: 2684822 - DNA, 15 bp, Homo sapiens
agttttgatgaaatt

SEQ ID NO: 2684823 - DNA, 14 bp, Homo sapiens
agttttttttgtaa

SEQ ID NO: 2684824 - DNA, 14 bp, Homo sapiens
ataaaacttatgct

SEQ ID NO: 2684825 - DNA, 22 bp, Homo sapiens
ataaaatactctagcctgggcc

SEQ ID NO: 2684826 - DNA, 17 bp, Homo sapiens
ataaacacccatgaatc

SEQ ID NO: 2684827 - DNA, 13 bp, Homo sapiens
ataaactgagcct

SEQ ID NO: 2684828 - DNA, 14 bp, Homo sapiens
ataaaggtatttag

SEQ ID NO: 2684829 - DNA, 15 bp, Homo sapiens
ataaagtatgccttc

SEQ ID NO: 2684830 - DNA, 13 bp, Homo sapiens
ataaataataaag

SEQ ID NO: 2684831 - DNA, 14 bp, Homo sapiens
ataaatgctgaatg

SEQ ID NO: 2684832 - DNA, 12 bp, Homo sapiens
ataaatgtttgt

SEQ ID NO: 2684833 - DNA, 14 bp, Homo sapiens
ataaattatattcc

SEQ ID NO: 2684834 - DNA, 15 bp, Homo sapiens
ataaattccactgga

SEQ ID NO: 2684835 - DNA, 22 bp, Homo sapiens
ataacatagaattgcaatctat

SEQ ID NO: 2684836 - DNA, 21 bp, Homo sapiens
ataacttccttgcccctgctc

SEQ ID NO: 2684837 - DNA, 22 bp, Homo sapiens
ataagctgggaaaaaagttttg

SEQ ID NO: 2684838 - DNA, 12 bp, Homo sapiens
ataatgtgttaa

SEQ ID NO: 2684839 - DNA, 16 bp, Homo sapiens
ataatgttctttaatg

SEQ ID NO: 2684840 - DNA, 19 bp, Homo sapiens
atacattttgttatagaat

SEQ ID NO: 2684841 - DNA, 19 bp, Homo sapiens
ataccagtgaaccaaagag

SEQ ID NO: 2684842 - DNA, 14 bp, Homo sapiens
atacttttttgaaa

SEQ ID NO: 2684843 - DNA, 19 bp, Homo sapiens
atagaacaggacctctgct

SEQ ID NO: 2684844 - DNA, 13 bp, Homo sapiens
atagaatactttt

SEQ ID NO: 2684845 - DNA, 12 bp, Homo sapiens
atagattaaatc

SEQ ID NO: 2684846 - DNA, 14 bp, Homo sapiens
atagattaaatcat

SEQ ID NO: 2684847 - DNA, 20 bp, Homo sapiens
atagattaaatcatactcct

SEQ ID NO: 2684848 - DNA, 13 bp, Homo sapiens
atagattgtgaat

SEQ ID NO: 2684849 - DNA, 18 bp, Homo sapiens
atagattgtgaataatga

SEQ ID NO: 2684850 - DNA, 19 bp, Homo sapiens
atagctctactgccctccc

SEQ ID NO: 2684851 - DNA, 12 bp, Homo sapiens
ataggtttccac

SEQ ID NO: 2684852 - DNA, 22 bp, Homo sapiens
atagtcatggggtccctgctgc

SEQ ID NO: 2684853 - DNA, 14 bp, Homo sapiens
atataggacattga

SEQ ID NO: 2684854 - DNA, 14 bp, Homo sapiens
atatatctcaaatt

SEQ ID NO: 2684855 - DNA, 20 bp, Homo sapiens
atatatgtatatgtatatct

SEQ ID NO: 2684856 - DNA, 21 bp, Homo sapiens
atatatgtatatgtatatcta

SEQ ID NO: 2684857 - DNA, 19 bp, Homo sapiens
atatattctacacatatat

SEQ ID NO: 2684858 - DNA, 17 bp, Homo sapiens
atatctctaaactgctg

SEQ ID NO: 2684859 - DNA, 17 bp, Homo sapiens
atatctgagaagtgtat

SEQ ID NO: 2684860 - DNA, 18 bp, Homo sapiens
atatctgagaagtgtata

SEQ ID NO: 2684861 - DNA, 22 bp, Homo sapiens
atatcttgctggattaatgttt

SEQ ID NO: 2684862 - DNA, 14 bp, Homo sapiens
atatgtatatctat

SEQ ID NO: 2684863 - DNA, 22 bp, Homo sapiens
atatgtatatctatatctctaa

SEQ ID NO: 2684864 - DNA, 12 bp, Homo sapiens
atatgtatatgt

SEQ ID NO: 2684865 - DNA, 11 bp, Homo sapiens
atatgttgtaa

SEQ ID NO: 2684866 - DNA, 20 bp, Homo sapiens
atattcaataaagctgctga

SEQ ID NO: 2684867 - DNA, 14 bp, Homo sapiens
atatttacctgtat

SEQ ID NO: 2684868 - DNA, 14 bp, Homo sapiens
atatttactttaaa

SEQ ID NO: 2684869 - DNA, 17 bp, Homo sapiens
atcaaatctgtatatgt

SEQ ID NO: 2684870 - DNA, 15 bp, Homo sapiens
atcacagggcagagc

SEQ ID NO: 2684871 - DNA, 19 bp, Homo sapiens
atcacagggcagagccggg

SEQ ID NO: 2684872 - DNA, 17 bp, Homo sapiens
atcactctctgctggca

SEQ ID NO: 2684873 - DNA, 12 bp, Homo sapiens
atcactggagcc

SEQ ID NO: 2684874 - DNA, 15 bp, Homo sapiens
atcactggagcccag

SEQ ID NO: 2684875 - DNA, 16 bp, Homo sapiens
atcactggagcccagg

SEQ ID NO: 2684876 - DNA, 17 bp, Homo sapiens
atcactggagcccagga

SEQ ID NO: 2684877 - DNA, 17 bp, Homo sapiens
atcactttacctgcagg

SEQ ID NO: 2684878 - DNA, 11 bp, Homo sapiens
atcataaagta

SEQ ID NO: 2684879 - DNA, 12 bp, Homo sapiens
atcataaagtat

SEQ ID NO: 2684880 - DNA, 13 bp, Homo sapiens
atcattgtagaaa

SEQ ID NO: 2684881 - DNA, 15 bp, Homo sapiens
atccaaccctgtcag

SEQ ID NO: 2684882 - DNA, 18 bp, Homo sapiens
atcccaggaggggcctct

SEQ ID NO: 2684883 - DNA, 11 bp, Homo sapiens
atcccatctct

SEQ ID NO: 2684884 - DNA, 9 bp, Homo sapiens
atcctgaaa

SEQ ID NO: 2684885 - DNA, 14 bp, Homo sapiens
atcctgaaagccag

SEQ ID NO: 2684886 - DNA, 15 bp, Homo sapiens
atcctgaaagccagc

SEQ ID NO: 2684887 - DNA, 17 bp, Homo sapiens
atcctgaaagccagcaa

SEQ ID NO: 2684888 - DNA, 18 bp, Homo sapiens
atcctgaggtgcctccca

SEQ ID NO: 2684889 - DNA, 19 bp, Homo sapiens
atcctgaggtgcctcccag

SEQ ID NO: 2684890 - DNA, 14 bp, Homo sapiens
atcctgctccagca

SEQ ID NO: 2684891 - DNA, 17 bp, Homo sapiens
atcctgctccagcagca

SEQ ID NO: 2684892 - DNA, 11 bp, Homo sapiens
atcctgcttcc

SEQ ID NO: 2684893 - DNA, 14 bp, Homo sapiens
atccttgacttttt

SEQ ID NO: 2684894 - DNA, 17 bp, Homo sapiens
atcgctgccttgccatg

SEQ ID NO: 2684895 - DNA, 16 bp, Homo sapiens
atcgctttccttcctc

SEQ ID NO: 2684896 - DNA, 23 bp, Homo sapiens
atcggctcccgcttgctctcctg

SEQ ID NO: 2684897 - DNA, 16 bp, Homo sapiens
atctacagctcacctc

SEQ ID NO: 2684898 - DNA, 16 bp, Homo sapiens
atctagccagaggctg

SEQ ID NO: 2684899 - DNA, 18 bp, Homo sapiens
atctatatctctaaactg

SEQ ID NO: 2684900 - DNA, 16 bp, Homo sapiens
atctctaaactgctgt

SEQ ID NO: 2684901 - DNA, 20 bp, Homo sapiens
atctctggttgacgggctgt

SEQ ID NO: 2684902 - DNA, 22 bp, Homo sapiens
atctctggttgacgggctgtcc

SEQ ID NO: 2684903 - DNA, 19 bp, Homo sapiens
atctgagaagtgtatatag

SEQ ID NO: 2684904 - DNA, 21 bp, Homo sapiens
atctgggaggcagaacaggct

SEQ ID NO: 2684905 - DNA, 12 bp, Homo sapiens
atctggtgcctt

SEQ ID NO: 2684906 - DNA, 15 bp, Homo sapiens
atctgtatgattcta

SEQ ID NO: 2684907 - DNA, 17 bp, Homo sapiens
atcttttccatcctgag

SEQ ID NO: 2684908 - DNA, 16 bp, Homo sapiens
atcttttctgaatctt

SEQ ID NO: 2684909 - DNA, 17 bp, Homo sapiens
atgaaactcctgatttt

SEQ ID NO: 2684910 - DNA, 18 bp, Homo sapiens
atgaaactcctgattttg

SEQ ID NO: 2684911 - DNA, 19 bp, Homo sapiens
atgaaactcctgattttgt

SEQ ID NO: 2684912 - DNA, 20 bp, Homo sapiens
atgaaagggaaagtcagctt

SEQ ID NO: 2684913 - DNA, 20 bp, Homo sapiens
atgaaattgtctagcagagc

SEQ ID NO: 2684914 - DNA, 22 bp, Homo sapiens
atgaaattgtctagcagagcag

SEQ ID NO: 2684915 - DNA, 13 bp, Homo sapiens
atgaacttgagga

SEQ ID NO: 2684916 - DNA, 16 bp, Homo sapiens
atgaacttgaggacac

SEQ ID NO: 2684917 - DNA, 18 bp, Homo sapiens
atgaacttgaggacacat

SEQ ID NO: 2684918 - DNA, 20 bp, Homo sapiens
atgaacttgaggacacatgt

SEQ ID NO: 2684919 - DNA, 21 bp, Homo sapiens
atgaagacaggacagtgcttc

SEQ ID NO: 2684920 - DNA, 13 bp, Homo sapiens
atgaatgctgacc

SEQ ID NO: 2684921 - DNA, 17 bp, Homo sapiens
atgacacctccatttct

SEQ ID NO: 2684922 - DNA, 15 bp, Homo sapiens
atgacccaaagacca

SEQ ID NO: 2684923 - DNA, 16 bp, Homo sapiens
atgacccaaagaccaa

SEQ ID NO: 2684924 - DNA, 14 bp, Homo sapiens
atgagcacttctaa

SEQ ID NO: 2684925 - DNA, 22 bp, Homo sapiens
atgaggcctcttggacctctgc

SEQ ID NO: 2684926 - DNA, 14 bp, Homo sapiens
atgagggtgactgt

SEQ ID NO: 2684927 - DNA, 17 bp, Homo sapiens
atgatcgagccactgca

SEQ ID NO: 2684928 - DNA, 17 bp, Homo sapiens
atgatggagcgcacctg

SEQ ID NO: 2684929 - DNA, 15 bp, Homo sapiens
atgatgtgtgaaacc

SEQ ID NO: 2684930 - DNA, 21 bp, Homo sapiens
atgatgtgtgaaacctgacac

SEQ ID NO: 2684931 - DNA, 23 bp, Homo sapiens
atgcaagtgtttgaagtctgctc

SEQ ID NO: 2684932 - DNA, 19 bp, Homo sapiens
atgcacctcccttccctcc

SEQ ID NO: 2684933 - DNA, 12 bp, Homo sapiens
atgccaaagctg

SEQ ID NO: 2684934 - DNA, 16 bp, Homo sapiens
atgccaaagctgcttt

SEQ ID NO: 2684935 - DNA, 17 bp, Homo sapiens
atgccaaagctgctttc

SEQ ID NO: 2684936 - DNA, 20 bp, Homo sapiens
atgcccagagggcccaggca

SEQ ID NO: 2684937 - DNA, 22 bp, Homo sapiens
atgcccagagggcccaggcagg

SEQ ID NO: 2684938 - DNA, 16 bp, Homo sapiens
atgccgcgtccctgcc

SEQ ID NO: 2684939 - DNA, 18 bp, Homo sapiens
atgccgcgtccctgcccc

SEQ ID NO: 2684940 - DNA, 12 bp, Homo sapiens
atgcctccccaa

SEQ ID NO: 2684941 - DNA, 17 bp, Homo sapiens
atgcctgcaggcatgga

SEQ ID NO: 2684942 - DNA, 15 bp, Homo sapiens
atgctacccacagcg

SEQ ID NO: 2684943 - DNA, 12 bp, Homo sapiens
atgctagtttat

SEQ ID NO: 2684944 - DNA, 18 bp, Homo sapiens
atgctcagaagccagtct

SEQ ID NO: 2684945 - DNA, 21 bp, Homo sapiens
atgctcagaagccagtctgcg

SEQ ID NO: 2684946 - DNA, 14 bp, Homo sapiens
atgctgaatgaatc

SEQ ID NO: 2684947 - DNA, 15 bp, Homo sapiens
atgctgaatgaatcc

SEQ ID NO: 2684948 - DNA, 13 bp, Homo sapiens
atgctgcctgagt

SEQ ID NO: 2684949 - DNA, 22 bp, Homo sapiens
atgctggggcaagtccctgact

SEQ ID NO: 2684950 - DNA, 18 bp, Homo sapiens
atgctgtgctctttgaag

SEQ ID NO: 2684951 - DNA, 14 bp, Homo sapiens
atgcttctttaaaa

SEQ ID NO: 2684952 - DNA, 12 bp, Homo sapiens
atggaccaaagc

SEQ ID NO: 2684953 - DNA, 22 bp, Homo sapiens
atggaccaaagccacctgctgc

SEQ ID NO: 2684954 - DNA, 18 bp, Homo sapiens
atggactctgaaaaacat

SEQ ID NO: 2684955 - DNA, 13 bp, Homo sapiens
atggatttttaaa

SEQ ID NO: 2684956 - DNA, 22 bp, Homo sapiens
atggatttttaaattatactgt

SEQ ID NO: 2684957 - DNA, 23 bp, Homo sapiens
atggcagaacgatgcctgcaggc

SEQ ID NO: 2684958 - DNA, 16 bp, Homo sapiens
atggcccctccagcac

SEQ ID NO: 2684959 - DNA, 14 bp, Homo sapiens
atggcctctggcca

SEQ ID NO: 2684960 - DNA, 20 bp, Homo sapiens
atggcgtgtccctctcggaa

SEQ ID NO: 2684961 - DNA, 17 bp, Homo sapiens
atggctacttgctttga

SEQ ID NO: 2684962 - DNA, 19 bp, Homo sapiens
atgggatcccaggccaggg

SEQ ID NO: 2684963 - DNA, 14 bp, Homo sapiens
atggggccagcact

SEQ ID NO: 2684964 - DNA, 19 bp, Homo sapiens
atggtcctggggctctgtg

SEQ ID NO: 2684965 - DNA, 19 bp, Homo sapiens
atggtctccacctgtgctt

SEQ ID NO: 2684966 - DNA, 18 bp, Homo sapiens
atggtgtgaaagtcagat

SEQ ID NO: 2684967 - DNA, 16 bp, Homo sapiens
atgtacaagttttgta

SEQ ID NO: 2684968 - DNA, 22 bp, Homo sapiens
atgtacaagttttgtataaata

SEQ ID NO: 2684969 - DNA, 23 bp, Homo sapiens
atgtagaacttcaagaagtaaga

SEQ ID NO: 2684970 - DNA, 13 bp, Homo sapiens
atgtatatctata

SEQ ID NO: 2684971 - DNA, 14 bp, Homo sapiens
atgtatatgtatat

SEQ ID NO: 2684972 - DNA, 19 bp, Homo sapiens
atgtatatttttgctagga

SEQ ID NO: 2684973 - DNA, 21 bp, Homo sapiens
atgtcaccgtggaccttcctg

SEQ ID NO: 2684974 - DNA, 22 bp, Homo sapiens
atgtcaccgtggaccttcctgc

SEQ ID NO: 2684975 - DNA, 15 bp, Homo sapiens
atgtctcttgtagaa

SEQ ID NO: 2684976 - DNA, 21 bp, Homo sapiens
atgtctgagcggcgcagagcc

SEQ ID NO: 2684977 - DNA, 21 bp, Homo sapiens
atgtgactttgaaaatatata

SEQ ID NO: 2684978 - DNA, 21 bp, Homo sapiens
ccagccggacacaagcggccc

SEQ ID NO: 2684979 - DNA, 22 bp, Homo sapiens
ccagcctggtgcccatcctccc

SEQ ID NO: 2684980 - DNA, 20 bp, Homo sapiens
ccagcctgttggacccgctc

SEQ ID NO: 2684981 - DNA, 23 bp, Homo sapiens
ccagctactcagaagcctgaggc

SEQ ID NO: 2684982 - DNA, 15 bp, Homo sapiens
ccagctattttctga

SEQ ID NO: 2684983 - DNA, 18 bp, Homo sapiens
ccagctattttctgacca

SEQ ID NO: 2684984 - DNA, 21 bp, Homo sapiens
ccagctattttctgaccaaaa

SEQ ID NO: 2684985 - DNA, 16 bp, Homo sapiens
ccagctctcttcctgt

SEQ ID NO: 2684986 - DNA, 12 bp, Homo sapiens
ccagctctggct

SEQ ID NO: 2684987 - DNA, 23 bp, Homo sapiens
ccagctgcacctgccagcctggc

SEQ ID NO: 2684988 - DNA, 13 bp, Homo sapiens
ccagctggccacc

SEQ ID NO: 2684989 - DNA, 12 bp, Homo sapiens
ccagctggcctc

SEQ ID NO: 2684990 - DNA, 16 bp, Homo sapiens
ccagctggcctctaga

SEQ ID NO: 2684991 - DNA, 17 bp, Homo sapiens
ccagctttccttctgcc

SEQ ID NO: 2684992 - DNA, 19 bp, Homo sapiens
ccagctttccttctgccct

SEQ ID NO: 2684993 - DNA, 20 bp, Homo sapiens
ccagctttccttctgccctt

SEQ ID NO: 2684994 - DNA, 16 bp, Homo sapiens
ccaggagaaggggccc

SEQ ID NO: 2684995 - DNA, 12 bp, Homo sapiens
ccaggagcaaat

SEQ ID NO: 2684996 - DNA, 15 bp, Homo sapiens
ccaggagcaaatgtt

SEQ ID NO: 2684997 - DNA, 13 bp, Homo sapiens
ccaggagcagaag

SEQ ID NO: 2684998 - DNA, 14 bp, Homo sapiens
ccaggaggggcctc

SEQ ID NO: 2684999 - DNA, 17 bp, Homo sapiens
ccaggaggggcctctga

SEQ ID NO: 2685000 - DNA, 14 bp, Homo sapiens
ccaggatcactctc

SEQ ID NO: 2685001 - DNA, 20 bp, Homo sapiens
ccaggatcactctctgctgg

SEQ ID NO: 2685002 - DNA, 21 bp, Homo sapiens
ccaggatcactctctgctggc

SEQ ID NO: 2685003 - DNA, 15 bp, Homo sapiens
ccaggcatggcgagg

SEQ ID NO: 2685004 - DNA, 19 bp, Homo sapiens
ccaggcatggcgaggctga

SEQ ID NO: 2685005 - DNA, 22 bp, Homo sapiens
ccaggcattcaatcctcaggtc

SEQ ID NO: 2685006 - DNA, 13 bp, Homo sapiens
ccaggcctccctg

SEQ ID NO: 2685007 - DNA, 20 bp, Homo sapiens
ccaggcctccctgcagactc

SEQ ID NO: 2685008 - DNA, 14 bp, Homo sapiens
ccaggctgagagcc

SEQ ID NO: 2685009 - DNA, 19 bp, Homo sapiens
ccaggctgagagccagatg

SEQ ID NO: 2685010 - DNA, 22 bp, Homo sapiens
ccaggctgagagccagatgcct

SEQ ID NO: 2685011 - DNA, 13 bp, Homo sapiens
ccaggcttcctgg

SEQ ID NO: 2685012 - DNA, 23 bp, Homo sapiens
ccaggcttcctgggtcctgcctg

SEQ ID NO: 2685013 - DNA, 22 bp, Homo sapiens
ccagggaaggctaagcatggcc

SEQ ID NO: 2685014 - DNA, 21 bp, Homo sapiens
ccaggtctgatgccaaagctg

SEQ ID NO: 2685015 - DNA, 19 bp, Homo sapiens
ccaggtgccaccaataaaa

SEQ ID NO: 2685016 - DNA, 23 bp, Homo sapiens
ccaggtgtggctgtcaggacacc

SEQ ID NO: 2685017 - DNA, 14 bp, Homo sapiens
ccagtcctagagct

SEQ ID NO: 2685018 - DNA, 17 bp, Homo sapiens
ccagtcctagagctcct

SEQ ID NO: 2685019 - DNA, 21 bp, Homo sapiens
ccagtcctagagctcctgtcc

SEQ ID NO: 2685020 - DNA, 22 bp, Homo sapiens
ccagtcctagagctcctgtccc

SEQ ID NO: 2685021 - DNA, 24 bp, Homo sapiens
ccagtcctagagctcctgtcccta

SEQ ID NO: 2685022 - DNA, 15 bp, Homo sapiens
ccagtggcctggctt

SEQ ID NO: 2685023 - DNA, 18 bp, Homo sapiens
ccagtgtaactggctgct

SEQ ID NO: 2685024 - DNA, 21 bp, Homo sapiens
ccagtgtaactggctgctccc

SEQ ID NO: 2685025 - DNA, 14 bp, Homo sapiens
ccagtgtagccttg

SEQ ID NO: 2685026 - DNA, 15 bp, Homo sapiens
ccagtgtgatcccaa

SEQ ID NO: 2685027 - DNA, 23 bp, Homo sapiens
ccagttctggggcccgcctgcca

SEQ ID NO: 2685028 - DNA, 21 bp, Homo sapiens
ccatcctgaggtgcctcccag

SEQ ID NO: 2685029 - DNA, 14 bp, Homo sapiens
ccatctggtgcctt

SEQ ID NO: 2685030 - DNA, 20 bp, Homo sapiens
ccatgatcgagccactgcac

SEQ ID NO: 2685031 - DNA, 19 bp, Homo sapiens
ccatgcacctcccttccct

SEQ ID NO: 2685032 - DNA, 19 bp, Homo sapiens
ccatgtggccccaggtgcc

SEQ ID NO: 2685033 - DNA, 14 bp, Homo sapiens
ccattaccatggag

SEQ ID NO: 2685034 - DNA, 17 bp, Homo sapiens
ccattcccgtggtctcc

SEQ ID NO: 2685035 - DNA, 14 bp, Homo sapiens
ccattgtcttccaa

SEQ ID NO: 2685036 - DNA, 20 bp, Homo sapiens
ccattgtcttccaaccccag

SEQ ID NO: 2685037 - DNA, 18 bp, Homo sapiens
cccaagtgccagtcttgt

SEQ ID NO: 2685038 - DNA, 19 bp, Homo sapiens
cccaatagctctactgccc

SEQ ID NO: 2685039 - DNA, 16 bp, Homo sapiens
cccacaccgctggtcc

SEQ ID NO: 2685040 - DNA, 14 bp, Homo sapiens
cccacattggaccc

SEQ ID NO: 2685041 - DNA, 20 bp, Homo sapiens
cccaccctcgtggacacctg

SEQ ID NO: 2685042 - DNA, 20 bp, Homo sapiens
cccaccttcaattcctgggc

SEQ ID NO: 2685043 - DNA, 21 bp, Homo sapiens
cccaccttcaattcctgggcc

SEQ ID NO: 2685044 - DNA, 13 bp, Homo sapiens
cccactggccagt

SEQ ID NO: 2685045 - DNA, 14 bp, Homo sapiens
cccactggccagtc

SEQ ID NO: 2685046 - DNA, 17 bp, Homo sapiens
cccactggccagtccta

SEQ ID NO: 2685047 - DNA, 19 bp, Homo sapiens
cccagagagaggggcctgc

SEQ ID NO: 2685048 - DNA, 20 bp, Homo sapiens
cccagagagaggggcctgca

SEQ ID NO: 2685049 - DNA, 22 bp, Homo sapiens
cccagagggcccaggcaggcca

SEQ ID NO: 2685050 - DNA, 14 bp, Homo sapiens
cccagcacctgctc

SEQ ID NO: 2685051 - DNA, 13 bp, Homo sapiens
cccagcaggcggg

SEQ ID NO: 2685052 - DNA, 10 bp, Homo sapiens
cccagccatt

SEQ ID NO: 2685053 - DNA, 17 bp, Homo sapiens
cccagctactcagaagc

SEQ ID NO: 2685054 - DNA, 17 bp, Homo sapiens
cccagctattttctgac

SEQ ID NO: 2685055 - DNA, 13 bp, Homo sapiens
cccagctctggct

SEQ ID NO: 2685056 - DNA, 12 bp, Homo sapiens
cccagctgcacc

SEQ ID NO: 2685057 - DNA, 11 bp, Homo sapiens
cccagctggcc

SEQ ID NO: 2685058 - DNA, 14 bp, Homo sapiens
cccagctggcctct

SEQ ID NO: 2685059 - DNA, 22 bp, Homo sapiens
cccaggaaccaaaaaaccccag

SEQ ID NO: 2685060 - DNA, 16 bp, Homo sapiens
cccaggagcagaagag

SEQ ID NO: 2685061 - DNA, 13 bp, Homo sapiens
cccaggaggggcc

SEQ ID NO: 2685062 - DNA, 22 bp, Homo sapiens
cccaggagtttgaggctgcagc

SEQ ID NO: 2685063 - DNA, 19 bp, Homo sapiens
cccaggatcactctctgct

SEQ ID NO: 2685064 - DNA, 20 bp, Homo sapiens
cccaggatcactctctgctg

SEQ ID NO: 2685065 - DNA, 16 bp, Homo sapiens
cccaggcctccctgca

SEQ ID NO: 2685066 - DNA, 17 bp, Homo sapiens
cccaggcctccctgcag

SEQ ID NO: 2685067 - DNA, 13 bp, Homo sapiens
cccaggcttcctg

SEQ ID NO: 2685068 - DNA, 19 bp, Homo sapiens
cccaggcttcctgggtcct

SEQ ID NO: 2685069 - DNA, 17 bp, Homo sapiens
cccagggccagggccct

SEQ ID NO: 2685070 - DNA, 22 bp, Homo sapiens
cccagggccagggccctgcaga

SEQ ID NO: 2685071 - DNA, 22 bp, Homo sapiens
cccaggtctgatgccaaagctg

SEQ ID NO: 2685072 - DNA, 19 bp, Homo sapiens
cccaggtggaggtgccagg

SEQ ID NO: 2685073 - DNA, 21 bp, Homo sapiens
cccagtcaattacatgtttgg

SEQ ID NO: 2685074 - DNA, 13 bp, Homo sapiens
cccatacttcctg

SEQ ID NO: 2685075 - DNA, 14 bp, Homo sapiens
cccatacttcctgg

SEQ ID NO: 2685076 - DNA, 16 bp, Homo sapiens
cccatacttcctggga

SEQ ID NO: 2685077 - DNA, 22 bp, Homo sapiens
cccatcattgcacctgcaggct

SEQ ID NO: 2685078 - DNA, 17 bp, Homo sapiens
cccatcccaggatgggt

SEQ ID NO: 2685079 - DNA, 19 bp, Homo sapiens
ccccaaacgggctgccctg

SEQ ID NO: 2685080 - DNA, 21 bp, Homo sapiens
ccccaccttcaattcctgggc

SEQ ID NO: 2685081 - DNA, 15 bp, Homo sapiens
ccccactgacaccca

SEQ ID NO: 2685082 - DNA, 11 bp, Homo sapiens
ccccagctggc

SEQ ID NO: 2685083 - DNA, 23 bp, Homo sapiens
ccccagctggcctctagaacacc

SEQ ID NO: 2685084 - DNA, 14 bp, Homo sapiens
ccccagcttcctgt

SEQ ID NO: 2685085 - DNA, 21 bp, Homo sapiens
ccccaggatcactctctgctg

SEQ ID NO: 2685086 - DNA, 22 bp, Homo sapiens
ccccaggatcactctctgctgg

SEQ ID NO: 2685087 - DNA, 23 bp, Homo sapiens
ccccaggatcactctctgctggc

SEQ ID NO: 2685088 - DNA, 22 bp, Homo sapiens
ccccagggacaaaacactgtgt

SEQ ID NO: 2685089 - DNA, 17 bp, Homo sapiens
cactacactccagcctg

SEQ ID NO: 2685090 - DNA, 14 bp, Homo sapiens
cactccagcctgag

SEQ ID NO: 2685091 - DNA, 15 bp, Homo sapiens
cactccagcctgagc

SEQ ID NO: 2685092 - DNA, 15 bp, Homo sapiens
cactccagcctgggc

SEQ ID NO: 2685093 - DNA, 14 bp, Homo sapiens
cactccccaccttc

SEQ ID NO: 2685094 - DNA, 15 bp, Homo sapiens
cactccccaccttca

SEQ ID NO: 2685095 - DNA, 19 bp, Homo sapiens
cactccggtgtgcctgcag

SEQ ID NO: 2685096 - DNA, 17 bp, Homo sapiens
cactgaagctgggattc

SEQ ID NO: 2685097 - DNA, 14 bp, Homo sapiens
cactgacacccagt

SEQ ID NO: 2685098 - DNA, 20 bp, Homo sapiens
cactgacccaactgatcctg

SEQ ID NO: 2685099 - DNA, 21 bp, Homo sapiens
cactgacccaactgatcctgc

SEQ ID NO: 2685100 - DNA, 20 bp, Homo sapiens
cactgcaacttctacctccg

SEQ ID NO: 2685101 - DNA, 16 bp, Homo sapiens
cactgctttccagcct

SEQ ID NO: 2685102 - DNA, 11 bp, Homo sapiens
cactggagccc

SEQ ID NO: 2685103 - DNA, 19 bp, Homo sapiens
cactggaggggcccaccca

SEQ ID NO: 2685104 - DNA, 12 bp, Homo sapiens
cactggccagtc

SEQ ID NO: 2685105 - DNA, 15 bp, Homo sapiens
cactggccagtccta

SEQ ID NO: 2685106 - DNA, 19 bp, Homo sapiens
cactggccagtcctagagc

SEQ ID NO: 2685107 - DNA, 13 bp, Homo sapiens
cactggccccacc

SEQ ID NO: 2685108 - DNA, 16 bp, Homo sapiens
cactggccccaccctc

SEQ ID NO: 2685109 - DNA, 16 bp, Homo sapiens
cactggtttgccaggc

SEQ ID NO: 2685110 - DNA, 18 bp, Homo sapiens
cactggtttgccaggcca

SEQ ID NO: 2685111 - DNA, 15 bp, Homo sapiens
cactgtgaccctggg

SEQ ID NO: 2685112 - DNA, 14 bp, Homo sapiens
cactgtgtattgtt

SEQ ID NO: 2685113 - DNA, 11 bp, Homo sapiens
cacttatatat

SEQ ID NO: 2685114 - DNA, 20 bp, Homo sapiens
cacttctaagttgagtatat

SEQ ID NO: 2685115 - DNA, 23 bp, Homo sapiens
cacttctaagttgagtatattat

SEQ ID NO: 2685116 - DNA, 13 bp, Homo sapiens
cacttctatgcaa

SEQ ID NO: 2685117 - DNA, 14 bp, Homo sapiens
cacttctgtctcct

SEQ ID NO: 2685118 - DNA, 15 bp, Homo sapiens
cacttctgtctcctg

SEQ ID NO: 2685119 - DNA, 16 bp, Homo sapiens
cactttacctgcaggc

SEQ ID NO: 2685120 - DNA, 19 bp, Homo sapiens
cactttggtacatggccag

SEQ ID NO: 2685121 - DNA, 20 bp, Homo sapiens
cactttggtacatggccagt

SEQ ID NO: 2685122 - DNA, 20 bp, Homo sapiens
cactttttaaaaaactttct

SEQ ID NO: 2685123 - DNA, 16 bp, Homo sapiens
cagaaattagccgggc

SEQ ID NO: 2685124 - DNA, 19 bp, Homo sapiens
cagaacgatgcctgcaggc

SEQ ID NO: 2685125 - DNA, 23 bp, Homo sapiens
cagaacgatgcctgcaggcatgg

SEQ ID NO: 2685126 - DNA, 16 bp, Homo sapiens
cagaactggcaggagc

SEQ ID NO: 2685127 - DNA, 17 bp, Homo sapiens
cagaactggcaggagcc

SEQ ID NO: 2685128 - DNA, 20 bp, Homo sapiens
cagaagagagtggggcctgc

SEQ ID NO: 2685129 - DNA, 15 bp, Homo sapiens
cagaagccaggagca

SEQ ID NO: 2685130 - DNA, 19 bp, Homo sapiens
cagaagccagtctgcgtca

SEQ ID NO: 2685131 - DNA, 19 bp, Homo sapiens
cagaaggggaatgtgtcct

SEQ ID NO: 2685132 - DNA, 23 bp, Homo sapiens
cagaaggggaatgtgtcctcctg

SEQ ID NO: 2685133 - DNA, 22 bp, Homo sapiens
cagaatagttattctctaagag

SEQ ID NO: 2685134 - DNA, 16 bp, Homo sapiens
cagacaagtcttgctg

SEQ ID NO: 2685135 - DNA, 20 bp, Homo sapiens
cagacaagtcttgctgtgct

SEQ ID NO: 2685136 - DNA, 21 bp, Homo sapiens
cagacaagtcttgctgtgctt

SEQ ID NO: 2685137 - DNA, 14 bp, Homo sapiens
cagaccaggaagct

SEQ ID NO: 2685138 - DNA, 23 bp, Homo sapiens
cagaccattgtcttccaacccca

SEQ ID NO: 2685139 - DNA, 21 bp, Homo sapiens
cagactccaatggggccagca

SEQ ID NO: 2685140 - DNA, 14 bp, Homo sapiens
cagactcctcagat

SEQ ID NO: 2685141 - DNA, 16 bp, Homo sapiens
cagactgctgggactg

SEQ ID NO: 2685142 - DNA, 17 bp, Homo sapiens
cagagagaggggcctgc

SEQ ID NO: 2685143 - DNA, 20 bp, Homo sapiens
cagagagaggggcctgcagg

SEQ ID NO: 2685144 - DNA, 21 bp, Homo sapiens
cagagagaggggcctgcaggt

SEQ ID NO: 2685145 - DNA, 16 bp, Homo sapiens
cagagagtcctctgga

SEQ ID NO: 2685146 - DNA, 23 bp, Homo sapiens
cagagcagggccaaagcacagct

SEQ ID NO: 2685147 - DNA, 14 bp, Homo sapiens
cagagcaggggcag

SEQ ID NO: 2685148 - DNA, 20 bp, Homo sapiens
cagagccctccaggcctgca

SEQ ID NO: 2685149 - DNA, 22 bp, Homo sapiens
cagagccctccaggcctgcagg

SEQ ID NO: 2685150 - DNA, 20 bp, Homo sapiens
cagagcgagactccgtctca

SEQ ID NO: 2685151 - DNA, 16 bp, Homo sapiens
cagagctgcagccagt

SEQ ID NO: 2685152 - DNA, 23 bp, Homo sapiens
cagagctgcagccagtcaggcag

SEQ ID NO: 2685153 - DNA, 16 bp, Homo sapiens
cagagggcccaggcag

SEQ ID NO: 2685154 - DNA, 19 bp, Homo sapiens
cagaggggctttctggaga

SEQ ID NO: 2685155 - DNA, 18 bp, Homo sapiens
cagagggggcgtgcctgc

SEQ ID NO: 2685156 - DNA, 19 bp, Homo sapiens
cagagtgagaccctgtctc

SEQ ID NO: 2685157 - DNA, 16 bp, Homo sapiens
cagagttattgaatct

SEQ ID NO: 2685158 - DNA, 20 bp, Homo sapiens
cagatgcccagagggcccag

SEQ ID NO: 2685159 - DNA, 13 bp, Homo sapiens
cagatgcctcccc

SEQ ID NO: 2685160 - DNA, 17 bp, Homo sapiens
cagattgggctggctct

SEQ ID NO: 2685161 - DNA, 15 bp, Homo sapiens
cagcaaagcctccag

SEQ ID NO: 2685162 - DNA, 16 bp, Homo sapiens
cagcacacctcagccc

SEQ ID NO: 2685163 - DNA, 17 bp, Homo sapiens
cagcacacctcagcccc

SEQ ID NO: 2685164 - DNA, 23 bp, Homo sapiens
cagcacacctcagccccactgac

SEQ ID NO: 2685165 - DNA, 23 bp, Homo sapiens
cagcacaggagagcacccacagc

SEQ ID NO: 2685166 - DNA, 13 bp, Homo sapiens
cagcacctgctcc

SEQ ID NO: 2685167 - DNA, 22 bp, Homo sapiens
cagcactggaggggcccaccca

SEQ ID NO: 2685168 - DNA, 16 bp, Homo sapiens
cagcagcaatctgtct

SEQ ID NO: 2685169 - DNA, 23 bp, Homo sapiens
cagcagcatagaacaggacctct

SEQ ID NO: 2685170 - DNA, 17 bp, Homo sapiens
cagcaggtgtgaccctg

SEQ ID NO: 2685171 - DNA, 22 bp, Homo sapiens
cagcaggtgtgaccctgagggc

SEQ ID NO: 2685172 - DNA, 20 bp, Homo sapiens
cagcatcttttccatcctga

SEQ ID NO: 2685173 - DNA, 23 bp, Homo sapiens
cagcatcttttccatcctgaggt

SEQ ID NO: 2685174 - DNA, 20 bp, Homo sapiens
cagcccagcacctgctccca

SEQ ID NO: 2685175 - DNA, 11 bp, Homo sapiens
cagcccagctg

SEQ ID NO: 2685176 - DNA, 13 bp, Homo sapiens
cagcccagctggc

SEQ ID NO: 2685177 - DNA, 14 bp, Homo sapiens
cagccctccatggc

SEQ ID NO: 2685178 - DNA, 17 bp, Homo sapiens
cagccctccatggcctg

SEQ ID NO: 2685179 - DNA, 20 bp, Homo sapiens
cagccggacacaagcggccc

SEQ ID NO: 2685180 - DNA, 22 bp, Homo sapiens
cagccggacacaagcggccctg

SEQ ID NO: 2685181 - DNA, 19 bp, Homo sapiens
cagcctcccttccatgccc

SEQ ID NO: 2685182 - DNA, 18 bp, Homo sapiens
cagcctccttgcctggaa

SEQ ID NO: 2685183 - DNA, 15 bp, Homo sapiens
cagcctgaggctgag

SEQ ID NO: 2685184 - DNA, 15 bp, Homo sapiens
cagcctggcttctgg

SEQ ID NO: 2685185 - DNA, 17 bp, Homo sapiens
cagcctggcttctggag

SEQ ID NO: 2685186 - DNA, 15 bp, Homo sapiens
cagcctggtgcccat

SEQ ID NO: 2685187 - DNA, 14 bp, Homo sapiens
cagccttccccctc

SEQ ID NO: 2685188 - DNA, 19 bp, Homo sapiens
cagcgcctgtgctgaggac

SEQ ID NO: 2685189 - DNA, 22 bp, Homo sapiens
cagcgcctgtgctgaggactcc

SEQ ID NO: 2685190 - DNA, 12 bp, Homo sapiens
cagcgtttacat

SEQ ID NO: 2685191 - DNA, 18 bp, Homo sapiens
cagcgtttacatatttac

SEQ ID NO: 2685192 - DNA, 17 bp, Homo sapiens
cagctaactgtggagaa

SEQ ID NO: 2685193 - DNA, 14 bp, Homo sapiens
cagctactcagaag

SEQ ID NO: 2685194 - DNA, 16 bp, Homo sapiens
cagctactcagaagcc

SEQ ID NO: 2685195 - DNA, 23 bp, Homo sapiens
cagctactcagaagcctgaggct

SEQ ID NO: 2685196 - DNA, 19 bp, Homo sapiens
cagctattagcaactgtgc

SEQ ID NO: 2685197 - DNA, 18 bp, Homo sapiens
cagctattttctgaccaa

SEQ ID NO: 2685198 - DNA, 21 bp, Homo sapiens
cagctattttctgaccaaaat

SEQ ID NO: 2685199 - DNA, 13 bp, Homo sapiens
cagctcctgacca

SEQ ID NO: 2685200 - DNA, 15 bp, Homo sapiens
cagctcctgaccaaa

SEQ ID NO: 2685201 - DNA, 14 bp, Homo sapiens
cagctctggcttcc

SEQ ID NO: 2685202 - DNA, 20 bp, Homo sapiens
cagctcttctcagtgtctga

SEQ ID NO: 2685203 - DNA, 22 bp, Homo sapiens
cagctgcacctgccagcctggc

SEQ ID NO: 2685204 - DNA, 16 bp, Homo sapiens
cagctgctgggaccca

SEQ ID NO: 2685205 - DNA, 19 bp, Homo sapiens
cagctgctgggacccacct

SEQ ID NO: 2685206 - DNA, 20 bp, Homo sapiens
cagctgctgggacccacctc

SEQ ID NO: 2685207 - DNA, 15 bp, Homo sapiens
cagctggccacctag

SEQ ID NO: 2685208 - DNA, 12 bp, Homo sapiens
cagctggcctct

SEQ ID NO: 2685209 - DNA, 19 bp, Homo sapiens
cagctggcctctagaacac

SEQ ID NO: 2685210 - DNA, 16 bp, Homo sapiens
cagctgggcatgccat

SEQ ID NO: 2685211 - DNA, 13 bp, Homo sapiens
cagctttcagagc

SEQ ID NO: 2685212 - DNA, 15 bp, Homo sapiens
cagctttcagagcca

SEQ ID NO: 2685213 - DNA, 15 bp, Homo sapiens
caggaaaccctggct

SEQ ID NO: 2685214 - DNA, 23 bp, Homo sapiens
caggaaccaaaaaaccccagcta

SEQ ID NO: 2685215 - DNA, 13 bp, Homo sapiens
caggacctctgct

SEQ ID NO: 2685216 - DNA, 15 bp, Homo sapiens
caggactgtgaccaa

SEQ ID NO: 2685217 - DNA, 18 bp, Homo sapiens
caggagcaaatgtttctg

SEQ ID NO: 2685218 - DNA, 22 bp, Homo sapiens
caggagcaaatgtttctgcagt

SEQ ID NO: 2685219 - DNA, 14 bp, Homo sapiens
caggagcagaagag

SEQ ID NO: 2685220 - DNA, 19 bp, Homo sapiens
caggagcctcgtgtcctgc

SEQ ID NO: 2685221 - DNA, 20 bp, Homo sapiens
caggagcctcgtgtcctgct

SEQ ID NO: 2685222 - DNA, 15 bp, Homo sapiens
caggaggccccaggc

SEQ ID NO: 2685223 - DNA, 21 bp, Homo sapiens
caggaggcttggaaagcatca

SEQ ID NO: 2685224 - DNA, 17 bp, Homo sapiens
caggaggggcctctgaa

SEQ ID NO: 2685225 - DNA, 20 bp, Homo sapiens
caggaggtggaggttgcagt

SEQ ID NO: 2685226 - DNA, 20 bp, Homo sapiens
caggaggttggtgactgaaa

SEQ ID NO: 2685227 - DNA, 19 bp, Homo sapiens
caggagttggagaccaggc

SEQ ID NO: 2685228 - DNA, 21 bp, Homo sapiens
caggagttggagaccaggcct

SEQ ID NO: 2685229 - DNA, 17 bp, Homo sapiens
caggatcactctctgct

SEQ ID NO: 2685230 - DNA, 18 bp, Homo sapiens
caggatcactctctgctg

SEQ ID NO: 2685231 - DNA, 20 bp, Homo sapiens
caggatcactctctgctggc

SEQ ID NO: 2685232 - DNA, 15 bp, Homo sapiens
caggcacgtctcctg

SEQ ID NO: 2685233 - DNA, 20 bp, Homo sapiens
caggcacgtctcctgctgcg

SEQ ID NO: 2685234 - DNA, 17 bp, Homo sapiens
caggcagggctgggcca

SEQ ID NO: 2685235 - DNA, 20 bp, Homo sapiens
caggccaatgttgctgatgg

SEQ ID NO: 2685236 - DNA, 12 bp, Homo sapiens
caggcctcaagc

SEQ ID NO: 2685237 - DNA, 23 bp, Homo sapiens
caggcctcaagcgtggaggggta

SEQ ID NO: 2685238 - DNA, 14 bp, Homo sapiens
caggcctccctgca

SEQ ID NO: 2685239 - DNA, 17 bp, Homo sapiens
caggcctgattcactgg

SEQ ID NO: 2685240 - DNA, 12 bp, Homo sapiens
caggcctgcagg

SEQ ID NO: 2685241 - DNA, 19 bp, Homo sapiens
caggctccatgcacctccc

SEQ ID NO: 2685242 - DNA, 16 bp, Homo sapiens
caggctgagagccaga

SEQ ID NO: 2685243 - DNA, 16 bp, Homo sapiens
caggcttcctgggtcc

SEQ ID NO: 2685244 - DNA, 21 bp, Homo sapiens
caggcttcctgggtcctgcct

SEQ ID NO: 2685245 - DNA, 21 bp, Homo sapiens
caggcttcggacagtgcccat

SEQ ID NO: 2685246 - DNA, 18 bp, Homo sapiens
cagggaggaggtggcagc

SEQ ID NO: 2685247 - DNA, 20 bp, Homo sapiens
cagggaggaggtggcagccc

SEQ ID NO: 2685248 - DNA, 12 bp, Homo sapiens
cagggcagagcc

SEQ ID NO: 2685249 - DNA, 15 bp, Homo sapiens
cagggcagagccggg

SEQ ID NO: 2685250 - DNA, 17 bp, Homo sapiens
cagggccaaagcacagc

SEQ ID NO: 2685251 - DNA, 21 bp, Homo sapiens
cagggccaaagcacagctggg

SEQ ID NO: 2685252 - DNA, 22 bp, Homo sapiens
cagggccaaagcacagctgggc

SEQ ID NO: 2685253 - DNA, 16 bp, Homo sapiens
cagggccagggccctg

SEQ ID NO: 2685254 - DNA, 18 bp, Homo sapiens
cagggccagggccctgca

SEQ ID NO: 2685255 - DNA, 19 bp, Homo sapiens
cagggccagggccctgcag

SEQ ID NO: 2685256 - DNA, 13 bp, Homo sapiens
cagggctgggcca

SEQ ID NO: 2685257 - DNA, 17 bp, Homo sapiens
cagggctgggccaggtc

SEQ ID NO: 2685258 - DNA, 20 bp, Homo sapiens
cagggctgggccaggtctcc

SEQ ID NO: 2685259 - DNA, 14 bp, Homo sapiens
caggggtcctgcag

SEQ ID NO: 2685260 - DNA, 20 bp, Homo sapiens
caggggtcctgcaggtcctg

SEQ ID NO: 2685261 - DNA, 21 bp, Homo sapiens
caggtcctggtgggtcagccc

SEQ ID NO: 2685262 - DNA, 17 bp, Homo sapiens
caggtcgagctgtgctc

SEQ ID NO: 2685263 - DNA, 16 bp, Homo sapiens
caggtctgatgccaaa

SEQ ID NO: 2685264 - DNA, 20 bp, Homo sapiens
caggtctgatgccaaagctg

SEQ ID NO: 2685265 - DNA, 21 bp, Homo sapiens
caggtctgatgccaaagctgc

SEQ ID NO: 2685266 - DNA, 15 bp, Homo sapiens
caggtgagaacccag

SEQ ID NO: 2685267 - DNA, 18 bp, Homo sapiens
caggtgagaacccagaga

SEQ ID NO: 2685268 - DNA, 15 bp, Homo sapiens
caggtgagcaggcag

SEQ ID NO: 2685269 - DNA, 19 bp, Homo sapiens
caggtgtgaccctgagggc

SEQ ID NO: 2685270 - DNA, 23 bp, Homo sapiens
caggtgtgaccctgagggctcct

SEQ ID NO: 2685271 - DNA, 14 bp, Homo sapiens
cagtaaacactgtg

SEQ ID NO: 2685272 - DNA, 17 bp, Homo sapiens
cagtagtctctgtgctt

SEQ ID NO: 2685273 - DNA, 15 bp, Homo sapiens
cagtcccacaccgct

SEQ ID NO: 2685274 - DNA, 19 bp, Homo sapiens
cagtcccacaccgctggtc

SEQ ID NO: 2685275 - DNA, 14 bp, Homo sapiens
cagtcctagagctc

SEQ ID NO: 2685276 - DNA, 15 bp, Homo sapiens
cagtcctagagctcc

SEQ ID NO: 2685277 - DNA, 17 bp, Homo sapiens
cagtcctagagctcctg

SEQ ID NO: 2685278 - DNA, 20 bp, Homo sapiens
cagtcctagagctcctgtcc

SEQ ID NO: 2685279 - DNA, 21 bp, Homo sapiens
cagtcctagagctcctgtccc

SEQ ID NO: 2685280 - DNA, 13 bp, Homo sapiens
cagtcctgggaga

SEQ ID NO: 2685281 - DNA, 19 bp, Homo sapiens
cagtctcaggagcatgggg

SEQ ID NO: 2685282 - DNA, 22 bp, Homo sapiens
cagtgaaaaatatgttgagtgt

SEQ ID NO: 2685283 - DNA, 22 bp, Homo sapiens
cagtgaaggagccacgtgaatg

SEQ ID NO: 2685284 - DNA, 16 bp, Homo sapiens
cagtgacgtgcacctg

SEQ ID NO: 2685285 - DNA, 20 bp, Homo sapiens
cagtgactttttctgagctt

SEQ ID NO: 2685286 - DNA, 22 bp, Homo sapiens
cagtgactttttctgagctttt

SEQ ID NO: 2685287 - DNA, 12 bp, Homo sapiens
cagtgaggctgg

SEQ ID NO: 2685288 - DNA, 18 bp, Homo sapiens
cagtgatttttcccccca

SEQ ID NO: 2685289 - DNA, 12 bp, Homo sapiens
cagtgctgtggc

SEQ ID NO: 2685290 - DNA, 19 bp, Homo sapiens
cagtgctgtggcctgggca

SEQ ID NO: 2685291 - DNA, 20 bp, Homo sapiens
cagtgcttcagcctgaggct

SEQ ID NO: 2685292 - DNA, 16 bp, Homo sapiens
cagtggcctggcttgt

SEQ ID NO: 2685293 - DNA, 18 bp, Homo sapiens
cagtgggcaggaggcccc

SEQ ID NO: 2685294 - DNA, 21 bp, Homo sapiens
cagtgggcaggaggccccagg

SEQ ID NO: 2685295 - DNA, 14 bp, Homo sapiens
cagtggttgctgtt

SEQ ID NO: 2685296 - DNA, 19 bp, Homo sapiens
cagtgtgatcccaagtgcc

SEQ ID NO: 2685297 - DNA, 23 bp, Homo sapiens
cagttcagagttgtacactgtgt

SEQ ID NO: 2685298 - DNA, 13 bp, Homo sapiens
cagtttagtgctt

SEQ ID NO: 2685299 - DNA, 15 bp, Homo sapiens
cagtttagtgcttta

SEQ ID NO: 2685300 - DNA, 12 bp, Homo sapiens
cagtttgatcaa

SEQ ID NO: 2685301 - DNA, 17 bp, Homo sapiens
cataacaaaccatctgg

SEQ ID NO: 2685302 - DNA, 17 bp, Homo sapiens
catactcctatgcttta

SEQ ID NO: 2685303 - DNA, 13 bp, Homo sapiens
catacttcctggg

SEQ ID NO: 2685304 - DNA, 21 bp, Homo sapiens
catagaacaggacctctgctt

SEQ ID NO: 2685305 - DNA, 20 bp, Homo sapiens
catagtaagaccccatctct

SEQ ID NO: 2685306 - DNA, 18 bp, Homo sapiens
catatatgtatatgtata

SEQ ID NO: 2685307 - DNA, 21 bp, Homo sapiens
catatatgtatatgtatatct

SEQ ID NO: 2685308 - DNA, 17 bp, Homo sapiens
catatttacctgtattt

SEQ ID NO: 2685309 - DNA, 13 bp, Homo sapiens
catcacctcaggc

SEQ ID NO: 2685310 - DNA, 18 bp, Homo sapiens
catcacctcaggccaggt

SEQ ID NO: 2685311 - DNA, 17 bp, Homo sapiens
catcattgcacctgcag

SEQ ID NO: 2685312 - DNA, 19 bp, Homo sapiens
catccaaccccccacctgc

SEQ ID NO: 2685313 - DNA, 16 bp, Homo sapiens
catcccaggaggggcc

SEQ ID NO: 2685314 - DNA, 13 bp, Homo sapiens
catcctgaaagcc

SEQ ID NO: 2685315 - DNA, 16 bp, Homo sapiens
catcctgaggtgcctc

SEQ ID NO: 2685316 - DNA, 11 bp, Homo sapiens
catcctgcttc

SEQ ID NO: 2685317 - DNA, 22 bp, Homo sapiens
catctctctactcctacctcag

SEQ ID NO: 2685318 - DNA, 18 bp, Homo sapiens
catctgactcacaagaag

SEQ ID NO: 2685319 - DNA, 13 bp, Homo sapiens
catctggtgcctt

SEQ ID NO: 2685320 - DNA, 16 bp, Homo sapiens
catctggtgcctttcc

SEQ ID NO: 2685321 - DNA, 13 bp, Homo sapiens
catcttctggagt

SEQ ID NO: 2685322 - DNA, 22 bp, Homo sapiens
catcttctggagtctccagtgg

SEQ ID NO: 2685323 - DNA, 17 bp, Homo sapiens
catcttttccatcctga

SEQ ID NO: 2685324 - DNA, 18 bp, Homo sapiens
catcttttccatcctgag

SEQ ID NO: 2685325 - DNA, 15 bp, Homo sapiens
catgaagacaggaca

SEQ ID NO: 2685326 - DNA, 17 bp, Homo sapiens
catgaagacaggacagt

SEQ ID NO: 2685327 - DNA, 20 bp, Homo sapiens
catgaggacatgatggagcg

SEQ ID NO: 2685328 - DNA, 18 bp, Homo sapiens
catgaggataacttcctt

SEQ ID NO: 2685329 - DNA, 18 bp, Homo sapiens
catgatggagcgcacctg

SEQ ID NO: 2685330 - DNA, 19 bp, Homo sapiens
catgatggagcgcacctgc

SEQ ID NO: 2685331 - DNA, 22 bp, Homo sapiens
catgcagactcctcagatctga

SEQ ID NO: 2685332 - DNA, 15 bp, Homo sapiens
catgccatgtctgag

SEQ ID NO: 2685333 - DNA, 20 bp, Homo sapiens
catggcagcatggagagcct

SEQ ID NO: 2685334 - DNA, 22 bp, Homo sapiens
catggcctggactgactgcagc

SEQ ID NO: 2685335 - DNA, 23 bp, Homo sapiens
catggcctggactgactgcagcc

SEQ ID NO: 2685336 - DNA, 19 bp, Homo sapiens
catggcgtgtccctctcgg

SEQ ID NO: 2685337 - DNA, 17 bp, Homo sapiens
catgggcattgggttct

SEQ ID NO: 2685338 - DNA, 22 bp, Homo sapiens
catggtgtgaaagtcagatgcc

SEQ ID NO: 2685339 - DNA, 22 bp, Homo sapiens
catgtcaccgtggaccttcctg

SEQ ID NO: 2685340 - DNA, 20 bp, Homo sapiens
catgtctgagcggcgcagag

SEQ ID NO: 2685341 - DNA, 21 bp, Homo sapiens
catgtctgagcggcgcagagc

SEQ ID NO: 2685342 - DNA, 21 bp, Homo sapiens
cattagtgagacatatttaca

SEQ ID NO: 2685343 - DNA, 13 bp, Homo sapiens
cattgatttgatt

SEQ ID NO: 2685344 - DNA, 22 bp, Homo sapiens
cattgatttgatttttattatt

SEQ ID NO: 2685345 - DNA, 24 bp, Homo sapiens
cattgcccctccgatgctgaggcc

SEQ ID NO: 2685346 - DNA, 13 bp, Homo sapiens
cattgtcttccaa

SEQ ID NO: 2685347 - DNA, 23 bp, Homo sapiens
cattgtcttccaaccccagctgg

SEQ ID NO: 2685348 - DNA, 23 bp, Homo sapiens
catttatcttttgggtctgtcct

SEQ ID NO: 2685349 - DNA, 18 bp, Homo sapiens
catttctctccaggaagt

SEQ ID NO: 2685350 - DNA, 23 bp, Homo sapiens
cattttgtacaaagatatgctaa

SEQ ID NO: 2685351 - DNA, 15 bp, Homo sapiens
ccaaaaaaccccagc

SEQ ID NO: 2685352 - DNA, 21 bp, Homo sapiens
ccaaagacgatacagcttggc

SEQ ID NO: 2685353 - DNA, 13 bp, Homo sapiens
ccaaagcacagct

SEQ ID NO: 2685354 - DNA, 17 bp, Homo sapiens
ccaaagcacagctgggc

SEQ ID NO: 2685355 - DNA, 13 bp, Homo sapiens
ccaaagccacctg

SEQ ID NO: 2685356 - DNA, 18 bp, Homo sapiens
ccaaagccacctgctgcg

SEQ ID NO: 2685357 - DNA, 12 bp, Homo sapiens
ccaaagctgctt

SEQ ID NO: 2685358 - DNA, 22 bp, Homo sapiens
ccaaagctgctttcttctctgc

SEQ ID NO: 2685359 - DNA, 14 bp, Homo sapiens
ccaaatttccctgg

SEQ ID NO: 2685360 - DNA, 13 bp, Homo sapiens
ccaaccccagctg

SEQ ID NO: 2685361 - DNA, 14 bp, Homo sapiens
ccaaccccagctgg

SEQ ID NO: 2685362 - DNA, 16 bp, Homo sapiens
ccaaccccagctggcc

SEQ ID NO: 2685363 - DNA, 19 bp, Homo sapiens
ccaactgatcctgctccag

SEQ ID NO: 2685364 - DNA, 18 bp, Homo sapiens
ccaagccattcacttccc

SEQ ID NO: 2685365 - DNA, 22 bp, Homo sapiens
ccaaggtccccgtggatggtct

SEQ ID NO: 2685366 - DNA, 20 bp, Homo sapiens
ccaaggtgggctgagccctg

SEQ ID NO: 2685367 - DNA, 23 bp, Homo sapiens
ccaaggtgggctgagccctggca

SEQ ID NO: 2685368 - DNA, 14 bp, Homo sapiens
ccaataaaaatcct

SEQ ID NO: 2685369 - DNA, 15 bp, Homo sapiens
ccaatggggccagca

SEQ ID NO: 2685370 - DNA, 15 bp, Homo sapiens
ccacaccccagcgcc

SEQ ID NO: 2685371 - DNA, 22 bp, Homo sapiens
ccacaccccagcgcctgtgctg

SEQ ID NO: 2685372 - DNA, 22 bp, Homo sapiens
ccacaccgctggtccctgccct

SEQ ID NO: 2685373 - DNA, 18 bp, Homo sapiens
ccacagaagccaggagca

SEQ ID NO: 2685374 - DNA, 20 bp, Homo sapiens
ccacagaagccaggagcaaa

SEQ ID NO: 2685375 - DNA, 15 bp, Homo sapiens
ccacagccgcagcct

SEQ ID NO: 2685376 - DNA, 11 bp, Homo sapiens
ccacataaagg

SEQ ID NO: 2685377 - DNA, 11 bp, Homo sapiens
ccaccaataaa

SEQ ID NO: 2685378 - DNA, 12 bp, Homo sapiens
ccaccaataaaa

SEQ ID NO: 2685379 - DNA, 13 bp, Homo sapiens
ccaccaataaaaa

SEQ ID NO: 2685380 - DNA, 15 bp, Homo sapiens
ccaccaataaaaatc

SEQ ID NO: 2685381 - DNA, 22 bp, Homo sapiens
ccaccatattcagtgctgtggc

SEQ ID NO: 2685382 - DNA, 9 bp, Homo sapiens
ccacccccc

SEQ ID NO: 2685383 - DNA, 14 bp, Homo sapiens
ccaccccttcctgt

SEQ ID NO: 2685384 - DNA, 20 bp, Homo sapiens
ccaccctcgtggacacctgc

SEQ ID NO: 2685385 - DNA, 21 bp, Homo sapiens
ccaccctcgtggacacctgcc

SEQ ID NO: 2685386 - DNA, 22 bp, Homo sapiens
ccaccctcgtggacacctgccc

SEQ ID NO: 2685387 - DNA, 11 bp, Homo sapiens
ccaccctggaa

SEQ ID NO: 2685388 - DNA, 15 bp, Homo sapiens
ccacctacccagctg

SEQ ID NO: 2685389 - DNA, 22 bp, Homo sapiens
ccacctagaagtctccctgcac

SEQ ID NO: 2685390 - DNA, 14 bp, Homo sapiens
ccacctccttggca

SEQ ID NO: 2685391 - DNA, 23 bp, Homo sapiens
ccacctctcaatattcaataaag

SEQ ID NO: 2685392 - DNA, 13 bp, Homo sapiens
ccacctctcccag

SEQ ID NO: 2685393 - DNA, 11 bp, Homo sapiens
ccacctgctgc

SEQ ID NO: 2685394 - DNA, 14 bp, Homo sapiens
ccacctgtgcttgg

SEQ ID NO: 2685395 - DNA, 19 bp, Homo sapiens
ccacctgtgcttggaacca

SEQ ID NO: 2685396 - DNA, 16 bp, Homo sapiens
ccacgaacgctcttag

SEQ ID NO: 2685397 - DNA, 14 bp, Homo sapiens
ccacgcaaggctgt

SEQ ID NO: 2685398 - DNA, 13 bp, Homo sapiens
ccacgctggcctt

SEQ ID NO: 2685399 - DNA, 23 bp, Homo sapiens
ccacgtgaatggccctagaactg

SEQ ID NO: 2685400 - DNA, 13 bp, Homo sapiens
ccactctttgcta

SEQ ID NO: 2685401 - DNA, 19 bp, Homo sapiens
ccactgcactccagcctgg

SEQ ID NO: 2685402 - DNA, 20 bp, Homo sapiens
ccactggacttgagcttggc

SEQ ID NO: 2685403 - DNA, 11 bp, Homo sapiens
ccactggccag

SEQ ID NO: 2685404 - DNA, 24 bp, Homo sapiens
ccactggccagtcctagagctcct

SEQ ID NO: 2685405 - DNA, 19 bp, Homo sapiens
ccagaccattgtcttccaa

SEQ ID NO: 2685406 - DNA, 13 bp, Homo sapiens
ccagactgtggag

SEQ ID NO: 2685407 - DNA, 20 bp, Homo sapiens
ccagagagaggggcctgcag

SEQ ID NO: 2685408 - DNA, 19 bp, Homo sapiens
ccagagctttgttttatat

SEQ ID NO: 2685409 - DNA, 20 bp, Homo sapiens
ccagagggggcgtgcctgcc

SEQ ID NO: 2685410 - DNA, 23 bp, Homo sapiens
ccagaggggtgggttcctcttcc

SEQ ID NO: 2685411 - DNA, 16 bp, Homo sapiens
ccagatgcctccccaa

SEQ ID NO: 2685412 - DNA, 19 bp, Homo sapiens
ccagattgttctgtccagt

SEQ ID NO: 2685413 - DNA, 15 bp, Homo sapiens
ccagcacaggagagc

SEQ ID NO: 2685414 - DNA, 15 bp, Homo sapiens
ccagcacctgctccc

SEQ ID NO: 2685415 - DNA, 18 bp, Homo sapiens
ccagcactggaggggccc

SEQ ID NO: 2685416 - DNA, 22 bp, Homo sapiens
ccagcactggaggggcccaccc

SEQ ID NO: 2685417 - DNA, 18 bp, Homo sapiens
ccagcagcaatctgtctt

SEQ ID NO: 2685418 - DNA, 21 bp, Homo sapiens
ccagcatccttttctgcagag

SEQ ID NO: 2685419 - DNA, 19 bp, Homo sapiens
ccagcatcttttccatcct

SEQ ID NO: 2685420 - DNA, 20 bp, Homo sapiens
ccagcatcttttccatcctg

SEQ ID NO: 2685421 - DNA, 12 bp, Homo sapiens
ccagccctcagc

SEQ ID NO: 2685422 - DNA, 20 bp, Homo sapiens
gactaaggggcagctcctga

SEQ ID NO: 2685423 - DNA, 21 bp, Homo sapiens
gactaaggggcagctcctgac

SEQ ID NO: 2685424 - DNA, 21 bp, Homo sapiens
gactcacaagaagaccagact

SEQ ID NO: 2685425 - DNA, 21 bp, Homo sapiens
gactccaatggggccagcact

SEQ ID NO: 2685426 - DNA, 14 bp, Homo sapiens
gactccctccatgt

SEQ ID NO: 2685427 - DNA, 19 bp, Homo sapiens
gactctgaggctctttctg

SEQ ID NO: 2685428 - DNA, 14 bp, Homo sapiens
gactgcagccccct

SEQ ID NO: 2685429 - DNA, 14 bp, Homo sapiens
gactgctgggactg

SEQ ID NO: 2685430 - DNA, 14 bp, Homo sapiens
gactggctggctgc

SEQ ID NO: 2685431 - DNA, 16 bp, Homo sapiens
gactgtgaccaaagca

SEQ ID NO: 2685432 - DNA, 13 bp, Homo sapiens
gacttgagccatc

SEQ ID NO: 2685433 - DNA, 16 bp, Homo sapiens
gacttgagccatccaa

SEQ ID NO: 2685434 - DNA, 18 bp, Homo sapiens
gactttgaaaatatatac

SEQ ID NO: 2685435 - DNA, 16 bp, Homo sapiens
gacttttattgagctc

SEQ ID NO: 2685436 - DNA, 18 bp, Homo sapiens
gacttttattgagctctt

SEQ ID NO: 2685437 - DNA, 16 bp, Homo sapiens
gacttttctaaagctc

SEQ ID NO: 2685438 - DNA, 16 bp, Homo sapiens
gactttttagccagtg

SEQ ID NO: 2685439 - DNA, 17 bp, Homo sapiens
gactttttagccagtga

SEQ ID NO: 2685440 - DNA, 11 bp, Homo sapiens
gagaaccaaaa

SEQ ID NO: 2685441 - DNA, 17 bp, Homo sapiens
gagaaccaaaagatgcc

SEQ ID NO: 2685442 - DNA, 20 bp, Homo sapiens
gagaaccaaaagatgccttg

SEQ ID NO: 2685443 - DNA, 23 bp, Homo sapiens
gagaactggggttcaagcccagg

SEQ ID NO: 2685444 - DNA, 15 bp, Homo sapiens
gagaagcgctgccct

SEQ ID NO: 2685445 - DNA, 12 bp, Homo sapiens
gagaccacctct

SEQ ID NO: 2685446 - DNA, 14 bp, Homo sapiens
gagaccagcctggc

SEQ ID NO: 2685447 - DNA, 23 bp, Homo sapiens
gagactaaggggcagctcctgac

SEQ ID NO: 2685448 - DNA, 12 bp, Homo sapiens
gagactctgtgg

SEQ ID NO: 2685449 - DNA, 16 bp, Homo sapiens
gagactggagcatctg

SEQ ID NO: 2685450 - DNA, 20 bp, Homo sapiens
gagactggagcatctgactc

SEQ ID NO: 2685451 - DNA, 20 bp, Homo sapiens
gagagccagatgcctcccca

SEQ ID NO: 2685452 - DNA, 10 bp, Homo sapiens
gagagcccag

SEQ ID NO: 2685453 - DNA, 22 bp, Homo sapiens
gagagggccaacaactgtccct

SEQ ID NO: 2685454 - DNA, 16 bp, Homo sapiens
gagatgactgagtcct

SEQ ID NO: 2685455 - DNA, 18 bp, Homo sapiens
gagcaaaatgcatgtaat

SEQ ID NO: 2685456 - DNA, 16 bp, Homo sapiens
gagcaaatgtttctgc

SEQ ID NO: 2685457 - DNA, 18 bp, Homo sapiens
gagcaagctctgccctgg

SEQ ID NO: 2685458 - DNA, 20 bp, Homo sapiens
gagcaagctctgccctggct

SEQ ID NO: 2685459 - DNA, 13 bp, Homo sapiens
gagcagaggcagc

SEQ ID NO: 2685460 - DNA, 15 bp, Homo sapiens
gagcaggcagggctg

SEQ ID NO: 2685461 - DNA, 15 bp, Homo sapiens
gagcagggccaaagc

SEQ ID NO: 2685462 - DNA, 19 bp, Homo sapiens
gagcagggccaaagcacag

SEQ ID NO: 2685463 - DNA, 20 bp, Homo sapiens
gagcagggccaaagcacagc

SEQ ID NO: 2685464 - DNA, 16 bp, Homo sapiens
gagccacgctggcctt

SEQ ID NO: 2685465 - DNA, 16 bp, Homo sapiens
gagccagttctggggc

SEQ ID NO: 2685466 - DNA, 18 bp, Homo sapiens
cttcgtctccatctctgg

SEQ ID NO: 2685467 - DNA, 21 bp, Homo sapiens
cttctaagttgagtatattat

SEQ ID NO: 2685468 - DNA, 20 bp, Homo sapiens
cttctagctttgttgtcctc

SEQ ID NO: 2685469 - DNA, 17 bp, Homo sapiens
cttctgcccttcctcca

SEQ ID NO: 2685470 - DNA, 18 bp, Homo sapiens
cttctggcttatgctcag

SEQ ID NO: 2685471 - DNA, 14 bp, Homo sapiens
cttctgtctcctgt

SEQ ID NO: 2685472 - DNA, 22 bp, Homo sapiens
cttgaaataccagtgaaccaaa

SEQ ID NO: 2685473 - DNA, 13 bp, Homo sapiens
cttgagccatcca

SEQ ID NO: 2685474 - DNA, 17 bp, Homo sapiens
cttgagccatccaaaga

SEQ ID NO: 2685475 - DNA, 16 bp, Homo sapiens
cttgaggacacatgtc

SEQ ID NO: 2685476 - DNA, 17 bp, Homo sapiens
cttgaggacacatgtcc

SEQ ID NO: 2685477 - DNA, 22 bp, Homo sapiens
cttgcatttcacttgagtggag

SEQ ID NO: 2685478 - DNA, 13 bp, Homo sapiens
cttgcccctgctc

SEQ ID NO: 2685479 - DNA, 14 bp, Homo sapiens
cttgccgagcctaa

SEQ ID NO: 2685480 - DNA, 19 bp, Homo sapiens
cttgccgagcctaatgaaa

SEQ ID NO: 2685481 - DNA, 23 bp, Homo sapiens
cttgccgagcctaatgaaaggga

SEQ ID NO: 2685482 - DNA, 24 bp, Homo sapiens
cttgcctggaactcactcactctg

SEQ ID NO: 2685483 - DNA, 16 bp, Homo sapiens
cttgctgtcctaggcc

SEQ ID NO: 2685484 - DNA, 22 bp, Homo sapiens
cttggaaagcatcacctcaggc

SEQ ID NO: 2685485 - DNA, 16 bp, Homo sapiens
cttggcacgagggggg

SEQ ID NO: 2685486 - DNA, 18 bp, Homo sapiens
cttggcatcacagggcag

SEQ ID NO: 2685487 - DNA, 17 bp, Homo sapiens
cttggttcccttgtgtg

SEQ ID NO: 2685488 - DNA, 23 bp, Homo sapiens
cttgtccttttgtaccatggtgt

SEQ ID NO: 2685489 - DNA, 17 bp, Homo sapiens
cttgtgggaccagtccc

SEQ ID NO: 2685490 - DNA, 21 bp, Homo sapiens
cttgtgggaccagtcccacac

SEQ ID NO: 2685491 - DNA, 20 bp, Homo sapiens
cttgtgtactgataaaatac

SEQ ID NO: 2685492 - DNA, 18 bp, Homo sapiens
cttgttagccaacttcaa

SEQ ID NO: 2685493 - DNA, 17 bp, Homo sapiens
cttgttccgtgccaggc

SEQ ID NO: 2685494 - DNA, 22 bp, Homo sapiens
ctttaaaaaagctataaattat

SEQ ID NO: 2685495 - DNA, 22 bp, Homo sapiens
ctttacatgctgtgctctttga

SEQ ID NO: 2685496 - DNA, 13 bp, Homo sapiens
ctttacctgcagg

SEQ ID NO: 2685497 - DNA, 17 bp, Homo sapiens
ctttacctgcaggctcc

SEQ ID NO: 2685498 - DNA, 13 bp, Homo sapiens
ctttactcagccc

SEQ ID NO: 2685499 - DNA, 14 bp, Homo sapiens
ctttactctgctct

SEQ ID NO: 2685500 - DNA, 19 bp, Homo sapiens
ctttagaatcgctttcctt

SEQ ID NO: 2685501 - DNA, 18 bp, Homo sapiens
ctttagcttatttttaca

SEQ ID NO: 2685502 - DNA, 14 bp, Homo sapiens
ctttcaactcattg

SEQ ID NO: 2685503 - DNA, 20 bp, Homo sapiens
ctttcagagaggtctcaggt

SEQ ID NO: 2685504 - DNA, 14 bp, Homo sapiens
ctttcagagccagt

SEQ ID NO: 2685505 - DNA, 21 bp, Homo sapiens
ctttcagcattaggcttttaa

SEQ ID NO: 2685506 - DNA, 16 bp, Homo sapiens
ctttctactcatttta

SEQ ID NO: 2685507 - DNA, 19 bp, Homo sapiens
ctttctctgagaaccaaaa

SEQ ID NO: 2685508 - DNA, 14 bp, Homo sapiens
ctttctgggccaag

SEQ ID NO: 2685509 - DNA, 18 bp, Homo sapiens
ctttcttctctgcctcct

SEQ ID NO: 2685510 - DNA, 16 bp, Homo sapiens
ctttgaaaatatatac

SEQ ID NO: 2685511 - DNA, 22 bp, Homo sapiens
ctttgatatataggacattgat

SEQ ID NO: 2685512 - DNA, 13 bp, Homo sapiens
ctttgctacaata

SEQ ID NO: 2685513 - DNA, 16 bp, Homo sapiens
ctttgctacaataaat

SEQ ID NO: 2685514 - DNA, 17 bp, Homo sapiens
ctttgctacaataaatg

SEQ ID NO: 2685515 - DNA, 18 bp, Homo sapiens
ctttgctacaataaatgc

SEQ ID NO: 2685516 - DNA, 15 bp, Homo sapiens
ctttgttgtcctccc

SEQ ID NO: 2685517 - DNA, 20 bp, Homo sapiens
ctttgttgtcctcccaggaa

SEQ ID NO: 2685518 - DNA, 18 bp, Homo sapiens
ctttgttgtctccctctt

SEQ ID NO: 2685519 - DNA, 13 bp, Homo sapiens
cttttaaaagact

SEQ ID NO: 2685520 - DNA, 13 bp, Homo sapiens
cttttaagccctg

SEQ ID NO: 2685521 - DNA, 16 bp, Homo sapiens
cttttccatcctgagg

SEQ ID NO: 2685522 - DNA, 17 bp, Homo sapiens
cttttccattgaccagc

SEQ ID NO: 2685523 - DNA, 14 bp, Homo sapiens
cttttccccaggag

SEQ ID NO: 2685524 - DNA, 22 bp, Homo sapiens
cttttctaattcctgttgctct

SEQ ID NO: 2685525 - DNA, 12 bp, Homo sapiens
cttttctgcaga

SEQ ID NO: 2685526 - DNA, 15 bp, Homo sapiens
cttttctgcagaggg

SEQ ID NO: 2685527 - DNA, 22 bp, Homo sapiens
cttttgggtctgtcctctctgt

SEQ ID NO: 2685528 - DNA, 16 bp, Homo sapiens
cttttgtcctgttatt

SEQ ID NO: 2685529 - DNA, 21 bp, Homo sapiens
cttttgtttaaatataaatgt

SEQ ID NO: 2685530 - DNA, 22 bp, Homo sapiens
gaaaaataccatgtctctaagc

SEQ ID NO: 2685531 - DNA, 21 bp, Homo sapiens
gaaaaatatgttgagtgttca

SEQ ID NO: 2685532 - DNA, 17 bp, Homo sapiens
gaaaacacggccctcct

SEQ ID NO: 2685533 - DNA, 20 bp, Homo sapiens
gaaaacacggccctcctggg

SEQ ID NO: 2685534 - DNA, 21 bp, Homo sapiens
gaaaacacggccctcctggga

SEQ ID NO: 2685535 - DNA, 19 bp, Homo sapiens
gaaaacctcatttaccata

SEQ ID NO: 2685536 - DNA, 20 bp, Homo sapiens
gaaacactaagctctctggg

SEQ ID NO: 2685537 - DNA, 13 bp, Homo sapiens
gaaacactcttat

SEQ ID NO: 2685538 - DNA, 22 bp, Homo sapiens
gaaacgcagattgggctggctc

SEQ ID NO: 2685539 - DNA, 24 bp, Homo sapiens
gaaagaaaaataccatgtctctaa

SEQ ID NO: 2685540 - DNA, 20 bp, Homo sapiens
gaaagccagcaaagcctcca

SEQ ID NO: 2685541 - DNA, 22 bp, Homo sapiens
gaaagctgatgatgtctcttgt

SEQ ID NO: 2685542 - DNA, 14 bp, Homo sapiens
gaaaggctcagtct

SEQ ID NO: 2685543 - DNA, 20 bp, Homo sapiens
gaaaggtgctgatggccctc

SEQ ID NO: 2685544 - DNA, 17 bp, Homo sapiens
gaaagtcagatgcccag

SEQ ID NO: 2685545 - DNA, 16 bp, Homo sapiens
gaaatcagtaaacact

SEQ ID NO: 2685546 - DNA, 19 bp, Homo sapiens
gaaatcagtaaacactgtg

SEQ ID NO: 2685547 - DNA, 15 bp, Homo sapiens
gaaatcattgtagaa

SEQ ID NO: 2685548 - DNA, 22 bp, Homo sapiens
gaaattttactgacagaaatgc

SEQ ID NO: 2685549 - DNA, 13 bp, Homo sapiens
gaacaatgaatgc

SEQ ID NO: 2685550 - DNA, 14 bp, Homo sapiens
gaacacccactggc

SEQ ID NO: 2685551 - DNA, 22 bp, Homo sapiens
gaacacccactggccagtccta

SEQ ID NO: 2685552 - DNA, 16 bp, Homo sapiens
gaaccaaaagatgcct

SEQ ID NO: 2685553 - DNA, 18 bp, Homo sapiens
gaaccaaaagatgccttg

SEQ ID NO: 2685554 - DNA, 17 bp, Homo sapiens
gaaccaaagagactgga

SEQ ID NO: 2685555 - DNA, 21 bp, Homo sapiens
gaaccagtgtaactggctgct

SEQ ID NO: 2685556 - DNA, 22 bp, Homo sapiens
gaaccagtgtaactggctgctc

SEQ ID NO: 2685557 - DNA, 19 bp, Homo sapiens
gaacccaggtctgatgcca

SEQ ID NO: 2685558 - DNA, 22 bp, Homo sapiens
gaaccgacttttctaaagctct

SEQ ID NO: 2685559 - DNA, 11 bp, Homo sapiens
gaacctcaggc

SEQ ID NO: 2685560 - DNA, 16 bp, Homo sapiens
gaacctccttacctgg

SEQ ID NO: 2685561 - DNA, 17 bp, Homo sapiens
gaacgatgcctgcaggc

SEQ ID NO: 2685562 - DNA, 13 bp, Homo sapiens
gaacttgaggaca

SEQ ID NO: 2685563 - DNA, 18 bp, Homo sapiens
gaacttgaggacacatgt

SEQ ID NO: 2685564 - DNA, 21 bp, Homo sapiens
gaacttgaggacacatgtcca

SEQ ID NO: 2685565 - DNA, 18 bp, Homo sapiens
gaagaaattcctgtagca

SEQ ID NO: 2685566 - DNA, 22 bp, Homo sapiens
gaagaaattcctgtagcatctt

SEQ ID NO: 2685567 - DNA, 19 bp, Homo sapiens
gaagagtagaacccaggtc

SEQ ID NO: 2685568 - DNA, 22 bp, Homo sapiens
gaagagtagaacccaggtctga

SEQ ID NO: 2685569 - DNA, 20 bp, Homo sapiens
gaagatcagagctgcagcca

SEQ ID NO: 2685570 - DNA, 18 bp, Homo sapiens
gaagatggactctgaaaa

SEQ ID NO: 2685571 - DNA, 19 bp, Homo sapiens
gaagcaggttgaggggctc

SEQ ID NO: 2685572 - DNA, 12 bp, Homo sapiens
gaagccaggagc

SEQ ID NO: 2685573 - DNA, 20 bp, Homo sapiens
gaagcccctgggggctccct

SEQ ID NO: 2685574 - DNA, 12 bp, Homo sapiens
gaagcctgaggc

SEQ ID NO: 2685575 - DNA, 13 bp, Homo sapiens
gaagcctgaggct

SEQ ID NO: 2685576 - DNA, 13 bp, Homo sapiens
ctgggccaggtct

SEQ ID NO: 2685577 - DNA, 13 bp, Homo sapiens
ctgggcgacagag

SEQ ID NO: 2685578 - DNA, 17 bp, Homo sapiens
ctgggctctgccccagc

SEQ ID NO: 2685579 - DNA, 16 bp, Homo sapiens
ctggggcaagtccctg

SEQ ID NO: 2685580 - DNA, 21 bp, Homo sapiens
ctggggcccgcctgccacctc

SEQ ID NO: 2685581 - DNA, 14 bp, Homo sapiens
ctgggggcatcctg

SEQ ID NO: 2685582 - DNA, 15 bp, Homo sapiens
ctgggggcatcctgc

SEQ ID NO: 2685583 - DNA, 21 bp, Homo sapiens
ctggggttcaagcccaggctt

SEQ ID NO: 2685584 - DNA, 23 bp, Homo sapiens
ctggggttcaagcccaggcttcc

SEQ ID NO: 2685585 - DNA, 14 bp, Homo sapiens
ctgggtcgggacag

SEQ ID NO: 2685586 - DNA, 20 bp, Homo sapiens
ctgggtggaagtgcccagcc

SEQ ID NO: 2685587 - DNA, 20 bp, Homo sapiens
ctggtatgaacttgaggaca

SEQ ID NO: 2685588 - DNA, 21 bp, Homo sapiens
ctggtatgaacttgaggacac

SEQ ID NO: 2685589 - DNA, 13 bp, Homo sapiens
ctggtccctgccc

SEQ ID NO: 2685590 - DNA, 14 bp, Homo sapiens
ctggtccctgccct

SEQ ID NO: 2685591 - DNA, 16 bp, Homo sapiens
ctggtccctgccctcc

SEQ ID NO: 2685592 - DNA, 22 bp, Homo sapiens
ctggtccctgccctcccctgct

SEQ ID NO: 2685593 - DNA, 16 bp, Homo sapiens
ctggtcctccctccca

SEQ ID NO: 2685594 - DNA, 12 bp, Homo sapiens
ctggtgcctttc

SEQ ID NO: 2685595 - DNA, 16 bp, Homo sapiens
ctggtggacagtcctg

SEQ ID NO: 2685596 - DNA, 18 bp, Homo sapiens
ctggtgggtcagcccagc

SEQ ID NO: 2685597 - DNA, 21 bp, Homo sapiens
ctggtgggtcagcccagcacc

SEQ ID NO: 2685598 - DNA, 14 bp, Homo sapiens
ctggtttgccaggc

SEQ ID NO: 2685599 - DNA, 17 bp, Homo sapiens
ctgtagcatcttctgga

SEQ ID NO: 2685600 - DNA, 15 bp, Homo sapiens
ctgtagccacctcct

SEQ ID NO: 2685601 - DNA, 17 bp, Homo sapiens
ctgtagccacctccttg

SEQ ID NO: 2685602 - DNA, 20 bp, Homo sapiens
ctgtagccacctccttggca

SEQ ID NO: 2685603 - DNA, 16 bp, Homo sapiens
ctgtcagaatcatgct

SEQ ID NO: 2685604 - DNA, 21 bp, Homo sapiens
ctgtcagaatcatgctgttct

SEQ ID NO: 2685605 - DNA, 24 bp, Homo sapiens
ctgtcagaatcatgctgttctctt

SEQ ID NO: 2685606 - DNA, 21 bp, Homo sapiens
ctgtcaggacaccagcctggt

SEQ ID NO: 2685607 - DNA, 20 bp, Homo sapiens
ctgtcagggcagtacaatgt

SEQ ID NO: 2685608 - DNA, 16 bp, Homo sapiens
ctgtcattgcccctcc

SEQ ID NO: 2685609 - DNA, 23 bp, Homo sapiens
ctgtccataaagtaattttgtga

SEQ ID NO: 2685610 - DNA, 14 bp, Homo sapiens
ctgtccctacccac

SEQ ID NO: 2685611 - DNA, 22 bp, Homo sapiens
ctgtccctccttgagcaccagc

SEQ ID NO: 2685612 - DNA, 18 bp, Homo sapiens
ctgtccgtgtgcctcctg

SEQ ID NO: 2685613 - DNA, 20 bp, Homo sapiens
ctgtccgtgtgcctcctgtg

SEQ ID NO: 2685614 - DNA, 15 bp, Homo sapiens
ctgtcctaggccaca

SEQ ID NO: 2685615 - DNA, 12 bp, Homo sapiens
ctgtcctctctg

SEQ ID NO: 2685616 - DNA, 16 bp, Homo sapiens
ctgtctgtctgtccca

SEQ ID NO: 2685617 - DNA, 17 bp, Homo sapiens
ctgtctgtctgtcccaa

SEQ ID NO: 2685618 - DNA, 15 bp, Homo sapiens
ctgtctgtctgtctg

SEQ ID NO: 2685619 - DNA, 23 bp, Homo sapiens
ctgtctttagaatcgctttcctt

SEQ ID NO: 2685620 - DNA, 13 bp, Homo sapiens
ctgtgaccaaagc

SEQ ID NO: 2685621 - DNA, 16 bp, Homo sapiens
ctgtgacctgccccgc

SEQ ID NO: 2685622 - DNA, 22 bp, Homo sapiens
ctgtgagagccacgctggcctt

SEQ ID NO: 2685623 - DNA, 23 bp, Homo sapiens
ctgtgagagccacgctggccttc

SEQ ID NO: 2685624 - DNA, 20 bp, Homo sapiens
ctgtgatattttacttgaat

SEQ ID NO: 2685625 - DNA, 22 bp, Homo sapiens
ctgtgcagggaggaggtggcag

SEQ ID NO: 2685626 - DNA, 19 bp, Homo sapiens
ctgtgctagcaacacccaa

SEQ ID NO: 2685627 - DNA, 15 bp, Homo sapiens
ctgtgctcttcctct

SEQ ID NO: 2685628 - DNA, 18 bp, Homo sapiens
ctgtgctcttcctctggt

SEQ ID NO: 2685629 - DNA, 21 bp, Homo sapiens
ctgtgctcttcctctggtttc

SEQ ID NO: 2685630 - DNA, 18 bp, Homo sapiens
ctgtgctttgactcacct

SEQ ID NO: 2685631 - DNA, 11 bp, Homo sapiens
ctgtggcctgg

SEQ ID NO: 2685632 - DNA, 18 bp, Homo sapiens
ctgtgggtatcaggactg

SEQ ID NO: 2685633 - DNA, 21 bp, Homo sapiens
ctgttacttgaaataccagtg

SEQ ID NO: 2685634 - DNA, 19 bp, Homo sapiens
ctgttattttttatttcca

SEQ ID NO: 2685635 - DNA, 14 bp, Homo sapiens
ctgttcattctgat

SEQ ID NO: 2685636 - DNA, 12 bp, Homo sapiens
ctgttctctttg

SEQ ID NO: 2685637 - DNA, 19 bp, Homo sapiens
ctgttctctttgctgacac

SEQ ID NO: 2685638 - DNA, 23 bp, Homo sapiens
ctgttgttgaggtggtggtagtg

SEQ ID NO: 2685639 - DNA, 18 bp, Homo sapiens
ctgtttaaaaaaagtata

SEQ ID NO: 2685640 - DNA, 23 bp, Homo sapiens
ctgtttaaaaaaagtatatattc

SEQ ID NO: 2685641 - DNA, 17 bp, Homo sapiens
ctgttttgcttttgtaa

SEQ ID NO: 2685642 - DNA, 19 bp, Homo sapiens
cttaaaaaaaactctttaa

SEQ ID NO: 2685643 - DNA, 16 bp, Homo sapiens
cttaattttttttaat

SEQ ID NO: 2685644 - DNA, 18 bp, Homo sapiens
cttacttcacccggctgg

SEQ ID NO: 2685645 - DNA, 19 bp, Homo sapiens
cttagacggaggtgcctga

SEQ ID NO: 2685646 - DNA, 20 bp, Homo sapiens
cttagattagctctggacca

SEQ ID NO: 2685647 - DNA, 21 bp, Homo sapiens
cttagattagctctggaccag

SEQ ID NO: 2685648 - DNA, 20 bp, Homo sapiens
cttagctgaacaatgaatgc

SEQ ID NO: 2685649 - DNA, 18 bp, Homo sapiens
cttagtggggttttatat

SEQ ID NO: 2685650 - DNA, 16 bp, Homo sapiens
cttatgctcagaagcc

SEQ ID NO: 2685651 - DNA, 19 bp, Homo sapiens
cttatgctcagaagccagt

SEQ ID NO: 2685652 - DNA, 20 bp, Homo sapiens
cttatgctcagaagccagtc

SEQ ID NO: 2685653 - DNA, 18 bp, Homo sapiens
cttcaagggaagaaacac

SEQ ID NO: 2685654 - DNA, 16 bp, Homo sapiens
cttcaagttagctcag

SEQ ID NO: 2685655 - DNA, 20 bp, Homo sapiens
cttcacagaggaagaaacct

SEQ ID NO: 2685656 - DNA, 14 bp, Homo sapiens
cttcacccggctgg

SEQ ID NO: 2685657 - DNA, 15 bp, Homo sapiens
cttcacccggctggg

SEQ ID NO: 2685658 - DNA, 19 bp, Homo sapiens
cttcactccggtgtgcctg

SEQ ID NO: 2685659 - DNA, 20 bp, Homo sapiens
cttcagaaggggacctgttt

SEQ ID NO: 2685660 - DNA, 15 bp, Homo sapiens
cttcagcctgaggct

SEQ ID NO: 2685661 - DNA, 20 bp, Homo sapiens
cttccaaccccagctggcct

SEQ ID NO: 2685662 - DNA, 16 bp, Homo sapiens
cttccaggcccccacc

SEQ ID NO: 2685663 - DNA, 17 bp, Homo sapiens
cttccatcttcacactg

SEQ ID NO: 2685664 - DNA, 15 bp, Homo sapiens
cttccatgccccagg

SEQ ID NO: 2685665 - DNA, 16 bp, Homo sapiens
cttcccagaggcagag

SEQ ID NO: 2685666 - DNA, 17 bp, Homo sapiens
cttcccctttactcagc

SEQ ID NO: 2685667 - DNA, 20 bp, Homo sapiens
cttcccctttactcagccca

SEQ ID NO: 2685668 - DNA, 13 bp, Homo sapiens
cttcccgctcccc

SEQ ID NO: 2685669 - DNA, 14 bp, Homo sapiens
cttcccgctcccca

SEQ ID NO: 2685670 - DNA, 16 bp, Homo sapiens
cttcccgctccccacc

SEQ ID NO: 2685671 - DNA, 17 bp, Homo sapiens
cttcccgctccccacct

SEQ ID NO: 2685672 - DNA, 17 bp, Homo sapiens
cttccctccctgaggca

SEQ ID NO: 2685673 - DNA, 14 bp, Homo sapiens
cttcccttctccct

SEQ ID NO: 2685674 - DNA, 22 bp, Homo sapiens
cttcctccaggagaaggggccc

SEQ ID NO: 2685675 - DNA, 22 bp, Homo sapiens
cttcctccccttttgcccccgt

SEQ ID NO: 2685676 - DNA, 15 bp, Homo sapiens
cttcctgaaagctgt

SEQ ID NO: 2685677 - DNA, 16 bp, Homo sapiens
cttcctgccaccagtc

SEQ ID NO: 2685678 - DNA, 18 bp, Homo sapiens
cttcctgccaccagtcac

SEQ ID NO: 2685679 - DNA, 17 bp, Homo sapiens
cttcctgtcccacctct

SEQ ID NO: 2685680 - DNA, 23 bp, Homo sapiens
cttcctgtctttgttgtctccct

SEQ ID NO: 2685681 - DNA, 11 bp, Homo sapiens
cttccttgccc

SEQ ID NO: 2685682 - DNA, 13 bp, Homo sapiens
cttccttgcccct

SEQ ID NO: 2685683 - DNA, 15 bp, Homo sapiens
cttccttgcccctgc

SEQ ID NO: 2685684 - DNA, 19 bp, Homo sapiens
cttccttgctgtcctaggc

SEQ ID NO: 2685685 - DNA, 14 bp, Homo sapiens
cttcctttcaggcc

SEQ ID NO: 2685686 - DNA, 18 bp, Homo sapiens
cttcctttcaggccaagg

SEQ ID NO: 2685687 - DNA, 12 bp, Homo sapiens
ctgccaccagtc

SEQ ID NO: 2685688 - DNA, 17 bp, Homo sapiens
ctgccaccagtcactgt

SEQ ID NO: 2685689 - DNA, 15 bp, Homo sapiens
ctgccacctctccca

SEQ ID NO: 2685690 - DNA, 22 bp, Homo sapiens
ctgccacctctcccagccctca

SEQ ID NO: 2685691 - DNA, 17 bp, Homo sapiens
ctgccacctgtctgtct

SEQ ID NO: 2685692 - DNA, 23 bp, Homo sapiens
ctgccactttggtacatggccag

SEQ ID NO: 2685693 - DNA, 12 bp, Homo sapiens
ctgccagccaca

SEQ ID NO: 2685694 - DNA, 16 bp, Homo sapiens
ctgccagcctggcttc

SEQ ID NO: 2685695 - DNA, 11 bp, Homo sapiens
ctgccagctgc

SEQ ID NO: 2685696 - DNA, 14 bp, Homo sapiens
ctgccccagctctg

SEQ ID NO: 2685697 - DNA, 15 bp, Homo sapiens
ctgccccagctctgg

SEQ ID NO: 2685698 - DNA, 20 bp, Homo sapiens
ctgccccatcattgcacctg

SEQ ID NO: 2685699 - DNA, 12 bp, Homo sapiens
ctgccccctggt

SEQ ID NO: 2685700 - DNA, 14 bp, Homo sapiens
ctgccccctggtgg

SEQ ID NO: 2685701 - DNA, 16 bp, Homo sapiens
ctgccccgcccagctg

SEQ ID NO: 2685702 - DNA, 19 bp, Homo sapiens
ctgcccctacgggcgctgc

SEQ ID NO: 2685703 - DNA, 22 bp, Homo sapiens
ctgcccctacgggcgctgcagc

SEQ ID NO: 2685704 - DNA, 23 bp, Homo sapiens
ctgcccctacgggcgctgcagcc

SEQ ID NO: 2685705 - DNA, 21 bp, Homo sapiens
ctgccctcccctgctcccagg

SEQ ID NO: 2685706 - DNA, 13 bp, Homo sapiens
ctgccctctgccc

SEQ ID NO: 2685707 - DNA, 15 bp, Homo sapiens
ctgccctgccacctg

SEQ ID NO: 2685708 - DNA, 18 bp, Homo sapiens
ctgccctgccacctgtct

SEQ ID NO: 2685709 - DNA, 21 bp, Homo sapiens
ctgccctgccacctgtctgtc

SEQ ID NO: 2685710 - DNA, 14 bp, Homo sapiens
ctgccctgccctgc

SEQ ID NO: 2685711 - DNA, 17 bp, Homo sapiens
ctgccctggctgtgggt

SEQ ID NO: 2685712 - DNA, 13 bp, Homo sapiens
ctgccctgtgaga

SEQ ID NO: 2685713 - DNA, 13 bp, Homo sapiens
ctgcccttcctcc

SEQ ID NO: 2685714 - DNA, 16 bp, Homo sapiens
ctgcccttcctccagg

SEQ ID NO: 2685715 - DNA, 18 bp, Homo sapiens
ctgcccttcctccaggag

SEQ ID NO: 2685716 - DNA, 14 bp, Homo sapiens
ctgcctcctcctca

SEQ ID NO: 2685717 - DNA, 16 bp, Homo sapiens
ctgcctcctcctcacg

SEQ ID NO: 2685718 - DNA, 17 bp, Homo sapiens
ctgcctgccttctcccc

SEQ ID NO: 2685719 - DNA, 14 bp, Homo sapiens
ctgcctggtcctcc

SEQ ID NO: 2685720 - DNA, 14 bp, Homo sapiens
ctgccttctcccct

SEQ ID NO: 2685721 - DNA, 18 bp, Homo sapiens
ctgcgaaggggccctggt

SEQ ID NO: 2685722 - DNA, 16 bp, Homo sapiens
ctgcgccccgcctccc

SEQ ID NO: 2685723 - DNA, 18 bp, Homo sapiens
ctgcgggatggtcctggg

SEQ ID NO: 2685724 - DNA, 20 bp, Homo sapiens
ctgcgggatggtcctggggc

SEQ ID NO: 2685725 - DNA, 22 bp, Homo sapiens
ctgcgggatggtcctggggctc

SEQ ID NO: 2685726 - DNA, 15 bp, Homo sapiens
ctgcgggggagccag

SEQ ID NO: 2685727 - DNA, 23 bp, Homo sapiens
ctgcgtcaggcacgtctcctgct

SEQ ID NO: 2685728 - DNA, 22 bp, Homo sapiens
ctgcgtgacatgtgcagtgctg

SEQ ID NO: 2685729 - DNA, 14 bp, Homo sapiens
ctgctagctgtctc

SEQ ID NO: 2685730 - DNA, 22 bp, Homo sapiens
ctgctcattccgagggtgaaac

SEQ ID NO: 2685731 - DNA, 11 bp, Homo sapiens
ctgctcccagg

SEQ ID NO: 2685732 - DNA, 14 bp, Homo sapiens
ctgctcccagggac

SEQ ID NO: 2685733 - DNA, 13 bp, Homo sapiens
ctgctcccagtgg

SEQ ID NO: 2685734 - DNA, 17 bp, Homo sapiens
ctgctccctgctcccag

SEQ ID NO: 2685735 - DNA, 16 bp, Homo sapiens
ctgctctatgccaggc

SEQ ID NO: 2685736 - DNA, 19 bp, Homo sapiens
ctgctctatgccaggctgt

SEQ ID NO: 2685737 - DNA, 23 bp, Homo sapiens
ctgctctatgccaggctgtgcta

SEQ ID NO: 2685738 - DNA, 22 bp, Homo sapiens
ctgctctgaggcttccagagag

SEQ ID NO: 2685739 - DNA, 14 bp, Homo sapiens
ctgctctgcttcct

SEQ ID NO: 2685740 - DNA, 19 bp, Homo sapiens
ctgctctgcttcctcaggg

SEQ ID NO: 2685741 - DNA, 16 bp, Homo sapiens
ctgctctgtagccacc

SEQ ID NO: 2685742 - DNA, 17 bp, Homo sapiens
ctgctctgtagccacct

SEQ ID NO: 2685743 - DNA, 12 bp, Homo sapiens
ctgctctttctc

SEQ ID NO: 2685744 - DNA, 19 bp, Homo sapiens
ctgctgcgggggagccagt

SEQ ID NO: 2685745 - DNA, 21 bp, Homo sapiens
ctgctgcgggggagccagttc

SEQ ID NO: 2685746 - DNA, 11 bp, Homo sapiens
ctgctggcagg

SEQ ID NO: 2685747 - DNA, 17 bp, Homo sapiens
ctgctgggacccacctc

SEQ ID NO: 2685748 - DNA, 21 bp, Homo sapiens
ctgctgggacccacctccccc

SEQ ID NO: 2685749 - DNA, 22 bp, Homo sapiens
ctgctgggacccacctccccct

SEQ ID NO: 2685750 - DNA, 17 bp, Homo sapiens
ctgctgggactggccag

SEQ ID NO: 2685751 - DNA, 22 bp, Homo sapiens
ctgcttcctcagggcccagcag

SEQ ID NO: 2685752 - DNA, 15 bp, Homo sapiens
ctgctttcttctctg

SEQ ID NO: 2685753 - DNA, 21 bp, Homo sapiens
ctgctttcttctctgcctcct

SEQ ID NO: 2685754 - DNA, 22 bp, Homo sapiens
ctgctttcttctctgcctcctc

SEQ ID NO: 2685755 - DNA, 22 bp, Homo sapiens
ctggaaaggctcagtctcagga

SEQ ID NO: 2685756 - DNA, 23 bp, Homo sapiens
ctggaaaggctcagtctcaggag

SEQ ID NO: 2685757 - DNA, 21 bp, Homo sapiens
ctggaccaaccctgtttcctg

SEQ ID NO: 2685758 - DNA, 22 bp, Homo sapiens
ctggaccaaccctgtttcctga

SEQ ID NO: 2685759 - DNA, 23 bp, Homo sapiens
ctggaccaaccctgtttcctgag

SEQ ID NO: 2685760 - DNA, 17 bp, Homo sapiens
ctggactgactgcagcc

SEQ ID NO: 2685761 - DNA, 18 bp, Homo sapiens
ctggacttgagcttggca

SEQ ID NO: 2685762 - DNA, 15 bp, Homo sapiens
ctggagcaagctctg

SEQ ID NO: 2685763 - DNA, 21 bp, Homo sapiens
ctggagcaagctctgccctgg

SEQ ID NO: 2685764 - DNA, 13 bp, Homo sapiens
ctggagcccagga

SEQ ID NO: 2685765 - DNA, 15 bp, Homo sapiens
ctggagcccttgggt

SEQ ID NO: 2685766 - DNA, 15 bp, Homo sapiens
ctggaggggcccacc

SEQ ID NO: 2685767 - DNA, 19 bp, Homo sapiens
ctggagtaaccggacacct

SEQ ID NO: 2685768 - DNA, 22 bp, Homo sapiens
ctggagtcccgtccctgcccag

SEQ ID NO: 2685769 - DNA, 15 bp, Homo sapiens
cgctcacctcagagc

SEQ ID NO: 2685770 - DNA, 21 bp, Homo sapiens
cgctccactacccggcagggt

SEQ ID NO: 2685771 - DNA, 13 bp, Homo sapiens
cgctgcagcctcc

SEQ ID NO: 2685772 - DNA, 20 bp, Homo sapiens
cgctgcagcctcccttccat

SEQ ID NO: 2685773 - DNA, 11 bp, Homo sapiens
cgctgccctgt

SEQ ID NO: 2685774 - DNA, 14 bp, Homo sapiens
cgctgccctgtgag

SEQ ID NO: 2685775 - DNA, 15 bp, Homo sapiens
cgctgccttgccatg

SEQ ID NO: 2685776 - DNA, 14 bp, Homo sapiens
cgctggtccctgcc

SEQ ID NO: 2685777 - DNA, 18 bp, Homo sapiens
cgcttgctctcctggagc

SEQ ID NO: 2685778 - DNA, 19 bp, Homo sapiens
cgcttgctctcctggagca

SEQ ID NO: 2685779 - DNA, 15 bp, Homo sapiens
cggagcttgcagtga

SEQ ID NO: 2685780 - DNA, 17 bp, Homo sapiens
cggcacccaggcctccc

SEQ ID NO: 2685781 - DNA, 18 bp, Homo sapiens
cggcacccaggcctccct

SEQ ID NO: 2685782 - DNA, 14 bp, Homo sapiens
cggccacatgccgc

SEQ ID NO: 2685783 - DNA, 13 bp, Homo sapiens
cggccctcctggg

SEQ ID NO: 2685784 - DNA, 15 bp, Homo sapiens
cggccctcctgggaa

SEQ ID NO: 2685785 - DNA, 12 bp, Homo sapiens
cggcgcagagcc

SEQ ID NO: 2685786 - DNA, 14 bp, Homo sapiens
cggcgcagagccct

SEQ ID NO: 2685787 - DNA, 16 bp, Homo sapiens
cggcgcagagccctcc

SEQ ID NO: 2685788 - DNA, 19 bp, Homo sapiens
cggcggcacccaggcctcc

SEQ ID NO: 2685789 - DNA, 14 bp, Homo sapiens
cggctcccgcttgc

SEQ ID NO: 2685790 - DNA, 17 bp, Homo sapiens
cggctcccgcttgctct

SEQ ID NO: 2685791 - DNA, 22 bp, Homo sapiens
cggctcccgcttgctctcctgg

SEQ ID NO: 2685792 - DNA, 23 bp, Homo sapiens
cggctcccgcttgctctcctgga

SEQ ID NO: 2685793 - DNA, 12 bp, Homo sapiens
cgggaagcggag

SEQ ID NO: 2685794 - DNA, 18 bp, Homo sapiens
cgggacagaccagcagca

SEQ ID NO: 2685795 - DNA, 17 bp, Homo sapiens
cgggaggctgaggcagg

SEQ ID NO: 2685796 - DNA, 19 bp, Homo sapiens
cgggataaactgagcctgt

SEQ ID NO: 2685797 - DNA, 19 bp, Homo sapiens
cgggcacctatagtcccag

SEQ ID NO: 2685798 - DNA, 11 bp, Homo sapiens
cgggcccctgc

SEQ ID NO: 2685799 - DNA, 13 bp, Homo sapiens
cgggcccctgcct

SEQ ID NO: 2685800 - DNA, 18 bp, Homo sapiens
cgggcgctgcagcctccc

SEQ ID NO: 2685801 - DNA, 19 bp, Homo sapiens
cgggcgctgcagcctccct

SEQ ID NO: 2685802 - DNA, 20 bp, Homo sapiens
cgggcgctgcagcctccctt

SEQ ID NO: 2685803 - DNA, 16 bp, Homo sapiens
cggggcatgctggggc

SEQ ID NO: 2685804 - DNA, 22 bp, Homo sapiens
cggggctgctggcctggccctt

SEQ ID NO: 2685805 - DNA, 21 bp, Homo sapiens
cgggggagccagttctggggc

SEQ ID NO: 2685806 - DNA, 19 bp, Homo sapiens
cgggtaacagtgaggctgg

SEQ ID NO: 2685807 - DNA, 19 bp, Homo sapiens
cgggtggatcacctgaggt

SEQ ID NO: 2685808 - DNA, 20 bp, Homo sapiens
cggtgtgcctgcagccccgc

SEQ ID NO: 2685809 - DNA, 20 bp, Homo sapiens
cgtagccaaggtgggctgag

SEQ ID NO: 2685810 - DNA, 22 bp, Homo sapiens
cgtcaggcacgtctcctgctgc

SEQ ID NO: 2685811 - DNA, 23 bp, Homo sapiens
cgtcattttgaatcatcatgtga

SEQ ID NO: 2685812 - DNA, 17 bp, Homo sapiens
cgtcgggcccctgcctg

SEQ ID NO: 2685813 - DNA, 16 bp, Homo sapiens
cgtctccatctctggt

SEQ ID NO: 2685814 - DNA, 14 bp, Homo sapiens
cgtctcctgctgcg

SEQ ID NO: 2685815 - DNA, 19 bp, Homo sapiens
cgtctgtcctcctttctta

SEQ ID NO: 2685816 - DNA, 17 bp, Homo sapiens
cgtgaaaccccgtctct

SEQ ID NO: 2685817 - DNA, 16 bp, Homo sapiens
cgtgatggaccaaagc

SEQ ID NO: 2685818 - DNA, 21 bp, Homo sapiens
cgtgatggaccaaagccacct

SEQ ID NO: 2685819 - DNA, 19 bp, Homo sapiens
cgtggacacctgccctgcc

SEQ ID NO: 2685820 - DNA, 13 bp, Homo sapiens
cgtggggctcccg

SEQ ID NO: 2685821 - DNA, 15 bp, Homo sapiens
cgtgtccctctcgga

SEQ ID NO: 2685822 - DNA, 17 bp, Homo sapiens
cgtgtgcctcctgtgtg

SEQ ID NO: 2685823 - DNA, 19 bp, Homo sapiens
cgtgttactgttgcactga

SEQ ID NO: 2685824 - DNA, 13 bp, Homo sapiens
cgttttgaaactc

SEQ ID NO: 2685825 - DNA, 22 bp, Homo sapiens
ctaaaatatctgggtggcttaa

SEQ ID NO: 2685826 - DNA, 16 bp, Homo sapiens
ctaaactctgaataag

SEQ ID NO: 2685827 - DNA, 20 bp, Homo sapiens
ctaaagatatcagagctctt

SEQ ID NO: 2685828 - DNA, 22 bp, Homo sapiens
ctaaagctctgaacaaaagctt

SEQ ID NO: 2685829 - DNA, 12 bp, Homo sapiens
ctaaattgtata

SEQ ID NO: 2685830 - DNA, 23 bp, Homo sapiens
ctaacataaaatctgtgaattaa

SEQ ID NO: 2685831 - DNA, 20 bp, Homo sapiens
ctaagaggaaactagtgttt

SEQ ID NO: 2685832 - DNA, 21 bp, Homo sapiens
ctaagaggaaactagtgtttg

SEQ ID NO: 2685833 - DNA, 16 bp, Homo sapiens
ctaagctctctgggcc

SEQ ID NO: 2685834 - DNA, 17 bp, Homo sapiens
ctaagctctctgggcct

SEQ ID NO: 2685835 - DNA, 22 bp, Homo sapiens
ctaaggacccaaatttccctgg

SEQ ID NO: 2685836 - DNA, 13 bp, Homo sapiens
ctaaggggcagct

SEQ ID NO: 2685837 - DNA, 19 bp, Homo sapiens
ctaaggggcagctcctgac

SEQ ID NO: 2685838 - DNA, 23 bp, Homo sapiens
ctaaggggcagctcctgaccaaa

SEQ ID NO: 2685839 - DNA, 21 bp, Homo sapiens
ctaattggaagaaattcctgt

SEQ ID NO: 2685840 - DNA, 22 bp, Homo sapiens
ctaattggaagaaattcctgta

SEQ ID NO: 2685841 - DNA, 20 bp, Homo sapiens
ctacaataaatgctgaatga

SEQ ID NO: 2685842 - DNA, 12 bp, Homo sapiens
ctacacatatat

SEQ ID NO: 2685843 - DNA, 17 bp, Homo sapiens
ctacagaataatgtgtt

SEQ ID NO: 2685844 - DNA, 17 bp, Homo sapiens
ctaccaccccttcctgt

SEQ ID NO: 2685845 - DNA, 23 bp, Homo sapiens
ctacccactctttgctacaataa

SEQ ID NO: 2685846 - DNA, 13 bp, Homo sapiens
ctacccagctgat

SEQ ID NO: 2685847 - DNA, 11 bp, Homo sapiens
ctacctcagcc

SEQ ID NO: 2685848 - DNA, 12 bp, Homo sapiens
ctacctcagcct

SEQ ID NO: 2685849 - DNA, 19 bp, Homo sapiens
ctacgggcgctgcagcctc

SEQ ID NO: 2685850 - DNA, 20 bp, Homo sapiens
ctacgggcgctgcagcctcc

SEQ ID NO: 2685851 - DNA, 16 bp, Homo sapiens
ctactcagaagcctga

SEQ ID NO: 2685852 - DNA, 18 bp, Homo sapiens
ctactcctacctcagcct

SEQ ID NO: 2685853 - DNA, 22 bp, Homo sapiens
ctactcgggaggctgaggcagg

SEQ ID NO: 2685854 - DNA, 12 bp, Homo sapiens
ctactgccctcc

SEQ ID NO: 2685855 - DNA, 15 bp, Homo sapiens
ctactgccctcccct

SEQ ID NO: 2685856 - DNA, 21 bp, Homo sapiens
ctagaacacccactggccagt

SEQ ID NO: 2685857 - DNA, 20 bp, Homo sapiens
ctagagctcctgtccctacc

SEQ ID NO: 2685858 - DNA, 22 bp, Homo sapiens
ctagagctcctgtccctaccca

SEQ ID NO: 2685859 - DNA, 23 bp, Homo sapiens
ctagagctcctgtccctacccac

SEQ ID NO: 2685860 - DNA, 23 bp, Homo sapiens
ctagcagagcaggggcagggtga

SEQ ID NO: 2685861 - DNA, 14 bp, Homo sapiens
ctagccagaggctg

SEQ ID NO: 2685862 - DNA, 15 bp, Homo sapiens
ctagcctgggccaga

SEQ ID NO: 2685863 - DNA, 15 bp, Homo sapiens
ctagctgtctctctt

SEQ ID NO: 2685864 - DNA, 17 bp, Homo sapiens
ctagctgtctctcttgt

SEQ ID NO: 2685865 - DNA, 22 bp, Homo sapiens
ctagctttgttgtcctcccagg

SEQ ID NO: 2685866 - DNA, 12 bp, Homo sapiens
ctaggactctga

SEQ ID NO: 2685867 - DNA, 16 bp, Homo sapiens
ctaggactctgaggct

SEQ ID NO: 2685868 - DNA, 18 bp, Homo sapiens
ctaggagccccagcttcc

SEQ ID NO: 2685869 - DNA, 21 bp, Homo sapiens
ctaggagccccagcttcctgt

SEQ ID NO: 2685870 - DNA, 20 bp, Homo sapiens
ctagtcccttctctctttct

SEQ ID NO: 2685871 - DNA, 18 bp, Homo sapiens
ctagtttcagtaaataat

SEQ ID NO: 2685872 - DNA, 21 bp, Homo sapiens
ctagtttcagtaaataatgaa

SEQ ID NO: 2685873 - DNA, 12 bp, Homo sapiens
ctataaacactg

SEQ ID NO: 2685874 - DNA, 20 bp, Homo sapiens
ctataactacatattgaata

SEQ ID NO: 2685875 - DNA, 17 bp, Homo sapiens
ctatatctataaacact

SEQ ID NO: 2685876 - DNA, 19 bp, Homo sapiens
ctatatctataaacactgt

SEQ ID NO: 2685877 - DNA, 14 bp, Homo sapiens
ctatatctctaaac

SEQ ID NO: 2685878 - DNA, 23 bp, Homo sapiens
ctatgaagggacagctgctggga

SEQ ID NO: 2685879 - DNA, 18 bp, Homo sapiens
ctatgattatgccactgc

SEQ ID NO: 2685880 - DNA, 15 bp, Homo sapiens
cctgctcccagtggg

SEQ ID NO: 2685881 - DNA, 14 bp, Homo sapiens
cctgctctgtagcc

SEQ ID NO: 2685882 - DNA, 21 bp, Homo sapiens
cctgctctgtagccacctcct

SEQ ID NO: 2685883 - DNA, 12 bp, Homo sapiens
cctgctctttct

SEQ ID NO: 2685884 - DNA, 18 bp, Homo sapiens
cctgctctttctctgaga

SEQ ID NO: 2685885 - DNA, 21 bp, Homo sapiens
cctgctgcaaaggacagtggg

SEQ ID NO: 2685886 - DNA, 19 bp, Homo sapiens
cctgctgcgggggagccag

SEQ ID NO: 2685887 - DNA, 11 bp, Homo sapiens
cctgcttcctg

SEQ ID NO: 2685888 - DNA, 18 bp, Homo sapiens
cctgcttcctgaaagctg

SEQ ID NO: 2685889 - DNA, 23 bp, Homo sapiens
cctggaaaggctcagtctcagga

SEQ ID NO: 2685890 - DNA, 13 bp, Homo sapiens
cctggaccccagg

SEQ ID NO: 2685891 - DNA, 19 bp, Homo sapiens
cctggactgactgcagccc

SEQ ID NO: 2685892 - DNA, 14 bp, Homo sapiens
cctggagcaagctc

SEQ ID NO: 2685893 - DNA, 17 bp, Homo sapiens
cctggagcaagctctgc

SEQ ID NO: 2685894 - DNA, 22 bp, Homo sapiens
cctggagcaagctctgccctgg

SEQ ID NO: 2685895 - DNA, 17 bp, Homo sapiens
cctggcaggatgaccct

SEQ ID NO: 2685896 - DNA, 12 bp, Homo sapiens
cctggccctgcc

SEQ ID NO: 2685897 - DNA, 22 bp, Homo sapiens
cctggcttctggagcccttggg

SEQ ID NO: 2685898 - DNA, 19 bp, Homo sapiens
cctggcttgcttgccgagc

SEQ ID NO: 2685899 - DNA, 19 bp, Homo sapiens
cctggcttgtcggagcaag

SEQ ID NO: 2685900 - DNA, 17 bp, Homo sapiens
cctgggagaacctcagg

SEQ ID NO: 2685901 - DNA, 18 bp, Homo sapiens
cctgggagaacctcaggc

SEQ ID NO: 2685902 - DNA, 19 bp, Homo sapiens
cctgggagaacctcaggct

SEQ ID NO: 2685903 - DNA, 15 bp, Homo sapiens
cctgggggcatcctg

SEQ ID NO: 2685904 - DNA, 15 bp, Homo sapiens
cctgggtcctgcctg

SEQ ID NO: 2685905 - DNA, 17 bp, Homo sapiens
cctgggtcctgcctggt

SEQ ID NO: 2685906 - DNA, 18 bp, Homo sapiens
cctggtcctccctcccaa

SEQ ID NO: 2685907 - DNA, 18 bp, Homo sapiens
cctggtccttccaggccc

SEQ ID NO: 2685908 - DNA, 12 bp, Homo sapiens
cctggtggacag

SEQ ID NO: 2685909 - DNA, 18 bp, Homo sapiens
cctggtggacagtcctgg

SEQ ID NO: 2685910 - DNA, 19 bp, Homo sapiens
cctggtggacagtcctggg

SEQ ID NO: 2685911 - DNA, 17 bp, Homo sapiens
cctggtgggtcagccca

SEQ ID NO: 2685912 - DNA, 23 bp, Homo sapiens
cctggtgggtcagcccagcacct

SEQ ID NO: 2685913 - DNA, 21 bp, Homo sapiens
cctggtggtcacaggctgtgc

SEQ ID NO: 2685914 - DNA, 20 bp, Homo sapiens
cctgtaacacaagccacaga

SEQ ID NO: 2685915 - DNA, 23 bp, Homo sapiens
cctgtaacacaagccacagaagc

SEQ ID NO: 2685916 - DNA, 16 bp, Homo sapiens
cctgtaatcccagcac

SEQ ID NO: 2685917 - DNA, 23 bp, Homo sapiens
cctgtactcaggaggctgagggg

SEQ ID NO: 2685918 - DNA, 19 bp, Homo sapiens
cctgtcagaatcatgctgt

SEQ ID NO: 2685919 - DNA, 14 bp, Homo sapiens
cctgtccataaagt

SEQ ID NO: 2685920 - DNA, 16 bp, Homo sapiens
cctgtccataaagtaa

SEQ ID NO: 2685921 - DNA, 12 bp, Homo sapiens
cctgtccctacc

SEQ ID NO: 2685922 - DNA, 20 bp, Homo sapiens
cctgtccctacccactcttt

SEQ ID NO: 2685923 - DNA, 21 bp, Homo sapiens
cctgtctgtctgtctgtccca

SEQ ID NO: 2685924 - DNA, 22 bp, Homo sapiens
cctgtctgtctgtctgtcccaa

SEQ ID NO: 2685925 - DNA, 18 bp, Homo sapiens
cctgtgagagccacgctg

SEQ ID NO: 2685926 - DNA, 21 bp, Homo sapiens
cctgtgagagccacgctggcc

SEQ ID NO: 2685927 - DNA, 21 bp, Homo sapiens
cctgtgctgaggactccctcc

SEQ ID NO: 2685928 - DNA, 23 bp, Homo sapiens
cctgttacttgaaataccagtga

SEQ ID NO: 2685929 - DNA, 12 bp, Homo sapiens
cctgtttcctga

SEQ ID NO: 2685930 - DNA, 14 bp, Homo sapiens
cctgttttgctttt

SEQ ID NO: 2685931 - DNA, 17 bp, Homo sapiens
ccttccccctcccaggg

SEQ ID NO: 2685932 - DNA, 18 bp, Homo sapiens
ccttcccctttactcagc

SEQ ID NO: 2685933 - DNA, 20 bp, Homo sapiens
ccttcccctttactcagccc

SEQ ID NO: 2685934 - DNA, 22 bp, Homo sapiens
ccttcccctttactcagcccag

SEQ ID NO: 2685935 - DNA, 24 bp, Homo sapiens
ccttcccctttactcagcccagct

SEQ ID NO: 2685936 - DNA, 14 bp, Homo sapiens
ccttccctccctga

SEQ ID NO: 2685937 - DNA, 14 bp, Homo sapiens
ccttcctccaggag

SEQ ID NO: 2685938 - DNA, 20 bp, Homo sapiens
ccttcgtctccatctctggt

SEQ ID NO: 2685939 - DNA, 16 bp, Homo sapiens
ccttctcccctccacg

SEQ ID NO: 2685940 - DNA, 17 bp, Homo sapiens
ccttctcccctccacgc

SEQ ID NO: 2685941 - DNA, 17 bp, Homo sapiens
ccttctcccttgccctc

SEQ ID NO: 2685942 - DNA, 19 bp, Homo sapiens
ccttctcccttgccctccc

SEQ ID NO: 2685943 - DNA, 19 bp, Homo sapiens
ccttgaagccactgaagct

SEQ ID NO: 2685944 - DNA, 13 bp, Homo sapiens
ccttgacttttta

SEQ ID NO: 2685945 - DNA, 12 bp, Homo sapiens
ccttgcccctgc

SEQ ID NO: 2685946 - DNA, 19 bp, Homo sapiens
ccttgcccggattctggga

SEQ ID NO: 2685947 - DNA, 16 bp, Homo sapiens
ccttgctgtcctaggc

SEQ ID NO: 2685948 - DNA, 17 bp, Homo sapiens
ccttggttcccttgtgt

SEQ ID NO: 2685949 - DNA, 19 bp, Homo sapiens
ccttgtgggaccagtccca

SEQ ID NO: 2685950 - DNA, 14 bp, Homo sapiens
cctttactcagccc

SEQ ID NO: 2685951 - DNA, 17 bp, Homo sapiens
cctttactcagcccagc

SEQ ID NO: 2685952 - DNA, 19 bp, Homo sapiens
cctttactcagcccagctg

SEQ ID NO: 2685953 - DNA, 18 bp, Homo sapiens
cctttccggggctgctgg

SEQ ID NO: 2685954 - DNA, 15 bp, Homo sapiens
cctttctctctccac

SEQ ID NO: 2685955 - DNA, 18 bp, Homo sapiens
cctttcttattctgtgag

SEQ ID NO: 2685956 - DNA, 15 bp, Homo sapiens
ccttttccccaggag

SEQ ID NO: 2685957 - DNA, 21 bp, Homo sapiens
ccttttcttctagctttgttg

SEQ ID NO: 2685958 - DNA, 19 bp, Homo sapiens
ccttttgtaccatggtgtg

SEQ ID NO: 2685959 - DNA, 18 bp, Homo sapiens
cctttttacagccaactt

SEQ ID NO: 2685960 - DNA, 20 bp, Homo sapiens
cgaaacctgtccataaagta

SEQ ID NO: 2685961 - DNA, 13 bp, Homo sapiens
cgagaccagcctg

SEQ ID NO: 2685962 - DNA, 14 bp, Homo sapiens
cgagaccagcctgg

SEQ ID NO: 2685963 - DNA, 17 bp, Homo sapiens
cgagaccagcctggcca

SEQ ID NO: 2685964 - DNA, 15 bp, Homo sapiens
cgagatcccatctct

SEQ ID NO: 2685965 - DNA, 14 bp, Homo sapiens
cgagcctaatgaaa

SEQ ID NO: 2685966 - DNA, 15 bp, Homo sapiens
cgagcctaatgaaag

SEQ ID NO: 2685967 - DNA, 23 bp, Homo sapiens
cgaggcctgacacaggccagcct

SEQ ID NO: 2685968 - DNA, 22 bp, Homo sapiens
cgagttgtggaaagcctctgct

SEQ ID NO: 2685969 - DNA, 16 bp, Homo sapiens
cgatgctgaggccacc

SEQ ID NO: 2685970 - DNA, 16 bp, Homo sapiens
cgcaaggctgtgctct

SEQ ID NO: 2685971 - DNA, 21 bp, Homo sapiens
cgcagaaggggaatgtgtcct

SEQ ID NO: 2685972 - DNA, 22 bp, Homo sapiens
cgcagaaggggaatgtgtcctc

SEQ ID NO: 2685973 - DNA, 17 bp, Homo sapiens
cgcagattgggctggct

SEQ ID NO: 2685974 - DNA, 22 bp, Homo sapiens
cgccactacactccagcctgag

SEQ ID NO: 2685975 - DNA, 22 bp, Homo sapiens
cgccactgcactccagcctggg

SEQ ID NO: 2685976 - DNA, 23 bp, Homo sapiens
cgccactgcactccagcctgggc

SEQ ID NO: 2685977 - DNA, 21 bp, Homo sapiens
cgcccacctagtgcttccact

SEQ ID NO: 2685978 - DNA, 23 bp, Homo sapiens
cgcccctggtggtcacaggctgt

SEQ ID NO: 2685979 - DNA, 20 bp, Homo sapiens
cgccctccgtcgggcccctg

SEQ ID NO: 2685980 - DNA, 16 bp, Homo sapiens
cgcctatgatcccagc

SEQ ID NO: 2685981 - DNA, 19 bp, Homo sapiens
cgcctccccatacttcctg

SEQ ID NO: 2685982 - DNA, 21 bp, Homo sapiens
cgcctccccatacttcctggg

SEQ ID NO: 2685983 - DNA, 23 bp, Homo sapiens
cgcctccccatacttcctgggat

SEQ ID NO: 2685984 - DNA, 14 bp, Homo sapiens
cgcctgccacctct

SEQ ID NO: 2685985 - DNA, 21 bp, Homo sapiens
ctctagcctgggccagagaag

SEQ ID NO: 2685986 - DNA, 15 bp, Homo sapiens
ctctatgccaggctg

SEQ ID NO: 2685987 - DNA, 16 bp, Homo sapiens
ctctatgccaggctgt

SEQ ID NO: 2685988 - DNA, 20 bp, Homo sapiens
ctctatgccaggctgtgcta

SEQ ID NO: 2685989 - DNA, 18 bp, Homo sapiens
ctctcaatattcaataaa

SEQ ID NO: 2685990 - DNA, 21 bp, Homo sapiens
ctctcagccctccatggcctg

SEQ ID NO: 2685991 - DNA, 22 bp, Homo sapiens
ctctcagccctccatggcctgg

SEQ ID NO: 2685992 - DNA, 15 bp, Homo sapiens
ctctccaccccccac

SEQ ID NO: 2685993 - DNA, 14 bp, Homo sapiens
ctctcccagccctc

SEQ ID NO: 2685994 - DNA, 16 bp, Homo sapiens
ctctcccagccctcag

SEQ ID NO: 2685995 - DNA, 19 bp, Homo sapiens
ctctcctggagcaagctct

SEQ ID NO: 2685996 - DNA, 21 bp, Homo sapiens
ctctcctggagcaagctctgc

SEQ ID NO: 2685997 - DNA, 18 bp, Homo sapiens
ctctcggaaggctggctg

SEQ ID NO: 2685998 - DNA, 19 bp, Homo sapiens
ctctctactcctacctcag

SEQ ID NO: 2685999 - DNA, 20 bp, Homo sapiens
ctctctactcctacctcagc

SEQ ID NO: 2686000 - DNA, 16 bp, Homo sapiens
ctctctccacccccca

SEQ ID NO: 2686001 - DNA, 17 bp, Homo sapiens
ctctctccaccccccac

SEQ ID NO: 2686002 - DNA, 12 bp, Homo sapiens
ctctctgctggc

SEQ ID NO: 2686003 - DNA, 18 bp, Homo sapiens
actgcactccagcctggg

SEQ ID NO: 2686004 - DNA, 20 bp, Homo sapiens
actgcactccagcctgggcg

SEQ ID NO: 2686005 - DNA, 13 bp, Homo sapiens
actgctgggactg

SEQ ID NO: 2686006 - DNA, 18 bp, Homo sapiens
actgctgggactggccag

SEQ ID NO: 2686007 - DNA, 19 bp, Homo sapiens
actgctgggactggccagg

SEQ ID NO: 2686008 - DNA, 17 bp, Homo sapiens
actgctttccagcctgg

SEQ ID NO: 2686009 - DNA, 16 bp, Homo sapiens
actggagcatctgact

SEQ ID NO: 2686010 - DNA, 18 bp, Homo sapiens
actggagcatctgactca

SEQ ID NO: 2686011 - DNA, 12 bp, Homo sapiens
actggagcccag

SEQ ID NO: 2686012 - DNA, 14 bp, Homo sapiens
actggagcccagga

SEQ ID NO: 2686013 - DNA, 18 bp, Homo sapiens
actggaggggcccaccca

SEQ ID NO: 2686014 - DNA, 19 bp, Homo sapiens
actggaggggcccacccac

SEQ ID NO: 2686015 - DNA, 18 bp, Homo sapiens
actggcaggagcctcgtg

SEQ ID NO: 2686016 - DNA, 17 bp, Homo sapiens
actggctgctccctgct

SEQ ID NO: 2686017 - DNA, 18 bp, Homo sapiens
actggctgctccctgctc

SEQ ID NO: 2686018 - DNA, 19 bp, Homo sapiens
actggctgctccctgctcc

SEQ ID NO: 2686019 - DNA, 21 bp, Homo sapiens
actggctgctccctgctccca

SEQ ID NO: 2686020 - DNA, 17 bp, Homo sapiens
actggctggctgcagtg

SEQ ID NO: 2686021 - DNA, 18 bp, Homo sapiens
actggggttcaagcccag

SEQ ID NO: 2686022 - DNA, 16 bp, Homo sapiens
actggtttgccaggcc

SEQ ID NO: 2686023 - DNA, 13 bp, Homo sapiens
actgtcattgccc

SEQ ID NO: 2686024 - DNA, 16 bp, Homo sapiens
actgtcattgcccctc

SEQ ID NO: 2686025 - DNA, 13 bp, Homo sapiens
actgtccctcaaa

SEQ ID NO: 2686026 - DNA, 20 bp, Homo sapiens
actgtccctcaaatgaccca

SEQ ID NO: 2686027 - DNA, 12 bp, Homo sapiens
actgtgaccaaa

SEQ ID NO: 2686028 - DNA, 23 bp, Homo sapiens
actgtgaccaaagcatttctagt

SEQ ID NO: 2686029 - DNA, 13 bp, Homo sapiens
actgtgaccctgg

SEQ ID NO: 2686030 - DNA, 16 bp, Homo sapiens
acttatgctagtttat

SEQ ID NO: 2686031 - DNA, 12 bp, Homo sapiens
acttcacagagg

SEQ ID NO: 2686032 - DNA, 17 bp, Homo sapiens
acttcacccggctgggc

SEQ ID NO: 2686033 - DNA, 19 bp, Homo sapiens
acttcacccggctgggctc

SEQ ID NO: 2686034 - DNA, 16 bp, Homo sapiens
acttcccagaggcaga

SEQ ID NO: 2686035 - DNA, 17 bp, Homo sapiens
acttccttgcccctgct

SEQ ID NO: 2686036 - DNA, 19 bp, Homo sapiens
acttccttgcccctgctct

SEQ ID NO: 2686037 - DNA, 15 bp, Homo sapiens
acttgaggacacatg

SEQ ID NO: 2686038 - DNA, 22 bp, Homo sapiens
acttgagtggaggtttatagtt

SEQ ID NO: 2686039 - DNA, 21 bp, Homo sapiens
acttgggaggctgaggcagga

SEQ ID NO: 2686040 - DNA, 17 bp, Homo sapiens
actttctactcatttta

SEQ ID NO: 2686041 - DNA, 21 bp, Homo sapiens
acttttcagaattgaaggaga

SEQ ID NO: 2686042 - DNA, 21 bp, Homo sapiens
acttttccattgaccagctct

SEQ ID NO: 2686043 - DNA, 15 bp, Homo sapiens
acttttctaaagctc

SEQ ID NO: 2686044 - DNA, 10 bp, Homo sapiens
actttttagc

SEQ ID NO: 2686045 - DNA, 22 bp, Homo sapiens
actttttagccagtgacttttt

SEQ ID NO: 2686046 - DNA, 17 bp, Homo sapiens
agaaatcattgtagaaa

SEQ ID NO: 2686047 - DNA, 22 bp, Homo sapiens
agaaatcattgtagaaacacag

SEQ ID NO: 2686048 - DNA, 19 bp, Homo sapiens
agaaattcctgtagcatct

SEQ ID NO: 2686049 - DNA, 23 bp, Homo sapiens
agaaattttactgacagaaatgc

SEQ ID NO: 2686050 - DNA, 17 bp, Homo sapiens
agaacaatgtcagaaac

SEQ ID NO: 2686051 - DNA, 18 bp, Homo sapiens
agaacacccactggccag

SEQ ID NO: 2686052 - DNA, 19 bp, Homo sapiens
agaaccaaaagatgccttg

SEQ ID NO: 2686053 - DNA, 17 bp, Homo sapiens
agaaccagtctttcaac

SEQ ID NO: 2686054 - DNA, 21 bp, Homo sapiens
agaacccaggtctgatgccaa

SEQ ID NO: 2686055 - DNA, 19 bp, Homo sapiens
agaacctcaggcttccttg

SEQ ID NO: 2686056 - DNA, 19 bp, Homo sapiens
agaactccttattttgtat

SEQ ID NO: 2686057 - DNA, 16 bp, Homo sapiens
agaactggcaggagcc

SEQ ID NO: 2686058 - DNA, 21 bp, Homo sapiens
agaactggggttcaagcccag

SEQ ID NO: 2686059 - DNA, 22 bp, Homo sapiens
agaagaccaaagcattgcctgc

SEQ ID NO: 2686060 - DNA, 13 bp, Homo sapiens
agaagccagtctg

SEQ ID NO: 2686061 - DNA, 23 bp, Homo sapiens
agaaggggaatgtgtcctcctgc

SEQ ID NO: 2686062 - DNA, 22 bp, Homo sapiens
agaagggttttccaccctggaa

SEQ ID NO: 2686063 - DNA, 23 bp, Homo sapiens
agaagggttttccaccctggaat

SEQ ID NO: 2686064 - DNA, 22 bp, Homo sapiens
agaagtaactggtgatatatct

SEQ ID NO: 2686065 - DNA, 17 bp, Homo sapiens
agaagtctccctgcaca

SEQ ID NO: 2686066 - DNA, 19 bp, Homo sapiens
agaatacttttttctagtt

SEQ ID NO: 2686067 - DNA, 20 bp, Homo sapiens
agaatagttattctctaaga

SEQ ID NO: 2686068 - DNA, 13 bp, Homo sapiens
agaatcatgctgt

SEQ ID NO: 2686069 - DNA, 19 bp, Homo sapiens
agaattgaaggagaaaatg

SEQ ID NO: 2686070 - DNA, 17 bp, Homo sapiens
agaattgcaatctataa

SEQ ID NO: 2686071 - DNA, 19 bp, Homo sapiens
agacaagtcttgctgtgct

SEQ ID NO: 2686072 - DNA, 14 bp, Homo sapiens
agacatatttacaa

SEQ ID NO: 2686073 - DNA, 13 bp, Homo sapiens
agacatttttatt

SEQ ID NO: 2686074 - DNA, 17 bp, Homo sapiens
agacatttttatttagt

SEQ ID NO: 2686075 - DNA, 16 bp, Homo sapiens
agaccagactgtggag

SEQ ID NO: 2686076 - DNA, 13 bp, Homo sapiens
agaccagcctggc

SEQ ID NO: 2686077 - DNA, 15 bp, Homo sapiens
agaccagcctggcca

SEQ ID NO: 2686078 - DNA, 16 bp, Homo sapiens
agaccattgtcttcca

SEQ ID NO: 2686079 - DNA, 20 bp, Homo sapiens
agaccattgtcttccaaccc

SEQ ID NO: 2686080 - DNA, 21 bp, Homo sapiens
agaccattgtcttccaacccc

SEQ ID NO: 2686081 - DNA, 23 bp, Homo sapiens
agacctgttttgcttttgtaact

SEQ ID NO: 2686082 - DNA, 21 bp, Homo sapiens
agactccaatggggccagcac

SEQ ID NO: 2686083 - DNA, 23 bp, Homo sapiens
agactccaatggggccagcactg

SEQ ID NO: 2686084 - DNA, 23 bp, Homo sapiens
agactgcgggatggtcctggggc

SEQ ID NO: 2686085 - DNA, 14 bp, Homo sapiens
agactgctgggact

SEQ ID NO: 2686086 - DNA, 16 bp, Homo sapiens
agactggagcatctga

SEQ ID NO: 2686087 - DNA, 20 bp, Homo sapiens
agactggctggctgcagtga

SEQ ID NO: 2686088 - DNA, 21 bp, Homo sapiens
agagactaaggggcagctcct

SEQ ID NO: 2686089 - DNA, 14 bp, Homo sapiens
agagaggggcctgc

SEQ ID NO: 2686090 - DNA, 15 bp, Homo sapiens
agagaggggcctgca

SEQ ID NO: 2686091 - DNA, 17 bp, Homo sapiens
agagaggggcctgcagg

SEQ ID NO: 2686092 - DNA, 21 bp, Homo sapiens
agagaggggcctgcaggtgag

SEQ ID NO: 2686093 - DNA, 18 bp, Homo sapiens
agagatgactgagtcctc

SEQ ID NO: 2686094 - DNA, 18 bp, Homo sapiens
agagatttcaacaagaat

SEQ ID NO: 2686095 - DNA, 17 bp, Homo sapiens
agagcacagcgtttaca

SEQ ID NO: 2686096 - DNA, 15 bp, Homo sapiens
agagcacccacagcc

SEQ ID NO: 2686097 - DNA, 14 bp, Homo sapiens
agagcagaggcagc

SEQ ID NO: 2686098 - DNA, 22 bp, Homo sapiens
agagcagggccaaagcacagct

SEQ ID NO: 2686099 - DNA, 17 bp, Homo sapiens
agagccagatgcctccc

SEQ ID NO: 2686100 - DNA, 17 bp, Homo sapiens
agagccctccaggcctg

SEQ ID NO: 2686101 - DNA, 21 bp, Homo sapiens
agagccctccaggcctgcagg

SEQ ID NO: 2686102 - DNA, 17 bp, Homo sapiens
agagcgagagtctgtct

SEQ ID NO: 2686103 - DNA, 22 bp, Homo sapiens
agagctcctgtccctacccact

SEQ ID NO: 2686104 - DNA, 23 bp, Homo sapiens
agagctcctgtccctacccactc

SEQ ID NO: 2686105 - DNA, 17 bp, Homo sapiens
agaggagggatgctgcc

SEQ ID NO: 2686106 - DNA, 22 bp, Homo sapiens
agaggctgcagaaggccaagaa

SEQ ID NO: 2686107 - DNA, 18 bp, Homo sapiens
agaggctggagacaggtg

SEQ ID NO: 2686108 - DNA, 14 bp, Homo sapiens
agagggcccaggca

SEQ ID NO: 2686109 - DNA, 22 bp, Homo sapiens
agtttccaaagggcagtaaagt

SEQ ID NO: 2686110 - DNA, 14 bp, Homo sapiens
agtttgaggctgca

SEQ ID NO: 2686111 - DNA, 20 bp, Homo sapiens
agtttgcactgtatgctgga

SEQ ID NO: 2686112 - DNA, 17 bp, Homo sapiens
agttttaccctatatct

SEQ ID NO: 2686113 - DNA, 13 bp, Homo sapiens
agttttgatgaaa

SEQ ID NO: 2686114 - DNA, 14 bp, Homo sapiens
agttttgatgaaat

SEQ ID NO: 2686115 - DNA, 13 bp, Homo sapiens
agttttgtataaa

SEQ ID NO: 2686116 - DNA, 15 bp, Homo sapiens
agttttgtataaata

SEQ ID NO: 2686117 - DNA, 14 bp, Homo sapiens
ataaaataatttta

SEQ ID NO: 2686118 - DNA, 11 bp, Homo sapiens
ataaaatctgt

SEQ ID NO: 2686119 - DNA, 12 bp, Homo sapiens
ataaacactgtt

SEQ ID NO: 2686120 - DNA, 13 bp, Homo sapiens
ataaaggtattta

SEQ ID NO: 2686121 - DNA, 12 bp, Homo sapiens
ataaatgctgaa

SEQ ID NO: 2686122 - DNA, 12 bp, Homo sapiens
ataaatgtttaa

SEQ ID NO: 2686123 - DNA, 12 bp, Homo sapiens
ataacatagaat

SEQ ID NO: 2686124 - DNA, 16 bp, Homo sapiens
ataaccttcatgatga

SEQ ID NO: 2686125 - DNA, 23 bp, Homo sapiens
ataacttccttgcccctgctctg

SEQ ID NO: 2686126 - DNA, 21 bp, Homo sapiens
ataataaagaactccttattt

SEQ ID NO: 2686127 - DNA, 11 bp, Homo sapiens
ataatgttctt

SEQ ID NO: 2686128 - DNA, 22 bp, Homo sapiens
atacattttgttatagaatact

SEQ ID NO: 2686129 - DNA, 16 bp, Homo sapiens
atactcctatgcttta

SEQ ID NO: 2686130 - DNA, 12 bp, Homo sapiens
atacttcctggg

SEQ ID NO: 2686131 - DNA, 13 bp, Homo sapiens
atacttcctggga

SEQ ID NO: 2686132 - DNA, 13 bp, Homo sapiens
atacttttttcta

SEQ ID NO: 2686133 - DNA, 18 bp, Homo sapiens
atagaattgcaatctata

SEQ ID NO: 2686134 - DNA, 21 bp, Homo sapiens
atagttctatcaggaaaacaa

SEQ ID NO: 2686135 - DNA, 20 bp, Homo sapiens
atataaaagttaaactactt

SEQ ID NO: 2686136 - DNA, 15 bp, Homo sapiens
atatagattaaatca

SEQ ID NO: 2686137 - DNA, 24 bp, Homo sapiens
atatagtttgtggtaaaaagatta

SEQ ID NO: 2686138 - DNA, 16 bp, Homo sapiens
atgcattgtcttgtgg

SEQ ID NO: 2686139 - DNA, 12 bp, Homo sapiens
atgccaggctgt

SEQ ID NO: 2686140 - DNA, 13 bp, Homo sapiens
atgccaggctgtg

SEQ ID NO: 2686141 - DNA, 14 bp, Homo sapiens
atgccaggctgtgc

SEQ ID NO: 2686142 - DNA, 13 bp, Homo sapiens
atgccatgtctga

SEQ ID NO: 2686143 - DNA, 23 bp, Homo sapiens
atgcccagagggcccaggcaggc

SEQ ID NO: 2686144 - DNA, 18 bp, Homo sapiens
atgccccaggatcactct

SEQ ID NO: 2686145 - DNA, 21 bp, Homo sapiens
atgccccaggatcactctctg

SEQ ID NO: 2686146 - DNA, 14 bp, Homo sapiens
atgcctccaagcca

SEQ ID NO: 2686147 - DNA, 12 bp, Homo sapiens
atgcctgcaggc

SEQ ID NO: 2686148 - DNA, 16 bp, Homo sapiens
atgctacccacagcgt

SEQ ID NO: 2686149 - DNA, 17 bp, Homo sapiens
atgctcagaagccagtc

SEQ ID NO: 2686150 - DNA, 19 bp, Homo sapiens
atgctgaggccacccactg

SEQ ID NO: 2686151 - DNA, 22 bp, Homo sapiens
atgctggacggcattcctgctt

SEQ ID NO: 2686152 - DNA, 15 bp, Homo sapiens
atgctgtgctctttg

SEQ ID NO: 2686153 - DNA, 13 bp, Homo sapiens
atgctgttctctt

SEQ ID NO: 2686154 - DNA, 17 bp, Homo sapiens
atgctgttctctttgct

SEQ ID NO: 2686155 - DNA, 12 bp, Homo sapiens
atgcttctttaa

SEQ ID NO: 2686156 - DNA, 15 bp, Homo sapiens
atgcttgtgtttctt

SEQ ID NO: 2686157 - DNA, 14 bp, Homo sapiens
atgctttagcttat

SEQ ID NO: 2686158 - DNA, 19 bp, Homo sapiens
atggaccaaagccacctgc

SEQ ID NO: 2686159 - DNA, 22 bp, Homo sapiens
atggcaccaacgggaccccctg

SEQ ID NO: 2686160 - DNA, 14 bp, Homo sapiens
atggcaccagaggc

SEQ ID NO: 2686161 - DNA, 17 bp, Homo sapiens
atggcatctagccagag

SEQ ID NO: 2686162 - DNA, 15 bp, Homo sapiens
atggcccctccagca

SEQ ID NO: 2686163 - DNA, 13 bp, Homo sapiens
atggggatgcttc

SEQ ID NO: 2686164 - DNA, 18 bp, Homo sapiens
atggggatgcttccgcct

SEQ ID NO: 2686165 - DNA, 14 bp, Homo sapiens
atggtatccagaat

SEQ ID NO: 2686166 - DNA, 12 bp, Homo sapiens
atggtcctgggg

SEQ ID NO: 2686167 - DNA, 17 bp, Homo sapiens
atggtcctggggctctg

SEQ ID NO: 2686168 - DNA, 18 bp, Homo sapiens
atggtctccacctgtgct

SEQ ID NO: 2686169 - DNA, 13 bp, Homo sapiens
atggtgacttttt

SEQ ID NO: 2686170 - DNA, 20 bp, Homo sapiens
atggttccgacttgtccctc

SEQ ID NO: 2686171 - DNA, 20 bp, Homo sapiens
atgtacaagttttgtataaa

SEQ ID NO: 2686172 - DNA, 20 bp, Homo sapiens
agctcctgtccctacccact

SEQ ID NO: 2686173 - DNA, 22 bp, Homo sapiens
agctcctgtccctacccactct

SEQ ID NO: 2686174 - DNA, 14 bp, Homo sapiens
agctctctgggcct

SEQ ID NO: 2686175 - DNA, 12 bp, Homo sapiens
agctctcttcct

SEQ ID NO: 2686176 - DNA, 13 bp, Homo sapiens
agctctgccctgg

SEQ ID NO: 2686177 - DNA, 17 bp, Homo sapiens
agctctgccctggctgt

SEQ ID NO: 2686178 - DNA, 21 bp, Homo sapiens
agctctgccctggctgtgggt

SEQ ID NO: 2686179 - DNA, 17 bp, Homo sapiens
agctctggaccagcctg

SEQ ID NO: 2686180 - DNA, 21 bp, Homo sapiens
cctccttttcttctagctttg

SEQ ID NO: 2686181 - DNA, 17 bp, Homo sapiens
cctcgccggccttgttt

SEQ ID NO: 2686182 - DNA, 17 bp, Homo sapiens
cctcgtggacacctgcc

SEQ ID NO: 2686183 - DNA, 13 bp, Homo sapiens
cctcgtgtcctgc

SEQ ID NO: 2686184 - DNA, 15 bp, Homo sapiens
cctcgtgtcctgcta

SEQ ID NO: 2686185 - DNA, 17 bp, Homo sapiens
cctcgtgtcctgctagc

SEQ ID NO: 2686186 - DNA, 21 bp, Homo sapiens
cctcgtgtcctgctagctgtc

SEQ ID NO: 2686187 - DNA, 18 bp, Homo sapiens
cctctagaacacccactg

SEQ ID NO: 2686188 - DNA, 21 bp, Homo sapiens
cctctagaacacccactggcc

SEQ ID NO: 2686189 - DNA, 23 bp, Homo sapiens
cctctagaacacccactggccag

SEQ ID NO: 2686190 - DNA, 22 bp, Homo sapiens
cctctcaatattcaataaagct

SEQ ID NO: 2686191 - DNA, 19 bp, Homo sapiens
cctctcccagccctcagca

SEQ ID NO: 2686192 - DNA, 18 bp, Homo sapiens
cctctctgttgccttttt

SEQ ID NO: 2686193 - DNA, 18 bp, Homo sapiens
cctctgaaatttcccaca

SEQ ID NO: 2686194 - DNA, 21 bp, Homo sapiens
cctctgaaatttcccacaccc

SEQ ID NO: 2686195 - DNA, 17 bp, Homo sapiens
cctctgacctgcaggcc

SEQ ID NO: 2686196 - DNA, 21 bp, Homo sapiens
cctctgctctgaggcttccag

SEQ ID NO: 2686197 - DNA, 14 bp, Homo sapiens
cctctgctgccatg

SEQ ID NO: 2686198 - DNA, 16 bp, Homo sapiens
cctctggtttctgtgt

SEQ ID NO: 2686199 - DNA, 19 bp, Homo sapiens
cctcttagtgattgtgtct

SEQ ID NO: 2686200 - DNA, 12 bp, Homo sapiens
cctcttccccac

SEQ ID NO: 2686201 - DNA, 16 bp, Homo sapiens
cctcttctcttcctgt

SEQ ID NO: 2686202 - DNA, 18 bp, Homo sapiens
cctcttggacctctgctc

SEQ ID NO: 2686203 - DNA, 19 bp, Homo sapiens
cctcttggacctctgctct

SEQ ID NO: 2686204 - DNA, 16 bp, Homo sapiens
cctgaagatcagagct

SEQ ID NO: 2686205 - DNA, 21 bp, Homo sapiens
cctgaagatcagagctgcagc

SEQ ID NO: 2686206 - DNA, 11 bp, Homo sapiens
cctgaccaaag

SEQ ID NO: 2686207 - DNA, 12 bp, Homo sapiens
cctgaccaaaga

SEQ ID NO: 2686208 - DNA, 13 bp, Homo sapiens
cctgaccaaagac

SEQ ID NO: 2686209 - DNA, 15 bp, Homo sapiens
cctgactctctgtga

SEQ ID NO: 2686210 - DNA, 20 bp, Homo sapiens
cctgagacctcgccggcctt

SEQ ID NO: 2686211 - DNA, 23 bp, Homo sapiens
cctgagcaacagagtgagaccct

SEQ ID NO: 2686212 - DNA, 20 bp, Homo sapiens
atgtatatctatatctctaa

SEQ ID NO: 2686213 - DNA, 17 bp, Homo sapiens
atgtatatgtatatcta

SEQ ID NO: 2686214 - DNA, 18 bp, Homo sapiens
atgtatatgtatatctat

SEQ ID NO: 2686215 - DNA, 13 bp, Homo sapiens
atgtcagaaactc

SEQ ID NO: 2686216 - DNA, 16 bp, Homo sapiens
atgtcagactggctgg

SEQ ID NO: 2686217 - DNA, 13 bp, Homo sapiens
atgtctcttgtag

SEQ ID NO: 2686218 - DNA, 16 bp, Homo sapiens
atgtctcttgtagaag

SEQ ID NO: 2686219 - DNA, 20 bp, Homo sapiens
atgtctgagcggcgcagagc

SEQ ID NO: 2686220 - DNA, 13 bp, Homo sapiens
atgtgactttgaa

SEQ ID NO: 2686221 - DNA, 16 bp, Homo sapiens
atgtgatcactgagac

SEQ ID NO: 2686222 - DNA, 14 bp, Homo sapiens
atgtgctgctttga

SEQ ID NO: 2686223 - DNA, 16 bp, Homo sapiens
atgtgctgctttgata

SEQ ID NO: 2686224 - DNA, 12 bp, Homo sapiens
atgtgtcctcct

SEQ ID NO: 2686225 - DNA, 18 bp, Homo sapiens
atgtgtcctcctgctctg

SEQ ID NO: 2686226 - DNA, 21 bp, Homo sapiens
atgtgtcctcctgctctgctt

SEQ ID NO: 2686227 - DNA, 22 bp, Homo sapiens
atgtgtcctcctgctctgcttc

SEQ ID NO: 2686228 - DNA, 23 bp, Homo sapiens
atgtgtcctcctgctctgcttcc

SEQ ID NO: 2686229 - DNA, 13 bp, Homo sapiens
atgtgtgaaacct

SEQ ID NO: 2686230 - DNA, 20 bp, Homo sapiens
atgtgttaaacatgctaaat

SEQ ID NO: 2686231 - DNA, 12 bp, Homo sapiens
atgttaaagcat

SEQ ID NO: 2686232 - DNA, 18 bp, Homo sapiens
atgttctcgttttgaaac

SEQ ID NO: 2686233 - DNA, 17 bp, Homo sapiens
atgtttggtaccaagaa

SEQ ID NO: 2686234 - DNA, 19 bp, Homo sapiens
atgtttgtaaattaatact

SEQ ID NO: 2686235 - DNA, 14 bp, Homo sapiens
atgtttgtacaaga

SEQ ID NO: 2686236 - DNA, 19 bp, Homo sapiens
atgttttgtacaattacta

SEQ ID NO: 2686237 - DNA, 16 bp, Homo sapiens
attaatacttcatttg

SEQ ID NO: 2686238 - DNA, 13 bp, Homo sapiens
attaatatttatg

SEQ ID NO: 2686239 - DNA, 19 bp, Homo sapiens
attaatatttatgtctctg

SEQ ID NO: 2686240 - DNA, 13 bp, Homo sapiens
attaatgctttgg

SEQ ID NO: 2686241 - DNA, 18 bp, Homo sapiens
attaatgttttgtacaat

SEQ ID NO: 2686242 - DNA, 13 bp, Homo sapiens
attaccatggaga

SEQ ID NO: 2686243 - DNA, 15 bp, Homo sapiens
attagagtcagcctt

SEQ ID NO: 2686244 - DNA, 13 bp, Homo sapiens
attatatatcata

SEQ ID NO: 2686245 - DNA, 17 bp, Homo sapiens
attatatatcataaagt

SEQ ID NO: 2686246 - DNA, 14 bp, Homo sapiens
attatgccactgct

SEQ ID NO: 2686247 - DNA, 14 bp, Homo sapiens
attattaatgcttt

SEQ ID NO: 2686248 - DNA, 15 bp, Homo sapiens
attattaatgctttg

SEQ ID NO: 2686249 - DNA, 22 bp, Homo sapiens
attatttcaaccgcttgccata

SEQ ID NO: 2686250 - DNA, 14 bp, Homo sapiens
attcaacctgtgtc

SEQ ID NO: 2686251 - DNA, 14 bp, Homo sapiens
attcagtgacttct

SEQ ID NO: 2686252 - DNA, 17 bp, Homo sapiens
attcagtgctgtggcct

SEQ ID NO: 2686253 - DNA, 21 bp, Homo sapiens
attcagtgctgtggcctgggc

SEQ ID NO: 2686254 - DNA, 12 bp, Homo sapiens
attccactggac

SEQ ID NO: 2686255 - DNA, 16 bp, Homo sapiens
attcctgtagcatctt

SEQ ID NO: 2686256 - DNA, 16 bp, Homo sapiens
attcctgttgctctgt

SEQ ID NO: 2686257 - DNA, 20 bp, Homo sapiens
attctacacatatatgtata

SEQ ID NO: 2686258 - DNA, 16 bp, Homo sapiens
attctgggttttgtag

SEQ ID NO: 2686259 - DNA, 24 bp, Homo sapiens
attcttcccgctccccacctaccc

SEQ ID NO: 2686260 - DNA, 14 bp, Homo sapiens
attgcacctgcagg

SEQ ID NO: 2686261 - DNA, 17 bp, Homo sapiens
attgcacctgcaggctt

SEQ ID NO: 2686262 - DNA, 15 bp, Homo sapiens
attgcatcatttaca

SEQ ID NO: 2686263 - DNA, 22 bp, Homo sapiens
attggagggtgggagagcccag

SEQ ID NO: 2686264 - DNA, 15 bp, Homo sapiens
attgggctggctctg

SEQ ID NO: 2686265 - DNA, 18 bp, Homo sapiens
attgtaattaataataga

SEQ ID NO: 2686266 - DNA, 14 bp, Homo sapiens
attgtcattagtga

SEQ ID NO: 2686267 - DNA, 14 bp, Homo sapiens
attgtgtctgcatt

SEQ ID NO: 2686268 - DNA, 17 bp, Homo sapiens
attgttagttttaagcc

SEQ ID NO: 2686269 - DNA, 20 bp, Homo sapiens
atttaccttttctgttgtac

SEQ ID NO: 2686270 - DNA, 13 bp, Homo sapiens
atttagaatatat

SEQ ID NO: 2686271 - DNA, 20 bp, Homo sapiens
atttagaatatattaaatcg

SEQ ID NO: 2686272 - DNA, 23 bp, Homo sapiens
atttatcttttgggtctgtcctc

SEQ ID NO: 2686273 - DNA, 15 bp, Homo sapiens
atttcaacaagaata

SEQ ID NO: 2686274 - DNA, 21 bp, Homo sapiens
atttcaacaagaatattgtat

SEQ ID NO: 2686275 - DNA, 15 bp, Homo sapiens
atttcaccagcagca

SEQ ID NO: 2686276 - DNA, 22 bp, Homo sapiens
atttccctgggggcatcctgct

SEQ ID NO: 2686277 - DNA, 23 bp, Homo sapiens
atttctagtcccttctctctttc

SEQ ID NO: 2686278 - DNA, 13 bp, Homo sapiens
atttctctttgaa

SEQ ID NO: 2686279 - DNA, 16 bp, Homo sapiens
atttctctttgaaaca

SEQ ID NO: 2686280 - DNA, 22 bp, Homo sapiens
atttggggattcagatttctct

SEQ ID NO: 2686281 - DNA, 18 bp, Homo sapiens
atttgtgtgttcactaaa

SEQ ID NO: 2686282 - DNA, 16 bp, Homo sapiens
attttactgacagaaa

SEQ ID NO: 2686283 - DNA, 19 bp, Homo sapiens
attttactgacagaaatgc

SEQ ID NO: 2686284 - DNA, 21 bp, Homo sapiens
attttactgacagaaatgcaa

SEQ ID NO: 2686285 - DNA, 14 bp, Homo sapiens
attttctgaccaaa

SEQ ID NO: 2686286 - DNA, 23 bp, Homo sapiens
attttctgaccaaaatgtgtttc

SEQ ID NO: 2686287 - DNA, 18 bp, Homo sapiens
attttgcattagacagat

SEQ ID NO: 2686288 - DNA, 18 bp, Homo sapiens
attttgttatagaatact

SEQ ID NO: 2686289 - DNA, 14 bp, Homo sapiens
atttttaagtggtt

SEQ ID NO: 2686290 - DNA, 16 bp, Homo sapiens
atttttacagttatag

SEQ ID NO: 2686291 - DNA, 15 bp, Homo sapiens
caaaaaaccccagct

SEQ ID NO: 2686292 - DNA, 13 bp, Homo sapiens
caaaaaactgcag

SEQ ID NO: 2686293 - DNA, 21 bp, Homo sapiens
caaaccatctggtgcctttcc

SEQ ID NO: 2686294 - DNA, 16 bp, Homo sapiens
caaagagactggagca

SEQ ID NO: 2686295 - DNA, 17 bp, Homo sapiens
caaagagactggagcat

SEQ ID NO: 2686296 - DNA, 20 bp, Homo sapiens
caaagatatgctaagcagta

SEQ ID NO: 2686297 - DNA, 17 bp, Homo sapiens
caaagcacagctgggca

SEQ ID NO: 2686298 - DNA, 18 bp, Homo sapiens
caaagcatttctagtccc

SEQ ID NO: 2686299 - DNA, 16 bp, Homo sapiens
caaagccacctgctgc

SEQ ID NO: 2686300 - DNA, 15 bp, Homo sapiens
caaagctgctttctt

SEQ ID NO: 2686301 - DNA, 16 bp, Homo sapiens
caaagctgctttcttc

SEQ ID NO: 2686302 - DNA, 18 bp, Homo sapiens
caaagctgctttcttctc

SEQ ID NO: 2686303 - DNA, 22 bp, Homo sapiens
caaaggacagtgggcaggaggc

SEQ ID NO: 2686304 - DNA, 14 bp, Homo sapiens
caaaggtggcctgc

SEQ ID NO: 2686305 - DNA, 13 bp, Homo sapiens
caaagttatattt

SEQ ID NO: 2686306 - DNA, 19 bp, Homo sapiens
caaatctgtatatgttgta

SEQ ID NO: 2686307 - DNA, 18 bp, Homo sapiens
caaatgacccaaagacca

SEQ ID NO: 2686308 - DNA, 20 bp, Homo sapiens
caaatgagcattagctactt

SEQ ID NO: 2686309 - DNA, 12 bp, Homo sapiens
caaatgtaacta

SEQ ID NO: 2686310 - DNA, 19 bp, Homo sapiens
caaatgtaactatgtttta

SEQ ID NO: 2686311 - DNA, 14 bp, Homo sapiens
caaatgtttctgca

SEQ ID NO: 2686312 - DNA, 21 bp, Homo sapiens
caaattgtaattaataataga

SEQ ID NO: 2686313 - DNA, 21 bp, Homo sapiens
caacaacgttcttagtttact

SEQ ID NO: 2686314 - DNA, 14 bp, Homo sapiens
caaccccagctggc

SEQ ID NO: 2686315 - DNA, 15 bp, Homo sapiens
caaccccagctggcc

SEQ ID NO: 2686316 - DNA, 17 bp, Homo sapiens
caaccccagctggcctc

SEQ ID NO: 2686317 - DNA, 23 bp, Homo sapiens
caaccccagctggcctctagaac

SEQ ID NO: 2686318 - DNA, 16 bp, Homo sapiens
caaccccccacctgcc

SEQ ID NO: 2686319 - DNA, 17 bp, Homo sapiens
caaccctgtttcctgag

SEQ ID NO: 2686320 - DNA, 14 bp, Homo sapiens
caacctgtgtctta

SEQ ID NO: 2686321 - DNA, 13 bp, Homo sapiens
caacgacaaagcc

SEQ ID NO: 2686322 - DNA, 20 bp, Homo sapiens
caacgggaccccctggccct

SEQ ID NO: 2686323 - DNA, 21 bp, Homo sapiens
caacgggaccccctggccctg

SEQ ID NO: 2686324 - DNA, 17 bp, Homo sapiens
caactcacacctccttt

SEQ ID NO: 2686325 - DNA, 18 bp, Homo sapiens
caactcacacctcctttt

SEQ ID NO: 2686326 - DNA, 23 bp, Homo sapiens
caactcacacctccttttcttct

SEQ ID NO: 2686327 - DNA, 16 bp, Homo sapiens
caactgatcctgctcc

SEQ ID NO: 2686328 - DNA, 21 bp, Homo sapiens
caactgatcctgctccagcag

SEQ ID NO: 2686329 - DNA, 15 bp, Homo sapiens
caagaatattgtatg

SEQ ID NO: 2686330 - DNA, 17 bp, Homo sapiens
caagaatattgtatgtt

SEQ ID NO: 2686331 - DNA, 15 bp, Homo sapiens
caagaattaatattt

SEQ ID NO: 2686332 - DNA, 16 bp, Homo sapiens
caagacaacattgtaa

SEQ ID NO: 2686333 - DNA, 19 bp, Homo sapiens
caagactgtcattgcccct

SEQ ID NO: 2686334 - DNA, 15 bp, Homo sapiens
caagagcagaggcag

SEQ ID NO: 2686335 - DNA, 16 bp, Homo sapiens
caagatgtcagactgg

SEQ ID NO: 2686336 - DNA, 17 bp, Homo sapiens
caagatgtcagactggc

SEQ ID NO: 2686337 - DNA, 14 bp, Homo sapiens
caagcaagcagaca

SEQ ID NO: 2686338 - DNA, 18 bp, Homo sapiens
caagccaacgacaaagcc

SEQ ID NO: 2686339 - DNA, 13 bp, Homo sapiens
caagccacagaag

SEQ ID NO: 2686340 - DNA, 19 bp, Homo sapiens
caagccacagaagccagga

SEQ ID NO: 2686341 - DNA, 17 bp, Homo sapiens
caagcccaggcttcctg

SEQ ID NO: 2686342 - DNA, 13 bp, Homo sapiens
caaggctgtgctc

SEQ ID NO: 2686343 - DNA, 21 bp, Homo sapiens
caaggctgtgctcttcctctg

SEQ ID NO: 2686344 - DNA, 22 bp, Homo sapiens
caaggctgtgctcttcctctgg

SEQ ID NO: 2686345 - DNA, 17 bp, Homo sapiens
caagggaagaaacactc

SEQ ID NO: 2686346 - DNA, 18 bp, Homo sapiens
caaggggctggctggagt

SEQ ID NO: 2686347 - DNA, 19 bp, Homo sapiens
caaggggctggctggagtc

SEQ ID NO: 2686348 - DNA, 16 bp, Homo sapiens
caaggtcggtaagttg

SEQ ID NO: 2686349 - DNA, 21 bp, Homo sapiens
caaggtgggctgagccctggc

SEQ ID NO: 2686350 - DNA, 17 bp, Homo sapiens
caagtagtagtgtcttc

SEQ ID NO: 2686351 - DNA, 20 bp, Homo sapiens
caagtccctgactctctgtg

SEQ ID NO: 2686352 - DNA, 21 bp, Homo sapiens
caagtccctgactctctgtga

SEQ ID NO: 2686353 - DNA, 15 bp, Homo sapiens
caagtcttgctgtgc

SEQ ID NO: 2686354 - DNA, 17 bp, Homo sapiens
caagtcttgctgtgctt

SEQ ID NO: 2686355 - DNA, 20 bp, Homo sapiens
caagtgccagtcttgtgtct

SEQ ID NO: 2686356 - DNA, 21 bp, Homo sapiens
caagtgtttgaagtctgctca

SEQ ID NO: 2686357 - DNA, 18 bp, Homo sapiens
caagtttcatcagcccta

SEQ ID NO: 2686358 - DNA, 17 bp, Homo sapiens
caataaagctgctgaga

SEQ ID NO: 2686359 - DNA, 15 bp, Homo sapiens
caataaatgctgaat

SEQ ID NO: 2686360 - DNA, 20 bp, Homo sapiens
caataaatgctgaatgaatc

SEQ ID NO: 2686361 - DNA, 21 bp, Homo sapiens
caatagctctactgccctccc

SEQ ID NO: 2686362 - DNA, 23 bp, Homo sapiens
caatagctctactgccctcccct

SEQ ID NO: 2686363 - DNA, 14 bp, Homo sapiens
caatattcaataaa

SEQ ID NO: 2686364 - DNA, 20 bp, Homo sapiens
caatcctcaaacatggaaga

SEQ ID NO: 2686365 - DNA, 17 bp, Homo sapiens
caatgaaagtttgcact

SEQ ID NO: 2686366 - DNA, 15 bp, Homo sapiens
caatggggccagcac

SEQ ID NO: 2686367 - DNA, 19 bp, Homo sapiens
caatggggccagcactgga

SEQ ID NO: 2686368 - DNA, 15 bp, Homo sapiens
caatgtcagaaactc

SEQ ID NO: 2686369 - DNA, 19 bp, Homo sapiens
caattactaaattgtatac

SEQ ID NO: 2686370 - DNA, 12 bp, Homo sapiens
caattcctgggc

SEQ ID NO: 2686371 - DNA, 17 bp, Homo sapiens
cacaagccacagaagcc

SEQ ID NO: 2686372 - DNA, 14 bp, Homo sapiens
cacacagaactggc

SEQ ID NO: 2686373 - DNA, 17 bp, Homo sapiens
cacacataagcactgaa

SEQ ID NO: 2686374 - DNA, 23 bp, Homo sapiens
cacaccccagcgcctgtgctgag

SEQ ID NO: 2686375 - DNA, 14 bp, Homo sapiens
cacaccgctggtcc

SEQ ID NO: 2686376 - DNA, 20 bp, Homo sapiens
cacaccgctggtccctgccc

SEQ ID NO: 2686377 - DNA, 15 bp, Homo sapiens
cacacctcagcccca

SEQ ID NO: 2686378 - DNA, 14 bp, Homo sapiens
cacacctccttttc

SEQ ID NO: 2686379 - DNA, 19 bp, Homo sapiens
cacaccttttccccaggag

SEQ ID NO: 2686380 - DNA, 20 bp, Homo sapiens
cacaccttttccccaggagc

SEQ ID NO: 2686381 - DNA, 19 bp, Homo sapiens
cacactggtttgccaggcc

SEQ ID NO: 2686382 - DNA, 18 bp, Homo sapiens
cacagaactggcaggagc

SEQ ID NO: 2686383 - DNA, 14 bp, Homo sapiens
cacagccgcagcct

SEQ ID NO: 2686384 - DNA, 21 bp, Homo sapiens
cacagccgcagcctccctctg

SEQ ID NO: 2686385 - DNA, 22 bp, Homo sapiens
cacagccgcagcctccctctga

SEQ ID NO: 2686386 - DNA, 18 bp, Homo sapiens
cacagctgggcatgccat

SEQ ID NO: 2686387 - DNA, 17 bp, Homo sapiens
cacaggagagcacccac

SEQ ID NO: 2686388 - DNA, 14 bp, Homo sapiens
cacaggccagcctt

SEQ ID NO: 2686389 - DNA, 16 bp, Homo sapiens
cacagggctctttgat

SEQ ID NO: 2686390 - DNA, 16 bp, Homo sapiens
cacagggttttgtatt

SEQ ID NO: 2686391 - DNA, 22 bp, Homo sapiens
cacctgctgcgggggagccagt

SEQ ID NO: 2686392 - DNA, 22 bp, Homo sapiens
cacctgtactcaggaggctgag

SEQ ID NO: 2686393 - DNA, 18 bp, Homo sapiens
cacctgtgcttggaacca

SEQ ID NO: 2686394 - DNA, 20 bp, Homo sapiens
cacctgtgcttggaaccagt

SEQ ID NO: 2686395 - DNA, 15 bp, Homo sapiens
cacgaggggggccag

SEQ ID NO: 2686396 - DNA, 14 bp, Homo sapiens
cacgccactgcact

SEQ ID NO: 2686397 - DNA, 19 bp, Homo sapiens
cacgcctatgatcccagca

SEQ ID NO: 2686398 - DNA, 22 bp, Homo sapiens
cacgcctatgatcccagcactt

SEQ ID NO: 2686399 - DNA, 12 bp, Homo sapiens
cacgctggcctt

SEQ ID NO: 2686400 - DNA, 13 bp, Homo sapiens
cacggccctcctg

SEQ ID NO: 2686401 - DNA, 17 bp, Homo sapiens
cacggccctcctgggaa

SEQ ID NO: 2686402 - DNA, 22 bp, Homo sapiens
cacggccctcctgggaacctcc

SEQ ID NO: 2686403 - DNA, 16 bp, Homo sapiens
cacgtctcctgctgcg

SEQ ID NO: 2686404 - DNA, 20 bp, Homo sapiens
cacgtgatggaccaaagcca

SEQ ID NO: 2686405 - DNA, 15 bp, Homo sapiens
cactaagctctctgg

SEQ ID NO: 2686406 - DNA, 16 bp, Homo sapiens
cactaagctctctggg

SEQ ID NO: 2686407 - DNA, 18 bp, Homo sapiens
cactaagctctctgggcc

SEQ ID NO: 2686408 - DNA, 19 bp, Homo sapiens
cactaagctctctgggcct

SEQ ID NO: 2686409 - DNA, 19 bp, Homo sapiens
cactacactccagcctgag

SEQ ID NO: 2686410 - DNA, 18 bp, Homo sapiens
cactaggactctgaggct

SEQ ID NO: 2686411 - DNA, 12 bp, Homo sapiens
cactccagcctg

SEQ ID NO: 2686412 - DNA, 21 bp, Homo sapiens
cactccagcctgagcaacaga

SEQ ID NO: 2686413 - DNA, 14 bp, Homo sapiens
cactccagcctggg

SEQ ID NO: 2686414 - DNA, 16 bp, Homo sapiens
cactccagcctgggcg

SEQ ID NO: 2686415 - DNA, 17 bp, Homo sapiens
cactccggtgtgcctgc

SEQ ID NO: 2686416 - DNA, 20 bp, Homo sapiens
cactccggtgtgcctgcagc

SEQ ID NO: 2686417 - DNA, 21 bp, Homo sapiens
cactccggtgtgcctgcagcc

SEQ ID NO: 2686418 - DNA, 13 bp, Homo sapiens
cactctctgctgg

SEQ ID NO: 2686419 - DNA, 14 bp, Homo sapiens
cactctctgctggc

SEQ ID NO: 2686420 - DNA, 12 bp, Homo sapiens
cactctttgcta

SEQ ID NO: 2686421 - DNA, 17 bp, Homo sapiens
cactctttgctacaata

SEQ ID NO: 2686422 - DNA, 19 bp, Homo sapiens
cactctttgctacaataaa

SEQ ID NO: 2686423 - DNA, 21 bp, Homo sapiens
cactctttgctacaataaatg

SEQ ID NO: 2686424 - DNA, 16 bp, Homo sapiens
cactgcactccagcct

SEQ ID NO: 2686425 - DNA, 18 bp, Homo sapiens
cactgcactccagcctgg

SEQ ID NO: 2686426 - DNA, 23 bp, Homo sapiens
cactgcagtccgcagtctggcct

SEQ ID NO: 2686427 - DNA, 15 bp, Homo sapiens
cactggagcccagga

SEQ ID NO: 2686428 - DNA, 23 bp, Homo sapiens
cactggaggggcccacccacatg

SEQ ID NO: 2686429 - DNA, 14 bp, Homo sapiens
cactggccccaccc

SEQ ID NO: 2686430 - DNA, 13 bp, Homo sapiens
cactggcctggcg

SEQ ID NO: 2686431 - DNA, 21 bp, Homo sapiens
cacttctaagttgagtatatt

SEQ ID NO: 2686432 - DNA, 18 bp, Homo sapiens
cacttgagttcaggagtt

SEQ ID NO: 2686433 - DNA, 20 bp, Homo sapiens
cacttggtttttggctcttt

SEQ ID NO: 2686434 - DNA, 17 bp, Homo sapiens
cactttacagatgagga

SEQ ID NO: 2686435 - DNA, 19 bp, Homo sapiens
cactttacctgcaggctcc

SEQ ID NO: 2686436 - DNA, 20 bp, Homo sapiens
cactttacctgcaggctcca

SEQ ID NO: 2686437 - DNA, 17 bp, Homo sapiens
cagaaccagtctttcaa

SEQ ID NO: 2686438 - DNA, 22 bp, Homo sapiens
cagaactggcaggagcctcgtg

SEQ ID NO: 2686439 - DNA, 15 bp, Homo sapiens
cagaagccagtctgc

SEQ ID NO: 2686440 - DNA, 19 bp, Homo sapiens
cagaagcctgaggctggga

SEQ ID NO: 2686441 - DNA, 18 bp, Homo sapiens
cagaaggccaagaatcaa

SEQ ID NO: 2686442 - DNA, 23 bp, Homo sapiens
cagaatgacttttattgagctct

SEQ ID NO: 2686443 - DNA, 19 bp, Homo sapiens
cagacaagtcttgctgtgc

SEQ ID NO: 2686444 - DNA, 22 bp, Homo sapiens
cagaccagcagcaatctgtctt

SEQ ID NO: 2686445 - DNA, 15 bp, Homo sapiens
cagaccattgtcttc

SEQ ID NO: 2686446 - DNA, 16 bp, Homo sapiens
cagaccattgtcttcc

SEQ ID NO: 2686447 - DNA, 21 bp, Homo sapiens
cagaccattgtcttccaaccc

SEQ ID NO: 2686448 - DNA, 22 bp, Homo sapiens
cagaccattgtcttccaacccc

SEQ ID NO: 2686449 - DNA, 24 bp, Homo sapiens
cagaccattgtcttccaaccccag

SEQ ID NO: 2686450 - DNA, 20 bp, Homo sapiens
cagactccaatggggccagc

SEQ ID NO: 2686451 - DNA, 22 bp, Homo sapiens
cagactccaatggggccagcac

SEQ ID NO: 2686452 - DNA, 23 bp, Homo sapiens
cagactccaatggggccagcact

SEQ ID NO: 2686453 - DNA, 23 bp, Homo sapiens
caggtcctggtgggtcagcccag

SEQ ID NO: 2686454 - DNA, 13 bp, Homo sapiens
caggtctgatgcc

SEQ ID NO: 2686455 - DNA, 14 bp, Homo sapiens
caggtctgatgcca

SEQ ID NO: 2686456 - DNA, 17 bp, Homo sapiens
caggtgagaacccagag

SEQ ID NO: 2686457 - DNA, 12 bp, Homo sapiens
caggtgcagtgg

SEQ ID NO: 2686458 - DNA, 15 bp, Homo sapiens
caggtgccaccaata

SEQ ID NO: 2686459 - DNA, 18 bp, Homo sapiens
caggtgccaccaataaaa

SEQ ID NO: 2686460 - DNA, 17 bp, Homo sapiens
caggtggaggtgccagg

SEQ ID NO: 2686461 - DNA, 16 bp, Homo sapiens
caggtgtgaccctgag

SEQ ID NO: 2686462 - DNA, 20 bp, Homo sapiens
caggttagcctttgccctgt

SEQ ID NO: 2686463 - DNA, 20 bp, Homo sapiens
caggttgaggggctcctgga

SEQ ID NO: 2686464 - DNA, 12 bp, Homo sapiens
cagtaaacactg

SEQ ID NO: 2686465 - DNA, 15 bp, Homo sapiens
cagtaaacactgtgt

SEQ ID NO: 2686466 - DNA, 21 bp, Homo sapiens
cagtacaatgtgactttgaaa

SEQ ID NO: 2686467 - DNA, 22 bp, Homo sapiens
cagtcactgtccctcaaatgac

SEQ ID NO: 2686468 - DNA, 12 bp, Homo sapiens
cagtcccacacc

SEQ ID NO: 2686469 - DNA, 16 bp, Homo sapiens
cagtcctagagctcct

SEQ ID NO: 2686470 - DNA, 22 bp, Homo sapiens
cagtcctgggagaacctcaggc

SEQ ID NO: 2686471 - DNA, 23 bp, Homo sapiens
cagtcctgggagaacctcaggct

SEQ ID NO: 2686472 - DNA, 14 bp, Homo sapiens
cagtctcaggagca

SEQ ID NO: 2686473 - DNA, 18 bp, Homo sapiens
cagtctcaggagcatggg

SEQ ID NO: 2686474 - DNA, 14 bp, Homo sapiens
cagtgaaccaaaga

SEQ ID NO: 2686475 - DNA, 21 bp, Homo sapiens
cagtgaaccaaagagactgga

SEQ ID NO: 2686476 - DNA, 18 bp, Homo sapiens
cagtgacgtgcacctgta

SEQ ID NO: 2686477 - DNA, 14 bp, Homo sapiens
cagtgaggctggga

SEQ ID NO: 2686478 - DNA, 14 bp, Homo sapiens
cagtgcttcagcct

SEQ ID NO: 2686479 - DNA, 18 bp, Homo sapiens
cagtgcttcagcctgagg

SEQ ID NO: 2686480 - DNA, 19 bp, Homo sapiens
cagtgcttcagcctgaggc

SEQ ID NO: 2686481 - DNA, 14 bp, Homo sapiens
cagtggcctggctt

SEQ ID NO: 2686482 - DNA, 23 bp, Homo sapiens
cagtgggcaggaggccccaggct

SEQ ID NO: 2686483 - DNA, 18 bp, Homo sapiens
cagtgtaactggctgctc

SEQ ID NO: 2686484 - DNA, 22 bp, Homo sapiens
cagtgtaactggctgctccctg

SEQ ID NO: 2686485 - DNA, 22 bp, Homo sapiens
cagtgtgatcccaagtgccagt

SEQ ID NO: 2686486 - DNA, 16 bp, Homo sapiens
cagttctgaactggaa

SEQ ID NO: 2686487 - DNA, 13 bp, Homo sapiens
cagttctggggcc

SEQ ID NO: 2686488 - DNA, 23 bp, Homo sapiens
cagttctggggcccgcctgccac

SEQ ID NO: 2686489 - DNA, 16 bp, Homo sapiens
cagttttgaaagaaaa

SEQ ID NO: 2686490 - DNA, 20 bp, Homo sapiens
cataaagtatgccttcctgt

SEQ ID NO: 2686491 - DNA, 21 bp, Homo sapiens
cataacaaaccatctggtgcc

SEQ ID NO: 2686492 - DNA, 20 bp, Homo sapiens
catagaattgcaatctataa

SEQ ID NO: 2686493 - DNA, 20 bp, Homo sapiens
catcacagggcagagccggg

SEQ ID NO: 2686494 - DNA, 12 bp, Homo sapiens
catcacctcagg

SEQ ID NO: 2686495 - DNA, 15 bp, Homo sapiens
catcacctcaggcca

SEQ ID NO: 2686496 - DNA, 19 bp, Homo sapiens
catcattgcacctgcaggc

SEQ ID NO: 2686497 - DNA, 14 bp, Homo sapiens
catccaccaatctc

SEQ ID NO: 2686498 - DNA, 19 bp, Homo sapiens
catcccaggaggggcctct

SEQ ID NO: 2686499 - DNA, 21 bp, Homo sapiens
catcccaggaggggcctctga

SEQ ID NO: 2686500 - DNA, 22 bp, Homo sapiens
catcccaggaggggcctctgaa

SEQ ID NO: 2686501 - DNA, 15 bp, Homo sapiens
catcctgaaagccag

SEQ ID NO: 2686502 - DNA, 14 bp, Homo sapiens
catcctgaggtgcc

SEQ ID NO: 2686503 - DNA, 14 bp, Homo sapiens
catcctgcttcctg

SEQ ID NO: 2686504 - DNA, 16 bp, Homo sapiens
catcctgcttcctgaa

SEQ ID NO: 2686505 - DNA, 18 bp, Homo sapiens
catcctgcttcctgaaag

SEQ ID NO: 2686506 - DNA, 12 bp, Homo sapiens
cccagctggcca

SEQ ID NO: 2686507 - DNA, 13 bp, Homo sapiens
cccagctggccac

SEQ ID NO: 2686508 - DNA, 12 bp, Homo sapiens
cccagctggcct

SEQ ID NO: 2686509 - DNA, 13 bp, Homo sapiens
cccagctggcctc

SEQ ID NO: 2686510 - DNA, 18 bp, Homo sapiens
cccagctggcctctagaa

SEQ ID NO: 2686511 - DNA, 12 bp, Homo sapiens
cccagcttcctg

SEQ ID NO: 2686512 - DNA, 14 bp, Homo sapiens
cccaggaggggcct

SEQ ID NO: 2686513 - DNA, 17 bp, Homo sapiens
cccaggaggggcctctg

SEQ ID NO: 2686514 - DNA, 18 bp, Homo sapiens
cccaggatcactctctgc

SEQ ID NO: 2686515 - DNA, 13 bp, Homo sapiens
cccaggcctccct

SEQ ID NO: 2686516 - DNA, 23 bp, Homo sapiens
cccaggcctgattcactggcctg

SEQ ID NO: 2686517 - DNA, 15 bp, Homo sapiens
cccaggctgagagcc

SEQ ID NO: 2686518 - DNA, 18 bp, Homo sapiens
cccaggctgagagccaga

SEQ ID NO: 2686519 - DNA, 18 bp, Homo sapiens
cccaggcttcctgggtcc

SEQ ID NO: 2686520 - DNA, 22 bp, Homo sapiens
cccaggcttcctgggtcctgcc

SEQ ID NO: 2686521 - DNA, 18 bp, Homo sapiens
cccagggccagggccctg

SEQ ID NO: 2686522 - DNA, 13 bp, Homo sapiens
cccaggtctgatg

SEQ ID NO: 2686523 - DNA, 20 bp, Homo sapiens
cccaggtggaggtgccagga

SEQ ID NO: 2686524 - DNA, 23 bp, Homo sapiens
cccaggtggaggtgccaggaagc

SEQ ID NO: 2686525 - DNA, 23 bp, Homo sapiens
cccaggttgaggtgcgctcacct

SEQ ID NO: 2686526 - DNA, 14 bp, Homo sapiens
cccagtgtccttcc

SEQ ID NO: 2686527 - DNA, 18 bp, Homo sapiens
cccatgaagacaggacag

SEQ ID NO: 2686528 - DNA, 19 bp, Homo sapiens
cccatgaagacaggacagt

SEQ ID NO: 2686529 - DNA, 21 bp, Homo sapiens
ccccaccctcgtggacacctg

SEQ ID NO: 2686530 - DNA, 23 bp, Homo sapiens
ccccaccctcgtggacacctgcc

SEQ ID NO: 2686531 - DNA, 15 bp, Homo sapiens
ccccacgtctgtcct

SEQ ID NO: 2686532 - DNA, 14 bp, Homo sapiens
ccccagctattttc

SEQ ID NO: 2686533 - DNA, 21 bp, Homo sapiens
ccccagctattttctgaccaa

SEQ ID NO: 2686534 - DNA, 12 bp, Homo sapiens
ccccagcttcct

SEQ ID NO: 2686535 - DNA, 15 bp, Homo sapiens
ccccagcttcctgtg

SEQ ID NO: 2686536 - DNA, 15 bp, Homo sapiens
ccccaggctgagagc

SEQ ID NO: 2686537 - DNA, 17 bp, Homo sapiens
ccccaggctgagagcca

SEQ ID NO: 2686538 - DNA, 21 bp, Homo sapiens
ccccaggtggaggtgccagga

SEQ ID NO: 2686539 - DNA, 14 bp, Homo sapiens
ccccatctctacta

SEQ ID NO: 2686540 - DNA, 15 bp, Homo sapiens
cccccaccactagga

SEQ ID NO: 2686541 - DNA, 15 bp, Homo sapiens
ccccctggccctgcc

SEQ ID NO: 2686542 - DNA, 19 bp, Homo sapiens
ccccctggtggacagtcct

SEQ ID NO: 2686543 - DNA, 20 bp, Homo sapiens
ccccctggtggacagtcctg

SEQ ID NO: 2686544 - DNA, 23 bp, Homo sapiens
ccccctggtggacagtcctggga

SEQ ID NO: 2686545 - DNA, 12 bp, Homo sapiens
ccccgcctcccc

SEQ ID NO: 2686546 - DNA, 17 bp, Homo sapiens
ccccgtggatggtctcc

SEQ ID NO: 2686547 - DNA, 22 bp, Homo sapiens
cccctacgggcgctgcagcctc

SEQ ID NO: 2686548 - DNA, 13 bp, Homo sapiens
cccctccagcaca

SEQ ID NO: 2686549 - DNA, 12 bp, Homo sapiens
cccctcccaggg

SEQ ID NO: 2686550 - DNA, 20 bp, Homo sapiens
cccctccgatgctgaggcca

SEQ ID NO: 2686551 - DNA, 14 bp, Homo sapiens
cccctgcctgcctt

SEQ ID NO: 2686552 - DNA, 20 bp, Homo sapiens
cccctgctctgtagccacct

SEQ ID NO: 2686553 - DNA, 13 bp, Homo sapiens
cccctggccctgc

SEQ ID NO: 2686554 - DNA, 11 bp, Homo sapiens
cccctgggctc

SEQ ID NO: 2686555 - DNA, 22 bp, Homo sapiens
cccctggtggacagtcctggga

SEQ ID NO: 2686556 - DNA, 23 bp, Homo sapiens
cccctggtggacagtcctgggag

SEQ ID NO: 2686557 - DNA, 22 bp, Homo sapiens
cccctttactcagcccagctgg

SEQ ID NO: 2686558 - DNA, 23 bp, Homo sapiens
cccgcctccccatacttcctggg

SEQ ID NO: 2686559 - DNA, 15 bp, Homo sapiens
cccgcgcctccttcc

SEQ ID NO: 2686560 - DNA, 13 bp, Homo sapiens
cccgctccccacc

SEQ ID NO: 2686561 - DNA, 14 bp, Homo sapiens
cccgctctggacca

SEQ ID NO: 2686562 - DNA, 20 bp, Homo sapiens
cccgcttgctctcctggagc

SEQ ID NO: 2686563 - DNA, 13 bp, Homo sapiens
cccggcatcctga

SEQ ID NO: 2686564 - DNA, 17 bp, Homo sapiens
cccggcatcctgaaagc

SEQ ID NO: 2686565 - DNA, 15 bp, Homo sapiens
cccggccacatgccg

SEQ ID NO: 2686566 - DNA, 23 bp, Homo sapiens
cccgtggggctcccggcatcctg

SEQ ID NO: 2686567 - DNA, 12 bp, Homo sapiens
ccctacccactc

SEQ ID NO: 2686568 - DNA, 22 bp, Homo sapiens
ccctacgggcgctgcagcctcc

SEQ ID NO: 2686569 - DNA, 14 bp, Homo sapiens
ccctcatctccagc

SEQ ID NO: 2686570 - DNA, 24 bp, Homo sapiens
ccctccacgcaaggctgtgctctt

SEQ ID NO: 2686571 - DNA, 12 bp, Homo sapiens
ccctccagcaca

SEQ ID NO: 2686572 - DNA, 21 bp, Homo sapiens
ccctccatgtggccccaggtg

SEQ ID NO: 2686573 - DNA, 16 bp, Homo sapiens
ccctccgatgctgagg

SEQ ID NO: 2686574 - DNA, 15 bp, Homo sapiens
ccctccgtcgggccc

SEQ ID NO: 2686575 - DNA, 12 bp, Homo sapiens
tccataaagtaa

SEQ ID NO: 2686576 - DNA, 21 bp, Homo sapiens
tccataaagtaattttgtgaa

SEQ ID NO: 2686577 - DNA, 17 bp, Homo sapiens
tccatgcacctcccttc

SEQ ID NO: 2686578 - DNA, 14 bp, Homo sapiens
tccatggtgctgca

SEQ ID NO: 2686579 - DNA, 15 bp, Homo sapiens
tccatggtgctgcat

SEQ ID NO: 2686580 - DNA, 11 bp, Homo sapiens
tccatgtggcc

SEQ ID NO: 2686581 - DNA, 18 bp, Homo sapiens
tccatgtggccccaggtg

SEQ ID NO: 2686582 - DNA, 20 bp, Homo sapiens
tccatgtggccccaggtgcc

SEQ ID NO: 2686583 - DNA, 17 bp, Homo sapiens
tccattgaccagctctc

SEQ ID NO: 2686584 - DNA, 21 bp, Homo sapiens
tcccaaggagccattctgtgt

SEQ ID NO: 2686585 - DNA, 22 bp, Homo sapiens
tcccaaggagccattctgtgtg

SEQ ID NO: 2686586 - DNA, 16 bp, Homo sapiens
tcccaatagctctact

SEQ ID NO: 2686587 - DNA, 18 bp, Homo sapiens
tcccacaccgctggtccc

SEQ ID NO: 2686588 - DNA, 24 bp, Homo sapiens
tcccagcactttgggaggccgagg

SEQ ID NO: 2686589 - DNA, 19 bp, Homo sapiens
tcccagctactcagaagcc

SEQ ID NO: 2686590 - DNA, 16 bp, Homo sapiens
tcccaggaaccaaaaa

SEQ ID NO: 2686591 - DNA, 12 bp, Homo sapiens
tcccaggagggg

SEQ ID NO: 2686592 - DNA, 16 bp, Homo sapiens
tcccagggccagggcc

SEQ ID NO: 2686593 - DNA, 21 bp, Homo sapiens
tcccagggccagggccctgca

SEQ ID NO: 2686594 - DNA, 12 bp, Homo sapiens
tcccagtggcct

SEQ ID NO: 2686595 - DNA, 14 bp, Homo sapiens
tcccagtggcctgg

SEQ ID NO: 2686596 - DNA, 22 bp, Homo sapiens
tccccaggtggaggtgccagga

SEQ ID NO: 2686597 - DNA, 19 bp, Homo sapiens
tccccattagagtcagcct

SEQ ID NO: 2686598 - DNA, 14 bp, Homo sapiens
tcccccccagtgca

SEQ ID NO: 2686599 - DNA, 18 bp, Homo sapiens
tccccctcccagggccag

SEQ ID NO: 2686600 - DNA, 20 bp, Homo sapiens
tccccctccccggccacatg

SEQ ID NO: 2686601 - DNA, 10 bp, Homo sapiens
tccccctggg

SEQ ID NO: 2686602 - DNA, 18 bp, Homo sapiens
tccccgtggatggtctcc

SEQ ID NO: 2686603 - DNA, 15 bp, Homo sapiens
tcccctgctcccagg

SEQ ID NO: 2686604 - DNA, 12 bp, Homo sapiens
tccccttcccct

SEQ ID NO: 2686605 - DNA, 19 bp, Homo sapiens
tcccctttactcagcccag

SEQ ID NO: 2686606 - DNA, 20 bp, Homo sapiens
tcccctttactcagcccagc

SEQ ID NO: 2686607 - DNA, 22 bp, Homo sapiens
tcccctttactcagcccagctg

SEQ ID NO: 2686608 - DNA, 23 bp, Homo sapiens
tcccctttactcagcccagctgg

SEQ ID NO: 2686609 - DNA, 19 bp, Homo sapiens
tcccgcttgctctcctgga

SEQ ID NO: 2686610 - DNA, 14 bp, Homo sapiens
tcccggcatcctga

SEQ ID NO: 2686611 - DNA, 16 bp, Homo sapiens
tcccggcatcctgaaa

SEQ ID NO: 2686612 - DNA, 12 bp, Homo sapiens
tccctacccact

SEQ ID NO: 2686613 - DNA, 13 bp, Homo sapiens
tccctacccactc

SEQ ID NO: 2686614 - DNA, 19 bp, Homo sapiens
tccctcaaatgacccaaag

SEQ ID NO: 2686615 - DNA, 14 bp, Homo sapiens
tccctccctcactg

SEQ ID NO: 2686616 - DNA, 12 bp, Homo sapiens
tccctctcggaa

SEQ ID NO: 2686617 - DNA, 23 bp, Homo sapiens
tccctctcggaaggctggctggg

SEQ ID NO: 2686618 - DNA, 13 bp, Homo sapiens
tccctctgacctg

SEQ ID NO: 2686619 - DNA, 18 bp, Homo sapiens
tccctctgacctgcaggc

SEQ ID NO: 2686620 - DNA, 20 bp, Homo sapiens
tccctgactctctgtgacct

SEQ ID NO: 2686621 - DNA, 17 bp, Homo sapiens
tccctgcacagcctcta

SEQ ID NO: 2686622 - DNA, 15 bp, Homo sapiens
tccctgcagactcca

SEQ ID NO: 2686623 - DNA, 16 bp, Homo sapiens
tccctgccctcccctg

SEQ ID NO: 2686624 - DNA, 17 bp, Homo sapiens
tccctgccctcccctgc

SEQ ID NO: 2686625 - DNA, 13 bp, Homo sapiens
tccctgctcccag

SEQ ID NO: 2686626 - DNA, 15 bp, Homo sapiens
tccctgctcccaggg

SEQ ID NO: 2686627 - DNA, 17 bp, Homo sapiens
tccctgggggcatcctg

SEQ ID NO: 2686628 - DNA, 16 bp, Homo sapiens
tcccttccatgcccca

SEQ ID NO: 2686629 - DNA, 19 bp, Homo sapiens
tcccttccatgccccagga

SEQ ID NO: 2686630 - DNA, 16 bp, Homo sapiens
tcccttctctctttct

SEQ ID NO: 2686631 - DNA, 13 bp, Homo sapiens
tcccttgtgtgtg

SEQ ID NO: 2686632 - DNA, 17 bp, Homo sapiens
tccctttctctctccac

SEQ ID NO: 2686633 - DNA, 19 bp, Homo sapiens
tccggtgtgcctgcagccc

SEQ ID NO: 2686634 - DNA, 20 bp, Homo sapiens
tccgtcgggcccctgcctgc

SEQ ID NO: 2686635 - DNA, 23 bp, Homo sapiens
tccgtgaaaatgcaagtgtttga

SEQ ID NO: 2686636 - DNA, 15 bp, Homo sapiens
tccgtgtgcctcctg

SEQ ID NO: 2686637 - DNA, 20 bp, Homo sapiens
tccgtgtgcctcctgtgtgt

SEQ ID NO: 2686638 - DNA, 21 bp, Homo sapiens
tccgtgtgcctcctgtgtgtc

SEQ ID NO: 2686639 - DNA, 12 bp, Homo sapiens
tcctacctcagc

SEQ ID NO: 2686640 - DNA, 16 bp, Homo sapiens
tcctagagctcctgtc

SEQ ID NO: 2686641 - DNA, 22 bp, Homo sapiens
tcctagagctcctgtccctacc

SEQ ID NO: 2686642 - DNA, 23 bp, Homo sapiens
tcctagtatattagtttgattta

SEQ ID NO: 2686643 - DNA, 13 bp, Homo sapiens
tcctatgctttag

SEQ ID NO: 2686644 - DNA, 15 bp, Homo sapiens
tcctcacttctgtct

SEQ ID NO: 2686645 - DNA, 16 bp, Homo sapiens
tcctcacttctgtctc

SEQ ID NO: 2686646 - DNA, 23 bp, Homo sapiens
tcctccaggagaaggggcccaag

SEQ ID NO: 2686647 - DNA, 12 bp, Homo sapiens
tcctccatggtg

SEQ ID NO: 2686648 - DNA, 11 bp, Homo sapiens
tcctcccagga

SEQ ID NO: 2686649 - DNA, 15 bp, Homo sapiens
tcctcccaggaacca

SEQ ID NO: 2686650 - DNA, 14 bp, Homo sapiens
tcctccccaggtgg

SEQ ID NO: 2686651 - DNA, 19 bp, Homo sapiens
tcctccccttttgcccccg

SEQ ID NO: 2686652 - DNA, 15 bp, Homo sapiens
tcctcctgctctgct

SEQ ID NO: 2686653 - DNA, 16 bp, Homo sapiens
tcctctggtttctgtg

SEQ ID NO: 2686654 - DNA, 22 bp, Homo sapiens
tcctctggtttctgtgtgtccg

SEQ ID NO: 2686655 - DNA, 13 bp, Homo sapiens
tcctgaccaaaga

SEQ ID NO: 2686656 - DNA, 14 bp, Homo sapiens
tcctgaccaaagac

SEQ ID NO: 2686657 - DNA, 13 bp, Homo sapiens
tcctgaggtgcct

SEQ ID NO: 2686658 - DNA, 15 bp, Homo sapiens
tcctgaggtgcctcc

SEQ ID NO: 2686659 - DNA, 18 bp, Homo sapiens
tcctgaggtgcctcccag

SEQ ID NO: 2686660 - DNA, 13 bp, Homo sapiens
tcctgattttgta

SEQ ID NO: 2686661 - DNA, 14 bp, Homo sapiens
tcctgccaccagtc

SEQ ID NO: 2686662 - DNA, 16 bp, Homo sapiens
tcctgccaccagtcac

SEQ ID NO: 2686663 - DNA, 15 bp, Homo sapiens
tcctgctccagcagc

SEQ ID NO: 2686664 - DNA, 17 bp, Homo sapiens
tcctgctccagcagcac

SEQ ID NO: 2686665 - DNA, 20 bp, Homo sapiens
tcctgctccagcagcacacc

SEQ ID NO: 2686666 - DNA, 21 bp, Homo sapiens
tcctgctccagcagcacacct

SEQ ID NO: 2686667 - DNA, 14 bp, Homo sapiens
tcctgctctgcttc

SEQ ID NO: 2686668 - DNA, 17 bp, Homo sapiens
tcctgctctgcttcctc

SEQ ID NO: 2686669 - DNA, 11 bp, Homo sapiens
tcctgcttcct

SEQ ID NO: 2686670 - DNA, 16 bp, Homo sapiens
tcctggaaaggctcag

SEQ ID NO: 2686671 - DNA, 15 bp, Homo sapiens
tcctggagcaagctc

SEQ ID NO: 2686672 - DNA, 21 bp, Homo sapiens
tcctgggaacctccttacctg

SEQ ID NO: 2686673 - DNA, 18 bp, Homo sapiens
tcctgggagaacctcagg

SEQ ID NO: 2686674 - DNA, 19 bp, Homo sapiens
tcctgggagaacctcaggc

SEQ ID NO: 2686675 - DNA, 20 bp, Homo sapiens
tcctgggagaacctcaggct

SEQ ID NO: 2686676 - DNA, 15 bp, Homo sapiens
tcctggggctctgtg

SEQ ID NO: 2686677 - DNA, 19 bp, Homo sapiens
tcctggggctctgtgcagg

SEQ ID NO: 2686678 - DNA, 13 bp, Homo sapiens
tcctgggtcctgc

SEQ ID NO: 2686679 - DNA, 19 bp, Homo sapiens
tcctggtgggtcagcccag

SEQ ID NO: 2686680 - DNA, 22 bp, Homo sapiens
tcctggtgggtcagcccagcac

SEQ ID NO: 2686681 - DNA, 21 bp, Homo sapiens
tcctgtaacacaagccacaga

SEQ ID NO: 2686682 - DNA, 14 bp, Homo sapiens
tcctgtagcatctt

SEQ ID NO: 2686683 - DNA, 19 bp, Homo sapiens
tcctgtctttgttgtctcc

SEQ ID NO: 2686684 - DNA, 22 bp, Homo sapiens
tcctgttgctctgtttcttcct

SEQ ID NO: 2686685 - DNA, 13 bp, Homo sapiens
tccttattttgta

SEQ ID NO: 2686686 - DNA, 14 bp, Homo sapiens
gacagaccagcagc

SEQ ID NO: 2686687 - DNA, 12 bp, Homo sapiens
gacagctgctgg

SEQ ID NO: 2686688 - DNA, 14 bp, Homo sapiens
gacagctgctggga

SEQ ID NO: 2686689 - DNA, 15 bp, Homo sapiens
gacagctgctgggac

SEQ ID NO: 2686690 - DNA, 16 bp, Homo sapiens
gacagctgctgggacc

SEQ ID NO: 2686691 - DNA, 15 bp, Homo sapiens
gacagtcctgggaga

SEQ ID NO: 2686692 - DNA, 23 bp, Homo sapiens
gacagtcctgggagaacctcagg

SEQ ID NO: 2686693 - DNA, 14 bp, Homo sapiens
gacagtgcccatgc

SEQ ID NO: 2686694 - DNA, 16 bp, Homo sapiens
gacagtgcttcagcct

SEQ ID NO: 2686695 - DNA, 19 bp, Homo sapiens
gacagtgcttcagcctgag

SEQ ID NO: 2686696 - DNA, 23 bp, Homo sapiens
gacagtgggcaggaggccccagg

SEQ ID NO: 2686697 - DNA, 21 bp, Homo sapiens
gacatgatggagcgcacctgc

SEQ ID NO: 2686698 - DNA, 18 bp, Homo sapiens
gaccaaaatgtgtttcat

SEQ ID NO: 2686699 - DNA, 19 bp, Homo sapiens
gaccaaagacgatacagct

SEQ ID NO: 2686700 - DNA, 15 bp, Homo sapiens
gaccaaagccacctg

SEQ ID NO: 2686701 - DNA, 19 bp, Homo sapiens
gaccaaagccacctgctgc

SEQ ID NO: 2686702 - DNA, 20 bp, Homo sapiens
gaccaaagccacctgctgcg

SEQ ID NO: 2686703 - DNA, 16 bp, Homo sapiens
gaccaaccctgtttcc

SEQ ID NO: 2686704 - DNA, 17 bp, Homo sapiens
gaccaaccctgtttcct

SEQ ID NO: 2686705 - DNA, 18 bp, Homo sapiens
gaccaatattcaaatgcg

SEQ ID NO: 2686706 - DNA, 16 bp, Homo sapiens
gaccacctctcaatat

SEQ ID NO: 2686707 - DNA, 22 bp, Homo sapiens
gaccagcagcaatctgtcttta

SEQ ID NO: 2686708 - DNA, 11 bp, Homo sapiens
gaccagcctgg

SEQ ID NO: 2686709 - DNA, 13 bp, Homo sapiens
gaccagcctggcc

SEQ ID NO: 2686710 - DNA, 16 bp, Homo sapiens
gaccagctctcttcct

SEQ ID NO: 2686711 - DNA, 14 bp, Homo sapiens
gaccagtcccacac

SEQ ID NO: 2686712 - DNA, 15 bp, Homo sapiens
gaccagtcccacacc

SEQ ID NO: 2686713 - DNA, 20 bp, Homo sapiens
gaccagtcccacaccgctgg

SEQ ID NO: 2686714 - DNA, 14 bp, Homo sapiens
gaccattgtcttcc

SEQ ID NO: 2686715 - DNA, 23 bp, Homo sapiens
gaccattgtcttccaaccccagc

SEQ ID NO: 2686716 - DNA, 15 bp, Homo sapiens
gacccacctccccct

SEQ ID NO: 2686717 - DNA, 15 bp, Homo sapiens
gaccctgagggctcc

SEQ ID NO: 2686718 - DNA, 17 bp, Homo sapiens
gaccctgagggctcctc

SEQ ID NO: 2686719 - DNA, 20 bp, Homo sapiens
gaccctgcgaaggggccctg

SEQ ID NO: 2686720 - DNA, 21 bp, Homo sapiens
gaccctgcgaaggggccctgg

SEQ ID NO: 2686721 - DNA, 12 bp, Homo sapiens
gaccctgtctct

SEQ ID NO: 2686722 - DNA, 15 bp, Homo sapiens
gacctctgctctgag

SEQ ID NO: 2686723 - DNA, 20 bp, Homo sapiens
gacctgcaggccaagagcag

SEQ ID NO: 2686724 - DNA, 13 bp, Homo sapiens
gaccttagaaatc

SEQ ID NO: 2686725 - DNA, 12 bp, Homo sapiens
gaccttcctgcc

SEQ ID NO: 2686726 - DNA, 16 bp, Homo sapiens
gaccttgtgggaccag

SEQ ID NO: 2686727 - DNA, 18 bp, Homo sapiens
gactaacataaaatctgt

SEQ ID NO: 2686728 - DNA, 20 bp, Homo sapiens
gactaacataaaatctgtga

SEQ ID NO: 2686729 - DNA, 22 bp, Homo sapiens
gactaacataaaatctgtgaat

SEQ ID NO: 2686730 - DNA, 19 bp, Homo sapiens
gactaaggggcagctcctg

SEQ ID NO: 2686731 - DNA, 22 bp, Homo sapiens
gactcacaagaagaccagactg

SEQ ID NO: 2686732 - DNA, 17 bp, Homo sapiens
gactcacctgttacttg

SEQ ID NO: 2686733 - DNA, 19 bp, Homo sapiens
gactccaatggggccagca

SEQ ID NO: 2686734 - DNA, 20 bp, Homo sapiens
gactccaatggggccagcac

SEQ ID NO: 2686735 - DNA, 22 bp, Homo sapiens
gactccaatggggccagcactg

SEQ ID NO: 2686736 - DNA, 12 bp, Homo sapiens
gactctctgtga

SEQ ID NO: 2686737 - DNA, 22 bp, Homo sapiens
gactctgggtggaagtgcccag

SEQ ID NO: 2686738 - DNA, 18 bp, Homo sapiens
gactctgtggggccttgg

SEQ ID NO: 2686739 - DNA, 18 bp, Homo sapiens
gactgactgcagccccct

SEQ ID NO: 2686740 - DNA, 21 bp, Homo sapiens
gactgcgggatggtcctgggg

SEQ ID NO: 2686741 - DNA, 12 bp, Homo sapiens
gactgctgggac

SEQ ID NO: 2686742 - DNA, 19 bp, Homo sapiens
gactgctgggactggccag

SEQ ID NO: 2686743 - DNA, 17 bp, Homo sapiens
gactgtcattgcccctc

SEQ ID NO: 2686744 - DNA, 14 bp, Homo sapiens
gactgtgaccaaag

SEQ ID NO: 2686745 - DNA, 17 bp, Homo sapiens
gactgtgaccaaagcat

SEQ ID NO: 2686746 - DNA, 22 bp, Homo sapiens
gactgtgaccaaagcatttcta

SEQ ID NO: 2686747 - DNA, 15 bp, Homo sapiens
gacttgagccatcca

SEQ ID NO: 2686748 - DNA, 15 bp, Homo sapiens
gacttttattgagct

SEQ ID NO: 2686749 - DNA, 19 bp, Homo sapiens
gactttttagccagtgact

SEQ ID NO: 2686750 - DNA, 21 bp, Homo sapiens
gagaaattttactgacagaaa

SEQ ID NO: 2686751 - DNA, 13 bp, Homo sapiens
gagaagcgctgcc

SEQ ID NO: 2686752 - DNA, 16 bp, Homo sapiens
gagaagcgctgccctg

SEQ ID NO: 2686753 - DNA, 14 bp, Homo sapiens
gagaatcgcttgaa

SEQ ID NO: 2686754 - DNA, 13 bp, Homo sapiens
gagaccagcctgg

SEQ ID NO: 2686755 - DNA, 19 bp, Homo sapiens
gagactgcgggatggtcct

SEQ ID NO: 2686756 - DNA, 16 bp, Homo sapiens
gagagcacccacagcc

SEQ ID NO: 2686757 - DNA, 17 bp, Homo sapiens
gagagccacgctggcct

SEQ ID NO: 2686758 - DNA, 23 bp, Homo sapiens
gagagccacgctggccttcgtct

SEQ ID NO: 2686759 - DNA, 14 bp, Homo sapiens
gagagtctgtctca

SEQ ID NO: 2686760 - DNA, 16 bp, Homo sapiens
gagatcacgccactgc

SEQ ID NO: 2686761 - DNA, 21 bp, Homo sapiens
gagatgactgagtcctcgtag

SEQ ID NO: 2686762 - DNA, 20 bp, Homo sapiens
gagatggtaatctacagctc

SEQ ID NO: 2686763 - DNA, 23 bp, Homo sapiens
gagatttttcttttaagccctgc

SEQ ID NO: 2686764 - DNA, 23 bp, Homo sapiens
gagcaaaagacttgagccatcca

SEQ ID NO: 2686765 - DNA, 20 bp, Homo sapiens
gagcaaaatgcatgtaatca

SEQ ID NO: 2686766 - DNA, 19 bp, Homo sapiens
gagcaaatgtttctgcagt

SEQ ID NO: 2686767 - DNA, 15 bp, Homo sapiens
gagcaagagaacatt

SEQ ID NO: 2686768 - DNA, 13 bp, Homo sapiens
gagcaagctctgc

SEQ ID NO: 2686769 - DNA, 16 bp, Homo sapiens
gagcaagctctgccct

SEQ ID NO: 2686770 - DNA, 17 bp, Homo sapiens
gagcacccacagccgca

SEQ ID NO: 2686771 - DNA, 20 bp, Homo sapiens
gagccacctttactctgctc

SEQ ID NO: 2686772 - DNA, 15 bp, Homo sapiens
gagccacgctggcct

SEQ ID NO: 2686773 - DNA, 19 bp, Homo sapiens
gagccagatgcctccccaa

SEQ ID NO: 2686774 - DNA, 14 bp, Homo sapiens
gagccctccaggcc

SEQ ID NO: 2686775 - DNA, 15 bp, Homo sapiens
gagccctccaggcct

SEQ ID NO: 2686776 - DNA, 18 bp, Homo sapiens
gagccctggaccccaggc

SEQ ID NO: 2686777 - DNA, 20 bp, Homo sapiens
gagcctcgtgtcctgctagc

SEQ ID NO: 2686778 - DNA, 18 bp, Homo sapiens
gagctcctgtccctaccc

SEQ ID NO: 2686779 - DNA, 19 bp, Homo sapiens
gagctcctgtccctaccca

SEQ ID NO: 2686780 - DNA, 22 bp, Homo sapiens
gagctcctgtccctacccactc

SEQ ID NO: 2686781 - DNA, 15 bp, Homo sapiens
gagctcttaatgttg

SEQ ID NO: 2686782 - DNA, 20 bp, Homo sapiens
gagctcttgttccgtgccag

SEQ ID NO: 2686783 - DNA, 23 bp, Homo sapiens
gagctcttgttccgtgccaggca

SEQ ID NO: 2686784 - DNA, 15 bp, Homo sapiens
gagctgcagccagtc

SEQ ID NO: 2686785 - DNA, 19 bp, Homo sapiens
gaggaaacaggcctcaagc

SEQ ID NO: 2686786 - DNA, 18 bp, Homo sapiens
gaggacacgtggcctgca

SEQ ID NO: 2686787 - DNA, 18 bp, Homo sapiens
gaggacatgatggagcgc

SEQ ID NO: 2686788 - DNA, 18 bp, Homo sapiens
gaggactccctccatgtg

SEQ ID NO: 2686789 - DNA, 21 bp, Homo sapiens
gaggactccctccatgtggcc

SEQ ID NO: 2686790 - DNA, 14 bp, Homo sapiens
gaggatacagctct

SEQ ID NO: 2686791 - DNA, 16 bp, Homo sapiens
gaggatcactggagcc

SEQ ID NO: 2686792 - DNA, 23 bp, Homo sapiens
gaggcaggggtcctgcaggtcct

SEQ ID NO: 2686793 - DNA, 11 bp, Homo sapiens
gaggcaggtga

SEQ ID NO: 2686794 - DNA, 11 bp, Homo sapiens
gaggccaccca

SEQ ID NO: 2686795 - DNA, 14 bp, Homo sapiens
gaggccacccactg

SEQ ID NO: 2686796 - DNA, 19 bp, Homo sapiens
gaggccacccactgaccca

SEQ ID NO: 2686797 - DNA, 15 bp, Homo sapiens
taactggctgctccc

SEQ ID NO: 2686798 - DNA, 17 bp, Homo sapiens
taactggctgctccctg

SEQ ID NO: 2686799 - DNA, 14 bp, Homo sapiens
taacttccttgccc

SEQ ID NO: 2686800 - DNA, 16 bp, Homo sapiens
taacttccttgcccct

SEQ ID NO: 2686801 - DNA, 17 bp, Homo sapiens
taacttccttgcccctg

SEQ ID NO: 2686802 - DNA, 14 bp, Homo sapiens
taacttgtaataaa

SEQ ID NO: 2686803 - DNA, 15 bp, Homo sapiens
taacttgtaataaac

SEQ ID NO: 2686804 - DNA, 18 bp, Homo sapiens
taagaggaaactagtgtt

SEQ ID NO: 2686805 - DNA, 19 bp, Homo sapiens
taagaggaaactagtgttt

SEQ ID NO: 2686806 - DNA, 15 bp, Homo sapiens
taagcactttttaaa

SEQ ID NO: 2686807 - DNA, 16 bp, Homo sapiens
taagcatggcctggac

SEQ ID NO: 2686808 - DNA, 13 bp, Homo sapiens
taagccctgctct

SEQ ID NO: 2686809 - DNA, 21 bp, Homo sapiens
taagccctgctctttctctga

SEQ ID NO: 2686810 - DNA, 12 bp, Homo sapiens
taagctctctgg

SEQ ID NO: 2686811 - DNA, 15 bp, Homo sapiens
taagctctctgggcc

SEQ ID NO: 2686812 - DNA, 16 bp, Homo sapiens
taagctctctgggcct

SEQ ID NO: 2686813 - DNA, 21 bp, Homo sapiens
taagctgggaaaaaagttttg

SEQ ID NO: 2686814 - DNA, 22 bp, Homo sapiens
taaggacccaaatttccctggg

SEQ ID NO: 2686815 - DNA, 17 bp, Homo sapiens
taagtaccactcaggcc

SEQ ID NO: 2686816 - DNA, 18 bp, Homo sapiens
taagttcatgtttgtaaa

SEQ ID NO: 2686817 - DNA, 18 bp, Homo sapiens
taagttctaagttcatgt

SEQ ID NO: 2686818 - DNA, 17 bp, Homo sapiens
taagttgaatggcctgc

SEQ ID NO: 2686819 - DNA, 18 bp, Homo sapiens
taatagattgtgaataat

SEQ ID NO: 2686820 - DNA, 12 bp, Homo sapiens
taatatcttgct

SEQ ID NO: 2686821 - DNA, 18 bp, Homo sapiens
gtgcctcctccccaggtg

SEQ ID NO: 2686822 - DNA, 12 bp, Homo sapiens
gtgcctcctgtg

SEQ ID NO: 2686823 - DNA, 15 bp, Homo sapiens
gtgcctcctgtgtgt

SEQ ID NO: 2686824 - DNA, 20 bp, Homo sapiens
gtgcctcctgtgtgtctgca

SEQ ID NO: 2686825 - DNA, 17 bp, Homo sapiens
gtgcgctcacctcagag

SEQ ID NO: 2686826 - DNA, 13 bp, Homo sapiens
gtgctcttcctct

SEQ ID NO: 2686827 - DNA, 17 bp, Homo sapiens
gtgctcttcctctggtt

SEQ ID NO: 2686828 - DNA, 12 bp, Homo sapiens
gtgctgaggact

SEQ ID NO: 2686829 - DNA, 13 bp, Homo sapiens
gtgctgctttgat

SEQ ID NO: 2686830 - DNA, 19 bp, Homo sapiens
gtgctgtaatcggctcccg

SEQ ID NO: 2686831 - DNA, 18 bp, Homo sapiens
gtgcttcagcctgaggct

SEQ ID NO: 2686832 - DNA, 14 bp, Homo sapiens
gtgcttggaaccag

SEQ ID NO: 2686833 - DNA, 14 bp, Homo sapiens
gtggaaagcctctg

SEQ ID NO: 2686834 - DNA, 15 bp, Homo sapiens
gtggaaagcctctgc

SEQ ID NO: 2686835 - DNA, 23 bp, Homo sapiens
gtggaaagcctctgctgccatgg

SEQ ID NO: 2686836 - DNA, 15 bp, Homo sapiens
gtggaagtgcccagc

SEQ ID NO: 2686837 - DNA, 11 bp, Homo sapiens
gtggacacctg

SEQ ID NO: 2686838 - DNA, 15 bp, Homo sapiens
gtggacagtcctggg

SEQ ID NO: 2686839 - DNA, 13 bp, Homo sapiens
gtggaccttcctg

SEQ ID NO: 2686840 - DNA, 16 bp, Homo sapiens
gtggaggttgcagtga

SEQ ID NO: 2686841 - DNA, 13 bp, Homo sapiens
gtggatcacctga

SEQ ID NO: 2686842 - DNA, 21 bp, Homo sapiens
gtggatggtctccacctgtgc

SEQ ID NO: 2686843 - DNA, 13 bp, Homo sapiens
gtggcagccctgt

SEQ ID NO: 2686844 - DNA, 15 bp, Homo sapiens
gtggccccaggtgcc

SEQ ID NO: 2686845 - DNA, 13 bp, Homo sapiens
gtggcctggcttg

SEQ ID NO: 2686846 - DNA, 20 bp, Homo sapiens
gtggcctggcttgtcggagc

SEQ ID NO: 2686847 - DNA, 14 bp, Homo sapiens
gtggcctgggcaag

SEQ ID NO: 2686848 - DNA, 14 bp, Homo sapiens
gtgggagagcccag

SEQ ID NO: 2686849 - DNA, 15 bp, Homo sapiens
gtgggagagcccagc

SEQ ID NO: 2686850 - DNA, 16 bp, Homo sapiens
tatcaggatttcctct

SEQ ID NO: 2686851 - DNA, 13 bp, Homo sapiens
tatcataaagtat

SEQ ID NO: 2686852 - DNA, 17 bp, Homo sapiens
tatctatatctctaaac

SEQ ID NO: 2686853 - DNA, 23 bp, Homo sapiens
tatctatatctctaaactgctgt

SEQ ID NO: 2686854 - DNA, 21 bp, Homo sapiens
tatctctaaactgctgttaat

SEQ ID NO: 2686855 - DNA, 19 bp, Homo sapiens
tatctgagaagtgtatata

SEQ ID NO: 2686856 - DNA, 22 bp, Homo sapiens
tatctgagaagtgtatatagtt

SEQ ID NO: 2686857 - DNA, 15 bp, Homo sapiens
tatcttttgggtctg

SEQ ID NO: 2686858 - DNA, 16 bp, Homo sapiens
tatgaacttgaggaca

SEQ ID NO: 2686859 - DNA, 19 bp, Homo sapiens
tatgaacttgaggacacat

SEQ ID NO: 2686860 - DNA, 15 bp, Homo sapiens
tatgatcccagcact

SEQ ID NO: 2686861 - DNA, 17 bp, Homo sapiens
tatgctacccacagcgt

SEQ ID NO: 2686862 - DNA, 21 bp, Homo sapiens
tatgctagtttattggaagtg

SEQ ID NO: 2686863 - DNA, 16 bp, Homo sapiens
tatgctcagaagccag

SEQ ID NO: 2686864 - DNA, 18 bp, Homo sapiens
tatgtatatgtatatcta

SEQ ID NO: 2686865 - DNA, 17 bp, Homo sapiens
tatgttgagtgttcatt

SEQ ID NO: 2686866 - DNA, 22 bp, Homo sapiens
tattaagtctgggatgtagaac

SEQ ID NO: 2686867 - DNA, 16 bp, Homo sapiens
tattacatctaatgct

SEQ ID NO: 2686868 - DNA, 21 bp, Homo sapiens
tattagtttgatttaatatct

SEQ ID NO: 2686869 - DNA, 12 bp, Homo sapiens
tattcaataaag

SEQ ID NO: 2686870 - DNA, 18 bp, Homo sapiens
tattcagtgacttctggc

SEQ ID NO: 2686871 - DNA, 21 bp, Homo sapiens
tattcagtgctgtggcctggg

SEQ ID NO: 2686872 - DNA, 22 bp, Homo sapiens
tattcagtgctgtggcctgggc

SEQ ID NO: 2686873 - DNA, 20 bp, Homo sapiens
tattctacacatatatgtat

SEQ ID NO: 2686874 - DNA, 20 bp, Homo sapiens
tatttacctgtatttaagat

SEQ ID NO: 2686875 - DNA, 16 bp, Homo sapiens
tatttccacataaagg

SEQ ID NO: 2686876 - DNA, 21 bp, Homo sapiens
tattttctctgatactttttt

SEQ ID NO: 2686877 - DNA, 15 bp, Homo sapiens
tattttttatttcca

SEQ ID NO: 2686878 - DNA, 18 bp, Homo sapiens
tattttttatttccacat

SEQ ID NO: 2686879 - DNA, 21 bp, Homo sapiens
tcaaacaggtcgagctgtgct

SEQ ID NO: 2686880 - DNA, 16 bp, Homo sapiens
tcaaatgacccaaaga

SEQ ID NO: 2686881 - DNA, 17 bp, Homo sapiens
tcaaatgacccaaagac

SEQ ID NO: 2686882 - DNA, 16 bp, Homo sapiens
tcaaattctcaaccta

SEQ ID NO: 2686883 - DNA, 20 bp, Homo sapiens
tcaacaagaatattgtatgt

SEQ ID NO: 2686884 - DNA, 18 bp, Homo sapiens
tcaacctaccaccccttc

SEQ ID NO: 2686885 - DNA, 20 bp, Homo sapiens
tcaacctaccaccccttcct

SEQ ID NO: 2686886 - DNA, 18 bp, Homo sapiens
tcaagatgtcagactggc

SEQ ID NO: 2686887 - DNA, 14 bp, Homo sapiens
tcaagcccaggctt

SEQ ID NO: 2686888 - DNA, 17 bp, Homo sapiens
tcaagcccaggcttcct

SEQ ID NO: 2686889 - DNA, 18 bp, Homo sapiens
tcaagcccaggcttcctg

SEQ ID NO: 2686890 - DNA, 19 bp, Homo sapiens
tcaagctagaaggccacat

SEQ ID NO: 2686891 - DNA, 13 bp, Homo sapiens
tcaagggctgggg

SEQ ID NO: 2686892 - DNA, 15 bp, Homo sapiens
tcaagttagctcagg

SEQ ID NO: 2686893 - DNA, 16 bp, Homo sapiens
tcaatattcaataaag

SEQ ID NO: 2686894 - DNA, 14 bp, Homo sapiens
tcacaagaagacca

SEQ ID NO: 2686895 - DNA, 15 bp, Homo sapiens
tcacagggcagagcc

SEQ ID NO: 2686896 - DNA, 11 bp, Homo sapiens
tcaccagcagc

SEQ ID NO: 2686897 - DNA, 16 bp, Homo sapiens
tcaccagcagcataga

SEQ ID NO: 2686898 - DNA, 22 bp, Homo sapiens
tcaccattcaaacaggtcgagc

SEQ ID NO: 2686899 - DNA, 13 bp, Homo sapiens
tcacccaggcctg

SEQ ID NO: 2686900 - DNA, 19 bp, Homo sapiens
tcaccgtggaccttcctgc

SEQ ID NO: 2686901 - DNA, 21 bp, Homo sapiens
tcaccgtggaccttcctgcca

SEQ ID NO: 2686902 - DNA, 18 bp, Homo sapiens
tcacctaggactgactcg

SEQ ID NO: 2686903 - DNA, 13 bp, Homo sapiens
tcacctcagagca

SEQ ID NO: 2686904 - DNA, 18 bp, Homo sapiens
tcacctcaggccaggtgc

SEQ ID NO: 2686905 - DNA, 20 bp, Homo sapiens
tcactccggtgtgcctgcag

SEQ ID NO: 2686906 - DNA, 22 bp, Homo sapiens
tcactccggtgtgcctgcagcc

SEQ ID NO: 2686907 - DNA, 13 bp, Homo sapiens
tcactctctgctg

SEQ ID NO: 2686908 - DNA, 17 bp, Homo sapiens
tcactttacctgcaggc

SEQ ID NO: 2686909 - DNA, 19 bp, Homo sapiens
tcactttacctgcaggctc

SEQ ID NO: 2686910 - DNA, 22 bp, Homo sapiens
tcagaatagttattctctaaga

SEQ ID NO: 2686911 - DNA, 16 bp, Homo sapiens
tcagactgctgggact

SEQ ID NO: 2686912 - DNA, 21 bp, Homo sapiens
tcagactgctgggactggcca

SEQ ID NO: 2686913 - DNA, 20 bp, Homo sapiens
tcagactggctggctgcagt

SEQ ID NO: 2686914 - DNA, 15 bp, Homo sapiens
tcagacttacttact

SEQ ID NO: 2686915 - DNA, 22 bp, Homo sapiens
tcagagaggccttttgtttaaa

SEQ ID NO: 2686916 - DNA, 22 bp, Homo sapiens
tcagagatggtaatctacagct

SEQ ID NO: 2686917 - DNA, 23 bp, Homo sapiens
tcagagatggtaatctacagctc

SEQ ID NO: 2686918 - DNA, 13 bp, Homo sapiens
tcagagcagggcc

SEQ ID NO: 2686919 - DNA, 21 bp, Homo sapiens
tcagagccagtgaaggagcca

SEQ ID NO: 2686920 - DNA, 13 bp, Homo sapiens
tcagagctcttaa

SEQ ID NO: 2686921 - DNA, 14 bp, Homo sapiens
tcagagctgcagcc

SEQ ID NO: 2686922 - DNA, 18 bp, Homo sapiens
tcagagctgcagccagtc

SEQ ID NO: 2686923 - DNA, 14 bp, Homo sapiens
tcagatctgaacac

SEQ ID NO: 2686924 - DNA, 20 bp, Homo sapiens
tcagatctgaacacagttta

SEQ ID NO: 2686925 - DNA, 22 bp, Homo sapiens
tcagcagagttattgaatctta

SEQ ID NO: 2686926 - DNA, 18 bp, Homo sapiens
tcagcattattcttcaga

SEQ ID NO: 2686927 - DNA, 13 bp, Homo sapiens
tcagcccagcacc

SEQ ID NO: 2686928 - DNA, 16 bp, Homo sapiens
tcagcccagcacctgc

SEQ ID NO: 2686929 - DNA, 12 bp, Homo sapiens
tcagcccagctg

SEQ ID NO: 2686930 - DNA, 20 bp, Homo sapiens
tcagccccactgacacccag

SEQ ID NO: 2686931 - DNA, 18 bp, Homo sapiens
tcagccctccatggcctg

SEQ ID NO: 2686932 - DNA, 13 bp, Homo sapiens
tcagcctgaggct

SEQ ID NO: 2686933 - DNA, 17 bp, Homo sapiens
tcagctttcagagccag

SEQ ID NO: 2686934 - DNA, 20 bp, Homo sapiens
tcaggaattgcccattgttt

SEQ ID NO: 2686935 - DNA, 17 bp, Homo sapiens
tcaggatttcctcttga

SEQ ID NO: 2686936 - DNA, 16 bp, Homo sapiens
tcaggcacgtctcctg

SEQ ID NO: 2686937 - DNA, 21 bp, Homo sapiens
tcaggcacgtctcctgctgcg

SEQ ID NO: 2686938 - DNA, 23 bp, Homo sapiens
tcaggcacgtctcctgctgcgtg

SEQ ID NO: 2686939 - DNA, 16 bp, Homo sapiens
tcaggccaggtgcagt

SEQ ID NO: 2686940 - DNA, 18 bp, Homo sapiens
tcaggccaggtgcagtgg

SEQ ID NO: 2686941 - DNA, 15 bp, Homo sapiens
tcaggcttccttggc

SEQ ID NO: 2686942 - DNA, 17 bp, Homo sapiens
tcagtgctgtggcctgg

SEQ ID NO: 2686943 - DNA, 22 bp, Homo sapiens
tcagtgctgtggcctgggcaag

SEQ ID NO: 2686944 - DNA, 13 bp, Homo sapiens
tcataaagtatgc

SEQ ID NO: 2686945 - DNA, 16 bp, Homo sapiens
tcatactcctatgctt

SEQ ID NO: 2686946 - DNA, 20 bp, Homo sapiens
tcatactcctatgctttagc

SEQ ID NO: 2686947 - DNA, 19 bp, Homo sapiens
tcatgctgttctctttgct

SEQ ID NO: 2686948 - DNA, 17 bp, Homo sapiens
tcatggggtccctgctg

SEQ ID NO: 2686949 - DNA, 18 bp, Homo sapiens
tcatggggtccctgctgc

SEQ ID NO: 2686950 - DNA, 20 bp, Homo sapiens
tcattatcagaacatgagga

SEQ ID NO: 2686951 - DNA, 22 bp, Homo sapiens
tcattcaccaaatgatgccact

SEQ ID NO: 2686952 - DNA, 14 bp, Homo sapiens
tcattgcatcattt

SEQ ID NO: 2686953 - DNA, 12 bp, Homo sapiens
tcattgtagaaa

SEQ ID NO: 2686954 - DNA, 17 bp, Homo sapiens
tcattgtagaaacacag

SEQ ID NO: 2686955 - DNA, 14 bp, Homo sapiens
tcattttagtgact

SEQ ID NO: 2686956 - DNA, 15 bp, Homo sapiens
tccaaccccagctgg

SEQ ID NO: 2686957 - DNA, 16 bp, Homo sapiens
tccaaccccagctggc

SEQ ID NO: 2686958 - DNA, 17 bp, Homo sapiens
tccaaccccagctggcc

SEQ ID NO: 2686959 - DNA, 17 bp, Homo sapiens
tccaaccccccacctgc

SEQ ID NO: 2686960 - DNA, 17 bp, Homo sapiens
tccaatggggccagcac

SEQ ID NO: 2686961 - DNA, 18 bp, Homo sapiens
tgctggcaggattcttcc

SEQ ID NO: 2686962 - DNA, 20 bp, Homo sapiens
tgctggcctggcccttgagt

SEQ ID NO: 2686963 - DNA, 15 bp, Homo sapiens
tgctgggactggcca

SEQ ID NO: 2686964 - DNA, 18 bp, Homo sapiens
tgctggggcaagtccctg

SEQ ID NO: 2686965 - DNA, 14 bp, Homo sapiens
tgctgtcctaggcc

SEQ ID NO: 2686966 - DNA, 12 bp, Homo sapiens
tgctgtggcctg

SEQ ID NO: 2686967 - DNA, 14 bp, Homo sapiens
tgctgtggcctggg

SEQ ID NO: 2686968 - DNA, 16 bp, Homo sapiens
tgctgttctctttgct

SEQ ID NO: 2686969 - DNA, 17 bp, Homo sapiens
tgctgttctctttgctg

SEQ ID NO: 2686970 - DNA, 21 bp, Homo sapiens
tgcttagatgagggtgactgt

SEQ ID NO: 2686971 - DNA, 19 bp, Homo sapiens
tgcttcaagtgttgctctt

SEQ ID NO: 2686972 - DNA, 14 bp, Homo sapiens
tgcttcagcctgag

SEQ ID NO: 2686973 - DNA, 21 bp, Homo sapiens
tgcttcctcagggcccagcag

SEQ ID NO: 2686974 - DNA, 20 bp, Homo sapiens
tgcttgccgagcctaatgaa

SEQ ID NO: 2686975 - DNA, 18 bp, Homo sapiens
tgctttccagcctgggca

SEQ ID NO: 2686976 - DNA, 21 bp, Homo sapiens
tggaaagcatcacctcaggcc

SEQ ID NO: 2686977 - DNA, 14 bp, Homo sapiens
tggaaagcctctgc

SEQ ID NO: 2686978 - DNA, 18 bp, Homo sapiens
tggaaagcctctgctgcc

SEQ ID NO: 2686979 - DNA, 17 bp, Homo sapiens
tggaaaggctcagtctc

SEQ ID NO: 2686980 - DNA, 13 bp, Homo sapiens
tggaaccagaggg

SEQ ID NO: 2686981 - DNA, 19 bp, Homo sapiens
tggaaccagtgtaactggc

SEQ ID NO: 2686982 - DNA, 20 bp, Homo sapiens
tggaagaaattcctgtagca

SEQ ID NO: 2686983 - DNA, 22 bp, Homo sapiens
tggaagatttaccttttctgtt

SEQ ID NO: 2686984 - DNA, 17 bp, Homo sapiens
tggaagtgttcaagaaa

SEQ ID NO: 2686985 - DNA, 10 bp, Homo sapiens
tggacacctg

SEQ ID NO: 2686986 - DNA, 11 bp, Homo sapiens
tggacacctgc

SEQ ID NO: 2686987 - DNA, 13 bp, Homo sapiens
tggacagtcctgg

SEQ ID NO: 2686988 - DNA, 17 bp, Homo sapiens
tggacagtcctgggaga

SEQ ID NO: 2686989 - DNA, 12 bp, Homo sapiens
tggaccaaagcc

SEQ ID NO: 2686990 - DNA, 13 bp, Homo sapiens
tggaccaaagcca

SEQ ID NO: 2686991 - DNA, 17 bp, Homo sapiens
tggaccaaagccacctg

SEQ ID NO: 2686992 - DNA, 20 bp, Homo sapiens
tggaccaaagccacctgctg

SEQ ID NO: 2686993 - DNA, 21 bp, Homo sapiens
tggaccaaccctgtttcctga

SEQ ID NO: 2686994 - DNA, 16 bp, Homo sapiens
tggaccccaggctctt

SEQ ID NO: 2686995 - DNA, 14 bp, Homo sapiens
tggacccgctctgg

SEQ ID NO: 2686996 - DNA, 13 bp, Homo sapiens
tggacctctgctc

SEQ ID NO: 2686997 - DNA, 16 bp, Homo sapiens
tggacctctgctctga

SEQ ID NO: 2686998 - DNA, 15 bp, Homo sapiens
tggagcaagctctgc

SEQ ID NO: 2686999 - DNA, 17 bp, Homo sapiens
tggagcaagctctgccc

SEQ ID NO: 2687000 - DNA, 19 bp, Homo sapiens
tggagcaagctctgccctg

SEQ ID NO: 2687001 - DNA, 16 bp, Homo sapiens
tggagcgcacctgccc

SEQ ID NO: 2687002 - DNA, 22 bp, Homo sapiens
tggagcgcacctgccccctggt

SEQ ID NO: 2687003 - DNA, 15 bp, Homo sapiens
tggagctattttaaa

SEQ ID NO: 2687004 - DNA, 21 bp, Homo sapiens
tggaggatgaatagatgtgat

SEQ ID NO: 2687005 - DNA, 13 bp, Homo sapiens
tggaggtgccagg

SEQ ID NO: 2687006 - DNA, 15 bp, Homo sapiens
tggagtctcagagca

SEQ ID NO: 2687007 - DNA, 17 bp, Homo sapiens
tggatggcatctagcca

SEQ ID NO: 2687008 - DNA, 17 bp, Homo sapiens
tggcaggagcctcgtgt

SEQ ID NO: 2687009 - DNA, 22 bp, Homo sapiens
tggcaggagcctcgtgtcctgc

SEQ ID NO: 2687010 - DNA, 23 bp, Homo sapiens
tggcaggagcctcgtgtcctgct

SEQ ID NO: 2687011 - DNA, 22 bp, Homo sapiens
tggcaggatgaccctgcgaagg

SEQ ID NO: 2687012 - DNA, 22 bp, Homo sapiens
tggcaggattcttcccgctccc

SEQ ID NO: 2687013 - DNA, 16 bp, Homo sapiens
tggcatctagccagag

SEQ ID NO: 2687014 - DNA, 19 bp, Homo sapiens
tggcatctagccagaggct

SEQ ID NO: 2687015 - DNA, 22 bp, Homo sapiens
tggcatctagccagaggctgga

SEQ ID NO: 2687016 - DNA, 21 bp, Homo sapiens
tggccagacacaggtgcctca

SEQ ID NO: 2687017 - DNA, 22 bp, Homo sapiens
tggccaggaggttggtgactga

SEQ ID NO: 2687018 - DNA, 15 bp, Homo sapiens
tggccagtcctagag

SEQ ID NO: 2687019 - DNA, 16 bp, Homo sapiens
tggccagtcctagagc

SEQ ID NO: 2687020 - DNA, 21 bp, Homo sapiens
tggccagtcctagagctcctg

SEQ ID NO: 2687021 - DNA, 16 bp, Homo sapiens
tggccccaggtgccac

SEQ ID NO: 2687022 - DNA, 22 bp, Homo sapiens
tggccccaggtgccaccaataa

SEQ ID NO: 2687023 - DNA, 12 bp, Homo sapiens
tggcccctccag

SEQ ID NO: 2687024 - DNA, 16 bp, Homo sapiens
tggcccctccagcaca

SEQ ID NO: 2687025 - DNA, 24 bp, Homo sapiens
tggcctctagaacacccactggcc

SEQ ID NO: 2687026 - DNA, 22 bp, Homo sapiens
tggcctggactgactgcagccc

SEQ ID NO: 2687027 - DNA, 12 bp, Homo sapiens
tggcctggcacg

SEQ ID NO: 2687028 - DNA, 22 bp, Homo sapiens
tggccttcgtctccatctctgg

SEQ ID NO: 2687029 - DNA, 15 bp, Homo sapiens
tggctgctccctgct

SEQ ID NO: 2687030 - DNA, 19 bp, Homo sapiens
tggctgctccctgctccca

SEQ ID NO: 2687031 - DNA, 13 bp, Homo sapiens
tggctggctgcag

SEQ ID NO: 2687032 - DNA, 22 bp, Homo sapiens
tggctgtcaggacaccagcctg

SEQ ID NO: 2687033 - DNA, 14 bp, Homo sapiens
tggcttctggagcc

SEQ ID NO: 2687034 - DNA, 15 bp, Homo sapiens
tggcttgtcggagca

SEQ ID NO: 2687035 - DNA, 22 bp, Homo sapiens
tgggaaggggaacacagaccag

SEQ ID NO: 2687036 - DNA, 13 bp, Homo sapiens
tgggaggctgagg

SEQ ID NO: 2687037 - DNA, 14 bp, Homo sapiens
tgggaggctgaggc

SEQ ID NO: 2687038 - DNA, 18 bp, Homo sapiens
tgggcaggaggccccagg

SEQ ID NO: 2687039 - DNA, 20 bp, Homo sapiens
tgggcaggaggccccaggct

SEQ ID NO: 2687040 - DNA, 21 bp, Homo sapiens
tgggcaggaggccccaggctg

SEQ ID NO: 2687041 - DNA, 19 bp, Homo sapiens
tgggcattgggttctaaag

SEQ ID NO: 2687042 - DNA, 17 bp, Homo sapiens
tgggcgaggcctgacac

SEQ ID NO: 2687043 - DNA, 20 bp, Homo sapiens
tgggctctgccccagctctg

SEQ ID NO: 2687044 - DNA, 23 bp, Homo sapiens
tgggctctgccccagctctggct

SEQ ID NO: 2687045 - DNA, 22 bp, Homo sapiens
tggggagggtcaagggctgggg

SEQ ID NO: 2687046 - DNA, 13 bp, Homo sapiens
tggggccagcact

SEQ ID NO: 2687047 - DNA, 18 bp, Homo sapiens
tggggctcccggcatcct

SEQ ID NO: 2687048 - DNA, 19 bp, Homo sapiens
tggggttcaagcccaggct

SEQ ID NO: 2687049 - DNA, 15 bp, Homo sapiens
tgggtcagcccagca

SEQ ID NO: 2687050 - DNA, 21 bp, Homo sapiens
tgggtcctgcctggtcctccc

SEQ ID NO: 2687051 - DNA, 18 bp, Homo sapiens
tgggtgcctcctccccag

SEQ ID NO: 2687052 - DNA, 21 bp, Homo sapiens
tgggtgcctcctccccaggtg

SEQ ID NO: 2687053 - DNA, 20 bp, Homo sapiens
tgggtggcttaaaaaaaact

SEQ ID NO: 2687054 - DNA, 21 bp, Homo sapiens
tgggttcctcttccccactcc

SEQ ID NO: 2687055 - DNA, 13 bp, Homo sapiens
cagccacttggtt

SEQ ID NO: 2687056 - DNA, 22 bp, Homo sapiens
cagccacttggtttttggctct

SEQ ID NO: 2687057 - DNA, 16 bp, Homo sapiens
cagccagtcaggcagg

SEQ ID NO: 2687058 - DNA, 12 bp, Homo sapiens
cagcccagcacc

SEQ ID NO: 2687059 - DNA, 16 bp, Homo sapiens
cagcccagcacctgct

SEQ ID NO: 2687060 - DNA, 14 bp, Homo sapiens
cagcccagctggcc

SEQ ID NO: 2687061 - DNA, 15 bp, Homo sapiens
cagcccagctggcca

SEQ ID NO: 2687062 - DNA, 17 bp, Homo sapiens
cagcccagctggccacc

SEQ ID NO: 2687063 - DNA, 14 bp, Homo sapiens
cagccccactgaca

SEQ ID NO: 2687064 - DNA, 18 bp, Homo sapiens
cagccccgcgcctccttc

SEQ ID NO: 2687065 - DNA, 14 bp, Homo sapiens
cagcccctgcccct

SEQ ID NO: 2687066 - DNA, 19 bp, Homo sapiens
cagccctccatggcctggc

SEQ ID NO: 2687067 - DNA, 16 bp, Homo sapiens
cagccgcagcctccct

SEQ ID NO: 2687068 - DNA, 18 bp, Homo sapiens
cagccggacacaagcggc

SEQ ID NO: 2687069 - DNA, 14 bp, Homo sapiens
cagcctccctctga

SEQ ID NO: 2687070 - DNA, 15 bp, Homo sapiens
cagcctccctctgac

SEQ ID NO: 2687071 - DNA, 22 bp, Homo sapiens
cagcctccctctgacctgcagg

SEQ ID NO: 2687072 - DNA, 16 bp, Homo sapiens
cagcctcccttccatg

SEQ ID NO: 2687073 - DNA, 21 bp, Homo sapiens
cagcctcccttccatgcccca

SEQ ID NO: 2687074 - DNA, 16 bp, Homo sapiens
cagcctccttgcctgg

SEQ ID NO: 2687075 - DNA, 12 bp, Homo sapiens
cagcctgaggct

SEQ ID NO: 2687076 - DNA, 19 bp, Homo sapiens
cagcctgaggctgagactg

SEQ ID NO: 2687077 - DNA, 16 bp, Homo sapiens
cagcctggcttctgga

SEQ ID NO: 2687078 - DNA, 19 bp, Homo sapiens
cagcctggcttctggagcc

SEQ ID NO: 2687079 - DNA, 21 bp, Homo sapiens
cagcctggcttctggagccct

SEQ ID NO: 2687080 - DNA, 11 bp, Homo sapiens
cagcctgggcg

SEQ ID NO: 2687081 - DNA, 20 bp, Homo sapiens
cagccttccccctcccaggg

SEQ ID NO: 2687082 - DNA, 14 bp, Homo sapiens
cagcgtttacatat

SEQ ID NO: 2687083 - DNA, 19 bp, Homo sapiens
cagctactcagaagcctga

SEQ ID NO: 2687084 - DNA, 20 bp, Homo sapiens
cagctactcagaagcctgag

SEQ ID NO: 2687085 - DNA, 21 bp, Homo sapiens
cagctactcagaagcctgagg

SEQ ID NO: 2687086 - DNA, 22 bp, Homo sapiens
cagctactcagaagcctgaggc

SEQ ID NO: 2687087 - DNA, 14 bp, Homo sapiens
cagctattttctga

SEQ ID NO: 2687088 - DNA, 17 bp, Homo sapiens
cagctattttctgacca

SEQ ID NO: 2687089 - DNA, 19 bp, Homo sapiens
cagctattttctgaccaaa

SEQ ID NO: 2687090 - DNA, 19 bp, Homo sapiens
cagctcacctctgaaggca

SEQ ID NO: 2687091 - DNA, 14 bp, Homo sapiens
cagctcctgaccaa

SEQ ID NO: 2687092 - DNA, 16 bp, Homo sapiens
cagctcctgaccaaag

SEQ ID NO: 2687093 - DNA, 17 bp, Homo sapiens
cagctcctgaccaaaga

SEQ ID NO: 2687094 - DNA, 18 bp, Homo sapiens
cagctcctgaccaaagac

SEQ ID NO: 2687095 - DNA, 13 bp, Homo sapiens
cagctctcttcct

SEQ ID NO: 2687096 - DNA, 14 bp, Homo sapiens
cagctctcttcctg

SEQ ID NO: 2687097 - DNA, 18 bp, Homo sapiens
cagctcttctcagtgtct

SEQ ID NO: 2687098 - DNA, 21 bp, Homo sapiens
cagctcttctcagtgtctgaa

SEQ ID NO: 2687099 - DNA, 16 bp, Homo sapiens
cagctgcacctgccag

SEQ ID NO: 2687100 - DNA, 17 bp, Homo sapiens
cagctgcacctgccagc

SEQ ID NO: 2687101 - DNA, 18 bp, Homo sapiens
cagctgcacctgccagcc

SEQ ID NO: 2687102 - DNA, 11 bp, Homo sapiens
cagctgctggg

SEQ ID NO: 2687103 - DNA, 13 bp, Homo sapiens
cagctgctgggac

SEQ ID NO: 2687104 - DNA, 10 bp, Homo sapiens
cagctggcct

SEQ ID NO: 2687105 - DNA, 15 bp, Homo sapiens
cagctggcctctaga

SEQ ID NO: 2687106 - DNA, 15 bp, Homo sapiens
cagctgggcatgcca

SEQ ID NO: 2687107 - DNA, 22 bp, Homo sapiens
cagctgggcatgccatgtctga

SEQ ID NO: 2687108 - DNA, 19 bp, Homo sapiens
cagctttcagagccagtga

SEQ ID NO: 2687109 - DNA, 22 bp, Homo sapiens
caggaaaacaaatcactgtatt

SEQ ID NO: 2687110 - DNA, 16 bp, Homo sapiens
caggacagtgcttcag

SEQ ID NO: 2687111 - DNA, 17 bp, Homo sapiens
caggactgtgaccaaag

SEQ ID NO: 2687112 - DNA, 19 bp, Homo sapiens
caggagcaaatgtttctgc

SEQ ID NO: 2687113 - DNA, 14 bp, Homo sapiens
ctttacctgcaggc

SEQ ID NO: 2687114 - DNA, 16 bp, Homo sapiens
ctttactcagcccagc

SEQ ID NO: 2687115 - DNA, 20 bp, Homo sapiens
ctttactcagcccagctggc

SEQ ID NO: 2687116 - DNA, 12 bp, Homo sapiens
ctttatttgtga

SEQ ID NO: 2687117 - DNA, 16 bp, Homo sapiens
ctttatttgtgaaact

SEQ ID NO: 2687118 - DNA, 20 bp, Homo sapiens
ctttcagggaatttcaggaa

SEQ ID NO: 2687119 - DNA, 21 bp, Homo sapiens
ctttccggggctgctggcctg

SEQ ID NO: 2687120 - DNA, 16 bp, Homo sapiens
ctttccttctgccctt

SEQ ID NO: 2687121 - DNA, 17 bp, Homo sapiens
ctttccttctgcccttc

SEQ ID NO: 2687122 - DNA, 24 bp, Homo sapiens
ctttctcagggggtcagcagagtt

SEQ ID NO: 2687123 - DNA, 16 bp, Homo sapiens
ctttctctctccaccc

SEQ ID NO: 2687124 - DNA, 13 bp, Homo sapiens
ctttcttctctgc

SEQ ID NO: 2687125 - DNA, 16 bp, Homo sapiens
ctttcttctctgcctc

SEQ ID NO: 2687126 - DNA, 19 bp, Homo sapiens
ctttcttctctgcctcctc

SEQ ID NO: 2687127 - DNA, 22 bp, Homo sapiens
ctttcttttctaattcctgttg

SEQ ID NO: 2687128 - DNA, 16 bp, Homo sapiens
ctttgactcacctgtt

SEQ ID NO: 2687129 - DNA, 19 bp, Homo sapiens
ctttgactcacctgttact

SEQ ID NO: 2687130 - DNA, 21 bp, Homo sapiens
ctttgctgacactgtgaccct

SEQ ID NO: 2687131 - DNA, 21 bp, Homo sapiens
ctttggttctgggttgtttcc

SEQ ID NO: 2687132 - DNA, 14 bp, Homo sapiens
ctttgttgtcctcc

SEQ ID NO: 2687133 - DNA, 16 bp, Homo sapiens
ctttgttgtcctccca

SEQ ID NO: 2687134 - DNA, 23 bp, Homo sapiens
ctttgttgtctccctctttctca

SEQ ID NO: 2687135 - DNA, 15 bp, Homo sapiens
cttttattgagctct

SEQ ID NO: 2687136 - DNA, 15 bp, Homo sapiens
cttttccatcctgag

SEQ ID NO: 2687137 - DNA, 18 bp, Homo sapiens
cttttgcaacaagacaaa

SEQ ID NO: 2687138 - DNA, 17 bp, Homo sapiens
cttttgtcctgttattt

SEQ ID NO: 2687139 - DNA, 17 bp, Homo sapiens
cttttgttgtgactttt

SEQ ID NO: 2687140 - DNA, 21 bp, Homo sapiens
gaaaaaaaaagtcagactgct

SEQ ID NO: 2687141 - DNA, 23 bp, Homo sapiens
gaaacactaagctctctgggcct

SEQ ID NO: 2687142 - DNA, 18 bp, Homo sapiens
gaaacctggaaccagagg

SEQ ID NO: 2687143 - DNA, 20 bp, Homo sapiens
gaaacgcagattgggctggc

SEQ ID NO: 2687144 - DNA, 18 bp, Homo sapiens
gaaagcatcacctcaggc

SEQ ID NO: 2687145 - DNA, 17 bp, Homo sapiens
gaaagccagcaaagcct

SEQ ID NO: 2687146 - DNA, 19 bp, Homo sapiens
gaaaggctcagtctcagga

SEQ ID NO: 2687147 - DNA, 21 bp, Homo sapiens
gaaaggctcagtctcaggagc

SEQ ID NO: 2687148 - DNA, 19 bp, Homo sapiens
gaaagtcagctttcagagc

SEQ ID NO: 2687149 - DNA, 20 bp, Homo sapiens
gaaatcactttacctgcagg

SEQ ID NO: 2687150 - DNA, 21 bp, Homo sapiens
gaaattcaacctgtgtcttat

SEQ ID NO: 2687151 - DNA, 16 bp, Homo sapiens
gaaattcctgtagcat

SEQ ID NO: 2687152 - DNA, 18 bp, Homo sapiens
gaaattttactgacagaa

SEQ ID NO: 2687153 - DNA, 15 bp, Homo sapiens
gaacaatgtcagaaa

SEQ ID NO: 2687154 - DNA, 20 bp, Homo sapiens
gaacacagtttagtgcttta

SEQ ID NO: 2687155 - DNA, 22 bp, Homo sapiens
gaaccaaaaaaccccagctatt

SEQ ID NO: 2687156 - DNA, 17 bp, Homo sapiens
gaaccaaaagatgcctt

SEQ ID NO: 2687157 - DNA, 18 bp, Homo sapiens
gaacctcaggcttccttg

SEQ ID NO: 2687158 - DNA, 22 bp, Homo sapiens
gaactattggagggtgggagag

SEQ ID NO: 2687159 - DNA, 17 bp, Homo sapiens
gaactccttattttgta

SEQ ID NO: 2687160 - DNA, 22 bp, Homo sapiens
gaactggggttcaagcccaggc

SEQ ID NO: 2687161 - DNA, 22 bp, Homo sapiens
gaacttcaagaagtaagagcta

SEQ ID NO: 2687162 - DNA, 14 bp, Homo sapiens
gaacttgaggacac

SEQ ID NO: 2687163 - DNA, 15 bp, Homo sapiens
gaacttgaggacaca

SEQ ID NO: 2687164 - DNA, 17 bp, Homo sapiens
gaacttgaggacacatg

SEQ ID NO: 2687165 - DNA, 14 bp, Homo sapiens
gaagaaattcctgt

SEQ ID NO: 2687166 - DNA, 15 bp, Homo sapiens
gaagacaggacagtg

SEQ ID NO: 2687167 - DNA, 23 bp, Homo sapiens
gaagataatgttctttaatgttg

SEQ ID NO: 2687168 - DNA, 18 bp, Homo sapiens
gaagatcagagctgcagc

SEQ ID NO: 2687169 - DNA, 22 bp, Homo sapiens
gaagcaggttgaggggctcctg

SEQ ID NO: 2687170 - DNA, 15 bp, Homo sapiens
gaagccactgaagct

SEQ ID NO: 2687171 - DNA, 13 bp, Homo sapiens
gaagccaggagca

SEQ ID NO: 2687172 - DNA, 18 bp, Homo sapiens
gaagccaggagcaaatgt

SEQ ID NO: 2687173 - DNA, 21 bp, Homo sapiens
gaagcccctgggggctccctg

SEQ ID NO: 2687174 - DNA, 22 bp, Homo sapiens
gaagcccctgggggctccctga

SEQ ID NO: 2687175 - DNA, 14 bp, Homo sapiens
gaagcgctgccctg

SEQ ID NO: 2687176 - DNA, 18 bp, Homo sapiens
gaagcgctgccctgtgag

SEQ ID NO: 2687177 - DNA, 23 bp, Homo sapiens
gaagcgctgccctgtgagagcca

SEQ ID NO: 2687178 - DNA, 21 bp, Homo sapiens
gaagctcggtgagtgatggca

SEQ ID NO: 2687179 - DNA, 23 bp, Homo sapiens
gaaggcaaatataagctgggaaa

SEQ ID NO: 2687180 - DNA, 20 bp, Homo sapiens
gaaggctaagcatggcctgg

SEQ ID NO: 2687181 - DNA, 21 bp, Homo sapiens
gaaggctaagcatggcctgga

SEQ ID NO: 2687182 - DNA, 16 bp, Homo sapiens
gaaggctggctgggca

SEQ ID NO: 2687183 - DNA, 20 bp, Homo sapiens
gaagggacagctgctgggac

SEQ ID NO: 2687184 - DNA, 17 bp, Homo sapiens
gaaggggaacacagacc

SEQ ID NO: 2687185 - DNA, 23 bp, Homo sapiens
gaaggggaatgtgtcctcctgct

SEQ ID NO: 2687186 - DNA, 21 bp, Homo sapiens
gaagtaagagctaagttctaa

SEQ ID NO: 2687187 - DNA, 22 bp, Homo sapiens
ctgtagctgatgaaactcctga

SEQ ID NO: 2687188 - DNA, 17 bp, Homo sapiens
ctgtaggtttctctctt

SEQ ID NO: 2687189 - DNA, 20 bp, Homo sapiens
ctgtaggtttctctcttccc

SEQ ID NO: 2687190 - DNA, 14 bp, Homo sapiens
ctgtatatgttgta

SEQ ID NO: 2687191 - DNA, 17 bp, Homo sapiens
ctgtatatgttgtaata

SEQ ID NO: 2687192 - DNA, 15 bp, Homo sapiens
ctgtatcaaatctgt

SEQ ID NO: 2687193 - DNA, 14 bp, Homo sapiens
ctgtcaagtacaag

SEQ ID NO: 2687194 - DNA, 19 bp, Homo sapiens
ctgtcagaatcatgctgtt

SEQ ID NO: 2687195 - DNA, 22 bp, Homo sapiens
ctgtcagaatcatgctgttctc

SEQ ID NO: 2687196 - DNA, 14 bp, Homo sapiens
ctgtccagtttcca

SEQ ID NO: 2687197 - DNA, 16 bp, Homo sapiens
ctgtccagtttccaaa

SEQ ID NO: 2687198 - DNA, 13 bp, Homo sapiens
ctgtccataaagt

SEQ ID NO: 2687199 - DNA, 14 bp, Homo sapiens
ctgtccataaagta

SEQ ID NO: 2687200 - DNA, 23 bp, Homo sapiens
ctgtcccacctcttctcttcctg

SEQ ID NO: 2687201 - DNA, 15 bp, Homo sapiens
ctgtccctacccact

SEQ ID NO: 2687202 - DNA, 16 bp, Homo sapiens
ctgtccctacccactc

SEQ ID NO: 2687203 - DNA, 18 bp, Homo sapiens
ctgtccctacccactctt

SEQ ID NO: 2687204 - DNA, 19 bp, Homo sapiens
ctgtccctacccactcttt

SEQ ID NO: 2687205 - DNA, 15 bp, Homo sapiens
ctgtccctcaaatga

SEQ ID NO: 2687206 - DNA, 15 bp, Homo sapiens
ctgtccgtgtgcctc

SEQ ID NO: 2687207 - DNA, 19 bp, Homo sapiens
ctgtccgtgtgcctcctgt

SEQ ID NO: 2687208 - DNA, 16 bp, Homo sapiens
ctgtcctcctttctta

SEQ ID NO: 2687209 - DNA, 15 bp, Homo sapiens
ctgtctgtctgtccc

SEQ ID NO: 2687210 - DNA, 12 bp, Homo sapiens
ctgtgaccaaag

SEQ ID NO: 2687211 - DNA, 15 bp, Homo sapiens
ctgtgaccaaagcat

SEQ ID NO: 2687212 - DNA, 13 bp, Homo sapiens
ctgtgagagccac

SEQ ID NO: 2687213 - DNA, 17 bp, Homo sapiens
ctgtgagagccacgctg

SEQ ID NO: 2687214 - DNA, 20 bp, Homo sapiens
ctgtgagagccacgctggcc

SEQ ID NO: 2687215 - DNA, 15 bp, Homo sapiens
ctgtgcagggaggag

SEQ ID NO: 2687216 - DNA, 23 bp, Homo sapiens
ctgtgctcgggtgctgccagctg

SEQ ID NO: 2687217 - DNA, 23 bp, Homo sapiens
ctgtgctcttcctctggtttctg

SEQ ID NO: 2687218 - DNA, 18 bp, Homo sapiens
ctgtgctctttgaagaga

SEQ ID NO: 2687219 - DNA, 21 bp, Homo sapiens
ctgtgctttatttgtgaaact

SEQ ID NO: 2687220 - DNA, 19 bp, Homo sapiens
ctgtgctttgactcacctg

SEQ ID NO: 2687221 - DNA, 13 bp, Homo sapiens
ctgtggagaaata

SEQ ID NO: 2687222 - DNA, 21 bp, Homo sapiens
ctgtgtcccccccagtgcagg

SEQ ID NO: 2687223 - DNA, 16 bp, Homo sapiens
ctgtgtcgtagccaag

SEQ ID NO: 2687224 - DNA, 15 bp, Homo sapiens
ctgttctctttgctg

SEQ ID NO: 2687225 - DNA, 20 bp, Homo sapiens
ctgttctctttgctgacact

SEQ ID NO: 2687226 - DNA, 17 bp, Homo sapiens
ctgttgatgaggcctct

SEQ ID NO: 2687227 - DNA, 20 bp, Homo sapiens
ctgttgatgaggcctcttgg

SEQ ID NO: 2687228 - DNA, 21 bp, Homo sapiens
ctgttgtacgtaaagcttaaa

SEQ ID NO: 2687229 - DNA, 21 bp, Homo sapiens
ctgtttaaaaaaagtatatat

SEQ ID NO: 2687230 - DNA, 22 bp, Homo sapiens
ctgtttaaaaaaagtatatatt

SEQ ID NO: 2687231 - DNA, 18 bp, Homo sapiens
ctgtttcttcctttctgt

SEQ ID NO: 2687232 - DNA, 20 bp, Homo sapiens
ctgttttgcttttgtaactt

SEQ ID NO: 2687233 - DNA, 19 bp, Homo sapiens
cttagatgagggtgactgt

SEQ ID NO: 2687234 - DNA, 21 bp, Homo sapiens
cttatgctcagaagccagtct

SEQ ID NO: 2687235 - DNA, 21 bp, Homo sapiens
cttattcccaaactacagaat

SEQ ID NO: 2687236 - DNA, 17 bp, Homo sapiens
cttcaagttagctcagg

SEQ ID NO: 2687237 - DNA, 20 bp, Homo sapiens
cttcaagttagctcaggagg

SEQ ID NO: 2687238 - DNA, 16 bp, Homo sapiens
cttcaattcctgggcc

SEQ ID NO: 2687239 - DNA, 22 bp, Homo sapiens
cttcacactggtttgccaggcc

SEQ ID NO: 2687240 - DNA, 16 bp, Homo sapiens
cttcacccggctgggc

SEQ ID NO: 2687241 - DNA, 14 bp, Homo sapiens
cttcactccggtgt

SEQ ID NO: 2687242 - DNA, 23 bp, Homo sapiens
cttcagagcaaaagacttgagcc

SEQ ID NO: 2687243 - DNA, 16 bp, Homo sapiens
cttccaaccccagctg

SEQ ID NO: 2687244 - DNA, 17 bp, Homo sapiens
cttccaaccccagctgg

SEQ ID NO: 2687245 - DNA, 19 bp, Homo sapiens
cttccaaccccagctggcc

SEQ ID NO: 2687246 - DNA, 21 bp, Homo sapiens
cttccaaccccagctggcctc

SEQ ID NO: 2687247 - DNA, 22 bp, Homo sapiens
cttccaaccccagctggcctct

SEQ ID NO: 2687248 - DNA, 16 bp, Homo sapiens
cttccatgccccagga

SEQ ID NO: 2687249 - DNA, 22 bp, Homo sapiens
cttcccgggataaactgagcct

SEQ ID NO: 2687250 - DNA, 15 bp, Homo sapiens
cttccctccctgagg

SEQ ID NO: 2687251 - DNA, 14 bp, Homo sapiens
cttcctcagggccc

SEQ ID NO: 2687252 - DNA, 15 bp, Homo sapiens
cttcctcagggccca

SEQ ID NO: 2687253 - DNA, 16 bp, Homo sapiens
cttcctcagggcccag

SEQ ID NO: 2687254 - DNA, 19 bp, Homo sapiens
cttcctcagggcccagcag

SEQ ID NO: 2687255 - DNA, 19 bp, Homo sapiens
cttcctctggtttctgtgt

SEQ ID NO: 2687256 - DNA, 17 bp, Homo sapiens
cttcctgggatgatgtg

SEQ ID NO: 2687257 - DNA, 20 bp, Homo sapiens
cttcctgggatgatgtgtga

SEQ ID NO: 2687258 - DNA, 15 bp, Homo sapiens
cttcctgggtcctgc

SEQ ID NO: 2687259 - DNA, 17 bp, Homo sapiens
cttcctgggtcctgcct

SEQ ID NO: 2687260 - DNA, 19 bp, Homo sapiens
cttcctgggtcctgcctgg

SEQ ID NO: 2687261 - DNA, 22 bp, Homo sapiens
cttcctgtaacacaagccacag

SEQ ID NO: 2687262 - DNA, 23 bp, Homo sapiens
cttcctgtaacacaagccacaga

SEQ ID NO: 2687263 - DNA, 18 bp, Homo sapiens
cttccttgcccctgctct

SEQ ID NO: 2687264 - DNA, 19 bp, Homo sapiens
cttccttggcatcacaggg

SEQ ID NO: 2687265 - DNA, 15 bp, Homo sapiens
cttcctttcaggcca

SEQ ID NO: 2687266 - DNA, 16 bp, Homo sapiens
cttcctttcaggccaa

SEQ ID NO: 2687267 - DNA, 13 bp, Homo sapiens
cttctagctttgt

SEQ ID NO: 2687268 - DNA, 19 bp, Homo sapiens
cttctagctttgttgtcct

SEQ ID NO: 2687269 - DNA, 23 bp, Homo sapiens
cttctagctttgttgtcctccca

SEQ ID NO: 2687270 - DNA, 12 bp, Homo sapiens
cttctcagtgtc

SEQ ID NO: 2687271 - DNA, 15 bp, Homo sapiens
cttctcccttgccct

SEQ ID NO: 2687272 - DNA, 17 bp, Homo sapiens
cttctcccttgccctcc

SEQ ID NO: 2687273 - DNA, 16 bp, Homo sapiens
cttctgcccttcctcc

SEQ ID NO: 2687274 - DNA, 18 bp, Homo sapiens
cttctggagtctccagtg

SEQ ID NO: 2687275 - DNA, 15 bp, Homo sapiens
cttctggcttatgct

SEQ ID NO: 2687276 - DNA, 24 bp, Homo sapiens
cttctggcttatgctcagaagcca

SEQ ID NO: 2687277 - DNA, 19 bp, Homo sapiens
cttgaaaacctcatttacc

SEQ ID NO: 2687278 - DNA, 13 bp, Homo sapiens
cttgaagccactg

SEQ ID NO: 2687279 - DNA, 13 bp, Homo sapiens
cttgaggacacat

SEQ ID NO: 2687280 - DNA, 15 bp, Homo sapiens
cttgaggacacatgt

SEQ ID NO: 2687281 - DNA, 18 bp, Homo sapiens
cttgaggacacatgtcca

SEQ ID NO: 2687282 - DNA, 13 bp, Homo sapiens
cttgagtggggca

SEQ ID NO: 2687283 - DNA, 22 bp, Homo sapiens
cttgataggacttccttaagca

SEQ ID NO: 2687284 - DNA, 17 bp, Homo sapiens
cttgcccggattctggg

SEQ ID NO: 2687285 - DNA, 18 bp, Homo sapiens
cttgcccggattctggga

SEQ ID NO: 2687286 - DNA, 14 bp, Homo sapiens
cttgctctctgaga

SEQ ID NO: 2687287 - DNA, 14 bp, Homo sapiens
cttgctgtcctagg

SEQ ID NO: 2687288 - DNA, 17 bp, Homo sapiens
cttgctgtcctaggcca

SEQ ID NO: 2687289 - DNA, 13 bp, Homo sapiens
cttgctttttcaa

SEQ ID NO: 2687290 - DNA, 23 bp, Homo sapiens
cttggaaagcatcacctcaggcc

SEQ ID NO: 2687291 - DNA, 24 bp, Homo sapiens
cttggaaagctgatgatgtctctt

SEQ ID NO: 2687292 - DNA, 17 bp, Homo sapiens
cttggacctctgctctg

SEQ ID NO: 2687293 - DNA, 20 bp, Homo sapiens
cttggcatcacagggcagag

SEQ ID NO: 2687294 - DNA, 17 bp, Homo sapiens
cttgggaggctgaggca

SEQ ID NO: 2687295 - DNA, 16 bp, Homo sapiens
cttggtttcctgagcc

SEQ ID NO: 2687296 - DNA, 22 bp, Homo sapiens
cttgtggaggatgaatagatgt

SEQ ID NO: 2687297 - DNA, 23 bp, Homo sapiens
cttgtgggaccagtcccacaccg

SEQ ID NO: 2687298 - DNA, 18 bp, Homo sapiens
tggtactgcacattttgt

SEQ ID NO: 2687299 - DNA, 21 bp, Homo sapiens
tggtatgaacttgaggacaca

SEQ ID NO: 2687300 - DNA, 15 bp, Homo sapiens
tggtcacaggctgtg

SEQ ID NO: 2687301 - DNA, 16 bp, Homo sapiens
tggtcacaggctgtgc

SEQ ID NO: 2687302 - DNA, 13 bp, Homo sapiens
tggtccctgccct

SEQ ID NO: 2687303 - DNA, 16 bp, Homo sapiens
tgccacctctcccagc

SEQ ID NO: 2687304 - DNA, 19 bp, Homo sapiens
tgccacctctcccagccct

SEQ ID NO: 2687305 - DNA, 11 bp, Homo sapiens
tgccacctgtc

SEQ ID NO: 2687306 - DNA, 14 bp, Homo sapiens
tgccacctgtctgt

SEQ ID NO: 2687307 - DNA, 15 bp, Homo sapiens
tgccacctgtctgtc

SEQ ID NO: 2687308 - DNA, 18 bp, Homo sapiens
tgccacttcccagaggca

SEQ ID NO: 2687309 - DNA, 23 bp, Homo sapiens
tgccactttggtacatggccagt

SEQ ID NO: 2687310 - DNA, 12 bp, Homo sapiens
tgccagcctggc

SEQ ID NO: 2687311 - DNA, 21 bp, Homo sapiens
tgccagcctggcttctggagc

SEQ ID NO: 2687312 - DNA, 22 bp, Homo sapiens
tgccagctgctcccaatgtgcc

SEQ ID NO: 2687313 - DNA, 14 bp, Homo sapiens
tgccaggctgtgct

SEQ ID NO: 2687314 - DNA, 15 bp, Homo sapiens
tgccaggctgtgcta

SEQ ID NO: 2687315 - DNA, 18 bp, Homo sapiens
tgccaggctgtgctagca

SEQ ID NO: 2687316 - DNA, 23 bp, Homo sapiens
tgccagttgaaaatggattttta

SEQ ID NO: 2687317 - DNA, 13 bp, Homo sapiens
tgccatgtctgag

SEQ ID NO: 2687318 - DNA, 17 bp, Homo sapiens
tgccatttgcaccctcc

SEQ ID NO: 2687319 - DNA, 19 bp, Homo sapiens
tgccatttgcaccctccgc

SEQ ID NO: 2687320 - DNA, 18 bp, Homo sapiens
tgcccagagggcccaggc

SEQ ID NO: 2687321 - DNA, 21 bp, Homo sapiens
tgcccagagggcccaggcagg

SEQ ID NO: 2687322 - DNA, 23 bp, Homo sapiens
tgcccagagggcccaggcaggcc

SEQ ID NO: 2687323 - DNA, 16 bp, Homo sapiens
tgccccagctctggct

SEQ ID NO: 2687324 - DNA, 21 bp, Homo sapiens
tgccccaggatcactctctgc

SEQ ID NO: 2687325 - DNA, 23 bp, Homo sapiens
tgccccatcattgcacctgcagg

SEQ ID NO: 2687326 - DNA, 18 bp, Homo sapiens
tgcccccgtggggctccc

SEQ ID NO: 2687327 - DNA, 21 bp, Homo sapiens
tgccccctggtggacagtcct

SEQ ID NO: 2687328 - DNA, 21 bp, Homo sapiens
tgcccctacgggcgctgcagc

SEQ ID NO: 2687329 - DNA, 23 bp, Homo sapiens
tgcccctacgggcgctgcagcct

SEQ ID NO: 2687330 - DNA, 17 bp, Homo sapiens
tgcccctgctctgtagc

SEQ ID NO: 2687331 - DNA, 19 bp, Homo sapiens
tgcccctgctctgtagcca

SEQ ID NO: 2687332 - DNA, 23 bp, Homo sapiens
tgcccctgctctgtagccacctc

SEQ ID NO: 2687333 - DNA, 18 bp, Homo sapiens
tgccctccacagccgcag

SEQ ID NO: 2687334 - DNA, 14 bp, Homo sapiens
tgccctcccctgct

SEQ ID NO: 2687335 - DNA, 15 bp, Homo sapiens
tgccctcccctgctc

SEQ ID NO: 2687336 - DNA, 22 bp, Homo sapiens
tgccctcccctgctcccaggtt

SEQ ID NO: 2687337 - DNA, 17 bp, Homo sapiens
tgccctccccttcccct

SEQ ID NO: 2687338 - DNA, 12 bp, Homo sapiens
tgccctctgccc

SEQ ID NO: 2687339 - DNA, 17 bp, Homo sapiens
tgccctctgccccatca

SEQ ID NO: 2687340 - DNA, 20 bp, Homo sapiens
tgccctgccacctgtctgtc

SEQ ID NO: 2687341 - DNA, 18 bp, Homo sapiens
tgccctgccctgccacct

SEQ ID NO: 2687342 - DNA, 18 bp, Homo sapiens
tgccctgtgagagccacg

SEQ ID NO: 2687343 - DNA, 23 bp, Homo sapiens
tgccctgtgagagccacgctggc

SEQ ID NO: 2687344 - DNA, 12 bp, Homo sapiens
tgcccttcctcc

SEQ ID NO: 2687345 - DNA, 16 bp, Homo sapiens
tgccgagcctaatgaa

SEQ ID NO: 2687346 - DNA, 13 bp, Homo sapiens
tgccggggacaga

SEQ ID NO: 2687347 - DNA, 17 bp, Homo sapiens
tgcctccaagccattca

SEQ ID NO: 2687348 - DNA, 11 bp, Homo sapiens
tgcctcccagt

SEQ ID NO: 2687349 - DNA, 22 bp, Homo sapiens
tgcctcccagtggcctggcttg

SEQ ID NO: 2687350 - DNA, 18 bp, Homo sapiens
tgcctcctccccaggtgg

SEQ ID NO: 2687351 - DNA, 19 bp, Homo sapiens
tgcctgagtcacccatgaa

SEQ ID NO: 2687352 - DNA, 11 bp, Homo sapiens
tgcctgcagcc

SEQ ID NO: 2687353 - DNA, 15 bp, Homo sapiens
tgcctgcagccccgc

SEQ ID NO: 2687354 - DNA, 11 bp, Homo sapiens
tgcctgccttc

SEQ ID NO: 2687355 - DNA, 20 bp, Homo sapiens
tgcctgccttctcccctcca

SEQ ID NO: 2687356 - DNA, 19 bp, Homo sapiens
tgcctggtcctccctccca

SEQ ID NO: 2687357 - DNA, 22 bp, Homo sapiens
tgcctggtcctccctcccaagg

SEQ ID NO: 2687358 - DNA, 16 bp, Homo sapiens
tgccttcctgtttaaa

SEQ ID NO: 2687359 - DNA, 21 bp, Homo sapiens
tgccttcctgtttaaaaaaag

SEQ ID NO: 2687360 - DNA, 16 bp, Homo sapiens
tgccttggtttcctga

SEQ ID NO: 2687361 - DNA, 17 bp, Homo sapiens
tgcctttttacagccaa

SEQ ID NO: 2687362 - DNA, 18 bp, Homo sapiens
tgcgaaggggccctggtc

SEQ ID NO: 2687363 - DNA, 18 bp, Homo sapiens
tgcgggatggtcctgggg

SEQ ID NO: 2687364 - DNA, 20 bp, Homo sapiens
tgcgtcaggcacgtctcctg

SEQ ID NO: 2687365 - DNA, 23 bp, Homo sapiens
tgcgtcaggcacgtctcctgctg

SEQ ID NO: 2687366 - DNA, 13 bp, Homo sapiens
tgcgtgtcgtggg

SEQ ID NO: 2687367 - DNA, 14 bp, Homo sapiens
tgctacaataaatg

SEQ ID NO: 2687368 - DNA, 18 bp, Homo sapiens
tgctacaataaatgctga

SEQ ID NO: 2687369 - DNA, 14 bp, Homo sapiens
tgctagacagccag

SEQ ID NO: 2687370 - DNA, 13 bp, Homo sapiens
tgctagctgtctc

SEQ ID NO: 2687371 - DNA, 16 bp, Homo sapiens
tgctagctgtctctct

SEQ ID NO: 2687372 - DNA, 13 bp, Homo sapiens
tgctccagcagca

SEQ ID NO: 2687373 - DNA, 15 bp, Homo sapiens
tgctccagcagcaca

SEQ ID NO: 2687374 - DNA, 19 bp, Homo sapiens
tgctcccagggactgacac

SEQ ID NO: 2687375 - DNA, 17 bp, Homo sapiens
tgctccctgctcccagg

SEQ ID NO: 2687376 - DNA, 19 bp, Homo sapiens
tgctccctgctcccaggga

SEQ ID NO: 2687377 - DNA, 17 bp, Homo sapiens
tgctcgggtgctgccag

SEQ ID NO: 2687378 - DNA, 13 bp, Homo sapiens
tgctctatgccag

SEQ ID NO: 2687379 - DNA, 16 bp, Homo sapiens
tgctctatgccaggct

SEQ ID NO: 2687380 - DNA, 19 bp, Homo sapiens
tgctctatgccaggctgtg

SEQ ID NO: 2687381 - DNA, 22 bp, Homo sapiens
tgctctcctggagcaagctctg

SEQ ID NO: 2687382 - DNA, 18 bp, Homo sapiens
tgctctgaggcttccaga

SEQ ID NO: 2687383 - DNA, 20 bp, Homo sapiens
tgctctgaggcttccagaga

SEQ ID NO: 2687384 - DNA, 11 bp, Homo sapiens
tgctctgcttc

SEQ ID NO: 2687385 - DNA, 12 bp, Homo sapiens
tgctctgcttcc

SEQ ID NO: 2687386 - DNA, 16 bp, Homo sapiens
tgctctgcttcctcag

SEQ ID NO: 2687387 - DNA, 17 bp, Homo sapiens
tgctctgcttcctcagg

SEQ ID NO: 2687388 - DNA, 20 bp, Homo sapiens
tgctctgtagccacctcctt

SEQ ID NO: 2687389 - DNA, 21 bp, Homo sapiens
tgctctgtagccacctccttg

SEQ ID NO: 2687390 - DNA, 23 bp, Homo sapiens
tgctctgtagccacctccttggc

SEQ ID NO: 2687391 - DNA, 15 bp, Homo sapiens
tgctctttctctgag

SEQ ID NO: 2687392 - DNA, 21 bp, Homo sapiens
tgctgacactgtgaccctggg

SEQ ID NO: 2687393 - DNA, 18 bp, Homo sapiens
tgctgaggactccctcca

SEQ ID NO: 2687394 - DNA, 14 bp, Homo sapiens
tgctgaggccaccc

SEQ ID NO: 2687395 - DNA, 16 bp, Homo sapiens
tgctgaggccacccac

SEQ ID NO: 2687396 - DNA, 17 bp, Homo sapiens
tgctgatggcccctcca

SEQ ID NO: 2687397 - DNA, 13 bp, Homo sapiens
tgctgatggccct

SEQ ID NO: 2687398 - DNA, 18 bp, Homo sapiens
tgctgatggccctcatct

SEQ ID NO: 2687399 - DNA, 18 bp, Homo sapiens
tgctgcattgagtccagc

SEQ ID NO: 2687400 - DNA, 16 bp, Homo sapiens
tgctgcgggggagcca

SEQ ID NO: 2687401 - DNA, 17 bp, Homo sapiens
tgctgcgggggagccag

SEQ ID NO: 2687402 - DNA, 13 bp, Homo sapiens
tgctggcctggcc

SEQ ID NO: 2687403 - DNA, 15 bp, Homo sapiens
tgctggcctggccct

SEQ ID NO: 2687404 - DNA, 23 bp, Homo sapiens
tgctggggcaagtccctgactct

SEQ ID NO: 2687405 - DNA, 17 bp, Homo sapiens
tgctgtaatcggctccc

SEQ ID NO: 2687406 - DNA, 23 bp, Homo sapiens
tgctgtcctaggccacaccatct

SEQ ID NO: 2687407 - DNA, 20 bp, Homo sapiens
tgctgtgctttatttgtgaa

SEQ ID NO: 2687408 - DNA, 16 bp, Homo sapiens
tgctgtggcctgggca

SEQ ID NO: 2687409 - DNA, 15 bp, Homo sapiens
tgcttcagcctgagg

SEQ ID NO: 2687410 - DNA, 17 bp, Homo sapiens
tgcttcagcctgaggct

SEQ ID NO: 2687411 - DNA, 22 bp, Homo sapiens
tgcttcagcctgaggctgagac

SEQ ID NO: 2687412 - DNA, 16 bp, Homo sapiens
acccaaaggtggcctg

SEQ ID NO: 2687413 - DNA, 16 bp, Homo sapiens
acccaaatttccctgg

SEQ ID NO: 2687414 - DNA, 20 bp, Homo sapiens
acccaactgatcctgctcca

SEQ ID NO: 2687415 - DNA, 11 bp, Homo sapiens
acccacctccc

SEQ ID NO: 2687416 - DNA, 18 bp, Homo sapiens
acccacctccccctcccc

SEQ ID NO: 2687417 - DNA, 23 bp, Homo sapiens
acccacctccccctccccggcca

SEQ ID NO: 2687418 - DNA, 16 bp, Homo sapiens
acccactgacccaact

SEQ ID NO: 2687419 - DNA, 22 bp, Homo sapiens
acccactgacccaactgatcct

SEQ ID NO: 2687420 - DNA, 23 bp, Homo sapiens
acccactgacccaactgatcctg

SEQ ID NO: 2687421 - DNA, 22 bp, Homo sapiens
acccagagagaggggcctgcag

SEQ ID NO: 2687422 - DNA, 14 bp, Homo sapiens
acccagctgatggg

SEQ ID NO: 2687423 - DNA, 16 bp, Homo sapiens
acccaggcctccctgc

SEQ ID NO: 2687424 - DNA, 17 bp, Homo sapiens
acccaggcctccctgca

SEQ ID NO: 2687425 - DNA, 22 bp, Homo sapiens
acccaggcctccctgcagactc

SEQ ID NO: 2687426 - DNA, 23 bp, Homo sapiens
acccaggcctccctgcagactcc

SEQ ID NO: 2687427 - DNA, 23 bp, Homo sapiens
acccaggcctgattcactggcct

SEQ ID NO: 2687428 - DNA, 18 bp, Homo sapiens
acccaggtctgatgccaa

SEQ ID NO: 2687429 - DNA, 13 bp, Homo sapiens
accccagcatcct

SEQ ID NO: 2687430 - DNA, 21 bp, Homo sapiens
accccagctattttctgacca

SEQ ID NO: 2687431 - DNA, 12 bp, Homo sapiens
accccagctggc

SEQ ID NO: 2687432 - DNA, 23 bp, Homo sapiens
accccagctggcctctagaacac

SEQ ID NO: 2687433 - DNA, 14 bp, Homo sapiens
accccaggctctta

SEQ ID NO: 2687434 - DNA, 12 bp, Homo sapiens
accccccacctg

SEQ ID NO: 2687435 - DNA, 13 bp, Homo sapiens
accccctggccct

SEQ ID NO: 2687436 - DNA, 12 bp, Homo sapiens
accccttcctgt

SEQ ID NO: 2687437 - DNA, 12 bp, Homo sapiens
acccgctctgga

SEQ ID NO: 2687438 - DNA, 15 bp, Homo sapiens
accctatatctataa

SEQ ID NO: 2687439 - DNA, 23 bp, Homo sapiens
accctcgtggacacctgccctgc

SEQ ID NO: 2687440 - DNA, 21 bp, Homo sapiens
accctgggtcgggacagacca

SEQ ID NO: 2687441 - DNA, 15 bp, Homo sapiens
accctgtttcctgag

SEQ ID NO: 2687442 - DNA, 22 bp, Homo sapiens
accgccctccgtcgggcccctg

SEQ ID NO: 2687443 - DNA, 18 bp, Homo sapiens
accgtggaccttcctgcc

SEQ ID NO: 2687444 - DNA, 18 bp, Homo sapiens
acctaccaccccttcctg

SEQ ID NO: 2687445 - DNA, 15 bp, Homo sapiens
acctacccagctgat

SEQ ID NO: 2687446 - DNA, 17 bp, Homo sapiens
acctagaagtctccctg

SEQ ID NO: 2687447 - DNA, 16 bp, Homo sapiens
acctaggactgactcg

SEQ ID NO: 2687448 - DNA, 22 bp, Homo sapiens
acctatagtcccagctactcag

SEQ ID NO: 2687449 - DNA, 14 bp, Homo sapiens
acctcagccccact

SEQ ID NO: 2687450 - DNA, 21 bp, Homo sapiens
acctcaggccaggtgcagtgg

SEQ ID NO: 2687451 - DNA, 21 bp, Homo sapiens
acctccccctccccggccaca

SEQ ID NO: 2687452 - DNA, 16 bp, Homo sapiens
acctcccttccctccc

SEQ ID NO: 2687453 - DNA, 15 bp, Homo sapiens
acctccttttcttct

SEQ ID NO: 2687454 - DNA, 19 bp, Homo sapiens
acctctcaatattcaataa

SEQ ID NO: 2687455 - DNA, 20 bp, Homo sapiens
acctctcaatattcaataaa

SEQ ID NO: 2687456 - DNA, 15 bp, Homo sapiens
acctcttctatgcaa

SEQ ID NO: 2687457 - DNA, 19 bp, Homo sapiens
acctgaagggtgacatccc

SEQ ID NO: 2687458 - DNA, 16 bp, Homo sapiens
acctgcaggctccatg

SEQ ID NO: 2687459 - DNA, 16 bp, Homo sapiens
acctgccagcctggct

SEQ ID NO: 2687460 - DNA, 18 bp, Homo sapiens
acctgccagcctggcttc

SEQ ID NO: 2687461 - DNA, 21 bp, Homo sapiens
acctgccagcctggcttctgg

SEQ ID NO: 2687462 - DNA, 13 bp, Homo sapiens
acctgccccctgg

SEQ ID NO: 2687463 - DNA, 12 bp, Homo sapiens
acctgccctgcc

SEQ ID NO: 2687464 - DNA, 20 bp, Homo sapiens
acctgccctgccctgccacc

SEQ ID NO: 2687465 - DNA, 23 bp, Homo sapiens
acctgctgcgggggagccagttc

SEQ ID NO: 2687466 - DNA, 14 bp, Homo sapiens
acctggaaccagag

SEQ ID NO: 2687467 - DNA, 19 bp, Homo sapiens
acctggtactgcacatttt

SEQ ID NO: 2687468 - DNA, 15 bp, Homo sapiens
acctgtccataaagt

SEQ ID NO: 2687469 - DNA, 12 bp, Homo sapiens
acctgtctgtct

SEQ ID NO: 2687470 - DNA, 18 bp, Homo sapiens
acctgtctgtctgtctgt

SEQ ID NO: 2687471 - DNA, 20 bp, Homo sapiens
acctgtctgtctgtctgtcc

SEQ ID NO: 2687472 - DNA, 12 bp, Homo sapiens
acctgtgtctta

SEQ ID NO: 2687473 - DNA, 20 bp, Homo sapiens
acctgttttgcttttgtaac

SEQ ID NO: 2687474 - DNA, 18 bp, Homo sapiens
accttcaattcctgggcc

SEQ ID NO: 2687475 - DNA, 11 bp, Homo sapiens
accttcctgcc

SEQ ID NO: 2687476 - DNA, 17 bp, Homo sapiens
accttccttaagccagg

SEQ ID NO: 2687477 - DNA, 15 bp, Homo sapiens
accttgtgggaccag

SEQ ID NO: 2687478 - DNA, 16 bp, Homo sapiens
accttgtgggaccagt

SEQ ID NO: 2687479 - DNA, 22 bp, Homo sapiens
accttgtgggaccagtcccaca

SEQ ID NO: 2687480 - DNA, 16 bp, Homo sapiens
accttttccccaggag

SEQ ID NO: 2687481 - DNA, 14 bp, Homo sapiens
acgatgcctgcagg

SEQ ID NO: 2687482 - DNA, 22 bp, Homo sapiens
acgcaactcacacctccttttc

SEQ ID NO: 2687483 - DNA, 18 bp, Homo sapiens
acgcaaggctgtgctctt

SEQ ID NO: 2687484 - DNA, 21 bp, Homo sapiens
acgcaaggctgtgctcttcct

SEQ ID NO: 2687485 - DNA, 13 bp, Homo sapiens
acgcagattgggc

SEQ ID NO: 2687486 - DNA, 17 bp, Homo sapiens
acgcagattgggctggc

SEQ ID NO: 2687487 - DNA, 21 bp, Homo sapiens
acgcagattgggctggctctg

SEQ ID NO: 2687488 - DNA, 20 bp, Homo sapiens
acgccactgcactccagcct

SEQ ID NO: 2687489 - DNA, 16 bp, Homo sapiens
acgcctatgatcccag

SEQ ID NO: 2687490 - DNA, 18 bp, Homo sapiens
acgcctatgatcccagca

SEQ ID NO: 2687491 - DNA, 20 bp, Homo sapiens
acgcctgtaatcccagcact

SEQ ID NO: 2687492 - DNA, 16 bp, Homo sapiens
acggccctcctgggaa

SEQ ID NO: 2687493 - DNA, 19 bp, Homo sapiens
acgggcgctgcagcctccc

SEQ ID NO: 2687494 - DNA, 19 bp, Homo sapiens
acggggatcatctctgtga

SEQ ID NO: 2687495 - DNA, 21 bp, Homo sapiens
acgggtaacagtgaggctggg

SEQ ID NO: 2687496 - DNA, 14 bp, Homo sapiens
acgtctcctgctgc

SEQ ID NO: 2687497 - DNA, 17 bp, Homo sapiens
acgtgatggaccaaagc

SEQ ID NO: 2687498 - DNA, 21 bp, Homo sapiens
acgtgcacctgtactcaggag

SEQ ID NO: 2687499 - DNA, 17 bp, Homo sapiens
acgtgtctttagaactc

SEQ ID NO: 2687500 - DNA, 21 bp, Homo sapiens
actaaactctgaataagcact

SEQ ID NO: 2687501 - DNA, 22 bp, Homo sapiens
actaaactctgaataagcactt

SEQ ID NO: 2687502 - DNA, 19 bp, Homo sapiens
actaaagatatcagagctc

SEQ ID NO: 2687503 - DNA, 22 bp, Homo sapiens
actaaagatatcagagctctta

SEQ ID NO: 2687504 - DNA, 20 bp, Homo sapiens
actaaattgtatacattttg

SEQ ID NO: 2687505 - DNA, 20 bp, Homo sapiens
actaacataaaatctgtgaa

SEQ ID NO: 2687506 - DNA, 18 bp, Homo sapiens
actaagctctctgggcct

SEQ ID NO: 2687507 - DNA, 15 bp, Homo sapiens
actagaaatctgcca

SEQ ID NO: 2687508 - DNA, 23 bp, Homo sapiens
actataacatagaattgcaatct

SEQ ID NO: 2687509 - DNA, 13 bp, Homo sapiens
actattggagggt

SEQ ID NO: 2687510 - DNA, 19 bp, Homo sapiens
actattggagggtgggaga

SEQ ID NO: 2687511 - DNA, 14 bp, Homo sapiens
actcacaagaagac

SEQ ID NO: 2687512 - DNA, 18 bp, Homo sapiens
actcacaagaagaccaga

SEQ ID NO: 2687513 - DNA, 17 bp, Homo sapiens
actcacacctccttttc

SEQ ID NO: 2687514 - DNA, 15 bp, Homo sapiens
actcacctgttactt

SEQ ID NO: 2687515 - DNA, 15 bp, Homo sapiens
actcagaagcctgag

SEQ ID NO: 2687516 - DNA, 16 bp, Homo sapiens
actcagaagcctgagg

SEQ ID NO: 2687517 - DNA, 17 bp, Homo sapiens
actcagaagcctgaggc

SEQ ID NO: 2687518 - DNA, 11 bp, Homo sapiens
actcagcccag

SEQ ID NO: 2687519 - DNA, 12 bp, Homo sapiens
actcagcccagc

SEQ ID NO: 2687520 - DNA, 19 bp, Homo sapiens
actccaatggggccagcac

SEQ ID NO: 2687521 - DNA, 20 bp, Homo sapiens
actccaatggggccagcact

SEQ ID NO: 2687522 - DNA, 23 bp, Homo sapiens
aggggaaaccagtgtagccttgc

SEQ ID NO: 2687523 - DNA, 19 bp, Homo sapiens
aggggaatgtgtcctcctg

SEQ ID NO: 2687524 - DNA, 20 bp, Homo sapiens
aggggaatgtgtcctcctgc

SEQ ID NO: 2687525 - DNA, 21 bp, Homo sapiens
aggggaatgtgtcctcctgct

SEQ ID NO: 2687526 - DNA, 22 bp, Homo sapiens
aggggaatgtgtcctcctgctc

SEQ ID NO: 2687527 - DNA, 12 bp, Homo sapiens
aggggcagctcc

SEQ ID NO: 2687528 - DNA, 15 bp, Homo sapiens
aggggcagctcctga

SEQ ID NO: 2687529 - DNA, 18 bp, Homo sapiens
aggggcagctcctgacca

SEQ ID NO: 2687530 - DNA, 12 bp, Homo sapiens
aggggccctggt

SEQ ID NO: 2687531 - DNA, 13 bp, Homo sapiens
aggggcctctgaa

SEQ ID NO: 2687532 - DNA, 13 bp, Homo sapiens
aggggctcctgga

SEQ ID NO: 2687533 - DNA, 23 bp, Homo sapiens
aggggctcctggaaaggctcagt

SEQ ID NO: 2687534 - DNA, 13 bp, Homo sapiens
aggggctgcaggg

SEQ ID NO: 2687535 - DNA, 14 bp, Homo sapiens
aggggctgcaggga

SEQ ID NO: 2687536 - DNA, 14 bp, Homo sapiens
aggggctttctgga

SEQ ID NO: 2687537 - DNA, 16 bp, Homo sapiens
aggggctttctggaga

SEQ ID NO: 2687538 - DNA, 20 bp, Homo sapiens
aggggtcctgcaggtcctgg

SEQ ID NO: 2687539 - DNA, 20 bp, Homo sapiens
aggggtgggttcctcttccc

SEQ ID NO: 2687540 - DNA, 13 bp, Homo sapiens
agggtgacatccc

SEQ ID NO: 2687541 - DNA, 16 bp, Homo sapiens
agggtgacatcccagg

SEQ ID NO: 2687542 - DNA, 16 bp, Homo sapiens
agggtgggagagccca

SEQ ID NO: 2687543 - DNA, 22 bp, Homo sapiens
agggtggggtgggatttgcagg

SEQ ID NO: 2687544 - DNA, 18 bp, Homo sapiens
agggttttccaccctgga

SEQ ID NO: 2687545 - DNA, 14 bp, Homo sapiens
aggtagaaggcaca

SEQ ID NO: 2687546 - DNA, 23 bp, Homo sapiens
aggtcctggtgggtcagcccagc

SEQ ID NO: 2687547 - DNA, 16 bp, Homo sapiens
aggtcgagctgtgctc

SEQ ID NO: 2687548 - DNA, 18 bp, Homo sapiens
aggtctgatgccaaagct

SEQ ID NO: 2687549 - DNA, 23 bp, Homo sapiens
aggtctgatgccaaagctgcttt

SEQ ID NO: 2687550 - DNA, 14 bp, Homo sapiens
aggtgagaacccag

SEQ ID NO: 2687551 - DNA, 16 bp, Homo sapiens
aggtgagaacccagag

SEQ ID NO: 2687552 - DNA, 14 bp, Homo sapiens
aggtgagaccacct

SEQ ID NO: 2687553 - DNA, 23 bp, Homo sapiens
aggtgagcaggcagggctgggcc

SEQ ID NO: 2687554 - DNA, 17 bp, Homo sapiens
aggtgcgctcacctcag

SEQ ID NO: 2687555 - DNA, 20 bp, Homo sapiens
aggtgcgctcacctcagagc

SEQ ID NO: 2687556 - DNA, 15 bp, Homo sapiens
aggtggcatctctaa

SEQ ID NO: 2687557 - DNA, 21 bp, Homo sapiens
aggttagcctttgccctgtca

SEQ ID NO: 2687558 - DNA, 17 bp, Homo sapiens
aggttgaggggctcctg

SEQ ID NO: 2687559 - DNA, 18 bp, Homo sapiens
aggttgcagggagccgag

SEQ ID NO: 2687560 - DNA, 13 bp, Homo sapiens
aggttggtgactg

SEQ ID NO: 2687561 - DNA, 14 bp, Homo sapiens
aggttggtgactga

SEQ ID NO: 2687562 - DNA, 16 bp, Homo sapiens
aggtttctctcttccc

SEQ ID NO: 2687563 - DNA, 20 bp, Homo sapiens
aggtttctctcttcccttct

SEQ ID NO: 2687564 - DNA, 16 bp, Homo sapiens
agtaaacactgtgtat

SEQ ID NO: 2687565 - DNA, 11 bp, Homo sapiens
agtaaagtttt

SEQ ID NO: 2687566 - DNA, 20 bp, Homo sapiens
agtaagtaccactcaggcca

SEQ ID NO: 2687567 - DNA, 18 bp, Homo sapiens
agtacttgctctctgaga

SEQ ID NO: 2687568 - DNA, 16 bp, Homo sapiens
agtatattataataga

SEQ ID NO: 2687569 - DNA, 21 bp, Homo sapiens
agtatgccttcctgtttaaaa

SEQ ID NO: 2687570 - DNA, 16 bp, Homo sapiens
agtcacccatgaagac

SEQ ID NO: 2687571 - DNA, 15 bp, Homo sapiens
agtcagactgctggg

SEQ ID NO: 2687572 - DNA, 14 bp, Homo sapiens
agtcagatgcccag

SEQ ID NO: 2687573 - DNA, 20 bp, Homo sapiens
agtcatggggtccctgctgc

SEQ ID NO: 2687574 - DNA, 21 bp, Homo sapiens
agtcccacaccgctggtccct

SEQ ID NO: 2687575 - DNA, 22 bp, Homo sapiens
agtcccagctactcagaagcct

SEQ ID NO: 2687576 - DNA, 16 bp, Homo sapiens
agtcctagagctcctg

SEQ ID NO: 2687577 - DNA, 21 bp, Homo sapiens
agtcctcgtagccatctctct

SEQ ID NO: 2687578 - DNA, 22 bp, Homo sapiens
agtcctgggagaacctcaggct

SEQ ID NO: 2687579 - DNA, 12 bp, Homo sapiens
agtctcagagca

SEQ ID NO: 2687580 - DNA, 13 bp, Homo sapiens
agtctcagagcac

SEQ ID NO: 2687581 - DNA, 16 bp, Homo sapiens
agtctcagagcacaga

SEQ ID NO: 2687582 - DNA, 17 bp, Homo sapiens
agtctcaggagcatggg

SEQ ID NO: 2687583 - DNA, 13 bp, Homo sapiens
agtctccctgcac

SEQ ID NO: 2687584 - DNA, 17 bp, Homo sapiens
agtctccctgcacagcc

SEQ ID NO: 2687585 - DNA, 18 bp, Homo sapiens
agtctccctgcacagcct

SEQ ID NO: 2687586 - DNA, 19 bp, Homo sapiens
agtctccctgcacagcctc

SEQ ID NO: 2687587 - DNA, 16 bp, Homo sapiens
agtctctgtgctttga

SEQ ID NO: 2687588 - DNA, 18 bp, Homo sapiens
agtctgctcattccgagg

SEQ ID NO: 2687589 - DNA, 15 bp, Homo sapiens
agtctggcctgggcg

SEQ ID NO: 2687590 - DNA, 22 bp, Homo sapiens
agtgaaaaatatgttgagtgtt

SEQ ID NO: 2687591 - DNA, 23 bp, Homo sapiens
agtgaaccaaagagactggagca

SEQ ID NO: 2687592 - DNA, 23 bp, Homo sapiens
agtgaagagtagaacccaggtct

SEQ ID NO: 2687593 - DNA, 17 bp, Homo sapiens
agtgaaggagccacgtg

SEQ ID NO: 2687594 - DNA, 20 bp, Homo sapiens
agtgactttttctgagcttt

SEQ ID NO: 2687595 - DNA, 13 bp, Homo sapiens
agtgaggctggga

SEQ ID NO: 2687596 - DNA, 22 bp, Homo sapiens
agtgcagtggtgcgatcttggc

SEQ ID NO: 2687597 - DNA, 12 bp, Homo sapiens
agtgcccagccc

SEQ ID NO: 2687598 - DNA, 13 bp, Homo sapiens
agtgcccagcccc

SEQ ID NO: 2687599 - DNA, 15 bp, Homo sapiens
agtgcccagcccctg

SEQ ID NO: 2687600 - DNA, 18 bp, Homo sapiens
agtgcccagcccctgccc

SEQ ID NO: 2687601 - DNA, 20 bp, Homo sapiens
agtgctgtaatcggctcccg

SEQ ID NO: 2687602 - DNA, 14 bp, Homo sapiens
agtgctgtggcctg

SEQ ID NO: 2687603 - DNA, 18 bp, Homo sapiens
agtgctgtggcctgggca

SEQ ID NO: 2687604 - DNA, 17 bp, Homo sapiens
agtgcttcagcctgagg

SEQ ID NO: 2687605 - DNA, 13 bp, Homo sapiens
agtggggcctgcc

SEQ ID NO: 2687606 - DNA, 18 bp, Homo sapiens
agtggggcctgccctctg

SEQ ID NO: 2687607 - DNA, 16 bp, Homo sapiens
agtgtaactggctgct

SEQ ID NO: 2687608 - DNA, 21 bp, Homo sapiens
agtgtaactggctgctccctg

SEQ ID NO: 2687609 - DNA, 22 bp, Homo sapiens
agtgtaactggctgctccctgc

SEQ ID NO: 2687610 - DNA, 14 bp, Homo sapiens
agtgtacacagact

SEQ ID NO: 2687611 - DNA, 15 bp, Homo sapiens
agtgtacacagactg

SEQ ID NO: 2687612 - DNA, 13 bp, Homo sapiens
agttaatctataa

SEQ ID NO: 2687613 - DNA, 19 bp, Homo sapiens
agttagctcaggaggcttg

SEQ ID NO: 2687614 - DNA, 15 bp, Homo sapiens
agttcatgtttgtaa

SEQ ID NO: 2687615 - DNA, 18 bp, Homo sapiens
agttcctgtggccaggag

SEQ ID NO: 2687616 - DNA, 22 bp, Homo sapiens
agttctggggcccgcctgccac

SEQ ID NO: 2687617 - DNA, 23 bp, Homo sapiens
agttctggggcccgcctgccacc

SEQ ID NO: 2687618 - DNA, 16 bp, Homo sapiens
agttgaaaaatctagt

SEQ ID NO: 2687619 - DNA, 16 bp, Homo sapiens
agtttgatttaatatc

SEQ ID NO: 2687620 - DNA, 19 bp, Homo sapiens
agtttgatttaatatctga

SEQ ID NO: 2687621 - DNA, 19 bp, Homo sapiens
agttttaccctatatctat

SEQ ID NO: 2687622 - DNA, 14 bp, Homo sapiens
agttttgaaagaaa

SEQ ID NO: 2687623 - DNA, 19 bp, Homo sapiens
ataaaacttatgctagttt

SEQ ID NO: 2687624 - DNA, 16 bp, Homo sapiens
ataaaataattttatt

SEQ ID NO: 2687625 - DNA, 23 bp, Homo sapiens
ataaagaactccttattttgtat

SEQ ID NO: 2687626 - DNA, 18 bp, Homo sapiens
ataaatgctgaatgaatc

SEQ ID NO: 2687627 - DNA, 21 bp, Homo sapiens
ataacaaaccatctggtgcct

SEQ ID NO: 2687628 - DNA, 22 bp, Homo sapiens
ataacttccttgcccctgctct

SEQ ID NO: 2687629 - DNA, 22 bp, Homo sapiens
ataaggcggcgtgggcgaggcc

SEQ ID NO: 2687630 - DNA, 19 bp, Homo sapiens
ataatgttctttaatgttg

SEQ ID NO: 2687631 - DNA, 21 bp, Homo sapiens
atacattttgttatagaatac

SEQ ID NO: 2687632 - DNA, 16 bp, Homo sapiens
cactaggactctgagg

SEQ ID NO: 2687633 - DNA, 17 bp, Homo sapiens
cactaggactctgaggc

SEQ ID NO: 2687634 - DNA, 13 bp, Homo sapiens
cactccagcctga

SEQ ID NO: 2687635 - DNA, 22 bp, Homo sapiens
cactctttgctacaataaatgc

SEQ ID NO: 2687636 - DNA, 13 bp, Homo sapiens
cactgaagctggg

SEQ ID NO: 2687637 - DNA, 18 bp, Homo sapiens
cactgacacccagtgtcc

SEQ ID NO: 2687638 - DNA, 18 bp, Homo sapiens
cactgacccaactgatcc

SEQ ID NO: 2687639 - DNA, 19 bp, Homo sapiens
cactgcactccagcctggg

SEQ ID NO: 2687640 - DNA, 20 bp, Homo sapiens
cactgcactccagcctgggc

SEQ ID NO: 2687641 - DNA, 13 bp, Homo sapiens
cactggagcccag

SEQ ID NO: 2687642 - DNA, 14 bp, Homo sapiens
cactggagcccagg

SEQ ID NO: 2687643 - DNA, 15 bp, Homo sapiens
cactggaggggccca

SEQ ID NO: 2687644 - DNA, 17 bp, Homo sapiens
cactggaggggcccacc

SEQ ID NO: 2687645 - DNA, 20 bp, Homo sapiens
cactggaggggcccacccac

SEQ ID NO: 2687646 - DNA, 17 bp, Homo sapiens
cactggtttgccaggcc

SEQ ID NO: 2687647 - DNA, 18 bp, Homo sapiens
cactgtatgctggacggc

SEQ ID NO: 2687648 - DNA, 16 bp, Homo sapiens
cactgtccctcaaatg

SEQ ID NO: 2687649 - DNA, 18 bp, Homo sapiens
cactgtccctcaaatgac

SEQ ID NO: 2687650 - DNA, 23 bp, Homo sapiens
cacttgagtggaggtttatagtt

SEQ ID NO: 2687651 - DNA, 17 bp, Homo sapiens
cactttttaaaaaactt

SEQ ID NO: 2687652 - DNA, 16 bp, Homo sapiens
cagaaccagtctttca

SEQ ID NO: 2687653 - DNA, 15 bp, Homo sapiens
cagaacgatgcctgc

SEQ ID NO: 2687654 - DNA, 18 bp, Homo sapiens
cagaacgatgcctgcagg

SEQ ID NO: 2687655 - DNA, 19 bp, Homo sapiens
cagaactggcaggagcctc

SEQ ID NO: 2687656 - DNA, 16 bp, Homo sapiens
cagaagccaggagcaa

SEQ ID NO: 2687657 - DNA, 19 bp, Homo sapiens
cagaagccaggagcaaatg

SEQ ID NO: 2687658 - DNA, 13 bp, Homo sapiens
cagaagccagtct

SEQ ID NO: 2687659 - DNA, 18 bp, Homo sapiens
cagaagccagtctgcgtc

SEQ ID NO: 2687660 - DNA, 14 bp, Homo sapiens
cagaagcctgaggc

SEQ ID NO: 2687661 - DNA, 15 bp, Homo sapiens
cagaagcctgaggct

SEQ ID NO: 2687662 - DNA, 14 bp, Homo sapiens
cagaaggccaagaa

SEQ ID NO: 2687663 - DNA, 20 bp, Homo sapiens
cagaatagttattctctaag

SEQ ID NO: 2687664 - DNA, 21 bp, Homo sapiens
cagaatagttattctctaaga

SEQ ID NO: 2687665 - DNA, 12 bp, Homo sapiens
cagaatctgtat

SEQ ID NO: 2687666 - DNA, 16 bp, Homo sapiens
cagaatctgtatgatt

SEQ ID NO: 2687667 - DNA, 21 bp, Homo sapiens
cagaccagcagcaatctgtct

SEQ ID NO: 2687668 - DNA, 17 bp, Homo sapiens
cagaccattgtcttcca

SEQ ID NO: 2687669 - DNA, 14 bp, Homo sapiens
cagactccaatggg

SEQ ID NO: 2687670 - DNA, 13 bp, Homo sapiens
cagactgctggga

SEQ ID NO: 2687671 - DNA, 20 bp, Homo sapiens
cagactgctgggactggcca

SEQ ID NO: 2687672 - DNA, 23 bp, Homo sapiens
cagactgctgggactggccaggt

SEQ ID NO: 2687673 - DNA, 18 bp, Homo sapiens
cagagagaggggcctgca

SEQ ID NO: 2687674 - DNA, 17 bp, Homo sapiens
cagagaggtctcaggtt

SEQ ID NO: 2687675 - DNA, 21 bp, Homo sapiens
cagagaggtctcaggttcttt

SEQ ID NO: 2687676 - DNA, 11 bp, Homo sapiens
cagagccagtg

SEQ ID NO: 2687677 - DNA, 15 bp, Homo sapiens
cagagccctccaggc

SEQ ID NO: 2687678 - DNA, 16 bp, Homo sapiens
cagagccctccaggcc

SEQ ID NO: 2687679 - DNA, 13 bp, Homo sapiens
cagagctgcagcc

SEQ ID NO: 2687680 - DNA, 13 bp, Homo sapiens
cagagggcccagg

SEQ ID NO: 2687681 - DNA, 22 bp, Homo sapiens
cagagggcccaggcaggccacc

SEQ ID NO: 2687682 - DNA, 21 bp, Homo sapiens
cagagggggcgtgcctgccaa

SEQ ID NO: 2687683 - DNA, 21 bp, Homo sapiens
cagagttattgaatcttaatt

SEQ ID NO: 2687684 - DNA, 14 bp, Homo sapiens
cagatctgaacaca

SEQ ID NO: 2687685 - DNA, 22 bp, Homo sapiens
cagatgcccagagggcccaggc

SEQ ID NO: 2687686 - DNA, 15 bp, Homo sapiens
cagatgcctccccaa

SEQ ID NO: 2687687 - DNA, 23 bp, Homo sapiens
cagatgcctccccaagactgtca

SEQ ID NO: 2687688 - DNA, 13 bp, Homo sapiens
cagattgggctgg

SEQ ID NO: 2687689 - DNA, 18 bp, Homo sapiens
cagattgggctggctctg

SEQ ID NO: 2687690 - DNA, 16 bp, Homo sapiens
cagcaaagcctccagc

SEQ ID NO: 2687691 - DNA, 17 bp, Homo sapiens
cagcaaagcctccagca

SEQ ID NO: 2687692 - DNA, 22 bp, Homo sapiens
cagcacacacacataagcactg

SEQ ID NO: 2687693 - DNA, 20 bp, Homo sapiens
cagcacacctcagccccact

SEQ ID NO: 2687694 - DNA, 20 bp, Homo sapiens
cagcactggaggggcccacc

SEQ ID NO: 2687695 - DNA, 19 bp, Homo sapiens
cagcactttgggaggctga

SEQ ID NO: 2687696 - DNA, 22 bp, Homo sapiens
cagcactttgggaggctgaggc

SEQ ID NO: 2687697 - DNA, 22 bp, Homo sapiens
cagcagagttattgaatcttaa

SEQ ID NO: 2687698 - DNA, 18 bp, Homo sapiens
cagcagcaatctgtcttt

SEQ ID NO: 2687699 - DNA, 20 bp, Homo sapiens
cagcaggtgtgaccctgagg

SEQ ID NO: 2687700 - DNA, 18 bp, Homo sapiens
cagcatagaacaggacct

SEQ ID NO: 2687701 - DNA, 15 bp, Homo sapiens
cagcattaggctttt

SEQ ID NO: 2687702 - DNA, 23 bp, Homo sapiens
cagccaggttagcctttgccctg

SEQ ID NO: 2687703 - DNA, 16 bp, Homo sapiens
cagccattaccatgga

SEQ ID NO: 2687704 - DNA, 20 bp, Homo sapiens
cagccattaccatggagaca

SEQ ID NO: 2687705 - DNA, 13 bp, Homo sapiens
cagcccagcacct

SEQ ID NO: 2687706 - DNA, 14 bp, Homo sapiens
cagcccagcacctg

SEQ ID NO: 2687707 - DNA, 19 bp, Homo sapiens
cagcccagcacctgctccc

SEQ ID NO: 2687708 - DNA, 12 bp, Homo sapiens
cagcccagctgg

SEQ ID NO: 2687709 - DNA, 16 bp, Homo sapiens
cagcccagctggccac

SEQ ID NO: 2687710 - DNA, 18 bp, Homo sapiens
cagccccactgacaccca

SEQ ID NO: 2687711 - DNA, 19 bp, Homo sapiens
cagccccactgacacccag

SEQ ID NO: 2687712 - DNA, 21 bp, Homo sapiens
cagccccctatagtcatgggg

SEQ ID NO: 2687713 - DNA, 11 bp, Homo sapiens
cagcccctgcc

SEQ ID NO: 2687714 - DNA, 22 bp, Homo sapiens
cagccctcagcattgtcagcct

SEQ ID NO: 2687715 - DNA, 23 bp, Homo sapiens
cagccggacacaagcggccctga

SEQ ID NO: 2687716 - DNA, 13 bp, Homo sapiens
cagcctccctctg

SEQ ID NO: 2687717 - DNA, 21 bp, Homo sapiens
cagcctccctctgacctgcag

SEQ ID NO: 2687718 - DNA, 23 bp, Homo sapiens
cagcctccctctgacctgcaggc

SEQ ID NO: 2687719 - DNA, 18 bp, Homo sapiens
cagcctcccttccatgcc

SEQ ID NO: 2687720 - DNA, 20 bp, Homo sapiens
cagcctcccttccatgcccc

SEQ ID NO: 2687721 - DNA, 22 bp, Homo sapiens
cagcctcccttccatgccccag

SEQ ID NO: 2687722 - DNA, 20 bp, Homo sapiens
cagcctgaagatcagagctg

SEQ ID NO: 2687723 - DNA, 22 bp, Homo sapiens
cagcctgaagatcagagctgca

SEQ ID NO: 2687724 - DNA, 20 bp, Homo sapiens
cagcctggcttctggagccc

SEQ ID NO: 2687725 - DNA, 16 bp, Homo sapiens
cagcctgttggacccg

SEQ ID NO: 2687726 - DNA, 14 bp, Homo sapiens
cagcgtcattttga

SEQ ID NO: 2687727 - DNA, 22 bp, Homo sapiens
cagcgtcattttgaatcatcat

SEQ ID NO: 2687728 - DNA, 16 bp, Homo sapiens
cagcgtttacatattt

SEQ ID NO: 2687729 - DNA, 12 bp, Homo sapiens
cagctattttct

SEQ ID NO: 2687730 - DNA, 20 bp, Homo sapiens
cagctgcacctgccagcctg

SEQ ID NO: 2687731 - DNA, 17 bp, Homo sapiens
cagctgctgggacccac

SEQ ID NO: 2687732 - DNA, 22 bp, Homo sapiens
cagctgctgggacccacctccc

SEQ ID NO: 2687733 - DNA, 11 bp, Homo sapiens
cagctggccac

SEQ ID NO: 2687734 - DNA, 14 bp, Homo sapiens
cagctggcctctag

SEQ ID NO: 2687735 - DNA, 14 bp, Homo sapiens
cagctgggcatgcc

SEQ ID NO: 2687736 - DNA, 17 bp, Homo sapiens
cagctgggcatgccatg

SEQ ID NO: 2687737 - DNA, 21 bp, Homo sapiens
cagctgggcatgccatgtctg

SEQ ID NO: 2687738 - DNA, 14 bp, Homo sapiens
cagctttccttctg

SEQ ID NO: 2687739 - DNA, 18 bp, Homo sapiens
cagctttccttctgccct

SEQ ID NO: 2687740 - DNA, 19 bp, Homo sapiens
cagctttccttctgccctt

SEQ ID NO: 2687741 - DNA, 19 bp, Homo sapiens
caggaaaccctggcttgct

SEQ ID NO: 2687742 - DNA, 15 bp, Homo sapiens
cccaggatcactctc

SEQ ID NO: 2687743 - DNA, 22 bp, Homo sapiens
cccaggcctgattcactggcct

SEQ ID NO: 2687744 - DNA, 19 bp, Homo sapiens
cccaggctggagtgcagtg

SEQ ID NO: 2687745 - DNA, 14 bp, Homo sapiens
cccaggcttcctgg

SEQ ID NO: 2687746 - DNA, 15 bp, Homo sapiens
cccagggccagggcc

SEQ ID NO: 2687747 - DNA, 21 bp, Homo sapiens
cccagggccagggccctgcag

SEQ ID NO: 2687748 - DNA, 15 bp, Homo sapiens
cccaggtctgatgcc

SEQ ID NO: 2687749 - DNA, 19 bp, Homo sapiens
cccaggtgccaccaataaa

SEQ ID NO: 2687750 - DNA, 16 bp, Homo sapiens
cccagtggcctggctt

SEQ ID NO: 2687751 - DNA, 15 bp, Homo sapiens
cccatacttcctggg

SEQ ID NO: 2687752 - DNA, 17 bp, Homo sapiens
cccatacttcctgggat

SEQ ID NO: 2687753 - DNA, 16 bp, Homo sapiens
cccatgaatcaaagac

SEQ ID NO: 2687754 - DNA, 17 bp, Homo sapiens
ccccaaaagtacttacc

SEQ ID NO: 2687755 - DNA, 22 bp, Homo sapiens
ccccaccctcgtggacacctgc

SEQ ID NO: 2687756 - DNA, 22 bp, Homo sapiens
ccccagctattttctgaccaaa

SEQ ID NO: 2687757 - DNA, 12 bp, Homo sapiens
ccccagctggcc

SEQ ID NO: 2687758 - DNA, 14 bp, Homo sapiens
ccccagctggcctc

SEQ ID NO: 2687759 - DNA, 15 bp, Homo sapiens
ccccagctggcctct

SEQ ID NO: 2687760 - DNA, 13 bp, Homo sapiens
ccccagcttcctg

SEQ ID NO: 2687761 - DNA, 18 bp, Homo sapiens
ccccaggatcactctctg

SEQ ID NO: 2687762 - DNA, 20 bp, Homo sapiens
ccccaggatcactctctgct

SEQ ID NO: 2687763 - DNA, 19 bp, Homo sapiens
ccccaggctgagagccaga

SEQ ID NO: 2687764 - DNA, 23 bp, Homo sapiens
ccccagggacaaaacactgtgtc

SEQ ID NO: 2687765 - DNA, 17 bp, Homo sapiens
ccccaggtgccaccaat

SEQ ID NO: 2687766 - DNA, 18 bp, Homo sapiens
ccccatacttcctgggat

SEQ ID NO: 2687767 - DNA, 22 bp, Homo sapiens
ccccatcattgcacctgcaggc

SEQ ID NO: 2687768 - DNA, 23 bp, Homo sapiens
cccccgtggggctcccggcatcc

SEQ ID NO: 2687769 - DNA, 11 bp, Homo sapiens
ccccctgggct

SEQ ID NO: 2687770 - DNA, 14 bp, Homo sapiens
ccccgacccgggtc

SEQ ID NO: 2687771 - DNA, 16 bp, Homo sapiens
ccccgtggggctcccg

SEQ ID NO: 2687772 - DNA, 13 bp, Homo sapiens
cccctgcccctac

SEQ ID NO: 2687773 - DNA, 15 bp, Homo sapiens
cccctgggctctgcc

SEQ ID NO: 2687774 - DNA, 21 bp, Homo sapiens
cccctgggctctgccccagct

SEQ ID NO: 2687775 - DNA, 23 bp, Homo sapiens
cccctggtgcactggccccaccc

SEQ ID NO: 2687776 - DNA, 15 bp, Homo sapiens
cccctggtggacagt

SEQ ID NO: 2687777 - DNA, 19 bp, Homo sapiens
cccctggtggacagtcctg

SEQ ID NO: 2687778 - DNA, 21 bp, Homo sapiens
cccctggtggacagtcctggg

SEQ ID NO: 2687779 - DNA, 12 bp, Homo sapiens
ccccttcctgtc

SEQ ID NO: 2687780 - DNA, 19 bp, Homo sapiens
cccctttactcagcccagc

SEQ ID NO: 2687781 - DNA, 14 bp, Homo sapiens
cccgcctccccata

SEQ ID NO: 2687782 - DNA, 18 bp, Homo sapiens
cccgctccccacctaccc

SEQ ID NO: 2687783 - DNA, 21 bp, Homo sapiens
cccggcatcctgaaagccagc

SEQ ID NO: 2687784 - DNA, 18 bp, Homo sapiens
cccgggataaactgagcc

SEQ ID NO: 2687785 - DNA, 19 bp, Homo sapiens
cccgggataaactgagcct

SEQ ID NO: 2687786 - DNA, 19 bp, Homo sapiens
cccgggtctggtgctgagg

SEQ ID NO: 2687787 - DNA, 14 bp, Homo sapiens
cccgtggatggtct

SEQ ID NO: 2687788 - DNA, 16 bp, Homo sapiens
cccgtggggctcccgg

SEQ ID NO: 2687789 - DNA, 16 bp, Homo sapiens
ccctacccactctttg

SEQ ID NO: 2687790 - DNA, 18 bp, Homo sapiens
ccctacccactctttgct

SEQ ID NO: 2687791 - DNA, 19 bp, Homo sapiens
ccctacgggcgctgcagcc

SEQ ID NO: 2687792 - DNA, 20 bp, Homo sapiens
ccctcaaatgacccaaagac

SEQ ID NO: 2687793 - DNA, 21 bp, Homo sapiens
ccctccacgcaaggctgtgct

SEQ ID NO: 2687794 - DNA, 15 bp, Homo sapiens
ccctccagcacacac

SEQ ID NO: 2687795 - DNA, 21 bp, Homo sapiens
ccctcccaaggagccattctg

SEQ ID NO: 2687796 - DNA, 18 bp, Homo sapiens
ccctccccggccacatgc

SEQ ID NO: 2687797 - DNA, 16 bp, Homo sapiens
ccctcccctgctccca

SEQ ID NO: 2687798 - DNA, 20 bp, Homo sapiens
ccctcccctgctcccaggtt

SEQ ID NO: 2687799 - DNA, 14 bp, Homo sapiens
ccctccctgaggca

SEQ ID NO: 2687800 - DNA, 18 bp, Homo sapiens
ccctccgatgctgaggcc

SEQ ID NO: 2687801 - DNA, 18 bp, Homo sapiens
ccctccgtcgggcccctg

SEQ ID NO: 2687802 - DNA, 12 bp, Homo sapiens
ccctcctgggaa

SEQ ID NO: 2687803 - DNA, 19 bp, Homo sapiens
ccctcctgggaacctcctt

SEQ ID NO: 2687804 - DNA, 18 bp, Homo sapiens
ccctccttgagcaccagc

SEQ ID NO: 2687805 - DNA, 18 bp, Homo sapiens
ccctcgtggacacctgcc

SEQ ID NO: 2687806 - DNA, 13 bp, Homo sapiens
ccctgactctctg

SEQ ID NO: 2687807 - DNA, 14 bp, Homo sapiens
ccctgagggctcct

SEQ ID NO: 2687808 - DNA, 16 bp, Homo sapiens
ccctgagggctcctcc

SEQ ID NO: 2687809 - DNA, 19 bp, Homo sapiens
ccctgagggctcctccatg

SEQ ID NO: 2687810 - DNA, 13 bp, Homo sapiens
ccctgcagactcc

SEQ ID NO: 2687811 - DNA, 15 bp, Homo sapiens
ccctgccacctgtct

SEQ ID NO: 2687812 - DNA, 17 bp, Homo sapiens
ccctgccacctgtctgt

SEQ ID NO: 2687813 - DNA, 18 bp, Homo sapiens
ccctgccacctgtctgtc

SEQ ID NO: 2687814 - DNA, 17 bp, Homo sapiens
ccctgcctcatccacca

SEQ ID NO: 2687815 - DNA, 17 bp, Homo sapiens
ccctgcgaaggggccct

SEQ ID NO: 2687816 - DNA, 20 bp, Homo sapiens
ccctgcgaaggggccctggt

SEQ ID NO: 2687817 - DNA, 21 bp, Homo sapiens
ccctgcgaaggggccctggtc

SEQ ID NO: 2687818 - DNA, 12 bp, Homo sapiens
ccctgctctgta

SEQ ID NO: 2687819 - DNA, 18 bp, Homo sapiens
ccctgctctttctctgag

SEQ ID NO: 2687820 - DNA, 13 bp, Homo sapiens
ccctggctgtggg

SEQ ID NO: 2687821 - DNA, 13 bp, Homo sapiens
ccctgggctctgc

SEQ ID NO: 2687822 - DNA, 15 bp, Homo sapiens
ccctgggggcatcct

SEQ ID NO: 2687823 - DNA, 18 bp, Homo sapiens
ccctgggggcatcctgct

SEQ ID NO: 2687824 - DNA, 20 bp, Homo sapiens
ccctggtggacagtcctggg

SEQ ID NO: 2687825 - DNA, 21 bp, Homo sapiens
ccctggtggacagtcctggga

SEQ ID NO: 2687826 - DNA, 19 bp, Homo sapiens
ccctggtggtcacaggctg

SEQ ID NO: 2687827 - DNA, 20 bp, Homo sapiens
ccctggtggtcacaggctgt

SEQ ID NO: 2687828 - DNA, 20 bp, Homo sapiens
ccctgtcagaatcatgctgt

SEQ ID NO: 2687829 - DNA, 14 bp, Homo sapiens
ccctgtttcctgag

SEQ ID NO: 2687830 - DNA, 18 bp, Homo sapiens
cccttccatgccccagga

SEQ ID NO: 2687831 - DNA, 15 bp, Homo sapiens
cccttccctccctga

SEQ ID NO: 2687832 - DNA, 16 bp, Homo sapiens
cccttctctctttcta

SEQ ID NO: 2687833 - DNA, 16 bp, Homo sapiens
ccctttactcagccca

SEQ ID NO: 2687834 - DNA, 13 bp, Homo sapiens
ccctttctctctc

SEQ ID NO: 2687835 - DNA, 14 bp, Homo sapiens
ccgacttgtccctc

SEQ ID NO: 2687836 - DNA, 17 bp, Homo sapiens
ccgcccagctgcacctg

SEQ ID NO: 2687837 - DNA, 21 bp, Homo sapiens
ccgcctccccatacttcctgg

SEQ ID NO: 2687838 - DNA, 17 bp, Homo sapiens
ccgctccccacctaccc

SEQ ID NO: 2687839 - DNA, 18 bp, Homo sapiens
ccgctccccacctaccca

SEQ ID NO: 2687840 - DNA, 15 bp, Homo sapiens
ccgctggtccctgcc

SEQ ID NO: 2687841 - DNA, 12 bp, Homo sapiens
ccggacacaagc

SEQ ID NO: 2687842 - DNA, 21 bp, Homo sapiens
ccggacacaagcggccctgac

SEQ ID NO: 2687843 - DNA, 11 bp, Homo sapiens
ccggcatcctg

SEQ ID NO: 2687844 - DNA, 16 bp, Homo sapiens
ccgggacttcaaagcc

SEQ ID NO: 2687845 - DNA, 23 bp, Homo sapiens
ccgggataaactgagcctgttca

SEQ ID NO: 2687846 - DNA, 23 bp, Homo sapiens
ccggggaggcaggggtcctgcag

SEQ ID NO: 2687847 - DNA, 15 bp, Homo sapiens
ccgtcgggcccctgc

SEQ ID NO: 2687848 - DNA, 15 bp, Homo sapiens
ccgtggaccttcctg

SEQ ID NO: 2687849 - DNA, 23 bp, Homo sapiens
ccgtggggctcccggcatcctga

SEQ ID NO: 2687850 - DNA, 15 bp, Homo sapiens
ccgtgtgcctcctgt

SEQ ID NO: 2687851 - DNA, 14 bp, Homo sapiens
cctacccactcttt

SEQ ID NO: 2687852 - DNA, 20 bp, Homo sapiens
cctggcttctggagcccttg

SEQ ID NO: 2687853 - DNA, 23 bp, Homo sapiens
cctggcttctggagcccttgggt

SEQ ID NO: 2687854 - DNA, 16 bp, Homo sapiens
cctggcttgtcggagc

SEQ ID NO: 2687855 - DNA, 12 bp, Homo sapiens
cctgggctctgc

SEQ ID NO: 2687856 - DNA, 22 bp, Homo sapiens
cctgggctctgccccagctctg

SEQ ID NO: 2687857 - DNA, 18 bp, Homo sapiens
cctggggctctgtgcagg

SEQ ID NO: 2687858 - DNA, 14 bp, Homo sapiens
cctgggggcatcct

SEQ ID NO: 2687859 - DNA, 16 bp, Homo sapiens
cctgggggcatcctgc

SEQ ID NO: 2687860 - DNA, 18 bp, Homo sapiens
cctgggggcatcctgctt

SEQ ID NO: 2687861 - DNA, 22 bp, Homo sapiens
cctgggggcatcctgcttcctg

SEQ ID NO: 2687862 - DNA, 15 bp, Homo sapiens
cctgggggctccctg

SEQ ID NO: 2687863 - DNA, 21 bp, Homo sapiens
cctgggtcctgcctggtcctc

SEQ ID NO: 2687864 - DNA, 19 bp, Homo sapiens
cctggtgcactggccccac

SEQ ID NO: 2687865 - DNA, 20 bp, Homo sapiens
cctggtgcactggccccacc

SEQ ID NO: 2687866 - DNA, 17 bp, Homo sapiens
cctggtggacagtcctg

SEQ ID NO: 2687867 - DNA, 20 bp, Homo sapiens
cctggtggacagtcctggga

SEQ ID NO: 2687868 - DNA, 18 bp, Homo sapiens
cctggtgggtcagcccag

SEQ ID NO: 2687869 - DNA, 19 bp, Homo sapiens
cctggtgggtcagcccagc

SEQ ID NO: 2687870 - DNA, 20 bp, Homo sapiens
cctggtgggtcagcccagca

SEQ ID NO: 2687871 - DNA, 21 bp, Homo sapiens
cctgtaacacaagccacagaa

SEQ ID NO: 2687872 - DNA, 21 bp, Homo sapiens
cctgtactcaggaggctgagg

SEQ ID NO: 2687873 - DNA, 15 bp, Homo sapiens
cctgtagcatcttct

SEQ ID NO: 2687874 - DNA, 15 bp, Homo sapiens
cctgtatttaagatt

SEQ ID NO: 2687875 - DNA, 15 bp, Homo sapiens
cctgtccataaagta

SEQ ID NO: 2687876 - DNA, 13 bp, Homo sapiens
cctgtcccacctc

SEQ ID NO: 2687877 - DNA, 19 bp, Homo sapiens
cctgtctttgttgtctccc

SEQ ID NO: 2687878 - DNA, 17 bp, Homo sapiens
cctgtgagagccacgct

SEQ ID NO: 2687879 - DNA, 12 bp, Homo sapiens
cctgtggccagg

SEQ ID NO: 2687880 - DNA, 23 bp, Homo sapiens
cctgttattttttatttccacat

SEQ ID NO: 2687881 - DNA, 23 bp, Homo sapiens
cctgttggacccgctctggacca

SEQ ID NO: 2687882 - DNA, 21 bp, Homo sapiens
ccttagaaatcattgtagaaa

SEQ ID NO: 2687883 - DNA, 21 bp, Homo sapiens
ccttagattagctctggacca

SEQ ID NO: 2687884 - DNA, 14 bp, Homo sapiens
ccttcaattcctgg

SEQ ID NO: 2687885 - DNA, 16 bp, Homo sapiens
ccttcaattcctgggc

SEQ ID NO: 2687886 - DNA, 14 bp, Homo sapiens
ccttcactccggtg

SEQ ID NO: 2687887 - DNA, 20 bp, Homo sapiens
ccttcactccggtgtgcctg

SEQ ID NO: 2687888 - DNA, 16 bp, Homo sapiens
ccttccatgccccagg

SEQ ID NO: 2687889 - DNA, 18 bp, Homo sapiens
ccttccatgccccaggat

SEQ ID NO: 2687890 - DNA, 20 bp, Homo sapiens
ccttccccctcccagggcca

SEQ ID NO: 2687891 - DNA, 19 bp, Homo sapiens
ccttcccctttactcagcc

SEQ ID NO: 2687892 - DNA, 21 bp, Homo sapiens
ccttcccctttactcagccca

SEQ ID NO: 2687893 - DNA, 23 bp, Homo sapiens
ccttcccctttactcagcccagc

SEQ ID NO: 2687894 - DNA, 16 bp, Homo sapiens
ccttcctgccaccagt

SEQ ID NO: 2687895 - DNA, 17 bp, Homo sapiens
ccttccttaagccagga

SEQ ID NO: 2687896 - DNA, 20 bp, Homo sapiens
ccttccttgctgtcctaggc

SEQ ID NO: 2687897 - DNA, 11 bp, Homo sapiens
ccttctccctt

SEQ ID NO: 2687898 - DNA, 18 bp, Homo sapiens
ccttctcccttgccctcc

SEQ ID NO: 2687899 - DNA, 15 bp, Homo sapiens
ccttctgcccttcct

SEQ ID NO: 2687900 - DNA, 14 bp, Homo sapiens
ccttgaagccactg

SEQ ID NO: 2687901 - DNA, 15 bp, Homo sapiens
ccttgcccctgctct

SEQ ID NO: 2687902 - DNA, 16 bp, Homo sapiens
ccttgcccctgctctg

SEQ ID NO: 2687903 - DNA, 18 bp, Homo sapiens
ccttgcccggattctggg

SEQ ID NO: 2687904 - DNA, 20 bp, Homo sapiens
ccttgccctccctttctctc

SEQ ID NO: 2687905 - DNA, 22 bp, Homo sapiens
ccttggtttcctgagccacctt

SEQ ID NO: 2687906 - DNA, 16 bp, Homo sapiens
cctttactcagcccag

SEQ ID NO: 2687907 - DNA, 13 bp, Homo sapiens
cctttcaggccaa

SEQ ID NO: 2687908 - DNA, 23 bp, Homo sapiens
cctttcaggccaaggctatgaag

SEQ ID NO: 2687909 - DNA, 23 bp, Homo sapiens
ccttttgcccccgtggggctccc

SEQ ID NO: 2687910 - DNA, 24 bp, Homo sapiens
ccttttgcccccgtggggctcccg

SEQ ID NO: 2687911 - DNA, 17 bp, Homo sapiens
cgaaagggacacaatgt

SEQ ID NO: 2687912 - DNA, 13 bp, Homo sapiens
cgaaggggccctg

SEQ ID NO: 2687913 - DNA, 15 bp, Homo sapiens
cgagaccagcctggc

SEQ ID NO: 2687914 - DNA, 20 bp, Homo sapiens
cgaggcctgacacaggccag

SEQ ID NO: 2687915 - DNA, 17 bp, Homo sapiens
cgcaactcacacctcct

SEQ ID NO: 2687916 - DNA, 15 bp, Homo sapiens
cgcaaggctgtgctc

SEQ ID NO: 2687917 - DNA, 23 bp, Homo sapiens
cgcaaggctgtgctcttcctctg

SEQ ID NO: 2687918 - DNA, 17 bp, Homo sapiens
cgcacctgccccctggt

SEQ ID NO: 2687919 - DNA, 13 bp, Homo sapiens
cgcagagccctcc

SEQ ID NO: 2687920 - DNA, 17 bp, Homo sapiens
cgcagagccctccaggc

SEQ ID NO: 2687921 - DNA, 20 bp, Homo sapiens
cgcagagccctccaggcctg

SEQ ID NO: 2687922 - DNA, 21 bp, Homo sapiens
cgcagagccctccaggcctgc

SEQ ID NO: 2687923 - DNA, 22 bp, Homo sapiens
cgcagagccctccaggcctgca

SEQ ID NO: 2687924 - DNA, 16 bp, Homo sapiens
cgcagattgggctggc

SEQ ID NO: 2687925 - DNA, 14 bp, Homo sapiens
cgcagtctggcctg

SEQ ID NO: 2687926 - DNA, 21 bp, Homo sapiens
cgccactgcactccagcctgg

SEQ ID NO: 2687927 - DNA, 24 bp, Homo sapiens
cgccctccgtcgggcccctgcctg

SEQ ID NO: 2687928 - DNA, 20 bp, Homo sapiens
cgcctccccatacttcctgg

SEQ ID NO: 2687929 - DNA, 18 bp, Homo sapiens
cgcctgccacctctccca

SEQ ID NO: 2687930 - DNA, 19 bp, Homo sapiens
cgcctgccacctctcccag

SEQ ID NO: 2687931 - DNA, 20 bp, Homo sapiens
cgcctgccacctctcccagc

SEQ ID NO: 2687932 - DNA, 14 bp, Homo sapiens
cgcctttccggggc

SEQ ID NO: 2687933 - DNA, 12 bp, Homo sapiens
cgcgtccctgcc

SEQ ID NO: 2687934 - DNA, 14 bp, Homo sapiens
cgctcacctcagag

SEQ ID NO: 2687935 - DNA, 21 bp, Homo sapiens
cgctcttagctttctcagggg

SEQ ID NO: 2687936 - DNA, 23 bp, Homo sapiens
cgctgccctgtgagagccacgct

SEQ ID NO: 2687937 - DNA, 22 bp, Homo sapiens
cgctggccttcgtctccatctc

SEQ ID NO: 2687938 - DNA, 15 bp, Homo sapiens
cgctggtccctgccc

SEQ ID NO: 2687939 - DNA, 16 bp, Homo sapiens
cgctggtccctgccct

SEQ ID NO: 2687940 - DNA, 21 bp, Homo sapiens
cgcttgctctcctggagcaag

SEQ ID NO: 2687941 - DNA, 18 bp, Homo sapiens
cggaaggctggctgggca

SEQ ID NO: 2687942 - DNA, 18 bp, Homo sapiens
cggacacaagcggccctg

SEQ ID NO: 2687943 - DNA, 13 bp, Homo sapiens
cggaggttgcagg

SEQ ID NO: 2687944 - DNA, 15 bp, Homo sapiens
cggcacccaggcctc

SEQ ID NO: 2687945 - DNA, 16 bp, Homo sapiens
cggcacccaggcctcc

SEQ ID NO: 2687946 - DNA, 15 bp, Homo sapiens
cggcatcctgaaagc

SEQ ID NO: 2687947 - DNA, 14 bp, Homo sapiens
cggcattcctgctt

SEQ ID NO: 2687948 - DNA, 12 bp, Homo sapiens
cggccctcctgg

SEQ ID NO: 2687949 - DNA, 22 bp, Homo sapiens
cggccctcctgggaacctcctt

SEQ ID NO: 2687950 - DNA, 23 bp, Homo sapiens
cggcgcagagccctccaggcctg

SEQ ID NO: 2687951 - DNA, 21 bp, Homo sapiens
cggctcccgcttgctctcctg

SEQ ID NO: 2687952 - DNA, 17 bp, Homo sapiens
cgggataaactgagcct

SEQ ID NO: 2687953 - DNA, 14 bp, Homo sapiens
cgggcccctgcctg

SEQ ID NO: 2687954 - DNA, 16 bp, Homo sapiens
cgggcccctgcctgcc

SEQ ID NO: 2687955 - DNA, 17 bp, Homo sapiens
cgggcccctgcctgcct

SEQ ID NO: 2687956 - DNA, 13 bp, Homo sapiens
cgggcgctgcagc

SEQ ID NO: 2687957 - DNA, 20 bp, Homo sapiens
cgggctgtccgtgtgcctcc

SEQ ID NO: 2687958 - DNA, 21 bp, Homo sapiens
cgggctgtccgtgtgcctcct

SEQ ID NO: 2687959 - DNA, 22 bp, Homo sapiens
cgggctgtccgtgtgcctcctg

SEQ ID NO: 2687960 - DNA, 23 bp, Homo sapiens
cgggctgtccgtgtgcctcctgt

SEQ ID NO: 2687961 - DNA, 19 bp, Homo sapiens
ctgccagcctggcttctgg

SEQ ID NO: 2687962 - DNA, 21 bp, Homo sapiens
ctgccatggcgtgtccctctc

SEQ ID NO: 2687963 - DNA, 19 bp, Homo sapiens
ctgccatttgcaccctccg

SEQ ID NO: 2687964 - DNA, 20 bp, Homo sapiens
ctgccatttgcaccctccgc

SEQ ID NO: 2687965 - DNA, 17 bp, Homo sapiens
ctgcccacattggaccc

SEQ ID NO: 2687966 - DNA, 19 bp, Homo sapiens
ctgccccagctctggcttc

SEQ ID NO: 2687967 - DNA, 19 bp, Homo sapiens
ctgccccatcattgcacct

SEQ ID NO: 2687968 - DNA, 22 bp, Homo sapiens
ctgccccatcattgcacctgca

SEQ ID NO: 2687969 - DNA, 15 bp, Homo sapiens
ctgccccgcccagct

SEQ ID NO: 2687970 - DNA, 17 bp, Homo sapiens
ctgccccgcccagctgc

SEQ ID NO: 2687971 - DNA, 17 bp, Homo sapiens
ctgccctcccctgctcc

SEQ ID NO: 2687972 - DNA, 12 bp, Homo sapiens
ctgccctctgcc

SEQ ID NO: 2687973 - DNA, 13 bp, Homo sapiens
ctgccctgccacc

SEQ ID NO: 2687974 - DNA, 16 bp, Homo sapiens
ctgccctgccacctgt

SEQ ID NO: 2687975 - DNA, 17 bp, Homo sapiens
ctgccctgccacctgtc

SEQ ID NO: 2687976 - DNA, 13 bp, Homo sapiens
ctgccctgccact

SEQ ID NO: 2687977 - DNA, 17 bp, Homo sapiens
ctgccctgtgagagcca

SEQ ID NO: 2687978 - DNA, 13 bp, Homo sapiens
ctgcctcctcctc

SEQ ID NO: 2687979 - DNA, 15 bp, Homo sapiens
ctgcctcctcctcac

SEQ ID NO: 2687980 - DNA, 19 bp, Homo sapiens
ctgccttctcccctccacg

SEQ ID NO: 2687981 - DNA, 17 bp, Homo sapiens
ctgcgaaggggccctgg

SEQ ID NO: 2687982 - DNA, 19 bp, Homo sapiens
ctgcgccccgcctccccat

SEQ ID NO: 2687983 - DNA, 22 bp, Homo sapiens
ctgcgtcaggcacgtctcctgc

SEQ ID NO: 2687984 - DNA, 24 bp, Homo sapiens
ctgcgtcaggcacgtctcctgctg

SEQ ID NO: 2687985 - DNA, 13 bp, Homo sapiens
ctgcgtctgtgtt

SEQ ID NO: 2687986 - DNA, 12 bp, Homo sapiens
ctgctagctgtc

SEQ ID NO: 2687987 - DNA, 16 bp, Homo sapiens
ctgctcattccgaggg

SEQ ID NO: 2687988 - DNA, 13 bp, Homo sapiens
ctgctccagcagc

SEQ ID NO: 2687989 - DNA, 16 bp, Homo sapiens
ctgctccagcagcaca

SEQ ID NO: 2687990 - DNA, 19 bp, Homo sapiens
ctgctccagcagcacacct

SEQ ID NO: 2687991 - DNA, 23 bp, Homo sapiens
ctgctcccagtgggagcttcccg

SEQ ID NO: 2687992 - DNA, 15 bp, Homo sapiens
ctgctccctgctccc

SEQ ID NO: 2687993 - DNA, 19 bp, Homo sapiens
ctgctccctgctcccaggg

SEQ ID NO: 2687994 - DNA, 17 bp, Homo sapiens
ctgctcgaagaacaatg

SEQ ID NO: 2687995 - DNA, 15 bp, Homo sapiens
ctgctctatgccagg

SEQ ID NO: 2687996 - DNA, 18 bp, Homo sapiens
ctgctctatgccaggctg

SEQ ID NO: 2687997 - DNA, 22 bp, Homo sapiens
ctgctctatgccaggctgtgct

SEQ ID NO: 2687998 - DNA, 13 bp, Homo sapiens
ctgctctgaggct

SEQ ID NO: 2687999 - DNA, 18 bp, Homo sapiens
ctgctctgaggcttccag

SEQ ID NO: 2688000 - DNA, 12 bp, Homo sapiens
ctgctctgcttc

SEQ ID NO: 2688001 - DNA, 15 bp, Homo sapiens
ctgctctgcttcctc

SEQ ID NO: 2688002 - DNA, 16 bp, Homo sapiens
ctgctctgcttcctca

SEQ ID NO: 2688003 - DNA, 21 bp, Homo sapiens
ctgctctgcttcctcagggcc

SEQ ID NO: 2688004 - DNA, 21 bp, Homo sapiens
ctgctctgtagccacctcctt

SEQ ID NO: 2688005 - DNA, 16 bp, Homo sapiens
ctgctctttctctgag

SEQ ID NO: 2688006 - DNA, 18 bp, Homo sapiens
ctgctgcgtgacatgtgc

SEQ ID NO: 2688007 - DNA, 11 bp, Homo sapiens
ctgctggcctg

SEQ ID NO: 2688008 - DNA, 20 bp, Homo sapiens
ctgctgggacccacctcccc

SEQ ID NO: 2688009 - DNA, 23 bp, Homo sapiens
ctgcttatcaataaacctgtttg

SEQ ID NO: 2688010 - DNA, 13 bp, Homo sapiens
ctgcttcctgaaa

SEQ ID NO: 2688011 - DNA, 20 bp, Homo sapiens
ctgcttcctgaaagctgttg

SEQ ID NO: 2688012 - DNA, 18 bp, Homo sapiens
ctgctttccagcctgggc

SEQ ID NO: 2688013 - DNA, 19 bp, Homo sapiens
ctgctttcttctctgcctc

SEQ ID NO: 2688014 - DNA, 17 bp, Homo sapiens
ctggaaaggctcagtct

SEQ ID NO: 2688015 - DNA, 20 bp, Homo sapiens
ctggaaaggctcagtctcag

SEQ ID NO: 2688016 - DNA, 21 bp, Homo sapiens
ctggaaaggctcagtctcagg

SEQ ID NO: 2688017 - DNA, 13 bp, Homo sapiens
ctggaccccaggc

SEQ ID NO: 2688018 - DNA, 20 bp, Homo sapiens
ctggacggcattcctgctta

SEQ ID NO: 2688019 - DNA, 19 bp, Homo sapiens
ctggactgactgcagcccc

SEQ ID NO: 2688020 - DNA, 13 bp, Homo sapiens
ctggacttgagct

SEQ ID NO: 2688021 - DNA, 15 bp, Homo sapiens
ctggacttgagcttg

SEQ ID NO: 2688022 - DNA, 23 bp, Homo sapiens
ctggagaggagggatgctgcctg

SEQ ID NO: 2688023 - DNA, 18 bp, Homo sapiens
ctggagcaagctctgccc

SEQ ID NO: 2688024 - DNA, 23 bp, Homo sapiens
ctggagcaagctctgccctggct

SEQ ID NO: 2688025 - DNA, 16 bp, Homo sapiens
ctggagcatctgactc

SEQ ID NO: 2688026 - DNA, 12 bp, Homo sapiens
ctggagcccagg

SEQ ID NO: 2688027 - DNA, 14 bp, Homo sapiens
ctggaggggcccac

SEQ ID NO: 2688028 - DNA, 15 bp, Homo sapiens
ctggagtctcagagc

SEQ ID NO: 2688029 - DNA, 17 bp, Homo sapiens
ctggagtctcagagcac

SEQ ID NO: 2688030 - DNA, 20 bp, Homo sapiens
ctggattggctataacatgt

SEQ ID NO: 2688031 - DNA, 12 bp, Homo sapiens
ctggcaggagcc

SEQ ID NO: 2688032 - DNA, 22 bp, Homo sapiens
ctggcaggagcctcgtgtcctg

SEQ ID NO: 2688033 - DNA, 20 bp, Homo sapiens
ctggcaggattcttcccgct

SEQ ID NO: 2688034 - DNA, 21 bp, Homo sapiens
ctggcaggattcttcccgctc

SEQ ID NO: 2688035 - DNA, 23 bp, Homo sapiens
ctggccacctagaagtctccctg

SEQ ID NO: 2688036 - DNA, 15 bp, Homo sapiens
ctggccaggcatggc

SEQ ID NO: 2688037 - DNA, 17 bp, Homo sapiens
ctggccagtcctagagc

SEQ ID NO: 2688038 - DNA, 20 bp, Homo sapiens
ctggccagtcctagagctcc

SEQ ID NO: 2688039 - DNA, 21 bp, Homo sapiens
ctggccagtcctagagctcct

SEQ ID NO: 2688040 - DNA, 22 bp, Homo sapiens
ctggccagtcctagagctcctg

SEQ ID NO: 2688041 - DNA, 11 bp, Homo sapiens
ctggccctgcc

SEQ ID NO: 2688042 - DNA, 16 bp, Homo sapiens
ctggccttcgtctcca

SEQ ID NO: 2688043 - DNA, 14 bp, Homo sapiens
ctggctctgaagcc

SEQ ID NO: 2688044 - DNA, 20 bp, Homo sapiens
ctggctgctccctgctccca

SEQ ID NO: 2688045 - DNA, 20 bp, Homo sapiens
ctggctggagtctcagagca

SEQ ID NO: 2688046 - DNA, 22 bp, Homo sapiens
ctggctggagtctcagagcaca

SEQ ID NO: 2688047 - DNA, 15 bp, Homo sapiens
ctggctggctgcagt

SEQ ID NO: 2688048 - DNA, 17 bp, Homo sapiens
ctggctggctgcagtga

SEQ ID NO: 2688049 - DNA, 15 bp, Homo sapiens
ctggctgggcatgga

SEQ ID NO: 2688050 - DNA, 22 bp, Homo sapiens
ctggctgtgggtatcaggactg

SEQ ID NO: 2688051 - DNA, 15 bp, Homo sapiens
ctggcttatgctcag

SEQ ID NO: 2688052 - DNA, 21 bp, Homo sapiens
ctggcttatgctcagaagcca

SEQ ID NO: 2688053 - DNA, 16 bp, Homo sapiens
ctggcttctggagccc

SEQ ID NO: 2688054 - DNA, 16 bp, Homo sapiens
ctgggaacctccttac

SEQ ID NO: 2688055 - DNA, 17 bp, Homo sapiens
ctgggaaggggaacaca

SEQ ID NO: 2688056 - DNA, 16 bp, Homo sapiens
ctgggagaacctcagg

SEQ ID NO: 2688057 - DNA, 18 bp, Homo sapiens
ctgggagaacctcaggct

SEQ ID NO: 2688058 - DNA, 15 bp, Homo sapiens
ctgggaggaagcagg

SEQ ID NO: 2688059 - DNA, 17 bp, Homo sapiens
ctgggaggcagaacagg

SEQ ID NO: 2688060 - DNA, 23 bp, Homo sapiens
ctgggatgatgtgtgaaacctga

SEQ ID NO: 2688061 - DNA, 15 bp, Homo sapiens
ctgggccaagttcct

SEQ ID NO: 2688062 - DNA, 20 bp, Homo sapiens
ctgggccaagttcctctagt

SEQ ID NO: 2688063 - DNA, 15 bp, Homo sapiens
ctgggccaggtctcc

SEQ ID NO: 2688064 - DNA, 16 bp, Homo sapiens
ctgggccaggtctccg

SEQ ID NO: 2688065 - DNA, 24 bp, Homo sapiens
ctgggccccaaacgggctgccctg

SEQ ID NO: 2688066 - DNA, 13 bp, Homo sapiens
ctgggctctgccc

SEQ ID NO: 2688067 - DNA, 22 bp, Homo sapiens
ctggggagggtcaagggctggg

SEQ ID NO: 2688068 - DNA, 23 bp, Homo sapiens
ctggggagggtcaagggctgggg

SEQ ID NO: 2688069 - DNA, 14 bp, Homo sapiens
ctggggcaagtccc

SEQ ID NO: 2688070 - DNA, 16 bp, Homo sapiens
ctggggcccgcctgcc

SEQ ID NO: 2688071 - DNA, 17 bp, Homo sapiens
ctggggcccgcctgcca

SEQ ID NO: 2688072 - DNA, 18 bp, Homo sapiens
ctggggcccgcctgccac

SEQ ID NO: 2688073 - DNA, 20 bp, Homo sapiens
ctggggcccgcctgccacct

SEQ ID NO: 2688074 - DNA, 17 bp, Homo sapiens
ctggggctctgtgcagg

SEQ ID NO: 2688075 - DNA, 19 bp, Homo sapiens
ctgggggcatcctgcttcc

SEQ ID NO: 2688076 - DNA, 21 bp, Homo sapiens
ctgggggcatcctgcttcctg

SEQ ID NO: 2688077 - DNA, 19 bp, Homo sapiens
ctggggttcaagcccaggc

SEQ ID NO: 2688078 - DNA, 23 bp, Homo sapiens
ctgggtcgggacagaccagcagc

SEQ ID NO: 2688079 - DNA, 14 bp, Homo sapiens
ctgggtgcctcctc

SEQ ID NO: 2688080 - DNA, 16 bp, Homo sapiens
ctgggtgcctcctccc

SEQ ID NO: 2688081 - DNA, 18 bp, Homo sapiens
ctgggtggaagtgcccag

SEQ ID NO: 2688082 - DNA, 19 bp, Homo sapiens
ctgggtggaagtgcccagc

SEQ ID NO: 2688083 - DNA, 21 bp, Homo sapiens
ctgggtggaagtgcccagccc

SEQ ID NO: 2688084 - DNA, 12 bp, Homo sapiens
ctggtccctgcc

SEQ ID NO: 2688085 - DNA, 17 bp, Homo sapiens
ctggtctattttgattt

SEQ ID NO: 2688086 - DNA, 16 bp, Homo sapiens
ctggtgcactggcccc

SEQ ID NO: 2688087 - DNA, 15 bp, Homo sapiens
ctggtggacagtcct

SEQ ID NO: 2688088 - DNA, 17 bp, Homo sapiens
ctggtgggtcagcccag

SEQ ID NO: 2688089 - DNA, 14 bp, Homo sapiens
ctggtttctgtgtg

SEQ ID NO: 2688090 - DNA, 15 bp, Homo sapiens
ctggtttctgtgtgt

SEQ ID NO: 2688091 - DNA, 17 bp, Homo sapiens
ctgtaacacaagccaca

SEQ ID NO: 2688092 - DNA, 18 bp, Homo sapiens
ctgtaacacaagccacag

SEQ ID NO: 2688093 - DNA, 21 bp, Homo sapiens
ctgtaacacaagccacagaag

SEQ ID NO: 2688094 - DNA, 17 bp, Homo sapiens
ctgtaatcggctcccgc

SEQ ID NO: 2688095 - DNA, 13 bp, Homo sapiens
ctgtactcaggag

SEQ ID NO: 2688096 - DNA, 13 bp, Homo sapiens
ctgtagccacctc

SEQ ID NO: 2688097 - DNA, 17 bp, Homo sapiens
ctgtcagaatcatgctg

SEQ ID NO: 2688098 - DNA, 20 bp, Homo sapiens
ctgtcattgcccctccgatg

SEQ ID NO: 2688099 - DNA, 13 bp, Homo sapiens
ctgtcccacctct

SEQ ID NO: 2688100 - DNA, 14 bp, Homo sapiens
ctgtcccacctctt

SEQ ID NO: 2688101 - DNA, 12 bp, Homo sapiens
ctgtccctaccc

SEQ ID NO: 2688102 - DNA, 13 bp, Homo sapiens
ctgtccctaccca

SEQ ID NO: 2688103 - DNA, 22 bp, Homo sapiens
ctgtccctacccactctttgct

SEQ ID NO: 2688104 - DNA, 23 bp, Homo sapiens
ctgtccctacccactctttgcta

SEQ ID NO: 2688105 - DNA, 23 bp, Homo sapiens
ctgtccctcaaatgacccaaaga

SEQ ID NO: 2688106 - DNA, 14 bp, Homo sapiens
ctgtccgtgtgcct

SEQ ID NO: 2688107 - DNA, 17 bp, Homo sapiens
ctgtccgtgtgcctcct

SEQ ID NO: 2688108 - DNA, 17 bp, Homo sapiens
ctgtcctctctgttgcc

SEQ ID NO: 2688109 - DNA, 14 bp, Homo sapiens
ctgtctgtctgtcc

SEQ ID NO: 2688110 - DNA, 14 bp, Homo sapiens
ctgtctgtctgtct

SEQ ID NO: 2688111 - DNA, 21 bp, Homo sapiens
ctgtctttgttgtctccctct

SEQ ID NO: 2688112 - DNA, 14 bp, Homo sapiens
ctgtgaccaaagca

SEQ ID NO: 2688113 - DNA, 13 bp, Homo sapiens
ctgtgaccctggg

SEQ ID NO: 2688114 - DNA, 15 bp, Homo sapiens
ctgtgaccgccctcc

SEQ ID NO: 2688115 - DNA, 14 bp, Homo sapiens
ctgtgatattttac

SEQ ID NO: 2688116 - DNA, 17 bp, Homo sapiens
ctgtgctcttcctctgg

SEQ ID NO: 2688117 - DNA, 19 bp, Homo sapiens
ctgtgctcttcctctggtt

SEQ ID NO: 2688118 - DNA, 21 bp, Homo sapiens
ctgtgctttgactcacctgtt

SEQ ID NO: 2688119 - DNA, 14 bp, Homo sapiens
ctgtggcctgggca

SEQ ID NO: 2688120 - DNA, 19 bp, Homo sapiens
ctgtggggccttggttccc

SEQ ID NO: 2688121 - DNA, 23 bp, Homo sapiens
ctgtgtcccccccagtgcaggga

SEQ ID NO: 2688122 - DNA, 18 bp, Homo sapiens
ctgttacttgaaatacca

SEQ ID NO: 2688123 - DNA, 21 bp, Homo sapiens
ctgttgatgaggcctcttgga

SEQ ID NO: 2688124 - DNA, 18 bp, Homo sapiens
ctgttggacccgctctgg

SEQ ID NO: 2688125 - DNA, 19 bp, Homo sapiens
ctgttggacccgctctgga

SEQ ID NO: 2688126 - DNA, 20 bp, Homo sapiens
ctgttggacccgctctggac

SEQ ID NO: 2688127 - DNA, 19 bp, Homo sapiens
ctgtttaaaaaaagtatat

SEQ ID NO: 2688128 - DNA, 19 bp, Homo sapiens
cttagaaatcattgtagaa

SEQ ID NO: 2688129 - DNA, 16 bp, Homo sapiens
cttagattagctctgg

SEQ ID NO: 2688130 - DNA, 18 bp, Homo sapiens
cttagattagctctggac

SEQ ID NO: 2688131 - DNA, 21 bp, Homo sapiens
cttatgctagtttattggaag

SEQ ID NO: 2688132 - DNA, 20 bp, Homo sapiens
cttcaagtgttgctcttgga

SEQ ID NO: 2688133 - DNA, 18 bp, Homo sapiens
cttcaagttagctcagga

SEQ ID NO: 2688134 - DNA, 15 bp, Homo sapiens
cttcacagaggaaga

SEQ ID NO: 2688135 - DNA, 18 bp, Homo sapiens
cttcacccggctgggctc

SEQ ID NO: 2688136 - DNA, 24 bp, Homo sapiens
cttcactccggtgtgcctgcagcc

SEQ ID NO: 2688137 - DNA, 14 bp, Homo sapiens
cttcagcctgaggc

SEQ ID NO: 2688138 - DNA, 16 bp, Homo sapiens
cttcagcctgaggctg

SEQ ID NO: 2688139 - DNA, 20 bp, Homo sapiens
cttcagcctgaggctgagac

SEQ ID NO: 2688140 - DNA, 22 bp, Homo sapiens
cttcagcctgaggctgagactg

SEQ ID NO: 2688141 - DNA, 13 bp, Homo sapiens
cttccaaccccag

SEQ ID NO: 2688142 - DNA, 15 bp, Homo sapiens
cttccaaccccagct

SEQ ID NO: 2688143 - DNA, 18 bp, Homo sapiens
cttccaaccccagctggc

SEQ ID NO: 2688144 - DNA, 20 bp, Homo sapiens
cttccagagagtcctctgga

SEQ ID NO: 2688145 - DNA, 21 bp, Homo sapiens
cttccagagagtcctctggat

SEQ ID NO: 2688146 - DNA, 19 bp, Homo sapiens
cttccaggcccccaccact

SEQ ID NO: 2688147 - DNA, 17 bp, Homo sapiens
cttccatgccccaggat

SEQ ID NO: 2688148 - DNA, 19 bp, Homo sapiens
cttccatgccccaggatca

SEQ ID NO: 2688149 - DNA, 15 bp, Homo sapiens
cttcccagaggcaga

SEQ ID NO: 2688150 - DNA, 16 bp, Homo sapiens
cttccccctcccaggg

SEQ ID NO: 2688151 - DNA, 19 bp, Homo sapiens
cttcccctttactcagccc

SEQ ID NO: 2688152 - DNA, 23 bp, Homo sapiens
cttcccctttactcagcccagct

SEQ ID NO: 2688153 - DNA, 21 bp, Homo sapiens
cttcccgggataaactgagcc

SEQ ID NO: 2688154 - DNA, 16 bp, Homo sapiens
cttccctccctgaggc

SEQ ID NO: 2688155 - DNA, 13 bp, Homo sapiens
cttcctctggttt

SEQ ID NO: 2688156 - DNA, 17 bp, Homo sapiens
cttcctctggtttctgt

SEQ ID NO: 2688157 - DNA, 20 bp, Homo sapiens
cttcctctggtttctgtgtg

SEQ ID NO: 2688158 - DNA, 21 bp, Homo sapiens
cttcctctggtttctgtgtgt

SEQ ID NO: 2688159 - DNA, 19 bp, Homo sapiens
cttcctgggatgatgtgtg

SEQ ID NO: 2688160 - DNA, 18 bp, Homo sapiens
cttcctgggtcctgcctg

SEQ ID NO: 2688161 - DNA, 23 bp, Homo sapiens
cttcctgggtcctgcctggtcct

SEQ ID NO: 2688162 - DNA, 17 bp, Homo sapiens
cttccttgcccctgctc

SEQ ID NO: 2688163 - DNA, 19 bp, Homo sapiens
cttccttgcccctgctctg

SEQ ID NO: 2688164 - DNA, 20 bp, Homo sapiens
cttccttgctgtcctaggcc

SEQ ID NO: 2688165 - DNA, 17 bp, Homo sapiens
cttcctttcaggccaag

SEQ ID NO: 2688166 - DNA, 21 bp, Homo sapiens
cttctagctttgttgtcctcc

SEQ ID NO: 2688167 - DNA, 22 bp, Homo sapiens
cttctagctttgttgtcctccc

SEQ ID NO: 2688168 - DNA, 16 bp, Homo sapiens
cttctcagtgtctgaa

SEQ ID NO: 2688169 - DNA, 14 bp, Homo sapiens
cttctctctttcta

SEQ ID NO: 2688170 - DNA, 15 bp, Homo sapiens
cttctctctttctaa

SEQ ID NO: 2688171 - DNA, 12 bp, Homo sapiens
cttctctgcctc

SEQ ID NO: 2688172 - DNA, 15 bp, Homo sapiens
cttctctgcctcctc

SEQ ID NO: 2688173 - DNA, 13 bp, Homo sapiens
cttctcttcctgt

SEQ ID NO: 2688174 - DNA, 18 bp, Homo sapiens
cttctgcccttcctccag

SEQ ID NO: 2688175 - DNA, 19 bp, Homo sapiens
cttctgcccttcctccagg

SEQ ID NO: 2688176 - DNA, 20 bp, Homo sapiens
cttctgcccttcctccagga

SEQ ID NO: 2688177 - DNA, 22 bp, Homo sapiens
cttctgcccttcctccaggaga

SEQ ID NO: 2688178 - DNA, 11 bp, Homo sapiens
cttctggagcc

SEQ ID NO: 2688179 - DNA, 13 bp, Homo sapiens
cttctggagccct

SEQ ID NO: 2688180 - DNA, 16 bp, Homo sapiens
cttctggagtctccag

SEQ ID NO: 2688181 - DNA, 16 bp, Homo sapiens
gcagcctccctctgac

SEQ ID NO: 2688182 - DNA, 22 bp, Homo sapiens
gcagcctccctctgacctgcag

SEQ ID NO: 2688183 - DNA, 14 bp, Homo sapiens
gcaggaactgagcc

SEQ ID NO: 2688184 - DNA, 16 bp, Homo sapiens
gcaggaactgagccag

SEQ ID NO: 2688185 - DNA, 24 bp, Homo sapiens
gcaggagcctcgtgtcctgctagc

SEQ ID NO: 2688186 - DNA, 18 bp, Homo sapiens
gcaggaggccccaggctg

SEQ ID NO: 2688187 - DNA, 15 bp, Homo sapiens
gcaggattcttcccg

SEQ ID NO: 2688188 - DNA, 22 bp, Homo sapiens
gcaggattcttcccgctcccca

SEQ ID NO: 2688189 - DNA, 20 bp, Homo sapiens
gcaggccaagagcagaggca

SEQ ID NO: 2688190 - DNA, 24 bp, Homo sapiens
gcaggccaagagcagaggcagcga

SEQ ID NO: 2688191 - DNA, 14 bp, Homo sapiens
gcagggctgggcca

SEQ ID NO: 2688192 - DNA, 14 bp, Homo sapiens
gcaggtgagaaccc

SEQ ID NO: 2688193 - DNA, 17 bp, Homo sapiens
gcaggtggcatctctaa

SEQ ID NO: 2688194 - DNA, 16 bp, Homo sapiens
gcaggttgaggggctc

SEQ ID NO: 2688195 - DNA, 19 bp, Homo sapiens
gcaggttgaggggctcctg

SEQ ID NO: 2688196 - DNA, 16 bp, Homo sapiens
gcagtctggcctgggc

SEQ ID NO: 2688197 - DNA, 16 bp, Homo sapiens
gcagtgaaaaatatgt

SEQ ID NO: 2688198 - DNA, 18 bp, Homo sapiens
gcagtgacgtgcacctgt

SEQ ID NO: 2688199 - DNA, 16 bp, Homo sapiens
gcatcacagggcagag

SEQ ID NO: 2688200 - DNA, 22 bp, Homo sapiens
gcatcacagggcagagccggga

SEQ ID NO: 2688201 - DNA, 14 bp, Homo sapiens
gcatcacctcaggc

SEQ ID NO: 2688202 - DNA, 15 bp, Homo sapiens
gcatcacctcaggcc

SEQ ID NO: 2688203 - DNA, 11 bp, Homo sapiens
gcatcctgaaa

SEQ ID NO: 2688204 - DNA, 16 bp, Homo sapiens
gcatcctgaaagccag

SEQ ID NO: 2688205 - DNA, 17 bp, Homo sapiens
gcatcctgaaagccagc

SEQ ID NO: 2688206 - DNA, 20 bp, Homo sapiens
gcatccttttctgcagaggg

SEQ ID NO: 2688207 - DNA, 13 bp, Homo sapiens
gcatctagccaga

SEQ ID NO: 2688208 - DNA, 17 bp, Homo sapiens
gcatctgactcacaaga

SEQ ID NO: 2688209 - DNA, 19 bp, Homo sapiens
gcatctgactcacaagaag

SEQ ID NO: 2688210 - DNA, 20 bp, Homo sapiens
gcatcttctggagtctccag

SEQ ID NO: 2688211 - DNA, 23 bp, Homo sapiens
gcatcttctggagtctccagtgg

SEQ ID NO: 2688212 - DNA, 20 bp, Homo sapiens
gcatcttttccatcctgagg

SEQ ID NO: 2688213 - DNA, 16 bp, Homo sapiens
gcatgctggggcaagt

SEQ ID NO: 2688214 - DNA, 19 bp, Homo sapiens
gcatggagagcctcttagt

SEQ ID NO: 2688215 - DNA, 17 bp, Homo sapiens
gcattgttattgtggaa

SEQ ID NO: 2688216 - DNA, 14 bp, Homo sapiens
gccaaagcacagct

SEQ ID NO: 2688217 - DNA, 13 bp, Homo sapiens
gccaaagctgctt

SEQ ID NO: 2688218 - DNA, 17 bp, Homo sapiens
gccaagctcacacagca

SEQ ID NO: 2688219 - DNA, 21 bp, Homo sapiens
gccaaggtgggctgagccctg

SEQ ID NO: 2688220 - DNA, 21 bp, Homo sapiens
gccaagttcctctagtgccct

SEQ ID NO: 2688221 - DNA, 22 bp, Homo sapiens
gccaatgttgctgatggcccct

SEQ ID NO: 2688222 - DNA, 14 bp, Homo sapiens
gccacagaagccag

SEQ ID NO: 2688223 - DNA, 17 bp, Homo sapiens
gccacatgccgcgtccc

SEQ ID NO: 2688224 - DNA, 20 bp, Homo sapiens
gccacctctcccagccctca

SEQ ID NO: 2688225 - DNA, 14 bp, Homo sapiens
gccacgctggcctt

SEQ ID NO: 2688226 - DNA, 14 bp, Homo sapiens
gccacgtgaatggc

SEQ ID NO: 2688227 - DNA, 17 bp, Homo sapiens
gccactacactccagcc

SEQ ID NO: 2688228 - DNA, 15 bp, Homo sapiens
gccactgaagctggg

SEQ ID NO: 2688229 - DNA, 17 bp, Homo sapiens
gccactgaagctgggat

SEQ ID NO: 2688230 - DNA, 18 bp, Homo sapiens
gccactgcactccagcct

SEQ ID NO: 2688231 - DNA, 23 bp, Homo sapiens
gccactttggtacatggccagtg

SEQ ID NO: 2688232 - DNA, 15 bp, Homo sapiens
gccagatgcctcccc

SEQ ID NO: 2688233 - DNA, 17 bp, Homo sapiens
gccagatgcctccccaa

SEQ ID NO: 2688234 - DNA, 18 bp, Homo sapiens
gccagatgcctccccaag

SEQ ID NO: 2688235 - DNA, 18 bp, Homo sapiens
gccagcctggcttctgga

SEQ ID NO: 2688236 - DNA, 19 bp, Homo sapiens
gccagcctggcttctggag

SEQ ID NO: 2688237 - DNA, 15 bp, Homo sapiens
gccaggagcaaatgt

SEQ ID NO: 2688238 - DNA, 13 bp, Homo sapiens
gccagggccctgc

SEQ ID NO: 2688239 - DNA, 19 bp, Homo sapiens
gccagggccctgcagaggg

SEQ ID NO: 2688240 - DNA, 22 bp, Homo sapiens
gccaggttagcctttgccctgt

SEQ ID NO: 2688241 - DNA, 15 bp, Homo sapiens
gccagtcctagagct

SEQ ID NO: 2688242 - DNA, 19 bp, Homo sapiens
gccagtcctagagctcctg

SEQ ID NO: 2688243 - DNA, 22 bp, Homo sapiens
gccagtcctagagctcctgtcc

SEQ ID NO: 2688244 - DNA, 20 bp, Homo sapiens
gccagtctgcgtcaggcacg

SEQ ID NO: 2688245 - DNA, 13 bp, Homo sapiens
gccagtgactttt

SEQ ID NO: 2688246 - DNA, 19 bp, Homo sapiens
gccagtgactttttctgag

SEQ ID NO: 2688247 - DNA, 20 bp, Homo sapiens
gccagtgtgatcccaagtgc

SEQ ID NO: 2688248 - DNA, 23 bp, Homo sapiens
gccagttctggggcccgcctgcc

SEQ ID NO: 2688249 - DNA, 16 bp, Homo sapiens
gccatggcgtgtccct

SEQ ID NO: 2688250 - DNA, 17 bp, Homo sapiens
gccatggcgtgtccctc

SEQ ID NO: 2688251 - DNA, 22 bp, Homo sapiens
gccatggcgtgtccctctcgga

SEQ ID NO: 2688252 - DNA, 15 bp, Homo sapiens
gccatgtcttgttca

SEQ ID NO: 2688253 - DNA, 16 bp, Homo sapiens
gccattaccatggaga

SEQ ID NO: 2688254 - DNA, 18 bp, Homo sapiens
gccattaccatggagaca

SEQ ID NO: 2688255 - DNA, 20 bp, Homo sapiens
gccatttgcaccctccgcct

SEQ ID NO: 2688256 - DNA, 13 bp, Homo sapiens
gcccagagggccc

SEQ ID NO: 2688257 - DNA, 15 bp, Homo sapiens
gcccagagggcccag

SEQ ID NO: 2688258 - DNA, 20 bp, Homo sapiens
gcccagagggcccaggcagg

SEQ ID NO: 2688259 - DNA, 17 bp, Homo sapiens
gcccagcacctgctccc

SEQ ID NO: 2688260 - DNA, 18 bp, Homo sapiens
gcccagcacctgctccca

SEQ ID NO: 2688261 - DNA, 22 bp, Homo sapiens
gcccagcacctgctcccagtgg

SEQ ID NO: 2688262 - DNA, 14 bp, Homo sapiens
gcccagcccctgcc

SEQ ID NO: 2688263 - DNA, 15 bp, Homo sapiens
gcccagcccctgccc

SEQ ID NO: 2688264 - DNA, 13 bp, Homo sapiens
gcccagctgcacc

SEQ ID NO: 2688265 - DNA, 18 bp, Homo sapiens
gcccagctgcacctgcca

SEQ ID NO: 2688266 - DNA, 23 bp, Homo sapiens
gcccagctgcacctgccagcctg

SEQ ID NO: 2688267 - DNA, 24 bp, Homo sapiens
gcccagctgcacctgccagcctgg

SEQ ID NO: 2688268 - DNA, 14 bp, Homo sapiens
gcccaggcaggcca

SEQ ID NO: 2688269 - DNA, 22 bp, Homo sapiens
gccccaccctcgtggacacctg

SEQ ID NO: 2688270 - DNA, 19 bp, Homo sapiens
gccccaggatcactctctg

SEQ ID NO: 2688271 - DNA, 17 bp, Homo sapiens
gccccaggctgagagcc

SEQ ID NO: 2688272 - DNA, 19 bp, Homo sapiens
gccccaggctgagagccag

SEQ ID NO: 2688273 - DNA, 21 bp, Homo sapiens
gccccaggtgccaccaataaa

SEQ ID NO: 2688274 - DNA, 22 bp, Homo sapiens
gccccatcattgcacctgcagg

SEQ ID NO: 2688275 - DNA, 23 bp, Homo sapiens
gccccatcattgcacctgcaggc

SEQ ID NO: 2688276 - DNA, 18 bp, Homo sapiens
gcccccgtggggctcccg

SEQ ID NO: 2688277 - DNA, 23 bp, Homo sapiens
gccccctggtggacagtcctggg

SEQ ID NO: 2688278 - DNA, 17 bp, Homo sapiens
gcccctacgggcgctgc

SEQ ID NO: 2688279 - DNA, 20 bp, Homo sapiens
gcccctacgggcgctgcagc

SEQ ID NO: 2688280 - DNA, 12 bp, Homo sapiens
gcccctccagca

SEQ ID NO: 2688281 - DNA, 15 bp, Homo sapiens
gcccctccagcacac

SEQ ID NO: 2688282 - DNA, 15 bp, Homo sapiens
gcccctccgatgctg

SEQ ID NO: 2688283 - DNA, 11 bp, Homo sapiens
gcccctgctct

SEQ ID NO: 2688284 - DNA, 12 bp, Homo sapiens
gcccgcctgcca

SEQ ID NO: 2688285 - DNA, 16 bp, Homo sapiens
gcccggattctgggag

SEQ ID NO: 2688286 - DNA, 17 bp, Homo sapiens
gcccggattctgggagg

SEQ ID NO: 2688287 - DNA, 20 bp, Homo sapiens
gccctccacagccgcagcct

SEQ ID NO: 2688288 - DNA, 23 bp, Homo sapiens
gccctccacagccgcagcctccc

SEQ ID NO: 2688289 - DNA, 12 bp, Homo sapiens
gccctccaggcc

SEQ ID NO: 2688290 - DNA, 17 bp, Homo sapiens
ggcctgccctctgcccc

SEQ ID NO: 2688291 - DNA, 18 bp, Homo sapiens
ggcctgccttgaagccac

SEQ ID NO: 2688292 - DNA, 23 bp, Homo sapiens
ggcgacagagcgagagtctgtct

SEQ ID NO: 2688293 - DNA, 14 bp, Homo sapiens
ggcgcagagccctc

SEQ ID NO: 2688294 - DNA, 15 bp, Homo sapiens
ggcgcagagccctcc

SEQ ID NO: 2688295 - DNA, 16 bp, Homo sapiens
ggcgcagagccctcca

SEQ ID NO: 2688296 - DNA, 17 bp, Homo sapiens
ggcgcagagccctccag

SEQ ID NO: 2688297 - DNA, 23 bp, Homo sapiens
ggcggcgtgggcgaggcctgaca

SEQ ID NO: 2688298 - DNA, 20 bp, Homo sapiens
ggcgggtggatcatgaggtc

SEQ ID NO: 2688299 - DNA, 23 bp, Homo sapiens
ggcgtgggcgaggcctgacacag

SEQ ID NO: 2688300 - DNA, 16 bp, Homo sapiens
ggctaagcatggcctg

SEQ ID NO: 2688301 - DNA, 15 bp, Homo sapiens
ggctacttgctttga

SEQ ID NO: 2688302 - DNA, 21 bp, Homo sapiens
ggctatgaagggacagctgct

SEQ ID NO: 2688303 - DNA, 13 bp, Homo sapiens
ggctatttgttca

SEQ ID NO: 2688304 - DNA, 14 bp, Homo sapiens
ggctcccgcttgct

SEQ ID NO: 2688305 - DNA, 20 bp, Homo sapiens
ggctcccgcttgctctcctg

SEQ ID NO: 2688306 - DNA, 16 bp, Homo sapiens
ggctcccggcatcctg

SEQ ID NO: 2688307 - DNA, 18 bp, Homo sapiens
ggctcccggcatcctgaa

SEQ ID NO: 2688308 - DNA, 18 bp, Homo sapiens
ggctcctccatggtgctg

SEQ ID NO: 2688309 - DNA, 12 bp, Homo sapiens
ggctctgcccca

SEQ ID NO: 2688310 - DNA, 14 bp, Homo sapiens
ggctctgccccagc

SEQ ID NO: 2688311 - DNA, 21 bp, Homo sapiens
ggctctgccccagctctggct

SEQ ID NO: 2688312 - DNA, 23 bp, Homo sapiens
ggctctgccccagctctggcttc

SEQ ID NO: 2688313 - DNA, 12 bp, Homo sapiens
ggctgagccctg

SEQ ID NO: 2688314 - DNA, 22 bp, Homo sapiens
ggctgcagtgacgtgcacctgt

SEQ ID NO: 2688315 - DNA, 13 bp, Homo sapiens
ggctgccctgcca

SEQ ID NO: 2688316 - DNA, 14 bp, Homo sapiens
ggctgctccctgct

SEQ ID NO: 2688317 - DNA, 15 bp, Homo sapiens
ggctgctccctgctc

SEQ ID NO: 2688318 - DNA, 21 bp, Homo sapiens
ggctgctccctgctcccaggg

SEQ ID NO: 2688319 - DNA, 12 bp, Homo sapiens
ggctgctggcct

SEQ ID NO: 2688320 - DNA, 21 bp, Homo sapiens
ggctggagtctcagagcacag

SEQ ID NO: 2688321 - DNA, 20 bp, Homo sapiens
ggctggagtgcagtggtgcg

SEQ ID NO: 2688322 - DNA, 13 bp, Homo sapiens
ggctggctgggca

SEQ ID NO: 2688323 - DNA, 23 bp, Homo sapiens
ggctgggaaggggaacacagacc

SEQ ID NO: 2688324 - DNA, 15 bp, Homo sapiens
ggctgggccaggtct

SEQ ID NO: 2688325 - DNA, 16 bp, Homo sapiens
ggctgggctcctcatt

SEQ ID NO: 2688326 - DNA, 13 bp, Homo sapiens
ggctgtccgtgtg

SEQ ID NO: 2688327 - DNA, 16 bp, Homo sapiens
ggctgtccgtgtgcct

SEQ ID NO: 2688328 - DNA, 21 bp, Homo sapiens
ggctgtccgtgtgcctcctgt

SEQ ID NO: 2688329 - DNA, 16 bp, Homo sapiens
ggctgtgctcttcctc

SEQ ID NO: 2688330 - DNA, 14 bp, Homo sapiens
ggcttaaaaaaaac

SEQ ID NO: 2688331 - DNA, 19 bp, Homo sapiens
ggcttatgctcagaagcca

SEQ ID NO: 2688332 - DNA, 21 bp, Homo sapiens
ggcttccagaaaaccccagca

SEQ ID NO: 2688333 - DNA, 14 bp, Homo sapiens
ggcttccagagagt

SEQ ID NO: 2688334 - DNA, 20 bp, Homo sapiens
ggcttccagagagtcctctg

SEQ ID NO: 2688335 - DNA, 21 bp, Homo sapiens
ggcttcctgggtcctgcctgg

SEQ ID NO: 2688336 - DNA, 18 bp, Homo sapiens
ggcttctggagcccttgg

SEQ ID NO: 2688337 - DNA, 18 bp, Homo sapiens
ggcttgcttgccgagcct

SEQ ID NO: 2688338 - DNA, 14 bp, Homo sapiens
ggctttctggagag

SEQ ID NO: 2688339 - DNA, 21 bp, Homo sapiens
gggaaaaaagttttgatgaaa

SEQ ID NO: 2688340 - DNA, 23 bp, Homo sapiens
gggaagcggaggttgcagggagc

SEQ ID NO: 2688341 - DNA, 14 bp, Homo sapiens
gggacagaccagca

SEQ ID NO: 2688342 - DNA, 15 bp, Homo sapiens
gggacagctgctggg

SEQ ID NO: 2688343 - DNA, 17 bp, Homo sapiens
gggaccagtcccacacc

SEQ ID NO: 2688344 - DNA, 18 bp, Homo sapiens
gggaccccctggccctgc

SEQ ID NO: 2688345 - DNA, 23 bp, Homo sapiens
gggaggaagcaggttgaggggct

SEQ ID NO: 2688346 - DNA, 17 bp, Homo sapiens
gggaggatcactggagc

SEQ ID NO: 2688347 - DNA, 23 bp, Homo sapiens
gggaggatcactggagcccagga

SEQ ID NO: 2688348 - DNA, 17 bp, Homo sapiens
gggaggctgaggcagga

SEQ ID NO: 2688349 - DNA, 18 bp, Homo sapiens
gggaggtgagaccacctc

SEQ ID NO: 2688350 - DNA, 16 bp, Homo sapiens
gggatcatctctgtga

SEQ ID NO: 2688351 - DNA, 17 bp, Homo sapiens
gggatcccaggccaggg

SEQ ID NO: 2688352 - DNA, 16 bp, Homo sapiens
gggatggtcctggggc

SEQ ID NO: 2688353 - DNA, 12 bp, Homo sapiens
gggatgtagaac

SEQ ID NO: 2688354 - DNA, 24 bp, Homo sapiens
gggcaagtccctgactctctgtga

SEQ ID NO: 2688355 - DNA, 14 bp, Homo sapiens
gggcagagccggga

SEQ ID NO: 2688356 - DNA, 11 bp, Homo sapiens
gggcagctcct

SEQ ID NO: 2688357 - DNA, 13 bp, Homo sapiens
gggcagctcctga

SEQ ID NO: 2688358 - DNA, 20 bp, Homo sapiens
gggcagctcctgaccaaaga

SEQ ID NO: 2688359 - DNA, 11 bp, Homo sapiens
gggcatcctgc

SEQ ID NO: 2688360 - DNA, 12 bp, Homo sapiens
gggcatcctgct

SEQ ID NO: 2688361 - DNA, 13 bp, Homo sapiens
gggcatcctgctt

SEQ ID NO: 2688362 - DNA, 14 bp, Homo sapiens
gggcatcctgcttc

SEQ ID NO: 2688363 - DNA, 18 bp, Homo sapiens
gggcatcctgcttcctga

SEQ ID NO: 2688364 - DNA, 19 bp, Homo sapiens
gggcatcctgcttcctgaa

SEQ ID NO: 2688365 - DNA, 22 bp, Homo sapiens
gggcatcctgcttcctgaaagc

SEQ ID NO: 2688366 - DNA, 16 bp, Homo sapiens
gggccagggccctgca

SEQ ID NO: 2688367 - DNA, 14 bp, Homo sapiens
gggcccacccacat

SEQ ID NO: 2688368 - DNA, 22 bp, Homo sapiens
gggccccaaacgggctgccctg

SEQ ID NO: 2688369 - DNA, 17 bp, Homo sapiens
gggcccgcctgccacct

SEQ ID NO: 2688370 - DNA, 19 bp, Homo sapiens
gggcccgcctgccacctct

SEQ ID NO: 2688371 - DNA, 16 bp, Homo sapiens
gggcgctgcagcctcc

SEQ ID NO: 2688372 - DNA, 18 bp, Homo sapiens
gggcgctgcagcctccct

SEQ ID NO: 2688373 - DNA, 21 bp, Homo sapiens
gggcgctgcagcctcccttcc

SEQ ID NO: 2688374 - DNA, 12 bp, Homo sapiens
gggctcctccat

SEQ ID NO: 2688375 - DNA, 11 bp, Homo sapiens
gggctcctgga

SEQ ID NO: 2688376 - DNA, 23 bp, Homo sapiens
gggctcctggaaaggctcagtct

SEQ ID NO: 2688377 - DNA, 11 bp, Homo sapiens
gggctctgccc

SEQ ID NO: 2688378 - DNA, 19 bp, Homo sapiens
gggctctgccccagctctg

SEQ ID NO: 2688379 - DNA, 20 bp, Homo sapiens
gggctctgccccagctctgg

SEQ ID NO: 2688380 - DNA, 16 bp, Homo sapiens
gggctgagccctggca

SEQ ID NO: 2688381 - DNA, 13 bp, Homo sapiens
gggctggctctga

SEQ ID NO: 2688382 - DNA, 12 bp, Homo sapiens
gggctgggccag

SEQ ID NO: 2688383 - DNA, 16 bp, Homo sapiens
gggctgggccaggtct

SEQ ID NO: 2688384 - DNA, 18 bp, Homo sapiens
gggctgggccaggtctcc

SEQ ID NO: 2688385 - DNA, 20 bp, Homo sapiens
gggctgtccgtgtgcctcct

SEQ ID NO: 2688386 - DNA, 14 bp, Homo sapiens
gggctttctggaga

SEQ ID NO: 2688387 - DNA, 18 bp, Homo sapiens
ggggaatgtgtcctcctg

SEQ ID NO: 2688388 - DNA, 13 bp, Homo sapiens
ggggcagctcctg

SEQ ID NO: 2688389 - DNA, 15 bp, Homo sapiens
ggggcatcctgcttc

SEQ ID NO: 2688390 - DNA, 16 bp, Homo sapiens
ggggcatcctgcttcc

SEQ ID NO: 2688391 - DNA, 14 bp, Homo sapiens
ggggcccacccaca

SEQ ID NO: 2688392 - DNA, 16 bp, Homo sapiens
ggggctcccggcatcc

SEQ ID NO: 2688393 - DNA, 21 bp, Homo sapiens
ggggctcccggcatcctgaaa

SEQ ID NO: 2688394 - DNA, 19 bp, Homo sapiens
gggggcatcctgcttcctg

SEQ ID NO: 2688395 - DNA, 12 bp, Homo sapiens
ggggggccaggg

SEQ ID NO: 2688396 - DNA, 22 bp, Homo sapiens
ggggtccttcaagttagctcag

SEQ ID NO: 2688397 - DNA, 15 bp, Homo sapiens
ggggttcaagcccag

SEQ ID NO: 2688398 - DNA, 22 bp, Homo sapiens
ggggttctgagaagcgctgccc

SEQ ID NO: 2688399 - DNA, 16 bp, Homo sapiens
ggggtttgagccctgg

SEQ ID NO: 2688400 - DNA, 16 bp, Homo sapiens
taggcatatgcttctt

SEQ ID NO: 2688401 - DNA, 23 bp, Homo sapiens
tagtactggattattcaggcttt

SEQ ID NO: 2688402 - DNA, 19 bp, Homo sapiens
tagtcatggggtccctgct

SEQ ID NO: 2688403 - DNA, 20 bp, Homo sapiens
tagtcatggggtccctgctg

SEQ ID NO: 2688404 - DNA, 21 bp, Homo sapiens
tagtcccagctactcagaagc

SEQ ID NO: 2688405 - DNA, 21 bp, Homo sapiens
tagtcccttctctctttctaa

SEQ ID NO: 2688406 - DNA, 14 bp, Homo sapiens
tagtctctgtgctt

SEQ ID NO: 2688407 - DNA, 20 bp, Homo sapiens
tagtgtcttcctagtatatt

SEQ ID NO: 2688408 - DNA, 15 bp, Homo sapiens
tagttattctctaag

SEQ ID NO: 2688409 - DNA, 16 bp, Homo sapiens
tagttcctgtggccag

SEQ ID NO: 2688410 - DNA, 22 bp, Homo sapiens
tagttctatcaggaaaacaaat

SEQ ID NO: 2688411 - DNA, 15 bp, Homo sapiens
tataaattatattcc

SEQ ID NO: 2688412 - DNA, 14 bp, Homo sapiens
tataagctgggaaa

SEQ ID NO: 2688413 - DNA, 13 bp, Homo sapiens
tatacattttgtt

SEQ ID NO: 2688414 - DNA, 22 bp, Homo sapiens
tatacattttgttatagaatac

SEQ ID NO: 2688415 - DNA, 22 bp, Homo sapiens
tatagaatacttttttctagtt

SEQ ID NO: 2688416 - DNA, 15 bp, Homo sapiens
tatagattaaatcat

SEQ ID NO: 2688417 - DNA, 12 bp, Homo sapiens
tatatatcataa

SEQ ID NO: 2688418 - DNA, 13 bp, Homo sapiens
tatatcataaagt

SEQ ID NO: 2688419 - DNA, 18 bp, Homo sapiens
tatatctataaacactgt

SEQ ID NO: 2688420 - DNA, 19 bp, Homo sapiens
tatatctcaaattgtaatt

SEQ ID NO: 2688421 - DNA, 16 bp, Homo sapiens
tatatgaagctcttga

SEQ ID NO: 2688422 - DNA, 13 bp, Homo sapiens
tatatgtatatct

SEQ ID NO: 2688423 - DNA, 22 bp, Homo sapiens
tatcaaatctgtatatgttgta

SEQ ID NO: 2688424 - DNA, 15 bp, Homo sapiens
tatcagagctcttaa

SEQ ID NO: 2688425 - DNA, 20 bp, Homo sapiens
tatcaggactgtgaccaaag

SEQ ID NO: 2688426 - DNA, 21 bp, Homo sapiens
tatcaggactgtgaccaaagc

SEQ ID NO: 2688427 - DNA, 14 bp, Homo sapiens
tatcataaagtatg

SEQ ID NO: 2688428 - DNA, 14 bp, Homo sapiens
tatctatatctcta

SEQ ID NO: 2688429 - DNA, 15 bp, Homo sapiens
tatctatatctctaa

SEQ ID NO: 2688430 - DNA, 14 bp, Homo sapiens
tatctcaaattgta

SEQ ID NO: 2688431 - DNA, 18 bp, Homo sapiens
tatgaacttgaggacaca

SEQ ID NO: 2688432 - DNA, 20 bp, Homo sapiens
tatgaacttgaggacacatg

SEQ ID NO: 2688433 - DNA, 20 bp, Homo sapiens
tatgcaaatgcctccaagcc

SEQ ID NO: 2688434 - DNA, 21 bp, Homo sapiens
tatgcagtatgctacccacag

SEQ ID NO: 2688435 - DNA, 17 bp, Homo sapiens
tatgctcagaagccagt

SEQ ID NO: 2688436 - DNA, 16 bp, Homo sapiens
tatgtatatgtatatc

SEQ ID NO: 2688437 - DNA, 17 bp, Homo sapiens
tatgtatatgtatatct

SEQ ID NO: 2688438 - DNA, 19 bp, Homo sapiens
tatgtatatgtatatctat

SEQ ID NO: 2688439 - DNA, 20 bp, Homo sapiens
tatgttgtaataaaacttat

SEQ ID NO: 2688440 - DNA, 15 bp, Homo sapiens
tattattaatgcttt

SEQ ID NO: 2688441 - DNA, 16 bp, Homo sapiens
tattattaatgctttg

SEQ ID NO: 2688442 - DNA, 16 bp, Homo sapiens
tattcagtgacttctg

SEQ ID NO: 2688443 - DNA, 15 bp, Homo sapiens
tattcagtgctgtgg

SEQ ID NO: 2688444 - DNA, 18 bp, Homo sapiens
tattcagtgctgtggcct

SEQ ID NO: 2688445 - DNA, 20 bp, Homo sapiens
tattcctcttgcatttcact

SEQ ID NO: 2688446 - DNA, 18 bp, Homo sapiens
tattctacacatatatgt

SEQ ID NO: 2688447 - DNA, 15 bp, Homo sapiens
tattctatgaccact

SEQ ID NO: 2688448 - DNA, 16 bp, Homo sapiens
tatttacaacctagaa

SEQ ID NO: 2688449 - DNA, 18 bp, Homo sapiens
tatttacctgtatttaag

SEQ ID NO: 2688450 - DNA, 18 bp, Homo sapiens
tatttccacataaaggta

SEQ ID NO: 2688451 - DNA, 11 bp, Homo sapiens
tattttctgac

SEQ ID NO: 2688452 - DNA, 13 bp, Homo sapiens
tattttctgacca

SEQ ID NO: 2688453 - DNA, 18 bp, Homo sapiens
tattttctgaccaaaatg

SEQ ID NO: 2688454 - DNA, 22 bp, Homo sapiens
tatttttgctaggagccccagc

SEQ ID NO: 2688455 - DNA, 12 bp, Homo sapiens
tcaaatctgtat

SEQ ID NO: 2688456 - DNA, 20 bp, Homo sapiens
tcaaatctgtatatgttgta

SEQ ID NO: 2688457 - DNA, 13 bp, Homo sapiens
tcaaattgtaatt

SEQ ID NO: 2688458 - DNA, 16 bp, Homo sapiens
tcaaattgtaattaat

SEQ ID NO: 2688459 - DNA, 17 bp, Homo sapiens
tcaagaagtaagagcta

SEQ ID NO: 2688460 - DNA, 16 bp, Homo sapiens
tcaagctagaaggcca

SEQ ID NO: 2688461 - DNA, 18 bp, Homo sapiens
tcaagctagaaggccaca

SEQ ID NO: 2688462 - DNA, 20 bp, Homo sapiens
tcaagctagaaggccacatg

SEQ ID NO: 2688463 - DNA, 16 bp, Homo sapiens
tcaatgcattgtcttg

SEQ ID NO: 2688464 - DNA, 17 bp, Homo sapiens
tcaattcctgggcccca

SEQ ID NO: 2688465 - DNA, 23 bp, Homo sapiens
tcacacagggctctttgatggac

SEQ ID NO: 2688466 - DNA, 17 bp, Homo sapiens
tcacacctccttttctt

SEQ ID NO: 2688467 - DNA, 22 bp, Homo sapiens
tcacacctccttttcttctagc

SEQ ID NO: 2688468 - DNA, 19 bp, Homo sapiens
tcacactggtttgccaggc

SEQ ID NO: 2688469 - DNA, 19 bp, Homo sapiens
tcacagggcagagccggga

SEQ ID NO: 2688470 - DNA, 22 bp, Homo sapiens
tcacatataaaagttaaactac

SEQ ID NO: 2688471 - DNA, 17 bp, Homo sapiens
tcaccgtggaccttcct

SEQ ID NO: 2688472 - DNA, 20 bp, Homo sapiens
tcaccgtggaccttcctgcc

SEQ ID NO: 2688473 - DNA, 14 bp, Homo sapiens
tcacgccactgcac

SEQ ID NO: 2688474 - DNA, 22 bp, Homo sapiens
tcacgccactgcactccagcct

SEQ ID NO: 2688475 - DNA, 22 bp, Homo sapiens
tcacgcctgtaatcccagcact

SEQ ID NO: 2688476 - DNA, 17 bp, Homo sapiens
tcactcactctgggtgc

SEQ ID NO: 2688477 - DNA, 14 bp, Homo sapiens
tcactccggtgtgc

SEQ ID NO: 2688478 - DNA, 18 bp, Homo sapiens
tcactctctgctggcagg

SEQ ID NO: 2688479 - DNA, 14 bp, Homo sapiens
tcactggagcccag

SEQ ID NO: 2688480 - DNA, 13 bp, Homo sapiens
tcacttctgtctc

SEQ ID NO: 2688481 - DNA, 17 bp, Homo sapiens
tcacttctgtctcctgt

SEQ ID NO: 2688482 - DNA, 14 bp, Homo sapiens
tcagactgctggga

SEQ ID NO: 2688483 - DNA, 15 bp, Homo sapiens
tcagactgctgggac

SEQ ID NO: 2688484 - DNA, 17 bp, Homo sapiens
tcagactgctgggactg

SEQ ID NO: 2688485 - DNA, 23 bp, Homo sapiens
tcagactgctgggactggccagg

SEQ ID NO: 2688486 - DNA, 18 bp, Homo sapiens
tcagagccagtgaaggag

SEQ ID NO: 2688487 - DNA, 16 bp, Homo sapiens
tcagagctcttaatgt

SEQ ID NO: 2688488 - DNA, 16 bp, Homo sapiens
tcagagctgcagccag

SEQ ID NO: 2688489 - DNA, 20 bp, Homo sapiens
tcagagttgtacactgtgta

SEQ ID NO: 2688490 - DNA, 15 bp, Homo sapiens
tcagatttctctttg

SEQ ID NO: 2688491 - DNA, 18 bp, Homo sapiens
tcagatttctctttgaaa

SEQ ID NO: 2688492 - DNA, 19 bp, Homo sapiens
tcagatttctctttgaaac

SEQ ID NO: 2688493 - DNA, 18 bp, Homo sapiens
tcagcattaggcttttaa

SEQ ID NO: 2688494 - DNA, 10 bp, Homo sapiens
tcagcccagc

SEQ ID NO: 2688495 - DNA, 14 bp, Homo sapiens
tcagcccagcacct

SEQ ID NO: 2688496 - DNA, 17 bp, Homo sapiens
tcagcccagcacctgct

SEQ ID NO: 2688497 - DNA, 18 bp, Homo sapiens
tcagcccagcacctgctc

SEQ ID NO: 2688498 - DNA, 20 bp, Homo sapiens
tcagcccagcacctgctccc

SEQ ID NO: 2688499 - DNA, 15 bp, Homo sapiens
tcagcccagctggcc

SEQ ID NO: 2688500 - DNA, 17 bp, Homo sapiens
tcagccctccatggcct

SEQ ID NO: 2688501 - DNA, 19 bp, Homo sapiens
tcagctttcagagccagtg

SEQ ID NO: 2688502 - DNA, 18 bp, Homo sapiens
tcaggactgtgaccaaag

SEQ ID NO: 2688503 - DNA, 15 bp, Homo sapiens
tcaggaggctgaggg

SEQ ID NO: 2688504 - DNA, 14 bp, Homo sapiens
tcaggcttccttgg

SEQ ID NO: 2688505 - DNA, 22 bp, Homo sapiens
tcagggaatttcaggaactaga

SEQ ID NO: 2688506 - DNA, 16 bp, Homo sapiens
tcagggcccagcaggc

SEQ ID NO: 2688507 - DNA, 14 bp, Homo sapiens
tcagtaaataatga

SEQ ID NO: 2688508 - DNA, 16 bp, Homo sapiens
tcagtaaataatgaaa

SEQ ID NO: 2688509 - DNA, 17 bp, Homo sapiens
tcagtgacttctggctt

SEQ ID NO: 2688510 - DNA, 22 bp, Homo sapiens
tctggcttatgctcagaagcca

SEQ ID NO: 2688511 - DNA, 13 bp, Homo sapiens
tctgggaggcaga

SEQ ID NO: 2688512 - DNA, 20 bp, Homo sapiens
tctggtgcctttccacacag

SEQ ID NO: 2688513 - DNA, 12 bp, Homo sapiens
tctggtgctgag

SEQ ID NO: 2688514 - DNA, 14 bp, Homo sapiens
tctggtgctgagga

SEQ ID NO: 2688515 - DNA, 21 bp, Homo sapiens
tctggttgacgggctgtccgt

SEQ ID NO: 2688516 - DNA, 17 bp, Homo sapiens
tctggtttctgtgtgtc

SEQ ID NO: 2688517 - DNA, 14 bp, Homo sapiens
tctgtagccacctc

SEQ ID NO: 2688518 - DNA, 16 bp, Homo sapiens
tctgtagccacctcct

SEQ ID NO: 2688519 - DNA, 22 bp, Homo sapiens
tctgtaggtttctctcttccct

SEQ ID NO: 2688520 - DNA, 21 bp, Homo sapiens
tctgtatatgttgtaataaaa

SEQ ID NO: 2688521 - DNA, 23 bp, Homo sapiens
tctgtctcctgtcttcagagcaa

SEQ ID NO: 2688522 - DNA, 14 bp, Homo sapiens
tctgtctgtcccaa

SEQ ID NO: 2688523 - DNA, 16 bp, Homo sapiens
tctgtctgtcccaaag

SEQ ID NO: 2688524 - DNA, 15 bp, Homo sapiens
tctgtctgtctgtcc

SEQ ID NO: 2688525 - DNA, 23 bp, Homo sapiens
tctgtctttagaatcgctttcct

SEQ ID NO: 2688526 - DNA, 13 bp, Homo sapiens
tctgtgaattaaa

SEQ ID NO: 2688527 - DNA, 22 bp, Homo sapiens
tctgtgctttgactcacctgtt

SEQ ID NO: 2688528 - DNA, 16 bp, Homo sapiens
tctgttgcctttttac

SEQ ID NO: 2688529 - DNA, 23 bp, Homo sapiens
tctgttgcctttttacagccaac

SEQ ID NO: 2688530 - DNA, 19 bp, Homo sapiens
tcttaattttttttaatgt

SEQ ID NO: 2688531 - DNA, 17 bp, Homo sapiens
tcttataggtttccact

SEQ ID NO: 2688532 - DNA, 16 bp, Homo sapiens
tcttattcccaaacta

SEQ ID NO: 2688533 - DNA, 22 bp, Homo sapiens
tcttattcccaaactacagaat

SEQ ID NO: 2688534 - DNA, 24 bp, Homo sapiens
tcttattcccaaactacagaataa

SEQ ID NO: 2688535 - DNA, 19 bp, Homo sapiens
tcttcaagggaagaaacac

SEQ ID NO: 2688536 - DNA, 19 bp, Homo sapiens
tcttccaaccccagctggc

SEQ ID NO: 2688537 - DNA, 22 bp, Homo sapiens
tcttccaaccccagctggcctc

SEQ ID NO: 2688538 - DNA, 16 bp, Homo sapiens
tcttcccgctccccac

SEQ ID NO: 2688539 - DNA, 15 bp, Homo sapiens
tcttctcagtgtctg

SEQ ID NO: 2688540 - DNA, 15 bp, Homo sapiens
tcttctcttcctgta

SEQ ID NO: 2688541 - DNA, 16 bp, Homo sapiens
tcttgattctctccct

SEQ ID NO: 2688542 - DNA, 14 bp, Homo sapiens
tcttggacctctgc

SEQ ID NO: 2688543 - DNA, 21 bp, Homo sapiens
tcttgtagaagatggactctg

SEQ ID NO: 2688544 - DNA, 18 bp, Homo sapiens
tcttgtggaggatgaata

SEQ ID NO: 2688545 - DNA, 21 bp, Homo sapiens
tctttctctgagaaccaaaag

SEQ ID NO: 2688546 - DNA, 14 bp, Homo sapiens
tctttgctacaata

SEQ ID NO: 2688547 - DNA, 20 bp, Homo sapiens
tctttgctacaataaatgct

SEQ ID NO: 2688548 - DNA, 22 bp, Homo sapiens
tctttgctacaataaatgctga

SEQ ID NO: 2688549 - DNA, 19 bp, Homo sapiens
tcttttctgaatcttctga

SEQ ID NO: 2688550 - DNA, 22 bp, Homo sapiens
tcttttctgaatcttctgaaac

SEQ ID NO: 2688551 - DNA, 16 bp, Homo sapiens
tgaaaaatatgttgag

SEQ ID NO: 2688552 - DNA, 16 bp, Homo sapiens
tgaaaatgcaagtgtt

SEQ ID NO: 2688553 - DNA, 21 bp, Homo sapiens
tgaaacattcacacagggctc

SEQ ID NO: 2688554 - DNA, 18 bp, Homo sapiens
tgaaacctgacacctaga

SEQ ID NO: 2688555 - DNA, 22 bp, Homo sapiens
tgaaactcctgattttgtagtt

SEQ ID NO: 2688556 - DNA, 21 bp, Homo sapiens
tgaaagccagcaaagcctcca

SEQ ID NO: 2688557 - DNA, 21 bp, Homo sapiens
tgaaagctgttggatttcagt

SEQ ID NO: 2688558 - DNA, 17 bp, Homo sapiens
tgaaaggtgctgatggc

SEQ ID NO: 2688559 - DNA, 23 bp, Homo sapiens
tgaaataccagtgaaccaaagag

SEQ ID NO: 2688560 - DNA, 17 bp, Homo sapiens
tgaaattcaacctgtgt

SEQ ID NO: 2688561 - DNA, 15 bp, Homo sapiens
tgaacacagtttagt

SEQ ID NO: 2688562 - DNA, 15 bp, Homo sapiens
tgaaccgacttttct

SEQ ID NO: 2688563 - DNA, 22 bp, Homo sapiens
tgaaccgacttttctaaagctc

SEQ ID NO: 2688564 - DNA, 21 bp, Homo sapiens
tgaacttgaggacacatgtcc

SEQ ID NO: 2688565 - DNA, 16 bp, Homo sapiens
tgaaggataagagaaa

SEQ ID NO: 2688566 - DNA, 16 bp, Homo sapiens
tgaagggacagctgct

SEQ ID NO: 2688567 - DNA, 20 bp, Homo sapiens
tgaagggacagctgctggga

SEQ ID NO: 2688568 - DNA, 18 bp, Homo sapiens
tgaagggtgacatcccag

SEQ ID NO: 2688569 - DNA, 18 bp, Homo sapiens
tgaagttcatggtgatca

SEQ ID NO: 2688570 - DNA, 20 bp, Homo sapiens
tgaagttcatggtgatcagt

SEQ ID NO: 2688571 - DNA, 13 bp, Homo sapiens
tgaataagcactt

SEQ ID NO: 2688572 - DNA, 13 bp, Homo sapiens
tgaataatgattt

SEQ ID NO: 2688573 - DNA, 13 bp, Homo sapiens
tgaatagatgtga

SEQ ID NO: 2688574 - DNA, 16 bp, Homo sapiens
tgaatatttattcagt

SEQ ID NO: 2688575 - DNA, 13 bp, Homo sapiens
tgaatcttaattt

SEQ ID NO: 2688576 - DNA, 14 bp, Homo sapiens
tgaatcttctgaaa

SEQ ID NO: 2688577 - DNA, 17 bp, Homo sapiens
tgaatttggagactctg

SEQ ID NO: 2688578 - DNA, 16 bp, Homo sapiens
tgacacaggccagcct

SEQ ID NO: 2688579 - DNA, 21 bp, Homo sapiens
tgacacaggccagccttggca

SEQ ID NO: 2688580 - DNA, 20 bp, Homo sapiens
tgacacgtgatggaccaaag

SEQ ID NO: 2688581 - DNA, 21 bp, Homo sapiens
tgacacgtgatggaccaaagc

SEQ ID NO: 2688582 - DNA, 15 bp, Homo sapiens
tgacactgtgaccct

SEQ ID NO: 2688583 - DNA, 20 bp, Homo sapiens
tgacactgtgaccctgggtc

SEQ ID NO: 2688584 - DNA, 16 bp, Homo sapiens
tgacatgtgcagtgct

SEQ ID NO: 2688585 - DNA, 13 bp, Homo sapiens
tgaccagctctct

SEQ ID NO: 2688586 - DNA, 15 bp, Homo sapiens
tgacccaactgatcc

SEQ ID NO: 2688587 - DNA, 17 bp, Homo sapiens
tgacccaactgatcctg

SEQ ID NO: 2688588 - DNA, 17 bp, Homo sapiens
tgaccctgagggctcct

SEQ ID NO: 2688589 - DNA, 24 bp, Homo sapiens
tgaccctgagggctcctccatggt

SEQ ID NO: 2688590 - DNA, 20 bp, Homo sapiens
tgaccctgcgaaggggccct

SEQ ID NO: 2688591 - DNA, 21 bp, Homo sapiens
tgaccctgcgaaggggccctg

SEQ ID NO: 2688592 - DNA, 22 bp, Homo sapiens
tgaccctgcgaaggggccctgg

SEQ ID NO: 2688593 - DNA, 19 bp, Homo sapiens
tgaccgggacttcaaagcc

SEQ ID NO: 2688594 - DNA, 19 bp, Homo sapiens
tgacctgccccgcccagct

SEQ ID NO: 2688595 - DNA, 23 bp, Homo sapiens
tgacgtgcacctgtactcaggag

SEQ ID NO: 2688596 - DNA, 15 bp, Homo sapiens
tgactctctgtgacc

SEQ ID NO: 2688597 - DNA, 12 bp, Homo sapiens
tgactgcagccc

SEQ ID NO: 2688598 - DNA, 19 bp, Homo sapiens
tgacttttattgagctctt

SEQ ID NO: 2688599 - DNA, 22 bp, Homo sapiens
tgactttttctgagcttttcat

SEQ ID NO: 2688600 - DNA, 13 bp, Homo sapiens
tgagaaccaaaag

SEQ ID NO: 2688601 - DNA, 19 bp, Homo sapiens
tgagaaccaaaagatgcct

SEQ ID NO: 2688602 - DNA, 13 bp, Homo sapiens
tgagaacccagag

SEQ ID NO: 2688603 - DNA, 14 bp, Homo sapiens
tgagaagtgtatat

SEQ ID NO: 2688604 - DNA, 15 bp, Homo sapiens
tgagaccctgtctct

SEQ ID NO: 2688605 - DNA, 15 bp, Homo sapiens
tgagagcacagcgtt

SEQ ID NO: 2688606 - DNA, 15 bp, Homo sapiens
tgagcaccagcccca

SEQ ID NO: 2688607 - DNA, 19 bp, Homo sapiens
tgagcattagctacttttc

SEQ ID NO: 2688608 - DNA, 14 bp, Homo sapiens
tgagccctggaccc

SEQ ID NO: 2688609 - DNA, 20 bp, Homo sapiens
tgagccgagattgcgccact

SEQ ID NO: 2688610 - DNA, 23 bp, Homo sapiens
tgagccgagattgcgccactgca

SEQ ID NO: 2688611 - DNA, 20 bp, Homo sapiens
tgagcttggcagctgaacta

SEQ ID NO: 2688612 - DNA, 12 bp, Homo sapiens
tgaggacacatg

SEQ ID NO: 2688613 - DNA, 21 bp, Homo sapiens
tgaggacacgtggcctgcacc

SEQ ID NO: 2688614 - DNA, 16 bp, Homo sapiens
tgaggatacagctctt

SEQ ID NO: 2688615 - DNA, 19 bp, Homo sapiens
tgaggatacagctcttctc

SEQ ID NO: 2688616 - DNA, 21 bp, Homo sapiens
tgaggcctcttggacctctgc

SEQ ID NO: 2688617 - DNA, 23 bp, Homo sapiens
tgaggcctcttggacctctgctc

SEQ ID NO: 2688618 - DNA, 17 bp, Homo sapiens
tgaggctctttctgggc

SEQ ID NO: 2688619 - DNA, 20 bp, Homo sapiens
tgggggcatcctgcttcctg

SEQ ID NO: 2688620 - DNA, 14 bp, Homo sapiens
tggggtgcttcctt

SEQ ID NO: 2688621 - DNA, 20 bp, Homo sapiens
tggggttcaagcccaggctt

SEQ ID NO: 2688622 - DNA, 23 bp, Homo sapiens
tgggtatcaggactgtgaccaaa

SEQ ID NO: 2688623 - DNA, 13 bp, Homo sapiens
tgggtcagcccag

SEQ ID NO: 2688624 - DNA, 16 bp, Homo sapiens
tgggtcagcccagcac

SEQ ID NO: 2688625 - DNA, 17 bp, Homo sapiens
tgggtcagcccagcacc

SEQ ID NO: 2688626 - DNA, 21 bp, Homo sapiens
tgggtcagcccagcacctgct

SEQ ID NO: 2688627 - DNA, 17 bp, Homo sapiens
tgggtcctgcctggtcc

SEQ ID NO: 2688628 - DNA, 18 bp, Homo sapiens
tgggtcgggacagaccag

SEQ ID NO: 2688629 - DNA, 18 bp, Homo sapiens
tgggtgtgtgtagccaag

SEQ ID NO: 2688630 - DNA, 18 bp, Homo sapiens
tggtaaaaagattatata

SEQ ID NO: 2688631 - DNA, 15 bp, Homo sapiens
tggtacatggccagt

SEQ ID NO: 2688632 - DNA, 19 bp, Homo sapiens
tggtatgaacttgaggaca

SEQ ID NO: 2688633 - DNA, 23 bp, Homo sapiens
tggtcccaagtagtagtgtcttc

SEQ ID NO: 2688634 - DNA, 19 bp, Homo sapiens
tggtccctgccctcccctg

SEQ ID NO: 2688635 - DNA, 15 bp, Homo sapiens
tggtcctccctccca

SEQ ID NO: 2688636 - DNA, 19 bp, Homo sapiens
tggtcctggggctctgtgc

SEQ ID NO: 2688637 - DNA, 14 bp, Homo sapiens
tggtctccacctgt

SEQ ID NO: 2688638 - DNA, 18 bp, Homo sapiens
tggtctccacctgtgctt

SEQ ID NO: 2688639 - DNA, 19 bp, Homo sapiens
tggtctccacctgtgcttg

SEQ ID NO: 2688640 - DNA, 17 bp, Homo sapiens
tggtgcccatcctcccg

SEQ ID NO: 2688641 - DNA, 17 bp, Homo sapiens
tggtggacagtcctggg

SEQ ID NO: 2688642 - DNA, 18 bp, Homo sapiens
tggtgggtcagcccagca

SEQ ID NO: 2688643 - DNA, 15 bp, Homo sapiens
tggtttctgtgtgtc

SEQ ID NO: 2688644 - DNA, 15 bp, Homo sapiens
tgtaaattaatactt

SEQ ID NO: 2688645 - DNA, 24 bp, Homo sapiens
tgtaacacaagccacagaagccag

SEQ ID NO: 2688646 - DNA, 19 bp, Homo sapiens
tgtaactggctgctccctg

SEQ ID NO: 2688647 - DNA, 14 bp, Homo sapiens
tgtaataaaccctt

SEQ ID NO: 2688648 - DNA, 15 bp, Homo sapiens
tgtaattaatatctt

SEQ ID NO: 2688649 - DNA, 20 bp, Homo sapiens
tgtactataacatagaattg

SEQ ID NO: 2688650 - DNA, 10 bp, Homo sapiens
tgtagccaag

SEQ ID NO: 2688651 - DNA, 22 bp, Homo sapiens
tgtaggtttctctcttcccttc

SEQ ID NO: 2688652 - DNA, 13 bp, Homo sapiens
tgtataaataata

SEQ ID NO: 2688653 - DNA, 16 bp, Homo sapiens
tgtatacattttgtta

SEQ ID NO: 2688654 - DNA, 14 bp, Homo sapiens
tgtatatgttgtaa

SEQ ID NO: 2688655 - DNA, 14 bp, Homo sapiens
tgtatcaaatctgt

SEQ ID NO: 2688656 - DNA, 12 bp, Homo sapiens
tgtatgctggac

SEQ ID NO: 2688657 - DNA, 19 bp, Homo sapiens
tgtattacatctaatgctt

SEQ ID NO: 2688658 - DNA, 17 bp, Homo sapiens
tgtattctttactaaag

SEQ ID NO: 2688659 - DNA, 18 bp, Homo sapiens
tgtcaccgtggaccttcc

SEQ ID NO: 2688660 - DNA, 21 bp, Homo sapiens
tgtcaccgtggaccttcctgc

SEQ ID NO: 2688661 - DNA, 12 bp, Homo sapiens
tgtcagaaactc

SEQ ID NO: 2688662 - DNA, 17 bp, Homo sapiens
tgtcagaatcatgctgt

SEQ ID NO: 2688663 - DNA, 19 bp, Homo sapiens
tgtcagaatcatgctgttc

SEQ ID NO: 2688664 - DNA, 22 bp, Homo sapiens
tgtcattagtgagacatattta

SEQ ID NO: 2688665 - DNA, 20 bp, Homo sapiens
tgtccagaccattgtcttcc

SEQ ID NO: 2688666 - DNA, 12 bp, Homo sapiens
tgtccataaagt

SEQ ID NO: 2688667 - DNA, 23 bp, Homo sapiens
tgtccataaagtaattttgtgaa

SEQ ID NO: 2688668 - DNA, 16 bp, Homo sapiens
tgtccatttgtcccaa

SEQ ID NO: 2688669 - DNA, 18 bp, Homo sapiens
tgtcccaatagctctact

SEQ ID NO: 2688670 - DNA, 12 bp, Homo sapiens
tgtcccacctct

SEQ ID NO: 2688671 - DNA, 13 bp, Homo sapiens
tgtcccacctctt

SEQ ID NO: 2688672 - DNA, 16 bp, Homo sapiens
tgtccctacccactct

SEQ ID NO: 2688673 - DNA, 19 bp, Homo sapiens
tgtccctcaaatgacccaa

SEQ ID NO: 2688674 - DNA, 21 bp, Homo sapiens
tgtccctctcggaaggctggc

SEQ ID NO: 2688675 - DNA, 13 bp, Homo sapiens
tgtccgtgtgcct

SEQ ID NO: 2688676 - DNA, 15 bp, Homo sapiens
tgtccgtgtgcctcc

SEQ ID NO: 2688677 - DNA, 20 bp, Homo sapiens
tgtccgtgtgcctcctgtgt

SEQ ID NO: 2688678 - DNA, 20 bp, Homo sapiens
tgtccgtttgagtgtctgcg

SEQ ID NO: 2688679 - DNA, 16 bp, Homo sapiens
tgtcctcccaggaacc

SEQ ID NO: 2688680 - DNA, 19 bp, Homo sapiens
tgtcctcccaggaaccaaa

SEQ ID NO: 2688681 - DNA, 15 bp, Homo sapiens
tgtcctcctgctctg

SEQ ID NO: 2688682 - DNA, 17 bp, Homo sapiens
tgtcctcctgctctgct

SEQ ID NO: 2688683 - DNA, 15 bp, Homo sapiens
tgtcctgctagctgt

SEQ ID NO: 2688684 - DNA, 18 bp, Homo sapiens
tgtccttccatcttcaca

SEQ ID NO: 2688685 - DNA, 13 bp, Homo sapiens
tgtctcctgtctt

SEQ ID NO: 2688686 - DNA, 21 bp, Homo sapiens
tgtctgagcggcgcagagccc

SEQ ID NO: 2688687 - DNA, 22 bp, Homo sapiens
tgtctgcagacaagtcttgctg

SEQ ID NO: 2688688 - DNA, 14 bp, Homo sapiens
tgtctgcgccccgc

SEQ ID NO: 2688689 - DNA, 15 bp, Homo sapiens
tgtctgtctgtccca

SEQ ID NO: 2688690 - DNA, 15 bp, Homo sapiens
tgtcttccaacccca

SEQ ID NO: 2688691 - DNA, 17 bp, Homo sapiens
tgtcttccaaccccagc

SEQ ID NO: 2688692 - DNA, 20 bp, Homo sapiens
tgtcttccaaccccagctgg

SEQ ID NO: 2688693 - DNA, 22 bp, Homo sapiens
tgtcttccaaccccagctggcc

SEQ ID NO: 2688694 - DNA, 23 bp, Homo sapiens
tgtcttccaaccccagctggcct

SEQ ID NO: 2688695 - DNA, 22 bp, Homo sapiens
tgtctttagaatcgctttcctt

SEQ ID NO: 2688696 - DNA, 20 bp, Homo sapiens
tgtctttgttgtctccctct

SEQ ID NO: 2688697 - DNA, 18 bp, Homo sapiens
tgtgaattaaaaaagctc

SEQ ID NO: 2688698 - DNA, 13 bp, Homo sapiens
tgtgaccaaagca

SEQ ID NO: 2688699 - DNA, 14 bp, Homo sapiens
tgtgactttgaaaa

SEQ ID NO: 2688700 - DNA, 19 bp, Homo sapiens
tgtgactttttagccagtg

SEQ ID NO: 2688701 - DNA, 17 bp, Homo sapiens
tgtgatcactgagacag

SEQ ID NO: 2688702 - DNA, 12 bp, Homo sapiens
tgtgcctgcagc

SEQ ID NO: 2688703 - DNA, 19 bp, Homo sapiens
tgtgctcttcctctggttt

SEQ ID NO: 2688704 - DNA, 17 bp, Homo sapiens
tgtgctgaggactccct

SEQ ID NO: 2688705 - DNA, 14 bp, Homo sapiens
tgtggaaagcctct

SEQ ID NO: 2688706 - DNA, 15 bp, Homo sapiens
tgtggaaagcctctg

SEQ ID NO: 2688707 - DNA, 17 bp, Homo sapiens
tgtggaaagcctctgct

SEQ ID NO: 2688708 - DNA, 19 bp, Homo sapiens
tgtggaaagcctctgctgc

SEQ ID NO: 2688709 - DNA, 12 bp, Homo sapiens
tgtggcatgact

SEQ ID NO: 2688710 - DNA, 18 bp, Homo sapiens
tgtgggaccagtcccaca

SEQ ID NO: 2688711 - DNA, 13 bp, Homo sapiens
tgtgtattgttgt

SEQ ID NO: 2688712 - DNA, 20 bp, Homo sapiens
tgtgtattgttgtaaaatgt

SEQ ID NO: 2688713 - DNA, 12 bp, Homo sapiens
tgtgtcctcctg

SEQ ID NO: 2688714 - DNA, 14 bp, Homo sapiens
tgtgtcctcctgct

SEQ ID NO: 2688715 - DNA, 23 bp, Homo sapiens
tgtgtcctcctgctctgcttcct

SEQ ID NO: 2688716 - DNA, 16 bp, Homo sapiens
tgtgtgtctgcagaca

SEQ ID NO: 2688717 - DNA, 17 bp, Homo sapiens
tgttactgttgcactga

SEQ ID NO: 2688718 - DNA, 15 bp, Homo sapiens
tgttatagaatactt

SEQ ID NO: 2688719 - DNA, 20 bp, Homo sapiens
tgttctctttgctgacactg

SEQ ID NO: 2688720 - DNA, 22 bp, Homo sapiens
tgttctctttgctgacactgtg

SEQ ID NO: 2688721 - DNA, 18 bp, Homo sapiens
tgttctgtccagtttcca

SEQ ID NO: 2688722 - DNA, 20 bp, Homo sapiens
tgttctgtccagtttccaaa

SEQ ID NO: 2688723 - DNA, 21 bp, Homo sapiens
tgttctgtccagtttccaaag

SEQ ID NO: 2688724 - DNA, 17 bp, Homo sapiens
tgttgatttgagaaatt

SEQ ID NO: 2688725 - DNA, 18 bp, Homo sapiens
tgttgctcttggaaagct

SEQ ID NO: 2688726 - DNA, 15 bp, Homo sapiens
tgttgcttagatgag

SEQ ID NO: 2688727 - DNA, 23 bp, Homo sapiens
tgttgcttagatgagggtgactg

SEQ ID NO: 2688728 - DNA, 13 bp, Homo sapiens
tgttggacccgct

SEQ ID NO: 2688729 - DNA, 23 bp, Homo sapiens
acctcttctatgcaagccttgct

SEQ ID NO: 2688730 - DNA, 22 bp, Homo sapiens
acctctttattttttgattgaa

SEQ ID NO: 2688731 - DNA, 21 bp, Homo sapiens
acctgaagggtgacatcccag

SEQ ID NO: 2688732 - DNA, 12 bp, Homo sapiens
acctgcaggctc

SEQ ID NO: 2688733 - DNA, 18 bp, Homo sapiens
acctgcaggctccatgca

SEQ ID NO: 2688734 - DNA, 19 bp, Homo sapiens
acctgcaggctccatgcac

SEQ ID NO: 2688735 - DNA, 21 bp, Homo sapiens
acctgcaggctccatgcacct

SEQ ID NO: 2688736 - DNA, 23 bp, Homo sapiens
acctgcaggcttaggtcctcact

SEQ ID NO: 2688737 - DNA, 14 bp, Homo sapiens
acctgccagcctgg

SEQ ID NO: 2688738 - DNA, 18 bp, Homo sapiens
acctgccctgccctgcca

SEQ ID NO: 2688739 - DNA, 23 bp, Homo sapiens
acctgccctgccctgccacctgt

SEQ ID NO: 2688740 - DNA, 16 bp, Homo sapiens
acctgtccataaagta

SEQ ID NO: 2688741 - DNA, 19 bp, Homo sapiens
accttagacggaggtgcct

SEQ ID NO: 2688742 - DNA, 14 bp, Homo sapiens
accttttccccagg

SEQ ID NO: 2688743 - DNA, 16 bp, Homo sapiens
accttttctgttgtac

SEQ ID NO: 2688744 - DNA, 16 bp, Homo sapiens
acgcaaggctgtgctc

SEQ ID NO: 2688745 - DNA, 19 bp, Homo sapiens
acgcaaggctgtgctcttc

SEQ ID NO: 2688746 - DNA, 18 bp, Homo sapiens
acgcagattgggctggct

SEQ ID NO: 2688747 - DNA, 17 bp, Homo sapiens
acgcctatgatcccagc

SEQ ID NO: 2688748 - DNA, 13 bp, Homo sapiens
acggccctcctgg

SEQ ID NO: 2688749 - DNA, 15 bp, Homo sapiens
acggccctcctggga

SEQ ID NO: 2688750 - DNA, 19 bp, Homo sapiens
acgggctgtccgtgtgcct

SEQ ID NO: 2688751 - DNA, 20 bp, Homo sapiens
acgggctgtccgtgtgcctc

SEQ ID NO: 2688752 - DNA, 21 bp, Homo sapiens
acgggctgtccgtgtgcctcc

SEQ ID NO: 2688753 - DNA, 18 bp, Homo sapiens
acgtgatggaccaaagcc

SEQ ID NO: 2688754 - DNA, 19 bp, Homo sapiens
acgtgatggaccaaagcca

SEQ ID NO: 2688755 - DNA, 20 bp, Homo sapiens
acgtgcacctgtactcagga

SEQ ID NO: 2688756 - DNA, 23 bp, Homo sapiens
acgtgcctgtgatcccagctact

SEQ ID NO: 2688757 - DNA, 17 bp, Homo sapiens
actaaggggcagctcct

SEQ ID NO: 2688758 - DNA, 19 bp, Homo sapiens
actaaggggcagctcctga

SEQ ID NO: 2688759 - DNA, 20 bp, Homo sapiens
actaaggggcagctcctgac

SEQ ID NO: 2688760 - DNA, 22 bp, Homo sapiens
actaaggggcagctcctgacca

SEQ ID NO: 2688761 - DNA, 15 bp, Homo sapiens
actacactccagcct

SEQ ID NO: 2688762 - DNA, 19 bp, Homo sapiens
actacactccagcctgagc

SEQ ID NO: 2688763 - DNA, 17 bp, Homo sapiens
actacagaataatgtgt

SEQ ID NO: 2688764 - DNA, 20 bp, Homo sapiens
actacagaataatgtgttaa

SEQ ID NO: 2688765 - DNA, 16 bp, Homo sapiens
actaggactctgaggc

SEQ ID NO: 2688766 - DNA, 19 bp, Homo sapiens
actataacatagaattgca

SEQ ID NO: 2688767 - DNA, 16 bp, Homo sapiens
actcacaagaagacca

SEQ ID NO: 2688768 - DNA, 14 bp, Homo sapiens
actcagaagcctga

SEQ ID NO: 2688769 - DNA, 21 bp, Homo sapiens
actccaatggggccagcactg

SEQ ID NO: 2688770 - DNA, 13 bp, Homo sapiens
actccagcctgag

SEQ ID NO: 2688771 - DNA, 14 bp, Homo sapiens
actccagcctgagc

SEQ ID NO: 2688772 - DNA, 14 bp, Homo sapiens
actccagcctgggc

SEQ ID NO: 2688773 - DNA, 18 bp, Homo sapiens
actccagcctgggcgaca

SEQ ID NO: 2688774 - DNA, 20 bp, Homo sapiens
actccagcctgggcgacaga

SEQ ID NO: 2688775 - DNA, 14 bp, Homo sapiens
actccctccatgtg

SEQ ID NO: 2688776 - DNA, 14 bp, Homo sapiens
actcctacctcagc

SEQ ID NO: 2688777 - DNA, 14 bp, Homo sapiens
actcctatgcttta

SEQ ID NO: 2688778 - DNA, 23 bp, Homo sapiens
actcctgccagttgaaaatggat

SEQ ID NO: 2688779 - DNA, 15 bp, Homo sapiens
actccttattttgta

SEQ ID NO: 2688780 - DNA, 13 bp, Homo sapiens
actctagcctggg

SEQ ID NO: 2688781 - DNA, 20 bp, Homo sapiens
actctagcctgggccagaga

SEQ ID NO: 2688782 - DNA, 20 bp, Homo sapiens
actctgaataagcacttttt

SEQ ID NO: 2688783 - DNA, 22 bp, Homo sapiens
actctgaataagcactttttaa

SEQ ID NO: 2688784 - DNA, 13 bp, Homo sapiens
actctgccagcca

SEQ ID NO: 2688785 - DNA, 16 bp, Homo sapiens
actctgccagccacat

SEQ ID NO: 2688786 - DNA, 19 bp, Homo sapiens
actctgctctatgccaggc

SEQ ID NO: 2688787 - DNA, 20 bp, Homo sapiens
actctgctctatgccaggct

SEQ ID NO: 2688788 - DNA, 17 bp, Homo sapiens
actctgggtgcctcctc

SEQ ID NO: 2688789 - DNA, 21 bp, Homo sapiens
actctgggtggaagtgcccag

SEQ ID NO: 2688790 - DNA, 22 bp, Homo sapiens
actctgggtggaagtgcccagc

SEQ ID NO: 2688791 - DNA, 23 bp, Homo sapiens
actctgggtggaagtgcccagcc

SEQ ID NO: 2688792 - DNA, 15 bp, Homo sapiens
actctttgctacaat

SEQ ID NO: 2688793 - DNA, 12 bp, Homo sapiens
actgacccaact

SEQ ID NO: 2688794 - DNA, 17 bp, Homo sapiens
actgactgcagccccct

SEQ ID NO: 2688795 - DNA, 18 bp, Homo sapiens
actgatcctgctccagca

SEQ ID NO: 2688796 - DNA, 20 bp, Homo sapiens
actgatcctgctccagcagc

SEQ ID NO: 2688797 - DNA, 19 bp, Homo sapiens
actgcaacttctacctccg

SEQ ID NO: 2688798 - DNA, 20 bp, Homo sapiens
actgcactccagcctgggca

SEQ ID NO: 2688799 - DNA, 15 bp, Homo sapiens
actgcagccccctat

SEQ ID NO: 2688800 - DNA, 22 bp, Homo sapiens
actgctgttaattgattaaaat

SEQ ID NO: 2688801 - DNA, 20 bp, Homo sapiens
actgctttccagcctgggca

SEQ ID NO: 2688802 - DNA, 13 bp, Homo sapiens
actggagcatctg

SEQ ID NO: 2688803 - DNA, 16 bp, Homo sapiens
actggagcccaggagt

SEQ ID NO: 2688804 - DNA, 15 bp, Homo sapiens
actggattattcagg

SEQ ID NO: 2688805 - DNA, 13 bp, Homo sapiens
actggcaggagcc

SEQ ID NO: 2688806 - DNA, 14 bp, Homo sapiens
actggcaggagcct

SEQ ID NO: 2688807 - DNA, 22 bp, Homo sapiens
actggcaggagcctcgtgtcct

SEQ ID NO: 2688808 - DNA, 18 bp, Homo sapiens
actggccagtcctagagc

SEQ ID NO: 2688809 - DNA, 21 bp, Homo sapiens
actggccagtcctagagctcc

SEQ ID NO: 2688810 - DNA, 22 bp, Homo sapiens
actggccagtcctagagctcct

SEQ ID NO: 2688811 - DNA, 12 bp, Homo sapiens
actggccccacc

SEQ ID NO: 2688812 - DNA, 22 bp, Homo sapiens
actggctgctccctgctcccag

SEQ ID NO: 2688813 - DNA, 16 bp, Homo sapiens
actggctggctgcagt

SEQ ID NO: 2688814 - DNA, 19 bp, Homo sapiens
actggggttcaagcccagg

SEQ ID NO: 2688815 - DNA, 13 bp, Homo sapiens
actggtgatatat

SEQ ID NO: 2688816 - DNA, 16 bp, Homo sapiens
actgtatcaaatctgt

SEQ ID NO: 2688817 - DNA, 17 bp, Homo sapiens
actgtatcaaatctgta

SEQ ID NO: 2688818 - DNA, 13 bp, Homo sapiens
actgtatgctgga

SEQ ID NO: 2688819 - DNA, 14 bp, Homo sapiens
actgtccctccttg

SEQ ID NO: 2688820 - DNA, 13 bp, Homo sapiens
actgtgaccaaag

SEQ ID NO: 2688821 - DNA, 15 bp, Homo sapiens
actgtgaccaaagca

SEQ ID NO: 2688822 - DNA, 16 bp, Homo sapiens
actgtgcctagttcct

SEQ ID NO: 2688823 - DNA, 22 bp, Homo sapiens
actgtttgttccagaatctgta

SEQ ID NO: 2688824 - DNA, 16 bp, Homo sapiens
acttactcccattttc

SEQ ID NO: 2688825 - DNA, 19 bp, Homo sapiens
acttatgctagtttattgg

SEQ ID NO: 2688826 - DNA, 24 bp, Homo sapiens
acttcacccggctgggctcctcat

SEQ ID NO: 2688827 - DNA, 16 bp, Homo sapiens
acttcactaccaaatg

SEQ ID NO: 2688828 - DNA, 17 bp, Homo sapiens
acttcatttggtgctgg

SEQ ID NO: 2688829 - DNA, 11 bp, Homo sapiens
acttcctggga

SEQ ID NO: 2688830 - DNA, 12 bp, Homo sapiens
acttcctgggat

SEQ ID NO: 2688831 - DNA, 22 bp, Homo sapiens
acttccttgcccctgctctgta

SEQ ID NO: 2688832 - DNA, 19 bp, Homo sapiens
acttctaagttgagtatat

SEQ ID NO: 2688833 - DNA, 23 bp, Homo sapiens
acttctaagttgagtatattata

SEQ ID NO: 2688834 - DNA, 13 bp, Homo sapiens
acttctgtctcct

SEQ ID NO: 2688835 - DNA, 17 bp, Homo sapiens
acttctgtctcctgtct

SEQ ID NO: 2688836 - DNA, 19 bp, Homo sapiens
acttgaaataccagtgaac

SEQ ID NO: 2688837 - DNA, 13 bp, Homo sapiens
acttgaggacaca

SEQ ID NO: 2688838 - DNA, 11 bp, Homo sapiens
atctataatat

SEQ ID NO: 2688839 - DNA, 21 bp, Homo sapiens
atctatatctctaaactgctg

SEQ ID NO: 2688840 - DNA, 15 bp, Homo sapiens
atctctaaactgctg

SEQ ID NO: 2688841 - DNA, 15 bp, Homo sapiens
atctctaattggaag

SEQ ID NO: 2688842 - DNA, 21 bp, Homo sapiens
atctctctactcctacctcag

SEQ ID NO: 2688843 - DNA, 18 bp, Homo sapiens
atctgactcacaagaaga

SEQ ID NO: 2688844 - DNA, 18 bp, Homo sapiens
atcttctggagtctccag

SEQ ID NO: 2688845 - DNA, 21 bp, Homo sapiens
atcttgctggattaatgtttt

SEQ ID NO: 2688846 - DNA, 18 bp, Homo sapiens
atcttttctgaatcttct

SEQ ID NO: 2688847 - DNA, 23 bp, Homo sapiens
atgaaattgtctagcagagcagg

SEQ ID NO: 2688848 - DNA, 17 bp, Homo sapiens
atgaacttgaggacaca

SEQ ID NO: 2688849 - DNA, 22 bp, Homo sapiens
atgaacttgaggacacatgtcc

SEQ ID NO: 2688850 - DNA, 20 bp, Homo sapiens
atgaatagatgtgatcactg

SEQ ID NO: 2688851 - DNA, 14 bp, Homo sapiens
atgaatcaaagaca

SEQ ID NO: 2688852 - DNA, 20 bp, Homo sapiens
atgaatttggagactctgtg

SEQ ID NO: 2688853 - DNA, 23 bp, Homo sapiens
atgaccctgcgaaggggccctgg

SEQ ID NO: 2688854 - DNA, 22 bp, Homo sapiens
atgactaagtacttgctctctg

SEQ ID NO: 2688855 - DNA, 20 bp, Homo sapiens
atgacttttattgagctctt

SEQ ID NO: 2688856 - DNA, 22 bp, Homo sapiens
atgacttttccattgaccagct

SEQ ID NO: 2688857 - DNA, 16 bp, Homo sapiens
atgaggaaacaggcct

SEQ ID NO: 2688858 - DNA, 20 bp, Homo sapiens
atgaggataacttccttgcc

SEQ ID NO: 2688859 - DNA, 19 bp, Homo sapiens
atgatgtctcttgtagaag

SEQ ID NO: 2688860 - DNA, 14 bp, Homo sapiens
atgatgtgtgaaac

SEQ ID NO: 2688861 - DNA, 20 bp, Homo sapiens
atgatttggggattcagatt

SEQ ID NO: 2688862 - DNA, 22 bp, Homo sapiens
atgcacctcccttccctccctg

SEQ ID NO: 2688863 - DNA, 19 bp, Homo sapiens
atgcacggtgaggccgggc

SEQ ID NO: 2688864 - DNA, 13 bp, Homo sapiens
atgcatgtaatca

SEQ ID NO: 2688865 - DNA, 18 bp, Homo sapiens
atgcattgtcttgtggag

SEQ ID NO: 2688866 - DNA, 13 bp, Homo sapiens
atgccaaagctgc

SEQ ID NO: 2688867 - DNA, 14 bp, Homo sapiens
atgccaaagctgct

SEQ ID NO: 2688868 - DNA, 14 bp, Homo sapiens
atgccaacttgtcc

SEQ ID NO: 2688869 - DNA, 21 bp, Homo sapiens
atgcccagagggcccaggcag

SEQ ID NO: 2688870 - DNA, 13 bp, Homo sapiens
atgcctccccaag

SEQ ID NO: 2688871 - DNA, 14 bp, Homo sapiens
atgctcagaagcca

SEQ ID NO: 2688872 - DNA, 15 bp, Homo sapiens
atgctcagaagccag

SEQ ID NO: 2688873 - DNA, 20 bp, Homo sapiens
atgctcagaagccagtctgc

SEQ ID NO: 2688874 - DNA, 15 bp, Homo sapiens
atgctgaggccaccc

SEQ ID NO: 2688875 - DNA, 18 bp, Homo sapiens
atgctgaggccacccact

SEQ ID NO: 2688876 - DNA, 21 bp, Homo sapiens
atgctggacggcattcctgct

SEQ ID NO: 2688877 - DNA, 14 bp, Homo sapiens
atgctgttctcttt

SEQ ID NO: 2688878 - DNA, 15 bp, Homo sapiens
atgctgttctctttg

SEQ ID NO: 2688879 - DNA, 20 bp, Homo sapiens
atgctgttctctttgctgac

SEQ ID NO: 2688880 - DNA, 16 bp, Homo sapiens
atgcttcaagtgttgc

SEQ ID NO: 2688881 - DNA, 19 bp, Homo sapiens
atgcttcaagtgttgctct

SEQ ID NO: 2688882 - DNA, 15 bp, Homo sapiens
atgctttagcttatt

SEQ ID NO: 2688883 - DNA, 18 bp, Homo sapiens
atggaagtggcagtgaaa

SEQ ID NO: 2688884 - DNA, 14 bp, Homo sapiens
atggaccaaagcca

SEQ ID NO: 2688885 - DNA, 21 bp, Homo sapiens
atggaccaaagccacctgctg

SEQ ID NO: 2688886 - DNA, 23 bp, Homo sapiens
atggagcgcacctgccccctggt

SEQ ID NO: 2688887 - DNA, 18 bp, Homo sapiens
atggagctattttaaacc

SEQ ID NO: 2688888 - DNA, 19 bp, Homo sapiens
atggcagaacgatgcctgc

SEQ ID NO: 2688889 - DNA, 15 bp, Homo sapiens
atggcatctagccag

SEQ ID NO: 2688890 - DNA, 22 bp, Homo sapiens
atggcatctagccagaggctgg

SEQ ID NO: 2688891 - DNA, 23 bp, Homo sapiens
atggcatctagccagaggctgga

SEQ ID NO: 2688892 - DNA, 17 bp, Homo sapiens
atggcccctccagcaca

SEQ ID NO: 2688893 - DNA, 19 bp, Homo sapiens
atggcccctccagcacaca

SEQ ID NO: 2688894 - DNA, 19 bp, Homo sapiens
atggccctagaactgtgcc

SEQ ID NO: 2688895 - DNA, 17 bp, Homo sapiens
atggcctctggccaggc

SEQ ID NO: 2688896 - DNA, 19 bp, Homo sapiens
atggcctgccttgaagcca

SEQ ID NO: 2688897 - DNA, 20 bp, Homo sapiens
atggcctgccttgaagccac

SEQ ID NO: 2688898 - DNA, 14 bp, Homo sapiens
atggtctccacctg

SEQ ID NO: 2688899 - DNA, 15 bp, Homo sapiens
atggtctccacctgt

SEQ ID NO: 2688900 - DNA, 15 bp, Homo sapiens
atggtgctgcattga

SEQ ID NO: 2688901 - DNA, 21 bp, Homo sapiens
atgtacaagttttgtataaat

SEQ ID NO: 2688902 - DNA, 17 bp, Homo sapiens
atgtactataacataga

SEQ ID NO: 2688903 - DNA, 15 bp, Homo sapiens
atgtatatctatatc

SEQ ID NO: 2688904 - DNA, 19 bp, Homo sapiens
atgtatatctatatctcta

SEQ ID NO: 2688905 - DNA, 21 bp, Homo sapiens
atgtatatttttgctaggagc

SEQ ID NO: 2688906 - DNA, 23 bp, Homo sapiens
atgtcaccgtggaccttcctgcc

SEQ ID NO: 2688907 - DNA, 13 bp, Homo sapiens
atgtgatcactga

SEQ ID NO: 2688908 - DNA, 19 bp, Homo sapiens
atgtgctgctttgatatat

SEQ ID NO: 2688909 - DNA, 14 bp, Homo sapiens
atgtgtcctcctgc

SEQ ID NO: 2688910 - DNA, 17 bp, Homo sapiens
atgtgtcctcctgctct

SEQ ID NO: 2688911 - DNA, 21 bp, Homo sapiens
atgttgagtgttcattttagt

SEQ ID NO: 2688912 - DNA, 17 bp, Homo sapiens
atgtttaaatataaatg

SEQ ID NO: 2688913 - DNA, 14 bp, Homo sapiens
atgttttgtacaat

SEQ ID NO: 2688914 - DNA, 23 bp, Homo sapiens
attaaaatctggcaaagttatat

SEQ ID NO: 2688915 - DNA, 14 bp, Homo sapiens
attaatatcttgct

SEQ ID NO: 2688916 - DNA, 22 bp, Homo sapiens
attagctacttttcagaattga

SEQ ID NO: 2688917 - DNA, 13 bp, Homo sapiens
attagctctggac

SEQ ID NO: 2688918 - DNA, 20 bp, Homo sapiens
attagtttgatttaatatct

SEQ ID NO: 2688919 - DNA, 21 bp, Homo sapiens
attagtttgatttaatatctg

SEQ ID NO: 2688920 - DNA, 22 bp, Homo sapiens
attagtttgatttaatatctga

SEQ ID NO: 2688921 - DNA, 20 bp, Homo sapiens
attatgagtctctatgatct

SEQ ID NO: 2688922 - DNA, 15 bp, Homo sapiens
attattcaggcttta

SEQ ID NO: 2688923 - DNA, 12 bp, Homo sapiens
attattcttcag

SEQ ID NO: 2688924 - DNA, 21 bp, Homo sapiens
attatttcaaccgcttgccat

SEQ ID NO: 2688925 - DNA, 13 bp, Homo sapiens
attcactggcctg

SEQ ID NO: 2688926 - DNA, 14 bp, Homo sapiens
attcagatttctct

SEQ ID NO: 2688927 - DNA, 22 bp, Homo sapiens
attcagtgctgtggcctgggca

SEQ ID NO: 2688928 - DNA, 18 bp, Homo sapiens
attcatctgggaggcaga

SEQ ID NO: 2688929 - DNA, 17 bp, Homo sapiens
attcctgtagcatcttc

SEQ ID NO: 2688930 - DNA, 23 bp, Homo sapiens
attcctgtagcatcttctggagt

SEQ ID NO: 2688931 - DNA, 15 bp, Homo sapiens
attctacacatatat

SEQ ID NO: 2688932 - DNA, 24 bp, Homo sapiens
attctacacatatatgtatatgta

SEQ ID NO: 2688933 - DNA, 21 bp, Homo sapiens
attctcaacctaccacccctt

SEQ ID NO: 2688934 - DNA, 18 bp, Homo sapiens
attctgggttttgtagca

SEQ ID NO: 2688935 - DNA, 18 bp, Homo sapiens
attcttcccgctccccac

SEQ ID NO: 2688936 - DNA, 20 bp, Homo sapiens
attcttcccgctccccacct

SEQ ID NO: 2688937 - DNA, 16 bp, Homo sapiens
attgaaggagaaaatg

SEQ ID NO: 2688938 - DNA, 17 bp, Homo sapiens
attgaaggagaaaatgc

SEQ ID NO: 2688939 - DNA, 13 bp, Homo sapiens
attgaccagctct

SEQ ID NO: 2688940 - DNA, 14 bp, Homo sapiens
attgaccagctctc

SEQ ID NO: 2688941 - DNA, 17 bp, Homo sapiens
attgagtccagctttcc

SEQ ID NO: 2688942 - DNA, 11 bp, Homo sapiens
attgcctctga

SEQ ID NO: 2688943 - DNA, 17 bp, Homo sapiens
attgcttaaaagacatt

SEQ ID NO: 2688944 - DNA, 14 bp, Homo sapiens
attggaagaaattc

SEQ ID NO: 2688945 - DNA, 21 bp, Homo sapiens
attggaagtgttcaagaaata

SEQ ID NO: 2688946 - DNA, 19 bp, Homo sapiens
attgtagaaacacagtttt

SEQ ID NO: 2688947 - DNA, 15 bp, Homo sapiens
cagagagtcctctgg

SEQ ID NO: 2688948 - DNA, 18 bp, Homo sapiens
cagagagtcctctggatg

SEQ ID NO: 2688949 - DNA, 19 bp, Homo sapiens
cagagagtcctctggatgg

SEQ ID NO: 2688950 - DNA, 22 bp, Homo sapiens
cagagatggtaatctacagctc

SEQ ID NO: 2688951 - DNA, 15 bp, Homo sapiens
cagagcaggggcagg

SEQ ID NO: 2688952 - DNA, 17 bp, Homo sapiens
cagagccagtgaaggag

SEQ ID NO: 2688953 - DNA, 20 bp, Homo sapiens
cagagcgagagtctgtctca

SEQ ID NO: 2688954 - DNA, 14 bp, Homo sapiens
cagagctgcagcca

SEQ ID NO: 2688955 - DNA, 19 bp, Homo sapiens
cagaggaagaaacctggaa

SEQ ID NO: 2688956 - DNA, 18 bp, Homo sapiens
cagagggcccaggcaggc

SEQ ID NO: 2688957 - DNA, 23 bp, Homo sapiens
cagagggggcgtgcctgccaagc

SEQ ID NO: 2688958 - DNA, 19 bp, Homo sapiens
cagaggtaggagaactggg

SEQ ID NO: 2688959 - DNA, 13 bp, Homo sapiens
cagatctttttgt

SEQ ID NO: 2688960 - DNA, 15 bp, Homo sapiens
cagatgcccagaggg

SEQ ID NO: 2688961 - DNA, 14 bp, Homo sapiens
cagatgcctcccca

SEQ ID NO: 2688962 - DNA, 18 bp, Homo sapiens
cagatgcctccccaagac

SEQ ID NO: 2688963 - DNA, 20 bp, Homo sapiens
cagatgcctccccaagactg

SEQ ID NO: 2688964 - DNA, 16 bp, Homo sapiens
cagattgggctggctc

SEQ ID NO: 2688965 - DNA, 13 bp, Homo sapiens
cagcacacctcag

SEQ ID NO: 2688966 - DNA, 15 bp, Homo sapiens
cagcacacctcagcc

SEQ ID NO: 2688967 - DNA, 22 bp, Homo sapiens
cagcacaggagagcacccacag

SEQ ID NO: 2688968 - DNA, 12 bp, Homo sapiens
cagcactggagg

SEQ ID NO: 2688969 - DNA, 21 bp, Homo sapiens
cagcactggaggggcccaccc

SEQ ID NO: 2688970 - DNA, 18 bp, Homo sapiens
cagcactttgggaggctg

SEQ ID NO: 2688971 - DNA, 20 bp, Homo sapiens
cagcagagttattgaatctt

SEQ ID NO: 2688972 - DNA, 12 bp, Homo sapiens
cagcagcacacc

SEQ ID NO: 2688973 - DNA, 16 bp, Homo sapiens
cagcagcacacctcag

SEQ ID NO: 2688974 - DNA, 21 bp, Homo sapiens
cagcagcatagaacaggacct

SEQ ID NO: 2688975 - DNA, 19 bp, Homo sapiens
cagcaggtgtgaccctgag

SEQ ID NO: 2688976 - DNA, 17 bp, Homo sapiens
cagcatagaacaggacc

SEQ ID NO: 2688977 - DNA, 19 bp, Homo sapiens
cagcatagaacaggacctc

SEQ ID NO: 2688978 - DNA, 23 bp, Homo sapiens
cagcatagaacaggacctctgct

SEQ ID NO: 2688979 - DNA, 19 bp, Homo sapiens
cagcatcttttccatcctg

SEQ ID NO: 2688980 - DNA, 21 bp, Homo sapiens
cagcatcttttccatcctgag

SEQ ID NO: 2688981 - DNA, 22 bp, Homo sapiens
cagcatcttttccatcctgagg

SEQ ID NO: 2688982 - DNA, 21 bp, Homo sapiens
cagcattaggcttttaagaaa

SEQ ID NO: 2688983 - DNA, 15 bp, Homo sapiens
cagcccagcacctgc

SEQ ID NO: 2688984 - DNA, 18 bp, Homo sapiens
cagcccagcacctgctcc

SEQ ID NO: 2688985 - DNA, 21 bp, Homo sapiens
cagcccagcacctgctcccag

SEQ ID NO: 2688986 - DNA, 10 bp, Homo sapiens
cagcccagct

SEQ ID NO: 2688987 - DNA, 21 bp, Homo sapiens
cagcccatggcctctggccag

SEQ ID NO: 2688988 - DNA, 16 bp, Homo sapiens
cagccccgcgcctcct

SEQ ID NO: 2688989 - DNA, 12 bp, Homo sapiens
cagcccctgccc

SEQ ID NO: 2688990 - DNA, 12 bp, Homo sapiens
cagccctcagca

SEQ ID NO: 2688991 - DNA, 18 bp, Homo sapiens
cagccctccatggcctgg

SEQ ID NO: 2688992 - DNA, 19 bp, Homo sapiens
cagccgcagcctccctctg

SEQ ID NO: 2688993 - DNA, 17 bp, Homo sapiens
cagcctccttgcctgga

SEQ ID NO: 2688994 - DNA, 18 bp, Homo sapiens
cagcctgaagatcagagc

SEQ ID NO: 2688995 - DNA, 18 bp, Homo sapiens
cagcctgaggctgagact

SEQ ID NO: 2688996 - DNA, 14 bp, Homo sapiens
cagcctggcttctg

SEQ ID NO: 2688997 - DNA, 15 bp, Homo sapiens
cagcctgggcgacag

SEQ ID NO: 2688998 - DNA, 21 bp, Homo sapiens
cagccttccccctcccagggc

SEQ ID NO: 2688999 - DNA, 22 bp, Homo sapiens
cagcgagttgtggaaagcctct

SEQ ID NO: 2689000 - DNA, 15 bp, Homo sapiens
cagctactcagaagc

SEQ ID NO: 2689001 - DNA, 23 bp, Homo sapiens
cagctactcgggaggctgaggca

SEQ ID NO: 2689002 - DNA, 13 bp, Homo sapiens
cagctattttctg

SEQ ID NO: 2689003 - DNA, 15 bp, Homo sapiens
cagctattttctgac

SEQ ID NO: 2689004 - DNA, 20 bp, Homo sapiens
cagctattttctgaccaaaa

SEQ ID NO: 2689005 - DNA, 16 bp, Homo sapiens
cagctcacctctgaag

SEQ ID NO: 2689006 - DNA, 12 bp, Homo sapiens
cagctctggctt

SEQ ID NO: 2689007 - DNA, 21 bp, Homo sapiens
cagctgcacctgccagcctgg

SEQ ID NO: 2689008 - DNA, 12 bp, Homo sapiens
cagctgctggga

SEQ ID NO: 2689009 - DNA, 20 bp, Homo sapiens
cagctggcctctagaacacc

SEQ ID NO: 2689010 - DNA, 23 bp, Homo sapiens
cagctggcctctagaacacccac

SEQ ID NO: 2689011 - DNA, 20 bp, Homo sapiens
cagctgggcatgccatgtct

SEQ ID NO: 2689012 - DNA, 17 bp, Homo sapiens
cagctttccttctgccc

SEQ ID NO: 2689013 - DNA, 20 bp, Homo sapiens
cagctttccttctgcccttc

SEQ ID NO: 2689014 - DNA, 12 bp, Homo sapiens
caggaaccaaaa

SEQ ID NO: 2689015 - DNA, 15 bp, Homo sapiens
caggaactgagccag

SEQ ID NO: 2689016 - DNA, 14 bp, Homo sapiens
caggacaccagcct

SEQ ID NO: 2689017 - DNA, 16 bp, Homo sapiens
caggactgtgaccaaa

SEQ ID NO: 2689018 - DNA, 20 bp, Homo sapiens
caggactgtgaccaaagcat

SEQ ID NO: 2689019 - DNA, 15 bp, Homo sapiens
caggagagcacccac

SEQ ID NO: 2689020 - DNA, 18 bp, Homo sapiens
caggagagcacccacagc

SEQ ID NO: 2689021 - DNA, 14 bp, Homo sapiens
caggagcctcgtgt

SEQ ID NO: 2689022 - DNA, 23 bp, Homo sapiens
caggagcctcgtgtcctgctagc

SEQ ID NO: 2689023 - DNA, 16 bp, Homo sapiens
caggaggggcctctga

SEQ ID NO: 2689024 - DNA, 21 bp, Homo sapiens
caggaggttggtgactgaaac

SEQ ID NO: 2689025 - DNA, 18 bp, Homo sapiens
caggagtttgaggctgca

SEQ ID NO: 2689026 - DNA, 16 bp, Homo sapiens
caggatcactctctgc

SEQ ID NO: 2689027 - DNA, 15 bp, Homo sapiens
caggatgaccctgcg

SEQ ID NO: 2689028 - DNA, 21 bp, Homo sapiens
caggattcttcccgctcccca

SEQ ID NO: 2689029 - DNA, 22 bp, Homo sapiens
caggcacgtctcctgctgcgtg

SEQ ID NO: 2689030 - DNA, 16 bp, Homo sapiens
caggcagggctgggcc

SEQ ID NO: 2689031 - DNA, 18 bp, Homo sapiens
caggcagggctgggccag

SEQ ID NO: 2689032 - DNA, 19 bp, Homo sapiens
caggccaagagcagaggca

SEQ ID NO: 2689033 - DNA, 23 bp, Homo sapiens
caggccaccatattcagtgctgt

SEQ ID NO: 2689034 - DNA, 12 bp, Homo sapiens
caggccagaaaa

SEQ ID NO: 2689035 - DNA, 15 bp, Homo sapiens
caggccaggtgcagt

SEQ ID NO: 2689036 - DNA, 16 bp, Homo sapiens
caggccaggtgcagtg

SEQ ID NO: 2689037 - DNA, 19 bp, Homo sapiens
caggccggtgtgggctgtg

SEQ ID NO: 2689038 - DNA, 17 bp, Homo sapiens
caggcctcaagcgtgga

SEQ ID NO: 2689039 - DNA, 15 bp, Homo sapiens
caggcctccctgcag

SEQ ID NO: 2689040 - DNA, 20 bp, Homo sapiens
caggcctccctgcagactcc

SEQ ID NO: 2689041 - DNA, 18 bp, Homo sapiens
caggctccatgcacctcc

SEQ ID NO: 2689042 - DNA, 15 bp, Homo sapiens
caggctgagagccag

SEQ ID NO: 2689043 - DNA, 14 bp, Homo sapiens
caggctgtgctagc

SEQ ID NO: 2689044 - DNA, 15 bp, Homo sapiens
caggcttcctgggtc

SEQ ID NO: 2689045 - DNA, 22 bp, Homo sapiens
caggcttcctgggtcctgcctg

SEQ ID NO: 2689046 - DNA, 23 bp, Homo sapiens
cagggaaggctaagcatggcctg

SEQ ID NO: 2689047 - DNA, 19 bp, Homo sapiens
cagggaggaggtggcagcc

SEQ ID NO: 2689048 - DNA, 22 bp, Homo sapiens
cagggaggaggtggcagccctg

SEQ ID NO: 2689049 - DNA, 23 bp, Homo sapiens
cagggaggaggtggcagccctgt

SEQ ID NO: 2689050 - DNA, 16 bp, Homo sapiens
cagggcagagccggga

SEQ ID NO: 2689051 - DNA, 15 bp, Homo sapiens
cagggccagggccct

SEQ ID NO: 2689052 - DNA, 13 bp, Homo sapiens
cagggcccagcag

SEQ ID NO: 2689053 - DNA, 15 bp, Homo sapiens
cagggccctgcagag

SEQ ID NO: 2689054 - DNA, 15 bp, Homo sapiens
caggggtcctgcagg

SEQ ID NO: 2689055 - DNA, 16 bp, Homo sapiens
caggggtcctgcaggt

SEQ ID NO: 2689056 - DNA, 19 bp, Homo sapiens
cagggtcattatcagaaca

SEQ ID NO: 2689057 - DNA, 14 bp, Homo sapiens
ccacctacccagct

SEQ ID NO: 2689058 - DNA, 14 bp, Homo sapiens
ccacctctcccagc

SEQ ID NO: 2689059 - DNA, 19 bp, Homo sapiens
ccacctcttctcttcctgt

SEQ ID NO: 2689060 - DNA, 23 bp, Homo sapiens
ccacctcttctcttcctgtaaca

SEQ ID NO: 2689061 - DNA, 22 bp, Homo sapiens
ccacctgctgcgggggagccag

SEQ ID NO: 2689062 - DNA, 14 bp, Homo sapiens
ccacctgtctgtct

SEQ ID NO: 2689063 - DNA, 16 bp, Homo sapiens
ccacctgtctgtctgt

SEQ ID NO: 2689064 - DNA, 18 bp, Homo sapiens
ccacctttactctgctct

SEQ ID NO: 2689065 - DNA, 14 bp, Homo sapiens
ccacgctggccttc

SEQ ID NO: 2689066 - DNA, 18 bp, Homo sapiens
ccactacactccagcctg

SEQ ID NO: 2689067 - DNA, 20 bp, Homo sapiens
ccactacactccagcctgag

SEQ ID NO: 2689068 - DNA, 22 bp, Homo sapiens
ccactacactccagcctgagca

SEQ ID NO: 2689069 - DNA, 17 bp, Homo sapiens
ccactacccggcagggt

SEQ ID NO: 2689070 - DNA, 19 bp, Homo sapiens
ccactaggactctgaggct

SEQ ID NO: 2689071 - DNA, 12 bp, Homo sapiens
ccactctttgct

SEQ ID NO: 2689072 - DNA, 22 bp, Homo sapiens
ccactctttgctacaataaatg

SEQ ID NO: 2689073 - DNA, 23 bp, Homo sapiens
ccactctttgctacaataaatgc

SEQ ID NO: 2689074 - DNA, 16 bp, Homo sapiens
ccactgaagctgggat

SEQ ID NO: 2689075 - DNA, 19 bp, Homo sapiens
ccactgacacccagtgtcc

SEQ ID NO: 2689076 - DNA, 14 bp, Homo sapiens
ccactgcactccag

SEQ ID NO: 2689077 - DNA, 17 bp, Homo sapiens
ccactgcactccagcct

SEQ ID NO: 2689078 - DNA, 20 bp, Homo sapiens
ccactgcactccagcctggg

SEQ ID NO: 2689079 - DNA, 21 bp, Homo sapiens
ccactgcactccagcctgggc

SEQ ID NO: 2689080 - DNA, 20 bp, Homo sapiens
ccactgcagtccgcagtctg

SEQ ID NO: 2689081 - DNA, 16 bp, Homo sapiens
ccactggacttgagct

SEQ ID NO: 2689082 - DNA, 12 bp, Homo sapiens
ccactggccagt

SEQ ID NO: 2689083 - DNA, 13 bp, Homo sapiens
ccactggccagtc

SEQ ID NO: 2689084 - DNA, 15 bp, Homo sapiens
ccactggccagtcct

SEQ ID NO: 2689085 - DNA, 22 bp, Homo sapiens
ccactggccagtcctagagctc

SEQ ID NO: 2689086 - DNA, 16 bp, Homo sapiens
ccagaaaaccccagca

SEQ ID NO: 2689087 - DNA, 12 bp, Homo sapiens
ccagactgtgga

SEQ ID NO: 2689088 - DNA, 18 bp, Homo sapiens
ccagagagaggggcctgc

SEQ ID NO: 2689089 - DNA, 19 bp, Homo sapiens
ccagagagaggggcctgca

SEQ ID NO: 2689090 - DNA, 22 bp, Homo sapiens
ccagagagaggggcctgcaggt

SEQ ID NO: 2689091 - DNA, 14 bp, Homo sapiens
ccagagagtcctct

SEQ ID NO: 2689092 - DNA, 17 bp, Homo sapiens
ccagagagtcctctgga

SEQ ID NO: 2689093 - DNA, 12 bp, Homo sapiens
ccagaggctgga

SEQ ID NO: 2689094 - DNA, 15 bp, Homo sapiens
ccagagggcccaggc

SEQ ID NO: 2689095 - DNA, 17 bp, Homo sapiens
ccagagggcccaggcag

SEQ ID NO: 2689096 - DNA, 23 bp, Homo sapiens
ccagcacacacacataagcactg

SEQ ID NO: 2689097 - DNA, 13 bp, Homo sapiens
ccagcacctgctc

SEQ ID NO: 2689098 - DNA, 18 bp, Homo sapiens
ccagcacctgctcccagt

SEQ ID NO: 2689099 - DNA, 16 bp, Homo sapiens
ccagcagcaatctgtc

SEQ ID NO: 2689100 - DNA, 20 bp, Homo sapiens
ccagcagcaatctgtcttta

SEQ ID NO: 2689101 - DNA, 13 bp, Homo sapiens
ccagcagcacacc

SEQ ID NO: 2689102 - DNA, 22 bp, Homo sapiens
ccagcagcacacctcagcccca

SEQ ID NO: 2689103 - DNA, 21 bp, Homo sapiens
ccagcatcttttccatcctga

SEQ ID NO: 2689104 - DNA, 23 bp, Homo sapiens
ccagcatcttttccatcctgagg

SEQ ID NO: 2689105 - DNA, 13 bp, Homo sapiens
ccagcccctgccc

SEQ ID NO: 2689106 - DNA, 13 bp, Homo sapiens
ccagccctcagca

SEQ ID NO: 2689107 - DNA, 16 bp, Homo sapiens
ccagccctcagcattg

SEQ ID NO: 2689108 - DNA, 20 bp, Homo sapiens
ccagccggacacaagcggcc

SEQ ID NO: 2689109 - DNA, 12 bp, Homo sapiens
ccagcctgagca

SEQ ID NO: 2689110 - DNA, 10 bp, Homo sapiens
ccagcctggc

SEQ ID NO: 2689111 - DNA, 12 bp, Homo sapiens
ccagcctggcca

SEQ ID NO: 2689112 - DNA, 13 bp, Homo sapiens
ccagcctggcttc

SEQ ID NO: 2689113 - DNA, 18 bp, Homo sapiens
ccagcctggcttctggag

SEQ ID NO: 2689114 - DNA, 20 bp, Homo sapiens
ccagcctggcttctggagcc

SEQ ID NO: 2689115 - DNA, 16 bp, Homo sapiens
ccagcctgggcgacag

SEQ ID NO: 2689116 - DNA, 14 bp, Homo sapiens
ccagcctgttggac

SEQ ID NO: 2689117 - DNA, 16 bp, Homo sapiens
ccagctactcagaagc

SEQ ID NO: 2689118 - DNA, 17 bp, Homo sapiens
ccagctactcagaagcc

SEQ ID NO: 2689119 - DNA, 20 bp, Homo sapiens
ccagctactcagaagcctga

SEQ ID NO: 2689120 - DNA, 20 bp, Homo sapiens
ccagctacttgggaggctga

SEQ ID NO: 2689121 - DNA, 16 bp, Homo sapiens
ccagctattttctgac

SEQ ID NO: 2689122 - DNA, 19 bp, Homo sapiens
ccagctattttctgaccaa

SEQ ID NO: 2689123 - DNA, 19 bp, Homo sapiens
ccagctctcttcctgtctt

SEQ ID NO: 2689124 - DNA, 17 bp, Homo sapiens
ccagctgcacctgccag

SEQ ID NO: 2689125 - DNA, 19 bp, Homo sapiens
ccagctggccacctagaag

SEQ ID NO: 2689126 - DNA, 20 bp, Homo sapiens
ccagctggcctctagaacac

SEQ ID NO: 2689127 - DNA, 12 bp, Homo sapiens
ccagcttcctgt

SEQ ID NO: 2689128 - DNA, 21 bp, Homo sapiens
ccagctttccttctgcccttc

SEQ ID NO: 2689129 - DNA, 14 bp, Homo sapiens
ccaggaagctccct

SEQ ID NO: 2689130 - DNA, 19 bp, Homo sapiens
ccaggagaaggggcccaag

SEQ ID NO: 2689131 - DNA, 19 bp, Homo sapiens
ccaggagcaaatgtttctg

SEQ ID NO: 2689132 - DNA, 23 bp, Homo sapiens
ccaggagcaaatgtttctgcagt

SEQ ID NO: 2689133 - DNA, 20 bp, Homo sapiens
ccaggaggggcctctgaaat

SEQ ID NO: 2689134 - DNA, 19 bp, Homo sapiens
ccaggatcactctctgctg

SEQ ID NO: 2689135 - DNA, 17 bp, Homo sapiens
ccaggatgacacctcca

SEQ ID NO: 2689136 - DNA, 22 bp, Homo sapiens
ccaggatgacacctccatttct

SEQ ID NO: 2689137 - DNA, 23 bp, Homo sapiens
ccaggcctgattcactggcctgg

SEQ ID NO: 2689138 - DNA, 24 bp, Homo sapiens
ccaggcctgattcactggcctggc

SEQ ID NO: 2689139 - DNA, 15 bp, Homo sapiens
ccaggctgagagcca

SEQ ID NO: 2689140 - DNA, 16 bp, Homo sapiens
ccaggctgagagccag

SEQ ID NO: 2689141 - DNA, 14 bp, Homo sapiens
ccagggactgacac

SEQ ID NO: 2689142 - DNA, 16 bp, Homo sapiens
ccagggccagggccct

SEQ ID NO: 2689143 - DNA, 15 bp, Homo sapiens
ccagggccctgcaga

SEQ ID NO: 2689144 - DNA, 18 bp, Homo sapiens
ccaggtgccaccaataaa

SEQ ID NO: 2689145 - DNA, 21 bp, Homo sapiens
ccaggtgccaccaataaaaat

SEQ ID NO: 2689146 - DNA, 19 bp, Homo sapiens
ccaggtggaggtgccagga

SEQ ID NO: 2689147 - DNA, 14 bp, Homo sapiens
ccagtcaggcaggg

SEQ ID NO: 2689148 - DNA, 15 bp, Homo sapiens
ccagtcctagagctc

SEQ ID NO: 2689149 - DNA, 18 bp, Homo sapiens
ccagtcctagagctcctg

SEQ ID NO: 2689150 - DNA, 15 bp, Homo sapiens
ccagtgaaccaaaga

SEQ ID NO: 2689151 - DNA, 16 bp, Homo sapiens
ccagtgaaccaaagag

SEQ ID NO: 2689152 - DNA, 17 bp, Homo sapiens
ccagtgaaggagccacg

SEQ ID NO: 2689153 - DNA, 18 bp, Homo sapiens
ccagtggcctggcttgtc

SEQ ID NO: 2689154 - DNA, 14 bp, Homo sapiens
ccagtggttgctgt

SEQ ID NO: 2689155 - DNA, 15 bp, Homo sapiens
ccagtgtagccttgc

SEQ ID NO: 2689156 - DNA, 22 bp, Homo sapiens
ccataaacacccatgaatcaaa

SEQ ID NO: 2689157 - DNA, 14 bp, Homo sapiens
ccatacttcctggg

SEQ ID NO: 2689158 - DNA, 16 bp, Homo sapiens
ccatacttcctgggat

SEQ ID NO: 2689159 - DNA, 16 bp, Homo sapiens
ccatcattgcacctgc

SEQ ID NO: 2689160 - DNA, 20 bp, Homo sapiens
ccatcattgcacctgcaggc

SEQ ID NO: 2689161 - DNA, 22 bp, Homo sapiens
ccatcattgcacctgcaggctt

SEQ ID NO: 2689162 - DNA, 16 bp, Homo sapiens
ccatcctgaggtgcct

SEQ ID NO: 2689163 - DNA, 17 bp, Homo sapiens
ccatctcctttcaggga

SEQ ID NO: 2689164 - DNA, 18 bp, Homo sapiens
ccatctcctttcagggaa

SEQ ID NO: 2689165 - DNA, 16 bp, Homo sapiens
ccatctggtgcctttc

SEQ ID NO: 2689166 - DNA, 13 bp, Homo sapiens
ccatgcacctccc

SEQ ID NO: 2689167 - DNA, 20 bp, Homo sapiens
cctgttggacccgctctgga

SEQ ID NO: 2689168 - DNA, 17 bp, Homo sapiens
cctgtttaaaaaaagta

SEQ ID NO: 2689169 - DNA, 18 bp, Homo sapiens
ccttagacggaggtgcct

SEQ ID NO: 2689170 - DNA, 18 bp, Homo sapiens
ccttagattagctctgga

SEQ ID NO: 2689171 - DNA, 14 bp, Homo sapiens
ccttattttgtatt

SEQ ID NO: 2689172 - DNA, 17 bp, Homo sapiens
ccttcaagttagctcag

SEQ ID NO: 2689173 - DNA, 15 bp, Homo sapiens
ccttccatcttcaca

SEQ ID NO: 2689174 - DNA, 18 bp, Homo sapiens
ccttccatcttcacactg

SEQ ID NO: 2689175 - DNA, 16 bp, Homo sapiens
ccttcctgtcccacct

SEQ ID NO: 2689176 - DNA, 19 bp, Homo sapiens
ccttcctgtcccacctctt

SEQ ID NO: 2689177 - DNA, 19 bp, Homo sapiens
ccttcgtctccatctctgg

SEQ ID NO: 2689178 - DNA, 22 bp, Homo sapiens
ccttcgtctccatctctggttg

SEQ ID NO: 2689179 - DNA, 15 bp, Homo sapiens
ccttctctctttcta

SEQ ID NO: 2689180 - DNA, 14 bp, Homo sapiens
ccttctgcccttcc

SEQ ID NO: 2689181 - DNA, 14 bp, Homo sapiens
ccttgagcaccagc

SEQ ID NO: 2689182 - DNA, 15 bp, Homo sapiens
ccttgagtggggcag

SEQ ID NO: 2689183 - DNA, 14 bp, Homo sapiens
ccttgcccctgctc

SEQ ID NO: 2689184 - DNA, 21 bp, Homo sapiens
ccttgcccctgctctgtagcc

SEQ ID NO: 2689185 - DNA, 18 bp, Homo sapiens
ccttgctagacagccagg

SEQ ID NO: 2689186 - DNA, 17 bp, Homo sapiens
ccttggcaccggcctct

SEQ ID NO: 2689187 - DNA, 19 bp, Homo sapiens
ccttggcatcacagggcag

SEQ ID NO: 2689188 - DNA, 19 bp, Homo sapiens
ccttggccgtgaggacacg

SEQ ID NO: 2689189 - DNA, 22 bp, Homo sapiens
ccttgtgggaccagtcccacac

SEQ ID NO: 2689190 - DNA, 19 bp, Homo sapiens
ccttgttttattcaaagac

SEQ ID NO: 2689191 - DNA, 18 bp, Homo sapiens
cctttactcagcccagct

SEQ ID NO: 2689192 - DNA, 15 bp, Homo sapiens
cctttcaggccaagg

SEQ ID NO: 2689193 - DNA, 12 bp, Homo sapiens
cctttcagggaa

SEQ ID NO: 2689194 - DNA, 20 bp, Homo sapiens
cctttcagggaatttcagga

SEQ ID NO: 2689195 - DNA, 22 bp, Homo sapiens
cctttctgtaggtttctctctt

SEQ ID NO: 2689196 - DNA, 15 bp, Homo sapiens
cctttgccctgtcac

SEQ ID NO: 2689197 - DNA, 13 bp, Homo sapiens
ccttttccccagg

SEQ ID NO: 2689198 - DNA, 16 bp, Homo sapiens
ccttttccccaggagc

SEQ ID NO: 2689199 - DNA, 17 bp, Homo sapiens
ccttttccccaggagca

SEQ ID NO: 2689200 - DNA, 18 bp, Homo sapiens
ccttttcttctagctttg

SEQ ID NO: 2689201 - DNA, 15 bp, Homo sapiens
cgaacgctcttagct

SEQ ID NO: 2689202 - DNA, 21 bp, Homo sapiens
cgaagaacaatgtcagaaact

SEQ ID NO: 2689203 - DNA, 15 bp, Homo sapiens
cgacagttctgaact

SEQ ID NO: 2689204 - DNA, 21 bp, Homo sapiens
cgacccgggtctggtgctgag

SEQ ID NO: 2689205 - DNA, 22 bp, Homo sapiens
cgacttttctaaagctctgaac

SEQ ID NO: 2689206 - DNA, 16 bp, Homo sapiens
cgagaccagcctggcc

SEQ ID NO: 2689207 - DNA, 14 bp, Homo sapiens
cgagagtctgtctc

SEQ ID NO: 2689208 - DNA, 15 bp, Homo sapiens
cgagagtctgtctca

SEQ ID NO: 2689209 - DNA, 13 bp, Homo sapiens
cgaggcctgacac

SEQ ID NO: 2689210 - DNA, 19 bp, Homo sapiens
cgaggcctgacacaggcca

SEQ ID NO: 2689211 - DNA, 21 bp, Homo sapiens
cgatgaatttggagactctgt

SEQ ID NO: 2689212 - DNA, 19 bp, Homo sapiens
cgatgcctgcaggcatgga

SEQ ID NO: 2689213 - DNA, 14 bp, Homo sapiens
cgatgctgaggcca

SEQ ID NO: 2689214 - DNA, 17 bp, Homo sapiens
cgatgctgaggccaccc

SEQ ID NO: 2689215 - DNA, 14 bp, Homo sapiens
cgcaaggctgtgct

SEQ ID NO: 2689216 - DNA, 22 bp, Homo sapiens
cgcaaggctgtgctcttcctct

SEQ ID NO: 2689217 - DNA, 22 bp, Homo sapiens
cgcacccctacttcacagagga

SEQ ID NO: 2689218 - DNA, 14 bp, Homo sapiens
cgcagagccctcca

SEQ ID NO: 2689219 - DNA, 15 bp, Homo sapiens
cgcagagccctccag

SEQ ID NO: 2689220 - DNA, 18 bp, Homo sapiens
cgcagagccctccaggcc

SEQ ID NO: 2689221 - DNA, 19 bp, Homo sapiens
cgcagagccctccaggcct

SEQ ID NO: 2689222 - DNA, 19 bp, Homo sapiens
cgcagattgggctggctct

SEQ ID NO: 2689223 - DNA, 20 bp, Homo sapiens
cgcagattgggctggctctg

SEQ ID NO: 2689224 - DNA, 22 bp, Homo sapiens
cgcagtctggcctgggcgacag

SEQ ID NO: 2689225 - DNA, 18 bp, Homo sapiens
cgcccagctgcacctgcc

SEQ ID NO: 2689226 - DNA, 23 bp, Homo sapiens
cgcccagctgcacctgccagcct

SEQ ID NO: 2689227 - DNA, 21 bp, Homo sapiens
cgccctccgtcgggcccctgc

SEQ ID NO: 2689228 - DNA, 22 bp, Homo sapiens
cgcctccccatacttcctggga

SEQ ID NO: 2689229 - DNA, 13 bp, Homo sapiens
cgcctgccacctc

SEQ ID NO: 2689230 - DNA, 19 bp, Homo sapiens
cgcctgtaatcccagcact

SEQ ID NO: 2689231 - DNA, 22 bp, Homo sapiens
cgccttcactccggtgtgcctg

SEQ ID NO: 2689232 - DNA, 22 bp, Homo sapiens
cgcgccactacactccagcctg

SEQ ID NO: 2689233 - DNA, 23 bp, Homo sapiens
cgcgccactacactccagcctga

SEQ ID NO: 2689234 - DNA, 13 bp, Homo sapiens
cgcgtccctgccc

SEQ ID NO: 2689235 - DNA, 21 bp, Homo sapiens
cgctcacctcagagcagggcc

SEQ ID NO: 2689236 - DNA, 14 bp, Homo sapiens
cgctgcagcctccc

SEQ ID NO: 2689237 - DNA, 15 bp, Homo sapiens
cgctgcagcctccct

SEQ ID NO: 2689238 - DNA, 12 bp, Homo sapiens
cgctgccctgtg

SEQ ID NO: 2689239 - DNA, 13 bp, Homo sapiens
cgctgccctgtga

SEQ ID NO: 2689240 - DNA, 18 bp, Homo sapiens
cgctggtccctgccctcc

SEQ ID NO: 2689241 - DNA, 14 bp, Homo sapiens
cgctttccttcctc

SEQ ID NO: 2689242 - DNA, 21 bp, Homo sapiens
cgctttccttcctcccctttt

SEQ ID NO: 2689243 - DNA, 19 bp, Homo sapiens
cggagcaagtttcatcagc

SEQ ID NO: 2689244 - DNA, 19 bp, Homo sapiens
cggcacccaggcctccctg

SEQ ID NO: 2689245 - DNA, 13 bp, Homo sapiens
cggcatcctgaaa

SEQ ID NO: 2689246 - DNA, 14 bp, Homo sapiens
cggccctcctggga

SEQ ID NO: 2689247 - DNA, 20 bp, Homo sapiens
cggcgcagagccctccaggc

SEQ ID NO: 2689248 - DNA, 20 bp, Homo sapiens
cggctcccgcttgctctcct

SEQ ID NO: 2689249 - DNA, 17 bp, Homo sapiens
cgggacagaccagcagc

SEQ ID NO: 2689250 - DNA, 18 bp, Homo sapiens
cgggatggtcctggggct

SEQ ID NO: 2689251 - DNA, 21 bp, Homo sapiens
cgggcacctatagtcccagct

SEQ ID NO: 2689252 - DNA, 15 bp, Homo sapiens
cgggcccctgcctgc

SEQ ID NO: 2689253 - DNA, 18 bp, Homo sapiens
cgggcccctgcctgcctt

SEQ ID NO: 2689254 - DNA, 20 bp, Homo sapiens
cgggcccctgcctgccttct

SEQ ID NO: 2689255 - DNA, 14 bp, Homo sapiens
cgggcgctgcagcc

SEQ ID NO: 2689256 - DNA, 15 bp, Homo sapiens
cgggcgctgcagcct

SEQ ID NO: 2689257 - DNA, 17 bp, Homo sapiens
cgggcgctgcagcctcc

SEQ ID NO: 2689258 - DNA, 15 bp, Homo sapiens
cgggctgtccgtgtg

SEQ ID NO: 2689259 - DNA, 22 bp, Homo sapiens
cggggaccttgtgggaccagtc

SEQ ID NO: 2689260 - DNA, 21 bp, Homo sapiens
cggggaggcaggggtcctgca

SEQ ID NO: 2689261 - DNA, 18 bp, Homo sapiens
cggggatcatctctgtga

SEQ ID NO: 2689262 - DNA, 17 bp, Homo sapiens
cggggcatgctggggca

SEQ ID NO: 2689263 - DNA, 14 bp, Homo sapiens
cggggctgctggcc

SEQ ID NO: 2689264 - DNA, 15 bp, Homo sapiens
cggggctgctggcct

SEQ ID NO: 2689265 - DNA, 16 bp, Homo sapiens
cggggctgctggcctg

SEQ ID NO: 2689266 - DNA, 15 bp, Homo sapiens
cggtgagtgatggca

SEQ ID NO: 2689267 - DNA, 15 bp, Homo sapiens
cggtgtgcctgcagc

SEQ ID NO: 2689268 - DNA, 17 bp, Homo sapiens
cggtgtgcctgcagccc

SEQ ID NO: 2689269 - DNA, 17 bp, Homo sapiens
cgtaagatggcttattt

SEQ ID NO: 2689270 - DNA, 16 bp, Homo sapiens
cgtaattaaaagaatt

SEQ ID NO: 2689271 - DNA, 15 bp, Homo sapiens
cgtctccatctctgg

SEQ ID NO: 2689272 - DNA, 13 bp, Homo sapiens
cgtctcctgctgc

SEQ ID NO: 2689273 - DNA, 17 bp, Homo sapiens
cgtgatggaccaaagcc

SEQ ID NO: 2689274 - DNA, 23 bp, Homo sapiens
cgtgatggaccaaagccacctgc

SEQ ID NO: 2689275 - DNA, 12 bp, Homo sapiens
cgtggacacctg

SEQ ID NO: 2689276 - DNA, 13 bp, Homo sapiens
cgtggacacctgc

SEQ ID NO: 2689277 - DNA, 23 bp, Homo sapiens
ctggatggcatctagccagaggc

SEQ ID NO: 2689278 - DNA, 21 bp, Homo sapiens
ctggattaatgttttgtacaa

SEQ ID NO: 2689279 - DNA, 13 bp, Homo sapiens
ctggcaggagcct

SEQ ID NO: 2689280 - DNA, 19 bp, Homo sapiens
ctggcaggagcctcgtgtc

SEQ ID NO: 2689281 - DNA, 23 bp, Homo sapiens
ctggcaggattcttcccgctccc

SEQ ID NO: 2689282 - DNA, 14 bp, Homo sapiens
ctggccaggcatgg

SEQ ID NO: 2689283 - DNA, 12 bp, Homo sapiens
ctggccctgcct

SEQ ID NO: 2689284 - DNA, 14 bp, Homo sapiens
ctggcctctagaac

SEQ ID NO: 2689285 - DNA, 20 bp, Homo sapiens
ctggcctctagaacacccac

SEQ ID NO: 2689286 - DNA, 21 bp, Homo sapiens
ctggcctctagaacacccact

SEQ ID NO: 2689287 - DNA, 23 bp, Homo sapiens
ctggcctctagaacacccactgg

SEQ ID NO: 2689288 - DNA, 14 bp, Homo sapiens
ctggcctggccctt

SEQ ID NO: 2689289 - DNA, 16 bp, Homo sapiens
ctggctctgaagccaa

SEQ ID NO: 2689290 - DNA, 13 bp, Homo sapiens
ctggctgcagtga

SEQ ID NO: 2689291 - DNA, 14 bp, Homo sapiens
ctggctgctccctg

SEQ ID NO: 2689292 - DNA, 21 bp, Homo sapiens
ctggctggagtctcagagcac

SEQ ID NO: 2689293 - DNA, 23 bp, Homo sapiens
ctggctggagtctcagagcacag

SEQ ID NO: 2689294 - DNA, 14 bp, Homo sapiens
ctggctgggcatgg

SEQ ID NO: 2689295 - DNA, 12 bp, Homo sapiens
ctggctgtgggt

SEQ ID NO: 2689296 - DNA, 23 bp, Homo sapiens
ctggcttatgctcagaagccagt

SEQ ID NO: 2689297 - DNA, 14 bp, Homo sapiens
ctggcttctggagc

SEQ ID NO: 2689298 - DNA, 15 bp, Homo sapiens
ctggcttctggagcc

SEQ ID NO: 2689299 - DNA, 14 bp, Homo sapiens
ctgggaacctcctt

SEQ ID NO: 2689300 - DNA, 18 bp, Homo sapiens
ctgggaacctccttacct

SEQ ID NO: 2689301 - DNA, 20 bp, Homo sapiens
ctgggaacctccttacctgg

SEQ ID NO: 2689302 - DNA, 23 bp, Homo sapiens
ctgggaaggggaacacagaccag

SEQ ID NO: 2689303 - DNA, 21 bp, Homo sapiens
ctgggacccacctccccctcc

SEQ ID NO: 2689304 - DNA, 12 bp, Homo sapiens
ctgggagaacct

SEQ ID NO: 2689305 - DNA, 17 bp, Homo sapiens
ctgggagaacctcaggc

SEQ ID NO: 2689306 - DNA, 13 bp, Homo sapiens
ctgggaggaagca

SEQ ID NO: 2689307 - DNA, 21 bp, Homo sapiens
ctgggaggaagcaggttgagg

SEQ ID NO: 2689308 - DNA, 14 bp, Homo sapiens
ctgggatgtagaac

SEQ ID NO: 2689309 - DNA, 16 bp, Homo sapiens
ctgggatgtagaactt

SEQ ID NO: 2689310 - DNA, 14 bp, Homo sapiens
ctgggattcctccc

SEQ ID NO: 2689311 - DNA, 18 bp, Homo sapiens
ctgggccaagttcctcta

SEQ ID NO: 2689312 - DNA, 16 bp, Homo sapiens
ctgggcctgggttcca

SEQ ID NO: 2689313 - DNA, 21 bp, Homo sapiens
ctgggcgacagagcgagactc

SEQ ID NO: 2689314 - DNA, 18 bp, Homo sapiens
ctgggctctgccccagct

SEQ ID NO: 2689315 - DNA, 21 bp, Homo sapiens
ctggggcaagtccctgactct

SEQ ID NO: 2689316 - DNA, 15 bp, Homo sapiens
ctggggcccgcctgc

SEQ ID NO: 2689317 - DNA, 14 bp, Homo sapiens
ctggggctctgtgc

SEQ ID NO: 2689318 - DNA, 15 bp, Homo sapiens
ctggggctgagcttt

SEQ ID NO: 2689319 - DNA, 17 bp, Homo sapiens
ctggggttcaagcccag

SEQ ID NO: 2689320 - DNA, 18 bp, Homo sapiens
ctggggttcaagcccagg

SEQ ID NO: 2689321 - DNA, 20 bp, Homo sapiens
ctggggttcaagcccaggct

SEQ ID NO: 2689322 - DNA, 22 bp, Homo sapiens
ctggggttcaagcccaggcttc

SEQ ID NO: 2689323 - DNA, 15 bp, Homo sapiens
ctgggtcctgcctgg

SEQ ID NO: 2689324 - DNA, 16 bp, Homo sapiens
ctgggtcctgcctggt

SEQ ID NO: 2689325 - DNA, 19 bp, Homo sapiens
ctgggtcctgcctggtcct

SEQ ID NO: 2689326 - DNA, 13 bp, Homo sapiens
ctgggtgcctcct

SEQ ID NO: 2689327 - DNA, 13 bp, Homo sapiens
ctgggttttgtag

SEQ ID NO: 2689328 - DNA, 23 bp, Homo sapiens
ctggtatgaacttgaggacacat

SEQ ID NO: 2689329 - DNA, 17 bp, Homo sapiens
ctggtccctgccctccc

SEQ ID NO: 2689330 - DNA, 21 bp, Homo sapiens
ctggtccctgccctcccctgc

SEQ ID NO: 2689331 - DNA, 20 bp, Homo sapiens
ctggtcctccctcccaagga

SEQ ID NO: 2689332 - DNA, 15 bp, Homo sapiens
ctggtgatatatctc

SEQ ID NO: 2689333 - DNA, 14 bp, Homo sapiens
ctggtgcctttcca

SEQ ID NO: 2689334 - DNA, 19 bp, Homo sapiens
ctggtgcctttccacacag

SEQ ID NO: 2689335 - DNA, 17 bp, Homo sapiens
ctggtggacagtcctgg

SEQ ID NO: 2689336 - DNA, 22 bp, Homo sapiens
ctggtgggtcagcccagcacct

SEQ ID NO: 2689337 - DNA, 14 bp, Homo sapiens
ctggtggtcacagg

SEQ ID NO: 2689338 - DNA, 19 bp, Homo sapiens
ctggtggtcacaggctgtg

SEQ ID NO: 2689339 - DNA, 20 bp, Homo sapiens
ctgtaacacaagccacagaa

SEQ ID NO: 2689340 - DNA, 22 bp, Homo sapiens
ctgtaacacaagccacagaagc

SEQ ID NO: 2689341 - DNA, 15 bp, Homo sapiens
ctgtagcatcttctg

SEQ ID NO: 2689342 - DNA, 16 bp, Homo sapiens
ctgtagcatcttctgg

SEQ ID NO: 2689343 - DNA, 19 bp, Homo sapiens
ctgtagcatcttctggagt

SEQ ID NO: 2689344 - DNA, 20 bp, Homo sapiens
ctgtagcatcttctggagtc

SEQ ID NO: 2689345 - DNA, 22 bp, Homo sapiens
ctgtagccacctccttggcacc

SEQ ID NO: 2689346 - DNA, 21 bp, Homo sapiens
ctgtaggtttctctcttccct

SEQ ID NO: 2689347 - DNA, 15 bp, Homo sapiens
ctgtatatgttgtaa

SEQ ID NO: 2689348 - DNA, 16 bp, Homo sapiens
ctgtatatgttgtaat

SEQ ID NO: 2689349 - DNA, 19 bp, Homo sapiens
ctgtatatgttgtaataaa

SEQ ID NO: 2689350 - DNA, 21 bp, Homo sapiens
ctgtatttaagatttttgtaa

SEQ ID NO: 2689351 - DNA, 15 bp, Homo sapiens
ctgtcattgcccctc

SEQ ID NO: 2689352 - DNA, 15 bp, Homo sapiens
ctgtcccacctcttc

SEQ ID NO: 2689353 - DNA, 17 bp, Homo sapiens
ctgtccctacccactct

SEQ ID NO: 2689354 - DNA, 16 bp, Homo sapiens
ctgtccgtgtgcctcc

SEQ ID NO: 2689355 - DNA, 21 bp, Homo sapiens
ctgtccgtgtgcctcctgtgt

SEQ ID NO: 2689356 - DNA, 23 bp, Homo sapiens
ctgtccgtgtgcctcctgtgtgt

SEQ ID NO: 2689357 - DNA, 13 bp, Homo sapiens
ctgtctcctgtct

SEQ ID NO: 2689358 - DNA, 13 bp, Homo sapiens
ctgtctctcttgt

SEQ ID NO: 2689359 - DNA, 14 bp, Homo sapiens
ctgtcttcagagca

SEQ ID NO: 2689360 - DNA, 15 bp, Homo sapiens
ctgtcttcagagcaa

SEQ ID NO: 2689361 - DNA, 18 bp, Homo sapiens
ctgtctttagaatcgctt

SEQ ID NO: 2689362 - DNA, 20 bp, Homo sapiens
ctgtctttagaatcgctttc

SEQ ID NO: 2689363 - DNA, 18 bp, Homo sapiens
ctgtctttgttgtctccc

SEQ ID NO: 2689364 - DNA, 14 bp, Homo sapiens
ctgtgaccctgggt

SEQ ID NO: 2689365 - DNA, 15 bp, Homo sapiens
ctgtgaccctgggtc

SEQ ID NO: 2689366 - DNA, 22 bp, Homo sapiens
ctgtgaccctgggtcgggacag

SEQ ID NO: 2689367 - DNA, 22 bp, Homo sapiens
ctgtgacctgccccgcccagct

SEQ ID NO: 2689368 - DNA, 13 bp, Homo sapiens
ctgtgcagggagg

SEQ ID NO: 2689369 - DNA, 21 bp, Homo sapiens
ctgtgctcgggtgctgccagc

SEQ ID NO: 2689370 - DNA, 15 bp, Homo sapiens
ctgtgctgaggactc

SEQ ID NO: 2689371 - DNA, 16 bp, Homo sapiens
ctgtgctttgactcac

SEQ ID NO: 2689372 - DNA, 13 bp, Homo sapiens
ctgtggcctgggc

SEQ ID NO: 2689373 - DNA, 16 bp, Homo sapiens
ctgtggcctgggcaag

SEQ ID NO: 2689374 - DNA, 23 bp, Homo sapiens
ctgtgggtatcaggactgtgacc

SEQ ID NO: 2689375 - DNA, 14 bp, Homo sapiens
ctgtgtgtctgcag

SEQ ID NO: 2689376 - DNA, 18 bp, Homo sapiens
ctgtgttgcgtgtcgtgg

SEQ ID NO: 2689377 - DNA, 20 bp, Homo sapiens
ctgtgttgcgtgtcgtgggt

SEQ ID NO: 2689378 - DNA, 21 bp, Homo sapiens
ctgttattttttatttccaca

SEQ ID NO: 2689379 - DNA, 14 bp, Homo sapiens
ctgttctctttgct

SEQ ID NO: 2689380 - DNA, 17 bp, Homo sapiens
ctgttgcactgatgtcc

SEQ ID NO: 2689381 - DNA, 21 bp, Homo sapiens
ctgttgcctttttacagccaa

SEQ ID NO: 2689382 - DNA, 22 bp, Homo sapiens
ctgttggacccgctctggacca

SEQ ID NO: 2689383 - DNA, 14 bp, Homo sapiens
ctgttttgcttttg

SEQ ID NO: 2689384 - DNA, 21 bp, Homo sapiens
cttaaattgcttttgttgtga

SEQ ID NO: 2689385 - DNA, 13 bp, Homo sapiens
cttaagcatgacg

SEQ ID NO: 2689386 - DNA, 20 bp, Homo sapiens
cttagaaatcattgtagaaa

SEQ ID NO: 2689387 - DNA, 20 bp, Homo sapiens
gccaggagcaaatgtttctg

SEQ ID NO: 2689388 - DNA, 20 bp, Homo sapiens
gccaggaggttggtgactga

SEQ ID NO: 2689389 - DNA, 23 bp, Homo sapiens
gccaggaggttggtgactgaaac

SEQ ID NO: 2689390 - DNA, 22 bp, Homo sapiens
gccaggccaatgttgctgatgg

SEQ ID NO: 2689391 - DNA, 16 bp, Homo sapiens
gccagggccctgcaga

SEQ ID NO: 2689392 - DNA, 22 bp, Homo sapiens
gccaggtttctgcccacattgg

SEQ ID NO: 2689393 - DNA, 14 bp, Homo sapiens
gccagtcaggcagg

SEQ ID NO: 2689394 - DNA, 15 bp, Homo sapiens
gccagtgactttttc

SEQ ID NO: 2689395 - DNA, 13 bp, Homo sapiens
gccagttctgggg

SEQ ID NO: 2689396 - DNA, 15 bp, Homo sapiens
gccagttctggggcc

SEQ ID NO: 2689397 - DNA, 12 bp, Homo sapiens
gccattctgtgt

SEQ ID NO: 2689398 - DNA, 16 bp, Homo sapiens
gcccacccacatgact

SEQ ID NO: 2689399 - DNA, 16 bp, Homo sapiens
gcccagagggcccagg

SEQ ID NO: 2689400 - DNA, 14 bp, Homo sapiens
gcccagcacctgct

SEQ ID NO: 2689401 - DNA, 15 bp, Homo sapiens
gcccagcacctgctc

SEQ ID NO: 2689402 - DNA, 23 bp, Homo sapiens
gcccagccattaccatggagaca

SEQ ID NO: 2689403 - DNA, 13 bp, Homo sapiens
gcccagcccctgc

SEQ ID NO: 2689404 - DNA, 16 bp, Homo sapiens
gcccagcccctgcccc

SEQ ID NO: 2689405 - DNA, 14 bp, Homo sapiens
gcccagctgcacct

SEQ ID NO: 2689406 - DNA, 15 bp, Homo sapiens
gcccagctgcacctg

SEQ ID NO: 2689407 - DNA, 19 bp, Homo sapiens
gcccaggctggagtgcagt

SEQ ID NO: 2689408 - DNA, 14 bp, Homo sapiens
gcccaggcttcctg

SEQ ID NO: 2689409 - DNA, 19 bp, Homo sapiens
gcccaggcttcctgggtcc

SEQ ID NO: 2689410 - DNA, 20 bp, Homo sapiens
gccccaccctcgtggacacc

SEQ ID NO: 2689411 - DNA, 17 bp, Homo sapiens
gccccactgacacccag

SEQ ID NO: 2689412 - DNA, 15 bp, Homo sapiens
gccccagcttcctgt

SEQ ID NO: 2689413 - DNA, 22 bp, Homo sapiens
gccccaggatcactctctgctg

SEQ ID NO: 2689414 - DNA, 23 bp, Homo sapiens
gccccaggtgccaccaataaaaa

SEQ ID NO: 2689415 - DNA, 21 bp, Homo sapiens
gccccatcattgcacctgcag

SEQ ID NO: 2689416 - DNA, 21 bp, Homo sapiens
gcccccaccactaggactctg

SEQ ID NO: 2689417 - DNA, 23 bp, Homo sapiens
gcccccgtggggctcccggcatc

SEQ ID NO: 2689418 - DNA, 21 bp, Homo sapiens
gccccctggtggacagtcctg

SEQ ID NO: 2689419 - DNA, 22 bp, Homo sapiens
gccccctggtggacagtcctgg

SEQ ID NO: 2689420 - DNA, 22 bp, Homo sapiens
gccccgcctccccatacttcct

SEQ ID NO: 2689421 - DNA, 17 bp, Homo sapiens
gccccgcgcctccttcc

SEQ ID NO: 2689422 - DNA, 11 bp, Homo sapiens
gcccctccagc

SEQ ID NO: 2689423 - DNA, 14 bp, Homo sapiens
gcccctccagcaca

SEQ ID NO: 2689424 - DNA, 21 bp, Homo sapiens
gcccctccgatgctgaggcca

SEQ ID NO: 2689425 - DNA, 13 bp, Homo sapiens
gcccctgccccta

SEQ ID NO: 2689426 - DNA, 19 bp, Homo sapiens
gcccctgctctgtagccac

SEQ ID NO: 2689427 - DNA, 21 bp, Homo sapiens
gcccctgctctgtagccacct

SEQ ID NO: 2689428 - DNA, 17 bp, Homo sapiens
gcccgacagttctgaac

SEQ ID NO: 2689429 - DNA, 16 bp, Homo sapiens
gcccgcctgccacctc

SEQ ID NO: 2689430 - DNA, 15 bp, Homo sapiens
gcccggattctggga

SEQ ID NO: 2689431 - DNA, 14 bp, Homo sapiens
gccctcatctccag

SEQ ID NO: 2689432 - DNA, 15 bp, Homo sapiens
gccctccaggcctgc

SEQ ID NO: 2689433 - DNA, 17 bp, Homo sapiens
gccctccatggcctggc

SEQ ID NO: 2689434 - DNA, 16 bp, Homo sapiens
gccctcccctgctccc

SEQ ID NO: 2689435 - DNA, 15 bp, Homo sapiens
gccctccctttctct

SEQ ID NO: 2689436 - DNA, 21 bp, Homo sapiens
gccctccctttctctctccac

SEQ ID NO: 2689437 - DNA, 23 bp, Homo sapiens
gccctccgtcgggcccctgcctg

SEQ ID NO: 2689438 - DNA, 10 bp, Homo sapiens
gccctcctgg

SEQ ID NO: 2689439 - DNA, 11 bp, Homo sapiens
gccctcctggg

SEQ ID NO: 2689440 - DNA, 16 bp, Homo sapiens
gccctgccacctgtct

SEQ ID NO: 2689441 - DNA, 17 bp, Homo sapiens
gccctgctctttctctg

SEQ ID NO: 2689442 - DNA, 12 bp, Homo sapiens
gccctggctgtg

SEQ ID NO: 2689443 - DNA, 18 bp, Homo sapiens
gccctggtccttccaggc

SEQ ID NO: 2689444 - DNA, 16 bp, Homo sapiens
gccctgtgagagccac

SEQ ID NO: 2689445 - DNA, 17 bp, Homo sapiens
gccctgtgagagccacg

SEQ ID NO: 2689446 - DNA, 19 bp, Homo sapiens
gccctgtgagagccacgct

SEQ ID NO: 2689447 - DNA, 14 bp, Homo sapiens
gcccttcctccagg

SEQ ID NO: 2689448 - DNA, 16 bp, Homo sapiens
gcccttcctccaggag

SEQ ID NO: 2689449 - DNA, 20 bp, Homo sapiens
gccgagatcacgccactgca

SEQ ID NO: 2689450 - DNA, 22 bp, Homo sapiens
gccgagatcacgccactgcact

SEQ ID NO: 2689451 - DNA, 17 bp, Homo sapiens
gccgcagcctccctctg

SEQ ID NO: 2689452 - DNA, 20 bp, Homo sapiens
gccggacacaagcggccctg

SEQ ID NO: 2689453 - DNA, 22 bp, Homo sapiens
gccgggcgtggtggcgggcacc

SEQ ID NO: 2689454 - DNA, 21 bp, Homo sapiens
gccgtgttactgttgcactga

SEQ ID NO: 2689455 - DNA, 22 bp, Homo sapiens
gcctagttcctgtggccaggag

SEQ ID NO: 2689456 - DNA, 13 bp, Homo sapiens
gcctcaagcgtgg

SEQ ID NO: 2689457 - DNA, 22 bp, Homo sapiens
gcctccaaatgccaacttgtcc

SEQ ID NO: 2689458 - DNA, 14 bp, Homo sapiens
gcctcccagtggcc

SEQ ID NO: 2689459 - DNA, 18 bp, Homo sapiens
gcctcccagtggcctggc

SEQ ID NO: 2689460 - DNA, 18 bp, Homo sapiens
gcctccccatacttcctg

SEQ ID NO: 2689461 - DNA, 20 bp, Homo sapiens
gcctccccatacttcctggg

SEQ ID NO: 2689462 - DNA, 22 bp, Homo sapiens
gcctccccatacttcctgggat

SEQ ID NO: 2689463 - DNA, 14 bp, Homo sapiens
gcctccctctgacc

SEQ ID NO: 2689464 - DNA, 19 bp, Homo sapiens
gcctcccttccatgcccca

SEQ ID NO: 2689465 - DNA, 22 bp, Homo sapiens
gcctcccttccatgccccagga

SEQ ID NO: 2689466 - DNA, 13 bp, Homo sapiens
gcctcctccccag

SEQ ID NO: 2689467 - DNA, 12 bp, Homo sapiens
gcctcctgtgtg

SEQ ID NO: 2689468 - DNA, 17 bp, Homo sapiens
gcctcctgtgtgtctgc

SEQ ID NO: 2689469 - DNA, 20 bp, Homo sapiens
gcctccttccttgctgtcct

SEQ ID NO: 2689470 - DNA, 15 bp, Homo sapiens
gcctccttgcctgga

SEQ ID NO: 2689471 - DNA, 13 bp, Homo sapiens
gcctcgtgtcctg

SEQ ID NO: 2689472 - DNA, 17 bp, Homo sapiens
gcctcgtgtcctgctag

SEQ ID NO: 2689473 - DNA, 15 bp, Homo sapiens
gcctctagaacaccc

SEQ ID NO: 2689474 - DNA, 19 bp, Homo sapiens
gcctctagaacacccactg

SEQ ID NO: 2689475 - DNA, 20 bp, Homo sapiens
gcctctagaacacccactgg

SEQ ID NO: 2689476 - DNA, 11 bp, Homo sapiens
gcctctgctgc

SEQ ID NO: 2689477 - DNA, 15 bp, Homo sapiens
gcctctgctgccatg

SEQ ID NO: 2689478 - DNA, 14 bp, Homo sapiens
gcctcttagtgatt

SEQ ID NO: 2689479 - DNA, 15 bp, Homo sapiens
gcctgacacaggcca

SEQ ID NO: 2689480 - DNA, 19 bp, Homo sapiens
gcctgacacaggccagcct

SEQ ID NO: 2689481 - DNA, 13 bp, Homo sapiens
gcctgaggctggg

SEQ ID NO: 2689482 - DNA, 18 bp, Homo sapiens
gcctgattcactggcctg

SEQ ID NO: 2689483 - DNA, 13 bp, Homo sapiens
gcctgcaggcatg

SEQ ID NO: 2689484 - DNA, 12 bp, Homo sapiens
gcctgccacctc

SEQ ID NO: 2689485 - DNA, 17 bp, Homo sapiens
gcctgccacctctccca

SEQ ID NO: 2689486 - DNA, 18 bp, Homo sapiens
gcctgccacctctcccag

SEQ ID NO: 2689487 - DNA, 18 bp, Homo sapiens
gcctgccttctcccctcc

SEQ ID NO: 2689488 - DNA, 15 bp, Homo sapiens
gcctggactgactgc

SEQ ID NO: 2689489 - DNA, 18 bp, Homo sapiens
gcctggactgactgcagc

SEQ ID NO: 2689490 - DNA, 19 bp, Homo sapiens
gcctggactgactgcagcc

SEQ ID NO: 2689491 - DNA, 11 bp, Homo sapiens
gcctggccctt

SEQ ID NO: 2689492 - DNA, 14 bp, Homo sapiens
gcctggcttctgga

SEQ ID NO: 2689493 - DNA, 15 bp, Homo sapiens
gcctggcttctggag

SEQ ID NO: 2689494 - DNA, 12 bp, Homo sapiens
gcctgggcaaga

SEQ ID NO: 2689495 - DNA, 13 bp, Homo sapiens
gcctggtcctccc

SEQ ID NO: 2689496 - DNA, 14 bp, Homo sapiens
gcctggtcctccct

SEQ ID NO: 2689497 - DNA, 14 bp, Homo sapiens
ggaggttgcagtga

SEQ ID NO: 2689498 - DNA, 12 bp, Homo sapiens
ggagtgcagtgg

SEQ ID NO: 2689499 - DNA, 18 bp, Homo sapiens
ggagttcgagaccagcct

SEQ ID NO: 2689500 - DNA, 13 bp, Homo sapiens
ggagtttgaggct

SEQ ID NO: 2689501 - DNA, 18 bp, Homo sapiens
ggatcactctctgctggc

SEQ ID NO: 2689502 - DNA, 18 bp, Homo sapiens
ggatcactggagcccagg

SEQ ID NO: 2689503 - DNA, 15 bp, Homo sapiens
ggatcatctctgtga

SEQ ID NO: 2689504 - DNA, 23 bp, Homo sapiens
ggatggcatctagccagaggctg

SEQ ID NO: 2689505 - DNA, 21 bp, Homo sapiens
ggatgggatcccaggccaggg

SEQ ID NO: 2689506 - DNA, 23 bp, Homo sapiens
ggcaagtccctgactctctgtga

SEQ ID NO: 2689507 - DNA, 12 bp, Homo sapiens
ggcaccagaggc

SEQ ID NO: 2689508 - DNA, 18 bp, Homo sapiens
ggcagaacgatgcctgca

SEQ ID NO: 2689509 - DNA, 17 bp, Homo sapiens
ggcagcctccttgcctg

SEQ ID NO: 2689510 - DNA, 17 bp, Homo sapiens
ggcagctcctgaccaaa

SEQ ID NO: 2689511 - DNA, 21 bp, Homo sapiens
ggcagctgaactattggaggg

SEQ ID NO: 2689512 - DNA, 19 bp, Homo sapiens
ggcaggaggccccaggctg

SEQ ID NO: 2689513 - DNA, 20 bp, Homo sapiens
ggcaggggtcctgcaggtcc

SEQ ID NO: 2689514 - DNA, 14 bp, Homo sapiens
ggcatcacagggca

SEQ ID NO: 2689515 - DNA, 13 bp, Homo sapiens
ggcatcctgaaag

SEQ ID NO: 2689516 - DNA, 19 bp, Homo sapiens
ggcatcctgaaagccagca

SEQ ID NO: 2689517 - DNA, 20 bp, Homo sapiens
ggcatcctgcttcctgaaag

SEQ ID NO: 2689518 - DNA, 18 bp, Homo sapiens
ggcatctctaattggaag

SEQ ID NO: 2689519 - DNA, 12 bp, Homo sapiens
ggcatgctgggg

SEQ ID NO: 2689520 - DNA, 14 bp, Homo sapiens
ggcatgctggggca

SEQ ID NO: 2689521 - DNA, 16 bp, Homo sapiens
ggcatgctggggcaag

SEQ ID NO: 2689522 - DNA, 16 bp, Homo sapiens
ggccaaagcacagctg

SEQ ID NO: 2689523 - DNA, 16 bp, Homo sapiens
ggccacccactgaccc

SEQ ID NO: 2689524 - DNA, 23 bp, Homo sapiens
ggccacctagaagtctccctgca

SEQ ID NO: 2689525 - DNA, 22 bp, Homo sapiens
ggccagccggacacaagcggcc

SEQ ID NO: 2689526 - DNA, 13 bp, Homo sapiens
ggccagggccctg

SEQ ID NO: 2689527 - DNA, 18 bp, Homo sapiens
ggccagggccctgcagag

SEQ ID NO: 2689528 - DNA, 17 bp, Homo sapiens
ggccaggtctccgggga

SEQ ID NO: 2689529 - DNA, 16 bp, Homo sapiens
ggccagtcctagagct

SEQ ID NO: 2689530 - DNA, 17 bp, Homo sapiens
ggccagtcctagagctc

SEQ ID NO: 2689531 - DNA, 18 bp, Homo sapiens
ggccagtcctagagctcc

SEQ ID NO: 2689532 - DNA, 19 bp, Homo sapiens
ggccagtgtgatcccaagt

SEQ ID NO: 2689533 - DNA, 23 bp, Homo sapiens
ggcccacccacatgacttttcca

SEQ ID NO: 2689534 - DNA, 12 bp, Homo sapiens
ggccccaggctg

SEQ ID NO: 2689535 - DNA, 22 bp, Homo sapiens
ggccccaggctgagagccagat

SEQ ID NO: 2689536 - DNA, 14 bp, Homo sapiens
ggccccaggtgcca

SEQ ID NO: 2689537 - DNA, 17 bp, Homo sapiens
ggccccaggtgccacca

SEQ ID NO: 2689538 - DNA, 15 bp, Homo sapiens
ggcccctccagcaca

SEQ ID NO: 2689539 - DNA, 13 bp, Homo sapiens
ggcccctgcctgc

SEQ ID NO: 2689540 - DNA, 14 bp, Homo sapiens
ggcccctgcctgcc

SEQ ID NO: 2689541 - DNA, 19 bp, Homo sapiens
ggcccctgcctgccttctc

SEQ ID NO: 2689542 - DNA, 15 bp, Homo sapiens
ggcccgcctgccacc

SEQ ID NO: 2689543 - DNA, 11 bp, Homo sapiens
ggccctcctgg

SEQ ID NO: 2689544 - DNA, 12 bp, Homo sapiens
ggccctcctggg

SEQ ID NO: 2689545 - DNA, 15 bp, Homo sapiens
ggccctcctgggaac

SEQ ID NO: 2689546 - DNA, 23 bp, Homo sapiens
ggccctcctgggaacctccttac

SEQ ID NO: 2689547 - DNA, 15 bp, Homo sapiens
ggccggtgtgggctg

SEQ ID NO: 2689548 - DNA, 13 bp, Homo sapiens
ggcctcaagcgtg

SEQ ID NO: 2689549 - DNA, 17 bp, Homo sapiens
ggcctctagaacaccca

SEQ ID NO: 2689550 - DNA, 22 bp, Homo sapiens
ggcctctagaacacccactggc

SEQ ID NO: 2689551 - DNA, 22 bp, Homo sapiens
ggcctctgaaatttcccacacc

SEQ ID NO: 2689552 - DNA, 22 bp, Homo sapiens
ggcctcttggacctctgctctg

SEQ ID NO: 2689553 - DNA, 15 bp, Homo sapiens
ggcctgacacaggcc

SEQ ID NO: 2689554 - DNA, 16 bp, Homo sapiens
ggcctgacacaggcca

SEQ ID NO: 2689555 - DNA, 18 bp, Homo sapiens
ggcctgacacaggccagc

SEQ ID NO: 2689556 - DNA, 20 bp, Homo sapiens
ggcctgagcaacaaagcgag

SEQ ID NO: 2689557 - DNA, 21 bp, Homo sapiens
ggcctgcaggtgagcaggcag

SEQ ID NO: 2689558 - DNA, 20 bp, Homo sapiens
ggcctggactgactgcagcc

SEQ ID NO: 2689559 - DNA, 14 bp, Homo sapiens
ggcctggcacgagg

SEQ ID NO: 2689560 - DNA, 14 bp, Homo sapiens
ggcctggcccttga

SEQ ID NO: 2689561 - DNA, 21 bp, Homo sapiens
ggcctggcttgtcggagcaag

SEQ ID NO: 2689562 - DNA, 20 bp, Homo sapiens
ggcgcagagccctccaggcc

SEQ ID NO: 2689563 - DNA, 21 bp, Homo sapiens
ggcgcagtggctcacgcctgt

SEQ ID NO: 2689564 - DNA, 22 bp, Homo sapiens
ggcggcacccaggcctccctgc

SEQ ID NO: 2689565 - DNA, 22 bp, Homo sapiens
ggcgggcacctatagtcccagc

SEQ ID NO: 2689566 - DNA, 15 bp, Homo sapiens
ggctatttgttcaga

SEQ ID NO: 2689567 - DNA, 18 bp, Homo sapiens
ggctatttgttcagagag

SEQ ID NO: 2689568 - DNA, 21 bp, Homo sapiens
ggctcacgcctatgatcccag

SEQ ID NO: 2689569 - DNA, 14 bp, Homo sapiens
ggctcagtctcagg

SEQ ID NO: 2689570 - DNA, 14 bp, Homo sapiens
ggctccatgcacct

SEQ ID NO: 2689571 - DNA, 15 bp, Homo sapiens
ggctcccgcttgctc

SEQ ID NO: 2689572 - DNA, 22 bp, Homo sapiens
ggctcccgcttgctctcctgga

SEQ ID NO: 2689573 - DNA, 23 bp, Homo sapiens
ggctcccggcatcctgaaagcca

SEQ ID NO: 2689574 - DNA, 20 bp, Homo sapiens
ggctcctccatggtgctgca

SEQ ID NO: 2689575 - DNA, 13 bp, Homo sapiens
ggctcctggaaag

SEQ ID NO: 2689576 - DNA, 13 bp, Homo sapiens
ggctgagccctgg

SEQ ID NO: 2689577 - DNA, 12 bp, Homo sapiens
ggctgccctgcc

SEQ ID NO: 2689578 - DNA, 12 bp, Homo sapiens
ggctgctccctg

SEQ ID NO: 2689579 - DNA, 17 bp, Homo sapiens
ggctgctccctgctccc

SEQ ID NO: 2689580 - DNA, 18 bp, Homo sapiens
ggctgctccctgctccca

SEQ ID NO: 2689581 - DNA, 22 bp, Homo sapiens
ggctgctccctgctcccaggga

SEQ ID NO: 2689582 - DNA, 13 bp, Homo sapiens
ggctgctggcctg

SEQ ID NO: 2689583 - DNA, 18 bp, Homo sapiens
ggctgctggcctggccct

SEQ ID NO: 2689584 - DNA, 15 bp, Homo sapiens
ggctggctgcagtga

SEQ ID NO: 2689585 - DNA, 15 bp, Homo sapiens
ggctgtcaggacacc

SEQ ID NO: 2689586 - DNA, 18 bp, Homo sapiens
ggctgtccgtgtgcctcc

SEQ ID NO: 2689587 - DNA, 20 bp, Homo sapiens
ggctgtccgtgtgcctcctg

SEQ ID NO: 2689588 - DNA, 22 bp, Homo sapiens
ggctgtccgtgtgcctcctgtg

SEQ ID NO: 2689589 - DNA, 22 bp, Homo sapiens
ggcttccagagagtcctctgga

SEQ ID NO: 2689590 - DNA, 16 bp, Homo sapiens
ggcttctggagccctt

SEQ ID NO: 2689591 - DNA, 20 bp, Homo sapiens
ggcttctggagcccttgggt

SEQ ID NO: 2689592 - DNA, 13 bp, Homo sapiens
ggctttctggaga

SEQ ID NO: 2689593 - DNA, 13 bp, Homo sapiens
ggcttttaagaaa

SEQ ID NO: 2689594 - DNA, 23 bp, Homo sapiens
gggaaaacacggccctcctggga

SEQ ID NO: 2689595 - DNA, 16 bp, Homo sapiens
gggaacctccttacct

SEQ ID NO: 2689596 - DNA, 17 bp, Homo sapiens
gggaatgtgtcctcctg

SEQ ID NO: 2689597 - DNA, 19 bp, Homo sapiens
gggaatgtgtcctcctgct

SEQ ID NO: 2689598 - DNA, 22 bp, Homo sapiens
gggacccacctccccctccccg

SEQ ID NO: 2689599 - DNA, 14 bp, Homo sapiens
gggagaacctcagg

SEQ ID NO: 2689600 - DNA, 15 bp, Homo sapiens
gggagaacctcaggc

SEQ ID NO: 2689601 - DNA, 22 bp, Homo sapiens
gggaggatcactggagcccagg

SEQ ID NO: 2689602 - DNA, 20 bp, Homo sapiens
gggagggtcaagggctgggg

SEQ ID NO: 2689603 - DNA, 14 bp, Homo sapiens
gggatgatgtgtga

SEQ ID NO: 2689604 - DNA, 19 bp, Homo sapiens
gggcacctatagtcccagc

SEQ ID NO: 2689605 - DNA, 16 bp, Homo sapiens
gggcagctcctgacca

SEQ ID NO: 2689606 - DNA, 19 bp, Homo sapiens
gggcatgccatgtctgagc

SEQ ID NO: 2689607 - DNA, 16 bp, Homo sapiens
taatgctttggttctg

SEQ ID NO: 2689608 - DNA, 18 bp, Homo sapiens
taatgtacaagttttgta

SEQ ID NO: 2689609 - DNA, 13 bp, Homo sapiens
taatgttgtccag

SEQ ID NO: 2689610 - DNA, 12 bp, Homo sapiens
taatgttttgta

SEQ ID NO: 2689611 - DNA, 15 bp, Homo sapiens
tacaagttttgtata

SEQ ID NO: 2689612 - DNA, 15 bp, Homo sapiens
tacaataaatgctga

SEQ ID NO: 2689613 - DNA, 14 bp, Homo sapiens
tacaatgtgacttt

SEQ ID NO: 2689614 - DNA, 16 bp, Homo sapiens
tacaatgtgactttga

SEQ ID NO: 2689615 - DNA, 17 bp, Homo sapiens
tacacatatatgtatat

SEQ ID NO: 2689616 - DNA, 16 bp, Homo sapiens
tacactccagcctgag

SEQ ID NO: 2689617 - DNA, 18 bp, Homo sapiens
tacagaaattagccgggc

SEQ ID NO: 2689618 - DNA, 18 bp, Homo sapiens
tacagaataatgtgttaa

SEQ ID NO: 2689619 - DNA, 14 bp, Homo sapiens
tacatatttacctg

SEQ ID NO: 2689620 - DNA, 16 bp, Homo sapiens
tacatatttacctgta

SEQ ID NO: 2689621 - DNA, 16 bp, Homo sapiens
tacatggccagtgtga

SEQ ID NO: 2689622 - DNA, 15 bp, Homo sapiens
taccaccccttcctg

SEQ ID NO: 2689623 - DNA, 16 bp, Homo sapiens
taccaccccttcctgt

SEQ ID NO: 2689624 - DNA, 18 bp, Homo sapiens
taccagtgaaccaaagag

SEQ ID NO: 2689625 - DNA, 13 bp, Homo sapiens
taccctatatcta

SEQ ID NO: 2689626 - DNA, 12 bp, Homo sapiens
tacctcagccta

SEQ ID NO: 2689627 - DNA, 22 bp, Homo sapiens
taccttagattagctctggacc

SEQ ID NO: 2689628 - DNA, 16 bp, Homo sapiens
taccttttctgttgta

SEQ ID NO: 2689629 - DNA, 17 bp, Homo sapiens
taccttttctgttgtac

SEQ ID NO: 2689630 - DNA, 16 bp, Homo sapiens
tacgggcgctgcagcc

SEQ ID NO: 2689631 - DNA, 22 bp, Homo sapiens
tacgggtaacagtgaggctggg

SEQ ID NO: 2689632 - DNA, 20 bp, Homo sapiens
tactaaagatatcagagctc

SEQ ID NO: 2689633 - DNA, 12 bp, Homo sapiens
tactcagcccag

SEQ ID NO: 2689634 - DNA, 18 bp, Homo sapiens
tactgccctccccttccc

SEQ ID NO: 2689635 - DNA, 21 bp, Homo sapiens
tacttcacccggctgggctcc

SEQ ID NO: 2689636 - DNA, 10 bp, Homo sapiens
tacttcctgg

SEQ ID NO: 2689637 - DNA, 14 bp, Homo sapiens
tacttttttgaaat

SEQ ID NO: 2689638 - DNA, 15 bp, Homo sapiens
tacttttttgaaatc

SEQ ID NO: 2689639 - DNA, 14 bp, Homo sapiens
tagaaatcattgta

SEQ ID NO: 2689640 - DNA, 19 bp, Homo sapiens
tagaacacccactggccag

SEQ ID NO: 2689641 - DNA, 23 bp, Homo sapiens
tagaacttcaagaagtaagagct

SEQ ID NO: 2689642 - DNA, 19 bp, Homo sapiens
tagaagatggactctgaaa

SEQ ID NO: 2689643 - DNA, 17 bp, Homo sapiens
tagaagtctccctgcac

SEQ ID NO: 2689644 - DNA, 16 bp, Homo sapiens
tagaatcgctttcctt

SEQ ID NO: 2689645 - DNA, 20 bp, Homo sapiens
tagaattgcaatctataata

SEQ ID NO: 2689646 - DNA, 16 bp, Homo sapiens
tagacggaggtgcctg

SEQ ID NO: 2689647 - DNA, 21 bp, Homo sapiens
tagagactaaggggcagctcc

SEQ ID NO: 2689648 - DNA, 12 bp, Homo sapiens
tagagctcctgt

SEQ ID NO: 2689649 - DNA, 15 bp, Homo sapiens
tagagctcctgtccc

SEQ ID NO: 2689650 - DNA, 17 bp, Homo sapiens
tagagctcctgtcccta

SEQ ID NO: 2689651 - DNA, 18 bp, Homo sapiens
tagagctcctgtccctac

SEQ ID NO: 2689652 - DNA, 23 bp, Homo sapiens
tagagctcctgtccctacccact

SEQ ID NO: 2689653 - DNA, 17 bp, Homo sapiens
tagatgagggtgactgt

SEQ ID NO: 2689654 - DNA, 18 bp, Homo sapiens
tagattaaatcatactcc

SEQ ID NO: 2689655 - DNA, 15 bp, Homo sapiens
tagattagctctgga

SEQ ID NO: 2689656 - DNA, 21 bp, Homo sapiens
tagattagtactggattattc

SEQ ID NO: 2689657 - DNA, 12 bp, Homo sapiens
tagcaactgtgc

SEQ ID NO: 2689658 - DNA, 20 bp, Homo sapiens
tagccaaggtgggctgagcc

SEQ ID NO: 2689659 - DNA, 14 bp, Homo sapiens
tagccacctccttg

SEQ ID NO: 2689660 - DNA, 12 bp, Homo sapiens
tagccagtgact

SEQ ID NO: 2689661 - DNA, 14 bp, Homo sapiens
tagcctttgccctg

SEQ ID NO: 2689662 - DNA, 15 bp, Homo sapiens
tagcctttgccctgt

SEQ ID NO: 2689663 - DNA, 19 bp, Homo sapiens
tagcttatttttacagtta

SEQ ID NO: 2689664 - DNA, 14 bp, Homo sapiens
taggactctgaggc

SEQ ID NO: 2689665 - DNA, 15 bp, Homo sapiens
taggagccccagctt

SEQ ID NO: 2689666 - DNA, 19 bp, Homo sapiens
tagggaaaacacggccctc

SEQ ID NO: 2689667 - DNA, 21 bp, Homo sapiens
tagggaaaacacggccctcct

SEQ ID NO: 2689668 - DNA, 23 bp, Homo sapiens
tagggaaaacacggccctcctgg

SEQ ID NO: 2689669 - DNA, 20 bp, Homo sapiens
tagtatattagtttgattta

SEQ ID NO: 2689670 - DNA, 17 bp, Homo sapiens
tagtgccctccacagcc

SEQ ID NO: 2689671 - DNA, 14 bp, Homo sapiens
tagttaatctataa

SEQ ID NO: 2689672 - DNA, 13 bp, Homo sapiens
tagttaatttatt

SEQ ID NO: 2689673 - DNA, 18 bp, Homo sapiens
tagttcctgtggccagga

SEQ ID NO: 2689674 - DNA, 18 bp, Homo sapiens
tagtttattggaagtgtt

SEQ ID NO: 2689675 - DNA, 17 bp, Homo sapiens
tagtttcagtaaataat

SEQ ID NO: 2689676 - DNA, 22 bp, Homo sapiens
tataacatgtctttcagcatta

SEQ ID NO: 2689677 - DNA, 13 bp, Homo sapiens
tataactacatat

SEQ ID NO: 2689678 - DNA, 18 bp, Homo sapiens
tataactacatattgaat

SEQ ID NO: 2689679 - DNA, 21 bp, Homo sapiens
tatacattttgttatagaata

SEQ ID NO: 2689680 - DNA, 14 bp, Homo sapiens
tatacctctctcaa

SEQ ID NO: 2689681 - DNA, 18 bp, Homo sapiens
tatagaaagcaagatgta

SEQ ID NO: 2689682 - DNA, 20 bp, Homo sapiens
tatagaatacttttttctag

SEQ ID NO: 2689683 - DNA, 20 bp, Homo sapiens
tatagtcccagctactcaga

SEQ ID NO: 2689684 - DNA, 19 bp, Homo sapiens
tatagttaatctataacta

SEQ ID NO: 2689685 - DNA, 21 bp, Homo sapiens
tatatattctacacatatatg

SEQ ID NO: 2689686 - DNA, 19 bp, Homo sapiens
tatatgtatatctatatct

SEQ ID NO: 2689687 - DNA, 14 bp, Homo sapiens
tatatgttgtaata

SEQ ID NO: 2689688 - DNA, 13 bp, Homo sapiens
tatattataatag

SEQ ID NO: 2689689 - DNA, 22 bp, Homo sapiens
tatcagagctcttaatgttgct

SEQ ID NO: 2689690 - DNA, 22 bp, Homo sapiens
tatcaggactgtgaccaaagca

SEQ ID NO: 2689691 - DNA, 23 bp, Homo sapiens
tatcaggatttcctcttgaacca

SEQ ID NO: 2689692 - DNA, 12 bp, Homo sapiens
tatcataaagta

SEQ ID NO: 2689693 - DNA, 15 bp, Homo sapiens
tatccagaatggaat

SEQ ID NO: 2689694 - DNA, 21 bp, Homo sapiens
tatccagaatggaattttgct

SEQ ID NO: 2689695 - DNA, 16 bp, Homo sapiens
tatctataaacactgt

SEQ ID NO: 2689696 - DNA, 16 bp, Homo sapiens
tatctgagaagtgtat

SEQ ID NO: 2689697 - DNA, 21 bp, Homo sapiens
tatgaacttgaggacacatgt

SEQ ID NO: 2689698 - DNA, 22 bp, Homo sapiens
tatgaacttgaggacacatgtc

SEQ ID NO: 2689699 - DNA, 20 bp, Homo sapiens
tatgaagggacagctgctgg

SEQ ID NO: 2689700 - DNA, 21 bp, Homo sapiens
tatgaagggacagctgctggg

SEQ ID NO: 2689701 - DNA, 17 bp, Homo sapiens
tatgccaggctgtgcta

SEQ ID NO: 2689702 - DNA, 17 bp, Homo sapiens
tatgccttcctgtttaa

SEQ ID NO: 2689703 - DNA, 14 bp, Homo sapiens
tatgctacccacag

SEQ ID NO: 2689704 - DNA, 20 bp, Homo sapiens
tatgctagtttattggaagt

SEQ ID NO: 2689705 - DNA, 21 bp, Homo sapiens
tattaagtctgggatgtagaa

SEQ ID NO: 2689706 - DNA, 15 bp, Homo sapiens
tattacatctaatgc

SEQ ID NO: 2689707 - DNA, 17 bp, Homo sapiens
tattacatctaatgctt

SEQ ID NO: 2689708 - DNA, 18 bp, Homo sapiens
tattatttcaccagcagc

SEQ ID NO: 2689709 - DNA, 14 bp, Homo sapiens
tattcaataaagct

SEQ ID NO: 2689710 - DNA, 19 bp, Homo sapiens
tattcagtgacttctggct

SEQ ID NO: 2689711 - DNA, 13 bp, Homo sapiens
tattctctaagag

SEQ ID NO: 2689712 - DNA, 14 bp, Homo sapiens
tattgaatcttaat

SEQ ID NO: 2689713 - DNA, 19 bp, Homo sapiens
tattggaagtgttcaagaa

SEQ ID NO: 2689714 - DNA, 16 bp, Homo sapiens
tatttcaccagcagca

SEQ ID NO: 2689715 - DNA, 23 bp, Homo sapiens
tatttgtgaaactttaatgagga

SEQ ID NO: 2689716 - DNA, 15 bp, Homo sapiens
tattttctgaccaaa

SEQ ID NO: 2689717 - DNA, 19 bp, Homo sapiens
tctggtgcctttccacaca

SEQ ID NO: 2689718 - DNA, 23 bp, Homo sapiens
tctggttgacgggctgtccgtgt

SEQ ID NO: 2689719 - DNA, 16 bp, Homo sapiens
tctggtttctgtgtgt

SEQ ID NO: 2689720 - DNA, 13 bp, Homo sapiens
tctgtagccacct

SEQ ID NO: 2689721 - DNA, 14 bp, Homo sapiens
tctgtatgattcta

SEQ ID NO: 2689722 - DNA, 12 bp, Homo sapiens
tcttagtttact

SEQ ID NO: 2689723 - DNA, 24 bp, Homo sapiens
tcttcacactggtttgccaggcca

SEQ ID NO: 2689724 - DNA, 11 bp, Homo sapiens
tcttcagagca

SEQ ID NO: 2689725 - DNA, 16 bp, Homo sapiens
tcttccaaccccagct

SEQ ID NO: 2689726 - DNA, 19 bp, Homo sapiens
tcttcccgctccccaccta

SEQ ID NO: 2689727 - DNA, 14 bp, Homo sapiens
tcttctcttcctgt

SEQ ID NO: 2689728 - DNA, 19 bp, Homo sapiens
tcttctggagtctccagtg

SEQ ID NO: 2689729 - DNA, 23 bp, Homo sapiens
tcttcttacttcacccggctggg

SEQ ID NO: 2689730 - DNA, 18 bp, Homo sapiens
tcttgctggattaatgtt

SEQ ID NO: 2689731 - DNA, 19 bp, Homo sapiens
tcttgctggattaatgttt

SEQ ID NO: 2689732 - DNA, 14 bp, Homo sapiens
tcttgctgtgcttt

SEQ ID NO: 2689733 - DNA, 23 bp, Homo sapiens
tcttgctgtgctttatttgtgaa

SEQ ID NO: 2689734 - DNA, 12 bp, Homo sapiens
tctttaacttgt

SEQ ID NO: 2689735 - DNA, 17 bp, Homo sapiens
tctttaatgttgtccag

SEQ ID NO: 2689736 - DNA, 17 bp, Homo sapiens
tctttcaactcattgca

SEQ ID NO: 2689737 - DNA, 12 bp, Homo sapiens
tctttgatggac

SEQ ID NO: 2689738 - DNA, 17 bp, Homo sapiens
tctttgctacaataaat

SEQ ID NO: 2689739 - DNA, 19 bp, Homo sapiens
tctttgctacaataaatgc

SEQ ID NO: 2689740 - DNA, 20 bp, Homo sapiens
tctttgctgacactgtgacc

SEQ ID NO: 2689741 - DNA, 12 bp, Homo sapiens
tcttttctgaat

SEQ ID NO: 2689742 - DNA, 14 bp, Homo sapiens
tcttttctgaatct

SEQ ID NO: 2689743 - DNA, 15 bp, Homo sapiens
tcttttctgaatctt

SEQ ID NO: 2689744 - DNA, 18 bp, Homo sapiens
tcttttctgaatcttctg

SEQ ID NO: 2689745 - DNA, 18 bp, Homo sapiens
tgaaaaacattccaggaa

SEQ ID NO: 2689746 - DNA, 13 bp, Homo sapiens
tgaaaatatatac

SEQ ID NO: 2689747 - DNA, 23 bp, Homo sapiens
tgaaacattcacacagggctctt

SEQ ID NO: 2689748 - DNA, 14 bp, Homo sapiens
tgaaagaaggagca

SEQ ID NO: 2689749 - DNA, 10 bp, Homo sapiens
tgaaagctgt

SEQ ID NO: 2689750 - DNA, 21 bp, Homo sapiens
tgaaaggtgctgatggccctc

SEQ ID NO: 2689751 - DNA, 22 bp, Homo sapiens
tgaaattgtctagcagagcagg

SEQ ID NO: 2689752 - DNA, 23 bp, Homo sapiens
tgaaatttcccacaccccagcgc

SEQ ID NO: 2689753 - DNA, 18 bp, Homo sapiens
tgaaccagaaccagtctt

SEQ ID NO: 2689754 - DNA, 14 bp, Homo sapiens
tgaaccgacttttc

SEQ ID NO: 2689755 - DNA, 16 bp, Homo sapiens
tgaacttgaggacaca

SEQ ID NO: 2689756 - DNA, 21 bp, Homo sapiens
tgaagagtagaacccaggtct

SEQ ID NO: 2689757 - DNA, 23 bp, Homo sapiens
tgaaggagaaaatgcattatgtg

SEQ ID NO: 2689758 - DNA, 18 bp, Homo sapiens
tgaaggagccacgtgaat

SEQ ID NO: 2689759 - DNA, 14 bp, Homo sapiens
tgaagggacagctg

SEQ ID NO: 2689760 - DNA, 13 bp, Homo sapiens
tgaagtctgctca

SEQ ID NO: 2689761 - DNA, 22 bp, Homo sapiens
tgaatcttctgaaaccaaatgt

SEQ ID NO: 2689762 - DNA, 15 bp, Homo sapiens
tgaatggcctgcctt

SEQ ID NO: 2689763 - DNA, 17 bp, Homo sapiens
tgaatggcctgccttga

SEQ ID NO: 2689764 - DNA, 16 bp, Homo sapiens
tgaatgtgttgatttg

SEQ ID NO: 2689765 - DNA, 15 bp, Homo sapiens
tgaatttggagactc

SEQ ID NO: 2689766 - DNA, 20 bp, Homo sapiens
tgaatttggagactctgtgg

SEQ ID NO: 2689767 - DNA, 16 bp, Homo sapiens
tgacactgtgaccctg

SEQ ID NO: 2689768 - DNA, 18 bp, Homo sapiens
tgacatgtgcagtgctgt

SEQ ID NO: 2689769 - DNA, 15 bp, Homo sapiens
tgaccaaaatgtgtt

SEQ ID NO: 2689770 - DNA, 16 bp, Homo sapiens
tgacccaaagaccaat

SEQ ID NO: 2689771 - DNA, 14 bp, Homo sapiens
tgacccacccagtg

SEQ ID NO: 2689772 - DNA, 23 bp, Homo sapiens
tgaccctgagggctcctccatgg

SEQ ID NO: 2689773 - DNA, 20 bp, Homo sapiens
tgacctgcaggccaagagca

SEQ ID NO: 2689774 - DNA, 18 bp, Homo sapiens
tgacgtgcacctgtactc

SEQ ID NO: 2689775 - DNA, 20 bp, Homo sapiens
tgactcacaagaagaccaga

SEQ ID NO: 2689776 - DNA, 21 bp, Homo sapiens
tgactcggcagtgtgcagtgg

SEQ ID NO: 2689777 - DNA, 14 bp, Homo sapiens
tgactttagaaaca

SEQ ID NO: 2689778 - DNA, 17 bp, Homo sapiens
tgactttttagccagtg

SEQ ID NO: 2689779 - DNA, 17 bp, Homo sapiens
tgagaaccaaaagatgc

SEQ ID NO: 2689780 - DNA, 18 bp, Homo sapiens
tgagaaccaaaagatgcc

SEQ ID NO: 2689781 - DNA, 14 bp, Homo sapiens
tgagaacccagaga

SEQ ID NO: 2689782 - DNA, 19 bp, Homo sapiens
tgagaagcgctgccctgtg

SEQ ID NO: 2689783 - DNA, 22 bp, Homo sapiens
tgagaagcgctgccctgtgaga

SEQ ID NO: 2689784 - DNA, 18 bp, Homo sapiens
tgagaagtgtatatagtt

SEQ ID NO: 2689785 - DNA, 13 bp, Homo sapiens
tgagacatattta

SEQ ID NO: 2689786 - DNA, 12 bp, Homo sapiens
tgagaccctgtc

SEQ ID NO: 2689787 - DNA, 14 bp, Homo sapiens
tgagaccctgtctc

SEQ ID NO: 2689788 - DNA, 16 bp, Homo sapiens
tgagagcacagcgttt

SEQ ID NO: 2689789 - DNA, 19 bp, Homo sapiens
tgagagccacgctggcctt

SEQ ID NO: 2689790 - DNA, 19 bp, Homo sapiens
tgagagccagatgcctccc

SEQ ID NO: 2689791 - DNA, 14 bp, Homo sapiens
tgagagttccagat

SEQ ID NO: 2689792 - DNA, 20 bp, Homo sapiens
tgagcaggcagggctgggcc

SEQ ID NO: 2689793 - DNA, 22 bp, Homo sapiens
tgagccacctttactctgctct

SEQ ID NO: 2689794 - DNA, 21 bp, Homo sapiens
tgagccagaaacgcagattgg

SEQ ID NO: 2689795 - DNA, 21 bp, Homo sapiens
tgagccctggaccccaggctc

SEQ ID NO: 2689796 - DNA, 22 bp, Homo sapiens
tgagccctggaccccaggctct

SEQ ID NO: 2689797 - DNA, 21 bp, Homo sapiens
tgagccgagattgcgccactg

SEQ ID NO: 2689798 - DNA, 12 bp, Homo sapiens
tgagcctgttca

SEQ ID NO: 2689799 - DNA, 21 bp, Homo sapiens
tgagcctgttcattctgatgt

SEQ ID NO: 2689800 - DNA, 20 bp, Homo sapiens
tgagctatgattatgccact

SEQ ID NO: 2689801 - DNA, 21 bp, Homo sapiens
tgagctatgattatgccactg

SEQ ID NO: 2689802 - DNA, 23 bp, Homo sapiens
tgagctatgattatgccactgct

SEQ ID NO: 2689803 - DNA, 17 bp, Homo sapiens
tgagcttttcatggaag

SEQ ID NO: 2689804 - DNA, 18 bp, Homo sapiens
tgagcttttcatggaagt

SEQ ID NO: 2689805 - DNA, 13 bp, Homo sapiens
tgaggacacatgt

SEQ ID NO: 2689806 - DNA, 15 bp, Homo sapiens
tgaggacacatgtcc

SEQ ID NO: 2689807 - DNA, 16 bp, Homo sapiens
tgaggataacttcctt

SEQ ID NO: 2689808 - DNA, 15 bp, Homo sapiens
tgaggatacagctct

SEQ ID NO: 2689809 - DNA, 22 bp, Homo sapiens
tgaggcaggtgagaacccagag

SEQ ID NO: 2689810 - DNA, 16 bp, Homo sapiens
tgaggctctttctggg

SEQ ID NO: 2689811 - DNA, 15 bp, Homo sapiens
tgaggcttccagaga

SEQ ID NO: 2689812 - DNA, 16 bp, Homo sapiens
tgaggcttccagagag

SEQ ID NO: 2689813 - DNA, 14 bp, Homo sapiens
tgaggggctcctgg

SEQ ID NO: 2689814 - DNA, 21 bp, Homo sapiens
tgaggtgcctcccagtggcct

SEQ ID NO: 2689815 - DNA, 23 bp, Homo sapiens
tgaggtgcgctcacctcagagca

SEQ ID NO: 2689816 - DNA, 12 bp, Homo sapiens
tgaggttaggag

SEQ ID NO: 2689817 - DNA, 12 bp, Homo sapiens
tgagtccagctt

SEQ ID NO: 2689818 - DNA, 12 bp, Homo sapiens
tgagtgttcatt

SEQ ID NO: 2689819 - DNA, 14 bp, Homo sapiens
tgagtgttcatttt

SEQ ID NO: 2689820 - DNA, 17 bp, Homo sapiens
tgatacttttttgaaat

SEQ ID NO: 2689821 - DNA, 20 bp, Homo sapiens
tgatacttttttgaaatcag

SEQ ID NO: 2689822 - DNA, 15 bp, Homo sapiens
tgatatatctcaaat

SEQ ID NO: 2689823 - DNA, 16 bp, Homo sapiens
tgatatatctcaaatt

SEQ ID NO: 2689824 - DNA, 18 bp, Homo sapiens
tgatcctgctccagcagc

SEQ ID NO: 2689825 - DNA, 20 bp, Homo sapiens
tgatgaaactcctgattttg

SEQ ID NO: 2689826 - DNA, 17 bp, Homo sapiens
tgatgaaattcttgaag

SEQ ID NO: 2689827 - DNA, 12 bp, Homo sapiens
tgttgatcccaa

SEQ ID NO: 2689828 - DNA, 16 bp, Homo sapiens
tgttgatcccaagaca

SEQ ID NO: 2689829 - DNA, 14 bp, Homo sapiens
tgttgctcttggaa

SEQ ID NO: 2689830 - DNA, 13 bp, Homo sapiens
tgttgtaaaatgt

SEQ ID NO: 2689831 - DNA, 17 bp, Homo sapiens
tgttgtacgtaaagctt

SEQ ID NO: 2689832 - DNA, 15 bp, Homo sapiens
tgttgtcctcccagg

SEQ ID NO: 2689833 - DNA, 15 bp, Homo sapiens
tgttgtctccctctt

SEQ ID NO: 2689834 - DNA, 13 bp, Homo sapiens
tgtttaaatataa

SEQ ID NO: 2689835 - DNA, 22 bp, Homo sapiens
tgtttaaatataaatgtttaaa

SEQ ID NO: 2689836 - DNA, 14 bp, Homo sapiens
tgtttcaacaattt

SEQ ID NO: 2689837 - DNA, 14 bp, Homo sapiens
tgtttcataacaaa

SEQ ID NO: 2689838 - DNA, 15 bp, Homo sapiens
tgtttctccccctgg

SEQ ID NO: 2689839 - DNA, 17 bp, Homo sapiens
tgttttgtacaattact

SEQ ID NO: 2689840 - DNA, 21 bp, Homo sapiens
tgttttgtacaattactaaat

SEQ ID NO: 2689841 - DNA, 22 bp, Homo sapiens
tgttttgtacaattactaaatt

SEQ ID NO: 2689842 - DNA, 17 bp, Homo sapiens
ttaaaaaaaactcttta

SEQ ID NO: 2689843 - DNA, 21 bp, Homo sapiens
ttaaaaaaaactctttaactt

SEQ ID NO: 2689844 - DNA, 23 bp, Homo sapiens
ttaaaagacatttttatttagtt

SEQ ID NO: 2689845 - DNA, 13 bp, Homo sapiens
ttaaatcgttaga

SEQ ID NO: 2689846 - DNA, 19 bp, Homo sapiens
ttaaattgcttttgttgtg

SEQ ID NO: 2689847 - DNA, 18 bp, Homo sapiens
ttaagccctgctctttct

SEQ ID NO: 2689848 - DNA, 22 bp, Homo sapiens
ttaataatagattgtgaataat

SEQ ID NO: 2689849 - DNA, 21 bp, Homo sapiens
ttaatgtacaagttttgtata

SEQ ID NO: 2689850 - DNA, 18 bp, Homo sapiens
ttaattttttttaatgta

SEQ ID NO: 2689851 - DNA, 16 bp, Homo sapiens
ttacaacctagaagta

SEQ ID NO: 2689852 - DNA, 12 bp, Homo sapiens
ttactaaagtca

SEQ ID NO: 2689853 - DNA, 15 bp, Homo sapiens
ttactaaattgtata

SEQ ID NO: 2689854 - DNA, 13 bp, Homo sapiens
ttactcagcccag

SEQ ID NO: 2689855 - DNA, 18 bp, Homo sapiens
ttactctgctctatgcca

SEQ ID NO: 2689856 - DNA, 17 bp, Homo sapiens
ttactgacagaaatgca

SEQ ID NO: 2689857 - DNA, 23 bp, Homo sapiens
ttagaaacaaatttttttcttgt

SEQ ID NO: 2689858 - DNA, 12 bp, Homo sapiens
ttagaatatatt

SEQ ID NO: 2689859 - DNA, 18 bp, Homo sapiens
ttagatgtgctgctttga

SEQ ID NO: 2689860 - DNA, 17 bp, Homo sapiens
ttagattagctctggac

SEQ ID NO: 2689861 - DNA, 13 bp, Homo sapiens
ttagctttctcag

SEQ ID NO: 2689862 - DNA, 14 bp, Homo sapiens
ttagtgctttacat

SEQ ID NO: 2689863 - DNA, 19 bp, Homo sapiens
ttagtttgatttaatatct

SEQ ID NO: 2689864 - DNA, 20 bp, Homo sapiens
ttagttttaagccttaaggt

SEQ ID NO: 2689865 - DNA, 14 bp, Homo sapiens
ttatagaatacttt

SEQ ID NO: 2689866 - DNA, 12 bp, Homo sapiens
ttatatatcata

SEQ ID NO: 2689867 - DNA, 13 bp, Homo sapiens
ttatatatcataa

SEQ ID NO: 2689868 - DNA, 14 bp, Homo sapiens
ttatatatcataaa

SEQ ID NO: 2689869 - DNA, 16 bp, Homo sapiens
ttatatatcataaagt

SEQ ID NO: 2689870 - DNA, 17 bp, Homo sapiens
ttatatatcataaagta

SEQ ID NO: 2689871 - DNA, 17 bp, Homo sapiens
ttatatccatttttatc

SEQ ID NO: 2689872 - DNA, 17 bp, Homo sapiens
ttatcgtccagtgactt

SEQ ID NO: 2689873 - DNA, 22 bp, Homo sapiens
ttattaagtctgggatgtagaa

SEQ ID NO: 2689874 - DNA, 14 bp, Homo sapiens
ttattaatgctttg

SEQ ID NO: 2689875 - DNA, 19 bp, Homo sapiens
ttattggaagtgttcaaga

SEQ ID NO: 2689876 - DNA, 22 bp, Homo sapiens
ttatttcaaccgcttgccatat

SEQ ID NO: 2689877 - DNA, 14 bp, Homo sapiens
ttatttgtgaaact

SEQ ID NO: 2689878 - DNA, 18 bp, Homo sapiens
ttcaaccgcttgccatat

SEQ ID NO: 2689879 - DNA, 12 bp, Homo sapiens
ttcaagcccagg

SEQ ID NO: 2689880 - DNA, 16 bp, Homo sapiens
ttcaagttagctcagg

SEQ ID NO: 2689881 - DNA, 12 bp, Homo sapiens
ttcaataaagct

SEQ ID NO: 2689882 - DNA, 23 bp, Homo sapiens
ttcaccaaatgatgccacttccc

SEQ ID NO: 2689883 - DNA, 17 bp, Homo sapiens
ttcacccggctgggctc

SEQ ID NO: 2689884 - DNA, 12 bp, Homo sapiens
ttcactggcctg

SEQ ID NO: 2689885 - DNA, 15 bp, Homo sapiens
ttcagagaggccttt

SEQ ID NO: 2689886 - DNA, 13 bp, Homo sapiens
ttcagagccagtg

SEQ ID NO: 2689887 - DNA, 18 bp, Homo sapiens
ttcagagttgtacactgt

SEQ ID NO: 2689888 - DNA, 19 bp, Homo sapiens
ttcagatttctctttgaaa

SEQ ID NO: 2689889 - DNA, 22 bp, Homo sapiens
ttcaggctttaggcatatgctt

SEQ ID NO: 2689890 - DNA, 18 bp, Homo sapiens
ttcagggaatttcaggaa

SEQ ID NO: 2689891 - DNA, 13 bp, Homo sapiens
ttcagtgctgtgg

SEQ ID NO: 2689892 - DNA, 23 bp, Homo sapiens
ttcataacaaaccatctggtgcc

SEQ ID NO: 2689893 - DNA, 18 bp, Homo sapiens
ttcatgatgaattacttc

SEQ ID NO: 2689894 - DNA, 18 bp, Homo sapiens
ttcatgtttgtaaattaa

SEQ ID NO: 2689895 - DNA, 17 bp, Homo sapiens
ttcattttagtgactgt

SEQ ID NO: 2689896 - DNA, 21 bp, Homo sapiens
ttccaaagggcagtaaagttt

SEQ ID NO: 2689897 - DNA, 12 bp, Homo sapiens
ttccaaccccag

SEQ ID NO: 2689898 - DNA, 16 bp, Homo sapiens
ttccaaccccagctgg

SEQ ID NO: 2689899 - DNA, 11 bp, Homo sapiens
ttccaccctgg

SEQ ID NO: 2689900 - DNA, 12 bp, Homo sapiens
ttccactggact

SEQ ID NO: 2689901 - DNA, 17 bp, Homo sapiens
ttccagaaaaccccagc

SEQ ID NO: 2689902 - DNA, 14 bp, Homo sapiens
ttccagaatctgta

SEQ ID NO: 2689903 - DNA, 17 bp, Homo sapiens
ttccagagagtcctctg

SEQ ID NO: 2689904 - DNA, 20 bp, Homo sapiens
ttccagagagtcctctggat

SEQ ID NO: 2689905 - DNA, 19 bp, Homo sapiens
ttccatcctgaggtgcctc

SEQ ID NO: 2689906 - DNA, 20 bp, Homo sapiens
ttccatcctgaggtgcctcc

SEQ ID NO: 2689907 - DNA, 21 bp, Homo sapiens
ttccatcctgaggtgcctccc

SEQ ID NO: 2689908 - DNA, 23 bp, Homo sapiens
ttccatcctgaggtgcctcccag

SEQ ID NO: 2689909 - DNA, 17 bp, Homo sapiens
ttccattgaccagctct

SEQ ID NO: 2689910 - DNA, 18 bp, Homo sapiens
ttcccacaccccagcgcc

SEQ ID NO: 2689911 - DNA, 14 bp, Homo sapiens
ttcccagaggcaga

SEQ ID NO: 2689912 - DNA, 18 bp, Homo sapiens
ttcccctttactcagccc

SEQ ID NO: 2689913 - DNA, 19 bp, Homo sapiens
ttcccctttactcagccca

SEQ ID NO: 2689914 - DNA, 22 bp, Homo sapiens
ttcccgtggtctccttgcactt

SEQ ID NO: 2689915 - DNA, 20 bp, Homo sapiens
ttccctgggggcatcctgct

SEQ ID NO: 2689916 - DNA, 23 bp, Homo sapiens
ttccctgggggcatcctgcttcc

SEQ ID NO: 2689917 - DNA, 19 bp, Homo sapiens
ttccggggctgctggcctg

SEQ ID NO: 2689918 - DNA, 22 bp, Homo sapiens
ttccggggctgctggcctggcc

SEQ ID NO: 2689919 - DNA, 14 bp, Homo sapiens
ttcctcagggccca

SEQ ID NO: 2689920 - DNA, 23 bp, Homo sapiens
ttcctccccattagagtcagcct

SEQ ID NO: 2689921 - DNA, 23 bp, Homo sapiens
ttcctctagtgccctccacagcc

SEQ ID NO: 2689922 - DNA, 14 bp, Homo sapiens
ttcctctggtttct

SEQ ID NO: 2689923 - DNA, 20 bp, Homo sapiens
ttcctctggtttctgtgtgt

SEQ ID NO: 2689924 - DNA, 13 bp, Homo sapiens
ttcctcttcccca

SEQ ID NO: 2689925 - DNA, 15 bp, Homo sapiens
ttcctcttgaaccag

SEQ ID NO: 2689926 - DNA, 23 bp, Homo sapiens
ttcctgaaagctgttggatttca

SEQ ID NO: 2689927 - DNA, 18 bp, Homo sapiens
ttcctgccaccagtcact

SEQ ID NO: 2689928 - DNA, 19 bp, Homo sapiens
ttcctgggatgatgtgtga

SEQ ID NO: 2689929 - DNA, 14 bp, Homo sapiens
ttcctgtggccagg

SEQ ID NO: 2689930 - DNA, 18 bp, Homo sapiens
ttcctgtggccaggaggt

SEQ ID NO: 2689931 - DNA, 19 bp, Homo sapiens
ttcctgtggccaggaggtt

SEQ ID NO: 2689932 - DNA, 13 bp, Homo sapiens
ttccttctgccct

SEQ ID NO: 2689933 - DNA, 23 bp, Homo sapiens
ttccttctgcccttcctccagga

SEQ ID NO: 2689934 - DNA, 15 bp, Homo sapiens
ttccttgcccctgct

SEQ ID NO: 2689935 - DNA, 16 bp, Homo sapiens
ttccttgcccctgctc

SEQ ID NO: 2689936 - DNA, 20 bp, Homo sapiens
ttccttgctgtcctaggcca

SEQ ID NO: 2689937 - DNA, 21 bp, Homo sapiens
ggccacccactgacccaactg

SEQ ID NO: 2689938 - DNA, 23 bp, Homo sapiens
ggccagagaagataatgttcttt

SEQ ID NO: 2689939 - DNA, 15 bp, Homo sapiens
ggccagcactggagg

SEQ ID NO: 2689940 - DNA, 14 bp, Homo sapiens
ggccagccttggca

SEQ ID NO: 2689941 - DNA, 17 bp, Homo sapiens
ggccagggccctgcaga

SEQ ID NO: 2689942 - DNA, 14 bp, Homo sapiens
ggccagtcctagag

SEQ ID NO: 2689943 - DNA, 15 bp, Homo sapiens
ggccagtcctagagc

SEQ ID NO: 2689944 - DNA, 21 bp, Homo sapiens
ggccagtcctagagctcctgt

SEQ ID NO: 2689945 - DNA, 22 bp, Homo sapiens
ggccagtcctagagctcctgtc

SEQ ID NO: 2689946 - DNA, 14 bp, Homo sapiens
ggcccacccacatg

SEQ ID NO: 2689947 - DNA, 15 bp, Homo sapiens
ggcccacccacatga

SEQ ID NO: 2689948 - DNA, 15 bp, Homo sapiens
ggcccagagaagcaa

SEQ ID NO: 2689949 - DNA, 23 bp, Homo sapiens
ggccccaccctcgtggacacctg

SEQ ID NO: 2689950 - DNA, 20 bp, Homo sapiens
ggccccaggtgccaccaata

SEQ ID NO: 2689951 - DNA, 22 bp, Homo sapiens
ggccccaggtgccaccaataaa

SEQ ID NO: 2689952 - DNA, 14 bp, Homo sapiens
ggcccctccagcac

SEQ ID NO: 2689953 - DNA, 15 bp, Homo sapiens
ggcccctgcctgcct

SEQ ID NO: 2689954 - DNA, 13 bp, Homo sapiens
ggcccgcctgcca

SEQ ID NO: 2689955 - DNA, 23 bp, Homo sapiens
ggcccgcctgccacctctcccag

SEQ ID NO: 2689956 - DNA, 21 bp, Homo sapiens
ggcccggggggaccaggatga

SEQ ID NO: 2689957 - DNA, 15 bp, Homo sapiens
ggccctggtccttcc

SEQ ID NO: 2689958 - DNA, 14 bp, Homo sapiens
ggcctccctgcaga

SEQ ID NO: 2689959 - DNA, 18 bp, Homo sapiens
ggcctctagaacacccac

SEQ ID NO: 2689960 - DNA, 17 bp, Homo sapiens
ggcctcttggacctctg

SEQ ID NO: 2689961 - DNA, 16 bp, Homo sapiens
ggcctgcaggggcaag

SEQ ID NO: 2689962 - DNA, 19 bp, Homo sapiens
ggcctgcaggtgagcaggc

SEQ ID NO: 2689963 - DNA, 12 bp, Homo sapiens
ggcctggccctt

SEQ ID NO: 2689964 - DNA, 18 bp, Homo sapiens
ggccttcgtctccatctc

SEQ ID NO: 2689965 - DNA, 21 bp, Homo sapiens
ggccttcgtctccatctctgg

SEQ ID NO: 2689966 - DNA, 20 bp, Homo sapiens
ggcgacagagcgagactccg

SEQ ID NO: 2689967 - DNA, 18 bp, Homo sapiens
ggcgctgcagcctccctt

SEQ ID NO: 2689968 - DNA, 13 bp, Homo sapiens
ggcgggcacctgt

SEQ ID NO: 2689969 - DNA, 22 bp, Homo sapiens
ggcgggtggatcatgaggtcag

SEQ ID NO: 2689970 - DNA, 15 bp, Homo sapiens
ggcgtgcctgccaag

SEQ ID NO: 2689971 - DNA, 16 bp, Homo sapiens
ggcgtgcctgccaagc

SEQ ID NO: 2689972 - DNA, 18 bp, Homo sapiens
ggctatgaagggacagct

SEQ ID NO: 2689973 - DNA, 16 bp, Homo sapiens
ggctatttgttcagag

SEQ ID NO: 2689974 - DNA, 13 bp, Homo sapiens
ggctcaccagaat

SEQ ID NO: 2689975 - DNA, 23 bp, Homo sapiens
ggctcacgcctatgatcccagca

SEQ ID NO: 2689976 - DNA, 16 bp, Homo sapiens
ggctccatgcacctcc

SEQ ID NO: 2689977 - DNA, 19 bp, Homo sapiens
ggctccatgcacctccctt

SEQ ID NO: 2689978 - DNA, 23 bp, Homo sapiens
ggctcccgcttgctctcctggag

SEQ ID NO: 2689979 - DNA, 15 bp, Homo sapiens
ggctctgtgcaggga

SEQ ID NO: 2689980 - DNA, 12 bp, Homo sapiens
ggctctttcaga

SEQ ID NO: 2689981 - DNA, 13 bp, Homo sapiens
ggctctttcagag

SEQ ID NO: 2689982 - DNA, 21 bp, Homo sapiens
ggctgaatccgtggtggcacc

SEQ ID NO: 2689983 - DNA, 14 bp, Homo sapiens
ggctgagccctggc

SEQ ID NO: 2689984 - DNA, 15 bp, Homo sapiens
ggctgagccctggca

SEQ ID NO: 2689985 - DNA, 13 bp, Homo sapiens
ggctgctccctgc

SEQ ID NO: 2689986 - DNA, 20 bp, Homo sapiens
ggctgctccctgctcccagg

SEQ ID NO: 2689987 - DNA, 15 bp, Homo sapiens
ggctgctggcctggc

SEQ ID NO: 2689988 - DNA, 11 bp, Homo sapiens
ggctggctctg

SEQ ID NO: 2689989 - DNA, 16 bp, Homo sapiens
ggctggctctgaagcc

SEQ ID NO: 2689990 - DNA, 14 bp, Homo sapiens
ggctggctgcagtg

SEQ ID NO: 2689991 - DNA, 17 bp, Homo sapiens
ggctgtccgtgtgcctc

SEQ ID NO: 2689992 - DNA, 19 bp, Homo sapiens
ggctgtgctcttcctctgg

SEQ ID NO: 2689993 - DNA, 20 bp, Homo sapiens
ggctgtgctcttcctctggt

SEQ ID NO: 2689994 - DNA, 16 bp, Homo sapiens
ggcttagctttctgga

SEQ ID NO: 2689995 - DNA, 18 bp, Homo sapiens
ggcttatgctcagaagcc

SEQ ID NO: 2689996 - DNA, 13 bp, Homo sapiens
ggcttctggagcc

SEQ ID NO: 2689997 - DNA, 17 bp, Homo sapiens
ggcttgcttgccgagcc

SEQ ID NO: 2689998 - DNA, 12 bp, Homo sapiens
ggctttctggag

SEQ ID NO: 2689999 - DNA, 19 bp, Homo sapiens
gggaaggggaacacagacc

SEQ ID NO: 2690000 - DNA, 18 bp, Homo sapiens
gggaatgtgtcctcctgc

SEQ ID NO: 2690001 - DNA, 23 bp, Homo sapiens
gggaatgtgtcctcctgctctgc

SEQ ID NO: 2690002 - DNA, 16 bp, Homo sapiens
gggacccacctccccc

SEQ ID NO: 2690003 - DNA, 13 bp, Homo sapiens
gggaccttagaaa

SEQ ID NO: 2690004 - DNA, 17 bp, Homo sapiens
gggaccttgtgggacca

SEQ ID NO: 2690005 - DNA, 16 bp, Homo sapiens
gggagaacctcaggct

SEQ ID NO: 2690006 - DNA, 20 bp, Homo sapiens
gggaggaggtggcagccctg

SEQ ID NO: 2690007 - DNA, 19 bp, Homo sapiens
gggaggatcactggagccc

SEQ ID NO: 2690008 - DNA, 21 bp, Homo sapiens
gggaggcaggggtcctgcagg

SEQ ID NO: 2690009 - DNA, 15 bp, Homo sapiens
gggatggtcctgggg

SEQ ID NO: 2690010 - DNA, 12 bp, Homo sapiens
gggcagctcctg

SEQ ID NO: 2690011 - DNA, 14 bp, Homo sapiens
gggcagctcctgac

SEQ ID NO: 2690012 - DNA, 15 bp, Homo sapiens
gggcagctcctgacc

SEQ ID NO: 2690013 - DNA, 19 bp, Homo sapiens
gggcagctcctgaccaaag

SEQ ID NO: 2690014 - DNA, 20 bp, Homo sapiens
gggcatcctgcttcctgaaa

SEQ ID NO: 2690015 - DNA, 22 bp, Homo sapiens
gggcatggacgttcggggcatg

SEQ ID NO: 2690016 - DNA, 14 bp, Homo sapiens
gggccaaagcacag

SEQ ID NO: 2690017 - DNA, 12 bp, Homo sapiens
gggccagcactg

SEQ ID NO: 2690018 - DNA, 13 bp, Homo sapiens
gggcccacccaca

SEQ ID NO: 2690019 - DNA, 11 bp, Homo sapiens
gggcccctgcc

SEQ ID NO: 2690020 - DNA, 19 bp, Homo sapiens
gggccctggtccttccagg

SEQ ID NO: 2690021 - DNA, 14 bp, Homo sapiens
gggcctctgaaatt

SEQ ID NO: 2690022 - DNA, 21 bp, Homo sapiens
gggcctctgaaatttcccaca

SEQ ID NO: 2690023 - DNA, 12 bp, Homo sapiens
gggcctgcaggt

SEQ ID NO: 2690024 - DNA, 14 bp, Homo sapiens
gggcctgccctctg

SEQ ID NO: 2690025 - DNA, 20 bp, Homo sapiens
gggcctgccctctgccccat

SEQ ID NO: 2690026 - DNA, 23 bp, Homo sapiens
gggcctgccctctgccccatcat

SEQ ID NO: 2690027 - DNA, 14 bp, Homo sapiens
gggcgaggcctgac

SEQ ID NO: 2690028 - DNA, 15 bp, Homo sapiens
gggcgaggcctgaca

SEQ ID NO: 2690029 - DNA, 18 bp, Homo sapiens
gggcgtgcctgccaagct

SEQ ID NO: 2690030 - DNA, 14 bp, Homo sapiens
gggctcctccatgg

SEQ ID NO: 2690031 - DNA, 12 bp, Homo sapiens
gggctctgcccc

SEQ ID NO: 2690032 - DNA, 15 bp, Homo sapiens
gggctgagccctggc

SEQ ID NO: 2690033 - DNA, 13 bp, Homo sapiens
gggctgccctgcc

SEQ ID NO: 2690034 - DNA, 22 bp, Homo sapiens
gggctgctggcctggcccttga

SEQ ID NO: 2690035 - DNA, 12 bp, Homo sapiens
gggctggctctg

SEQ ID NO: 2690036 - DNA, 17 bp, Homo sapiens
gggctgggccaggtctc

SEQ ID NO: 2690037 - DNA, 17 bp, Homo sapiens
gggctgtccgtgtgcct

SEQ ID NO: 2690038 - DNA, 18 bp, Homo sapiens
gggctgtccgtgtgcctc

SEQ ID NO: 2690039 - DNA, 22 bp, Homo sapiens
gggctgtccgtgtgcctcctgt

SEQ ID NO: 2690040 - DNA, 23 bp, Homo sapiens
gggctgtccgtgtgcctcctgtg

SEQ ID NO: 2690041 - DNA, 22 bp, Homo sapiens
ggggaacacagaccaggaagct

SEQ ID NO: 2690042 - DNA, 14 bp, Homo sapiens
ggggatcatctctg

SEQ ID NO: 2690043 - DNA, 19 bp, Homo sapiens
ggggcatcctgcttcctga

SEQ ID NO: 2690044 - DNA, 19 bp, Homo sapiens
ggggccagccggacacaag

SEQ ID NO: 2690045 - DNA, 22 bp, Homo sapiens
ggggccaggggttctgagaagc

SEQ ID NO: 2690046 - DNA, 18 bp, Homo sapiens
ggggcccgcctgccacct

SEQ ID NO: 2690047 - DNA, 12 bp, Homo sapiens
ggggccctggtc

SEQ ID NO: 2690048 - DNA, 21 bp, Homo sapiens
ggggccctggtccttccaggc

SEQ ID NO: 2690049 - DNA, 11 bp, Homo sapiens
ggggccctgtg

SEQ ID NO: 2690050 - DNA, 18 bp, Homo sapiens
ggggctcccggcatcctg

SEQ ID NO: 2690051 - DNA, 20 bp, Homo sapiens
ggggctcccggcatcctgaa

SEQ ID NO: 2690052 - DNA, 23 bp, Homo sapiens
ggggctcccggcatcctgaaagc

SEQ ID NO: 2690053 - DNA, 12 bp, Homo sapiens
ggggctgcaggg

SEQ ID NO: 2690054 - DNA, 15 bp, Homo sapiens
ggggctttctggaga

SEQ ID NO: 2690055 - DNA, 11 bp, Homo sapiens
gggggagccag

SEQ ID NO: 2690056 - DNA, 12 bp, Homo sapiens
gggggagccagt

SEQ ID NO: 2690057 - DNA, 12 bp, Homo sapiens
gggggcatcctg

SEQ ID NO: 2690058 - DNA, 20 bp, Homo sapiens
gggggcatcctgcttcctga

SEQ ID NO: 2690059 - DNA, 17 bp, Homo sapiens
gggggtttgagccctgg

SEQ ID NO: 2690060 - DNA, 22 bp, Homo sapiens
gggtaatcagcattattcttca

SEQ ID NO: 2690061 - DNA, 22 bp, Homo sapiens
gggtcagcccagcacctgctcc

SEQ ID NO: 2690062 - DNA, 15 bp, Homo sapiens
gggtgacatcccagg

SEQ ID NO: 2690063 - DNA, 15 bp, Homo sapiens
gggttcaagcccagg

SEQ ID NO: 2690064 - DNA, 14 bp, Homo sapiens
gggttcctcttccc

SEQ ID NO: 2690065 - DNA, 21 bp, Homo sapiens
gggttctgagaagcgctgccc

SEQ ID NO: 2690066 - DNA, 16 bp, Homo sapiens
ggtactgcacattttg

SEQ ID NO: 2690067 - DNA, 16 bp, Homo sapiens
ggtaggggctgcaggg

SEQ ID NO: 2690068 - DNA, 15 bp, Homo sapiens
ggtcaagggctgggg

SEQ ID NO: 2690069 - DNA, 22 bp, Homo sapiens
ggtcccaagtagtagtgtcttc

SEQ ID NO: 2690070 - DNA, 21 bp, Homo sapiens
ggtccctgccctcccctgctc

SEQ ID NO: 2690071 - DNA, 18 bp, Homo sapiens
ggtcctccctcccaagga

SEQ ID NO: 2690072 - DNA, 15 bp, Homo sapiens
ggtcctgcaggtcct

SEQ ID NO: 2690073 - DNA, 22 bp, Homo sapiens
ggtcctggggctctgtgcaggg

SEQ ID NO: 2690074 - DNA, 21 bp, Homo sapiens
ggtccttcaagttagctcagg

SEQ ID NO: 2690075 - DNA, 17 bp, Homo sapiens
ggtcgggacagaccagc

SEQ ID NO: 2690076 - DNA, 19 bp, Homo sapiens
ggtctgatgccaaagctgc

SEQ ID NO: 2690077 - DNA, 16 bp, Homo sapiens
ggtgagaacccagaga

SEQ ID NO: 2690078 - DNA, 19 bp, Homo sapiens
ggtgagcaggcagggctgg

SEQ ID NO: 2690079 - DNA, 24 bp, Homo sapiens
ggtgagcaggcagggctgggccag

SEQ ID NO: 2690080 - DNA, 18 bp, Homo sapiens
ggtgccaccaataaaaat

SEQ ID NO: 2690081 - DNA, 13 bp, Homo sapiens
ggtgcctcccagt

SEQ ID NO: 2690082 - DNA, 22 bp, Homo sapiens
ggtgcctcccagtggcctggct

SEQ ID NO: 2690083 - DNA, 22 bp, Homo sapiens
ggtgctgcattgagtccagctt

SEQ ID NO: 2690084 - DNA, 15 bp, Homo sapiens
ggtgctgccagctgc

SEQ ID NO: 2690085 - DNA, 16 bp, Homo sapiens
ggtggacagtcctggg

SEQ ID NO: 2690086 - DNA, 18 bp, Homo sapiens
ggtggacagtcctgggag

SEQ ID NO: 2690087 - DNA, 16 bp, Homo sapiens
ggtggatcacctgagg

SEQ ID NO: 2690088 - DNA, 15 bp, Homo sapiens
ggtgggagagcccag

SEQ ID NO: 2690089 - DNA, 13 bp, Homo sapiens
ggtgggctgagcc

SEQ ID NO: 2690090 - DNA, 19 bp, Homo sapiens
ggtgggtcagcccagcacc

SEQ ID NO: 2690091 - DNA, 17 bp, Homo sapiens
ggtggtcacaggctgtg

SEQ ID NO: 2690092 - DNA, 14 bp, Homo sapiens
ggtgtgtgtagcca

SEQ ID NO: 2690093 - DNA, 20 bp, Homo sapiens
ggttaggagttcgagaccag

SEQ ID NO: 2690094 - DNA, 17 bp, Homo sapiens
ggttcaagcccaggctt

SEQ ID NO: 2690095 - DNA, 18 bp, Homo sapiens
ggttcaagcccaggcttc

SEQ ID NO: 2690096 - DNA, 18 bp, Homo sapiens
ggttgaggggctcctgga

SEQ ID NO: 2690097 - DNA, 19 bp, Homo sapiens
ggttgaggggctcctggaa

SEQ ID NO: 2690098 - DNA, 20 bp, Homo sapiens
ggttgaggtgcgctcacctc

SEQ ID NO: 2690099 - DNA, 12 bp, Homo sapiens
ggtttctctctt

SEQ ID NO: 2690100 - DNA, 11 bp, Homo sapiens
ggttttgtagc

SEQ ID NO: 2690101 - DNA, 20 bp, Homo sapiens
gtaaaaagattatatatcat

SEQ ID NO: 2690102 - DNA, 19 bp, Homo sapiens
gtaacacaagccacagaag

SEQ ID NO: 2690103 - DNA, 14 bp, Homo sapiens
gtaactatgtttta

SEQ ID NO: 2690104 - DNA, 15 bp, Homo sapiens
gtaactggctgctcc

SEQ ID NO: 2690105 - DNA, 21 bp, Homo sapiens
gtaactggctgctccctgctc

SEQ ID NO: 2690106 - DNA, 23 bp, Homo sapiens
gtaattaataatagattgtgaat

SEQ ID NO: 2690107 - DNA, 20 bp, Homo sapiens
gtacaaagatatgctaagca

SEQ ID NO: 2690108 - DNA, 16 bp, Homo sapiens
gtacaagttttgtata

SEQ ID NO: 2690109 - DNA, 22 bp, Homo sapiens
gtacaatgtgactttgaaaata

SEQ ID NO: 2690110 - DNA, 15 bp, Homo sapiens
gtacaattactaaat

SEQ ID NO: 2690111 - DNA, 21 bp, Homo sapiens
gtacaattactaaattgtata

SEQ ID NO: 2690112 - DNA, 17 bp, Homo sapiens
gtactcaggaggctgag

SEQ ID NO: 2690113 - DNA, 23 bp, Homo sapiens
gtactcaggaggctgaggggagg

SEQ ID NO: 2690114 - DNA, 18 bp, Homo sapiens
gtactcttgctttttcaa

SEQ ID NO: 2690115 - DNA, 18 bp, Homo sapiens
gtagaaacacagttttga

SEQ ID NO: 2690116 - DNA, 15 bp, Homo sapiens
gtagaacccaggtct

SEQ ID NO: 2690117 - DNA, 16 bp, Homo sapiens
gtaggggctgcaggga

SEQ ID NO: 2690118 - DNA, 21 bp, Homo sapiens
gtagtgtcttcctagtatatt

SEQ ID NO: 2690119 - DNA, 22 bp, Homo sapiens
gtagtgtcttcctagtatatta

SEQ ID NO: 2690120 - DNA, 14 bp, Homo sapiens
gtataaataataaa

SEQ ID NO: 2690121 - DNA, 21 bp, Homo sapiens
gtatacattttgttatagaat

SEQ ID NO: 2690122 - DNA, 17 bp, Homo sapiens
gtatatgtatatctata

SEQ ID NO: 2690123 - DNA, 14 bp, Homo sapiens
gtatattagtttga

SEQ ID NO: 2690124 - DNA, 12 bp, Homo sapiens
gtatattataat

SEQ ID NO: 2690125 - DNA, 14 bp, Homo sapiens
gtatcaaatctgta

SEQ ID NO: 2690126 - DNA, 18 bp, Homo sapiens
gtatcgctgccttgccat

SEQ ID NO: 2690127 - DNA, 17 bp, Homo sapiens
gtattatttcaccagca

SEQ ID NO: 2690128 - DNA, 14 bp, Homo sapiens
gtcacaggctgtgc

SEQ ID NO: 2690129 - DNA, 18 bp, Homo sapiens
gtcaccgtggaccttcct

SEQ ID NO: 2690130 - DNA, 21 bp, Homo sapiens
gtcaccgtggaccttcctgcc

SEQ ID NO: 2690131 - DNA, 17 bp, Homo sapiens
gtcactgtccctcaaat

SEQ ID NO: 2690132 - DNA, 16 bp, Homo sapiens
gtcagaatcatgctgt

SEQ ID NO: 2690133 - DNA, 24 bp, Homo sapiens
gtcagactgctgggactggccagg

SEQ ID NO: 2690134 - DNA, 18 bp, Homo sapiens
gtcagactggctggctgc

SEQ ID NO: 2690135 - DNA, 21 bp, Homo sapiens
gtcagcccagcacctgctccc

SEQ ID NO: 2690136 - DNA, 14 bp, Homo sapiens
gtcagctttcagag

SEQ ID NO: 2690137 - DNA, 17 bp, Homo sapiens
gtcagctttcagagcca

SEQ ID NO: 2690138 - DNA, 18 bp, Homo sapiens
gtcaggacaccagcctgg

SEQ ID NO: 2690139 - DNA, 17 bp, Homo sapiens
gtcaggcacgtctcctg

SEQ ID NO: 2690140 - DNA, 14 bp, Homo sapiens
gtcataaggcggcg

SEQ ID NO: 2690141 - DNA, 21 bp, Homo sapiens
gtccagctttccttctgccct

SEQ ID NO: 2690142 - DNA, 23 bp, Homo sapiens
gtccagctttccttctgcccttc

SEQ ID NO: 2690143 - DNA, 15 bp, Homo sapiens
gtcccaatagctcta

SEQ ID NO: 2690144 - DNA, 18 bp, Homo sapiens
gtcccaatagctctactg

SEQ ID NO: 2690145 - DNA, 13 bp, Homo sapiens
gtcccacaccgct

SEQ ID NO: 2690146 - DNA, 14 bp, Homo sapiens
gtcccacctcttct

SEQ ID NO: 2690147 - DNA, 22 bp, Homo sapiens
gtcccacctcttctcttcctgt

SEQ ID NO: 2690148 - DNA, 13 bp, Homo sapiens
gtccctacccact

SEQ ID NO: 2690149 - DNA, 15 bp, Homo sapiens
gtccctacccactct

SEQ ID NO: 2690150 - DNA, 21 bp, Homo sapiens
gtccctctcggaaggctggct

SEQ ID NO: 2690151 - DNA, 14 bp, Homo sapiens
gtccctctctcagc

SEQ ID NO: 2690152 - DNA, 16 bp, Homo sapiens
gtccctgccccgaccc

SEQ ID NO: 2690153 - DNA, 14 bp, Homo sapiens
gtccctgccctccc

SEQ ID NO: 2690154 - DNA, 15 bp, Homo sapiens
gtccctgccctcccc

SEQ ID NO: 2690155 - DNA, 13 bp, Homo sapiens
gtccgtgtgcctc

SEQ ID NO: 2690156 - DNA, 17 bp, Homo sapiens
gtccgtgtgcctcctgt

SEQ ID NO: 2690157 - DNA, 17 bp, Homo sapiens
gtcctagagctcctgtc

SEQ ID NO: 2690158 - DNA, 19 bp, Homo sapiens
gtcctagagctcctgtccc

SEQ ID NO: 2690159 - DNA, 20 bp, Homo sapiens
gtcctagagctcctgtccct

SEQ ID NO: 2690160 - DNA, 20 bp, Homo sapiens
gttctggggcccgcctgcca

SEQ ID NO: 2690161 - DNA, 16 bp, Homo sapiens
gttgaggggctcctgg

SEQ ID NO: 2690162 - DNA, 15 bp, Homo sapiens
gttgatgaggcctct

SEQ ID NO: 2690163 - DNA, 18 bp, Homo sapiens
gttgctctgtttcttcct

SEQ ID NO: 2690164 - DNA, 19 bp, Homo sapiens
gttgctcttggaaagctga

SEQ ID NO: 2690165 - DNA, 17 bp, Homo sapiens
gttgctgatggcccctc

SEQ ID NO: 2690166 - DNA, 16 bp, Homo sapiens
gttggaaagcaggtgg

SEQ ID NO: 2690167 - DNA, 17 bp, Homo sapiens
gttggacccgctctgga

SEQ ID NO: 2690168 - DNA, 16 bp, Homo sapiens
gttggatttcagtgat

SEQ ID NO: 2690169 - DNA, 16 bp, Homo sapiens
gttggggtgcttcctt

SEQ ID NO: 2690170 - DNA, 12 bp, Homo sapiens
gttggtgactga

SEQ ID NO: 2690171 - DNA, 14 bp, Homo sapiens
gttggtgactgaaa

SEQ ID NO: 2690172 - DNA, 18 bp, Homo sapiens
gttgtcctcccaggaacc

SEQ ID NO: 2690173 - DNA, 18 bp, Homo sapiens
gttgtctccctctttctc

SEQ ID NO: 2690174 - DNA, 17 bp, Homo sapiens
gtttaaaaaaagtatat

SEQ ID NO: 2690175 - DNA, 18 bp, Homo sapiens
gtttaaaaaaagtatata

SEQ ID NO: 2690176 - DNA, 20 bp, Homo sapiens
gtttaaaaaaagtatatatt

SEQ ID NO: 2690177 - DNA, 17 bp, Homo sapiens
gtttcctgagccacctt

SEQ ID NO: 2690178 - DNA, 17 bp, Homo sapiens
gtttctccccctgggct

SEQ ID NO: 2690179 - DNA, 22 bp, Homo sapiens
gtttctccccctgggctctgcc

SEQ ID NO: 2690180 - DNA, 15 bp, Homo sapiens
gtttctctcttccct

SEQ ID NO: 2690181 - DNA, 21 bp, Homo sapiens
gtttctctcttcccttctccc

SEQ ID NO: 2690182 - DNA, 15 bp, Homo sapiens
gtttctgtgtgtccg

SEQ ID NO: 2690183 - DNA, 14 bp, Homo sapiens
gtttcttcctttct

SEQ ID NO: 2690184 - DNA, 16 bp, Homo sapiens
gtttgaggctgcagcg

SEQ ID NO: 2690185 - DNA, 14 bp, Homo sapiens
gtttgagtgtctgc

SEQ ID NO: 2690186 - DNA, 20 bp, Homo sapiens
gtttgcactgtatgctggac

SEQ ID NO: 2690187 - DNA, 22 bp, Homo sapiens
gtttgtaccttccttaagccag

SEQ ID NO: 2690188 - DNA, 19 bp, Homo sapiens
gtttgtttctccccctggg

SEQ ID NO: 2690189 - DNA, 14 bp, Homo sapiens
gttttgaaagaaaa

SEQ ID NO: 2690190 - DNA, 22 bp, Homo sapiens
gttttgtataaataataaagaa

SEQ ID NO: 2690191 - DNA, 15 bp, Homo sapiens
gtttttctgatatgt

SEQ ID NO: 2690192 - DNA, 21 bp, Homo sapiens
taaaaaactttctactcattt

SEQ ID NO: 2690193 - DNA, 19 bp, Homo sapiens
taaaaccccatctctacta

SEQ ID NO: 2690194 - DNA, 18 bp, Homo sapiens
taaaacttatgctagttt

SEQ ID NO: 2690195 - DNA, 12 bp, Homo sapiens
taaaataataaa

SEQ ID NO: 2690196 - DNA, 23 bp, Homo sapiens
taaaatactctagcctgggccag

SEQ ID NO: 2690197 - DNA, 20 bp, Homo sapiens
taaaatctggcaaagttata

SEQ ID NO: 2690198 - DNA, 21 bp, Homo sapiens
taaaatctggcaaagttatat

SEQ ID NO: 2690199 - DNA, 14 bp, Homo sapiens
taaaatctgtgaat

SEQ ID NO: 2690200 - DNA, 11 bp, Homo sapiens
taaacactgtt

SEQ ID NO: 2690201 - DNA, 19 bp, Homo sapiens
taaactctgaataagcact

SEQ ID NO: 2690202 - DNA, 20 bp, Homo sapiens
taaactgtatcaaatctgta

SEQ ID NO: 2690203 - DNA, 21 bp, Homo sapiens
taaagaactccttattttgta

SEQ ID NO: 2690204 - DNA, 23 bp, Homo sapiens
taaagaactccttattttgtatt

SEQ ID NO: 2690205 - DNA, 21 bp, Homo sapiens
taaagcatcagagatggtaat

SEQ ID NO: 2690206 - DNA, 12 bp, Homo sapiens
taaataatgaaa

SEQ ID NO: 2690207 - DNA, 13 bp, Homo sapiens
taaatagttctat

SEQ ID NO: 2690208 - DNA, 12 bp, Homo sapiens
taaatcctccag

SEQ ID NO: 2690209 - DNA, 23 bp, Homo sapiens
taaattgcttttgttgtgacttt

SEQ ID NO: 2690210 - DNA, 19 bp, Homo sapiens
taaattgtatacattttgt

SEQ ID NO: 2690211 - DNA, 23 bp, Homo sapiens
taacaaaccatctggtgcctttc

SEQ ID NO: 2690212 - DNA, 17 bp, Homo sapiens
taacacaagccacagaa

SEQ ID NO: 2690213 - DNA, 15 bp, Homo sapiens
taacataaaatctgt

SEQ ID NO: 2690214 - DNA, 14 bp, Homo sapiens
taactggctgctcc

SEQ ID NO: 2690215 - DNA, 19 bp, Homo sapiens
taactggctgctccctgct

SEQ ID NO: 2690216 - DNA, 20 bp, Homo sapiens
taacttccttgcccctgctc

SEQ ID NO: 2690217 - DNA, 21 bp, Homo sapiens
taacttccttgcccctgctct

SEQ ID NO: 2690218 - DNA, 21 bp, Homo sapiens
taagaaacacagggttttgta

SEQ ID NO: 2690219 - DNA, 15 bp, Homo sapiens
taagaccccatctct

SEQ ID NO: 2690220 - DNA, 13 bp, Homo sapiens
taagcacttttta

SEQ ID NO: 2690221 - DNA, 21 bp, Homo sapiens
taagcactttttaaaaaactt

SEQ ID NO: 2690222 - DNA, 11 bp, Homo sapiens
taagccctgct

SEQ ID NO: 2690223 - DNA, 20 bp, Homo sapiens
taagccctgctctttctctg

SEQ ID NO: 2690224 - DNA, 21 bp, Homo sapiens
taaggacccaaatttccctgg

SEQ ID NO: 2690225 - DNA, 17 bp, Homo sapiens
taaggggcagctcctga

SEQ ID NO: 2690226 - DNA, 20 bp, Homo sapiens
taagtacttgctctctgaga

SEQ ID NO: 2690227 - DNA, 18 bp, Homo sapiens
taagtggttttaataaaa

SEQ ID NO: 2690228 - DNA, 16 bp, Homo sapiens
taagttcatgtttgta

SEQ ID NO: 2690229 - DNA, 17 bp, Homo sapiens
taagttcatgtttgtaa

SEQ ID NO: 2690230 - DNA, 13 bp, Homo sapiens
taagttctaagtt

SEQ ID NO: 2690231 - DNA, 19 bp, Homo sapiens
taatatctgagaagtgtat

SEQ ID NO: 2690232 - DNA, 22 bp, Homo sapiens
taatatcttgctggattaatgt

SEQ ID NO: 2690233 - DNA, 22 bp, Homo sapiens
taatcggctcccgcttgctctc

SEQ ID NO: 2690234 - DNA, 14 bp, Homo sapiens
taatcttttctgaa

SEQ ID NO: 2690235 - DNA, 15 bp, Homo sapiens
taatcttttctgaat

SEQ ID NO: 2690236 - DNA, 19 bp, Homo sapiens
taatgaaagggaaagtcag

SEQ ID NO: 2690237 - DNA, 17 bp, Homo sapiens
taatgcttcaagtgttg

SEQ ID NO: 2690238 - DNA, 19 bp, Homo sapiens
taatggtgttactaaagtc

SEQ ID NO: 2690239 - DNA, 15 bp, Homo sapiens
taatgtacaagtttt

SEQ ID NO: 2690240 - DNA, 16 bp, Homo sapiens
taatgtacaagttttg

SEQ ID NO: 2690241 - DNA, 21 bp, Homo sapiens
taatgtacaagttttgtataa

SEQ ID NO: 2690242 - DNA, 16 bp, Homo sapiens
taatgttctttaatgt

SEQ ID NO: 2690243 - DNA, 15 bp, Homo sapiens
taatgttttgtacaa

SEQ ID NO: 2690244 - DNA, 17 bp, Homo sapiens
taatgttttgtacaatt

SEQ ID NO: 2690245 - DNA, 18 bp, Homo sapiens
taattgcttaaaagacat

SEQ ID NO: 2690246 - DNA, 17 bp, Homo sapiens
tacaagacaacattgta

SEQ ID NO: 2690247 - DNA, 11 bp, Homo sapiens
tacaataaatg

SEQ ID NO: 2690248 - DNA, 12 bp, Homo sapiens
tacaataaatgc

SEQ ID NO: 2690249 - DNA, 20 bp, Homo sapiens
tacaatgtgactttgaaaat

SEQ ID NO: 2690250 - DNA, 18 bp, Homo sapiens
tacaattactaaattgta

SEQ ID NO: 2690251 - DNA, 19 bp, Homo sapiens
tacaattactaaattgtat

SEQ ID NO: 2690252 - DNA, 15 bp, Homo sapiens
tacacatatatgtat

SEQ ID NO: 2690253 - DNA, 15 bp, Homo sapiens
tacactccagcctga

SEQ ID NO: 2690254 - DNA, 11 bp, Homo sapiens
tacactgtgta

SEQ ID NO: 2690255 - DNA, 12 bp, Homo sapiens
tacatattgaat

SEQ ID NO: 2690256 - DNA, 13 bp, Homo sapiens
tacatatttacct

SEQ ID NO: 2690257 - DNA, 15 bp, Homo sapiens
tacatatttacctgt

SEQ ID NO: 2690258 - DNA, 15 bp, Homo sapiens
tacatctaatgcttc

SEQ ID NO: 2690259 - DNA, 12 bp, Homo sapiens
tacattttgtta

SEQ ID NO: 2690260 - DNA, 21 bp, Homo sapiens
taccaagaaaggaacctgtca

SEQ ID NO: 2690261 - DNA, 14 bp, Homo sapiens
taccaccccttcct

SEQ ID NO: 2690262 - DNA, 18 bp, Homo sapiens
taccaccccttcctgtcc

SEQ ID NO: 2690263 - DNA, 19 bp, Homo sapiens
taccaccccttcctgtccc

SEQ ID NO: 2690264 - DNA, 15 bp, Homo sapiens
taccagtgaaccaaa

SEQ ID NO: 2690265 - DNA, 21 bp, Homo sapiens
tacccactctttgctacaata

SEQ ID NO: 2690266 - DNA, 16 bp, Homo sapiens
tacctgcaggctccat

SEQ ID NO: 2690267 - DNA, 16 bp, Homo sapiens
taccttagattagctc

SEQ ID NO: 2690268 - DNA, 22 bp, Homo sapiens
tactaaagatatcagagctctt

SEQ ID NO: 2690269 - DNA, 20 bp, Homo sapiens
tactaaattgtatacatttt

SEQ ID NO: 2690270 - DNA, 17 bp, Homo sapiens
tactcagaagcctgagg

SEQ ID NO: 2690271 - DNA, 11 bp, Homo sapiens
tccctgaggca

SEQ ID NO: 2690272 - DNA, 12 bp, Homo sapiens
tccctgcacagc

SEQ ID NO: 2690273 - DNA, 14 bp, Homo sapiens
tccctgcacagcct

SEQ ID NO: 2690274 - DNA, 12 bp, Homo sapiens
tccctgccctcc

SEQ ID NO: 2690275 - DNA, 15 bp, Homo sapiens
tccctgggggcatcc

SEQ ID NO: 2690276 - DNA, 19 bp, Homo sapiens
tccctgggggcatcctgct

SEQ ID NO: 2690277 - DNA, 21 bp, Homo sapiens
tccctgggggcatcctgcttc

SEQ ID NO: 2690278 - DNA, 22 bp, Homo sapiens
tccctgggggcatcctgcttcc

SEQ ID NO: 2690279 - DNA, 20 bp, Homo sapiens
tcccttccatgccccaggat

SEQ ID NO: 2690280 - DNA, 21 bp, Homo sapiens
tcccttccatgccccaggatc

SEQ ID NO: 2690281 - DNA, 15 bp, Homo sapiens
tccgatgctgaggcc

SEQ ID NO: 2690282 - DNA, 17 bp, Homo sapiens
tccgccttcactccggt

SEQ ID NO: 2690283 - DNA, 22 bp, Homo sapiens
tccgcctttccggggctgctgg

SEQ ID NO: 2690284 - DNA, 15 bp, Homo sapiens
tccggggctgctggc

SEQ ID NO: 2690285 - DNA, 18 bp, Homo sapiens
tccggggctgctggcctg

SEQ ID NO: 2690286 - DNA, 17 bp, Homo sapiens
tccggtgtgcctgcagc

SEQ ID NO: 2690287 - DNA, 12 bp, Homo sapiens
tccgtgccaggc

SEQ ID NO: 2690288 - DNA, 14 bp, Homo sapiens
tcctacctcagcct

SEQ ID NO: 2690289 - DNA, 13 bp, Homo sapiens
tcctagagctcct

SEQ ID NO: 2690290 - DNA, 19 bp, Homo sapiens
tcctagagctcctgtccct

SEQ ID NO: 2690291 - DNA, 13 bp, Homo sapiens
tcctagtatatta

SEQ ID NO: 2690292 - DNA, 17 bp, Homo sapiens
tcctcacttctgtctcc

SEQ ID NO: 2690293 - DNA, 19 bp, Homo sapiens
tcctcacttctgtctcctg

SEQ ID NO: 2690294 - DNA, 17 bp, Homo sapiens
tcctccatggtgctgca

SEQ ID NO: 2690295 - DNA, 22 bp, Homo sapiens
tcctccccattagagtcagcct

SEQ ID NO: 2690296 - DNA, 13 bp, Homo sapiens
tcctcctgctctg

SEQ ID NO: 2690297 - DNA, 14 bp, Homo sapiens
tcctcctgctctgc

SEQ ID NO: 2690298 - DNA, 20 bp, Homo sapiens
tcctcctgctctgcttcctc

SEQ ID NO: 2690299 - DNA, 13 bp, Homo sapiens
tcctctggtttct

SEQ ID NO: 2690300 - DNA, 15 bp, Homo sapiens
tcctctggtttctgt

SEQ ID NO: 2690301 - DNA, 17 bp, Homo sapiens
tcctctggtttctgtgt

SEQ ID NO: 2690302 - DNA, 18 bp, Homo sapiens
tcctctggtttctgtgtg

SEQ ID NO: 2690303 - DNA, 20 bp, Homo sapiens
tcctctggtttctgtgtgtc

SEQ ID NO: 2690304 - DNA, 15 bp, Homo sapiens
tcctgaaagccagca

SEQ ID NO: 2690305 - DNA, 19 bp, Homo sapiens
tcctgaaagccagcaaagc

SEQ ID NO: 2690306 - DNA, 20 bp, Homo sapiens
tcctgaaagccagcaaagcc

SEQ ID NO: 2690307 - DNA, 13 bp, Homo sapiens
tcctgaaagctgt

SEQ ID NO: 2690308 - DNA, 17 bp, Homo sapiens
tcctgaggtgcctccca

SEQ ID NO: 2690309 - DNA, 22 bp, Homo sapiens
tcctgaggtgcctcccagtggc

SEQ ID NO: 2690310 - DNA, 19 bp, Homo sapiens
tcctgagtttctctctcct

SEQ ID NO: 2690311 - DNA, 22 bp, Homo sapiens
tcctgccaccagtcactgtccc

SEQ ID NO: 2690312 - DNA, 16 bp, Homo sapiens
tcctgcctggtcctcc

SEQ ID NO: 2690313 - DNA, 12 bp, Homo sapiens
tcctgctccagc

SEQ ID NO: 2690314 - DNA, 18 bp, Homo sapiens
tcctgctccagcagcaca

SEQ ID NO: 2690315 - DNA, 12 bp, Homo sapiens
tcctgctctgct

SEQ ID NO: 2690316 - DNA, 13 bp, Homo sapiens
tcctgctctgctt

SEQ ID NO: 2690317 - DNA, 10 bp, Homo sapiens
tcctgcttcc

SEQ ID NO: 2690318 - DNA, 12 bp, Homo sapiens
tcctgcttcctg

SEQ ID NO: 2690319 - DNA, 19 bp, Homo sapiens
tcctgcttcctgaaagctg

SEQ ID NO: 2690320 - DNA, 21 bp, Homo sapiens
tcctgcttcctgaaagctgtt

SEQ ID NO: 2690321 - DNA, 18 bp, Homo sapiens
tcctggagcaagctctgc

SEQ ID NO: 2690322 - DNA, 23 bp, Homo sapiens
tcctgggagaacctcaggcttcc

SEQ ID NO: 2690323 - DNA, 18 bp, Homo sapiens
tcctgggatgatgtgtga

SEQ ID NO: 2690324 - DNA, 18 bp, Homo sapiens
tcctggggctctgtgcag

SEQ ID NO: 2690325 - DNA, 16 bp, Homo sapiens
tcctggtgggtcagcc

SEQ ID NO: 2690326 - DNA, 18 bp, Homo sapiens
tcctggtgggtcagccca

SEQ ID NO: 2690327 - DNA, 21 bp, Homo sapiens
tcctggtgggtcagcccagca

SEQ ID NO: 2690328 - DNA, 20 bp, Homo sapiens
tcctgtaacacaagccacag

SEQ ID NO: 2690329 - DNA, 15 bp, Homo sapiens
tcctgtagcatcttc

SEQ ID NO: 2690330 - DNA, 13 bp, Homo sapiens
tcctgtccctacc

SEQ ID NO: 2690331 - DNA, 16 bp, Homo sapiens
tcctgtccctacccac

SEQ ID NO: 2690332 - DNA, 18 bp, Homo sapiens
tcctgtgtgtctgcagac

SEQ ID NO: 2690333 - DNA, 18 bp, Homo sapiens
tccttcaagttagctcag

SEQ ID NO: 2690334 - DNA, 19 bp, Homo sapiens
tccttcaagttagctcagg

SEQ ID NO: 2690335 - DNA, 20 bp, Homo sapiens
tccttcaagttagctcagga

SEQ ID NO: 2690336 - DNA, 13 bp, Homo sapiens
tccttccaggccc

SEQ ID NO: 2690337 - DNA, 20 bp, Homo sapiens
tccttctgcccttcctccag

SEQ ID NO: 2690338 - DNA, 13 bp, Homo sapiens
tccttgcccctgc

SEQ ID NO: 2690339 - DNA, 14 bp, Homo sapiens
tccttgcccctgct

SEQ ID NO: 2690340 - DNA, 17 bp, Homo sapiens
tccttgcccctgctctg

SEQ ID NO: 2690341 - DNA, 12 bp, Homo sapiens
tccttgcctgga

SEQ ID NO: 2690342 - DNA, 21 bp, Homo sapiens
tccttgctgtcctaggccaca

SEQ ID NO: 2690343 - DNA, 20 bp, Homo sapiens
tccttggcatcacagggcag

SEQ ID NO: 2690344 - DNA, 21 bp, Homo sapiens
tcctttcagggaatttcagga

SEQ ID NO: 2690345 - DNA, 22 bp, Homo sapiens
tcctttcagggaatttcaggaa

SEQ ID NO: 2690346 - DNA, 15 bp, Homo sapiens
tccttttcttctagc

SEQ ID NO: 2690347 - DNA, 21 bp, Homo sapiens
tccttttgcaacaagacaaag

SEQ ID NO: 2690348 - DNA, 21 bp, Homo sapiens
tcgaaacctgtccataaagta

SEQ ID NO: 2690349 - DNA, 23 bp, Homo sapiens
tcgatgaatgtgttgatttgaga

SEQ ID NO: 2690350 - DNA, 19 bp, Homo sapiens
tcgccggccttgttttatt

SEQ ID NO: 2690351 - DNA, 14 bp, Homo sapiens
tcgggacagaccag

SEQ ID NO: 2690352 - DNA, 16 bp, Homo sapiens
tcggggcatgctgggg

SEQ ID NO: 2690353 - DNA, 19 bp, Homo sapiens
tctaactagaaatctgcca

SEQ ID NO: 2690354 - DNA, 14 bp, Homo sapiens
tctaaggacccaaa

SEQ ID NO: 2690355 - DNA, 17 bp, Homo sapiens
tctacacatatatgtat

SEQ ID NO: 2690356 - DNA, 19 bp, Homo sapiens
tctacacatatatgtatat

SEQ ID NO: 2690357 - DNA, 19 bp, Homo sapiens
tctactccatgcacatagt

SEQ ID NO: 2690358 - DNA, 19 bp, Homo sapiens
tctactcctacctcagcct

SEQ ID NO: 2690359 - DNA, 17 bp, Homo sapiens
tctactgagacatgact

SEQ ID NO: 2690360 - DNA, 13 bp, Homo sapiens
tctactgccctcc

SEQ ID NO: 2690361 - DNA, 20 bp, Homo sapiens
tctactgccctccccttccc

SEQ ID NO: 2690362 - DNA, 15 bp, Homo sapiens
tctagaacacccact

SEQ ID NO: 2690363 - DNA, 18 bp, Homo sapiens
tctagaacacccactggc

SEQ ID NO: 2690364 - DNA, 19 bp, Homo sapiens
tctagaacacccactggcc

SEQ ID NO: 2690365 - DNA, 21 bp, Homo sapiens
tctagaacacccactggccag

SEQ ID NO: 2690366 - DNA, 16 bp, Homo sapiens
tctagccagaggctgg

SEQ ID NO: 2690367 - DNA, 14 bp, Homo sapiens
tctagcctgggcca

SEQ ID NO: 2690368 - DNA, 20 bp, Homo sapiens
tctagctttgttgtcctccc

SEQ ID NO: 2690369 - DNA, 21 bp, Homo sapiens
tctagctttgttgtcctccca

SEQ ID NO: 2690370 - DNA, 15 bp, Homo sapiens
tctagtcccttctct

SEQ ID NO: 2690371 - DNA, 20 bp, Homo sapiens
tctagtcccttctctctttc

SEQ ID NO: 2690372 - DNA, 15 bp, Homo sapiens
tctagtttcagtaaa

SEQ ID NO: 2690373 - DNA, 18 bp, Homo sapiens
tctagttttttttgtaaa

SEQ ID NO: 2690374 - DNA, 18 bp, Homo sapiens
tctatgccaggctgtgct

SEQ ID NO: 2690375 - DNA, 19 bp, Homo sapiens
tctattttctctgatactt

SEQ ID NO: 2690376 - DNA, 20 bp, Homo sapiens
tctattttctctgatacttt

SEQ ID NO: 2690377 - DNA, 14 bp, Homo sapiens
tctattttgatttt

SEQ ID NO: 2690378 - DNA, 23 bp, Homo sapiens
tctcaaattgtaattaataatag

SEQ ID NO: 2690379 - DNA, 17 bp, Homo sapiens
tctcaatattcaataaa

SEQ ID NO: 2690380 - DNA, 18 bp, Homo sapiens
tctcaatattcaataaag

SEQ ID NO: 2690381 - DNA, 18 bp, Homo sapiens
tctccaccccccacgtct

SEQ ID NO: 2690382 - DNA, 22 bp, Homo sapiens
gtcctaggccacaccatctcct

SEQ ID NO: 2690383 - DNA, 11 bp, Homo sapiens
gtcctcccagg

SEQ ID NO: 2690384 - DNA, 15 bp, Homo sapiens
gtcctcccaggaacc

SEQ ID NO: 2690385 - DNA, 18 bp, Homo sapiens
gtcctcccaggaaccaaa

SEQ ID NO: 2690386 - DNA, 11 bp, Homo sapiens
gtcctcctgct

SEQ ID NO: 2690387 - DNA, 13 bp, Homo sapiens
gtcctcctgctct

SEQ ID NO: 2690388 - DNA, 17 bp, Homo sapiens
gtcctcctgctctgctt

SEQ ID NO: 2690389 - DNA, 17 bp, Homo sapiens
gtcctcgtagccatctc

SEQ ID NO: 2690390 - DNA, 19 bp, Homo sapiens
gtcctgcctggtcctccct

SEQ ID NO: 2690391 - DNA, 13 bp, Homo sapiens
gtcctgctagctg

SEQ ID NO: 2690392 - DNA, 14 bp, Homo sapiens
gtcctgctagctgt

SEQ ID NO: 2690393 - DNA, 20 bp, Homo sapiens
gtcctgggagaacctcaggc

SEQ ID NO: 2690394 - DNA, 21 bp, Homo sapiens
gtcctgggagaacctcaggct

SEQ ID NO: 2690395 - DNA, 15 bp, Homo sapiens
gtcctggggctctgt

SEQ ID NO: 2690396 - DNA, 16 bp, Homo sapiens
gtcctggggctctgtg

SEQ ID NO: 2690397 - DNA, 19 bp, Homo sapiens
gtcctggtgggtcagccca

SEQ ID NO: 2690398 - DNA, 21 bp, Homo sapiens
gtcctggtgggtcagcccagc

SEQ ID NO: 2690399 - DNA, 14 bp, Homo sapiens
gtcgggacagacca

SEQ ID NO: 2690400 - DNA, 22 bp, Homo sapiens
gtcgggcccctgcctgccttct

SEQ ID NO: 2690401 - DNA, 19 bp, Homo sapiens
gtctagcagagcaggggca

SEQ ID NO: 2690402 - DNA, 15 bp, Homo sapiens
gtctccacctgtgct

SEQ ID NO: 2690403 - DNA, 18 bp, Homo sapiens
gtctccagtggttgctgt

SEQ ID NO: 2690404 - DNA, 19 bp, Homo sapiens
gtctccctgcacagcctct

SEQ ID NO: 2690405 - DNA, 13 bp, Homo sapiens
gtctcctgctgcg

SEQ ID NO: 2690406 - DNA, 14 bp, Homo sapiens
gtctccttgcactt

SEQ ID NO: 2690407 - DNA, 20 bp, Homo sapiens
gtctcttgtagaagatggac

SEQ ID NO: 2690408 - DNA, 18 bp, Homo sapiens
gtctgagcggcgcagagc

SEQ ID NO: 2690409 - DNA, 16 bp, Homo sapiens
gtctgatgccaaagct

SEQ ID NO: 2690410 - DNA, 23 bp, Homo sapiens
gtctgatgccaaagctgctttct

SEQ ID NO: 2690411 - DNA, 20 bp, Homo sapiens
gtctgcgccccgcctcccca

SEQ ID NO: 2690412 - DNA, 16 bp, Homo sapiens
gtctgggatgtagaac

SEQ ID NO: 2690413 - DNA, 14 bp, Homo sapiens
gtctggtgctgagg

SEQ ID NO: 2690414 - DNA, 16 bp, Homo sapiens
gtctgtctgtctgtcc

SEQ ID NO: 2690415 - DNA, 13 bp, Homo sapiens
gtcttccaacccc

SEQ ID NO: 2690416 - DNA, 18 bp, Homo sapiens
gtcttccaaccccagctg

SEQ ID NO: 2690417 - DNA, 22 bp, Homo sapiens
gtcttccaaccccagctggcct

SEQ ID NO: 2690418 - DNA, 13 bp, Homo sapiens
gtcttgctgtgct

SEQ ID NO: 2690419 - DNA, 21 bp, Homo sapiens
gtctttagaatcgctttcctt

SEQ ID NO: 2690420 - DNA, 15 bp, Homo sapiens
gtctttgttgtctcc

SEQ ID NO: 2690421 - DNA, 16 bp, Homo sapiens
gtctttgttgtctccc

SEQ ID NO: 2690422 - DNA, 22 bp, Homo sapiens
gtgaaaggtgctgatggccctc

SEQ ID NO: 2690423 - DNA, 12 bp, Homo sapiens
gtgaaccaaaga

SEQ ID NO: 2690424 - DNA, 23 bp, Homo sapiens
gtgaaccaaagagactggagcat

SEQ ID NO: 2690425 - DNA, 20 bp, Homo sapiens
gtgaagagtagaacccaggt

SEQ ID NO: 2690426 - DNA, 20 bp, Homo sapiens
gtgacacaatcctcaaacat

SEQ ID NO: 2690427 - DNA, 22 bp, Homo sapiens
gtgacatcccaggaggggcctc

SEQ ID NO: 2690428 - DNA, 17 bp, Homo sapiens
gtgacatgtgcagtgct

SEQ ID NO: 2690429 - DNA, 18 bp, Homo sapiens
gtgaccctgagggctcct

SEQ ID NO: 2690430 - DNA, 19 bp, Homo sapiens
gtgaccctgagggctcctc

SEQ ID NO: 2690431 - DNA, 21 bp, Homo sapiens
gtgaccgccctccgtcgggcc

SEQ ID NO: 2690432 - DNA, 14 bp, Homo sapiens
gtgacttctggctt

SEQ ID NO: 2690433 - DNA, 20 bp, Homo sapiens
gtgagaccacctctcaatat

SEQ ID NO: 2690434 - DNA, 18 bp, Homo sapiens
gtgagagccacgctggcc

SEQ ID NO: 2690435 - DNA, 20 bp, Homo sapiens
gtgaggccgggcgcagtggc

SEQ ID NO: 2690436 - DNA, 22 bp, Homo sapiens
gtgatggaccaaagccacctgc

SEQ ID NO: 2690437 - DNA, 17 bp, Homo sapiens
gtgcactggccccaccc

SEQ ID NO: 2690438 - DNA, 22 bp, Homo sapiens
gtgccaggcattcaatcctcag

SEQ ID NO: 2690439 - DNA, 20 bp, Homo sapiens
gtgccctccacagccgcagc

SEQ ID NO: 2690440 - DNA, 21 bp, Homo sapiens
gtgcctcccagtggcctggct

SEQ ID NO: 2690441 - DNA, 11 bp, Homo sapiens
gtgcctcctgt

SEQ ID NO: 2690442 - DNA, 14 bp, Homo sapiens
gtgcctcctgtgtg

SEQ ID NO: 2690443 - DNA, 12 bp, Homo sapiens
gtgctgatggcc

SEQ ID NO: 2690444 - DNA, 15 bp, Homo sapiens
gtgctgatggccctc

SEQ ID NO: 2690445 - DNA, 18 bp, Homo sapiens
gtgctgcattgagtccag

SEQ ID NO: 2690446 - DNA, 13 bp, Homo sapiens
gtgctgccagctg

SEQ ID NO: 2690447 - DNA, 13 bp, Homo sapiens
gtggacacctgcc

SEQ ID NO: 2690448 - DNA, 18 bp, Homo sapiens
gtggacacctgccctgcc

SEQ ID NO: 2690449 - DNA, 15 bp, Homo sapiens
gtggaccttcctgcc

SEQ ID NO: 2690450 - DNA, 22 bp, Homo sapiens
gtggagaaataaaaatacctct

SEQ ID NO: 2690451 - DNA, 12 bp, Homo sapiens
gtggcagccctg

SEQ ID NO: 2690452 - DNA, 14 bp, Homo sapiens
gtggccccaggtgc

SEQ ID NO: 2690453 - DNA, 11 bp, Homo sapiens
gtggcctggct

SEQ ID NO: 2690454 - DNA, 21 bp, Homo sapiens
gtggcctggcttgtcggagca

SEQ ID NO: 2690455 - DNA, 13 bp, Homo sapiens
gtgggagagccca

SEQ ID NO: 2690456 - DNA, 15 bp, Homo sapiens
gtgggctgagccctg

SEQ ID NO: 2690457 - DNA, 16 bp, Homo sapiens
gtgggctgagccctgg

SEQ ID NO: 2690458 - DNA, 16 bp, Homo sapiens
gtgggtcagcccagca

SEQ ID NO: 2690459 - DNA, 13 bp, Homo sapiens
gtggtcacaggct

SEQ ID NO: 2690460 - DNA, 20 bp, Homo sapiens
gtggtcacaggctgtgcctt

SEQ ID NO: 2690461 - DNA, 15 bp, Homo sapiens
gtgtaactggctgct

SEQ ID NO: 2690462 - DNA, 22 bp, Homo sapiens
gtgtaactggctgctccctgct

SEQ ID NO: 2690463 - DNA, 12 bp, Homo sapiens
gtgtcctcctgc

SEQ ID NO: 2690464 - DNA, 13 bp, Homo sapiens
gtgtcctcctgct

SEQ ID NO: 2690465 - DNA, 22 bp, Homo sapiens
gtgtcctcctgctctgcttcct

SEQ ID NO: 2690466 - DNA, 23 bp, Homo sapiens
gtgtcctcctgctctgcttcctc

SEQ ID NO: 2690467 - DNA, 23 bp, Homo sapiens
gtgtcctgctagctgtctctctt

SEQ ID NO: 2690468 - DNA, 15 bp, Homo sapiens
gtgtcgtagccaagg

SEQ ID NO: 2690469 - DNA, 22 bp, Homo sapiens
gtgtctgcagacaagtcttgct

SEQ ID NO: 2690470 - DNA, 16 bp, Homo sapiens
gtgtctgcgccccgcc

SEQ ID NO: 2690471 - DNA, 18 bp, Homo sapiens
gtgtgaaagtcagatgcc

SEQ ID NO: 2690472 - DNA, 17 bp, Homo sapiens
gtgtgatcccaagtgcc

SEQ ID NO: 2690473 - DNA, 14 bp, Homo sapiens
gtgtgcctcctgtg

SEQ ID NO: 2690474 - DNA, 15 bp, Homo sapiens
gtgtgcctcctgtgt

SEQ ID NO: 2690475 - DNA, 13 bp, Homo sapiens
gtgtgcctgcagc

SEQ ID NO: 2690476 - DNA, 15 bp, Homo sapiens
gtgtgcctgcagccc

SEQ ID NO: 2690477 - DNA, 16 bp, Homo sapiens
gtgtgcctgcagcccc

SEQ ID NO: 2690478 - DNA, 16 bp, Homo sapiens
gtgttactaaagtcac

SEQ ID NO: 2690479 - DNA, 18 bp, Homo sapiens
gtgttgcgtgtcgtgggt

SEQ ID NO: 2690480 - DNA, 16 bp, Homo sapiens
gtgtttgaagtctgct

SEQ ID NO: 2690481 - DNA, 17 bp, Homo sapiens
gttaaagcatcagagat

SEQ ID NO: 2690482 - DNA, 15 bp, Homo sapiens
gttactgttgcactg

SEQ ID NO: 2690483 - DNA, 16 bp, Homo sapiens
gttacttgaaatacca

SEQ ID NO: 2690484 - DNA, 15 bp, Homo sapiens
gttaggagttcgaga

SEQ ID NO: 2690485 - DNA, 22 bp, Homo sapiens
gttatgtttgcactttgtatat

SEQ ID NO: 2690486 - DNA, 13 bp, Homo sapiens
gttcaagcccagg

SEQ ID NO: 2690487 - DNA, 15 bp, Homo sapiens
gttcactaaactctg

SEQ ID NO: 2690488 - DNA, 14 bp, Homo sapiens
gttcattctgatgt

SEQ ID NO: 2690489 - DNA, 12 bp, Homo sapiens
gttcattttagt

SEQ ID NO: 2690490 - DNA, 13 bp, Homo sapiens
gttcattttagtg

SEQ ID NO: 2690491 - DNA, 18 bp, Homo sapiens
gttcattttagtgactgt

SEQ ID NO: 2690492 - DNA, 17 bp, Homo sapiens
gttcctgtggccaggag

SEQ ID NO: 2690493 - DNA, 17 bp, Homo sapiens
gttcgagaccagcctgg

SEQ ID NO: 2690494 - DNA, 19 bp, Homo sapiens
tactcagaagcctgaggct

SEQ ID NO: 2690495 - DNA, 18 bp, Homo sapiens
tactcagcccagctggcc

SEQ ID NO: 2690496 - DNA, 14 bp, Homo sapiens
tactcctacctcag

SEQ ID NO: 2690497 - DNA, 15 bp, Homo sapiens
tactcctacctcagc

SEQ ID NO: 2690498 - DNA, 16 bp, Homo sapiens
tactcctacctcagcc

SEQ ID NO: 2690499 - DNA, 17 bp, Homo sapiens
tactcctacctcagcct

SEQ ID NO: 2690500 - DNA, 22 bp, Homo sapiens
tactcgggaggctgaggcagga

SEQ ID NO: 2690501 - DNA, 22 bp, Homo sapiens
tactctagcctgggccagagaa

SEQ ID NO: 2690502 - DNA, 14 bp, Homo sapiens
tactgccctcccct

SEQ ID NO: 2690503 - DNA, 15 bp, Homo sapiens
tactgccctcccctt

SEQ ID NO: 2690504 - DNA, 18 bp, Homo sapiens
tacttcacccggctgggc

SEQ ID NO: 2690505 - DNA, 13 bp, Homo sapiens
tacttcctgggat

SEQ ID NO: 2690506 - DNA, 20 bp, Homo sapiens
tagaacacccactggccagt

SEQ ID NO: 2690507 - DNA, 14 bp, Homo sapiens
tagaacccaggtct

SEQ ID NO: 2690508 - DNA, 19 bp, Homo sapiens
tagaaggccacatgtcacc

SEQ ID NO: 2690509 - DNA, 21 bp, Homo sapiens
tagaagtaactggtgatatat

SEQ ID NO: 2690510 - DNA, 12 bp, Homo sapiens
tagaatactttt

SEQ ID NO: 2690511 - DNA, 20 bp, Homo sapiens
tagagctcctgtccctaccc

SEQ ID NO: 2690512 - DNA, 13 bp, Homo sapiens
tagagtcagcctt

SEQ ID NO: 2690513 - DNA, 14 bp, Homo sapiens
tagagtcagccttc

SEQ ID NO: 2690514 - DNA, 16 bp, Homo sapiens
tagatgtgctgctttg

SEQ ID NO: 2690515 - DNA, 22 bp, Homo sapiens
tagattagtactggattattca

SEQ ID NO: 2690516 - DNA, 22 bp, Homo sapiens
tagcatcttctggagtctccag

SEQ ID NO: 2690517 - DNA, 23 bp, Homo sapiens
tagcatcttctggagtctccagt

SEQ ID NO: 2690518 - DNA, 23 bp, Homo sapiens
tagccagtgactttttctgagct

SEQ ID NO: 2690519 - DNA, 16 bp, Homo sapiens
tagcctgggccagaga

SEQ ID NO: 2690520 - DNA, 22 bp, Homo sapiens
tagccttgcccggattctggga

SEQ ID NO: 2690521 - DNA, 17 bp, Homo sapiens
tagcctttgccctgtca

SEQ ID NO: 2690522 - DNA, 18 bp, Homo sapiens
tagctctactgccctccc

SEQ ID NO: 2690523 - DNA, 14 bp, Homo sapiens
tagctgatgaaact

SEQ ID NO: 2690524 - DNA, 15 bp, Homo sapiens
tagctgtctctcttg

SEQ ID NO: 2690525 - DNA, 18 bp, Homo sapiens
tagctgtctctcttgttg

SEQ ID NO: 2690526 - DNA, 15 bp, Homo sapiens
tagctttctggatgg

SEQ ID NO: 2690527 - DNA, 19 bp, Homo sapiens
tagctttgttgtcctccca

SEQ ID NO: 2690528 - DNA, 18 bp, Homo sapiens
taggacttccttaagcat

SEQ ID NO: 2690529 - DNA, 19 bp, Homo sapiens
taggacttccttaagcatg

SEQ ID NO: 2690530 - DNA, 11 bp, Homo sapiens
taggagcccca

SEQ ID NO: 2690531 - DNA, 13 bp, Homo sapiens
taggagccccagc

SEQ ID NO: 2690532 - DNA, 17 bp, Homo sapiens
taggagttcgagaccag

SEQ ID NO: 2690533 - DNA, 20 bp, Homo sapiens
taggtcctcacttctgtctc

SEQ ID NO: 2690534 - DNA, 17 bp, Homo sapiens
tagtcccttctctcttt

SEQ ID NO: 2690535 - DNA, 17 bp, Homo sapiens
tagtctctgtgctttga

SEQ ID NO: 2690536 - DNA, 15 bp, Homo sapiens
tagttgaaaaatcta

SEQ ID NO: 2690537 - DNA, 14 bp, Homo sapiens
tagtttcagtaaat

SEQ ID NO: 2690538 - DNA, 18 bp, Homo sapiens
tagttttttttgtaaact

SEQ ID NO: 2690539 - DNA, 14 bp, Homo sapiens
tatatatcataaag

SEQ ID NO: 2690540 - DNA, 15 bp, Homo sapiens
tatatatcataaagt

SEQ ID NO: 2690541 - DNA, 17 bp, Homo sapiens
tatatatcataaagtat

SEQ ID NO: 2690542 - DNA, 14 bp, Homo sapiens
tatatcataaagta

SEQ ID NO: 2690543 - DNA, 20 bp, Homo sapiens
tatatctataaacactgttt

SEQ ID NO: 2690544 - DNA, 18 bp, Homo sapiens
tatatctatatctctaaa

SEQ ID NO: 2690545 - DNA, 15 bp, Homo sapiens
tatatgtatatgtat

SEQ ID NO: 2690546 - DNA, 17 bp, Homo sapiens
tatatgtatatgtatat

SEQ ID NO: 2690547 - DNA, 13 bp, Homo sapiens
tatcaaatctgta

SEQ ID NO: 2690548 - DNA, 14 bp, Homo sapiens
tatcacttatatat

SEQ ID NO: 2690549 - DNA, 11 bp, Homo sapiens
tatcataaagt

SEQ ID NO: 2690550 - DNA, 16 bp, Homo sapiens
tatctctaaactgctg

SEQ ID NO: 2690551 - DNA, 18 bp, Homo sapiens
tatctgagaagtgtatat

SEQ ID NO: 2690552 - DNA, 23 bp, Homo sapiens
tatgaacttgaggacacatgtcc

SEQ ID NO: 2690553 - DNA, 15 bp, Homo sapiens
tatgatcgcgccact

SEQ ID NO: 2690554 - DNA, 15 bp, Homo sapiens
tatgctcagaagcca

SEQ ID NO: 2690555 - DNA, 23 bp, Homo sapiens
tatgctcagaagccagtctgcgt

SEQ ID NO: 2690556 - DNA, 14 bp, Homo sapiens
tatgttgtaataaa

SEQ ID NO: 2690557 - DNA, 19 bp, Homo sapiens
tatgtttgtacaagattgt

SEQ ID NO: 2690558 - DNA, 14 bp, Homo sapiens
tattacatctaatg

SEQ ID NO: 2690559 - DNA, 15 bp, Homo sapiens
tattagcaactgtgc

SEQ ID NO: 2690560 - DNA, 22 bp, Homo sapiens
tattagtttgatttaatatctg

SEQ ID NO: 2690561 - DNA, 11 bp, Homo sapiens
tattattaatg

SEQ ID NO: 2690562 - DNA, 14 bp, Homo sapiens
tattattaatgctt

SEQ ID NO: 2690563 - DNA, 16 bp, Homo sapiens
tattatttcaccagca

SEQ ID NO: 2690564 - DNA, 11 bp, Homo sapiens
tattcaataaa

SEQ ID NO: 2690565 - DNA, 13 bp, Homo sapiens
tattcaataaagc

SEQ ID NO: 2690566 - DNA, 15 bp, Homo sapiens
tattcaggctttagg

SEQ ID NO: 2690567 - DNA, 15 bp, Homo sapiens
tattcagtgacttct

SEQ ID NO: 2690568 - DNA, 20 bp, Homo sapiens
tattcagtgacttctggctt

SEQ ID NO: 2690569 - DNA, 16 bp, Homo sapiens
tattctacacatatat

SEQ ID NO: 2690570 - DNA, 22 bp, Homo sapiens
tattctacacatatatgtatat

SEQ ID NO: 2690571 - DNA, 18 bp, Homo sapiens
tattggaagtgttcaaga

SEQ ID NO: 2690572 - DNA, 13 bp, Homo sapiens
tatttagaatata

SEQ ID NO: 2690573 - DNA, 20 bp, Homo sapiens
tatttagaatatattaaatc

SEQ ID NO: 2690574 - DNA, 22 bp, Homo sapiens
tatttatctccgcaggctattt

SEQ ID NO: 2690575 - DNA, 19 bp, Homo sapiens
tatttattcagtgacttct

SEQ ID NO: 2690576 - DNA, 19 bp, Homo sapiens
tatttccacataaaggtat

SEQ ID NO: 2690577 - DNA, 20 bp, Homo sapiens
tatttggaaatattctatga

SEQ ID NO: 2690578 - DNA, 22 bp, Homo sapiens
tatttgtgtgttcactaaactc

SEQ ID NO: 2690579 - DNA, 14 bp, Homo sapiens
tatttgttcagaga

SEQ ID NO: 2690580 - DNA, 14 bp, Homo sapiens
tattttctgaccaa

SEQ ID NO: 2690581 - DNA, 16 bp, Homo sapiens
tattttctgaccaaaa

SEQ ID NO: 2690582 - DNA, 21 bp, Homo sapiens
tcaaatctgtatatgttgtaa

SEQ ID NO: 2690583 - DNA, 18 bp, Homo sapiens
tcaacaatttttgatcaa

SEQ ID NO: 2690584 - DNA, 23 bp, Homo sapiens
tcaacctaccaccccttcctgtc

SEQ ID NO: 2690585 - DNA, 15 bp, Homo sapiens
tcaacctgtgtctta

SEQ ID NO: 2690586 - DNA, 17 bp, Homo sapiens
tcaagatgtcagactgg

SEQ ID NO: 2690587 - DNA, 15 bp, Homo sapiens
tcaagcccaggcttc

SEQ ID NO: 2690588 - DNA, 13 bp, Homo sapiens
tcaagggaagaaa

SEQ ID NO: 2690589 - DNA, 14 bp, Homo sapiens
tcaagggctggggc

SEQ ID NO: 2690590 - DNA, 20 bp, Homo sapiens
tcaagggctggggctgagct

SEQ ID NO: 2690591 - DNA, 17 bp, Homo sapiens
tcacacagggctctttg

SEQ ID NO: 2690592 - DNA, 20 bp, Homo sapiens
tcacacctccttttcttcta

SEQ ID NO: 2690593 - DNA, 21 bp, Homo sapiens
tcacatataaaagttaaacta

SEQ ID NO: 2690594 - DNA, 16 bp, Homo sapiens
tcacatccttgacttt

SEQ ID NO: 2690595 - DNA, 19 bp, Homo sapiens
tcacatccttgacttttta

SEQ ID NO: 2690596 - DNA, 14 bp, Homo sapiens
tcacccaggcctga

SEQ ID NO: 2690597 - DNA, 14 bp, Homo sapiens
tcacccggctgggc

SEQ ID NO: 2690598 - DNA, 19 bp, Homo sapiens
tcacgcctatgatcccagc

SEQ ID NO: 2690599 - DNA, 21 bp, Homo sapiens
tcacgcctatgatcccagcac

SEQ ID NO: 2690600 - DNA, 14 bp, Homo sapiens
tcactcactctggg

SEQ ID NO: 2690601 - DNA, 19 bp, Homo sapiens
tcactccggtgtgcctgca

SEQ ID NO: 2690602 - DNA, 14 bp, Homo sapiens
tcactctctgctgg

SEQ ID NO: 2690603 - DNA, 15 bp, Homo sapiens
tcactctctgctggc

SEQ ID NO: 2690604 - DNA, 11 bp, Homo sapiens
tcactggagcc

SEQ ID NO: 2690605 - DNA, 11 bp, Homo sapiens
tcactggcctg

SEQ ID NO: 2690606 - DNA, 18 bp, Homo sapiens
tcactgtccctcaaatga

SEQ ID NO: 2690607 - DNA, 16 bp, Homo sapiens
tcactttacctgcagg

SEQ ID NO: 2690608 - DNA, 20 bp, Homo sapiens
tcactttttaaaccactgta

SEQ ID NO: 2690609 - DNA, 19 bp, Homo sapiens
tcagaagccagtctgcgtc

SEQ ID NO: 2690610 - DNA, 13 bp, Homo sapiens
tcagaagcctgag

SEQ ID NO: 2690611 - DNA, 20 bp, Homo sapiens
tcagaagcctgaggctggga

SEQ ID NO: 2690612 - DNA, 23 bp, Homo sapiens
tcagaatagttattctctaagag

SEQ ID NO: 2690613 - DNA, 13 bp, Homo sapiens
tcagactggctgg

SEQ ID NO: 2690614 - DNA, 17 bp, Homo sapiens
tcagagaggtctcaggt

SEQ ID NO: 2690615 - DNA, 14 bp, Homo sapiens
tcagagccagtgaa

SEQ ID NO: 2690616 - DNA, 15 bp, Homo sapiens
tcagagccagtgaag

SEQ ID NO: 2690617 - DNA, 15 bp, Homo sapiens
tcagagctgcagcca

SEQ ID NO: 2690618 - DNA, 14 bp, Homo sapiens
tcagatgcccagag

SEQ ID NO: 2690619 - DNA, 22 bp, Homo sapiens
tcagatgcccagagggcccagg

SEQ ID NO: 2690620 - DNA, 18 bp, Homo sapiens
tcagcattgtcagcctga

SEQ ID NO: 2690621 - DNA, 12 bp, Homo sapiens
tcagcccagcac

SEQ ID NO: 2690622 - DNA, 19 bp, Homo sapiens
tcagcccagcacctgctcc

SEQ ID NO: 2690623 - DNA, 14 bp, Homo sapiens
tcagcccagctggc

SEQ ID NO: 2690624 - DNA, 16 bp, Homo sapiens
tcagcccagctggcca

SEQ ID NO: 2690625 - DNA, 14 bp, Homo sapiens
tcagccctccatgg

SEQ ID NO: 2690626 - DNA, 21 bp, Homo sapiens
tcagcctgaagatcagagctg

SEQ ID NO: 2690627 - DNA, 24 bp, Homo sapiens
tcagccttccccctcccagggcca

SEQ ID NO: 2690628 - DNA, 14 bp, Homo sapiens
tcagctttcagagc

SEQ ID NO: 2690629 - DNA, 20 bp, Homo sapiens
tcagctttcagagccagtga

SEQ ID NO: 2690630 - DNA, 22 bp, Homo sapiens
tcagctttcagagccagtgaag

SEQ ID NO: 2690631 - DNA, 19 bp, Homo sapiens
tcaggactgtgaccaaagc

SEQ ID NO: 2690632 - DNA, 17 bp, Homo sapiens
tcaggcacgtctcctgc

SEQ ID NO: 2690633 - DNA, 14 bp, Homo sapiens
tcagtctcaggagc

SEQ ID NO: 2690634 - DNA, 16 bp, Homo sapiens
tcagtgacttctggct

SEQ ID NO: 2690635 - DNA, 19 bp, Homo sapiens
tcagtgatttttcccccca

SEQ ID NO: 2690636 - DNA, 12 bp, Homo sapiens
tcagtgctgtgg

SEQ ID NO: 2690637 - DNA, 14 bp, Homo sapiens
tcataacaaaccat

SEQ ID NO: 2690638 - DNA, 16 bp, Homo sapiens
tcataacaaaccatct

SEQ ID NO: 2690639 - DNA, 17 bp, Homo sapiens
tcatgctgttctctttg

SEQ ID NO: 2690640 - DNA, 19 bp, Homo sapiens
tcatggtgatcagtgcaat

SEQ ID NO: 2690641 - DNA, 13 bp, Homo sapiens
tcatgtttgtaaa

SEQ ID NO: 2690642 - DNA, 19 bp, Homo sapiens
tcattccgagggtgaaaca

SEQ ID NO: 2690643 - DNA, 16 bp, Homo sapiens
tcattgcacctgcagg

SEQ ID NO: 2690644 - DNA, 21 bp, Homo sapiens
tcatttacaagacaacattgt

SEQ ID NO: 2690645 - DNA, 16 bp, Homo sapiens
tcattttagtgactgt

SEQ ID NO: 2690646 - DNA, 17 bp, Homo sapiens
tcattttagtgactgta

SEQ ID NO: 2690647 - DNA, 14 bp, Homo sapiens
tccaaccccagctg

SEQ ID NO: 2690648 - DNA, 18 bp, Homo sapiens
tccaatggggccagcact

SEQ ID NO: 2690649 - DNA, 19 bp, Homo sapiens
tccaatggggccagcactg

SEQ ID NO: 2690650 - DNA, 14 bp, Homo sapiens
tccacagccgcagc

SEQ ID NO: 2690651 - DNA, 12 bp, Homo sapiens
tccacataaagg

SEQ ID NO: 2690652 - DNA, 13 bp, Homo sapiens
tccaccaatctct

SEQ ID NO: 2690653 - DNA, 21 bp, Homo sapiens
tccaccccccacgtctgtcct

SEQ ID NO: 2690654 - DNA, 12 bp, Homo sapiens
tccaccctggaa

SEQ ID NO: 2690655 - DNA, 12 bp, Homo sapiens
tccacctgtgct

SEQ ID NO: 2690656 - DNA, 13 bp, Homo sapiens
tccacctgtgctt

SEQ ID NO: 2690657 - DNA, 14 bp, Homo sapiens
tccacctgtgcttg

SEQ ID NO: 2690658 - DNA, 14 bp, Homo sapiens
tccacgcaaggctg

SEQ ID NO: 2690659 - DNA, 16 bp, Homo sapiens
tccacgcaaggctgtg

SEQ ID NO: 2690660 - DNA, 19 bp, Homo sapiens
tccacgcaaggctgtgctc

SEQ ID NO: 2690661 - DNA, 16 bp, Homo sapiens
tccactgccaaaacaa

SEQ ID NO: 2690662 - DNA, 12 bp, Homo sapiens
tccactggactt

SEQ ID NO: 2690663 - DNA, 15 bp, Homo sapiens
tccagaccattgtct

SEQ ID NO: 2690664 - DNA, 17 bp, Homo sapiens
tccagaccattgtcttc

SEQ ID NO: 2690665 - DNA, 19 bp, Homo sapiens
tccagcagcacacctcagc

SEQ ID NO: 2690666 - DNA, 20 bp, Homo sapiens
tccagcagcacacctcagcc

SEQ ID NO: 2690667 - DNA, 21 bp, Homo sapiens
tccagcagcacacctcagccc

SEQ ID NO: 2690668 - DNA, 22 bp, Homo sapiens
tccagcagcacacctcagcccc

SEQ ID NO: 2690669 - DNA, 21 bp, Homo sapiens
tccagctttccttctgccctt

SEQ ID NO: 2690670 - DNA, 20 bp, Homo sapiens
tccaggagaaggggcccaag

SEQ ID NO: 2690671 - DNA, 21 bp, Homo sapiens
tccaggagaaggggcccaagg

SEQ ID NO: 2690672 - DNA, 12 bp, Homo sapiens
tccaggcctgca

SEQ ID NO: 2690673 - DNA, 14 bp, Homo sapiens
tccaggcctgcagg

SEQ ID NO: 2690674 - DNA, 23 bp, Homo sapiens
tccagtgggaggtgagaccacct

SEQ ID NO: 2690675 - DNA, 13 bp, Homo sapiens
tccagtttccaaa

SEQ ID NO: 2690676 - DNA, 23 bp, Homo sapiens
tccatcctgaggtgcctcccagt

SEQ ID NO: 2690677 - DNA, 12 bp, Homo sapiens
tccatctctggt

SEQ ID NO: 2690678 - DNA, 19 bp, Homo sapiens
tccatgcagactcctcaga

SEQ ID NO: 2690679 - DNA, 14 bp, Homo sapiens
tccattgaccagct

SEQ ID NO: 2690680 - DNA, 14 bp, Homo sapiens
tcccaaggagccat

SEQ ID NO: 2690681 - DNA, 22 bp, Homo sapiens
tcccaatagctctactgccctc

SEQ ID NO: 2690682 - DNA, 13 bp, Homo sapiens
tcccaatgtgccg

SEQ ID NO: 2690683 - DNA, 17 bp, Homo sapiens
tcccacaccccagcgcc

SEQ ID NO: 2690684 - DNA, 13 bp, Homo sapiens
tcccacaccgctg

SEQ ID NO: 2690685 - DNA, 13 bp, Homo sapiens
tcccagccctcag

SEQ ID NO: 2690686 - DNA, 14 bp, Homo sapiens
tcccagccctcagc

SEQ ID NO: 2690687 - DNA, 15 bp, Homo sapiens
tcccagccctcagca

SEQ ID NO: 2690688 - DNA, 21 bp, Homo sapiens
tcccagctactcagaagcctg

SEQ ID NO: 2690689 - DNA, 23 bp, Homo sapiens
tcccagctactcagaagcctgag

SEQ ID NO: 2690690 - DNA, 15 bp, Homo sapiens
tcccaggaaccaaaa

SEQ ID NO: 2690691 - DNA, 15 bp, Homo sapiens
tcccaggaggggcct

SEQ ID NO: 2690692 - DNA, 19 bp, Homo sapiens
tcccaggaggggcctctga

SEQ ID NO: 2690693 - DNA, 23 bp, Homo sapiens
tcccagggccagggccctgcaga

SEQ ID NO: 2690694 - DNA, 18 bp, Homo sapiens
tcccagtgggagcttccc

SEQ ID NO: 2690695 - DNA, 20 bp, Homo sapiens
tcccagtgggagcttcccgg

SEQ ID NO: 2690696 - DNA, 15 bp, Homo sapiens
tccccacctacccag

SEQ ID NO: 2690697 - DNA, 20 bp, Homo sapiens
tccccaccttcaattcctgg

SEQ ID NO: 2690698 - DNA, 22 bp, Homo sapiens
tccccaccttcaattcctgggc

SEQ ID NO: 2690699 - DNA, 19 bp, Homo sapiens
tccccaggtggaggtgcca

SEQ ID NO: 2690700 - DNA, 21 bp, Homo sapiens
tccccattagagtcagccttc

SEQ ID NO: 2690701 - DNA, 20 bp, Homo sapiens
tccccctgggctctgcccca

SEQ ID NO: 2690702 - DNA, 22 bp, Homo sapiens
tcccctccacgcaaggctgtgc

SEQ ID NO: 2690703 - DNA, 14 bp, Homo sapiens
tcccctgctcccag

SEQ ID NO: 2690704 - DNA, 16 bp, Homo sapiens
tcccctgctcccaggt

SEQ ID NO: 2690705 - DNA, 18 bp, Homo sapiens
tcccctttactcagccca

SEQ ID NO: 2690706 - DNA, 16 bp, Homo sapiens
tcccgcttgctctcct

SEQ ID NO: 2690707 - DNA, 18 bp, Homo sapiens
tcccgcttgctctcctgg

SEQ ID NO: 2690708 - DNA, 21 bp, Homo sapiens
tcccgcttgctctcctggagc

SEQ ID NO: 2690709 - DNA, 23 bp, Homo sapiens
tcccggcatcctgaaagccagca

SEQ ID NO: 2690710 - DNA, 14 bp, Homo sapiens
tccctacccactct

SEQ ID NO: 2690711 - DNA, 15 bp, Homo sapiens
tccctacccactctt

SEQ ID NO: 2690712 - DNA, 13 bp, Homo sapiens
tccctcaaatgac

SEQ ID NO: 2690713 - DNA, 15 bp, Homo sapiens
tccctctctcagccc

SEQ ID NO: 2690714 - DNA, 17 bp, Homo sapiens
tccctctgacctgcagg

SEQ ID NO: 2690715 - DNA, 16 bp, Homo sapiens
tccctgactctctgtg

SEQ ID NO: 2690716 - DNA, 17 bp, Homo sapiens
tccctgactctctgtga

SEQ ID NO: 2690717 - DNA, 18 bp, Homo sapiens
tccctgactctctgtgac

SEQ ID NO: 2690718 - DNA, 13 bp, Homo sapiens
ttttttgtaaact

SEQ ID NO: 2690719 - DNA, 18 bp, Homo sapiens
ttgatgaaattcttgaag

SEQ ID NO: 2690720 - DNA, 14 bp, Homo sapiens
ttgatttaatatct

SEQ ID NO: 2690721 - DNA, 20 bp, Homo sapiens
ttgcccaggctggagtgcag

SEQ ID NO: 2690722 - DNA, 20 bp, Homo sapiens
ttgcccccgtggggctcccg

SEQ ID NO: 2690723 - DNA, 22 bp, Homo sapiens
ttgcccctccgatgctgaggcc

SEQ ID NO: 2690724 - DNA, 23 bp, Homo sapiens
ttgcccctccgatgctgaggcca

SEQ ID NO: 2690725 - DNA, 12 bp, Homo sapiens
ttgcccctgctc

SEQ ID NO: 2690726 - DNA, 15 bp, Homo sapiens
ttgcccctgctctgt

SEQ ID NO: 2690727 - DNA, 19 bp, Homo sapiens
ttgcccggattctgggagg

SEQ ID NO: 2690728 - DNA, 19 bp, Homo sapiens
ttgctacaataaatgctga

SEQ ID NO: 2690729 - DNA, 14 bp, Homo sapiens
ttgctctcctggag

SEQ ID NO: 2690730 - DNA, 16 bp, Homo sapiens
ttgctgatggcccctc

SEQ ID NO: 2690731 - DNA, 20 bp, Homo sapiens
ttgctgatggcccctccagc

SEQ ID NO: 2690732 - DNA, 23 bp, Homo sapiens
ttgctgatggcccctccagcaca

SEQ ID NO: 2690733 - DNA, 22 bp, Homo sapiens
ttgcttagatgagggtgactgt

SEQ ID NO: 2690734 - DNA, 22 bp, Homo sapiens
ttgcttgccgagcctaatgaaa

SEQ ID NO: 2690735 - DNA, 21 bp, Homo sapiens
ttggaaagcaggtggcatctc

SEQ ID NO: 2690736 - DNA, 20 bp, Homo sapiens
ttggaaagcatcacctcagg

SEQ ID NO: 2690737 - DNA, 22 bp, Homo sapiens
ttggaaagcatcacctcaggcc

SEQ ID NO: 2690738 - DNA, 21 bp, Homo sapiens
ttggaagtgttcaagaaataa

SEQ ID NO: 2690739 - DNA, 16 bp, Homo sapiens
ttggacccgctctgga

SEQ ID NO: 2690740 - DNA, 14 bp, Homo sapiens
ttggacctctgctc

SEQ ID NO: 2690741 - DNA, 15 bp, Homo sapiens
ttggacctctgctct

SEQ ID NO: 2690742 - DNA, 16 bp, Homo sapiens
ttggacctctgctctg

SEQ ID NO: 2690743 - DNA, 15 bp, Homo sapiens
ttggagactctgtgg

SEQ ID NO: 2690744 - DNA, 22 bp, Homo sapiens
ttggagggtgggagagcccagc

SEQ ID NO: 2690745 - DNA, 15 bp, Homo sapiens
ttggcaccggcctct

SEQ ID NO: 2690746 - DNA, 15 bp, Homo sapiens
ttgggaggctgaggc

SEQ ID NO: 2690747 - DNA, 14 bp, Homo sapiens
ttgggctggctctg

SEQ ID NO: 2690748 - DNA, 14 bp, Homo sapiens
ttggttcccttgtg

SEQ ID NO: 2690749 - DNA, 15 bp, Homo sapiens
ttgtaaactgtatca

SEQ ID NO: 2690750 - DNA, 23 bp, Homo sapiens
ttgtaaattaatacttcatttgg

SEQ ID NO: 2690751 - DNA, 12 bp, Homo sapiens
ttgtagaaacac

SEQ ID NO: 2690752 - DNA, 22 bp, Homo sapiens
ttgtagaaacacagttttgaaa

SEQ ID NO: 2690753 - DNA, 20 bp, Homo sapiens
ttgtagaagatggactctga

SEQ ID NO: 2690754 - DNA, 19 bp, Homo sapiens
ttgtataaataataaagaa

SEQ ID NO: 2690755 - DNA, 13 bp, Homo sapiens
ttgtcctcccagg

SEQ ID NO: 2690756 - DNA, 20 bp, Homo sapiens
ttgtgaaattcaacctgtgt

SEQ ID NO: 2690757 - DNA, 17 bp, Homo sapiens
ttgttattgtggaagat

SEQ ID NO: 2690758 - DNA, 17 bp, Homo sapiens
ttgtttctccccctggg

SEQ ID NO: 2690759 - DNA, 11 bp, Homo sapiens
tttaaaaaact

SEQ ID NO: 2690760 - DNA, 14 bp, Homo sapiens
tttaaaaaactttc

SEQ ID NO: 2690761 - DNA, 18 bp, Homo sapiens
tttaaaaaactttctact

SEQ ID NO: 2690762 - DNA, 20 bp, Homo sapiens
tttaagccctgctctttctc

SEQ ID NO: 2690763 - DNA, 14 bp, Homo sapiens
tttaatgtacaagt

SEQ ID NO: 2690764 - DNA, 15 bp, Homo sapiens
tttaccctatatcta

SEQ ID NO: 2690765 - DNA, 18 bp, Homo sapiens
tttacctgtatttaagat

SEQ ID NO: 2690766 - DNA, 19 bp, Homo sapiens
tttagatgtgctgctttga

SEQ ID NO: 2690767 - DNA, 18 bp, Homo sapiens
tttagttgaaaaatctag

SEQ ID NO: 2690768 - DNA, 18 bp, Homo sapiens
tttatagttaatctataa

SEQ ID NO: 2690769 - DNA, 13 bp, Homo sapiens
tttatatccattt

SEQ ID NO: 2690770 - DNA, 16 bp, Homo sapiens
tttatatccattttta

SEQ ID NO: 2690771 - DNA, 20 bp, Homo sapiens
tttattaatatggtgacttt

SEQ ID NO: 2690772 - DNA, 13 bp, Homo sapiens
tttcaactcattg

SEQ ID NO: 2690773 - DNA, 19 bp, Homo sapiens
tttcagagccagtgaagga

SEQ ID NO: 2690774 - DNA, 15 bp, Homo sapiens
tttcaggccaaggct

SEQ ID NO: 2690775 - DNA, 20 bp, Homo sapiens
tttcataacaaaccatctgg

SEQ ID NO: 2690776 - DNA, 23 bp, Homo sapiens
tttcataacaaaccatctggtgc

SEQ ID NO: 2690777 - DNA, 12 bp, Homo sapiens
tttcatggaagt

SEQ ID NO: 2690778 - DNA, 14 bp, Homo sapiens
tttccacataaagg

SEQ ID NO: 2690779 - DNA, 18 bp, Homo sapiens
tttccattgaccagctct

SEQ ID NO: 2690780 - DNA, 20 bp, Homo sapiens
tttccattgaccagctctct

SEQ ID NO: 2690781 - DNA, 20 bp, Homo sapiens
tttccctgggggcatcctgc

SEQ ID NO: 2690782 - DNA, 20 bp, Homo sapiens
tttccggggctgctggcctg

SEQ ID NO: 2690783 - DNA, 14 bp, Homo sapiens
tttccttctgccct

SEQ ID NO: 2690784 - DNA, 15 bp, Homo sapiens
tttccttctgccctt

SEQ ID NO: 2690785 - DNA, 21 bp, Homo sapiens
tttccttttgcaacaagacaa

SEQ ID NO: 2690786 - DNA, 19 bp, Homo sapiens
tttctaaagctctgaacaa

SEQ ID NO: 2690787 - DNA, 22 bp, Homo sapiens
tttctaaagctctgaacaaaag

SEQ ID NO: 2690788 - DNA, 17 bp, Homo sapiens
tttctactcattttaat

SEQ ID NO: 2690789 - DNA, 14 bp, Homo sapiens
tttctattttctct

SEQ ID NO: 2690790 - DNA, 16 bp, Homo sapiens
tttctattttctctga

SEQ ID NO: 2690791 - DNA, 13 bp, Homo sapiens
tttctctcttccc

SEQ ID NO: 2690792 - DNA, 14 bp, Homo sapiens
tttctctttgaaac

SEQ ID NO: 2690793 - DNA, 20 bp, Homo sapiens
tttctctttgaaacatgctt

SEQ ID NO: 2690794 - DNA, 20 bp, Homo sapiens
tttctgaaatcgccgtgtta

SEQ ID NO: 2690795 - DNA, 14 bp, Homo sapiens
tttcttctctgcct

SEQ ID NO: 2690796 - DNA, 20 bp, Homo sapiens
tttcttttaagccctgctct

SEQ ID NO: 2690797 - DNA, 15 bp, Homo sapiens
tttgaaatcagtaaa

SEQ ID NO: 2690798 - DNA, 14 bp, Homo sapiens
tttgaagtctgctc

SEQ ID NO: 2690799 - DNA, 17 bp, Homo sapiens
tttgcactgtatgctgg

SEQ ID NO: 2690800 - DNA, 12 bp, Homo sapiens
tttgctacaata

SEQ ID NO: 2690801 - DNA, 14 bp, Homo sapiens
tttgctacaataaa

SEQ ID NO: 2690802 - DNA, 14 bp, Homo sapiens
tttggctctttcag

SEQ ID NO: 2690803 - DNA, 18 bp, Homo sapiens
tttggtgctggtctattt

SEQ ID NO: 2690804 - DNA, 17 bp, Homo sapiens
tttgtaaactgtatcaa

SEQ ID NO: 2690805 - DNA, 17 bp, Homo sapiens
tttgtaaattaatactt

SEQ ID NO: 2690806 - DNA, 14 bp, Homo sapiens
tttgtaccatggtg

SEQ ID NO: 2690807 - DNA, 14 bp, Homo sapiens
tttgtataaataat

SEQ ID NO: 2690808 - DNA, 17 bp, Homo sapiens
tttgttatagaatactt

SEQ ID NO: 2690809 - DNA, 19 bp, Homo sapiens
tttgttatagaatactttt

SEQ ID NO: 2690810 - DNA, 17 bp, Homo sapiens
tttgttgtcctcccagg

SEQ ID NO: 2690811 - DNA, 13 bp, Homo sapiens
tttgttgtgactt

SEQ ID NO: 2690812 - DNA, 20 bp, Homo sapiens
ttttaaattatactgtagct

SEQ ID NO: 2690813 - DNA, 15 bp, Homo sapiens
ttttacagccaactt

SEQ ID NO: 2690814 - DNA, 15 bp, Homo sapiens
ttttactgacagaaa

SEQ ID NO: 2690815 - DNA, 19 bp, Homo sapiens
ttttacttgaatttgtctc

SEQ ID NO: 2690816 - DNA, 19 bp, Homo sapiens
ttttagatgtgctgctttg

SEQ ID NO: 2690817 - DNA, 19 bp, Homo sapiens
ttttatttagttgaaaaat

SEQ ID NO: 2690818 - DNA, 20 bp, Homo sapiens
ttttatttccacataaaggt

SEQ ID NO: 2690819 - DNA, 13 bp, Homo sapiens
ttttcatggaagt

SEQ ID NO: 2690820 - DNA, 19 bp, Homo sapiens
ttttcatggaagtggcagt

SEQ ID NO: 2690821 - DNA, 24 bp, Homo sapiens
ttttccatcctgaggtgcctccca

SEQ ID NO: 2690822 - DNA, 20 bp, Homo sapiens
ttttccattgaccagctctc

SEQ ID NO: 2690823 - DNA, 17 bp, Homo sapiens
ttttctccactttgttg

SEQ ID NO: 2690824 - DNA, 14 bp, Homo sapiens
ttttctgaccaaaa

SEQ ID NO: 2690825 - DNA, 20 bp, Homo sapiens
ttttgtattacatctaatgc

SEQ ID NO: 2690826 - DNA, 12 bp, Homo sapiens
ttttgttataga

SEQ ID NO: 2690827 - DNA, 12 bp, Homo sapiens
tttttaaattat

SEQ ID NO: 2690828 - DNA, 21 bp, Homo sapiens
tttttctagtttcagtaaata

SEQ ID NO: 2690829 - DNA, 12 bp, Homo sapiens
ttttttaatgta

SEQ ID NO: 2690830 - DNA, 19 bp, Homo sapiens
ttaagtctgggatgtagaa

SEQ ID NO: 2690831 - DNA, 22 bp, Homo sapiens
ttaagtctgggatgtagaactt

SEQ ID NO: 2690832 - DNA, 17 bp, Homo sapiens
ttaatgttttgtacaat

SEQ ID NO: 2690833 - DNA, 16 bp, Homo sapiens
ttaattttttttaatg

SEQ ID NO: 2690834 - DNA, 17 bp, Homo sapiens
ttaattttttttaatgt

SEQ ID NO: 2690835 - DNA, 13 bp, Homo sapiens
ttacaacctagaa

SEQ ID NO: 2690836 - DNA, 16 bp, Homo sapiens
ttacagttatagaaag

SEQ ID NO: 2690837 - DNA, 13 bp, Homo sapiens
ttacatctaatgc

SEQ ID NO: 2690838 - DNA, 16 bp, Homo sapiens
ttacatctaatgcttc

SEQ ID NO: 2690839 - DNA, 18 bp, Homo sapiens
ttaccctaaaacatgtgt

SEQ ID NO: 2690840 - DNA, 17 bp, Homo sapiens
ttaccctatatctataa

SEQ ID NO: 2690841 - DNA, 13 bp, Homo sapiens
ttacctgcaggct

SEQ ID NO: 2690842 - DNA, 19 bp, Homo sapiens
ttaccttagattagctctg

SEQ ID NO: 2690843 - DNA, 22 bp, Homo sapiens
ttactaaagatatcagagctct

SEQ ID NO: 2690844 - DNA, 15 bp, Homo sapiens
ttactcagcccagct

SEQ ID NO: 2690845 - DNA, 16 bp, Homo sapiens
ttactcagcccagctg

SEQ ID NO: 2690846 - DNA, 18 bp, Homo sapiens
ttactgacagaaatgcaa

SEQ ID NO: 2690847 - DNA, 14 bp, Homo sapiens
ttagaatatattaa

SEQ ID NO: 2690848 - DNA, 14 bp, Homo sapiens
ttagagtcagcctt

SEQ ID NO: 2690849 - DNA, 14 bp, Homo sapiens
ttagattagctctg

SEQ ID NO: 2690850 - DNA, 19 bp, Homo sapiens
ttagctctggaccagcctg

SEQ ID NO: 2690851 - DNA, 16 bp, Homo sapiens
ttaggcttttaagaaa

SEQ ID NO: 2690852 - DNA, 16 bp, Homo sapiens
ttagtgattgtgtctg

SEQ ID NO: 2690853 - DNA, 17 bp, Homo sapiens
ttatagttaatctataa

SEQ ID NO: 2690854 - DNA, 18 bp, Homo sapiens
ttatcgtccagtgacttt

SEQ ID NO: 2690855 - DNA, 23 bp, Homo sapiens
ttattaagtctgggatgtagaac

SEQ ID NO: 2690856 - DNA, 13 bp, Homo sapiens
ttattaatgcttt

SEQ ID NO: 2690857 - DNA, 18 bp, Homo sapiens
ttattcagtgacttctgg

SEQ ID NO: 2690858 - DNA, 22 bp, Homo sapiens
ttatttagttgaaaaatctagt

SEQ ID NO: 2690859 - DNA, 13 bp, Homo sapiens
ttatttgtataat

SEQ ID NO: 2690860 - DNA, 14 bp, Homo sapiens
ttattttgcactgt

SEQ ID NO: 2690861 - DNA, 18 bp, Homo sapiens
ttattttgtattacatct

SEQ ID NO: 2690862 - DNA, 23 bp, Homo sapiens
ttcaaacaggtcgagctgtgctc

SEQ ID NO: 2690863 - DNA, 15 bp, Homo sapiens
ttcaagggaagaaac

SEQ ID NO: 2690864 - DNA, 13 bp, Homo sapiens
ttcaataaagctg

SEQ ID NO: 2690865 - DNA, 14 bp, Homo sapiens
ttcactaccaaatg

SEQ ID NO: 2690866 - DNA, 21 bp, Homo sapiens
ttcactccggtgtgcctgcag

SEQ ID NO: 2690867 - DNA, 22 bp, Homo sapiens
ttcactccggtgtgcctgcagc

SEQ ID NO: 2690868 - DNA, 23 bp, Homo sapiens
ttcactccggtgtgcctgcagcc

SEQ ID NO: 2690869 - DNA, 24 bp, Homo sapiens
ttcactccggtgtgcctgcagccc

SEQ ID NO: 2690870 - DNA, 23 bp, Homo sapiens
ttcacttcgatgactggatacag

SEQ ID NO: 2690871 - DNA, 22 bp, Homo sapiens
ttcagagccagtgaaggagcca

SEQ ID NO: 2690872 - DNA, 15 bp, Homo sapiens
ttcagatttctcttt

SEQ ID NO: 2690873 - DNA, 17 bp, Homo sapiens
ttcagatttctctttga

SEQ ID NO: 2690874 - DNA, 18 bp, Homo sapiens
ttcagctattagcaactg

SEQ ID NO: 2690875 - DNA, 22 bp, Homo sapiens
ttcagggaatttcaggaactag

SEQ ID NO: 2690876 - DNA, 17 bp, Homo sapiens
ttcagtaaataatgaaa

SEQ ID NO: 2690877 - DNA, 13 bp, Homo sapiens
ttcagtgacttct

SEQ ID NO: 2690878 - DNA, 20 bp, Homo sapiens
ttcagtgatttttcccccca

SEQ ID NO: 2690879 - DNA, 19 bp, Homo sapiens
ttcagtgctgtggcctggg

SEQ ID NO: 2690880 - DNA, 21 bp, Homo sapiens
ttcagtgctgtggcctgggca

SEQ ID NO: 2690881 - DNA, 15 bp, Homo sapiens
ttcatgtttgtaaat

SEQ ID NO: 2690882 - DNA, 21 bp, Homo sapiens
ttccaaccccagctggcctct

SEQ ID NO: 2690883 - DNA, 13 bp, Homo sapiens
ttccacataaagg

SEQ ID NO: 2690884 - DNA, 18 bp, Homo sapiens
ttccactgccaaaacaat

SEQ ID NO: 2690885 - DNA, 19 bp, Homo sapiens
ttccactgccaaaacaatg

SEQ ID NO: 2690886 - DNA, 22 bp, Homo sapiens
ttccactggacttgagcttggc

SEQ ID NO: 2690887 - DNA, 21 bp, Homo sapiens
ttccagaaaaccccagcatcc

SEQ ID NO: 2690888 - DNA, 14 bp, Homo sapiens
ttccagattgttct

SEQ ID NO: 2690889 - DNA, 14 bp, Homo sapiens
ttccatgccccagg

SEQ ID NO: 2690890 - DNA, 15 bp, Homo sapiens
ttccatgccccagga

SEQ ID NO: 2690891 - DNA, 15 bp, Homo sapiens
ttccccctcccaggg

SEQ ID NO: 2690892 - DNA, 20 bp, Homo sapiens
ttcccctaatcttttctgaa

SEQ ID NO: 2690893 - DNA, 12 bp, Homo sapiens
ttcccgctcccc

SEQ ID NO: 2690894 - DNA, 17 bp, Homo sapiens
ttccctgggggcatcct

SEQ ID NO: 2690895 - DNA, 21 bp, Homo sapiens
ttccctgggggcatcctgctt

SEQ ID NO: 2690896 - DNA, 13 bp, Homo sapiens
ttcccttctccct

SEQ ID NO: 2690897 - DNA, 20 bp, Homo sapiens
ttcctccaggagaaggggcc

SEQ ID NO: 2690898 - DNA, 21 bp, Homo sapiens
ttcctccccattagagtcagc

SEQ ID NO: 2690899 - DNA, 18 bp, Homo sapiens
ttcctctggtttctgtgt

SEQ ID NO: 2690900 - DNA, 13 bp, Homo sapiens
ttcctcttgaacc

SEQ ID NO: 2690901 - DNA, 23 bp, Homo sapiens
ttcctgggatgatgtgtgaaacc

SEQ ID NO: 2690902 - DNA, 22 bp, Homo sapiens
ttcctgggtcctgcctggtcct

SEQ ID NO: 2690903 - DNA, 15 bp, Homo sapiens
ttcctgtagcatctt

SEQ ID NO: 2690904 - DNA, 17 bp, Homo sapiens
ttcctgtagcatcttct

SEQ ID NO: 2690905 - DNA, 14 bp, Homo sapiens
ttcctgtcccacct

SEQ ID NO: 2690906 - DNA, 22 bp, Homo sapiens
ttccttctgcccttcctccagg

SEQ ID NO: 2690907 - DNA, 18 bp, Homo sapiens
ttccttgcccctgctctg

SEQ ID NO: 2690908 - DNA, 17 bp, Homo sapiens
ttcctttcaggccaagg

SEQ ID NO: 2690909 - DNA, 20 bp, Homo sapiens
ttccttttgcaacaagacaa

SEQ ID NO: 2690910 - DNA, 21 bp, Homo sapiens
ttcgaaacctgtccataaagt

SEQ ID NO: 2690911 - DNA, 22 bp, Homo sapiens
ttcgaaacctgtccataaagta

SEQ ID NO: 2690912 - DNA, 14 bp, Homo sapiens
ttcgagaccagcct

SEQ ID NO: 2690913 - DNA, 20 bp, Homo sapiens
ttctaagttgagtatattat

SEQ ID NO: 2690914 - DNA, 16 bp, Homo sapiens
ttctagctttgttgtc

SEQ ID NO: 2690915 - DNA, 17 bp, Homo sapiens
ttctcagggggtcagca

SEQ ID NO: 2690916 - DNA, 15 bp, Homo sapiens
ttctcagtgtctgaa

SEQ ID NO: 2690917 - DNA, 12 bp, Homo sapiens
ttctctctttct

SEQ ID NO: 2690918 - DNA, 18 bp, Homo sapiens
ttctctgagaaccaaaag

SEQ ID NO: 2690919 - DNA, 12 bp, Homo sapiens
ttctctgcctcc

SEQ ID NO: 2690920 - DNA, 13 bp, Homo sapiens
ttctctgcctcct

SEQ ID NO: 2690921 - DNA, 15 bp, Homo sapiens
ttctctttgctgaca

SEQ ID NO: 2690922 - DNA, 21 bp, Homo sapiens
ttctgagaagcgctgccctgt

SEQ ID NO: 2690923 - DNA, 19 bp, Homo sapiens
ttctgagcttttcatggaa

SEQ ID NO: 2690924 - DNA, 15 bp, Homo sapiens
ttctgcccttcctcc

SEQ ID NO: 2690925 - DNA, 18 bp, Homo sapiens
ttctgcccttcctccagg

SEQ ID NO: 2690926 - DNA, 15 bp, Homo sapiens
ttctggagtctccag

SEQ ID NO: 2690927 - DNA, 17 bp, Homo sapiens
ttctggagtctccagtg

SEQ ID NO: 2690928 - DNA, 15 bp, Homo sapiens
ttctggatggcatct

SEQ ID NO: 2690929 - DNA, 21 bp, Homo sapiens
ttctggcttatgctcagaagc

SEQ ID NO: 2690930 - DNA, 21 bp, Homo sapiens
ttctggtatgaacttgaggac

SEQ ID NO: 2690931 - DNA, 14 bp, Homo sapiens
ttcttcccgctccc

SEQ ID NO: 2690932 - DNA, 17 bp, Homo sapiens
ttcttcccgctccccac

SEQ ID NO: 2690933 - DNA, 14 bp, Homo sapiens
ttcttctctgcctc

SEQ ID NO: 2690934 - DNA, 17 bp, Homo sapiens
ttcttttaagccctgct

SEQ ID NO: 2690935 - DNA, 18 bp, Homo sapiens
ttcttttaagccctgctc

SEQ ID NO: 2690936 - DNA, 23 bp, Homo sapiens
ttgaatagggctaggaatataga

SEQ ID NO: 2690937 - DNA, 19 bp, Homo sapiens
ttgaccagctctcttcctg

SEQ ID NO: 2690938 - DNA, 14 bp, Homo sapiens
ttgactcacctgtt

SEQ ID NO: 2690939 - DNA, 19 bp, Homo sapiens
ttgagccctggaccccagg

SEQ ID NO: 2690940 - DNA, 19 bp, Homo sapiens
ttgataaattccactggac

SEQ ID NO: 2690941 - DNA, 19 bp, Homo sapiens
tgaagggtgacatcccagg

SEQ ID NO: 2690942 - DNA, 23 bp, Homo sapiens
tgaagggtgacatcccaggaggg

SEQ ID NO: 2690943 - DNA, 16 bp, Homo sapiens
tgaagttcatggtgat

SEQ ID NO: 2690944 - DNA, 16 bp, Homo sapiens
tgaattaaaaaagctc

SEQ ID NO: 2690945 - DNA, 14 bp, Homo sapiens
tgaatttggagact

SEQ ID NO: 2690946 - DNA, 14 bp, Homo sapiens
tgacacaggccagc

SEQ ID NO: 2690947 - DNA, 23 bp, Homo sapiens
tgacacggggatcatctctgtga

SEQ ID NO: 2690948 - DNA, 17 bp, Homo sapiens
tctccagtggttgctgt

SEQ ID NO: 2690949 - DNA, 14 bp, Homo sapiens
tctccatctctggt

SEQ ID NO: 2690950 - DNA, 12 bp, Homo sapiens
tctccctgcaca

SEQ ID NO: 2690951 - DNA, 18 bp, Homo sapiens
tctccctgcacagcctct

SEQ ID NO: 2690952 - DNA, 11 bp, Homo sapiens
tctcctgctgc

SEQ ID NO: 2690953 - DNA, 11 bp, Homo sapiens
tctcctggagc

SEQ ID NO: 2690954 - DNA, 22 bp, Homo sapiens
tctcctggagcaagctctgccc

SEQ ID NO: 2690955 - DNA, 23 bp, Homo sapiens
tctcctggagcaagctctgccct

SEQ ID NO: 2690956 - DNA, 22 bp, Homo sapiens
tctctcagccctccatggcctg

SEQ ID NO: 2690957 - DNA, 14 bp, Homo sapiens
tctctccaggaagt

SEQ ID NO: 2690958 - DNA, 18 bp, Homo sapiens
tctctcttcccttctccc

SEQ ID NO: 2690959 - DNA, 23 bp, Homo sapiens
tctctgatacttttttgaaatca

SEQ ID NO: 2690960 - DNA, 22 bp, Homo sapiens
tctctggttgacgggctgtccg

SEQ ID NO: 2690961 - DNA, 13 bp, Homo sapiens
tctcttgtagaag

SEQ ID NO: 2690962 - DNA, 16 bp, Homo sapiens
tctgaaaccaaatgta

SEQ ID NO: 2690963 - DNA, 15 bp, Homo sapiens
tctgaataagcactt

SEQ ID NO: 2690964 - DNA, 19 bp, Homo sapiens
tctgaataagcacttttta

SEQ ID NO: 2690965 - DNA, 15 bp, Homo sapiens
tctgaatcttctgaa

SEQ ID NO: 2690966 - DNA, 15 bp, Homo sapiens
tctgaccaaaatgtg

SEQ ID NO: 2690967 - DNA, 14 bp, Homo sapiens
tctgacctgcaggc

SEQ ID NO: 2690968 - DNA, 15 bp, Homo sapiens
tctgacctgcaggcc

SEQ ID NO: 2690969 - DNA, 17 bp, Homo sapiens
tctgacctgcaggccaa

SEQ ID NO: 2690970 - DNA, 19 bp, Homo sapiens
tctgacctgcaggccaaga

SEQ ID NO: 2690971 - DNA, 14 bp, Homo sapiens
tctgactcacaaga

SEQ ID NO: 2690972 - DNA, 15 bp, Homo sapiens
tctgagaaccaaaag

SEQ ID NO: 2690973 - DNA, 19 bp, Homo sapiens
tctgagaagcgctgccctg

SEQ ID NO: 2690974 - DNA, 23 bp, Homo sapiens
tctgagagcacagcgtttacata

SEQ ID NO: 2690975 - DNA, 20 bp, Homo sapiens
tctgagcggcgcagagccct

SEQ ID NO: 2690976 - DNA, 14 bp, Homo sapiens
tctgaggcttccag

SEQ ID NO: 2690977 - DNA, 19 bp, Homo sapiens
tctgatacttttttgaaat

SEQ ID NO: 2690978 - DNA, 19 bp, Homo sapiens
tctgatgccaaagctgctt

SEQ ID NO: 2690979 - DNA, 20 bp, Homo sapiens
tctgatgccaaagctgcttt

SEQ ID NO: 2690980 - DNA, 21 bp, Homo sapiens
tctgatgccaaagctgctttc

SEQ ID NO: 2690981 - DNA, 21 bp, Homo sapiens
tctgcagacaagtcttgctgt

SEQ ID NO: 2690982 - DNA, 16 bp, Homo sapiens
tctgcagtagtctctg

SEQ ID NO: 2690983 - DNA, 18 bp, Homo sapiens
tctgcagtagtctctgtg

SEQ ID NO: 2690984 - DNA, 13 bp, Homo sapiens
tctgccagccaca

SEQ ID NO: 2690985 - DNA, 13 bp, Homo sapiens
tctgcccttcctc

SEQ ID NO: 2690986 - DNA, 14 bp, Homo sapiens
tctgcccttcctcc

SEQ ID NO: 2690987 - DNA, 16 bp, Homo sapiens
tctgcccttcctccag

SEQ ID NO: 2690988 - DNA, 16 bp, Homo sapiens
tctgcctcctcctcac

SEQ ID NO: 2690989 - DNA, 20 bp, Homo sapiens
tctgcgccccgcctccccat

SEQ ID NO: 2690990 - DNA, 16 bp, Homo sapiens
tctgctctatgccagg

SEQ ID NO: 2690991 - DNA, 19 bp, Homo sapiens
tctgctctgaggcttccag

SEQ ID NO: 2690992 - DNA, 23 bp, Homo sapiens
tctgcttcctcagggcccagcag

SEQ ID NO: 2690993 - DNA, 21 bp, Homo sapiens
tctgcttttgcacaccttttc

SEQ ID NO: 2690994 - DNA, 22 bp, Homo sapiens
tctggaccaaccctgtttcctg

SEQ ID NO: 2690995 - DNA, 14 bp, Homo sapiens
tctggccaggcatg

SEQ ID NO: 2690996 - DNA, 21 bp, Homo sapiens
tctggcttatgctcagaagcc

SEQ ID NO: 2690997 - DNA, 22 bp, Homo sapiens
tctgggatgtagaacttcaaga

SEQ ID NO: 2690998 - DNA, 16 bp, Homo sapiens
tctgggccaagttcct

SEQ ID NO: 2690999 - DNA, 21 bp, Homo sapiens
tctgggcctgggttccaggga

SEQ ID NO: 2691000 - DNA, 17 bp, Homo sapiens
tctggggcccgcctgcc

SEQ ID NO: 2691001 - DNA, 21 bp, Homo sapiens
tctggggcccgcctgccacct

SEQ ID NO: 2691002 - DNA, 22 bp, Homo sapiens
tctggtatgaacttgaggacac

SEQ ID NO: 2691003 - DNA, 12 bp, Homo sapiens
tctggtgccttt

SEQ ID NO: 2691004 - DNA, 20 bp, Homo sapiens
tctgtatatgttgtaataaa

SEQ ID NO: 2691005 - DNA, 15 bp, Homo sapiens
tctgtccagtttcca

SEQ ID NO: 2691006 - DNA, 13 bp, Homo sapiens
tctgtcctctctg

SEQ ID NO: 2691007 - DNA, 16 bp, Homo sapiens
tctgtctcctgtcttc

SEQ ID NO: 2691008 - DNA, 18 bp, Homo sapiens
tctgtctgtctgtcccaa

SEQ ID NO: 2691009 - DNA, 20 bp, Homo sapiens
tctgtgctttgactcacctg

SEQ ID NO: 2691010 - DNA, 22 bp, Homo sapiens
tcttacttcacccggctgggct

SEQ ID NO: 2691011 - DNA, 21 bp, Homo sapiens
tcttattcccaaactacagaa

SEQ ID NO: 2691012 - DNA, 15 bp, Homo sapiens
tcttccaaccccagc

SEQ ID NO: 2691013 - DNA, 14 bp, Homo sapiens
tcttccccactccc

SEQ ID NO: 2691014 - DNA, 13 bp, Homo sapiens
tcttcccgctccc

SEQ ID NO: 2691015 - DNA, 14 bp, Homo sapiens
tcttcccgctcccc

SEQ ID NO: 2691016 - DNA, 18 bp, Homo sapiens
tcttcccgctccccacct

SEQ ID NO: 2691017 - DNA, 23 bp, Homo sapiens
tcttcccgctccccacctaccca

SEQ ID NO: 2691018 - DNA, 19 bp, Homo sapiens
tcttcctagtatattagtt

SEQ ID NO: 2691019 - DNA, 20 bp, Homo sapiens
tcttcctctggtttctgtgt

SEQ ID NO: 2691020 - DNA, 22 bp, Homo sapiens
tcttcctgtaacacaagccaca

SEQ ID NO: 2691021 - DNA, 22 bp, Homo sapiens
tcttcctgtctttgttgtctcc

SEQ ID NO: 2691022 - DNA, 12 bp, Homo sapiens
tcttctctgcct

SEQ ID NO: 2691023 - DNA, 17 bp, Homo sapiens
tcttctctgcctcctcc

SEQ ID NO: 2691024 - DNA, 17 bp, Homo sapiens
tcttctggagtctccag

SEQ ID NO: 2691025 - DNA, 16 bp, Homo sapiens
tcttgaaccagaacca

SEQ ID NO: 2691026 - DNA, 11 bp, Homo sapiens
tcttgctgtgc

SEQ ID NO: 2691027 - DNA, 13 bp, Homo sapiens
tcttgctgtgctt

SEQ ID NO: 2691028 - DNA, 16 bp, Homo sapiens
tcttggacctctgctc

SEQ ID NO: 2691029 - DNA, 23 bp, Homo sapiens
tcttggacctctgctctgaggct

SEQ ID NO: 2691030 - DNA, 23 bp, Homo sapiens
tctttagaatcgctttccttcct

SEQ ID NO: 2691031 - DNA, 16 bp, Homo sapiens
tctttgctacaataaa

SEQ ID NO: 2691032 - DNA, 18 bp, Homo sapiens
tctttgctacaataaatg

SEQ ID NO: 2691033 - DNA, 23 bp, Homo sapiens
tctttgctacaataaatgctgaa

SEQ ID NO: 2691034 - DNA, 14 bp, Homo sapiens
tctttgctgacact

SEQ ID NO: 2691035 - DNA, 21 bp, Homo sapiens
tctttgctgacactgtgaccc

SEQ ID NO: 2691036 - DNA, 22 bp, Homo sapiens
tctttgctgacactgtgaccct

SEQ ID NO: 2691037 - DNA, 15 bp, Homo sapiens
tcttttaagccctgc

SEQ ID NO: 2691038 - DNA, 17 bp, Homo sapiens
tcttttaagccctgctc

SEQ ID NO: 2691039 - DNA, 15 bp, Homo sapiens
tcttttccatcctga

SEQ ID NO: 2691040 - DNA, 20 bp, Homo sapiens
tcttttctgaatcttctgaa

SEQ ID NO: 2691041 - DNA, 20 bp, Homo sapiens
tgaaacatgcttgtgtttct

SEQ ID NO: 2691042 - DNA, 20 bp, Homo sapiens
tgaaactcctgattttgtag

SEQ ID NO: 2691043 - DNA, 15 bp, Homo sapiens
tgaaagtcagatgcc

SEQ ID NO: 2691044 - DNA, 18 bp, Homo sapiens
tgaaagtcagatgcccag

SEQ ID NO: 2691045 - DNA, 22 bp, Homo sapiens
tgaaataccagtgaaccaaaga

SEQ ID NO: 2691046 - DNA, 17 bp, Homo sapiens
tgaacaaaagcttttct

SEQ ID NO: 2691047 - DNA, 17 bp, Homo sapiens
tgaacttgaggacacat

SEQ ID NO: 2691048 - DNA, 19 bp, Homo sapiens
tgaacttgaggacacatgt

SEQ ID NO: 2691049 - DNA, 20 bp, Homo sapiens
tgaacttgaggacacatgtc

SEQ ID NO: 2691050 - DNA, 21 bp, Homo sapiens
tgaagagatttcaacaagaat

SEQ ID NO: 2691051 - DNA, 22 bp, Homo sapiens
tgaagagtagaacccaggtctg

SEQ ID NO: 2691052 - DNA, 17 bp, Homo sapiens
tgaagatatttattctg

SEQ ID NO: 2691053 - DNA, 16 bp, Homo sapiens
tgaagatcagagctgc

SEQ ID NO: 2691054 - DNA, 16 bp, Homo sapiens
tgaagccactgaagct

SEQ ID NO: 2691055 - DNA, 20 bp, Homo sapiens
tgaagccactgaagctggga

SEQ ID NO: 2691056 - DNA, 19 bp, Homo sapiens
tgaagggacagctgctggg

SEQ ID NO: 2691057 - DNA, 16 bp, Homo sapiens
tgaagggtgacatccc

SEQ ID NO: 2691058 - DNA, 19 bp, Homo sapiens
gcacctgtactcaggaggc

SEQ ID NO: 2691059 - DNA, 16 bp, Homo sapiens
gcacgaggggggccag

SEQ ID NO: 2691060 - DNA, 15 bp, Homo sapiens
gcacgtctcctgctg

SEQ ID NO: 2691061 - DNA, 18 bp, Homo sapiens
gcacgtctcctgctgcgt

SEQ ID NO: 2691062 - DNA, 16 bp, Homo sapiens
gcactgtctcagccaa

SEQ ID NO: 2691063 - DNA, 20 bp, Homo sapiens
gcagaacgatgcctgcaggc

SEQ ID NO: 2691064 - DNA, 14 bp, Homo sapiens
gcagaaggccaaga

SEQ ID NO: 2691065 - DNA, 22 bp, Homo sapiens
gcagaaggggaatgtgtcctcc

SEQ ID NO: 2691066 - DNA, 22 bp, Homo sapiens
gcagactccaatggggccagca

SEQ ID NO: 2691067 - DNA, 16 bp, Homo sapiens
gcagagccctccaggc

SEQ ID NO: 2691068 - DNA, 12 bp, Homo sapiens
gcagaggggctt

SEQ ID NO: 2691069 - DNA, 20 bp, Homo sapiens
gcagaggggctttctggaga

SEQ ID NO: 2691070 - DNA, 20 bp, Homo sapiens
gcagattgggctggctctga

SEQ ID NO: 2691071 - DNA, 14 bp, Homo sapiens
gcagcaatctgtct

SEQ ID NO: 2691072 - DNA, 15 bp, Homo sapiens
gcagcacacctcagc

SEQ ID NO: 2691073 - DNA, 16 bp, Homo sapiens
gcagcacacctcagcc

SEQ ID NO: 2691074 - DNA, 14 bp, Homo sapiens
gcagcctccctctg

SEQ ID NO: 2691075 - DNA, 23 bp, Homo sapiens
gcagcctccctctgacctgcagg

SEQ ID NO: 2691076 - DNA, 24 bp, Homo sapiens
gcagcgagttgtggaaagcctctg

SEQ ID NO: 2691077 - DNA, 17 bp, Homo sapiens
gcagctcctgaccaaag

SEQ ID NO: 2691078 - DNA, 18 bp, Homo sapiens
gcagctcctgaccaaaga

SEQ ID NO: 2691079 - DNA, 20 bp, Homo sapiens
gcaggagcctcgtgtcctgc

SEQ ID NO: 2691080 - DNA, 21 bp, Homo sapiens
gcaggagcctcgtgtcctgct

SEQ ID NO: 2691081 - DNA, 12 bp, Homo sapiens
gcaggaggcccc

SEQ ID NO: 2691082 - DNA, 23 bp, Homo sapiens
gcaggaggccccaggctgagagc

SEQ ID NO: 2691083 - DNA, 24 bp, Homo sapiens
gcaggaggccccaggctgagagcc

SEQ ID NO: 2691084 - DNA, 23 bp, Homo sapiens
gcaggattcttcccgctccccac

SEQ ID NO: 2691085 - DNA, 18 bp, Homo sapiens
gcaggcagggctgggcca

SEQ ID NO: 2691086 - DNA, 14 bp, Homo sapiens
gcaggctccatgca

SEQ ID NO: 2691087 - DNA, 18 bp, Homo sapiens
gcagggccaaagcacagc

SEQ ID NO: 2691088 - DNA, 19 bp, Homo sapiens
gcagggtcattatcagaac

SEQ ID NO: 2691089 - DNA, 19 bp, Homo sapiens
gcaggtcctggtgggtcag

SEQ ID NO: 2691090 - DNA, 14 bp, Homo sapiens
gcaggtgtgaccct

SEQ ID NO: 2691091 - DNA, 15 bp, Homo sapiens
gcaggtgtgaccctg

SEQ ID NO: 2691092 - DNA, 16 bp, Homo sapiens
gcaggtgtgaccctga

SEQ ID NO: 2691093 - DNA, 22 bp, Homo sapiens
gcatatgcttctttaaaaaagc

SEQ ID NO: 2691094 - DNA, 14 bp, Homo sapiens
gcatctagccagag

SEQ ID NO: 2691095 - DNA, 20 bp, Homo sapiens
gcatctagccagaggctgga

SEQ ID NO: 2691096 - DNA, 14 bp, Homo sapiens
gcatgcactgtctc

SEQ ID NO: 2691097 - DNA, 15 bp, Homo sapiens
gcatgctggggcaag

SEQ ID NO: 2691098 - DNA, 23 bp, Homo sapiens
gcatggggataaaggagaaggca

SEQ ID NO: 2691099 - DNA, 21 bp, Homo sapiens
gcattaggcttttaagaaaca

SEQ ID NO: 2691100 - DNA, 14 bp, Homo sapiens
gcattgtcttgtgg

SEQ ID NO: 2691101 - DNA, 17 bp, Homo sapiens
gcatttctagtcccttc

SEQ ID NO: 2691102 - DNA, 22 bp, Homo sapiens
gcatttctagtcccttctctct

SEQ ID NO: 2691103 - DNA, 16 bp, Homo sapiens
gcatttgtgttattat

SEQ ID NO: 2691104 - DNA, 21 bp, Homo sapiens
gccaaaacaatgcccgtaaga

SEQ ID NO: 2691105 - DNA, 16 bp, Homo sapiens
gccaaagcacagctgg

SEQ ID NO: 2691106 - DNA, 18 bp, Homo sapiens
gccaaagcacagctgggc

SEQ ID NO: 2691107 - DNA, 14 bp, Homo sapiens
gccaaagctgcttt

SEQ ID NO: 2691108 - DNA, 19 bp, Homo sapiens
gccaaagctgctttcttct

SEQ ID NO: 2691109 - DNA, 23 bp, Homo sapiens
gccaaagctgctttcttctctgc

SEQ ID NO: 2691110 - DNA, 16 bp, Homo sapiens
gccaagctcacacagc

SEQ ID NO: 2691111 - DNA, 22 bp, Homo sapiens
gccaaggctatgaagggacagc

SEQ ID NO: 2691112 - DNA, 18 bp, Homo sapiens
gccaaggtgggctgagcc

SEQ ID NO: 2691113 - DNA, 22 bp, Homo sapiens
gccaaggtgggctgagccctgg

SEQ ID NO: 2691114 - DNA, 23 bp, Homo sapiens
gccaaggtgggctgagccctggc

SEQ ID NO: 2691115 - DNA, 11 bp, Homo sapiens
gccacattttg

SEQ ID NO: 2691116 - DNA, 12 bp, Homo sapiens
gccaccaataaa

SEQ ID NO: 2691117 - DNA, 14 bp, Homo sapiens
gccaccaataaaaa

SEQ ID NO: 2691118 - DNA, 18 bp, Homo sapiens
gccaccaataaaaatcct

SEQ ID NO: 2691119 - DNA, 16 bp, Homo sapiens
gccaccagtcactgtc

SEQ ID NO: 2691120 - DNA, 23 bp, Homo sapiens
gccaccatattcagtgctgtggc

SEQ ID NO: 2691121 - DNA, 14 bp, Homo sapiens
gccacctccttggc

SEQ ID NO: 2691122 - DNA, 16 bp, Homo sapiens
gccacctctcccagcc

SEQ ID NO: 2691123 - DNA, 18 bp, Homo sapiens
gccacctctcccagccct

SEQ ID NO: 2691124 - DNA, 22 bp, Homo sapiens
gccacctctcccagccctcagc

SEQ ID NO: 2691125 - DNA, 13 bp, Homo sapiens
gccacctgctgcg

SEQ ID NO: 2691126 - DNA, 13 bp, Homo sapiens
gccacctgtctgt

SEQ ID NO: 2691127 - DNA, 15 bp, Homo sapiens
gccacctgtctgtct

SEQ ID NO: 2691128 - DNA, 18 bp, Homo sapiens
gccactacactccagcct

SEQ ID NO: 2691129 - DNA, 19 bp, Homo sapiens
gccactacactccagcctg

SEQ ID NO: 2691130 - DNA, 21 bp, Homo sapiens
gccactacactccagcctgag

SEQ ID NO: 2691131 - DNA, 20 bp, Homo sapiens
gccactgcactccagcctgg

SEQ ID NO: 2691132 - DNA, 22 bp, Homo sapiens
gccactgcactccagcctgggc

SEQ ID NO: 2691133 - DNA, 20 bp, Homo sapiens
gccacttggtttttggctct

SEQ ID NO: 2691134 - DNA, 13 bp, Homo sapiens
gccagaggctgga

SEQ ID NO: 2691135 - DNA, 14 bp, Homo sapiens
gccagatgcctccc

SEQ ID NO: 2691136 - DNA, 17 bp, Homo sapiens
gccagcaaagcctccag

SEQ ID NO: 2691137 - DNA, 18 bp, Homo sapiens
gccagcaaagcctccagc

SEQ ID NO: 2691138 - DNA, 20 bp, Homo sapiens
gccagcactggaggggccca

SEQ ID NO: 2691139 - DNA, 21 bp, Homo sapiens
gccagccggacacaagcggcc

SEQ ID NO: 2691140 - DNA, 16 bp, Homo sapiens
gccagcctggcttctg

SEQ ID NO: 2691141 - DNA, 17 bp, Homo sapiens
gccagcctggcttctgg

SEQ ID NO: 2691142 - DNA, 20 bp, Homo sapiens
gccagcctggcttctggagc

SEQ ID NO: 2691143 - DNA, 22 bp, Homo sapiens
gccagcctggcttctggagccc

SEQ ID NO: 2691144 - DNA, 21 bp, Homo sapiens
gccaggcattcaatcctcagg

SEQ ID NO: 2691145 - DNA, 23 bp, Homo sapiens
gccaggccaatgttgctgatggc

SEQ ID NO: 2691146 - DNA, 14 bp, Homo sapiens
gccaggctgtgcta

SEQ ID NO: 2691147 - DNA, 17 bp, Homo sapiens
gccagggccctgcagag

SEQ ID NO: 2691148 - DNA, 16 bp, Homo sapiens
gccaggggttctgaga

SEQ ID NO: 2691149 - DNA, 13 bp, Homo sapiens
gccaggtgcagtg

SEQ ID NO: 2691150 - DNA, 14 bp, Homo sapiens
gccaggtgcagtgg

SEQ ID NO: 2691151 - DNA, 14 bp, Homo sapiens
gccagtcctagagc

SEQ ID NO: 2691152 - DNA, 18 bp, Homo sapiens
gccagtcctagagctcct

SEQ ID NO: 2691153 - DNA, 24 bp, Homo sapiens
gccagtcctagagctcctgtccct

SEQ ID NO: 2691154 - DNA, 13 bp, Homo sapiens
gccagtctgcgtc

SEQ ID NO: 2691155 - DNA, 13 bp, Homo sapiens
gccagtcttgtgt

SEQ ID NO: 2691156 - DNA, 18 bp, Homo sapiens
gccagtgactttttctga

SEQ ID NO: 2691157 - DNA, 20 bp, Homo sapiens
gccatgatcgagccactgca

SEQ ID NO: 2691158 - DNA, 23 bp, Homo sapiens
gccatttgcaccctccgccttca

SEQ ID NO: 2691159 - DNA, 14 bp, Homo sapiens
gcccacccacatga

SEQ ID NO: 2691160 - DNA, 21 bp, Homo sapiens
gcccagagggcccaggcaggc

SEQ ID NO: 2691161 - DNA, 13 bp, Homo sapiens
gcccagcacctgc

SEQ ID NO: 2691162 - DNA, 19 bp, Homo sapiens
gcccagcacctgctcccag

SEQ ID NO: 2691163 - DNA, 18 bp, Homo sapiens
gcccagcccctgccccta

SEQ ID NO: 2691164 - DNA, 13 bp, Homo sapiens
gcccagctggcca

SEQ ID NO: 2691165 - DNA, 14 bp, Homo sapiens
gcccagctggccac

SEQ ID NO: 2691166 - DNA, 22 bp, Homo sapiens
gcccaggagtttgaggctgcag

SEQ ID NO: 2691167 - DNA, 20 bp, Homo sapiens
gcccaggctggagtgcagtg

SEQ ID NO: 2691168 - DNA, 17 bp, Homo sapiens
gagccagttctggggcc

SEQ ID NO: 2691169 - DNA, 23 bp, Homo sapiens
gagccatcacctaggactgactc

SEQ ID NO: 2691170 - DNA, 22 bp, Homo sapiens
gagcccagccattaccatggag

SEQ ID NO: 2691171 - DNA, 22 bp, Homo sapiens
gagccctggaccccaggctctt

SEQ ID NO: 2691172 - DNA, 13 bp, Homo sapiens
gagccctggcagg

SEQ ID NO: 2691173 - DNA, 23 bp, Homo sapiens
gagccctggcaggatgaccctgc

SEQ ID NO: 2691174 - DNA, 20 bp, Homo sapiens
gagccgagattgcgccactg

SEQ ID NO: 2691175 - DNA, 14 bp, Homo sapiens
gagcctcgtgtcct

SEQ ID NO: 2691176 - DNA, 19 bp, Homo sapiens
gagcctcgtgtcctgctag

SEQ ID NO: 2691177 - DNA, 18 bp, Homo sapiens
gagcgcacctgccccctg

SEQ ID NO: 2691178 - DNA, 15 bp, Homo sapiens
gagcggcgcagagcc

SEQ ID NO: 2691179 - DNA, 20 bp, Homo sapiens
gagcggcgcagagccctcca

SEQ ID NO: 2691180 - DNA, 14 bp, Homo sapiens
gagctcctgtccct

SEQ ID NO: 2691181 - DNA, 21 bp, Homo sapiens
gagctcttgttccgtgccagg

SEQ ID NO: 2691182 - DNA, 13 bp, Homo sapiens
gagctgcagccag

SEQ ID NO: 2691183 - DNA, 14 bp, Homo sapiens
gagctgcagccagt

SEQ ID NO: 2691184 - DNA, 23 bp, Homo sapiens
gagctgtgctcgggtgctgccag

SEQ ID NO: 2691185 - DNA, 14 bp, Homo sapiens
gaggacacatgtcc

SEQ ID NO: 2691186 - DNA, 13 bp, Homo sapiens
gaggactccctcc

SEQ ID NO: 2691187 - DNA, 18 bp, Homo sapiens
gaggaggtggcagccctg

SEQ ID NO: 2691188 - DNA, 22 bp, Homo sapiens
gaggaggtggcagccctgtagg

SEQ ID NO: 2691189 - DNA, 21 bp, Homo sapiens
gaggataacttccttgcccct

SEQ ID NO: 2691190 - DNA, 22 bp, Homo sapiens
gaggataacttccttgcccctg

SEQ ID NO: 2691191 - DNA, 21 bp, Homo sapiens
gaggcaggggtcctgcaggtc

SEQ ID NO: 2691192 - DNA, 20 bp, Homo sapiens
gaggccccaggctgagagcc

SEQ ID NO: 2691193 - DNA, 12 bp, Homo sapiens
gaggcgggtgga

SEQ ID NO: 2691194 - DNA, 19 bp, Homo sapiens
gaggcgggtggatcacctg

SEQ ID NO: 2691195 - DNA, 21 bp, Homo sapiens
gaggcgggtggatcacttgag

SEQ ID NO: 2691196 - DNA, 21 bp, Homo sapiens
gaggcttccagagagtcctct

SEQ ID NO: 2691197 - DNA, 22 bp, Homo sapiens
gaggcttccagagagtcctctg

SEQ ID NO: 2691198 - DNA, 13 bp, Homo sapiens
gagggcccaggca

SEQ ID NO: 2691199 - DNA, 16 bp, Homo sapiens
gagggcccaggcaggc

SEQ ID NO: 2691200 - DNA, 14 bp, Homo sapiens
gaggggcccaccca

SEQ ID NO: 2691201 - DNA, 12 bp, Homo sapiens
gaggggctcctg

SEQ ID NO: 2691202 - DNA, 21 bp, Homo sapiens
gagggggcggtaggggctgca

SEQ ID NO: 2691203 - DNA, 11 bp, Homo sapiens
gaggtgcctcc

SEQ ID NO: 2691204 - DNA, 23 bp, Homo sapiens
gaggtgcctcccagtggcctggc

SEQ ID NO: 2691205 - DNA, 16 bp, Homo sapiens
gaggtggcagccctgt

SEQ ID NO: 2691206 - DNA, 22 bp, Homo sapiens
gaggttaggagttcgagaccag

SEQ ID NO: 2691207 - DNA, 20 bp, Homo sapiens
gagtcacccatgaagacagg

SEQ ID NO: 2691208 - DNA, 14 bp, Homo sapiens
gagtctcagagcac

SEQ ID NO: 2691209 - DNA, 18 bp, Homo sapiens
gagtctcagagcacagag

SEQ ID NO: 2691210 - DNA, 24 bp, Homo sapiens
gagtgatggcagaacgatgcctgc

SEQ ID NO: 2691211 - DNA, 16 bp, Homo sapiens
gagtggggcctgccct

SEQ ID NO: 2691212 - DNA, 23 bp, Homo sapiens
gagtggggcctgccctctgcccc

SEQ ID NO: 2691213 - DNA, 20 bp, Homo sapiens
gagtgtctgcgccccgcctc

SEQ ID NO: 2691214 - DNA, 21 bp, Homo sapiens
gagttattgaatcttaatttt

SEQ ID NO: 2691215 - DNA, 20 bp, Homo sapiens
gagttcgagaccagcctggc

SEQ ID NO: 2691216 - DNA, 12 bp, Homo sapiens
gatacagaatga

SEQ ID NO: 2691217 - DNA, 15 bp, Homo sapiens
gatcactctctgctg

SEQ ID NO: 2691218 - DNA, 17 bp, Homo sapiens
gatcactctctgctggc

SEQ ID NO: 2691219 - DNA, 14 bp, Homo sapiens
gatcactggagccc

SEQ ID NO: 2691220 - DNA, 16 bp, Homo sapiens
gatcagagctgcagcc

SEQ ID NO: 2691221 - DNA, 15 bp, Homo sapiens
gatcatctctgtgac

SEQ ID NO: 2691222 - DNA, 18 bp, Homo sapiens
gatcctgctccagcagca

SEQ ID NO: 2691223 - DNA, 19 bp, Homo sapiens
gatctttttgtgaaattca

SEQ ID NO: 2691224 - DNA, 12 bp, Homo sapiens
gatgactgagtc

SEQ ID NO: 2691225 - DNA, 22 bp, Homo sapiens
gatgaggcctcttggacctctg

SEQ ID NO: 2691226 - DNA, 14 bp, Homo sapiens
gatgagggtgactg

SEQ ID NO: 2691227 - DNA, 14 bp, Homo sapiens
gatgatgtctcttg

SEQ ID NO: 2691228 - DNA, 12 bp, Homo sapiens
gatgccaaagct

SEQ ID NO: 2691229 - DNA, 14 bp, Homo sapiens
gatgccaaagctgc

SEQ ID NO: 2691230 - DNA, 15 bp, Homo sapiens
gatgccaaagctgct

SEQ ID NO: 2691231 - DNA, 23 bp, Homo sapiens
gatgcccagagggcccaggcagg

SEQ ID NO: 2691232 - DNA, 13 bp, Homo sapiens
gatgcctgcaggc

SEQ ID NO: 2691233 - DNA, 14 bp, Homo sapiens
gatgcctgcaggca

SEQ ID NO: 2691234 - DNA, 13 bp, Homo sapiens
gatgctgaggcca

SEQ ID NO: 2691235 - DNA, 18 bp, Homo sapiens
gatgctgaggccacccac

SEQ ID NO: 2691236 - DNA, 12 bp, Homo sapiens
gatggaccaaag

SEQ ID NO: 2691237 - DNA, 14 bp, Homo sapiens
gatggaccaaagcc

SEQ ID NO: 2691238 - DNA, 21 bp, Homo sapiens
gatggaccaaagccacctgct

SEQ ID NO: 2691239 - DNA, 16 bp, Homo sapiens
gatggagcgcacctgc

SEQ ID NO: 2691240 - DNA, 22 bp, Homo sapiens
gatggagcgcacctgccccctg

SEQ ID NO: 2691241 - DNA, 15 bp, Homo sapiens
gatggcatctagcca

SEQ ID NO: 2691242 - DNA, 20 bp, Homo sapiens
gatggcatctagccagaggc

SEQ ID NO: 2691243 - DNA, 18 bp, Homo sapiens
gatggcccctccagcaca

SEQ ID NO: 2691244 - DNA, 20 bp, Homo sapiens
gatggcccctccagcacaca

SEQ ID NO: 2691245 - DNA, 12 bp, Homo sapiens
gatgtagaactt

SEQ ID NO: 2691246 - DNA, 13 bp, Homo sapiens
gattagctctgga

SEQ ID NO: 2691247 - DNA, 13 bp, Homo sapiens
gattcactggcct

SEQ ID NO: 2691248 - DNA, 20 bp, Homo sapiens
gattcactggcctggcggag

SEQ ID NO: 2691249 - DNA, 20 bp, Homo sapiens
gattcagatttctctttgaa

SEQ ID NO: 2691250 - DNA, 22 bp, Homo sapiens
gattctgggaggaagcaggttg

SEQ ID NO: 2691251 - DNA, 15 bp, Homo sapiens
gattgggctggctct

SEQ ID NO: 2691252 - DNA, 16 bp, Homo sapiens
gattgggctggctctg

SEQ ID NO: 2691253 - DNA, 20 bp, Homo sapiens
gatttaccttttctgttgta

SEQ ID NO: 2691254 - DNA, 13 bp, Homo sapiens
gatttctctttga

SEQ ID NO: 2691255 - DNA, 22 bp, Homo sapiens
gatttctctttgaaacatgctt

SEQ ID NO: 2691256 - DNA, 14 bp, Homo sapiens
gatttgagaaattt

SEQ ID NO: 2691257 - DNA, 21 bp, Homo sapiens
gcaaaagacttgagccatcca

SEQ ID NO: 2691258 - DNA, 19 bp, Homo sapiens
gcaaagagacccagtcaat

SEQ ID NO: 2691259 - DNA, 16 bp, Homo sapiens
gcaactcacacctcct

SEQ ID NO: 2691260 - DNA, 13 bp, Homo sapiens
gcaagagaacatt

SEQ ID NO: 2691261 - DNA, 14 bp, Homo sapiens
gcaagctctgccct

SEQ ID NO: 2691262 - DNA, 15 bp, Homo sapiens
gcaagctctgccctg

SEQ ID NO: 2691263 - DNA, 19 bp, Homo sapiens
gcaagctctgccctggctg

SEQ ID NO: 2691264 - DNA, 14 bp, Homo sapiens
gcaaggctgtgctc

SEQ ID NO: 2691265 - DNA, 22 bp, Homo sapiens
gcaaggctgtgctcttcctctg

SEQ ID NO: 2691266 - DNA, 20 bp, Homo sapiens
gcaagtccctgactctctgt

SEQ ID NO: 2691267 - DNA, 18 bp, Homo sapiens
gcaatctgtctttagaat

SEQ ID NO: 2691268 - DNA, 15 bp, Homo sapiens
gcacacctcagcccc

SEQ ID NO: 2691269 - DNA, 16 bp, Homo sapiens
gcacacctcagcccca

SEQ ID NO: 2691270 - DNA, 13 bp, Homo sapiens
gcacaccttttcc

SEQ ID NO: 2691271 - DNA, 20 bp, Homo sapiens
gcacaccttttccccaggag

SEQ ID NO: 2691272 - DNA, 22 bp, Homo sapiens
gcacaccttttccccaggagca

SEQ ID NO: 2691273 - DNA, 14 bp, Homo sapiens
gcacagctgggcat

SEQ ID NO: 2691274 - DNA, 23 bp, Homo sapiens
gcacaggagagcacccacagccg

SEQ ID NO: 2691275 - DNA, 21 bp, Homo sapiens
gcaccagaggctgcagaaggc

SEQ ID NO: 2691276 - DNA, 16 bp, Homo sapiens
gcacccacagccgcag

SEQ ID NO: 2691277 - DNA, 16 bp, Homo sapiens
gcacccaggcctccct

SEQ ID NO: 2691278 - DNA, 18 bp, Homo sapiens
gcacccaggcctccctgc

SEQ ID NO: 2691279 - DNA, 13 bp, Homo sapiens
gaagcgctgccct

SEQ ID NO: 2691280 - DNA, 17 bp, Homo sapiens
gaagcgctgccctgtga

SEQ ID NO: 2691281 - DNA, 19 bp, Homo sapiens
gaagctccctccctcactg

SEQ ID NO: 2691282 - DNA, 18 bp, Homo sapiens
gaaggcaaatataagctg

SEQ ID NO: 2691283 - DNA, 13 bp, Homo sapiens
gaaggctggctgg

SEQ ID NO: 2691284 - DNA, 17 bp, Homo sapiens
gaagggacagctgctgg

SEQ ID NO: 2691285 - DNA, 15 bp, Homo sapiens
gaaggggcccaaggt

SEQ ID NO: 2691286 - DNA, 19 bp, Homo sapiens
gaagtaactggtgatatat

SEQ ID NO: 2691287 - DNA, 13 bp, Homo sapiens
gaagtctccctgc

SEQ ID NO: 2691288 - DNA, 18 bp, Homo sapiens
gaagtctccctgcacagc

SEQ ID NO: 2691289 - DNA, 21 bp, Homo sapiens
gaagtctccctgcacagcctc

SEQ ID NO: 2691290 - DNA, 18 bp, Homo sapiens
gaagtgcccagcccctgc

SEQ ID NO: 2691291 - DNA, 17 bp, Homo sapiens
gaagtgttcaagaaata

SEQ ID NO: 2691292 - DNA, 19 bp, Homo sapiens
gaatagatgtgatcactga

SEQ ID NO: 2691293 - DNA, 14 bp, Homo sapiens
gaatcgctttcctt

SEQ ID NO: 2691294 - DNA, 17 bp, Homo sapiens
gaatctgtatgattcta

SEQ ID NO: 2691295 - DNA, 21 bp, Homo sapiens
gaatggcctgccttgaagcca

SEQ ID NO: 2691296 - DNA, 22 bp, Homo sapiens
gaatggtgtgaacccgggaagc

SEQ ID NO: 2691297 - DNA, 16 bp, Homo sapiens
gaatgtgtcctcctgc

SEQ ID NO: 2691298 - DNA, 19 bp, Homo sapiens
gaatgtgtcctcctgctct

SEQ ID NO: 2691299 - DNA, 23 bp, Homo sapiens
gaatgtgtcctcctgctctgctt

SEQ ID NO: 2691300 - DNA, 22 bp, Homo sapiens
gaattaccttagattagctctg

SEQ ID NO: 2691301 - DNA, 20 bp, Homo sapiens
gaattgcccattgtttttct

SEQ ID NO: 2691302 - DNA, 18 bp, Homo sapiens
gacaagtcttgctgtgct

SEQ ID NO: 2691303 - DNA, 19 bp, Homo sapiens
gacaagtcttgctgtgctt

SEQ ID NO: 2691304 - DNA, 18 bp, Homo sapiens
gacacaagcggccctgac

SEQ ID NO: 2691305 - DNA, 12 bp, Homo sapiens
gacacaggccag

SEQ ID NO: 2691306 - DNA, 22 bp, Homo sapiens
gacacaggtgcctcacgcctgt

SEQ ID NO: 2691307 - DNA, 9 bp, Homo sapiens
gacacctgc

SEQ ID NO: 2691308 - DNA, 11 bp, Homo sapiens
gacacctgccc

SEQ ID NO: 2691309 - DNA, 23 bp, Homo sapiens
gacacctgccctgccctgccacc

SEQ ID NO: 2691310 - DNA, 19 bp, Homo sapiens
gacacgtgatggaccaaag

SEQ ID NO: 2691311 - DNA, 17 bp, Homo sapiens
gacactgtgaccctggg

SEQ ID NO: 2691312 - DNA, 23 bp, Homo sapiens
gacagaccagcagcaatctgtct

SEQ ID NO: 2691313 - DNA, 18 bp, Homo sapiens
gacagctgctgggaccca

SEQ ID NO: 2691314 - DNA, 21 bp, Homo sapiens
gacagctgctgggacccacct

SEQ ID NO: 2691315 - DNA, 14 bp, Homo sapiens
gacaggacagtgct

SEQ ID NO: 2691316 - DNA, 22 bp, Homo sapiens
gacaggacagtgcttcagcctg

SEQ ID NO: 2691317 - DNA, 23 bp, Homo sapiens
gacaggacagtgcttcagcctga

SEQ ID NO: 2691318 - DNA, 16 bp, Homo sapiens
gacagtgcccatgcaa

SEQ ID NO: 2691319 - DNA, 17 bp, Homo sapiens
gacagtgcttcagcctg

SEQ ID NO: 2691320 - DNA, 17 bp, Homo sapiens
gacagtgggcaggaggc

SEQ ID NO: 2691321 - DNA, 18 bp, Homo sapiens
gaccaaccctgtttcctg

SEQ ID NO: 2691322 - DNA, 12 bp, Homo sapiens
gaccagcctggc

SEQ ID NO: 2691323 - DNA, 15 bp, Homo sapiens
gaccattgtcttcca

SEQ ID NO: 2691324 - DNA, 21 bp, Homo sapiens
gacccaaatttccctgggggc

SEQ ID NO: 2691325 - DNA, 21 bp, Homo sapiens
gacccaactgatcctgctcca

SEQ ID NO: 2691326 - DNA, 12 bp, Homo sapiens
gaccccatctct

SEQ ID NO: 2691327 - DNA, 17 bp, Homo sapiens
gaccccctggccctgcc

SEQ ID NO: 2691328 - DNA, 13 bp, Homo sapiens
gacccgctctgga

SEQ ID NO: 2691329 - DNA, 14 bp, Homo sapiens
gacccgctctggac

SEQ ID NO: 2691330 - DNA, 16 bp, Homo sapiens
gacccgctctggacca

SEQ ID NO: 2691331 - DNA, 19 bp, Homo sapiens
gaccctcctcctcccccag

SEQ ID NO: 2691332 - DNA, 22 bp, Homo sapiens
gaccctcctcctcccccagagg

SEQ ID NO: 2691333 - DNA, 20 bp, Homo sapiens
gaccctgagggctcctccat

SEQ ID NO: 2691334 - DNA, 22 bp, Homo sapiens
gaccctgagggctcctccatgg

SEQ ID NO: 2691335 - DNA, 23 bp, Homo sapiens
gaccctgggtcgggacagaccag

SEQ ID NO: 2691336 - DNA, 23 bp, Homo sapiens
gaccgccctccgtcgggcccctg

SEQ ID NO: 2691337 - DNA, 21 bp, Homo sapiens
gacctctgcttttgcacacct

SEQ ID NO: 2691338 - DNA, 22 bp, Homo sapiens
gacctgaagggtgacatcccag

SEQ ID NO: 2691339 - DNA, 21 bp, Homo sapiens
gacctgttttgcttttgtaac

SEQ ID NO: 2691340 - DNA, 14 bp, Homo sapiens
gaccttcctgccac

SEQ ID NO: 2691341 - DNA, 13 bp, Homo sapiens
gacggaggtgcct

SEQ ID NO: 2691342 - DNA, 18 bp, Homo sapiens
gacgtgcacctgtactca

SEQ ID NO: 2691343 - DNA, 21 bp, Homo sapiens
gacgttcggggcatgctgggg

SEQ ID NO: 2691344 - DNA, 21 bp, Homo sapiens
gactaacataaaatctgtgaa

SEQ ID NO: 2691345 - DNA, 18 bp, Homo sapiens
gactaaggggcagctcct

SEQ ID NO: 2691346 - DNA, 15 bp, Homo sapiens
ctggagtctccagtg

SEQ ID NO: 2691347 - DNA, 15 bp, Homo sapiens
ctggatggcaccaga

SEQ ID NO: 2691348 - DNA, 16 bp, Homo sapiens
ctggatggcaccagag

SEQ ID NO: 2691349 - DNA, 23 bp, Homo sapiens
ctggatggcaccagaggctgcag

SEQ ID NO: 2691350 - DNA, 18 bp, Homo sapiens
ctggcaggatgaccctgc

SEQ ID NO: 2691351 - DNA, 20 bp, Homo sapiens
ctggcaggatgaccctgcga

SEQ ID NO: 2691352 - DNA, 22 bp, Homo sapiens
ctggcaggattcttcccgctcc

SEQ ID NO: 2691353 - DNA, 21 bp, Homo sapiens
ctggccacctagaagtctccc

SEQ ID NO: 2691354 - DNA, 16 bp, Homo sapiens
ctggccagtcctagag

SEQ ID NO: 2691355 - DNA, 23 bp, Homo sapiens
ctggccccaccctcgtggacacc

SEQ ID NO: 2691356 - DNA, 15 bp, Homo sapiens
ctggccctgcctcat

SEQ ID NO: 2691357 - DNA, 22 bp, Homo sapiens
ctggcccttgagtggggcagcc

SEQ ID NO: 2691358 - DNA, 22 bp, Homo sapiens
ctggcctctagaacacccactg

SEQ ID NO: 2691359 - DNA, 21 bp, Homo sapiens
ctggccttcgtctccatctct

SEQ ID NO: 2691360 - DNA, 12 bp, Homo sapiens
ctggctgctccc

SEQ ID NO: 2691361 - DNA, 13 bp, Homo sapiens
ctggctgctccct

SEQ ID NO: 2691362 - DNA, 18 bp, Homo sapiens
ctggctgctccctgctcc

SEQ ID NO: 2691363 - DNA, 18 bp, Homo sapiens
ctggctggagtctcagag

SEQ ID NO: 2691364 - DNA, 17 bp, Homo sapiens
ctggctgggcatggacg

SEQ ID NO: 2691365 - DNA, 13 bp, Homo sapiens
ctggcttatgctc

SEQ ID NO: 2691366 - DNA, 14 bp, Homo sapiens
ctggcttgcttgcc

SEQ ID NO: 2691367 - DNA, 20 bp, Homo sapiens
ctggcttgcttgccgagcct

SEQ ID NO: 2691368 - DNA, 19 bp, Homo sapiens
ctggcttgtcggagcaagt

SEQ ID NO: 2691369 - DNA, 23 bp, Homo sapiens
ctgggaacctccttacctggagt

SEQ ID NO: 2691370 - DNA, 14 bp, Homo sapiens
ctgggactggccag

SEQ ID NO: 2691371 - DNA, 15 bp, Homo sapiens
ctgggagaacctcag

SEQ ID NO: 2691372 - DNA, 14 bp, Homo sapiens
ctgggaggaagcag

SEQ ID NO: 2691373 - DNA, 21 bp, Homo sapiens
ctgggccaagttcctctagtg

SEQ ID NO: 2691374 - DNA, 11 bp, Homo sapiens
ctgggccaggt

SEQ ID NO: 2691375 - DNA, 18 bp, Homo sapiens
gcttgtcggagcaagttt

SEQ ID NO: 2691376 - DNA, 20 bp, Homo sapiens
gctttaggcatatgcttctt

SEQ ID NO: 2691377 - DNA, 15 bp, Homo sapiens
gctttcagagccagt

SEQ ID NO: 2691378 - DNA, 16 bp, Homo sapiens
gctttcagagccagtg

SEQ ID NO: 2691379 - DNA, 13 bp, Homo sapiens
gctttctggagag

SEQ ID NO: 2691380 - DNA, 18 bp, Homo sapiens
gctttgttgtcctcccag

SEQ ID NO: 2691381 - DNA, 21 bp, Homo sapiens
gctttgttgtcctcccaggaa

SEQ ID NO: 2691382 - DNA, 18 bp, Homo sapiens
gcttttgttgtgactttt

SEQ ID NO: 2691383 - DNA, 18 bp, Homo sapiens
gcttttttttgagaatac

SEQ ID NO: 2691384 - DNA, 16 bp, Homo sapiens
ggaaaacacggccctc

SEQ ID NO: 2691385 - DNA, 20 bp, Homo sapiens
ggaaaacacggccctcctgg

SEQ ID NO: 2691386 - DNA, 11 bp, Homo sapiens
ggaaagcaggt

SEQ ID NO: 2691387 - DNA, 18 bp, Homo sapiens
ggaaagcatcacctcagg

SEQ ID NO: 2691388 - DNA, 19 bp, Homo sapiens
ggaaagcatcacctcaggc

SEQ ID NO: 2691389 - DNA, 12 bp, Homo sapiens
ggaaaggctcag

SEQ ID NO: 2691390 - DNA, 19 bp, Homo sapiens
ggaaaggctcagtctcagg

SEQ ID NO: 2691391 - DNA, 18 bp, Homo sapiens
ggaaatattctatgacca

SEQ ID NO: 2691392 - DNA, 22 bp, Homo sapiens
ggaaccaaaaaaccccagctat

SEQ ID NO: 2691393 - DNA, 16 bp, Homo sapiens
ggaacctccttacctg

SEQ ID NO: 2691394 - DNA, 21 bp, Homo sapiens
ggaacctccttacctggagta

SEQ ID NO: 2691395 - DNA, 18 bp, Homo sapiens
ggaacggggtccttcaag

SEQ ID NO: 2691396 - DNA, 21 bp, Homo sapiens
ggaagaaacctggaaccagag

SEQ ID NO: 2691397 - DNA, 23 bp, Homo sapiens
ggaagaaacctggaaccagaggg

SEQ ID NO: 2691398 - DNA, 19 bp, Homo sapiens
ggaagaaattcctgtagca

SEQ ID NO: 2691399 - DNA, 21 bp, Homo sapiens
ggaagatttaccttttctgtt

SEQ ID NO: 2691400 - DNA, 23 bp, Homo sapiens
ggaagcgatgaatttggagactc

SEQ ID NO: 2691401 - DNA, 20 bp, Homo sapiens
ggaaggctaagcatggcctg

SEQ ID NO: 2691402 - DNA, 22 bp, Homo sapiens
ggaaggctaagcatggcctgga

SEQ ID NO: 2691403 - DNA, 18 bp, Homo sapiens
ggaagtggcagtgaaaaa

SEQ ID NO: 2691404 - DNA, 16 bp, Homo sapiens
ggaagtgttcaagaaa

SEQ ID NO: 2691405 - DNA, 18 bp, Homo sapiens
ggaagtgttcaagaaata

SEQ ID NO: 2691406 - DNA, 10 bp, Homo sapiens
ggacacctgc

SEQ ID NO: 2691407 - DNA, 11 bp, Homo sapiens
ggacacctgcc

SEQ ID NO: 2691408 - DNA, 15 bp, Homo sapiens
ggacacctgccctgc

SEQ ID NO: 2691409 - DNA, 21 bp, Homo sapiens
ggacagaccagcagcaatctg

SEQ ID NO: 2691410 - DNA, 14 bp, Homo sapiens
ggacagctgctggg

SEQ ID NO: 2691411 - DNA, 19 bp, Homo sapiens
ggacagtcctgggagaacc

SEQ ID NO: 2691412 - DNA, 16 bp, Homo sapiens
ggacagtgcttcagcc

SEQ ID NO: 2691413 - DNA, 18 bp, Homo sapiens
ggacagtgcttcagcctg

SEQ ID NO: 2691414 - DNA, 19 bp, Homo sapiens
ggacagtgcttcagcctga

SEQ ID NO: 2691415 - DNA, 20 bp, Homo sapiens
ggacagtgcttcagcctgag

SEQ ID NO: 2691416 - DNA, 14 bp, Homo sapiens
ggacatcatgaagc

SEQ ID NO: 2691417 - DNA, 17 bp, Homo sapiens
ggaccaaagccacctgc

SEQ ID NO: 2691418 - DNA, 19 bp, Homo sapiens
ggaccaaagccacctgctg

SEQ ID NO: 2691419 - DNA, 17 bp, Homo sapiens
ggaccaaccctgtttcc

SEQ ID NO: 2691420 - DNA, 18 bp, Homo sapiens
ggaccaaccctgtttcct

SEQ ID NO: 2691421 - DNA, 16 bp, Homo sapiens
ggaccagtcccacacc

SEQ ID NO: 2691422 - DNA, 18 bp, Homo sapiens
ggaccccctggccctgcc

SEQ ID NO: 2691423 - DNA, 17 bp, Homo sapiens
ggacccgctctggacca

SEQ ID NO: 2691424 - DNA, 19 bp, Homo sapiens
ggacccgctctggaccaac

SEQ ID NO: 2691425 - DNA, 12 bp, Homo sapiens
ggacctctgctt

SEQ ID NO: 2691426 - DNA, 21 bp, Homo sapiens
ggacctgaagggtgacatccc

SEQ ID NO: 2691427 - DNA, 15 bp, Homo sapiens
ggaccttcctgccac

SEQ ID NO: 2691428 - DNA, 11 bp, Homo sapiens
ggactctgagg

SEQ ID NO: 2691429 - DNA, 13 bp, Homo sapiens
ggactctgaggct

SEQ ID NO: 2691430 - DNA, 17 bp, Homo sapiens
ggactgactgcagcccc

SEQ ID NO: 2691431 - DNA, 18 bp, Homo sapiens
ggactgactgcagccccc

SEQ ID NO: 2691432 - DNA, 23 bp, Homo sapiens
ggagaactggggttcaagcccag

SEQ ID NO: 2691433 - DNA, 23 bp, Homo sapiens
ggagacaggtgcgcccctggtgg

SEQ ID NO: 2691434 - DNA, 16 bp, Homo sapiens
ggagactctgtggggc

SEQ ID NO: 2691435 - DNA, 18 bp, Homo sapiens
ggagatcgagaccatcct

SEQ ID NO: 2691436 - DNA, 22 bp, Homo sapiens
ggagatgcttctaaggcatggt

SEQ ID NO: 2691437 - DNA, 14 bp, Homo sapiens
ggagcaagctctgc

SEQ ID NO: 2691438 - DNA, 23 bp, Homo sapiens
ggagcaagctctgccctggctgt

SEQ ID NO: 2691439 - DNA, 14 bp, Homo sapiens
ggagcatctgactc

SEQ ID NO: 2691440 - DNA, 23 bp, Homo sapiens
ggagccagttctggggcccgcct

SEQ ID NO: 2691441 - DNA, 13 bp, Homo sapiens
ggagccccagctt

SEQ ID NO: 2691442 - DNA, 13 bp, Homo sapiens
ggagcccttgggt

SEQ ID NO: 2691443 - DNA, 23 bp, Homo sapiens
ggagcctcgtgtcctgctagctg

SEQ ID NO: 2691444 - DNA, 19 bp, Homo sapiens
ggagcgcacctgccccctg

SEQ ID NO: 2691445 - DNA, 12 bp, Homo sapiens
ggagctatttta

SEQ ID NO: 2691446 - DNA, 16 bp, Homo sapiens
ggaggatcactggagc

SEQ ID NO: 2691447 - DNA, 12 bp, Homo sapiens
ggaggggcccac

SEQ ID NO: 2691448 - DNA, 15 bp, Homo sapiens
ggaggggcccaccca

SEQ ID NO: 2691449 - DNA, 13 bp, Homo sapiens
ggaggtgccagga

SEQ ID NO: 2691450 - DNA, 17 bp, Homo sapiens
ggaggttgcagggagcc

SEQ ID NO: 2691451 - DNA, 14 bp, Homo sapiens
ggaggttggtgact

SEQ ID NO: 2691452 - DNA, 17 bp, Homo sapiens
ggagtctcagagcacag

SEQ ID NO: 2691453 - DNA, 19 bp, Homo sapiens
ggagtttgaggctgcagcg

SEQ ID NO: 2691454 - DNA, 20 bp, Homo sapiens
ggagtttgaggctgcagcga

SEQ ID NO: 2691455 - DNA, 21 bp, Homo sapiens
ggatcactctctgctggcagg

SEQ ID NO: 2691456 - DNA, 13 bp, Homo sapiens
ggatcactggagc

SEQ ID NO: 2691457 - DNA, 15 bp, Homo sapiens
ggatggcaccagagg

SEQ ID NO: 2691458 - DNA, 16 bp, Homo sapiens
ggatggtcctggggct

SEQ ID NO: 2691459 - DNA, 15 bp, Homo sapiens
ggatggtctccacct

SEQ ID NO: 2691460 - DNA, 16 bp, Homo sapiens
ggatggtctccacctg

SEQ ID NO: 2691461 - DNA, 17 bp, Homo sapiens
ggatggtttgagctcag

SEQ ID NO: 2691462 - DNA, 15 bp, Homo sapiens
ggatgtcaggcccag

SEQ ID NO: 2691463 - DNA, 20 bp, Homo sapiens
ggattcttcccgctccccac

SEQ ID NO: 2691464 - DNA, 21 bp, Homo sapiens
ggattcttcccgctccccacc

SEQ ID NO: 2691465 - DNA, 20 bp, Homo sapiens
ggcaaagagacccagtcaat

SEQ ID NO: 2691466 - DNA, 17 bp, Homo sapiens
ggcaaggggctggctgg

SEQ ID NO: 2691467 - DNA, 21 bp, Homo sapiens
ggcacccaggcctccctgcag

SEQ ID NO: 2691468 - DNA, 22 bp, Homo sapiens
ggcacctatagtcccagctact

SEQ ID NO: 2691469 - DNA, 17 bp, Homo sapiens
ggcacgaggggggccag

SEQ ID NO: 2691470 - DNA, 16 bp, Homo sapiens
ggcactttaaagcatt

SEQ ID NO: 2691471 - DNA, 19 bp, Homo sapiens
ggcagcctccttgcctgga

SEQ ID NO: 2691472 - DNA, 12 bp, Homo sapiens
ggcagctcctga

SEQ ID NO: 2691473 - DNA, 16 bp, Homo sapiens
ggcagctcctgaccaa

SEQ ID NO: 2691474 - DNA, 15 bp, Homo sapiens
ggcaggagcctcgtg

SEQ ID NO: 2691475 - DNA, 16 bp, Homo sapiens
ggcaggaggccccagg

SEQ ID NO: 2691476 - DNA, 17 bp, Homo sapiens
ggcaggaggccccaggc

SEQ ID NO: 2691477 - DNA, 23 bp, Homo sapiens
ggcaggggtcctgcaggtcctgg

SEQ ID NO: 2691478 - DNA, 17 bp, Homo sapiens
ggcaggtgagaacccag

SEQ ID NO: 2691479 - DNA, 22 bp, Homo sapiens
ggcatcacagggcagagccggg

SEQ ID NO: 2691480 - DNA, 21 bp, Homo sapiens
ggcatcctgaaagccagcaaa

SEQ ID NO: 2691481 - DNA, 12 bp, Homo sapiens
ggcatcctgctt

SEQ ID NO: 2691482 - DNA, 13 bp, Homo sapiens
ggcatgctggggc

SEQ ID NO: 2691483 - DNA, 17 bp, Homo sapiens
ggcatggcgaggctgag

SEQ ID NO: 2691484 - DNA, 17 bp, Homo sapiens
ggccaaagcacagctgg

SEQ ID NO: 2691485 - DNA, 20 bp, Homo sapiens
ggccaatgttgctgatggcc

SEQ ID NO: 2691486 - DNA, 20 bp, Homo sapiens
gcgggcacctatagtcccag

SEQ ID NO: 2691487 - DNA, 13 bp, Homo sapiens
gcgggggagccag

SEQ ID NO: 2691488 - DNA, 22 bp, Homo sapiens
gcgggggtttgagccctggacc

SEQ ID NO: 2691489 - DNA, 20 bp, Homo sapiens
gcgtcaggcacgtctcctgc

SEQ ID NO: 2691490 - DNA, 18 bp, Homo sapiens
gcgtccctgccccgaccc

SEQ ID NO: 2691491 - DNA, 19 bp, Homo sapiens
gcgtgacatgtgcagtgct

SEQ ID NO: 2691492 - DNA, 19 bp, Homo sapiens
gcgtttacatatttacctg

SEQ ID NO: 2691493 - DNA, 16 bp, Homo sapiens
gctaagcatggcctgg

SEQ ID NO: 2691494 - DNA, 13 bp, Homo sapiens
gctaagttctaag

SEQ ID NO: 2691495 - DNA, 15 bp, Homo sapiens
gctacaataaatgct

SEQ ID NO: 2691496 - DNA, 20 bp, Homo sapiens
gctacatggggtctgggtgg

SEQ ID NO: 2691497 - DNA, 14 bp, Homo sapiens
gctactcagaagcc

SEQ ID NO: 2691498 - DNA, 18 bp, Homo sapiens
gctactcagaagcctgag

SEQ ID NO: 2691499 - DNA, 19 bp, Homo sapiens
gctactcagaagcctgagg

SEQ ID NO: 2691500 - DNA, 20 bp, Homo sapiens
gctactcgggaggctgaggc

SEQ ID NO: 2691501 - DNA, 13 bp, Homo sapiens
gctagaaggccac

SEQ ID NO: 2691502 - DNA, 12 bp, Homo sapiens
gctaggagcccc

SEQ ID NO: 2691503 - DNA, 16 bp, Homo sapiens
gctaggagccccagct

SEQ ID NO: 2691504 - DNA, 22 bp, Homo sapiens
gctaggagccccagcttcctgt

SEQ ID NO: 2691505 - DNA, 23 bp, Homo sapiens
gctatgaagggacagctgctggg

SEQ ID NO: 2691506 - DNA, 18 bp, Homo sapiens
gctatgattatgccactg

SEQ ID NO: 2691507 - DNA, 13 bp, Homo sapiens
gctatttgttcag

SEQ ID NO: 2691508 - DNA, 14 bp, Homo sapiens
gctatttgttcaga

SEQ ID NO: 2691509 - DNA, 15 bp, Homo sapiens
gctattttctgacca

SEQ ID NO: 2691510 - DNA, 21 bp, Homo sapiens
gctcacctcagagcagggcca

SEQ ID NO: 2691511 - DNA, 20 bp, Homo sapiens
gctcagaagccagtctgcgt

SEQ ID NO: 2691512 - DNA, 17 bp, Homo sapiens
gctcaggaggcttggaa

SEQ ID NO: 2691513 - DNA, 15 bp, Homo sapiens
gctccagcagcacac

SEQ ID NO: 2691514 - DNA, 21 bp, Homo sapiens
gctccagcagcacacctcagc

SEQ ID NO: 2691515 - DNA, 22 bp, Homo sapiens
gctccagcagcacacctcagcc

SEQ ID NO: 2691516 - DNA, 20 bp, Homo sapiens
gctcccagtgggagcttccc

SEQ ID NO: 2691517 - DNA, 16 bp, Homo sapiens
gctccccacctaccca

SEQ ID NO: 2691518 - DNA, 22 bp, Homo sapiens
gctcccgcttgctctcctggag

SEQ ID NO: 2691519 - DNA, 23 bp, Homo sapiens
gctcccgcttgctctcctggagc

SEQ ID NO: 2691520 - DNA, 21 bp, Homo sapiens
gctccctgattaatggaggct

SEQ ID NO: 2691521 - DNA, 17 bp, Homo sapiens
gctccctgctcccaggg

SEQ ID NO: 2691522 - DNA, 19 bp, Homo sapiens
gctccctgctcccagggac

SEQ ID NO: 2691523 - DNA, 22 bp, Homo sapiens
gctcctggaaaggctcagtctc

SEQ ID NO: 2691524 - DNA, 23 bp, Homo sapiens
gctcctggaaaggctcagtctca

SEQ ID NO: 2691525 - DNA, 14 bp, Homo sapiens
gctcctgtccctac

SEQ ID NO: 2691526 - DNA, 21 bp, Homo sapiens
gctcctgtccctacccactct

SEQ ID NO: 2691527 - DNA, 16 bp, Homo sapiens
gctctactgccctccc

SEQ ID NO: 2691528 - DNA, 18 bp, Homo sapiens
gctctactgccctcccct

SEQ ID NO: 2691529 - DNA, 14 bp, Homo sapiens
gctctatgccaggc

SEQ ID NO: 2691530 - DNA, 16 bp, Homo sapiens
gctctcctggagcaag

SEQ ID NO: 2691531 - DNA, 18 bp, Homo sapiens
gctctcctggagcaagct

SEQ ID NO: 2691532 - DNA, 21 bp, Homo sapiens
gctctgaagccaagcctcttc

SEQ ID NO: 2691533 - DNA, 16 bp, Homo sapiens
gctctgaggcttccag

SEQ ID NO: 2691534 - DNA, 20 bp, Homo sapiens
gctctgaggcttccagagag

SEQ ID NO: 2691535 - DNA, 21 bp, Homo sapiens
gctctgaggcttccagagagt

SEQ ID NO: 2691536 - DNA, 20 bp, Homo sapiens
gctctgccccagctctggct

SEQ ID NO: 2691537 - DNA, 12 bp, Homo sapiens
gctctgcttcct

SEQ ID NO: 2691538 - DNA, 16 bp, Homo sapiens
gctctggaccagcctg

SEQ ID NO: 2691539 - DNA, 21 bp, Homo sapiens
gctcttcctctggtttctgtg

SEQ ID NO: 2691540 - DNA, 18 bp, Homo sapiens
gctcttgttccgtgccag

SEQ ID NO: 2691541 - DNA, 15 bp, Homo sapiens
gctctttcagagagg

SEQ ID NO: 2691542 - DNA, 14 bp, Homo sapiens
gctctttctgggcc

SEQ ID NO: 2691543 - DNA, 19 bp, Homo sapiens
gctgacactgtgaccctgg

SEQ ID NO: 2691544 - DNA, 11 bp, Homo sapiens
gctgagccctg

SEQ ID NO: 2691545 - DNA, 14 bp, Homo sapiens
gctgagccctggca

SEQ ID NO: 2691546 - DNA, 22 bp, Homo sapiens
gctgaggggaggatcactggag

SEQ ID NO: 2691547 - DNA, 22 bp, Homo sapiens
gctgatgatgtctcttgtagaa

SEQ ID NO: 2691548 - DNA, 13 bp, Homo sapiens
gctgatggcccct

SEQ ID NO: 2691549 - DNA, 17 bp, Homo sapiens
gctgatggcccctccag

SEQ ID NO: 2691550 - DNA, 20 bp, Homo sapiens
gctgatggcccctccagcac

SEQ ID NO: 2691551 - DNA, 21 bp, Homo sapiens
gctgcacctgccagcctggct

SEQ ID NO: 2691552 - DNA, 19 bp, Homo sapiens
gctgcagccagtcaggcag

SEQ ID NO: 2691553 - DNA, 14 bp, Homo sapiens
gctgcagcctccct

SEQ ID NO: 2691554 - DNA, 23 bp, Homo sapiens
gctgcattgagtccagctttcct

SEQ ID NO: 2691555 - DNA, 22 bp, Homo sapiens
gctgccatggcgtgtccctctc

SEQ ID NO: 2691556 - DNA, 15 bp, Homo sapiens
gctgccctgccactt

SEQ ID NO: 2691557 - DNA, 18 bp, Homo sapiens
gctgccctgtgagagcca

SEQ ID NO: 2691558 - DNA, 12 bp, Homo sapiens
gctgctggcctg

SEQ ID NO: 2691559 - DNA, 20 bp, Homo sapiens
gctgctgggacccacctccc

SEQ ID NO: 2691560 - DNA, 19 bp, Homo sapiens
gctgctttcttctctgcct

SEQ ID NO: 2691561 - DNA, 15 bp, Homo sapiens
gctgctttgatatat

SEQ ID NO: 2691562 - DNA, 17 bp, Homo sapiens
gctggagtctcagagca

SEQ ID NO: 2691563 - DNA, 20 bp, Homo sapiens
gctggagtctcagagcacag

SEQ ID NO: 2691564 - DNA, 23 bp, Homo sapiens
gctggccacctagaagtctccct

SEQ ID NO: 2691565 - DNA, 13 bp, Homo sapiens
gctggcctctaga

SEQ ID NO: 2691566 - DNA, 22 bp, Homo sapiens
gctggcctctagaacacccact

SEQ ID NO: 2691567 - DNA, 23 bp, Homo sapiens
gctggcctctagaacacccactg

SEQ ID NO: 2691568 - DNA, 23 bp, Homo sapiens
gctggccttcgtctccatctctg

SEQ ID NO: 2691569 - DNA, 16 bp, Homo sapiens
gctggctctgaagcca

SEQ ID NO: 2691570 - DNA, 19 bp, Homo sapiens
gctggctggagtctcagag

SEQ ID NO: 2691571 - DNA, 22 bp, Homo sapiens
gctggctggagtctcagagcac

SEQ ID NO: 2691572 - DNA, 15 bp, Homo sapiens
gctgggacccacctc

SEQ ID NO: 2691573 - DNA, 19 bp, Homo sapiens
gctgggacccacctccccc

SEQ ID NO: 2691574 - DNA, 16 bp, Homo sapiens
gctgggctcctcattt

SEQ ID NO: 2691575 - DNA, 18 bp, Homo sapiens
gctgtaatcggctcccgc

SEQ ID NO: 2691576 - DNA, 19 bp, Homo sapiens
gctgtaatcggctcccgct

SEQ ID NO: 2691577 - DNA, 16 bp, Homo sapiens
gctgtccgtgtgcctc

SEQ ID NO: 2691578 - DNA, 20 bp, Homo sapiens
gctgtccgtgtgcctcctgt

SEQ ID NO: 2691579 - DNA, 13 bp, Homo sapiens
gctgtcctaggcc

SEQ ID NO: 2691580 - DNA, 13 bp, Homo sapiens
gctgtctctcttg

SEQ ID NO: 2691581 - DNA, 14 bp, Homo sapiens
gctgtggcctgggc

SEQ ID NO: 2691582 - DNA, 15 bp, Homo sapiens
gctgttctctttgct

SEQ ID NO: 2691583 - DNA, 16 bp, Homo sapiens
gctgttctctttgctg

SEQ ID NO: 2691584 - DNA, 18 bp, Homo sapiens
gctgttggatttcagtga

SEQ ID NO: 2691585 - DNA, 18 bp, Homo sapiens
gcttatgctcagaagcca

SEQ ID NO: 2691586 - DNA, 21 bp, Homo sapiens
gcttcagcctgaggctgagac

SEQ ID NO: 2691587 - DNA, 23 bp, Homo sapiens
gcttcagcctgaggctgagactg

SEQ ID NO: 2691588 - DNA, 17 bp, Homo sapiens
gcttcctcagggcccag

SEQ ID NO: 2691589 - DNA, 20 bp, Homo sapiens
gcttcctgggtcctgcctgg

SEQ ID NO: 2691590 - DNA, 15 bp, Homo sapiens
gcttcctttcaggcc

SEQ ID NO: 2691591 - DNA, 20 bp, Homo sapiens
gcttgccgagcctaatgaaa

SEQ ID NO: 2691592 - DNA, 14 bp, Homo sapiens
gcttgctctcctgg

SEQ ID NO: 2691593 - DNA, 17 bp, Homo sapiens
gcttgctctcctggagc

SEQ ID NO: 2691594 - DNA, 18 bp, Homo sapiens
gcttgctctcctggagca

SEQ ID NO: 2691595 - DNA, 13 bp, Homo sapiens
gcttggcagctga

SEQ ID NO: 2691596 - DNA, 11 bp, Homo sapiens
gcccaggcttc

SEQ ID NO: 2691597 - DNA, 15 bp, Homo sapiens
gcccaggcttcctgg

SEQ ID NO: 2691598 - DNA, 20 bp, Homo sapiens
gcccaggcttcctgggtcct

SEQ ID NO: 2691599 - DNA, 22 bp, Homo sapiens
gcccaggcttcctgggtcctgc

SEQ ID NO: 2691600 - DNA, 14 bp, Homo sapiens
gcccatggcctctg

SEQ ID NO: 2691601 - DNA, 20 bp, Homo sapiens
gccccaaacgggctgccctg

SEQ ID NO: 2691602 - DNA, 23 bp, Homo sapiens
gccccaccctcgtggacacctgc

SEQ ID NO: 2691603 - DNA, 14 bp, Homo sapiens
gccccactgacacc

SEQ ID NO: 2691604 - DNA, 22 bp, Homo sapiens
gccccactgacacccagtgtcc

SEQ ID NO: 2691605 - DNA, 14 bp, Homo sapiens
gccccagctctggc

SEQ ID NO: 2691606 - DNA, 20 bp, Homo sapiens
gccccaggatcactctctgc

SEQ ID NO: 2691607 - DNA, 18 bp, Homo sapiens
gccccaggctgagagcca

SEQ ID NO: 2691608 - DNA, 13 bp, Homo sapiens
gccccaggtgcca

SEQ ID NO: 2691609 - DNA, 15 bp, Homo sapiens
gccccaggtgccacc

SEQ ID NO: 2691610 - DNA, 20 bp, Homo sapiens
gccccaggtgccaccaataa

SEQ ID NO: 2691611 - DNA, 20 bp, Homo sapiens
gccccatcattgcacctgca

SEQ ID NO: 2691612 - DNA, 15 bp, Homo sapiens
gccccgcctccccat

SEQ ID NO: 2691613 - DNA, 16 bp, Homo sapiens
gcccctccagcacaca

SEQ ID NO: 2691614 - DNA, 19 bp, Homo sapiens
gcccctccgatgctgaggc

SEQ ID NO: 2691615 - DNA, 20 bp, Homo sapiens
gcccctccgatgctgaggcc

SEQ ID NO: 2691616 - DNA, 12 bp, Homo sapiens
gcccctgcctgc

SEQ ID NO: 2691617 - DNA, 13 bp, Homo sapiens
gcccctgcctgcc

SEQ ID NO: 2691618 - DNA, 23 bp, Homo sapiens
gcccctggtggtcacaggctgtg

SEQ ID NO: 2691619 - DNA, 13 bp, Homo sapiens
gcccgcctgccac

SEQ ID NO: 2691620 - DNA, 21 bp, Homo sapiens
gccctagggaaaacacggccc

SEQ ID NO: 2691621 - DNA, 14 bp, Homo sapiens
gccctccacagccg

SEQ ID NO: 2691622 - DNA, 17 bp, Homo sapiens
gccctccaggcctgcag

SEQ ID NO: 2691623 - DNA, 18 bp, Homo sapiens
gccctccaggcctgcagg

SEQ ID NO: 2691624 - DNA, 20 bp, Homo sapiens
gccctccaggcctgcagggg

SEQ ID NO: 2691625 - DNA, 15 bp, Homo sapiens
gccctcccctgctcc

SEQ ID NO: 2691626 - DNA, 14 bp, Homo sapiens
gccctccccttccc

SEQ ID NO: 2691627 - DNA, 16 bp, Homo sapiens
gccctccgtcgggccc

SEQ ID NO: 2691628 - DNA, 20 bp, Homo sapiens
gccctccgtcgggcccctgc

SEQ ID NO: 2691629 - DNA, 12 bp, Homo sapiens
gccctcctggga

SEQ ID NO: 2691630 - DNA, 13 bp, Homo sapiens
gccctcctgggaa

SEQ ID NO: 2691631 - DNA, 13 bp, Homo sapiens
gccctctgcccca

SEQ ID NO: 2691632 - DNA, 13 bp, Homo sapiens
gccctgccacctg

SEQ ID NO: 2691633 - DNA, 18 bp, Homo sapiens
gccctgccacctgtctgt

SEQ ID NO: 2691634 - DNA, 13 bp, Homo sapiens
gccctgccctgcc

SEQ ID NO: 2691635 - DNA, 18 bp, Homo sapiens
gccctgctctttctctga

SEQ ID NO: 2691636 - DNA, 14 bp, Homo sapiens
gccctggctgtggg

SEQ ID NO: 2691637 - DNA, 17 bp, Homo sapiens
gcccttcctccaggaga

SEQ ID NO: 2691638 - DNA, 13 bp, Homo sapiens
gccgagcctaatg

SEQ ID NO: 2691639 - DNA, 14 bp, Homo sapiens
gccgcgtccctgcc

SEQ ID NO: 2691640 - DNA, 18 bp, Homo sapiens
gcctatgatcccagcact

SEQ ID NO: 2691641 - DNA, 18 bp, Homo sapiens
gcctccagcatcttttcc

SEQ ID NO: 2691642 - DNA, 24 bp, Homo sapiens
gcctccagcatcttttccatcctg

SEQ ID NO: 2691643 - DNA, 16 bp, Homo sapiens
gcctcccagtggcctg

SEQ ID NO: 2691644 - DNA, 19 bp, Homo sapiens
gcctcccagtggcctggct

SEQ ID NO: 2691645 - DNA, 21 bp, Homo sapiens
gcctccccatacttcctggga

SEQ ID NO: 2691646 - DNA, 12 bp, Homo sapiens
gcctccctgcag

SEQ ID NO: 2691647 - DNA, 16 bp, Homo sapiens
gcctccctgcagactc

SEQ ID NO: 2691648 - DNA, 21 bp, Homo sapiens
gcctcccttccatgccccagg

SEQ ID NO: 2691649 - DNA, 14 bp, Homo sapiens
gcctcctgtgtgtc

SEQ ID NO: 2691650 - DNA, 18 bp, Homo sapiens
gcctcctgtgtgtctgca

SEQ ID NO: 2691651 - DNA, 21 bp, Homo sapiens
gcctcctgtgtgtctgcagac

SEQ ID NO: 2691652 - DNA, 16 bp, Homo sapiens
gcctcgtgtcctgcta

SEQ ID NO: 2691653 - DNA, 18 bp, Homo sapiens
gcctcgtgtcctgctagc

SEQ ID NO: 2691654 - DNA, 19 bp, Homo sapiens
gcctcgtgtcctgctagct

SEQ ID NO: 2691655 - DNA, 20 bp, Homo sapiens
gcctcgtgtcctgctagctg

SEQ ID NO: 2691656 - DNA, 18 bp, Homo sapiens
gcctctagaacacccact

SEQ ID NO: 2691657 - DNA, 23 bp, Homo sapiens
gcctctagaacacccactggcca

SEQ ID NO: 2691658 - DNA, 15 bp, Homo sapiens
gcctctggccaggca

SEQ ID NO: 2691659 - DNA, 16 bp, Homo sapiens
gcctcttagtgattgt

SEQ ID NO: 2691660 - DNA, 17 bp, Homo sapiens
gcctcttggacctctgc

SEQ ID NO: 2691661 - DNA, 18 bp, Homo sapiens
gcctcttggacctctgct

SEQ ID NO: 2691662 - DNA, 20 bp, Homo sapiens
gcctcttggacctctgctct

SEQ ID NO: 2691663 - DNA, 23 bp, Homo sapiens
gcctgaagatcagagctgcagcc

SEQ ID NO: 2691664 - DNA, 17 bp, Homo sapiens
gcctgacacaggccagc

SEQ ID NO: 2691665 - DNA, 24 bp, Homo sapiens
gcctgacacaggccagccttggca

SEQ ID NO: 2691666 - DNA, 22 bp, Homo sapiens
gcctgagcaacagagtgagacc

SEQ ID NO: 2691667 - DNA, 15 bp, Homo sapiens
gcctgaggctgagac

SEQ ID NO: 2691668 - DNA, 18 bp, Homo sapiens
gcctgaggctgagactgc

SEQ ID NO: 2691669 - DNA, 13 bp, Homo sapiens
gcctgccacctct

SEQ ID NO: 2691670 - DNA, 19 bp, Homo sapiens
gcctgccacctctcccagc

SEQ ID NO: 2691671 - DNA, 12 bp, Homo sapiens
gcctgccctctg

SEQ ID NO: 2691672 - DNA, 20 bp, Homo sapiens
gcctgccctctgccccatca

SEQ ID NO: 2691673 - DNA, 16 bp, Homo sapiens
gcctgccttgaagcca

SEQ ID NO: 2691674 - DNA, 23 bp, Homo sapiens
gcctgccttgaagccactgaagc

SEQ ID NO: 2691675 - DNA, 20 bp, Homo sapiens
gcctggactgactgcagccc

SEQ ID NO: 2691676 - DNA, 18 bp, Homo sapiens
gcctggcggagatgcttc

SEQ ID NO: 2691677 - DNA, 17 bp, Homo sapiens
gcctggcttctggagcc

SEQ ID NO: 2691678 - DNA, 18 bp, Homo sapiens
gcctggcttctggagccc

SEQ ID NO: 2691679 - DNA, 20 bp, Homo sapiens
gcctggtcctccctcccaag

SEQ ID NO: 2691680 - DNA, 18 bp, Homo sapiens
gccttccccctcccaggg

SEQ ID NO: 2691681 - DNA, 21 bp, Homo sapiens
gccttcgtctccatctctggt

SEQ ID NO: 2691682 - DNA, 14 bp, Homo sapiens
gccttctcccctcc

SEQ ID NO: 2691683 - DNA, 14 bp, Homo sapiens
gccttgaagccact

SEQ ID NO: 2691684 - DNA, 15 bp, Homo sapiens
gccttgaagccactg

SEQ ID NO: 2691685 - DNA, 14 bp, Homo sapiens
gccttgttttattc

SEQ ID NO: 2691686 - DNA, 22 bp, Homo sapiens
gccttgttttattcaaagacag

SEQ ID NO: 2691687 - DNA, 19 bp, Homo sapiens
gcctttccggggctgctgg

SEQ ID NO: 2691688 - DNA, 15 bp, Homo sapiens
gcctttttacagcca

SEQ ID NO: 2691689 - DNA, 15 bp, Homo sapiens
gcgaaggggccctgg

SEQ ID NO: 2691690 - DNA, 23 bp, Homo sapiens
gcgacagagcgagagtctgtctc

SEQ ID NO: 2691691 - DNA, 21 bp, Homo sapiens
gcgaggcctgacacaggccag

SEQ ID NO: 2691692 - DNA, 19 bp, Homo sapiens
gcgatgaatttggagactc

SEQ ID NO: 2691693 - DNA, 12 bp, Homo sapiens
gcgcacctgccc

SEQ ID NO: 2691694 - DNA, 19 bp, Homo sapiens
gcgcacctgccccctggtg

SEQ ID NO: 2691695 - DNA, 16 bp, Homo sapiens
gcgcagagccctccag

SEQ ID NO: 2691696 - DNA, 24 bp, Homo sapiens
gcgcagagccctccaggcctgcag

SEQ ID NO: 2691697 - DNA, 21 bp, Homo sapiens
gcgccactacactccagcctg

SEQ ID NO: 2691698 - DNA, 24 bp, Homo sapiens
gcgccactacactccagcctgagc

SEQ ID NO: 2691699 - DNA, 22 bp, Homo sapiens
gcgcccctggtggtcacaggct

SEQ ID NO: 2691700 - DNA, 13 bp, Homo sapiens
gcgctgccctgtg

SEQ ID NO: 2691701 - DNA, 15 bp, Homo sapiens
gcgctgccctgtgag

SEQ ID NO: 2691702 - DNA, 22 bp, Homo sapiens
gcgctgccctgtgagagccacg

SEQ ID NO: 2691703 - DNA, 19 bp, Homo sapiens
gcggagcttgcagtgagcc

SEQ ID NO: 2691704 - DNA, 19 bp, Homo sapiens
gcggcgcagagccctccag

SEQ ID NO: 2691705 - DNA, 16 bp, Homo sapiens
gcggcgtgggcgaggc

SEQ ID NO: 2691706 - DNA, 15 bp, Homo sapiens
gcgggatggtcctgg

SEQ ID NO: 2691707 - DNA, 13 bp, Homo sapiens
ctctctgctggca

SEQ ID NO: 2691708 - DNA, 22 bp, Homo sapiens
ctctctgggcctgggttccagg

SEQ ID NO: 2691709 - DNA, 14 bp, Homo sapiens
ctctgaaatttccc

SEQ ID NO: 2691710 - DNA, 14 bp, Homo sapiens
ctctgagaaccaaa

SEQ ID NO: 2691711 - DNA, 22 bp, Homo sapiens
ctctgagaaccaaaagatgcct

SEQ ID NO: 2691712 - DNA, 20 bp, Homo sapiens
ctctgaggctctttctgggc

SEQ ID NO: 2691713 - DNA, 18 bp, Homo sapiens
ctctgaggcttccagaga

SEQ ID NO: 2691714 - DNA, 19 bp, Homo sapiens
ctctgaggcttccagagag

SEQ ID NO: 2691715 - DNA, 16 bp, Homo sapiens
ctctgatacttttttg

SEQ ID NO: 2691716 - DNA, 21 bp, Homo sapiens
ctctgccccagctctggcttc

SEQ ID NO: 2691717 - DNA, 11 bp, Homo sapiens
ctctgccctgg

SEQ ID NO: 2691718 - DNA, 16 bp, Homo sapiens
ctctgccctggctgtg

SEQ ID NO: 2691719 - DNA, 12 bp, Homo sapiens
ctctgcctcctc

SEQ ID NO: 2691720 - DNA, 15 bp, Homo sapiens
ctctgcctcctcctc

SEQ ID NO: 2691721 - DNA, 15 bp, Homo sapiens
ctctgctctgaggct

SEQ ID NO: 2691722 - DNA, 23 bp, Homo sapiens
ctctgctggcaggattcttcccg

SEQ ID NO: 2691723 - DNA, 13 bp, Homo sapiens
ctctgcttcctca

SEQ ID NO: 2691724 - DNA, 18 bp, Homo sapiens
ctctgcttttgcacacct

SEQ ID NO: 2691725 - DNA, 13 bp, Homo sapiens
ctctggatggcac

SEQ ID NO: 2691726 - DNA, 19 bp, Homo sapiens
ctctggatggcaccagagg

SEQ ID NO: 2691727 - DNA, 20 bp, Homo sapiens
ctctggatggcaccagaggc

SEQ ID NO: 2691728 - DNA, 14 bp, Homo sapiens
ctctggtttctgtg

SEQ ID NO: 2691729 - DNA, 13 bp, Homo sapiens
ctcttaatgttgc

SEQ ID NO: 2691730 - DNA, 18 bp, Homo sapiens
ctcttagctttctcaggg

SEQ ID NO: 2691731 - DNA, 13 bp, Homo sapiens
ctcttcctctggt

SEQ ID NO: 2691732 - DNA, 22 bp, Homo sapiens
ctcttcctctggtttctgtgtg

SEQ ID NO: 2691733 - DNA, 12 bp, Homo sapiens
ctcttcctgtct

SEQ ID NO: 2691734 - DNA, 16 bp, Homo sapiens
ctcttctcagtgtctg

SEQ ID NO: 2691735 - DNA, 16 bp, Homo sapiens
ctcttctcttcctgta

SEQ ID NO: 2691736 - DNA, 12 bp, Homo sapiens
ctcttggacctc

SEQ ID NO: 2691737 - DNA, 20 bp, Homo sapiens
ctcttggacctctgctctga

SEQ ID NO: 2691738 - DNA, 12 bp, Homo sapiens
ctcttgtagaag

SEQ ID NO: 2691739 - DNA, 18 bp, Homo sapiens
ctcttgttccgtgccagg

SEQ ID NO: 2691740 - DNA, 17 bp, Homo sapiens
ctctttaacttgtaata

SEQ ID NO: 2691741 - DNA, 13 bp, Homo sapiens
ctctttctctgag

SEQ ID NO: 2691742 - DNA, 14 bp, Homo sapiens
ctctttctctgaga

SEQ ID NO: 2691743 - DNA, 12 bp, Homo sapiens
ctctttctgggc

SEQ ID NO: 2691744 - DNA, 18 bp, Homo sapiens
ctctttgctacaataaat

SEQ ID NO: 2691745 - DNA, 19 bp, Homo sapiens
ctctttgctgacactgtga

SEQ ID NO: 2691746 - DNA, 21 bp, Homo sapiens
ctgaaacattcacacagggct

SEQ ID NO: 2691747 - DNA, 16 bp, Homo sapiens
ctgaaagccagcaaag

SEQ ID NO: 2691748 - DNA, 20 bp, Homo sapiens
ctgaaagccagcaaagcctc

SEQ ID NO: 2691749 - DNA, 22 bp, Homo sapiens
ctgaaagccagcaaagcctcca

SEQ ID NO: 2691750 - DNA, 23 bp, Homo sapiens
ctgaaagccagcaaagcctccag

SEQ ID NO: 2691751 - DNA, 13 bp, Homo sapiens
ctgaaagctgttg

SEQ ID NO: 2691752 - DNA, 14 bp, Homo sapiens
ctgaaagctgttgg

SEQ ID NO: 2691753 - DNA, 16 bp, Homo sapiens
ctgaacaatctccaaa

SEQ ID NO: 2691754 - DNA, 23 bp, Homo sapiens
ctgacacaggccagccttggcac

SEQ ID NO: 2691755 - DNA, 17 bp, Homo sapiens
ctgaccaaaatgtgttt

SEQ ID NO: 2691756 - DNA, 21 bp, Homo sapiens
ctgacccaactgatcctgctc

SEQ ID NO: 2691757 - DNA, 14 bp, Homo sapiens
ctgactcacaagaa

SEQ ID NO: 2691758 - DNA, 21 bp, Homo sapiens
ctgactcacaagaagaccaga

SEQ ID NO: 2691759 - DNA, 16 bp, Homo sapiens
ctgactctctgtgacc

SEQ ID NO: 2691760 - DNA, 18 bp, Homo sapiens
ctgactctctgtgacctg

SEQ ID NO: 2691761 - DNA, 20 bp, Homo sapiens
ctgagaaccaaaagatgcct

SEQ ID NO: 2691762 - DNA, 23 bp, Homo sapiens
ctgagaaccaaaagatgccttga

SEQ ID NO: 2691763 - DNA, 15 bp, Homo sapiens
ctgagaagcgctgcc

SEQ ID NO: 2691764 - DNA, 22 bp, Homo sapiens
ctgagaagcgctgccctgtgag

SEQ ID NO: 2691765 - DNA, 16 bp, Homo sapiens
ctgagaagtgtatata

SEQ ID NO: 2691766 - DNA, 14 bp, Homo sapiens
ctgagactgcggga

SEQ ID NO: 2691767 - DNA, 17 bp, Homo sapiens
ctgagagcacagcgttt

SEQ ID NO: 2691768 - DNA, 16 bp, Homo sapiens
ctgagccagaaacgca

SEQ ID NO: 2691769 - DNA, 12 bp, Homo sapiens
ctgagccctggc

SEQ ID NO: 2691770 - DNA, 18 bp, Homo sapiens
ctgagcggcgcagagccc

SEQ ID NO: 2691771 - DNA, 22 bp, Homo sapiens
ctgagcggcgcagagccctcca

SEQ ID NO: 2691772 - DNA, 10 bp, Homo sapiens
ctgagcttta

SEQ ID NO: 2691773 - DNA, 19 bp, Homo sapiens
ctgagcttttcatggaagt

SEQ ID NO: 2691774 - DNA, 20 bp, Homo sapiens
ctgaggactccctccatgtg

SEQ ID NO: 2691775 - DNA, 17 bp, Homo sapiens
ctgaggatacagctctt

SEQ ID NO: 2691776 - DNA, 21 bp, Homo sapiens
ctgaggatacagctcttctca

SEQ ID NO: 2691777 - DNA, 21 bp, Homo sapiens
ctgaggcaggtgagaacccag

SEQ ID NO: 2691778 - DNA, 17 bp, Homo sapiens
ctgaggccacccactga

SEQ ID NO: 2691779 - DNA, 16 bp, Homo sapiens
ctgaggctctttctgg

SEQ ID NO: 2691780 - DNA, 15 bp, Homo sapiens
ctgaggctgagactg

SEQ ID NO: 2691781 - DNA, 18 bp, Homo sapiens
ctgaggcttccagagagt

SEQ ID NO: 2691782 - DNA, 13 bp, Homo sapiens
ctgagggctcctc

SEQ ID NO: 2691783 - DNA, 18 bp, Homo sapiens
ctgagggctcctccatgg

SEQ ID NO: 2691784 - DNA, 22 bp, Homo sapiens
ctgagtcacccatgaagacagg

SEQ ID NO: 2691785 - DNA, 13 bp, Homo sapiens
ctgatatgtttgt

SEQ ID NO: 2691786 - DNA, 18 bp, Homo sapiens
ctgatcctgctccagcag

SEQ ID NO: 2691787 - DNA, 22 bp, Homo sapiens
ctgatcctgctccagcagcaca

SEQ ID NO: 2691788 - DNA, 22 bp, Homo sapiens
ctgatgatgtctcttgtagaag

SEQ ID NO: 2691789 - DNA, 15 bp, Homo sapiens
ctgatgccaaagctg

SEQ ID NO: 2691790 - DNA, 22 bp, Homo sapiens
ctgatgccaaagctgctttctt

SEQ ID NO: 2691791 - DNA, 17 bp, Homo sapiens
ctgatggcccctccagc

SEQ ID NO: 2691792 - DNA, 18 bp, Homo sapiens
ctgatggcccctccagca

SEQ ID NO: 2691793 - DNA, 19 bp, Homo sapiens
ctgatggcccctccagcac

SEQ ID NO: 2691794 - DNA, 16 bp, Homo sapiens
ctgattcactggcctg

SEQ ID NO: 2691795 - DNA, 19 bp, Homo sapiens
ctgcaaaggacagtgggca

SEQ ID NO: 2691796 - DNA, 17 bp, Homo sapiens
ctgcacctgccagcctg

SEQ ID NO: 2691797 - DNA, 18 bp, Homo sapiens
ctgcacctgccagcctgg

SEQ ID NO: 2691798 - DNA, 14 bp, Homo sapiens
ctgcactccagcct

SEQ ID NO: 2691799 - DNA, 18 bp, Homo sapiens
ctgcactccagcctgggc

SEQ ID NO: 2691800 - DNA, 19 bp, Homo sapiens
ctgcactccagcctgggcg

SEQ ID NO: 2691801 - DNA, 15 bp, Homo sapiens
ctgcagaaggccaag

SEQ ID NO: 2691802 - DNA, 16 bp, Homo sapiens
ctgcagaaggccaaga

SEQ ID NO: 2691803 - DNA, 18 bp, Homo sapiens
ctgcagacaagtcttgct

SEQ ID NO: 2691804 - DNA, 19 bp, Homo sapiens
ctgcagacaagtcttgctg

SEQ ID NO: 2691805 - DNA, 23 bp, Homo sapiens
ctgcagacaagtcttgctgtgct

SEQ ID NO: 2691806 - DNA, 11 bp, Homo sapiens
ctgcagactcc

SEQ ID NO: 2691807 - DNA, 18 bp, Homo sapiens
ctgcagcctcccttccat

SEQ ID NO: 2691808 - DNA, 22 bp, Homo sapiens
ctgcagcctcccttccatgccc

SEQ ID NO: 2691809 - DNA, 15 bp, Homo sapiens
ctgcaggccaagagc

SEQ ID NO: 2691810 - DNA, 22 bp, Homo sapiens
ctgcaggccaagagcagaggca

SEQ ID NO: 2691811 - DNA, 23 bp, Homo sapiens
ctgcaggccaagagcagaggcag

SEQ ID NO: 2691812 - DNA, 11 bp, Homo sapiens
ctgcaggctcc

SEQ ID NO: 2691813 - DNA, 16 bp, Homo sapiens
ctgcaggctccatgca

SEQ ID NO: 2691814 - DNA, 17 bp, Homo sapiens
ctgcaggctccatgcac

SEQ ID NO: 2691815 - DNA, 18 bp, Homo sapiens
ctgcaggtgagcaggcag

SEQ ID NO: 2691816 - DNA, 16 bp, Homo sapiens
ctgcattgagtccagc

SEQ ID NO: 2691817 - DNA, 19 bp, Homo sapiens
ctgcattgttattgtggaa

SEQ ID NO: 2691818 - DNA, 12 bp, Homo sapiens
ctattttctgac

SEQ ID NO: 2691819 - DNA, 23 bp, Homo sapiens
ctattttctgaccaaaatgtgtt

SEQ ID NO: 2691820 - DNA, 17 bp, Homo sapiens
ctcaaatgacccaaaga

SEQ ID NO: 2691821 - DNA, 18 bp, Homo sapiens
ctcaaattgtaattaata

SEQ ID NO: 2691822 - DNA, 22 bp, Homo sapiens
ctcaacctaccaccccttcctg

SEQ ID NO: 2691823 - DNA, 17 bp, Homo sapiens
ctcaatattcaataaag

SEQ ID NO: 2691824 - DNA, 18 bp, Homo sapiens
ctcaatattcaataaagc

SEQ ID NO: 2691825 - DNA, 15 bp, Homo sapiens
ctcacaagaagacca

SEQ ID NO: 2691826 - DNA, 17 bp, Homo sapiens
ctcacaagaagaccaga

SEQ ID NO: 2691827 - DNA, 22 bp, Homo sapiens
ctcacacagcaggaactgagcc

SEQ ID NO: 2691828 - DNA, 16 bp, Homo sapiens
ctcaccagaattattt

SEQ ID NO: 2691829 - DNA, 18 bp, Homo sapiens
ctcacgcaactcacacct

SEQ ID NO: 2691830 - DNA, 15 bp, Homo sapiens
ctcactctgggtgcc

SEQ ID NO: 2691831 - DNA, 19 bp, Homo sapiens
ctcacttctgtctcctgtc

SEQ ID NO: 2691832 - DNA, 19 bp, Homo sapiens
ctcagagcagggccaaagc

SEQ ID NO: 2691833 - DNA, 16 bp, Homo sapiens
ctcagcattgtcagcc

SEQ ID NO: 2691834 - DNA, 22 bp, Homo sapiens
ctcagcattgtcagcctgaaga

SEQ ID NO: 2691835 - DNA, 11 bp, Homo sapiens
ctcagcccagc

SEQ ID NO: 2691836 - DNA, 16 bp, Homo sapiens
ctcagcccagctggcc

SEQ ID NO: 2691837 - DNA, 23 bp, Homo sapiens
ctcagcccagctggccacctaga

SEQ ID NO: 2691838 - DNA, 14 bp, Homo sapiens
ctcagccccactga

SEQ ID NO: 2691839 - DNA, 16 bp, Homo sapiens
ctcaggaggctgaggg

SEQ ID NO: 2691840 - DNA, 19 bp, Homo sapiens
ctcaggccaacaagccaac

SEQ ID NO: 2691841 - DNA, 16 bp, Homo sapiens
ctcagggcccagcagg

SEQ ID NO: 2691842 - DNA, 16 bp, Homo sapiens
ctcagtctcaggagca

SEQ ID NO: 2691843 - DNA, 20 bp, Homo sapiens
ctcattttaatgattgttta

SEQ ID NO: 2691844 - DNA, 15 bp, Homo sapiens
ctccacagccgcagc

SEQ ID NO: 2691845 - DNA, 13 bp, Homo sapiens
ctccacctgtgct

SEQ ID NO: 2691846 - DNA, 14 bp, Homo sapiens
ctccacctgtgctt

SEQ ID NO: 2691847 - DNA, 19 bp, Homo sapiens
ctccacgcaaggctgtgct

SEQ ID NO: 2691848 - DNA, 14 bp, Homo sapiens
ctccagcatctttt

SEQ ID NO: 2691849 - DNA, 17 bp, Homo sapiens
ctccagcatcttttcca

SEQ ID NO: 2691850 - DNA, 22 bp, Homo sapiens
ctccagcatcttttccatcctg

SEQ ID NO: 2691851 - DNA, 14 bp, Homo sapiens
ctccagcctgagca

SEQ ID NO: 2691852 - DNA, 22 bp, Homo sapiens
ctccaggagaaggggcccaagg

SEQ ID NO: 2691853 - DNA, 14 bp, Homo sapiens
ctccaggcctgcag

SEQ ID NO: 2691854 - DNA, 19 bp, Homo sapiens
ctccagtggttgctgttga

SEQ ID NO: 2691855 - DNA, 13 bp, Homo sapiens
ctccatctctggt

SEQ ID NO: 2691856 - DNA, 14 bp, Homo sapiens
ctccatctctggtt

SEQ ID NO: 2691857 - DNA, 20 bp, Homo sapiens
ctccatgcacctcccttccc

SEQ ID NO: 2691858 - DNA, 21 bp, Homo sapiens
ctccatgcacctcccttccct

SEQ ID NO: 2691859 - DNA, 17 bp, Homo sapiens
ctccatttctctccagg

SEQ ID NO: 2691860 - DNA, 22 bp, Homo sapiens
ctcccaaggagccattctgtgt

SEQ ID NO: 2691861 - DNA, 17 bp, Homo sapiens
ctcccaggaaccaaaaa

SEQ ID NO: 2691862 - DNA, 22 bp, Homo sapiens
ctcccagggccagggccctgca

SEQ ID NO: 2691863 - DNA, 23 bp, Homo sapiens
ctcccagggccagggccctgcag

SEQ ID NO: 2691864 - DNA, 18 bp, Homo sapiens
ctcccagtggcctggctt

SEQ ID NO: 2691865 - DNA, 20 bp, Homo sapiens
ctcccagtggcctggcttgt

SEQ ID NO: 2691866 - DNA, 20 bp, Homo sapiens
ctcccagtgggagcttcccg

SEQ ID NO: 2691867 - DNA, 21 bp, Homo sapiens
ctccccaccttcaattcctgg

SEQ ID NO: 2691868 - DNA, 21 bp, Homo sapiens
ctccccattagagtcagcctt

SEQ ID NO: 2691869 - DNA, 22 bp, Homo sapiens
ctcccctccacgcaaggctgtg

SEQ ID NO: 2691870 - DNA, 12 bp, Homo sapiens
ctcccctgctcc

SEQ ID NO: 2691871 - DNA, 18 bp, Homo sapiens
ctcccgcttgctctcctg

SEQ ID NO: 2691872 - DNA, 15 bp, Homo sapiens
ctcccggcatcctga

SEQ ID NO: 2691873 - DNA, 17 bp, Homo sapiens
ctcccggcatcctgaaa

SEQ ID NO: 2691874 - DNA, 17 bp, Homo sapiens
ctccctcccaaggagcc

SEQ ID NO: 2691875 - DNA, 13 bp, Homo sapiens
ctccctctgacct

SEQ ID NO: 2691876 - DNA, 11 bp, Homo sapiens
ctccctgatta

SEQ ID NO: 2691877 - DNA, 18 bp, Homo sapiens
ctccctgctcccagggac

SEQ ID NO: 2691878 - DNA, 21 bp, Homo sapiens
ctcccttccatgccccaggat

SEQ ID NO: 2691879 - DNA, 18 bp, Homo sapiens
ctcccttccctccctgag

SEQ ID NO: 2691880 - DNA, 15 bp, Homo sapiens
ctccgatgctgaggc

SEQ ID NO: 2691881 - DNA, 19 bp, Homo sapiens
ctccgccttcactccggtg

SEQ ID NO: 2691882 - DNA, 23 bp, Homo sapiens
ctccggggaggcaggggtcctgc

SEQ ID NO: 2691883 - DNA, 18 bp, Homo sapiens
ctccggtgtgcctgcagc

SEQ ID NO: 2691884 - DNA, 23 bp, Homo sapiens
ctccggtgtgcctgcagccccgc

SEQ ID NO: 2691885 - DNA, 16 bp, Homo sapiens
ctccgtcgggcccctg

SEQ ID NO: 2691886 - DNA, 16 bp, Homo sapiens
ctcctacctcagccta

SEQ ID NO: 2691887 - DNA, 14 bp, Homo sapiens
ctcctccatggtgc

SEQ ID NO: 2691888 - DNA, 11 bp, Homo sapiens
ctcctgaccaa

SEQ ID NO: 2691889 - DNA, 13 bp, Homo sapiens
ctcctgctctgct

SEQ ID NO: 2691890 - DNA, 14 bp, Homo sapiens
ctcctgctctgctt

SEQ ID NO: 2691891 - DNA, 16 bp, Homo sapiens
ctcctgctctgcttcc

SEQ ID NO: 2691892 - DNA, 19 bp, Homo sapiens
ctcctggaaaggctcagtc

SEQ ID NO: 2691893 - DNA, 20 bp, Homo sapiens
ctcctggaaaggctcagtct

SEQ ID NO: 2691894 - DNA, 23 bp, Homo sapiens
ctcctggaaaggctcagtctcag

SEQ ID NO: 2691895 - DNA, 22 bp, Homo sapiens
ctcctggagcaagctctgccct

SEQ ID NO: 2691896 - DNA, 13 bp, Homo sapiens
ctcctgtgtgtct

SEQ ID NO: 2691897 - DNA, 14 bp, Homo sapiens
ctcctgtgtgtctg

SEQ ID NO: 2691898 - DNA, 15 bp, Homo sapiens
ctcctgtgtgtctgc

SEQ ID NO: 2691899 - DNA, 16 bp, Homo sapiens
ctccttattttgtatt

SEQ ID NO: 2691900 - DNA, 22 bp, Homo sapiens
ctccttccttgctgtcctaggc

SEQ ID NO: 2691901 - DNA, 17 bp, Homo sapiens
ctcggcagtgtgcagtg

SEQ ID NO: 2691902 - DNA, 16 bp, Homo sapiens
ctcgtggacacctgcc

SEQ ID NO: 2691903 - DNA, 17 bp, Homo sapiens
ctcgtggacacctgccc

SEQ ID NO: 2691904 - DNA, 20 bp, Homo sapiens
ctcgtggacacctgccctgc

SEQ ID NO: 2691905 - DNA, 13 bp, Homo sapiens
ctcgtgtcctgct

SEQ ID NO: 2691906 - DNA, 16 bp, Homo sapiens
ctcgtgtcctgctagc

SEQ ID NO: 2691907 - DNA, 19 bp, Homo sapiens
ctctactcctacctcagcc

SEQ ID NO: 2691908 - DNA, 21 bp, Homo sapiens
ctctactgccctccccttccc

SEQ ID NO: 2691909 - DNA, 15 bp, Homo sapiens
ctctagaacacccac

SEQ ID NO: 2691910 - DNA, 17 bp, Homo sapiens
ctctagaacacccactg

SEQ ID NO: 2691911 - DNA, 18 bp, Homo sapiens
cctgccttctcccctcca

SEQ ID NO: 2691912 - DNA, 20 bp, Homo sapiens
cctgccttctcccctccacg

SEQ ID NO: 2691913 - DNA, 13 bp, Homo sapiens
cctgccttgaagc

SEQ ID NO: 2691914 - DNA, 17 bp, Homo sapiens
cctgccttgaagccact

SEQ ID NO: 2691915 - DNA, 13 bp, Homo sapiens
cctgctccagcag

SEQ ID NO: 2691916 - DNA, 13 bp, Homo sapiens
cctaccacccctt

SEQ ID NO: 2691917 - DNA, 17 bp, Homo sapiens
cctaccaccccttcctg

SEQ ID NO: 2691918 - DNA, 12 bp, Homo sapiens
cctacccactct

SEQ ID NO: 2691919 - DNA, 20 bp, Homo sapiens
cctacccactctttgctaca

SEQ ID NO: 2691920 - DNA, 13 bp, Homo sapiens
cctacctcagcct

SEQ ID NO: 2691921 - DNA, 15 bp, Homo sapiens
cctagaactgtgcct

SEQ ID NO: 2691922 - DNA, 16 bp, Homo sapiens
cctagaagtctccctg

SEQ ID NO: 2691923 - DNA, 20 bp, Homo sapiens
cctagaagtctccctgcaca

SEQ ID NO: 2691924 - DNA, 15 bp, Homo sapiens
cctagagctcctgtc

SEQ ID NO: 2691925 - DNA, 18 bp, Homo sapiens
cctagagctcctgtccct

SEQ ID NO: 2691926 - DNA, 19 bp, Homo sapiens
cctagagctcctgtcccta

SEQ ID NO: 2691927 - DNA, 20 bp, Homo sapiens
cctagagctcctgtccctac

SEQ ID NO: 2691928 - DNA, 21 bp, Homo sapiens
cctagagctcctgtccctacc

SEQ ID NO: 2691929 - DNA, 15 bp, Homo sapiens
cctaggactgactcg

SEQ ID NO: 2691930 - DNA, 23 bp, Homo sapiens
cctaggccacaccatctcctttc

SEQ ID NO: 2691931 - DNA, 21 bp, Homo sapiens
cctagggaaaacacggccctc

SEQ ID NO: 2691932 - DNA, 18 bp, Homo sapiens
cctatagtcccagctact

SEQ ID NO: 2691933 - DNA, 13 bp, Homo sapiens
cctatgatcccag

SEQ ID NO: 2691934 - DNA, 14 bp, Homo sapiens
cctatgatcccagc

SEQ ID NO: 2691935 - DNA, 20 bp, Homo sapiens
cctcacgcaactcacacctc

SEQ ID NO: 2691936 - DNA, 22 bp, Homo sapiens
cctcagcattgtcagcctgaag

SEQ ID NO: 2691937 - DNA, 14 bp, Homo sapiens
cctcagccccactg

SEQ ID NO: 2691938 - DNA, 16 bp, Homo sapiens
cctcaggcttccttgg

SEQ ID NO: 2691939 - DNA, 14 bp, Homo sapiens
cctcagggcccagc

SEQ ID NO: 2691940 - DNA, 18 bp, Homo sapiens
cctcagggcccagcaggc

SEQ ID NO: 2691941 - DNA, 19 bp, Homo sapiens
cctccaggagaaggggccc

SEQ ID NO: 2691942 - DNA, 20 bp, Homo sapiens
cctccaggagaaggggccca

SEQ ID NO: 2691943 - DNA, 14 bp, Homo sapiens
cctccaggcctgca

SEQ ID NO: 2691944 - DNA, 15 bp, Homo sapiens
cctccatggcctggc

SEQ ID NO: 2691945 - DNA, 14 bp, Homo sapiens
cctccatggtgctg

SEQ ID NO: 2691946 - DNA, 22 bp, Homo sapiens
cctccatgtggccccaggtgcc

SEQ ID NO: 2691947 - DNA, 20 bp, Homo sapiens
cctccatttctctccaggaa

SEQ ID NO: 2691948 - DNA, 14 bp, Homo sapiens
cctcccaggaacca

SEQ ID NO: 2691949 - DNA, 14 bp, Homo sapiens
cctcccagggccag

SEQ ID NO: 2691950 - DNA, 21 bp, Homo sapiens
cctcccagggccagggccctg

SEQ ID NO: 2691951 - DNA, 18 bp, Homo sapiens
cctcccagtggcctggct

SEQ ID NO: 2691952 - DNA, 13 bp, Homo sapiens
cctccccaagact

SEQ ID NO: 2691953 - DNA, 15 bp, Homo sapiens
cctcccccagagggg

SEQ ID NO: 2691954 - DNA, 13 bp, Homo sapiens
cctcccctgctcc

SEQ ID NO: 2691955 - DNA, 18 bp, Homo sapiens
cctcccctgctcccaggt

SEQ ID NO: 2691956 - DNA, 19 bp, Homo sapiens
cctccctctgacctgcagg

SEQ ID NO: 2691957 - DNA, 22 bp, Homo sapiens
cctcccttccatgccccaggat

SEQ ID NO: 2691958 - DNA, 18 bp, Homo sapiens
cctccctttctctctcca

SEQ ID NO: 2691959 - DNA, 18 bp, Homo sapiens
cctccgatgctgaggcca

SEQ ID NO: 2691960 - DNA, 20 bp, Homo sapiens
cctccgatgctgaggccacc

SEQ ID NO: 2691961 - DNA, 22 bp, Homo sapiens
cctccgatgctgaggccaccca

SEQ ID NO: 2691962 - DNA, 16 bp, Homo sapiens
cctccgtcgggcccct

SEQ ID NO: 2691963 - DNA, 18 bp, Homo sapiens
cctccgtcgggcccctgc

SEQ ID NO: 2691964 - DNA, 17 bp, Homo sapiens
cctcctccccaggtgga

SEQ ID NO: 2691965 - DNA, 13 bp, Homo sapiens
cctcctgctctgc

SEQ ID NO: 2691966 - DNA, 14 bp, Homo sapiens
cctcctgctctgct

SEQ ID NO: 2691967 - DNA, 19 bp, Homo sapiens
cctcctgctctgcttcctc

SEQ ID NO: 2691968 - DNA, 23 bp, Homo sapiens
cctcctgggaacctccttacctg

SEQ ID NO: 2691969 - DNA, 12 bp, Homo sapiens
cctcctgtgtgt

SEQ ID NO: 2691970 - DNA, 13 bp, Homo sapiens
cctccttacctgg

SEQ ID NO: 2691971 - DNA, 16 bp, Homo sapiens
cctccttacctggagt

SEQ ID NO: 2691972 - DNA, 13 bp, Homo sapiens
cctccttgcctgg

SEQ ID NO: 2691973 - DNA, 14 bp, Homo sapiens
cctccttgcctgga

SEQ ID NO: 2691974 - DNA, 21 bp, Homo sapiens
cctcctttcttattctgtgag

SEQ ID NO: 2691975 - DNA, 17 bp, Homo sapiens
cctccttttcttctagc

SEQ ID NO: 2691976 - DNA, 15 bp, Homo sapiens
cctcgtggacacctg

SEQ ID NO: 2691977 - DNA, 21 bp, Homo sapiens
cctcgtggacacctgccctgc

SEQ ID NO: 2691978 - DNA, 19 bp, Homo sapiens
cctcgtgtcctgctagctg

SEQ ID NO: 2691979 - DNA, 15 bp, Homo sapiens
cctctagaacaccca

SEQ ID NO: 2691980 - DNA, 24 bp, Homo sapiens
cctctagaacacccactggccagt

SEQ ID NO: 2691981 - DNA, 13 bp, Homo sapiens
cctctagtgccct

SEQ ID NO: 2691982 - DNA, 15 bp, Homo sapiens
cctctagtgccctcc

SEQ ID NO: 2691983 - DNA, 20 bp, Homo sapiens
cctctcaatattcaataaag

SEQ ID NO: 2691984 - DNA, 16 bp, Homo sapiens
cctctcccagccctca

SEQ ID NO: 2691985 - DNA, 17 bp, Homo sapiens
cctctcggaaggctggc

SEQ ID NO: 2691986 - DNA, 21 bp, Homo sapiens
cctctcggaaggctggctggg

SEQ ID NO: 2691987 - DNA, 16 bp, Homo sapiens
cctctctgttgccttt

SEQ ID NO: 2691988 - DNA, 15 bp, Homo sapiens
cctctgacctgcagg

SEQ ID NO: 2691989 - DNA, 20 bp, Homo sapiens
cctctgctctgaggcttcca

SEQ ID NO: 2691990 - DNA, 22 bp, Homo sapiens
cctctgctctgaggcttccaga

SEQ ID NO: 2691991 - DNA, 21 bp, Homo sapiens
cctctggatggcaccagaggc

SEQ ID NO: 2691992 - DNA, 17 bp, Homo sapiens
cctctggtttctgtgtg

SEQ ID NO: 2691993 - DNA, 12 bp, Homo sapiens
cctcttctcttc

SEQ ID NO: 2691994 - DNA, 14 bp, Homo sapiens
cctcttctcttcct

SEQ ID NO: 2691995 - DNA, 14 bp, Homo sapiens
cctcttgcatttca

SEQ ID NO: 2691996 - DNA, 15 bp, Homo sapiens
cctcttggacctctg

SEQ ID NO: 2691997 - DNA, 12 bp, Homo sapiens
cctgaaagctgt

SEQ ID NO: 2691998 - DNA, 22 bp, Homo sapiens
cctgaagatcagagctgcagcc

SEQ ID NO: 2691999 - DNA, 18 bp, Homo sapiens
cctgacacaggccagcct

SEQ ID NO: 2692000 - DNA, 21 bp, Homo sapiens
cctgacacaggccagccttgg

SEQ ID NO: 2692001 - DNA, 19 bp, Homo sapiens
cctgacacgtgatggacca

SEQ ID NO: 2692002 - DNA, 23 bp, Homo sapiens
cctgacacgtgatggaccaaagc

SEQ ID NO: 2692003 - DNA, 22 bp, Homo sapiens
cctgaggcaggtgagaacccag

SEQ ID NO: 2692004 - DNA, 14 bp, Homo sapiens
cctgaggctgagac

SEQ ID NO: 2692005 - DNA, 15 bp, Homo sapiens
cctgagggctcctcc

SEQ ID NO: 2692006 - DNA, 20 bp, Homo sapiens
cctgagggctcctccatggt

SEQ ID NO: 2692007 - DNA, 15 bp, Homo sapiens
cctgaggtgcctccc

SEQ ID NO: 2692008 - DNA, 17 bp, Homo sapiens
cctgaggtgcctcccag

SEQ ID NO: 2692009 - DNA, 19 bp, Homo sapiens
cctgaggtgcctcccagtg

SEQ ID NO: 2692010 - DNA, 22 bp, Homo sapiens
cctgaggtgcctcccagtggcc

SEQ ID NO: 2692011 - DNA, 23 bp, Homo sapiens
cctgaggtgcctcccagtggcct

SEQ ID NO: 2692012 - DNA, 16 bp, Homo sapiens
cctgattcactggcct

SEQ ID NO: 2692013 - DNA, 22 bp, Homo sapiens
cctgcagactccaatggggcca

SEQ ID NO: 2692014 - DNA, 20 bp, Homo sapiens
cctgcaggctccatgcacct

SEQ ID NO: 2692015 - DNA, 14 bp, Homo sapiens
cctgcaggtgagca

SEQ ID NO: 2692016 - DNA, 19 bp, Homo sapiens
cctgccaccagtcactgtc

SEQ ID NO: 2692017 - DNA, 14 bp, Homo sapiens
cctgccacctgtct

SEQ ID NO: 2692018 - DNA, 16 bp, Homo sapiens
cctgccacctgtctgt

SEQ ID NO: 2692019 - DNA, 14 bp, Homo sapiens
cctgccagcctggc

SEQ ID NO: 2692020 - DNA, 19 bp, Homo sapiens
cctgccagttgaaaatgga

SEQ ID NO: 2692021 - DNA, 14 bp, Homo sapiens
cctgccccctggtg

SEQ ID NO: 2692022 - DNA, 16 bp, Homo sapiens
cctgccccctggtgga

SEQ ID NO: 2692023 - DNA, 16 bp, Homo sapiens
cctgccccgcccagct

SEQ ID NO: 2692024 - DNA, 22 bp, Homo sapiens
cctgccccgcccagctgcacct

SEQ ID NO: 2692025 - DNA, 15 bp, Homo sapiens
cctgccctctgcccc

SEQ ID NO: 2692026 - DNA, 13 bp, Homo sapiens
cctgcctgccttc

SEQ ID NO: 2692027 - DNA, 19 bp, Homo sapiens
ccccaggtgccaccaataa

SEQ ID NO: 2692028 - DNA, 20 bp, Homo sapiens
ccccaggtgccaccaataaa

SEQ ID NO: 2692029 - DNA, 22 bp, Homo sapiens
ccccaggtgccaccaataaaaa

SEQ ID NO: 2692030 - DNA, 20 bp, Homo sapiens
ccccatcattgcacctgcag

SEQ ID NO: 2692031 - DNA, 17 bp, Homo sapiens
ccccattagagtcagcc

SEQ ID NO: 2692032 - DNA, 17 bp, Homo sapiens
cccccgtggggctcccg

SEQ ID NO: 2692033 - DNA, 13 bp, Homo sapiens
ccccctcccaggg

SEQ ID NO: 2692034 - DNA, 10 bp, Homo sapiens
ccccctgggc

SEQ ID NO: 2692035 - DNA, 13 bp, Homo sapiens
ccccctgggctct

SEQ ID NO: 2692036 - DNA, 21 bp, Homo sapiens
ccccctggtggacagtcctgg

SEQ ID NO: 2692037 - DNA, 17 bp, Homo sapiens
ccccgcccagctgcacc

SEQ ID NO: 2692038 - DNA, 23 bp, Homo sapiens
ccccgcccagctgcacctgccag

SEQ ID NO: 2692039 - DNA, 19 bp, Homo sapiens
cccctacgggcgctgcagc

SEQ ID NO: 2692040 - DNA, 21 bp, Homo sapiens
cccctccacgcaaggctgtgc

SEQ ID NO: 2692041 - DNA, 17 bp, Homo sapiens
cccctccgatgctgagg

SEQ ID NO: 2692042 - DNA, 18 bp, Homo sapiens
cccctccgatgctgaggc

SEQ ID NO: 2692043 - DNA, 14 bp, Homo sapiens
cccctgctcccagg

SEQ ID NO: 2692044 - DNA, 14 bp, Homo sapiens
cccctggccctgcc

SEQ ID NO: 2692045 - DNA, 13 bp, Homo sapiens
cccctgggctctg

SEQ ID NO: 2692046 - DNA, 23 bp, Homo sapiens
cccctgggctctgccccagctct

SEQ ID NO: 2692047 - DNA, 20 bp, Homo sapiens
cccctggtggtcacaggctg

SEQ ID NO: 2692048 - DNA, 22 bp, Homo sapiens
ccccttcctgtcccacctcttc

SEQ ID NO: 2692049 - DNA, 18 bp, Homo sapiens
cccctttactcagcccag

SEQ ID NO: 2692050 - DNA, 20 bp, Homo sapiens
cccctttactcagcccagct

SEQ ID NO: 2692051 - DNA, 21 bp, Homo sapiens
cccctttactcagcccagctg

SEQ ID NO: 2692052 - DNA, 13 bp, Homo sapiens
cccgcccagctgc

SEQ ID NO: 2692053 - DNA, 13 bp, Homo sapiens
cccgcctgccacc

SEQ ID NO: 2692054 - DNA, 11 bp, Homo sapiens
cccgctctgga

SEQ ID NO: 2692055 - DNA, 12 bp, Homo sapiens
cccgctctggac

SEQ ID NO: 2692056 - DNA, 14 bp, Homo sapiens
cccgcttgctctcc

SEQ ID NO: 2692057 - DNA, 22 bp, Homo sapiens
cccgtggatggtctccacctgt

SEQ ID NO: 2692058 - DNA, 15 bp, Homo sapiens
cccgtggggctcccg

SEQ ID NO: 2692059 - DNA, 18 bp, Homo sapiens
cccgtggtctccttgcac

SEQ ID NO: 2692060 - DNA, 13 bp, Homo sapiens
ccctacccactct

SEQ ID NO: 2692061 - DNA, 15 bp, Homo sapiens
ccctacgggcgctgc

SEQ ID NO: 2692062 - DNA, 23 bp, Homo sapiens
ccctagggaaaacacggccctcc

SEQ ID NO: 2692063 - DNA, 19 bp, Homo sapiens
ccctcaaatgacccaaaga

SEQ ID NO: 2692064 - DNA, 16 bp, Homo sapiens
ccctccacagccgcag

SEQ ID NO: 2692065 - DNA, 13 bp, Homo sapiens
ccctccaggcctg

SEQ ID NO: 2692066 - DNA, 15 bp, Homo sapiens
ccctccaggcctgca

SEQ ID NO: 2692067 - DNA, 18 bp, Homo sapiens
ccctccaggcctgcaggg

SEQ ID NO: 2692068 - DNA, 19 bp, Homo sapiens
ccctccaggcctgcagggg

SEQ ID NO: 2692069 - DNA, 14 bp, Homo sapiens
ccctccatggcctg

SEQ ID NO: 2692070 - DNA, 15 bp, Homo sapiens
ccctcccaaggagcc

SEQ ID NO: 2692071 - DNA, 13 bp, Homo sapiens
ccctcccctgctc

SEQ ID NO: 2692072 - DNA, 14 bp, Homo sapiens
ccctcccctgctcc

SEQ ID NO: 2692073 - DNA, 16 bp, Homo sapiens
ccctccccttcccctt

SEQ ID NO: 2692074 - DNA, 13 bp, Homo sapiens
ccctccgccttca

SEQ ID NO: 2692075 - DNA, 22 bp, Homo sapiens
ccctccgtcgggcccctgcctg

SEQ ID NO: 2692076 - DNA, 10 bp, Homo sapiens
ccctcctggg

SEQ ID NO: 2692077 - DNA, 19 bp, Homo sapiens
ccctcgtggacacctgccc

SEQ ID NO: 2692078 - DNA, 23 bp, Homo sapiens
ccctcgtggacacctgccctgcc

SEQ ID NO: 2692079 - DNA, 15 bp, Homo sapiens
ccctctgccccatca

SEQ ID NO: 2692080 - DNA, 17 bp, Homo sapiens
ccctgactctctgtgac

SEQ ID NO: 2692081 - DNA, 22 bp, Homo sapiens
ccctgaggcaggtgagaaccca

SEQ ID NO: 2692082 - DNA, 17 bp, Homo sapiens
ccctgagggctcctcca

SEQ ID NO: 2692083 - DNA, 21 bp, Homo sapiens
ccctgagggctcctccatggt

SEQ ID NO: 2692084 - DNA, 14 bp, Homo sapiens
ccctgcacagcctc

SEQ ID NO: 2692085 - DNA, 15 bp, Homo sapiens
ccctgcacagcctct

SEQ ID NO: 2692086 - DNA, 22 bp, Homo sapiens
ccctgcccctacgggcgctgca

SEQ ID NO: 2692087 - DNA, 15 bp, Homo sapiens
ccctgccctcccctg

SEQ ID NO: 2692088 - DNA, 18 bp, Homo sapiens
ccctgccctcccctgctc

SEQ ID NO: 2692089 - DNA, 19 bp, Homo sapiens
ccctgccctcccctgctcc

SEQ ID NO: 2692090 - DNA, 17 bp, Homo sapiens
ccctgccctgccacctg

SEQ ID NO: 2692091 - DNA, 18 bp, Homo sapiens
ccctgccctgccacctgt

SEQ ID NO: 2692092 - DNA, 14 bp, Homo sapiens
ccctgcctgccttc

SEQ ID NO: 2692093 - DNA, 15 bp, Homo sapiens
ccctgcctgccttct

SEQ ID NO: 2692094 - DNA, 19 bp, Homo sapiens
ccctgcgaaggggccctgg

SEQ ID NO: 2692095 - DNA, 13 bp, Homo sapiens
ccctgctcccagg

SEQ ID NO: 2692096 - DNA, 13 bp, Homo sapiens
ccctgctctttct

SEQ ID NO: 2692097 - DNA, 17 bp, Homo sapiens
ccctgctctttctctga

SEQ ID NO: 2692098 - DNA, 13 bp, Homo sapiens
ccctggaccccag

SEQ ID NO: 2692099 - DNA, 20 bp, Homo sapiens
ccctggaccccaggctctta

SEQ ID NO: 2692100 - DNA, 20 bp, Homo sapiens
ccctggcaggatgaccctgc

SEQ ID NO: 2692101 - DNA, 16 bp, Homo sapiens
ccctgggctctgcccc

SEQ ID NO: 2692102 - DNA, 17 bp, Homo sapiens
ccctgggggcatcctgc

SEQ ID NO: 2692103 - DNA, 22 bp, Homo sapiens
ccctgggggcatcctgcttcct

SEQ ID NO: 2692104 - DNA, 20 bp, Homo sapiens
ccctgggtcgggacagacca

SEQ ID NO: 2692105 - DNA, 13 bp, Homo sapiens
ccctggtccttcc

SEQ ID NO: 2692106 - DNA, 21 bp, Homo sapiens
ccctggtgcactggccccacc

SEQ ID NO: 2692107 - DNA, 23 bp, Homo sapiens
ccctggtggacagtcctgggaga

SEQ ID NO: 2692108 - DNA, 21 bp, Homo sapiens
ccctgtgagagccacgctggc

SEQ ID NO: 2692109 - DNA, 22 bp, Homo sapiens
cccttgccctccctttctctct

SEQ ID NO: 2692110 - DNA, 17 bp, Homo sapiens
ccctttactcagcccag

SEQ ID NO: 2692111 - DNA, 23 bp, Homo sapiens
ccctttctctctccaccccccac

SEQ ID NO: 2692112 - DNA, 13 bp, Homo sapiens
ccgacttttctaa

SEQ ID NO: 2692113 - DNA, 21 bp, Homo sapiens
ccgagatcacgccactgcact

SEQ ID NO: 2692114 - DNA, 19 bp, Homo sapiens
ccgatgctgaggccaccca

SEQ ID NO: 2692115 - DNA, 24 bp, Homo sapiens
ccgcagaaggggaatgtgtcctcc

SEQ ID NO: 2692116 - DNA, 14 bp, Homo sapiens
ccgcagcctccctc

SEQ ID NO: 2692117 - DNA, 14 bp, Homo sapiens
ccgcctgccacctc

SEQ ID NO: 2692118 - DNA, 17 bp, Homo sapiens
ccgcctttccggggctg

SEQ ID NO: 2692119 - DNA, 16 bp, Homo sapiens
ccgctggtccctgccc

SEQ ID NO: 2692120 - DNA, 20 bp, Homo sapiens
ccgctggtccctgccctccc

SEQ ID NO: 2692121 - DNA, 18 bp, Homo sapiens
ccgcttgctctcctggag

SEQ ID NO: 2692122 - DNA, 14 bp, Homo sapiens
ccggcatcctgaaa

SEQ ID NO: 2692123 - DNA, 13 bp, Homo sapiens
ccggggctgctgg

SEQ ID NO: 2692124 - DNA, 18 bp, Homo sapiens
ccggggctgctggcctgg

SEQ ID NO: 2692125 - DNA, 17 bp, Homo sapiens
ccggtgtgcctgcagcc

SEQ ID NO: 2692126 - DNA, 20 bp, Homo sapiens
ccgtcgggcccctgcctgcc

SEQ ID NO: 2692127 - DNA, 22 bp, Homo sapiens
ccgtcgggcccctgcctgcctt

SEQ ID NO: 2692128 - DNA, 17 bp, Homo sapiens
ccgtgaaaatgcaagtg

SEQ ID NO: 2692129 - DNA, 11 bp, Homo sapiens
ccgtgccaggc

SEQ ID NO: 2692130 - DNA, 14 bp, Homo sapiens
ccgtgccaggcatt

SEQ ID NO: 2692131 - DNA, 16 bp, Homo sapiens
ccgtggaccttcctgc

SEQ ID NO: 2692132 - DNA, 17 bp, Homo sapiens
ccgtggaccttcctgcc

SEQ ID NO: 2692133 - DNA, 15 bp, Homo sapiens
ccgtggggctcccgg

SEQ ID NO: 2692134 - DNA, 22 bp, Homo sapiens
ccgtggggctcccggcatcctg

SEQ ID NO: 2692135 - DNA, 12 bp, Homo sapiens
ccgtgtgcctcc

SEQ ID NO: 2692136 - DNA, 14 bp, Homo sapiens
ccgtgtgcctcctg

SEQ ID NO: 2692137 - DNA, 19 bp, Homo sapiens
ccgtgtgcctcctgtgtgt

SEQ ID NO: 2692138 - DNA, 13 bp, Homo sapiens
aaaaaaaactctt

SEQ ID NO: 2692139 - DNA, 18 bp, Homo sapiens
aaaaaagttttgatgaaa

SEQ ID NO: 2692140 - DNA, 19 bp, Homo sapiens
aaaaactctttaacttgta

SEQ ID NO: 2692141 - DNA, 20 bp, Homo sapiens
aaaaactctttaacttgtaa

SEQ ID NO: 2692142 - DNA, 19 bp, Homo sapiens
aaaaactttctactcattt

SEQ ID NO: 2692143 - DNA, 18 bp, Homo sapiens
aaaaagattatatatcat

SEQ ID NO: 2692144 - DNA, 19 bp, Homo sapiens
aaaaagctataaattatat

SEQ ID NO: 2692145 - DNA, 21 bp, Homo sapiens
aaaaagtaagtaccactcagg

SEQ ID NO: 2692146 - DNA, 11 bp, Homo sapiens
aaaaagtatat

SEQ ID NO: 2692147 - DNA, 14 bp, Homo sapiens
aaaaagtatatatt

SEQ ID NO: 2692148 - DNA, 12 bp, Homo sapiens
aaaaatctagtt

SEQ ID NO: 2692149 - DNA, 15 bp, Homo sapiens
aaaaatctagttttt

SEQ ID NO: 2692150 - DNA, 18 bp, Homo sapiens
aaaacacggccctcctgg

SEQ ID NO: 2692151 - DNA, 19 bp, Homo sapiens
aaaacacggccctcctggg

SEQ ID NO: 2692152 - DNA, 13 bp, Homo sapiens
aaaactctttaac

SEQ ID NO: 2692153 - DNA, 18 bp, Homo sapiens
aaaactgcagtttgatca

SEQ ID NO: 2692154 - DNA, 20 bp, Homo sapiens
aaaagattatatatcataaa

SEQ ID NO: 2692155 - DNA, 16 bp, Homo sapiens
aaaagctataaattat

SEQ ID NO: 2692156 - DNA, 16 bp, Homo sapiens
aaaagttaaactactt

SEQ ID NO: 2692157 - DNA, 16 bp, Homo sapiens
aaaatcaacttgtgta

SEQ ID NO: 2692158 - DNA, 19 bp, Homo sapiens
aaaatctagttttttttgt

SEQ ID NO: 2692159 - DNA, 15 bp, Homo sapiens
aaaatgcattatgtg

SEQ ID NO: 2692160 - DNA, 20 bp, Homo sapiens
aaacaaaatccaaccctgtc

SEQ ID NO: 2692161 - DNA, 17 bp, Homo sapiens
aaacacagggttttgta

SEQ ID NO: 2692162 - DNA, 18 bp, Homo sapiens
aaacacagggttttgtat

SEQ ID NO: 2692163 - DNA, 23 bp, Homo sapiens
aaacactgtttgttccagaatct

SEQ ID NO: 2692164 - DNA, 20 bp, Homo sapiens
aaacaggtcgagctgtgctc

SEQ ID NO: 2692165 - DNA, 23 bp, Homo sapiens
aaacattcacacagggctctttg

SEQ ID NO: 2692166 - DNA, 11 bp, Homo sapiens
aaaccctggtt

SEQ ID NO: 2692167 - DNA, 17 bp, Homo sapiens
aaacctgtccataaagt

SEQ ID NO: 2692168 - DNA, 18 bp, Homo sapiens
aaacctgtccataaagta

SEQ ID NO: 2692169 - DNA, 21 bp, Homo sapiens
aaacgcagattgggctggctc

SEQ ID NO: 2692170 - DNA, 12 bp, Homo sapiens
aaactagtgttt

SEQ ID NO: 2692171 - DNA, 19 bp, Homo sapiens
aaactcctgattttgtagt

SEQ ID NO: 2692172 - DNA, 23 bp, Homo sapiens
aaactctttaacttgtaataaac

SEQ ID NO: 2692173 - DNA, 13 bp, Homo sapiens
aaacttatgctag

SEQ ID NO: 2692174 - DNA, 18 bp, Homo sapiens
aaagcatcacctcaggcc

SEQ ID NO: 2692175 - DNA, 15 bp, Homo sapiens
aaagccacattttgc

SEQ ID NO: 2692176 - DNA, 14 bp, Homo sapiens
aaagccacctgctg

SEQ ID NO: 2692177 - DNA, 16 bp, Homo sapiens
aaagccagcaaagcct

SEQ ID NO: 2692178 - DNA, 16 bp, Homo sapiens
aaagcctccagcatct

SEQ ID NO: 2692179 - DNA, 16 bp, Homo sapiens
aaagcctctgctgcca

SEQ ID NO: 2692180 - DNA, 19 bp, Homo sapiens
aaagcgagatcccatctct

SEQ ID NO: 2692181 - DNA, 18 bp, Homo sapiens
aaagctctgaacaaaagc

SEQ ID NO: 2692182 - DNA, 14 bp, Homo sapiens
aaagctgctttctt

SEQ ID NO: 2692183 - DNA, 17 bp, Homo sapiens
aaagctgctttcttctc

SEQ ID NO: 2692184 - DNA, 19 bp, Homo sapiens
aaagctgctttcttctctg

SEQ ID NO: 2692185 - DNA, 22 bp, Homo sapiens
aaagctgctttcttctctgcct

SEQ ID NO: 2692186 - DNA, 23 bp, Homo sapiens
aaagctgctttcttctctgcctc

SEQ ID NO: 2692187 - DNA, 22 bp, Homo sapiens
aaaggactaacataaaatctgt

SEQ ID NO: 2692188 - DNA, 19 bp, Homo sapiens
aaaggtgctgatggccctc

SEQ ID NO: 2692189 - DNA, 16 bp, Homo sapiens
aaagtaattttgtgaa

SEQ ID NO: 2692190 - DNA, 15 bp, Homo sapiens
aaagtatatattcta

SEQ ID NO: 2692191 - DNA, 20 bp, Homo sapiens
aaagttaaactacttgtaaa

SEQ ID NO: 2692192 - DNA, 21 bp, Homo sapiens
aaataccagtgaaccaaagag

SEQ ID NO: 2692193 - DNA, 19 bp, Homo sapiens
aaataccatgtctctaagc

SEQ ID NO: 2692194 - DNA, 19 bp, Homo sapiens
aaatataagctgggaaaaa

SEQ ID NO: 2692195 - DNA, 19 bp, Homo sapiens
aaatcactttacctgcagg

SEQ ID NO: 2692196 - DNA, 17 bp, Homo sapiens
aaatctggcaaagttat

SEQ ID NO: 2692197 - DNA, 15 bp, Homo sapiens
aaatctgtgaattaa

SEQ ID NO: 2692198 - DNA, 16 bp, Homo sapiens
aaatgacccaaagacc

SEQ ID NO: 2692199 - DNA, 13 bp, Homo sapiens
aaatgctgaatga

SEQ ID NO: 2692200 - DNA, 17 bp, Homo sapiens
aaatgctgaatgaatcc

SEQ ID NO: 2692201 - DNA, 18 bp, Homo sapiens
aaatgtaactatgtttta

SEQ ID NO: 2692202 - DNA, 15 bp, Homo sapiens
aaatgtttctgcagt

SEQ ID NO: 2692203 - DNA, 16 bp, Homo sapiens
aaattatactgtagct

SEQ ID NO: 2692204 - DNA, 23 bp, Homo sapiens
aaattgcttttgttgtgactttt

SEQ ID NO: 2692205 - DNA, 18 bp, Homo sapiens
aaattgtatacattttgt

SEQ ID NO: 2692206 - DNA, 13 bp, Homo sapiens
aaatttccctggg

SEQ ID NO: 2692207 - DNA, 18 bp, Homo sapiens
aaattttactgacagaaa

SEQ ID NO: 2692208 - DNA, 19 bp, Homo sapiens
aaattttactgacagaaat

SEQ ID NO: 2692209 - DNA, 16 bp, Homo sapiens
aacaatgtcagaaact

SEQ ID NO: 2692210 - DNA, 19 bp, Homo sapiens
aacacccaaaggtggcctg

SEQ ID NO: 2692211 - DNA, 15 bp, Homo sapiens
aacacccactggcca

SEQ ID NO: 2692212 - DNA, 14 bp, Homo sapiens
aacacggccctcct

SEQ ID NO: 2692213 - DNA, 15 bp, Homo sapiens
aacacggccctcctg

SEQ ID NO: 2692214 - DNA, 19 bp, Homo sapiens
aacacggccctcctgggaa

SEQ ID NO: 2692215 - DNA, 22 bp, Homo sapiens
aacacgttccctaatcaggaaa

SEQ ID NO: 2692216 - DNA, 16 bp, Homo sapiens
aacaggacctctgctt

SEQ ID NO: 2692217 - DNA, 16 bp, Homo sapiens
aacaggcctcaagcgt

SEQ ID NO: 2692218 - DNA, 15 bp, Homo sapiens
aacagtgaggctggg

SEQ ID NO: 2692219 - DNA, 20 bp, Homo sapiens
aacattcacacagggctctt

SEQ ID NO: 2692220 - DNA, 16 bp, Homo sapiens
aaccaaaagatgcctt

SEQ ID NO: 2692221 - DNA, 18 bp, Homo sapiens
aaccaaaagatgccttga

SEQ ID NO: 2692222 - DNA, 23 bp, Homo sapiens
aaccaaagagactggagcatctg

SEQ ID NO: 2692223 - DNA, 16 bp, Homo sapiens
aaccagtgtaactggc

SEQ ID NO: 2692224 - DNA, 15 bp, Homo sapiens
aaccatctggtgcct

SEQ ID NO: 2692225 - DNA, 19 bp, Homo sapiens
aaccatctggtgcctttcc

SEQ ID NO: 2692226 - DNA, 18 bp, Homo sapiens
aacccaggtctgatgcca

SEQ ID NO: 2692227 - DNA, 11 bp, Homo sapiens
aaccccagcta

SEQ ID NO: 2692228 - DNA, 12 bp, Homo sapiens
aaccccagctgg

SEQ ID NO: 2692229 - DNA, 16 bp, Homo sapiens
aaccccagctggcctc

SEQ ID NO: 2692230 - DNA, 22 bp, Homo sapiens
aaccctggcttgcttgccgagc

SEQ ID NO: 2692231 - DNA, 12 bp, Homo sapiens
aaccgacttttc

SEQ ID NO: 2692232 - DNA, 14 bp, Homo sapiens
aaccgcttgccata

SEQ ID NO: 2692233 - DNA, 18 bp, Homo sapiens
aacctcaggcttccttgg

SEQ ID NO: 2692234 - DNA, 16 bp, Homo sapiens
aacctgtccataaagt

SEQ ID NO: 2692235 - DNA, 22 bp, Homo sapiens
aacgcagattgggctggctctg

SEQ ID NO: 2692236 - DNA, 21 bp, Homo sapiens
aacgggaccccctggccctgc

SEQ ID NO: 2692237 - DNA, 16 bp, Homo sapiens
aactagaaatctgcca

SEQ ID NO: 2692238 - DNA, 19 bp, Homo sapiens
aactcctgattttgtagtt

SEQ ID NO: 2692239 - DNA, 16 bp, Homo sapiens
gattaatgttttgtac

SEQ ID NO: 2692240 - DNA, 19 bp, Homo sapiens
gattaatgttttgtacaat

SEQ ID NO: 2692241 - DNA, 13 bp, Homo sapiens
gattatatatcat

SEQ ID NO: 2692242 - DNA, 14 bp, Homo sapiens
gattcactggcctg

SEQ ID NO: 2692243 - DNA, 15 bp, Homo sapiens
gattctgggaggaag

SEQ ID NO: 2692244 - DNA, 19 bp, Homo sapiens
gattcttcccgctccccac

SEQ ID NO: 2692245 - DNA, 21 bp, Homo sapiens
gattgttctgtccagtttcca

SEQ ID NO: 2692246 - DNA, 16 bp, Homo sapiens
gatttaccttttctgt

SEQ ID NO: 2692247 - DNA, 17 bp, Homo sapiens
gatttaccttttctgtt

SEQ ID NO: 2692248 - DNA, 23 bp, Homo sapiens
gatttccgtgaaaatgcaagtgt

SEQ ID NO: 2692249 - DNA, 12 bp, Homo sapiens
gattttgtagtt

SEQ ID NO: 2692250 - DNA, 17 bp, Homo sapiens
gatttttgtaaaaagct

SEQ ID NO: 2692251 - DNA, 16 bp, Homo sapiens
gcaaaagacttgagcc

SEQ ID NO: 2692252 - DNA, 19 bp, Homo sapiens
gcaaatataagctgggaaa

SEQ ID NO: 2692253 - DNA, 19 bp, Homo sapiens
gcaacagagtgagaccctg

SEQ ID NO: 2692254 - DNA, 23 bp, Homo sapiens
gcaaggctgtgctcttcctctgg

SEQ ID NO: 2692255 - DNA, 20 bp, Homo sapiens
gcaaggggctggctggagtc

SEQ ID NO: 2692256 - DNA, 15 bp, Homo sapiens
gcaagtttcatcagc

SEQ ID NO: 2692257 - DNA, 20 bp, Homo sapiens
gcacacacacataagcactg

SEQ ID NO: 2692258 - DNA, 14 bp, Homo sapiens
gcacacctcagccc

SEQ ID NO: 2692259 - DNA, 13 bp, Homo sapiens
gcacagctgggca

SEQ ID NO: 2692260 - DNA, 21 bp, Homo sapiens
gcacaggagagcacccacagc

SEQ ID NO: 2692261 - DNA, 15 bp, Homo sapiens
gcacccacagccgca

SEQ ID NO: 2692262 - DNA, 20 bp, Homo sapiens
gcacccaggcctccctgcag

SEQ ID NO: 2692263 - DNA, 16 bp, Homo sapiens
gcaccctccgccttca

SEQ ID NO: 2692264 - DNA, 21 bp, Homo sapiens
gcacctatagtcccagctact

SEQ ID NO: 2692265 - DNA, 19 bp, Homo sapiens
gcacctcccttccctccct

SEQ ID NO: 2692266 - DNA, 14 bp, Homo sapiens
gcacctgccagcct

SEQ ID NO: 2692267 - DNA, 16 bp, Homo sapiens
gcacctgccagcctgg

SEQ ID NO: 2692268 - DNA, 15 bp, Homo sapiens
gcacctgccccctgg

SEQ ID NO: 2692269 - DNA, 22 bp, Homo sapiens
gcacctgccccctggtggacag

SEQ ID NO: 2692270 - DNA, 17 bp, Homo sapiens
gcacctgctcccagtgg

SEQ ID NO: 2692271 - DNA, 13 bp, Homo sapiens
gcacgtctcctgc

SEQ ID NO: 2692272 - DNA, 14 bp, Homo sapiens
gcacgtctcctgct

SEQ ID NO: 2692273 - DNA, 17 bp, Homo sapiens
gcacgtctcctgctgcg

SEQ ID NO: 2692274 - DNA, 14 bp, Homo sapiens
gcactccagcctgg

SEQ ID NO: 2692275 - DNA, 16 bp, Homo sapiens
gcactccagcctgggc

SEQ ID NO: 2692276 - DNA, 21 bp, Homo sapiens
gcactccagcctgggcgacag

SEQ ID NO: 2692277 - DNA, 14 bp, Homo sapiens
gcactggccccacc

SEQ ID NO: 2692278 - DNA, 15 bp, Homo sapiens
gcactggccccaccc

SEQ ID NO: 2692279 - DNA, 16 bp, Homo sapiens
gcactttgggaggctg

SEQ ID NO: 2692280 - DNA, 20 bp, Homo sapiens
gcactttgggaggctgaggc

SEQ ID NO: 2692281 - DNA, 21 bp, Homo sapiens
gcactttgggaggctgaggcg

SEQ ID NO: 2692282 - DNA, 13 bp, Homo sapiens
gccccagctctgg

SEQ ID NO: 2692283 - DNA, 14 bp, Homo sapiens
gccccagcttcctg

SEQ ID NO: 2692284 - DNA, 14 bp, Homo sapiens
gccccaggtgccac

SEQ ID NO: 2692285 - DNA, 19 bp, Homo sapiens
gccccaggtgccaccaata

SEQ ID NO: 2692286 - DNA, 22 bp, Homo sapiens
gccccaggtgccaccaataaaa

SEQ ID NO: 2692287 - DNA, 17 bp, Homo sapiens
gccccatcattgcacct

SEQ ID NO: 2692288 - DNA, 19 bp, Homo sapiens
gcccctacgggcgctgcag

SEQ ID NO: 2692289 - DNA, 21 bp, Homo sapiens
gcccctacgggcgctgcagcc

SEQ ID NO: 2692290 - DNA, 13 bp, Homo sapiens
gcccctccagcac

SEQ ID NO: 2692291 - DNA, 14 bp, Homo sapiens
gcccctgcctgcct

SEQ ID NO: 2692292 - DNA, 15 bp, Homo sapiens
gcccctgcctgcctt

SEQ ID NO: 2692293 - DNA, 22 bp, Homo sapiens
gcccctgctctgtagccacctc

SEQ ID NO: 2692294 - DNA, 21 bp, Homo sapiens
gcccctggtggtcacaggctg

SEQ ID NO: 2692295 - DNA, 16 bp, Homo sapiens
gccctccaggcctgca

SEQ ID NO: 2692296 - DNA, 14 bp, Homo sapiens
gccctcccctgctc

SEQ ID NO: 2692297 - DNA, 16 bp, Homo sapiens
gccctccccttcccct

SEQ ID NO: 2692298 - DNA, 19 bp, Homo sapiens
gccctccgtcgggcccctg

SEQ ID NO: 2692299 - DNA, 15 bp, Homo sapiens
gccctctgccccatc

SEQ ID NO: 2692300 - DNA, 13 bp, Homo sapiens
gccctgcagaggg

SEQ ID NO: 2692301 - DNA, 14 bp, Homo sapiens
gccctgccacctgt

SEQ ID NO: 2692302 - DNA, 17 bp, Homo sapiens
gccctgccctgccacct

SEQ ID NO: 2692303 - DNA, 16 bp, Homo sapiens
gccctggaccccaggc

SEQ ID NO: 2692304 - DNA, 19 bp, Homo sapiens
gccctggaccccaggctct

SEQ ID NO: 2692305 - DNA, 12 bp, Homo sapiens
gccctggcagga

SEQ ID NO: 2692306 - DNA, 19 bp, Homo sapiens
gccctggcaggatgaccct

SEQ ID NO: 2692307 - DNA, 15 bp, Homo sapiens
gccctggctgtgggt

SEQ ID NO: 2692308 - DNA, 15 bp, Homo sapiens
gccctgtgagagcca

SEQ ID NO: 2692309 - DNA, 23 bp, Homo sapiens
gccctgtgagagccacgctggcc

SEQ ID NO: 2692310 - DNA, 13 bp, Homo sapiens
gcccttcctccag

SEQ ID NO: 2692311 - DNA, 19 bp, Homo sapiens
gccgagcctaatgaaaggg

SEQ ID NO: 2692312 - DNA, 18 bp, Homo sapiens
gccgcagcctccctctga

SEQ ID NO: 2692313 - DNA, 15 bp, Homo sapiens
gccgcgtccctgccc

SEQ ID NO: 2692314 - DNA, 21 bp, Homo sapiens
gccggacacaagcggccctga

SEQ ID NO: 2692315 - DNA, 19 bp, Homo sapiens
gccgggcgtggtggcgggc

SEQ ID NO: 2692316 - DNA, 23 bp, Homo sapiens
gccgtgaggacacgtggcctgca

SEQ ID NO: 2692317 - DNA, 16 bp, Homo sapiens
gccgtgttactgttgc

SEQ ID NO: 2692318 - DNA, 15 bp, Homo sapiens
gcctatgatcccagc

SEQ ID NO: 2692319 - DNA, 17 bp, Homo sapiens
gcctccaaatgccaact

SEQ ID NO: 2692320 - DNA, 20 bp, Homo sapiens
gcctcccagtggcctggctt

SEQ ID NO: 2692321 - DNA, 19 bp, Homo sapiens
gcctccccatacttcctgg

SEQ ID NO: 2692322 - DNA, 12 bp, Homo sapiens
gcctccctctga

SEQ ID NO: 2692323 - DNA, 20 bp, Homo sapiens
gcctccctctgacctgcagg

SEQ ID NO: 2692324 - DNA, 21 bp, Homo sapiens
gcctccctctgacctgcaggc

SEQ ID NO: 2692325 - DNA, 13 bp, Homo sapiens
gcctccctgcaga

SEQ ID NO: 2692326 - DNA, 17 bp, Homo sapiens
gcctccctgcagactcc

SEQ ID NO: 2692327 - DNA, 17 bp, Homo sapiens
gcctcccttccatgccc

SEQ ID NO: 2692328 - DNA, 20 bp, Homo sapiens
gcctcccttccatgccccag

SEQ ID NO: 2692329 - DNA, 17 bp, Homo sapiens
gcctcctccccaggtgg

SEQ ID NO: 2692330 - DNA, 13 bp, Homo sapiens
gcctcctcctcac

SEQ ID NO: 2692331 - DNA, 14 bp, Homo sapiens
gcctcctcctcacg

SEQ ID NO: 2692332 - DNA, 19 bp, Homo sapiens
gcctcctgtgtgtctgcag

SEQ ID NO: 2692333 - DNA, 17 bp, Homo sapiens
gcctctagaacacccac

SEQ ID NO: 2692334 - DNA, 22 bp, Homo sapiens
gcctctagaacacccactggcc

SEQ ID NO: 2692335 - DNA, 19 bp, Homo sapiens
gcctcttggacctctgctc

SEQ ID NO: 2692336 - DNA, 14 bp, Homo sapiens
gcctgaggctgaga

SEQ ID NO: 2692337 - DNA, 14 bp, Homo sapiens
gcctgaggctggga

SEQ ID NO: 2692338 - DNA, 10 bp, Homo sapiens
gcctgcagcc

SEQ ID NO: 2692339 - DNA, 20 bp, Homo sapiens
gcctgcaggggcaaggggct

SEQ ID NO: 2692340 - DNA, 15 bp, Homo sapiens
gcctgccacctctcc

SEQ ID NO: 2692341 - DNA, 16 bp, Homo sapiens
gcctgccctctgcccc

SEQ ID NO: 2692342 - DNA, 13 bp, Homo sapiens
gcctgccttctcc

SEQ ID NO: 2692343 - DNA, 14 bp, Homo sapiens
gcctggactgactg

SEQ ID NO: 2692344 - DNA, 13 bp, Homo sapiens
gcctggcacgagg

SEQ ID NO: 2692345 - DNA, 13 bp, Homo sapiens
gcctggcttctgg

SEQ ID NO: 2692346 - DNA, 21 bp, Homo sapiens
gcctgttggacccgctctgga

SEQ ID NO: 2692347 - DNA, 16 bp, Homo sapiens
gccttggtttcctgag

SEQ ID NO: 2692348 - DNA, 20 bp, Homo sapiens
gcctttccggggctgctggc

SEQ ID NO: 2692349 - DNA, 16 bp, Homo sapiens
gcgaaggggccctggt

SEQ ID NO: 2692350 - DNA, 23 bp, Homo sapiens
gcgaggcctgacacaggccagcc

SEQ ID NO: 2692351 - DNA, 17 bp, Homo sapiens
gcgagttgtggaaagcc

SEQ ID NO: 2692352 - DNA, 21 bp, Homo sapiens
gcgcagagccctccaggcctg

SEQ ID NO: 2692353 - DNA, 16 bp, Homo sapiens
gcggaggttgcaggga

SEQ ID NO: 2692354 - DNA, 18 bp, Homo sapiens
gcggcacccaggcctccc

SEQ ID NO: 2692355 - DNA, 20 bp, Homo sapiens
gcgggggtttgagccctgga

SEQ ID NO: 2692356 - DNA, 19 bp, Homo sapiens
gcggtaggggctgcaggga

SEQ ID NO: 2692357 - DNA, 19 bp, Homo sapiens
gcgtcaggcacgtctcctg

SEQ ID NO: 2692358 - DNA, 22 bp, Homo sapiens
gcgtgacatgtgcagtgctgta

SEQ ID NO: 2692359 - DNA, 19 bp, Homo sapiens
gcgtgggcgaggcctgaca

SEQ ID NO: 2692360 - DNA, 23 bp, Homo sapiens
gcgtggtggcgggcacctgtagt

SEQ ID NO: 2692361 - DNA, 21 bp, Homo sapiens
gcgtttacatatttacctgta

SEQ ID NO: 2692362 - DNA, 19 bp, Homo sapiens
gctaacacgtgaaaccccg

SEQ ID NO: 2692363 - DNA, 14 bp, Homo sapiens
gctacaataaatgc

SEQ ID NO: 2692364 - DNA, 16 bp, Homo sapiens
gctactcagaagcctg

SEQ ID NO: 2692365 - DNA, 17 bp, Homo sapiens
gctactcagaagcctga

SEQ ID NO: 2692366 - DNA, 22 bp, Homo sapiens
gctactcgggaggctgaggcag

SEQ ID NO: 2692367 - DNA, 22 bp, Homo sapiens
gctacttgggaggctgaggcag

SEQ ID NO: 2692368 - DNA, 17 bp, Homo sapiens
gctagaaggccacatgt

SEQ ID NO: 2692369 - DNA, 14 bp, Homo sapiens
gctaggagccccag

SEQ ID NO: 2692370 - DNA, 20 bp, Homo sapiens
gctatctactgagacatgac

SEQ ID NO: 2692371 - DNA, 20 bp, Homo sapiens
gctatgaagggacagctgct

SEQ ID NO: 2692372 - DNA, 20 bp, Homo sapiens
gctatgattatgccactgct

SEQ ID NO: 2692373 - DNA, 18 bp, Homo sapiens
gctatttgttcagagagg

SEQ ID NO: 2692374 - DNA, 17 bp, Homo sapiens
gctattttctgaccaaa

SEQ ID NO: 2692375 - DNA, 21 bp, Homo sapiens
gctcaatgcattgtcttgtgg

SEQ ID NO: 2692376 - DNA, 14 bp, Homo sapiens
gctcacctcagagc

SEQ ID NO: 2692377 - DNA, 20 bp, Homo sapiens
gctcacctcagagcagggcc

SEQ ID NO: 2692378 - DNA, 13 bp, Homo sapiens
gctcagaagccag

SEQ ID NO: 2692379 - DNA, 16 bp, Homo sapiens
gctcagaagccagtct

SEQ ID NO: 2692380 - DNA, 18 bp, Homo sapiens
gctcagaagccagtctgc

SEQ ID NO: 2692381 - DNA, 15 bp, Homo sapiens
gctcaggaggcttgg

SEQ ID NO: 2692382 - DNA, 16 bp, Homo sapiens
gctccagcagcacacc

SEQ ID NO: 2692383 - DNA, 16 bp, Homo sapiens
gctccatgcacctccc

SEQ ID NO: 2692384 - DNA, 23 bp, Homo sapiens
gctccatgcacctcccttccctc

SEQ ID NO: 2692385 - DNA, 18 bp, Homo sapiens
gctcccagggactgacac

SEQ ID NO: 2692386 - DNA, 19 bp, Homo sapiens
gctcccagtgggagcttcc

SEQ ID NO: 2692387 - DNA, 20 bp, Homo sapiens
gctccccacctacccagctg

SEQ ID NO: 2692388 - DNA, 21 bp, Homo sapiens
gctcccgcttgctctcctgga

SEQ ID NO: 2692389 - DNA, 14 bp, Homo sapiens
gctcccggcatcct

SEQ ID NO: 2692390 - DNA, 17 bp, Homo sapiens
gctcccggcatcctgaa

SEQ ID NO: 2692391 - DNA, 18 bp, Homo sapiens
gctccctccctcactgtg

SEQ ID NO: 2692392 - DNA, 13 bp, Homo sapiens
gctccctgctccc

SEQ ID NO: 2692393 - DNA, 16 bp, Homo sapiens
gctcctccatggtgct

SEQ ID NO: 2692394 - DNA, 12 bp, Homo sapiens
gctcctgaccaa

SEQ ID NO: 2692395 - DNA, 13 bp, Homo sapiens
gctcctgaccaaa

SEQ ID NO: 2692396 - DNA, 15 bp, Homo sapiens
gctcctgaccaaaga

SEQ ID NO: 2692397 - DNA, 13 bp, Homo sapiens
gctcctgtcccta

SEQ ID NO: 2692398 - DNA, 18 bp, Homo sapiens
gctcctgtccctacccac

SEQ ID NO: 2692399 - DNA, 19 bp, Homo sapiens
gctcctgtccctacccact

SEQ ID NO: 2692400 - DNA, 12 bp, Homo sapiens
gctcggtgagtg

SEQ ID NO: 2692401 - DNA, 14 bp, Homo sapiens
gctctactgccctc

SEQ ID NO: 2692402 - DNA, 15 bp, Homo sapiens
gctctatgccaggct

SEQ ID NO: 2692403 - DNA, 17 bp, Homo sapiens
gctctatgccaggctgt

SEQ ID NO: 2692404 - DNA, 18 bp, Homo sapiens
gctctatgccaggctgtg

SEQ ID NO: 2692405 - DNA, 19 bp, Homo sapiens
gctctatgccaggctgtgc

SEQ ID NO: 2692406 - DNA, 12 bp, Homo sapiens
gctctcctggag

SEQ ID NO: 2692407 - DNA, 17 bp, Homo sapiens
gctctctgagagcacag

SEQ ID NO: 2692408 - DNA, 13 bp, Homo sapiens
gctctctgggcct

SEQ ID NO: 2692409 - DNA, 18 bp, Homo sapiens
gctctgaggcttccagag

SEQ ID NO: 2692410 - DNA, 19 bp, Homo sapiens
gctctgaggcttccagaga

SEQ ID NO: 2692411 - DNA, 18 bp, Homo sapiens
gctctgccccagctctgg

SEQ ID NO: 2692412 - DNA, 19 bp, Homo sapiens
gctctgccccagctctggc

SEQ ID NO: 2692413 - DNA, 11 bp, Homo sapiens
gctctgcttcc

SEQ ID NO: 2692414 - DNA, 11 bp, Homo sapiens
gctctggacca

SEQ ID NO: 2692415 - DNA, 20 bp, Homo sapiens
gctctgtagccacctccttg

SEQ ID NO: 2692416 - DNA, 13 bp, Homo sapiens
gctcttcctctgg

SEQ ID NO: 2692417 - DNA, 16 bp, Homo sapiens
gctcttcctctggttt

SEQ ID NO: 2692418 - DNA, 23 bp, Homo sapiens
gctcttcctctggtttctgtgtg

SEQ ID NO: 2692419 - DNA, 13 bp, Homo sapiens
gctctttcagaga

SEQ ID NO: 2692420 - DNA, 16 bp, Homo sapiens
gctgaacaatgaatgc

SEQ ID NO: 2692421 - DNA, 22 bp, Homo sapiens
gctgacactgtgaccctgggtc

SEQ ID NO: 2692422 - DNA, 14 bp, Homo sapiens
gctgaggactccct

SEQ ID NO: 2692423 - DNA, 15 bp, Homo sapiens
gctgaggccacccac

SEQ ID NO: 2692424 - DNA, 12 bp, Homo sapiens
gctgatgaaact

SEQ ID NO: 2692425 - DNA, 17 bp, Homo sapiens
gctgatgaaactcctga

SEQ ID NO: 2692426 - DNA, 22 bp, Homo sapiens
gctgatgaaactcctgattttg

SEQ ID NO: 2692427 - DNA, 12 bp, Homo sapiens
gctgatggccct

SEQ ID NO: 2692428 - DNA, 17 bp, Homo sapiens
gctgcacctgccagcct

SEQ ID NO: 2692429 - DNA, 20 bp, Homo sapiens
gctgcagccagtcaggcagg

SEQ ID NO: 2692430 - DNA, 20 bp, Homo sapiens
gctgcagtgacgtgcacctg

SEQ ID NO: 2692431 - DNA, 18 bp, Homo sapiens
gctgcattgagtccagct

SEQ ID NO: 2692432 - DNA, 14 bp, Homo sapiens
gctgccttgccatg

SEQ ID NO: 2692433 - DNA, 15 bp, Homo sapiens
gctgcgggggagcca

SEQ ID NO: 2692434 - DNA, 16 bp, Homo sapiens
gctgcgggggagccag

SEQ ID NO: 2692435 - DNA, 22 bp, Homo sapiens
gctgcgggggagccagttctgg

SEQ ID NO: 2692436 - DNA, 18 bp, Homo sapiens
gctgcgtgacatgtgcag

SEQ ID NO: 2692437 - DNA, 19 bp, Homo sapiens
gctgctcccaatgtgccga

SEQ ID NO: 2692438 - DNA, 13 bp, Homo sapiens
gctgctccctgct

SEQ ID NO: 2692439 - DNA, 15 bp, Homo sapiens
gctgctccctgctcc

SEQ ID NO: 2692440 - DNA, 19 bp, Homo sapiens
gctgctccctgctcccagg

SEQ ID NO: 2692441 - DNA, 22 bp, Homo sapiens
gctgctccctgctcccagggac

SEQ ID NO: 2692442 - DNA, 18 bp, Homo sapiens
gctgctggcctggccctt

SEQ ID NO: 2692443 - DNA, 17 bp, Homo sapiens
gctgctgggacccacct

SEQ ID NO: 2692444 - DNA, 17 bp, Homo sapiens
gctgctttcttctctgc

SEQ ID NO: 2692445 - DNA, 23 bp, Homo sapiens
gctgctttcttctctgcctcctc

SEQ ID NO: 2692446 - DNA, 23 bp, Homo sapiens
gctggagacaggtgcgcccctgg

SEQ ID NO: 2692447 - DNA, 22 bp, Homo sapiens
gctggagtctcagagcacagag

SEQ ID NO: 2692448 - DNA, 16 bp, Homo sapiens
gcactttttaaaaaac

SEQ ID NO: 2692449 - DNA, 16 bp, Homo sapiens
gcagaacgatgcctgc

SEQ ID NO: 2692450 - DNA, 17 bp, Homo sapiens
gcagacaagtcttgctg

SEQ ID NO: 2692451 - DNA, 21 bp, Homo sapiens
gcagacaagtcttgctgtgct

SEQ ID NO: 2692452 - DNA, 21 bp, Homo sapiens
gcagactcctcagatctgaac

SEQ ID NO: 2692453 - DNA, 14 bp, Homo sapiens
gcagagcaggggca

SEQ ID NO: 2692454 - DNA, 20 bp, Homo sapiens
gcagagcaggggcagggtga

SEQ ID NO: 2692455 - DNA, 15 bp, Homo sapiens
gcagagccctccagg

SEQ ID NO: 2692456 - DNA, 20 bp, Homo sapiens
gcagagccctccaggcctgc

SEQ ID NO: 2692457 - DNA, 23 bp, Homo sapiens
gcagagccctccaggcctgcagg

SEQ ID NO: 2692458 - DNA, 13 bp, Homo sapiens
gcagagcctgagt

SEQ ID NO: 2692459 - DNA, 16 bp, Homo sapiens
gcagaggggctttctg

SEQ ID NO: 2692460 - DNA, 15 bp, Homo sapiens
gcagatctttttgtg

SEQ ID NO: 2692461 - DNA, 23 bp, Homo sapiens
gcagatctttttgtgaaattcaa

SEQ ID NO: 2692462 - DNA, 19 bp, Homo sapiens
gcagcacacctcagcccca

SEQ ID NO: 2692463 - DNA, 22 bp, Homo sapiens
gcagcccatggcctctggccag

SEQ ID NO: 2692464 - DNA, 13 bp, Homo sapiens
gcagcctcccttc

SEQ ID NO: 2692465 - DNA, 22 bp, Homo sapiens
gcagcgagctatgatcgcgcca

SEQ ID NO: 2692466 - DNA, 16 bp, Homo sapiens
gcagctcctgaccaaa

SEQ ID NO: 2692467 - DNA, 22 bp, Homo sapiens
gcaggagcctcgtgtcctgcta

SEQ ID NO: 2692468 - DNA, 15 bp, Homo sapiens
gcaggctccatgcac

SEQ ID NO: 2692469 - DNA, 18 bp, Homo sapiens
gcaggctccatgcacctc

SEQ ID NO: 2692470 - DNA, 19 bp, Homo sapiens
gcagggccaaagcacagct

SEQ ID NO: 2692471 - DNA, 22 bp, Homo sapiens
gcagggtcattatcagaacatg

SEQ ID NO: 2692472 - DNA, 16 bp, Homo sapiens
gcaggtgagaacccag

SEQ ID NO: 2692473 - DNA, 18 bp, Homo sapiens
gcaggtgagaacccagag

SEQ ID NO: 2692474 - DNA, 18 bp, Homo sapiens
gcaggtgtgaccctgagg

SEQ ID NO: 2692475 - DNA, 17 bp, Homo sapiens
gcagtagtctctgtgct

SEQ ID NO: 2692476 - DNA, 12 bp, Homo sapiens
gcagtccgcagt

SEQ ID NO: 2692477 - DNA, 18 bp, Homo sapiens
gcagtctggcctgggcga

SEQ ID NO: 2692478 - DNA, 23 bp, Homo sapiens
gcagtgctgtaatcggctcccgc

SEQ ID NO: 2692479 - DNA, 15 bp, Homo sapiens
gcatcacagggcaga

SEQ ID NO: 2692480 - DNA, 17 bp, Homo sapiens
gcatcacctcaggccag

SEQ ID NO: 2692481 - DNA, 11 bp, Homo sapiens
gcatcctgctt

SEQ ID NO: 2692482 - DNA, 13 bp, Homo sapiens
gcatcctgcttcc

SEQ ID NO: 2692483 - DNA, 15 bp, Homo sapiens
gcatcctgcttcctg

SEQ ID NO: 2692484 - DNA, 22 bp, Homo sapiens
gcatcctgcttcctgaaagctg

SEQ ID NO: 2692485 - DNA, 23 bp, Homo sapiens
gcatcctgcttcctgaaagctgt

SEQ ID NO: 2692486 - DNA, 18 bp, Homo sapiens
gcatctagccagaggctg

SEQ ID NO: 2692487 - DNA, 19 bp, Homo sapiens
gcatcttctggagtctcca

SEQ ID NO: 2692488 - DNA, 19 bp, Homo sapiens
gcatcttttccatcctgag

SEQ ID NO: 2692489 - DNA, 21 bp, Homo sapiens
gcatcttttccatcctgaggt

SEQ ID NO: 2692490 - DNA, 16 bp, Homo sapiens
gcatgccatgtctgag

SEQ ID NO: 2692491 - DNA, 13 bp, Homo sapiens
gcatgctggggca

SEQ ID NO: 2692492 - DNA, 21 bp, Homo sapiens
gcatggagagcctcttagtga

SEQ ID NO: 2692493 - DNA, 20 bp, Homo sapiens
gcattaacagcaggtgtgac

SEQ ID NO: 2692494 - DNA, 15 bp, Homo sapiens
gcattgagtccagct

SEQ ID NO: 2692495 - DNA, 20 bp, Homo sapiens
gcattgagtccagctttcct

SEQ ID NO: 2692496 - DNA, 17 bp, Homo sapiens
gccaaagcacagctggg

SEQ ID NO: 2692497 - DNA, 12 bp, Homo sapiens
gccaaagctgct

SEQ ID NO: 2692498 - DNA, 14 bp, Homo sapiens
gccaacgacaaagc

SEQ ID NO: 2692499 - DNA, 23 bp, Homo sapiens
gccaacgacaaagccaaactctg

SEQ ID NO: 2692500 - DNA, 20 bp, Homo sapiens
gccaagagcagaggcagcga

SEQ ID NO: 2692501 - DNA, 16 bp, Homo sapiens
gccaaggtgggctgag

SEQ ID NO: 2692502 - DNA, 17 bp, Homo sapiens
gccaatgttgctgatgg

SEQ ID NO: 2692503 - DNA, 19 bp, Homo sapiens
gccacagaagccaggagca

SEQ ID NO: 2692504 - DNA, 13 bp, Homo sapiens
gccaccaataaaa

SEQ ID NO: 2692505 - DNA, 22 bp, Homo sapiens
gccaccatattcagtgctgtgg

SEQ ID NO: 2692506 - DNA, 19 bp, Homo sapiens
gccacctagaagtctccct

SEQ ID NO: 2692507 - DNA, 22 bp, Homo sapiens
gccacctagaagtctccctgca

SEQ ID NO: 2692508 - DNA, 15 bp, Homo sapiens
gccacctccttggca

SEQ ID NO: 2692509 - DNA, 16 bp, Homo sapiens
gccacctccttggcac

SEQ ID NO: 2692510 - DNA, 17 bp, Homo sapiens
gccacctccttggcacc

SEQ ID NO: 2692511 - DNA, 15 bp, Homo sapiens
gccacctctcccagc

SEQ ID NO: 2692512 - DNA, 12 bp, Homo sapiens
gccacctgctgc

SEQ ID NO: 2692513 - DNA, 12 bp, Homo sapiens
gccacctgtctg

SEQ ID NO: 2692514 - DNA, 14 bp, Homo sapiens
gccacctgtctgtc

SEQ ID NO: 2692515 - DNA, 13 bp, Homo sapiens
gccacgctggcct

SEQ ID NO: 2692516 - DNA, 20 bp, Homo sapiens
gccactacactccagcctga

SEQ ID NO: 2692517 - DNA, 23 bp, Homo sapiens
gccactacactccagcctgagca

SEQ ID NO: 2692518 - DNA, 19 bp, Homo sapiens
gccactgaagctgggattc

SEQ ID NO: 2692519 - DNA, 21 bp, Homo sapiens
gccactgcactccagcctggg

SEQ ID NO: 2692520 - DNA, 20 bp, Homo sapiens
gccactgctttccagcctgg

SEQ ID NO: 2692521 - DNA, 16 bp, Homo sapiens
gccacttggtttttgg

SEQ ID NO: 2692522 - DNA, 21 bp, Homo sapiens
gccactttggtacatggccag

SEQ ID NO: 2692523 - DNA, 15 bp, Homo sapiens
gccagagctttgttt

SEQ ID NO: 2692524 - DNA, 20 bp, Homo sapiens
gccagatgcctccccaagac

SEQ ID NO: 2692525 - DNA, 14 bp, Homo sapiens
gccagcaaagcctc

SEQ ID NO: 2692526 - DNA, 16 bp, Homo sapiens
gccagcaaagcctcca

SEQ ID NO: 2692527 - DNA, 14 bp, Homo sapiens
gccagcactggagg

SEQ ID NO: 2692528 - DNA, 21 bp, Homo sapiens
gccagcactggaggggcccac

SEQ ID NO: 2692529 - DNA, 11 bp, Homo sapiens
gccagcctggc

SEQ ID NO: 2692530 - DNA, 21 bp, Homo sapiens
gccagcctggcttctggagcc

SEQ ID NO: 2692531 - DNA, 22 bp, Homo sapiens
gccaggagcaaatgtttctgca

SEQ ID NO: 2692532 - DNA, 19 bp, Homo sapiens
gccaggaggttggtgactg

SEQ ID NO: 2692533 - DNA, 24 bp, Homo sapiens
gccaggccaatgttgctgatggcc

SEQ ID NO: 2692534 - DNA, 13 bp, Homo sapiens
gccaggctgtgct

SEQ ID NO: 2692535 - DNA, 15 bp, Homo sapiens
gccagggccctgcag

SEQ ID NO: 2692536 - DNA, 19 bp, Homo sapiens
gccaggggttctgagaagc

SEQ ID NO: 2692537 - DNA, 22 bp, Homo sapiens
gccaggggttctgagaagcgct

SEQ ID NO: 2692538 - DNA, 23 bp, Homo sapiens
gccaggttagcctttgccctgtc

SEQ ID NO: 2692539 - DNA, 13 bp, Homo sapiens
gccagtcctagag

SEQ ID NO: 2692540 - DNA, 23 bp, Homo sapiens
gccagtcctagagctcctgtccc

SEQ ID NO: 2692541 - DNA, 14 bp, Homo sapiens
gccagtctgcgtca

SEQ ID NO: 2692542 - DNA, 17 bp, Homo sapiens
gccagtgtgatcccaag

SEQ ID NO: 2692543 - DNA, 22 bp, Homo sapiens
gccatcacctaggactgactcg

SEQ ID NO: 2692544 - DNA, 22 bp, Homo sapiens
gccatccaaagaaacactaagc

SEQ ID NO: 2692545 - DNA, 18 bp, Homo sapiens
gccatgatcgagccactg

SEQ ID NO: 2692546 - DNA, 12 bp, Homo sapiens
gccatgtctgag

SEQ ID NO: 2692547 - DNA, 22 bp, Homo sapiens
gccatgtctgagcggcgcagag

SEQ ID NO: 2692548 - DNA, 13 bp, Homo sapiens
gccattaccatgg

SEQ ID NO: 2692549 - DNA, 16 bp, Homo sapiens
gcccacattggaccca

SEQ ID NO: 2692550 - DNA, 12 bp, Homo sapiens
gcccacccacat

SEQ ID NO: 2692551 - DNA, 16 bp, Homo sapiens
gcccagcacctgctcc

SEQ ID NO: 2692552 - DNA, 20 bp, Homo sapiens
gcccagccattaccatggag

SEQ ID NO: 2692553 - DNA, 21 bp, Homo sapiens
gcccagccattaccatggaga

SEQ ID NO: 2692554 - DNA, 22 bp, Homo sapiens
gcccagccattaccatggagac

SEQ ID NO: 2692555 - DNA, 11 bp, Homo sapiens
gcccagctggc

SEQ ID NO: 2692556 - DNA, 22 bp, Homo sapiens
gcccatggcctctggccaggca

SEQ ID NO: 2692557 - DNA, 21 bp, Homo sapiens
gccccaccctcgtggacacct

SEQ ID NO: 2692558 - DNA, 18 bp, Homo sapiens
tgccaaagctgctttctt

SEQ ID NO: 2692559 - DNA, 14 bp, Homo sapiens
tgccaagctcacac

SEQ ID NO: 2692560 - DNA, 10 bp, Homo sapiens
tgcttcctca

SEQ ID NO: 2692561 - DNA, 15 bp, Homo sapiens
tgcttcctgaaagct

SEQ ID NO: 2692562 - DNA, 19 bp, Homo sapiens
tgcttcctgaaagctgttg

SEQ ID NO: 2692563 - DNA, 20 bp, Homo sapiens
tgcttcctgaaagctgttgg

SEQ ID NO: 2692564 - DNA, 20 bp, Homo sapiens
tgctttacatgctgtgctct

SEQ ID NO: 2692565 - DNA, 12 bp, Homo sapiens
tgctttcttctc

SEQ ID NO: 2692566 - DNA, 16 bp, Homo sapiens
tgctttcttctctgcc

SEQ ID NO: 2692567 - DNA, 20 bp, Homo sapiens
tgctttcttctctgcctcct

SEQ ID NO: 2692568 - DNA, 21 bp, Homo sapiens
tgctttcttctctgcctcctc

SEQ ID NO: 2692569 - DNA, 22 bp, Homo sapiens
tgctttgactcacctgttactt

SEQ ID NO: 2692570 - DNA, 22 bp, Homo sapiens
tgctttgaggctcaccagaatt

SEQ ID NO: 2692571 - DNA, 14 bp, Homo sapiens
tgcttttgtaactt

SEQ ID NO: 2692572 - DNA, 16 bp, Homo sapiens
tgcttttgttgtgact

SEQ ID NO: 2692573 - DNA, 15 bp, Homo sapiens
tggaaagcctctgct

SEQ ID NO: 2692574 - DNA, 13 bp, Homo sapiens
tggaaaggctcag

SEQ ID NO: 2692575 - DNA, 21 bp, Homo sapiens
tggaaaggctcagtctcagga

SEQ ID NO: 2692576 - DNA, 19 bp, Homo sapiens
tggaaatattctatgacca

SEQ ID NO: 2692577 - DNA, 17 bp, Homo sapiens
tggaagaaattcctgta

SEQ ID NO: 2692578 - DNA, 15 bp, Homo sapiens
tggaagtgcccagcc

SEQ ID NO: 2692579 - DNA, 17 bp, Homo sapiens
tggaagtggcagtgaaa

SEQ ID NO: 2692580 - DNA, 12 bp, Homo sapiens
tggacacctgcc

SEQ ID NO: 2692581 - DNA, 16 bp, Homo sapiens
tggacacctgccctgc

SEQ ID NO: 2692582 - DNA, 18 bp, Homo sapiens
tggacacctgccctgccc

SEQ ID NO: 2692583 - DNA, 12 bp, Homo sapiens
tggacagtcctg

SEQ ID NO: 2692584 - DNA, 18 bp, Homo sapiens
tggaccaaagccacctgc

SEQ ID NO: 2692585 - DNA, 21 bp, Homo sapiens
tggaccaaagccacctgctgc

SEQ ID NO: 2692586 - DNA, 22 bp, Homo sapiens
tggaccaaagccacctgctgcg

SEQ ID NO: 2692587 - DNA, 15 bp, Homo sapiens
tggaccccaggctct

SEQ ID NO: 2692588 - DNA, 15 bp, Homo sapiens
tggacccgctctgga

SEQ ID NO: 2692589 - DNA, 19 bp, Homo sapiens
tggacccgctctggaccaa

SEQ ID NO: 2692590 - DNA, 14 bp, Homo sapiens
tggaccttcctgcc

SEQ ID NO: 2692591 - DNA, 19 bp, Homo sapiens
tggaccttcctgccaccag

SEQ ID NO: 2692592 - DNA, 17 bp, Homo sapiens
tggacgttcggggcatg

SEQ ID NO: 2692593 - DNA, 17 bp, Homo sapiens
tggacttgagcttggca

SEQ ID NO: 2692594 - DNA, 20 bp, Homo sapiens
tggagagcctcttagtgatt

SEQ ID NO: 2692595 - DNA, 21 bp, Homo sapiens
tggagaggagggatgctgcct

SEQ ID NO: 2692596 - DNA, 16 bp, Homo sapiens
tggagcaagctctgcc

SEQ ID NO: 2692597 - DNA, 18 bp, Homo sapiens
tggagcaagctctgccct

SEQ ID NO: 2692598 - DNA, 16 bp, Homo sapiens
tggagcatctgactca

SEQ ID NO: 2692599 - DNA, 13 bp, Homo sapiens
tggaggcttagct

SEQ ID NO: 2692600 - DNA, 19 bp, Homo sapiens
tggaggggcccacccacat

SEQ ID NO: 2692601 - DNA, 20 bp, Homo sapiens
tggagggtgggagagcccag

SEQ ID NO: 2692602 - DNA, 17 bp, Homo sapiens
tggaggtgccaggaagc

SEQ ID NO: 2692603 - DNA, 17 bp, Homo sapiens
tggagtctccagtggtt

SEQ ID NO: 2692604 - DNA, 22 bp, Homo sapiens
tggatggtctccacctgtgctt

SEQ ID NO: 2692605 - DNA, 19 bp, Homo sapiens
tggattaatgttttgtaca

SEQ ID NO: 2692606 - DNA, 19 bp, Homo sapiens
tggcaccagaggctgcaga

SEQ ID NO: 2692607 - DNA, 18 bp, Homo sapiens
tggcagaacgatgcctgc

SEQ ID NO: 2692608 - DNA, 11 bp, Homo sapiens
tggcaggagcc

SEQ ID NO: 2692609 - DNA, 17 bp, Homo sapiens
tggcaggattcttcccg

SEQ ID NO: 2692610 - DNA, 20 bp, Homo sapiens
tggcatcacagggcagagcc

SEQ ID NO: 2692611 - DNA, 13 bp, Homo sapiens
tggcatctagcca

SEQ ID NO: 2692612 - DNA, 21 bp, Homo sapiens
tggcatctagccagaggctgg

SEQ ID NO: 2692613 - DNA, 19 bp, Homo sapiens
tggccagtcctagagctcc

SEQ ID NO: 2692614 - DNA, 22 bp, Homo sapiens
tggccagtcctagagctcctgt

SEQ ID NO: 2692615 - DNA, 22 bp, Homo sapiens
tggccccaccctcgtggacacc

SEQ ID NO: 2692616 - DNA, 15 bp, Homo sapiens
tggccccaggtgcca

SEQ ID NO: 2692617 - DNA, 13 bp, Homo sapiens
tggcccctccagc

SEQ ID NO: 2692618 - DNA, 14 bp, Homo sapiens
tggcccctccagca

SEQ ID NO: 2692619 - DNA, 13 bp, Homo sapiens
tggccctgcctca

SEQ ID NO: 2692620 - DNA, 14 bp, Homo sapiens
tggcctctggccag

SEQ ID NO: 2692621 - DNA, 13 bp, Homo sapiens
tggcctggccctt

SEQ ID NO: 2692622 - DNA, 16 bp, Homo sapiens
tggcctgggcgacaga

SEQ ID NO: 2692623 - DNA, 16 bp, Homo sapiens
tggccttcgtctccat

SEQ ID NO: 2692624 - DNA, 20 bp, Homo sapiens
tggccttcgtctccatctct

SEQ ID NO: 2692625 - DNA, 15 bp, Homo sapiens
tggctctttcagaga

SEQ ID NO: 2692626 - DNA, 12 bp, Homo sapiens
tggctgctccct

SEQ ID NO: 2692627 - DNA, 12 bp, Homo sapiens
tggctgggcatg

SEQ ID NO: 2692628 - DNA, 18 bp, Homo sapiens
tggcttaaaaaaaactct

SEQ ID NO: 2692629 - DNA, 19 bp, Homo sapiens
tggcttaaaaaaaactctt

SEQ ID NO: 2692630 - DNA, 15 bp, Homo sapiens
tggcttctgggagat

SEQ ID NO: 2692631 - DNA, 20 bp, Homo sapiens
tgggaaaaaagttttgatga

SEQ ID NO: 2692632 - DNA, 14 bp, Homo sapiens
tgggaacctcctta

SEQ ID NO: 2692633 - DNA, 21 bp, Homo sapiens
tgggaccagtcccacaccgct

SEQ ID NO: 2692634 - DNA, 14 bp, Homo sapiens
tgggacccacctcc

SEQ ID NO: 2692635 - DNA, 15 bp, Homo sapiens
tgggagaacctcagg

SEQ ID NO: 2692636 - DNA, 22 bp, Homo sapiens
tgggagaacctcaggcttcctt

SEQ ID NO: 2692637 - DNA, 11 bp, Homo sapiens
tgggaggaagc

SEQ ID NO: 2692638 - DNA, 13 bp, Homo sapiens
tgggaggaagcag

SEQ ID NO: 2692639 - DNA, 24 bp, Homo sapiens
tgggaggaagcaggttgaggggct

SEQ ID NO: 2692640 - DNA, 19 bp, Homo sapiens
tgggaggtgagaccacctc

SEQ ID NO: 2692641 - DNA, 22 bp, Homo sapiens
tgggatgatgtgtgaaacctga

SEQ ID NO: 2692642 - DNA, 19 bp, Homo sapiens
tgggattgtggtacaatct

SEQ ID NO: 2692643 - DNA, 19 bp, Homo sapiens
tgggcatgccatgtctgag

SEQ ID NO: 2692644 - DNA, 12 bp, Homo sapiens
tgggccaggtct

SEQ ID NO: 2692645 - DNA, 17 bp, Homo sapiens
tgggctctgccccagct

SEQ ID NO: 2692646 - DNA, 19 bp, Homo sapiens
tgggctctgccccagctct

SEQ ID NO: 2692647 - DNA, 13 bp, Homo sapiens
tgggctggctctg

SEQ ID NO: 2692648 - DNA, 13 bp, Homo sapiens
tggggattcagat

SEQ ID NO: 2692649 - DNA, 19 bp, Homo sapiens
tggggcaagtccctgactc

SEQ ID NO: 2692650 - DNA, 13 bp, Homo sapiens
tggggcagcctcc

SEQ ID NO: 2692651 - DNA, 20 bp, Homo sapiens
tggggcagcctccttgcctg

SEQ ID NO: 2692652 - DNA, 19 bp, Homo sapiens
tggggccagcactggaggg

SEQ ID NO: 2692653 - DNA, 20 bp, Homo sapiens
tggggcccgcctgccacctc

SEQ ID NO: 2692654 - DNA, 21 bp, Homo sapiens
tggggcccgcctgccacctct

SEQ ID NO: 2692655 - DNA, 12 bp, Homo sapiens
tggggccttggt

SEQ ID NO: 2692656 - DNA, 19 bp, Homo sapiens
tggggctcccggcatcctg

SEQ ID NO: 2692657 - DNA, 20 bp, Homo sapiens
tggggctcccggcatcctga

SEQ ID NO: 2692658 - DNA, 15 bp, Homo sapiens
tggggctctgtgcag

SEQ ID NO: 2692659 - DNA, 17 bp, Homo sapiens
tggggctctgtgcaggg

SEQ ID NO: 2692660 - DNA, 17 bp, Homo sapiens
tgggggcatcctgcttc

SEQ ID NO: 2692661 - DNA, 18 bp, Homo sapiens
tgggggcatcctgcttcc

SEQ ID NO: 2692662 - DNA, 21 bp, Homo sapiens
tgggggcatcctgcttcctga

SEQ ID NO: 2692663 - DNA, 16 bp, Homo sapiens
tggggttcaagcccag

SEQ ID NO: 2692664 - DNA, 14 bp, Homo sapiens
tgggtcagcccagc

SEQ ID NO: 2692665 - DNA, 19 bp, Homo sapiens
tgggtcgggacagaccagc

SEQ ID NO: 2692666 - DNA, 22 bp, Homo sapiens
tgggtgcctcctccccaggtgg

SEQ ID NO: 2692667 - DNA, 16 bp, Homo sapiens
aacacccactggccag

SEQ ID NO: 2692668 - DNA, 21 bp, Homo sapiens
aacacccatgaatcaaagaca

SEQ ID NO: 2692669 - DNA, 17 bp, Homo sapiens
aacacggccctcctggg

SEQ ID NO: 2692670 - DNA, 14 bp, Homo sapiens
aacagtgaggctgg

SEQ ID NO: 2692671 - DNA, 16 bp, Homo sapiens
aacataaaatctgtga

SEQ ID NO: 2692672 - DNA, 22 bp, Homo sapiens
aacatagaattgcaatctataa

SEQ ID NO: 2692673 - DNA, 21 bp, Homo sapiens
aacatgggcattgggttctaa

SEQ ID NO: 2692674 - DNA, 19 bp, Homo sapiens
aaccaaaaaaccccagcta

SEQ ID NO: 2692675 - DNA, 20 bp, Homo sapiens
aaccagtgtaactggctgct

SEQ ID NO: 2692676 - DNA, 22 bp, Homo sapiens
aaccagtgtaactggctgctcc

SEQ ID NO: 2692677 - DNA, 14 bp, Homo sapiens
aaccagtgtagcct

SEQ ID NO: 2692678 - DNA, 16 bp, Homo sapiens
aacccaggtctgatgc

SEQ ID NO: 2692679 - DNA, 23 bp, Homo sapiens
aacccaggtctgatgccaaagct

SEQ ID NO: 2692680 - DNA, 22 bp, Homo sapiens
aaccccagctattttctgacca

SEQ ID NO: 2692681 - DNA, 11 bp, Homo sapiens
aaccccagctg

SEQ ID NO: 2692682 - DNA, 20 bp, Homo sapiens
aacctaccaccccttcctgt

SEQ ID NO: 2692683 - DNA, 16 bp, Homo sapiens
aacctcatttaccata

SEQ ID NO: 2692684 - DNA, 14 bp, Homo sapiens
aacctgaattattc

SEQ ID NO: 2692685 - DNA, 17 bp, Homo sapiens
aacctgaattattccaa

SEQ ID NO: 2692686 - DNA, 17 bp, Homo sapiens
aacctggaaccagaggg

SEQ ID NO: 2692687 - DNA, 17 bp, Homo sapiens
aacctgtccataaagta

SEQ ID NO: 2692688 - DNA, 21 bp, Homo sapiens
aacctgtccataaagtaattt

SEQ ID NO: 2692689 - DNA, 20 bp, Homo sapiens
aacgctcttagctttctcag

SEQ ID NO: 2692690 - DNA, 19 bp, Homo sapiens
aactcacacctccttttct

SEQ ID NO: 2692691 - DNA, 18 bp, Homo sapiens
aactctgaataagcactt

SEQ ID NO: 2692692 - DNA, 15 bp, Homo sapiens
aactggcaggagcct

SEQ ID NO: 2692693 - DNA, 19 bp, Homo sapiens
aactggctgctccctgctc

SEQ ID NO: 2692694 - DNA, 22 bp, Homo sapiens
aactggggttcaagcccaggct

SEQ ID NO: 2692695 - DNA, 22 bp, Homo sapiens
aacttccttgcccctgctctgt

SEQ ID NO: 2692696 - DNA, 13 bp, Homo sapiens
aacttgaggacac

SEQ ID NO: 2692697 - DNA, 19 bp, Homo sapiens
aacttgaggacacatgtcc

SEQ ID NO: 2692698 - DNA, 23 bp, Homo sapiens
aagaaaaataccatgtctctaag

SEQ ID NO: 2692699 - DNA, 13 bp, Homo sapiens
aagaactccttat

SEQ ID NO: 2692700 - DNA, 14 bp, Homo sapiens
aagacaacattgta

SEQ ID NO: 2692701 - DNA, 17 bp, Homo sapiens
aagacaacattgtaaga

SEQ ID NO: 2692702 - DNA, 13 bp, Homo sapiens
aagacatttttat

SEQ ID NO: 2692703 - DNA, 14 bp, Homo sapiens
aagaccccatctct

SEQ ID NO: 2692704 - DNA, 16 bp, Homo sapiens
aagactgtcattgccc

SEQ ID NO: 2692705 - DNA, 22 bp, Homo sapiens
aagacttgttagccaacttcaa

SEQ ID NO: 2692706 - DNA, 21 bp, Homo sapiens
aagagagtggggcctgccctc

SEQ ID NO: 2692707 - DNA, 12 bp, Homo sapiens
aagataatgttc

SEQ ID NO: 2692708 - DNA, 20 bp, Homo sapiens
aagataatgttctttaatgt

SEQ ID NO: 2692709 - DNA, 23 bp, Homo sapiens
aagataatgttctttaatgttgt

SEQ ID NO: 2692710 - DNA, 18 bp, Homo sapiens
aagatatcagagctctta

SEQ ID NO: 2692711 - DNA, 16 bp, Homo sapiens
aagattatatatcata

SEQ ID NO: 2692712 - DNA, 20 bp, Homo sapiens
aagattatatatcataaagt

SEQ ID NO: 2692713 - DNA, 16 bp, Homo sapiens
aagcacagctgggcat

SEQ ID NO: 2692714 - DNA, 19 bp, Homo sapiens
aagcaccgcctccaaatgc

SEQ ID NO: 2692715 - DNA, 16 bp, Homo sapiens
aagcatcacctcaggc

SEQ ID NO: 2692716 - DNA, 21 bp, Homo sapiens
aagcatttctagtcccttctc

SEQ ID NO: 2692717 - DNA, 15 bp, Homo sapiens
aagccaaactctgcc

SEQ ID NO: 2692718 - DNA, 20 bp, Homo sapiens
aagccaaactctgccagcca

SEQ ID NO: 2692719 - DNA, 13 bp, Homo sapiens
aagccacctgctg

SEQ ID NO: 2692720 - DNA, 14 bp, Homo sapiens
aagccactgaagct

SEQ ID NO: 2692721 - DNA, 15 bp, Homo sapiens
aagccagcaaagcct

SEQ ID NO: 2692722 - DNA, 19 bp, Homo sapiens
aagccagcaaagcctccag

SEQ ID NO: 2692723 - DNA, 21 bp, Homo sapiens
aagccagcaaagcctccagca

SEQ ID NO: 2692724 - DNA, 16 bp, Homo sapiens
aagccagtctgcgtca

SEQ ID NO: 2692725 - DNA, 17 bp, Homo sapiens
aagcccaggcttcctgg

SEQ ID NO: 2692726 - DNA, 20 bp, Homo sapiens
aagcccctgggggctccctg

SEQ ID NO: 2692727 - DNA, 12 bp, Homo sapiens
aagccctgctct

SEQ ID NO: 2692728 - DNA, 14 bp, Homo sapiens
aagccctgctcttt

SEQ ID NO: 2692729 - DNA, 15 bp, Homo sapiens
aagcctccagcatct

SEQ ID NO: 2692730 - DNA, 15 bp, Homo sapiens
aagctctctgggcct

SEQ ID NO: 2692731 - DNA, 20 bp, Homo sapiens
aagctctctgggcctgggtt

SEQ ID NO: 2692732 - DNA, 12 bp, Homo sapiens
aagctctgccct

SEQ ID NO: 2692733 - DNA, 13 bp, Homo sapiens
aagctctgccctg

SEQ ID NO: 2692734 - DNA, 18 bp, Homo sapiens
aagctgctttcttctctg

SEQ ID NO: 2692735 - DNA, 19 bp, Homo sapiens
aagctgctttcttctctgc

SEQ ID NO: 2692736 - DNA, 20 bp, Homo sapiens
aagctgctttcttctctgcc

SEQ ID NO: 2692737 - DNA, 22 bp, Homo sapiens
aagcttaaattgcttttgttgt

SEQ ID NO: 2692738 - DNA, 21 bp, Homo sapiens
aaggacccaaatttccctggg

SEQ ID NO: 2692739 - DNA, 18 bp, Homo sapiens
aaggactaacataaaatc

SEQ ID NO: 2692740 - DNA, 16 bp, Homo sapiens
aaggctggctgggcat

SEQ ID NO: 2692741 - DNA, 22 bp, Homo sapiens
aaggctgtgctcttcctctggt

SEQ ID NO: 2692742 - DNA, 23 bp, Homo sapiens
aaggctgtgctcttcctctggtt

SEQ ID NO: 2692743 - DNA, 16 bp, Homo sapiens
aagggcagtaaagttt

SEQ ID NO: 2692744 - DNA, 16 bp, Homo sapiens
aaggggcagctcctga

SEQ ID NO: 2692745 - DNA, 14 bp, Homo sapiens
aaggggctggctgg

SEQ ID NO: 2692746 - DNA, 19 bp, Homo sapiens
aagggttttccaccctgga

SEQ ID NO: 2692747 - DNA, 16 bp, Homo sapiens
aaggtgggctgagccc

SEQ ID NO: 2692748 - DNA, 19 bp, Homo sapiens
aaggtgggctgagccctgg

SEQ ID NO: 2692749 - DNA, 20 bp, Homo sapiens
aaggtgggctgagccctggc

SEQ ID NO: 2692750 - DNA, 13 bp, Homo sapiens
aaggttttctcca

SEQ ID NO: 2692751 - DNA, 14 bp, Homo sapiens
aagtaagacacaaa

SEQ ID NO: 2692752 - DNA, 21 bp, Homo sapiens
aagtaagagctaagttctaag

SEQ ID NO: 2692753 - DNA, 22 bp, Homo sapiens
aagtaagagctaagttctaagt

SEQ ID NO: 2692754 - DNA, 20 bp, Homo sapiens
aagtaagtaccactcaggcc

SEQ ID NO: 2692755 - DNA, 16 bp, Homo sapiens
aagtagtagtgtcttc

SEQ ID NO: 2692756 - DNA, 14 bp, Homo sapiens
aagtatatattcta

SEQ ID NO: 2692757 - DNA, 23 bp, Homo sapiens
aagtatatattctacacatatat

SEQ ID NO: 2692758 - DNA, 17 bp, Homo sapiens
aagtcacatataaaagt

SEQ ID NO: 2692759 - DNA, 21 bp, Homo sapiens
aagtctccctgcacagcctct

SEQ ID NO: 2692760 - DNA, 12 bp, Homo sapiens
aagtgcccagcc

SEQ ID NO: 2692761 - DNA, 13 bp, Homo sapiens
aagtgcccagccc

SEQ ID NO: 2692762 - DNA, 19 bp, Homo sapiens
aagtgcccagcccctgccc

SEQ ID NO: 2692763 - DNA, 17 bp, Homo sapiens
aagtgttcaagaaataa

SEQ ID NO: 2692764 - DNA, 16 bp, Homo sapiens
aagtgttgctcttgga

SEQ ID NO: 2692765 - DNA, 18 bp, Homo sapiens
aagtgttgctcttggaaa

SEQ ID NO: 2692766 - DNA, 19 bp, Homo sapiens
aagtgtttgaagtctgctc

SEQ ID NO: 2692767 - DNA, 19 bp, Homo sapiens
aagttttgatgaaattctt

SEQ ID NO: 2692768 - DNA, 12 bp, Homo sapiens
aagttttgtata

SEQ ID NO: 2692769 - DNA, 20 bp, Homo sapiens
aagttttgtataaataataa

SEQ ID NO: 2692770 - DNA, 23 bp, Homo sapiens
aataaagaactccttattttgta

SEQ ID NO: 2692771 - DNA, 14 bp, Homo sapiens
aataaagctgctga

SEQ ID NO: 2692772 - DNA, 13 bp, Homo sapiens
aataaatgctgaa

SEQ ID NO: 2692773 - DNA, 21 bp, Homo sapiens
aataaatgttctcgttttgaa

SEQ ID NO: 2692774 - DNA, 20 bp, Homo sapiens
aatacttcatttggtgctgg

SEQ ID NO: 2692775 - DNA, 15 bp, Homo sapiens
aatataaatgtttaa

SEQ ID NO: 2692776 - DNA, 19 bp, Homo sapiens
agagctcctgtccctaccc

SEQ ID NO: 2692777 - DNA, 14 bp, Homo sapiens
agagctgcagccag

SEQ ID NO: 2692778 - DNA, 21 bp, Homo sapiens
agagctgcagccagtcaggca

SEQ ID NO: 2692779 - DNA, 23 bp, Homo sapiens
agagctgcagccagtcaggcagg

SEQ ID NO: 2692780 - DNA, 14 bp, Homo sapiens
agaggccttttgtt

SEQ ID NO: 2692781 - DNA, 21 bp, Homo sapiens
agaggctgcagaaggccaaga

SEQ ID NO: 2692782 - DNA, 18 bp, Homo sapiens
agaggggctttctggaga

SEQ ID NO: 2692783 - DNA, 18 bp, Homo sapiens
agagtcagccttccccct

SEQ ID NO: 2692784 - DNA, 16 bp, Homo sapiens
agagtggggcctgccc

SEQ ID NO: 2692785 - DNA, 17 bp, Homo sapiens
agataatgttctttaat

SEQ ID NO: 2692786 - DNA, 15 bp, Homo sapiens
agatatcagagctct

SEQ ID NO: 2692787 - DNA, 16 bp, Homo sapiens
agatatcagagctctt

SEQ ID NO: 2692788 - DNA, 19 bp, Homo sapiens
agatcagagctgcagccag

SEQ ID NO: 2692789 - DNA, 20 bp, Homo sapiens
agatcgagaccatcctggct

SEQ ID NO: 2692790 - DNA, 14 bp, Homo sapiens
agatgagcacttct

SEQ ID NO: 2692791 - DNA, 22 bp, Homo sapiens
agatgcccagagggcccaggca

SEQ ID NO: 2692792 - DNA, 17 bp, Homo sapiens
agatgcctccccaagac

SEQ ID NO: 2692793 - DNA, 18 bp, Homo sapiens
agattatatatcataaag

SEQ ID NO: 2692794 - DNA, 20 bp, Homo sapiens
agattatatatcataaagta

SEQ ID NO: 2692795 - DNA, 14 bp, Homo sapiens
agattgggctggct

SEQ ID NO: 2692796 - DNA, 18 bp, Homo sapiens
agattgggctggctctga

SEQ ID NO: 2692797 - DNA, 13 bp, Homo sapiens
agattgtgaataa

SEQ ID NO: 2692798 - DNA, 14 bp, Homo sapiens
agatttctctttga

SEQ ID NO: 2692799 - DNA, 22 bp, Homo sapiens
agatttttcttttaagccctgc

SEQ ID NO: 2692800 - DNA, 20 bp, Homo sapiens
agcaaaatgcatgtaatcaa

SEQ ID NO: 2692801 - DNA, 14 bp, Homo sapiens
agcaaatgtttctg

SEQ ID NO: 2692802 - DNA, 17 bp, Homo sapiens
agcaaatgtttctgcag

SEQ ID NO: 2692803 - DNA, 20 bp, Homo sapiens
agcaacagagtgagaccctg

SEQ ID NO: 2692804 - DNA, 23 bp, Homo sapiens
agcaacagagtgagaccctgtct

SEQ ID NO: 2692805 - DNA, 15 bp, Homo sapiens
agcaagctctgccct

SEQ ID NO: 2692806 - DNA, 20 bp, Homo sapiens
agcaagctctgccctggctg

SEQ ID NO: 2692807 - DNA, 19 bp, Homo sapiens
agcaagtttcatcagccct

SEQ ID NO: 2692808 - DNA, 21 bp, Homo sapiens
agcaagtttcatcagccctag

SEQ ID NO: 2692809 - DNA, 15 bp, Homo sapiens
agcacacctcagccc

SEQ ID NO: 2692810 - DNA, 17 bp, Homo sapiens
agcacccacagccgcag

SEQ ID NO: 2692811 - DNA, 22 bp, Homo sapiens
agcactggaggggcccacccac

SEQ ID NO: 2692812 - DNA, 21 bp, Homo sapiens
agcactttgggaggctgaggc

SEQ ID NO: 2692813 - DNA, 22 bp, Homo sapiens
agcactttgggaggctgaggcg

SEQ ID NO: 2692814 - DNA, 14 bp, Homo sapiens
agcagagcaggggc

SEQ ID NO: 2692815 - DNA, 14 bp, Homo sapiens
agcagcacacctca

SEQ ID NO: 2692816 - DNA, 16 bp, Homo sapiens
agcagcacacctcagc

SEQ ID NO: 2692817 - DNA, 19 bp, Homo sapiens
agcagcacacctcagcccc

SEQ ID NO: 2692818 - DNA, 20 bp, Homo sapiens
agcagcatagaacaggacct

SEQ ID NO: 2692819 - DNA, 21 bp, Homo sapiens
agcagcatagaacaggacctc

SEQ ID NO: 2692820 - DNA, 19 bp, Homo sapiens
agcaggaactgagccagaa

SEQ ID NO: 2692821 - DNA, 23 bp, Homo sapiens
agcaggcagggctgggccaggtc

SEQ ID NO: 2692822 - DNA, 16 bp, Homo sapiens
agcagggccaaagcac

SEQ ID NO: 2692823 - DNA, 16 bp, Homo sapiens
agcaggtgtgaccctg

SEQ ID NO: 2692824 - DNA, 21 bp, Homo sapiens
agcaggttgaggggctcctgg

SEQ ID NO: 2692825 - DNA, 22 bp, Homo sapiens
agcatagaacaggacctctgct

SEQ ID NO: 2692826 - DNA, 19 bp, Homo sapiens
agcatcacctcaggccagg

SEQ ID NO: 2692827 - DNA, 21 bp, Homo sapiens
agcatccttttctgcagaggg

SEQ ID NO: 2692828 - DNA, 20 bp, Homo sapiens
agcatcttttccatcctgag

SEQ ID NO: 2692829 - DNA, 22 bp, Homo sapiens
agcatggagagcctcttagtga

SEQ ID NO: 2692830 - DNA, 16 bp, Homo sapiens
agcatggcctggactg

SEQ ID NO: 2692831 - DNA, 18 bp, Homo sapiens
agcatttctagtcccttc

SEQ ID NO: 2692832 - DNA, 17 bp, Homo sapiens
agccacagaagccagga

SEQ ID NO: 2692833 - DNA, 18 bp, Homo sapiens
agccacagaagccaggag

SEQ ID NO: 2692834 - DNA, 20 bp, Homo sapiens
agccacagaagccaggagca

SEQ ID NO: 2692835 - DNA, 16 bp, Homo sapiens
agccacctccttggca

SEQ ID NO: 2692836 - DNA, 11 bp, Homo sapiens
agccacctgct

SEQ ID NO: 2692837 - DNA, 16 bp, Homo sapiens
agccacgctggccttc

SEQ ID NO: 2692838 - DNA, 19 bp, Homo sapiens
agccacgctggccttcgtc

SEQ ID NO: 2692839 - DNA, 14 bp, Homo sapiens
agccacgtgaatgg

SEQ ID NO: 2692840 - DNA, 13 bp, Homo sapiens
agccactgaagct

SEQ ID NO: 2692841 - DNA, 15 bp, Homo sapiens
agccagatgcctccc

SEQ ID NO: 2692842 - DNA, 16 bp, Homo sapiens
agccagatgcctcccc

SEQ ID NO: 2692843 - DNA, 23 bp, Homo sapiens
agccagatgcctccccaagactg

SEQ ID NO: 2692844 - DNA, 18 bp, Homo sapiens
agccagcaaagcctccag

SEQ ID NO: 2692845 - DNA, 13 bp, Homo sapiens
agccaggagcaaa

SEQ ID NO: 2692846 - DNA, 22 bp, Homo sapiens
agccaggagcaaatgtttctgc

SEQ ID NO: 2692847 - DNA, 23 bp, Homo sapiens
agccaggagcaaatgtttctgca

SEQ ID NO: 2692848 - DNA, 16 bp, Homo sapiens
agccagttctggggcc

SEQ ID NO: 2692849 - DNA, 20 bp, Homo sapiens
agccagttctggggcccgcc

SEQ ID NO: 2692850 - DNA, 19 bp, Homo sapiens
agccatgatcgagccactg

SEQ ID NO: 2692851 - DNA, 21 bp, Homo sapiens
agccatgatcgagccactgca

SEQ ID NO: 2692852 - DNA, 11 bp, Homo sapiens
agcccagcacc

SEQ ID NO: 2692853 - DNA, 14 bp, Homo sapiens
agcccagcacctgc

SEQ ID NO: 2692854 - DNA, 19 bp, Homo sapiens
agcccagctggccacctag

SEQ ID NO: 2692855 - DNA, 19 bp, Homo sapiens
agcccaggagtttgaggct

SEQ ID NO: 2692856 - DNA, 15 bp, Homo sapiens
agcccatggcctctg

SEQ ID NO: 2692857 - DNA, 13 bp, Homo sapiens
agccccagcttcc

SEQ ID NO: 2692858 - DNA, 15 bp, Homo sapiens
agccccgcgcctcct

SEQ ID NO: 2692859 - DNA, 13 bp, Homo sapiens
agccctccaggcc

SEQ ID NO: 2692860 - DNA, 19 bp, Homo sapiens
agccctccaggcctgcagg

SEQ ID NO: 2692861 - DNA, 17 bp, Homo sapiens
agccctgctctttctct

SEQ ID NO: 2692862 - DNA, 19 bp, Homo sapiens
agccctgctctttctctga

SEQ ID NO: 2692863 - DNA, 21 bp, Homo sapiens
agccctgctctttctctgaga

SEQ ID NO: 2692864 - DNA, 16 bp, Homo sapiens
agccctggaccccagg

SEQ ID NO: 2692865 - DNA, 17 bp, Homo sapiens
agccctggcaggatgac

SEQ ID NO: 2692866 - DNA, 18 bp, Homo sapiens
agccgcagcctccctctg

SEQ ID NO: 2692867 - DNA, 12 bp, Homo sapiens
agcctaatgaaa

SEQ ID NO: 2692868 - DNA, 23 bp, Homo sapiens
agcctaatgaaagggaaagtcag

SEQ ID NO: 2692869 - DNA, 13 bp, Homo sapiens
agcctcgtgtcct

SEQ ID NO: 2692870 - DNA, 20 bp, Homo sapiens
agcctcgtgtcctgctagct

SEQ ID NO: 2692871 - DNA, 22 bp, Homo sapiens
agcctcgtgtcctgctagctgt

SEQ ID NO: 2692872 - DNA, 12 bp, Homo sapiens
agcctctgctgc

SEQ ID NO: 2692873 - DNA, 18 bp, Homo sapiens
agcctctgctgccatggc

SEQ ID NO: 2692874 - DNA, 21 bp, Homo sapiens
agcctggcttctggagccctt

SEQ ID NO: 2692875 - DNA, 14 bp, Homo sapiens
agcctgggcgacag

SEQ ID NO: 2692876 - DNA, 15 bp, Homo sapiens
agcctgggcgacaga

SEQ ID NO: 2692877 - DNA, 16 bp, Homo sapiens
agcctgttcattctga

SEQ ID NO: 2692878 - DNA, 19 bp, Homo sapiens
agcgatgaatttggagact

SEQ ID NO: 2692879 - DNA, 14 bp, Homo sapiens
agcgcacctgcccc

SEQ ID NO: 2692880 - DNA, 19 bp, Homo sapiens
agcgcacctgccccctggt

SEQ ID NO: 2692881 - DNA, 24 bp, Homo sapiens
agcgcctgtgctgaggactccctc

SEQ ID NO: 2692882 - DNA, 12 bp, Homo sapiens
agcgctgccctg

SEQ ID NO: 2692883 - DNA, 16 bp, Homo sapiens
agcgctgccctgtgag

SEQ ID NO: 2692884 - DNA, 13 bp, Homo sapiens
agcggcgcagagc

SEQ ID NO: 2692885 - DNA, 20 bp, Homo sapiens
ataccagtgaaccaaagaga

SEQ ID NO: 2692886 - DNA, 14 bp, Homo sapiens
atacttcctgggat

SEQ ID NO: 2692887 - DNA, 17 bp, Homo sapiens
atacttttttgaaatca

SEQ ID NO: 2692888 - DNA, 21 bp, Homo sapiens
atagaatacttttttctagtt

SEQ ID NO: 2692889 - DNA, 15 bp, Homo sapiens
atagattgtgaataa

SEQ ID NO: 2692890 - DNA, 18 bp, Homo sapiens
atagctctactgccctcc

SEQ ID NO: 2692891 - DNA, 19 bp, Homo sapiens
atatatctcaaattgtaat

SEQ ID NO: 2692892 - DNA, 16 bp, Homo sapiens
atatatgtatatgtat

SEQ ID NO: 2692893 - DNA, 18 bp, Homo sapiens
atatcagagctcttaatg

SEQ ID NO: 2692894 - DNA, 13 bp, Homo sapiens
atatcataaagta

SEQ ID NO: 2692895 - DNA, 13 bp, Homo sapiens
atatctatatctc

SEQ ID NO: 2692896 - DNA, 17 bp, Homo sapiens
atatgttgagtgttcat

SEQ ID NO: 2692897 - DNA, 14 bp, Homo sapiens
atatgttgtaataa

SEQ ID NO: 2692898 - DNA, 22 bp, Homo sapiens
atattctacacatatatgtata

SEQ ID NO: 2692899 - DNA, 13 bp, Homo sapiens
atatttacaacct

SEQ ID NO: 2692900 - DNA, 19 bp, Homo sapiens
atatttacctgtatttaag

SEQ ID NO: 2692901 - DNA, 21 bp, Homo sapiens
atatttacctgtatttaagat

SEQ ID NO: 2692902 - DNA, 14 bp, Homo sapiens
atatttatgtctct

SEQ ID NO: 2692903 - DNA, 23 bp, Homo sapiens
atatttattctgggttttgtagc

SEQ ID NO: 2692904 - DNA, 13 bp, Homo sapiens
atattttacttga

SEQ ID NO: 2692905 - DNA, 15 bp, Homo sapiens
atattttacttgaat

SEQ ID NO: 2692906 - DNA, 21 bp, Homo sapiens
atcaaatctgtatatgttgta

SEQ ID NO: 2692907 - DNA, 16 bp, Homo sapiens
atcaacttgtgtactg

SEQ ID NO: 2692908 - DNA, 18 bp, Homo sapiens
atcaagatgtcagactgg

SEQ ID NO: 2692909 - DNA, 20 bp, Homo sapiens
atcaagctagaaggccacat

SEQ ID NO: 2692910 - DNA, 22 bp, Homo sapiens
atcaatgtatatgaagctcttg

SEQ ID NO: 2692911 - DNA, 16 bp, Homo sapiens
atcactctctgctggc

SEQ ID NO: 2692912 - DNA, 14 bp, Homo sapiens
atcactggagccca

SEQ ID NO: 2692913 - DNA, 17 bp, Homo sapiens
atcagagctgcagccag

SEQ ID NO: 2692914 - DNA, 18 bp, Homo sapiens
atcaggactgtgaccaaa

SEQ ID NO: 2692915 - DNA, 21 bp, Homo sapiens
atcaggactgtgaccaaagca

SEQ ID NO: 2692916 - DNA, 19 bp, Homo sapiens
atcagtaaacactgtgtat
